United States Patent 7,314,750 (ADDRESSABLE OLIGONUCLEOTIDE ARRAY OF THE RAT GENOME) - sequence listing, part 16

SEQ ID NO: 566547 - DNA, 25 bp, Rattus norvegicus
tatccaggtggagagtgcattcact

SEQ ID NO: 566548 - DNA, 25 bp, Rattus norvegicus
tatccaggtgtgaaagctgctgctg

SEQ ID NO: 566549 - DNA, 25 bp, Rattus norvegicus
tatccaggtgtgaccaacttgggaa

SEQ ID NO: 566550 - DNA, 25 bp, Rattus norvegicus
tatccaggtgtgtaagctgctgctg

SEQ ID NO: 566551 - DNA, 25 bp, Rattus norvegicus
tatccaggtgtgtccaacttgggaa

SEQ ID NO: 566552 - DNA, 25 bp, Rattus norvegicus
tatccagtattcaggtctaaaacag

SEQ ID NO: 566553 - DNA, 25 bp, Rattus norvegicus
tatccagtattctggtctaaaacag

SEQ ID NO: 566554 - DNA, 25 bp, Rattus norvegicus
tatccagtcatcacttgctcataag

SEQ ID NO: 566555 - DNA, 25 bp, Rattus norvegicus
tatccagtcatctcttgctcataag

SEQ ID NO: 566556 - DNA, 25 bp, Rattus norvegicus
tatccagtcctccttttacattcat

SEQ ID NO: 566557 - DNA, 25 bp, Rattus norvegicus
tatccagtcctcgttttacattcat

SEQ ID NO: 566558 - DNA, 25 bp, Rattus norvegicus
tatccagtccttactttacttcgtg

SEQ ID NO: 566559 - DNA, 25 bp, Rattus norvegicus
tatccagtcctttctttacttcgtg

SEQ ID NO: 566560 - DNA, 25 bp, Rattus norvegicus
tatccagtctggctgcaacggtgac

SEQ ID NO: 566561 - DNA, 25 bp, Rattus norvegicus
tatccagtctgggtgcaacggtgac

SEQ ID NO: 566562 - DNA, 25 bp, Rattus norvegicus
tatccagtgcttcccctcagagtgt

SEQ ID NO: 566563 - DNA, 25 bp, Rattus norvegicus
tatccagtgcttgccctcagagtgt

SEQ ID NO: 566564 - DNA, 25 bp, Rattus norvegicus
tatccagtgtctacctcgacatgga

SEQ ID NO: 566565 - DNA, 25 bp, Rattus norvegicus
tatccagtgtctcttctgtttggga

SEQ ID NO: 566566 - DNA, 25 bp, Rattus norvegicus
tatccagtgtctgttctgtttggga

SEQ ID NO: 566567 - DNA, 25 bp, Rattus norvegicus
tatccagtgtcttcctcgacatgga

SEQ ID NO: 566568 - DNA, 25 bp, Rattus norvegicus
tatccataatctctttgtgtccgtc

SEQ ID NO: 566569 - DNA, 25 bp, Rattus norvegicus
tatccataatctgtttgtgtccgtc

SEQ ID NO: 566570 - DNA, 25 bp, Rattus norvegicus
tatccatagcctaatttctgtccag

SEQ ID NO: 566571 - DNA, 25 bp, Rattus norvegicus
tatccatagccttatttctgtccag

SEQ ID NO: 566572 - DNA, 25 bp, Rattus norvegicus
tatccatagtatacccaacacacac

SEQ ID NO: 566573 - DNA, 25 bp, Rattus norvegicus
tatccatagtattcccaacacacac

SEQ ID NO: 566574 - DNA, 25 bp, Rattus norvegicus
tatccatatctgcagtgtgtaccaa

SEQ ID NO: 566575 - DNA, 25 bp, Rattus norvegicus
tatccatatctggagtgtgtaccaa

SEQ ID NO: 566576 - DNA, 25 bp, Rattus norvegicus
tatccatcccatagtcacttgggtc

SEQ ID NO: 566577 - DNA, 25 bp, Rattus norvegicus
tatccatcccattgtcacttgggtc

SEQ ID NO: 566578 - DNA, 25 bp, Rattus norvegicus
tatccatgaagcagagcagccgcag

SEQ ID NO: 566579 - DNA, 25 bp, Rattus norvegicus
tatccatgaagctgagcagccgcag

SEQ ID NO: 566580 - DNA, 25 bp, Rattus norvegicus
tatccatgaaggctacactcacgga

SEQ ID NO: 566581 - DNA, 25 bp, Rattus norvegicus
tatccatgaagggtacactcacgga

SEQ ID NO: 566582 - DNA, 25 bp, Rattus norvegicus
tatccatgacacacgcttgcagaag

SEQ ID NO: 566583 - DNA, 25 bp, Rattus norvegicus
tatccatgacactcgcttgcagaag

SEQ ID NO: 566584 - DNA, 25 bp, Rattus norvegicus
tatccatgctacatccagctctgcc

SEQ ID NO: 566585 - DNA, 25 bp, Rattus norvegicus
tatccatgctacttccagctctgcc

SEQ ID NO: 566586 - DNA, 25 bp, Rattus norvegicus
tatccatggcatatgtttccccaaa

SEQ ID NO: 566587 - DNA, 25 bp, Rattus norvegicus
tatccatggcatttgtttccccaaa

SEQ ID NO: 566588 - DNA, 25 bp, Rattus norvegicus
tatccatggctacctgggcatcgtg

SEQ ID NO: 566589 - DNA, 25 bp, Rattus norvegicus
tatccatggctagctgggcatcgtg

SEQ ID NO: 566590 - DNA, 25 bp, Rattus norvegicus
tatccatggtttaactaacccgttg

SEQ ID NO: 566591 - DNA, 25 bp, Rattus norvegicus
tatccatggttttactaacccgttg

SEQ ID NO: 566592 - DNA, 25 bp, Rattus norvegicus
tatccatgtcatctctctttacagc

SEQ ID NO: 566593 - DNA, 25 bp, Rattus norvegicus
tatccatgtcatgtctctttacagc

SEQ ID NO: 566594 - DNA, 25 bp, Rattus norvegicus
tatccatgtgccagggccaaaggat

SEQ ID NO: 566595 - DNA, 25 bp, Rattus norvegicus
tatccatgtgcctgggccaaaggat

SEQ ID NO: 566596 - DNA, 25 bp, Rattus norvegicus
tatccatgtgtgagcattgttgtac

SEQ ID NO: 566597 - DNA, 25 bp, Rattus norvegicus
tatccatgtgtgtgcattgttgtac

SEQ ID NO: 566598 - DNA, 25 bp, Rattus norvegicus
tatccatgttttagcgcagtcgcca

SEQ ID NO: 566599 - DNA, 25 bp, Rattus norvegicus
tatccatgtttttgcgcagtcgcca

SEQ ID NO: 566600 - DNA, 25 bp, Rattus norvegicus
tatccattaggccagcaacgcttgt

SEQ ID NO: 566601 - DNA, 25 bp, Rattus norvegicus
tatccattaggcgagcaacgcttgt

SEQ ID NO: 566602 - DNA, 25 bp, Rattus norvegicus
tatccattcatcagagggcagccaa

SEQ ID NO: 566603 - DNA, 25 bp, Rattus norvegicus
tatccattcatctgagggcagccaa

SEQ ID NO: 566604 - DNA, 25 bp, Rattus norvegicus
tatccattccatatggccggcacga

SEQ ID NO: 566605 - DNA, 25 bp, Rattus norvegicus
tatccattccatttggccggcacga

SEQ ID NO: 566606 - DNA, 25 bp, Rattus norvegicus
tatccattcggcctgtggctgaaaa

SEQ ID NO: 566607 - DNA, 25 bp, Rattus norvegicus
tatccattcggcgtgtggctgaaaa

SEQ ID NO: 566608 - DNA, 25 bp, Rattus norvegicus
tatccattctgcaaatgcctctgaa

SEQ ID NO: 566609 - DNA, 25 bp, Rattus norvegicus
tatccattctgctaatgcctctgaa

SEQ ID NO: 566610 - DNA, 25 bp, Rattus norvegicus
tatccattggacattgggctcaact

SEQ ID NO: 566611 - DNA, 25 bp, Rattus norvegicus
tatccattggactttgggctcaact

SEQ ID NO: 566612 - DNA, 25 bp, Rattus norvegicus
tatccatttgaacgcattagtgtct

SEQ ID NO: 566613 - DNA, 25 bp, Rattus norvegicus
tatccatttgaaggcattagtgtct

SEQ ID NO: 566614 - DNA, 25 bp, Rattus norvegicus
tatccattttccaccattggtatat

SEQ ID NO: 566615 - DNA, 25 bp, Rattus norvegicus
tatccattttcctccattggtatat

SEQ ID NO: 566616 - DNA, 25 bp, Rattus norvegicus
tatcccaaggtcattcctaactcca

SEQ ID NO: 566617 - DNA, 25 bp, Rattus norvegicus
tatcccaaggtctttcctaactcca

SEQ ID NO: 566618 - DNA, 25 bp, Rattus norvegicus
tatcccaagtagctcttaggtgcag

SEQ ID NO: 566619 - DNA, 25 bp, Rattus norvegicus
tatcccaagtaggtcttaggtgcag

SEQ ID NO: 566620 - DNA, 25 bp, Rattus norvegicus
tatcccacaagcagttacctgtaca

SEQ ID NO: 566621 - DNA, 25 bp, Rattus norvegicus
tatcccacaagctgttacctgtaca

SEQ ID NO: 566622 - DNA, 25 bp, Rattus norvegicus
tatcccacagcaatatagcaagcct

SEQ ID NO: 566623 - DNA, 25 bp, Rattus norvegicus
tatcccacagcattatagcaagcct

SEQ ID NO: 566624 - DNA, 25 bp, Rattus norvegicus
tatcccacatgaatgatgcttgaca

SEQ ID NO: 566625 - DNA, 25 bp, Rattus norvegicus
tatcccacatgattgatgcttgaca

SEQ ID NO: 566626 - DNA, 25 bp, Rattus norvegicus
tatcccaccggacttgaaagccagt

SEQ ID NO: 566627 - DNA, 25 bp, Rattus norvegicus
tatcccaccggagttgaaagccagt

SEQ ID NO: 566628 - DNA, 25 bp, Rattus norvegicus
tatcccacctgcacaaaataagtta

SEQ ID NO: 566629 - DNA, 25 bp, Rattus norvegicus
tatcccacctgctcaaaataagtta

SEQ ID NO: 566630 - DNA, 25 bp, Rattus norvegicus
tatcccactgtccactgggaaagga

SEQ ID NO: 566631 - DNA, 25 bp, Rattus norvegicus
tatcccactgtcgactgggaaagga

SEQ ID NO: 566632 - DNA, 25 bp, Rattus norvegicus
tatcccactgtgcagtggtacccaa

SEQ ID NO: 566633 - DNA, 25 bp, Rattus norvegicus
tatcccactgtggagtggtacccaa

SEQ ID NO: 566634 - DNA, 25 bp, Rattus norvegicus
tatcccactgttacagagatttgga

SEQ ID NO: 566635 - DNA, 25 bp, Rattus norvegicus
tatcccactgtttcagagatttgga

SEQ ID NO: 566636 - DNA, 25 bp, Rattus norvegicus
tatcccagaatcagctgttctgctt

SEQ ID NO: 566637 - DNA, 25 bp, Rattus norvegicus
tatcccagaatctgctgttctgctt

SEQ ID NO: 566638 - DNA, 25 bp, Rattus norvegicus
tatcccagatgacctcttgtgcctc

SEQ ID NO: 566639 - DNA, 25 bp, Rattus norvegicus
tatcccagatgagctcttgtgcctc

SEQ ID NO: 566640 - DNA, 25 bp, Rattus norvegicus
tatcccagcaagctcaggtggaaat

SEQ ID NO: 566641 - DNA, 25 bp, Rattus norvegicus
tatcccagcaaggtcaggtggaaat

SEQ ID NO: 566642 - DNA, 25 bp, Rattus norvegicus
tatcccagccgaagcagtggtgcag

SEQ ID NO: 566643 - DNA, 25 bp, Rattus norvegicus
tatcccagccgatgcagtggtgcag

SEQ ID NO: 566644 - DNA, 25 bp, Rattus norvegicus
tatcccaggatactgccagcagtgg

SEQ ID NO: 566645 - DNA, 25 bp, Rattus norvegicus
tatcccaggatagtgccagcagtgg

SEQ ID NO: 566646 - DNA, 25 bp, Rattus norvegicus
tatcccaggcatatgaagtactttc

SEQ ID NO: 566647 - DNA, 25 bp, Rattus norvegicus
tatcccaggcatttgaagtactttc

SEQ ID NO: 566648 - DNA, 25 bp, Rattus norvegicus
tatcccaggcgtcttctgagaaggc

SEQ ID NO: 566649 - DNA, 25 bp, Rattus norvegicus
tatcccaggcgtgttctgagaaggc

SEQ ID NO: 566650 - DNA, 25 bp, Rattus norvegicus
tatcccaggctgaccatgaatgatc

SEQ ID NO: 566651 - DNA, 25 bp, Rattus norvegicus
tatcccaggctgtccatgaatgatc

SEQ ID NO: 566652 - DNA, 25 bp, Rattus norvegicus
tatcccagtggccagatcggcttca

SEQ ID NO: 566653 - DNA, 25 bp, Rattus norvegicus
tatcccagtggcgagatcggcttca

SEQ ID NO: 566654 - DNA, 25 bp, Rattus norvegicus
tatcccagtgggacattctaaacac

SEQ ID NO: 566655 - DNA, 25 bp, Rattus norvegicus
tatcccagtgggtcattctaaacac

SEQ ID NO: 566656 - DNA, 25 bp, Rattus norvegicus
tatcccagtgtaccagctgtgttaa

SEQ ID NO: 566657 - DNA, 25 bp, Rattus norvegicus
tatcccagtgtagcagctgtgttaa

SEQ ID NO: 566658 - DNA, 25 bp, Rattus norvegicus
tatcccagttgaaccagactacctg

SEQ ID NO: 566659 - DNA, 25 bp, Rattus norvegicus
tatcccagttgatccagactacctg

SEQ ID NO: 566660 - DNA, 25 bp, Rattus norvegicus
tatcccatctcacagtggcgggcat

SEQ ID NO: 566661 - DNA, 25 bp, Rattus norvegicus
tatcccatctcagagtggcgggcat

SEQ ID NO: 566662 - DNA, 25 bp, Rattus norvegicus
tatcccatgcctatagtattagtaa

SEQ ID NO: 566663 - DNA, 25 bp, Rattus norvegicus
tatcccatgcctttagtattagtaa

SEQ ID NO: 566664 - DNA, 25 bp, Rattus norvegicus
tatcccatgcttacattcatgatgt

SEQ ID NO: 566665 - DNA, 25 bp, Rattus norvegicus
tatcccatgctttcattcatgatgt

SEQ ID NO: 566666 - DNA, 25 bp, Rattus norvegicus
tatcccatgtgcaagaatcacaggc

SEQ ID NO: 566667 - DNA, 25 bp, Rattus norvegicus
tatcccatgtgctagaatcacaggc

SEQ ID NO: 566668 - DNA, 25 bp, Rattus norvegicus
tatccccaacaaagtgccaactcat

SEQ ID NO: 566669 - DNA, 25 bp, Rattus norvegicus
tatccccaacaatgtgccaactcat

SEQ ID NO: 566670 - DNA, 25 bp, Rattus norvegicus
tatccccaagcacgtctttgctcgt

SEQ ID NO: 566671 - DNA, 25 bp, Rattus norvegicus
tatccccaagcaggtctttgctcgt

SEQ ID NO: 566672 - DNA, 25 bp, Rattus norvegicus
tatccccacatcctttcttaggtta

SEQ ID NO: 566673 - DNA, 25 bp, Rattus norvegicus
tatccccacatcgtttcttaggtta

SEQ ID NO: 566674 - DNA, 25 bp, Rattus norvegicus
tatccccacatgcactcgtttgaga

SEQ ID NO: 566675 - DNA, 25 bp, Rattus norvegicus
tatccccacatggactcgtttgaga

SEQ ID NO: 566676 - DNA, 25 bp, Rattus norvegicus
tatccccaggaactgaccagttcgt

SEQ ID NO: 566677 - DNA, 25 bp, Rattus norvegicus
tatccccaggaagtgaccagttcgt

SEQ ID NO: 566678 - DNA, 25 bp, Rattus norvegicus
tatccccagggccatatttgtcacc

SEQ ID NO: 566679 - DNA, 25 bp, Rattus norvegicus
tatccccagggcgatatttgtcacc

SEQ ID NO: 566680 - DNA, 25 bp, Rattus norvegicus
tatccccagggtctttactaactct

SEQ ID NO: 566681 - DNA, 25 bp, Rattus norvegicus
tatccccagggtgtttactaactct

SEQ ID NO: 566682 - DNA, 25 bp, Rattus norvegicus
tatccccatccgatcgtatttatat

SEQ ID NO: 566683 - DNA, 25 bp, Rattus norvegicus
tatccccatccgttcgtatttatat

SEQ ID NO: 566684 - DNA, 25 bp, Rattus norvegicus
tatccccgagggagtgagcacaagt

SEQ ID NO: 566685 - DNA, 25 bp, Rattus norvegicus
tatccccgagggtgtgagcacaagt

SEQ ID NO: 566686 - DNA, 25 bp, Rattus norvegicus
tatcccctagccaggtgctgagtga

SEQ ID NO: 566687 - DNA, 25 bp, Rattus norvegicus
tatcccctagcctggtgctgagtga

SEQ ID NO: 566688 - DNA, 25 bp, Rattus norvegicus
tatcccctatggctgcctggaagag

SEQ ID NO: 566689 - DNA, 25 bp, Rattus norvegicus
tatcccctatgggtgcctggaagag

SEQ ID NO: 566690 - DNA, 25 bp, Rattus norvegicus
tatcccctgaaacctcgtgaagtat

SEQ ID NO: 566691 - DNA, 25 bp, Rattus norvegicus
tatcccctgaaagctcgtgaagtat

SEQ ID NO: 566692 - DNA, 25 bp, Rattus norvegicus
tatcccctggcaaatatccttgaca

SEQ ID NO: 566693 - DNA, 25 bp, Rattus norvegicus
tatcccctggcatatatccttgaca

SEQ ID NO: 566694 - DNA, 25 bp, Rattus norvegicus
tatcccctttgcactgtagtactga

SEQ ID NO: 566695 - DNA, 25 bp, Rattus norvegicus
tatcccctttgctctgtagtactga

SEQ ID NO: 566696 - DNA, 25 bp, Rattus norvegicus
tatcccgaacgacttttcttggttg

SEQ ID NO: 566697 - DNA, 25 bp, Rattus norvegicus
tatcccgaacgagttttcttggttg

SEQ ID NO: 566698 - DNA, 25 bp, Rattus norvegicus
tatcccgacttgataatttttctgt

SEQ ID NO: 566699 - DNA, 25 bp, Rattus norvegicus
tatcccgacttgttaatttttctgt

SEQ ID NO: 566700 - DNA, 25 bp, Rattus norvegicus
tatcccgctgttaggaattcattac

SEQ ID NO: 566701 - DNA, 25 bp, Rattus norvegicus
tatcccgctgtttggaattcattac

SEQ ID NO: 566702 - DNA, 25 bp, Rattus norvegicus
tatcccgggagcctgattcctgagg

SEQ ID NO: 566703 - DNA, 25 bp, Rattus norvegicus
tatcccgggagcgtgattcctgagg

SEQ ID NO: 566704 - DNA, 25 bp, Rattus norvegicus
tatcccgtcaaacgattccgtttct

SEQ ID NO: 566705 - DNA, 25 bp, Rattus norvegicus
tatcccgtcaaaggattccgtttct

SEQ ID NO: 566706 - DNA, 25 bp, Rattus norvegicus
tatcccgtgttaatactttgtttca

SEQ ID NO: 566707 - DNA, 25 bp, Rattus norvegicus
tatcccgtgttattactttgtttca

SEQ ID NO: 566708 - DNA, 25 bp, Rattus norvegicus
tatccctaagctcttgcctgtatgt

SEQ ID NO: 566709 - DNA, 25 bp, Rattus norvegicus
tatccctaagctgttgcctgtatgt

SEQ ID NO: 566710 - DNA, 25 bp, Rattus norvegicus
tatccctaattccctgaatagtgcc

SEQ ID NO: 566711 - DNA, 25 bp, Rattus norvegicus
tatccctaattcgctgaatagtgcc

SEQ ID NO: 566712 - DNA, 25 bp, Rattus norvegicus
tatccctatgtcagccctcagagag

SEQ ID NO: 566713 - DNA, 25 bp, Rattus norvegicus
tatccctatgtctgccctcagagag

SEQ ID NO: 566714 - DNA, 25 bp, Rattus norvegicus
tatccctcaattctggtagcttgtg

SEQ ID NO: 566715 - DNA, 25 bp, Rattus norvegicus
tatccctcaattgtggtagcttgtg

SEQ ID NO: 566716 - DNA, 25 bp, Rattus norvegicus
tatccctcatgaatccttctggaaa

SEQ ID NO: 566717 - DNA, 25 bp, Rattus norvegicus
tatccctcatgattccttctggaaa

SEQ ID NO: 566718 - DNA, 25 bp, Rattus norvegicus
tatccctcctctccatgtgtgggtt

SEQ ID NO: 566719 - DNA, 25 bp, Rattus norvegicus
tatccctcctctgcatgtgtgggtt

SEQ ID NO: 566720 - DNA, 25 bp, Rattus norvegicus
tatccctcctttcaaaatttatggt

SEQ ID NO: 566721 - DNA, 25 bp, Rattus norvegicus
tatccctcctttgaaaatttatggt

SEQ ID NO: 566722 - DNA, 25 bp, Rattus norvegicus
tatccctctcttcaaagcattgtta

SEQ ID NO: 566723 - DNA, 25 bp, Rattus norvegicus
tatccctctcttgaaagcattgtta

SEQ ID NO: 566724 - DNA, 25 bp, Rattus norvegicus
tatccctctgctcattcagtcagga

SEQ ID NO: 566725 - DNA, 25 bp, Rattus norvegicus
tatccctctgctgattcagtcagga

SEQ ID NO: 566726 - DNA, 25 bp, Rattus norvegicus
tatccctctgtcagtctgcttgttt

SEQ ID NO: 566727 - DNA, 25 bp, Rattus norvegicus
tatccctctgtctgtctgcttgttt

SEQ ID NO: 566728 - DNA, 25 bp, Rattus norvegicus
tatccctgaaacaccccacaaaatg

SEQ ID NO: 566729 - DNA, 25 bp, Rattus norvegicus
tatccctgaaactccccacaaaatg

SEQ ID NO: 566730 - DNA, 25 bp, Rattus norvegicus
tatccctgcataccaatgacaactg

SEQ ID NO: 566731 - DNA, 25 bp, Rattus norvegicus
tatccctgcatagcaatgacaactg

SEQ ID NO: 566732 - DNA, 25 bp, Rattus norvegicus
tatccctgctcgagtgtttgggcat

SEQ ID NO: 566733 - DNA, 25 bp, Rattus norvegicus
tatccctgctcgtgtgtttgggcat

SEQ ID NO: 566734 - DNA, 25 bp, Rattus norvegicus
tatccctgctgtacctaatcgagga

SEQ ID NO: 566735 - DNA, 25 bp, Rattus norvegicus
tatccctgctgttcctaatcgagga

SEQ ID NO: 566736 - DNA, 25 bp, Rattus norvegicus
tatccctggcatacagctatagcag

SEQ ID NO: 566737 - DNA, 25 bp, Rattus norvegicus
tatccctggcattcagctatagcag

SEQ ID NO: 566738 - DNA, 25 bp, Rattus norvegicus
tatccctggtttatgatagtcctac

SEQ ID NO: 566739 - DNA, 25 bp, Rattus norvegicus
tatccctggtttttgatagtcctac

SEQ ID NO: 566740 - DNA, 25 bp, Rattus norvegicus
tatcccttacatccctaataatctg

SEQ ID NO: 566741 - DNA, 25 bp, Rattus norvegicus
tatcccttacatgcctaataatctg

SEQ ID NO: 566742 - DNA, 25 bp, Rattus norvegicus
tatcccttcaggatcaactcaatgc

SEQ ID NO: 566743 - DNA, 25 bp, Rattus norvegicus
tatcccttcaggttcaactcaatgc

SEQ ID NO: 566744 - DNA, 25 bp, Rattus norvegicus
tatcccttccgtactggtgattggc

SEQ ID NO: 566745 - DNA, 25 bp, Rattus norvegicus
tatcccttccgttctggtgattggc

SEQ ID NO: 566746 - DNA, 25 bp, Rattus norvegicus
tatcccttgaacctctcacgtaaag

SEQ ID NO: 566747 - DNA, 25 bp, Rattus norvegicus
tatcccttgaacgtctcacgtaaag

SEQ ID NO: 566748 - DNA, 25 bp, Rattus norvegicus
tatcccttggatacctcattcttta

SEQ ID NO: 566749 - DNA, 25 bp, Rattus norvegicus
tatcccttggattcctcattcttta

SEQ ID NO: 566750 - DNA, 25 bp, Rattus norvegicus
tatccctttgtgcttgtatctaatc

SEQ ID NO: 566751 - DNA, 25 bp, Rattus norvegicus
tatccctttgtggttgtatctaatc

SEQ ID NO: 566752 - DNA, 25 bp, Rattus norvegicus
tatcccttttcaacactcagtattc

SEQ ID NO: 566753 - DNA, 25 bp, Rattus norvegicus
tatcccttttcatcactcagtattc

SEQ ID NO: 566754 - DNA, 25 bp, Rattus norvegicus
tatccctttttaatgtgcttttgtg

SEQ ID NO: 566755 - DNA, 25 bp, Rattus norvegicus
tatccctttttattgtgcttttgtg

SEQ ID NO: 566756 - DNA, 25 bp, Rattus norvegicus
tatccgaccaaacaacactgccagt

SEQ ID NO: 566757 - DNA, 25 bp, Rattus norvegicus
tatccgaccaaagaacactgccagt

SEQ ID NO: 566758 - DNA, 25 bp, Rattus norvegicus
tatccgaccccgagtcattgtaggg

SEQ ID NO: 566759 - DNA, 25 bp, Rattus norvegicus
tatccgaccccgtgtcattgtaggg

SEQ ID NO: 566760 - DNA, 25 bp, Rattus norvegicus
tatccgaccgcaccagcgggagctg

SEQ ID NO: 566761 - DNA, 25 bp, Rattus norvegicus
tatccgaccgcagcagcgggagctg

SEQ ID NO: 566762 - DNA, 25 bp, Rattus norvegicus
tatccgattcggaaaatgcctcccc

SEQ ID NO: 566763 - DNA, 25 bp, Rattus norvegicus
tatccgattcggtaaatgcctcccc

SEQ ID NO: 566764 - DNA, 25 bp, Rattus norvegicus
tatccgcagctaaatgtgtattgaa

SEQ ID NO: 566765 - DNA, 25 bp, Rattus norvegicus
tatccgcagctatatgtgtattgaa

SEQ ID NO: 566766 - DNA, 25 bp, Rattus norvegicus
tatccgcagctccatgactgttaga

SEQ ID NO: 566767 - DNA, 25 bp, Rattus norvegicus
tatccgcagctcgatgactgttaga

SEQ ID NO: 566768 - DNA, 25 bp, Rattus norvegicus
tatccgcatttcctatcagtattat

SEQ ID NO: 566769 - DNA, 25 bp, Rattus norvegicus
tatccgcatttcgtatcagtattat

SEQ ID NO: 566770 - DNA, 25 bp, Rattus norvegicus
tatccgcgggctcaatttgtcggaa

SEQ ID NO: 566771 - DNA, 25 bp, Rattus norvegicus
tatccgcgggctgaatttgtcggaa

SEQ ID NO: 566772 - DNA, 25 bp, Rattus norvegicus
tatccggaacctccttgaattacat

SEQ ID NO: 566773 - DNA, 25 bp, Rattus norvegicus
tatccggaacctgcttgaattacat

SEQ ID NO: 566774 - DNA, 25 bp, Rattus norvegicus
tatccggacaggaacgagtggcagt

SEQ ID NO: 566775 - DNA, 25 bp, Rattus norvegicus
tatccggacaggtacgagtggcagt

SEQ ID NO: 566776 - DNA, 25 bp, Rattus norvegicus
tatccgggtttaaaggtgacagctc

SEQ ID NO: 566777 - DNA, 25 bp, Rattus norvegicus
tatccgggtttataggtgacagctc

SEQ ID NO: 566778 - DNA, 25 bp, Rattus norvegicus
tatccggtcacacctttaatttttt

SEQ ID NO: 566779 - DNA, 25 bp, Rattus norvegicus
tatccggtcacagctttaatttttt

SEQ ID NO: 566780 - DNA, 25 bp, Rattus norvegicus
tatccggtggctcattccaggacaa

SEQ ID NO: 566781 - DNA, 25 bp, Rattus norvegicus
tatccggtggctgattccaggacaa

SEQ ID NO: 566782 - DNA, 25 bp, Rattus norvegicus
tatccgtacctcagtgtcagttaca

SEQ ID NO: 566783 - DNA, 25 bp, Rattus norvegicus
tatccgtacctctgtgtcagttaca

SEQ ID NO: 566784 - DNA, 25 bp, Rattus norvegicus
tatccgtcaagaactgcttcatcag

SEQ ID NO: 566785 - DNA, 25 bp, Rattus norvegicus
tatccgtcaagatctgcttcatcag

SEQ ID NO: 566786 - DNA, 25 bp, Rattus norvegicus
tatccgttacatcagtggttctaga

SEQ ID NO: 566787 - DNA, 25 bp, Rattus norvegicus
tatccgttacatgagtggttctaga

SEQ ID NO: 566788 - DNA, 25 bp, Rattus norvegicus
tatccgttgggtcgagtgaccgatt

SEQ ID NO: 566789 - DNA, 25 bp, Rattus norvegicus
tatccgttgggtggagtgaccgatt

SEQ ID NO: 566790 - DNA, 25 bp, Rattus norvegicus
tatcctaaatcaaatggactctttg

SEQ ID NO: 566791 - DNA, 25 bp, Rattus norvegicus
tatcctaaatcatatggactctttg

SEQ ID NO: 566792 - DNA, 25 bp, Rattus norvegicus
tatcctaacccaacacctgtgagca

SEQ ID NO: 566793 - DNA, 25 bp, Rattus norvegicus
tatcctaacccatcacctgtgagca

SEQ ID NO: 566794 - DNA, 25 bp, Rattus norvegicus
tatcctacccatatccagagcaaaa

SEQ ID NO: 566795 - DNA, 25 bp, Rattus norvegicus
tatcctacccatttccagagcaaaa

SEQ ID NO: 566796 - DNA, 25 bp, Rattus norvegicus
tatcctagaatcattctcctgacag

SEQ ID NO: 566797 - DNA, 25 bp, Rattus norvegicus
tatcctagaatctttctcctgacag

SEQ ID NO: 566798 - DNA, 25 bp, Rattus norvegicus
tatcctagcagaccagacaagcggt

SEQ ID NO: 566799 - DNA, 25 bp, Rattus norvegicus
tatcctagcagagcagacaagcggt

SEQ ID NO: 566800 - DNA, 25 bp, Rattus norvegicus
tatcctagtctgctcagctcattgg

SEQ ID NO: 566801 - DNA, 25 bp, Rattus norvegicus
tatcctagtctggtcagctcattgg

SEQ ID NO: 566802 - DNA, 25 bp, Rattus norvegicus
tatcctagttaacccataagtgtca

SEQ ID NO: 566803 - DNA, 25 bp, Rattus norvegicus
tatcctagttaagccataagtgtca

SEQ ID NO: 566804 - DNA, 25 bp, Rattus norvegicus
tatcctagttccatacagtatccca

SEQ ID NO: 566805 - DNA, 25 bp, Rattus norvegicus
tatcctagttccttacagtatccca

SEQ ID NO: 566806 - DNA, 25 bp, Rattus norvegicus
tatcctataactcctcctcgtgagt

SEQ ID NO: 566807 - DNA, 25 bp, Rattus norvegicus
tatcctataactgctcctcgtgagt

SEQ ID NO: 566808 - DNA, 25 bp, Rattus norvegicus
tatcctatccaaccatactaacgtg

SEQ ID NO: 566809 - DNA, 25 bp, Rattus norvegicus
tatcctatccaagcatactaacgtg

SEQ ID NO: 566810 - DNA, 25 bp, Rattus norvegicus
tatcctatctaaagtacccaaccct

SEQ ID NO: 566811 - DNA, 25 bp, Rattus norvegicus
tatcctatctaatgtacccaaccct

SEQ ID NO: 566812 - DNA, 25 bp, Rattus norvegicus
tatcctattggtctgggcatcagct

SEQ ID NO: 566813 - DNA, 25 bp, Rattus norvegicus
tatcctattggtgtgggcatcagct

SEQ ID NO: 566814 - DNA, 25 bp, Rattus norvegicus
tatcctcaaaagacctagttccctg

SEQ ID NO: 566815 - DNA, 25 bp, Rattus norvegicus
tatcctcaaaagtcctagttccctg

SEQ ID NO: 566816 - DNA, 25 bp, Rattus norvegicus
tatcctcaagcgaaacatccagcag

SEQ ID NO: 566817 - DNA, 25 bp, Rattus norvegicus
tatcctcaagcgtaacatccagcag

SEQ ID NO: 566818 - DNA, 25 bp, Rattus norvegicus
tatcctcaggcgagtcaaggcccaa

SEQ ID NO: 566819 - DNA, 25 bp, Rattus norvegicus
tatcctcaggcgtgtcaaggcccaa

SEQ ID NO: 566820 - DNA, 25 bp, Rattus norvegicus
tatcctcagtttcccctcggaaaag

SEQ ID NO: 566821 - DNA, 25 bp, Rattus norvegicus
tatcctcagtttgccctcggaaaag

SEQ ID NO: 566822 - DNA, 25 bp, Rattus norvegicus
tatcctcattgcatggtgcgcccga

SEQ ID NO: 566823 - DNA, 25 bp, Rattus norvegicus
tatcctcattgcttggtgcgcccga

SEQ ID NO: 566824 - DNA, 25 bp, Rattus norvegicus
tatcctccacacagagtcactgaag

SEQ ID NO: 566825 - DNA, 25 bp, Rattus norvegicus
tatcctccacactgagtcactgaag

SEQ ID NO: 566826 - DNA, 25 bp, Rattus norvegicus
tatcctccagttattgttaacacct

SEQ ID NO: 566827 - DNA, 25 bp, Rattus norvegicus
tatcctccagtttttgttaacacct

SEQ ID NO: 566828 - DNA, 25 bp, Rattus norvegicus
tatcctccattaactgaactccttg

SEQ ID NO: 566829 - DNA, 25 bp, Rattus norvegicus
tatcctccattatctgaactccttg

SEQ ID NO: 566830 - DNA, 25 bp, Rattus norvegicus
tatcctcccaagcagtttattctaa

SEQ ID NO: 566831 - DNA, 25 bp, Rattus norvegicus
tatcctcccaaggagtttattctaa

SEQ ID NO: 566832 - DNA, 25 bp, Rattus norvegicus
tatcctcccgcgcagaaatatgaat

SEQ ID NO: 566833 - DNA, 25 bp, Rattus norvegicus
tatcctcccgcggagaaatatgaat

SEQ ID NO: 566834 - DNA, 25 bp, Rattus norvegicus
tatcctcctggaacatagctaacct

SEQ ID NO: 566835 - DNA, 25 bp, Rattus norvegicus
tatcctcctggatcatagctaacct

SEQ ID NO: 566836 - DNA, 25 bp, Rattus norvegicus
tatcctcgaagcacatactgcgtct

SEQ ID NO: 566837 - DNA, 25 bp, Rattus norvegicus
tatcctcgaagctcatactgcgtct

SEQ ID NO: 566838 - DNA, 25 bp, Rattus norvegicus
tatcctcgctggcaacagggtcttc

SEQ ID NO: 566839 - DNA, 25 bp, Rattus norvegicus
tatcctcgctgggaacagggtcttc

SEQ ID NO: 566840 - DNA, 25 bp, Rattus norvegicus
tatcctcgtcaacgcaggaaaacgg

SEQ ID NO: 566841 - DNA, 25 bp, Rattus norvegicus
tatcctcgtcaaggcaggaaaacgg

SEQ ID NO: 566842 - DNA, 25 bp, Rattus norvegicus
tatcctctcagacccatctgtgttt

SEQ ID NO: 566843 - DNA, 25 bp, Rattus norvegicus
tatcctctcagagccatctgtgttt

SEQ ID NO: 566844 - DNA, 25 bp, Rattus norvegicus
tatcctctcagtccatgttctcggc

SEQ ID NO: 566845 - DNA, 25 bp, Rattus norvegicus
tatcctctcagtgcatgttctcggc

SEQ ID NO: 566846 - DNA, 25 bp, Rattus norvegicus
tatcctctgaaacgtggcccatggc

SEQ ID NO: 566847 - DNA, 25 bp, Rattus norvegicus
tatcctctgaaaggtggcccatggc

SEQ ID NO: 566848 - DNA, 25 bp, Rattus norvegicus
tatcctctgacaactatagcaataa

SEQ ID NO: 566849 - DNA, 25 bp, Rattus norvegicus
tatcctctgacatctatagcaataa

SEQ ID NO: 566850 - DNA, 25 bp, Rattus norvegicus
tatcctctgaccactatacatgtga

SEQ ID NO: 566851 - DNA, 25 bp, Rattus norvegicus
tatcctctgacctctatacatgtga

SEQ ID NO: 566852 - DNA, 25 bp, Rattus norvegicus
tatcctctgatacggttttcttcct

SEQ ID NO: 566853 - DNA, 25 bp, Rattus norvegicus
tatcctctgatagggttttcttcct

SEQ ID NO: 566854 - DNA, 25 bp, Rattus norvegicus
tatcctctgatgcttcacatagctg

SEQ ID NO: 566855 - DNA, 25 bp, Rattus norvegicus
tatcctctgatggttcacatagctg

SEQ ID NO: 566856 - DNA, 25 bp, Rattus norvegicus
tatcctctgggaagttctagaaaaa

SEQ ID NO: 566857 - DNA, 25 bp, Rattus norvegicus
tatcctctgggatgttctagaaaaa

SEQ ID NO: 566858 - DNA, 25 bp, Rattus norvegicus
tatcctctggttcccatgcatacct

SEQ ID NO: 566859 - DNA, 25 bp, Rattus norvegicus
tatcctctggttgccatgcatacct

SEQ ID NO: 566860 - DNA, 25 bp, Rattus norvegicus
tatcctcttgtgaattcactcctcc

SEQ ID NO: 566861 - DNA, 25 bp, Rattus norvegicus
tatcctcttgtgtattcactcctcc

SEQ ID NO: 566862 - DNA, 25 bp, Rattus norvegicus
tatcctctttaaagttaaggatttg

SEQ ID NO: 566863 - DNA, 25 bp, Rattus norvegicus
tatcctctttaatgttaaggatttg

SEQ ID NO: 566864 - DNA, 25 bp, Rattus norvegicus
tatcctctttttaaccaaataggtg

SEQ ID NO: 566865 - DNA, 25 bp, Rattus norvegicus
tatcctcttttttaccaaataggtg

SEQ ID NO: 566866 - DNA, 25 bp, Rattus norvegicus
tatcctgaaacgcaggctgcccttg

SEQ ID NO: 566867 - DNA, 25 bp, Rattus norvegicus
tatcctgaaacggaggctgcccttg

SEQ ID NO: 566868 - DNA, 25 bp, Rattus norvegicus
tatcctgaaggacacctgcttcctt

SEQ ID NO: 566869 - DNA, 25 bp, Rattus norvegicus
tatcctgaaggagacctgcttcctt

SEQ ID NO: 566870 - DNA, 25 bp, Rattus norvegicus
tatcctgacaagaatcccaggccag

SEQ ID NO: 566871 - DNA, 25 bp, Rattus norvegicus
tatcctgacaagagcaacctactga

SEQ ID NO: 566872 - DNA, 25 bp, Rattus norvegicus
tatcctgacaagtatcccaggccag

SEQ ID NO: 566873 - DNA, 25 bp, Rattus norvegicus
tatcctgacaagtgcaacctactga

SEQ ID NO: 566874 - DNA, 25 bp, Rattus norvegicus
tatcctgacaatcaagaatcaccca

SEQ ID NO: 566875 - DNA, 25 bp, Rattus norvegicus
tatcctgacaatgaagaatcaccca

SEQ ID NO: 566876 - DNA, 25 bp, Rattus norvegicus
tatcctgagactaggccattgttct

SEQ ID NO: 566877 - DNA, 25 bp, Rattus norvegicus
tatcctgagacttggccattgttct

SEQ ID NO: 566878 - DNA, 25 bp, Rattus norvegicus
tatcctgagatcaatccaagtgttg

SEQ ID NO: 566879 - DNA, 25 bp, Rattus norvegicus
tatcctgagatccatttctactacg

SEQ ID NO: 566880 - DNA, 25 bp, Rattus norvegicus
tatcctgagatcgatttctactacg

SEQ ID NO: 566881 - DNA, 25 bp, Rattus norvegicus
tatcctgagatctatccaagtgttg

SEQ ID NO: 566882 - DNA, 25 bp, Rattus norvegicus
tatcctgaggaaataggtcaccact

SEQ ID NO: 566883 - DNA, 25 bp, Rattus norvegicus
tatcctgaggaattaggtcaccact

SEQ ID NO: 566884 - DNA, 25 bp, Rattus norvegicus
tatcctgaggcaccaacttcactgg

SEQ ID NO: 566885 - DNA, 25 bp, Rattus norvegicus
tatcctgaggcagcaacttcactgg

SEQ ID NO: 566886 - DNA, 25 bp, Rattus norvegicus
tatcctgattatcaggtcacctggg

SEQ ID NO: 566887 - DNA, 25 bp, Rattus norvegicus
tatcctgattatgaggtcacctggg

SEQ ID NO: 566888 - DNA, 25 bp, Rattus norvegicus
tatcctgcaaacattcctgaactct

SEQ ID NO: 566889 - DNA, 25 bp, Rattus norvegicus
tatcctgcaaactttcctgaactct

SEQ ID NO: 566890 - DNA, 25 bp, Rattus norvegicus
tatcctgcaactactcaaactgtac

SEQ ID NO: 566891 - DNA, 25 bp, Rattus norvegicus
tatcctgcaacttctcaaactgtac

SEQ ID NO: 566892 - DNA, 25 bp, Rattus norvegicus
tatcctgcagggaggctctctaaaa

SEQ ID NO: 566893 - DNA, 25 bp, Rattus norvegicus
tatcctgcagggtggctctctaaaa

SEQ ID NO: 566894 - DNA, 25 bp, Rattus norvegicus
tatcctgccaacaacgttgaggcta

SEQ ID NO: 566895 - DNA, 25 bp, Rattus norvegicus
tatcctgccaactacgttgaggcta

SEQ ID NO: 566896 - DNA, 25 bp, Rattus norvegicus
tatcctgccactcagaacatttgca

SEQ ID NO: 566897 - DNA, 25 bp, Rattus norvegicus
tatcctgccactgagaacatttgca

SEQ ID NO: 566898 - DNA, 25 bp, Rattus norvegicus
tatcctgcccagctcttggaagacg

SEQ ID NO: 566899 - DNA, 25 bp, Rattus norvegicus
tatcctgcccaggtcttggaagacg

SEQ ID NO: 566900 - DNA, 25 bp, Rattus norvegicus
tatcctgcctctagaacgctagcgg

SEQ ID NO: 566901 - DNA, 25 bp, Rattus norvegicus
tatcctgcctcttgaacgctagcgg

SEQ ID NO: 566902 - DNA, 25 bp, Rattus norvegicus
tatcctgcggaactctcaattaaca

SEQ ID NO: 566903 - DNA, 25 bp, Rattus norvegicus
tatcctgcggaagtctcaattaaca

SEQ ID NO: 566904 - DNA, 25 bp, Rattus norvegicus
tatcctgctcatacttgcatgggaa

SEQ ID NO: 566905 - DNA, 25 bp, Rattus norvegicus
tatcctgctcattcttgcatgggaa

SEQ ID NO: 566906 - DNA, 25 bp, Rattus norvegicus
tatcctgctgcactagatactattg

SEQ ID NO: 566907 - DNA, 25 bp, Rattus norvegicus
tatcctgctgcagtagatactattg

SEQ ID NO: 566908 - DNA, 25 bp, Rattus norvegicus
tatcctggaagcactgctggttgac

SEQ ID NO: 566909 - DNA, 25 bp, Rattus norvegicus
tatcctggaagctctgctggttgac

SEQ ID NO: 566910 - DNA, 25 bp, Rattus norvegicus
tatcctggagctcggagatgcttct

SEQ ID NO: 566911 - DNA, 25 bp, Rattus norvegicus
tatcctggagctgggagatgcttct

SEQ ID NO: 566912 - DNA, 25 bp, Rattus norvegicus
tatcctggcggtactcgtagaggtg

SEQ ID NO: 566913 - DNA, 25 bp, Rattus norvegicus
tatcctggcggttctcgtagaggtg

SEQ ID NO: 566914 - DNA, 25 bp, Rattus norvegicus
tatcctgggagccactgggtgttaa

SEQ ID NO: 566915 - DNA, 25 bp, Rattus norvegicus
tatcctgggagcgactgggtgttaa

SEQ ID NO: 566916 - DNA, 25 bp, Rattus norvegicus
tatcctgggaggcaaccagtctgga

SEQ ID NO: 566917 - DNA, 25 bp, Rattus norvegicus
tatcctgggagggaaccagtctgga

SEQ ID NO: 566918 - DNA, 25 bp, Rattus norvegicus
tatcctgggattagccttgtctgaa

SEQ ID NO: 566919 - DNA, 25 bp, Rattus norvegicus
tatcctgggatttgccttgtctgaa

SEQ ID NO: 566920 - DNA, 25 bp, Rattus norvegicus
tatcctgggctaatattagctggtt

SEQ ID NO: 566921 - DNA, 25 bp, Rattus norvegicus
tatcctgggctattattagctggtt

SEQ ID NO: 566922 - DNA, 25 bp, Rattus norvegicus
tatcctggtaccattctcgtgaata

SEQ ID NO: 566923 - DNA, 25 bp, Rattus norvegicus
tatcctggtacctttctcgtgaata

SEQ ID NO: 566924 - DNA, 25 bp, Rattus norvegicus
tatcctggtatgactgtgtactttc

SEQ ID NO: 566925 - DNA, 25 bp, Rattus norvegicus
tatcctggtatgtctgtgtactttc

SEQ ID NO: 566926 - DNA, 25 bp, Rattus norvegicus
tatcctggtgctacccatgtaagaa

SEQ ID NO: 566927 - DNA, 25 bp, Rattus norvegicus
tatcctggtgcttcccatgtaagaa

SEQ ID NO: 566928 - DNA, 25 bp, Rattus norvegicus
tatcctggtggcagtcatggctgag

SEQ ID NO: 566929 - DNA, 25 bp, Rattus norvegicus
tatcctggtggctgtcatggctgag

SEQ ID NO: 566930 - DNA, 25 bp, Rattus norvegicus
tatcctggttgtctgacttgagagc

SEQ ID NO: 566931 - DNA, 25 bp, Rattus norvegicus
tatcctggttgtgtgacttgagagc

SEQ ID NO: 566932 - DNA, 25 bp, Rattus norvegicus
tatcctgtaaatatgcctagagcta

SEQ ID NO: 566933 - DNA, 25 bp, Rattus norvegicus
tatcctgtaaatttgcctagagcta

SEQ ID NO: 566934 - DNA, 25 bp, Rattus norvegicus
tatcctgtaaccagccatgatgcat

SEQ ID NO: 566935 - DNA, 25 bp, Rattus norvegicus
tatcctgtaacctgccatgatgcat

SEQ ID NO: 566936 - DNA, 25 bp, Rattus norvegicus
tatcctgtactgaccctgagctagg

SEQ ID NO: 566937 - DNA, 25 bp, Rattus norvegicus
tatcctgtactgtccctgagctagg

SEQ ID NO: 566938 - DNA, 25 bp, Rattus norvegicus
tatcctgtcagcatcaaaccagcag

SEQ ID NO: 566939 - DNA, 25 bp, Rattus norvegicus
tatcctgtcagcttcaaaccagcag

SEQ ID NO: 566940 - DNA, 25 bp, Rattus norvegicus
tatcctgtcaggcacaaacactaga

SEQ ID NO: 566941 - DNA, 25 bp, Rattus norvegicus
tatcctgtcagggacaaacactaga

SEQ ID NO: 566942 - DNA, 25 bp, Rattus norvegicus
tatcctgtccagaagggtagcctct

SEQ ID NO: 566943 - DNA, 25 bp, Rattus norvegicus
tatcctgtccagtagggtagcctct

SEQ ID NO: 566944 - DNA, 25 bp, Rattus norvegicus
tatcctgtcctcattcatgtagatg

SEQ ID NO: 566945 - DNA, 25 bp, Rattus norvegicus
tatcctgtcctctttcatgtagatg

SEQ ID NO: 566946 - DNA, 25 bp, Rattus norvegicus
tatcctgtgagaagccaaggccacg

SEQ ID NO: 566947 - DNA, 25 bp, Rattus norvegicus
tatcctgtgagatgccaaggccacg

SEQ ID NO: 566948 - DNA, 25 bp, Rattus norvegicus
tatcctgtgccaaactattgttaaa

SEQ ID NO: 566949 - DNA, 25 bp, Rattus norvegicus
tatcctgtgccatactattgttaaa

SEQ ID NO: 566950 - DNA, 25 bp, Rattus norvegicus
tatcctgtgctgacagagcctcaaa

SEQ ID NO: 566951 - DNA, 25 bp, Rattus norvegicus
tatcctgtgctgtcagagcctcaaa

SEQ ID NO: 566952 - DNA, 25 bp, Rattus norvegicus
tatcctgtggcaaacaacctgtttt

SEQ ID NO: 566953 - DNA, 25 bp, Rattus norvegicus
tatcctgtggcatacaacctgtttt

SEQ ID NO: 566954 - DNA, 25 bp, Rattus norvegicus
tatcctgtggtcagcatataactta

SEQ ID NO: 566955 - DNA, 25 bp, Rattus norvegicus
tatcctgtggtctgcatataactta

SEQ ID NO: 566956 - DNA, 25 bp, Rattus norvegicus
tatcctgtgtaacgtgggtctgttt

SEQ ID NO: 566957 - DNA, 25 bp, Rattus norvegicus
tatcctgtgtaaggtgggtctgttt

SEQ ID NO: 566958 - DNA, 25 bp, Rattus norvegicus
tatcctgtgtataagcttcattgct

SEQ ID NO: 566959 - DNA, 25 bp, Rattus norvegicus
tatcctgtgtattagcttcattgct

SEQ ID NO: 566960 - DNA, 25 bp, Rattus norvegicus
tatcctgtttggatgggccacttaa

SEQ ID NO: 566961 - DNA, 25 bp, Rattus norvegicus
tatcctgtttggttgggccacttaa

SEQ ID NO: 566962 - DNA, 25 bp, Rattus norvegicus
tatccttaagttccatgttttcacc

SEQ ID NO: 566963 - DNA, 25 bp, Rattus norvegicus
tatccttaagttgcatgttttcacc

SEQ ID NO: 566964 - DNA, 25 bp, Rattus norvegicus
tatccttagggtctgggtgcctcaa

SEQ ID NO: 566965 - DNA, 25 bp, Rattus norvegicus
tatccttagggtgtgggtgcctcaa

SEQ ID NO: 566966 - DNA, 25 bp, Rattus norvegicus
tatccttcaataccaaatcttagtg

SEQ ID NO: 566967 - DNA, 25 bp, Rattus norvegicus
tatccttcaatagcaaatcttagtg

SEQ ID NO: 566968 - DNA, 25 bp, Rattus norvegicus
tatccttccccgcaattaaagggtg

SEQ ID NO: 566969 - DNA, 25 bp, Rattus norvegicus
tatccttccccggaattaaagggtg

SEQ ID NO: 566970 - DNA, 25 bp, Rattus norvegicus
tatccttcctctaaaagcgagcctt

SEQ ID NO: 566971 - DNA, 25 bp, Rattus norvegicus
tatccttcctcttaaagcgagcctt

SEQ ID NO: 566972 - DNA, 25 bp, Rattus norvegicus
tatccttcctgtcccagatagggaa

SEQ ID NO: 566973 - DNA, 25 bp, Rattus norvegicus
tatccttcctgtgccagatagggaa

SEQ ID NO: 566974 - DNA, 25 bp, Rattus norvegicus
tatccttctcctcaagcttcatatc

SEQ ID NO: 566975 - DNA, 25 bp, Rattus norvegicus
tatccttctcctgaagcttcatatc

SEQ ID NO: 566976 - DNA, 25 bp, Rattus norvegicus
tatccttgagcactggatttaactc

SEQ ID NO: 566977 - DNA, 25 bp, Rattus norvegicus
tatccttgagcagtggatttaactc

SEQ ID NO: 566978 - DNA, 25 bp, Rattus norvegicus
tatccttgaggtatcttatagacat

SEQ ID NO: 566979 - DNA, 25 bp, Rattus norvegicus
tatccttgaggtttcttatagacat

SEQ ID NO: 566980 - DNA, 25 bp, Rattus norvegicus
tatccttgcatgcacagcagctcta

SEQ ID NO: 566981 - DNA, 25 bp, Rattus norvegicus
tatccttgcatggacagcagctcta

SEQ ID NO: 566982 - DNA, 25 bp, Rattus norvegicus
tatccttgcccacccaaagggaggg

SEQ ID NO: 566983 - DNA, 25 bp, Rattus norvegicus
tatccttgcccagccaaagggaggg

SEQ ID NO: 566984 - DNA, 25 bp, Rattus norvegicus
tatccttgctaacagaaatccacag

SEQ ID NO: 566985 - DNA, 25 bp, Rattus norvegicus
tatccttgctaagagaaatccacag

SEQ ID NO: 566986 - DNA, 25 bp, Rattus norvegicus
tatccttgctgtctgtaacctttca

SEQ ID NO: 566987 - DNA, 25 bp, Rattus norvegicus
tatccttgctgtgtgtaacctttca

SEQ ID NO: 566988 - DNA, 25 bp, Rattus norvegicus
tatccttgtcatatgtgtgccaacc

SEQ ID NO: 566989 - DNA, 25 bp, Rattus norvegicus
tatccttgtcatttgtgtgccaacc

SEQ ID NO: 566990 - DNA, 25 bp, Rattus norvegicus
tatccttgtgttaacttgacttatg

SEQ ID NO: 566991 - DNA, 25 bp, Rattus norvegicus
tatccttgtgtttacttgacttatg

SEQ ID NO: 566992 - DNA, 25 bp, Rattus norvegicus
tatccttgttaccagccattctata

SEQ ID NO: 566993 - DNA, 25 bp, Rattus norvegicus
tatccttgttacgagccattctata

SEQ ID NO: 566994 - DNA, 25 bp, Rattus norvegicus
tatccttgttatattcttagctcaa

SEQ ID NO: 566995 - DNA, 25 bp, Rattus norvegicus
tatccttgttattttcttagctcaa

SEQ ID NO: 566996 - DNA, 25 bp, Rattus norvegicus
tatcctttccatacacaactgcaga

SEQ ID NO: 566997 - DNA, 25 bp, Rattus norvegicus
tatcctttccattcacaactgcaga

SEQ ID NO: 566998 - DNA, 25 bp, Rattus norvegicus
tatcctttcctgaaactaggcttag

SEQ ID NO: 566999 - DNA, 25 bp, Rattus norvegicus
tatcctttcctgtaactaggcttag

SEQ ID NO: 567000 - DNA, 25 bp, Rattus norvegicus
tatcctttcgtaactctctggtgag

SEQ ID NO: 567001 - DNA, 25 bp, Rattus norvegicus
tatcctttcgtatctctctggtgag

SEQ ID NO: 567002 - DNA, 25 bp, Rattus norvegicus
tatcctttctctctgtcttcaatgg

SEQ ID NO: 567003 - DNA, 25 bp, Rattus norvegicus
tatcctttctctgtgtcttcaatgg

SEQ ID NO: 567004 - DNA, 25 bp, Rattus norvegicus
tatcctttcttccagcacagtgcaa

SEQ ID NO: 567005 - DNA, 25 bp, Rattus norvegicus
tatcctttcttcgagcacagtgcaa

SEQ ID NO: 567006 - DNA, 25 bp, Rattus norvegicus
tatcctttcttgcttcatgaatcgt

SEQ ID NO: 567007 - DNA, 25 bp, Rattus norvegicus
tatcctttcttggttcatgaatcgt

SEQ ID NO: 567008 - DNA, 25 bp, Rattus norvegicus
tatcctttgtttccagtgaccttta

SEQ ID NO: 567009 - DNA, 25 bp, Rattus norvegicus
tatcctttgtttgcagtgaccttta

SEQ ID NO: 567010 - DNA, 25 bp, Rattus norvegicus
tatccttttaagagcctagcctaac

SEQ ID NO: 567011 - DNA, 25 bp, Rattus norvegicus
tatccttttaagtgcctagcctaac

SEQ ID NO: 567012 - DNA, 25 bp, Rattus norvegicus
tatccttttgggacccttgtcacaa

SEQ ID NO: 567013 - DNA, 25 bp, Rattus norvegicus
tatccttttgggtcccttgtcacaa

SEQ ID NO: 567014 - DNA, 25 bp, Rattus norvegicus
tatccttttgttacctccctctcaa

SEQ ID NO: 567015 - DNA, 25 bp, Rattus norvegicus
tatccttttgtttcctccctctcaa

SEQ ID NO: 567016 - DNA, 25 bp, Rattus norvegicus
tatcgaacctcgagcttttttcctt

SEQ ID NO: 567017 - DNA, 25 bp, Rattus norvegicus
tatcgaacctcgtgcttttttcctt

SEQ ID NO: 567018 - DNA, 25 bp, Rattus norvegicus
tatcgaacttctagactgtcatccg

SEQ ID NO: 567019 - DNA, 25 bp, Rattus norvegicus
tatcgaacttcttgactgtcatccg

SEQ ID NO: 567020 - DNA, 25 bp, Rattus norvegicus
tatcgaatctacacttatcatgaac

SEQ ID NO: 567021 - DNA, 25 bp, Rattus norvegicus
tatcgaatctactcttatcatgaac

SEQ ID NO: 567022 - DNA, 25 bp, Rattus norvegicus
tatcgacatggcagccgtggagatc

SEQ ID NO: 567023 - DNA, 25 bp, Rattus norvegicus
tatcgacatggctgccgtggagatc

SEQ ID NO: 567024 - DNA, 25 bp, Rattus norvegicus
tatcgaccctatcaaggaaccagaa

SEQ ID NO: 567025 - DNA, 25 bp, Rattus norvegicus
tatcgaccctatgaaggaaccagaa

SEQ ID NO: 567026 - DNA, 25 bp, Rattus norvegicus
tatcgaccgacgctggcaattggag

SEQ ID NO: 567027 - DNA, 25 bp, Rattus norvegicus
tatcgaccgacggtggcaattggag

SEQ ID NO: 567028 - DNA, 25 bp, Rattus norvegicus
tatcgagaccgtccagctgaacgca

SEQ ID NO: 567029 - DNA, 25 bp, Rattus norvegicus
tatcgagaccgtgcagctgaacgca

SEQ ID NO: 567030 - DNA, 25 bp, Rattus norvegicus
tatcgagactatccgatgggtctgc

SEQ ID NO: 567031 - DNA, 25 bp, Rattus norvegicus
tatcgagactatgcgatgggtctgc

SEQ ID NO: 567032 - DNA, 25 bp, Rattus norvegicus
tatcgagggcacacgggctcccaag

SEQ ID NO: 567033 - DNA, 25 bp, Rattus norvegicus
tatcgagggcactcgggctcccaag

SEQ ID NO: 567034 - DNA, 25 bp, Rattus norvegicus
tatcgagggtgcactgtccctgggt

SEQ ID NO: 567035 - DNA, 25 bp, Rattus norvegicus
tatcgagggtgctctgtccctgggt

SEQ ID NO: 567036 - DNA, 25 bp, Rattus norvegicus
tatcgagtaattcaccgcgctgttc

SEQ ID NO: 567037 - DNA, 25 bp, Rattus norvegicus
tatcgagtaattgaccgcgctgttc

SEQ ID NO: 567038 - DNA, 25 bp, Rattus norvegicus
tatcgatccatcagacttaccgaga

SEQ ID NO: 567039 - DNA, 25 bp, Rattus norvegicus
tatcgatccatctgacttaccgaga

SEQ ID NO: 567040 - DNA, 25 bp, Rattus norvegicus
tatcgattccctcccagagcatatc

SEQ ID NO: 567041 - DNA, 25 bp, Rattus norvegicus
tatcgattccctgccagagcatatc

SEQ ID NO: 567042 - DNA, 25 bp, Rattus norvegicus
tatcgcactgccctcaggaacctgg

SEQ ID NO: 567043 - DNA, 25 bp, Rattus norvegicus
tatcgcactgccgtcaggaacctgg

SEQ ID NO: 567044 - DNA, 25 bp, Rattus norvegicus
tatcgcatcgatctggtctcacaat

SEQ ID NO: 567045 - DNA, 25 bp, Rattus norvegicus
tatcgcatcgatgtggtctcacaat

SEQ ID NO: 567046 - DNA, 25 bp, Rattus norvegicus
tatcgccaatggctggtaccaaaca

SEQ ID NO: 567047 - DNA, 25 bp, Rattus norvegicus
tatcgccaatgggtggtaccaaaca

SEQ ID NO: 567048 - DNA, 25 bp, Rattus norvegicus
tatcgccattgcagtctcattgtat

SEQ ID NO: 567049 - DNA, 25 bp, Rattus norvegicus
tatcgccattgctgtctcattgtat

SEQ ID NO: 567050 - DNA, 25 bp, Rattus norvegicus
tatcgcccaagcattgtatcagcca

SEQ ID NO: 567051 - DNA, 25 bp, Rattus norvegicus
tatcgcccaagctttgtatcagcca

SEQ ID NO: 567052 - DNA, 25 bp, Rattus norvegicus
tatcgcccagtcctgatcttatggt

SEQ ID NO: 567053 - DNA, 25 bp, Rattus norvegicus
tatcgcccagtcgtgatcttatggt

SEQ ID NO: 567054 - DNA, 25 bp, Rattus norvegicus
tatcgcccttcaaatgcgacttctt

SEQ ID NO: 567055 - DNA, 25 bp, Rattus norvegicus
tatcgcccttcatatgcgacttctt

SEQ ID NO: 567056 - DNA, 25 bp, Rattus norvegicus
tatcgcctagctacctttgttaatg

SEQ ID NO: 567057 - DNA, 25 bp, Rattus norvegicus
tatcgcctagcttcctttgttaatg

SEQ ID NO: 567058 - DNA, 25 bp, Rattus norvegicus
tatcgcctgagaacagtccacaagt

SEQ ID NO: 567059 - DNA, 25 bp, Rattus norvegicus
tatcgcctgagatcagtccacaagt

SEQ ID NO: 567060 - DNA, 25 bp, Rattus norvegicus
tatcgcgatgaaaacggcaagccgt

SEQ ID NO: 567061 - DNA, 25 bp, Rattus norvegicus
tatcgcgatgaatacggcaagccgt

SEQ ID NO: 567062 - DNA, 25 bp, Rattus norvegicus
tatcgctacatcattgctgctgaag

SEQ ID NO: 567063 - DNA, 25 bp, Rattus norvegicus
tatcgctacatctttgctgctgaag

SEQ ID NO: 567064 - DNA, 25 bp, Rattus norvegicus
tatcgctgcgctcgtcgtcgacaac

SEQ ID NO: 567065 - DNA, 25 bp, Rattus norvegicus
tatcgctgcgctggtcgtcgacaac

SEQ ID NO: 567066 - DNA, 25 bp, Rattus norvegicus
tatcgctgcttacatgtatgcctgc

SEQ ID NO: 567067 - DNA, 25 bp, Rattus norvegicus
tatcgctgcttagatgtatgcctgc

SEQ ID NO: 567068 - DNA, 25 bp, Rattus norvegicus
tatcgctgttatccgagtgtcactg

SEQ ID NO: 567069 - DNA, 25 bp, Rattus norvegicus
tatcgctgttatgcgagtgtcactg

SEQ ID NO: 567070 - DNA, 25 bp, Rattus norvegicus
tatcgcttgttgacacttaaatatc

SEQ ID NO: 567071 - DNA, 25 bp, Rattus norvegicus
tatcgcttgttgtcacttaaatatc

SEQ ID NO: 567072 - DNA, 25 bp, Rattus norvegicus
tatcggaattccatagtgcaaaagt

SEQ ID NO: 567073 - DNA, 25 bp, Rattus norvegicus
tatcggaattccttagtgcaaaagt

SEQ ID NO: 567074 - DNA, 25 bp, Rattus norvegicus
tatcggatatcaaaccgggccagcc

SEQ ID NO: 567075 - DNA, 25 bp, Rattus norvegicus
tatcggatatcataccgggccagcc

SEQ ID NO: 567076 - DNA, 25 bp, Rattus norvegicus
tatcggatccggaggtgcagtccaa

SEQ ID NO: 567077 - DNA, 25 bp, Rattus norvegicus
tatcggatccggtggtgcagtccaa

SEQ ID NO: 567078 - DNA, 25 bp, Rattus norvegicus
tatcggcagcttctgtggatgacct

SEQ ID NO: 567079 - DNA, 25 bp, Rattus norvegicus
tatcggcagcttgtgtggatgacct

SEQ ID NO: 567080 - DNA, 25 bp, Rattus norvegicus
tatcggccacaaaatgtcctttcgg

SEQ ID NO: 567081 - DNA, 25 bp, Rattus norvegicus
tatcggccacaatatgtcctttcgg

SEQ ID NO: 567082 - DNA, 25 bp, Rattus norvegicus
tatcggcggttacttccttcaggaa

SEQ ID NO: 567083 - DNA, 25 bp, Rattus norvegicus
tatcggcggttagttccttcaggaa

SEQ ID NO: 567084 - DNA, 25 bp, Rattus norvegicus
tatcggctatacagaaatcttctgg

SEQ ID NO: 567085 - DNA, 25 bp, Rattus norvegicus
tatcggctatactgaaatcttctgg

SEQ ID NO: 567086 - DNA, 25 bp, Rattus norvegicus
tatcgggaagcccttgtgttccagg

SEQ ID NO: 567087 - DNA, 25 bp, Rattus norvegicus
tatcgggaagccgttgtgttccagg

SEQ ID NO: 567088 - DNA, 25 bp, Rattus norvegicus
tatcgggaagctaggcgtccttcat

SEQ ID NO: 567089 - DNA, 25 bp, Rattus norvegicus
tatcgggaagcttggcgtccttcat

SEQ ID NO: 567090 - DNA, 25 bp, Rattus norvegicus
tatcgggatatcctttcactctgca

SEQ ID NO: 567091 - DNA, 25 bp, Rattus norvegicus
tatcgggatatcgtttcactctgca

SEQ ID NO: 567092 - DNA, 25 bp, Rattus norvegicus
tatcggggtcatagccaatgatatg

SEQ ID NO: 567093 - DNA, 25 bp, Rattus norvegicus
tatcggggtcattgccaatgatatg

SEQ ID NO: 567094 - DNA, 25 bp, Rattus norvegicus
tatcgggtcagcacacacatctctg

SEQ ID NO: 567095 - DNA, 25 bp, Rattus norvegicus
tatcgggtcagctcacacatctctg

SEQ ID NO: 567096 - DNA, 25 bp, Rattus norvegicus
tatcggtgccctcaagacagccagt

SEQ ID NO: 567097 - DNA, 25 bp, Rattus norvegicus
tatcggtgccctgaagacagccagt

SEQ ID NO: 567098 - DNA, 25 bp, Rattus norvegicus
tatcggttctggcattggcatcttt

SEQ ID NO: 567099 - DNA, 25 bp, Rattus norvegicus
tatcggttctgggattggcatcttt

SEQ ID NO: 567100 - DNA, 25 bp, Rattus norvegicus
tatcggttcttcacggctggaggga

SEQ ID NO: 567101 - DNA, 25 bp, Rattus norvegicus
tatcggttcttctcggctggaggga

SEQ ID NO: 567102 - DNA, 25 bp, Rattus norvegicus
tatcgtaacaccctaacacacctga

SEQ ID NO: 567103 - DNA, 25 bp, Rattus norvegicus
tatcgtaacaccgtaacacacctga

SEQ ID NO: 567104 - DNA, 25 bp, Rattus norvegicus
tatcgtaccgtaattgaactgcagc

SEQ ID NO: 567105 - DNA, 25 bp, Rattus norvegicus
tatcgtaccgtatttgaactgcagc

SEQ ID NO: 567106 - DNA, 25 bp, Rattus norvegicus
tatcgtagacatctctcaagtgttc

SEQ ID NO: 567107 - DNA, 25 bp, Rattus norvegicus
tatcgtagacatgtctcaagtgttc

SEQ ID NO: 567108 - DNA, 25 bp, Rattus norvegicus
tatcgtagtactcctccatgaaagc

SEQ ID NO: 567109 - DNA, 25 bp, Rattus norvegicus
tatcgtagtactgctccatgaaagc

SEQ ID NO: 567110 - DNA, 25 bp, Rattus norvegicus
tatcgtcaccagaaataaacacact

SEQ ID NO: 567111 - DNA, 25 bp, Rattus norvegicus
tatcgtcaccagtaataaacacact

SEQ ID NO: 567112 - DNA, 25 bp, Rattus norvegicus
tatcgtcacgatcatagttcactgg

SEQ ID NO: 567113 - DNA, 25 bp, Rattus norvegicus
tatcgtcacgatgatagttcactgg

SEQ ID NO: 567114 - DNA, 25 bp, Rattus norvegicus
tatcgtcctgacctgccattaagtt

SEQ ID NO: 567115 - DNA, 25 bp, Rattus norvegicus
tatcgtcctgacgtgccattaagtt

SEQ ID NO: 567116 - DNA, 25 bp, Rattus norvegicus
tatcgtccttttccttttcctatgt

SEQ ID NO: 567117 - DNA, 25 bp, Rattus norvegicus
tatcgtccttttgcttttcctatgt

SEQ ID NO: 567118 - DNA, 25 bp, Rattus norvegicus
tatcgtcggcaacagtgcccaggag

SEQ ID NO: 567119 - DNA, 25 bp, Rattus norvegicus
tatcgtcggcaagagtgcccaggag

SEQ ID NO: 567120 - DNA, 25 bp, Rattus norvegicus
tatcgtctaggtactgtgaccactg

SEQ ID NO: 567121 - DNA, 25 bp, Rattus norvegicus
tatcgtctaggttctgtgaccactg

SEQ ID NO: 567122 - DNA, 25 bp, Rattus norvegicus
tatcgtgccacactaatttctatag

SEQ ID NO: 567123 - DNA, 25 bp, Rattus norvegicus
tatcgtgccacagtaatttctatag

SEQ ID NO: 567124 - DNA, 25 bp, Rattus norvegicus
tatcgtgcctcacttacggttactg

SEQ ID NO: 567125 - DNA, 25 bp, Rattus norvegicus
tatcgtgcctcagttacggttactg

SEQ ID NO: 567126 - DNA, 25 bp, Rattus norvegicus
tatcgtgctggtcgttggcaagttt

SEQ ID NO: 567127 - DNA, 25 bp, Rattus norvegicus
tatcgtgctggtggttggcaagttt

SEQ ID NO: 567128 - DNA, 25 bp, Rattus norvegicus
tatcgtggaccccaaggtgatcgtg

SEQ ID NO: 567129 - DNA, 25 bp, Rattus norvegicus
tatcgtggacccgaaggtgatcgtg

SEQ ID NO: 567130 - DNA, 25 bp, Rattus norvegicus
tatcgtggccttctacgtccgaatc

SEQ ID NO: 567131 - DNA, 25 bp, Rattus norvegicus
tatcgtggccttgtacgtccgaatc

SEQ ID NO: 567132 - DNA, 25 bp, Rattus norvegicus
tatcgtggtcgtaggaggctgtcct

SEQ ID NO: 567133 - DNA, 25 bp, Rattus norvegicus
tatcgtggtcgttggaggctgtcct

SEQ ID NO: 567134 - DNA, 25 bp, Rattus norvegicus
tatcgtgtatgcatcattgtgattt

SEQ ID NO: 567135 - DNA, 25 bp, Rattus norvegicus
tatcgtgtatgcttcattgtgattt

SEQ ID NO: 567136 - DNA, 25 bp, Rattus norvegicus
tatcgtgtgagtatattgtgctggc

SEQ ID NO: 567137 - DNA, 25 bp, Rattus norvegicus
tatcgtgtgagtttattgtgctggc

SEQ ID NO: 567138 - DNA, 25 bp, Rattus norvegicus
tatcgtgtgccacctcaacatggaa

SEQ ID NO: 567139 - DNA, 25 bp, Rattus norvegicus
tatcgtgtgccagctcaacatggaa

SEQ ID NO: 567140 - DNA, 25 bp, Rattus norvegicus
tatcgtgtgctgagcggttttcaca

SEQ ID NO: 567141 - DNA, 25 bp, Rattus norvegicus
tatcgtgtgctgtgcggttttcaca

SEQ ID NO: 567142 - DNA, 25 bp, Rattus norvegicus
tatcgttaaagactcagggagtcct

SEQ ID NO: 567143 - DNA, 25 bp, Rattus norvegicus
tatcgttaaagagtcagggagtcct

SEQ ID NO: 567144 - DNA, 25 bp, Rattus norvegicus
tatcgttactttcatttctgcgggt

SEQ ID NO: 567145 - DNA, 25 bp, Rattus norvegicus
tatcgttactttgatttctgcgggt

SEQ ID NO: 567146 - DNA, 25 bp, Rattus norvegicus
tatcgttgcccaatctatctcttat

SEQ ID NO: 567147 - DNA, 25 bp, Rattus norvegicus
tatcgttgcccattctatctcttat

SEQ ID NO: 567148 - DNA, 25 bp, Rattus norvegicus
tatcgtttccaccagatggcagact

SEQ ID NO: 567149 - DNA, 25 bp, Rattus norvegicus
tatcgtttccacgagatggcagact

SEQ ID NO: 567150 - DNA, 25 bp, Rattus norvegicus
tatcgttttgtaagtgcgtgttctc

SEQ ID NO: 567151 - DNA, 25 bp, Rattus norvegicus
tatcgttttgtactcaatctgggct

SEQ ID NO: 567152 - DNA, 25 bp, Rattus norvegicus
tatcgttttgtagtcaatctgggct

SEQ ID NO: 567153 - DNA, 25 bp, Rattus norvegicus
tatcgttttgtatgtgcgtgttctc

SEQ ID NO: 567154 - DNA, 25 bp, Rattus norvegicus
tatcgtttttagaagtgtggcccag

SEQ ID NO: 567155 - DNA, 25 bp, Rattus norvegicus
tatcgtttttagtagtgtggcccag

SEQ ID NO: 567156 - DNA, 25 bp, Rattus norvegicus
tatctaaacaaactcaacgcacggg

SEQ ID NO: 567157 - DNA, 25 bp, Rattus norvegicus
tatctaaacaaagtcaacgcacggg

SEQ ID NO: 567158 - DNA, 25 bp, Rattus norvegicus
tatctaacctgtaccatgccatgga

SEQ ID NO: 567159 - DNA, 25 bp, Rattus norvegicus
tatctaacctgttccatgccatgga

SEQ ID NO: 567160 - DNA, 25 bp, Rattus norvegicus
tatctaactactctttttctcttcc

SEQ ID NO: 567161 - DNA, 25 bp, Rattus norvegicus
tatctaactactgtttttctcttcc

SEQ ID NO: 567162 - DNA, 25 bp, Rattus norvegicus
tatctaatcaatctcttcagtcctg

SEQ ID NO: 567163 - DNA, 25 bp, Rattus norvegicus
tatctaatcaatgtcttcagtcctg

SEQ ID NO: 567164 - DNA, 25 bp, Rattus norvegicus
tatctacaatcccaggccttactac

SEQ ID NO: 567165 - DNA, 25 bp, Rattus norvegicus
tatctacaatccgaggccttactac

SEQ ID NO: 567166 - DNA, 25 bp, Rattus norvegicus
tatctacaatgtcgcggtcctgtgt

SEQ ID NO: 567167 - DNA, 25 bp, Rattus norvegicus
tatctacaatgtggcggtcctgtgt

SEQ ID NO: 567168 - DNA, 25 bp, Rattus norvegicus
tatctaccacgcatgactaatgtca

SEQ ID NO: 567169 - DNA, 25 bp, Rattus norvegicus
tatctaccacgcttgactaatgtca

SEQ ID NO: 567170 - DNA, 25 bp, Rattus norvegicus
tatctaccagtacgtgtggctgacc

SEQ ID NO: 567171 - DNA, 25 bp, Rattus norvegicus
tatctaccagtaggtgtggctgacc

SEQ ID NO: 567172 - DNA, 25 bp, Rattus norvegicus
tatctaccgagaagtttgtcaaaat

SEQ ID NO: 567173 - DNA, 25 bp, Rattus norvegicus
tatctaccgagatgtttgtcaaaat

SEQ ID NO: 567174 - DNA, 25 bp, Rattus norvegicus
tatctacctgccaattgcactgtaa

SEQ ID NO: 567175 - DNA, 25 bp, Rattus norvegicus
tatctacctgcctattgcactgtaa

SEQ ID NO: 567176 - DNA, 25 bp, Rattus norvegicus
tatctactgcaaaaatacatgtctg

SEQ ID NO: 567177 - DNA, 25 bp, Rattus norvegicus
tatctactgcaataatacatgtctg

SEQ ID NO: 567178 - DNA, 25 bp, Rattus norvegicus
tatctactgctaccactctctcatt

SEQ ID NO: 567179 - DNA, 25 bp, Rattus norvegicus
tatctactgctagcactctctcatt

SEQ ID NO: 567180 - DNA, 25 bp, Rattus norvegicus
tatctactggtcagtggccttctac

SEQ ID NO: 567181 - DNA, 25 bp, Rattus norvegicus
tatctactggtctgtggccttctac

SEQ ID NO: 567182 - DNA, 25 bp, Rattus norvegicus
tatctacttctgactcatgtcatga

SEQ ID NO: 567183 - DNA, 25 bp, Rattus norvegicus
tatctacttctgtctcatgtcatga

SEQ ID NO: 567184 - DNA, 25 bp, Rattus norvegicus
tatctacttgtgctccactgcagga

SEQ ID NO: 567185 - DNA, 25 bp, Rattus norvegicus
tatctacttgtggtccactgcagga

SEQ ID NO: 567186 - DNA, 25 bp, Rattus norvegicus
tatctagaaaccacgatcctctcag

SEQ ID NO: 567187 - DNA, 25 bp, Rattus norvegicus
tatctagaaacctcgatcctctcag

SEQ ID NO: 567188 - DNA, 25 bp, Rattus norvegicus
tatctagaagtcctcaggcaaccaa

SEQ ID NO: 567189 - DNA, 25 bp, Rattus norvegicus
tatctagaagtcgtcaggcaaccaa

SEQ ID NO: 567190 - DNA, 25 bp, Rattus norvegicus
tatctagaccacagctgcctggaga

SEQ ID NO: 567191 - DNA, 25 bp, Rattus norvegicus
tatctagaccactgctgcctggaga

SEQ ID NO: 567192 - DNA, 25 bp, Rattus norvegicus
tatctagccctaaatatcactcact

SEQ ID NO: 567193 - DNA, 25 bp, Rattus norvegicus
tatctagccctatatatcactcact

SEQ ID NO: 567194 - DNA, 25 bp, Rattus norvegicus
tatctaggagctacccatcagggaa

SEQ ID NO: 567195 - DNA, 25 bp, Rattus norvegicus
tatctaggagcttcccatcagggaa

SEQ ID NO: 567196 - DNA, 25 bp, Rattus norvegicus
tatctagtagacacatcgctgccag

SEQ ID NO: 567197 - DNA, 25 bp, Rattus norvegicus
tatctagtagactcatcgctgccag

SEQ ID NO: 567198 - DNA, 25 bp, Rattus norvegicus
tatctagtcctgagttcttgttgtc

SEQ ID NO: 567199 - DNA, 25 bp, Rattus norvegicus
tatctagtcctgtgttcttgttgtc

SEQ ID NO: 567200 - DNA, 25 bp, Rattus norvegicus
tatctataccatcttagcattcttg

SEQ ID NO: 567201 - DNA, 25 bp, Rattus norvegicus
tatctataccatgttagcattcttg

SEQ ID NO: 567202 - DNA, 25 bp, Rattus norvegicus
tatctatatggtatctggttactca

SEQ ID NO: 567203 - DNA, 25 bp, Rattus norvegicus
tatctatatggtttctggttactca

SEQ ID NO: 567204 - DNA, 25 bp, Rattus norvegicus
tatctatcatctacccctggttcct

SEQ ID NO: 567205 - DNA, 25 bp, Rattus norvegicus
tatctatcatcttcccctggttcct

SEQ ID NO: 567206 - DNA, 25 bp, Rattus norvegicus
tatctatcccagcacttcattgaag

SEQ ID NO: 567207 - DNA, 25 bp, Rattus norvegicus
tatctatcccaggacttcattgaag

SEQ ID NO: 567208 - DNA, 25 bp, Rattus norvegicus
tatctatctactatcctatctatcg

SEQ ID NO: 567209 - DNA, 25 bp, Rattus norvegicus
tatctatctactttcctatctatcg

SEQ ID NO: 567210 - DNA, 25 bp, Rattus norvegicus
tatctatctcccacagcggatatgt

SEQ ID NO: 567211 - DNA, 25 bp, Rattus norvegicus
tatctatctccctcagcggatatgt

SEQ ID NO: 567212 - DNA, 25 bp, Rattus norvegicus
tatctatgcggtctcatggactaga

SEQ ID NO: 567213 - DNA, 25 bp, Rattus norvegicus
tatctatgcggtgtcatggactaga

SEQ ID NO: 567214 - DNA, 25 bp, Rattus norvegicus
tatctatgggcaccggaactacttc

SEQ ID NO: 567215 - DNA, 25 bp, Rattus norvegicus
tatctatgggcagcggaactacttc

SEQ ID NO: 567216 - DNA, 25 bp, Rattus norvegicus
tatctatgggttacgcctcaaagac

SEQ ID NO: 567217 - DNA, 25 bp, Rattus norvegicus
tatctatgggtttcgcctcaaagac

SEQ ID NO: 567218 - DNA, 25 bp, Rattus norvegicus
tatctatgtcatagtactctcacta

SEQ ID NO: 567219 - DNA, 25 bp, Rattus norvegicus
tatctatgtcattgtactctcacta

SEQ ID NO: 567220 - DNA, 25 bp, Rattus norvegicus
tatctattaagaaggctgaccacca

SEQ ID NO: 567221 - DNA, 25 bp, Rattus norvegicus
tatctattaagatggctgaccacca

SEQ ID NO: 567222 - DNA, 25 bp, Rattus norvegicus
tatctattccagcactatgctcctg

SEQ ID NO: 567223 - DNA, 25 bp, Rattus norvegicus
tatctattccaggactatgctcctg

SEQ ID NO: 567224 - DNA, 25 bp, Rattus norvegicus
tatctattcctcaaccatggtgtgg

SEQ ID NO: 567225 - DNA, 25 bp, Rattus norvegicus
tatctattcctctaccatggtgtgg

SEQ ID NO: 567226 - DNA, 25 bp, Rattus norvegicus
tatctattgtcaccctgtagaacag

SEQ ID NO: 567227 - DNA, 25 bp, Rattus norvegicus
tatctattgtcagcctgtagaacag

SEQ ID NO: 567228 - DNA, 25 bp, Rattus norvegicus
tatctcaaagaacactactggcccc

SEQ ID NO: 567229 - DNA, 25 bp, Rattus norvegicus
tatctcaaagaagactactggcccc

SEQ ID NO: 567230 - DNA, 25 bp, Rattus norvegicus
tatctcaaccttaagccgactttaa

SEQ ID NO: 567231 - DNA, 25 bp, Rattus norvegicus
tatctcaacctttagccgactttaa

SEQ ID NO: 567232 - DNA, 25 bp, Rattus norvegicus
tatctcaacggcctcggcaattgtt

SEQ ID NO: 567233 - DNA, 25 bp, Rattus norvegicus
tatctcaacggcgtcggcaattgtt

SEQ ID NO: 567234 - DNA, 25 bp, Rattus norvegicus
tatctcaagtgccaatgaatacaga

SEQ ID NO: 567235 - DNA, 25 bp, Rattus norvegicus
tatctcaagtgcgaatgaatacaga

SEQ ID NO: 567236 - DNA, 25 bp, Rattus norvegicus
tatctcacatttccggctagtctgg

SEQ ID NO: 567237 - DNA, 25 bp, Rattus norvegicus
tatctcacatttgcggctagtctgg

SEQ ID NO: 567238 - DNA, 25 bp, Rattus norvegicus
tatctcaccaacatgatccaaagaa

SEQ ID NO: 567239 - DNA, 25 bp, Rattus norvegicus
tatctcaccaacttgatccaaagaa

SEQ ID NO: 567240 - DNA, 25 bp, Rattus norvegicus
tatctcactactaccttgcttgttg

SEQ ID NO: 567241 - DNA, 25 bp, Rattus norvegicus
tatctcactacttccttgcttgttg

SEQ ID NO: 567242 - DNA, 25 bp, Rattus norvegicus
tatctcagagagaaatttttattta

SEQ ID NO: 567243 - DNA, 25 bp, Rattus norvegicus
tatctcagagagtaatttttattta

SEQ ID NO: 567244 - DNA, 25 bp, Rattus norvegicus
tatctcaggctcaggcacctttaga

SEQ ID NO: 567245 - DNA, 25 bp, Rattus norvegicus
tatctcaggctctggcacctttaga

SEQ ID NO: 567246 - DNA, 25 bp, Rattus norvegicus
tatctcatcctccaaaccaaagtgt

SEQ ID NO: 567247 - DNA, 25 bp, Rattus norvegicus
tatctcatcctcgaaaccaaagtgt

SEQ ID NO: 567248 - DNA, 25 bp, Rattus norvegicus
tatctcatgatgcaactggaccagg

SEQ ID NO: 567249 - DNA, 25 bp, Rattus norvegicus
tatctcatgatggaactggaccagg

SEQ ID NO: 567250 - DNA, 25 bp, Rattus norvegicus
tatctcatggctatgtgtccctcct

SEQ ID NO: 567251 - DNA, 25 bp, Rattus norvegicus
tatctcatggctttgtgtccctcct

SEQ ID NO: 567252 - DNA, 25 bp, Rattus norvegicus
tatctcatgttacctgtaccagtca

SEQ ID NO: 567253 - DNA, 25 bp, Rattus norvegicus
tatctcatgttagctgtaccagtca

SEQ ID NO: 567254 - DNA, 25 bp, Rattus norvegicus
tatctcattcctacaatttttattg

SEQ ID NO: 567255 - DNA, 25 bp, Rattus norvegicus
tatctcattccttcaatttttattg

SEQ ID NO: 567256 - DNA, 25 bp, Rattus norvegicus
tatctcattcttccaagtagctttt

SEQ ID NO: 567257 - DNA, 25 bp, Rattus norvegicus
tatctcattcttgcaagtagctttt

SEQ ID NO: 567258 - DNA, 25 bp, Rattus norvegicus
tatctcatttgtatcctggcttttc

SEQ ID NO: 567259 - DNA, 25 bp, Rattus norvegicus
tatctcatttgtttcctggcttttc

SEQ ID NO: 567260 - DNA, 25 bp, Rattus norvegicus
tatctccaacgcagggtcttcagga

SEQ ID NO: 567261 - DNA, 25 bp, Rattus norvegicus
tatctccaacgctgggtcttcagga

SEQ ID NO: 567262 - DNA, 25 bp, Rattus norvegicus
tatctccagaacatttgtgccgggt

SEQ ID NO: 567263 - DNA, 25 bp, Rattus norvegicus
tatctccagaacttttgtgccgggt

SEQ ID NO: 567264 - DNA, 25 bp, Rattus norvegicus
tatctccagagccaatagcagtgtt

SEQ ID NO: 567265 - DNA, 25 bp, Rattus norvegicus
tatctccagagcgaatagcagtgtt

SEQ ID NO: 567266 - DNA, 25 bp, Rattus norvegicus
tatctccagatcatgaggcctaaca

SEQ ID NO: 567267 - DNA, 25 bp, Rattus norvegicus
tatctccagatcttgaggcctaaca

SEQ ID NO: 567268 - DNA, 25 bp, Rattus norvegicus
tatctccagcctctacttacaaggg

SEQ ID NO: 567269 - DNA, 25 bp, Rattus norvegicus
tatctccagcctgtacttacaaggg

SEQ ID NO: 567270 - DNA, 25 bp, Rattus norvegicus
tatctccaggtaattgctagtgttt

SEQ ID NO: 567271 - DNA, 25 bp, Rattus norvegicus
tatctccaggtatttgctagtgttt

SEQ ID NO: 567272 - DNA, 25 bp, Rattus norvegicus
tatctccatgttacaaaacacagtt

SEQ ID NO: 567273 - DNA, 25 bp, Rattus norvegicus
tatctccatgtttcaaaacacagtt

SEQ ID NO: 567274 - DNA, 25 bp, Rattus norvegicus
tatctccattctacagagaggtcag

SEQ ID NO: 567275 - DNA, 25 bp, Rattus norvegicus
tatctccattcttcagagaggtcag

SEQ ID NO: 567276 - DNA, 25 bp, Rattus norvegicus
tatctccatttgacagacaaccttg

SEQ ID NO: 567277 - DNA, 25 bp, Rattus norvegicus
tatctccatttgtcagacaaccttg

SEQ ID NO: 567278 - DNA, 25 bp, Rattus norvegicus
tatctcccctagattatgacgtatg

SEQ ID NO: 567279 - DNA, 25 bp, Rattus norvegicus
tatctcccctagtttatgacgtatg

SEQ ID NO: 567280 - DNA, 25 bp, Rattus norvegicus
tatctcccggccattggttcactgt

SEQ ID NO: 567281 - DNA, 25 bp, Rattus norvegicus
tatctcccggcctttggttcactgt

SEQ ID NO: 567282 - DNA, 25 bp, Rattus norvegicus
tatctcccgtccattgtttgcaggg

SEQ ID NO: 567283 - DNA, 25 bp, Rattus norvegicus
tatctcccgtcctttgtttgcaggg

SEQ ID NO: 567284 - DNA, 25 bp, Rattus norvegicus
tatctcccttctctgtctttaagaa

SEQ ID NO: 567285 - DNA, 25 bp, Rattus norvegicus
tatctcccttctgtgtctttaagaa

SEQ ID NO: 567286 - DNA, 25 bp, Rattus norvegicus
tatctccggcaacagacgagacaga

SEQ ID NO: 567287 - DNA, 25 bp, Rattus norvegicus
tatctccggcaagagacgagacaga

SEQ ID NO: 567288 - DNA, 25 bp, Rattus norvegicus
tatctccgtcccagagcttctctga

SEQ ID NO: 567289 - DNA, 25 bp, Rattus norvegicus
tatctccgtccctgagcttctctga

SEQ ID NO: 567290 - DNA, 25 bp, Rattus norvegicus
tatctccgtgttactcatagttcta

SEQ ID NO: 567291 - DNA, 25 bp, Rattus norvegicus
tatctccgtgtttctcatagttcta

SEQ ID NO: 567292 - DNA, 25 bp, Rattus norvegicus
tatctcctaacccaaactgtaaccg

SEQ ID NO: 567293 - DNA, 25 bp, Rattus norvegicus
tatctcctaaccgaaactgtaaccg

SEQ ID NO: 567294 - DNA, 25 bp, Rattus norvegicus
tatctcctactccaaaacttccatt

SEQ ID NO: 567295 - DNA, 25 bp, Rattus norvegicus
tatctcctactcgaaaacttccatt

SEQ ID NO: 567296 - DNA, 25 bp, Rattus norvegicus
tatctcctaggccagacaactcata

SEQ ID NO: 567297 - DNA, 25 bp, Rattus norvegicus
tatctcctaggcgagacaactcata

SEQ ID NO: 567298 - DNA, 25 bp, Rattus norvegicus
tatctcctccctatacactcatttc

SEQ ID NO: 567299 - DNA, 25 bp, Rattus norvegicus
tatctcctccctttacactcatttc

SEQ ID NO: 567300 - DNA, 25 bp, Rattus norvegicus
tatctcctctaaccccaaagacatg

SEQ ID NO: 567301 - DNA, 25 bp, Rattus norvegicus
tatctcctctaagcccaaagacatg

SEQ ID NO: 567302 - DNA, 25 bp, Rattus norvegicus
tatctcctgatgctattcacataga

SEQ ID NO: 567303 - DNA, 25 bp, Rattus norvegicus
tatctcctgatggtattcacataga

SEQ ID NO: 567304 - DNA, 25 bp, Rattus norvegicus
tatctcctgctgaaatggcagtggc

SEQ ID NO: 567305 - DNA, 25 bp, Rattus norvegicus
tatctcctgctgtaatggcagtggc

SEQ ID NO: 567306 - DNA, 25 bp, Rattus norvegicus
tatctccttctgactgtgtactgtt

SEQ ID NO: 567307 - DNA, 25 bp, Rattus norvegicus
tatctccttctgtctgtgtactgtt

SEQ ID NO: 567308 - DNA, 25 bp, Rattus norvegicus
tatctcctttatcagagccgggtct

SEQ ID NO: 567309 - DNA, 25 bp, Rattus norvegicus
tatctcctttatgagagccgggtct

SEQ ID NO: 567310 - DNA, 25 bp, Rattus norvegicus
tatctcgctctactgctcataaaaa

SEQ ID NO: 567311 - DNA, 25 bp, Rattus norvegicus
tatctcgctctagtgctcataaaaa

SEQ ID NO: 567312 - DNA, 25 bp, Rattus norvegicus
tatctcggacttatcctttcctaga

SEQ ID NO: 567313 - DNA, 25 bp, Rattus norvegicus
tatctcggacttttcctttcctaga

SEQ ID NO: 567314 - DNA, 25 bp, Rattus norvegicus
tatctcgggaggacagctttgctgt

SEQ ID NO: 567315 - DNA, 25 bp, Rattus norvegicus
tatctcgggaggtcagctttgctgt

SEQ ID NO: 567316 - DNA, 25 bp, Rattus norvegicus
tatctcgtgttcctgtgtttctgtt

SEQ ID NO: 567317 - DNA, 25 bp, Rattus norvegicus
tatctcgtgttcgtgtgtttctgtt

SEQ ID NO: 567318 - DNA, 25 bp, Rattus norvegicus
tatctctaccttactgtgagcccaa

SEQ ID NO: 567319 - DNA, 25 bp, Rattus norvegicus
tatctctacctttctgtgagcccaa

SEQ ID NO: 567320 - DNA, 25 bp, Rattus norvegicus
tatctctactttcttttttctctca

SEQ ID NO: 567321 - DNA, 25 bp, Rattus norvegicus
tatctctactttgttttttctctca

SEQ ID NO: 567322 - DNA, 25 bp, Rattus norvegicus
tatctctagcccaacaagtgtgtgc

SEQ ID NO: 567323 - DNA, 25 bp, Rattus norvegicus
tatctctagccctacaagtgtgtgc

SEQ ID NO: 567324 - DNA, 25 bp, Rattus norvegicus
tatctctaggatcttctgtgttttc

SEQ ID NO: 567325 - DNA, 25 bp, Rattus norvegicus
tatctctaggatgttctgtgttttc

SEQ ID NO: 567326 - DNA, 25 bp, Rattus norvegicus
tatctctatgataggccagtttggt

SEQ ID NO: 567327 - DNA, 25 bp, Rattus norvegicus
tatctctatgattggccagtttggt

SEQ ID NO: 567328 - DNA, 25 bp, Rattus norvegicus
tatctctcaacactggcaatacata

SEQ ID NO: 567329 - DNA, 25 bp, Rattus norvegicus
tatctctcaacagtggcaatacata

SEQ ID NO: 567330 - DNA, 25 bp, Rattus norvegicus
tatctctcactgacaaggtcatcga

SEQ ID NO: 567331 - DNA, 25 bp, Rattus norvegicus
tatctctcactgtcaaggtcatcga

SEQ ID NO: 567332 - DNA, 25 bp, Rattus norvegicus
tatctctccaggataggttttaaag

SEQ ID NO: 567333 - DNA, 25 bp, Rattus norvegicus
tatctctccaggttaggttttaaag

SEQ ID NO: 567334 - DNA, 25 bp, Rattus norvegicus
tatctctccgttcagagacaccaat

SEQ ID NO: 567335 - DNA, 25 bp, Rattus norvegicus
tatctctccgttgagagacaccaat

SEQ ID NO: 567336 - DNA, 25 bp, Rattus norvegicus
tatctctcctggaccatgtcaatga

SEQ ID NO: 567337 - DNA, 25 bp, Rattus norvegicus
tatctctcctggtccatgtcaatga

SEQ ID NO: 567338 - DNA, 25 bp, Rattus norvegicus
tatctctcgcctacgagacagtgag

SEQ ID NO: 567339 - DNA, 25 bp, Rattus norvegicus
tatctctcgccttcgagacagtgag

SEQ ID NO: 567340 - DNA, 25 bp, Rattus norvegicus
tatctctctataaatttgacccagg

SEQ ID NO: 567341 - DNA, 25 bp, Rattus norvegicus
tatctctctatatatttgacccagg

SEQ ID NO: 567342 - DNA, 25 bp, Rattus norvegicus
tatctctctcacagagtgcatcagg

SEQ ID NO: 567343 - DNA, 25 bp, Rattus norvegicus
tatctctctcactgagtgcatcagg

SEQ ID NO: 567344 - DNA, 25 bp, Rattus norvegicus
tatctctctctactagaccatatag

SEQ ID NO: 567345 - DNA, 25 bp, Rattus norvegicus
tatctctctctagtagaccatatag

SEQ ID NO: 567346 - DNA, 25 bp, Rattus norvegicus
tatctctggatgctttataggccct

SEQ ID NO: 567347 - DNA, 25 bp, Rattus norvegicus
tatctctggatggtttataggccct

SEQ ID NO: 567348 - DNA, 25 bp, Rattus norvegicus
tatctctgtcttcccaatgcataat

SEQ ID NO: 567349 - DNA, 25 bp, Rattus norvegicus
tatctctgtcttgccaatgcataat

SEQ ID NO: 567350 - DNA, 25 bp, Rattus norvegicus
tatctctgtgcccatgggtgtacat

SEQ ID NO: 567351 - DNA, 25 bp, Rattus norvegicus
tatctctgtgccgatgggtgtacat

SEQ ID NO: 567352 - DNA, 25 bp, Rattus norvegicus
tatctctgtgtcactcctggaaaac

SEQ ID NO: 567353 - DNA, 25 bp, Rattus norvegicus
tatctctgtgtctctcctggaaaac

SEQ ID NO: 567354 - DNA, 25 bp, Rattus norvegicus
tatctcttatttctctgcttcatct

SEQ ID NO: 567355 - DNA, 25 bp, Rattus norvegicus
tatctcttatttgtctgcttcatct

SEQ ID NO: 567356 - DNA, 25 bp, Rattus norvegicus
tatctcttccttcgttcttcttcaa

SEQ ID NO: 567357 - DNA, 25 bp, Rattus norvegicus
tatctcttccttggttcttcttcaa

SEQ ID NO: 567358 - DNA, 25 bp, Rattus norvegicus
tatctcttgacccaaaatgctcagg

SEQ ID NO: 567359 - DNA, 25 bp, Rattus norvegicus
tatctcttgaccgaaaatgctcagg

SEQ ID NO: 567360 - DNA, 25 bp, Rattus norvegicus
tatctcttggtgctctgtggacaca

SEQ ID NO: 567361 - DNA, 25 bp, Rattus norvegicus
tatctcttggtggtctgtggacaca

SEQ ID NO: 567362 - DNA, 25 bp, Rattus norvegicus
tatctctttcatccacttgctgagc

SEQ ID NO: 567363 - DNA, 25 bp, Rattus norvegicus
tatctctttcatgcacttgctgagc

SEQ ID NO: 567364 - DNA, 25 bp, Rattus norvegicus
tatctctttcctaactggtgtgggc

SEQ ID NO: 567365 - DNA, 25 bp, Rattus norvegicus
tatctctttccttactggtgtgggc

SEQ ID NO: 567366 - DNA, 25 bp, Rattus norvegicus
tatctctttttaattgtgcatgccc

SEQ ID NO: 567367 - DNA, 25 bp, Rattus norvegicus
tatctctttttatttgtgcatgccc

SEQ ID NO: 567368 - DNA, 25 bp, Rattus norvegicus
tatctgaagatgatcagcaccggct

SEQ ID NO: 567369 - DNA, 25 bp, Rattus norvegicus
tatctgaagatgttcagcaccggct

SEQ ID NO: 567370 - DNA, 25 bp, Rattus norvegicus
tatctgaagcaaccgtcttcgacgc

SEQ ID NO: 567371 - DNA, 25 bp, Rattus norvegicus
tatctgaagcaagcgtcttcgacgc

SEQ ID NO: 567372 - DNA, 25 bp, Rattus norvegicus
tatctgacagccagttctctgtact

SEQ ID NO: 567373 - DNA, 25 bp, Rattus norvegicus
tatctgacagcctgttctctgtact

SEQ ID NO: 567374 - DNA, 25 bp, Rattus norvegicus
tatctgacaggtactaaaatgccat

SEQ ID NO: 567375 - DNA, 25 bp, Rattus norvegicus
tatctgacaggttctaaaatgccat

SEQ ID NO: 567376 - DNA, 25 bp, Rattus norvegicus
tatctgacagtcacacatctcaaca

SEQ ID NO: 567377 - DNA, 25 bp, Rattus norvegicus
tatctgacagtctcacatctcaaca

SEQ ID NO: 567378 - DNA, 25 bp, Rattus norvegicus
tatctgacatgcaattacaccctcc

SEQ ID NO: 567379 - DNA, 25 bp, Rattus norvegicus
tatctgacatgctattacaccctcc

SEQ ID NO: 567380 - DNA, 25 bp, Rattus norvegicus
tatctgaccaacatgttactgcttc

SEQ ID NO: 567381 - DNA, 25 bp, Rattus norvegicus
tatctgaccaacttgttactgcttc

SEQ ID NO: 567382 - DNA, 25 bp, Rattus norvegicus
tatctgacgttaagatacccaatgt

SEQ ID NO: 567383 - DNA, 25 bp, Rattus norvegicus
tatctgacgttatgatacccaatgt

SEQ ID NO: 567384 - DNA, 25 bp, Rattus norvegicus
tatctgagacatacctgcttgtcgt

SEQ ID NO: 567385 - DNA, 25 bp, Rattus norvegicus
tatctgagacattcctgcttgtcgt

SEQ ID NO: 567386 - DNA, 25 bp, Rattus norvegicus
tatctgagcctcacatctacaggga

SEQ ID NO: 567387 - DNA, 25 bp, Rattus norvegicus
tatctgagcctctcatctacaggga

SEQ ID NO: 567388 - DNA, 25 bp, Rattus norvegicus
tatctgagctttaaattcaccagtg

SEQ ID NO: 567389 - DNA, 25 bp, Rattus norvegicus
tatctgagcttttaattcaccagtg

SEQ ID NO: 567390 - DNA, 25 bp, Rattus norvegicus
tatctgaggactattgctatgacaa

SEQ ID NO: 567391 - DNA, 25 bp, Rattus norvegicus
tatctgaggacttttgctatgacaa

SEQ ID NO: 567392 - DNA, 25 bp, Rattus norvegicus
tatctgaggctgattcccagccagt

SEQ ID NO: 567393 - DNA, 25 bp, Rattus norvegicus
tatctgaggctgtttcccagccagt

SEQ ID NO: 567394 - DNA, 25 bp, Rattus norvegicus
tatctgaggtgtcagacggcctgct

SEQ ID NO: 567395 - DNA, 25 bp, Rattus norvegicus
tatctgaggtgtgagacggcctgct

SEQ ID NO: 567396 - DNA, 25 bp, Rattus norvegicus
tatctgagtgccattcccaggtaat

SEQ ID NO: 567397 - DNA, 25 bp, Rattus norvegicus
tatctgagtgcctttcccaggtaat

SEQ ID NO: 567398 - DNA, 25 bp, Rattus norvegicus
tatctgagttgcattgtttcttgga

SEQ ID NO: 567399 - DNA, 25 bp, Rattus norvegicus
tatctgagttgctttgtttcttgga

SEQ ID NO: 567400 - DNA, 25 bp, Rattus norvegicus
tatctgatacaccttacccctgata

SEQ ID NO: 567401 - DNA, 25 bp, Rattus norvegicus
tatctgatacacgttacccctgata

SEQ ID NO: 567402 - DNA, 25 bp, Rattus norvegicus
tatctgatatgcaggccatctgaga

SEQ ID NO: 567403 - DNA, 25 bp, Rattus norvegicus
tatctgatatgctggccatctgaga

SEQ ID NO: 567404 - DNA, 25 bp, Rattus norvegicus
tatctgatgcaacagacccagcctt

SEQ ID NO: 567405 - DNA, 25 bp, Rattus norvegicus
tatctgatgcaagagacccagcctt

SEQ ID NO: 567406 - DNA, 25 bp, Rattus norvegicus
tatctgatggatcccttaagctatg

SEQ ID NO: 567407 - DNA, 25 bp, Rattus norvegicus
tatctgatggatgccttaagctatg

SEQ ID NO: 567408 - DNA, 25 bp, Rattus norvegicus
tatctgatgtgaagcctgttgagtc

SEQ ID NO: 567409 - DNA, 25 bp, Rattus norvegicus
tatctgatgtgatgcctgttgagtc

SEQ ID NO: 567410 - DNA, 25 bp, Rattus norvegicus
tatctgattcagacccaaggtgcag

SEQ ID NO: 567411 - DNA, 25 bp, Rattus norvegicus
tatctgattcagtcccaaggtgcag

SEQ ID NO: 567412 - DNA, 25 bp, Rattus norvegicus
tatctgatttttcttccactgccct

SEQ ID NO: 567413 - DNA, 25 bp, Rattus norvegicus
tatctgatttttgttccactgccct

SEQ ID NO: 567414 - DNA, 25 bp, Rattus norvegicus
tatctgcaagcgcactcccaagagc

SEQ ID NO: 567415 - DNA, 25 bp, Rattus norvegicus
tatctgcaagcggactcccaagagc

SEQ ID NO: 567416 - DNA, 25 bp, Rattus norvegicus
tatctgcagggtatatgagcttctc

SEQ ID NO: 567417 - DNA, 25 bp, Rattus norvegicus
tatctgcagggtttatgagcttctc

SEQ ID NO: 567418 - DNA, 25 bp, Rattus norvegicus
tatctgccaagcctgtttctgaaag

SEQ ID NO: 567419 - DNA, 25 bp, Rattus norvegicus
tatctgccaagcgtgtttctgaaag

SEQ ID NO: 567420 - DNA, 25 bp, Rattus norvegicus
tatctgccacacagtcacagaactt

SEQ ID NO: 567421 - DNA, 25 bp, Rattus norvegicus
tatctgccacactgtcacagaactt

SEQ ID NO: 567422 - DNA, 25 bp, Rattus norvegicus
tatctgccagcgatctgcattgaaa

SEQ ID NO: 567423 - DNA, 25 bp, Rattus norvegicus
tatctgccagcgttctgcattgaaa

SEQ ID NO: 567424 - DNA, 25 bp, Rattus norvegicus
tatctgccagctacttcagctaaat

SEQ ID NO: 567425 - DNA, 25 bp, Rattus norvegicus
tatctgccagcttcttcagctaaat

SEQ ID NO: 567426 - DNA, 25 bp, Rattus norvegicus
tatctgcccattcctagagccttca

SEQ ID NO: 567427 - DNA, 25 bp, Rattus norvegicus
tatctgcccattgctagagccttca

SEQ ID NO: 567428 - DNA, 25 bp, Rattus norvegicus
tatctgcctatcattggaatctgta

SEQ ID NO: 567429 - DNA, 25 bp, Rattus norvegicus
tatctgcctatctttggaatctgta

SEQ ID NO: 567430 - DNA, 25 bp, Rattus norvegicus
tatctgcctggacatatgactgaag

SEQ ID NO: 567431 - DNA, 25 bp, Rattus norvegicus
tatctgcctggagatatgactgaag

SEQ ID NO: 567432 - DNA, 25 bp, Rattus norvegicus
tatctgcctttcaccgtatccagac

SEQ ID NO: 567433 - DNA, 25 bp, Rattus norvegicus
tatctgcctttctccgtatccagac

SEQ ID NO: 567434 - DNA, 25 bp, Rattus norvegicus
tatctgctcagcactgtgatctttt

SEQ ID NO: 567435 - DNA, 25 bp, Rattus norvegicus
tatctgctcagctctgtgatctttt

SEQ ID NO: 567436 - DNA, 25 bp, Rattus norvegicus
tatctgctcctcacacagtgttgag

SEQ ID NO: 567437 - DNA, 25 bp, Rattus norvegicus
tatctgctcctctcacagtgttgag

SEQ ID NO: 567438 - DNA, 25 bp, Rattus norvegicus
tatctgctgccacgactacatccgt

SEQ ID NO: 567439 - DNA, 25 bp, Rattus norvegicus
tatctgctgccaggactacatccgt

SEQ ID NO: 567440 - DNA, 25 bp, Rattus norvegicus
tatctgctgtttatggagtcagaca

SEQ ID NO: 567441 - DNA, 25 bp, Rattus norvegicus
tatctgctgtttttggagtcagaca

SEQ ID NO: 567442 - DNA, 25 bp, Rattus norvegicus
tatctggaaattctggcctgctacc

SEQ ID NO: 567443 - DNA, 25 bp, Rattus norvegicus
tatctggaaattgtggcctgctacc

SEQ ID NO: 567444 - DNA, 25 bp, Rattus norvegicus
tatctggacagtattacgggaacct

SEQ ID NO: 567445 - DNA, 25 bp, Rattus norvegicus
tatctggacagttttacgggaacct

SEQ ID NO: 567446 - DNA, 25 bp, Rattus norvegicus
tatctggacatgactttgctacaca

SEQ ID NO: 567447 - DNA, 25 bp, Rattus norvegicus
tatctggacatgtctttgctacaca

SEQ ID NO: 567448 - DNA, 25 bp, Rattus norvegicus
tatctggcactcagtgggtgcttaa

SEQ ID NO: 567449 - DNA, 25 bp, Rattus norvegicus
tatctggcactctgtgggtgcttaa

SEQ ID NO: 567450 - DNA, 25 bp, Rattus norvegicus
tatctggcagcaaacttggtgttga

SEQ ID NO: 567451 - DNA, 25 bp, Rattus norvegicus
tatctggcagcatacttggtgttga

SEQ ID NO: 567452 - DNA, 25 bp, Rattus norvegicus
tatctggcagctctcaagatccatg

SEQ ID NO: 567453 - DNA, 25 bp, Rattus norvegicus
tatctggcagctgtcaagatccatg

SEQ ID NO: 567454 - DNA, 25 bp, Rattus norvegicus
tatctggccacaacaagctgcagca

SEQ ID NO: 567455 - DNA, 25 bp, Rattus norvegicus
tatctggccacatcaagctgcagca

SEQ ID NO: 567456 - DNA, 25 bp, Rattus norvegicus
tatctggcccagaactacgacatgc

SEQ ID NO: 567457 - DNA, 25 bp, Rattus norvegicus
tatctggcccagtactacgacatgc

SEQ ID NO: 567458 - DNA, 25 bp, Rattus norvegicus
tatctggcctgacgaatacatttct

SEQ ID NO: 567459 - DNA, 25 bp, Rattus norvegicus
tatctggcctgaggaatacatttct

SEQ ID NO: 567460 - DNA, 25 bp, Rattus norvegicus
tatctggctacacaggtggctgctc

SEQ ID NO: 567461 - DNA, 25 bp, Rattus norvegicus
tatctggctacagaggtggctgctc

SEQ ID NO: 567462 - DNA, 25 bp, Rattus norvegicus
tatctggctatacttcttgcctgac

SEQ ID NO: 567463 - DNA, 25 bp, Rattus norvegicus
tatctggctatagttcttgcctgac

SEQ ID NO: 567464 - DNA, 25 bp, Rattus norvegicus
tatctggctcaaacctctggtcaag

SEQ ID NO: 567465 - DNA, 25 bp, Rattus norvegicus
tatctggctcaatcctctggtcaag

SEQ ID NO: 567466 - DNA, 25 bp, Rattus norvegicus
tatctggctcggaaccttggtttga

SEQ ID NO: 567467 - DNA, 25 bp, Rattus norvegicus
tatctggctcggtaccttggtttga

SEQ ID NO: 567468 - DNA, 25 bp, Rattus norvegicus
tatctgggaggacgctttttaccct

SEQ ID NO: 567469 - DNA, 25 bp, Rattus norvegicus
tatctgggaggaggctttttaccct

SEQ ID NO: 567470 - DNA, 25 bp, Rattus norvegicus
tatctgggattacctattgctccaa

SEQ ID NO: 567471 - DNA, 25 bp, Rattus norvegicus
tatctgggattagctattgctccaa

SEQ ID NO: 567472 - DNA, 25 bp, Rattus norvegicus
tatctgggctacaaaggaaactcaa

SEQ ID NO: 567473 - DNA, 25 bp, Rattus norvegicus
tatctgggctactaaggaaactcaa

SEQ ID NO: 567474 - DNA, 25 bp, Rattus norvegicus
tatctgggctttcggttcttagtcc

SEQ ID NO: 567475 - DNA, 25 bp, Rattus norvegicus
tatctgggctttgggttcttagtcc

SEQ ID NO: 567476 - DNA, 25 bp, Rattus norvegicus
tatctgggtagcataattctcccca

SEQ ID NO: 567477 - DNA, 25 bp, Rattus norvegicus
tatctgggtagcttaattctcccca

SEQ ID NO: 567478 - DNA, 25 bp, Rattus norvegicus
tatctggtcactcccggcactggaa

SEQ ID NO: 567479 - DNA, 25 bp, Rattus norvegicus
tatctggtcactgccggcactggaa

SEQ ID NO: 567480 - DNA, 25 bp, Rattus norvegicus
tatctggtcctgcagagtcttcact

SEQ ID NO: 567481 - DNA, 25 bp, Rattus norvegicus
tatctggtcctggagagtcttcact

SEQ ID NO: 567482 - DNA, 25 bp, Rattus norvegicus
tatctggtccttctttaatttgttt

SEQ ID NO: 567483 - DNA, 25 bp, Rattus norvegicus
tatctggtccttgtttaatttgttt

SEQ ID NO: 567484 - DNA, 25 bp, Rattus norvegicus
tatctggtctcacgttggattccct

SEQ ID NO: 567485 - DNA, 25 bp, Rattus norvegicus
tatctggtctcaggttggattccct

SEQ ID NO: 567486 - DNA, 25 bp, Rattus norvegicus
tatctggtgagaccaaacctgccca

SEQ ID NO: 567487 - DNA, 25 bp, Rattus norvegicus
tatctggtgagagcaaacctgccca

SEQ ID NO: 567488 - DNA, 25 bp, Rattus norvegicus
tatctgtaaacaccctgtccatcgg

SEQ ID NO: 567489 - DNA, 25 bp, Rattus norvegicus
tatctgtaaacagcctgtccatcgg

SEQ ID NO: 567490 - DNA, 25 bp, Rattus norvegicus
tatctgtacctaccaatatgatgag

SEQ ID NO: 567491 - DNA, 25 bp, Rattus norvegicus
tatctgtacctagcaatatgatgag

SEQ ID NO: 567492 - DNA, 25 bp, Rattus norvegicus
tatctgtataggactgccacgtctg

SEQ ID NO: 567493 - DNA, 25 bp, Rattus norvegicus
tatctgtataggtctgccacgtctg

SEQ ID NO: 567494 - DNA, 25 bp, Rattus norvegicus
tatctgtatctaacgctgtttgtgt

SEQ ID NO: 567495 - DNA, 25 bp, Rattus norvegicus
tatctgtatctatcgctgtttgtgt

SEQ ID NO: 567496 - DNA, 25 bp, Rattus norvegicus
tatctgtcacaccaataagccttct

SEQ ID NO: 567497 - DNA, 25 bp, Rattus norvegicus
tatctgtcacacgaataagccttct

SEQ ID NO: 567498 - DNA, 25 bp, Rattus norvegicus
tatctgtcacagaatcacctcttgt

SEQ ID NO: 567499 - DNA, 25 bp, Rattus norvegicus
tatctgtcacagtatcacctcttgt

SEQ ID NO: 567500 - DNA, 25 bp, Rattus norvegicus
tatctgtcacatacatagcccctta

SEQ ID NO: 567501 - DNA, 25 bp, Rattus norvegicus
tatctgtcacattcatagcccctta

SEQ ID NO: 567502 - DNA, 25 bp, Rattus norvegicus
tatctgtcacctatgctgcatgtca

SEQ ID NO: 567503 - DNA, 25 bp, Rattus norvegicus
tatctgtcacctttgctgcatgtca

SEQ ID NO: 567504 - DNA, 25 bp, Rattus norvegicus
tatctgtcccagagcagcaggcaag

SEQ ID NO: 567505 - DNA, 25 bp, Rattus norvegicus
tatctgtcccagtgcagcaggcaag

SEQ ID NO: 567506 - DNA, 25 bp, Rattus norvegicus
tatctgtcccatcccagttttgaaa

SEQ ID NO: 567507 - DNA, 25 bp, Rattus norvegicus
tatctgtcccatgccagttttgaaa

SEQ ID NO: 567508 - DNA, 25 bp, Rattus norvegicus
tatctgtcgatgctagtctccctaa

SEQ ID NO: 567509 - DNA, 25 bp, Rattus norvegicus
tatctgtcgatggtagtctccctaa

SEQ ID NO: 567510 - DNA, 25 bp, Rattus norvegicus
tatctgtctcttactttgtctgtct

SEQ ID NO: 567511 - DNA, 25 bp, Rattus norvegicus
tatctgtctctttctttgtctgtct

SEQ ID NO: 567512 - DNA, 25 bp, Rattus norvegicus
tatctgtgacagaacttatcccttg

SEQ ID NO: 567513 - DNA, 25 bp, Rattus norvegicus
tatctgtgacagtacttatcccttg

SEQ ID NO: 567514 - DNA, 25 bp, Rattus norvegicus
tatctgtgaccacgtggcatccgag

SEQ ID NO: 567515 - DNA, 25 bp, Rattus norvegicus
tatctgtgaccaggtggcatccgag

SEQ ID NO: 567516 - DNA, 25 bp, Rattus norvegicus
tatctgtgatagcacttcgttctga

SEQ ID NO: 567517 - DNA, 25 bp, Rattus norvegicus
tatctgtgataggacttcgttctga

SEQ ID NO: 567518 - DNA, 25 bp, Rattus norvegicus
tatctgtgcaagagaaccggtccaa

SEQ ID NO: 567519 - DNA, 25 bp, Rattus norvegicus
tatctgtgcaagtgaaccggtccaa

SEQ ID NO: 567520 - DNA, 25 bp, Rattus norvegicus
tatctgtggtgacatatcccagccc

SEQ ID NO: 567521 - DNA, 25 bp, Rattus norvegicus
tatctgtggtgagatatcccagccc

SEQ ID NO: 567522 - DNA, 25 bp, Rattus norvegicus
tatctgtgtcctatcatgagtgact

SEQ ID NO: 567523 - DNA, 25 bp, Rattus norvegicus
tatctgtgtcctttcatgagtgact

SEQ ID NO: 567524 - DNA, 25 bp, Rattus norvegicus
tatctgttcgggaatgatcgtcatt

SEQ ID NO: 567525 - DNA, 25 bp, Rattus norvegicus
tatctgttcgggtatgatcgtcatt

SEQ ID NO: 567526 - DNA, 25 bp, Rattus norvegicus
tatctgttgctgatacctcttgaaa

SEQ ID NO: 567527 - DNA, 25 bp, Rattus norvegicus
tatctgttgctgttacctcttgaaa

SEQ ID NO: 567528 - DNA, 25 bp, Rattus norvegicus
tatctgttgttcattcaggatgacc

SEQ ID NO: 567529 - DNA, 25 bp, Rattus norvegicus
tatctgttgttctttcaggatgacc

SEQ ID NO: 567530 - DNA, 25 bp, Rattus norvegicus
tatctgttgttgaatggcagcctct

SEQ ID NO: 567531 - DNA, 25 bp, Rattus norvegicus
tatctgttgttgtatggcagcctct

SEQ ID NO: 567532 - DNA, 25 bp, Rattus norvegicus
tatctgtttgccctgtaatgtgtag

SEQ ID NO: 567533 - DNA, 25 bp, Rattus norvegicus
tatctgtttgccgtgtaatgtgtag

SEQ ID NO: 567534 - DNA, 25 bp, Rattus norvegicus
tatctgtttgtacgaccactgtctg

SEQ ID NO: 567535 - DNA, 25 bp, Rattus norvegicus
tatctgtttgtaggaccactgtctg

SEQ ID NO: 567536 - DNA, 25 bp, Rattus norvegicus
tatcttaaacctcgcccctcaaggg

SEQ ID NO: 567537 - DNA, 25 bp, Rattus norvegicus
tatcttaaacctggcccctcaaggg

SEQ ID NO: 567538 - DNA, 25 bp, Rattus norvegicus
tatcttaaatatagggaactacttg

SEQ ID NO: 567539 - DNA, 25 bp, Rattus norvegicus
tatcttaaatattgggaactacttg

SEQ ID NO: 567540 - DNA, 25 bp, Rattus norvegicus
tatcttaacgatacgggttctgttt

SEQ ID NO: 567541 - DNA, 25 bp, Rattus norvegicus
tatcttaacgattcgggttctgttt

SEQ ID NO: 567542 - DNA, 25 bp, Rattus norvegicus
tatcttactatactgcgatggagtc

SEQ ID NO: 567543 - DNA, 25 bp, Rattus norvegicus
tatcttactatagtgcgatggagtc

SEQ ID NO: 567544 - DNA, 25 bp, Rattus norvegicus
tatcttaggtagatgcgctgtgcat

SEQ ID NO: 567545 - DNA, 25 bp, Rattus norvegicus
tatcttaggtagttgcgctgtgcat

SEQ ID NO: 567546 - DNA, 25 bp, Rattus norvegicus
tatcttagtgcaattcagtcccaaa

SEQ ID NO: 567547 - DNA, 25 bp, Rattus norvegicus
tatcttagtgcatttcagtcccaaa

SEQ ID NO: 567548 - DNA, 25 bp, Rattus norvegicus
tatcttatctctcttcatctccaaa

SEQ ID NO: 567549 - DNA, 25 bp, Rattus norvegicus
tatcttatctctgttcatctccaaa

SEQ ID NO: 567550 - DNA, 25 bp, Rattus norvegicus
tatcttatttgtatcctggtcctga

SEQ ID NO: 567551 - DNA, 25 bp, Rattus norvegicus
tatcttatttgtttcctggtcctga

SEQ ID NO: 567552 - DNA, 25 bp, Rattus norvegicus
tatcttcaaagtatccttgtccact

SEQ ID NO: 567553 - DNA, 25 bp, Rattus norvegicus
tatcttcaaagtttccttgtccact

SEQ ID NO: 567554 - DNA, 25 bp, Rattus norvegicus
tatcttcaagttattggacactctt

SEQ ID NO: 567555 - DNA, 25 bp, Rattus norvegicus
tatcttcaagtttttggacactctt

SEQ ID NO: 567556 - DNA, 25 bp, Rattus norvegicus
tatcttcaatgtatttggcccttgg

SEQ ID NO: 567557 - DNA, 25 bp, Rattus norvegicus
tatcttcaatgtttttggcccttgg

SEQ ID NO: 567558 - DNA, 25 bp, Rattus norvegicus
tatcttcaccacatcactgactaaa

SEQ ID NO: 567559 - DNA, 25 bp, Rattus norvegicus
tatcttcaccacttcactgactaaa

SEQ ID NO: 567560 - DNA, 25 bp, Rattus norvegicus
tatcttcaccccataatcttcatag

SEQ ID NO: 567561 - DNA, 25 bp, Rattus norvegicus
tatcttcaccccttaatcttcatag

SEQ ID NO: 567562 - DNA, 25 bp, Rattus norvegicus
tatcttcactggcagcagctcaaat

SEQ ID NO: 567563 - DNA, 25 bp, Rattus norvegicus
tatcttcactgggagcagctcaaat

SEQ ID NO: 567564 - DNA, 25 bp, Rattus norvegicus
tatcttcatataactgtaacagtgc

SEQ ID NO: 567565 - DNA, 25 bp, Rattus norvegicus
tatcttcatatatctgtaacagtgc

SEQ ID NO: 567566 - DNA, 25 bp, Rattus norvegicus
tatcttcattagacttctgttagag

SEQ ID NO: 567567 - DNA, 25 bp, Rattus norvegicus
tatcttcattagtcttctgttagag

SEQ ID NO: 567568 - DNA, 25 bp, Rattus norvegicus
tatcttccaagcaccaagttctggg

SEQ ID NO: 567569 - DNA, 25 bp, Rattus norvegicus
tatcttccaagctccaagttctggg

SEQ ID NO: 567570 - DNA, 25 bp, Rattus norvegicus
tatcttccaccacatttagcacagt

SEQ ID NO: 567571 - DNA, 25 bp, Rattus norvegicus
tatcttccaccagatttagcacagt

SEQ ID NO: 567572 - DNA, 25 bp, Rattus norvegicus
tatcttcccagcctagaggcagtta

SEQ ID NO: 567573 - DNA, 25 bp, Rattus norvegicus
tatcttcccagcgtagaggcagtta

SEQ ID NO: 567574 - DNA, 25 bp, Rattus norvegicus
tatcttccctgcactgggcagagga

SEQ ID NO: 567575 - DNA, 25 bp, Rattus norvegicus
tatcttccctgcctttatttttaat

SEQ ID NO: 567576 - DNA, 25 bp, Rattus norvegicus
tatcttccctgcgtttatttttaat

SEQ ID NO: 567577 - DNA, 25 bp, Rattus norvegicus
tatcttccctgctctgggcagagga

SEQ ID NO: 567578 - DNA, 25 bp, Rattus norvegicus
tatcttccgaacatcatgtctgccg

SEQ ID NO: 567579 - DNA, 25 bp, Rattus norvegicus
tatcttccgaacttcatgtctgccg

SEQ ID NO: 567580 - DNA, 25 bp, Rattus norvegicus
tatcttccgagtctgtgccagccaa

SEQ ID NO: 567581 - DNA, 25 bp, Rattus norvegicus
tatcttccgagtgtgtgccagccaa

SEQ ID NO: 567582 - DNA, 25 bp, Rattus norvegicus
tatcttccgtttagcctttacttag

SEQ ID NO: 567583 - DNA, 25 bp, Rattus norvegicus
tatcttccgttttgcctttacttag

SEQ ID NO: 567584 - DNA, 25 bp, Rattus norvegicus
tatcttcctctgagactgggacaga

SEQ ID NO: 567585 - DNA, 25 bp, Rattus norvegicus
tatcttcctctgtgactgggacaga

SEQ ID NO: 567586 - DNA, 25 bp, Rattus norvegicus
tatcttcctcttattggcatactag

SEQ ID NO: 567587 - DNA, 25 bp, Rattus norvegicus
tatcttcctctttttggcatactag

SEQ ID NO: 567588 - DNA, 25 bp, Rattus norvegicus
tatcttcctgaacacatgacgctgt

SEQ ID NO: 567589 - DNA, 25 bp, Rattus norvegicus
tatcttcctgaagacatgacgctgt

SEQ ID NO: 567590 - DNA, 25 bp, Rattus norvegicus
tatcttcctgctccggacaaggtga

SEQ ID NO: 567591 - DNA, 25 bp, Rattus norvegicus
tatcttcctgctgcggacaaggtga

SEQ ID NO: 567592 - DNA, 25 bp, Rattus norvegicus
tatcttccttctagtctatactttg

SEQ ID NO: 567593 - DNA, 25 bp, Rattus norvegicus
tatcttccttcttgtctatactttg

SEQ ID NO: 567594 - DNA, 25 bp, Rattus norvegicus
tatcttcgacagcattgcctcctgc

SEQ ID NO: 567595 - DNA, 25 bp, Rattus norvegicus
tatcttcgacaggattgcctcctgc

SEQ ID NO: 567596 - DNA, 25 bp, Rattus norvegicus
tatcttcgccagactgtcatgtgtt

SEQ ID NO: 567597 - DNA, 25 bp, Rattus norvegicus
tatcttcgccagtctgtcatgtgtt

SEQ ID NO: 567598 - DNA, 25 bp, Rattus norvegicus
tatcttcgcctgatagtgactgttt

SEQ ID NO: 567599 - DNA, 25 bp, Rattus norvegicus
tatcttcgcctgttagtgactgttt

SEQ ID NO: 567600 - DNA, 25 bp, Rattus norvegicus
tatcttcggtcaaccttgaggtcaa

SEQ ID NO: 567601 - DNA, 25 bp, Rattus norvegicus
tatcttcggtcatccttgaggtcaa

SEQ ID NO: 567602 - DNA, 25 bp, Rattus norvegicus
tatcttcgtatacctttccaagtgg

SEQ ID NO: 567603 - DNA, 25 bp, Rattus norvegicus
tatcttcgtatagctttccaagtgg

SEQ ID NO: 567604 - DNA, 25 bp, Rattus norvegicus
tatcttctaagacgctgaccactgg

SEQ ID NO: 567605 - DNA, 25 bp, Rattus norvegicus
tatcttctaagaggctgaccactgg

SEQ ID NO: 567606 - DNA, 25 bp, Rattus norvegicus
tatcttctggagctgttcagggcct

SEQ ID NO: 567607 - DNA, 25 bp, Rattus norvegicus
tatcttctggaggtgttcagggcct

SEQ ID NO: 567608 - DNA, 25 bp, Rattus norvegicus
tatcttctgtttcccttgaactcta

SEQ ID NO: 567609 - DNA, 25 bp, Rattus norvegicus
tatcttctgtttgccttgaactcta

SEQ ID NO: 567610 - DNA, 25 bp, Rattus norvegicus
tatcttcttctgagctcttcaggga

SEQ ID NO: 567611 - DNA, 25 bp, Rattus norvegicus
tatcttcttctgtgctcttcaggga

SEQ ID NO: 567612 - DNA, 25 bp, Rattus norvegicus
tatcttcttgccctgttcaaatttt

SEQ ID NO: 567613 - DNA, 25 bp, Rattus norvegicus
tatcttcttgccgtgttcaaatttt

SEQ ID NO: 567614 - DNA, 25 bp, Rattus norvegicus
tatcttcttttaacatgacacggga

SEQ ID NO: 567615 - DNA, 25 bp, Rattus norvegicus
tatcttcttttatcatgacacggga

SEQ ID NO: 567616 - DNA, 25 bp, Rattus norvegicus
tatcttgagtggcttcctcagcatg

SEQ ID NO: 567617 - DNA, 25 bp, Rattus norvegicus
tatcttgagtgggttcctcagcatg

SEQ ID NO: 567618 - DNA, 25 bp, Rattus norvegicus
tatcttgataaaaaacctacttgta

SEQ ID NO: 567619 - DNA, 25 bp, Rattus norvegicus
tatcttgataaataacctacttgta

SEQ ID NO: 567620 - DNA, 25 bp, Rattus norvegicus
tatcttgatatcctcttaatccatg

SEQ ID NO: 567621 - DNA, 25 bp, Rattus norvegicus
tatcttgatatcgtcttaatccatg

SEQ ID NO: 567622 - DNA, 25 bp, Rattus norvegicus
tatcttgatgatcacagccctgaaa

SEQ ID NO: 567623 - DNA, 25 bp, Rattus norvegicus
tatcttgatgatgacagccctgaaa

SEQ ID NO: 567624 - DNA, 25 bp, Rattus norvegicus
tatcttgatgtcagccatgagcctc

SEQ ID NO: 567625 - DNA, 25 bp, Rattus norvegicus
tatcttgatgtctgccatgagcctc

SEQ ID NO: 567626 - DNA, 25 bp, Rattus norvegicus
tatcttgcaaacatcaacaaaggga

SEQ ID NO: 567627 - DNA, 25 bp, Rattus norvegicus
tatcttgcaaacttcaacaaaggga

SEQ ID NO: 567628 - DNA, 25 bp, Rattus norvegicus
tatcttgccaccctgcaggttttgg

SEQ ID NO: 567629 - DNA, 25 bp, Rattus norvegicus
tatcttgccaccgtgcaggttttgg

SEQ ID NO: 567630 - DNA, 25 bp, Rattus norvegicus
tatcttgcgtctaatgtatcaaagg

SEQ ID NO: 567631 - DNA, 25 bp, Rattus norvegicus
tatcttgcgtcttatgtatcaaagg

SEQ ID NO: 567632 - DNA, 25 bp, Rattus norvegicus
tatcttgctcagcaattagtcggta

SEQ ID NO: 567633 - DNA, 25 bp, Rattus norvegicus
tatcttgctcaggaattagtcggta

SEQ ID NO: 567634 - DNA, 25 bp, Rattus norvegicus
tatcttgctcccaataatctgacta

SEQ ID NO: 567635 - DNA, 25 bp, Rattus norvegicus
tatcttgctccctataatctgacta

SEQ ID NO: 567636 - DNA, 25 bp, Rattus norvegicus
tatcttggccaaatacttcagcaaa

SEQ ID NO: 567637 - DNA, 25 bp, Rattus norvegicus
tatcttggccaattacttcagcaaa

SEQ ID NO: 567638 - DNA, 25 bp, Rattus norvegicus
tatcttgtaaagagtctattcggac

SEQ ID NO: 567639 - DNA, 25 bp, Rattus norvegicus
tatcttgtaaagtgtctattcggac

SEQ ID NO: 567640 - DNA, 25 bp, Rattus norvegicus
tatcttgtagataattctggaatat

SEQ ID NO: 567641 - DNA, 25 bp, Rattus norvegicus
tatcttgtagattattctggaatat

SEQ ID NO: 567642 - DNA, 25 bp, Rattus norvegicus
tatcttgtctctcggaattcgggtt

SEQ ID NO: 567643 - DNA, 25 bp, Rattus norvegicus
tatcttgtctctgggaattcgggtt

SEQ ID NO: 567644 - DNA, 25 bp, Rattus norvegicus
tatctttaaagtcctgtctctcaaa

SEQ ID NO: 567645 - DNA, 25 bp, Rattus norvegicus
tatctttaaagtgctgtctctcaaa

SEQ ID NO: 567646 - DNA, 25 bp, Rattus norvegicus
tatctttaatacaaccaggccgtca

SEQ ID NO: 567647 - DNA, 25 bp, Rattus norvegicus
tatctttaatactaccaggccgtca

SEQ ID NO: 567648 - DNA, 25 bp, Rattus norvegicus
tatctttacaacacgcacagtgctg

SEQ ID NO: 567649 - DNA, 25 bp, Rattus norvegicus
tatctttacaactcgcacagtgctg

SEQ ID NO: 567650 - DNA, 25 bp, Rattus norvegicus
tatctttactcactcccaaaacata

SEQ ID NO: 567651 - DNA, 25 bp, Rattus norvegicus
tatctttactcagtcccaaaacata

SEQ ID NO: 567652 - DNA, 25 bp, Rattus norvegicus
tatctttagaatctaaggaaccacc

SEQ ID NO: 567653 - DNA, 25 bp, Rattus norvegicus
tatctttagaatgtaaggaaccacc

SEQ ID NO: 567654 - DNA, 25 bp, Rattus norvegicus
tatctttatcctatttcccagtttg

SEQ ID NO: 567655 - DNA, 25 bp, Rattus norvegicus
tatctttatcctttttcccagtttg

SEQ ID NO: 567656 - DNA, 25 bp, Rattus norvegicus
tatctttatcgaataattcctcggg

SEQ ID NO: 567657 - DNA, 25 bp, Rattus norvegicus
tatctttatcgattaattcctcggg

SEQ ID NO: 567658 - DNA, 25 bp, Rattus norvegicus
tatctttatcttaatgccagctcaa

SEQ ID NO: 567659 - DNA, 25 bp, Rattus norvegicus
tatctttatctttatgccagctcaa

SEQ ID NO: 567660 - DNA, 25 bp, Rattus norvegicus
tatctttcaagtactgtggagcatt

SEQ ID NO: 567661 - DNA, 25 bp, Rattus norvegicus
tatctttcaagttctgtggagcatt

SEQ ID NO: 567662 - DNA, 25 bp, Rattus norvegicus
tatctttccagccatgcatgttgtt

SEQ ID NO: 567663 - DNA, 25 bp, Rattus norvegicus
tatctttccagcgatgcatgttgtt

SEQ ID NO: 567664 - DNA, 25 bp, Rattus norvegicus
tatctttccctcagtgtcacaacag

SEQ ID NO: 567665 - DNA, 25 bp, Rattus norvegicus
tatctttccctctgtgtcacaacag

SEQ ID NO: 567666 - DNA, 25 bp, Rattus norvegicus
tatctttcgagccaccaaactaggg

SEQ ID NO: 567667 - DNA, 25 bp, Rattus norvegicus
tatctttcgagcgaccaaactaggg

SEQ ID NO: 567668 - DNA, 25 bp, Rattus norvegicus
tatctttgaatccatcactcagagc

SEQ ID NO: 567669 - DNA, 25 bp, Rattus norvegicus
tatctttgaatcgatcactcagagc

SEQ ID NO: 567670 - DNA, 25 bp, Rattus norvegicus
tatctttgccagacactcgtagaaa

SEQ ID NO: 567671 - DNA, 25 bp, Rattus norvegicus
tatctttgccagtcactcgtagaaa

SEQ ID NO: 567672 - DNA, 25 bp, Rattus norvegicus
tatctttgccttctcgtaacggtgc

SEQ ID NO: 567673 - DNA, 25 bp, Rattus norvegicus
tatctttgccttgtcgtaacggtgc

SEQ ID NO: 567674 - DNA, 25 bp, Rattus norvegicus
tatctttgcgaacgccaacgactca

SEQ ID NO: 567675 - DNA, 25 bp, Rattus norvegicus
tatctttgcgaaggccaacgactca

SEQ ID NO: 567676 - DNA, 25 bp, Rattus norvegicus
tatctttgttacaagggttcagcct

SEQ ID NO: 567677 - DNA, 25 bp, Rattus norvegicus
tatctttgttactagggttcagcct

SEQ ID NO: 567678 - DNA, 25 bp, Rattus norvegicus
tatcttttagttatcccatctttgc

SEQ ID NO: 567679 - DNA, 25 bp, Rattus norvegicus
tatcttttagttttcccatctttgc

SEQ ID NO: 567680 - DNA, 25 bp, Rattus norvegicus
tatcttttatttcatggcttctccc

SEQ ID NO: 567681 - DNA, 25 bp, Rattus norvegicus
tatcttttatttgatggcttctccc

SEQ ID NO: 567682 - DNA, 25 bp, Rattus norvegicus
tatcttttccttcgttctcctctgt

SEQ ID NO: 567683 - DNA, 25 bp, Rattus norvegicus
tatcttttccttggttctcctctgt

SEQ ID NO: 567684 - DNA, 25 bp, Rattus norvegicus
tatcttttcgtgcatcaagcttgtg

SEQ ID NO: 567685 - DNA, 25 bp, Rattus norvegicus
tatcttttcgtggatcaagcttgtg

SEQ ID NO: 567686 - DNA, 25 bp, Rattus norvegicus
tatcttttgactaatcggacctggg

SEQ ID NO: 567687 - DNA, 25 bp, Rattus norvegicus
tatcttttgacttatcggacctggg

SEQ ID NO: 567688 - DNA, 25 bp, Rattus norvegicus
tatctttttgtcatgctttgggcta

SEQ ID NO: 567689 - DNA, 25 bp, Rattus norvegicus
tatctttttgtcttgctttgggcta

SEQ ID NO: 567690 - DNA, 25 bp, Rattus norvegicus
tatgaaaaagcccatctcccgtgtc

SEQ ID NO: 567691 - DNA, 25 bp, Rattus norvegicus
tatgaaaaagccgatctcccgtgtc

SEQ ID NO: 567692 - DNA, 25 bp, Rattus norvegicus
tatgaaaagaccctggctatcctcc

SEQ ID NO: 567693 - DNA, 25 bp, Rattus norvegicus
tatgaaaagaccgtggctatcctcc

SEQ ID NO: 567694 - DNA, 25 bp, Rattus norvegicus
tatgaaaagtagatcggtccccagc

SEQ ID NO: 567695 - DNA, 25 bp, Rattus norvegicus
tatgaaaagtagttcggtccccagc

SEQ ID NO: 567696 - DNA, 25 bp, Rattus norvegicus
tatgaaaatggcatccttttgactt

SEQ ID NO: 567697 - DNA, 25 bp, Rattus norvegicus
tatgaaaatggcttccttttgactt

SEQ ID NO: 567698 - DNA, 25 bp, Rattus norvegicus
tatgaaaattcacacctcggtaata

SEQ ID NO: 567699 - DNA, 25 bp, Rattus norvegicus
tatgaaaattcagacctcggtaata

SEQ ID NO: 567700 - DNA, 25 bp, Rattus norvegicus
tatgaaacaataacagcccgccgtc

SEQ ID NO: 567701 - DNA, 25 bp, Rattus norvegicus
tatgaaacaatatcagcccgccgtc

SEQ ID NO: 567702 - DNA, 25 bp, Rattus norvegicus
tatgaaaccacacgcaggagctggg

SEQ ID NO: 567703 - DNA, 25 bp, Rattus norvegicus
tatgaaaccacaggcaggagctggg

SEQ ID NO: 567704 - DNA, 25 bp, Rattus norvegicus
tatgaaaccatccatttgactgagg

SEQ ID NO: 567705 - DNA, 25 bp, Rattus norvegicus
tatgaaaccatcgatttgactgagg

SEQ ID NO: 567706 - DNA, 25 bp, Rattus norvegicus
tatgaaacctgtaatgtcacctccc

SEQ ID NO: 567707 - DNA, 25 bp, Rattus norvegicus
tatgaaacctgttatgtcacctccc

SEQ ID NO: 567708 - DNA, 25 bp, Rattus norvegicus
tatgaaaggccaaacccctaaagaa

SEQ ID NO: 567709 - DNA, 25 bp, Rattus norvegicus
tatgaaaggccatacccctaaagaa

SEQ ID NO: 567710 - DNA, 25 bp, Rattus norvegicus
tatgaaatggtcattgcctggctgg

SEQ ID NO: 567711 - DNA, 25 bp, Rattus norvegicus
tatgaaatggtctttgcctggctgg

SEQ ID NO: 567712 - DNA, 25 bp, Rattus norvegicus
tatgaacacctgcattcgtacatgg

SEQ ID NO: 567713 - DNA, 25 bp, Rattus norvegicus
tatgaacacctggattcgtacatgg

SEQ ID NO: 567714 - DNA, 25 bp, Rattus norvegicus
tatgaacactcaatacctctggctg

SEQ ID NO: 567715 - DNA, 25 bp, Rattus norvegicus
tatgaacactcattacctctggctg

SEQ ID NO: 567716 - DNA, 25 bp, Rattus norvegicus
tatgaacagcgtagggagcagcccc

SEQ ID NO: 567717 - DNA, 25 bp, Rattus norvegicus
tatgaacagcgttgggagcagcccc

SEQ ID NO: 567718 - DNA, 25 bp, Rattus norvegicus
tatgaacagctgctaagtctggaaa

SEQ ID NO: 567719 - DNA, 25 bp, Rattus norvegicus
tatgaacagctggtaagtctggaaa

SEQ ID NO: 567720 - DNA, 25 bp, Rattus norvegicus
tatgaacagtacagccgtctccaag

SEQ ID NO: 567721 - DNA, 25 bp, Rattus norvegicus
tatgaacagtactgccgtctccaag

SEQ ID NO: 567722 - DNA, 25 bp, Rattus norvegicus
tatgaacagtccctatggctctgca

SEQ ID NO: 567723 - DNA, 25 bp, Rattus norvegicus
tatgaacagtccgtatggctctgca

SEQ ID NO: 567724 - DNA, 25 bp, Rattus norvegicus
tatgaaccagccaccagaattccta

SEQ ID NO: 567725 - DNA, 25 bp, Rattus norvegicus
tatgaaccagcctccagaattccta

SEQ ID NO: 567726 - DNA, 25 bp, Rattus norvegicus
tatgaacctactctggactgtacca

SEQ ID NO: 567727 - DNA, 25 bp, Rattus norvegicus
tatgaacctactgtggactgtacca

SEQ ID NO: 567728 - DNA, 25 bp, Rattus norvegicus
tatgaacctctgcatgtgtgtgtac

SEQ ID NO: 567729 - DNA, 25 bp, Rattus norvegicus
tatgaacctctggatgtgtgtgtac

SEQ ID NO: 567730 - DNA, 25 bp, Rattus norvegicus
tatgaacctgtgatctgctcagctc

SEQ ID NO: 567731 - DNA, 25 bp, Rattus norvegicus
tatgaacctgtgttctgctcagctc

SEQ ID NO: 567732 - DNA, 25 bp, Rattus norvegicus
tatgaaccttccctctaattagctt

SEQ ID NO: 567733 - DNA, 25 bp, Rattus norvegicus
tatgaaccttccgtctaattagctt

SEQ ID NO: 567734 - DNA, 25 bp, Rattus norvegicus
tatgaacgcatcaggtctgctgtgt

SEQ ID NO: 567735 - DNA, 25 bp, Rattus norvegicus
tatgaacgcatctggtctgctgtgt

SEQ ID NO: 567736 - DNA, 25 bp, Rattus norvegicus
tatgaactacaccttcagctccagt

SEQ ID NO: 567737 - DNA, 25 bp, Rattus norvegicus
tatgaactacacgttcagctccagt

SEQ ID NO: 567738 - DNA, 25 bp, Rattus norvegicus
tatgaactccagcagggcaggatgc

SEQ ID NO: 567739 - DNA, 25 bp, Rattus norvegicus
tatgaactccaggagggcaggatgc

SEQ ID NO: 567740 - DNA, 25 bp, Rattus norvegicus
tatgaactcctgcacttgatgactt

SEQ ID NO: 567741 - DNA, 25 bp, Rattus norvegicus
tatgaactcctggacttgatgactt

SEQ ID NO: 567742 - DNA, 25 bp, Rattus norvegicus
tatgaactcgctatatacctgaaga

SEQ ID NO: 567743 - DNA, 25 bp, Rattus norvegicus
tatgaactcgctttatacctgaaga

SEQ ID NO: 567744 - DNA, 25 bp, Rattus norvegicus
tatgaactgtcaagtgccacctgag

SEQ ID NO: 567745 - DNA, 25 bp, Rattus norvegicus
tatgaactgtcatgtgccacctgag

SEQ ID NO: 567746 - DNA, 25 bp, Rattus norvegicus
tatgaagatccgaggtgtcagacct

SEQ ID NO: 567747 - DNA, 25 bp, Rattus norvegicus
tatgaagatccgtggtgtcagacct

SEQ ID NO: 567748 - DNA, 25 bp, Rattus norvegicus
tatgaagatggacggcgcgagcctg

SEQ ID NO: 567749 - DNA, 25 bp, Rattus norvegicus
tatgaagatggagggcgcgagcctg

SEQ ID NO: 567750 - DNA, 25 bp, Rattus norvegicus
tatgaagctaatcgccagaccttgg

SEQ ID NO: 567751 - DNA, 25 bp, Rattus norvegicus
tatgaagctaatggccagaccttgg

SEQ ID NO: 567752 - DNA, 25 bp, Rattus norvegicus
tatgaagctgggaccatgcctgaaa

SEQ ID NO: 567753 - DNA, 25 bp, Rattus norvegicus
tatgaagctgggtccatgcctgaaa

SEQ ID NO: 567754 - DNA, 25 bp, Rattus norvegicus
tatgaaggaccaagctgcccacata

SEQ ID NO: 567755 - DNA, 25 bp, Rattus norvegicus
tatgaaggaccatgctgcccacata

SEQ ID NO: 567756 - DNA, 25 bp, Rattus norvegicus
tatgaaggccaaacatccctatcct

SEQ ID NO: 567757 - DNA, 25 bp, Rattus norvegicus
tatgaaggccaatcatccctatcct

SEQ ID NO: 567758 - DNA, 25 bp, Rattus norvegicus
tatgaagtcccacccttctgactct

SEQ ID NO: 567759 - DNA, 25 bp, Rattus norvegicus
tatgaagtcccagccttctgactct

SEQ ID NO: 567760 - DNA, 25 bp, Rattus norvegicus
tatgaagtccgacacgtaaccccac

SEQ ID NO: 567761 - DNA, 25 bp, Rattus norvegicus
tatgaagtccgagacgtaaccccac

SEQ ID NO: 567762 - DNA, 25 bp, Rattus norvegicus
tatgaagtctcgatgcctcagtgta

SEQ ID NO: 567763 - DNA, 25 bp, Rattus norvegicus
tatgaagtctcgttgcctcagtgta

SEQ ID NO: 567764 - DNA, 25 bp, Rattus norvegicus
tatgaataactcagcacccatggct

SEQ ID NO: 567765 - DNA, 25 bp, Rattus norvegicus
tatgaataactctgcacccatggct

SEQ ID NO: 567766 - DNA, 25 bp, Rattus norvegicus
tatgaatcatgtacccagagcacaa

SEQ ID NO: 567767 - DNA, 25 bp, Rattus norvegicus
tatgaatcatgttcccagagcacaa

SEQ ID NO: 567768 - DNA, 25 bp, Rattus norvegicus
tatgaatctccaacactgttgaccg

SEQ ID NO: 567769 - DNA, 25 bp, Rattus norvegicus
tatgaatctccatcactgttgaccg

SEQ ID NO: 567770 - DNA, 25 bp, Rattus norvegicus
tatgaatctctcagcagtctttgtt

SEQ ID NO: 567771 - DNA, 25 bp, Rattus norvegicus
tatgaatctctctgcagtctttgtt

SEQ ID NO: 567772 - DNA, 25 bp, Rattus norvegicus
tatgaatgcccgaatctgtgtcctg

SEQ ID NO: 567773 - DNA, 25 bp, Rattus norvegicus
tatgaatgcccgtatctgtgtcctg

SEQ ID NO: 567774 - DNA, 25 bp, Rattus norvegicus
tatgaatgtaagagccctgtacctg

SEQ ID NO: 567775 - DNA, 25 bp, Rattus norvegicus
tatgaatgtaagtgccctgtacctg

SEQ ID NO: 567776 - DNA, 25 bp, Rattus norvegicus
tatgaatgtgagcttgccctttctt

SEQ ID NO: 567777 - DNA, 25 bp, Rattus norvegicus
tatgaatgtgaggttgccctttctt

SEQ ID NO: 567778 - DNA, 25 bp, Rattus norvegicus
tatgaatgtgccaggctcctttggg

SEQ ID NO: 567779 - DNA, 25 bp, Rattus norvegicus
tatgaatgtgcctggctcctttggg

SEQ ID NO: 567780 - DNA, 25 bp, Rattus norvegicus
tatgaattagcgctgactccccaca

SEQ ID NO: 567781 - DNA, 25 bp, Rattus norvegicus
tatgaattagcggtgactccccaca

SEQ ID NO: 567782 - DNA, 25 bp, Rattus norvegicus
tatgacaaaaaacccgggaccatct

SEQ ID NO: 567783 - DNA, 25 bp, Rattus norvegicus
tatgacaaaaaagccgggaccatct

SEQ ID NO: 567784 - DNA, 25 bp, Rattus norvegicus
tatgacaaaacactccctggccaat

SEQ ID NO: 567785 - DNA, 25 bp, Rattus norvegicus
tatgacaaaacagtccctggccaat

SEQ ID NO: 567786 - DNA, 25 bp, Rattus norvegicus
tatgacaaagacaacctcagcggtg

SEQ ID NO: 567787 - DNA, 25 bp, Rattus norvegicus
tatgacaaagactacctcagcggtg

SEQ ID NO: 567788 - DNA, 25 bp, Rattus norvegicus
tatgacaacactagctcacatcttg

SEQ ID NO: 567789 - DNA, 25 bp, Rattus norvegicus
tatgacaacacttgctcacatcttg

SEQ ID NO: 567790 - DNA, 25 bp, Rattus norvegicus
tatgacacacacacgctgatgcaca

SEQ ID NO: 567791 - DNA, 25 bp, Rattus norvegicus
tatgacacacactcgctgatgcaca

SEQ ID NO: 567792 - DNA, 25 bp, Rattus norvegicus
tatgacacagatccatgcccgcttt

SEQ ID NO: 567793 - DNA, 25 bp, Rattus norvegicus
tatgacacagatgcatgcccgcttt

SEQ ID NO: 567794 - DNA, 25 bp, Rattus norvegicus
tatgacacatatcttccccacagac

SEQ ID NO: 567795 - DNA, 25 bp, Rattus norvegicus
tatgacacatatgttccccacagac

SEQ ID NO: 567796 - DNA, 25 bp, Rattus norvegicus
tatgacacctacctgaagcgctgtg

SEQ ID NO: 567797 - DNA, 25 bp, Rattus norvegicus
tatgacacctacgtgaagcgctgtg

SEQ ID NO: 567798 - DNA, 25 bp, Rattus norvegicus
tatgacacctgcatgatgtctctgt

SEQ ID NO: 567799 - DNA, 25 bp, Rattus norvegicus
tatgacacctgcttgatgtctctgt

SEQ ID NO: 567800 - DNA, 25 bp, Rattus norvegicus
tatgacaccttcctaaacctttctt

SEQ ID NO: 567801 - DNA, 25 bp, Rattus norvegicus
tatgacaccttcgtaaacctttctt

SEQ ID NO: 567802 - DNA, 25 bp, Rattus norvegicus
tatgacacgctgcacatcactggca

SEQ ID NO: 567803 - DNA, 25 bp, Rattus norvegicus
tatgacacgctggacatcactggca

SEQ ID NO: 567804 - DNA, 25 bp, Rattus norvegicus
tatgacactcaccttacttactttt

SEQ ID NO: 567805 - DNA, 25 bp, Rattus norvegicus
tatgacactcacgttacttactttt

SEQ ID NO: 567806 - DNA, 25 bp, Rattus norvegicus
tatgacactgggaatgggtccccat

SEQ ID NO: 567807 - DNA, 25 bp, Rattus norvegicus
tatgacactgggtatgggtccccat

SEQ ID NO: 567808 - DNA, 25 bp, Rattus norvegicus
tatgacactgttcccaagtggccag

SEQ ID NO: 567809 - DNA, 25 bp, Rattus norvegicus
tatgacactgttgccaagtggccag

SEQ ID NO: 567810 - DNA, 25 bp, Rattus norvegicus
tatgacaggcctcgacagcaagtgc

SEQ ID NO: 567811 - DNA, 25 bp, Rattus norvegicus
tatgacaggcctggacagcaagtgc

SEQ ID NO: 567812 - DNA, 25 bp, Rattus norvegicus
tatgacaggtacatcgccatctgct

SEQ ID NO: 567813 - DNA, 25 bp, Rattus norvegicus
tatgacaggtacttcgccatctgct

SEQ ID NO: 567814 - DNA, 25 bp, Rattus norvegicus
tatgacaggtgtcctcctgctagca

SEQ ID NO: 567815 - DNA, 25 bp, Rattus norvegicus
tatgacaggtgtgctcctgctagca

SEQ ID NO: 567816 - DNA, 25 bp, Rattus norvegicus
tatgacagtggcaccgtatccctag

SEQ ID NO: 567817 - DNA, 25 bp, Rattus norvegicus
tatgacagtggctccgtatccctag

SEQ ID NO: 567818 - DNA, 25 bp, Rattus norvegicus
tatgacatacatcagccttcctgct

SEQ ID NO: 567819 - DNA, 25 bp, Rattus norvegicus
tatgacatacatgagccttcctgct

SEQ ID NO: 567820 - DNA, 25 bp, Rattus norvegicus
tatgacatattcaccactctgtata

SEQ ID NO: 567821 - DNA, 25 bp, Rattus norvegicus
tatgacatattctccactctgtata

SEQ ID NO: 567822 - DNA, 25 bp, Rattus norvegicus
tatgacatgtggctgcaggcatccc

SEQ ID NO: 567823 - DNA, 25 bp, Rattus norvegicus
tatgacatgtgggtgcaggcatccc

SEQ ID NO: 567824 - DNA, 25 bp, Rattus norvegicus
tatgaccaatgtccagcagtggctg

SEQ ID NO: 567825 - DNA, 25 bp, Rattus norvegicus
tatgaccaatgtgcagcagtggctg

SEQ ID NO: 567826 - DNA, 25 bp, Rattus norvegicus
tatgaccacactcccggtatggcgg

SEQ ID NO: 567827 - DNA, 25 bp, Rattus norvegicus
tatgaccacactgccggtatggcgg

SEQ ID NO: 567828 - DNA, 25 bp, Rattus norvegicus
tatgaccatcacagaccagagtttg

SEQ ID NO: 567829 - DNA, 25 bp, Rattus norvegicus
tatgaccatcactgaccagagtttg

SEQ ID NO: 567830 - DNA, 25 bp, Rattus norvegicus
tatgaccatgtgcaccccgtgggag

SEQ ID NO: 567831 - DNA, 25 bp, Rattus norvegicus
tatgaccatgtggaccccgtgggag

SEQ ID NO: 567832 - DNA, 25 bp, Rattus norvegicus
tatgacccaatacacccctgattat

SEQ ID NO: 567833 - DNA, 25 bp, Rattus norvegicus
tatgacccaatagacccctgattat

SEQ ID NO: 567834 - DNA, 25 bp, Rattus norvegicus
tatgacccacggacaagcaggcttg

SEQ ID NO: 567835 - DNA, 25 bp, Rattus norvegicus
tatgacccacggtcaagcaggcttg

SEQ ID NO: 567836 - DNA, 25 bp, Rattus norvegicus
tatgacccactccaataaaactcca

SEQ ID NO: 567837 - DNA, 25 bp, Rattus norvegicus
tatgacccactcgaataaaactcca

SEQ ID NO: 567838 - DNA, 25 bp, Rattus norvegicus
tatgacccctagatttctgttttgt

SEQ ID NO: 567839 - DNA, 25 bp, Rattus norvegicus
tatgacccctagttttctgttttgt

SEQ ID NO: 567840 - DNA, 25 bp, Rattus norvegicus
tatgaccccttcctttcggaagtag

SEQ ID NO: 567841 - DNA, 25 bp, Rattus norvegicus
tatgaccccttcgtttcggaagtag

SEQ ID NO: 567842 - DNA, 25 bp, Rattus norvegicus
tatgaccctcagaagtcagcgagac

SEQ ID NO: 567843 - DNA, 25 bp, Rattus norvegicus
tatgaccctcagtagtcagcgagac

SEQ ID NO: 567844 - DNA, 25 bp, Rattus norvegicus
tatgaccctggtcagctggaagctg

SEQ ID NO: 567845 - DNA, 25 bp, Rattus norvegicus
tatgaccctggtgagctggaagctg

SEQ ID NO: 567846 - DNA, 25 bp, Rattus norvegicus
tatgaccgatgcactgcctttggag

SEQ ID NO: 567847 - DNA, 25 bp, Rattus norvegicus
tatgaccgatgctctgcctttggag

SEQ ID NO: 567848 - DNA, 25 bp, Rattus norvegicus
tatgaccgctggactggatcctaag

SEQ ID NO: 567849 - DNA, 25 bp, Rattus norvegicus
tatgaccgctggtctggatcctaag

SEQ ID NO: 567850 - DNA, 25 bp, Rattus norvegicus
tatgaccgcttcactgaagccaaga

SEQ ID NO: 567851 - DNA, 25 bp, Rattus norvegicus
tatgaccgcttctctgaagccaaga

SEQ ID NO: 567852 - DNA, 25 bp, Rattus norvegicus
tatgacctaaatctatgggcagttt

SEQ ID NO: 567853 - DNA, 25 bp, Rattus norvegicus
tatgacctaaatgtatgggcagttt

SEQ ID NO: 567854 - DNA, 25 bp, Rattus norvegicus
tatgacctataacactacccaaatt

SEQ ID NO: 567855 - DNA, 25 bp, Rattus norvegicus
tatgacctataagactacccaaatt

SEQ ID NO: 567856 - DNA, 25 bp, Rattus norvegicus
tatgacctattgcaccaactttgcc

SEQ ID NO: 567857 - DNA, 25 bp, Rattus norvegicus
tatgacctattggaccaactttgcc

SEQ ID NO: 567858 - DNA, 25 bp, Rattus norvegicus
tatgacctcaagctctcagttgaag

SEQ ID NO: 567859 - DNA, 25 bp, Rattus norvegicus
tatgacctcaaggtctcagttgaag

SEQ ID NO: 567860 - DNA, 25 bp, Rattus norvegicus
tatgacctcctcagtgagacaggtg

SEQ ID NO: 567861 - DNA, 25 bp, Rattus norvegicus
tatgacctcctctgtgagacaggtg

SEQ ID NO: 567862 - DNA, 25 bp, Rattus norvegicus
tatgacctgcctcacaaagatgatt

SEQ ID NO: 567863 - DNA, 25 bp, Rattus norvegicus
tatgacctgcctgacaaagatgatt

SEQ ID NO: 567864 - DNA, 25 bp, Rattus norvegicus
tatgaccttgataggaggctactct

SEQ ID NO: 567865 - DNA, 25 bp, Rattus norvegicus
tatgaccttgattggaggctactct

SEQ ID NO: 567866 - DNA, 25 bp, Rattus norvegicus
tatgacgaaaggaacatctccttct

SEQ ID NO: 567867 - DNA, 25 bp, Rattus norvegicus
tatgacgaaaggtacatctccttct

SEQ ID NO: 567868 - DNA, 25 bp, Rattus norvegicus
tatgacgatgtccacggctttgtag

SEQ ID NO: 567869 - DNA, 25 bp, Rattus norvegicus
tatgacgatgtcgacggctttgtag

SEQ ID NO: 567870 - DNA, 25 bp, Rattus norvegicus
tatgacggaactctttcctacttgc

SEQ ID NO: 567871 - DNA, 25 bp, Rattus norvegicus
tatgacggaactgtttcctacttgc

SEQ ID NO: 567872 - DNA, 25 bp, Rattus norvegicus
tatgacggacagaagacctaccctt

SEQ ID NO: 567873 - DNA, 25 bp, Rattus norvegicus
tatgacggacagtagacctaccctt

SEQ ID NO: 567874 - DNA, 25 bp, Rattus norvegicus
tatgacgggacacgatatagatctt

SEQ ID NO: 567875 - DNA, 25 bp, Rattus norvegicus
tatgacgggacaggatatagatctt

SEQ ID NO: 567876 - DNA, 25 bp, Rattus norvegicus
tatgacggtgctattcgttttccat

SEQ ID NO: 567877 - DNA, 25 bp, Rattus norvegicus
tatgacggtgcttttcgttttccat

SEQ ID NO: 567878 - DNA, 25 bp, Rattus norvegicus
tatgacgtatttcgtccccttcaat

SEQ ID NO: 567879 - DNA, 25 bp, Rattus norvegicus
tatgacgtatttggtccccttcaat

SEQ ID NO: 567880 - DNA, 25 bp, Rattus norvegicus
tatgacgttgaaatcacccaggccc

SEQ ID NO: 567881 - DNA, 25 bp, Rattus norvegicus
tatgacgttgaattcacccaggccc

SEQ ID NO: 567882 - DNA, 25 bp, Rattus norvegicus
tatgacgtttaacgtgtggcctcca

SEQ ID NO: 567883 - DNA, 25 bp, Rattus norvegicus
tatgacgtttaaggtgtggcctcca

SEQ ID NO: 567884 - DNA, 25 bp, Rattus norvegicus
tatgactacgttcaagccactggaa

SEQ ID NO: 567885 - DNA, 25 bp, Rattus norvegicus
tatgactacgttgaagccactggaa

SEQ ID NO: 567886 - DNA, 25 bp, Rattus norvegicus
tatgactcagcaatctccatcggag

SEQ ID NO: 567887 - DNA, 25 bp, Rattus norvegicus
tatgactcagcattctccatcggag

SEQ ID NO: 567888 - DNA, 25 bp, Rattus norvegicus
tatgactccatgaagctccaacgca

SEQ ID NO: 567889 - DNA, 25 bp, Rattus norvegicus
tatgactccatgtagctccaacgca

SEQ ID NO: 567890 - DNA, 25 bp, Rattus norvegicus
tatgactcccttccattcattgaga

SEQ ID NO: 567891 - DNA, 25 bp, Rattus norvegicus
tatgactcccttgcattcattgaga

SEQ ID NO: 567892 - DNA, 25 bp, Rattus norvegicus
tatgactcgcccaaaaacagccaca

SEQ ID NO: 567893 - DNA, 25 bp, Rattus norvegicus
tatgactcgccctaaaacagccaca

SEQ ID NO: 567894 - DNA, 25 bp, Rattus norvegicus
tatgactcgccgctaagcacagtga

SEQ ID NO: 567895 - DNA, 25 bp, Rattus norvegicus
tatgactcgccggtaagcacagtga

SEQ ID NO: 567896 - DNA, 25 bp, Rattus norvegicus
tatgactcggagaatcctcctggct

SEQ ID NO: 567897 - DNA, 25 bp, Rattus norvegicus
tatgactcggagtatcctcctggct

SEQ ID NO: 567898 - DNA, 25 bp, Rattus norvegicus
tatgactcgtaaaatactttcttcg

SEQ ID NO: 567899 - DNA, 25 bp, Rattus norvegicus
tatgactcgtaatatactttcttcg

SEQ ID NO: 567900 - DNA, 25 bp, Rattus norvegicus
tatgactcgtcaatggttattacca

SEQ ID NO: 567901 - DNA, 25 bp, Rattus norvegicus
tatgactcgtcattggttattacca

SEQ ID NO: 567902 - DNA, 25 bp, Rattus norvegicus
tatgactgagaccacaccagatcct

SEQ ID NO: 567903 - DNA, 25 bp, Rattus norvegicus
tatgactgagacgacaccagatcct

SEQ ID NO: 567904 - DNA, 25 bp, Rattus norvegicus
tatgactgagcccatgatgcacctt

SEQ ID NO: 567905 - DNA, 25 bp, Rattus norvegicus
tatgactgagccgatgatgcacctt

SEQ ID NO: 567906 - DNA, 25 bp, Rattus norvegicus
tatgactgcagtcagaaacctaatc

SEQ ID NO: 567907 - DNA, 25 bp, Rattus norvegicus
tatgactgcagtgagaaacctaatc

SEQ ID NO: 567908 - DNA, 25 bp, Rattus norvegicus
tatgactgctaacttgctcagcacc

SEQ ID NO: 567909 - DNA, 25 bp, Rattus norvegicus
tatgactgctaagttgctcagcacc

SEQ ID NO: 567910 - DNA, 25 bp, Rattus norvegicus
tatgactgtaccatgtgtggtcctt

SEQ ID NO: 567911 - DNA, 25 bp, Rattus norvegicus
tatgactgtaccttgtgtggtcctt

SEQ ID NO: 567912 - DNA, 25 bp, Rattus norvegicus
tatgactgttacagaggcgtcctca

SEQ ID NO: 567913 - DNA, 25 bp, Rattus norvegicus
tatgactgttactgaggcgtcctca

SEQ ID NO: 567914 - DNA, 25 bp, Rattus norvegicus
tatgacttacttagaggcctcagcc

SEQ ID NO: 567915 - DNA, 25 bp, Rattus norvegicus
tatgacttactttgaggcctcagcc

SEQ ID NO: 567916 - DNA, 25 bp, Rattus norvegicus
tatgacttccagctctttcaggtct

SEQ ID NO: 567917 - DNA, 25 bp, Rattus norvegicus
tatgacttccaggtctttcaggtct

SEQ ID NO: 567918 - DNA, 25 bp, Rattus norvegicus
tatgacttctgcctactgggtcttg

SEQ ID NO: 567919 - DNA, 25 bp, Rattus norvegicus
tatgacttctgcgtactgggtcttg

SEQ ID NO: 567920 - DNA, 25 bp, Rattus norvegicus
tatgacttggtccatgcggagacaa

SEQ ID NO: 567921 - DNA, 25 bp, Rattus norvegicus
tatgacttggtcgatgcggagacaa

SEQ ID NO: 567922 - DNA, 25 bp, Rattus norvegicus
tatgacttggtgatactactggcct

SEQ ID NO: 567923 - DNA, 25 bp, Rattus norvegicus
tatgacttggtgttactactggcct

SEQ ID NO: 567924 - DNA, 25 bp, Rattus norvegicus
tatgacttgtatctctctgtagcct

SEQ ID NO: 567925 - DNA, 25 bp, Rattus norvegicus
tatgacttgtatgtctctgtagcct

SEQ ID NO: 567926 - DNA, 25 bp, Rattus norvegicus
tatgactttaaaaggctggaactgc

SEQ ID NO: 567927 - DNA, 25 bp, Rattus norvegicus
tatgactttaaatggctggaactgc

SEQ ID NO: 567928 - DNA, 25 bp, Rattus norvegicus
tatgactttaacatctttctgaggt

SEQ ID NO: 567929 - DNA, 25 bp, Rattus norvegicus
tatgactttaacttctttctgaggt

SEQ ID NO: 567930 - DNA, 25 bp, Rattus norvegicus
tatgactttgagcccctggaggaag

SEQ ID NO: 567931 - DNA, 25 bp, Rattus norvegicus
tatgactttgaggccctggaggaag

SEQ ID NO: 567932 - DNA, 25 bp, Rattus norvegicus
tatgactttttcagtaaacagattg

SEQ ID NO: 567933 - DNA, 25 bp, Rattus norvegicus
tatgactttttctgtaaacagattg

SEQ ID NO: 567934 - DNA, 25 bp, Rattus norvegicus
tatgagaaagtgacccagctgcctg

SEQ ID NO: 567935 - DNA, 25 bp, Rattus norvegicus
tatgagaaagtgtcccagctgcctg

SEQ ID NO: 567936 - DNA, 25 bp, Rattus norvegicus
tatgagaacctcatgccttccatga

SEQ ID NO: 567937 - DNA, 25 bp, Rattus norvegicus
tatgagaacctcttgccttccatga

SEQ ID NO: 567938 - DNA, 25 bp, Rattus norvegicus
tatgagaacttccactacaccgatc

SEQ ID NO: 567939 - DNA, 25 bp, Rattus norvegicus
tatgagaacttcgactacaccgatc

SEQ ID NO: 567940 - DNA, 25 bp, Rattus norvegicus
tatgagaagctcagccgggccatga

SEQ ID NO: 567941 - DNA, 25 bp, Rattus norvegicus
tatgagaagctctgccgggccatga

SEQ ID NO: 567942 - DNA, 25 bp, Rattus norvegicus
tatgagaatgacatgttcctacttg

SEQ ID NO: 567943 - DNA, 25 bp, Rattus norvegicus
tatgagaatgacttgttcctacttg

SEQ ID NO: 567944 - DNA, 25 bp, Rattus norvegicus
tatgagacccggagcgcctgagaga

SEQ ID NO: 567945 - DNA, 25 bp, Rattus norvegicus
tatgagacccggtgcgcctgagaga

SEQ ID NO: 567946 - DNA, 25 bp, Rattus norvegicus
tatgagaccctgagaggttgcccat

SEQ ID NO: 567947 - DNA, 25 bp, Rattus norvegicus
tatgagaccctgtgaggttgcccat

SEQ ID NO: 567948 - DNA, 25 bp, Rattus norvegicus
tatgagagaactcctcaacctaccc

SEQ ID NO: 567949 - DNA, 25 bp, Rattus norvegicus
tatgagagaactgctcaacctaccc

SEQ ID NO: 567950 - DNA, 25 bp, Rattus norvegicus
tatgagagacatcgcccttttccta

SEQ ID NO: 567951 - DNA, 25 bp, Rattus norvegicus
tatgagagacatggcccttttccta

SEQ ID NO: 567952 - DNA, 25 bp, Rattus norvegicus
tatgagagcagacacaggatcctgt

SEQ ID NO: 567953 - DNA, 25 bp, Rattus norvegicus
tatgagagcagagacaggatcctgt

SEQ ID NO: 567954 - DNA, 25 bp, Rattus norvegicus
tatgagaggacacccaggcccacat

SEQ ID NO: 567955 - DNA, 25 bp, Rattus norvegicus
tatgagaggacagccaggcccacat

SEQ ID NO: 567956 - DNA, 25 bp, Rattus norvegicus
tatgagagtaccaattgcccgtggg

SEQ ID NO: 567957 - DNA, 25 bp, Rattus norvegicus
tatgagagtacctattgcccgtggg

SEQ ID NO: 567958 - DNA, 25 bp, Rattus norvegicus
tatgagagttagaaggtccgaccct

SEQ ID NO: 567959 - DNA, 25 bp, Rattus norvegicus
tatgagagttagtaggtccgaccct

SEQ ID NO: 567960 - DNA, 25 bp, Rattus norvegicus
tatgagagtttcaacttcctctccc

SEQ ID NO: 567961 - DNA, 25 bp, Rattus norvegicus
tatgagagtttctacttcctctccc

SEQ ID NO: 567962 - DNA, 25 bp, Rattus norvegicus
tatgagatatccaccatgggcgtat

SEQ ID NO: 567963 - DNA, 25 bp, Rattus norvegicus
tatgagatatcctccatgggcgtat

SEQ ID NO: 567964 - DNA, 25 bp, Rattus norvegicus
tatgagatccaaaccatttccctcc

SEQ ID NO: 567965 - DNA, 25 bp, Rattus norvegicus
tatgagatccaatccatttccctcc

SEQ ID NO: 567966 - DNA, 25 bp, Rattus norvegicus
tatgagatcgccacaggaccagttt

SEQ ID NO: 567967 - DNA, 25 bp, Rattus norvegicus
tatgagatcgcctcaggaccagttt

SEQ ID NO: 567968 - DNA, 25 bp, Rattus norvegicus
tatgagatgcgtagccacggcacca

SEQ ID NO: 567969 - DNA, 25 bp, Rattus norvegicus
tatgagatgcgttgccacggcacca

SEQ ID NO: 567970 - DNA, 25 bp, Rattus norvegicus
tatgagcaccatcgctgctgcagaa

SEQ ID NO: 567971 - DNA, 25 bp, Rattus norvegicus
tatgagcaccatggctgctgcagaa

SEQ ID NO: 567972 - DNA, 25 bp, Rattus norvegicus
tatgagcacctgctgtgattctcag

SEQ ID NO: 567973 - DNA, 25 bp, Rattus norvegicus
tatgagcacctggtgtgattctcag

SEQ ID NO: 567974 - DNA, 25 bp, Rattus norvegicus
tatgagcactcaccgggacctggaa

SEQ ID NO: 567975 - DNA, 25 bp, Rattus norvegicus
tatgagcactcagcgggacctggaa

SEQ ID NO: 567976 - DNA, 25 bp, Rattus norvegicus
tatgagcacttcatgctcttccaga

SEQ ID NO: 567977 - DNA, 25 bp, Rattus norvegicus
tatgagcacttcttgctcttccaga

SEQ ID NO: 567978 - DNA, 25 bp, Rattus norvegicus
tatgagcagaagattcctttttccc

SEQ ID NO: 567979 - DNA, 25 bp, Rattus norvegicus
tatgagcagaagtttcctttttccc

SEQ ID NO: 567980 - DNA, 25 bp, Rattus norvegicus
tatgagcaggccatccgcgagcact

SEQ ID NO: 567981 - DNA, 25 bp, Rattus norvegicus
tatgagcaggccttccgcgagcact

SEQ ID NO: 567982 - DNA, 25 bp, Rattus norvegicus
tatgagcatcagattaacatttttt

SEQ ID NO: 567983 - DNA, 25 bp, Rattus norvegicus
tatgagcatcagtttaacatttttt

SEQ ID NO: 567984 - DNA, 25 bp, Rattus norvegicus
tatgagccaagcatcttagccagcc

SEQ ID NO: 567985 - DNA, 25 bp, Rattus norvegicus
tatgagccaagcttcttagccagcc

SEQ ID NO: 567986 - DNA, 25 bp, Rattus norvegicus
tatgagccaataccacaagtgttct

SEQ ID NO: 567987 - DNA, 25 bp, Rattus norvegicus
tatgagccaatagcacaagtgttct

SEQ ID NO: 567988 - DNA, 25 bp, Rattus norvegicus
tatgagccagataaaccctctctct

SEQ ID NO: 567989 - DNA, 25 bp, Rattus norvegicus
tatgagccagattaaccctctctct

SEQ ID NO: 567990 - DNA, 25 bp, Rattus norvegicus
tatgagccatctccctacagagtca

SEQ ID NO: 567991 - DNA, 25 bp, Rattus norvegicus
tatgagccatctgcctacagagtca

SEQ ID NO: 567992 - DNA, 25 bp, Rattus norvegicus
tatgagcccgcacagactattgagt

SEQ ID NO: 567993 - DNA, 25 bp, Rattus norvegicus
tatgagcccgcagagactattgagt

SEQ ID NO: 567994 - DNA, 25 bp, Rattus norvegicus
tatgagccctacaccattatggtgt

SEQ ID NO: 567995 - DNA, 25 bp, Rattus norvegicus
tatgagccctactccattatggtgt

SEQ ID NO: 567996 - DNA, 25 bp, Rattus norvegicus
tatgagcctggcagtgagtcggtca

SEQ ID NO: 567997 - DNA, 25 bp, Rattus norvegicus
tatgagcctggctgtgagtcggtca

SEQ ID NO: 567998 - DNA, 25 bp, Rattus norvegicus
tatgagcgactaatccagcacaaga

SEQ ID NO: 567999 - DNA, 25 bp, Rattus norvegicus
tatgagcgactattccagcacaaga

SEQ ID NO: 568000 - DNA, 25 bp, Rattus norvegicus
tatgagcgataaaggccagctgcca

SEQ ID NO: 568001 - DNA, 25 bp, Rattus norvegicus
tatgagcgataatggccagctgcca

SEQ ID NO: 568002 - DNA, 25 bp, Rattus norvegicus
tatgagcgccttatccgatggattc

SEQ ID NO: 568003 - DNA, 25 bp, Rattus norvegicus
tatgagcgccttttccgatggattc

SEQ ID NO: 568004 - DNA, 25 bp, Rattus norvegicus
tatgagctaatcctttgtaatcccg

SEQ ID NO: 568005 - DNA, 25 bp, Rattus norvegicus
tatgagctaatcgtttgtaatcccg

SEQ ID NO: 568006 - DNA, 25 bp, Rattus norvegicus
tatgagctcgccctgttcctgctta

SEQ ID NO: 568007 - DNA, 25 bp, Rattus norvegicus
tatgagctcgccgtgttcctgctta

SEQ ID NO: 568008 - DNA, 25 bp, Rattus norvegicus
tatgagctgatcattgttgccccgc

SEQ ID NO: 568009 - DNA, 25 bp, Rattus norvegicus
tatgagctgatctttgttgccccgc

SEQ ID NO: 568010 - DNA, 25 bp, Rattus norvegicus
tatgagctgctcctactggtacaat

SEQ ID NO: 568011 - DNA, 25 bp, Rattus norvegicus
tatgagctgctcgtactggtacaat

SEQ ID NO: 568012 - DNA, 25 bp, Rattus norvegicus
tatgagctgctgacactgcacctgt

SEQ ID NO: 568013 - DNA, 25 bp, Rattus norvegicus
tatgagctgctgtcactgcacctgt

SEQ ID NO: 568014 - DNA, 25 bp, Rattus norvegicus
tatgagctgcttaccattgataaca

SEQ ID NO: 568015 - DNA, 25 bp, Rattus norvegicus
tatgagctgctttccattgataaca

SEQ ID NO: 568016 - DNA, 25 bp, Rattus norvegicus
tatgagcttctgacgcactgtattc

SEQ ID NO: 568017 - DNA, 25 bp, Rattus norvegicus
tatgagcttctgtcgcactgtattc

SEQ ID NO: 568018 - DNA, 25 bp, Rattus norvegicus
tatgagcttgtaatcctcgtgcttt

SEQ ID NO: 568019 - DNA, 25 bp, Rattus norvegicus
tatgagcttgtattcctcgtgcttt

SEQ ID NO: 568020 - DNA, 25 bp, Rattus norvegicus
tatgagctttgaaccaaaccttctc

SEQ ID NO: 568021 - DNA, 25 bp, Rattus norvegicus
tatgagctttgatccaaaccttctc

SEQ ID NO: 568022 - DNA, 25 bp, Rattus norvegicus
tatgaggaacccagtgcaagtcact

SEQ ID NO: 568023 - DNA, 25 bp, Rattus norvegicus
tatgaggaaccctgtgcaagtcact

SEQ ID NO: 568024 - DNA, 25 bp, Rattus norvegicus
tatgaggaagccatgtctctgccca

SEQ ID NO: 568025 - DNA, 25 bp, Rattus norvegicus
tatgaggaagccttgtctctgccca

SEQ ID NO: 568026 - DNA, 25 bp, Rattus norvegicus
tatgaggacatccaactggtatgtt

SEQ ID NO: 568027 - DNA, 25 bp, Rattus norvegicus
tatgaggacatcgaactggtatgtt

SEQ ID NO: 568028 - DNA, 25 bp, Rattus norvegicus
tatgaggactacctgtccatcctgt

SEQ ID NO: 568029 - DNA, 25 bp, Rattus norvegicus
tatgaggactacgtgtccatcctgt

SEQ ID NO: 568030 - DNA, 25 bp, Rattus norvegicus
tatgaggagattacgcccctgctct

SEQ ID NO: 568031 - DNA, 25 bp, Rattus norvegicus
tatgaggagatttcgcccctgctct

SEQ ID NO: 568032 - DNA, 25 bp, Rattus norvegicus
tatgaggagctgctgtcttccctag

SEQ ID NO: 568033 - DNA, 25 bp, Rattus norvegicus
tatgaggagctggtgtcttccctag

SEQ ID NO: 568034 - DNA, 25 bp, Rattus norvegicus
tatgaggaggcccacgcccagattg

SEQ ID NO: 568035 - DNA, 25 bp, Rattus norvegicus
tatgaggaggccgacgcccagattg

SEQ ID NO: 568036 - DNA, 25 bp, Rattus norvegicus
tatgaggatcatcaatttgagacca

SEQ ID NO: 568037 - DNA, 25 bp, Rattus norvegicus
tatgaggatcatgaatttgagacca

SEQ ID NO: 568038 - DNA, 25 bp, Rattus norvegicus
tatgaggatgcaactcttgctcttt

SEQ ID NO: 568039 - DNA, 25 bp, Rattus norvegicus
tatgaggatgcatctcttgctcttt

SEQ ID NO: 568040 - DNA, 25 bp, Rattus norvegicus
tatgaggcacctcccattaagtcac

SEQ ID NO: 568041 - DNA, 25 bp, Rattus norvegicus
tatgaggcacctgccattaagtcac

SEQ ID NO: 568042 - DNA, 25 bp, Rattus norvegicus
tatgaggcacttaaatctcacccct

SEQ ID NO: 568043 - DNA, 25 bp, Rattus norvegicus
tatgaggcactttaatctcacccct

SEQ ID NO: 568044 - DNA, 25 bp, Rattus norvegicus
tatgaggcaggacggcatctcttgc

SEQ ID NO: 568045 - DNA, 25 bp, Rattus norvegicus
tatgaggcaggagggcatctcttgc

SEQ ID NO: 568046 - DNA, 25 bp, Rattus norvegicus
tatgaggcagtacctggtcctgagc

SEQ ID NO: 568047 - DNA, 25 bp, Rattus norvegicus
tatgaggcagtagctggtcctgagc

SEQ ID NO: 568048 - DNA, 25 bp, Rattus norvegicus
tatgaggccattaaccacgggatcc

SEQ ID NO: 568049 - DNA, 25 bp, Rattus norvegicus
tatgaggccatttaccacgggatcc

SEQ ID NO: 568050 - DNA, 25 bp, Rattus norvegicus
tatgaggcctccctccgaattgaac

SEQ ID NO: 568051 - DNA, 25 bp, Rattus norvegicus
tatgaggcctccgtccgaattgaac

SEQ ID NO: 568052 - DNA, 25 bp, Rattus norvegicus
tatgaggctcccatgtgagggccaa

SEQ ID NO: 568053 - DNA, 25 bp, Rattus norvegicus
tatgaggctcccttgtgagggccaa

SEQ ID NO: 568054 - DNA, 25 bp, Rattus norvegicus
tatgaggctcctaggcattgtgaca

SEQ ID NO: 568055 - DNA, 25 bp, Rattus norvegicus
tatgaggctccttggcattgtgaca

SEQ ID NO: 568056 - DNA, 25 bp, Rattus norvegicus
tatgaggctgacaggctgactttgc

SEQ ID NO: 568057 - DNA, 25 bp, Rattus norvegicus
tatgaggctgactggctgactttgc

SEQ ID NO: 568058 - DNA, 25 bp, Rattus norvegicus
tatgaggctgcaactttgagctctc

SEQ ID NO: 568059 - DNA, 25 bp, Rattus norvegicus
tatgaggctgcatctttgagctctc

SEQ ID NO: 568060 - DNA, 25 bp, Rattus norvegicus
tatgaggctgtgagcgcctgccttt

SEQ ID NO: 568061 - DNA, 25 bp, Rattus norvegicus
tatgaggctgtgtgcgcctgccttt

SEQ ID NO: 568062 - DNA, 25 bp, Rattus norvegicus
tatgaggcttccatctctgggactc

SEQ ID NO: 568063 - DNA, 25 bp, Rattus norvegicus
tatgaggcttccttctctgggactc

SEQ ID NO: 568064 - DNA, 25 bp, Rattus norvegicus
tatgagggcaacaccttttctgctt

SEQ ID NO: 568065 - DNA, 25 bp, Rattus norvegicus
tatgagggcaactccttttctgctt

SEQ ID NO: 568066 - DNA, 25 bp, Rattus norvegicus
tatgagggctataacgtgcttccgg

SEQ ID NO: 568067 - DNA, 25 bp, Rattus norvegicus
tatgagggctattacgtgcttccgg

SEQ ID NO: 568068 - DNA, 25 bp, Rattus norvegicus
tatgagggtcaccattggccagtcc

SEQ ID NO: 568069 - DNA, 25 bp, Rattus norvegicus
tatgagggtcacgattggccagtcc

SEQ ID NO: 568070 - DNA, 25 bp, Rattus norvegicus
tatgagggtcctcagctagtagctg

SEQ ID NO: 568071 - DNA, 25 bp, Rattus norvegicus
tatgagggtcctccaaacccgaggc

SEQ ID NO: 568072 - DNA, 25 bp, Rattus norvegicus
tatgagggtcctgagctagtagctg

SEQ ID NO: 568073 - DNA, 25 bp, Rattus norvegicus
tatgagggtcctgcaaacccgaggc

SEQ ID NO: 568074 - DNA, 25 bp, Rattus norvegicus
tatgaggtcactacgtatcttacag

SEQ ID NO: 568075 - DNA, 25 bp, Rattus norvegicus
tatgaggtcacttcgtatcttacag

SEQ ID NO: 568076 - DNA, 25 bp, Rattus norvegicus
tatgaggtcccaccataccaggcca

SEQ ID NO: 568077 - DNA, 25 bp, Rattus norvegicus
tatgaggtcccagcataccaggcca

SEQ ID NO: 568078 - DNA, 25 bp, Rattus norvegicus
tatgaggtttgtatctacacccgtt

SEQ ID NO: 568079 - DNA, 25 bp, Rattus norvegicus
tatgaggtttgtttctacacccgtt

SEQ ID NO: 568080 - DNA, 25 bp, Rattus norvegicus
tatgagtacatcagtcttttggaca

SEQ ID NO: 568081 - DNA, 25 bp, Rattus norvegicus
tatgagtacatctgtcttttggaca

SEQ ID NO: 568082 - DNA, 25 bp, Rattus norvegicus
tatgagtcaagccagtctgatctac

SEQ ID NO: 568083 - DNA, 25 bp, Rattus norvegicus
tatgagtcaagcgagtctgatctac

SEQ ID NO: 568084 - DNA, 25 bp, Rattus norvegicus
tatgagtctggtcacctgggttgca

SEQ ID NO: 568085 - DNA, 25 bp, Rattus norvegicus
tatgagtctggtgacctgggttgca

SEQ ID NO: 568086 - DNA, 25 bp, Rattus norvegicus
tatgagtgcatcagcggacctgaca

SEQ ID NO: 568087 - DNA, 25 bp, Rattus norvegicus
tatgagtgcatctgcggacctgaca

SEQ ID NO: 568088 - DNA, 25 bp, Rattus norvegicus
tatgagtgttccatctatgtgctgc

SEQ ID NO: 568089 - DNA, 25 bp, Rattus norvegicus
tatgagtgttccttctatgtgctgc

SEQ ID NO: 568090 - DNA, 25 bp, Rattus norvegicus
tatgagttcaaaaggcaggcagtgc

SEQ ID NO: 568091 - DNA, 25 bp, Rattus norvegicus
tatgagttcaaatggcaggcagtgc

SEQ ID NO: 568092 - DNA, 25 bp, Rattus norvegicus
tatgagttgcccaccagctgtagga

SEQ ID NO: 568093 - DNA, 25 bp, Rattus norvegicus
tatgagttgccctccagctgtagga

SEQ ID NO: 568094 - DNA, 25 bp, Rattus norvegicus
tatgagttgggcattgtaaatgcag

SEQ ID NO: 568095 - DNA, 25 bp, Rattus norvegicus
tatgagttgggctttgtaaatgcag

SEQ ID NO: 568096 - DNA, 25 bp, Rattus norvegicus
tatgagttgttgattctagcggatt

SEQ ID NO: 568097 - DNA, 25 bp, Rattus norvegicus
tatgagttgttgtttctagcggatt

SEQ ID NO: 568098 - DNA, 25 bp, Rattus norvegicus
tatgataaccctcaactatgtcgcc

SEQ ID NO: 568099 - DNA, 25 bp, Rattus norvegicus
tatgataaccctgaactatgtcgcc

SEQ ID NO: 568100 - DNA, 25 bp, Rattus norvegicus
tatgataagcagagacgttggtctc

SEQ ID NO: 568101 - DNA, 25 bp, Rattus norvegicus
tatgataagcagtgacgttggtctc

SEQ ID NO: 568102 - DNA, 25 bp, Rattus norvegicus
tatgataagcctattttcccagcca

SEQ ID NO: 568103 - DNA, 25 bp, Rattus norvegicus
tatgataagccttttttcccagcca

SEQ ID NO: 568104 - DNA, 25 bp, Rattus norvegicus
tatgataaggtcatccggtgccttc

SEQ ID NO: 568105 - DNA, 25 bp, Rattus norvegicus
tatgataaggtcttccggtgccttc

SEQ ID NO: 568106 - DNA, 25 bp, Rattus norvegicus
tatgatacacccagtgttgaccggc

SEQ ID NO: 568107 - DNA, 25 bp, Rattus norvegicus
tatgatacaccctgtgttgaccggc

SEQ ID NO: 568108 - DNA, 25 bp, Rattus norvegicus
tatgatacactcacatctatggaca

SEQ ID NO: 568109 - DNA, 25 bp, Rattus norvegicus
tatgatacactctcatctatggaca

SEQ ID NO: 568110 - DNA, 25 bp, Rattus norvegicus
tatgatacccagactttatttttaa

SEQ ID NO: 568111 - DNA, 25 bp, Rattus norvegicus
tatgatacccagtctttatttttaa

SEQ ID NO: 568112 - DNA, 25 bp, Rattus norvegicus
tatgatacctccaagtgttttccct

SEQ ID NO: 568113 - DNA, 25 bp, Rattus norvegicus
tatgatacctcctagtgttttccct

SEQ ID NO: 568114 - DNA, 25 bp, Rattus norvegicus
tatgatacgggtctcttgggtctgt

SEQ ID NO: 568115 - DNA, 25 bp, Rattus norvegicus
tatgatacgggtgtcttgggtctgt

SEQ ID NO: 568116 - DNA, 25 bp, Rattus norvegicus
tatgatatccatattccagaattgt

SEQ ID NO: 568117 - DNA, 25 bp, Rattus norvegicus
tatgatatccattttccagaattgt

SEQ ID NO: 568118 - DNA, 25 bp, Rattus norvegicus
tatgatatcccacctagtgtggccg

SEQ ID NO: 568119 - DNA, 25 bp, Rattus norvegicus
tatgatatcccagctagtgtggccg

SEQ ID NO: 568120 - DNA, 25 bp, Rattus norvegicus
tatgatatccccagaggctcttgga

SEQ ID NO: 568121 - DNA, 25 bp, Rattus norvegicus
tatgatatcccctgaggctcttgga

SEQ ID NO: 568122 - DNA, 25 bp, Rattus norvegicus
tatgatatgacccaagtgctttcca

SEQ ID NO: 568123 - DNA, 25 bp, Rattus norvegicus
tatgatatgaccgaagtgctttcca

SEQ ID NO: 568124 - DNA, 25 bp, Rattus norvegicus
tatgatatgtccaaaatgtccccag

SEQ ID NO: 568125 - DNA, 25 bp, Rattus norvegicus
tatgatatgtcctaaatgtccccag

SEQ ID NO: 568126 - DNA, 25 bp, Rattus norvegicus
tatgatattgttagcttcctccctg

SEQ ID NO: 568127 - DNA, 25 bp, Rattus norvegicus
tatgatattgtttgcttcctccctg

SEQ ID NO: 568128 - DNA, 25 bp, Rattus norvegicus
tatgatcaagacacggaactggttt

SEQ ID NO: 568129 - DNA, 25 bp, Rattus norvegicus
tatgatcaagactcggaactggttt

SEQ ID NO: 568130 - DNA, 25 bp, Rattus norvegicus
tatgatcacaacatgggtcctgcca

SEQ ID NO: 568131 - DNA, 25 bp, Rattus norvegicus
tatgatcacaacttgggtcctgcca

SEQ ID NO: 568132 - DNA, 25 bp, Rattus norvegicus
tatgatcattatcttcctggcccac

SEQ ID NO: 568133 - DNA, 25 bp, Rattus norvegicus
tatgatcattatgttcctggcccac

SEQ ID NO: 568134 - DNA, 25 bp, Rattus norvegicus
tatgatcccagtcgctgagcggagt

SEQ ID NO: 568135 - DNA, 25 bp, Rattus norvegicus
tatgatcccagtggctgagcggagt

SEQ ID NO: 568136 - DNA, 25 bp, Rattus norvegicus
tatgatcccggaatgtttgtaagca

SEQ ID NO: 568137 - DNA, 25 bp, Rattus norvegicus
tatgatcccggattgtttgtaagca

SEQ ID NO: 568138 - DNA, 25 bp, Rattus norvegicus
tatgatccctgacatctccatttgg

SEQ ID NO: 568139 - DNA, 25 bp, Rattus norvegicus
tatgatccctgagatctccatttgg

SEQ ID NO: 568140 - DNA, 25 bp, Rattus norvegicus
tatgatcctgtgagtggtactgacg

SEQ ID NO: 568141 - DNA, 25 bp, Rattus norvegicus
tatgatcctgtgtgtggtactgacg

SEQ ID NO: 568142 - DNA, 25 bp, Rattus norvegicus
tatgatcggttgaaggaatccttca

SEQ ID NO: 568143 - DNA, 25 bp, Rattus norvegicus
tatgatcggttgtaggaatccttca

SEQ ID NO: 568144 - DNA, 25 bp, Rattus norvegicus
tatgatcgtggtaagtcctctgtgg

SEQ ID NO: 568145 - DNA, 25 bp, Rattus norvegicus
tatgatcgtggttagtcctctgtgg

SEQ ID NO: 568146 - DNA, 25 bp, Rattus norvegicus
tatgatctaccaaagccctctgtgc

SEQ ID NO: 568147 - DNA, 25 bp, Rattus norvegicus
tatgatctaccatagccctctgtgc

SEQ ID NO: 568148 - DNA, 25 bp, Rattus norvegicus
tatgatctccaaacggccagagcac

SEQ ID NO: 568149 - DNA, 25 bp, Rattus norvegicus
tatgatctccaatcggccagagcac

SEQ ID NO: 568150 - DNA, 25 bp, Rattus norvegicus
tatgatctgaagagcctgaccacct

SEQ ID NO: 568151 - DNA, 25 bp, Rattus norvegicus
tatgatctgaagtgcctgaccacct

SEQ ID NO: 568152 - DNA, 25 bp, Rattus norvegicus
tatgatctggcacttacactcacag

SEQ ID NO: 568153 - DNA, 25 bp, Rattus norvegicus
tatgatctggcagttacactcacag

SEQ ID NO: 568154 - DNA, 25 bp, Rattus norvegicus
tatgatctgtgtccagctgtctgct

SEQ ID NO: 568155 - DNA, 25 bp, Rattus norvegicus
tatgatctgtgtgcagctgtctgct

SEQ ID NO: 568156 - DNA, 25 bp, Rattus norvegicus
tatgatcttcataatcccctccaat

SEQ ID NO: 568157 - DNA, 25 bp, Rattus norvegicus
tatgatcttcattatcccctccaat

SEQ ID NO: 568158 - DNA, 25 bp, Rattus norvegicus
tatgatcttttacctactcactggc

SEQ ID NO: 568159 - DNA, 25 bp, Rattus norvegicus
tatgatcttttagctactcactggc

SEQ ID NO: 568160 - DNA, 25 bp, Rattus norvegicus
tatgatgagcaacggcagcctttaa

SEQ ID NO: 568161 - DNA, 25 bp, Rattus norvegicus
tatgatgagcaagggcagcctttaa

SEQ ID NO: 568162 - DNA, 25 bp, Rattus norvegicus
tatgatgagtctaaggcctgcaccg

SEQ ID NO: 568163 - DNA, 25 bp, Rattus norvegicus
tatgatgagtcttaggcctgcaccg

SEQ ID NO: 568164 - DNA, 25 bp, Rattus norvegicus
tatgatgatactatctctgtgagat

SEQ ID NO: 568165 - DNA, 25 bp, Rattus norvegicus
tatgatgatactttctctgtgagat

SEQ ID NO: 568166 - DNA, 25 bp, Rattus norvegicus
tatgatgatggcagcggaaatgact

SEQ ID NO: 568167 - DNA, 25 bp, Rattus norvegicus
tatgatgatggctgcggaaatgact

SEQ ID NO: 568168 - DNA, 25 bp, Rattus norvegicus
tatgatgattggatgcatctgcatc

SEQ ID NO: 568169 - DNA, 25 bp, Rattus norvegicus
tatgatgattggttgcatctgcatc

SEQ ID NO: 568170 - DNA, 25 bp, Rattus norvegicus
tatgatgcagccacggtttccgtta

SEQ ID NO: 568171 - DNA, 25 bp, Rattus norvegicus
tatgatgcagcctcggtttccgtta

SEQ ID NO: 568172 - DNA, 25 bp, Rattus norvegicus
tatgatgcgttcaagatctaccgaa

SEQ ID NO: 568173 - DNA, 25 bp, Rattus norvegicus
tatgatgcgttctagatctaccgaa

SEQ ID NO: 568174 - DNA, 25 bp, Rattus norvegicus
tatgatgctattagtcaatggaggg

SEQ ID NO: 568175 - DNA, 25 bp, Rattus norvegicus
tatgatgctatttgtcaatggaggg

SEQ ID NO: 568176 - DNA, 25 bp, Rattus norvegicus
tatgatgctctcaaggcaggcgatc

SEQ ID NO: 568177 - DNA, 25 bp, Rattus norvegicus
tatgatgctctctaggcaggcgatc

SEQ ID NO: 568178 - DNA, 25 bp, Rattus norvegicus
tatgatgcttggcttcattcgcacc

SEQ ID NO: 568179 - DNA, 25 bp, Rattus norvegicus
tatgatgcttgggttcattcgcacc

SEQ ID NO: 568180 - DNA, 25 bp, Rattus norvegicus
tatgatggcatgactacactcggag

SEQ ID NO: 568181 - DNA, 25 bp, Rattus norvegicus
tatgatggcatgtctacactcggag

SEQ ID NO: 568182 - DNA, 25 bp, Rattus norvegicus
tatgatggctcacatctgctcactc

SEQ ID NO: 568183 - DNA, 25 bp, Rattus norvegicus
tatgatggctcagatctgctcactc

SEQ ID NO: 568184 - DNA, 25 bp, Rattus norvegicus
tatgatggtcctcatggtcacgtgc

SEQ ID NO: 568185 - DNA, 25 bp, Rattus norvegicus
tatgatggtcctgatggtcacgtgc

SEQ ID NO: 568186 - DNA, 25 bp, Rattus norvegicus
tatgatggtgtgagcccttcttctc

SEQ ID NO: 568187 - DNA, 25 bp, Rattus norvegicus
tatgatggtgtgtgcccttcttctc

SEQ ID NO: 568188 - DNA, 25 bp, Rattus norvegicus
tatgatggttggacggaactggttt

SEQ ID NO: 568189 - DNA, 25 bp, Rattus norvegicus
tatgatggttggtcggaactggttt

SEQ ID NO: 568190 - DNA, 25 bp, Rattus norvegicus
tatgatgtagagatccgcctctccc

SEQ ID NO: 568191 - DNA, 25 bp, Rattus norvegicus
tatgatgtagagttccgcctctccc

SEQ ID NO: 568192 - DNA, 25 bp, Rattus norvegicus
tatgatgtcagtccttcagtgccag

SEQ ID NO: 568193 - DNA, 25 bp, Rattus norvegicus
tatgatgtcagtgcttcagtgccag

SEQ ID NO: 568194 - DNA, 25 bp, Rattus norvegicus
tatgatgtccagaatttcccaaaat

SEQ ID NO: 568195 - DNA, 25 bp, Rattus norvegicus
tatgatgtccagcaccgattccgca

SEQ ID NO: 568196 - DNA, 25 bp, Rattus norvegicus
tatgatgtccaggaccgattccgca

SEQ ID NO: 568197 - DNA, 25 bp, Rattus norvegicus
tatgatgtccagtatttcccaaaat

SEQ ID NO: 568198 - DNA, 25 bp, Rattus norvegicus
tatgatgtgatcacactctggcccc

SEQ ID NO: 568199 - DNA, 25 bp, Rattus norvegicus
tatgatgtgatctcactctggcccc

SEQ ID NO: 568200 - DNA, 25 bp, Rattus norvegicus
tatgatgtgctcattgtcgactaaa

SEQ ID NO: 568201 - DNA, 25 bp, Rattus norvegicus
tatgatgtgctctttgtcgactaaa

SEQ ID NO: 568202 - DNA, 25 bp, Rattus norvegicus
tatgatgtggccagtctagacaagc

SEQ ID NO: 568203 - DNA, 25 bp, Rattus norvegicus
tatgatgtggcctgtctagacaagc

SEQ ID NO: 568204 - DNA, 25 bp, Rattus norvegicus
tatgattaacctcctgatgcagctt

SEQ ID NO: 568205 - DNA, 25 bp, Rattus norvegicus
tatgattaacctgctgatgcagctt

SEQ ID NO: 568206 - DNA, 25 bp, Rattus norvegicus
tatgattaactcaggatacctgggc

SEQ ID NO: 568207 - DNA, 25 bp, Rattus norvegicus
tatgattaactctggatacctgggc

SEQ ID NO: 568208 - DNA, 25 bp, Rattus norvegicus
tatgattaacttcccctctgaatga

SEQ ID NO: 568209 - DNA, 25 bp, Rattus norvegicus
tatgattaacttgccctctgaatga

SEQ ID NO: 568210 - DNA, 25 bp, Rattus norvegicus
tatgattagcatcttcagcctcccc

SEQ ID NO: 568211 - DNA, 25 bp, Rattus norvegicus
tatgattagcatgttcagcctcccc

SEQ ID NO: 568212 - DNA, 25 bp, Rattus norvegicus
tatgattcgggaaccaagcgctctc

SEQ ID NO: 568213 - DNA, 25 bp, Rattus norvegicus
tatgattcgggatccaagcgctctc

SEQ ID NO: 568214 - DNA, 25 bp, Rattus norvegicus
tatgattctggaagcctgtctatct

SEQ ID NO: 568215 - DNA, 25 bp, Rattus norvegicus
tatgattctggatgcctgtctatct

SEQ ID NO: 568216 - DNA, 25 bp, Rattus norvegicus
tatgattggcacagcctccgagtcg

SEQ ID NO: 568217 - DNA, 25 bp, Rattus norvegicus
tatgattggcactgcctccgagtcg

SEQ ID NO: 568218 - DNA, 25 bp, Rattus norvegicus
tatgattggcttctgtcttacacac

SEQ ID NO: 568219 - DNA, 25 bp, Rattus norvegicus
tatgattggcttgtgtcttacacac

SEQ ID NO: 568220 - DNA, 25 bp, Rattus norvegicus
tatgattgtagcatcctctttcctc

SEQ ID NO: 568221 - DNA, 25 bp, Rattus norvegicus
tatgattgtagcttcctctttcctc

SEQ ID NO: 568222 - DNA, 25 bp, Rattus norvegicus
tatgattgtcctactgcctcagatc

SEQ ID NO: 568223 - DNA, 25 bp, Rattus norvegicus
tatgattgtccttctgcctcagatc

SEQ ID NO: 568224 - DNA, 25 bp, Rattus norvegicus
tatgattttgagcacgactgtgaca

SEQ ID NO: 568225 - DNA, 25 bp, Rattus norvegicus
tatgattttgaggacgactgtgaca

SEQ ID NO: 568226 - DNA, 25 bp, Rattus norvegicus
tatgatttttgtctttcctgcactg

SEQ ID NO: 568227 - DNA, 25 bp, Rattus norvegicus
tatgatttttgtgtttcctgcactg

SEQ ID NO: 568228 - DNA, 25 bp, Rattus norvegicus
tatgcaaacaatcttcaggcagcaa

SEQ ID NO: 568229 - DNA, 25 bp, Rattus norvegicus
tatgcaaacaatgttcaggcagcaa

SEQ ID NO: 568230 - DNA, 25 bp, Rattus norvegicus
tatgcaaactggatcctggcccaga

SEQ ID NO: 568231 - DNA, 25 bp, Rattus norvegicus
tatgcaaactggttcctggcccaga

SEQ ID NO: 568232 - DNA, 25 bp, Rattus norvegicus
tatgcaaagcttaccttcacagtaa

SEQ ID NO: 568233 - DNA, 25 bp, Rattus norvegicus
tatgcaaagcttcttccgtaaccga

SEQ ID NO: 568234 - DNA, 25 bp, Rattus norvegicus
tatgcaaagcttgttccgtaaccga

SEQ ID NO: 568235 - DNA, 25 bp, Rattus norvegicus
tatgcaaagctttccttcacagtaa

SEQ ID NO: 568236 - DNA, 25 bp, Rattus norvegicus
tatgcaaagtaaatgtttcctaacc

SEQ ID NO: 568237 - DNA, 25 bp, Rattus norvegicus
tatgcaaagtaattgtttcctaacc

SEQ ID NO: 568238 - DNA, 25 bp, Rattus norvegicus
tatgcaaatggcaggtcccacattc

SEQ ID NO: 568239 - DNA, 25 bp, Rattus norvegicus
tatgcaaatggctggtcccacattc

SEQ ID NO: 568240 - DNA, 25 bp, Rattus norvegicus
tatgcaacaaagaggccaatccgcc

SEQ ID NO: 568241 - DNA, 25 bp, Rattus norvegicus
tatgcaacaaagtggccaatccgcc

SEQ ID NO: 568242 - DNA, 25 bp, Rattus norvegicus
tatgcaacgcacagacacttttgga

SEQ ID NO: 568243 - DNA, 25 bp, Rattus norvegicus
tatgcaacgcactgacacttttgga

SEQ ID NO: 568244 - DNA, 25 bp, Rattus norvegicus
tatgcaagatgcctacttcctgcta

SEQ ID NO: 568245 - DNA, 25 bp, Rattus norvegicus
tatgcaagatgcgtacttcctgcta

SEQ ID NO: 568246 - DNA, 25 bp, Rattus norvegicus
tatgcaagcaggcagactctggcct

SEQ ID NO: 568247 - DNA, 25 bp, Rattus norvegicus
tatgcaagcagggagactctggcct

SEQ ID NO: 568248 - DNA, 25 bp, Rattus norvegicus
tatgcaaggactcgctctagattct

SEQ ID NO: 568249 - DNA, 25 bp, Rattus norvegicus
tatgcaaggactggctctagattct

SEQ ID NO: 568250 - DNA, 25 bp, Rattus norvegicus
tatgcaaggaggactcactgctctg

SEQ ID NO: 568251 - DNA, 25 bp, Rattus norvegicus
tatgcaaggaggtctcactgctctg

SEQ ID NO: 568252 - DNA, 25 bp, Rattus norvegicus
tatgcaaggattactcatgctgaac

SEQ ID NO: 568253 - DNA, 25 bp, Rattus norvegicus
tatgcaaggatttctcatgctgaac

SEQ ID NO: 568254 - DNA, 25 bp, Rattus norvegicus
tatgcaaggcaactttcctctgtgc

SEQ ID NO: 568255 - DNA, 25 bp, Rattus norvegicus
tatgcaaggcaagtttcctctgtgc

SEQ ID NO: 568256 - DNA, 25 bp, Rattus norvegicus
tatgcaaggctgacccatcgtggct

SEQ ID NO: 568257 - DNA, 25 bp, Rattus norvegicus
tatgcaaggctgtcccatcgtggct

SEQ ID NO: 568258 - DNA, 25 bp, Rattus norvegicus
tatgcaatacctccttatatcatgt

SEQ ID NO: 568259 - DNA, 25 bp, Rattus norvegicus
tatgcaatacctgcttatatcatgt

SEQ ID NO: 568260 - DNA, 25 bp, Rattus norvegicus
tatgcaatagctctacagaatacta

SEQ ID NO: 568261 - DNA, 25 bp, Rattus norvegicus
tatgcaatagctgtacagaatacta

SEQ ID NO: 568262 - DNA, 25 bp, Rattus norvegicus
tatgcaatatgcaccgtgacccttc

SEQ ID NO: 568263 - DNA, 25 bp, Rattus norvegicus
tatgcaatatgctccgtgacccttc

SEQ ID NO: 568264 - DNA, 25 bp, Rattus norvegicus
tatgcaatcttgacagaggccgact

SEQ ID NO: 568265 - DNA, 25 bp, Rattus norvegicus
tatgcaatcttgtcagaggccgact

SEQ ID NO: 568266 - DNA, 25 bp, Rattus norvegicus
tatgcaattagtccatcttgccggc

SEQ ID NO: 568267 - DNA, 25 bp, Rattus norvegicus
tatgcaattagtgcatcttgccggc

SEQ ID NO: 568268 - DNA, 25 bp, Rattus norvegicus
tatgcacaaggcaacagtcagaaca

SEQ ID NO: 568269 - DNA, 25 bp, Rattus norvegicus
tatgcacaaggctacagtcagaaca

SEQ ID NO: 568270 - DNA, 25 bp, Rattus norvegicus
tatgcacacaataacacacctacac

SEQ ID NO: 568271 - DNA, 25 bp, Rattus norvegicus
tatgcacacaattacacacctacac

SEQ ID NO: 568272 - DNA, 25 bp, Rattus norvegicus
tatgcacacattccgaacttctgcc

SEQ ID NO: 568273 - DNA, 25 bp, Rattus norvegicus
tatgcacacattgcgaacttctgcc

SEQ ID NO: 568274 - DNA, 25 bp, Rattus norvegicus
tatgcacaccaacgccatactaaac

SEQ ID NO: 568275 - DNA, 25 bp, Rattus norvegicus
tatgcacaccaaggccatactaaac

SEQ ID NO: 568276 - DNA, 25 bp, Rattus norvegicus
tatgcacactgcaccaagtgggact

SEQ ID NO: 568277 - DNA, 25 bp, Rattus norvegicus
tatgcacactgctccaagtgggact

SEQ ID NO: 568278 - DNA, 25 bp, Rattus norvegicus
tatgcacactggctttctccgcagg

SEQ ID NO: 568279 - DNA, 25 bp, Rattus norvegicus
tatgcacactgggtttctccgcagg

SEQ ID NO: 568280 - DNA, 25 bp, Rattus norvegicus
tatgcacagtacatccagggagacc

SEQ ID NO: 568281 - DNA, 25 bp, Rattus norvegicus
tatgcacagtacttccagggagacc

SEQ ID NO: 568282 - DNA, 25 bp, Rattus norvegicus
tatgcacataagaatcccctactct

SEQ ID NO: 568283 - DNA, 25 bp, Rattus norvegicus
tatgcacataagtatcccctactct

SEQ ID NO: 568284 - DNA, 25 bp, Rattus norvegicus
tatgcacatattaatccctctaatt

SEQ ID NO: 568285 - DNA, 25 bp, Rattus norvegicus
tatgcacatatttatccctctaatt

SEQ ID NO: 568286 - DNA, 25 bp, Rattus norvegicus
tatgcacatgaaaggctttgctagc

SEQ ID NO: 568287 - DNA, 25 bp, Rattus norvegicus
tatgcacatgaactgtcctcagccc

SEQ ID NO: 568288 - DNA, 25 bp, Rattus norvegicus
tatgcacatgaagtgtcctcagccc

SEQ ID NO: 568289 - DNA, 25 bp, Rattus norvegicus
tatgcacatgaatggctttgctagc

SEQ ID NO: 568290 - DNA, 25 bp, Rattus norvegicus
tatgcacatgtgacgtgcgcactga

SEQ ID NO: 568291 - DNA, 25 bp, Rattus norvegicus
tatgcacatgtgtcgtgcgcactga

SEQ ID NO: 568292 - DNA, 25 bp, Rattus norvegicus
tatgcacattttctaaccaggtccc

SEQ ID NO: 568293 - DNA, 25 bp, Rattus norvegicus
tatgcacattttgtaaccaggtccc

SEQ ID NO: 568294 - DNA, 25 bp, Rattus norvegicus
tatgcaccaactagtgatgtccccg

SEQ ID NO: 568295 - DNA, 25 bp, Rattus norvegicus
tatgcaccaacttgtgatgtccccg

SEQ ID NO: 568296 - DNA, 25 bp, Rattus norvegicus
tatgcaccactaattaatttctcag

SEQ ID NO: 568297 - DNA, 25 bp, Rattus norvegicus
tatgcaccactatttaatttctcag

SEQ ID NO: 568298 - DNA, 25 bp, Rattus norvegicus
tatgcacccagcaatctttgggctt

SEQ ID NO: 568299 - DNA, 25 bp, Rattus norvegicus
tatgcacccagcagagggctcttga

SEQ ID NO: 568300 - DNA, 25 bp, Rattus norvegicus
tatgcacccagctatctttgggctt

SEQ ID NO: 568301 - DNA, 25 bp, Rattus norvegicus
tatgcacccagctgagggctcttga

SEQ ID NO: 568302 - DNA, 25 bp, Rattus norvegicus
tatgcacccgagaggctgtttcttc

SEQ ID NO: 568303 - DNA, 25 bp, Rattus norvegicus
tatgcacccgagtggctgtttcttc

SEQ ID NO: 568304 - DNA, 25 bp, Rattus norvegicus
tatgcacctgagactgattttgtat

SEQ ID NO: 568305 - DNA, 25 bp, Rattus norvegicus
tatgcacctgagtctgattttgtat

SEQ ID NO: 568306 - DNA, 25 bp, Rattus norvegicus
tatgcacgtggacagaccgggatac

SEQ ID NO: 568307 - DNA, 25 bp, Rattus norvegicus
tatgcacgtggagagaccgggatac

SEQ ID NO: 568308 - DNA, 25 bp, Rattus norvegicus
tatgcacgtttcatctacacctata

SEQ ID NO: 568309 - DNA, 25 bp, Rattus norvegicus
tatgcacgtttcttctacacctata

SEQ ID NO: 568310 - DNA, 25 bp, Rattus norvegicus
tatgcactacgtcttccgggtggtt

SEQ ID NO: 568311 - DNA, 25 bp, Rattus norvegicus
tatgcactacgtgttccgggtggtt

SEQ ID NO: 568312 - DNA, 25 bp, Rattus norvegicus
tatgcactcgcaatagctctgaggc

SEQ ID NO: 568313 - DNA, 25 bp, Rattus norvegicus
tatgcactcgcattagctctgaggc

SEQ ID NO: 568314 - DNA, 25 bp, Rattus norvegicus
tatgcactctatccactcggagtat

SEQ ID NO: 568315 - DNA, 25 bp, Rattus norvegicus
tatgcactctatgcactcggagtat

SEQ ID NO: 568316 - DNA, 25 bp, Rattus norvegicus
tatgcactctgcaaacaacgcggtg

SEQ ID NO: 568317 - DNA, 25 bp, Rattus norvegicus
tatgcactctgctaacaacgcggtg

SEQ ID NO: 568318 - DNA, 25 bp, Rattus norvegicus
tatgcactgtccactgtagccctaa

SEQ ID NO: 568319 - DNA, 25 bp, Rattus norvegicus
tatgcactgtcctctgtagccctaa

SEQ ID NO: 568320 - DNA, 25 bp, Rattus norvegicus
tatgcactgtggcttgcggctgtca

SEQ ID NO: 568321 - DNA, 25 bp, Rattus norvegicus
tatgcactgtgggttgcggctgtca

SEQ ID NO: 568322 - DNA, 25 bp, Rattus norvegicus
tatgcacttcgtatctctgctgtgt

SEQ ID NO: 568323 - DNA, 25 bp, Rattus norvegicus
tatgcacttcgtttctctgctgtgt

SEQ ID NO: 568324 - DNA, 25 bp, Rattus norvegicus
tatgcacttgatacgctgttccagc

SEQ ID NO: 568325 - DNA, 25 bp, Rattus norvegicus
tatgcacttgattcgctgttccagc

SEQ ID NO: 568326 - DNA, 25 bp, Rattus norvegicus
tatgcacttgtaactagccagcgtt

SEQ ID NO: 568327 - DNA, 25 bp, Rattus norvegicus
tatgcacttgtatctagccagcgtt

SEQ ID NO: 568328 - DNA, 25 bp, Rattus norvegicus
tatgcagaaaggctacagtcccaaa

SEQ ID NO: 568329 - DNA, 25 bp, Rattus norvegicus
tatgcagaaagggtacagtcccaaa

SEQ ID NO: 568330 - DNA, 25 bp, Rattus norvegicus
tatgcagaatgtcaacctctctggc

SEQ ID NO: 568331 - DNA, 25 bp, Rattus norvegicus
tatgcagaatgtgaacctctctggc

SEQ ID NO: 568332 - DNA, 25 bp, Rattus norvegicus
tatgcagacacactgcacgcacaca

SEQ ID NO: 568333 - DNA, 25 bp, Rattus norvegicus
tatgcagacacagtgcacgcacaca

SEQ ID NO: 568334 - DNA, 25 bp, Rattus norvegicus
tatgcagacgagaacctccagctgg

SEQ ID NO: 568335 - DNA, 25 bp, Rattus norvegicus
tatgcagacgagtacctccagctgg

SEQ ID NO: 568336 - DNA, 25 bp, Rattus norvegicus
tatgcagacgttcaaggactagttt

SEQ ID NO: 568337 - DNA, 25 bp, Rattus norvegicus
tatgcagacgttgaaggactagttt

SEQ ID NO: 568338 - DNA, 25 bp, Rattus norvegicus
tatgcagagttcctgatggccaagt

SEQ ID NO: 568339 - DNA, 25 bp, Rattus norvegicus
tatgcagagttcgtgatggccaagt

SEQ ID NO: 568340 - DNA, 25 bp, Rattus norvegicus
tatgcagagtttagttttacggtcc

SEQ ID NO: 568341 - DNA, 25 bp, Rattus norvegicus
tatgcagagttttgttttacggtcc

SEQ ID NO: 568342 - DNA, 25 bp, Rattus norvegicus
tatgcagatcccacagaagcatggg

SEQ ID NO: 568343 - DNA, 25 bp, Rattus norvegicus
tatgcagatccctcagaagcatggg

SEQ ID NO: 568344 - DNA, 25 bp, Rattus norvegicus
tatgcagatcgcctggtctcgggaa

SEQ ID NO: 568345 - DNA, 25 bp, Rattus norvegicus
tatgcagatcgcgtggtctcgggaa

SEQ ID NO: 568346 - DNA, 25 bp, Rattus norvegicus
tatgcagcaaggaatagcgctcagt

SEQ ID NO: 568347 - DNA, 25 bp, Rattus norvegicus
tatgcagcaaggtatagcgctcagt

SEQ ID NO: 568348 - DNA, 25 bp, Rattus norvegicus
tatgcagcacgcattcaaactcttc

SEQ ID NO: 568349 - DNA, 25 bp, Rattus norvegicus
tatgcagcacgctttcaaactcttc

SEQ ID NO: 568350 - DNA, 25 bp, Rattus norvegicus
tatgcagcacggcttctttcttttc

SEQ ID NO: 568351 - DNA, 25 bp, Rattus norvegicus
tatgcagcacgggttctttcttttc

SEQ ID NO: 568352 - DNA, 25 bp, Rattus norvegicus
tatgcagcaggtccctgtataccta

SEQ ID NO: 568353 - DNA, 25 bp, Rattus norvegicus
tatgcagcaggtgcctgtataccta

SEQ ID NO: 568354 - DNA, 25 bp, Rattus norvegicus
tatgcagccagtctttgttgaccct

SEQ ID NO: 568355 - DNA, 25 bp, Rattus norvegicus
tatgcagccagtgtttgttgaccct

SEQ ID NO: 568356 - DNA, 25 bp, Rattus norvegicus
tatgcagcccatcctgtgagagcca

SEQ ID NO: 568357 - DNA, 25 bp, Rattus norvegicus
tatgcagcccatgctgtgagagcca

SEQ ID NO: 568358 - DNA, 25 bp, Rattus norvegicus
tatgcagcctttaccagctgtacag

SEQ ID NO: 568359 - DNA, 25 bp, Rattus norvegicus
tatgcagccttttccagctgtacag

SEQ ID NO: 568360 - DNA, 25 bp, Rattus norvegicus
tatgcagctccgcttgtgagcaccg

SEQ ID NO: 568361 - DNA, 25 bp, Rattus norvegicus
tatgcagctccggttgtgagcaccg

SEQ ID NO: 568362 - DNA, 25 bp, Rattus norvegicus
tatgcagctggaagtgcttgctccc

SEQ ID NO: 568363 - DNA, 25 bp, Rattus norvegicus
tatgcagctggatgtgcttgctccc

SEQ ID NO: 568364 - DNA, 25 bp, Rattus norvegicus
tatgcaggaatccacctagctgtct

SEQ ID NO: 568365 - DNA, 25 bp, Rattus norvegicus
tatgcaggaatcgacctagctgtct

SEQ ID NO: 568366 - DNA, 25 bp, Rattus norvegicus
tatgcaggatgcacatcaccctgga

SEQ ID NO: 568367 - DNA, 25 bp, Rattus norvegicus
tatgcaggatgctcatcaccctgga

SEQ ID NO: 568368 - DNA, 25 bp, Rattus norvegicus
tatgcaggctagaagcttttgggac

SEQ ID NO: 568369 - DNA, 25 bp, Rattus norvegicus
tatgcaggctagtagcttttgggac

SEQ ID NO: 568370 - DNA, 25 bp, Rattus norvegicus
tatgcagtagaaccagagccgcccg

SEQ ID NO: 568371 - DNA, 25 bp, Rattus norvegicus
tatgcagtagaagcagagccgcccg

SEQ ID NO: 568372 - DNA, 25 bp, Rattus norvegicus
tatgcagtattaaagggaagccctt

SEQ ID NO: 568373 - DNA, 25 bp, Rattus norvegicus
tatgcagtattatagggaagccctt

SEQ ID NO: 568374 - DNA, 25 bp, Rattus norvegicus
tatgcagtcactaagaaattgcccc

SEQ ID NO: 568375 - DNA, 25 bp, Rattus norvegicus
tatgcagtcacttagaaattgcccc

SEQ ID NO: 568376 - DNA, 25 bp, Rattus norvegicus
tatgcagtcatgatacatccctaat

SEQ ID NO: 568377 - DNA, 25 bp, Rattus norvegicus
tatgcagtcatgttacatccctaat

SEQ ID NO: 568378 - DNA, 25 bp, Rattus norvegicus
tatgcagtcattaaaagctgagctg

SEQ ID NO: 568379 - DNA, 25 bp, Rattus norvegicus
tatgcagtcatttaaagctgagctg

SEQ ID NO: 568380 - DNA, 25 bp, Rattus norvegicus
tatgcagtccagaagtaaaaatcaa

SEQ ID NO: 568381 - DNA, 25 bp, Rattus norvegicus
tatgcagtccagtagtaaaaatcaa

SEQ ID NO: 568382 - DNA, 25 bp, Rattus norvegicus
tatgcagtctgccacaggatgctgg

SEQ ID NO: 568383 - DNA, 25 bp, Rattus norvegicus
tatgcagtctgcgacaggatgctgg

SEQ ID NO: 568384 - DNA, 25 bp, Rattus norvegicus
tatgcagtggttaccttcacagcca

SEQ ID NO: 568385 - DNA, 25 bp, Rattus norvegicus
tatgcagtggtttccttcacagcca

SEQ ID NO: 568386 - DNA, 25 bp, Rattus norvegicus
tatgcagttacacagccacaaaggg

SEQ ID NO: 568387 - DNA, 25 bp, Rattus norvegicus
tatgcagttacagagccacaaaggg

SEQ ID NO: 568388 - DNA, 25 bp, Rattus norvegicus
tatgcagttgtgaactgtctgacgt

SEQ ID NO: 568389 - DNA, 25 bp, Rattus norvegicus
tatgcagttgtgtactgtctgacgt

SEQ ID NO: 568390 - DNA, 25 bp, Rattus norvegicus
tatgcataaaccacatggacacaca

SEQ ID NO: 568391 - DNA, 25 bp, Rattus norvegicus
tatgcataaacctcatggacacaca

SEQ ID NO: 568392 - DNA, 25 bp, Rattus norvegicus
tatgcataccataaactttttcagg

SEQ ID NO: 568393 - DNA, 25 bp, Rattus norvegicus
tatgcataccattaactttttcagg

SEQ ID NO: 568394 - DNA, 25 bp, Rattus norvegicus
tatgcatagcttcggcagtagcccc

SEQ ID NO: 568395 - DNA, 25 bp, Rattus norvegicus
tatgcatagcttgggcagtagcccc

SEQ ID NO: 568396 - DNA, 25 bp, Rattus norvegicus
tatgcatagtggagctggcctgtca

SEQ ID NO: 568397 - DNA, 25 bp, Rattus norvegicus
tatgcatagtggtgctggcctgtca

SEQ ID NO: 568398 - DNA, 25 bp, Rattus norvegicus
tatgcatattacactgcgctccatc

SEQ ID NO: 568399 - DNA, 25 bp, Rattus norvegicus
tatgcatattactctgcgctccatc

SEQ ID NO: 568400 - DNA, 25 bp, Rattus norvegicus
tatgcatattcaaatttccagggta

SEQ ID NO: 568401 - DNA, 25 bp, Rattus norvegicus
tatgcatattcatatttccagggta

SEQ ID NO: 568402 - DNA, 25 bp, Rattus norvegicus
tatgcatcattaacgggtctctgcc

SEQ ID NO: 568403 - DNA, 25 bp, Rattus norvegicus
tatgcatcattatcgggtctctgcc

SEQ ID NO: 568404 - DNA, 25 bp, Rattus norvegicus
tatgcatccaccatgtacaaacact

SEQ ID NO: 568405 - DNA, 25 bp, Rattus norvegicus
tatgcatccaccttgtacaaacact

SEQ ID NO: 568406 - DNA, 25 bp, Rattus norvegicus
tatgcatcctgacctgttctttacc

SEQ ID NO: 568407 - DNA, 25 bp, Rattus norvegicus
tatgcatcctgagctgttctttacc

SEQ ID NO: 568408 - DNA, 25 bp, Rattus norvegicus
tatgcatctagtacctacgcacctt

SEQ ID NO: 568409 - DNA, 25 bp, Rattus norvegicus
tatgcatctagttcctacgcacctt

SEQ ID NO: 568410 - DNA, 25 bp, Rattus norvegicus
tatgcatctgctaatttcctacttt

SEQ ID NO: 568411 - DNA, 25 bp, Rattus norvegicus
tatgcatctgcttatttcctacttt

SEQ ID NO: 568412 - DNA, 25 bp, Rattus norvegicus
tatgcatgagccaaactgttgtgat

SEQ ID NO: 568413 - DNA, 25 bp, Rattus norvegicus
tatgcatgagcctaactgttgtgat

SEQ ID NO: 568414 - DNA, 25 bp, Rattus norvegicus
tatgcatgagtcaccaactccactg

SEQ ID NO: 568415 - DNA, 25 bp, Rattus norvegicus
tatgcatgagtctccaactccactg

SEQ ID NO: 568416 - DNA, 25 bp, Rattus norvegicus
tatgcatgccaaccacatggcctat

SEQ ID NO: 568417 - DNA, 25 bp, Rattus norvegicus
tatgcatgccaagcacatggcctat

SEQ ID NO: 568418 - DNA, 25 bp, Rattus norvegicus
tatgcatgctgcagtgggaccgctc

SEQ ID NO: 568419 - DNA, 25 bp, Rattus norvegicus
tatgcatgctgctgtgggaccgctc

SEQ ID NO: 568420 - DNA, 25 bp, Rattus norvegicus
tatgcatgggttctaatcacacaag

SEQ ID NO: 568421 - DNA, 25 bp, Rattus norvegicus
tatgcatgggttgtaatcacacaag

SEQ ID NO: 568422 - DNA, 25 bp, Rattus norvegicus
tatgcatgtatgaaagtcctcaaga

SEQ ID NO: 568423 - DNA, 25 bp, Rattus norvegicus
tatgcatgtatgtaagtcctcaaga

SEQ ID NO: 568424 - DNA, 25 bp, Rattus norvegicus
tatgcatgtcataaggcagctggac

SEQ ID NO: 568425 - DNA, 25 bp, Rattus norvegicus
tatgcatgtcatataatcggtcaga

SEQ ID NO: 568426 - DNA, 25 bp, Rattus norvegicus
tatgcatgtcattaggcagctggac

SEQ ID NO: 568427 - DNA, 25 bp, Rattus norvegicus
tatgcatgtcatttaatcggtcaga

SEQ ID NO: 568428 - DNA, 25 bp, Rattus norvegicus
tatgcatgtgccagttcgccgagtc

SEQ ID NO: 568429 - DNA, 25 bp, Rattus norvegicus
tatgcatgtgcctgttcgccgagtc

SEQ ID NO: 568430 - DNA, 25 bp, Rattus norvegicus
tatgcattccttatgtctacttaca

SEQ ID NO: 568431 - DNA, 25 bp, Rattus norvegicus
tatgcattccttttgtctacttaca

SEQ ID NO: 568432 - DNA, 25 bp, Rattus norvegicus
tatgcattctggctggcttagaact

SEQ ID NO: 568433 - DNA, 25 bp, Rattus norvegicus
tatgcattctgggtggcttagaact

SEQ ID NO: 568434 - DNA, 25 bp, Rattus norvegicus
tatgcattctttctctgtgattcgg

SEQ ID NO: 568435 - DNA, 25 bp, Rattus norvegicus
tatgcattctttgtctgtgattcgg

SEQ ID NO: 568436 - DNA, 25 bp, Rattus norvegicus
tatgcattgcatagttgggaaacgt

SEQ ID NO: 568437 - DNA, 25 bp, Rattus norvegicus
tatgcattgcattgttgggaaacgt

SEQ ID NO: 568438 - DNA, 25 bp, Rattus norvegicus
tatgcattggtcagctttgactctt

SEQ ID NO: 568439 - DNA, 25 bp, Rattus norvegicus
tatgcattggtctgctttgactctt

SEQ ID NO: 568440 - DNA, 25 bp, Rattus norvegicus
tatgcatttaaacacttacgctttt

SEQ ID NO: 568441 - DNA, 25 bp, Rattus norvegicus
tatgcatttaaagacttacgctttt

SEQ ID NO: 568442 - DNA, 25 bp, Rattus norvegicus
tatgcatttatacactacgagttga

SEQ ID NO: 568443 - DNA, 25 bp, Rattus norvegicus
tatgcatttatagactacgagttga

SEQ ID NO: 568444 - DNA, 25 bp, Rattus norvegicus
tatgcatttccaacactcttcttct

SEQ ID NO: 568445 - DNA, 25 bp, Rattus norvegicus
tatgcatttccatcactcttcttct

SEQ ID NO: 568446 - DNA, 25 bp, Rattus norvegicus
tatgcatttctaaagagctcctcaa

SEQ ID NO: 568447 - DNA, 25 bp, Rattus norvegicus
tatgcatttctatagagctcctcaa

SEQ ID NO: 568448 - DNA, 25 bp, Rattus norvegicus
tatgcatttctcactctgaatctct

SEQ ID NO: 568449 - DNA, 25 bp, Rattus norvegicus
tatgcatttctctctctgaatctct

SEQ ID NO: 568450 - DNA, 25 bp, Rattus norvegicus
tatgccaaaacccaagccttatgtg

SEQ ID NO: 568451 - DNA, 25 bp, Rattus norvegicus
tatgccaaaaccgaagccttatgtg

SEQ ID NO: 568452 - DNA, 25 bp, Rattus norvegicus
tatgccaaagtcattcccagaacct

SEQ ID NO: 568453 - DNA, 25 bp, Rattus norvegicus
tatgccaaagtctttcccagaacct

SEQ ID NO: 568454 - DNA, 25 bp, Rattus norvegicus
tatgccaagcctctgttattatcct

SEQ ID NO: 568455 - DNA, 25 bp, Rattus norvegicus
tatgccaagcctgtgttattatcct

SEQ ID NO: 568456 - DNA, 25 bp, Rattus norvegicus
tatgccaagctcacgtgctgtagtt

SEQ ID NO: 568457 - DNA, 25 bp, Rattus norvegicus
tatgccaagctctcgtgctgtagtt

SEQ ID NO: 568458 - DNA, 25 bp, Rattus norvegicus
tatgccaaggaacttttttccccag

SEQ ID NO: 568459 - DNA, 25 bp, Rattus norvegicus
tatgccaaggaagttttttccccag

SEQ ID NO: 568460 - DNA, 25 bp, Rattus norvegicus
tatgccaaggccacttcagacagct

SEQ ID NO: 568461 - DNA, 25 bp, Rattus norvegicus
tatgccaaggcctcttcagacagct

SEQ ID NO: 568462 - DNA, 25 bp, Rattus norvegicus
tatgccaagtccatacttactgagt

SEQ ID NO: 568463 - DNA, 25 bp, Rattus norvegicus
tatgccaagtccttacttactgagt

SEQ ID NO: 568464 - DNA, 25 bp, Rattus norvegicus
tatgccaagtgaccagttagctgcc

SEQ ID NO: 568465 - DNA, 25 bp, Rattus norvegicus
tatgccaagtgagcagttagctgcc

SEQ ID NO: 568466 - DNA, 25 bp, Rattus norvegicus
tatgccaatcaaacccttcattaga

SEQ ID NO: 568467 - DNA, 25 bp, Rattus norvegicus
tatgccaatcaatcccttcattaga

SEQ ID NO: 568468 - DNA, 25 bp, Rattus norvegicus
tatgccaatgaacactccaaccaaa

SEQ ID NO: 568469 - DNA, 25 bp, Rattus norvegicus
tatgccaatgaagactccaaccaaa

SEQ ID NO: 568470 - DNA, 25 bp, Rattus norvegicus
tatgccacagttctcttcccgggaa

SEQ ID NO: 568471 - DNA, 25 bp, Rattus norvegicus
tatgccacagttgtcttcccgggaa

SEQ ID NO: 568472 - DNA, 25 bp, Rattus norvegicus
tatgccacgctcctgagaattacca

SEQ ID NO: 568473 - DNA, 25 bp, Rattus norvegicus
tatgccacgctcgtgagaattacca

SEQ ID NO: 568474 - DNA, 25 bp, Rattus norvegicus
tatgccacgtatatctgcttcaagt

SEQ ID NO: 568475 - DNA, 25 bp, Rattus norvegicus
tatgccacgtatttctgcttcaagt

SEQ ID NO: 568476 - DNA, 25 bp, Rattus norvegicus
tatgccactgctagagccttcaaga

SEQ ID NO: 568477 - DNA, 25 bp, Rattus norvegicus
tatgccactgcttgagccttcaaga

SEQ ID NO: 568478 - DNA, 25 bp, Rattus norvegicus
tatgccactttcattcttcagagga

SEQ ID NO: 568479 - DNA, 25 bp, Rattus norvegicus
tatgccactttctttcttcagagga

SEQ ID NO: 568480 - DNA, 25 bp, Rattus norvegicus
tatgccagacacacacacagcgtta

SEQ ID NO: 568481 - DNA, 25 bp, Rattus norvegicus
tatgccagacactcacacagcgtta

SEQ ID NO: 568482 - DNA, 25 bp, Rattus norvegicus
tatgccagactgacatctgtctaat

SEQ ID NO: 568483 - DNA, 25 bp, Rattus norvegicus
tatgccagactgtcatctgtctaat

SEQ ID NO: 568484 - DNA, 25 bp, Rattus norvegicus
tatgccagcatcattgcacggacaa

SEQ ID NO: 568485 - DNA, 25 bp, Rattus norvegicus
tatgccagcatctttgcacggacaa

SEQ ID NO: 568486 - DNA, 25 bp, Rattus norvegicus
tatgccagcatgactttcaagtcct

SEQ ID NO: 568487 - DNA, 25 bp, Rattus norvegicus
tatgccagcatgtctttcaagtcct

SEQ ID NO: 568488 - DNA, 25 bp, Rattus norvegicus
tatgccagccgtatagagaagtctt

SEQ ID NO: 568489 - DNA, 25 bp, Rattus norvegicus
tatgccagccgtttagagaagtctt

SEQ ID NO: 568490 - DNA, 25 bp, Rattus norvegicus
tatgccaggaggctatgtctccagc

SEQ ID NO: 568491 - DNA, 25 bp, Rattus norvegicus
tatgccaggagggtatgtctccagc

SEQ ID NO: 568492 - DNA, 25 bp, Rattus norvegicus
tatgccaggctgatgaagcacgcag

SEQ ID NO: 568493 - DNA, 25 bp, Rattus norvegicus
tatgccaggctgttgaagcacgcag

SEQ ID NO: 568494 - DNA, 25 bp, Rattus norvegicus
tatgccagggctatggatgtttttt

SEQ ID NO: 568495 - DNA, 25 bp, Rattus norvegicus
tatgccagggctttggatgtttttt

SEQ ID NO: 568496 - DNA, 25 bp, Rattus norvegicus
tatgccaggttaacttgtactaatg

SEQ ID NO: 568497 - DNA, 25 bp, Rattus norvegicus
tatgccaggttatcttgtactaatg

SEQ ID NO: 568498 - DNA, 25 bp, Rattus norvegicus
tatgccagtgaccagaaccgagtaa

SEQ ID NO: 568499 - DNA, 25 bp, Rattus norvegicus
tatgccagtgacgagaaccgagtaa

SEQ ID NO: 568500 - DNA, 25 bp, Rattus norvegicus
tatgccatatgtcgcagctatccag

SEQ ID NO: 568501 - DNA, 25 bp, Rattus norvegicus
tatgccatatgtggcagctatccag

SEQ ID NO: 568502 - DNA, 25 bp, Rattus norvegicus
tatgccatcaacctgtctcagaaga

SEQ ID NO: 568503 - DNA, 25 bp, Rattus norvegicus
tatgccatcaacgtgtctcagaaga

SEQ ID NO: 568504 - DNA, 25 bp, Rattus norvegicus
tatgccatgctgcaccacagccgaa

SEQ ID NO: 568505 - DNA, 25 bp, Rattus norvegicus
tatgccatgctggaccacagccgaa

SEQ ID NO: 568506 - DNA, 25 bp, Rattus norvegicus
tatgccatgtggagaacccaataag

SEQ ID NO: 568507 - DNA, 25 bp, Rattus norvegicus
tatgccatgtggtgaacccaataag

SEQ ID NO: 568508 - DNA, 25 bp, Rattus norvegicus
tatgccattacccttgactgcaagt

SEQ ID NO: 568509 - DNA, 25 bp, Rattus norvegicus
tatgccattaccgttgactgcaagt

SEQ ID NO: 568510 - DNA, 25 bp, Rattus norvegicus
tatgccattggccttgcgtacaaat

SEQ ID NO: 568511 - DNA, 25 bp, Rattus norvegicus
tatgccattggcgttgcgtacaaat

SEQ ID NO: 568512 - DNA, 25 bp, Rattus norvegicus
tatgccattttcatcttggtcagca

SEQ ID NO: 568513 - DNA, 25 bp, Rattus norvegicus
tatgccattttcttcttggtcagca

SEQ ID NO: 568514 - DNA, 25 bp, Rattus norvegicus
tatgcccaaagcagggccttcaaga

SEQ ID NO: 568515 - DNA, 25 bp, Rattus norvegicus
tatgcccaaagctgggccttcaaga

SEQ ID NO: 568516 - DNA, 25 bp, Rattus norvegicus
tatgcccaactgagaagatctgaat

SEQ ID NO: 568517 - DNA, 25 bp, Rattus norvegicus
tatgcccaactgtgaagatctgaat

SEQ ID NO: 568518 - DNA, 25 bp, Rattus norvegicus
tatgcccaatccatggtggccactg

SEQ ID NO: 568519 - DNA, 25 bp, Rattus norvegicus
tatgcccaatccttggtggccactg

SEQ ID NO: 568520 - DNA, 25 bp, Rattus norvegicus
tatgcccacaccacgtcaggaataa

SEQ ID NO: 568521 - DNA, 25 bp, Rattus norvegicus
tatgcccacacctcgtcaggaataa

SEQ ID NO: 568522 - DNA, 25 bp, Rattus norvegicus
tatgcccaccttagaagccaggatg

SEQ ID NO: 568523 - DNA, 25 bp, Rattus norvegicus
tatgcccacctttgaagccaggatg

SEQ ID NO: 568524 - DNA, 25 bp, Rattus norvegicus
tatgcccagcatactttgttcccat

SEQ ID NO: 568525 - DNA, 25 bp, Rattus norvegicus
tatgcccagcattctttgttcccat

SEQ ID NO: 568526 - DNA, 25 bp, Rattus norvegicus
tatgcccagtcaaaacacaccattg

SEQ ID NO: 568527 - DNA, 25 bp, Rattus norvegicus
tatgcccagtcataacacaccattg

SEQ ID NO: 568528 - DNA, 25 bp, Rattus norvegicus
tatgcccatgccaggatttgttcca

SEQ ID NO: 568529 - DNA, 25 bp, Rattus norvegicus
tatgcccatgcctggatttgttcca

SEQ ID NO: 568530 - DNA, 25 bp, Rattus norvegicus
tatgcccatgtaatattagatcttt

SEQ ID NO: 568531 - DNA, 25 bp, Rattus norvegicus
tatgcccatgtattattagatcttt

SEQ ID NO: 568532 - DNA, 25 bp, Rattus norvegicus
tatgccccaaatcctacttagttac

SEQ ID NO: 568533 - DNA, 25 bp, Rattus norvegicus
tatgccccaaatgctacttagttac

SEQ ID NO: 568534 - DNA, 25 bp, Rattus norvegicus
tatgccccactgcaccctgttgtga

SEQ ID NO: 568535 - DNA, 25 bp, Rattus norvegicus
tatgccccactggaccctgttgtga

SEQ ID NO: 568536 - DNA, 25 bp, Rattus norvegicus
tatgccccagggatgatgcagagcg

SEQ ID NO: 568537 - DNA, 25 bp, Rattus norvegicus
tatgccccagggttgatgcagagcg

SEQ ID NO: 568538 - DNA, 25 bp, Rattus norvegicus
tatgccccagtaccagtgaccaaga

SEQ ID NO: 568539 - DNA, 25 bp, Rattus norvegicus
tatgccccagtagcagtgaccaaga

SEQ ID NO: 568540 - DNA, 25 bp, Rattus norvegicus
tatgcccgcaccatggtagacaagc

SEQ ID NO: 568541 - DNA, 25 bp, Rattus norvegicus
tatgcccgcaccttggtagacaagc

SEQ ID NO: 568542 - DNA, 25 bp, Rattus norvegicus
tatgcccgggaaccaagtatgagat

SEQ ID NO: 568543 - DNA, 25 bp, Rattus norvegicus
tatgcccgggaagcaagtatgagat

SEQ ID NO: 568544 - DNA, 25 bp, Rattus norvegicus
tatgcccgggagaagctatctgtgc

SEQ ID NO: 568545 - DNA, 25 bp, Rattus norvegicus
tatgcccgggagtagctatctgtgc

SEQ ID NO: 568546 - DNA, 25 bp, Rattus norvegicus
tatgcccggtgtaaactggaggtct

SEQ ID NO: 568547 - DNA, 25 bp, Rattus norvegicus
tatgcccggtgttaactggaggtct

SEQ ID NO: 568548 - DNA, 25 bp, Rattus norvegicus
tatgccctacatattccttgaagat

SEQ ID NO: 568549 - DNA, 25 bp, Rattus norvegicus
tatgccctacattttccttgaagat

SEQ ID NO: 568550 - DNA, 25 bp, Rattus norvegicus
tatgccctacttctagcctcaaaat

SEQ ID NO: 568551 - DNA, 25 bp, Rattus norvegicus
tatgccctacttgtagcctcaaaat

SEQ ID NO: 568552 - DNA, 25 bp, Rattus norvegicus
tatgccctagagaggcggttcttag

SEQ ID NO: 568553 - DNA, 25 bp, Rattus norvegicus
tatgccctagagtggcggttcttag

SEQ ID NO: 568554 - DNA, 25 bp, Rattus norvegicus
tatgccctccacattacctggagat

SEQ ID NO: 568555 - DNA, 25 bp, Rattus norvegicus
tatgccctccactttacctggagat

SEQ ID NO: 568556 - DNA, 25 bp, Rattus norvegicus
tatgccctccccacatttggaaaaa

SEQ ID NO: 568557 - DNA, 25 bp, Rattus norvegicus
tatgccctcccctcatttggaaaaa

SEQ ID NO: 568558 - DNA, 25 bp, Rattus norvegicus
tatgccctccttcgagacaggctta

SEQ ID NO: 568559 - DNA, 25 bp, Rattus norvegicus
tatgccctccttggagacaggctta

SEQ ID NO: 568560 - DNA, 25 bp, Rattus norvegicus
tatgccctctggaattgctttttaa

SEQ ID NO: 568561 - DNA, 25 bp, Rattus norvegicus
tatgccctctggtattgctttttaa

SEQ ID NO: 568562 - DNA, 25 bp, Rattus norvegicus
tatgccctctttaccaaatgttttg

SEQ ID NO: 568563 - DNA, 25 bp, Rattus norvegicus
tatgccctcttttccaaatgttttg

SEQ ID NO: 568564 - DNA, 25 bp, Rattus norvegicus
tatgccctgaaaagcttaacctgta

SEQ ID NO: 568565 - DNA, 25 bp, Rattus norvegicus
tatgccctgaaacctgaccggaaca

SEQ ID NO: 568566 - DNA, 25 bp, Rattus norvegicus
tatgccctgaaagctgaccggaaca

SEQ ID NO: 568567 - DNA, 25 bp, Rattus norvegicus
tatgccctgaaatgcttaacctgta

SEQ ID NO: 568568 - DNA, 25 bp, Rattus norvegicus
tatgccctgacacgagtactgcacg

SEQ ID NO: 568569 - DNA, 25 bp, Rattus norvegicus
tatgccctgacaggagtactgcacg

SEQ ID NO: 568570 - DNA, 25 bp, Rattus norvegicus
tatgccctgcggagtcaagaactga

SEQ ID NO: 568571 - DNA, 25 bp, Rattus norvegicus
tatgccctgcggtgtcaagaactga

SEQ ID NO: 568572 - DNA, 25 bp, Rattus norvegicus
tatgccctgctgctacgggtggaat

SEQ ID NO: 568573 - DNA, 25 bp, Rattus norvegicus
tatgccctgctggtacgggtggaat

SEQ ID NO: 568574 - DNA, 25 bp, Rattus norvegicus
tatgccctggaaccaagaggctaat

SEQ ID NO: 568575 - DNA, 25 bp, Rattus norvegicus
tatgccctggaagcaagaggctaat

SEQ ID NO: 568576 - DNA, 25 bp, Rattus norvegicus
tatgccctgggcactattcgctaag

SEQ ID NO: 568577 - DNA, 25 bp, Rattus norvegicus
tatgccctgggctctattcgctaag

SEQ ID NO: 568578 - DNA, 25 bp, Rattus norvegicus
tatgcccttctgctcctttaaaaga

SEQ ID NO: 568579 - DNA, 25 bp, Rattus norvegicus
tatgcccttctggtcctttaaaaga

SEQ ID NO: 568580 - DNA, 25 bp, Rattus norvegicus
tatgccctttctctataaatgaaat

SEQ ID NO: 568581 - DNA, 25 bp, Rattus norvegicus
tatgccctttctgtataaatgaaat

SEQ ID NO: 568582 - DNA, 25 bp, Rattus norvegicus
tatgccgaaggtcgcggactctgct

SEQ ID NO: 568583 - DNA, 25 bp, Rattus norvegicus
tatgccgaaggtggcggactctgct

SEQ ID NO: 568584 - DNA, 25 bp, Rattus norvegicus
tatgccgagttcatttggaccaaac

SEQ ID NO: 568585 - DNA, 25 bp, Rattus norvegicus
tatgccgagttcttttggaccaaac

SEQ ID NO: 568586 - DNA, 25 bp, Rattus norvegicus
tatgccgcagaaaagcacccagagt

SEQ ID NO: 568587 - DNA, 25 bp, Rattus norvegicus
tatgccgcagaatagcacccagagt

SEQ ID NO: 568588 - DNA, 25 bp, Rattus norvegicus
tatgccgcagtgattcaggaccagt

SEQ ID NO: 568589 - DNA, 25 bp, Rattus norvegicus
tatgccgcagtgtttcaggaccagt

SEQ ID NO: 568590 - DNA, 25 bp, Rattus norvegicus
tatgccgcctcaagatccggaagtg

SEQ ID NO: 568591 - DNA, 25 bp, Rattus norvegicus
tatgccgcctcatgatccggaagtg

SEQ ID NO: 568592 - DNA, 25 bp, Rattus norvegicus
tatgccggcgttaagtagttttgtt

SEQ ID NO: 568593 - DNA, 25 bp, Rattus norvegicus
tatgccggcgtttagtagttttgtt

SEQ ID NO: 568594 - DNA, 25 bp, Rattus norvegicus
tatgccgtgagtacccgatgtctat

SEQ ID NO: 568595 - DNA, 25 bp, Rattus norvegicus
tatgccgtgagttcccgatgtctat

SEQ ID NO: 568596 - DNA, 25 bp, Rattus norvegicus
tatgccgtgtgaacatgaactcaac

SEQ ID NO: 568597 - DNA, 25 bp, Rattus norvegicus
tatgccgtgtgatcatgaactcaac

SEQ ID NO: 568598 - DNA, 25 bp, Rattus norvegicus
tatgcctactttactttgcacgatg

SEQ ID NO: 568599 - DNA, 25 bp, Rattus norvegicus
tatgcctacttttctttgcacgatg

SEQ ID NO: 568600 - DNA, 25 bp, Rattus norvegicus
tatgcctatctgagtgtatgcacaa

SEQ ID NO: 568601 - DNA, 25 bp, Rattus norvegicus
tatgcctatctgtgtgtatgcacaa

SEQ ID NO: 568602 - DNA, 25 bp, Rattus norvegicus
tatgcctattagatttccaggtata

SEQ ID NO: 568603 - DNA, 25 bp, Rattus norvegicus
tatgcctattagttttccaggtata

SEQ ID NO: 568604 - DNA, 25 bp, Rattus norvegicus
tatgcctatttaccctagactgtgt

SEQ ID NO: 568605 - DNA, 25 bp, Rattus norvegicus
tatgcctatttagcctagactgtgt

SEQ ID NO: 568606 - DNA, 25 bp, Rattus norvegicus
tatgcctcaagtcactgaaagcctt

SEQ ID NO: 568607 - DNA, 25 bp, Rattus norvegicus
tatgcctcaagtgactgaaagcctt

SEQ ID NO: 568608 - DNA, 25 bp, Rattus norvegicus
tatgcctcaggcaacgctaaacttc

SEQ ID NO: 568609 - DNA, 25 bp, Rattus norvegicus
tatgcctcaggctacgctaaacttc

SEQ ID NO: 568610 - DNA, 25 bp, Rattus norvegicus
tatgcctcccacactgatgaaggtg

SEQ ID NO: 568611 - DNA, 25 bp, Rattus norvegicus
tatgcctcccactctgatgaaggtg

SEQ ID NO: 568612 - DNA, 25 bp, Rattus norvegicus
tatgcctcctgcctgcttgaagact

SEQ ID NO: 568613 - DNA, 25 bp, Rattus norvegicus
tatgcctcctgcgtgcttgaagact

SEQ ID NO: 568614 - DNA, 25 bp, Rattus norvegicus
tatgcctcctgtatcaacactgaca

SEQ ID NO: 568615 - DNA, 25 bp, Rattus norvegicus
tatgcctcctgtttcaacactgaca

SEQ ID NO: 568616 - DNA, 25 bp, Rattus norvegicus
tatgcctcgataatagctgcaaaga

SEQ ID NO: 568617 - DNA, 25 bp, Rattus norvegicus
tatgcctcgatattagctgcaaaga

SEQ ID NO: 568618 - DNA, 25 bp, Rattus norvegicus
tatgcctctagactccagcaagatg

SEQ ID NO: 568619 - DNA, 25 bp, Rattus norvegicus
tatgcctctagagtccagcaagatg

SEQ ID NO: 568620 - DNA, 25 bp, Rattus norvegicus
tatgcctgaagtacatacggccact

SEQ ID NO: 568621 - DNA, 25 bp, Rattus norvegicus
tatgcctgaagttcatacggccact

SEQ ID NO: 568622 - DNA, 25 bp, Rattus norvegicus
tatgcctgagtgagtttatgtgaac

SEQ ID NO: 568623 - DNA, 25 bp, Rattus norvegicus
tatgcctgagtgtgtttatgtgaac

SEQ ID NO: 568624 - DNA, 25 bp, Rattus norvegicus
tatgcctgcaggattgatcgcggga

SEQ ID NO: 568625 - DNA, 25 bp, Rattus norvegicus
tatgcctgcaggtttgatcgcggga

SEQ ID NO: 568626 - DNA, 25 bp, Rattus norvegicus
tatgcctgctaacgtgggatcccaa

SEQ ID NO: 568627 - DNA, 25 bp, Rattus norvegicus
tatgcctgctaaggtgggatcccaa

SEQ ID NO: 568628 - DNA, 25 bp, Rattus norvegicus
tatgcctgcttgcacatttgcatgt

SEQ ID NO: 568629 - DNA, 25 bp, Rattus norvegicus
tatgcctgcttggacatttgcatgt

SEQ ID NO: 568630 - DNA, 25 bp, Rattus norvegicus
tatgcctggactctgcttgttttta

SEQ ID NO: 568631 - DNA, 25 bp, Rattus norvegicus
tatgcctggactgtgcttgttttta

SEQ ID NO: 568632 - DNA, 25 bp, Rattus norvegicus
tatgcctggctcagctaggcgcgcc

SEQ ID NO: 568633 - DNA, 25 bp, Rattus norvegicus
tatgcctggctctgctaggcgcgcc

SEQ ID NO: 568634 - DNA, 25 bp, Rattus norvegicus
tatgcctgggctatgtacacaactt

SEQ ID NO: 568635 - DNA, 25 bp, Rattus norvegicus
tatgcctgggctttgtacacaactt

SEQ ID NO: 568636 - DNA, 25 bp, Rattus norvegicus
tatgcctggtacacaagctcacaaa

SEQ ID NO: 568637 - DNA, 25 bp, Rattus norvegicus
tatgcctggtactcaagctcacaaa

SEQ ID NO: 568638 - DNA, 25 bp, Rattus norvegicus
tatgcctgtaatctgacaaaccaca

SEQ ID NO: 568639 - DNA, 25 bp, Rattus norvegicus
tatgcctgtaatgtgacaaaccaca

SEQ ID NO: 568640 - DNA, 25 bp, Rattus norvegicus
tatgcctgtggaatcttcctatcag

SEQ ID NO: 568641 - DNA, 25 bp, Rattus norvegicus
tatgcctgtggattcttcctatcag

SEQ ID NO: 568642 - DNA, 25 bp, Rattus norvegicus
tatgcctgtggtagttttggaacat

SEQ ID NO: 568643 - DNA, 25 bp, Rattus norvegicus
tatgcctgtggttgttttggaacat

SEQ ID NO: 568644 - DNA, 25 bp, Rattus norvegicus
tatgcctgttcacactgagggccat

SEQ ID NO: 568645 - DNA, 25 bp, Rattus norvegicus
tatgcctgttcagactgagggccat

SEQ ID NO: 568646 - DNA, 25 bp, Rattus norvegicus
tatgcctgtttgattggctgtccat

SEQ ID NO: 568647 - DNA, 25 bp, Rattus norvegicus
tatgcctgtttgtttggctgtccat

SEQ ID NO: 568648 - DNA, 25 bp, Rattus norvegicus
tatgccttcaccacgggatcagatg

SEQ ID NO: 568649 - DNA, 25 bp, Rattus norvegicus
tatgccttcacctcgggatcagatg

SEQ ID NO: 568650 - DNA, 25 bp, Rattus norvegicus
tatgccttcagtcagaacccacttc

SEQ ID NO: 568651 - DNA, 25 bp, Rattus norvegicus
tatgccttcagtgagaacccacttc

SEQ ID NO: 568652 - DNA, 25 bp, Rattus norvegicus
tatgccttctttctggcatcacaag

SEQ ID NO: 568653 - DNA, 25 bp, Rattus norvegicus
tatgccttctttgtggcatcacaag

SEQ ID NO: 568654 - DNA, 25 bp, Rattus norvegicus
tatgccttggctattgtgtagacga

SEQ ID NO: 568655 - DNA, 25 bp, Rattus norvegicus
tatgccttggcttttgtgtagacga

SEQ ID NO: 568656 - DNA, 25 bp, Rattus norvegicus
tatgccttgtcacagttctgggcct

SEQ ID NO: 568657 - DNA, 25 bp, Rattus norvegicus
tatgccttgtcagagttctgggcct

SEQ ID NO: 568658 - DNA, 25 bp, Rattus norvegicus
tatgccttgtgaaggccaacgttcc

SEQ ID NO: 568659 - DNA, 25 bp, Rattus norvegicus
tatgccttgtgatggccaacgttcc

SEQ ID NO: 568660 - DNA, 25 bp, Rattus norvegicus
tatgcctttattcgccagaaatttc

SEQ ID NO: 568661 - DNA, 25 bp, Rattus norvegicus
tatgcctttattggccagaaatttc

SEQ ID NO: 568662 - DNA, 25 bp, Rattus norvegicus
tatgcctttctaactcttgtatctg

SEQ ID NO: 568663 - DNA, 25 bp, Rattus norvegicus
tatgcctttctatctcttgtatctg

SEQ ID NO: 568664 - DNA, 25 bp, Rattus norvegicus
tatgcctttgccaacttttcagaag

SEQ ID NO: 568665 - DNA, 25 bp, Rattus norvegicus
tatgcctttgcctacttttcagaag

SEQ ID NO: 568666 - DNA, 25 bp, Rattus norvegicus
tatgccttttcgctttgggacccag

SEQ ID NO: 568667 - DNA, 25 bp, Rattus norvegicus
tatgccttttcggtttgggacccag

SEQ ID NO: 568668 - DNA, 25 bp, Rattus norvegicus
tatgccttttgccttttgataactg

SEQ ID NO: 568669 - DNA, 25 bp, Rattus norvegicus
tatgccttttgcgttttgataactg

SEQ ID NO: 568670 - DNA, 25 bp, Rattus norvegicus
tatgcctttttcaaacctggtgagt

SEQ ID NO: 568671 - DNA, 25 bp, Rattus norvegicus
tatgcctttttcaatccctggttca

SEQ ID NO: 568672 - DNA, 25 bp, Rattus norvegicus
tatgcctttttctaacctggtgagt

SEQ ID NO: 568673 - DNA, 25 bp, Rattus norvegicus
tatgcctttttctatccctggttca

SEQ ID NO: 568674 - DNA, 25 bp, Rattus norvegicus
tatgcgacaaaccactgggcactca

SEQ ID NO: 568675 - DNA, 25 bp, Rattus norvegicus
tatgcgacaaacgactgggcactca

SEQ ID NO: 568676 - DNA, 25 bp, Rattus norvegicus
tatgcgacacaacttgccgtgcaac

SEQ ID NO: 568677 - DNA, 25 bp, Rattus norvegicus
tatgcgacacaagttgccgtgcaac

SEQ ID NO: 568678 - DNA, 25 bp, Rattus norvegicus
tatgcgactaaaactggtacccaat

SEQ ID NO: 568679 - DNA, 25 bp, Rattus norvegicus
tatgcgactaaatctggtacccaat

SEQ ID NO: 568680 - DNA, 25 bp, Rattus norvegicus
tatgcgactaggagtctgatactgt

SEQ ID NO: 568681 - DNA, 25 bp, Rattus norvegicus
tatgcgactaggtgtctgatactgt

SEQ ID NO: 568682 - DNA, 25 bp, Rattus norvegicus
tatgcgactctgaggtcttgaactt

SEQ ID NO: 568683 - DNA, 25 bp, Rattus norvegicus
tatgcgactctgtggtcttgaactt

SEQ ID NO: 568684 - DNA, 25 bp, Rattus norvegicus
tatgcgagatacactttcctgcagg

SEQ ID NO: 568685 - DNA, 25 bp, Rattus norvegicus
tatgcgagatactctttcctgcagg

SEQ ID NO: 568686 - DNA, 25 bp, Rattus norvegicus
tatgcgagcgctctggatcccgaga

SEQ ID NO: 568687 - DNA, 25 bp, Rattus norvegicus
tatgcgagcgctgtggatcccgaga

SEQ ID NO: 568688 - DNA, 25 bp, Rattus norvegicus
tatgcgcagaggctagaccatgacc

SEQ ID NO: 568689 - DNA, 25 bp, Rattus norvegicus
tatgcgcagagggtagaccatgacc

SEQ ID NO: 568690 - DNA, 25 bp, Rattus norvegicus
tatgcgcatgcaattccacaaaatt

SEQ ID NO: 568691 - DNA, 25 bp, Rattus norvegicus
tatgcgcatgcatttccacaaaatt

SEQ ID NO: 568692 - DNA, 25 bp, Rattus norvegicus
tatgcgcattcgctgagtactgcac

SEQ ID NO: 568693 - DNA, 25 bp, Rattus norvegicus
tatgcgcattcggtgagtactgcac

SEQ ID NO: 568694 - DNA, 25 bp, Rattus norvegicus
tatgcgccaagcacaagggcaccta

SEQ ID NO: 568695 - DNA, 25 bp, Rattus norvegicus
tatgcgccaagctcaagggcaccta

SEQ ID NO: 568696 - DNA, 25 bp, Rattus norvegicus
tatgcgccagcccatcaaacaggag

SEQ ID NO: 568697 - DNA, 25 bp, Rattus norvegicus
tatgcgccagccgatcaaacaggag

SEQ ID NO: 568698 - DNA, 25 bp, Rattus norvegicus
tatgcgcgcgtgctgaaatctgtct

SEQ ID NO: 568699 - DNA, 25 bp, Rattus norvegicus
tatgcgcgcgtggtgaaatctgtct

SEQ ID NO: 568700 - DNA, 25 bp, Rattus norvegicus
tatgcggaaccaccttagacccgga

SEQ ID NO: 568701 - DNA, 25 bp, Rattus norvegicus
tatgcggaaccagcttagacccgga

SEQ ID NO: 568702 - DNA, 25 bp, Rattus norvegicus
tatgcggactggacaaaacacttgg

SEQ ID NO: 568703 - DNA, 25 bp, Rattus norvegicus
tatgcggactggtcaaaacacttgg

SEQ ID NO: 568704 - DNA, 25 bp, Rattus norvegicus
tatgcggcccggctttgcgacgctg

SEQ ID NO: 568705 - DNA, 25 bp, Rattus norvegicus
tatgcggcccgggtttgcgacgctg

SEQ ID NO: 568706 - DNA, 25 bp, Rattus norvegicus
tatgcggctgtcagtgtgtcatttc

SEQ ID NO: 568707 - DNA, 25 bp, Rattus norvegicus
tatgcggctgtctgtgtgtcatttc

SEQ ID NO: 568708 - DNA, 25 bp, Rattus norvegicus
tatgcgggtcttacaaaagcacaag

SEQ ID NO: 568709 - DNA, 25 bp, Rattus norvegicus
tatgcgggtctttcaaaagcacaag

SEQ ID NO: 568710 - DNA, 25 bp, Rattus norvegicus
tatgcgggtttcatgtttcacatct

SEQ ID NO: 568711 - DNA, 25 bp, Rattus norvegicus
tatgcgggtttcttgtttcacatct

SEQ ID NO: 568712 - DNA, 25 bp, Rattus norvegicus
tatgcggtaggaaccaagagcatta

SEQ ID NO: 568713 - DNA, 25 bp, Rattus norvegicus
tatgcggtaggatccaagagcatta

SEQ ID NO: 568714 - DNA, 25 bp, Rattus norvegicus
tatgcgtacaaacacaacctggcct

SEQ ID NO: 568715 - DNA, 25 bp, Rattus norvegicus
tatgcgtacaaagacaacctggcct

SEQ ID NO: 568716 - DNA, 25 bp, Rattus norvegicus
tatgcgtacataccactgaggccac

SEQ ID NO: 568717 - DNA, 25 bp, Rattus norvegicus
tatgcgtacatagcactgaggccac

SEQ ID NO: 568718 - DNA, 25 bp, Rattus norvegicus
tatgcgtcagcactacattcacgtt

SEQ ID NO: 568719 - DNA, 25 bp, Rattus norvegicus
tatgcgtcagcagtacattcacgtt

SEQ ID NO: 568720 - DNA, 25 bp, Rattus norvegicus
tatgcgtgccgtccgtgtttccatc

SEQ ID NO: 568721 - DNA, 25 bp, Rattus norvegicus
tatgcgtgccgtgcgtgtttccatc

SEQ ID NO: 568722 - DNA, 25 bp, Rattus norvegicus
tatgcgtgctagctgagctccattc

SEQ ID NO: 568723 - DNA, 25 bp, Rattus norvegicus
tatgcgtgctaggtgagctccattc

SEQ ID NO: 568724 - DNA, 25 bp, Rattus norvegicus
tatgcgtgggccacctccattgatg

SEQ ID NO: 568725 - DNA, 25 bp, Rattus norvegicus
tatgcgtgggcctcctccattgatg

SEQ ID NO: 568726 - DNA, 25 bp, Rattus norvegicus
tatgctaaacagacaagggcctaag

SEQ ID NO: 568727 - DNA, 25 bp, Rattus norvegicus
tatgctaaacagtcaagggcctaag

SEQ ID NO: 568728 - DNA, 25 bp, Rattus norvegicus
tatgctaacccaagccaccttgttt

SEQ ID NO: 568729 - DNA, 25 bp, Rattus norvegicus
tatgctaacccatgccaccttgttt

SEQ ID NO: 568730 - DNA, 25 bp, Rattus norvegicus
tatgctaacctccacgccagagttg

SEQ ID NO: 568731 - DNA, 25 bp, Rattus norvegicus
tatgctaacctcgacgccagagttg

SEQ ID NO: 568732 - DNA, 25 bp, Rattus norvegicus
tatgctaacctgcactgcttcttac

SEQ ID NO: 568733 - DNA, 25 bp, Rattus norvegicus
tatgctaacctggactgcttcttac

SEQ ID NO: 568734 - DNA, 25 bp, Rattus norvegicus
tatgctaagtgcaataaggccatct

SEQ ID NO: 568735 - DNA, 25 bp, Rattus norvegicus
tatgctaagtgctataaggccatct

SEQ ID NO: 568736 - DNA, 25 bp, Rattus norvegicus
tatgctaatttgacaggctgtgttc

SEQ ID NO: 568737 - DNA, 25 bp, Rattus norvegicus
tatgctaatttgtcaggctgtgttc

SEQ ID NO: 568738 - DNA, 25 bp, Rattus norvegicus
tatgctacacttatgacccatggtt

SEQ ID NO: 568739 - DNA, 25 bp, Rattus norvegicus
tatgctacacttttgacccatggtt

SEQ ID NO: 568740 - DNA, 25 bp, Rattus norvegicus
tatgctacatttaggtcgttgacaa

SEQ ID NO: 568741 - DNA, 25 bp, Rattus norvegicus
tatgctacattttggtcgttgacaa

SEQ ID NO: 568742 - DNA, 25 bp, Rattus norvegicus
tatgctaccctcatattcctttaaa

SEQ ID NO: 568743 - DNA, 25 bp, Rattus norvegicus
tatgctaccctcttattcctttaaa

SEQ ID NO: 568744 - DNA, 25 bp, Rattus norvegicus
tatgctaccttgattataggacccc

SEQ ID NO: 568745 - DNA, 25 bp, Rattus norvegicus
tatgctaccttgtttataggacccc

SEQ ID NO: 568746 - DNA, 25 bp, Rattus norvegicus
tatgctagctacacttcaatggaca

SEQ ID NO: 568747 - DNA, 25 bp, Rattus norvegicus
tatgctagctactcttcaatggaca

SEQ ID NO: 568748 - DNA, 25 bp, Rattus norvegicus
tatgctataaggaaaccctcggtat

SEQ ID NO: 568749 - DNA, 25 bp, Rattus norvegicus
tatgctataaggtaaccctcggtat

SEQ ID NO: 568750 - DNA, 25 bp, Rattus norvegicus
tatgctatattcctgtcctgacaag

SEQ ID NO: 568751 - DNA, 25 bp, Rattus norvegicus
tatgctatattcgtgtcctgacaag

SEQ ID NO: 568752 - DNA, 25 bp, Rattus norvegicus
tatgctatcaacaatgctggtccag

SEQ ID NO: 568753 - DNA, 25 bp, Rattus norvegicus
tatgctatcaactatgctggtccag

SEQ ID NO: 568754 - DNA, 25 bp, Rattus norvegicus
tatgctatccatactgtttttaaat

SEQ ID NO: 568755 - DNA, 25 bp, Rattus norvegicus
tatgctatccattctgtttttaaat

SEQ ID NO: 568756 - DNA, 25 bp, Rattus norvegicus
tatgctatctttccagctaactccc

SEQ ID NO: 568757 - DNA, 25 bp, Rattus norvegicus
tatgctatctttgcagctaactccc

SEQ ID NO: 568758 - DNA, 25 bp, Rattus norvegicus
tatgctatgcacattcttgtctcct

SEQ ID NO: 568759 - DNA, 25 bp, Rattus norvegicus
tatgctatgcactttcttgtctcct

SEQ ID NO: 568760 - DNA, 25 bp, Rattus norvegicus
tatgctatggagatttcagttccca

SEQ ID NO: 568761 - DNA, 25 bp, Rattus norvegicus
tatgctatggagttttcagttccca

SEQ ID NO: 568762 - DNA, 25 bp, Rattus norvegicus
tatgctatgtgtactaattggtggc

SEQ ID NO: 568763 - DNA, 25 bp, Rattus norvegicus
tatgctatgtgttctaattggtggc

SEQ ID NO: 568764 - DNA, 25 bp, Rattus norvegicus
tatgctattagcagtctcctttttc

SEQ ID NO: 568765 - DNA, 25 bp, Rattus norvegicus
tatgctattagctgtctcctttttc

SEQ ID NO: 568766 - DNA, 25 bp, Rattus norvegicus
tatgctattttgctgtgggaacact

SEQ ID NO: 568767 - DNA, 25 bp, Rattus norvegicus
tatgctattttggtgtgggaacact

SEQ ID NO: 568768 - DNA, 25 bp, Rattus norvegicus
tatgctcaacatatggattgttcta

SEQ ID NO: 568769 - DNA, 25 bp, Rattus norvegicus
tatgctcaacatttggattgttcta

SEQ ID NO: 568770 - DNA, 25 bp, Rattus norvegicus
tatgctcagcgccttgtggatgacg

SEQ ID NO: 568771 - DNA, 25 bp, Rattus norvegicus
tatgctcagcgcgttgtggatgacg

SEQ ID NO: 568772 - DNA, 25 bp, Rattus norvegicus
tatgctcaggaaacctccccagtgg

SEQ ID NO: 568773 - DNA, 25 bp, Rattus norvegicus
tatgctcaggaatcctccccagtgg

SEQ ID NO: 568774 - DNA, 25 bp, Rattus norvegicus
tatgctcataacagatgtggctgga

SEQ ID NO: 568775 - DNA, 25 bp, Rattus norvegicus
tatgctcataactgatgtggctgga

SEQ ID NO: 568776 - DNA, 25 bp, Rattus norvegicus
tatgctcatctcagtgcggaacggc

SEQ ID NO: 568777 - DNA, 25 bp, Rattus norvegicus
tatgctcatctctgtgcggaacggc

SEQ ID NO: 568778 - DNA, 25 bp, Rattus norvegicus
tatgctccatgccaactgtaaattg

SEQ ID NO: 568779 - DNA, 25 bp, Rattus norvegicus
tatgctccatgcgaactgtaaattg

SEQ ID NO: 568780 - DNA, 25 bp, Rattus norvegicus
tatgctcccacacacaggcaatagt

SEQ ID NO: 568781 - DNA, 25 bp, Rattus norvegicus
tatgctcccacagacaggcaatagt

SEQ ID NO: 568782 - DNA, 25 bp, Rattus norvegicus
tatgctcccagcaagcatccagaag

SEQ ID NO: 568783 - DNA, 25 bp, Rattus norvegicus
tatgctcccagctagcatccagaag

SEQ ID NO: 568784 - DNA, 25 bp, Rattus norvegicus
tatgctcccgaaaccttgacagaga

SEQ ID NO: 568785 - DNA, 25 bp, Rattus norvegicus
tatgctcccgaatccttgacagaga

SEQ ID NO: 568786 - DNA, 25 bp, Rattus norvegicus
tatgctccgtgcatgtatacaaaga

SEQ ID NO: 568787 - DNA, 25 bp, Rattus norvegicus
tatgctccgtgcttgtatacaaaga

SEQ ID NO: 568788 - DNA, 25 bp, Rattus norvegicus
tatgctcctcgacagaacaggcggt

SEQ ID NO: 568789 - DNA, 25 bp, Rattus norvegicus
tatgctcctcgagagaacaggcggt

SEQ ID NO: 568790 - DNA, 25 bp, Rattus norvegicus
tatgctcgccctaagagtagacgtt

SEQ ID NO: 568791 - DNA, 25 bp, Rattus norvegicus
tatgctcgcccttagagtagacgtt

SEQ ID NO: 568792 - DNA, 25 bp, Rattus norvegicus
tatgctctattaaccagaaggccga

SEQ ID NO: 568793 - DNA, 25 bp, Rattus norvegicus
tatgctctattatccagaaggccga

SEQ ID NO: 568794 - DNA, 25 bp, Rattus norvegicus
tatgctctccctactggttctgaag

SEQ ID NO: 568795 - DNA, 25 bp, Rattus norvegicus
tatgctctcccttctggttctgaag

SEQ ID NO: 568796 - DNA, 25 bp, Rattus norvegicus
tatgctctgcatatgctcatctacc

SEQ ID NO: 568797 - DNA, 25 bp, Rattus norvegicus
tatgctctgcatttgctcatctacc

SEQ ID NO: 568798 - DNA, 25 bp, Rattus norvegicus
tatgctctgcggatgctgcccaaga

SEQ ID NO: 568799 - DNA, 25 bp, Rattus norvegicus
tatgctctgcggttgctgcccaaga

SEQ ID NO: 568800 - DNA, 25 bp, Rattus norvegicus
tatgctctggtcactcacttgggag

SEQ ID NO: 568801 - DNA, 25 bp, Rattus norvegicus
tatgctctggtcagccacaacagag

SEQ ID NO: 568802 - DNA, 25 bp, Rattus norvegicus
tatgctctggtctctcacttgggag

SEQ ID NO: 568803 - DNA, 25 bp, Rattus norvegicus
tatgctctggtctgccacaacagag

SEQ ID NO: 568804 - DNA, 25 bp, Rattus norvegicus
tatgctctgtttaaccttatcctgt

SEQ ID NO: 568805 - DNA, 25 bp, Rattus norvegicus
tatgctctgttttaccttatcctgt

SEQ ID NO: 568806 - DNA, 25 bp, Rattus norvegicus
tatgctcttaggacccctgcgtgac

SEQ ID NO: 568807 - DNA, 25 bp, Rattus norvegicus
tatgctcttaggtcccctgcgtgac

SEQ ID NO: 568808 - DNA, 25 bp, Rattus norvegicus
tatgctcttattcctgcttagtaca

SEQ ID NO: 568809 - DNA, 25 bp, Rattus norvegicus
tatgctcttattgctgcttagtaca

SEQ ID NO: 568810 - DNA, 25 bp, Rattus norvegicus
tatgctcttccacacagtttactaa

SEQ ID NO: 568811 - DNA, 25 bp, Rattus norvegicus
tatgctcttccagacagtttactaa

SEQ ID NO: 568812 - DNA, 25 bp, Rattus norvegicus
tatgctcttcgcctttaccaaggat

SEQ ID NO: 568813 - DNA, 25 bp, Rattus norvegicus
tatgctcttcgcgtttaccaaggat

SEQ ID NO: 568814 - DNA, 25 bp, Rattus norvegicus
tatgctcttgctactctaagacagc

SEQ ID NO: 568815 - DNA, 25 bp, Rattus norvegicus
tatgctcttgcttctctaagacagc

SEQ ID NO: 568816 - DNA, 25 bp, Rattus norvegicus
tatgctcttgttcgctggttcatta

SEQ ID NO: 568817 - DNA, 25 bp, Rattus norvegicus
tatgctcttgttggctggttcatta

SEQ ID NO: 568818 - DNA, 25 bp, Rattus norvegicus
tatgctctttcaattgcacaagtgg

SEQ ID NO: 568819 - DNA, 25 bp, Rattus norvegicus
tatgctctttcatttgcacaagtgg

SEQ ID NO: 568820 - DNA, 25 bp, Rattus norvegicus
tatgctgaacatagggtcacccatg

SEQ ID NO: 568821 - DNA, 25 bp, Rattus norvegicus
tatgctgaacattgggtcacccatg

SEQ ID NO: 568822 - DNA, 25 bp, Rattus norvegicus
tatgctgaagcaccgcctgaagctg

SEQ ID NO: 568823 - DNA, 25 bp, Rattus norvegicus
tatgctgaagcagcgcctgaagctg

SEQ ID NO: 568824 - DNA, 25 bp, Rattus norvegicus
tatgctgaccacatcctttcagatc

SEQ ID NO: 568825 - DNA, 25 bp, Rattus norvegicus
tatgctgaccacttcctttcagatc

SEQ ID NO: 568826 - DNA, 25 bp, Rattus norvegicus
tatgctgactgaatttgggttctag

SEQ ID NO: 568827 - DNA, 25 bp, Rattus norvegicus
tatgctgactgattttgggttctag

SEQ ID NO: 568828 - DNA, 25 bp, Rattus norvegicus
tatgctgacttcatcgaggccaatc

SEQ ID NO: 568829 - DNA, 25 bp, Rattus norvegicus
tatgctgacttcttcgaggccaatc

SEQ ID NO: 568830 - DNA, 25 bp, Rattus norvegicus
tatgctgagatgaggcagctgcagc

SEQ ID NO: 568831 - DNA, 25 bp, Rattus norvegicus
tatgctgagatgtggcagctgcagc

SEQ ID NO: 568832 - DNA, 25 bp, Rattus norvegicus
tatgctgagctgatgcccatcttca

SEQ ID NO: 568833 - DNA, 25 bp, Rattus norvegicus
tatgctgagctgttgcccatcttca

SEQ ID NO: 568834 - DNA, 25 bp, Rattus norvegicus
tatgctgatgctcccaagcccgtgg

SEQ ID NO: 568835 - DNA, 25 bp, Rattus norvegicus
tatgctgatgctgccaagcccgtgg

SEQ ID NO: 568836 - DNA, 25 bp, Rattus norvegicus
tatgctgcacagaaagaatcctaag

SEQ ID NO: 568837 - DNA, 25 bp, Rattus norvegicus
tatgctgcacagatggctgggcttc

SEQ ID NO: 568838 - DNA, 25 bp, Rattus norvegicus
tatgctgcacagtaagaatcctaag

SEQ ID NO: 568839 - DNA, 25 bp, Rattus norvegicus
tatgctgcacagttggctgggcttc

SEQ ID NO: 568840 - DNA, 25 bp, Rattus norvegicus
tatgctgcactgagtggctacacca

SEQ ID NO: 568841 - DNA, 25 bp, Rattus norvegicus
tatgctgcactgtgtggctacacca

SEQ ID NO: 568842 - DNA, 25 bp, Rattus norvegicus
tatgctgccaccatccgaataaaag

SEQ ID NO: 568843 - DNA, 25 bp, Rattus norvegicus
tatgctgccaccttccgaataaaag

SEQ ID NO: 568844 - DNA, 25 bp, Rattus norvegicus
tatgctgcccagctgaccggacagt

SEQ ID NO: 568845 - DNA, 25 bp, Rattus norvegicus
tatgctgcccaggtgaccggacagt

SEQ ID NO: 568846 - DNA, 25 bp, Rattus norvegicus
tatgctgccctacatgatctgataa

SEQ ID NO: 568847 - DNA, 25 bp, Rattus norvegicus
tatgctgccctagatgatctgataa

SEQ ID NO: 568848 - DNA, 25 bp, Rattus norvegicus
tatgctgccctcagctggagagaat

SEQ ID NO: 568849 - DNA, 25 bp, Rattus norvegicus
tatgctgccctctgctggagagaat

SEQ ID NO: 568850 - DNA, 25 bp, Rattus norvegicus
tatgctgcctccagtcccatgtgag

SEQ ID NO: 568851 - DNA, 25 bp, Rattus norvegicus
tatgctgcctcctgtcccatgtgag

SEQ ID NO: 568852 - DNA, 25 bp, Rattus norvegicus
tatgctgcctgtatggcttcggacc

SEQ ID NO: 568853 - DNA, 25 bp, Rattus norvegicus
tatgctgcctgtttggcttcggacc

SEQ ID NO: 568854 - DNA, 25 bp, Rattus norvegicus
tatgctgctcatcgctttgtaaaag

SEQ ID NO: 568855 - DNA, 25 bp, Rattus norvegicus
tatgctgctcatggctttgtaaaag

SEQ ID NO: 568856 - DNA, 25 bp, Rattus norvegicus
tatgctgctgccaaggaagctgcaa

SEQ ID NO: 568857 - DNA, 25 bp, Rattus norvegicus
tatgctgctgcctaggaagctgcaa

SEQ ID NO: 568858 - DNA, 25 bp, Rattus norvegicus
tatgctgctttcaggctgtctaaga

SEQ ID NO: 568859 - DNA, 25 bp, Rattus norvegicus
tatgctgctttctggctgtctaaga

SEQ ID NO: 568860 - DNA, 25 bp, Rattus norvegicus
tatgctggaatcaacaatccctaca

SEQ ID NO: 568861 - DNA, 25 bp, Rattus norvegicus
tatgctggaatctacaatccctaca

SEQ ID NO: 568862 - DNA, 25 bp, Rattus norvegicus
tatgctggacttatgaaccttgaaa

SEQ ID NO: 568863 - DNA, 25 bp, Rattus norvegicus
tatgctggacttttgaaccttgaaa

SEQ ID NO: 568864 - DNA, 25 bp, Rattus norvegicus
tatgctggatctctgtccctagaac

SEQ ID NO: 568865 - DNA, 25 bp, Rattus norvegicus
tatgctggatctgtgtccctagaac

SEQ ID NO: 568866 - DNA, 25 bp, Rattus norvegicus
tatgctggatgcacaatggccactt

SEQ ID NO: 568867 - DNA, 25 bp, Rattus norvegicus
tatgctggatgctcaatggccactt

SEQ ID NO: 568868 - DNA, 25 bp, Rattus norvegicus
tatgctggcgcaaacaacatacaga

SEQ ID NO: 568869 - DNA, 25 bp, Rattus norvegicus
tatgctggcgcatacaacatacaga

SEQ ID NO: 568870 - DNA, 25 bp, Rattus norvegicus
tatgctggctgcagacgatgcgaca

SEQ ID NO: 568871 - DNA, 25 bp, Rattus norvegicus
tatgctggctgctgacgatgcgaca

SEQ ID NO: 568872 - DNA, 25 bp, Rattus norvegicus
tatgctgggaccatgcactgctgag

SEQ ID NO: 568873 - DNA, 25 bp, Rattus norvegicus
tatgctgggaccttgcactgctgag

SEQ ID NO: 568874 - DNA, 25 bp, Rattus norvegicus
tatgctgggcaaaatgtccactcct

SEQ ID NO: 568875 - DNA, 25 bp, Rattus norvegicus
tatgctgggcaatatgtccactcct

SEQ ID NO: 568876 - DNA, 25 bp, Rattus norvegicus
tatgctgggcttccacactttctgc

SEQ ID NO: 568877 - DNA, 25 bp, Rattus norvegicus
tatgctgggcttgcacactttctgc

SEQ ID NO: 568878 - DNA, 25 bp, Rattus norvegicus
tatgctggtaccaccacagaacgat

SEQ ID NO: 568879 - DNA, 25 bp, Rattus norvegicus
tatgctggtacctccacagaacgat

SEQ ID NO: 568880 - DNA, 25 bp, Rattus norvegicus
tatgctggtattctcactgccacat

SEQ ID NO: 568881 - DNA, 25 bp, Rattus norvegicus
tatgctggtattgtcactgccacat

SEQ ID NO: 568882 - DNA, 25 bp, Rattus norvegicus
tatgctggttagacacattcccttc

SEQ ID NO: 568883 - DNA, 25 bp, Rattus norvegicus
tatgctggttagtcacattcccttc

SEQ ID NO: 568884 - DNA, 25 bp, Rattus norvegicus
tatgctgtaatcatgctttgtaaaa

SEQ ID NO: 568885 - DNA, 25 bp, Rattus norvegicus
tatgctgtaatcttgctttgtaaaa

SEQ ID NO: 568886 - DNA, 25 bp, Rattus norvegicus
tatgctgtatctcctatcaccaagg

SEQ ID NO: 568887 - DNA, 25 bp, Rattus norvegicus
tatgctgtatctgctatcaccaagg

SEQ ID NO: 568888 - DNA, 25 bp, Rattus norvegicus
tatgctgtattcattctcctttgag

SEQ ID NO: 568889 - DNA, 25 bp, Rattus norvegicus
tatgctgtattctttctcctttgag

SEQ ID NO: 568890 - DNA, 25 bp, Rattus norvegicus
tatgctgtcagcagaccctcggtct

SEQ ID NO: 568891 - DNA, 25 bp, Rattus norvegicus
tatgctgtcagctgaccctcggtct

SEQ ID NO: 568892 - DNA, 25 bp, Rattus norvegicus
tatgctgtctggcagtgcccttcat

SEQ ID NO: 568893 - DNA, 25 bp, Rattus norvegicus
tatgctgtctgggagtgcccttcat

SEQ ID NO: 568894 - DNA, 25 bp, Rattus norvegicus
tatgctgtctgtaaaatcctgccct

SEQ ID NO: 568895 - DNA, 25 bp, Rattus norvegicus
tatgctgtctgttaaatcctgccct

SEQ ID NO: 568896 - DNA, 25 bp, Rattus norvegicus
tatgctgtgcagaaatccactgagc

SEQ ID NO: 568897 - DNA, 25 bp, Rattus norvegicus
tatgctgtgcagtaatccactgagc

SEQ ID NO: 568898 - DNA, 25 bp, Rattus norvegicus
tatgctgtggtgctccagatagaag

SEQ ID NO: 568899 - DNA, 25 bp, Rattus norvegicus
tatgctgtggtggtccagatagaag

SEQ ID NO: 568900 - DNA, 25 bp, Rattus norvegicus
tatgctgttcgcattaccctttagc

SEQ ID NO: 568901 - DNA, 25 bp, Rattus norvegicus
tatgctgttcgctttaccctttagc

SEQ ID NO: 568902 - DNA, 25 bp, Rattus norvegicus
tatgctgttctgcaagagactctga

SEQ ID NO: 568903 - DNA, 25 bp, Rattus norvegicus
tatgctgttctggaagagactctga

SEQ ID NO: 568904 - DNA, 25 bp, Rattus norvegicus
tatgctgttgaactgctgtgaatct

SEQ ID NO: 568905 - DNA, 25 bp, Rattus norvegicus
tatgctgttgaagtgctgtgaatct

SEQ ID NO: 568906 - DNA, 25 bp, Rattus norvegicus
tatgctgttgatccatacaacccag

SEQ ID NO: 568907 - DNA, 25 bp, Rattus norvegicus
tatgctgttgatgcatacaacccag

SEQ ID NO: 568908 - DNA, 25 bp, Rattus norvegicus
tatgctgtttagagaagcctagagc

SEQ ID NO: 568909 - DNA, 25 bp, Rattus norvegicus
tatgctgtttagtgaagcctagagc

SEQ ID NO: 568910 - DNA, 25 bp, Rattus norvegicus
tatgcttaatagaggattcccctca

SEQ ID NO: 568911 - DNA, 25 bp, Rattus norvegicus
tatgcttaatagtggattcccctca

SEQ ID NO: 568912 - DNA, 25 bp, Rattus norvegicus
tatgcttaattgataggactgccac

SEQ ID NO: 568913 - DNA, 25 bp, Rattus norvegicus
tatgcttaattgttaggactgccac

SEQ ID NO: 568914 - DNA, 25 bp, Rattus norvegicus
tatgcttagcatctaagggcctggg

SEQ ID NO: 568915 - DNA, 25 bp, Rattus norvegicus
tatgcttagcatgtaagggcctggg

SEQ ID NO: 568916 - DNA, 25 bp, Rattus norvegicus
tatgcttagctcatcaggtcgtaat

SEQ ID NO: 568917 - DNA, 25 bp, Rattus norvegicus
tatgcttagctcttcaggtcgtaat

SEQ ID NO: 568918 - DNA, 25 bp, Rattus norvegicus
tatgcttatgttcgctgtgctcatg

SEQ ID NO: 568919 - DNA, 25 bp, Rattus norvegicus
tatgcttatgttggctgtgctcatg

SEQ ID NO: 568920 - DNA, 25 bp, Rattus norvegicus
tatgcttcccatcttctttcttttt

SEQ ID NO: 568921 - DNA, 25 bp, Rattus norvegicus
tatgcttcccatgttctttcttttt

SEQ ID NO: 568922 - DNA, 25 bp, Rattus norvegicus
tatgcttccccaatgatggtgccca

SEQ ID NO: 568923 - DNA, 25 bp, Rattus norvegicus
tatgcttccccattgatggtgccca

SEQ ID NO: 568924 - DNA, 25 bp, Rattus norvegicus
tatgcttgaagtcgcatgccctctg

SEQ ID NO: 568925 - DNA, 25 bp, Rattus norvegicus
tatgcttgaagtggcatgccctctg

SEQ ID NO: 568926 - DNA, 25 bp, Rattus norvegicus
tatgcttgcaggatatatcttagtg

SEQ ID NO: 568927 - DNA, 25 bp, Rattus norvegicus
tatgcttgcaggttatatcttagtg

SEQ ID NO: 568928 - DNA, 25 bp, Rattus norvegicus
tatgcttgcctacttacgaggtcaa

SEQ ID NO: 568929 - DNA, 25 bp, Rattus norvegicus
tatgcttgcctagttacgaggtcaa

SEQ ID NO: 568930 - DNA, 25 bp, Rattus norvegicus
tatgcttgctacacagtcactacat

SEQ ID NO: 568931 - DNA, 25 bp, Rattus norvegicus
tatgcttgctactcagtcactacat

SEQ ID NO: 568932 - DNA, 25 bp, Rattus norvegicus
tatgcttgctgtctgcttgctgctc

SEQ ID NO: 568933 - DNA, 25 bp, Rattus norvegicus
tatgcttgctgtgtgcttgctgctc

SEQ ID NO: 568934 - DNA, 25 bp, Rattus norvegicus
tatgcttgctttcatacctgactaa

SEQ ID NO: 568935 - DNA, 25 bp, Rattus norvegicus
tatgcttgctttgatacctgactaa

SEQ ID NO: 568936 - DNA, 25 bp, Rattus norvegicus
tatgcttggcagctggcattctaga

SEQ ID NO: 568937 - DNA, 25 bp, Rattus norvegicus
tatgcttggcaggtggcattctaga

SEQ ID NO: 568938 - DNA, 25 bp, Rattus norvegicus
tatgcttggctgagatggcacggca

SEQ ID NO: 568939 - DNA, 25 bp, Rattus norvegicus
tatgcttggctgtgatggcacggca

SEQ ID NO: 568940 - DNA, 25 bp, Rattus norvegicus
tatgcttgtcatctagttgctgaaa

SEQ ID NO: 568941 - DNA, 25 bp, Rattus norvegicus
tatgcttgtcatgtagttgctgaaa

SEQ ID NO: 568942 - DNA, 25 bp, Rattus norvegicus
tatgctttcctgagtgtactctcaa

SEQ ID NO: 568943 - DNA, 25 bp, Rattus norvegicus
tatgctttcctgtgtgtactctcaa

SEQ ID NO: 568944 - DNA, 25 bp, Rattus norvegicus
tatgctttcttaataaagggctggg

SEQ ID NO: 568945 - DNA, 25 bp, Rattus norvegicus
tatgctttcttattaaagggctggg

SEQ ID NO: 568946 - DNA, 25 bp, Rattus norvegicus
tatgctttgcaaatcgtcctgtaaa

SEQ ID NO: 568947 - DNA, 25 bp, Rattus norvegicus
tatgctttgcaattcgtcctgtaaa

SEQ ID NO: 568948 - DNA, 25 bp, Rattus norvegicus
tatgctttggcaaccagctgctgaa

SEQ ID NO: 568949 - DNA, 25 bp, Rattus norvegicus
tatgctttggcatccagctgctgaa

SEQ ID NO: 568950 - DNA, 25 bp, Rattus norvegicus
tatgctttgttgctatgcacctctt

SEQ ID NO: 568951 - DNA, 25 bp, Rattus norvegicus
tatgctttgttggtatgcacctctt

SEQ ID NO: 568952 - DNA, 25 bp, Rattus norvegicus
tatgcttttcctatgcttgtaacaa

SEQ ID NO: 568953 - DNA, 25 bp, Rattus norvegicus
tatgcttttcctttgcttgtaacaa

SEQ ID NO: 568954 - DNA, 25 bp, Rattus norvegicus
tatgcttttttcataccaactatgg

SEQ ID NO: 568955 - DNA, 25 bp, Rattus norvegicus
tatgcttttttcttaccaactatgg

SEQ ID NO: 568956 - DNA, 25 bp, Rattus norvegicus
tatggaaaaacccatcttattttca

SEQ ID NO: 568957 - DNA, 25 bp, Rattus norvegicus
tatggaaaaaccctgccttccgcac

SEQ ID NO: 568958 - DNA, 25 bp, Rattus norvegicus
tatggaaaaaccgatcttattttca

SEQ ID NO: 568959 - DNA, 25 bp, Rattus norvegicus
tatggaaaaaccgtgccttccgcac

SEQ ID NO: 568960 - DNA, 25 bp, Rattus norvegicus
tatggaaaactccactctggcacct

SEQ ID NO: 568961 - DNA, 25 bp, Rattus norvegicus
tatggaaaactcgactctggcacct

SEQ ID NO: 568962 - DNA, 25 bp, Rattus norvegicus
tatggaaacactcagctacttagct

SEQ ID NO: 568963 - DNA, 25 bp, Rattus norvegicus
tatggaaacactgagctacttagct

SEQ ID NO: 568964 - DNA, 25 bp, Rattus norvegicus
tatggaaacctcaccacactgtttt

SEQ ID NO: 568965 - DNA, 25 bp, Rattus norvegicus
tatggaaacctctccacactgtttt

SEQ ID NO: 568966 - DNA, 25 bp, Rattus norvegicus
tatggaaactcacactttaaaggaa

SEQ ID NO: 568967 - DNA, 25 bp, Rattus norvegicus
tatggaaactcagactttaaaggaa

SEQ ID NO: 568968 - DNA, 25 bp, Rattus norvegicus
tatggaaaggcacactgggcccttc

SEQ ID NO: 568969 - DNA, 25 bp, Rattus norvegicus
tatggaaaggcagactgggcccttc

SEQ ID NO: 568970 - DNA, 25 bp, Rattus norvegicus
tatggaacagccacaagtccctaca

SEQ ID NO: 568971 - DNA, 25 bp, Rattus norvegicus
tatggaacagcctcaagtccctaca

SEQ ID NO: 568972 - DNA, 25 bp, Rattus norvegicus
tatggaacatgtaacctctcccttt

SEQ ID NO: 568973 - DNA, 25 bp, Rattus norvegicus
tatggaacatgttacctctcccttt

SEQ ID NO: 568974 - DNA, 25 bp, Rattus norvegicus
tatggaaccagtctgcagtctgtga

SEQ ID NO: 568975 - DNA, 25 bp, Rattus norvegicus
tatggaaccagtgtgcagtctgtga

SEQ ID NO: 568976 - DNA, 25 bp, Rattus norvegicus
tatggaacctcccacatcccagggt

SEQ ID NO: 568977 - DNA, 25 bp, Rattus norvegicus
tatggaacctccgacatcccagggt

SEQ ID NO: 568978 - DNA, 25 bp, Rattus norvegicus
tatggaacggaaactgcccagcaat

SEQ ID NO: 568979 - DNA, 25 bp, Rattus norvegicus
tatggaacggaatctgcccagcaat

SEQ ID NO: 568980 - DNA, 25 bp, Rattus norvegicus
tatggaactagacctcagcctcctc

SEQ ID NO: 568981 - DNA, 25 bp, Rattus norvegicus
tatggaactagagctcagcctcctc

SEQ ID NO: 568982 - DNA, 25 bp, Rattus norvegicus
tatggaactatcacagacttctgta

SEQ ID NO: 568983 - DNA, 25 bp, Rattus norvegicus
tatggaactatctcagacttctgta

SEQ ID NO: 568984 - DNA, 25 bp, Rattus norvegicus
tatggaactccgaaactacttctcc

SEQ ID NO: 568985 - DNA, 25 bp, Rattus norvegicus
tatggaactccgtaactacttctcc

SEQ ID NO: 568986 - DNA, 25 bp, Rattus norvegicus
tatggaacttctctgggttgtccca

SEQ ID NO: 568987 - DNA, 25 bp, Rattus norvegicus
tatggaacttctgtgggttgtccca

SEQ ID NO: 568988 - DNA, 25 bp, Rattus norvegicus
tatggaagcacaaccgtgtaccgct

SEQ ID NO: 568989 - DNA, 25 bp, Rattus norvegicus
tatggaagcacatccgtgtaccgct

SEQ ID NO: 568990 - DNA, 25 bp, Rattus norvegicus
tatggaagcccgaattctgcctttg

SEQ ID NO: 568991 - DNA, 25 bp, Rattus norvegicus
tatggaagcccgtattctgcctttg

SEQ ID NO: 568992 - DNA, 25 bp, Rattus norvegicus
tatggaagcctcattgtgtacccca

SEQ ID NO: 568993 - DNA, 25 bp, Rattus norvegicus
tatggaagcctctttgtgtacccca

SEQ ID NO: 568994 - DNA, 25 bp, Rattus norvegicus
tatggaaggtctagggttacatccc

SEQ ID NO: 568995 - DNA, 25 bp, Rattus norvegicus
tatggaaggtctctgaaacccctcc

SEQ ID NO: 568996 - DNA, 25 bp, Rattus norvegicus
tatggaaggtctgtgaaacccctcc

SEQ ID NO: 568997 - DNA, 25 bp, Rattus norvegicus
tatggaaggtcttgggttacatccc

SEQ ID NO: 568998 - DNA, 25 bp, Rattus norvegicus
tatggaagtccccataggcacccag

SEQ ID NO: 568999 - DNA, 25 bp, Rattus norvegicus
tatggaagtcccgataggcacccag

SEQ ID NO: 569000 - DNA, 25 bp, Rattus norvegicus
tatggaagtcctagatggcctgaac

SEQ ID NO: 569001 - DNA, 25 bp, Rattus norvegicus
tatggaagtccttgatggcctgaac

SEQ ID NO: 569002 - DNA, 25 bp, Rattus norvegicus
tatggaagtgcccagtgcagcctct

SEQ ID NO: 569003 - DNA, 25 bp, Rattus norvegicus
tatggaagtgccgagtgcagcctct

SEQ ID NO: 569004 - DNA, 25 bp, Rattus norvegicus
tatggaataccaccagaacttgata

SEQ ID NO: 569005 - DNA, 25 bp, Rattus norvegicus
tatggaataccagcagaacttgata

SEQ ID NO: 569006 - DNA, 25 bp, Rattus norvegicus
tatggaatattcacccagcttcgct

SEQ ID NO: 569007 - DNA, 25 bp, Rattus norvegicus
tatggaatattctcccagcttcgct

SEQ ID NO: 569008 - DNA, 25 bp, Rattus norvegicus
tatggaatctctcaacctgccagcc

SEQ ID NO: 569009 - DNA, 25 bp, Rattus norvegicus
tatggaatctctgaacctgccagcc

SEQ ID NO: 569010 - DNA, 25 bp, Rattus norvegicus
tatggaatctgcatagagcctacag

SEQ ID NO: 569011 - DNA, 25 bp, Rattus norvegicus
tatggaatctgcttagagcctacag

SEQ ID NO: 569012 - DNA, 25 bp, Rattus norvegicus
tatggaatttctcttccggttggtt

SEQ ID NO: 569013 - DNA, 25 bp, Rattus norvegicus
tatggaatttctgttccggttggtt

SEQ ID NO: 569014 - DNA, 25 bp, Rattus norvegicus
tatggacacacacaaacccgctatg

SEQ ID NO: 569015 - DNA, 25 bp, Rattus norvegicus
tatggacacacagaaacccgctatg

SEQ ID NO: 569016 - DNA, 25 bp, Rattus norvegicus
tatggacactttatcagcaacccct

SEQ ID NO: 569017 - DNA, 25 bp, Rattus norvegicus
tatggacactttttcagcaacccct

SEQ ID NO: 569018 - DNA, 25 bp, Rattus norvegicus
tatggacatatgctacacccacaca

SEQ ID NO: 569019 - DNA, 25 bp, Rattus norvegicus
tatggacatatggtacacccacaca

SEQ ID NO: 569020 - DNA, 25 bp, Rattus norvegicus
tatggaccatcaccaagccacaagg

SEQ ID NO: 569021 - DNA, 25 bp, Rattus norvegicus
tatggaccatcagcaagccacaagg

SEQ ID NO: 569022 - DNA, 25 bp, Rattus norvegicus
tatggacctagcacgaggcagtttt

SEQ ID NO: 569023 - DNA, 25 bp, Rattus norvegicus
tatggacctagctcgaggcagtttt

SEQ ID NO: 569024 - DNA, 25 bp, Rattus norvegicus
tatggacgcctcatctctgagctca

SEQ ID NO: 569025 - DNA, 25 bp, Rattus norvegicus
tatggacgcctcttctctgagctca

SEQ ID NO: 569026 - DNA, 25 bp, Rattus norvegicus
tatggacgcctgcactaggtttcac

SEQ ID NO: 569027 - DNA, 25 bp, Rattus norvegicus
tatggacgcctggactaggtttcac

SEQ ID NO: 569028 - DNA, 25 bp, Rattus norvegicus
tatggacgggctcccgaagaactcc

SEQ ID NO: 569029 - DNA, 25 bp, Rattus norvegicus
tatggacgggctgccgaagaactcc

SEQ ID NO: 569030 - DNA, 25 bp, Rattus norvegicus
tatggacgtatgacgggttcaccca

SEQ ID NO: 569031 - DNA, 25 bp, Rattus norvegicus
tatggacgtatgtcgggttcaccca

SEQ ID NO: 569032 - DNA, 25 bp, Rattus norvegicus
tatggacgtggacatgcaaagcccc

SEQ ID NO: 569033 - DNA, 25 bp, Rattus norvegicus
tatggacgtggagatgcaaagcccc

SEQ ID NO: 569034 - DNA, 25 bp, Rattus norvegicus
tatggactagtcactgtcagttaat

SEQ ID NO: 569035 - DNA, 25 bp, Rattus norvegicus
tatggactagtctctgtcagttaat

SEQ ID NO: 569036 - DNA, 25 bp, Rattus norvegicus
tatggactattacagcaactgcagc

SEQ ID NO: 569037 - DNA, 25 bp, Rattus norvegicus
tatggactattagagcaactgcagc

SEQ ID NO: 569038 - DNA, 25 bp, Rattus norvegicus
tatggactcagaccctccaagaggt

SEQ ID NO: 569039 - DNA, 25 bp, Rattus norvegicus
tatggactcagagcctccaagaggt

SEQ ID NO: 569040 - DNA, 25 bp, Rattus norvegicus
tatggactcaggctcatcatgcctc

SEQ ID NO: 569041 - DNA, 25 bp, Rattus norvegicus
tatggactcagggtcatcatgcctc

SEQ ID NO: 569042 - DNA, 25 bp, Rattus norvegicus
tatggactcctgagaggcctaggcc

SEQ ID NO: 569043 - DNA, 25 bp, Rattus norvegicus
tatggactcctgtgaggcctaggcc

SEQ ID NO: 569044 - DNA, 25 bp, Rattus norvegicus
tatggactctctagacctccagaac

SEQ ID NO: 569045 - DNA, 25 bp, Rattus norvegicus
tatggactctcttgacctccagaac

SEQ ID NO: 569046 - DNA, 25 bp, Rattus norvegicus
tatggactgcatcaaagctctccgg

SEQ ID NO: 569047 - DNA, 25 bp, Rattus norvegicus
tatggactgcatgaaagctctccgg

SEQ ID NO: 569048 - DNA, 25 bp, Rattus norvegicus
tatggactgtgtaggtttccgtccg

SEQ ID NO: 569049 - DNA, 25 bp, Rattus norvegicus
tatggactgtgttggtttccgtccg

SEQ ID NO: 569050 - DNA, 25 bp, Rattus norvegicus
tatggacttgctccatgtgtcacct

SEQ ID NO: 569051 - DNA, 25 bp, Rattus norvegicus
tatggacttgctgcatgtgtcacct

SEQ ID NO: 569052 - DNA, 25 bp, Rattus norvegicus
tatggagaacccacacaactgccag

SEQ ID NO: 569053 - DNA, 25 bp, Rattus norvegicus
tatggagaaccctcacaactgccag

SEQ ID NO: 569054 - DNA, 25 bp, Rattus norvegicus
tatggagaagatatggcaccacact

SEQ ID NO: 569055 - DNA, 25 bp, Rattus norvegicus
tatggagaagatttggcaccacact

SEQ ID NO: 569056 - DNA, 25 bp, Rattus norvegicus
tatggagaattgatcaagtcttccc

SEQ ID NO: 569057 - DNA, 25 bp, Rattus norvegicus
tatggagaattgttcaagtcttccc

SEQ ID NO: 569058 - DNA, 25 bp, Rattus norvegicus
tatggagacatgaaggcacggaggc

SEQ ID NO: 569059 - DNA, 25 bp, Rattus norvegicus
tatggagacatgtaggcacggaggc

SEQ ID NO: 569060 - DNA, 25 bp, Rattus norvegicus
tatggagacccgcagtcgccacagt

SEQ ID NO: 569061 - DNA, 25 bp, Rattus norvegicus
tatggagacccggagtcgccacagt

SEQ ID NO: 569062 - DNA, 25 bp, Rattus norvegicus
tatggagaccctccctccaggcaaa

SEQ ID NO: 569063 - DNA, 25 bp, Rattus norvegicus
tatggagaccctgcctccaggcaaa

SEQ ID NO: 569064 - DNA, 25 bp, Rattus norvegicus
tatggagaggacatgacgcccaccc

SEQ ID NO: 569065 - DNA, 25 bp, Rattus norvegicus
tatggagaggacttgacgcccaccc

SEQ ID NO: 569066 - DNA, 25 bp, Rattus norvegicus
tatggagatggtcttcctctgcagc

SEQ ID NO: 569067 - DNA, 25 bp, Rattus norvegicus
tatggagatggtgttcctctgcagc

SEQ ID NO: 569068 - DNA, 25 bp, Rattus norvegicus
tatggagccaacataagcggccaca

SEQ ID NO: 569069 - DNA, 25 bp, Rattus norvegicus
tatggagccaacttaagcggccaca

SEQ ID NO: 569070 - DNA, 25 bp, Rattus norvegicus
tatggagccagactcatgccatggt

SEQ ID NO: 569071 - DNA, 25 bp, Rattus norvegicus
tatggagccagagtcatgccatggt

SEQ ID NO: 569072 - DNA, 25 bp, Rattus norvegicus
tatggagcccatcaaaggtgacggt

SEQ ID NO: 569073 - DNA, 25 bp, Rattus norvegicus
tatggagcccatgaaaggtgacggt

SEQ ID NO: 569074 - DNA, 25 bp, Rattus norvegicus
tatggagcctagcaaccagcccagg

SEQ ID NO: 569075 - DNA, 25 bp, Rattus norvegicus
tatggagcctaggaaccagcccagg

SEQ ID NO: 569076 - DNA, 25 bp, Rattus norvegicus
tatggagcctctcggtggagaaact

SEQ ID NO: 569077 - DNA, 25 bp, Rattus norvegicus
tatggagcctctgggtggagaaact

SEQ ID NO: 569078 - DNA, 25 bp, Rattus norvegicus
tatggagcctgcctcttccctaaaa

SEQ ID NO: 569079 - DNA, 25 bp, Rattus norvegicus
tatggagcctgcgtcttccctaaaa

SEQ ID NO: 569080 - DNA, 25 bp, Rattus norvegicus
tatggagctagtaccacttcagagt

SEQ ID NO: 569081 - DNA, 25 bp, Rattus norvegicus
tatggagctagttccacttcagagt

SEQ ID NO: 569082 - DNA, 25 bp, Rattus norvegicus
tatggagctccgcaacccaggagtc

SEQ ID NO: 569083 - DNA, 25 bp, Rattus norvegicus
tatggagctccggaacccaggagtc

SEQ ID NO: 569084 - DNA, 25 bp, Rattus norvegicus
tatggagctgtgcaccctggaaata

SEQ ID NO: 569085 - DNA, 25 bp, Rattus norvegicus
tatggagctgtggaccctggaaata

SEQ ID NO: 569086 - DNA, 25 bp, Rattus norvegicus
tatggagcttccagagcagtggttc

SEQ ID NO: 569087 - DNA, 25 bp, Rattus norvegicus
tatggagcttcctgagcagtggttc

SEQ ID NO: 569088 - DNA, 25 bp, Rattus norvegicus
tatggaggcccacgaatttgattcc

SEQ ID NO: 569089 - DNA, 25 bp, Rattus norvegicus
tatggaggcccaggaatttgattcc

SEQ ID NO: 569090 - DNA, 25 bp, Rattus norvegicus
tatggaggctgaacttggacaactt

SEQ ID NO: 569091 - DNA, 25 bp, Rattus norvegicus
tatggaggctgatcttggacaactt

SEQ ID NO: 569092 - DNA, 25 bp, Rattus norvegicus
tatggagggcctcgtgtacaataaa

SEQ ID NO: 569093 - DNA, 25 bp, Rattus norvegicus
tatggagggcctggtgtacaataaa

SEQ ID NO: 569094 - DNA, 25 bp, Rattus norvegicus
tatggaggtctcacgggcctcaata

SEQ ID NO: 569095 - DNA, 25 bp, Rattus norvegicus
tatggaggtctctcgggcctcaata

SEQ ID NO: 569096 - DNA, 25 bp, Rattus norvegicus
tatggagtaaccctgtcacacaaga

SEQ ID NO: 569097 - DNA, 25 bp, Rattus norvegicus
tatggagtaaccgtgtcacacaaga

SEQ ID NO: 569098 - DNA, 25 bp, Rattus norvegicus
tatggagtactaatgcctacctctc

SEQ ID NO: 569099 - DNA, 25 bp, Rattus norvegicus
tatggagtactattgcctacctctc

SEQ ID NO: 569100 - DNA, 25 bp, Rattus norvegicus
tatggagtcattattacaacgtaat

SEQ ID NO: 569101 - DNA, 25 bp, Rattus norvegicus
tatggagtcatttttacaacgtaat

SEQ ID NO: 569102 - DNA, 25 bp, Rattus norvegicus
tatggagtggccacaaatctccctg

SEQ ID NO: 569103 - DNA, 25 bp, Rattus norvegicus
tatggagtggcctcaaatctccctg

SEQ ID NO: 569104 - DNA, 25 bp, Rattus norvegicus
tatggagttataccctacgggaaaa

SEQ ID NO: 569105 - DNA, 25 bp, Rattus norvegicus
tatggagttatagcctacgggaaaa

SEQ ID NO: 569106 - DNA, 25 bp, Rattus norvegicus
tatggagttcaaaccgtcctgtctg

SEQ ID NO: 569107 - DNA, 25 bp, Rattus norvegicus
tatggagttcaatccgtcctgtctg

SEQ ID NO: 569108 - DNA, 25 bp, Rattus norvegicus
tatggataagacaccaccgaatcat

SEQ ID NO: 569109 - DNA, 25 bp, Rattus norvegicus
tatggataagactccaccgaatcat

SEQ ID NO: 569110 - DNA, 25 bp, Rattus norvegicus
tatggatatatgacagtctggcccc

SEQ ID NO: 569111 - DNA, 25 bp, Rattus norvegicus
tatggatatatgtcagtctggcccc

SEQ ID NO: 569112 - DNA, 25 bp, Rattus norvegicus
tatggatcacaaccgaaaccgcagg

SEQ ID NO: 569113 - DNA, 25 bp, Rattus norvegicus
tatggatcacaagcgaaaccgcagg

SEQ ID NO: 569114 - DNA, 25 bp, Rattus norvegicus
tatggatccagcaggtgtccagcac

SEQ ID NO: 569115 - DNA, 25 bp, Rattus norvegicus
tatggatccagctggtgtccagcac

SEQ ID NO: 569116 - DNA, 25 bp, Rattus norvegicus
tatggatcccacagagaaccccaag

SEQ ID NO: 569117 - DNA, 25 bp, Rattus norvegicus
tatggatcccactgagaaccccaag

SEQ ID NO: 569118 - DNA, 25 bp, Rattus norvegicus
tatggatccctacaccagcacagga

SEQ ID NO: 569119 - DNA, 25 bp, Rattus norvegicus
tatggatccctagaccagcacagga

SEQ ID NO: 569120 - DNA, 25 bp, Rattus norvegicus
tatggatcctatattcggctgaaca

SEQ ID NO: 569121 - DNA, 25 bp, Rattus norvegicus
tatggatcctattttcggctgaaca

SEQ ID NO: 569122 - DNA, 25 bp, Rattus norvegicus
tatggatctgagcactctctgggtg

SEQ ID NO: 569123 - DNA, 25 bp, Rattus norvegicus
tatggatctgaggactctctgggtg

SEQ ID NO: 569124 - DNA, 25 bp, Rattus norvegicus
tatggatcttcccagtctaatgcac

SEQ ID NO: 569125 - DNA, 25 bp, Rattus norvegicus
tatggatcttccgagtctaatgcac

SEQ ID NO: 569126 - DNA, 25 bp, Rattus norvegicus
tatggatgcaaaccagacttacctg

SEQ ID NO: 569127 - DNA, 25 bp, Rattus norvegicus
tatggatgcaaagcagacttacctg

SEQ ID NO: 569128 - DNA, 25 bp, Rattus norvegicus
tatggatgccaaattaccctctgtg

SEQ ID NO: 569129 - DNA, 25 bp, Rattus norvegicus
tatggatgccaatttaccctctgtg

SEQ ID NO: 569130 - DNA, 25 bp, Rattus norvegicus
tatggatgccacaatgaacgctgac

SEQ ID NO: 569131 - DNA, 25 bp, Rattus norvegicus
tatggatgccacacttcctgtgcgt

SEQ ID NO: 569132 - DNA, 25 bp, Rattus norvegicus
tatggatgccactatgaacgctgac

SEQ ID NO: 569133 - DNA, 25 bp, Rattus norvegicus
tatggatgccactcttcctgtgcgt

SEQ ID NO: 569134 - DNA, 25 bp, Rattus norvegicus
tatggatgcctacgcttcatgctgg

SEQ ID NO: 569135 - DNA, 25 bp, Rattus norvegicus
tatggatgcctaggcttcatgctgg

SEQ ID NO: 569136 - DNA, 25 bp, Rattus norvegicus
tatggattgccacacagcacagatg

SEQ ID NO: 569137 - DNA, 25 bp, Rattus norvegicus
tatggattgccagacagcacagatg

SEQ ID NO: 569138 - DNA, 25 bp, Rattus norvegicus
tatggattggcgaggttcttccgca

SEQ ID NO: 569139 - DNA, 25 bp, Rattus norvegicus
tatggattggcgtggttcttccgca

SEQ ID NO: 569140 - DNA, 25 bp, Rattus norvegicus
tatggatttgccagataccttgtct

SEQ ID NO: 569141 - DNA, 25 bp, Rattus norvegicus
tatggatttgcctgataccttgtct

SEQ ID NO: 569142 - DNA, 25 bp, Rattus norvegicus
tatggcaaagccacgagctgcagct

SEQ ID NO: 569143 - DNA, 25 bp, Rattus norvegicus
tatggcaaagcctcgagctgcagct

SEQ ID NO: 569144 - DNA, 25 bp, Rattus norvegicus
tatggcaaatccctgtactacttca

SEQ ID NO: 569145 - DNA, 25 bp, Rattus norvegicus
tatggcaaatccgtgtactacttca

SEQ ID NO: 569146 - DNA, 25 bp, Rattus norvegicus
tatggcaaccggcagaacatgggct

SEQ ID NO: 569147 - DNA, 25 bp, Rattus norvegicus
tatggcaaccgggagaacatgggct

SEQ ID NO: 569148 - DNA, 25 bp, Rattus norvegicus
tatggcaccaagaactcgggcaggc

SEQ ID NO: 569149 - DNA, 25 bp, Rattus norvegicus
tatggcaccaagatacaaccctttc

SEQ ID NO: 569150 - DNA, 25 bp, Rattus norvegicus
tatggcaccaagtactcgggcaggc

SEQ ID NO: 569151 - DNA, 25 bp, Rattus norvegicus
tatggcaccaagttacaaccctttc

SEQ ID NO: 569152 - DNA, 25 bp, Rattus norvegicus
tatggcaccaccctttagggcatgt

SEQ ID NO: 569153 - DNA, 25 bp, Rattus norvegicus
tatggcaccaccgtttagggcatgt

SEQ ID NO: 569154 - DNA, 25 bp, Rattus norvegicus
tatggcaccctacctcgaatactaa

SEQ ID NO: 569155 - DNA, 25 bp, Rattus norvegicus
tatggcaccctagctcgaatactaa

SEQ ID NO: 569156 - DNA, 25 bp, Rattus norvegicus
tatggcactgcactcccgtgagcaa

SEQ ID NO: 569157 - DNA, 25 bp, Rattus norvegicus
tatggcactgcagtcccgtgagcaa

SEQ ID NO: 569158 - DNA, 25 bp, Rattus norvegicus
tatggcagaactcccacaggtcaag

SEQ ID NO: 569159 - DNA, 25 bp, Rattus norvegicus
tatggcagaactgccacaggtcaag

SEQ ID NO: 569160 - DNA, 25 bp, Rattus norvegicus
tatggcagctttcggcattcttttt

SEQ ID NO: 569161 - DNA, 25 bp, Rattus norvegicus
tatggcagctttgggcattcttttt

SEQ ID NO: 569162 - DNA, 25 bp, Rattus norvegicus
tatggcaggcgcaaactcgattttc

SEQ ID NO: 569163 - DNA, 25 bp, Rattus norvegicus
tatggcaggcgctaactcgattttc

SEQ ID NO: 569164 - DNA, 25 bp, Rattus norvegicus
tatggcagtgaaaggacggtcaaca

SEQ ID NO: 569165 - DNA, 25 bp, Rattus norvegicus
tatggcagtgaatggacggtcaaca

SEQ ID NO: 569166 - DNA, 25 bp, Rattus norvegicus
tatggcagtgcgagtggctctccta

SEQ ID NO: 569167 - DNA, 25 bp, Rattus norvegicus
tatggcagtgcgtgtggctctccta

SEQ ID NO: 569168 - DNA, 25 bp, Rattus norvegicus
tatggcatctacaaggaccgcgggc

SEQ ID NO: 569169 - DNA, 25 bp, Rattus norvegicus
tatggcatctactaggaccgcgggc

SEQ ID NO: 569170 - DNA, 25 bp, Rattus norvegicus
tatggcatctatcctggacacttgg

SEQ ID NO: 569171 - DNA, 25 bp, Rattus norvegicus
tatggcatctatgctggacacttgg

SEQ ID NO: 569172 - DNA, 25 bp, Rattus norvegicus
tatggcatgacaatcctaggactcg

SEQ ID NO: 569173 - DNA, 25 bp, Rattus norvegicus
tatggcatgacattcctaggactcg

SEQ ID NO: 569174 - DNA, 25 bp, Rattus norvegicus
tatggcattgccaatcagctcaggc

SEQ ID NO: 569175 - DNA, 25 bp, Rattus norvegicus
tatggcattgcctatcagctcaggc

SEQ ID NO: 569176 - DNA, 25 bp, Rattus norvegicus
tatggccaaatgatactccgtgtac

SEQ ID NO: 569177 - DNA, 25 bp, Rattus norvegicus
tatggccaaatgttactccgtgtac

SEQ ID NO: 569178 - DNA, 25 bp, Rattus norvegicus
tatggccaagcccaacttgatcatc

SEQ ID NO: 569179 - DNA, 25 bp, Rattus norvegicus
tatggccaagccgaacttgatcatc

SEQ ID NO: 569180 - DNA, 25 bp, Rattus norvegicus
tatggccaattccagcaaaggatta

SEQ ID NO: 569181 - DNA, 25 bp, Rattus norvegicus
tatggccaattcgagcaaaggatta

SEQ ID NO: 569182 - DNA, 25 bp, Rattus norvegicus
tatggccacactctttgtttcttgt

SEQ ID NO: 569183 - DNA, 25 bp, Rattus norvegicus
tatggccacactgtttgtttcttgt

SEQ ID NO: 569184 - DNA, 25 bp, Rattus norvegicus
tatggccacattccgttttcaacat

SEQ ID NO: 569185 - DNA, 25 bp, Rattus norvegicus
tatggccacattgcgttttcaacat

SEQ ID NO: 569186 - DNA, 25 bp, Rattus norvegicus
tatggccaccccaaagttcaatcat

SEQ ID NO: 569187 - DNA, 25 bp, Rattus norvegicus
tatggccacccctaagttcaatcat

SEQ ID NO: 569188 - DNA, 25 bp, Rattus norvegicus
tatggccaggccattcatggatccc

SEQ ID NO: 569189 - DNA, 25 bp, Rattus norvegicus
tatggccaggcctttcatggatccc

SEQ ID NO: 569190 - DNA, 25 bp, Rattus norvegicus
tatggccaggtcacacatatcctca

SEQ ID NO: 569191 - DNA, 25 bp, Rattus norvegicus
tatggccaggtctcacatatcctca

SEQ ID NO: 569192 - DNA, 25 bp, Rattus norvegicus
tatggccatcatagttatcttatac

SEQ ID NO: 569193 - DNA, 25 bp, Rattus norvegicus
tatggccatcattgttatcttatac

SEQ ID NO: 569194 - DNA, 25 bp, Rattus norvegicus
tatggccatggtctctgtggagcat

SEQ ID NO: 569195 - DNA, 25 bp, Rattus norvegicus
tatggccatggtgtctgtggagcat

SEQ ID NO: 569196 - DNA, 25 bp, Rattus norvegicus
tatggcccagccatgagtggacagt

SEQ ID NO: 569197 - DNA, 25 bp, Rattus norvegicus
tatggcccagccttgagtggacagt

SEQ ID NO: 569198 - DNA, 25 bp, Rattus norvegicus
tatggcccagtaaccactccaagaa

SEQ ID NO: 569199 - DNA, 25 bp, Rattus norvegicus
tatggcccagtatccactccaagaa

SEQ ID NO: 569200 - DNA, 25 bp, Rattus norvegicus
tatggcccattcacttcctatagta

SEQ ID NO: 569201 - DNA, 25 bp, Rattus norvegicus
tatggcccattctcttcctatagta

SEQ ID NO: 569202 - DNA, 25 bp, Rattus norvegicus
tatggccccaaactgtaaatagtct

SEQ ID NO: 569203 - DNA, 25 bp, Rattus norvegicus
tatggccccaaagtgtaaatagtct

SEQ ID NO: 569204 - DNA, 25 bp, Rattus norvegicus
tatggccccagcatgctaggtcacc

SEQ ID NO: 569205 - DNA, 25 bp, Rattus norvegicus
tatggccccagcttgctaggtcacc

SEQ ID NO: 569206 - DNA, 25 bp, Rattus norvegicus
tatggcccctggaattgctgggatt

SEQ ID NO: 569207 - DNA, 25 bp, Rattus norvegicus
tatggcccctggtattgctgggatt

SEQ ID NO: 569208 - DNA, 25 bp, Rattus norvegicus
tatggccctatcaatgattctttcc

SEQ ID NO: 569209 - DNA, 25 bp, Rattus norvegicus
tatggccctatctatgattctttcc

SEQ ID NO: 569210 - DNA, 25 bp, Rattus norvegicus
tatggccctggccatgacatcgtgt

SEQ ID NO: 569211 - DNA, 25 bp, Rattus norvegicus
tatggccctggcgatgacatcgtgt

SEQ ID NO: 569212 - DNA, 25 bp, Rattus norvegicus
tatggccgacgccttagtgaagcta

SEQ ID NO: 569213 - DNA, 25 bp, Rattus norvegicus
tatggccgacgcgttagtgaagcta

SEQ ID NO: 569214 - DNA, 25 bp, Rattus norvegicus
tatggccgagtcacctctagattca

SEQ ID NO: 569215 - DNA, 25 bp, Rattus norvegicus
tatggccgagtctcctctagattca

SEQ ID NO: 569216 - DNA, 25 bp, Rattus norvegicus
tatggccgcccgaccctgaatgtac

SEQ ID NO: 569217 - DNA, 25 bp, Rattus norvegicus
tatggccgcccgtccctgaatgtac

SEQ ID NO: 569218 - DNA, 25 bp, Rattus norvegicus
tatggccgtgccaggcaggaatact

SEQ ID NO: 569219 - DNA, 25 bp, Rattus norvegicus
tatggccgtgcctggcaggaatact

SEQ ID NO: 569220 - DNA, 25 bp, Rattus norvegicus
tatggcctacaactaaaccccgaat

SEQ ID NO: 569221 - DNA, 25 bp, Rattus norvegicus
tatggcctacaagtaaaccccgaat

SEQ ID NO: 569222 - DNA, 25 bp, Rattus norvegicus
tatggcctagtaatccttcagaaac

SEQ ID NO: 569223 - DNA, 25 bp, Rattus norvegicus
tatggcctagtattccttcagaaac

SEQ ID NO: 569224 - DNA, 25 bp, Rattus norvegicus
tatggcctatttcctgtgtatcctt

SEQ ID NO: 569225 - DNA, 25 bp, Rattus norvegicus
tatggcctatttgctgtgtatcctt

SEQ ID NO: 569226 - DNA, 25 bp, Rattus norvegicus
tatggcctcactagtcatattggct

SEQ ID NO: 569227 - DNA, 25 bp, Rattus norvegicus
tatggcctcacttgtcatattggct

SEQ ID NO: 569228 - DNA, 25 bp, Rattus norvegicus
tatggcctcgggatacaggttggaa

SEQ ID NO: 569229 - DNA, 25 bp, Rattus norvegicus
tatggcctcgggttacaggttggaa

SEQ ID NO: 569230 - DNA, 25 bp, Rattus norvegicus
tatggcctcttcaggactgaactgc

SEQ ID NO: 569231 - DNA, 25 bp, Rattus norvegicus
tatggcctcttctggactgaactgc

SEQ ID NO: 569232 - DNA, 25 bp, Rattus norvegicus
tatggcctgagcatggtgggacaac

SEQ ID NO: 569233 - DNA, 25 bp, Rattus norvegicus
tatggcctgagcttggtgggacaac

SEQ ID NO: 569234 - DNA, 25 bp, Rattus norvegicus
tatggcctggacaaggaactgcctc

SEQ ID NO: 569235 - DNA, 25 bp, Rattus norvegicus
tatggcctggactaggaactgcctc

SEQ ID NO: 569236 - DNA, 25 bp, Rattus norvegicus
tatggccttcttactattcttattt

SEQ ID NO: 569237 - DNA, 25 bp, Rattus norvegicus
tatggccttctttctattcttattt

SEQ ID NO: 569238 - DNA, 25 bp, Rattus norvegicus
tatggccttgtaagatgagagcttc

SEQ ID NO: 569239 - DNA, 25 bp, Rattus norvegicus
tatggccttgtatgatgagagcttc

SEQ ID NO: 569240 - DNA, 25 bp, Rattus norvegicus
tatggcctttataacagtgaacagt

SEQ ID NO: 569241 - DNA, 25 bp, Rattus norvegicus
tatggcctttattacagtgaacagt

SEQ ID NO: 569242 - DNA, 25 bp, Rattus norvegicus
tatggcgatcttcagtgcactctct

SEQ ID NO: 569243 - DNA, 25 bp, Rattus norvegicus
tatggcgatcttgagtgcactctct

SEQ ID NO: 569244 - DNA, 25 bp, Rattus norvegicus
tatggcgtgtaactcgccacagtca

SEQ ID NO: 569245 - DNA, 25 bp, Rattus norvegicus
tatggcgtgtaagtcgccacagtca

SEQ ID NO: 569246 - DNA, 25 bp, Rattus norvegicus
tatggctagcttaggtctgggcagt

SEQ ID NO: 569247 - DNA, 25 bp, Rattus norvegicus
tatggctagctttggtctgggcagt

SEQ ID NO: 569248 - DNA, 25 bp, Rattus norvegicus
tatggctatgagattcctgtggaca

SEQ ID NO: 569249 - DNA, 25 bp, Rattus norvegicus
tatggctatgagtttcctgtggaca

SEQ ID NO: 569250 - DNA, 25 bp, Rattus norvegicus
tatggctatgctactattatggaat

SEQ ID NO: 569251 - DNA, 25 bp, Rattus norvegicus
tatggctatgcttctattatggaat

SEQ ID NO: 569252 - DNA, 25 bp, Rattus norvegicus
tatggctcagcaagcctcagggaga

SEQ ID NO: 569253 - DNA, 25 bp, Rattus norvegicus
tatggctcagcatgcctcagggaga

SEQ ID NO: 569254 - DNA, 25 bp, Rattus norvegicus
tatggctccctgcagataattcctg

SEQ ID NO: 569255 - DNA, 25 bp, Rattus norvegicus
tatggctccctggagataattcctg

SEQ ID NO: 569256 - DNA, 25 bp, Rattus norvegicus
tatggctcctccacctggaatgaga

SEQ ID NO: 569257 - DNA, 25 bp, Rattus norvegicus
tatggctcctcctcctggaatgaga

SEQ ID NO: 569258 - DNA, 25 bp, Rattus norvegicus
tatggctctttcattgtgtcatcct

SEQ ID NO: 569259 - DNA, 25 bp, Rattus norvegicus
tatggctctttctttgtgtcatcct

SEQ ID NO: 569260 - DNA, 25 bp, Rattus norvegicus
tatggctgagccaatgtttgtgtcc

SEQ ID NO: 569261 - DNA, 25 bp, Rattus norvegicus
tatggctgagcctatgtttgtgtcc

SEQ ID NO: 569262 - DNA, 25 bp, Rattus norvegicus
tatggctgaggacaataaggatgat

SEQ ID NO: 569263 - DNA, 25 bp, Rattus norvegicus
tatggctgaggagaataaggatgat

SEQ ID NO: 569264 - DNA, 25 bp, Rattus norvegicus
tatggctgctgaccgaatgcaaacc

SEQ ID NO: 569265 - DNA, 25 bp, Rattus norvegicus
tatggctgctgagcgaatgcaaacc

SEQ ID NO: 569266 - DNA, 25 bp, Rattus norvegicus
tatggctgcttgaacgtgtcttgtt

SEQ ID NO: 569267 - DNA, 25 bp, Rattus norvegicus
tatggctgcttgtacgtgtcttgtt

SEQ ID NO: 569268 - DNA, 25 bp, Rattus norvegicus
tatggctgggctaactcttaacaga

SEQ ID NO: 569269 - DNA, 25 bp, Rattus norvegicus
tatggctgggcttactcttaacaga

SEQ ID NO: 569270 - DNA, 25 bp, Rattus norvegicus
tatggctggtgtacactttcctccc

SEQ ID NO: 569271 - DNA, 25 bp, Rattus norvegicus
tatggctggtgttcactttcctccc

SEQ ID NO: 569272 - DNA, 25 bp, Rattus norvegicus
tatggctgtgcactagggtgtctct

SEQ ID NO: 569273 - DNA, 25 bp, Rattus norvegicus
tatggctgtgcagtagggtgtctct

SEQ ID NO: 569274 - DNA, 25 bp, Rattus norvegicus
tatggctgtgctaaggactgcggtt

SEQ ID NO: 569275 - DNA, 25 bp, Rattus norvegicus
tatggctgtgcttaggactgcggtt

SEQ ID NO: 569276 - DNA, 25 bp, Rattus norvegicus
tatggctgttaacaactgtgggctt

SEQ ID NO: 569277 - DNA, 25 bp, Rattus norvegicus
tatggctgttaagaactgtgggctt

SEQ ID NO: 569278 - DNA, 25 bp, Rattus norvegicus
tatggcttacccaatgttcctgaca

SEQ ID NO: 569279 - DNA, 25 bp, Rattus norvegicus
tatggcttaccctatgttcctgaca

SEQ ID NO: 569280 - DNA, 25 bp, Rattus norvegicus
tatggcttcaccatcgtgcgtgact

SEQ ID NO: 569281 - DNA, 25 bp, Rattus norvegicus
tatggcttcaccttcgtgcgtgact

SEQ ID NO: 569282 - DNA, 25 bp, Rattus norvegicus
tatggcttcagtcaatatgtagcag

SEQ ID NO: 569283 - DNA, 25 bp, Rattus norvegicus
tatggcttcagtgaatatgtagcag

SEQ ID NO: 569284 - DNA, 25 bp, Rattus norvegicus
tatggcttctcgctttgccactcta

SEQ ID NO: 569285 - DNA, 25 bp, Rattus norvegicus
tatggcttctcggtttgccactcta

SEQ ID NO: 569286 - DNA, 25 bp, Rattus norvegicus
tatggcttctgtcaccgtgtgggca

SEQ ID NO: 569287 - DNA, 25 bp, Rattus norvegicus
tatggcttctgtcgcacttgaaagg

SEQ ID NO: 569288 - DNA, 25 bp, Rattus norvegicus
tatggcttctgtgaccgtgtgggca

SEQ ID NO: 569289 - DNA, 25 bp, Rattus norvegicus
tatggcttctgtggcacttgaaagg

SEQ ID NO: 569290 - DNA, 25 bp, Rattus norvegicus
tatggcttgggcatggaacgatttc

SEQ ID NO: 569291 - DNA, 25 bp, Rattus norvegicus
tatggcttgggcttggaacgatttc

SEQ ID NO: 569292 - DNA, 25 bp, Rattus norvegicus
tatggcttgttactgctgtagttcc

SEQ ID NO: 569293 - DNA, 25 bp, Rattus norvegicus
tatggcttgttagtgctgtagttcc

SEQ ID NO: 569294 - DNA, 25 bp, Rattus norvegicus
tatggcttgttcacagcctcagtgc

SEQ ID NO: 569295 - DNA, 25 bp, Rattus norvegicus
tatggcttgttctcagcctcagtgc

SEQ ID NO: 569296 - DNA, 25 bp, Rattus norvegicus
tatggctttaatcttcctgcctaaa

SEQ ID NO: 569297 - DNA, 25 bp, Rattus norvegicus
tatggctttaatgttcctgcctaaa

SEQ ID NO: 569298 - DNA, 25 bp, Rattus norvegicus
tatggctttctgaattggaatttca

SEQ ID NO: 569299 - DNA, 25 bp, Rattus norvegicus
tatggctttctgtattggaatttca

SEQ ID NO: 569300 - DNA, 25 bp, Rattus norvegicus
tatggcttttgcatcttcctttatt

SEQ ID NO: 569301 - DNA, 25 bp, Rattus norvegicus
tatggcttttgcttcttcctttatt

SEQ ID NO: 569302 - DNA, 25 bp, Rattus norvegicus
tatgggaaaagtcaggtgccaccac

SEQ ID NO: 569303 - DNA, 25 bp, Rattus norvegicus
tatgggaaaagtgaggtgccaccac

SEQ ID NO: 569304 - DNA, 25 bp, Rattus norvegicus
tatgggaaatgcaactcctgggcag

SEQ ID NO: 569305 - DNA, 25 bp, Rattus norvegicus
tatgggaaatgctactcctgggcag

SEQ ID NO: 569306 - DNA, 25 bp, Rattus norvegicus
tatgggaagactctactccaacccc

SEQ ID NO: 569307 - DNA, 25 bp, Rattus norvegicus
tatgggaagactgtactccaacccc

SEQ ID NO: 569308 - DNA, 25 bp, Rattus norvegicus
tatgggaaggaaagccccgttcctg

SEQ ID NO: 569309 - DNA, 25 bp, Rattus norvegicus
tatgggaaggaatgccccgttcctg

SEQ ID NO: 569310 - DNA, 25 bp, Rattus norvegicus
tatgggacagcccattttccctctt

SEQ ID NO: 569311 - DNA, 25 bp, Rattus norvegicus
tatgggacagccgattttccctctt

SEQ ID NO: 569312 - DNA, 25 bp, Rattus norvegicus
tatgggaccagaacatggcttccct

SEQ ID NO: 569313 - DNA, 25 bp, Rattus norvegicus
tatgggaccagatcatggcttccct

SEQ ID NO: 569314 - DNA, 25 bp, Rattus norvegicus
tatgggacctgcctgacctagaaac

SEQ ID NO: 569315 - DNA, 25 bp, Rattus norvegicus
tatgggacctgcgtgacctagaaac

SEQ ID NO: 569316 - DNA, 25 bp, Rattus norvegicus
tatgggacggatccaagctcatcac

SEQ ID NO: 569317 - DNA, 25 bp, Rattus norvegicus
tatgggacggatgcaagctcatcac

SEQ ID NO: 569318 - DNA, 25 bp, Rattus norvegicus
tatgggagcataagtgcccctctca

SEQ ID NO: 569319 - DNA, 25 bp, Rattus norvegicus
tatgggagcatatgtgcccctctca

SEQ ID NO: 569320 - DNA, 25 bp, Rattus norvegicus
tatgggagccacagtcatgacacgg

SEQ ID NO: 569321 - DNA, 25 bp, Rattus norvegicus
tatgggagccactgtcatgacacgg

SEQ ID NO: 569322 - DNA, 25 bp, Rattus norvegicus
tatgggagcgagatgaccttttcct

SEQ ID NO: 569323 - DNA, 25 bp, Rattus norvegicus
tatgggagcgagttgaccttttcct

SEQ ID NO: 569324 - DNA, 25 bp, Rattus norvegicus
tatgggatacctcttctccttagga

SEQ ID NO: 569325 - DNA, 25 bp, Rattus norvegicus
tatgggatacctgttctccttagga

SEQ ID NO: 569326 - DNA, 25 bp, Rattus norvegicus
tatgggatatgtacccctaaccctg

SEQ ID NO: 569327 - DNA, 25 bp, Rattus norvegicus
tatgggatatgttcccctaaccctg

SEQ ID NO: 569328 - DNA, 25 bp, Rattus norvegicus
tatgggatcccaagccttcatctga

SEQ ID NO: 569329 - DNA, 25 bp, Rattus norvegicus
tatgggatcccatgccttcatctga

SEQ ID NO: 569330 - DNA, 25 bp, Rattus norvegicus
tatgggatgggcaacactggtgacc

SEQ ID NO: 569331 - DNA, 25 bp, Rattus norvegicus
tatgggatgggctacactggtgacc

SEQ ID NO: 569332 - DNA, 25 bp, Rattus norvegicus
tatgggcaattccacatgccgttat

SEQ ID NO: 569333 - DNA, 25 bp, Rattus norvegicus
tatgggcaattcgacatgccgttat

SEQ ID NO: 569334 - DNA, 25 bp, Rattus norvegicus
tatgggcaggaaagcacagagattt

SEQ ID NO: 569335 - DNA, 25 bp, Rattus norvegicus
tatgggcaggaatgcacagagattt

SEQ ID NO: 569336 - DNA, 25 bp, Rattus norvegicus
tatgggcagtatcacatcctccttc

SEQ ID NO: 569337 - DNA, 25 bp, Rattus norvegicus
tatgggcagtatgacatcctccttc

SEQ ID NO: 569338 - DNA, 25 bp, Rattus norvegicus
tatgggcatctgaatctcggttgtc

SEQ ID NO: 569339 - DNA, 25 bp, Rattus norvegicus
tatgggcatctgtatctcggttgtc

SEQ ID NO: 569340 - DNA, 25 bp, Rattus norvegicus
tatgggccaatacccaagcctggga

SEQ ID NO: 569341 - DNA, 25 bp, Rattus norvegicus
tatgggccaatagccaagcctggga

SEQ ID NO: 569342 - DNA, 25 bp, Rattus norvegicus
tatgggcctacaaagatctgcagtc

SEQ ID NO: 569343 - DNA, 25 bp, Rattus norvegicus
tatgggcctacatagatctgcagtc

SEQ ID NO: 569344 - DNA, 25 bp, Rattus norvegicus
tatgggcgcatgagggaagacccca

SEQ ID NO: 569345 - DNA, 25 bp, Rattus norvegicus
tatgggcgcatgtgggaagacccca

SEQ ID NO: 569346 - DNA, 25 bp, Rattus norvegicus
tatgggctccacaactgacctgagt

SEQ ID NO: 569347 - DNA, 25 bp, Rattus norvegicus
tatgggctccactactgacctgagt

SEQ ID NO: 569348 - DNA, 25 bp, Rattus norvegicus
tatgggctcctgactcgagagctag

SEQ ID NO: 569349 - DNA, 25 bp, Rattus norvegicus
tatgggctcctgtctcgagagctag

SEQ ID NO: 569350 - DNA, 25 bp, Rattus norvegicus
tatgggctgcagcagaacatggtac

SEQ ID NO: 569351 - DNA, 25 bp, Rattus norvegicus
tatgggctgcaggagaacatggtac

SEQ ID NO: 569352 - DNA, 25 bp, Rattus norvegicus
tatgggctgcggaatgattatcaca

SEQ ID NO: 569353 - DNA, 25 bp, Rattus norvegicus
tatgggctgcggtatgattatcaca

SEQ ID NO: 569354 - DNA, 25 bp, Rattus norvegicus
tatgggctgtccatatgattccggg

SEQ ID NO: 569355 - DNA, 25 bp, Rattus norvegicus
tatgggctgtccttatgattccggg

SEQ ID NO: 569356 - DNA, 25 bp, Rattus norvegicus
tatgggcttaggcatcaacctcata

SEQ ID NO: 569357 - DNA, 25 bp, Rattus norvegicus
tatgggcttagggatcaacctcata

SEQ ID NO: 569358 - DNA, 25 bp, Rattus norvegicus
tatgggcttccaagacttacatttg

SEQ ID NO: 569359 - DNA, 25 bp, Rattus norvegicus
tatgggcttccatgacttacatttg

SEQ ID NO: 569360 - DNA, 25 bp, Rattus norvegicus
tatggggctctaaaaacacaggtcc

SEQ ID NO: 569361 - DNA, 25 bp, Rattus norvegicus
tatggggctctataaacacaggtcc

SEQ ID NO: 569362 - DNA, 25 bp, Rattus norvegicus
tatgggtaccatacatgactttgat

SEQ ID NO: 569363 - DNA, 25 bp, Rattus norvegicus
tatgggtaccattcatgactttgat

SEQ ID NO: 569364 - DNA, 25 bp, Rattus norvegicus
tatgggtactgccatcatttctgga

SEQ ID NO: 569365 - DNA, 25 bp, Rattus norvegicus
tatgggtactgcgatcatttctgga

SEQ ID NO: 569366 - DNA, 25 bp, Rattus norvegicus
tatgggtatacccacaccacataca

SEQ ID NO: 569367 - DNA, 25 bp, Rattus norvegicus
tatgggtataccgacaccacataca

SEQ ID NO: 569368 - DNA, 25 bp, Rattus norvegicus
tatgggtatccacacatgtaaacaa

SEQ ID NO: 569369 - DNA, 25 bp, Rattus norvegicus
tatgggtatccagacatgtaaacaa

SEQ ID NO: 569370 - DNA, 25 bp, Rattus norvegicus
tatgggtcacttaattctgagaaat

SEQ ID NO: 569371 - DNA, 25 bp, Rattus norvegicus
tatgggtcactttattctgagaaat

SEQ ID NO: 569372 - DNA, 25 bp, Rattus norvegicus
tatgggtcctttaggtttccagcca

SEQ ID NO: 569373 - DNA, 25 bp, Rattus norvegicus
tatgggtccttttggtttccagcca

SEQ ID NO: 569374 - DNA, 25 bp, Rattus norvegicus
tatgggtctgcacccctcaaatacc

SEQ ID NO: 569375 - DNA, 25 bp, Rattus norvegicus
tatgggtctgcagccctcaaatacc

SEQ ID NO: 569376 - DNA, 25 bp, Rattus norvegicus
tatgggtctgtgacatggcactgtt

SEQ ID NO: 569377 - DNA, 25 bp, Rattus norvegicus
tatgggtctgtgtcatggcactgtt

SEQ ID NO: 569378 - DNA, 25 bp, Rattus norvegicus
tatgggtcttcgatgttctgttcca

SEQ ID NO: 569379 - DNA, 25 bp, Rattus norvegicus
tatgggtcttcgttgttctgttcca

SEQ ID NO: 569380 - DNA, 25 bp, Rattus norvegicus
tatgggtcttggcagtgactccctt

SEQ ID NO: 569381 - DNA, 25 bp, Rattus norvegicus
tatgggtcttgggagtgactccctt

SEQ ID NO: 569382 - DNA, 25 bp, Rattus norvegicus
tatgggtgattgagagccttcctaa

SEQ ID NO: 569383 - DNA, 25 bp, Rattus norvegicus
tatgggtgattgtgagccttcctaa

SEQ ID NO: 569384 - DNA, 25 bp, Rattus norvegicus
tatgggtgccaactacagcagctac

SEQ ID NO: 569385 - DNA, 25 bp, Rattus norvegicus
tatgggtgccaagtacagcagctac

SEQ ID NO: 569386 - DNA, 25 bp, Rattus norvegicus
tatgggtgccctagtagagctgcca

SEQ ID NO: 569387 - DNA, 25 bp, Rattus norvegicus
tatgggtgcccttgtagagctgcca

SEQ ID NO: 569388 - DNA, 25 bp, Rattus norvegicus
tatgggtggtaactgctgctctcta

SEQ ID NO: 569389 - DNA, 25 bp, Rattus norvegicus
tatgggtggtaagtgctgctctcta

SEQ ID NO: 569390 - DNA, 25 bp, Rattus norvegicus
tatgggttacttcataccttgtatg

SEQ ID NO: 569391 - DNA, 25 bp, Rattus norvegicus
tatgggttacttgataccttgtatg

SEQ ID NO: 569392 - DNA, 25 bp, Rattus norvegicus
tatgggttcgttagcctcttcaagg

SEQ ID NO: 569393 - DNA, 25 bp, Rattus norvegicus
tatgggttcgtttgcctcttcaagg

SEQ ID NO: 569394 - DNA, 25 bp, Rattus norvegicus
tatgggttgactactactcctgctc

SEQ ID NO: 569395 - DNA, 25 bp, Rattus norvegicus
tatgggttgacttctactcctgctc

SEQ ID NO: 569396 - DNA, 25 bp, Rattus norvegicus
tatgggtttcatagtgtctctaata

SEQ ID NO: 569397 - DNA, 25 bp, Rattus norvegicus
tatgggtttcattgtgtctctaata

SEQ ID NO: 569398 - DNA, 25 bp, Rattus norvegicus
tatgggttttccactaaatgctggg

SEQ ID NO: 569399 - DNA, 25 bp, Rattus norvegicus
tatgggttttcctctaaatgctggg

SEQ ID NO: 569400 - DNA, 25 bp, Rattus norvegicus
tatggtaagtccctaggagttactt

SEQ ID NO: 569401 - DNA, 25 bp, Rattus norvegicus
tatggtaagtccgtaggagttactt

SEQ ID NO: 569402 - DNA, 25 bp, Rattus norvegicus
tatggtaccatgagatcatccagcc

SEQ ID NO: 569403 - DNA, 25 bp, Rattus norvegicus
tatggtaccatgtgatcatccagcc

SEQ ID NO: 569404 - DNA, 25 bp, Rattus norvegicus
tatggtacctaaactccacagttag

SEQ ID NO: 569405 - DNA, 25 bp, Rattus norvegicus
tatggtacctaatctccacagttag

SEQ ID NO: 569406 - DNA, 25 bp, Rattus norvegicus
tatggtactctcatggtgggctact

SEQ ID NO: 569407 - DNA, 25 bp, Rattus norvegicus
tatggtactctcttggtgggctact

SEQ ID NO: 569408 - DNA, 25 bp, Rattus norvegicus
tatggtagaaacaaggccccttctc

SEQ ID NO: 569409 - DNA, 25 bp, Rattus norvegicus
tatggtagaaactaggccccttctc

SEQ ID NO: 569410 - DNA, 25 bp, Rattus norvegicus
tatggtagatctcatccaggctctc

SEQ ID NO: 569411 - DNA, 25 bp, Rattus norvegicus
tatggtagatctgatccaggctctc

SEQ ID NO: 569412 - DNA, 25 bp, Rattus norvegicus
tatggtatcccacccagtttgctaa

SEQ ID NO: 569413 - DNA, 25 bp, Rattus norvegicus
tatggtatcccagccagtttgctaa

SEQ ID NO: 569414 - DNA, 25 bp, Rattus norvegicus
tatggtatctggactggtaggtcaa

SEQ ID NO: 569415 - DNA, 25 bp, Rattus norvegicus
tatggtatctggtctggtaggtcaa

SEQ ID NO: 569416 - DNA, 25 bp, Rattus norvegicus
tatggtatcttaacgtaactctgaa

SEQ ID NO: 569417 - DNA, 25 bp, Rattus norvegicus
tatggtatcttatcgtaactctgaa

SEQ ID NO: 569418 - DNA, 25 bp, Rattus norvegicus
tatggtatttgtaagccttgctttt

SEQ ID NO: 569419 - DNA, 25 bp, Rattus norvegicus
tatggtatttgttagccttgctttt

SEQ ID NO: 569420 - DNA, 25 bp, Rattus norvegicus
tatggtcaacggctgactagtgcct

SEQ ID NO: 569421 - DNA, 25 bp, Rattus norvegicus
tatggtcaacgggtgactagtgcct

SEQ ID NO: 569422 - DNA, 25 bp, Rattus norvegicus
tatggtcaccacaacacataggcca

SEQ ID NO: 569423 - DNA, 25 bp, Rattus norvegicus
tatggtcaccactacacataggcca

SEQ ID NO: 569424 - DNA, 25 bp, Rattus norvegicus
tatggtcactagcacgtctttaatg

SEQ ID NO: 569425 - DNA, 25 bp, Rattus norvegicus
tatggtcactaggacgtctttaatg

SEQ ID NO: 569426 - DNA, 25 bp, Rattus norvegicus
tatggtcagtctatcctatgaggct

SEQ ID NO: 569427 - DNA, 25 bp, Rattus norvegicus
tatggtcagtctttcctatgaggct

SEQ ID NO: 569428 - DNA, 25 bp, Rattus norvegicus
tatggtcattacagcaggattctaa

SEQ ID NO: 569429 - DNA, 25 bp, Rattus norvegicus
tatggtcattactgcaggattctaa

SEQ ID NO: 569430 - DNA, 25 bp, Rattus norvegicus
tatggtcattgacatatgtaagttc

SEQ ID NO: 569431 - DNA, 25 bp, Rattus norvegicus
tatggtcattgagatatgtaagttc

SEQ ID NO: 569432 - DNA, 25 bp, Rattus norvegicus
tatggtccactgaaatagccttatt

SEQ ID NO: 569433 - DNA, 25 bp, Rattus norvegicus
tatggtccactgtaatagccttatt

SEQ ID NO: 569434 - DNA, 25 bp, Rattus norvegicus
tatggtccatgcatctagagtcaca

SEQ ID NO: 569435 - DNA, 25 bp, Rattus norvegicus
tatggtccatgcttctagagtcaca

SEQ ID NO: 569436 - DNA, 25 bp, Rattus norvegicus
tatggtcccatgcacacacggtgat

SEQ ID NO: 569437 - DNA, 25 bp, Rattus norvegicus
tatggtcccatggacacacggtgat

SEQ ID NO: 569438 - DNA, 25 bp, Rattus norvegicus
tatggtccctagcttgtcatctcct

SEQ ID NO: 569439 - DNA, 25 bp, Rattus norvegicus
tatggtccctaggttgtcatctcct

SEQ ID NO: 569440 - DNA, 25 bp, Rattus norvegicus
tatggtccctctaaagtggcggagt

SEQ ID NO: 569441 - DNA, 25 bp, Rattus norvegicus
tatggtccctcttaagtggcggagt

SEQ ID NO: 569442 - DNA, 25 bp, Rattus norvegicus
tatggtccctttctttgatggtgct

SEQ ID NO: 569443 - DNA, 25 bp, Rattus norvegicus
tatggtccctttgtttgatggtgct

SEQ ID NO: 569444 - DNA, 25 bp, Rattus norvegicus
tatggtccgtccctttgtccgaagt

SEQ ID NO: 569445 - DNA, 25 bp, Rattus norvegicus
tatggtccgtccgtttgtccgaagt

SEQ ID NO: 569446 - DNA, 25 bp, Rattus norvegicus
tatggtcgccaaactcataggctac

SEQ ID NO: 569447 - DNA, 25 bp, Rattus norvegicus
tatggtcgccaatctcataggctac

SEQ ID NO: 569448 - DNA, 25 bp, Rattus norvegicus
tatggtcgctttctatgtgtggtaa

SEQ ID NO: 569449 - DNA, 25 bp, Rattus norvegicus
tatggtcgctttgtatgtgtggtaa

SEQ ID NO: 569450 - DNA, 25 bp, Rattus norvegicus
tatggtctcaacagtcttgtctttt

SEQ ID NO: 569451 - DNA, 25 bp, Rattus norvegicus
tatggtctcaactgtcttgtctttt

SEQ ID NO: 569452 - DNA, 25 bp, Rattus norvegicus
tatggtctgctacacagctcagact

SEQ ID NO: 569453 - DNA, 25 bp, Rattus norvegicus
tatggtctgctagacagctcagact

SEQ ID NO: 569454 - DNA, 25 bp, Rattus norvegicus
tatggtctggcgaggtggtttccta

SEQ ID NO: 569455 - DNA, 25 bp, Rattus norvegicus
tatggtctggcgtggtggtttccta

SEQ ID NO: 569456 - DNA, 25 bp, Rattus norvegicus
tatggtctgtgcaggcagcagcaac

SEQ ID NO: 569457 - DNA, 25 bp, Rattus norvegicus
tatggtctgtgctggcagcagcaac

SEQ ID NO: 569458 - DNA, 25 bp, Rattus norvegicus
tatggtctgttacgtaactcctaac

SEQ ID NO: 569459 - DNA, 25 bp, Rattus norvegicus
tatggtctgttaggtaactcctaac

SEQ ID NO: 569460 - DNA, 25 bp, Rattus norvegicus
tatggtctgttgcttttacctgtca

SEQ ID NO: 569461 - DNA, 25 bp, Rattus norvegicus
tatggtctgttggttttacctgtca

SEQ ID NO: 569462 - DNA, 25 bp, Rattus norvegicus
tatggtgacattcaataataactgt

SEQ ID NO: 569463 - DNA, 25 bp, Rattus norvegicus
tatggtgacattgaataataactgt

SEQ ID NO: 569464 - DNA, 25 bp, Rattus norvegicus
tatggtgaccagctgacttccggga

SEQ ID NO: 569465 - DNA, 25 bp, Rattus norvegicus
tatggtgaccaggtgacttccggga

SEQ ID NO: 569466 - DNA, 25 bp, Rattus norvegicus
tatggtgacctgattgacagctcga

SEQ ID NO: 569467 - DNA, 25 bp, Rattus norvegicus
tatggtgacctgtttgacagctcga

SEQ ID NO: 569468 - DNA, 25 bp, Rattus norvegicus
tatggtgacttgagcgctgcttaaa

SEQ ID NO: 569469 - DNA, 25 bp, Rattus norvegicus
tatggtgacttgtgcgctgcttaaa

SEQ ID NO: 569470 - DNA, 25 bp, Rattus norvegicus
tatggtgatggcctgcttacacgct

SEQ ID NO: 569471 - DNA, 25 bp, Rattus norvegicus
tatggtgatggcgtgcttacacgct

SEQ ID NO: 569472 - DNA, 25 bp, Rattus norvegicus
tatggtgccacgcaccattcacaaa

SEQ ID NO: 569473 - DNA, 25 bp, Rattus norvegicus
tatggtgccacggaccattcacaaa

SEQ ID NO: 569474 - DNA, 25 bp, Rattus norvegicus
tatggtgccggaacaaagctccagt

SEQ ID NO: 569475 - DNA, 25 bp, Rattus norvegicus
tatggtgccggatcaaagctccagt

SEQ ID NO: 569476 - DNA, 25 bp, Rattus norvegicus
tatggtgctgctcgatcaacccgaa

SEQ ID NO: 569477 - DNA, 25 bp, Rattus norvegicus
tatggtgctgctggatcaacccgaa

SEQ ID NO: 569478 - DNA, 25 bp, Rattus norvegicus
tatggtgcttctatctgtctatcta

SEQ ID NO: 569479 - DNA, 25 bp, Rattus norvegicus
tatggtgcttctttctgtctatcta

SEQ ID NO: 569480 - DNA, 25 bp, Rattus norvegicus
tatggtggcacgaaacctgtcatct

SEQ ID NO: 569481 - DNA, 25 bp, Rattus norvegicus
tatggtggcacgtaacctgtcatct

SEQ ID NO: 569482 - DNA, 25 bp, Rattus norvegicus
tatggtggcatcatgactcctgggc

SEQ ID NO: 569483 - DNA, 25 bp, Rattus norvegicus
tatggtggcatcttgactcctgggc

SEQ ID NO: 569484 - DNA, 25 bp, Rattus norvegicus
tatggtggccttagtggccatcctt

SEQ ID NO: 569485 - DNA, 25 bp, Rattus norvegicus
tatggtggcctttgtggccatcctt

SEQ ID NO: 569486 - DNA, 25 bp, Rattus norvegicus
tatggtggctagaattgtcaacttg

SEQ ID NO: 569487 - DNA, 25 bp, Rattus norvegicus
tatggtggctagtattgtcaacttg

SEQ ID NO: 569488 - DNA, 25 bp, Rattus norvegicus
tatggtgggaacaccttgctgggca

SEQ ID NO: 569489 - DNA, 25 bp, Rattus norvegicus
tatggtgggaactccttgctgggca

SEQ ID NO: 569490 - DNA, 25 bp, Rattus norvegicus
tatggtgtaataacagctaccggat

SEQ ID NO: 569491 - DNA, 25 bp, Rattus norvegicus
tatggtgtaatatcagctaccggat

SEQ ID NO: 569492 - DNA, 25 bp, Rattus norvegicus
tatggtgtcccaatggactgacggc

SEQ ID NO: 569493 - DNA, 25 bp, Rattus norvegicus
tatggtgtcccattggactgacggc

SEQ ID NO: 569494 - DNA, 25 bp, Rattus norvegicus
tatggtgtctttccctttctcctta

SEQ ID NO: 569495 - DNA, 25 bp, Rattus norvegicus
tatggtgtctttgcctttctcctta

SEQ ID NO: 569496 - DNA, 25 bp, Rattus norvegicus
tatggtgtgagcctagtcagtcccc

SEQ ID NO: 569497 - DNA, 25 bp, Rattus norvegicus
tatggtgtgagcgtagtcagtcccc

SEQ ID NO: 569498 - DNA, 25 bp, Rattus norvegicus
tatggtgtgatccactgtgccagca

SEQ ID NO: 569499 - DNA, 25 bp, Rattus norvegicus
tatggtgtgatcgactgtgccagca

SEQ ID NO: 569500 - DNA, 25 bp, Rattus norvegicus
tatggtgtgtagcagatggaaccca

SEQ ID NO: 569501 - DNA, 25 bp, Rattus norvegicus
tatggtgtgtaggagatggaaccca

SEQ ID NO: 569502 - DNA, 25 bp, Rattus norvegicus
tatggtgttagcaccactggtgccc

SEQ ID NO: 569503 - DNA, 25 bp, Rattus norvegicus
tatggtgttagctccactggtgccc

SEQ ID NO: 569504 - DNA, 25 bp, Rattus norvegicus
tatggtgttgaaagtctaaccccac

SEQ ID NO: 569505 - DNA, 25 bp, Rattus norvegicus
tatggtgttgaatgtctaaccccac

SEQ ID NO: 569506 - DNA, 25 bp, Rattus norvegicus
tatggtgtttacactttagggaact

SEQ ID NO: 569507 - DNA, 25 bp, Rattus norvegicus
tatggtgtttactctttagggaact

SEQ ID NO: 569508 - DNA, 25 bp, Rattus norvegicus
tatggtgttttccacgtagcccaga

SEQ ID NO: 569509 - DNA, 25 bp, Rattus norvegicus
tatggtgttttcgacgtagcccaga

SEQ ID NO: 569510 - DNA, 25 bp, Rattus norvegicus
tatggttacaccatctactcagtgg

SEQ ID NO: 569511 - DNA, 25 bp, Rattus norvegicus
tatggttacaccttctactcagtgg

SEQ ID NO: 569512 - DNA, 25 bp, Rattus norvegicus
tatggttaccaaaaggaacttgtat

SEQ ID NO: 569513 - DNA, 25 bp, Rattus norvegicus
tatggttaccaataggaacttgtat

SEQ ID NO: 569514 - DNA, 25 bp, Rattus norvegicus
tatggttacctcaacgtccttcaat

SEQ ID NO: 569515 - DNA, 25 bp, Rattus norvegicus
tatggttacctctacgtccttcaat

SEQ ID NO: 569516 - DNA, 25 bp, Rattus norvegicus
tatggttatagcaccctgcaggtag

SEQ ID NO: 569517 - DNA, 25 bp, Rattus norvegicus
tatggttatagctccctgcaggtag

SEQ ID NO: 569518 - DNA, 25 bp, Rattus norvegicus
tatggttcatcactttcttgtccct

SEQ ID NO: 569519 - DNA, 25 bp, Rattus norvegicus
tatggttcatcagtttcttgtccct

SEQ ID NO: 569520 - DNA, 25 bp, Rattus norvegicus
tatggttcctttctgcagtagtggg

SEQ ID NO: 569521 - DNA, 25 bp, Rattus norvegicus
tatggttcctttgtgcagtagtggg

SEQ ID NO: 569522 - DNA, 25 bp, Rattus norvegicus
tatggttctgaacgctatgggacta

SEQ ID NO: 569523 - DNA, 25 bp, Rattus norvegicus
tatggttctgaaggctatgggacta

SEQ ID NO: 569524 - DNA, 25 bp, Rattus norvegicus
tatggttgaactctcaggccctgtt

SEQ ID NO: 569525 - DNA, 25 bp, Rattus norvegicus
tatggttgaactgtcaggccctgtt

SEQ ID NO: 569526 - DNA, 25 bp, Rattus norvegicus
tatggttgcagccttgtcttactgt

SEQ ID NO: 569527 - DNA, 25 bp, Rattus norvegicus
tatggttgcagcgttgtcttactgt

SEQ ID NO: 569528 - DNA, 25 bp, Rattus norvegicus
tatggttggctgagagcatccacct

SEQ ID NO: 569529 - DNA, 25 bp, Rattus norvegicus
tatggttggctgtgagcatccacct

SEQ ID NO: 569530 - DNA, 25 bp, Rattus norvegicus
tatggttgtctcctgtctttaggaa

SEQ ID NO: 569531 - DNA, 25 bp, Rattus norvegicus
tatggttgtctcgtgtctttaggaa

SEQ ID NO: 569532 - DNA, 25 bp, Rattus norvegicus
tatggtttccagacgtgcattgcac

SEQ ID NO: 569533 - DNA, 25 bp, Rattus norvegicus
tatggtttccagtcgtgcattgcac

SEQ ID NO: 569534 - DNA, 25 bp, Rattus norvegicus
tatggtttctgcaatcgagactcct

SEQ ID NO: 569535 - DNA, 25 bp, Rattus norvegicus
tatggtttctgctatcgagactcct

SEQ ID NO: 569536 - DNA, 25 bp, Rattus norvegicus
tatggtttctgtatggtcctggtga

SEQ ID NO: 569537 - DNA, 25 bp, Rattus norvegicus
tatggtttctgtttggtcctggtga

SEQ ID NO: 569538 - DNA, 25 bp, Rattus norvegicus
tatggtttgcatctctcagtgataa

SEQ ID NO: 569539 - DNA, 25 bp, Rattus norvegicus
tatggtttgcatgtctcagtgataa

SEQ ID NO: 569540 - DNA, 25 bp, Rattus norvegicus
tatggtttggacactgttctgaagc

SEQ ID NO: 569541 - DNA, 25 bp, Rattus norvegicus
tatggtttggactctgttctgaagc

SEQ ID NO: 569542 - DNA, 25 bp, Rattus norvegicus
tatggttttcatccacttggctttt

SEQ ID NO: 569543 - DNA, 25 bp, Rattus norvegicus
tatggttttcatgcacttggctttt

SEQ ID NO: 569544 - DNA, 25 bp, Rattus norvegicus
tatggttttgacactgacctcagcc

SEQ ID NO: 569545 - DNA, 25 bp, Rattus norvegicus
tatggttttgactctgacctcagcc

SEQ ID NO: 569546 - DNA, 25 bp, Rattus norvegicus
tatggttttgtacgagttctctgtt

SEQ ID NO: 569547 - DNA, 25 bp, Rattus norvegicus
tatggttttgtaggagttctctgtt

SEQ ID NO: 569548 - DNA, 25 bp, Rattus norvegicus
tatggtttttacacttctctttaat

SEQ ID NO: 569549 - DNA, 25 bp, Rattus norvegicus
tatggtttttactcttctctttaat

SEQ ID NO: 569550 - DNA, 25 bp, Rattus norvegicus
tatgtaaaacggacccctggtatct

SEQ ID NO: 569551 - DNA, 25 bp, Rattus norvegicus
tatgtaaaacggtcccctggtatct

SEQ ID NO: 569552 - DNA, 25 bp, Rattus norvegicus
tatgtaaaccttcagctgctggtcc

SEQ ID NO: 569553 - DNA, 25 bp, Rattus norvegicus
tatgtaaaccttgagctgctggtcc

SEQ ID NO: 569554 - DNA, 25 bp, Rattus norvegicus
tatgtaaactgcaacggcctcgtgt

SEQ ID NO: 569555 - DNA, 25 bp, Rattus norvegicus
tatgtaaactgctacggcctcgtgt

SEQ ID NO: 569556 - DNA, 25 bp, Rattus norvegicus
tatgtaaagcagatctcattattag

SEQ ID NO: 569557 - DNA, 25 bp, Rattus norvegicus
tatgtaaagcagttctcattattag

SEQ ID NO: 569558 - DNA, 25 bp, Rattus norvegicus
tatgtaaataatccagcctctcctc

SEQ ID NO: 569559 - DNA, 25 bp, Rattus norvegicus
tatgtaaataatgcagcctctcctc

SEQ ID NO: 569560 - DNA, 25 bp, Rattus norvegicus
tatgtaaatagcacatcctctgccc

SEQ ID NO: 569561 - DNA, 25 bp, Rattus norvegicus
tatgtaaatagctcatcctctgccc

SEQ ID NO: 569562 - DNA, 25 bp, Rattus norvegicus
tatgtaacatttcaccatcctctgg

SEQ ID NO: 569563 - DNA, 25 bp, Rattus norvegicus
tatgtaacatttgaccatcctctgg

SEQ ID NO: 569564 - DNA, 25 bp, Rattus norvegicus
tatgtaactatactttaactttatt

SEQ ID NO: 569565 - DNA, 25 bp, Rattus norvegicus
tatgtaactatagtttaactttatt

SEQ ID NO: 569566 - DNA, 25 bp, Rattus norvegicus
tatgtaactgggacttttgtaaata

SEQ ID NO: 569567 - DNA, 25 bp, Rattus norvegicus
tatgtaactgggtcttttgtaaata

SEQ ID NO: 569568 - DNA, 25 bp, Rattus norvegicus
tatgtaagcaaccacagctcctgtg

SEQ ID NO: 569569 - DNA, 25 bp, Rattus norvegicus
tatgtaagcaacgacagctcctgtg

SEQ ID NO: 569570 - DNA, 25 bp, Rattus norvegicus
tatgtaagtgctccccttaccgcac

SEQ ID NO: 569571 - DNA, 25 bp, Rattus norvegicus
tatgtaagtgctgcccttaccgcac

SEQ ID NO: 569572 - DNA, 25 bp, Rattus norvegicus
tatgtaatggcgatgctgtcggcaa

SEQ ID NO: 569573 - DNA, 25 bp, Rattus norvegicus
tatgtaatggcgttgctgtcggcaa

SEQ ID NO: 569574 - DNA, 25 bp, Rattus norvegicus
tatgtaatttcccatctcgagcctg

SEQ ID NO: 569575 - DNA, 25 bp, Rattus norvegicus
tatgtaatttccgatctcgagcctg

SEQ ID NO: 569576 - DNA, 25 bp, Rattus norvegicus
tatgtacaaagaatttccctcccac

SEQ ID NO: 569577 - DNA, 25 bp, Rattus norvegicus
tatgtacaaagattttccctcccac

SEQ ID NO: 569578 - DNA, 25 bp, Rattus norvegicus
tatgtacaaggcctgtctcctgaag

SEQ ID NO: 569579 - DNA, 25 bp, Rattus norvegicus
tatgtacaaggcgtgtctcctgaag

SEQ ID NO: 569580 - DNA, 25 bp, Rattus norvegicus
tatgtacaatgcactacgccctgat

SEQ ID NO: 569581 - DNA, 25 bp, Rattus norvegicus
tatgtacaatgctctacgccctgat

SEQ ID NO: 569582 - DNA, 25 bp, Rattus norvegicus
tatgtacacactcatctatgccctt

SEQ ID NO: 569583 - DNA, 25 bp, Rattus norvegicus
tatgtacacactgatctatgccctt

SEQ ID NO: 569584 - DNA, 25 bp, Rattus norvegicus
tatgtacactttagctgtgccagct

SEQ ID NO: 569585 - DNA, 25 bp, Rattus norvegicus
tatgtacacttttgctgtgccagct

SEQ ID NO: 569586 - DNA, 25 bp, Rattus norvegicus
tatgtacatgcgcttggtcattccc

SEQ ID NO: 569587 - DNA, 25 bp, Rattus norvegicus
tatgtacatgcggttggtcattccc

SEQ ID NO: 569588 - DNA, 25 bp, Rattus norvegicus
tatgtacattctatgcaagcattcg

SEQ ID NO: 569589 - DNA, 25 bp, Rattus norvegicus
tatgtacattctttgcaagcattcg

SEQ ID NO: 569590 - DNA, 25 bp, Rattus norvegicus
tatgtaccacagcttaccttcagaa

SEQ ID NO: 569591 - DNA, 25 bp, Rattus norvegicus
tatgtaccacaggttaccttcagaa

SEQ ID NO: 569592 - DNA, 25 bp, Rattus norvegicus
tatgtaccatttctatacctgaatt

SEQ ID NO: 569593 - DNA, 25 bp, Rattus norvegicus
tatgtaccatttgtatacctgaatt

SEQ ID NO: 569594 - DNA, 25 bp, Rattus norvegicus
tatgtaccgtgcaccagtgactaag

SEQ ID NO: 569595 - DNA, 25 bp, Rattus norvegicus
tatgtaccgtgctccagtgactaag

SEQ ID NO: 569596 - DNA, 25 bp, Rattus norvegicus
tatgtacctctgactgtgctggaac

SEQ ID NO: 569597 - DNA, 25 bp, Rattus norvegicus
tatgtacctctgtctgtgctggaac

SEQ ID NO: 569598 - DNA, 25 bp, Rattus norvegicus
tatgtacctgcccatcactatggtg

SEQ ID NO: 569599 - DNA, 25 bp, Rattus norvegicus
tatgtacctgccgatcactatggtg

SEQ ID NO: 569600 - DNA, 25 bp, Rattus norvegicus
tatgtaccttgtccccagttttgag

SEQ ID NO: 569601 - DNA, 25 bp, Rattus norvegicus
tatgtaccttgtgcccagttttgag

SEQ ID NO: 569602 - DNA, 25 bp, Rattus norvegicus
tatgtactactaacacacgttgtaa

SEQ ID NO: 569603 - DNA, 25 bp, Rattus norvegicus
tatgtactactatcacacgttgtaa

SEQ ID NO: 569604 - DNA, 25 bp, Rattus norvegicus
tatgtactcgatccttttgcgtctc

SEQ ID NO: 569605 - DNA, 25 bp, Rattus norvegicus
tatgtactcgatgcttttgcgtctc

SEQ ID NO: 569606 - DNA, 25 bp, Rattus norvegicus
tatgtactgccacgcattcctgcca

SEQ ID NO: 569607 - DNA, 25 bp, Rattus norvegicus
tatgtactgccaggcattcctgcca

SEQ ID NO: 569608 - DNA, 25 bp, Rattus norvegicus
tatgtactgcccataaagagttcag

SEQ ID NO: 569609 - DNA, 25 bp, Rattus norvegicus
tatgtactgcccttaaagagttcag

SEQ ID NO: 569610 - DNA, 25 bp, Rattus norvegicus
tatgtactggtgcatgtgagccgtt

SEQ ID NO: 569611 - DNA, 25 bp, Rattus norvegicus
tatgtactggtggatgtgagccgtt

SEQ ID NO: 569612 - DNA, 25 bp, Rattus norvegicus
tatgtagataaaccgttgggaacgt

SEQ ID NO: 569613 - DNA, 25 bp, Rattus norvegicus
tatgtagataaagcgttgggaacgt

SEQ ID NO: 569614 - DNA, 25 bp, Rattus norvegicus
tatgtagatcacaagactccttgtt

SEQ ID NO: 569615 - DNA, 25 bp, Rattus norvegicus
tatgtagatcactagactccttgtt

SEQ ID NO: 569616 - DNA, 25 bp, Rattus norvegicus
tatgtagcagtgatacccaagtcca

SEQ ID NO: 569617 - DNA, 25 bp, Rattus norvegicus
tatgtagcagtgttacccaagtcca

SEQ ID NO: 569618 - DNA, 25 bp, Rattus norvegicus
tatgtagccgagctgcccttccttc

SEQ ID NO: 569619 - DNA, 25 bp, Rattus norvegicus
tatgtagccgaggtgcccttccttc

SEQ ID NO: 569620 - DNA, 25 bp, Rattus norvegicus
tatgtagctcagcatgtgcttaccc

SEQ ID NO: 569621 - DNA, 25 bp, Rattus norvegicus
tatgtagctcaggatgtgcttaccc

SEQ ID NO: 569622 - DNA, 25 bp, Rattus norvegicus
tatgtagctggcaccgatgttcctg

SEQ ID NO: 569623 - DNA, 25 bp, Rattus norvegicus
tatgtagctggccttgaagtcctag

SEQ ID NO: 569624 - DNA, 25 bp, Rattus norvegicus
tatgtagctggcgttgaagtcctag

SEQ ID NO: 569625 - DNA, 25 bp, Rattus norvegicus
tatgtagctggctccgatgttcctg

SEQ ID NO: 569626 - DNA, 25 bp, Rattus norvegicus
tatgtagcttccaggtaaatgggca

SEQ ID NO: 569627 - DNA, 25 bp, Rattus norvegicus
tatgtagcttcctggtaaatgggca

SEQ ID NO: 569628 - DNA, 25 bp, Rattus norvegicus
tatgtaggagctatgcctgccctga

SEQ ID NO: 569629 - DNA, 25 bp, Rattus norvegicus
tatgtaggagctttgcctgccctga

SEQ ID NO: 569630 - DNA, 25 bp, Rattus norvegicus
tatgtaggcactaccaactcactgc

SEQ ID NO: 569631 - DNA, 25 bp, Rattus norvegicus
tatgtaggcacttccaactcactgc

SEQ ID NO: 569632 - DNA, 25 bp, Rattus norvegicus
tatgtagggccgatgttttctcaag

SEQ ID NO: 569633 - DNA, 25 bp, Rattus norvegicus
tatgtagggccgttgttttctcaag

SEQ ID NO: 569634 - DNA, 25 bp, Rattus norvegicus
tatgtaggtgcaacttctgcctggt

SEQ ID NO: 569635 - DNA, 25 bp, Rattus norvegicus
tatgtaggtgcatcttctgcctggt

SEQ ID NO: 569636 - DNA, 25 bp, Rattus norvegicus
tatgtagtaatcaggtgctgctcct

SEQ ID NO: 569637 - DNA, 25 bp, Rattus norvegicus
tatgtagtaatctggtgctgctcct

SEQ ID NO: 569638 - DNA, 25 bp, Rattus norvegicus
tatgtagtatttatccaaggcttgg

SEQ ID NO: 569639 - DNA, 25 bp, Rattus norvegicus
tatgtagtatttttccaaggcttgg

SEQ ID NO: 569640 - DNA, 25 bp, Rattus norvegicus
tatgtagtcctacttgtctctgtct

SEQ ID NO: 569641 - DNA, 25 bp, Rattus norvegicus
tatgtagtcctagttgtctctgtct

SEQ ID NO: 569642 - DNA, 25 bp, Rattus norvegicus
tatgtagtgtttctcagtcctccag

SEQ ID NO: 569643 - DNA, 25 bp, Rattus norvegicus
tatgtagtgtttgtcagtcctccag

SEQ ID NO: 569644 - DNA, 25 bp, Rattus norvegicus
tatgtataaacgagtgcgcatgtgt

SEQ ID NO: 569645 - DNA, 25 bp, Rattus norvegicus
tatgtataaacgtgtgcgcatgtgt

SEQ ID NO: 569646 - DNA, 25 bp, Rattus norvegicus
tatgtatacgtaagtctgctgctcc

SEQ ID NO: 569647 - DNA, 25 bp, Rattus norvegicus
tatgtatacgtatgtctgctgctcc

SEQ ID NO: 569648 - DNA, 25 bp, Rattus norvegicus
tatgtatagcccaggcactgggaag

SEQ ID NO: 569649 - DNA, 25 bp, Rattus norvegicus
tatgtatagccctggcactgggaag

SEQ ID NO: 569650 - DNA, 25 bp, Rattus norvegicus
tatgtatatggccacagtcctccat

SEQ ID NO: 569651 - DNA, 25 bp, Rattus norvegicus
tatgtatatggcgacagtcctccat

SEQ ID NO: 569652 - DNA, 25 bp, Rattus norvegicus
tatgtatcattaagcctgcctgtgt

SEQ ID NO: 569653 - DNA, 25 bp, Rattus norvegicus
tatgtatcattatgcctgcctgtgt

SEQ ID NO: 569654 - DNA, 25 bp, Rattus norvegicus
tatgtatctcaaactttttctgaca

SEQ ID NO: 569655 - DNA, 25 bp, Rattus norvegicus
tatgtatctcaatctttttctgaca

SEQ ID NO: 569656 - DNA, 25 bp, Rattus norvegicus
tatgtatctcatagctctctgcctg

SEQ ID NO: 569657 - DNA, 25 bp, Rattus norvegicus
tatgtatctcattgctctctgcctg

SEQ ID NO: 569658 - DNA, 25 bp, Rattus norvegicus
tatgtatctcctccttagaacccag

SEQ ID NO: 569659 - DNA, 25 bp, Rattus norvegicus
tatgtatctcctgcttagaacccag

SEQ ID NO: 569660 - DNA, 25 bp, Rattus norvegicus
tatgtatgatgcaggacacctgccc

SEQ ID NO: 569661 - DNA, 25 bp, Rattus norvegicus
tatgtatgatgctggacacctgccc

SEQ ID NO: 569662 - DNA, 25 bp, Rattus norvegicus
tatgtatgctcactgggtgctgctt

SEQ ID NO: 569663 - DNA, 25 bp, Rattus norvegicus
tatgtatgctcagtgggtgctgctt

SEQ ID NO: 569664 - DNA, 25 bp, Rattus norvegicus
tatgtatgtacaccatgggcttgcc

SEQ ID NO: 569665 - DNA, 25 bp, Rattus norvegicus
tatgtatgtacagcatgggcttgcc

SEQ ID NO: 569666 - DNA, 25 bp, Rattus norvegicus
tatgtatgtccacccggttctgaat

SEQ ID NO: 569667 - DNA, 25 bp, Rattus norvegicus
tatgtatgtccagccggttctgaat

SEQ ID NO: 569668 - DNA, 25 bp, Rattus norvegicus
tatgtattactgactcgtgctgtct

SEQ ID NO: 569669 - DNA, 25 bp, Rattus norvegicus
tatgtattactgtctcgtgctgtct

SEQ ID NO: 569670 - DNA, 25 bp, Rattus norvegicus
tatgtattgccactgttgagagata

SEQ ID NO: 569671 - DNA, 25 bp, Rattus norvegicus
tatgtattgccagtgttgagagata

SEQ ID NO: 569672 - DNA, 25 bp, Rattus norvegicus
tatgtattggctctacttgctgggt

SEQ ID NO: 569673 - DNA, 25 bp, Rattus norvegicus
tatgtattggctgtacttgctgggt

SEQ ID NO: 569674 - DNA, 25 bp, Rattus norvegicus
tatgtattgtctatctctgctgtgc

SEQ ID NO: 569675 - DNA, 25 bp, Rattus norvegicus
tatgtattgtctttctctgctgtgc

SEQ ID NO: 569676 - DNA, 25 bp, Rattus norvegicus
tatgtatttaacaagggaccgtcgg

SEQ ID NO: 569677 - DNA, 25 bp, Rattus norvegicus
tatgtatttaactagggaccgtcgg

SEQ ID NO: 569678 - DNA, 25 bp, Rattus norvegicus
tatgtcaaactgctactactggtat

SEQ ID NO: 569679 - DNA, 25 bp, Rattus norvegicus
tatgtcaaactggtactactggtat

SEQ ID NO: 569680 - DNA, 25 bp, Rattus norvegicus
tatgtcaaatctccgaaatgctttc

SEQ ID NO: 569681 - DNA, 25 bp, Rattus norvegicus
tatgtcaaatctgcgaaatgctttc

SEQ ID NO: 569682 - DNA, 25 bp, Rattus norvegicus
tatgtcaactctctggagcgccttc

SEQ ID NO: 569683 - DNA, 25 bp, Rattus norvegicus
tatgtcaactctgtggagcgccttc

SEQ ID NO: 569684 - DNA, 25 bp, Rattus norvegicus
tatgtcaagctaccacctcacacga

SEQ ID NO: 569685 - DNA, 25 bp, Rattus norvegicus
tatgtcaagctagcacctcacacga

SEQ ID NO: 569686 - DNA, 25 bp, Rattus norvegicus
tatgtcacatagctcccaactgcct

SEQ ID NO: 569687 - DNA, 25 bp, Rattus norvegicus
tatgtcacataggtcccaactgcct

SEQ ID NO: 569688 - DNA, 25 bp, Rattus norvegicus
tatgtcacccacagtgcatcaggca

SEQ ID NO: 569689 - DNA, 25 bp, Rattus norvegicus
tatgtcacccactgtgcatcaggca

SEQ ID NO: 569690 - DNA, 25 bp, Rattus norvegicus
tatgtcacctggattgccttgatgg

SEQ ID NO: 569691 - DNA, 25 bp, Rattus norvegicus
tatgtcacctggtttgccttgatgg

SEQ ID NO: 569692 - DNA, 25 bp, Rattus norvegicus
tatgtcactcatcagctgcagcaaa

SEQ ID NO: 569693 - DNA, 25 bp, Rattus norvegicus
tatgtcactcatgagctgcagcaaa

SEQ ID NO: 569694 - DNA, 25 bp, Rattus norvegicus
tatgtcactttgctggccagactgt

SEQ ID NO: 569695 - DNA, 25 bp, Rattus norvegicus
tatgtcactttggtggccagactgt

SEQ ID NO: 569696 - DNA, 25 bp, Rattus norvegicus
tatgtcagacagagtgaacctcccc

SEQ ID NO: 569697 - DNA, 25 bp, Rattus norvegicus
tatgtcagacagtgtgaacctcccc

SEQ ID NO: 569698 - DNA, 25 bp, Rattus norvegicus
tatgtcagaggacccgtcagccagc

SEQ ID NO: 569699 - DNA, 25 bp, Rattus norvegicus
tatgtcagaggagccgtcagccagc

SEQ ID NO: 569700 - DNA, 25 bp, Rattus norvegicus
tatgtcagcaacctgtagtccgcag

SEQ ID NO: 569701 - DNA, 25 bp, Rattus norvegicus
tatgtcagcaacgtgtagtccgcag

SEQ ID NO: 569702 - DNA, 25 bp, Rattus norvegicus
tatgtcagccctctcagacactgag

SEQ ID NO: 569703 - DNA, 25 bp, Rattus norvegicus
tatgtcagccctgtcagacactgag

SEQ ID NO: 569704 - DNA, 25 bp, Rattus norvegicus
tatgtcaggtcacttttatgccaca

SEQ ID NO: 569705 - DNA, 25 bp, Rattus norvegicus
tatgtcaggtcagttttatgccaca

SEQ ID NO: 569706 - DNA, 25 bp, Rattus norvegicus
tatgtcatagaaaccttcctgggcc

SEQ ID NO: 569707 - DNA, 25 bp, Rattus norvegicus
tatgtcatagaatccttcctgggcc

SEQ ID NO: 569708 - DNA, 25 bp, Rattus norvegicus
tatgtcatatgcaccttcttttacc

SEQ ID NO: 569709 - DNA, 25 bp, Rattus norvegicus
tatgtcatatgctccttcttttacc

SEQ ID NO: 569710 - DNA, 25 bp, Rattus norvegicus
tatgtcatctcccttgttttatttt

SEQ ID NO: 569711 - DNA, 25 bp, Rattus norvegicus
tatgtcatctccgttgttttatttt

SEQ ID NO: 569712 - DNA, 25 bp, Rattus norvegicus
tatgtcatgtgaagctctttcctca

SEQ ID NO: 569713 - DNA, 25 bp, Rattus norvegicus
tatgtcatgtgactgctgagacccc

SEQ ID NO: 569714 - DNA, 25 bp, Rattus norvegicus
tatgtcatgtgagtgctgagacccc

SEQ ID NO: 569715 - DNA, 25 bp, Rattus norvegicus
tatgtcatgtgatgctctttcctca

SEQ ID NO: 569716 - DNA, 25 bp, Rattus norvegicus
tatgtcattgaaaaccaggcggccg

SEQ ID NO: 569717 - DNA, 25 bp, Rattus norvegicus
tatgtcattgaataccaggcggccg

SEQ ID NO: 569718 - DNA, 25 bp, Rattus norvegicus
tatgtccacagtacttgggcgccag

SEQ ID NO: 569719 - DNA, 25 bp, Rattus norvegicus
tatgtccacagttcttgggcgccag

SEQ ID NO: 569720 - DNA, 25 bp, Rattus norvegicus
tatgtccacggccacgaccaaagta

SEQ ID NO: 569721 - DNA, 25 bp, Rattus norvegicus
tatgtccacggcgacgaccaaagta

SEQ ID NO: 569722 - DNA, 25 bp, Rattus norvegicus
tatgtccagcgaacttttccagtaa

SEQ ID NO: 569723 - DNA, 25 bp, Rattus norvegicus
tatgtccagcgatcttttccagtaa

SEQ ID NO: 569724 - DNA, 25 bp, Rattus norvegicus
tatgtcccatggattgagaaacccc

SEQ ID NO: 569725 - DNA, 25 bp, Rattus norvegicus
tatgtcccatggtttgagaaacccc

SEQ ID NO: 569726 - DNA, 25 bp, Rattus norvegicus
tatgtcccattcataaataaactcc

SEQ ID NO: 569727 - DNA, 25 bp, Rattus norvegicus
tatgtcccattcttaaataaactcc

SEQ ID NO: 569728 - DNA, 25 bp, Rattus norvegicus
tatgtccccaatccctggacatgga

SEQ ID NO: 569729 - DNA, 25 bp, Rattus norvegicus
tatgtccccaatgcctggacatgga

SEQ ID NO: 569730 - DNA, 25 bp, Rattus norvegicus
tatgtccccacaaggagcttaattt

SEQ ID NO: 569731 - DNA, 25 bp, Rattus norvegicus
tatgtccccacatggagcttaattt

SEQ ID NO: 569732 - DNA, 25 bp, Rattus norvegicus
tatgtccccagtcttgtcccaaagg

SEQ ID NO: 569733 - DNA, 25 bp, Rattus norvegicus
tatgtccccagtgttgtcccaaagg

SEQ ID NO: 569734 - DNA, 25 bp, Rattus norvegicus
tatgtccctagcaggagcctcaggt

SEQ ID NO: 569735 - DNA, 25 bp, Rattus norvegicus
tatgtccctagctggagcctcaggt

SEQ ID NO: 569736 - DNA, 25 bp, Rattus norvegicus
tatgtccctggcatacaaggcagac

SEQ ID NO: 569737 - DNA, 25 bp, Rattus norvegicus
tatgtccctggcttacaaggcagac

SEQ ID NO: 569738 - DNA, 25 bp, Rattus norvegicus
tatgtcccttagatctttattacct

SEQ ID NO: 569739 - DNA, 25 bp, Rattus norvegicus
tatgtcccttagttctttattacct

SEQ ID NO: 569740 - DNA, 25 bp, Rattus norvegicus
tatgtccgtggcacatattaccatt

SEQ ID NO: 569741 - DNA, 25 bp, Rattus norvegicus
tatgtccgtggctcatattaccatt

SEQ ID NO: 569742 - DNA, 25 bp, Rattus norvegicus
tatgtccgttccaagggccggaagt

SEQ ID NO: 569743 - DNA, 25 bp, Rattus norvegicus
tatgtccgttcctagggccggaagt

SEQ ID NO: 569744 - DNA, 25 bp, Rattus norvegicus
tatgtccgtttcaagcacaatctct

SEQ ID NO: 569745 - DNA, 25 bp, Rattus norvegicus
tatgtccgtttctagcacaatctct

SEQ ID NO: 569746 - DNA, 25 bp, Rattus norvegicus
tatgtcctaactattatggcctccc

SEQ ID NO: 569747 - DNA, 25 bp, Rattus norvegicus
tatgtcctaacttttatggcctccc

SEQ ID NO: 569748 - DNA, 25 bp, Rattus norvegicus
tatgtcctaccgacaggtgaccgca

SEQ ID NO: 569749 - DNA, 25 bp, Rattus norvegicus
tatgtcctaccgtcaggtgaccgca

SEQ ID NO: 569750 - DNA, 25 bp, Rattus norvegicus
tatgtcctagatagaagcctgtgcc

SEQ ID NO: 569751 - DNA, 25 bp, Rattus norvegicus
tatgtcctagattgaagcctgtgcc

SEQ ID NO: 569752 - DNA, 25 bp, Rattus norvegicus
tatgtcctagtcatttctgccctct

SEQ ID NO: 569753 - DNA, 25 bp, Rattus norvegicus
tatgtcctagtcttttctgccctct

SEQ ID NO: 569754 - DNA, 25 bp, Rattus norvegicus
tatgtcctcctaactgagaaagcag

SEQ ID NO: 569755 - DNA, 25 bp, Rattus norvegicus
tatgtcctcctatctgagaaagcag

SEQ ID NO: 569756 - DNA, 25 bp, Rattus norvegicus
tatgtcctcgaactccccatggtct

SEQ ID NO: 569757 - DNA, 25 bp, Rattus norvegicus
tatgtcctcgaagtccccatggtct

SEQ ID NO: 569758 - DNA, 25 bp, Rattus norvegicus
tatgtcctgtaaattattagttgaa

SEQ ID NO: 569759 - DNA, 25 bp, Rattus norvegicus
tatgtcctgtaatttattagttgaa

SEQ ID NO: 569760 - DNA, 25 bp, Rattus norvegicus
tatgtccttagcatctgtgaccttc

SEQ ID NO: 569761 - DNA, 25 bp, Rattus norvegicus
tatgtccttagcttctgtgaccttc

SEQ ID NO: 569762 - DNA, 25 bp, Rattus norvegicus
tatgtcgagataagtgtctcttttc

SEQ ID NO: 569763 - DNA, 25 bp, Rattus norvegicus
tatgtcgagatatgtgtctcttttc

SEQ ID NO: 569764 - DNA, 25 bp, Rattus norvegicus
tatgtcgccatgctgatggaccaca

SEQ ID NO: 569765 - DNA, 25 bp, Rattus norvegicus
tatgtcgccatggtgatggaccaca

SEQ ID NO: 569766 - DNA, 25 bp, Rattus norvegicus
tatgtcgcgggtctgaattccccat

SEQ ID NO: 569767 - DNA, 25 bp, Rattus norvegicus
tatgtcgcgggtgtgaattccccat

SEQ ID NO: 569768 - DNA, 25 bp, Rattus norvegicus
tatgtcgctgctctgggctaacagt

SEQ ID NO: 569769 - DNA, 25 bp, Rattus norvegicus
tatgtcgctgctgtgggctaacagt

SEQ ID NO: 569770 - DNA, 25 bp, Rattus norvegicus
tatgtcggacaaacaaagtgcattt

SEQ ID NO: 569771 - DNA, 25 bp, Rattus norvegicus
tatgtcggacaatcaaagtgcattt

SEQ ID NO: 569772 - DNA, 25 bp, Rattus norvegicus
tatgtcggactccacggatccaatg

SEQ ID NO: 569773 - DNA, 25 bp, Rattus norvegicus
tatgtcggactcgacggatccaatg

SEQ ID NO: 569774 - DNA, 25 bp, Rattus norvegicus
tatgtcggcggtatccagtcaagaa

SEQ ID NO: 569775 - DNA, 25 bp, Rattus norvegicus
tatgtcggcggtttccagtcaagaa

SEQ ID NO: 569776 - DNA, 25 bp, Rattus norvegicus
tatgtcgtacgactggtttgcctgc

SEQ ID NO: 569777 - DNA, 25 bp, Rattus norvegicus
tatgtcgtacgagtggtttgcctgc

SEQ ID NO: 569778 - DNA, 25 bp, Rattus norvegicus
tatgtcgtggagactactggcgtct

SEQ ID NO: 569779 - DNA, 25 bp, Rattus norvegicus
tatgtcgtggagtctactggcgtct

SEQ ID NO: 569780 - DNA, 25 bp, Rattus norvegicus
tatgtctaccttcagaggcatgcct

SEQ ID NO: 569781 - DNA, 25 bp, Rattus norvegicus
tatgtctaccttgagaggcatgcct

SEQ ID NO: 569782 - DNA, 25 bp, Rattus norvegicus
tatgtctagacaaaccttcagcctc

SEQ ID NO: 569783 - DNA, 25 bp, Rattus norvegicus
tatgtctagacataccttcagcctc

SEQ ID NO: 569784 - DNA, 25 bp, Rattus norvegicus
tatgtctatgaaactcacactggag

SEQ ID NO: 569785 - DNA, 25 bp, Rattus norvegicus
tatgtctatgaatctcacactggag

SEQ ID NO: 569786 - DNA, 25 bp, Rattus norvegicus
tatgtctatggtcccagaggtctgt

SEQ ID NO: 569787 - DNA, 25 bp, Rattus norvegicus
tatgtctatggtgccagaggtctgt

SEQ ID NO: 569788 - DNA, 25 bp, Rattus norvegicus
tatgtctcaagccagagggagcctg

SEQ ID NO: 569789 - DNA, 25 bp, Rattus norvegicus
tatgtctcaagcgagagggagcctg

SEQ ID NO: 569790 - DNA, 25 bp, Rattus norvegicus
tatgtctcactcactcataaatgtg

SEQ ID NO: 569791 - DNA, 25 bp, Rattus norvegicus
tatgtctcactctctcataaatgtg

SEQ ID NO: 569792 - DNA, 25 bp, Rattus norvegicus
tatgtctcccagctacccagtaaag

SEQ ID NO: 569793 - DNA, 25 bp, Rattus norvegicus
tatgtctcccaggtacccagtaaag

SEQ ID NO: 569794 - DNA, 25 bp, Rattus norvegicus
tatgtctccttgatctcgggctttg

SEQ ID NO: 569795 - DNA, 25 bp, Rattus norvegicus
tatgtctccttgttctcgggctttg

SEQ ID NO: 569796 - DNA, 25 bp, Rattus norvegicus
tatgtctcgtccctttggagtagca

SEQ ID NO: 569797 - DNA, 25 bp, Rattus norvegicus
tatgtctcgtccgtttggagtagca

SEQ ID NO: 569798 - DNA, 25 bp, Rattus norvegicus
tatgtctctcatctaggcaagcacc

SEQ ID NO: 569799 - DNA, 25 bp, Rattus norvegicus
tatgtctctcatgtaggcaagcacc

SEQ ID NO: 569800 - DNA, 25 bp, Rattus norvegicus
tatgtctctctgactgcagaaccgg

SEQ ID NO: 569801 - DNA, 25 bp, Rattus norvegicus
tatgtctctctgtctgcagaaccgg

SEQ ID NO: 569802 - DNA, 25 bp, Rattus norvegicus
tatgtctctgtgagcccaacaggct

SEQ ID NO: 569803 - DNA, 25 bp, Rattus norvegicus
tatgtctctgtgtgcccaacaggct

SEQ ID NO: 569804 - DNA, 25 bp, Rattus norvegicus
tatgtctctttactttttcgccctc

SEQ ID NO: 569805 - DNA, 25 bp, Rattus norvegicus
tatgtctctttagtttttcgccctc

SEQ ID NO: 569806 - DNA, 25 bp, Rattus norvegicus
tatgtctcttttcagttgcgcgtgc

SEQ ID NO: 569807 - DNA, 25 bp, Rattus norvegicus
tatgtctcttttgagttgcgcgtgc

SEQ ID NO: 569808 - DNA, 25 bp, Rattus norvegicus
tatgtctgcacaccgggtgtagttt

SEQ ID NO: 569809 - DNA, 25 bp, Rattus norvegicus
tatgtctgcacagcgggtgtagttt

SEQ ID NO: 569810 - DNA, 25 bp, Rattus norvegicus
tatgtctgccacctgaccatgtaga

SEQ ID NO: 569811 - DNA, 25 bp, Rattus norvegicus
tatgtctgccacgtgaccatgtaga

SEQ ID NO: 569812 - DNA, 25 bp, Rattus norvegicus
tatgtctgctacacagaaagctcaa

SEQ ID NO: 569813 - DNA, 25 bp, Rattus norvegicus
tatgtctgctactcagaaagctcaa

SEQ ID NO: 569814 - DNA, 25 bp, Rattus norvegicus
tatgtctgggttctgttttcacgat

SEQ ID NO: 569815 - DNA, 25 bp, Rattus norvegicus
tatgtctgggttgtgttttcacgat

SEQ ID NO: 569816 - DNA, 25 bp, Rattus norvegicus
tatgtctgtaatctactctgtgact

SEQ ID NO: 569817 - DNA, 25 bp, Rattus norvegicus
tatgtctgtaatgtactctgtgact

SEQ ID NO: 569818 - DNA, 25 bp, Rattus norvegicus
tatgtctgtacaatctggaagtcta

SEQ ID NO: 569819 - DNA, 25 bp, Rattus norvegicus
tatgtctgtacattctggaagtcta

SEQ ID NO: 569820 - DNA, 25 bp, Rattus norvegicus
tatgtctgtacccaatccttaactt

SEQ ID NO: 569821 - DNA, 25 bp, Rattus norvegicus
tatgtctgtaccgaatccttaactt

SEQ ID NO: 569822 - DNA, 25 bp, Rattus norvegicus
tatgtctgtcacaatggctgcctag

SEQ ID NO: 569823 - DNA, 25 bp, Rattus norvegicus
tatgtctgtcactatggctgcctag

SEQ ID NO: 569824 - DNA, 25 bp, Rattus norvegicus
tatgtctgtctactggctgtcgcca

SEQ ID NO: 569825 - DNA, 25 bp, Rattus norvegicus
tatgtctgtctagtggctgtcgcca

SEQ ID NO: 569826 - DNA, 25 bp, Rattus norvegicus
tatgtctgtcttatacctgttcctt

SEQ ID NO: 569827 - DNA, 25 bp, Rattus norvegicus
tatgtctgtcttttacctgttcctt

SEQ ID NO: 569828 - DNA, 25 bp, Rattus norvegicus
tatgtctgtgatctgctagtgtggc

SEQ ID NO: 569829 - DNA, 25 bp, Rattus norvegicus
tatgtctgtgatgtgctagtgtggc

SEQ ID NO: 569830 - DNA, 25 bp, Rattus norvegicus
tatgtctgtgtcactatgtgtgtct

SEQ ID NO: 569831 - DNA, 25 bp, Rattus norvegicus
tatgtctgtgtctctatgtgtgtct

SEQ ID NO: 569832 - DNA, 25 bp, Rattus norvegicus
tatgtcttacatcatggtgcaccag

SEQ ID NO: 569833 - DNA, 25 bp, Rattus norvegicus
tatgtcttacatgatggtgcaccag

SEQ ID NO: 569834 - DNA, 25 bp, Rattus norvegicus
tatgtcttatttagtgttcttatcc

SEQ ID NO: 569835 - DNA, 25 bp, Rattus norvegicus
tatgtcttattttgtgttcttatcc

SEQ ID NO: 569836 - DNA, 25 bp, Rattus norvegicus
tatgtcttcctgagttgctgggcct

SEQ ID NO: 569837 - DNA, 25 bp, Rattus norvegicus
tatgtcttcctgtgttgctgggcct

SEQ ID NO: 569838 - DNA, 25 bp, Rattus norvegicus
tatgtcttggctacaggaccgagct

SEQ ID NO: 569839 - DNA, 25 bp, Rattus norvegicus
tatgtcttggcttcaggaccgagct

SEQ ID NO: 569840 - DNA, 25 bp, Rattus norvegicus
tatgtcttgtgaccacacgtggttt

SEQ ID NO: 569841 - DNA, 25 bp, Rattus norvegicus
tatgtcttgtgagcacacgtggttt

SEQ ID NO: 569842 - DNA, 25 bp, Rattus norvegicus
tatgtctttaaccatttatccaagg

SEQ ID NO: 569843 - DNA, 25 bp, Rattus norvegicus
tatgtctttaacgatttatccaagg

SEQ ID NO: 569844 - DNA, 25 bp, Rattus norvegicus
tatgtctttagacccatagtccacc

SEQ ID NO: 569845 - DNA, 25 bp, Rattus norvegicus
tatgtctttagagccatagtccacc

SEQ ID NO: 569846 - DNA, 25 bp, Rattus norvegicus
tatgtctttcgacgcagcttcctga

SEQ ID NO: 569847 - DNA, 25 bp, Rattus norvegicus
tatgtctttcgaggcagcttcctga

SEQ ID NO: 569848 - DNA, 25 bp, Rattus norvegicus
tatgtctttgaaccttttaattatg

SEQ ID NO: 569849 - DNA, 25 bp, Rattus norvegicus
tatgtctttgaagcttttaattatg

SEQ ID NO: 569850 - DNA, 25 bp, Rattus norvegicus
tatgtctttgccatcattgaggttc

SEQ ID NO: 569851 - DNA, 25 bp, Rattus norvegicus
tatgtctttgccttcattgaggttc

SEQ ID NO: 569852 - DNA, 25 bp, Rattus norvegicus
tatgtgaagacaacttcctggtttt

SEQ ID NO: 569853 - DNA, 25 bp, Rattus norvegicus
tatgtgaagacatcttcctggtttt

SEQ ID NO: 569854 - DNA, 25 bp, Rattus norvegicus
tatgtgaagcaaccgcaggacgttt

SEQ ID NO: 569855 - DNA, 25 bp, Rattus norvegicus
tatgtgaagcaagcgcaggacgttt

SEQ ID NO: 569856 - DNA, 25 bp, Rattus norvegicus
tatgtgacaaggacacccaccctgt

SEQ ID NO: 569857 - DNA, 25 bp, Rattus norvegicus
tatgtgacaaggtcacccaccctgt

SEQ ID NO: 569858 - DNA, 25 bp, Rattus norvegicus
tatgtgacaattctttcgcctgcat

SEQ ID NO: 569859 - DNA, 25 bp, Rattus norvegicus
tatgtgacaattgtttcgcctgcat

SEQ ID NO: 569860 - DNA, 25 bp, Rattus norvegicus
tatgtgacagctcgctaggacccct

SEQ ID NO: 569861 - DNA, 25 bp, Rattus norvegicus
tatgtgacagctggctaggacccct

SEQ ID NO: 569862 - DNA, 25 bp, Rattus norvegicus
tatgtgacctcaaaggctggctgcc

SEQ ID NO: 569863 - DNA, 25 bp, Rattus norvegicus
tatgtgacctcataggctggctgcc

SEQ ID NO: 569864 - DNA, 25 bp, Rattus norvegicus
tatgtgactcccattgaagactccc

SEQ ID NO: 569865 - DNA, 25 bp, Rattus norvegicus
tatgtgactccctttgaagactccc

SEQ ID NO: 569866 - DNA, 25 bp, Rattus norvegicus
tatgtgactcctcaaagaagggcca

SEQ ID NO: 569867 - DNA, 25 bp, Rattus norvegicus
tatgtgactcctgaaagaagggcca

SEQ ID NO: 569868 - DNA, 25 bp, Rattus norvegicus
tatgtgactgacagggattttcccc

SEQ ID NO: 569869 - DNA, 25 bp, Rattus norvegicus
tatgtgactgactgggattttcccc

SEQ ID NO: 569870 - DNA, 25 bp, Rattus norvegicus
tatgtgagactgacctgtacttgtg

SEQ ID NO: 569871 - DNA, 25 bp, Rattus norvegicus
tatgtgagactgtcctgtacttgtg

SEQ ID NO: 569872 - DNA, 25 bp, Rattus norvegicus
tatgtgagataacggagtcctcttt

SEQ ID NO: 569873 - DNA, 25 bp, Rattus norvegicus
tatgtgagataagggagtcctcttt

SEQ ID NO: 569874 - DNA, 25 bp, Rattus norvegicus
tatgtgagcatgctcgcccattcaa

SEQ ID NO: 569875 - DNA, 25 bp, Rattus norvegicus
tatgtgagcatggtcgcccattcaa

SEQ ID NO: 569876 - DNA, 25 bp, Rattus norvegicus
tatgtgagccctcagatcctcaaca

SEQ ID NO: 569877 - DNA, 25 bp, Rattus norvegicus
tatgtgagccctgagatcctcaaca

SEQ ID NO: 569878 - DNA, 25 bp, Rattus norvegicus
tatgtgatatgtattcccaccctgt

SEQ ID NO: 569879 - DNA, 25 bp, Rattus norvegicus
tatgtgatatgttttcccaccctgt

SEQ ID NO: 569880 - DNA, 25 bp, Rattus norvegicus
tatgtgatggtcaccagcagatccc

SEQ ID NO: 569881 - DNA, 25 bp, Rattus norvegicus
tatgtgatggtctccagcagatccc

SEQ ID NO: 569882 - DNA, 25 bp, Rattus norvegicus
tatgtgatttctcctgttccttgta

SEQ ID NO: 569883 - DNA, 25 bp, Rattus norvegicus
tatgtgatttctgctgttccttgta

SEQ ID NO: 569884 - DNA, 25 bp, Rattus norvegicus
tatgtgcagccaacagtgtacaaca

SEQ ID NO: 569885 - DNA, 25 bp, Rattus norvegicus
tatgtgcagccatcagtgtacaaca

SEQ ID NO: 569886 - DNA, 25 bp, Rattus norvegicus
tatgtgcatccgacctgctagaagc

SEQ ID NO: 569887 - DNA, 25 bp, Rattus norvegicus
tatgtgcatccgtcctgctagaagc

SEQ ID NO: 569888 - DNA, 25 bp, Rattus norvegicus
tatgtgcatgcacattactccacct

SEQ ID NO: 569889 - DNA, 25 bp, Rattus norvegicus
tatgtgcatgcactagtggcctact

SEQ ID NO: 569890 - DNA, 25 bp, Rattus norvegicus
tatgtgcatgcagattactccacct

SEQ ID NO: 569891 - DNA, 25 bp, Rattus norvegicus
tatgtgcatgcagtagtggcctact

SEQ ID NO: 569892 - DNA, 25 bp, Rattus norvegicus
tatgtgccagcacatcttccaacga

SEQ ID NO: 569893 - DNA, 25 bp, Rattus norvegicus
tatgtgccagcagatcttccaacga

SEQ ID NO: 569894 - DNA, 25 bp, Rattus norvegicus
tatgtgccattgataaccctctaga

SEQ ID NO: 569895 - DNA, 25 bp, Rattus norvegicus
tatgtgccattgttaaccctctaga

SEQ ID NO: 569896 - DNA, 25 bp, Rattus norvegicus
tatgtgcccgcacaaccaaaattgg

SEQ ID NO: 569897 - DNA, 25 bp, Rattus norvegicus
tatgtgcccgcagaaccaaaattgg

SEQ ID NO: 569898 - DNA, 25 bp, Rattus norvegicus
tatgtgctagaactgccttgaggcc

SEQ ID NO: 569899 - DNA, 25 bp, Rattus norvegicus
tatgtgctagaagtgccttgaggcc

SEQ ID NO: 569900 - DNA, 25 bp, Rattus norvegicus
tatgtgctagggaaccctttctcta

SEQ ID NO: 569901 - DNA, 25 bp, Rattus norvegicus
tatgtgctagggtaccctttctcta

SEQ ID NO: 569902 - DNA, 25 bp, Rattus norvegicus
tatgtgctcgtaaaaatgcatgcgg

SEQ ID NO: 569903 - DNA, 25 bp, Rattus norvegicus
tatgtgctcgtataaatgcatgcgg

SEQ ID NO: 569904 - DNA, 25 bp, Rattus norvegicus
tatgtgctctttactgacagttgtc

SEQ ID NO: 569905 - DNA, 25 bp, Rattus norvegicus
tatgtgctcttttctgacagttgtc

SEQ ID NO: 569906 - DNA, 25 bp, Rattus norvegicus
tatgtgctgacaaatcgctctacgc

SEQ ID NO: 569907 - DNA, 25 bp, Rattus norvegicus
tatgtgctgacatatcgctctacgc

SEQ ID NO: 569908 - DNA, 25 bp, Rattus norvegicus
tatgtgctgcctctaccctagtaac

SEQ ID NO: 569909 - DNA, 25 bp, Rattus norvegicus
tatgtgctgcctgtaccctagtaac

SEQ ID NO: 569910 - DNA, 25 bp, Rattus norvegicus
tatgtgctggccagcgttctgaaac

SEQ ID NO: 569911 - DNA, 25 bp, Rattus norvegicus
tatgtgctggcctgcgttctgaaac

SEQ ID NO: 569912 - DNA, 25 bp, Rattus norvegicus
tatgtgcttaagaccccaagtgttc

SEQ ID NO: 569913 - DNA, 25 bp, Rattus norvegicus
tatgtgcttaagtccccaagtgttc

SEQ ID NO: 569914 - DNA, 25 bp, Rattus norvegicus
tatgtggaaaacaaaccctccgatc

SEQ ID NO: 569915 - DNA, 25 bp, Rattus norvegicus
tatgtggaaaactaaccctccgatc

SEQ ID NO: 569916 - DNA, 25 bp, Rattus norvegicus
tatgtggaatccctgttggccctag

SEQ ID NO: 569917 - DNA, 25 bp, Rattus norvegicus
tatgtggaatccgtgttggccctag

SEQ ID NO: 569918 - DNA, 25 bp, Rattus norvegicus
tatgtggaatttcgtaccctgtcgt

SEQ ID NO: 569919 - DNA, 25 bp, Rattus norvegicus
tatgtggaatttggtaccctgtcgt

SEQ ID NO: 569920 - DNA, 25 bp, Rattus norvegicus
tatgtggacactatggtaaaacgca

SEQ ID NO: 569921 - DNA, 25 bp, Rattus norvegicus
tatgtggacactttggtaaaacgca

SEQ ID NO: 569922 - DNA, 25 bp, Rattus norvegicus
tatgtggacattcccatcccatgca

SEQ ID NO: 569923 - DNA, 25 bp, Rattus norvegicus
tatgtggacattgccatcccatgca

SEQ ID NO: 569924 - DNA, 25 bp, Rattus norvegicus
tatgtggaccacattgccgccgagt

SEQ ID NO: 569925 - DNA, 25 bp, Rattus norvegicus
tatgtggaccactttgccgccgagt

SEQ ID NO: 569926 - DNA, 25 bp, Rattus norvegicus
tatgtggacgcacgccccgagacca

SEQ ID NO: 569927 - DNA, 25 bp, Rattus norvegicus
tatgtggacgcaggccccgagacca

SEQ ID NO: 569928 - DNA, 25 bp, Rattus norvegicus
tatgtggatattcctcctgttggct

SEQ ID NO: 569929 - DNA, 25 bp, Rattus norvegicus
tatgtggatattgctcctgttggct

SEQ ID NO: 569930 - DNA, 25 bp, Rattus norvegicus
tatgtggatgatcctctgtgtatac

SEQ ID NO: 569931 - DNA, 25 bp, Rattus norvegicus
tatgtggatgatgctctgtgtatac

SEQ ID NO: 569932 - DNA, 25 bp, Rattus norvegicus
tatgtggatgcaactaaccttattc

SEQ ID NO: 569933 - DNA, 25 bp, Rattus norvegicus
tatgtggatgcatctaaccttattc

SEQ ID NO: 569934 - DNA, 25 bp, Rattus norvegicus
tatgtggattggcagacctggcctc

SEQ ID NO: 569935 - DNA, 25 bp, Rattus norvegicus
tatgtggattgggagacctggcctc

SEQ ID NO: 569936 - DNA, 25 bp, Rattus norvegicus
tatgtggcaaagaactaccctgtct

SEQ ID NO: 569937 - DNA, 25 bp, Rattus norvegicus
tatgtggcaaagtactaccctgtct

SEQ ID NO: 569938 - DNA, 25 bp, Rattus norvegicus
tatgtggcccttacaatatttgaac

SEQ ID NO: 569939 - DNA, 25 bp, Rattus norvegicus
tatgtggccctttcaatatttgaac

SEQ ID NO: 569940 - DNA, 25 bp, Rattus norvegicus
tatgtggcgcgcaacgggctgcatc

SEQ ID NO: 569941 - DNA, 25 bp, Rattus norvegicus
tatgtggcgcgctacgggctgcatc

SEQ ID NO: 569942 - DNA, 25 bp, Rattus norvegicus
tatgtggctaggatcaacctcgggc

SEQ ID NO: 569943 - DNA, 25 bp, Rattus norvegicus
tatgtggctaggttcaacctcgggc

SEQ ID NO: 569944 - DNA, 25 bp, Rattus norvegicus
tatgtggctccaatgtaccctccag

SEQ ID NO: 569945 - DNA, 25 bp, Rattus norvegicus
tatgtggctccattgtaccctccag

SEQ ID NO: 569946 - DNA, 25 bp, Rattus norvegicus
tatgtggctgaccaccgcataccaa

SEQ ID NO: 569947 - DNA, 25 bp, Rattus norvegicus
tatgtggctgacgaccgcataccaa

SEQ ID NO: 569948 - DNA, 25 bp, Rattus norvegicus
tatgtgggaaccattgtccctggct

SEQ ID NO: 569949 - DNA, 25 bp, Rattus norvegicus
tatgtgggaacctttgtccctggct

SEQ ID NO: 569950 - DNA, 25 bp, Rattus norvegicus
tatgtgggttctcaggcttggacct

SEQ ID NO: 569951 - DNA, 25 bp, Rattus norvegicus
tatgtgggttctgaggcttggacct

SEQ ID NO: 569952 - DNA, 25 bp, Rattus norvegicus
tatgtggtcaccaaaactcctacac

SEQ ID NO: 569953 - DNA, 25 bp, Rattus norvegicus
tatgtggtcacctaaactcctacac

SEQ ID NO: 569954 - DNA, 25 bp, Rattus norvegicus
tatgtggtccaactgctatgagccc

SEQ ID NO: 569955 - DNA, 25 bp, Rattus norvegicus
tatgtggtccaagtgctatgagccc

SEQ ID NO: 569956 - DNA, 25 bp, Rattus norvegicus
tatgtggtccctaacagtagcagtt

SEQ ID NO: 569957 - DNA, 25 bp, Rattus norvegicus
tatgtggtcccttacagtagcagtt

SEQ ID NO: 569958 - DNA, 25 bp, Rattus norvegicus
tatgtggtcctcagttgctggaact

SEQ ID NO: 569959 - DNA, 25 bp, Rattus norvegicus
tatgtggtcctctgttgctggaact

SEQ ID NO: 569960 - DNA, 25 bp, Rattus norvegicus
tatgtggtctttcatcgagcccgaa

SEQ ID NO: 569961 - DNA, 25 bp, Rattus norvegicus
tatgtggtctttgatcgagcccgaa

SEQ ID NO: 569962 - DNA, 25 bp, Rattus norvegicus
tatgtggtggcgacaagccgtacat

SEQ ID NO: 569963 - DNA, 25 bp, Rattus norvegicus
tatgtggtggcgtcaagccgtacat

SEQ ID NO: 569964 - DNA, 25 bp, Rattus norvegicus
tatgtggtgttcagtttctcctccc

SEQ ID NO: 569965 - DNA, 25 bp, Rattus norvegicus
tatgtggtgttctgtttctcctccc

SEQ ID NO: 569966 - DNA, 25 bp, Rattus norvegicus
tatgtggttgtaagacgtgcccctc

SEQ ID NO: 569967 - DNA, 25 bp, Rattus norvegicus
tatgtggttgtatgacgtgcccctc

SEQ ID NO: 569968 - DNA, 25 bp, Rattus norvegicus
tatgtggtttcaagcttcactcagc

SEQ ID NO: 569969 - DNA, 25 bp, Rattus norvegicus
tatgtggtttcatgcttcactcagc

SEQ ID NO: 569970 - DNA, 25 bp, Rattus norvegicus
tatgtgtactggctgctcaagcact

SEQ ID NO: 569971 - DNA, 25 bp, Rattus norvegicus
tatgtgtactgggtgctcaagcact

SEQ ID NO: 569972 - DNA, 25 bp, Rattus norvegicus
tatgtgtatacccatgtgcatcctc

SEQ ID NO: 569973 - DNA, 25 bp, Rattus norvegicus
tatgtgtataccgatgtgcatcctc

SEQ ID NO: 569974 - DNA, 25 bp, Rattus norvegicus
tatgtgtcacataactgggcaaact

SEQ ID NO: 569975 - DNA, 25 bp, Rattus norvegicus
tatgtgtcacattactgggcaaact

SEQ ID NO: 569976 - DNA, 25 bp, Rattus norvegicus
tatgtgtcagacaataaccgccttc

SEQ ID NO: 569977 - DNA, 25 bp, Rattus norvegicus
tatgtgtcagactataaccgccttc

SEQ ID NO: 569978 - DNA, 25 bp, Rattus norvegicus
tatgtgtcagtcaccgtaacagtaa

SEQ ID NO: 569979 - DNA, 25 bp, Rattus norvegicus
tatgtgtcagtctccgtaacagtaa

SEQ ID NO: 569980 - DNA, 25 bp, Rattus norvegicus
tatgtgtcatacatcaccctacagc

SEQ ID NO: 569981 - DNA, 25 bp, Rattus norvegicus
tatgtgtcatacttcaccctacagc

SEQ ID NO: 569982 - DNA, 25 bp, Rattus norvegicus
tatgtgtcctccaaggacctgtctt

SEQ ID NO: 569983 - DNA, 25 bp, Rattus norvegicus
tatgtgtcctccacgggcacaggaa

SEQ ID NO: 569984 - DNA, 25 bp, Rattus norvegicus
tatgtgtcctcctaggacctgtctt

SEQ ID NO: 569985 - DNA, 25 bp, Rattus norvegicus
tatgtgtcctcctcgggcacaggaa

SEQ ID NO: 569986 - DNA, 25 bp, Rattus norvegicus
tatgtgtctctaagtccagttgtca

SEQ ID NO: 569987 - DNA, 25 bp, Rattus norvegicus
tatgtgtctctatgtccagttgtca

SEQ ID NO: 569988 - DNA, 25 bp, Rattus norvegicus
tatgtgtctctgatcctctgtgtct

SEQ ID NO: 569989 - DNA, 25 bp, Rattus norvegicus
tatgtgtctctgttcctctgtgtct

SEQ ID NO: 569990 - DNA, 25 bp, Rattus norvegicus
tatgtgtctgacagaacgttttcat

SEQ ID NO: 569991 - DNA, 25 bp, Rattus norvegicus
tatgtgtctgactgaacgttttcat

SEQ ID NO: 569992 - DNA, 25 bp, Rattus norvegicus
tatgtgtctgatctgctacctgtgt

SEQ ID NO: 569993 - DNA, 25 bp, Rattus norvegicus
tatgtgtctgatgtgctacctgtgt

SEQ ID NO: 569994 - DNA, 25 bp, Rattus norvegicus
tatgtgtgacatctttccaaacccg

SEQ ID NO: 569995 - DNA, 25 bp, Rattus norvegicus
tatgtgtgacatgtttccaaacccg

SEQ ID NO: 569996 - DNA, 25 bp, Rattus norvegicus
tatgtgtgcgctcgtgcctggctaa

SEQ ID NO: 569997 - DNA, 25 bp, Rattus norvegicus
tatgtgtgcgctggtgcctggctaa

SEQ ID NO: 569998 - DNA, 25 bp, Rattus norvegicus
tatgtgtgctagcaactctcaccta

SEQ ID NO: 569999 - DNA, 25 bp, Rattus norvegicus
tatgtgtgctaggaactctcaccta

SEQ ID NO: 570000 - DNA, 25 bp, Rattus norvegicus
tatgtgtggattatctctgtgtctc

SEQ ID NO: 570001 - DNA, 25 bp, Rattus norvegicus
tatgtgtggattttctctgtgtctc

SEQ ID NO: 570002 - DNA, 25 bp, Rattus norvegicus
tatgtgtgggcactctgcagagacc

SEQ ID NO: 570003 - DNA, 25 bp, Rattus norvegicus
tatgtgtgggcagtctgcagagacc

SEQ ID NO: 570004 - DNA, 25 bp, Rattus norvegicus
tatgtgtggtgcactaagaccgccc

SEQ ID NO: 570005 - DNA, 25 bp, Rattus norvegicus
tatgtgtggtgctctaagaccgccc

SEQ ID NO: 570006 - DNA, 25 bp, Rattus norvegicus
tatgtgtgtctgaaggagaggttct

SEQ ID NO: 570007 - DNA, 25 bp, Rattus norvegicus
tatgtgtgtctgaagttggtctcca

SEQ ID NO: 570008 - DNA, 25 bp, Rattus norvegicus
tatgtgtgtctgtaggagaggttct

SEQ ID NO: 570009 - DNA, 25 bp, Rattus norvegicus
tatgtgtgtctgtagttggtctcca

SEQ ID NO: 570010 - DNA, 25 bp, Rattus norvegicus
tatgtgtgtgcactgtccctccaga

SEQ ID NO: 570011 - DNA, 25 bp, Rattus norvegicus
tatgtgtgtgcagtgtccctccaga

SEQ ID NO: 570012 - DNA, 25 bp, Rattus norvegicus
tatgtgtgtgccactgtctctcacc

SEQ ID NO: 570013 - DNA, 25 bp, Rattus norvegicus
tatgtgtgtgcctctgtctctcacc

SEQ ID NO: 570014 - DNA, 25 bp, Rattus norvegicus
tatgtgttcagtacacccctgcagg

SEQ ID NO: 570015 - DNA, 25 bp, Rattus norvegicus
tatgtgttcagttcacccctgcagg

SEQ ID NO: 570016 - DNA, 25 bp, Rattus norvegicus
tatgtgttctgtctgcctggaaggc

SEQ ID NO: 570017 - DNA, 25 bp, Rattus norvegicus
tatgtgttctgtgtgcctggaaggc

SEQ ID NO: 570018 - DNA, 25 bp, Rattus norvegicus
tatgtgttgtgtatgtagtcttgtc

SEQ ID NO: 570019 - DNA, 25 bp, Rattus norvegicus
tatgtgttgtgtttgtagtcttgtc

SEQ ID NO: 570020 - DNA, 25 bp, Rattus norvegicus
tatgtgtttattacaccatgtgcac

SEQ ID NO: 570021 - DNA, 25 bp, Rattus norvegicus
tatgtgtttatttcaccatgtgcac

SEQ ID NO: 570022 - DNA, 25 bp, Rattus norvegicus
tatgtgtttctcattcagtggcaga

SEQ ID NO: 570023 - DNA, 25 bp, Rattus norvegicus
tatgtgtttctctttcagtggcaga

SEQ ID NO: 570024 - DNA, 25 bp, Rattus norvegicus
tatgttaacttcatcgcccagtgga

SEQ ID NO: 570025 - DNA, 25 bp, Rattus norvegicus
tatgttaacttcttcgcccagtgga

SEQ ID NO: 570026 - DNA, 25 bp, Rattus norvegicus
tatgttaatcccattctggctgagc

SEQ ID NO: 570027 - DNA, 25 bp, Rattus norvegicus
tatgttaatccctttctggctgagc

SEQ ID NO: 570028 - DNA, 25 bp, Rattus norvegicus
tatgttaatgtgactgtccacccct

SEQ ID NO: 570029 - DNA, 25 bp, Rattus norvegicus
tatgttaatgtgtctgtccacccct

SEQ ID NO: 570030 - DNA, 25 bp, Rattus norvegicus
tatgttacaataaaggcgtctcctg

SEQ ID NO: 570031 - DNA, 25 bp, Rattus norvegicus
tatgttacaatataggcgtctcctg

SEQ ID NO: 570032 - DNA, 25 bp, Rattus norvegicus
tatgttacacatatcccagatataa

SEQ ID NO: 570033 - DNA, 25 bp, Rattus norvegicus
tatgttacacatttcccagatataa

SEQ ID NO: 570034 - DNA, 25 bp, Rattus norvegicus
tatgttaccgacaggctctgtttcc

SEQ ID NO: 570035 - DNA, 25 bp, Rattus norvegicus
tatgttaccgactggctctgtttcc

SEQ ID NO: 570036 - DNA, 25 bp, Rattus norvegicus
tatgttacgtgtccacaagtgccca

SEQ ID NO: 570037 - DNA, 25 bp, Rattus norvegicus
tatgttacgtgtgcacaagtgccca

SEQ ID NO: 570038 - DNA, 25 bp, Rattus norvegicus
tatgttactgccaaaacccgaaccg

SEQ ID NO: 570039 - DNA, 25 bp, Rattus norvegicus
tatgttactgcctaaacccgaaccg

SEQ ID NO: 570040 - DNA, 25 bp, Rattus norvegicus
tatgttagaccgcagctggccagca

SEQ ID NO: 570041 - DNA, 25 bp, Rattus norvegicus
tatgttagaccggagctggccagca

SEQ ID NO: 570042 - DNA, 25 bp, Rattus norvegicus
tatgttagcacaactacaaacccta

SEQ ID NO: 570043 - DNA, 25 bp, Rattus norvegicus
tatgttagcacatctacaaacccta

SEQ ID NO: 570044 - DNA, 25 bp, Rattus norvegicus
tatgttataagcactttgtcacagg

SEQ ID NO: 570045 - DNA, 25 bp, Rattus norvegicus
tatgttataagctctttgtcacagg

SEQ ID NO: 570046 - DNA, 25 bp, Rattus norvegicus
tatgttataccaaactccagccagc

SEQ ID NO: 570047 - DNA, 25 bp, Rattus norvegicus
tatgttataccatactccagccagc

SEQ ID NO: 570048 - DNA, 25 bp, Rattus norvegicus
tatgttcaacatatcacctcacgga

SEQ ID NO: 570049 - DNA, 25 bp, Rattus norvegicus
tatgttcaacatttcacctcacgga

SEQ ID NO: 570050 - DNA, 25 bp, Rattus norvegicus
tatgttcaaggaaactagacagggt

SEQ ID NO: 570051 - DNA, 25 bp, Rattus norvegicus
tatgttcaaggatactagacagggt

SEQ ID NO: 570052 - DNA, 25 bp, Rattus norvegicus
tatgttcaatatacttcccctcatt

SEQ ID NO: 570053 - DNA, 25 bp, Rattus norvegicus
tatgttcaatattcttcccctcatt

SEQ ID NO: 570054 - DNA, 25 bp, Rattus norvegicus
tatgttcacaagcatcagtcagcct

SEQ ID NO: 570055 - DNA, 25 bp, Rattus norvegicus
tatgttcacaaggatcagtcagcct

SEQ ID NO: 570056 - DNA, 25 bp, Rattus norvegicus
tatgttcacacaaactaagtccgaa

SEQ ID NO: 570057 - DNA, 25 bp, Rattus norvegicus
tatgttcacacatactaagtccgaa

SEQ ID NO: 570058 - DNA, 25 bp, Rattus norvegicus
tatgttcagatcctttctgccatgg

SEQ ID NO: 570059 - DNA, 25 bp, Rattus norvegicus
tatgttcagatcgtttctgccatgg

SEQ ID NO: 570060 - DNA, 25 bp, Rattus norvegicus
tatgttcaggaacgccaagcctaca

SEQ ID NO: 570061 - DNA, 25 bp, Rattus norvegicus
tatgttcaggaaggccaagcctaca

SEQ ID NO: 570062 - DNA, 25 bp, Rattus norvegicus
tatgttcagtatccattctcccaaa

SEQ ID NO: 570063 - DNA, 25 bp, Rattus norvegicus
tatgttcagtatgcattctcccaaa

SEQ ID NO: 570064 - DNA, 25 bp, Rattus norvegicus
tatgttcatagtcgccttatttgtg

SEQ ID NO: 570065 - DNA, 25 bp, Rattus norvegicus
tatgttcatagtggccttatttgtg

SEQ ID NO: 570066 - DNA, 25 bp, Rattus norvegicus
tatgttcatgtaacgtccactggca

SEQ ID NO: 570067 - DNA, 25 bp, Rattus norvegicus
tatgttcatgtatcgtccactggca

SEQ ID NO: 570068 - DNA, 25 bp, Rattus norvegicus
tatgttccactgcaggcacaggaat

SEQ ID NO: 570069 - DNA, 25 bp, Rattus norvegicus
tatgttccactggaggcacaggaat

SEQ ID NO: 570070 - DNA, 25 bp, Rattus norvegicus
tatgttccagatcgcagatgctgtc

SEQ ID NO: 570071 - DNA, 25 bp, Rattus norvegicus
tatgttccagatggcagatgctgtc

SEQ ID NO: 570072 - DNA, 25 bp, Rattus norvegicus
tatgttcccgatcctaaagttgcag

SEQ ID NO: 570073 - DNA, 25 bp, Rattus norvegicus
tatgttcccgatgctaaagttgcag

SEQ ID NO: 570074 - DNA, 25 bp, Rattus norvegicus
tatgttccctagatctatccatctt

SEQ ID NO: 570075 - DNA, 25 bp, Rattus norvegicus
tatgttccctagttctatccatctt

SEQ ID NO: 570076 - DNA, 25 bp, Rattus norvegicus
tatgttcccttcatttaacctcttg

SEQ ID NO: 570077 - DNA, 25 bp, Rattus norvegicus
tatgttcccttcttttaacctcttg

SEQ ID NO: 570078 - DNA, 25 bp, Rattus norvegicus
tatgttcctcatatctcccgttttt

SEQ ID NO: 570079 - DNA, 25 bp, Rattus norvegicus
tatgttcctcatttctcccgttttt

SEQ ID NO: 570080 - DNA, 25 bp, Rattus norvegicus
tatgttccttccattccatttctaa

SEQ ID NO: 570081 - DNA, 25 bp, Rattus norvegicus
tatgttccttcctttccatttctaa

SEQ ID NO: 570082 - DNA, 25 bp, Rattus norvegicus
tatgttccttttacctctcttgatt

SEQ ID NO: 570083 - DNA, 25 bp, Rattus norvegicus
tatgttcctttttcctctcttgatt

SEQ ID NO: 570084 - DNA, 25 bp, Rattus norvegicus
tatgttctatatcctgtttcaccaa

SEQ ID NO: 570085 - DNA, 25 bp, Rattus norvegicus
tatgttctatatgctgtttcaccaa

SEQ ID NO: 570086 - DNA, 25 bp, Rattus norvegicus
tatgttctatccagtatcactctgc

SEQ ID NO: 570087 - DNA, 25 bp, Rattus norvegicus
tatgttctatcctgtatcactctgc

SEQ ID NO: 570088 - DNA, 25 bp, Rattus norvegicus
tatgttctcgtgagatcaccattct

SEQ ID NO: 570089 - DNA, 25 bp, Rattus norvegicus
tatgttctcgtgtgatcaccattct

SEQ ID NO: 570090 - DNA, 25 bp, Rattus norvegicus
tatgttctctggacacttttgtgga

SEQ ID NO: 570091 - DNA, 25 bp, Rattus norvegicus
tatgttctctggtcacttttgtgga

SEQ ID NO: 570092 - DNA, 25 bp, Rattus norvegicus
tatgttctcttccaaattcgatcag

SEQ ID NO: 570093 - DNA, 25 bp, Rattus norvegicus
tatgttctcttcgaaattcgatcag

SEQ ID NO: 570094 - DNA, 25 bp, Rattus norvegicus
tatgttctgttaatacggcctcctc

SEQ ID NO: 570095 - DNA, 25 bp, Rattus norvegicus
tatgttctgttattacggcctcctc

SEQ ID NO: 570096 - DNA, 25 bp, Rattus norvegicus
tatgttcttacacactccaggatca

SEQ ID NO: 570097 - DNA, 25 bp, Rattus norvegicus
tatgttcttacagactccaggatca

SEQ ID NO: 570098 - DNA, 25 bp, Rattus norvegicus
tatgttcttctcactagtaggtctc

SEQ ID NO: 570099 - DNA, 25 bp, Rattus norvegicus
tatgttcttctctctagtaggtctc

SEQ ID NO: 570100 - DNA, 25 bp, Rattus norvegicus
tatgttcttctgattctctttgagc

SEQ ID NO: 570101 - DNA, 25 bp, Rattus norvegicus
tatgttcttctgtttctctttgagc

SEQ ID NO: 570102 - DNA, 25 bp, Rattus norvegicus
tatgttcttcttcagctgggcagcc

SEQ ID NO: 570103 - DNA, 25 bp, Rattus norvegicus
tatgttcttcttgagctgggcagcc

SEQ ID NO: 570104 - DNA, 25 bp, Rattus norvegicus
tatgttcttgggagatctgtaataa

SEQ ID NO: 570105 - DNA, 25 bp, Rattus norvegicus
tatgttcttgggtgatctgtaataa

SEQ ID NO: 570106 - DNA, 25 bp, Rattus norvegicus
tatgttgaaagcaggctcccgggcc

SEQ ID NO: 570107 - DNA, 25 bp, Rattus norvegicus
tatgttgaaagctggctcccgggcc

SEQ ID NO: 570108 - DNA, 25 bp, Rattus norvegicus
tatgttgaatcacagcctttgacgg

SEQ ID NO: 570109 - DNA, 25 bp, Rattus norvegicus
tatgttgaatcagagcctttgacgg

SEQ ID NO: 570110 - DNA, 25 bp, Rattus norvegicus
tatgttgacagcatagccgacctct

SEQ ID NO: 570111 - DNA, 25 bp, Rattus norvegicus
tatgttgacagcttagccgacctct

SEQ ID NO: 570112 - DNA, 25 bp, Rattus norvegicus
tatgttgacccacatggcagccact

SEQ ID NO: 570113 - DNA, 25 bp, Rattus norvegicus
tatgttgacccacgaacctttaatt

SEQ ID NO: 570114 - DNA, 25 bp, Rattus norvegicus
tatgttgacccagatggcagccact

SEQ ID NO: 570115 - DNA, 25 bp, Rattus norvegicus
tatgttgacccaggaacctttaatt

SEQ ID NO: 570116 - DNA, 25 bp, Rattus norvegicus
tatgttgagaatcctagcctagttt

SEQ ID NO: 570117 - DNA, 25 bp, Rattus norvegicus
tatgttgagaatgctagcctagttt

SEQ ID NO: 570118 - DNA, 25 bp, Rattus norvegicus
tatgttgatgcaaccattccctatg

SEQ ID NO: 570119 - DNA, 25 bp, Rattus norvegicus
tatgttgatgcatccattccctatg

SEQ ID NO: 570120 - DNA, 25 bp, Rattus norvegicus
tatgttgatgccaacttcctgtgaa

SEQ ID NO: 570121 - DNA, 25 bp, Rattus norvegicus
tatgttgatgcccatttcacttaaa

SEQ ID NO: 570122 - DNA, 25 bp, Rattus norvegicus
tatgttgatgccgatttcacttaaa

SEQ ID NO: 570123 - DNA, 25 bp, Rattus norvegicus
tatgttgatgcctacttcctgtgaa

SEQ ID NO: 570124 - DNA, 25 bp, Rattus norvegicus
tatgttgccagaaaccctttttgta

SEQ ID NO: 570125 - DNA, 25 bp, Rattus norvegicus
tatgttgccagataccctttttgta

SEQ ID NO: 570126 - DNA, 25 bp, Rattus norvegicus
tatgttgctgggaatggccttcgga

SEQ ID NO: 570127 - DNA, 25 bp, Rattus norvegicus
tatgttgctgggtatggccttcgga

SEQ ID NO: 570128 - DNA, 25 bp, Rattus norvegicus
tatgttgctggtatggcagtttgac

SEQ ID NO: 570129 - DNA, 25 bp, Rattus norvegicus
tatgttgctggtttggcagtttgac

SEQ ID NO: 570130 - DNA, 25 bp, Rattus norvegicus
tatgttgcttcaacaggctactttc

SEQ ID NO: 570131 - DNA, 25 bp, Rattus norvegicus
tatgttgcttcatcaggctactttc

SEQ ID NO: 570132 - DNA, 25 bp, Rattus norvegicus
tatgttggactcagccatagactcc

SEQ ID NO: 570133 - DNA, 25 bp, Rattus norvegicus
tatgttggactctgccatagactcc

SEQ ID NO: 570134 - DNA, 25 bp, Rattus norvegicus
tatgttgggaacatgctcgcttctg

SEQ ID NO: 570135 - DNA, 25 bp, Rattus norvegicus
tatgttgggaacttgctcgcttctg

SEQ ID NO: 570136 - DNA, 25 bp, Rattus norvegicus
tatgttgggcttatctccttgattt

SEQ ID NO: 570137 - DNA, 25 bp, Rattus norvegicus
tatgttgggcttttctccttgattt

SEQ ID NO: 570138 - DNA, 25 bp, Rattus norvegicus
tatgttggtatccatccgagctctc

SEQ ID NO: 570139 - DNA, 25 bp, Rattus norvegicus
tatgttggtatcgatccgagctctc

SEQ ID NO: 570140 - DNA, 25 bp, Rattus norvegicus
tatgttgtagttcttgtgtcccagg

SEQ ID NO: 570141 - DNA, 25 bp, Rattus norvegicus
tatgttgtagttgttgtgtcccagg

SEQ ID NO: 570142 - DNA, 25 bp, Rattus norvegicus
tatgttgtcaggctgatgacccagt

SEQ ID NO: 570143 - DNA, 25 bp, Rattus norvegicus
tatgttgtcagggtgatgacccagt

SEQ ID NO: 570144 - DNA, 25 bp, Rattus norvegicus
tatgttgtcatgcagataccacggc

SEQ ID NO: 570145 - DNA, 25 bp, Rattus norvegicus
tatgttgtcatggagataccacggc

SEQ ID NO: 570146 - DNA, 25 bp, Rattus norvegicus
tatgttgtgggcattccggcgtgtc

SEQ ID NO: 570147 - DNA, 25 bp, Rattus norvegicus
tatgttgtgggctttccggcgtgtc

SEQ ID NO: 570148 - DNA, 25 bp, Rattus norvegicus
tatgttgttctacctactgttcttg

SEQ ID NO: 570149 - DNA, 25 bp, Rattus norvegicus
tatgttgttctagctactgttcttg

SEQ ID NO: 570150 - DNA, 25 bp, Rattus norvegicus
tatgttgttctccttacccagtaac

SEQ ID NO: 570151 - DNA, 25 bp, Rattus norvegicus
tatgttgttctcgttacccagtaac

SEQ ID NO: 570152 - DNA, 25 bp, Rattus norvegicus
tatgtttacaatcctataacccttt

SEQ ID NO: 570153 - DNA, 25 bp, Rattus norvegicus
tatgtttacaatgctataacccttt

SEQ ID NO: 570154 - DNA, 25 bp, Rattus norvegicus
tatgtttacagcaactgtctgtctt

SEQ ID NO: 570155 - DNA, 25 bp, Rattus norvegicus
tatgtttacagctactgtctgtctt

SEQ ID NO: 570156 - DNA, 25 bp, Rattus norvegicus
tatgtttaccatctgcctttccgaa

SEQ ID NO: 570157 - DNA, 25 bp, Rattus norvegicus
tatgtttaccatgtgcctttccgaa

SEQ ID NO: 570158 - DNA, 25 bp, Rattus norvegicus
tatgtttacccactttcctaccttg

SEQ ID NO: 570159 - DNA, 25 bp, Rattus norvegicus
tatgtttacccagtttcctaccttg

SEQ ID NO: 570160 - DNA, 25 bp, Rattus norvegicus
tatgtttaccgtatcctaccttttg

SEQ ID NO: 570161 - DNA, 25 bp, Rattus norvegicus
tatgtttaccgtttcctaccttttg

SEQ ID NO: 570162 - DNA, 25 bp, Rattus norvegicus
tatgtttacctcagtttgcccagtg

SEQ ID NO: 570163 - DNA, 25 bp, Rattus norvegicus
tatgtttacctctgtttgcccagtg

SEQ ID NO: 570164 - DNA, 25 bp, Rattus norvegicus
tatgtttatgggagtgctgccttca

SEQ ID NO: 570165 - DNA, 25 bp, Rattus norvegicus
tatgtttatgggtgtgctgccttca

SEQ ID NO: 570166 - DNA, 25 bp, Rattus norvegicus
tatgtttatgttatctctcagcccg

SEQ ID NO: 570167 - DNA, 25 bp, Rattus norvegicus
tatgtttatgttcttctatgatgtc

SEQ ID NO: 570168 - DNA, 25 bp, Rattus norvegicus
tatgtttatgttgttctatgatgtc

SEQ ID NO: 570169 - DNA, 25 bp, Rattus norvegicus
tatgtttatgttttctctcagcccg

SEQ ID NO: 570170 - DNA, 25 bp, Rattus norvegicus
tatgtttcacatatctgcaccttca

SEQ ID NO: 570171 - DNA, 25 bp, Rattus norvegicus
tatgtttcacatttctgcaccttca

SEQ ID NO: 570172 - DNA, 25 bp, Rattus norvegicus
tatgtttcctatcggccgccgtggg

SEQ ID NO: 570173 - DNA, 25 bp, Rattus norvegicus
tatgtttcctatgggccgccgtggg

SEQ ID NO: 570174 - DNA, 25 bp, Rattus norvegicus
tatgtttccttccagtagggacaat

SEQ ID NO: 570175 - DNA, 25 bp, Rattus norvegicus
tatgtttccttcgagtagggacaat

SEQ ID NO: 570176 - DNA, 25 bp, Rattus norvegicus
tatgtttcttatagctacgcgtggt

SEQ ID NO: 570177 - DNA, 25 bp, Rattus norvegicus
tatgtttcttattgctacgcgtggt

SEQ ID NO: 570178 - DNA, 25 bp, Rattus norvegicus
tatgtttgatacaacattgaatctg

SEQ ID NO: 570179 - DNA, 25 bp, Rattus norvegicus
tatgtttgatactacattgaatctg

SEQ ID NO: 570180 - DNA, 25 bp, Rattus norvegicus
tatgtttgcagtacagacacctaaa

SEQ ID NO: 570181 - DNA, 25 bp, Rattus norvegicus
tatgtttgcagttcagacacctaaa

SEQ ID NO: 570182 - DNA, 25 bp, Rattus norvegicus
tatgtttgctccatcttctttcttc

SEQ ID NO: 570183 - DNA, 25 bp, Rattus norvegicus
tatgtttgctccttcttctttcttc

SEQ ID NO: 570184 - DNA, 25 bp, Rattus norvegicus
tatgtttggacccagattgtctgtc

SEQ ID NO: 570185 - DNA, 25 bp, Rattus norvegicus
tatgtttggaccgagattgtctgtc

SEQ ID NO: 570186 - DNA, 25 bp, Rattus norvegicus
tatgtttggccaagctgctgcccaa

SEQ ID NO: 570187 - DNA, 25 bp, Rattus norvegicus
tatgtttggccatgctgctgcccaa

SEQ ID NO: 570188 - DNA, 25 bp, Rattus norvegicus
tatgtttgtgccatgtttgctgctt

SEQ ID NO: 570189 - DNA, 25 bp, Rattus norvegicus
tatgtttgtgccttgtttgctgctt

SEQ ID NO: 570190 - DNA, 25 bp, Rattus norvegicus
tatgttttatgtatttccttttcag

SEQ ID NO: 570191 - DNA, 25 bp, Rattus norvegicus
tatgttttatgtttttccttttcag

SEQ ID NO: 570192 - DNA, 25 bp, Rattus norvegicus
tatgttttcgttacccaattctttg

SEQ ID NO: 570193 - DNA, 25 bp, Rattus norvegicus
tatgttttcgtttcccaattctttg

SEQ ID NO: 570194 - DNA, 25 bp, Rattus norvegicus
tatgttttctttcagcaatctccta

SEQ ID NO: 570195 - DNA, 25 bp, Rattus norvegicus
tatgttttctttgagcaatctccta

SEQ ID NO: 570196 - DNA, 25 bp, Rattus norvegicus
tatgttttgctgaacccgtgttttg

SEQ ID NO: 570197 - DNA, 25 bp, Rattus norvegicus
tatgttttgctgtacccgtgttttg

SEQ ID NO: 570198 - DNA, 25 bp, Rattus norvegicus
tatgttttgttgacgggtctttaag

SEQ ID NO: 570199 - DNA, 25 bp, Rattus norvegicus
tatgttttgttgtcgggtctttaag

SEQ ID NO: 570200 - DNA, 25 bp, Rattus norvegicus
tatgtttttcagatccgggcgttca

SEQ ID NO: 570201 - DNA, 25 bp, Rattus norvegicus
tatgtttttcagttccgggcgttca

SEQ ID NO: 570202 - DNA, 25 bp, Rattus norvegicus
tatgtttttcccactgtaattactt

SEQ ID NO: 570203 - DNA, 25 bp, Rattus norvegicus
tatgtttttccctctgtaattactt

SEQ ID NO: 570204 - DNA, 25 bp, Rattus norvegicus
tatgtttttgtgactactgtttatt

SEQ ID NO: 570205 - DNA, 25 bp, Rattus norvegicus
tatgtttttgtgtctactgtttatt

SEQ ID NO: 570206 - DNA, 25 bp, Rattus norvegicus
tatgttttttctacccattatcaga

SEQ ID NO: 570207 - DNA, 25 bp, Rattus norvegicus
tatgttttttcttcccattatcaga

SEQ ID NO: 570208 - DNA, 25 bp, Rattus norvegicus
tattaaaaagatacaccgacctgtg

SEQ ID NO: 570209 - DNA, 25 bp, Rattus norvegicus
tattaaaaagattcaccgacctgtg

SEQ ID NO: 570210 - DNA, 25 bp, Rattus norvegicus
tattaaaagtttcccctctcagtca

SEQ ID NO: 570211 - DNA, 25 bp, Rattus norvegicus
tattaaaagtttgccctctcagtca

SEQ ID NO: 570212 - DNA, 25 bp, Rattus norvegicus
tattaaacaaaaactcccaagccgg

SEQ ID NO: 570213 - DNA, 25 bp, Rattus norvegicus
tattaaacaaaatctcccaagccgg

SEQ ID NO: 570214 - DNA, 25 bp, Rattus norvegicus
tattaaaccaggctccgtaaccgtg

SEQ ID NO: 570215 - DNA, 25 bp, Rattus norvegicus
tattaaaccagggtccgtaaccgtg

SEQ ID NO: 570216 - DNA, 25 bp, Rattus norvegicus
tattaaagaggtctgtgcccattgc

SEQ ID NO: 570217 - DNA, 25 bp, Rattus norvegicus
tattaaagaggtgtgtgcccattgc

SEQ ID NO: 570218 - DNA, 25 bp, Rattus norvegicus
tattaaagatctcctccattttcga

SEQ ID NO: 570219 - DNA, 25 bp, Rattus norvegicus
tattaaagatctgctccattttcga

SEQ ID NO: 570220 - DNA, 25 bp, Rattus norvegicus
tattaaaggagtctgccgctgctct

SEQ ID NO: 570221 - DNA, 25 bp, Rattus norvegicus
tattaaaggagtgtgccgctgctct

SEQ ID NO: 570222 - DNA, 25 bp, Rattus norvegicus
tattaaaggcctcactttctcctct

SEQ ID NO: 570223 - DNA, 25 bp, Rattus norvegicus
tattaaaggcctgactttctcctct

SEQ ID NO: 570224 - DNA, 25 bp, Rattus norvegicus
tattaacaacaaaaggacggctgct

SEQ ID NO: 570225 - DNA, 25 bp, Rattus norvegicus
tattaacaacaataggacggctgct

SEQ ID NO: 570226 - DNA, 25 bp, Rattus norvegicus
tattaacactaacaccctgtttctt

SEQ ID NO: 570227 - DNA, 25 bp, Rattus norvegicus
tattaacactaagaccctgtttctt

SEQ ID NO: 570228 - DNA, 25 bp, Rattus norvegicus
tattaacactcccatggatccaggt

SEQ ID NO: 570229 - DNA, 25 bp, Rattus norvegicus
tattaacactccgatggatccaggt

SEQ ID NO: 570230 - DNA, 25 bp, Rattus norvegicus
tattaacattggctcttcctggtca

SEQ ID NO: 570231 - DNA, 25 bp, Rattus norvegicus
tattaacattgggtcttcctggtca

SEQ ID NO: 570232 - DNA, 25 bp, Rattus norvegicus
tattaaccaagcactgaccttctga

SEQ ID NO: 570233 - DNA, 25 bp, Rattus norvegicus
tattaaccaagctctgaccttctga

SEQ ID NO: 570234 - DNA, 25 bp, Rattus norvegicus
tattaaccacatctgtacccgagag

SEQ ID NO: 570235 - DNA, 25 bp, Rattus norvegicus
tattaaccacatgtgtacccgagag

SEQ ID NO: 570236 - DNA, 25 bp, Rattus norvegicus
tattaaccctggatcctgtgctgga

SEQ ID NO: 570237 - DNA, 25 bp, Rattus norvegicus
tattaaccctggttcctgtgctgga

SEQ ID NO: 570238 - DNA, 25 bp, Rattus norvegicus
tattaacccttactctttctatctg

SEQ ID NO: 570239 - DNA, 25 bp, Rattus norvegicus
tattaacccttagtctttctatctg

SEQ ID NO: 570240 - DNA, 25 bp, Rattus norvegicus
tattaaccttggctactggcaccaa

SEQ ID NO: 570241 - DNA, 25 bp, Rattus norvegicus
tattaaccttgggtactggcaccaa

SEQ ID NO: 570242 - DNA, 25 bp, Rattus norvegicus
tattaacctttgcaaccatttctcc

SEQ ID NO: 570243 - DNA, 25 bp, Rattus norvegicus
tattaacctttggaaccatttctcc

SEQ ID NO: 570244 - DNA, 25 bp, Rattus norvegicus
tattaacgcgctatggctggtaacc

SEQ ID NO: 570245 - DNA, 25 bp, Rattus norvegicus
tattaacgcgctttggctggtaacc

SEQ ID NO: 570246 - DNA, 25 bp, Rattus norvegicus
tattaacgcgttcgcagttgcagcg

SEQ ID NO: 570247 - DNA, 25 bp, Rattus norvegicus
tattaacgcgttggcagttgcagcg

SEQ ID NO: 570248 - DNA, 25 bp, Rattus norvegicus
tattaacgtggcaggttttctctct

SEQ ID NO: 570249 - DNA, 25 bp, Rattus norvegicus
tattaacgtggctggttttctctct

SEQ ID NO: 570250 - DNA, 25 bp, Rattus norvegicus
tattaactaaccatcgtctgtgcca

SEQ ID NO: 570251 - DNA, 25 bp, Rattus norvegicus
tattaactaaccttcgtctgtgcca

SEQ ID NO: 570252 - DNA, 25 bp, Rattus norvegicus
tattaactgggactcttccgtcctc

SEQ ID NO: 570253 - DNA, 25 bp, Rattus norvegicus
tattaactgggagtcttccgtcctc

SEQ ID NO: 570254 - DNA, 25 bp, Rattus norvegicus
tattaacttgctaatgaacatcgtt

SEQ ID NO: 570255 - DNA, 25 bp, Rattus norvegicus
tattaacttgcttatgaacatcgtt

SEQ ID NO: 570256 - DNA, 25 bp, Rattus norvegicus
tattaactttgtccctctgagtctg

SEQ ID NO: 570257 - DNA, 25 bp, Rattus norvegicus
tattaactttgtgcctctgagtctg

SEQ ID NO: 570258 - DNA, 25 bp, Rattus norvegicus
tattaagaaggtctgggtccccatg

SEQ ID NO: 570259 - DNA, 25 bp, Rattus norvegicus
tattaagaaggtgtgggtccccatg

SEQ ID NO: 570260 - DNA, 25 bp, Rattus norvegicus
tattaagacagtactttctggttgg

SEQ ID NO: 570261 - DNA, 25 bp, Rattus norvegicus
tattaagacagttctttctggttgg

SEQ ID NO: 570262 - DNA, 25 bp, Rattus norvegicus
tattaagaggcccaatccactgtgg

SEQ ID NO: 570263 - DNA, 25 bp, Rattus norvegicus
tattaagaggccgaatccactgtgg

SEQ ID NO: 570264 - DNA, 25 bp, Rattus norvegicus
tattaagcatcacactaccagggag

SEQ ID NO: 570265 - DNA, 25 bp, Rattus norvegicus
tattaagcatcagactaccagggag

SEQ ID NO: 570266 - DNA, 25 bp, Rattus norvegicus
tattaagccagacgcaacggccccg

SEQ ID NO: 570267 - DNA, 25 bp, Rattus norvegicus
tattaagccagaggcaacggccccg

SEQ ID NO: 570268 - DNA, 25 bp, Rattus norvegicus
tattaaggtctacagcacagccaca

SEQ ID NO: 570269 - DNA, 25 bp, Rattus norvegicus
tattaaggtctagagcacagccaca

SEQ ID NO: 570270 - DNA, 25 bp, Rattus norvegicus
tattaaggtttcatcttcccaggtg

SEQ ID NO: 570271 - DNA, 25 bp, Rattus norvegicus
tattaaggtttcttcttcccaggtg

SEQ ID NO: 570272 - DNA, 25 bp, Rattus norvegicus
tattaagtagcaatctgtcagccac

SEQ ID NO: 570273 - DNA, 25 bp, Rattus norvegicus
tattaagtagcattctgtcagccac

SEQ ID NO: 570274 - DNA, 25 bp, Rattus norvegicus
tattaagttcctctatccttcgggt

SEQ ID NO: 570275 - DNA, 25 bp, Rattus norvegicus
tattaagttcctgtatccttcgggt

SEQ ID NO: 570276 - DNA, 25 bp, Rattus norvegicus
tattaagttggcctttgcctgtccc

SEQ ID NO: 570277 - DNA, 25 bp, Rattus norvegicus
tattaagttggcgtttgcctgtccc

SEQ ID NO: 570278 - DNA, 25 bp, Rattus norvegicus
tattaatactgcaactggaattggg

SEQ ID NO: 570279 - DNA, 25 bp, Rattus norvegicus
tattaatactgctactggaattggg

SEQ ID NO: 570280 - DNA, 25 bp, Rattus norvegicus
tattaatcagtgctgtggtctcagt

SEQ ID NO: 570281 - DNA, 25 bp, Rattus norvegicus
tattaatcagtggtgtggtctcagt

SEQ ID NO: 570282 - DNA, 25 bp, Rattus norvegicus
tattaatcccttactataccctttg

SEQ ID NO: 570283 - DNA, 25 bp, Rattus norvegicus
tattaatccctttctataccctttg

SEQ ID NO: 570284 - DNA, 25 bp, Rattus norvegicus
tattaatgatgtccagcctgtctga

SEQ ID NO: 570285 - DNA, 25 bp, Rattus norvegicus
tattaatgatgtgcagcctgtctga

SEQ ID NO: 570286 - DNA, 25 bp, Rattus norvegicus
tattaatggcccagcttcttagcaa

SEQ ID NO: 570287 - DNA, 25 bp, Rattus norvegicus
tattaatggccctgcttcttagcaa

SEQ ID NO: 570288 - DNA, 25 bp, Rattus norvegicus
tattaatggcctctggtttctgctg

SEQ ID NO: 570289 - DNA, 25 bp, Rattus norvegicus
tattaatggcctgtggtttctgctg

SEQ ID NO: 570290 - DNA, 25 bp, Rattus norvegicus
tattaattcattcccccaaccaaag

SEQ ID NO: 570291 - DNA, 25 bp, Rattus norvegicus
tattaattcattgccccaaccaaag

SEQ ID NO: 570292 - DNA, 25 bp, Rattus norvegicus
tattacaaccgcatgtttctccaag

SEQ ID NO: 570293 - DNA, 25 bp, Rattus norvegicus
tattacaaccgcttgtttctccaag

SEQ ID NO: 570294 - DNA, 25 bp, Rattus norvegicus
tattacaatgtgagccctaggccag

SEQ ID NO: 570295 - DNA, 25 bp, Rattus norvegicus
tattacaatgtgtgccctaggccag

SEQ ID NO: 570296 - DNA, 25 bp, Rattus norvegicus
tattacaattaaaccgggaccccag

SEQ ID NO: 570297 - DNA, 25 bp, Rattus norvegicus
tattacaattaatccgggaccccag

SEQ ID NO: 570298 - DNA, 25 bp, Rattus norvegicus
tattacagaacgagctaccagcact

SEQ ID NO: 570299 - DNA, 25 bp, Rattus norvegicus
tattacagaacgtgctaccagcact

SEQ ID NO: 570300 - DNA, 25 bp, Rattus norvegicus
tattacagggtcatctgttgatttc

SEQ ID NO: 570301 - DNA, 25 bp, Rattus norvegicus
tattacagggtcttctgttgatttc

SEQ ID NO: 570302 - DNA, 25 bp, Rattus norvegicus
tattacagtatcatagtccccacca

SEQ ID NO: 570303 - DNA, 25 bp, Rattus norvegicus
tattacagtatcttagtccccacca

SEQ ID NO: 570304 - DNA, 25 bp, Rattus norvegicus
tattacatagctcaaggcggcccga

SEQ ID NO: 570305 - DNA, 25 bp, Rattus norvegicus
tattacatagctgaaggcggcccga

SEQ ID NO: 570306 - DNA, 25 bp, Rattus norvegicus
tattacatcatcaaccttggctatg

SEQ ID NO: 570307 - DNA, 25 bp, Rattus norvegicus
tattacatcatctaccttggctatg

SEQ ID NO: 570308 - DNA, 25 bp, Rattus norvegicus
tattacatccttctggcgctttttt

SEQ ID NO: 570309 - DNA, 25 bp, Rattus norvegicus
tattacatccttgtggcgctttttt

SEQ ID NO: 570310 - DNA, 25 bp, Rattus norvegicus
tattaccaataaactcgggatgtat

SEQ ID NO: 570311 - DNA, 25 bp, Rattus norvegicus
tattaccaataatctcgggatgtat

SEQ ID NO: 570312 - DNA, 25 bp, Rattus norvegicus
tattaccagagcattgcaccacttc

SEQ ID NO: 570313 - DNA, 25 bp, Rattus norvegicus
tattaccagagctttgcaccacttc

SEQ ID NO: 570314 - DNA, 25 bp, Rattus norvegicus
tattaccatcttcctctgagagcca

SEQ ID NO: 570315 - DNA, 25 bp, Rattus norvegicus
tattaccatcttgctctgagagcca

SEQ ID NO: 570316 - DNA, 25 bp, Rattus norvegicus
tattaccatgctctatactgacagc

SEQ ID NO: 570317 - DNA, 25 bp, Rattus norvegicus
tattaccatgctgtatactgacagc

SEQ ID NO: 570318 - DNA, 25 bp, Rattus norvegicus
tattaccatggtagtttccaaagga

SEQ ID NO: 570319 - DNA, 25 bp, Rattus norvegicus
tattaccatggttgtttccaaagga

SEQ ID NO: 570320 - DNA, 25 bp, Rattus norvegicus
tattacccaggcacactttatcagt

SEQ ID NO: 570321 - DNA, 25 bp, Rattus norvegicus
tattacccaggctcactttatcagt

SEQ ID NO: 570322 - DNA, 25 bp, Rattus norvegicus
tattaccccacccaaagtgcaaagt

SEQ ID NO: 570323 - DNA, 25 bp, Rattus norvegicus
tattaccccaccgaaagtgcaaagt

SEQ ID NO: 570324 - DNA, 25 bp, Rattus norvegicus
tattacccctctcgagaccatcaag

SEQ ID NO: 570325 - DNA, 25 bp, Rattus norvegicus
tattacccctctggagaccatcaag

SEQ ID NO: 570326 - DNA, 25 bp, Rattus norvegicus
tattacccctgtcaggttcttggat

SEQ ID NO: 570327 - DNA, 25 bp, Rattus norvegicus
tattacccctgtccacctattttaa

SEQ ID NO: 570328 - DNA, 25 bp, Rattus norvegicus
tattacccctgtgaggttcttggat

SEQ ID NO: 570329 - DNA, 25 bp, Rattus norvegicus
tattacccctgtgcacctattttaa

SEQ ID NO: 570330 - DNA, 25 bp, Rattus norvegicus
tattaccgaagtcaggagcctacct

SEQ ID NO: 570331 - DNA, 25 bp, Rattus norvegicus
tattaccgaagtgaggagcctacct

SEQ ID NO: 570332 - DNA, 25 bp, Rattus norvegicus
tattaccgctgcactatgcccaggc

SEQ ID NO: 570333 - DNA, 25 bp, Rattus norvegicus
tattaccgctgctctatgcccaggc

SEQ ID NO: 570334 - DNA, 25 bp, Rattus norvegicus
tattaccgtcccatgggcggctgga

SEQ ID NO: 570335 - DNA, 25 bp, Rattus norvegicus
tattaccgtcccttgggcggctgga

SEQ ID NO: 570336 - DNA, 25 bp, Rattus norvegicus
tattacctcaatacacaagctgttg

SEQ ID NO: 570337 - DNA, 25 bp, Rattus norvegicus
tattacctcaattcacaagctgttg

SEQ ID NO: 570338 - DNA, 25 bp, Rattus norvegicus
tattacctcccacctatggtatgta

SEQ ID NO: 570339 - DNA, 25 bp, Rattus norvegicus
tattacctcccagctatggtatgta

SEQ ID NO: 570340 - DNA, 25 bp, Rattus norvegicus
tattacctcgtaaagctgtcactcc

SEQ ID NO: 570341 - DNA, 25 bp, Rattus norvegicus
tattacctcgtatagctgtcactcc

SEQ ID NO: 570342 - DNA, 25 bp, Rattus norvegicus
tattacctgagactggaccatggaa

SEQ ID NO: 570343 - DNA, 25 bp, Rattus norvegicus
tattacctgagagtggaccatggaa

SEQ ID NO: 570344 - DNA, 25 bp, Rattus norvegicus
tattaccttcatattggttgtccaa

SEQ ID NO: 570345 - DNA, 25 bp, Rattus norvegicus
tattaccttcattttggttgtccaa

SEQ ID NO: 570346 - DNA, 25 bp, Rattus norvegicus
tattacctttctcgtggtggcagct

SEQ ID NO: 570347 - DNA, 25 bp, Rattus norvegicus
tattacctttctggtggtggcagct

SEQ ID NO: 570348 - DNA, 25 bp, Rattus norvegicus
tattacgaagttcccctggaggtag

SEQ ID NO: 570349 - DNA, 25 bp, Rattus norvegicus
tattacgaagttgccctggaggtag

SEQ ID NO: 570350 - DNA, 25 bp, Rattus norvegicus
tattacgagcgacgccccgtttcag

SEQ ID NO: 570351 - DNA, 25 bp, Rattus norvegicus
tattacgagcgaggccccgtttcag

SEQ ID NO: 570352 - DNA, 25 bp, Rattus norvegicus
tattactaactcacaggttcacctt

SEQ ID NO: 570353 - DNA, 25 bp, Rattus norvegicus
tattactaactctcaggttcacctt

SEQ ID NO: 570354 - DNA, 25 bp, Rattus norvegicus
tattactaactgaagggtgaggcgg

SEQ ID NO: 570355 - DNA, 25 bp, Rattus norvegicus
tattactaactgtagggtgaggcgg

SEQ ID NO: 570356 - DNA, 25 bp, Rattus norvegicus
tattactaagctcttgtctcgtgcc

SEQ ID NO: 570357 - DNA, 25 bp, Rattus norvegicus
tattactaagctgttgtctcgtgcc

SEQ ID NO: 570358 - DNA, 25 bp, Rattus norvegicus
tattactatgatctgaaccccgcat

SEQ ID NO: 570359 - DNA, 25 bp, Rattus norvegicus
tattactatgatgtgaaccccgcat

SEQ ID NO: 570360 - DNA, 25 bp, Rattus norvegicus
tattactcaagcaagccttacaccc

SEQ ID NO: 570361 - DNA, 25 bp, Rattus norvegicus
tattactcaagctagccttacaccc

SEQ ID NO: 570362 - DNA, 25 bp, Rattus norvegicus
tattactcagtgacttactctctgt

SEQ ID NO: 570363 - DNA, 25 bp, Rattus norvegicus
tattactcagtgtcttactctctgt

SEQ ID NO: 570364 - DNA, 25 bp, Rattus norvegicus
tattactcgtatcacattcctccag

SEQ ID NO: 570365 - DNA, 25 bp, Rattus norvegicus
tattactcgtatgacattcctccag

SEQ ID NO: 570366 - DNA, 25 bp, Rattus norvegicus
tattactgcatgagtgggtttctca

SEQ ID NO: 570367 - DNA, 25 bp, Rattus norvegicus
tattactgcatgtgtgggtttctca

SEQ ID NO: 570368 - DNA, 25 bp, Rattus norvegicus
tattactgtaatcgtgatctggatc

SEQ ID NO: 570369 - DNA, 25 bp, Rattus norvegicus
tattactgtaatggtgatctggatc

SEQ ID NO: 570370 - DNA, 25 bp, Rattus norvegicus
tattactgtacacacacctcactaa

SEQ ID NO: 570371 - DNA, 25 bp, Rattus norvegicus
tattactgtacagacacctcactaa

SEQ ID NO: 570372 - DNA, 25 bp, Rattus norvegicus
tattactgtcttctaccagcttggg

SEQ ID NO: 570373 - DNA, 25 bp, Rattus norvegicus
tattactgtcttgtaccagcttggg

SEQ ID NO: 570374 - DNA, 25 bp, Rattus norvegicus
tattactgttctcatgacttcctcc

SEQ ID NO: 570375 - DNA, 25 bp, Rattus norvegicus
tattactgttctgatgacttcctcc

SEQ ID NO: 570376 - DNA, 25 bp, Rattus norvegicus
tattacttagcacctgttttcagca

SEQ ID NO: 570377 - DNA, 25 bp, Rattus norvegicus
tattacttagcagctgttttcagca

SEQ ID NO: 570378 - DNA, 25 bp, Rattus norvegicus
tattacttcccgagccaggaaggaa

SEQ ID NO: 570379 - DNA, 25 bp, Rattus norvegicus
tattacttcccgtgccaggaaggaa

SEQ ID NO: 570380 - DNA, 25 bp, Rattus norvegicus
tattacttgaatctctcttgccctc

SEQ ID NO: 570381 - DNA, 25 bp, Rattus norvegicus
tattacttgaatgtctcttgccctc

SEQ ID NO: 570382 - DNA, 25 bp, Rattus norvegicus
tattagaatcccaacccagagcaga

SEQ ID NO: 570383 - DNA, 25 bp, Rattus norvegicus
tattagaatccctacccagagcaga

SEQ ID NO: 570384 - DNA, 25 bp, Rattus norvegicus
tattagactataattgatgatgcat

SEQ ID NO: 570385 - DNA, 25 bp, Rattus norvegicus
tattagactatatttgatgatgcat

SEQ ID NO: 570386 - DNA, 25 bp, Rattus norvegicus
tattagagagcacccactgagcagc

SEQ ID NO: 570387 - DNA, 25 bp, Rattus norvegicus
tattagagagcaccccagggagaat

SEQ ID NO: 570388 - DNA, 25 bp, Rattus norvegicus
tattagagagcagccactgagcagc

SEQ ID NO: 570389 - DNA, 25 bp, Rattus norvegicus
tattagagagcagcccagggagaat

SEQ ID NO: 570390 - DNA, 25 bp, Rattus norvegicus
tattagatgggcaactctctcttgc

SEQ ID NO: 570391 - DNA, 25 bp, Rattus norvegicus
tattagatgggctactctctcttgc

SEQ ID NO: 570392 - DNA, 25 bp, Rattus norvegicus
tattagatgtgccatgcccatgagt

SEQ ID NO: 570393 - DNA, 25 bp, Rattus norvegicus
tattagatgtgcgatgcccatgagt

SEQ ID NO: 570394 - DNA, 25 bp, Rattus norvegicus
tattagatttttctccccttgccca

SEQ ID NO: 570395 - DNA, 25 bp, Rattus norvegicus
tattagatttttgtccccttgccca

SEQ ID NO: 570396 - DNA, 25 bp, Rattus norvegicus
tattagcactccaaccccaggacat

SEQ ID NO: 570397 - DNA, 25 bp, Rattus norvegicus
tattagcactcctaccccaggacat

SEQ ID NO: 570398 - DNA, 25 bp, Rattus norvegicus
tattagcactggatgctgtttccat

SEQ ID NO: 570399 - DNA, 25 bp, Rattus norvegicus
tattagcactggttgctgtttccat

SEQ ID NO: 570400 - DNA, 25 bp, Rattus norvegicus
tattagcatgcgatgccacaggcat

SEQ ID NO: 570401 - DNA, 25 bp, Rattus norvegicus
tattagcatgcgttgccacaggcat

SEQ ID NO: 570402 - DNA, 25 bp, Rattus norvegicus
tattagccataaaccaccagggtcc

SEQ ID NO: 570403 - DNA, 25 bp, Rattus norvegicus
tattagccataatccaccagggtcc

SEQ ID NO: 570404 - DNA, 25 bp, Rattus norvegicus
tattagctaaccatccttttgcaca

SEQ ID NO: 570405 - DNA, 25 bp, Rattus norvegicus
tattagctaaccttccttttgcaca

SEQ ID NO: 570406 - DNA, 25 bp, Rattus norvegicus
tattagctacctattccacccaaat

SEQ ID NO: 570407 - DNA, 25 bp, Rattus norvegicus
tattagctaccttttccacccaaat

SEQ ID NO: 570408 - DNA, 25 bp, Rattus norvegicus
tattagctcaaccttccaaacactg

SEQ ID NO: 570409 - DNA, 25 bp, Rattus norvegicus
tattagctcaacgttccaaacactg

SEQ ID NO: 570410 - DNA, 25 bp, Rattus norvegicus
tattagctggttcctggtggcacac

SEQ ID NO: 570411 - DNA, 25 bp, Rattus norvegicus
tattagctggttgctggtggcacac

SEQ ID NO: 570412 - DNA, 25 bp, Rattus norvegicus
tattagctgtccatactatgaaaag

SEQ ID NO: 570413 - DNA, 25 bp, Rattus norvegicus
tattagctgtccttactatgaaaag

SEQ ID NO: 570414 - DNA, 25 bp, Rattus norvegicus
tattagcttcccatcagttgtcagc

SEQ ID NO: 570415 - DNA, 25 bp, Rattus norvegicus
tattagcttcccttcagttgtcagc

SEQ ID NO: 570416 - DNA, 25 bp, Rattus norvegicus
tattaggaaccccattggtccttgc

SEQ ID NO: 570417 - DNA, 25 bp, Rattus norvegicus
tattaggaacccgattggtccttgc

SEQ ID NO: 570418 - DNA, 25 bp, Rattus norvegicus
tattaggaagtgctcccgctcttga

SEQ ID NO: 570419 - DNA, 25 bp, Rattus norvegicus
tattaggaagtggtcccgctcttga

SEQ ID NO: 570420 - DNA, 25 bp, Rattus norvegicus
tattaggatgatcctctgcccctag

SEQ ID NO: 570421 - DNA, 25 bp, Rattus norvegicus
tattaggatgatgctctgcccctag

SEQ ID NO: 570422 - DNA, 25 bp, Rattus norvegicus
tattaggcttggctttttgcttggt

SEQ ID NO: 570423 - DNA, 25 bp, Rattus norvegicus
tattaggcttgggtttttgcttggt

SEQ ID NO: 570424 - DNA, 25 bp, Rattus norvegicus
tattaggtaaagagcccccatttag

SEQ ID NO: 570425 - DNA, 25 bp, Rattus norvegicus
tattaggtaaagtgcccccatttag

SEQ ID NO: 570426 - DNA, 25 bp, Rattus norvegicus
tattaggtcctacccaagcactgtc

SEQ ID NO: 570427 - DNA, 25 bp, Rattus norvegicus
tattaggtcctagccaagcactgtc

SEQ ID NO: 570428 - DNA, 25 bp, Rattus norvegicus
tattaggtgctgagttcatgttcta

SEQ ID NO: 570429 - DNA, 25 bp, Rattus norvegicus
tattaggtgctgtgttcatgttcta

SEQ ID NO: 570430 - DNA, 25 bp, Rattus norvegicus
tattagtaatgtcggctgtgcctct

SEQ ID NO: 570431 - DNA, 25 bp, Rattus norvegicus
tattagtaatgtgggctgtgcctct

SEQ ID NO: 570432 - DNA, 25 bp, Rattus norvegicus
tattagtactgaagtgctccgctgt

SEQ ID NO: 570433 - DNA, 25 bp, Rattus norvegicus
tattagtactgatgtgctccgctgt

SEQ ID NO: 570434 - DNA, 25 bp, Rattus norvegicus
tattagtatcaaactcatctcccct

SEQ ID NO: 570435 - DNA, 25 bp, Rattus norvegicus
tattagtatcaatctcatctcccct

SEQ ID NO: 570436 - DNA, 25 bp, Rattus norvegicus
tattagtatcctccatttctctgac

SEQ ID NO: 570437 - DNA, 25 bp, Rattus norvegicus
tattagtatcctgcatttctctgac

SEQ ID NO: 570438 - DNA, 25 bp, Rattus norvegicus
tattagtccaaacggctcggtcttc

SEQ ID NO: 570439 - DNA, 25 bp, Rattus norvegicus
tattagtccaaagggctcggtcttc

SEQ ID NO: 570440 - DNA, 25 bp, Rattus norvegicus
tattagtctcccctctgtatatgag

SEQ ID NO: 570441 - DNA, 25 bp, Rattus norvegicus
tattagtctcccgtctgtatatgag

SEQ ID NO: 570442 - DNA, 25 bp, Rattus norvegicus
tattagtgacagaatagaggtccca

SEQ ID NO: 570443 - DNA, 25 bp, Rattus norvegicus
tattagtgacagtatagaggtccca

SEQ ID NO: 570444 - DNA, 25 bp, Rattus norvegicus
tattagtgttaccagcattcatgtg

SEQ ID NO: 570445 - DNA, 25 bp, Rattus norvegicus
tattagtgttacgagcattcatgtg

SEQ ID NO: 570446 - DNA, 25 bp, Rattus norvegicus
tattagttcctgagataccattgat

SEQ ID NO: 570447 - DNA, 25 bp, Rattus norvegicus
tattagttcctgtgataccattgat

SEQ ID NO: 570448 - DNA, 25 bp, Rattus norvegicus
tattagttgccaatacgccagcttg

SEQ ID NO: 570449 - DNA, 25 bp, Rattus norvegicus
tattagttgccattacgccagcttg

SEQ ID NO: 570450 - DNA, 25 bp, Rattus norvegicus
tattagttgtgcctgttccttgtac

SEQ ID NO: 570451 - DNA, 25 bp, Rattus norvegicus
tattagttgtgcgtgttccttgtac

SEQ ID NO: 570452 - DNA, 25 bp, Rattus norvegicus
tattagttgttaaaatcccacacag

SEQ ID NO: 570453 - DNA, 25 bp, Rattus norvegicus
tattagttgttataatcccacacag

SEQ ID NO: 570454 - DNA, 25 bp, Rattus norvegicus
tattagttttctacccttcctctgg

SEQ ID NO: 570455 - DNA, 25 bp, Rattus norvegicus
tattagttttcttcccttcctctgg

SEQ ID NO: 570456 - DNA, 25 bp, Rattus norvegicus
tattataaccatatttgcgctctat

SEQ ID NO: 570457 - DNA, 25 bp, Rattus norvegicus
tattataaccatttttgcgctctat

SEQ ID NO: 570458 - DNA, 25 bp, Rattus norvegicus
tattataatctacctgtctaccaag

SEQ ID NO: 570459 - DNA, 25 bp, Rattus norvegicus
tattataatctagctgtctaccaag

SEQ ID NO: 570460 - DNA, 25 bp, Rattus norvegicus
tattataattatcgactcttaaccc

SEQ ID NO: 570461 - DNA, 25 bp, Rattus norvegicus
tattataattatggactcttaaccc

SEQ ID NO: 570462 - DNA, 25 bp, Rattus norvegicus
tattatacaaaaacaaggcccaaag

SEQ ID NO: 570463 - DNA, 25 bp, Rattus norvegicus
tattatacaaaatcaaggcccaaag

SEQ ID NO: 570464 - DNA, 25 bp, Rattus norvegicus
tattatacatccaatctttagcagg

SEQ ID NO: 570465 - DNA, 25 bp, Rattus norvegicus
tattatacatcctatctttagcagg

SEQ ID NO: 570466 - DNA, 25 bp, Rattus norvegicus
tattataccatccatattcccacta

SEQ ID NO: 570467 - DNA, 25 bp, Rattus norvegicus
tattataccatcgatattcccacta

SEQ ID NO: 570468 - DNA, 25 bp, Rattus norvegicus
tattatactgtgctctctcctagtg

SEQ ID NO: 570469 - DNA, 25 bp, Rattus norvegicus
tattatactgtggtctctcctagtg

SEQ ID NO: 570470 - DNA, 25 bp, Rattus norvegicus
tattatagagtcatacctgtgcatg

SEQ ID NO: 570471 - DNA, 25 bp, Rattus norvegicus
tattatagagtcttacctgtgcatg

SEQ ID NO: 570472 - DNA, 25 bp, Rattus norvegicus
tattataggctgcagtctccctcaa

SEQ ID NO: 570473 - DNA, 25 bp, Rattus norvegicus
tattataggctggagtctccctcaa

SEQ ID NO: 570474 - DNA, 25 bp, Rattus norvegicus
tattatataatcagcgactggttcg

SEQ ID NO: 570475 - DNA, 25 bp, Rattus norvegicus
tattatataatctgcgactggttcg

SEQ ID NO: 570476 - DNA, 25 bp, Rattus norvegicus
tattatccagaactgtgtcacagct

SEQ ID NO: 570477 - DNA, 25 bp, Rattus norvegicus
tattatccagaagtgtgtcacagct

SEQ ID NO: 570478 - DNA, 25 bp, Rattus norvegicus
tattatcctcataagcagttgggag

SEQ ID NO: 570479 - DNA, 25 bp, Rattus norvegicus
tattatcctcattagcagttgggag

SEQ ID NO: 570480 - DNA, 25 bp, Rattus norvegicus
tattatctctatcccttcttgcttt

SEQ ID NO: 570481 - DNA, 25 bp, Rattus norvegicus
tattatctctatgccttcttgcttt

SEQ ID NO: 570482 - DNA, 25 bp, Rattus norvegicus
tattatgaatgtacttctctccgat

SEQ ID NO: 570483 - DNA, 25 bp, Rattus norvegicus
tattatgaatgttcttctctccgat

SEQ ID NO: 570484 - DNA, 25 bp, Rattus norvegicus
tattatgacacaacccattgctggc

SEQ ID NO: 570485 - DNA, 25 bp, Rattus norvegicus
tattatgacacatcccattgctggc

SEQ ID NO: 570486 - DNA, 25 bp, Rattus norvegicus
tattatgagcatcgcctgcagctgg

SEQ ID NO: 570487 - DNA, 25 bp, Rattus norvegicus
tattatgagcatggcctgcagctgg

SEQ ID NO: 570488 - DNA, 25 bp, Rattus norvegicus
tattatgatcatagcgggcaggcac

SEQ ID NO: 570489 - DNA, 25 bp, Rattus norvegicus
tattatgatcattgcgggcaggcac

SEQ ID NO: 570490 - DNA, 25 bp, Rattus norvegicus
tattatgatgagaagtcccacagac

SEQ ID NO: 570491 - DNA, 25 bp, Rattus norvegicus
tattatgatgagtagtcccacagac

SEQ ID NO: 570492 - DNA, 25 bp, Rattus norvegicus
tattatgatttcaagcctctcacct

SEQ ID NO: 570493 - DNA, 25 bp, Rattus norvegicus
tattatgatttctagcctctcacct

SEQ ID NO: 570494 - DNA, 25 bp, Rattus norvegicus
tattatgcagagctgtgtgctcccc

SEQ ID NO: 570495 - DNA, 25 bp, Rattus norvegicus
tattatgcagaggtgtgtgctcccc

SEQ ID NO: 570496 - DNA, 25 bp, Rattus norvegicus
tattatgcctacacccagttctgtt

SEQ ID NO: 570497 - DNA, 25 bp, Rattus norvegicus
tattatgcctactcccagttctgtt

SEQ ID NO: 570498 - DNA, 25 bp, Rattus norvegicus
tattatgcctagaggtagactggaa

SEQ ID NO: 570499 - DNA, 25 bp, Rattus norvegicus
tattatgcctagtggtagactggaa

SEQ ID NO: 570500 - DNA, 25 bp, Rattus norvegicus
tattatggcgcccagaccgtgagat

SEQ ID NO: 570501 - DNA, 25 bp, Rattus norvegicus
tattatggcgccgagaccgtgagat

SEQ ID NO: 570502 - DNA, 25 bp, Rattus norvegicus
tattatggcggcaactcgcgtccct

SEQ ID NO: 570503 - DNA, 25 bp, Rattus norvegicus
tattatggcggctactcgcgtccct

SEQ ID NO: 570504 - DNA, 25 bp, Rattus norvegicus
tattatggtgctagcctgtggcagt

SEQ ID NO: 570505 - DNA, 25 bp, Rattus norvegicus
tattatggtgcttgcctgtggcagt

SEQ ID NO: 570506 - DNA, 25 bp, Rattus norvegicus
tattatggttttcctctactcagag

SEQ ID NO: 570507 - DNA, 25 bp, Rattus norvegicus
tattatggttttgctctactcagag

SEQ ID NO: 570508 - DNA, 25 bp, Rattus norvegicus
tattatgtacttaaccattgccaag

SEQ ID NO: 570509 - DNA, 25 bp, Rattus norvegicus
tattatgtactttaccattgccaag

SEQ ID NO: 570510 - DNA, 25 bp, Rattus norvegicus
tattatgtaggtcttcctctcttta

SEQ ID NO: 570511 - DNA, 25 bp, Rattus norvegicus
tattatgtaggtgttcctctcttta

SEQ ID NO: 570512 - DNA, 25 bp, Rattus norvegicus
tattatgtcctaccagaactcgtta

SEQ ID NO: 570513 - DNA, 25 bp, Rattus norvegicus
tattatgtcctagcagaactcgtta

SEQ ID NO: 570514 - DNA, 25 bp, Rattus norvegicus
tattattatcttatgccttggcttt

SEQ ID NO: 570515 - DNA, 25 bp, Rattus norvegicus
tattattatcttttgccttggcttt

SEQ ID NO: 570516 - DNA, 25 bp, Rattus norvegicus
tattattcccaactgccgcagcggt

SEQ ID NO: 570517 - DNA, 25 bp, Rattus norvegicus
tattattcccaagtgccgcagcggt

SEQ ID NO: 570518 - DNA, 25 bp, Rattus norvegicus
tattattcctctacagcagctttca

SEQ ID NO: 570519 - DNA, 25 bp, Rattus norvegicus
tattattcctcttcagcagctttca

SEQ ID NO: 570520 - DNA, 25 bp, Rattus norvegicus
tattattcctggatggtgtctgtgt

SEQ ID NO: 570521 - DNA, 25 bp, Rattus norvegicus
tattattcctggctgtttctgagtc

SEQ ID NO: 570522 - DNA, 25 bp, Rattus norvegicus
tattattcctgggtgtttctgagtc

SEQ ID NO: 570523 - DNA, 25 bp, Rattus norvegicus
tattattcctggttggtgtctgtgt

SEQ ID NO: 570524 - DNA, 25 bp, Rattus norvegicus
tattattcggttatcgtctccaggc

SEQ ID NO: 570525 - DNA, 25 bp, Rattus norvegicus
tattattcggttttcgtctccaggc

SEQ ID NO: 570526 - DNA, 25 bp, Rattus norvegicus
tattattcgtgacccatttgtgctg

SEQ ID NO: 570527 - DNA, 25 bp, Rattus norvegicus
tattattcgtgagccatttgtgctg

SEQ ID NO: 570528 - DNA, 25 bp, Rattus norvegicus
tattattgctgtcgcttggctgtag

SEQ ID NO: 570529 - DNA, 25 bp, Rattus norvegicus
tattattgctgtggcttggctgtag

SEQ ID NO: 570530 - DNA, 25 bp, Rattus norvegicus
tattatttatgcactgcttgccggt

SEQ ID NO: 570531 - DNA, 25 bp, Rattus norvegicus
tattatttatgctctgcttgccggt

SEQ ID NO: 570532 - DNA, 25 bp, Rattus norvegicus
tattatttcactatgcatctggcac

SEQ ID NO: 570533 - DNA, 25 bp, Rattus norvegicus
tattatttcactttgcatctggcac

SEQ ID NO: 570534 - DNA, 25 bp, Rattus norvegicus
tattatttccccagtgcttgatggc

SEQ ID NO: 570535 - DNA, 25 bp, Rattus norvegicus
tattatttcccctgtgcttgatggc

SEQ ID NO: 570536 - DNA, 25 bp, Rattus norvegicus
tattatttcgatatagtatgtccct

SEQ ID NO: 570537 - DNA, 25 bp, Rattus norvegicus
tattatttcgatttagtatgtccct

SEQ ID NO: 570538 - DNA, 25 bp, Rattus norvegicus
tattatttctagatccctctcaatg

SEQ ID NO: 570539 - DNA, 25 bp, Rattus norvegicus
tattatttctagttccctctcaatg

SEQ ID NO: 570540 - DNA, 25 bp, Rattus norvegicus
tattatttgctaatcttcttcttct

SEQ ID NO: 570541 - DNA, 25 bp, Rattus norvegicus
tattatttgctattcttcttcttct

SEQ ID NO: 570542 - DNA, 25 bp, Rattus norvegicus
tattattttaagagcccctctcacc

SEQ ID NO: 570543 - DNA, 25 bp, Rattus norvegicus
tattattttaagtgcccctctcacc

SEQ ID NO: 570544 - DNA, 25 bp, Rattus norvegicus
tattattttccccactgtgcagatg

SEQ ID NO: 570545 - DNA, 25 bp, Rattus norvegicus
tattattttcccgactgtgcagatg

SEQ ID NO: 570546 - DNA, 25 bp, Rattus norvegicus
tattattttgcaagacacccgggcc

SEQ ID NO: 570547 - DNA, 25 bp, Rattus norvegicus
tattattttgcatgacacccgggcc

SEQ ID NO: 570548 - DNA, 25 bp, Rattus norvegicus
tattatttttaaagccttcctaggg

SEQ ID NO: 570549 - DNA, 25 bp, Rattus norvegicus
tattatttttaatgccttcctaggg

SEQ ID NO: 570550 - DNA, 25 bp, Rattus norvegicus
tattcaaaattacaccaccggtagt

SEQ ID NO: 570551 - DNA, 25 bp, Rattus norvegicus
tattcaaaattagaccaccggtagt

SEQ ID NO: 570552 - DNA, 25 bp, Rattus norvegicus
tattcaaacagactcaagggccagt

SEQ ID NO: 570553 - DNA, 25 bp, Rattus norvegicus
tattcaaacagagtcaagggccagt

SEQ ID NO: 570554 - DNA, 25 bp, Rattus norvegicus
tattcaaacctaacgatgatttcta

SEQ ID NO: 570555 - DNA, 25 bp, Rattus norvegicus
tattcaaacctatcgatgatttcta

SEQ ID NO: 570556 - DNA, 25 bp, Rattus norvegicus
tattcaaacctccatttctttctga

SEQ ID NO: 570557 - DNA, 25 bp, Rattus norvegicus
tattcaaacctcgatttctttctga

SEQ ID NO: 570558 - DNA, 25 bp, Rattus norvegicus
tattcaaactggctctcgtctgcca

SEQ ID NO: 570559 - DNA, 25 bp, Rattus norvegicus
tattcaaactgggtctcgtctgcca

SEQ ID NO: 570560 - DNA, 25 bp, Rattus norvegicus
tattcaaacttcactgccctggaag

SEQ ID NO: 570561 - DNA, 25 bp, Rattus norvegicus
tattcaaacttctctgccctggaag

SEQ ID NO: 570562 - DNA, 25 bp, Rattus norvegicus
tattcaaccccgagtgtttctgttt

SEQ ID NO: 570563 - DNA, 25 bp, Rattus norvegicus
tattcaaccccgtgtgtttctgttt

SEQ ID NO: 570564 - DNA, 25 bp, Rattus norvegicus
tattcaaccttaccagttcttctgt

SEQ ID NO: 570565 - DNA, 25 bp, Rattus norvegicus
tattcaaccttagcagttcttctgt

SEQ ID NO: 570566 - DNA, 25 bp, Rattus norvegicus
tattcaagcacccagtggcgtccta

SEQ ID NO: 570567 - DNA, 25 bp, Rattus norvegicus
tattcaagcaccgagtggcgtccta

SEQ ID NO: 570568 - DNA, 25 bp, Rattus norvegicus
tattcaaggaccacgctgccttcga

SEQ ID NO: 570569 - DNA, 25 bp, Rattus norvegicus
tattcaaggacctcgctgccttcga

SEQ ID NO: 570570 - DNA, 25 bp, Rattus norvegicus
tattcaagtgcaatctctcactgcc

SEQ ID NO: 570571 - DNA, 25 bp, Rattus norvegicus
tattcaagtgcattctctcactgcc

SEQ ID NO: 570572 - DNA, 25 bp, Rattus norvegicus
tattcaagttaactgctccccttgg

SEQ ID NO: 570573 - DNA, 25 bp, Rattus norvegicus
tattcaagttaagtgctccccttgg

SEQ ID NO: 570574 - DNA, 25 bp, Rattus norvegicus
tattcaatgaggaagcaggttgctt

SEQ ID NO: 570575 - DNA, 25 bp, Rattus norvegicus
tattcaatgaggtagcaggttgctt

SEQ ID NO: 570576 - DNA, 25 bp, Rattus norvegicus
tattcacaaagtagatcttcttcat

SEQ ID NO: 570577 - DNA, 25 bp, Rattus norvegicus
tattcacaaagttgatcttcttcat

SEQ ID NO: 570578 - DNA, 25 bp, Rattus norvegicus
tattcacagataacccatggctgag

SEQ ID NO: 570579 - DNA, 25 bp, Rattus norvegicus
tattcacagatatcccatggctgag

SEQ ID NO: 570580 - DNA, 25 bp, Rattus norvegicus
tattcacattagacctctagcccaa

SEQ ID NO: 570581 - DNA, 25 bp, Rattus norvegicus
tattcacattagtcctctagcccaa

SEQ ID NO: 570582 - DNA, 25 bp, Rattus norvegicus
tattcacatttgcttttgccacaag

SEQ ID NO: 570583 - DNA, 25 bp, Rattus norvegicus
tattcacatttggttttgccacaag

SEQ ID NO: 570584 - DNA, 25 bp, Rattus norvegicus
tattcaccaaatacctatacccatt

SEQ ID NO: 570585 - DNA, 25 bp, Rattus norvegicus
tattcaccaaattcctatacccatt

SEQ ID NO: 570586 - DNA, 25 bp, Rattus norvegicus
tattcaccaaccataacagtctgcc

SEQ ID NO: 570587 - DNA, 25 bp, Rattus norvegicus
tattcaccaaccttaacagtctgcc

SEQ ID NO: 570588 - DNA, 25 bp, Rattus norvegicus
tattcaccagcacaaaatgtctttc

SEQ ID NO: 570589 - DNA, 25 bp, Rattus norvegicus
tattcaccagcagaaaatgtctttc

SEQ ID NO: 570590 - DNA, 25 bp, Rattus norvegicus
tattcacccacaacaaactaatttg

SEQ ID NO: 570591 - DNA, 25 bp, Rattus norvegicus
tattcacccacaagaggactctgct

SEQ ID NO: 570592 - DNA, 25 bp, Rattus norvegicus
tattcacccacatcaaactaatttg

SEQ ID NO: 570593 - DNA, 25 bp, Rattus norvegicus
tattcacccacatgaggactctgct

SEQ ID NO: 570594 - DNA, 25 bp, Rattus norvegicus
tattcacccctcattggaaggcaat

SEQ ID NO: 570595 - DNA, 25 bp, Rattus norvegicus
tattcacccctctttggaaggcaat

SEQ ID NO: 570596 - DNA, 25 bp, Rattus norvegicus
tattcacccgtcctttgaaaactcg

SEQ ID NO: 570597 - DNA, 25 bp, Rattus norvegicus
tattcacccgtcgtttgaaaactcg

SEQ ID NO: 570598 - DNA, 25 bp, Rattus norvegicus
tattcaccctgaacctggaggctag

SEQ ID NO: 570599 - DNA, 25 bp, Rattus norvegicus
tattcaccctgacagccgagaagct

SEQ ID NO: 570600 - DNA, 25 bp, Rattus norvegicus
tattcaccctgagagccgagaagct

SEQ ID NO: 570601 - DNA, 25 bp, Rattus norvegicus
tattcaccctgatcctggaggctag

SEQ ID NO: 570602 - DNA, 25 bp, Rattus norvegicus
tattcaccgttcctattttcctatt

SEQ ID NO: 570603 - DNA, 25 bp, Rattus norvegicus
tattcaccgttcgtattttcctatt

SEQ ID NO: 570604 - DNA, 25 bp, Rattus norvegicus
tattcacctccaagtgtccttatat

SEQ ID NO: 570605 - DNA, 25 bp, Rattus norvegicus
tattcacctccatgtgtccttatat

SEQ ID NO: 570606 - DNA, 25 bp, Rattus norvegicus
tattcacggttaatttacattctaa

SEQ ID NO: 570607 - DNA, 25 bp, Rattus norvegicus
tattcacggttattttacattctaa

SEQ ID NO: 570608 - DNA, 25 bp, Rattus norvegicus
tattcactagaaagcactgccctca

SEQ ID NO: 570609 - DNA, 25 bp, Rattus norvegicus
tattcactagaatgcactgccctca

SEQ ID NO: 570610 - DNA, 25 bp, Rattus norvegicus
tattcactcaccatggattacacaa

SEQ ID NO: 570611 - DNA, 25 bp, Rattus norvegicus
tattcactcaccttggattacacaa

SEQ ID NO: 570612 - DNA, 25 bp, Rattus norvegicus
tattcactccagctgtaccatatca

SEQ ID NO: 570613 - DNA, 25 bp, Rattus norvegicus
tattcactccaggtgtaccatatca

SEQ ID NO: 570614 - DNA, 25 bp, Rattus norvegicus
tattcactcccgatgtttcttgtac

SEQ ID NO: 570615 - DNA, 25 bp, Rattus norvegicus
tattcactcccgttgtttcttgtac

SEQ ID NO: 570616 - DNA, 25 bp, Rattus norvegicus
tattcactctctccatttgtcagtc

SEQ ID NO: 570617 - DNA, 25 bp, Rattus norvegicus
tattcactctctcctagcttggaag

SEQ ID NO: 570618 - DNA, 25 bp, Rattus norvegicus
tattcactctctgcatttgtcagtc

SEQ ID NO: 570619 - DNA, 25 bp, Rattus norvegicus
tattcactctctgctagcttggaag

SEQ ID NO: 570620 - DNA, 25 bp, Rattus norvegicus
tattcactcttgaggtccctttggg

SEQ ID NO: 570621 - DNA, 25 bp, Rattus norvegicus
tattcactcttgtggtccctttggg

SEQ ID NO: 570622 - DNA, 25 bp, Rattus norvegicus
tattcactgaggctgaggctctcca

SEQ ID NO: 570623 - DNA, 25 bp, Rattus norvegicus
tattcactgagggtgaggctctcca

SEQ ID NO: 570624 - DNA, 25 bp, Rattus norvegicus
tattcactgcctcatgcctggctgg

SEQ ID NO: 570625 - DNA, 25 bp, Rattus norvegicus
tattcactgcctgatgcctggctgg

SEQ ID NO: 570626 - DNA, 25 bp, Rattus norvegicus
tattcactgctgatctcacagagcc

SEQ ID NO: 570627 - DNA, 25 bp, Rattus norvegicus
tattcactgctgttctcacagagcc

SEQ ID NO: 570628 - DNA, 25 bp, Rattus norvegicus
tattcactggctatggccaagcaga

SEQ ID NO: 570629 - DNA, 25 bp, Rattus norvegicus
tattcactggctttggccaagcaga

SEQ ID NO: 570630 - DNA, 25 bp, Rattus norvegicus
tattcactgtggctaaactcggccc

SEQ ID NO: 570631 - DNA, 25 bp, Rattus norvegicus
tattcactgtgggtaaactcggccc

SEQ ID NO: 570632 - DNA, 25 bp, Rattus norvegicus
tattcacttctgatgtcctgaggac

SEQ ID NO: 570633 - DNA, 25 bp, Rattus norvegicus
tattcacttctgttgtcctgaggac

SEQ ID NO: 570634 - DNA, 25 bp, Rattus norvegicus
tattcacttgcaaatgtccctaggt

SEQ ID NO: 570635 - DNA, 25 bp, Rattus norvegicus
tattcacttgcatatgtccctaggt

SEQ ID NO: 570636 - DNA, 25 bp, Rattus norvegicus
tattcactttgaactgctcctggaa

SEQ ID NO: 570637 - DNA, 25 bp, Rattus norvegicus
tattcactttgatctgctcctggaa

SEQ ID NO: 570638 - DNA, 25 bp, Rattus norvegicus
tattcagaatcaacggcaaccacat

SEQ ID NO: 570639 - DNA, 25 bp, Rattus norvegicus
tattcagaatcatcggcaaccacat

SEQ ID NO: 570640 - DNA, 25 bp, Rattus norvegicus
tattcagacgcaacacattcatttt

SEQ ID NO: 570641 - DNA, 25 bp, Rattus norvegicus
tattcagacgcatcacattcatttt

SEQ ID NO: 570642 - DNA, 25 bp, Rattus norvegicus
tattcagaggataatgcacagcttg

SEQ ID NO: 570643 - DNA, 25 bp, Rattus norvegicus
tattcagaggattatgcacagcttg

SEQ ID NO: 570644 - DNA, 25 bp, Rattus norvegicus
tattcagaggtgctgttcttctccc

SEQ ID NO: 570645 - DNA, 25 bp, Rattus norvegicus
tattcagaggtggtgttcttctccc

SEQ ID NO: 570646 - DNA, 25 bp, Rattus norvegicus
tattcagattgaccccagccttgat

SEQ ID NO: 570647 - DNA, 25 bp, Rattus norvegicus
tattcagattgagcccagccttgat

SEQ ID NO: 570648 - DNA, 25 bp, Rattus norvegicus
tattcagcacacacaaagtccaggg

SEQ ID NO: 570649 - DNA, 25 bp, Rattus norvegicus
tattcagcacactcaaagtccaggg

SEQ ID NO: 570650 - DNA, 25 bp, Rattus norvegicus
tattcagccacgaggtgtctttttt

SEQ ID NO: 570651 - DNA, 25 bp, Rattus norvegicus
tattcagccacgtggtgtctttttt

SEQ ID NO: 570652 - DNA, 25 bp, Rattus norvegicus
tattcagcccggctttgggccgtct

SEQ ID NO: 570653 - DNA, 25 bp, Rattus norvegicus
tattcagcccgggtttgggccgtct

SEQ ID NO: 570654 - DNA, 25 bp, Rattus norvegicus
tattcagccgttattacctgtgcac

SEQ ID NO: 570655 - DNA, 25 bp, Rattus norvegicus
tattcagccgtttttacctgtgcac

SEQ ID NO: 570656 - DNA, 25 bp, Rattus norvegicus
tattcagcctctctaggccggtggg

SEQ ID NO: 570657 - DNA, 25 bp, Rattus norvegicus
tattcagcctctgtaggccggtggg

SEQ ID NO: 570658 - DNA, 25 bp, Rattus norvegicus
tattcaggacttatcagattttctt

SEQ ID NO: 570659 - DNA, 25 bp, Rattus norvegicus
tattcaggacttttcagattttctt

SEQ ID NO: 570660 - DNA, 25 bp, Rattus norvegicus
tattcaggagcccaatcgaccgtcc

SEQ ID NO: 570661 - DNA, 25 bp, Rattus norvegicus
tattcaggagccgaatcgaccgtcc

SEQ ID NO: 570662 - DNA, 25 bp, Rattus norvegicus
tattcaggctaaaggctacagtttt

SEQ ID NO: 570663 - DNA, 25 bp, Rattus norvegicus
tattcaggctaatggctacagtttt

SEQ ID NO: 570664 - DNA, 25 bp, Rattus norvegicus
tattcaggctttcaacccagagttc

SEQ ID NO: 570665 - DNA, 25 bp, Rattus norvegicus
tattcaggctttgaacccagagttc

SEQ ID NO: 570666 - DNA, 25 bp, Rattus norvegicus
tattcagggcgtatacacatcagtg

SEQ ID NO: 570667 - DNA, 25 bp, Rattus norvegicus
tattcagggcgtttacacatcagtg

SEQ ID NO: 570668 - DNA, 25 bp, Rattus norvegicus
tattcaggtcagacttccagttaac

SEQ ID NO: 570669 - DNA, 25 bp, Rattus norvegicus
tattcaggtcagtcttccagttaac

SEQ ID NO: 570670 - DNA, 25 bp, Rattus norvegicus
tattcaggtgacagcccagtggatg

SEQ ID NO: 570671 - DNA, 25 bp, Rattus norvegicus
tattcaggtgactgcccagtggatg

SEQ ID NO: 570672 - DNA, 25 bp, Rattus norvegicus
tattcaggtgcaagctctacaactt

SEQ ID NO: 570673 - DNA, 25 bp, Rattus norvegicus
tattcaggtgcatgctctacaactt

SEQ ID NO: 570674 - DNA, 25 bp, Rattus norvegicus
tattcagtattgctttccctgtcct

SEQ ID NO: 570675 - DNA, 25 bp, Rattus norvegicus
tattcagtattggtttccctgtcct

SEQ ID NO: 570676 - DNA, 25 bp, Rattus norvegicus
tattcagtatttactatcacatgct

SEQ ID NO: 570677 - DNA, 25 bp, Rattus norvegicus
tattcagtattttctatcacatgct

SEQ ID NO: 570678 - DNA, 25 bp, Rattus norvegicus
tattcagtgttacttcagtggcaag

SEQ ID NO: 570679 - DNA, 25 bp, Rattus norvegicus
tattcagtgttagttcagtggcaag

SEQ ID NO: 570680 - DNA, 25 bp, Rattus norvegicus
tattcataatctctgtctggcctta

SEQ ID NO: 570681 - DNA, 25 bp, Rattus norvegicus
tattcataatctgtgtctggcctta

SEQ ID NO: 570682 - DNA, 25 bp, Rattus norvegicus
tattcatatactaccaggttccggg

SEQ ID NO: 570683 - DNA, 25 bp, Rattus norvegicus
tattcatatacttccaggttccggg

SEQ ID NO: 570684 - DNA, 25 bp, Rattus norvegicus
tattcatcacataaccaatgttagg

SEQ ID NO: 570685 - DNA, 25 bp, Rattus norvegicus
tattcatcacattaccaatgttagg

SEQ ID NO: 570686 - DNA, 25 bp, Rattus norvegicus
tattcatccactaactctgtcataa

SEQ ID NO: 570687 - DNA, 25 bp, Rattus norvegicus
tattcatccacttactctgtcataa

SEQ ID NO: 570688 - DNA, 25 bp, Rattus norvegicus
tattcatccatgcttccttataggc

SEQ ID NO: 570689 - DNA, 25 bp, Rattus norvegicus
tattcatccatggttccttataggc

SEQ ID NO: 570690 - DNA, 25 bp, Rattus norvegicus
tattcatcctccatctcaaagcaga

SEQ ID NO: 570691 - DNA, 25 bp, Rattus norvegicus
tattcatcctccttctcaaagcaga

SEQ ID NO: 570692 - DNA, 25 bp, Rattus norvegicus
tattcatctggaacatgggaccctc

SEQ ID NO: 570693 - DNA, 25 bp, Rattus norvegicus
tattcatctggatcatgggaccctc

SEQ ID NO: 570694 - DNA, 25 bp, Rattus norvegicus
tattcatctggtcagctctactgga

SEQ ID NO: 570695 - DNA, 25 bp, Rattus norvegicus
tattcatctggtgagctctactgga

SEQ ID NO: 570696 - DNA, 25 bp, Rattus norvegicus
tattcatgaataaagggcctaagac

SEQ ID NO: 570697 - DNA, 25 bp, Rattus norvegicus
tattcatgaatatagggcctaagac

SEQ ID NO: 570698 - DNA, 25 bp, Rattus norvegicus
tattcatgcagtcagggtcactcag

SEQ ID NO: 570699 - DNA, 25 bp, Rattus norvegicus
tattcatgcagtgagggtcactcag

SEQ ID NO: 570700 - DNA, 25 bp, Rattus norvegicus
tattcatgcctgatctccctagtaa

SEQ ID NO: 570701 - DNA, 25 bp, Rattus norvegicus
tattcatgcctgttctccctagtaa

SEQ ID NO: 570702 - DNA, 25 bp, Rattus norvegicus
tattcatggcttacttgcagcccaa

SEQ ID NO: 570703 - DNA, 25 bp, Rattus norvegicus
tattcatggctttcttgcagcccaa

SEQ ID NO: 570704 - DNA, 25 bp, Rattus norvegicus
tattcatggtgcagggtagcttcaa

SEQ ID NO: 570705 - DNA, 25 bp, Rattus norvegicus
tattcatggtgctgggtagcttcaa

SEQ ID NO: 570706 - DNA, 25 bp, Rattus norvegicus
tattcatgtcctagctgcttgtagc

SEQ ID NO: 570707 - DNA, 25 bp, Rattus norvegicus
tattcatgtccttgctgcttgtagc

SEQ ID NO: 570708 - DNA, 25 bp, Rattus norvegicus
tattcattcactagcaactgttccc

SEQ ID NO: 570709 - DNA, 25 bp, Rattus norvegicus
tattcattcacttgcaactgttccc

SEQ ID NO: 570710 - DNA, 25 bp, Rattus norvegicus
tattcatttgtaaccaaggtgctga

SEQ ID NO: 570711 - DNA, 25 bp, Rattus norvegicus
tattcatttgtatccaaggtgctga

SEQ ID NO: 570712 - DNA, 25 bp, Rattus norvegicus
tattccaaaaccacatttgccttat

SEQ ID NO: 570713 - DNA, 25 bp, Rattus norvegicus
tattccaaaacctcatttgccttat

SEQ ID NO: 570714 - DNA, 25 bp, Rattus norvegicus
tattccaaaactctccccttgaatt

SEQ ID NO: 570715 - DNA, 25 bp, Rattus norvegicus
tattccaaaactgtccccttgaatt

SEQ ID NO: 570716 - DNA, 25 bp, Rattus norvegicus
tattccaaaggccaatccaaggttt

SEQ ID NO: 570717 - DNA, 25 bp, Rattus norvegicus
tattccaaaggcgaatccaaggttt

SEQ ID NO: 570718 - DNA, 25 bp, Rattus norvegicus
tattccaaatctctcctgagttcaa

SEQ ID NO: 570719 - DNA, 25 bp, Rattus norvegicus
tattccaaatctgtcctgagttcaa

SEQ ID NO: 570720 - DNA, 25 bp, Rattus norvegicus
tattccaacatcattcccattttta

SEQ ID NO: 570721 - DNA, 25 bp, Rattus norvegicus
tattccaacatctttcccattttta

SEQ ID NO: 570722 - DNA, 25 bp, Rattus norvegicus
tattccaaccagacagcatctttga

SEQ ID NO: 570723 - DNA, 25 bp, Rattus norvegicus
tattccaaccagtcagcatctttga

SEQ ID NO: 570724 - DNA, 25 bp, Rattus norvegicus
tattccaagcccaacaagcaaccgg

SEQ ID NO: 570725 - DNA, 25 bp, Rattus norvegicus
tattccaagccctacaagcaaccgg

SEQ ID NO: 570726 - DNA, 25 bp, Rattus norvegicus
tattccaagtatctctgtgttttct

SEQ ID NO: 570727 - DNA, 25 bp, Rattus norvegicus
tattccaagtatgtctgtgttttct

SEQ ID NO: 570728 - DNA, 25 bp, Rattus norvegicus
tattccaagtcaacaccagcagctg

SEQ ID NO: 570729 - DNA, 25 bp, Rattus norvegicus
tattccaagtcatcaccagcagctg

SEQ ID NO: 570730 - DNA, 25 bp, Rattus norvegicus
tattccaatgtgaggttgctctccc

SEQ ID NO: 570731 - DNA, 25 bp, Rattus norvegicus
tattccaatgtgtggttgctctccc

SEQ ID NO: 570732 - DNA, 25 bp, Rattus norvegicus
tattccaattgcagagcgtgcccca

SEQ ID NO: 570733 - DNA, 25 bp, Rattus norvegicus
tattccaattgctgagcgtgcccca

SEQ ID NO: 570734 - DNA, 25 bp, Rattus norvegicus
tattccacaggaatcacttttttcc

SEQ ID NO: 570735 - DNA, 25 bp, Rattus norvegicus
tattccacaggattcacttttttcc

SEQ ID NO: 570736 - DNA, 25 bp, Rattus norvegicus
tattccaccgcgacatcaaggactt

SEQ ID NO: 570737 - DNA, 25 bp, Rattus norvegicus
tattccaccgcgtcatcaaggactt

SEQ ID NO: 570738 - DNA, 25 bp, Rattus norvegicus
tattccacgagaatcctgttgagag

SEQ ID NO: 570739 - DNA, 25 bp, Rattus norvegicus
tattccacgagattcctgttgagag

SEQ ID NO: 570740 - DNA, 25 bp, Rattus norvegicus
tattccacggctatgtcacaggctt

SEQ ID NO: 570741 - DNA, 25 bp, Rattus norvegicus
tattccacggctttgtcacaggctt

SEQ ID NO: 570742 - DNA, 25 bp, Rattus norvegicus
tattccactgtacccattcgtgaag

SEQ ID NO: 570743 - DNA, 25 bp, Rattus norvegicus
tattccactgtagccattcgtgaag

SEQ ID NO: 570744 - DNA, 25 bp, Rattus norvegicus
tattccagacctctcatgagccgag

SEQ ID NO: 570745 - DNA, 25 bp, Rattus norvegicus
tattccagacctgtcatgagccgag

SEQ ID NO: 570746 - DNA, 25 bp, Rattus norvegicus
tattccagagaacagcgtggcccgt

SEQ ID NO: 570747 - DNA, 25 bp, Rattus norvegicus
tattccagagaagagcgtggcccgt

SEQ ID NO: 570748 - DNA, 25 bp, Rattus norvegicus
tattccaggatacagtgagctagac

SEQ ID NO: 570749 - DNA, 25 bp, Rattus norvegicus
tattccaggatagagtgagctagac

SEQ ID NO: 570750 - DNA, 25 bp, Rattus norvegicus
tattccaggattcatgtgccagggt

SEQ ID NO: 570751 - DNA, 25 bp, Rattus norvegicus
tattccaggattgatgtgccagggt

SEQ ID NO: 570752 - DNA, 25 bp, Rattus norvegicus
tattccagggaaacatctcctcact

SEQ ID NO: 570753 - DNA, 25 bp, Rattus norvegicus
tattccagggaatcatctcctcact

SEQ ID NO: 570754 - DNA, 25 bp, Rattus norvegicus
tattccaggtggacacttgggagtt

SEQ ID NO: 570755 - DNA, 25 bp, Rattus norvegicus
tattccaggtggtcacttgggagtt

SEQ ID NO: 570756 - DNA, 25 bp, Rattus norvegicus
tattccagtcacaccgagcaagatg

SEQ ID NO: 570757 - DNA, 25 bp, Rattus norvegicus
tattccagtcactccgagcaagatg

SEQ ID NO: 570758 - DNA, 25 bp, Rattus norvegicus
tattccatagcacttctggcctctc

SEQ ID NO: 570759 - DNA, 25 bp, Rattus norvegicus
tattccatagcagttctggcctctc

SEQ ID NO: 570760 - DNA, 25 bp, Rattus norvegicus
tattccatagtcagcagttactcta

SEQ ID NO: 570761 - DNA, 25 bp, Rattus norvegicus
tattccatagtctgcagttactcta

SEQ ID NO: 570762 - DNA, 25 bp, Rattus norvegicus
tattccatcaacatggcatcctgcc

SEQ ID NO: 570763 - DNA, 25 bp, Rattus norvegicus
tattccatcaacttggcatcctgcc

SEQ ID NO: 570764 - DNA, 25 bp, Rattus norvegicus
tattccatcctgaccggcggtatct

SEQ ID NO: 570765 - DNA, 25 bp, Rattus norvegicus
tattccatcctgtccggcggtatct

SEQ ID NO: 570766 - DNA, 25 bp, Rattus norvegicus
tattccatgcatagccccagaggag

SEQ ID NO: 570767 - DNA, 25 bp, Rattus norvegicus
tattccatgcattgccccagaggag

SEQ ID NO: 570768 - DNA, 25 bp, Rattus norvegicus
tattccatggttccttgtaccctcc

SEQ ID NO: 570769 - DNA, 25 bp, Rattus norvegicus
tattccatggttgcttgtaccctcc

SEQ ID NO: 570770 - DNA, 25 bp, Rattus norvegicus
tattccattccaccagatactccgg

SEQ ID NO: 570771 - DNA, 25 bp, Rattus norvegicus
tattccattccagcagatactccgg

SEQ ID NO: 570772 - DNA, 25 bp, Rattus norvegicus
tattccattgcaagttcacctatat

SEQ ID NO: 570773 - DNA, 25 bp, Rattus norvegicus
tattccattgcatgttcacctatat

SEQ ID NO: 570774 - DNA, 25 bp, Rattus norvegicus
tattccatttcacccatgttgtagc

SEQ ID NO: 570775 - DNA, 25 bp, Rattus norvegicus
tattccatttcagccatgttgtagc

SEQ ID NO: 570776 - DNA, 25 bp, Rattus norvegicus
tattccatttcccaacaagttcagc

SEQ ID NO: 570777 - DNA, 25 bp, Rattus norvegicus
tattccatttccgaacaagttcagc

SEQ ID NO: 570778 - DNA, 25 bp, Rattus norvegicus
tattccatttggacttttggtcttt

SEQ ID NO: 570779 - DNA, 25 bp, Rattus norvegicus
tattccatttggtcttttggtcttt

SEQ ID NO: 570780 - DNA, 25 bp, Rattus norvegicus
tattcccaagtaactgcttctgcat

SEQ ID NO: 570781 - DNA, 25 bp, Rattus norvegicus
tattcccaagtatctgcttctgcat

SEQ ID NO: 570782 - DNA, 25 bp, Rattus norvegicus
tattcccacaacacatctgcttttc

SEQ ID NO: 570783 - DNA, 25 bp, Rattus norvegicus
tattcccacaactcatctgcttttc

SEQ ID NO: 570784 - DNA, 25 bp, Rattus norvegicus
tattcccacaatctcagctcaagtg

SEQ ID NO: 570785 - DNA, 25 bp, Rattus norvegicus
tattcccacaatgtcagctcaagtg

SEQ ID NO: 570786 - DNA, 25 bp, Rattus norvegicus
tattcccactcgagttgtggtccaa

SEQ ID NO: 570787 - DNA, 25 bp, Rattus norvegicus
tattcccactcgtgttgtggtccaa

SEQ ID NO: 570788 - DNA, 25 bp, Rattus norvegicus
tattcccactgtcctcaagagggac

SEQ ID NO: 570789 - DNA, 25 bp, Rattus norvegicus
tattcccactgtgctcaagagggac

SEQ ID NO: 570790 - DNA, 25 bp, Rattus norvegicus
tattcccagaatcccacctgagaag

SEQ ID NO: 570791 - DNA, 25 bp, Rattus norvegicus
tattcccagaatgccacctgagaag

SEQ ID NO: 570792 - DNA, 25 bp, Rattus norvegicus
tattcccagagaccagttaccctaa

SEQ ID NO: 570793 - DNA, 25 bp, Rattus norvegicus
tattcccagagagcagttaccctaa

SEQ ID NO: 570794 - DNA, 25 bp, Rattus norvegicus
tattcccagattacctgcttggtta

SEQ ID NO: 570795 - DNA, 25 bp, Rattus norvegicus
tattcccagatttcctgcttggtta

SEQ ID NO: 570796 - DNA, 25 bp, Rattus norvegicus
tattcccagcagcaccataaaaagt

SEQ ID NO: 570797 - DNA, 25 bp, Rattus norvegicus
tattcccagcaggaccataaaaagt

SEQ ID NO: 570798 - DNA, 25 bp, Rattus norvegicus
tattcccagccaaatccactatatt

SEQ ID NO: 570799 - DNA, 25 bp, Rattus norvegicus
tattcccagccatatccactatatt

SEQ ID NO: 570800 - DNA, 25 bp, Rattus norvegicus
tattcccagtgtccctttgtaagta

SEQ ID NO: 570801 - DNA, 25 bp, Rattus norvegicus
tattcccagtgtgcctttgtaagta

SEQ ID NO: 570802 - DNA, 25 bp, Rattus norvegicus
tattcccatcacagagttctgagag

SEQ ID NO: 570803 - DNA, 25 bp, Rattus norvegicus
tattcccatcactgagttctgagag

SEQ ID NO: 570804 - DNA, 25 bp, Rattus norvegicus
tattcccatcctattaatactatgt

SEQ ID NO: 570805 - DNA, 25 bp, Rattus norvegicus
tattcccatccttttaatactatgt

SEQ ID NO: 570806 - DNA, 25 bp, Rattus norvegicus
tattccccaatacctgactgtactt

SEQ ID NO: 570807 - DNA, 25 bp, Rattus norvegicus
tattccccaatagctgactgtactt

SEQ ID NO: 570808 - DNA, 25 bp, Rattus norvegicus
tattcccctaaacgtccctgtgact

SEQ ID NO: 570809 - DNA, 25 bp, Rattus norvegicus
tattcccctaaaggtccctgtgact

SEQ ID NO: 570810 - DNA, 25 bp, Rattus norvegicus
tattcccctgcactagcattaccga

SEQ ID NO: 570811 - DNA, 25 bp, Rattus norvegicus
tattcccctgcagtagcattaccga

SEQ ID NO: 570812 - DNA, 25 bp, Rattus norvegicus
tattcccgggatccaacctagagaa

SEQ ID NO: 570813 - DNA, 25 bp, Rattus norvegicus
tattcccgggatgcaacctagagaa

SEQ ID NO: 570814 - DNA, 25 bp, Rattus norvegicus
tattccctaaatctcatgttcactt

SEQ ID NO: 570815 - DNA, 25 bp, Rattus norvegicus
tattccctaaatgtcatgttcactt

SEQ ID NO: 570816 - DNA, 25 bp, Rattus norvegicus
tattccctctagaatttgcagtggt

SEQ ID NO: 570817 - DNA, 25 bp, Rattus norvegicus
tattccctctagtatttgcagtggt

SEQ ID NO: 570818 - DNA, 25 bp, Rattus norvegicus
tattccctgtgtaccatatcttttg

SEQ ID NO: 570819 - DNA, 25 bp, Rattus norvegicus
tattccctgtgttccatatcttttg

SEQ ID NO: 570820 - DNA, 25 bp, Rattus norvegicus
tattcccttctcagcctttataaaa

SEQ ID NO: 570821 - DNA, 25 bp, Rattus norvegicus
tattcccttctctgcctttataaaa

SEQ ID NO: 570822 - DNA, 25 bp, Rattus norvegicus
tattcccttctgatatgctcagcaa

SEQ ID NO: 570823 - DNA, 25 bp, Rattus norvegicus
tattcccttctgttatgctcagcaa

SEQ ID NO: 570824 - DNA, 25 bp, Rattus norvegicus
tattcccttgctatggatgaccagg

SEQ ID NO: 570825 - DNA, 25 bp, Rattus norvegicus
tattcccttgctttggatgaccagg

SEQ ID NO: 570826 - DNA, 25 bp, Rattus norvegicus
tattcccttgtaactttttcactcc

SEQ ID NO: 570827 - DNA, 25 bp, Rattus norvegicus
tattcccttgtatctttttcactcc

SEQ ID NO: 570828 - DNA, 25 bp, Rattus norvegicus
tattccctttagatcatgctgtaga

SEQ ID NO: 570829 - DNA, 25 bp, Rattus norvegicus
tattccctttagttcatgctgtaga

SEQ ID NO: 570830 - DNA, 25 bp, Rattus norvegicus
tattcccttttaacgtgatgcccac

SEQ ID NO: 570831 - DNA, 25 bp, Rattus norvegicus
tattcccttttatcgtgatgcccac

SEQ ID NO: 570832 - DNA, 25 bp, Rattus norvegicus
tattccgcagacagagaggacctct

SEQ ID NO: 570833 - DNA, 25 bp, Rattus norvegicus
tattccgcagactgagaggacctct

SEQ ID NO: 570834 - DNA, 25 bp, Rattus norvegicus
tattccggaacacggtcgcttggca

SEQ ID NO: 570835 - DNA, 25 bp, Rattus norvegicus
tattccggaacagggtcgcttggca

SEQ ID NO: 570836 - DNA, 25 bp, Rattus norvegicus
tattccggactaaacgtgcagcttc

SEQ ID NO: 570837 - DNA, 25 bp, Rattus norvegicus
tattccggactatacgtgcagcttc

SEQ ID NO: 570838 - DNA, 25 bp, Rattus norvegicus
tattccgggctaaaccaaggtcact

SEQ ID NO: 570839 - DNA, 25 bp, Rattus norvegicus
tattccgggctataccaaggtcact

SEQ ID NO: 570840 - DNA, 25 bp, Rattus norvegicus
tattccgtcggtcgatttctttcct

SEQ ID NO: 570841 - DNA, 25 bp, Rattus norvegicus
tattccgtcggtggatttctttcct

SEQ ID NO: 570842 - DNA, 25 bp, Rattus norvegicus
tattccgtggatcagtacacctagt

SEQ ID NO: 570843 - DNA, 25 bp, Rattus norvegicus
tattccgtggatgagtacacctagt

SEQ ID NO: 570844 - DNA, 25 bp, Rattus norvegicus
tattcctaaagcacagagacccctg

SEQ ID NO: 570845 - DNA, 25 bp, Rattus norvegicus
tattcctaaagctcagagacccctg

SEQ ID NO: 570846 - DNA, 25 bp, Rattus norvegicus
tattcctaagaccaaatcctctcca

SEQ ID NO: 570847 - DNA, 25 bp, Rattus norvegicus
tattcctaagacgaaatcctctcca

SEQ ID NO: 570848 - DNA, 25 bp, Rattus norvegicus
tattcctactgtccctttggagttc

SEQ ID NO: 570849 - DNA, 25 bp, Rattus norvegicus
tattcctactgtgcctttggagttc

SEQ ID NO: 570850 - DNA, 25 bp, Rattus norvegicus
tattcctactttaaaccgcctgata

SEQ ID NO: 570851 - DNA, 25 bp, Rattus norvegicus
tattcctacttttaaccgcctgata

SEQ ID NO: 570852 - DNA, 25 bp, Rattus norvegicus
tattcctcccgaccgatggatgtga

SEQ ID NO: 570853 - DNA, 25 bp, Rattus norvegicus
tattcctcccgagcgatggatgtga

SEQ ID NO: 570854 - DNA, 25 bp, Rattus norvegicus
tattcctccctaatatgtatgtgtg

SEQ ID NO: 570855 - DNA, 25 bp, Rattus norvegicus
tattcctccctaatcccgaggctga

SEQ ID NO: 570856 - DNA, 25 bp, Rattus norvegicus
tattcctccctattatgtatgtgtg

SEQ ID NO: 570857 - DNA, 25 bp, Rattus norvegicus
tattcctccctattcccgaggctga

SEQ ID NO: 570858 - DNA, 25 bp, Rattus norvegicus
tattcctccttcaacgaacatcgga

SEQ ID NO: 570859 - DNA, 25 bp, Rattus norvegicus
tattcctccttctacgaacatcgga

SEQ ID NO: 570860 - DNA, 25 bp, Rattus norvegicus
tattcctcggaaaattttacctgga

SEQ ID NO: 570861 - DNA, 25 bp, Rattus norvegicus
tattcctcggaatattttacctgga

SEQ ID NO: 570862 - DNA, 25 bp, Rattus norvegicus
tattcctctatgagacagctggcta

SEQ ID NO: 570863 - DNA, 25 bp, Rattus norvegicus
tattcctctatgtgacagctggcta

SEQ ID NO: 570864 - DNA, 25 bp, Rattus norvegicus
tattcctctctcaattctcatacat

SEQ ID NO: 570865 - DNA, 25 bp, Rattus norvegicus
tattcctctctctattctcatacat

SEQ ID NO: 570866 - DNA, 25 bp, Rattus norvegicus
tattcctctggacatgctagcagct

SEQ ID NO: 570867 - DNA, 25 bp, Rattus norvegicus
tattcctctggagatgctagcagct

SEQ ID NO: 570868 - DNA, 25 bp, Rattus norvegicus
tattcctctgttatgatctctttga

SEQ ID NO: 570869 - DNA, 25 bp, Rattus norvegicus
tattcctctgttttgatctctttga

SEQ ID NO: 570870 - DNA, 25 bp, Rattus norvegicus
tattcctgacatcctatgagcctga

SEQ ID NO: 570871 - DNA, 25 bp, Rattus norvegicus
tattcctgacatgctatgagcctga

SEQ ID NO: 570872 - DNA, 25 bp, Rattus norvegicus
tattcctgctccactattgcctttc

SEQ ID NO: 570873 - DNA, 25 bp, Rattus norvegicus
tattcctgctcctctattgcctttc

SEQ ID NO: 570874 - DNA, 25 bp, Rattus norvegicus
tattcctgctgcaatactgtgacac

SEQ ID NO: 570875 - DNA, 25 bp, Rattus norvegicus
tattcctgctgctatactgtgacac

SEQ ID NO: 570876 - DNA, 25 bp, Rattus norvegicus
tattcctggaagagtggcccaagct

SEQ ID NO: 570877 - DNA, 25 bp, Rattus norvegicus
tattcctggaagtgtggcccaagct

SEQ ID NO: 570878 - DNA, 25 bp, Rattus norvegicus
tattcctggaatccccacagaggga

SEQ ID NO: 570879 - DNA, 25 bp, Rattus norvegicus
tattcctggaatgcccacagaggga

SEQ ID NO: 570880 - DNA, 25 bp, Rattus norvegicus
tattcctggaccagcagagtgcata

SEQ ID NO: 570881 - DNA, 25 bp, Rattus norvegicus
tattcctggacctgcagagtgcata

SEQ ID NO: 570882 - DNA, 25 bp, Rattus norvegicus
tattcctggagacctcagccctgga

SEQ ID NO: 570883 - DNA, 25 bp, Rattus norvegicus
tattcctggagagctcagccctgga

SEQ ID NO: 570884 - DNA, 25 bp, Rattus norvegicus
tattcctgggagaggcatctgttac

SEQ ID NO: 570885 - DNA, 25 bp, Rattus norvegicus
tattcctgggagtggcatctgttac

SEQ ID NO: 570886 - DNA, 25 bp, Rattus norvegicus
tattcctgttataggcatgtgcacg

SEQ ID NO: 570887 - DNA, 25 bp, Rattus norvegicus
tattcctgttattggcatgtgcacg

SEQ ID NO: 570888 - DNA, 25 bp, Rattus norvegicus
tattcctgttccctatatcttgtga

SEQ ID NO: 570889 - DNA, 25 bp, Rattus norvegicus
tattcctgttccgtatatcttgtga

SEQ ID NO: 570890 - DNA, 25 bp, Rattus norvegicus
tattcctgttgtacatagccccgcg

SEQ ID NO: 570891 - DNA, 25 bp, Rattus norvegicus
tattcctgttgttcatagccccgcg

SEQ ID NO: 570892 - DNA, 25 bp, Rattus norvegicus
tattccttctgcctcagtacattac

SEQ ID NO: 570893 - DNA, 25 bp, Rattus norvegicus
tattccttctgcgtcagtacattac

SEQ ID NO: 570894 - DNA, 25 bp, Rattus norvegicus
tattccttcttgacataatcaagca

SEQ ID NO: 570895 - DNA, 25 bp, Rattus norvegicus
tattccttcttgtcataatcaagca

SEQ ID NO: 570896 - DNA, 25 bp, Rattus norvegicus
tattccttgcggaccagcagcgcag

SEQ ID NO: 570897 - DNA, 25 bp, Rattus norvegicus
tattccttgcggtccagcagcgcag

SEQ ID NO: 570898 - DNA, 25 bp, Rattus norvegicus
tattccttggccattgatcttttct

SEQ ID NO: 570899 - DNA, 25 bp, Rattus norvegicus
tattccttggcctttgatcttttct

SEQ ID NO: 570900 - DNA, 25 bp, Rattus norvegicus
tattccttgtttacatcatcctggt

SEQ ID NO: 570901 - DNA, 25 bp, Rattus norvegicus
tattccttgtttccaacagccagcc

SEQ ID NO: 570902 - DNA, 25 bp, Rattus norvegicus
tattccttgtttgcaacagccagcc

SEQ ID NO: 570903 - DNA, 25 bp, Rattus norvegicus
tattccttgttttcatcatcctggt

SEQ ID NO: 570904 - DNA, 25 bp, Rattus norvegicus
tattcctttatcatgggatggtgga

SEQ ID NO: 570905 - DNA, 25 bp, Rattus norvegicus
tattcctttatcttgggatggtgga

SEQ ID NO: 570906 - DNA, 25 bp, Rattus norvegicus
tattcctttcatattgtggtttcaa

SEQ ID NO: 570907 - DNA, 25 bp, Rattus norvegicus
tattcctttcattttgtggtttcaa

SEQ ID NO: 570908 - DNA, 25 bp, Rattus norvegicus
tattcctttcccacttataaacctg

SEQ ID NO: 570909 - DNA, 25 bp, Rattus norvegicus
tattcctttcccatcttcagcagta

SEQ ID NO: 570910 - DNA, 25 bp, Rattus norvegicus
tattcctttcccctgaactattaat

SEQ ID NO: 570911 - DNA, 25 bp, Rattus norvegicus
tattcctttcccgtgaactattaat

SEQ ID NO: 570912 - DNA, 25 bp, Rattus norvegicus
tattcctttccctcttataaacctg

SEQ ID NO: 570913 - DNA, 25 bp, Rattus norvegicus
tattcctttcccttcttcagcagta

SEQ ID NO: 570914 - DNA, 25 bp, Rattus norvegicus
tattcctttcttacgttttcatctg

SEQ ID NO: 570915 - DNA, 25 bp, Rattus norvegicus
tattcctttctttcgttttcatctg

SEQ ID NO: 570916 - DNA, 25 bp, Rattus norvegicus
tattccttttataggcagccaaatg

SEQ ID NO: 570917 - DNA, 25 bp, Rattus norvegicus
tattccttttattggcagccaaatg

SEQ ID NO: 570918 - DNA, 25 bp, Rattus norvegicus
tattccttttgaacttgcctcataa

SEQ ID NO: 570919 - DNA, 25 bp, Rattus norvegicus
tattccttttgatcttgcctcataa

SEQ ID NO: 570920 - DNA, 25 bp, Rattus norvegicus
tattcgaaagacactagccttagac

SEQ ID NO: 570921 - DNA, 25 bp, Rattus norvegicus
tattcgaaagactctagccttagac

SEQ ID NO: 570922 - DNA, 25 bp, Rattus norvegicus
tattcgaagtctcgctggtgtttct

SEQ ID NO: 570923 - DNA, 25 bp, Rattus norvegicus
tattcgaagtctggctggtgtttct

SEQ ID NO: 570924 - DNA, 25 bp, Rattus norvegicus
tattcgacccagaaagattcccaga

SEQ ID NO: 570925 - DNA, 25 bp, Rattus norvegicus
tattcgacccagtaagattcccaga

SEQ ID NO: 570926 - DNA, 25 bp, Rattus norvegicus
tattcgactgttacttcacggctaa

SEQ ID NO: 570927 - DNA, 25 bp, Rattus norvegicus
tattcgactgtttcttcacggctaa

SEQ ID NO: 570928 - DNA, 25 bp, Rattus norvegicus
tattcgattcggagggcaagtgatc

SEQ ID NO: 570929 - DNA, 25 bp, Rattus norvegicus
tattcgattcggtgggcaagtgatc

SEQ ID NO: 570930 - DNA, 25 bp, Rattus norvegicus
tattcgccaatgcaggaggagcccc

SEQ ID NO: 570931 - DNA, 25 bp, Rattus norvegicus
tattcgccaatggaggaggagcccc

SEQ ID NO: 570932 - DNA, 25 bp, Rattus norvegicus
tattcgctgctgaaggcggtgagct

SEQ ID NO: 570933 - DNA, 25 bp, Rattus norvegicus
tattcgctgctgtaggcggtgagct

SEQ ID NO: 570934 - DNA, 25 bp, Rattus norvegicus
tattcggacccgctatgctttctga

SEQ ID NO: 570935 - DNA, 25 bp, Rattus norvegicus
tattcggacccggtatgctttctga

SEQ ID NO: 570936 - DNA, 25 bp, Rattus norvegicus
tattcggcaggactcagccacttaa

SEQ ID NO: 570937 - DNA, 25 bp, Rattus norvegicus
tattcggcaggagtcagccacttaa

SEQ ID NO: 570938 - DNA, 25 bp, Rattus norvegicus
tattcggctcctattttgagtgggt

SEQ ID NO: 570939 - DNA, 25 bp, Rattus norvegicus
tattcggctccttttttgagtgggt

SEQ ID NO: 570940 - DNA, 25 bp, Rattus norvegicus
tattcggcttatacttctacactgc

SEQ ID NO: 570941 - DNA, 25 bp, Rattus norvegicus
tattcggcttattcttctacactgc

SEQ ID NO: 570942 - DNA, 25 bp, Rattus norvegicus
tattcgggaaggagtccttctctca

SEQ ID NO: 570943 - DNA, 25 bp, Rattus norvegicus
tattcgggaaggtgtccttctctca

SEQ ID NO: 570944 - DNA, 25 bp, Rattus norvegicus
tattcggtcctgcagatggtccaag

SEQ ID NO: 570945 - DNA, 25 bp, Rattus norvegicus
tattcggtcctggagatggtccaag

SEQ ID NO: 570946 - DNA, 25 bp, Rattus norvegicus
tattcgtctcttaaactttccatat

SEQ ID NO: 570947 - DNA, 25 bp, Rattus norvegicus
tattcgtctctttaactttccatat

SEQ ID NO: 570948 - DNA, 25 bp, Rattus norvegicus
tattcgtgtcctctggtggtactac

SEQ ID NO: 570949 - DNA, 25 bp, Rattus norvegicus
tattcgtgtcctgtggtggtactac

SEQ ID NO: 570950 - DNA, 25 bp, Rattus norvegicus
tattcgttataccgaagatgatgaa

SEQ ID NO: 570951 - DNA, 25 bp, Rattus norvegicus
tattcgttatacggaagatgatgaa

SEQ ID NO: 570952 - DNA, 25 bp, Rattus norvegicus
tattcgttgaagctctcaagcctgc

SEQ ID NO: 570953 - DNA, 25 bp, Rattus norvegicus
tattcgttgaaggtctcaagcctgc

SEQ ID NO: 570954 - DNA, 25 bp, Rattus norvegicus
tattctaaacatatcaccctacgcc

SEQ ID NO: 570955 - DNA, 25 bp, Rattus norvegicus
tattctaaacatttcaccctacgcc

SEQ ID NO: 570956 - DNA, 25 bp, Rattus norvegicus
tattctaacctcaaactcattcctc

SEQ ID NO: 570957 - DNA, 25 bp, Rattus norvegicus
tattctaacctctaactcattcctc

SEQ ID NO: 570958 - DNA, 25 bp, Rattus norvegicus
tattctaactgtacagggtctgtgc

SEQ ID NO: 570959 - DNA, 25 bp, Rattus norvegicus
tattctaactgttcagggtctgtgc

SEQ ID NO: 570960 - DNA, 25 bp, Rattus norvegicus
tattctaagatcacagtggtctcct

SEQ ID NO: 570961 - DNA, 25 bp, Rattus norvegicus
tattctaagatctcagtggtctcct

SEQ ID NO: 570962 - DNA, 25 bp, Rattus norvegicus
tattctaagtttatgccaccttccc

SEQ ID NO: 570963 - DNA, 25 bp, Rattus norvegicus
tattctaagtttttgccaccttccc

SEQ ID NO: 570964 - DNA, 25 bp, Rattus norvegicus
tattctacaaatactatctgaaaga

SEQ ID NO: 570965 - DNA, 25 bp, Rattus norvegicus
tattctacaaattctatctgaaaga

SEQ ID NO: 570966 - DNA, 25 bp, Rattus norvegicus
tattctacccctcagatgaattttg

SEQ ID NO: 570967 - DNA, 25 bp, Rattus norvegicus
tattctacccctgagatgaattttg

SEQ ID NO: 570968 - DNA, 25 bp, Rattus norvegicus
tattctacctccatagctttgcctg

SEQ ID NO: 570969 - DNA, 25 bp, Rattus norvegicus
tattctacctccttagctttgcctg

SEQ ID NO: 570970 - DNA, 25 bp, Rattus norvegicus
tattctacgaacagccaacatacgc

SEQ ID NO: 570971 - DNA, 25 bp, Rattus norvegicus
tattctacgaactgccaacatacgc

SEQ ID NO: 570972 - DNA, 25 bp, Rattus norvegicus
tattctacgttaaggaaggccagat

SEQ ID NO: 570973 - DNA, 25 bp, Rattus norvegicus
tattctacgttatggaaggccagat

SEQ ID NO: 570974 - DNA, 25 bp, Rattus norvegicus
tattctagaaaaatccctgcctcac

SEQ ID NO: 570975 - DNA, 25 bp, Rattus norvegicus
tattctagaaaattccctgcctcac

SEQ ID NO: 570976 - DNA, 25 bp, Rattus norvegicus
tattctagaagaagggtcagggttc

SEQ ID NO: 570977 - DNA, 25 bp, Rattus norvegicus
tattctagaagatgggtcagggttc

SEQ ID NO: 570978 - DNA, 25 bp, Rattus norvegicus
tattctagacggctgagttcctctg

SEQ ID NO: 570979 - DNA, 25 bp, Rattus norvegicus
tattctagacgggtgagttcctctg

SEQ ID NO: 570980 - DNA, 25 bp, Rattus norvegicus
tattctagatctagggagggccctc

SEQ ID NO: 570981 - DNA, 25 bp, Rattus norvegicus
tattctagatcttgggagggccctc

SEQ ID NO: 570982 - DNA, 25 bp, Rattus norvegicus
tattctaggcggattcaggtacttt

SEQ ID NO: 570983 - DNA, 25 bp, Rattus norvegicus
tattctaggcggtttcaggtacttt

SEQ ID NO: 570984 - DNA, 25 bp, Rattus norvegicus
tattctatacccataagcagtccct

SEQ ID NO: 570985 - DNA, 25 bp, Rattus norvegicus
tattctatacccttaagcagtccct

SEQ ID NO: 570986 - DNA, 25 bp, Rattus norvegicus
tattctatcatcatagctctcctct

SEQ ID NO: 570987 - DNA, 25 bp, Rattus norvegicus
tattctatcatcttagctctcctct

SEQ ID NO: 570988 - DNA, 25 bp, Rattus norvegicus
tattctatgtggagggccttggctc

SEQ ID NO: 570989 - DNA, 25 bp, Rattus norvegicus
tattctatgtggtgggccttggctc

SEQ ID NO: 570990 - DNA, 25 bp, Rattus norvegicus
tattctattggtcactagggcctct

SEQ ID NO: 570991 - DNA, 25 bp, Rattus norvegicus
tattctattggtgactagggcctct

SEQ ID NO: 570992 - DNA, 25 bp, Rattus norvegicus
tattctcaataacttcctctaccct

SEQ ID NO: 570993 - DNA, 25 bp, Rattus norvegicus
tattctcaataagttcctctaccct

SEQ ID NO: 570994 - DNA, 25 bp, Rattus norvegicus
tattctcaatcacaacatctagcag

SEQ ID NO: 570995 - DNA, 25 bp, Rattus norvegicus
tattctcaatcagaacatctagcag

SEQ ID NO: 570996 - DNA, 25 bp, Rattus norvegicus
tattctcaccatccccaatgatgat

SEQ ID NO: 570997 - DNA, 25 bp, Rattus norvegicus
tattctcaccatgcccaatgatgat

SEQ ID NO: 570998 - DNA, 25 bp, Rattus norvegicus
tattctcacccactttgaccttgat

SEQ ID NO: 570999 - DNA, 25 bp, Rattus norvegicus
tattctcacccagtttgaccttgat

SEQ ID NO: 571000 - DNA, 25 bp, Rattus norvegicus
tattctcacgtcatgctgctgcata

SEQ ID NO: 571001 - DNA, 25 bp, Rattus norvegicus
tattctcacgtcttgctgctgcata

SEQ ID NO: 571002 - DNA, 25 bp, Rattus norvegicus
tattctcagagtcctttcttctttg

SEQ ID NO: 571003 - DNA, 25 bp, Rattus norvegicus
tattctcagagtgctttcttctttg

SEQ ID NO: 571004 - DNA, 25 bp, Rattus norvegicus
tattctcaggtaccatcagtccgta

SEQ ID NO: 571005 - DNA, 25 bp, Rattus norvegicus
tattctcaggtagcatcagtccgta

SEQ ID NO: 571006 - DNA, 25 bp, Rattus norvegicus
tattctcatgagcacttcgtacacg

SEQ ID NO: 571007 - DNA, 25 bp, Rattus norvegicus
tattctcatgaggacttcgtacacg

SEQ ID NO: 571008 - DNA, 25 bp, Rattus norvegicus
tattctcattcccagtagaacccat

SEQ ID NO: 571009 - DNA, 25 bp, Rattus norvegicus
tattctcattccgagtagaacccat

SEQ ID NO: 571010 - DNA, 25 bp, Rattus norvegicus
tattctcatttgcatttgtctttcc

SEQ ID NO: 571011 - DNA, 25 bp, Rattus norvegicus
tattctcatttggatttgtctttcc

SEQ ID NO: 571012 - DNA, 25 bp, Rattus norvegicus
tattctccaatactgcattccctat

SEQ ID NO: 571013 - DNA, 25 bp, Rattus norvegicus
tattctccaatagtgcattccctat

SEQ ID NO: 571014 - DNA, 25 bp, Rattus norvegicus
tattctccagcacctactcttgagt

SEQ ID NO: 571015 - DNA, 25 bp, Rattus norvegicus
tattctccagcagctactcttgagt

SEQ ID NO: 571016 - DNA, 25 bp, Rattus norvegicus
tattctccatctagttgtgacctcc

SEQ ID NO: 571017 - DNA, 25 bp, Rattus norvegicus
tattctccatcttgttgtgacctcc

SEQ ID NO: 571018 - DNA, 25 bp, Rattus norvegicus
tattctcgctctatgtggctatgta

SEQ ID NO: 571019 - DNA, 25 bp, Rattus norvegicus
tattctcgctctttgtggctatgta

SEQ ID NO: 571020 - DNA, 25 bp, Rattus norvegicus
tattctcggccacgaacctagcgga

SEQ ID NO: 571021 - DNA, 25 bp, Rattus norvegicus
tattctcggccaggaacctagcgga

SEQ ID NO: 571022 - DNA, 25 bp, Rattus norvegicus
tattctcggttcatggagccggcgg

SEQ ID NO: 571023 - DNA, 25 bp, Rattus norvegicus
tattctcggttcttggagccggcgg

SEQ ID NO: 571024 - DNA, 25 bp, Rattus norvegicus
tattctctacctaccagaacactaa

SEQ ID NO: 571025 - DNA, 25 bp, Rattus norvegicus
tattctctaccttccagaacactaa

SEQ ID NO: 571026 - DNA, 25 bp, Rattus norvegicus
tattctctatacacatttctttaca

SEQ ID NO: 571027 - DNA, 25 bp, Rattus norvegicus
tattctctatactcatttctttaca

SEQ ID NO: 571028 - DNA, 25 bp, Rattus norvegicus
tattctctattacccttggaacttt

SEQ ID NO: 571029 - DNA, 25 bp, Rattus norvegicus
tattctctattagccttggaacttt

SEQ ID NO: 571030 - DNA, 25 bp, Rattus norvegicus
tattctctcacacatttcattcctg

SEQ ID NO: 571031 - DNA, 25 bp, Rattus norvegicus
tattctctcacagatttcattcctg

SEQ ID NO: 571032 - DNA, 25 bp, Rattus norvegicus
tattctctcccgctttgatgaagag

SEQ ID NO: 571033 - DNA, 25 bp, Rattus norvegicus
tattctctcccggtttgatgaagag

SEQ ID NO: 571034 - DNA, 25 bp, Rattus norvegicus
tattctctcctacttgcagctttgt

SEQ ID NO: 571035 - DNA, 25 bp, Rattus norvegicus
tattctctcctagttgcagctttgt

SEQ ID NO: 571036 - DNA, 25 bp, Rattus norvegicus
tattctctcgagagtgccaagggtg

SEQ ID NO: 571037 - DNA, 25 bp, Rattus norvegicus
tattctctcgagtgtgccaagggtg

SEQ ID NO: 571038 - DNA, 25 bp, Rattus norvegicus
tattctctctagaaacctgctgttg

SEQ ID NO: 571039 - DNA, 25 bp, Rattus norvegicus
tattctctctagtaacctgctgttg

SEQ ID NO: 571040 - DNA, 25 bp, Rattus norvegicus
tattctctcttcatgtaaacctaat

SEQ ID NO: 571041 - DNA, 25 bp, Rattus norvegicus
tattctctcttcttgtaaacctaat

SEQ ID NO: 571042 - DNA, 25 bp, Rattus norvegicus
tattctctggctcatgaatctcatt

SEQ ID NO: 571043 - DNA, 25 bp, Rattus norvegicus
tattctctggctgatgaatctcatt

SEQ ID NO: 571044 - DNA, 25 bp, Rattus norvegicus
tattctctgggaacacatttctctc

SEQ ID NO: 571045 - DNA, 25 bp, Rattus norvegicus
tattctctgggatcacatttctctc

SEQ ID NO: 571046 - DNA, 25 bp, Rattus norvegicus
tattctctgtcaagtgggatcctgt

SEQ ID NO: 571047 - DNA, 25 bp, Rattus norvegicus
tattctctgtcatgtgggatcctgt

SEQ ID NO: 571048 - DNA, 25 bp, Rattus norvegicus
tattctctgtgcctgggacgatacc

SEQ ID NO: 571049 - DNA, 25 bp, Rattus norvegicus
tattctctgtgcgtgggacgatacc

SEQ ID NO: 571050 - DNA, 25 bp, Rattus norvegicus
tattctcttatcatttggtttccca

SEQ ID NO: 571051 - DNA, 25 bp, Rattus norvegicus
tattctcttatcttttggtttccca

SEQ ID NO: 571052 - DNA, 25 bp, Rattus norvegicus
tattctcttcctcgtcaaggttaac

SEQ ID NO: 571053 - DNA, 25 bp, Rattus norvegicus
tattctcttcctggtcaaggttaac

SEQ ID NO: 571054 - DNA, 25 bp, Rattus norvegicus
tattctcttctgagttctaaccata

SEQ ID NO: 571055 - DNA, 25 bp, Rattus norvegicus
tattctcttctgtgttctaaccata

SEQ ID NO: 571056 - DNA, 25 bp, Rattus norvegicus
tattctcttcttattctgatgttta

SEQ ID NO: 571057 - DNA, 25 bp, Rattus norvegicus
tattctcttctttttctgatgttta

SEQ ID NO: 571058 - DNA, 25 bp, Rattus norvegicus
tattctcttgcgaccggcagcaggg

SEQ ID NO: 571059 - DNA, 25 bp, Rattus norvegicus
tattctcttgcgtccggcagcaggg

SEQ ID NO: 571060 - DNA, 25 bp, Rattus norvegicus
tattctgaacgacttagcaccgcgc

SEQ ID NO: 571061 - DNA, 25 bp, Rattus norvegicus
tattctgaacgagttagcaccgcgc

SEQ ID NO: 571062 - DNA, 25 bp, Rattus norvegicus
tattctgaatttatggtctctgtaa

SEQ ID NO: 571063 - DNA, 25 bp, Rattus norvegicus
tattctgaatttttggtctctgtaa

SEQ ID NO: 571064 - DNA, 25 bp, Rattus norvegicus
tattctgacattctgctgtgcttaa

SEQ ID NO: 571065 - DNA, 25 bp, Rattus norvegicus
tattctgacattgtgctgtgcttaa

SEQ ID NO: 571066 - DNA, 25 bp, Rattus norvegicus
tattctgaccttaacccatctatgg

SEQ ID NO: 571067 - DNA, 25 bp, Rattus norvegicus
tattctgacctttacccatctatgg

SEQ ID NO: 571068 - DNA, 25 bp, Rattus norvegicus
tattctgagcatctctgtagatcgc

SEQ ID NO: 571069 - DNA, 25 bp, Rattus norvegicus
tattctgagcatgtctgtagatcgc

SEQ ID NO: 571070 - DNA, 25 bp, Rattus norvegicus
tattctgagctgatatgttgtgtat

SEQ ID NO: 571071 - DNA, 25 bp, Rattus norvegicus
tattctgagctgttatgttgtgtat

SEQ ID NO: 571072 - DNA, 25 bp, Rattus norvegicus
tattctgaggtgatgctgtcgtttc

SEQ ID NO: 571073 - DNA, 25 bp, Rattus norvegicus
tattctgaggtgttgctgtcgtttc

SEQ ID NO: 571074 - DNA, 25 bp, Rattus norvegicus
tattctgatatcattcctacaggat

SEQ ID NO: 571075 - DNA, 25 bp, Rattus norvegicus
tattctgatatctttcctacaggat

SEQ ID NO: 571076 - DNA, 25 bp, Rattus norvegicus
tattctgattggacagcagatgctg

SEQ ID NO: 571077 - DNA, 25 bp, Rattus norvegicus
tattctgattggtcagcagatgctg

SEQ ID NO: 571078 - DNA, 25 bp, Rattus norvegicus
tattctgcacccaagaaggctgtag

SEQ ID NO: 571079 - DNA, 25 bp, Rattus norvegicus
tattctgcaccctagaaggctgtag

SEQ ID NO: 571080 - DNA, 25 bp, Rattus norvegicus
tattctgcactcagtagctccaaac

SEQ ID NO: 571081 - DNA, 25 bp, Rattus norvegicus
tattctgcactctgtagctccaaac

SEQ ID NO: 571082 - DNA, 25 bp, Rattus norvegicus
tattctgcagggatgccattctggg

SEQ ID NO: 571083 - DNA, 25 bp, Rattus norvegicus
tattctgcagggttgccattctggg

SEQ ID NO: 571084 - DNA, 25 bp, Rattus norvegicus
tattctgcatctctaggctaaggaa

SEQ ID NO: 571085 - DNA, 25 bp, Rattus norvegicus
tattctgcatctcttcagtgactag

SEQ ID NO: 571086 - DNA, 25 bp, Rattus norvegicus
tattctgcatctgtaggctaaggaa

SEQ ID NO: 571087 - DNA, 25 bp, Rattus norvegicus
tattctgcatctgttcagtgactag

SEQ ID NO: 571088 - DNA, 25 bp, Rattus norvegicus
tattctgccatgaagtaagccttca

SEQ ID NO: 571089 - DNA, 25 bp, Rattus norvegicus
tattctgccatgtagtaagccttca

SEQ ID NO: 571090 - DNA, 25 bp, Rattus norvegicus
tattctgcccttaaaggtaagccat

SEQ ID NO: 571091 - DNA, 25 bp, Rattus norvegicus
tattctgccctttaaggtaagccat

SEQ ID NO: 571092 - DNA, 25 bp, Rattus norvegicus
tattctgcctaaagtttgcttccgt

SEQ ID NO: 571093 - DNA, 25 bp, Rattus norvegicus
tattctgcctaatgtttgcttccgt

SEQ ID NO: 571094 - DNA, 25 bp, Rattus norvegicus
tattctgcctgacgtgaggacccta

SEQ ID NO: 571095 - DNA, 25 bp, Rattus norvegicus
tattctgcctgaggtgaggacccta

SEQ ID NO: 571096 - DNA, 25 bp, Rattus norvegicus
tattctgctgcaagtactgtactcc

SEQ ID NO: 571097 - DNA, 25 bp, Rattus norvegicus
tattctgctgcatgtactgtactcc

SEQ ID NO: 571098 - DNA, 25 bp, Rattus norvegicus
tattctgctgtcactgaagatgttc

SEQ ID NO: 571099 - DNA, 25 bp, Rattus norvegicus
tattctgctgtctctgaagatgttc

SEQ ID NO: 571100 - DNA, 25 bp, Rattus norvegicus
tattctgcttgtaagtctccagtcc

SEQ ID NO: 571101 - DNA, 25 bp, Rattus norvegicus
tattctgcttgttagtctccagtcc

SEQ ID NO: 571102 - DNA, 25 bp, Rattus norvegicus
tattctgctttaagaggctatggga

SEQ ID NO: 571103 - DNA, 25 bp, Rattus norvegicus
tattctgctttatgaggctatggga

SEQ ID NO: 571104 - DNA, 25 bp, Rattus norvegicus
tattctggagaacgccgtcctgaag

SEQ ID NO: 571105 - DNA, 25 bp, Rattus norvegicus
tattctggagaaggccgtcctgaag

SEQ ID NO: 571106 - DNA, 25 bp, Rattus norvegicus
tattctggatggagtatctggcctc

SEQ ID NO: 571107 - DNA, 25 bp, Rattus norvegicus
tattctggatggtgtatctggcctc

SEQ ID NO: 571108 - DNA, 25 bp, Rattus norvegicus
tattctggcattacttcactttgtg

SEQ ID NO: 571109 - DNA, 25 bp, Rattus norvegicus
tattctggcatttcttcactttgtg

SEQ ID NO: 571110 - DNA, 25 bp, Rattus norvegicus
tattctgggactactgggtgggcaa

SEQ ID NO: 571111 - DNA, 25 bp, Rattus norvegicus
tattctgggacttctgggtgggcaa

SEQ ID NO: 571112 - DNA, 25 bp, Rattus norvegicus
tattctggttgacacaccatggcgc

SEQ ID NO: 571113 - DNA, 25 bp, Rattus norvegicus
tattctggttgagacaccatggcgc

SEQ ID NO: 571114 - DNA, 25 bp, Rattus norvegicus
tattctggttttctataccttagga

SEQ ID NO: 571115 - DNA, 25 bp, Rattus norvegicus
tattctggttttgtataccttagga

SEQ ID NO: 571116 - DNA, 25 bp, Rattus norvegicus
tattctgtaaatcggctacctttat

SEQ ID NO: 571117 - DNA, 25 bp, Rattus norvegicus
tattctgtaaatgggctacctttat

SEQ ID NO: 571118 - DNA, 25 bp, Rattus norvegicus
tattctgtactcatgagccgtcttg

SEQ ID NO: 571119 - DNA, 25 bp, Rattus norvegicus
tattctgtactcttgagccgtcttg

SEQ ID NO: 571120 - DNA, 25 bp, Rattus norvegicus
tattctgtacttaacgatgtccttg

SEQ ID NO: 571121 - DNA, 25 bp, Rattus norvegicus
tattctgtactttacgatgtccttg

SEQ ID NO: 571122 - DNA, 25 bp, Rattus norvegicus
tattctgtagagctattgcatagat

SEQ ID NO: 571123 - DNA, 25 bp, Rattus norvegicus
tattctgtagaggtattgcatagat

SEQ ID NO: 571124 - DNA, 25 bp, Rattus norvegicus
tattctgtccttatcattttgcgat

SEQ ID NO: 571125 - DNA, 25 bp, Rattus norvegicus
tattctgtccttttcattttgcgat

SEQ ID NO: 571126 - DNA, 25 bp, Rattus norvegicus
tattctgtcgctcctgaaggatcct

SEQ ID NO: 571127 - DNA, 25 bp, Rattus norvegicus
tattctgtcgctgctgaaggatcct

SEQ ID NO: 571128 - DNA, 25 bp, Rattus norvegicus
tattctgtgacaattacttattggg

SEQ ID NO: 571129 - DNA, 25 bp, Rattus norvegicus
tattctgtgacatttacttattggg

SEQ ID NO: 571130 - DNA, 25 bp, Rattus norvegicus
tattctgtgggaaccggagggaact

SEQ ID NO: 571131 - DNA, 25 bp, Rattus norvegicus
tattctgtgggatccggagggaact

SEQ ID NO: 571132 - DNA, 25 bp, Rattus norvegicus
tattctgtgttcagtgttttctcga

SEQ ID NO: 571133 - DNA, 25 bp, Rattus norvegicus
tattctgtgttctgtgttttctcga

SEQ ID NO: 571134 - DNA, 25 bp, Rattus norvegicus
tattctgtgtttactttggcttgac

SEQ ID NO: 571135 - DNA, 25 bp, Rattus norvegicus
tattctgtgttttctttggcttgac

SEQ ID NO: 571136 - DNA, 25 bp, Rattus norvegicus
tattctgttctcagaatggctgagc

SEQ ID NO: 571137 - DNA, 25 bp, Rattus norvegicus
tattctgttctctgaatggctgagc

SEQ ID NO: 571138 - DNA, 25 bp, Rattus norvegicus
tattctgtttctcttgggaacccag

SEQ ID NO: 571139 - DNA, 25 bp, Rattus norvegicus
tattctgtttctgttgggaacccag

SEQ ID NO: 571140 - DNA, 25 bp, Rattus norvegicus
tattcttaaactaggacactgatgc

SEQ ID NO: 571141 - DNA, 25 bp, Rattus norvegicus
tattcttaaacttggacactgatgc

SEQ ID NO: 571142 - DNA, 25 bp, Rattus norvegicus
tattcttaacatcgccgatgaggca

SEQ ID NO: 571143 - DNA, 25 bp, Rattus norvegicus
tattcttaacatggccgatgaggca

SEQ ID NO: 571144 - DNA, 25 bp, Rattus norvegicus
tattcttaactcaagcatttgctga

SEQ ID NO: 571145 - DNA, 25 bp, Rattus norvegicus
tattcttaactctagcatttgctga

SEQ ID NO: 571146 - DNA, 25 bp, Rattus norvegicus
tattcttaatctatgcaccttttcc

SEQ ID NO: 571147 - DNA, 25 bp, Rattus norvegicus
tattcttaatctttgcaccttttcc

SEQ ID NO: 571148 - DNA, 25 bp, Rattus norvegicus
tattcttagactatgatctggccaa

SEQ ID NO: 571149 - DNA, 25 bp, Rattus norvegicus
tattcttagactttgatctggccaa

SEQ ID NO: 571150 - DNA, 25 bp, Rattus norvegicus
tattcttagctgactgttttagcag

SEQ ID NO: 571151 - DNA, 25 bp, Rattus norvegicus
tattcttagctgtctgttttagcag

SEQ ID NO: 571152 - DNA, 25 bp, Rattus norvegicus
tattcttataggacgccactggtat

SEQ ID NO: 571153 - DNA, 25 bp, Rattus norvegicus
tattcttataggtcgccactggtat

SEQ ID NO: 571154 - DNA, 25 bp, Rattus norvegicus
tattcttatcaccagacagccacag

SEQ ID NO: 571155 - DNA, 25 bp, Rattus norvegicus
tattcttatcacgagacagccacag

SEQ ID NO: 571156 - DNA, 25 bp, Rattus norvegicus
tattcttcagttattccggattcat

SEQ ID NO: 571157 - DNA, 25 bp, Rattus norvegicus
tattcttcagtttttccggattcat

SEQ ID NO: 571158 - DNA, 25 bp, Rattus norvegicus
tattcttcataaaggagggcaatgt

SEQ ID NO: 571159 - DNA, 25 bp, Rattus norvegicus
tattcttcataatggagggcaatgt

SEQ ID NO: 571160 - DNA, 25 bp, Rattus norvegicus
tattcttcatacatcaagcctgaca

SEQ ID NO: 571161 - DNA, 25 bp, Rattus norvegicus
tattcttcatacttcaagcctgaca

SEQ ID NO: 571162 - DNA, 25 bp, Rattus norvegicus
tattcttccataaagcagtactgtg

SEQ ID NO: 571163 - DNA, 25 bp, Rattus norvegicus
tattcttccatatagcagtactgtg

SEQ ID NO: 571164 - DNA, 25 bp, Rattus norvegicus
tattcttcccagacctactaggaga

SEQ ID NO: 571165 - DNA, 25 bp, Rattus norvegicus
tattcttcccagagattagtgcaca

SEQ ID NO: 571166 - DNA, 25 bp, Rattus norvegicus
tattcttcccagtcctactaggaga

SEQ ID NO: 571167 - DNA, 25 bp, Rattus norvegicus
tattcttcccagtgattagtgcaca

SEQ ID NO: 571168 - DNA, 25 bp, Rattus norvegicus
tattcttcccttcctgaattctcga

SEQ ID NO: 571169 - DNA, 25 bp, Rattus norvegicus
tattcttcccttgctgaattctcga

SEQ ID NO: 571170 - DNA, 25 bp, Rattus norvegicus
tattcttccgtgctctatgcttcag

SEQ ID NO: 571171 - DNA, 25 bp, Rattus norvegicus
tattcttccgtggtctatgcttcag

SEQ ID NO: 571172 - DNA, 25 bp, Rattus norvegicus
tattcttcctggacacgcccttggc

SEQ ID NO: 571173 - DNA, 25 bp, Rattus norvegicus
tattcttcctggtcacgcccttggc

SEQ ID NO: 571174 - DNA, 25 bp, Rattus norvegicus
tattcttcctttagtgagctgcatg

SEQ ID NO: 571175 - DNA, 25 bp, Rattus norvegicus
tattcttccttttgtgagctgcatg

SEQ ID NO: 571176 - DNA, 25 bp, Rattus norvegicus
tattcttctaggcacatcccgtcag

SEQ ID NO: 571177 - DNA, 25 bp, Rattus norvegicus
tattcttctagggacatcccgtcag

SEQ ID NO: 571178 - DNA, 25 bp, Rattus norvegicus
tattcttctgtaacttcccattcga

SEQ ID NO: 571179 - DNA, 25 bp, Rattus norvegicus
tattcttctgtatcttcccattcga

SEQ ID NO: 571180 - DNA, 25 bp, Rattus norvegicus
tattcttctgttctactggctgagc

SEQ ID NO: 571181 - DNA, 25 bp, Rattus norvegicus
tattcttctgttgtactggctgagc

SEQ ID NO: 571182 - DNA, 25 bp, Rattus norvegicus
tattcttgaacaactgactcctctg

SEQ ID NO: 571183 - DNA, 25 bp, Rattus norvegicus
tattcttgaacatctgactcctctg

SEQ ID NO: 571184 - DNA, 25 bp, Rattus norvegicus
tattcttgaactacctttcgttgtc

SEQ ID NO: 571185 - DNA, 25 bp, Rattus norvegicus
tattcttgaacttcctttcgttgtc

SEQ ID NO: 571186 - DNA, 25 bp, Rattus norvegicus
tattcttgagtcctcttgagagact

SEQ ID NO: 571187 - DNA, 25 bp, Rattus norvegicus
tattcttgagtcgtcttgagagact

SEQ ID NO: 571188 - DNA, 25 bp, Rattus norvegicus
tattcttgcctaaagtctgattggg

SEQ ID NO: 571189 - DNA, 25 bp, Rattus norvegicus
tattcttgcctatagtctgattggg

SEQ ID NO: 571190 - DNA, 25 bp, Rattus norvegicus
tattcttgctaaaacctctctatgg

SEQ ID NO: 571191 - DNA, 25 bp, Rattus norvegicus
tattcttgctaatacctctctatgg

SEQ ID NO: 571192 - DNA, 25 bp, Rattus norvegicus
tattcttgctgactgctccatgtgt

SEQ ID NO: 571193 - DNA, 25 bp, Rattus norvegicus
tattcttgctgagtgctccatgtgt

SEQ ID NO: 571194 - DNA, 25 bp, Rattus norvegicus
tattcttgctgtactccacctttga

SEQ ID NO: 571195 - DNA, 25 bp, Rattus norvegicus
tattcttgctgttctccacctttga

SEQ ID NO: 571196 - DNA, 25 bp, Rattus norvegicus
tattcttgggctccttttctaaaag

SEQ ID NO: 571197 - DNA, 25 bp, Rattus norvegicus
tattcttgggctgcttttctaaaag

SEQ ID NO: 571198 - DNA, 25 bp, Rattus norvegicus
tattcttgtatccttccctgtttaa

SEQ ID NO: 571199 - DNA, 25 bp, Rattus norvegicus
tattcttgtatcgttccctgtttaa

SEQ ID NO: 571200 - DNA, 25 bp, Rattus norvegicus
tattcttgtcagacttcctcaggat

SEQ ID NO: 571201 - DNA, 25 bp, Rattus norvegicus
tattcttgtcagtcttcctcaggat

SEQ ID NO: 571202 - DNA, 25 bp, Rattus norvegicus
tattctttaaccaatgctccttctc

SEQ ID NO: 571203 - DNA, 25 bp, Rattus norvegicus
tattctttaacctatgctccttctc

SEQ ID NO: 571204 - DNA, 25 bp, Rattus norvegicus
tattctttacctatgcctgtctttt

SEQ ID NO: 571205 - DNA, 25 bp, Rattus norvegicus
tattctttacctttgcctgtctttt

SEQ ID NO: 571206 - DNA, 25 bp, Rattus norvegicus
tattctttcaacatttcttacagta

SEQ ID NO: 571207 - DNA, 25 bp, Rattus norvegicus
tattctttcaacttttcttacagta

SEQ ID NO: 571208 - DNA, 25 bp, Rattus norvegicus
tattctttcacaatgaaggagtcag

SEQ ID NO: 571209 - DNA, 25 bp, Rattus norvegicus
tattctttcacattgaaggagtcag

SEQ ID NO: 571210 - DNA, 25 bp, Rattus norvegicus
tattctttctatccttgcaccctgt

SEQ ID NO: 571211 - DNA, 25 bp, Rattus norvegicus
tattctttctatgcttgcaccctgt

SEQ ID NO: 571212 - DNA, 25 bp, Rattus norvegicus
tattctttgaagacccagtgcctgt

SEQ ID NO: 571213 - DNA, 25 bp, Rattus norvegicus
tattctttgaagtcccagtgcctgt

SEQ ID NO: 571214 - DNA, 25 bp, Rattus norvegicus
tattctttgcggcttatctcacaga

SEQ ID NO: 571215 - DNA, 25 bp, Rattus norvegicus
tattctttgcgggttatctcacaga

SEQ ID NO: 571216 - DNA, 25 bp, Rattus norvegicus
tattcttttacaaatctgggtcaca

SEQ ID NO: 571217 - DNA, 25 bp, Rattus norvegicus
tattcttttacatatctgggtcaca

SEQ ID NO: 571218 - DNA, 25 bp, Rattus norvegicus
tattcttttataaagcctgatcggt

SEQ ID NO: 571219 - DNA, 25 bp, Rattus norvegicus
tattcttttatatagcctgatcggt

SEQ ID NO: 571220 - DNA, 25 bp, Rattus norvegicus
tattcttttatgaggtgcactcaca

SEQ ID NO: 571221 - DNA, 25 bp, Rattus norvegicus
tattcttttatgtggtgcactcaca

SEQ ID NO: 571222 - DNA, 25 bp, Rattus norvegicus
tattcttttattaccgtacaagcca

SEQ ID NO: 571223 - DNA, 25 bp, Rattus norvegicus
tattcttttatttccgtacaagcca

SEQ ID NO: 571224 - DNA, 25 bp, Rattus norvegicus
tattcttttcatatggacagcagga

SEQ ID NO: 571225 - DNA, 25 bp, Rattus norvegicus
tattcttttcatttggacagcagga

SEQ ID NO: 571226 - DNA, 25 bp, Rattus norvegicus
tattcttttgtgcagactgggtctc

SEQ ID NO: 571227 - DNA, 25 bp, Rattus norvegicus
tattcttttgtggagactgggtctc

SEQ ID NO: 571228 - DNA, 25 bp, Rattus norvegicus
tattgaaagccgcactgatggatat

SEQ ID NO: 571229 - DNA, 25 bp, Rattus norvegicus
tattgaaagccggactgatggatat

SEQ ID NO: 571230 - DNA, 25 bp, Rattus norvegicus
tattgaaaggagctaatgccattgt

SEQ ID NO: 571231 - DNA, 25 bp, Rattus norvegicus
tattgaaaggaggtaatgccattgt

SEQ ID NO: 571232 - DNA, 25 bp, Rattus norvegicus
tattgaacacgcaaacccttgggac

SEQ ID NO: 571233 - DNA, 25 bp, Rattus norvegicus
tattgaacacgctaacccttgggac

SEQ ID NO: 571234 - DNA, 25 bp, Rattus norvegicus
tattgaaccaataaaagatcccact

SEQ ID NO: 571235 - DNA, 25 bp, Rattus norvegicus
tattgaaccaattaaagatcccact

SEQ ID NO: 571236 - DNA, 25 bp, Rattus norvegicus
tattgaacttagctgcttggctctt

SEQ ID NO: 571237 - DNA, 25 bp, Rattus norvegicus
tattgaacttaggtgcttggctctt

SEQ ID NO: 571238 - DNA, 25 bp, Rattus norvegicus
tattgaaggtccctggctctattgc

SEQ ID NO: 571239 - DNA, 25 bp, Rattus norvegicus
tattgaaggtccgtggctctattgc

SEQ ID NO: 571240 - DNA, 25 bp, Rattus norvegicus
tattgaatgtcaacccacctgagta

SEQ ID NO: 571241 - DNA, 25 bp, Rattus norvegicus
tattgaatgtcatcccacctgagta

SEQ ID NO: 571242 - DNA, 25 bp, Rattus norvegicus
tattgaatgttactcacctgacccc

SEQ ID NO: 571243 - DNA, 25 bp, Rattus norvegicus
tattgaatgttagtcacctgacccc

SEQ ID NO: 571244 - DNA, 25 bp, Rattus norvegicus
tattgaattctaacagggcgcctgt

SEQ ID NO: 571245 - DNA, 25 bp, Rattus norvegicus
tattgaattctatcagggcgcctgt

SEQ ID NO: 571246 - DNA, 25 bp, Rattus norvegicus
tattgacagattacacctggtcccc

SEQ ID NO: 571247 - DNA, 25 bp, Rattus norvegicus
tattgacagatttcacctggtcccc

SEQ ID NO: 571248 - DNA, 25 bp, Rattus norvegicus
tattgacagcaaactacacctacct

SEQ ID NO: 571249 - DNA, 25 bp, Rattus norvegicus
tattgacagcaatctacacctacct

SEQ ID NO: 571250 - DNA, 25 bp, Rattus norvegicus
tattgacatctacgggcggctattg

SEQ ID NO: 571251 - DNA, 25 bp, Rattus norvegicus
tattgacatctaggggcggctattg

SEQ ID NO: 571252 - DNA, 25 bp, Rattus norvegicus
tattgaccaactctggaagacattg

SEQ ID NO: 571253 - DNA, 25 bp, Rattus norvegicus
tattgaccaactgtggaagacattg

SEQ ID NO: 571254 - DNA, 25 bp, Rattus norvegicus
tattgaccactacaggtcagctgct

SEQ ID NO: 571255 - DNA, 25 bp, Rattus norvegicus
tattgaccactagaggtcagctgct

SEQ ID NO: 571256 - DNA, 25 bp, Rattus norvegicus
tattgaccagcacgctgaacctctt

SEQ ID NO: 571257 - DNA, 25 bp, Rattus norvegicus
tattgaccagcaggctgaacctctt

SEQ ID NO: 571258 - DNA, 25 bp, Rattus norvegicus
tattgaccattcagtcctcgtatag

SEQ ID NO: 571259 - DNA, 25 bp, Rattus norvegicus
tattgaccattctgtcctcgtatag

SEQ ID NO: 571260 - DNA, 25 bp, Rattus norvegicus
tattgaccatttacgtgagtgctaa

SEQ ID NO: 571261 - DNA, 25 bp, Rattus norvegicus
tattgaccattttcgtgagtgctaa

SEQ ID NO: 571262 - DNA, 25 bp, Rattus norvegicus
tattgacctcaacctgtactagaat

SEQ ID NO: 571263 - DNA, 25 bp, Rattus norvegicus
tattgacctcaagctgtactagaat

SEQ ID NO: 571264 - DNA, 25 bp, Rattus norvegicus
tattgacctgttaacttggagagca

SEQ ID NO: 571265 - DNA, 25 bp, Rattus norvegicus
tattgacctgtttacttggagagca

SEQ ID NO: 571266 - DNA, 25 bp, Rattus norvegicus
tattgaccttggagggcaacgggtc

SEQ ID NO: 571267 - DNA, 25 bp, Rattus norvegicus
tattgaccttggtgggcaacgggtc

SEQ ID NO: 571268 - DNA, 25 bp, Rattus norvegicus
tattgacgctaaaaccatgggacag

SEQ ID NO: 571269 - DNA, 25 bp, Rattus norvegicus
tattgacgctaataccatgggacag

SEQ ID NO: 571270 - DNA, 25 bp, Rattus norvegicus
tattgacgctttaccaggctgcctt

SEQ ID NO: 571271 - DNA, 25 bp, Rattus norvegicus
tattgacgcttttccaggctgcctt

SEQ ID NO: 571272 - DNA, 25 bp, Rattus norvegicus
tattgacggattacccttcagggtt

SEQ ID NO: 571273 - DNA, 25 bp, Rattus norvegicus
tattgacggatttcccttcagggtt

SEQ ID NO: 571274 - DNA, 25 bp, Rattus norvegicus
tattgactccaactccttcctgaaa

SEQ ID NO: 571275 - DNA, 25 bp, Rattus norvegicus
tattgactccaagtccttcctgaaa

SEQ ID NO: 571276 - DNA, 25 bp, Rattus norvegicus
tattgactgcctcaaaactactgtg

SEQ ID NO: 571277 - DNA, 25 bp, Rattus norvegicus
tattgactgcctgaaaactactgtg

SEQ ID NO: 571278 - DNA, 25 bp, Rattus norvegicus
tattgactggacagagacctgccaa

SEQ ID NO: 571279 - DNA, 25 bp, Rattus norvegicus
tattgactggactgagacctgccaa

SEQ ID NO: 571280 - DNA, 25 bp, Rattus norvegicus
tattgagactctctttctgggtgat

SEQ ID NO: 571281 - DNA, 25 bp, Rattus norvegicus
tattgagactctgtttctgggtgat

SEQ ID NO: 571282 - DNA, 25 bp, Rattus norvegicus
tattgagagagtatcggatgcctgg

SEQ ID NO: 571283 - DNA, 25 bp, Rattus norvegicus
tattgagagagtttcggatgcctgg

SEQ ID NO: 571284 - DNA, 25 bp, Rattus norvegicus
tattgagcaagacgcccacatcctt

SEQ ID NO: 571285 - DNA, 25 bp, Rattus norvegicus
tattgagcaagaggcccacatcctt

SEQ ID NO: 571286 - DNA, 25 bp, Rattus norvegicus
tattgagcaataactccttctcctc

SEQ ID NO: 571287 - DNA, 25 bp, Rattus norvegicus
tattgagcaatatctccttctcctc

SEQ ID NO: 571288 - DNA, 25 bp, Rattus norvegicus
tattgagcacccactgtatgctgac

SEQ ID NO: 571289 - DNA, 25 bp, Rattus norvegicus
tattgagcaccctctgtatgctgac

SEQ ID NO: 571290 - DNA, 25 bp, Rattus norvegicus
tattgagcaccgagttatgtgacaa

SEQ ID NO: 571291 - DNA, 25 bp, Rattus norvegicus
tattgagcaccgtgttatgtgacaa

SEQ ID NO: 571292 - DNA, 25 bp, Rattus norvegicus
tattgagcacgtacactttgactgt

SEQ ID NO: 571293 - DNA, 25 bp, Rattus norvegicus
tattgagcacgttcactttgactgt

SEQ ID NO: 571294 - DNA, 25 bp, Rattus norvegicus
tattgagccaggcttatgacctata

SEQ ID NO: 571295 - DNA, 25 bp, Rattus norvegicus
tattgagccagggttatgacctata

SEQ ID NO: 571296 - DNA, 25 bp, Rattus norvegicus
tattgagcctcaatgtgagccctgc

SEQ ID NO: 571297 - DNA, 25 bp, Rattus norvegicus
tattgagcctcattgtgagccctgc

SEQ ID NO: 571298 - DNA, 25 bp, Rattus norvegicus
tattgagcctttctgatggccgcat

SEQ ID NO: 571299 - DNA, 25 bp, Rattus norvegicus
tattgagcctttgtgatggccgcat

SEQ ID NO: 571300 - DNA, 25 bp, Rattus norvegicus
tattgagcgcttcgactgtgacatg

SEQ ID NO: 571301 - DNA, 25 bp, Rattus norvegicus
tattgagcgcttggactgtgacatg

SEQ ID NO: 571302 - DNA, 25 bp, Rattus norvegicus
tattgagctcaacttcattgacacc

SEQ ID NO: 571303 - DNA, 25 bp, Rattus norvegicus
tattgagctcaagttcattgacacc

SEQ ID NO: 571304 - DNA, 25 bp, Rattus norvegicus
tattgaggaagccattcccgcagtt

SEQ ID NO: 571305 - DNA, 25 bp, Rattus norvegicus
tattgaggaagcgattcccgcagtt

SEQ ID NO: 571306 - DNA, 25 bp, Rattus norvegicus
tattgaggaccccactgcactaaac

SEQ ID NO: 571307 - DNA, 25 bp, Rattus norvegicus
tattgaggacccgactgcactaaac

SEQ ID NO: 571308 - DNA, 25 bp, Rattus norvegicus
tattgaggacctagctgagaacata

SEQ ID NO: 571309 - DNA, 25 bp, Rattus norvegicus
tattgaggaccttgctgagaacata

SEQ ID NO: 571310 - DNA, 25 bp, Rattus norvegicus
tattgaggtcagagtgtgccagaat

SEQ ID NO: 571311 - DNA, 25 bp, Rattus norvegicus
tattgaggtcagtgtgtgccagaat

SEQ ID NO: 571312 - DNA, 25 bp, Rattus norvegicus
tattgaggttggactggctgtatag

SEQ ID NO: 571313 - DNA, 25 bp, Rattus norvegicus
tattgaggttggtctggctgtatag

SEQ ID NO: 571314 - DNA, 25 bp, Rattus norvegicus
tattgagtagatctgcaccttgcag

SEQ ID NO: 571315 - DNA, 25 bp, Rattus norvegicus
tattgagtagatgtgcaccttgcag

SEQ ID NO: 571316 - DNA, 25 bp, Rattus norvegicus
tattgagtgcttatgtgggccttct

SEQ ID NO: 571317 - DNA, 25 bp, Rattus norvegicus
tattgagtgcttttgtgggccttct

SEQ ID NO: 571318 - DNA, 25 bp, Rattus norvegicus
tattgagtggcactctttggtcttg

SEQ ID NO: 571319 - DNA, 25 bp, Rattus norvegicus
tattgagtggcagtctttggtcttg

SEQ ID NO: 571320 - DNA, 25 bp, Rattus norvegicus
tattgagtgtgtatgtatcctggat

SEQ ID NO: 571321 - DNA, 25 bp, Rattus norvegicus
tattgagtgtgtttgtatcctggat

SEQ ID NO: 571322 - DNA, 25 bp, Rattus norvegicus
tattgagttgtgacttgtccagtga

SEQ ID NO: 571323 - DNA, 25 bp, Rattus norvegicus
tattgagttgtgtcttgtccagtga

SEQ ID NO: 571324 - DNA, 25 bp, Rattus norvegicus
tattgataccttacctttactcacc

SEQ ID NO: 571325 - DNA, 25 bp, Rattus norvegicus
tattgatacctttcctttactcacc

SEQ ID NO: 571326 - DNA, 25 bp, Rattus norvegicus
tattgatagtttctctggattacca

SEQ ID NO: 571327 - DNA, 25 bp, Rattus norvegicus
tattgatagtttgtctggattacca

SEQ ID NO: 571328 - DNA, 25 bp, Rattus norvegicus
tattgatatttgagcttctgcccaa

SEQ ID NO: 571329 - DNA, 25 bp, Rattus norvegicus
tattgatatttgtgcttctgcccaa

SEQ ID NO: 571330 - DNA, 25 bp, Rattus norvegicus
tattgatcctccctagctgccttta

SEQ ID NO: 571331 - DNA, 25 bp, Rattus norvegicus
tattgatcctccgtagctgccttta

SEQ ID NO: 571332 - DNA, 25 bp, Rattus norvegicus
tattgatcctgcctgatgcatcaca

SEQ ID NO: 571333 - DNA, 25 bp, Rattus norvegicus
tattgatcctgcgtgatgcatcaca

SEQ ID NO: 571334 - DNA, 25 bp, Rattus norvegicus
tattgatcttaaccattccaacagg

SEQ ID NO: 571335 - DNA, 25 bp, Rattus norvegicus
tattgatcttaagcattccaacagg

SEQ ID NO: 571336 - DNA, 25 bp, Rattus norvegicus
tattgatgcggtcccaaatccttgc

SEQ ID NO: 571337 - DNA, 25 bp, Rattus norvegicus
tattgatgcggtgccaaatccttgc

SEQ ID NO: 571338 - DNA, 25 bp, Rattus norvegicus
tattgatgctttatgtataggacca

SEQ ID NO: 571339 - DNA, 25 bp, Rattus norvegicus
tattgatgctttttgtataggacca

SEQ ID NO: 571340 - DNA, 25 bp, Rattus norvegicus
tattgatggcacacaaggtccctgt

SEQ ID NO: 571341 - DNA, 25 bp, Rattus norvegicus
tattgatggcactcaaggtccctgt

SEQ ID NO: 571342 - DNA, 25 bp, Rattus norvegicus
tattgatggtgacactgtcccctct

SEQ ID NO: 571343 - DNA, 25 bp, Rattus norvegicus
tattgatggtgagactgtcccctct

SEQ ID NO: 571344 - DNA, 25 bp, Rattus norvegicus
tattgatgtatgactgtgccttgaa

SEQ ID NO: 571345 - DNA, 25 bp, Rattus norvegicus
tattgatgtatgtctgtgccttgaa

SEQ ID NO: 571346 - DNA, 25 bp, Rattus norvegicus
tattgattagcactgccgtcacctc

SEQ ID NO: 571347 - DNA, 25 bp, Rattus norvegicus
tattgattagcagtgccgtcacctc

SEQ ID NO: 571348 - DNA, 25 bp, Rattus norvegicus
tattgattcgacacttcttctccgt

SEQ ID NO: 571349 - DNA, 25 bp, Rattus norvegicus
tattgattcgactcttcttctccgt

SEQ ID NO: 571350 - DNA, 25 bp, Rattus norvegicus
tattgatttcttactcctgtgtgat

SEQ ID NO: 571351 - DNA, 25 bp, Rattus norvegicus
tattgatttctttctcctgtgtgat

SEQ ID NO: 571352 - DNA, 25 bp, Rattus norvegicus
tattgattttctaaaggtacccgtg

SEQ ID NO: 571353 - DNA, 25 bp, Rattus norvegicus
tattgattttcttaaggtacccgtg

SEQ ID NO: 571354 - DNA, 25 bp, Rattus norvegicus
tattgcaagcaacggtcgtggctgt

SEQ ID NO: 571355 - DNA, 25 bp, Rattus norvegicus
tattgcaagcaagggtcgtggctgt

SEQ ID NO: 571356 - DNA, 25 bp, Rattus norvegicus
tattgcaaggtgagatggtctggtt

SEQ ID NO: 571357 - DNA, 25 bp, Rattus norvegicus
tattgcaaggtgtgatggtctggtt

SEQ ID NO: 571358 - DNA, 25 bp, Rattus norvegicus
tattgcaatcacagtgctccactgg

SEQ ID NO: 571359 - DNA, 25 bp, Rattus norvegicus
tattgcaatcactgtgctccactgg

SEQ ID NO: 571360 - DNA, 25 bp, Rattus norvegicus
tattgcacagccacattacctagaa

SEQ ID NO: 571361 - DNA, 25 bp, Rattus norvegicus
tattgcacagcctcattacctagaa

SEQ ID NO: 571362 - DNA, 25 bp, Rattus norvegicus
tattgcacagctagacctcgttgga

SEQ ID NO: 571363 - DNA, 25 bp, Rattus norvegicus
tattgcacagcttgacctcgttgga

SEQ ID NO: 571364 - DNA, 25 bp, Rattus norvegicus
tattgcacgccccaggtgagcgaga

SEQ ID NO: 571365 - DNA, 25 bp, Rattus norvegicus
tattgcacgcccgaggtgagcgaga

SEQ ID NO: 571366 - DNA, 25 bp, Rattus norvegicus
tattgcacttaaagctgtggcagca

SEQ ID NO: 571367 - DNA, 25 bp, Rattus norvegicus
tattgcacttaatgctgtggcagca

SEQ ID NO: 571368 - DNA, 25 bp, Rattus norvegicus
tattgcagcttcagttcacactgtg

SEQ ID NO: 571369 - DNA, 25 bp, Rattus norvegicus
tattgcagcttctgttcacactgtg

SEQ ID NO: 571370 - DNA, 25 bp, Rattus norvegicus
tattgcagtggtctaacatcgggta

SEQ ID NO: 571371 - DNA, 25 bp, Rattus norvegicus
tattgcagtggtgtaacatcgggta

SEQ ID NO: 571372 - DNA, 25 bp, Rattus norvegicus
tattgcagtgtgaagtgggctccta

SEQ ID NO: 571373 - DNA, 25 bp, Rattus norvegicus
tattgcagtgtgtagtgggctccta

SEQ ID NO: 571374 - DNA, 25 bp, Rattus norvegicus
tattgcatctgcaagcacttgaatg

SEQ ID NO: 571375 - DNA, 25 bp, Rattus norvegicus
tattgcatctgctagcacttgaatg

SEQ ID NO: 571376 - DNA, 25 bp, Rattus norvegicus
tattgcatggagaaacacctcccag

SEQ ID NO: 571377 - DNA, 25 bp, Rattus norvegicus
tattgcatggagtaacacctcccag

SEQ ID NO: 571378 - DNA, 25 bp, Rattus norvegicus
tattgcatgggaagatgctcattat

SEQ ID NO: 571379 - DNA, 25 bp, Rattus norvegicus
tattgcatgggatgatgctcattat

SEQ ID NO: 571380 - DNA, 25 bp, Rattus norvegicus
tattgcatgtgtcgccactgcagtc

SEQ ID NO: 571381 - DNA, 25 bp, Rattus norvegicus
tattgcatgtgtggccactgcagtc

SEQ ID NO: 571382 - DNA, 25 bp, Rattus norvegicus
tattgcatttgcctaccctgagagg

SEQ ID NO: 571383 - DNA, 25 bp, Rattus norvegicus
tattgcatttgcgtaccctgagagg

SEQ ID NO: 571384 - DNA, 25 bp, Rattus norvegicus
tattgccaaggtcactgccatttct

SEQ ID NO: 571385 - DNA, 25 bp, Rattus norvegicus
tattgccaaggtgactgccatttct

SEQ ID NO: 571386 - DNA, 25 bp, Rattus norvegicus
tattgccacttgcttttctgttggt

SEQ ID NO: 571387 - DNA, 25 bp, Rattus norvegicus
tattgccacttggttttctgttggt

SEQ ID NO: 571388 - DNA, 25 bp, Rattus norvegicus
tattgccactttctattttttcatg

SEQ ID NO: 571389 - DNA, 25 bp, Rattus norvegicus
tattgccactttgtattttttcatg

SEQ ID NO: 571390 - DNA, 25 bp, Rattus norvegicus
tattgccagtatataagccgtttag

SEQ ID NO: 571391 - DNA, 25 bp, Rattus norvegicus
tattgccagtatttaagccgtttag

SEQ ID NO: 571392 - DNA, 25 bp, Rattus norvegicus
tattgcccacgaacctacccatgtg

SEQ ID NO: 571393 - DNA, 25 bp, Rattus norvegicus
tattgcccacgatcctacccatgtg

SEQ ID NO: 571394 - DNA, 25 bp, Rattus norvegicus
tattgcccaggtagtccttaatctt

SEQ ID NO: 571395 - DNA, 25 bp, Rattus norvegicus
tattgcccaggttgtccttaatctt

SEQ ID NO: 571396 - DNA, 25 bp, Rattus norvegicus
tattgcccgtatcctggccgcggcg

SEQ ID NO: 571397 - DNA, 25 bp, Rattus norvegicus
tattgcccgtatgctggccgcggcg

SEQ ID NO: 571398 - DNA, 25 bp, Rattus norvegicus
tattgccctgagacacgtggtgcca

SEQ ID NO: 571399 - DNA, 25 bp, Rattus norvegicus
tattgccctgagtcacgtggtgcca

SEQ ID NO: 571400 - DNA, 25 bp, Rattus norvegicus
tattgcccttatctgatgtgtgcct

SEQ ID NO: 571401 - DNA, 25 bp, Rattus norvegicus
tattgcccttatgtgatgtgtgcct

SEQ ID NO: 571402 - DNA, 25 bp, Rattus norvegicus
tattgccggaagctggaccctccag

SEQ ID NO: 571403 - DNA, 25 bp, Rattus norvegicus
tattgccggaaggtggaccctccag

SEQ ID NO: 571404 - DNA, 25 bp, Rattus norvegicus
tattgccggtccagcggatgcagct

SEQ ID NO: 571405 - DNA, 25 bp, Rattus norvegicus
tattgccggtcctgcggatgcagct

SEQ ID NO: 571406 - DNA, 25 bp, Rattus norvegicus
tattgcctactacctggacgtggaa

SEQ ID NO: 571407 - DNA, 25 bp, Rattus norvegicus
tattgcctactagctggacgtggaa

SEQ ID NO: 571408 - DNA, 25 bp, Rattus norvegicus
tattgcctatgtagtcccgaccatc

SEQ ID NO: 571409 - DNA, 25 bp, Rattus norvegicus
tattgcctatgttgtcccgaccatc

SEQ ID NO: 571410 - DNA, 25 bp, Rattus norvegicus
tattgcctcaagaccaggccagtgt

SEQ ID NO: 571411 - DNA, 25 bp, Rattus norvegicus
tattgcctcaagtccaggccagtgt

SEQ ID NO: 571412 - DNA, 25 bp, Rattus norvegicus
tattgcctcccaaattttgacagtc

SEQ ID NO: 571413 - DNA, 25 bp, Rattus norvegicus
tattgcctcccatattttgacagtc

SEQ ID NO: 571414 - DNA, 25 bp, Rattus norvegicus
tattgcctggcaaatgaaagatcct

SEQ ID NO: 571415 - DNA, 25 bp, Rattus norvegicus
tattgcctggcatatgaaagatcct

SEQ ID NO: 571416 - DNA, 25 bp, Rattus norvegicus
tattgcctggtacttctttctttgt

SEQ ID NO: 571417 - DNA, 25 bp, Rattus norvegicus
tattgcctggtagttctttctttgt

SEQ ID NO: 571418 - DNA, 25 bp, Rattus norvegicus
tattgcctgtttagtgaatactgac

SEQ ID NO: 571419 - DNA, 25 bp, Rattus norvegicus
tattgcctgttttgtgaatactgac

SEQ ID NO: 571420 - DNA, 25 bp, Rattus norvegicus
tattgccttgacctagaactaacct

SEQ ID NO: 571421 - DNA, 25 bp, Rattus norvegicus
tattgccttgacgtagaactaacct

SEQ ID NO: 571422 - DNA, 25 bp, Rattus norvegicus
tattgccttgccagtccagacactg

SEQ ID NO: 571423 - DNA, 25 bp, Rattus norvegicus
tattgccttgccattattacgtgta

SEQ ID NO: 571424 - DNA, 25 bp, Rattus norvegicus
tattgccttgcctgtccagacactg

SEQ ID NO: 571425 - DNA, 25 bp, Rattus norvegicus
tattgccttgcctttattacgtgta

SEQ ID NO: 571426 - DNA, 25 bp, Rattus norvegicus
tattgccttgcgaaaacagctttgg

SEQ ID NO: 571427 - DNA, 25 bp, Rattus norvegicus
tattgccttgcgtaaacagctttgg

SEQ ID NO: 571428 - DNA, 25 bp, Rattus norvegicus
tattgcgacatgctggtaactcctc

SEQ ID NO: 571429 - DNA, 25 bp, Rattus norvegicus
tattgcgacatggtggtaactcctc

SEQ ID NO: 571430 - DNA, 25 bp, Rattus norvegicus
tattgcgcatctatgagcccattct

SEQ ID NO: 571431 - DNA, 25 bp, Rattus norvegicus
tattgcgcatctttgagcccattct

SEQ ID NO: 571432 - DNA, 25 bp, Rattus norvegicus
tattgcgccagccatcatgtaagca

SEQ ID NO: 571433 - DNA, 25 bp, Rattus norvegicus
tattgcgccagcgatcatgtaagca

SEQ ID NO: 571434 - DNA, 25 bp, Rattus norvegicus
tattgcggtcctccagctcatcttt

SEQ ID NO: 571435 - DNA, 25 bp, Rattus norvegicus
tattgcggtcctgcagctcatcttt

SEQ ID NO: 571436 - DNA, 25 bp, Rattus norvegicus
tattgcgtaacacaccaacccctgg

SEQ ID NO: 571437 - DNA, 25 bp, Rattus norvegicus
tattgcgtaacagaccaacccctgg

SEQ ID NO: 571438 - DNA, 25 bp, Rattus norvegicus
tattgcgtcacgcacagcaacctcg

SEQ ID NO: 571439 - DNA, 25 bp, Rattus norvegicus
tattgcgtcacggacagcaacctcg

SEQ ID NO: 571440 - DNA, 25 bp, Rattus norvegicus
tattgctaagtgatcgtcagtgtaa

SEQ ID NO: 571441 - DNA, 25 bp, Rattus norvegicus
tattgctaagtgttcgtcagtgtaa

SEQ ID NO: 571442 - DNA, 25 bp, Rattus norvegicus
tattgctccaaaatcttgtgtgcca

SEQ ID NO: 571443 - DNA, 25 bp, Rattus norvegicus
tattgctccaaacttctgaattcat

SEQ ID NO: 571444 - DNA, 25 bp, Rattus norvegicus
tattgctccaaagttctgaattcat

SEQ ID NO: 571445 - DNA, 25 bp, Rattus norvegicus
tattgctccaaattcttgtgtgcca

SEQ ID NO: 571446 - DNA, 25 bp, Rattus norvegicus
tattgctccatacgccagggctgtg

SEQ ID NO: 571447 - DNA, 25 bp, Rattus norvegicus
tattgctccataggccagggctgtg

SEQ ID NO: 571448 - DNA, 25 bp, Rattus norvegicus
tattgctccctgcaaaatcctggaa

SEQ ID NO: 571449 - DNA, 25 bp, Rattus norvegicus
tattgctccctggaaaatcctggaa

SEQ ID NO: 571450 - DNA, 25 bp, Rattus norvegicus
tattgctcctgccacattctataaa

SEQ ID NO: 571451 - DNA, 25 bp, Rattus norvegicus
tattgctcctgcgacattctataaa

SEQ ID NO: 571452 - DNA, 25 bp, Rattus norvegicus
tattgctcctttcaagtctgacttc

SEQ ID NO: 571453 - DNA, 25 bp, Rattus norvegicus
tattgctcctttgaagtctgacttc

SEQ ID NO: 571454 - DNA, 25 bp, Rattus norvegicus
tattgctctttcatggtgatgccaa

SEQ ID NO: 571455 - DNA, 25 bp, Rattus norvegicus
tattgctctttcttggtgatgccaa

SEQ ID NO: 571456 - DNA, 25 bp, Rattus norvegicus
tattgctgaatcctggaggccacct

SEQ ID NO: 571457 - DNA, 25 bp, Rattus norvegicus
tattgctgaatcgtggaggccacct

SEQ ID NO: 571458 - DNA, 25 bp, Rattus norvegicus
tattgctgctgtccattacaagccc

SEQ ID NO: 571459 - DNA, 25 bp, Rattus norvegicus
tattgctgctgtgcattacaagccc

SEQ ID NO: 571460 - DNA, 25 bp, Rattus norvegicus
tattgctggacgcagacactatcat

SEQ ID NO: 571461 - DNA, 25 bp, Rattus norvegicus
tattgctggacggagacactatcat

SEQ ID NO: 571462 - DNA, 25 bp, Rattus norvegicus
tattgctgggtgctgtctatgcatc

SEQ ID NO: 571463 - DNA, 25 bp, Rattus norvegicus
tattgctgggtggtgtctatgcatc

SEQ ID NO: 571464 - DNA, 25 bp, Rattus norvegicus
tattgctgtaccagacattgcttat

SEQ ID NO: 571465 - DNA, 25 bp, Rattus norvegicus
tattgctgtacctgacattgcttat

SEQ ID NO: 571466 - DNA, 25 bp, Rattus norvegicus
tattgctgtttaattttctatgttc

SEQ ID NO: 571467 - DNA, 25 bp, Rattus norvegicus
tattgctgtttatttttctatgttc

SEQ ID NO: 571468 - DNA, 25 bp, Rattus norvegicus
tattgcttacacctgtttgccatgt

SEQ ID NO: 571469 - DNA, 25 bp, Rattus norvegicus
tattgcttacacgtgtttgccatgt

SEQ ID NO: 571470 - DNA, 25 bp, Rattus norvegicus
tattgcttcaataccaacgtcgcct

SEQ ID NO: 571471 - DNA, 25 bp, Rattus norvegicus
tattgcttcaattccaacgtcgcct

SEQ ID NO: 571472 - DNA, 25 bp, Rattus norvegicus
tattgcttcactacaaaagttagag

SEQ ID NO: 571473 - DNA, 25 bp, Rattus norvegicus
tattgcttcacttcaaaagttagag

SEQ ID NO: 571474 - DNA, 25 bp, Rattus norvegicus
tattgcttcatgatttgtaccctca

SEQ ID NO: 571475 - DNA, 25 bp, Rattus norvegicus
tattgcttcatgttttgtaccctca

SEQ ID NO: 571476 - DNA, 25 bp, Rattus norvegicus
tattgcttcctcattgccaaacatt

SEQ ID NO: 571477 - DNA, 25 bp, Rattus norvegicus
tattgcttcctctttgccaaacatt

SEQ ID NO: 571478 - DNA, 25 bp, Rattus norvegicus
tattgcttctcgcatttggacttaa

SEQ ID NO: 571479 - DNA, 25 bp, Rattus norvegicus
tattgcttctcggatttggacttaa

SEQ ID NO: 571480 - DNA, 25 bp, Rattus norvegicus
tattgcttctggattggagctctgg

SEQ ID NO: 571481 - DNA, 25 bp, Rattus norvegicus
tattgcttctggtttggagctctgg

SEQ ID NO: 571482 - DNA, 25 bp, Rattus norvegicus
tattgcttgaccattttacgtgaat

SEQ ID NO: 571483 - DNA, 25 bp, Rattus norvegicus
tattgcttgacctttttacgtgaat

SEQ ID NO: 571484 - DNA, 25 bp, Rattus norvegicus
tattgcttggacactgtacttggct

SEQ ID NO: 571485 - DNA, 25 bp, Rattus norvegicus
tattgcttggactctgtacttggct

SEQ ID NO: 571486 - DNA, 25 bp, Rattus norvegicus
tattgctttgcaagctcagtctcct

SEQ ID NO: 571487 - DNA, 25 bp, Rattus norvegicus
tattgctttgcatgctcagtctcct

SEQ ID NO: 571488 - DNA, 25 bp, Rattus norvegicus
tattgctttgttcctcattttctca

SEQ ID NO: 571489 - DNA, 25 bp, Rattus norvegicus
tattgctttgttgctcattttctca

SEQ ID NO: 571490 - DNA, 25 bp, Rattus norvegicus
tattggaaacttaatagcacagccc

SEQ ID NO: 571491 - DNA, 25 bp, Rattus norvegicus
tattggaaactttatagcacagccc

SEQ ID NO: 571492 - DNA, 25 bp, Rattus norvegicus
tattggaaccttcagctcctggtca

SEQ ID NO: 571493 - DNA, 25 bp, Rattus norvegicus
tattggaaccttgagctcctggtca

SEQ ID NO: 571494 - DNA, 25 bp, Rattus norvegicus
tattggaacttaagcaacatgcctt

SEQ ID NO: 571495 - DNA, 25 bp, Rattus norvegicus
tattggaacttatgcaacatgcctt

SEQ ID NO: 571496 - DNA, 25 bp, Rattus norvegicus
tattggaaggttcgacataagcaca

SEQ ID NO: 571497 - DNA, 25 bp, Rattus norvegicus
tattggaaggttggacataagcaca

SEQ ID NO: 571498 - DNA, 25 bp, Rattus norvegicus
tattggaatccgcagcatccacctc

SEQ ID NO: 571499 - DNA, 25 bp, Rattus norvegicus
tattggaatccggagcatccacctc

SEQ ID NO: 571500 - DNA, 25 bp, Rattus norvegicus
tattggaccaccattggttctcatt

SEQ ID NO: 571501 - DNA, 25 bp, Rattus norvegicus
tattggaccacctttggttctcatt

SEQ ID NO: 571502 - DNA, 25 bp, Rattus norvegicus
tattggacccgaactgcacgtggca

SEQ ID NO: 571503 - DNA, 25 bp, Rattus norvegicus
tattggacccgatctgcacgtggca

SEQ ID NO: 571504 - DNA, 25 bp, Rattus norvegicus
tattggacctgtaccttctggccta

SEQ ID NO: 571505 - DNA, 25 bp, Rattus norvegicus
tattggacctgttccttctggccta

SEQ ID NO: 571506 - DNA, 25 bp, Rattus norvegicus
tattggactgccagggacaccatgc

SEQ ID NO: 571507 - DNA, 25 bp, Rattus norvegicus
tattggactgcctgggacaccatgc

SEQ ID NO: 571508 - DNA, 25 bp, Rattus norvegicus
tattggactggtagtgttgactggc

SEQ ID NO: 571509 - DNA, 25 bp, Rattus norvegicus
tattggactggttgtgttgactggc

SEQ ID NO: 571510 - DNA, 25 bp, Rattus norvegicus
tattggagacatatggccctggccc

SEQ ID NO: 571511 - DNA, 25 bp, Rattus norvegicus
tattggagacatttggccctggccc

SEQ ID NO: 571512 - DNA, 25 bp, Rattus norvegicus
tattggagctccaaaccttcttcac

SEQ ID NO: 571513 - DNA, 25 bp, Rattus norvegicus
tattggagctcctaaccttcttcac

SEQ ID NO: 571514 - DNA, 25 bp, Rattus norvegicus
tattggatggatccagagacggcct

SEQ ID NO: 571515 - DNA, 25 bp, Rattus norvegicus
tattggatggatgcagagacggcct

SEQ ID NO: 571516 - DNA, 25 bp, Rattus norvegicus
tattggattcccatttacagtgccc

SEQ ID NO: 571517 - DNA, 25 bp, Rattus norvegicus
tattggattcccttttacagtgccc

SEQ ID NO: 571518 - DNA, 25 bp, Rattus norvegicus
tattggcaccttagttttaggagga

SEQ ID NO: 571519 - DNA, 25 bp, Rattus norvegicus
tattggcacctttgttttaggagga

SEQ ID NO: 571520 - DNA, 25 bp, Rattus norvegicus
tattggcactcacgacttggacact

SEQ ID NO: 571521 - DNA, 25 bp, Rattus norvegicus
tattggcactcaggacttggacact

SEQ ID NO: 571522 - DNA, 25 bp, Rattus norvegicus
tattggcactggcttgcaatcaagt

SEQ ID NO: 571523 - DNA, 25 bp, Rattus norvegicus
tattggcactgggttgcaatcaagt

SEQ ID NO: 571524 - DNA, 25 bp, Rattus norvegicus
tattggcagaacaatcccatcttcc

SEQ ID NO: 571525 - DNA, 25 bp, Rattus norvegicus
tattggcagaactatcccatcttcc

SEQ ID NO: 571526 - DNA, 25 bp, Rattus norvegicus
tattggcagctgatcaaactcttca

SEQ ID NO: 571527 - DNA, 25 bp, Rattus norvegicus
tattggcagctgttcaaactcttca

SEQ ID NO: 571528 - DNA, 25 bp, Rattus norvegicus
tattggccaagtccccgtggtcagc

SEQ ID NO: 571529 - DNA, 25 bp, Rattus norvegicus
tattggccaagtgcccgtggtcagc

SEQ ID NO: 571530 - DNA, 25 bp, Rattus norvegicus
tattggccacatcaggagttcctct

SEQ ID NO: 571531 - DNA, 25 bp, Rattus norvegicus
tattggccacatgaggagttcctct

SEQ ID NO: 571532 - DNA, 25 bp, Rattus norvegicus
tattggccagttcatctacagcagc

SEQ ID NO: 571533 - DNA, 25 bp, Rattus norvegicus
tattggccagttgatctacagcagc

SEQ ID NO: 571534 - DNA, 25 bp, Rattus norvegicus
tattggcccgcgaaaggcttactct

SEQ ID NO: 571535 - DNA, 25 bp, Rattus norvegicus
tattggcccgcgtaaggcttactct

SEQ ID NO: 571536 - DNA, 25 bp, Rattus norvegicus
tattggccgcataactaggcttccg

SEQ ID NO: 571537 - DNA, 25 bp, Rattus norvegicus
tattggccgcattactaggcttccg

SEQ ID NO: 571538 - DNA, 25 bp, Rattus norvegicus
tattggcggcagcacgttcaagaca

SEQ ID NO: 571539 - DNA, 25 bp, Rattus norvegicus
tattggcggcaggacgttcaagaca

SEQ ID NO: 571540 - DNA, 25 bp, Rattus norvegicus
tattggcggccaagacaacatttcc

SEQ ID NO: 571541 - DNA, 25 bp, Rattus norvegicus
tattggcggccatgacaacatttcc

SEQ ID NO: 571542 - DNA, 25 bp, Rattus norvegicus
tattggcggcttagtgctttgtgaa

SEQ ID NO: 571543 - DNA, 25 bp, Rattus norvegicus
tattggcggctttgtgctttgtgaa

SEQ ID NO: 571544 - DNA, 25 bp, Rattus norvegicus
tattggctaacaaagccccttcctg

SEQ ID NO: 571545 - DNA, 25 bp, Rattus norvegicus
tattggctaacatagccccttcctg

SEQ ID NO: 571546 - DNA, 25 bp, Rattus norvegicus
tattggctagccatatgccagcctg

SEQ ID NO: 571547 - DNA, 25 bp, Rattus norvegicus
tattggctagccttatgccagcctg

SEQ ID NO: 571548 - DNA, 25 bp, Rattus norvegicus
tattggctcagtcctagctgggttc

SEQ ID NO: 571549 - DNA, 25 bp, Rattus norvegicus
tattggctcagtgctagctgggttc

SEQ ID NO: 571550 - DNA, 25 bp, Rattus norvegicus
tattggctccacaggcatcgttcta

SEQ ID NO: 571551 - DNA, 25 bp, Rattus norvegicus
tattggctccactggcatcgttcta

SEQ ID NO: 571552 - DNA, 25 bp, Rattus norvegicus
tattggctccgtccacacagtaaat

SEQ ID NO: 571553 - DNA, 25 bp, Rattus norvegicus
tattggctccgtgcacacagtaaat

SEQ ID NO: 571554 - DNA, 25 bp, Rattus norvegicus
tattggctgccaaaatgtatttatt

SEQ ID NO: 571555 - DNA, 25 bp, Rattus norvegicus
tattggctgccacgacggtgtctaa

SEQ ID NO: 571556 - DNA, 25 bp, Rattus norvegicus
tattggctgccaggacggtgtctaa

SEQ ID NO: 571557 - DNA, 25 bp, Rattus norvegicus
tattggctgccataatgtatttatt

SEQ ID NO: 571558 - DNA, 25 bp, Rattus norvegicus
tattggctgctgcttacgtttgtgt

SEQ ID NO: 571559 - DNA, 25 bp, Rattus norvegicus
tattggctgctggttacgtttgtgt

SEQ ID NO: 571560 - DNA, 25 bp, Rattus norvegicus
tattggctggacctgtggttccata

SEQ ID NO: 571561 - DNA, 25 bp, Rattus norvegicus
tattggctggacgtgtggttccata

SEQ ID NO: 571562 - DNA, 25 bp, Rattus norvegicus
tattggctggctcgtatttcttttt

SEQ ID NO: 571563 - DNA, 25 bp, Rattus norvegicus
tattggctggctggtatttcttttt

SEQ ID NO: 571564 - DNA, 25 bp, Rattus norvegicus
tattggcttatccaactggtgagtt

SEQ ID NO: 571565 - DNA, 25 bp, Rattus norvegicus
tattggcttatcgaactggtgagtt

SEQ ID NO: 571566 - DNA, 25 bp, Rattus norvegicus
tattggcttctcctttatgctggat

SEQ ID NO: 571567 - DNA, 25 bp, Rattus norvegicus
tattggcttctcgtttatgctggat

SEQ ID NO: 571568 - DNA, 25 bp, Rattus norvegicus
tattggctttagatgtctgatgaca

SEQ ID NO: 571569 - DNA, 25 bp, Rattus norvegicus
tattggctttagttgtctgatgaca

SEQ ID NO: 571570 - DNA, 25 bp, Rattus norvegicus
tattggctttttactttgctagaac

SEQ ID NO: 571571 - DNA, 25 bp, Rattus norvegicus
tattggcttttttctttgctagaac

SEQ ID NO: 571572 - DNA, 25 bp, Rattus norvegicus
tattgggaactacttgttgaactta

SEQ ID NO: 571573 - DNA, 25 bp, Rattus norvegicus
tattgggaactagttgttgaactta

SEQ ID NO: 571574 - DNA, 25 bp, Rattus norvegicus
tattgggcacacaccttcacaacag

SEQ ID NO: 571575 - DNA, 25 bp, Rattus norvegicus
tattgggcacactccttcacaacag

SEQ ID NO: 571576 - DNA, 25 bp, Rattus norvegicus
tattgggcattgcatcgccacctac

SEQ ID NO: 571577 - DNA, 25 bp, Rattus norvegicus
tattgggcattggatcgccacctac

SEQ ID NO: 571578 - DNA, 25 bp, Rattus norvegicus
tattgggccctcatgaaggtttaag

SEQ ID NO: 571579 - DNA, 25 bp, Rattus norvegicus
tattgggccctcttgaaggtttaag

SEQ ID NO: 571580 - DNA, 25 bp, Rattus norvegicus
tattgggcggtcctctgagcttaac

SEQ ID NO: 571581 - DNA, 25 bp, Rattus norvegicus
tattgggcggtcgtctgagcttaac

SEQ ID NO: 571582 - DNA, 25 bp, Rattus norvegicus
tattgggctttaatcgttgctttgc

SEQ ID NO: 571583 - DNA, 25 bp, Rattus norvegicus
tattgggctttattcgttgctttgc

SEQ ID NO: 571584 - DNA, 25 bp, Rattus norvegicus
tattgggtacccagtcagagccctt

SEQ ID NO: 571585 - DNA, 25 bp, Rattus norvegicus
tattgggtaccctgtcagagccctt

SEQ ID NO: 571586 - DNA, 25 bp, Rattus norvegicus
tattgggtagacaagcatccctccc

SEQ ID NO: 571587 - DNA, 25 bp, Rattus norvegicus
tattgggtagactagcatccctccc

SEQ ID NO: 571588 - DNA, 25 bp, Rattus norvegicus
tattgggtcaaactgggctccttaa

SEQ ID NO: 571589 - DNA, 25 bp, Rattus norvegicus
tattgggtcaaagtgggctccttaa

SEQ ID NO: 571590 - DNA, 25 bp, Rattus norvegicus
tattggtaggctacttgtccattct

SEQ ID NO: 571591 - DNA, 25 bp, Rattus norvegicus
tattggtaggcttcttgtccattct

SEQ ID NO: 571592 - DNA, 25 bp, Rattus norvegicus
tattggtcacttacctttcacagaa

SEQ ID NO: 571593 - DNA, 25 bp, Rattus norvegicus
tattggtcactttcctttcacagaa

SEQ ID NO: 571594 - DNA, 25 bp, Rattus norvegicus
tattggtccgccagagtcttgagcc

SEQ ID NO: 571595 - DNA, 25 bp, Rattus norvegicus
tattggtccgcctgagtcttgagcc

SEQ ID NO: 571596 - DNA, 25 bp, Rattus norvegicus
tattggtcctttacccactgtttct

SEQ ID NO: 571597 - DNA, 25 bp, Rattus norvegicus
tattggtccttttcccactgtttct

SEQ ID NO: 571598 - DNA, 25 bp, Rattus norvegicus
tattggtctctgagattactctctc

SEQ ID NO: 571599 - DNA, 25 bp, Rattus norvegicus
tattggtctctgtgattactctctc

SEQ ID NO: 571600 - DNA, 25 bp, Rattus norvegicus
tattggtgcttcatcacttcgggac

SEQ ID NO: 571601 - DNA, 25 bp, Rattus norvegicus
tattggtgcttcttcacttcgggac

SEQ ID NO: 571602 - DNA, 25 bp, Rattus norvegicus
tattggtggttcactgtgcatttcc

SEQ ID NO: 571603 - DNA, 25 bp, Rattus norvegicus
tattggtggttctctgtgcatttcc

SEQ ID NO: 571604 - DNA, 25 bp, Rattus norvegicus
tattggtgtggtatgcgcatcagct

SEQ ID NO: 571605 - DNA, 25 bp, Rattus norvegicus
tattggtgtggtttgcgcatcagct

SEQ ID NO: 571606 - DNA, 25 bp, Rattus norvegicus
tattggtgtgtaacactcctcgtga

SEQ ID NO: 571607 - DNA, 25 bp, Rattus norvegicus
tattggtgtgtatcactcctcgtga

SEQ ID NO: 571608 - DNA, 25 bp, Rattus norvegicus
tattggttcagtaccaggaccctgc

SEQ ID NO: 571609 - DNA, 25 bp, Rattus norvegicus
tattggttcagttccaggaccctgc

SEQ ID NO: 571610 - DNA, 25 bp, Rattus norvegicus
tattggttctatctgaaactgttaa

SEQ ID NO: 571611 - DNA, 25 bp, Rattus norvegicus
tattggttctatgtgaaactgttaa

SEQ ID NO: 571612 - DNA, 25 bp, Rattus norvegicus
tattggttctttaggttgttgtaca

SEQ ID NO: 571613 - DNA, 25 bp, Rattus norvegicus
tattggttcttttggttgttgtaca

SEQ ID NO: 571614 - DNA, 25 bp, Rattus norvegicus
tattgtaagacgctgacttcccttt

SEQ ID NO: 571615 - DNA, 25 bp, Rattus norvegicus
tattgtaagacggtgacttcccttt

SEQ ID NO: 571616 - DNA, 25 bp, Rattus norvegicus
tattgtaatgcaaaccgtgagcccc

SEQ ID NO: 571617 - DNA, 25 bp, Rattus norvegicus
tattgtaatgcataccgtgagcccc

SEQ ID NO: 571618 - DNA, 25 bp, Rattus norvegicus
tattgtacaactcaaggctggtttc

SEQ ID NO: 571619 - DNA, 25 bp, Rattus norvegicus
tattgtacaactgaaggctggtttc

SEQ ID NO: 571620 - DNA, 25 bp, Rattus norvegicus
tattgtacagttatgcagatggagt

SEQ ID NO: 571621 - DNA, 25 bp, Rattus norvegicus
tattgtacagttttgcagatggagt

SEQ ID NO: 571622 - DNA, 25 bp, Rattus norvegicus
tattgtactccaagctgtccttgaa

SEQ ID NO: 571623 - DNA, 25 bp, Rattus norvegicus
tattgtactccatgctgtccttgaa

SEQ ID NO: 571624 - DNA, 25 bp, Rattus norvegicus
tattgtaggcctatttacctctcac

SEQ ID NO: 571625 - DNA, 25 bp, Rattus norvegicus
tattgtaggcctttttacctctcac

SEQ ID NO: 571626 - DNA, 25 bp, Rattus norvegicus
tattgtagtgagcttgtgccacccc

SEQ ID NO: 571627 - DNA, 25 bp, Rattus norvegicus
tattgtagtgaggttgtgccacccc

SEQ ID NO: 571628 - DNA, 25 bp, Rattus norvegicus
tattgtagttcacaacaatccatct

SEQ ID NO: 571629 - DNA, 25 bp, Rattus norvegicus
tattgtagttcagaacaatccatct

SEQ ID NO: 571630 - DNA, 25 bp, Rattus norvegicus
tattgtatacagattttgcacgcca

SEQ ID NO: 571631 - DNA, 25 bp, Rattus norvegicus
tattgtatacagtttttgcacgcca

SEQ ID NO: 571632 - DNA, 25 bp, Rattus norvegicus
tattgtatccctcattacctgcttc

SEQ ID NO: 571633 - DNA, 25 bp, Rattus norvegicus
tattgtatccctgattacctgcttc

SEQ ID NO: 571634 - DNA, 25 bp, Rattus norvegicus
tattgtattgctcctgtgcgtggaa

SEQ ID NO: 571635 - DNA, 25 bp, Rattus norvegicus
tattgtattgctgctgtgcgtggaa

SEQ ID NO: 571636 - DNA, 25 bp, Rattus norvegicus
tattgtatttctactcactgtgagg

SEQ ID NO: 571637 - DNA, 25 bp, Rattus norvegicus
tattgtatttcttctcactgtgagg

SEQ ID NO: 571638 - DNA, 25 bp, Rattus norvegicus
tattgtcaatgcagacttcccggaa

SEQ ID NO: 571639 - DNA, 25 bp, Rattus norvegicus
tattgtcaatgctgacttcccggaa

SEQ ID NO: 571640 - DNA, 25 bp, Rattus norvegicus
tattgtcacaccaagcttgtactaa

SEQ ID NO: 571641 - DNA, 25 bp, Rattus norvegicus
tattgtcacacctagcttgtactaa

SEQ ID NO: 571642 - DNA, 25 bp, Rattus norvegicus
tattgtcacagacgccaagcaggaa

SEQ ID NO: 571643 - DNA, 25 bp, Rattus norvegicus
tattgtcacagaggccaagcaggaa

SEQ ID NO: 571644 - DNA, 25 bp, Rattus norvegicus
tattgtcaccgccacaggccgaacg

SEQ ID NO: 571645 - DNA, 25 bp, Rattus norvegicus
tattgtcaccgcgacaggccgaacg

SEQ ID NO: 571646 - DNA, 25 bp, Rattus norvegicus
tattgtcagcctcgacaccgtgttg

SEQ ID NO: 571647 - DNA, 25 bp, Rattus norvegicus
tattgtcagcctggacaccgtgttg

SEQ ID NO: 571648 - DNA, 25 bp, Rattus norvegicus
tattgtcatgctaccttgcttctaa

SEQ ID NO: 571649 - DNA, 25 bp, Rattus norvegicus
tattgtcatgcttccttgcttctaa

SEQ ID NO: 571650 - DNA, 25 bp, Rattus norvegicus
tattgtcatgggagccactgtgcca

SEQ ID NO: 571651 - DNA, 25 bp, Rattus norvegicus
tattgtcatgggtgccactgtgcca

SEQ ID NO: 571652 - DNA, 25 bp, Rattus norvegicus
tattgtcattttataacactagttg

SEQ ID NO: 571653 - DNA, 25 bp, Rattus norvegicus
tattgtcattttttaacactagttg

SEQ ID NO: 571654 - DNA, 25 bp, Rattus norvegicus
tattgtcccaagaacgtgtaaagcc

SEQ ID NO: 571655 - DNA, 25 bp, Rattus norvegicus
tattgtcccaagtacgtgtaaagcc

SEQ ID NO: 571656 - DNA, 25 bp, Rattus norvegicus
tattgtcccatgcagcagaacccag

SEQ ID NO: 571657 - DNA, 25 bp, Rattus norvegicus
tattgtcccatggagcagaacccag

SEQ ID NO: 571658 - DNA, 25 bp, Rattus norvegicus
tattgtccccagcttgttctgagta

SEQ ID NO: 571659 - DNA, 25 bp, Rattus norvegicus
tattgtccccaggttgttctgagta

SEQ ID NO: 571660 - DNA, 25 bp, Rattus norvegicus
tattgtcccccaccatgtgaatatc

SEQ ID NO: 571661 - DNA, 25 bp, Rattus norvegicus
tattgtcccccagcatgtgaatatc

SEQ ID NO: 571662 - DNA, 25 bp, Rattus norvegicus
tattgtccgtcacatgcagagcagt

SEQ ID NO: 571663 - DNA, 25 bp, Rattus norvegicus
tattgtccgtcagatgcagagcagt

SEQ ID NO: 571664 - DNA, 25 bp, Rattus norvegicus
tattgtcctatgaagtggtgcctct

SEQ ID NO: 571665 - DNA, 25 bp, Rattus norvegicus
tattgtcctatgtagtggtgcctct

SEQ ID NO: 571666 - DNA, 25 bp, Rattus norvegicus
tattgtcgttacagcctttggaaga

SEQ ID NO: 571667 - DNA, 25 bp, Rattus norvegicus
tattgtcgttactgcctttggaaga

SEQ ID NO: 571668 - DNA, 25 bp, Rattus norvegicus
tattgtctatacatcctttctaaac

SEQ ID NO: 571669 - DNA, 25 bp, Rattus norvegicus
tattgtctatacttcctttctaaac

SEQ ID NO: 571670 - DNA, 25 bp, Rattus norvegicus
tattgtctatctcatgctgtcctaa

SEQ ID NO: 571671 - DNA, 25 bp, Rattus norvegicus
tattgtctatctgatgctgtcctaa

SEQ ID NO: 571672 - DNA, 25 bp, Rattus norvegicus
tattgtctatgcactaggcgcctgg

SEQ ID NO: 571673 - DNA, 25 bp, Rattus norvegicus
tattgtctatgctctaggcgcctgg

SEQ ID NO: 571674 - DNA, 25 bp, Rattus norvegicus
tattgtctattgagaggaggctact

SEQ ID NO: 571675 - DNA, 25 bp, Rattus norvegicus
tattgtctattgtgaggaggctact

SEQ ID NO: 571676 - DNA, 25 bp, Rattus norvegicus
tattgtctcattaatttgcccttcc

SEQ ID NO: 571677 - DNA, 25 bp, Rattus norvegicus
tattgtctcatttatttgcccttcc

SEQ ID NO: 571678 - DNA, 25 bp, Rattus norvegicus
tattgtctcgtgatttctctgtatt

SEQ ID NO: 571679 - DNA, 25 bp, Rattus norvegicus
tattgtctcgtgttttctctgtatt

SEQ ID NO: 571680 - DNA, 25 bp, Rattus norvegicus
tattgtctcttaaacagccactcct

SEQ ID NO: 571681 - DNA, 25 bp, Rattus norvegicus
tattgtctcttatacagccactcct

SEQ ID NO: 571682 - DNA, 25 bp, Rattus norvegicus
tattgtctgccacattttgcactgg

SEQ ID NO: 571683 - DNA, 25 bp, Rattus norvegicus
tattgtctgccagattttgcactgg

SEQ ID NO: 571684 - DNA, 25 bp, Rattus norvegicus
tattgtctgcgtctgggctatgttc

SEQ ID NO: 571685 - DNA, 25 bp, Rattus norvegicus
tattgtctgcgtgtgggctatgttc

SEQ ID NO: 571686 - DNA, 25 bp, Rattus norvegicus
tattgtcttgtccagtaatagcctg

SEQ ID NO: 571687 - DNA, 25 bp, Rattus norvegicus
tattgtcttgtcgagtaatagcctg

SEQ ID NO: 571688 - DNA, 25 bp, Rattus norvegicus
tattgtcttgttcactttataccca

SEQ ID NO: 571689 - DNA, 25 bp, Rattus norvegicus
tattgtcttgttgactttataccca

SEQ ID NO: 571690 - DNA, 25 bp, Rattus norvegicus
tattgtctttctaatcccagggcat

SEQ ID NO: 571691 - DNA, 25 bp, Rattus norvegicus
tattgtctttcttatcccagggcat

SEQ ID NO: 571692 - DNA, 25 bp, Rattus norvegicus
tattgtctttgcattctgggtataa

SEQ ID NO: 571693 - DNA, 25 bp, Rattus norvegicus
tattgtctttgctttctgggtataa

SEQ ID NO: 571694 - DNA, 25 bp, Rattus norvegicus
tattgtcttttgaatcttggaaatt

SEQ ID NO: 571695 - DNA, 25 bp, Rattus norvegicus
tattgtcttttgtatcttggaaatt

SEQ ID NO: 571696 - DNA, 25 bp, Rattus norvegicus
tattgtgaaaaaccgcctcttccca

SEQ ID NO: 571697 - DNA, 25 bp, Rattus norvegicus
tattgtgaaaaagcgcctcttccca

SEQ ID NO: 571698 - DNA, 25 bp, Rattus norvegicus
tattgtgacaccctcttaaccattt

SEQ ID NO: 571699 - DNA, 25 bp, Rattus norvegicus
tattgtgacaccgtcttaaccattt

SEQ ID NO: 571700 - DNA, 25 bp, Rattus norvegicus
tattgtgaccacaccttttcataaa

SEQ ID NO: 571701 - DNA, 25 bp, Rattus norvegicus
tattgtgaccactccttttcataaa

SEQ ID NO: 571702 - DNA, 25 bp, Rattus norvegicus
tattgtgacttcacagagtatggga

SEQ ID NO: 571703 - DNA, 25 bp, Rattus norvegicus
tattgtgacttctcagagtatggga

SEQ ID NO: 571704 - DNA, 25 bp, Rattus norvegicus
tattgtgactttacaactgttctga

SEQ ID NO: 571705 - DNA, 25 bp, Rattus norvegicus
tattgtgacttttcaactgttctga

SEQ ID NO: 571706 - DNA, 25 bp, Rattus norvegicus
tattgtgagagtcctttagcctgcc

SEQ ID NO: 571707 - DNA, 25 bp, Rattus norvegicus
tattgtgagagtgctttagcctgcc

SEQ ID NO: 571708 - DNA, 25 bp, Rattus norvegicus
tattgtgagctcaaaggcatcctgc

SEQ ID NO: 571709 - DNA, 25 bp, Rattus norvegicus
tattgtgagctctaaggcatcctgc

SEQ ID NO: 571710 - DNA, 25 bp, Rattus norvegicus
tattgtgatgccatggtcagggccc

SEQ ID NO: 571711 - DNA, 25 bp, Rattus norvegicus
tattgtgatgccttggtcagggccc

SEQ ID NO: 571712 - DNA, 25 bp, Rattus norvegicus
tattgtgatggcctgacactgccac

SEQ ID NO: 571713 - DNA, 25 bp, Rattus norvegicus
tattgtgatggcgtgacactgccac

SEQ ID NO: 571714 - DNA, 25 bp, Rattus norvegicus
tattgtgatgtgaaagacagtttcc

SEQ ID NO: 571715 - DNA, 25 bp, Rattus norvegicus
tattgtgatgtgtaagacagtttcc

SEQ ID NO: 571716 - DNA, 25 bp, Rattus norvegicus
tattgtgccttcatgggtcctgcca

SEQ ID NO: 571717 - DNA, 25 bp, Rattus norvegicus
tattgtgccttcttgggtcctgcca

SEQ ID NO: 571718 - DNA, 25 bp, Rattus norvegicus
tattgtgctaaaagccctgctatgc

SEQ ID NO: 571719 - DNA, 25 bp, Rattus norvegicus
tattgtgctaaatgccctgctatgc

SEQ ID NO: 571720 - DNA, 25 bp, Rattus norvegicus
tattgtgctcttaatctgtgaatgg

SEQ ID NO: 571721 - DNA, 25 bp, Rattus norvegicus
tattgtgctctttatctgtgaatgg

SEQ ID NO: 571722 - DNA, 25 bp, Rattus norvegicus
tattgtgctgttagcccagagcagc

SEQ ID NO: 571723 - DNA, 25 bp, Rattus norvegicus
tattgtgctgtttgcccagagcagc

SEQ ID NO: 571724 - DNA, 25 bp, Rattus norvegicus
tattgtgcttttagttcagttctaa

SEQ ID NO: 571725 - DNA, 25 bp, Rattus norvegicus
tattgtgctttttgttcagttctaa

SEQ ID NO: 571726 - DNA, 25 bp, Rattus norvegicus
tattgtggacccattcatagactac

SEQ ID NO: 571727 - DNA, 25 bp, Rattus norvegicus
tattgtggaccctttcatagactac

SEQ ID NO: 571728 - DNA, 25 bp, Rattus norvegicus
tattgtggagctaccctggagcagc

SEQ ID NO: 571729 - DNA, 25 bp, Rattus norvegicus
tattgtggagcttccctggagcagc

SEQ ID NO: 571730 - DNA, 25 bp, Rattus norvegicus
tattgtggctatcttggtctacgtg

SEQ ID NO: 571731 - DNA, 25 bp, Rattus norvegicus
tattgtggctatgttggtctacgtg

SEQ ID NO: 571732 - DNA, 25 bp, Rattus norvegicus
tattgtggctgcacttgccctaaaa

SEQ ID NO: 571733 - DNA, 25 bp, Rattus norvegicus
tattgtggctgctcttgccctaaaa

SEQ ID NO: 571734 - DNA, 25 bp, Rattus norvegicus
tattgtggctggcttacagctcaga

SEQ ID NO: 571735 - DNA, 25 bp, Rattus norvegicus
tattgtggctgggttacagctcaga

SEQ ID NO: 571736 - DNA, 25 bp, Rattus norvegicus
tattgtggctttcaaagtctgtact

SEQ ID NO: 571737 - DNA, 25 bp, Rattus norvegicus
tattgtggctttgaaagtctgtact

SEQ ID NO: 571738 - DNA, 25 bp, Rattus norvegicus
tattgtgggcatagtgctctttaaa

SEQ ID NO: 571739 - DNA, 25 bp, Rattus norvegicus
tattgtgggcattgtgctctttaaa

SEQ ID NO: 571740 - DNA, 25 bp, Rattus norvegicus
tattgtgggccactgtgccaacaac

SEQ ID NO: 571741 - DNA, 25 bp, Rattus norvegicus
tattgtgggccagtgtgccaacaac

SEQ ID NO: 571742 - DNA, 25 bp, Rattus norvegicus
tattgtggtctccagtttgctgtga

SEQ ID NO: 571743 - DNA, 25 bp, Rattus norvegicus
tattgtggtctcgagtttgctgtga

SEQ ID NO: 571744 - DNA, 25 bp, Rattus norvegicus
tattgtggtgtcatggctgagccgt

SEQ ID NO: 571745 - DNA, 25 bp, Rattus norvegicus
tattgtggtgtcttggctgagccgt

SEQ ID NO: 571746 - DNA, 25 bp, Rattus norvegicus
tattgtggtttacaggttgagctct

SEQ ID NO: 571747 - DNA, 25 bp, Rattus norvegicus
tattgtggtttactcgttcatgccc

SEQ ID NO: 571748 - DNA, 25 bp, Rattus norvegicus
tattgtggtttagaggttgagctct

SEQ ID NO: 571749 - DNA, 25 bp, Rattus norvegicus
tattgtggtttagtcgttcatgccc

SEQ ID NO: 571750 - DNA, 25 bp, Rattus norvegicus
tattgtgtacagattgccactgggt

SEQ ID NO: 571751 - DNA, 25 bp, Rattus norvegicus
tattgtgtacagtttgccactgggt

SEQ ID NO: 571752 - DNA, 25 bp, Rattus norvegicus
tattgtgtagccactctccccagag

SEQ ID NO: 571753 - DNA, 25 bp, Rattus norvegicus
tattgtgtagcctctctccccagag

SEQ ID NO: 571754 - DNA, 25 bp, Rattus norvegicus
tattgtgtccccagtgtccaagtca

SEQ ID NO: 571755 - DNA, 25 bp, Rattus norvegicus
tattgtgtcccctgtgtccaagtca

SEQ ID NO: 571756 - DNA, 25 bp, Rattus norvegicus
tattgtgtctgtccattatcgtctg

SEQ ID NO: 571757 - DNA, 25 bp, Rattus norvegicus
tattgtgtctgtgcattatcgtctg

SEQ ID NO: 571758 - DNA, 25 bp, Rattus norvegicus
tattgtgtgcttagataccatctgg

SEQ ID NO: 571759 - DNA, 25 bp, Rattus norvegicus
tattgtgtgctttgataccatctgg

SEQ ID NO: 571760 - DNA, 25 bp, Rattus norvegicus
tattgtgtggttagtgggcaactcc

SEQ ID NO: 571761 - DNA, 25 bp, Rattus norvegicus
tattgtgtggtttgtgggcaactcc

SEQ ID NO: 571762 - DNA, 25 bp, Rattus norvegicus
tattgtgttgcaccttctgctgatt

SEQ ID NO: 571763 - DNA, 25 bp, Rattus norvegicus
tattgtgttgcagcttctgctgatt

SEQ ID NO: 571764 - DNA, 25 bp, Rattus norvegicus
tattgtgtttgactccttgagcgca

SEQ ID NO: 571765 - DNA, 25 bp, Rattus norvegicus
tattgtgtttgagtccttgagcgca

SEQ ID NO: 571766 - DNA, 25 bp, Rattus norvegicus
tattgtgtttgcctgcctctagaat

SEQ ID NO: 571767 - DNA, 25 bp, Rattus norvegicus
tattgtgtttgcgtgcctctagaat

SEQ ID NO: 571768 - DNA, 25 bp, Rattus norvegicus
tattgttacccaatatactttagga

SEQ ID NO: 571769 - DNA, 25 bp, Rattus norvegicus
tattgttacccattatactttagga

SEQ ID NO: 571770 - DNA, 25 bp, Rattus norvegicus
tattgttacctgacctgcagagcta

SEQ ID NO: 571771 - DNA, 25 bp, Rattus norvegicus
tattgttacctgtcctgcagagcta

SEQ ID NO: 571772 - DNA, 25 bp, Rattus norvegicus
tattgttacttgaagcggcctgttg

SEQ ID NO: 571773 - DNA, 25 bp, Rattus norvegicus
tattgttacttgtagcggcctgttg

SEQ ID NO: 571774 - DNA, 25 bp, Rattus norvegicus
tattgttcccaaaggtgttcagccc

SEQ ID NO: 571775 - DNA, 25 bp, Rattus norvegicus
tattgttcccaatggtgttcagccc

SEQ ID NO: 571776 - DNA, 25 bp, Rattus norvegicus
tattgttccctcaggtattgtgcac

SEQ ID NO: 571777 - DNA, 25 bp, Rattus norvegicus
tattgttccctctggtattgtgcac

SEQ ID NO: 571778 - DNA, 25 bp, Rattus norvegicus
tattgttcgttaattctctatgctg

SEQ ID NO: 571779 - DNA, 25 bp, Rattus norvegicus
tattgttcgttatttctctatgctg

SEQ ID NO: 571780 - DNA, 25 bp, Rattus norvegicus
tattgttctcctcccatttctggaa

SEQ ID NO: 571781 - DNA, 25 bp, Rattus norvegicus
tattgttctcctgccatttctggaa

SEQ ID NO: 571782 - DNA, 25 bp, Rattus norvegicus
tattgttcttacagacagcctgggt

SEQ ID NO: 571783 - DNA, 25 bp, Rattus norvegicus
tattgttcttactgacagcctgggt

SEQ ID NO: 571784 - DNA, 25 bp, Rattus norvegicus
tattgttcttctatattcccaccta

SEQ ID NO: 571785 - DNA, 25 bp, Rattus norvegicus
tattgttcttctttattcccaccta

SEQ ID NO: 571786 - DNA, 25 bp, Rattus norvegicus
tattgttgagatccgttctgtccgt

SEQ ID NO: 571787 - DNA, 25 bp, Rattus norvegicus
tattgttgagatgcgttctgtccgt

SEQ ID NO: 571788 - DNA, 25 bp, Rattus norvegicus
tattgttgagtgaccacgccccttt

SEQ ID NO: 571789 - DNA, 25 bp, Rattus norvegicus
tattgttgagtgtccacgccccttt

SEQ ID NO: 571790 - DNA, 25 bp, Rattus norvegicus
tattgttggaacactgggcctcagt

SEQ ID NO: 571791 - DNA, 25 bp, Rattus norvegicus
tattgttggaactctgggcctcagt

SEQ ID NO: 571792 - DNA, 25 bp, Rattus norvegicus
tattgttgggatctaggcttcctcg

SEQ ID NO: 571793 - DNA, 25 bp, Rattus norvegicus
tattgttgggatgtaggcttcctcg

SEQ ID NO: 571794 - DNA, 25 bp, Rattus norvegicus
tattgttgggtacttgtgctaggca

SEQ ID NO: 571795 - DNA, 25 bp, Rattus norvegicus
tattgttgggtagttgtgctaggca

SEQ ID NO: 571796 - DNA, 25 bp, Rattus norvegicus
tattgttggtgcattcattgtggac

SEQ ID NO: 571797 - DNA, 25 bp, Rattus norvegicus
tattgttggtgctttcattgtggac

SEQ ID NO: 571798 - DNA, 25 bp, Rattus norvegicus
tattgttgtgtgaattctcttgtat

SEQ ID NO: 571799 - DNA, 25 bp, Rattus norvegicus
tattgttgtgtgtattctcttgtat

SEQ ID NO: 571800 - DNA, 25 bp, Rattus norvegicus
tattgtttgctactgctctcatgct

SEQ ID NO: 571801 - DNA, 25 bp, Rattus norvegicus
tattgtttgctagtgctctcatgct

SEQ ID NO: 571802 - DNA, 25 bp, Rattus norvegicus
tattgttttgccaacttcctgaagt

SEQ ID NO: 571803 - DNA, 25 bp, Rattus norvegicus
tattgttttgcctacttcctgaagt

SEQ ID NO: 571804 - DNA, 25 bp, Rattus norvegicus
tattgtttttccagagaggctttct

SEQ ID NO: 571805 - DNA, 25 bp, Rattus norvegicus
tattgtttttcctgagaggctttct

SEQ ID NO: 571806 - DNA, 25 bp, Rattus norvegicus
tatttaaaacatcgccccttttgtg

SEQ ID NO: 571807 - DNA, 25 bp, Rattus norvegicus
tatttaaaacatggccccttttgtg

SEQ ID NO: 571808 - DNA, 25 bp, Rattus norvegicus
tatttaaaaccccatctccaatcat

SEQ ID NO: 571809 - DNA, 25 bp, Rattus norvegicus
tatttaaaacccgatctccaatcat

SEQ ID NO: 571810 - DNA, 25 bp, Rattus norvegicus
tatttaaaacctacactgctgtctg

SEQ ID NO: 571811 - DNA, 25 bp, Rattus norvegicus
tatttaaaaccttcactgctgtctg

SEQ ID NO: 571812 - DNA, 25 bp, Rattus norvegicus
tatttaaacttcacaccggagccct

SEQ ID NO: 571813 - DNA, 25 bp, Rattus norvegicus
tatttaaacttctcaccggagccct

SEQ ID NO: 571814 - DNA, 25 bp, Rattus norvegicus
tatttaaagcccctccagcttgaca

SEQ ID NO: 571815 - DNA, 25 bp, Rattus norvegicus
tatttaaagcccgtccagcttgaca

SEQ ID NO: 571816 - DNA, 25 bp, Rattus norvegicus
tatttaaatggccaattctgtaccc

SEQ ID NO: 571817 - DNA, 25 bp, Rattus norvegicus
tatttaaatggcgaattctgtaccc

SEQ ID NO: 571818 - DNA, 25 bp, Rattus norvegicus
tatttaagcaacacgaaagtgcctg

SEQ ID NO: 571819 - DNA, 25 bp, Rattus norvegicus
tatttaagcaactcgaaagtgcctg

SEQ ID NO: 571820 - DNA, 25 bp, Rattus norvegicus
tatttaagctcccaaaggtgtcctc

SEQ ID NO: 571821 - DNA, 25 bp, Rattus norvegicus
tatttaagctccgaaaggtgtcctc

SEQ ID NO: 571822 - DNA, 25 bp, Rattus norvegicus
tatttaataaatattgcctccaact

SEQ ID NO: 571823 - DNA, 25 bp, Rattus norvegicus
tatttaataaattttgcctccaact

SEQ ID NO: 571824 - DNA, 25 bp, Rattus norvegicus
tatttaatgtccacctaggtcccag

SEQ ID NO: 571825 - DNA, 25 bp, Rattus norvegicus
tatttaatgtcctcctaggtcccag

SEQ ID NO: 571826 - DNA, 25 bp, Rattus norvegicus
tatttacaaacgctctcgtggtccc

SEQ ID NO: 571827 - DNA, 25 bp, Rattus norvegicus
tatttacaaacggtctcgtggtccc

SEQ ID NO: 571828 - DNA, 25 bp, Rattus norvegicus
tatttacacttaactacctccttct

SEQ ID NO: 571829 - DNA, 25 bp, Rattus norvegicus
tatttacacttatctacctccttct

SEQ ID NO: 571830 - DNA, 25 bp, Rattus norvegicus
tatttacagccaccatagggattca

SEQ ID NO: 571831 - DNA, 25 bp, Rattus norvegicus
tatttacagccagcatagggattca

SEQ ID NO: 571832 - DNA, 25 bp, Rattus norvegicus
tatttacatccgaccttacaaccat

SEQ ID NO: 571833 - DNA, 25 bp, Rattus norvegicus
tatttacatccgtccttacaaccat

SEQ ID NO: 571834 - DNA, 25 bp, Rattus norvegicus
tatttacatgccatagcacacgctc

SEQ ID NO: 571835 - DNA, 25 bp, Rattus norvegicus
tatttacatgccttagcacacgctc

SEQ ID NO: 571836 - DNA, 25 bp, Rattus norvegicus
tatttaccctccatcagcgttctta

SEQ ID NO: 571837 - DNA, 25 bp, Rattus norvegicus
tatttaccctccttcagcgttctta

SEQ ID NO: 571838 - DNA, 25 bp, Rattus norvegicus
tatttacctgagcttgtcgtggaag

SEQ ID NO: 571839 - DNA, 25 bp, Rattus norvegicus
tatttacctgaggttgtcgtggaag

SEQ ID NO: 571840 - DNA, 25 bp, Rattus norvegicus
tatttacggtcaactcatctcttaa

SEQ ID NO: 571841 - DNA, 25 bp, Rattus norvegicus
tatttacggtcatctcatctcttaa

SEQ ID NO: 571842 - DNA, 25 bp, Rattus norvegicus
tatttactacatctgtgccattccc

SEQ ID NO: 571843 - DNA, 25 bp, Rattus norvegicus
tatttactacatgtgtgccattccc

SEQ ID NO: 571844 - DNA, 25 bp, Rattus norvegicus
tatttactaccactacaggacctct

SEQ ID NO: 571845 - DNA, 25 bp, Rattus norvegicus
tatttactaccagtacaggacctct

SEQ ID NO: 571846 - DNA, 25 bp, Rattus norvegicus
tatttactgctcattaccccggtaa

SEQ ID NO: 571847 - DNA, 25 bp, Rattus norvegicus
tatttactgctctttaccccggtaa

SEQ ID NO: 571848 - DNA, 25 bp, Rattus norvegicus
tatttacttcatatggctccgttgg

SEQ ID NO: 571849 - DNA, 25 bp, Rattus norvegicus
tatttacttcatttggctccgttgg

SEQ ID NO: 571850 - DNA, 25 bp, Rattus norvegicus
tatttacttccacgtttggagccag

SEQ ID NO: 571851 - DNA, 25 bp, Rattus norvegicus
tatttacttccaggtttggagccag

SEQ ID NO: 571852 - DNA, 25 bp, Rattus norvegicus
tatttacttcctacagcacagcttg

SEQ ID NO: 571853 - DNA, 25 bp, Rattus norvegicus
tatttacttccttcagcacagcttg

SEQ ID NO: 571854 - DNA, 25 bp, Rattus norvegicus
tatttacttgtactcgctggtttca

SEQ ID NO: 571855 - DNA, 25 bp, Rattus norvegicus
tatttacttgtagtcgctggtttca

SEQ ID NO: 571856 - DNA, 25 bp, Rattus norvegicus
tatttacttgtgcttccagagggta

SEQ ID NO: 571857 - DNA, 25 bp, Rattus norvegicus
tatttacttgtggttccagagggta

SEQ ID NO: 571858 - DNA, 25 bp, Rattus norvegicus
tatttacttgttactgttgctttaa

SEQ ID NO: 571859 - DNA, 25 bp, Rattus norvegicus
tatttacttgtttctgttgctttaa

SEQ ID NO: 571860 - DNA, 25 bp, Rattus norvegicus
tatttagaatctactcagggcagtt

SEQ ID NO: 571861 - DNA, 25 bp, Rattus norvegicus
tatttagaatcttctcagggcagtt

SEQ ID NO: 571862 - DNA, 25 bp, Rattus norvegicus
tatttagagaccattcgtgttcgaa

SEQ ID NO: 571863 - DNA, 25 bp, Rattus norvegicus
tatttagagacctttcgtgttcgaa

SEQ ID NO: 571864 - DNA, 25 bp, Rattus norvegicus
tatttagattttccgtaatccccag

SEQ ID NO: 571865 - DNA, 25 bp, Rattus norvegicus
tatttagattttgcgtaatccccag

SEQ ID NO: 571866 - DNA, 25 bp, Rattus norvegicus
tatttagccagccttcatgtagaag

SEQ ID NO: 571867 - DNA, 25 bp, Rattus norvegicus
tatttagccagcgttcatgtagaag

SEQ ID NO: 571868 - DNA, 25 bp, Rattus norvegicus
tatttagccattacccatgcaacac

SEQ ID NO: 571869 - DNA, 25 bp, Rattus norvegicus
tatttagccatttcccatgcaacac

SEQ ID NO: 571870 - DNA, 25 bp, Rattus norvegicus
tatttagcgaggcatgtgctcagtt

SEQ ID NO: 571871 - DNA, 25 bp, Rattus norvegicus
tatttagcgagggatgtgctcagtt

SEQ ID NO: 571872 - DNA, 25 bp, Rattus norvegicus
tatttagcttagacactgtcgcgct

SEQ ID NO: 571873 - DNA, 25 bp, Rattus norvegicus
tatttagcttagtcactgtcgcgct

SEQ ID NO: 571874 - DNA, 25 bp, Rattus norvegicus
tatttaggccaacctctgggacatg

SEQ ID NO: 571875 - DNA, 25 bp, Rattus norvegicus
tatttaggccaagctctgggacatg

SEQ ID NO: 571876 - DNA, 25 bp, Rattus norvegicus
tatttaggtgccatttctccagcaa

SEQ ID NO: 571877 - DNA, 25 bp, Rattus norvegicus
tatttaggtgccttttctccagcaa

SEQ ID NO: 571878 - DNA, 25 bp, Rattus norvegicus
tatttagtaacacagcagctcagaa

SEQ ID NO: 571879 - DNA, 25 bp, Rattus norvegicus
tatttagtaacagagcagctcagaa

SEQ ID NO: 571880 - DNA, 25 bp, Rattus norvegicus
tatttagtcagaccttctaggcagg

SEQ ID NO: 571881 - DNA, 25 bp, Rattus norvegicus
tatttagtcagagcttctaggcagg

SEQ ID NO: 571882 - DNA, 25 bp, Rattus norvegicus
tatttagttctacaccatcttgggt

SEQ ID NO: 571883 - DNA, 25 bp, Rattus norvegicus
tatttagttctagaccatcttgggt

SEQ ID NO: 571884 - DNA, 25 bp, Rattus norvegicus
tatttagtttgacctccgtaggtta

SEQ ID NO: 571885 - DNA, 25 bp, Rattus norvegicus
tatttagtttgagctccgtaggtta

SEQ ID NO: 571886 - DNA, 25 bp, Rattus norvegicus
tatttagtttgtaaggtactccttg

SEQ ID NO: 571887 - DNA, 25 bp, Rattus norvegicus
tatttagtttgttaggtactccttg

SEQ ID NO: 571888 - DNA, 25 bp, Rattus norvegicus
tatttataacctcagacttgggccc

SEQ ID NO: 571889 - DNA, 25 bp, Rattus norvegicus
tatttataacctgagacttgggccc

SEQ ID NO: 571890 - DNA, 25 bp, Rattus norvegicus
tatttataagccctctcggttgcta

SEQ ID NO: 571891 - DNA, 25 bp, Rattus norvegicus
tatttataagccgtctcggttgcta

SEQ ID NO: 571892 - DNA, 25 bp, Rattus norvegicus
tatttataatccaccttggcccgga

SEQ ID NO: 571893 - DNA, 25 bp, Rattus norvegicus
tatttataatcctccttggcccgga

SEQ ID NO: 571894 - DNA, 25 bp, Rattus norvegicus
tatttatactctacaagggatcgga

SEQ ID NO: 571895 - DNA, 25 bp, Rattus norvegicus
tatttatactcttcaagggatcgga

SEQ ID NO: 571896 - DNA, 25 bp, Rattus norvegicus
tatttatagtataccgtgaaaccaa

SEQ ID NO: 571897 - DNA, 25 bp, Rattus norvegicus
tatttatagtattccgtgaaaccaa

SEQ ID NO: 571898 - DNA, 25 bp, Rattus norvegicus
tatttatataatattaccacctagg

SEQ ID NO: 571899 - DNA, 25 bp, Rattus norvegicus
tatttatataattttaccacctagg

SEQ ID NO: 571900 - DNA, 25 bp, Rattus norvegicus
tatttatatcccaatgcccttcgca

SEQ ID NO: 571901 - DNA, 25 bp, Rattus norvegicus
tatttatatcccaccagtccctgct

SEQ ID NO: 571902 - DNA, 25 bp, Rattus norvegicus
tatttatatccctatgcccttcgca

SEQ ID NO: 571903 - DNA, 25 bp, Rattus norvegicus
tatttatatccctccagtccctgct

SEQ ID NO: 571904 - DNA, 25 bp, Rattus norvegicus
tatttatcagtgacctagcaaccag

SEQ ID NO: 571905 - DNA, 25 bp, Rattus norvegicus
tatttatcagtgtcctagcaaccag

SEQ ID NO: 571906 - DNA, 25 bp, Rattus norvegicus
tatttatccattaagctttgagctc

SEQ ID NO: 571907 - DNA, 25 bp, Rattus norvegicus
tatttatccatttagctttgagctc

SEQ ID NO: 571908 - DNA, 25 bp, Rattus norvegicus
tatttatcctttcctggtttcccat

SEQ ID NO: 571909 - DNA, 25 bp, Rattus norvegicus
tatttatcctttctttgcatctctg

SEQ ID NO: 571910 - DNA, 25 bp, Rattus norvegicus
tatttatcctttgctggtttcccat

SEQ ID NO: 571911 - DNA, 25 bp, Rattus norvegicus
tatttatcctttgtttgcatctctg

SEQ ID NO: 571912 - DNA, 25 bp, Rattus norvegicus
tatttatctcacagtgccctctctg

SEQ ID NO: 571913 - DNA, 25 bp, Rattus norvegicus
tatttatctcactgtgccctctctg

SEQ ID NO: 571914 - DNA, 25 bp, Rattus norvegicus
tatttatctctccttatttttcatg

SEQ ID NO: 571915 - DNA, 25 bp, Rattus norvegicus
tatttatctctcgttatttttcatg

SEQ ID NO: 571916 - DNA, 25 bp, Rattus norvegicus
tatttatctcttacgtctatctatg

SEQ ID NO: 571917 - DNA, 25 bp, Rattus norvegicus
tatttatctctttcgtctatctatg

SEQ ID NO: 571918 - DNA, 25 bp, Rattus norvegicus
tatttatgaagtcctcacgctccga

SEQ ID NO: 571919 - DNA, 25 bp, Rattus norvegicus
tatttatgaagtgctcacgctccga

SEQ ID NO: 571920 - DNA, 25 bp, Rattus norvegicus
tatttatgaccactgaccctgacca

SEQ ID NO: 571921 - DNA, 25 bp, Rattus norvegicus
tatttatgaccagtgaccctgacca

SEQ ID NO: 571922 - DNA, 25 bp, Rattus norvegicus
tatttatgagctcccttggccctgt

SEQ ID NO: 571923 - DNA, 25 bp, Rattus norvegicus
tatttatgagctgccttggccctgt

SEQ ID NO: 571924 - DNA, 25 bp, Rattus norvegicus
tatttatgctacagtaagccctttt

SEQ ID NO: 571925 - DNA, 25 bp, Rattus norvegicus
tatttatgctactgtaagccctttt

SEQ ID NO: 571926 - DNA, 25 bp, Rattus norvegicus
tatttatgcttgctgcacagacgat

SEQ ID NO: 571927 - DNA, 25 bp, Rattus norvegicus
tatttatgcttggtgcacagacgat

SEQ ID NO: 571928 - DNA, 25 bp, Rattus norvegicus
tatttatggagcaggcctgctactc

SEQ ID NO: 571929 - DNA, 25 bp, Rattus norvegicus
tatttatggagctggcctgctactc

SEQ ID NO: 571930 - DNA, 25 bp, Rattus norvegicus
tatttatggcttacgcacctcaact

SEQ ID NO: 571931 - DNA, 25 bp, Rattus norvegicus
tatttatggctttcgcacctcaact

SEQ ID NO: 571932 - DNA, 25 bp, Rattus norvegicus
tatttatggtccagctgtgaaacgc

SEQ ID NO: 571933 - DNA, 25 bp, Rattus norvegicus
tatttatggtcctgctgtgaaacgc

SEQ ID NO: 571934 - DNA, 25 bp, Rattus norvegicus
tatttatgttcccagcacagagcaa

SEQ ID NO: 571935 - DNA, 25 bp, Rattus norvegicus
tatttatgttccgagcacagagcaa

SEQ ID NO: 571936 - DNA, 25 bp, Rattus norvegicus
tatttattcaccatctgtgcctcaa

SEQ ID NO: 571937 - DNA, 25 bp, Rattus norvegicus
tatttattcaccttctgtgcctcaa

SEQ ID NO: 571938 - DNA, 25 bp, Rattus norvegicus
tatttattcattcttgttttgttca

SEQ ID NO: 571939 - DNA, 25 bp, Rattus norvegicus
tatttattcattgttgttttgttca

SEQ ID NO: 571940 - DNA, 25 bp, Rattus norvegicus
tatttattcttcagttgggtttttg

SEQ ID NO: 571941 - DNA, 25 bp, Rattus norvegicus
tatttattcttctgttgggtttttg

SEQ ID NO: 571942 - DNA, 25 bp, Rattus norvegicus
tatttattgactctcccgagggcct

SEQ ID NO: 571943 - DNA, 25 bp, Rattus norvegicus
tatttattgactgtcccgagggcct

SEQ ID NO: 571944 - DNA, 25 bp, Rattus norvegicus
tatttattgctcacctcaggaaaat

SEQ ID NO: 571945 - DNA, 25 bp, Rattus norvegicus
tatttattgctctcctcaggaaaat

SEQ ID NO: 571946 - DNA, 25 bp, Rattus norvegicus
tatttattgcttacctcaggaaatg

SEQ ID NO: 571947 - DNA, 25 bp, Rattus norvegicus
tatttattgctttcctcaggaaatg

SEQ ID NO: 571948 - DNA, 25 bp, Rattus norvegicus
tatttattgtcactggctccttatt

SEQ ID NO: 571949 - DNA, 25 bp, Rattus norvegicus
tatttattgtcagtggctccttatt

SEQ ID NO: 571950 - DNA, 25 bp, Rattus norvegicus
tatttattgtggctcctcacgtgcc

SEQ ID NO: 571951 - DNA, 25 bp, Rattus norvegicus
tatttattgtgggtcctcacgtgcc

SEQ ID NO: 571952 - DNA, 25 bp, Rattus norvegicus
tatttatttaacattctgcccctcc

SEQ ID NO: 571953 - DNA, 25 bp, Rattus norvegicus
tatttatttaactttctgcccctcc

SEQ ID NO: 571954 - DNA, 25 bp, Rattus norvegicus
tatttatttacaaactgaagtccta

SEQ ID NO: 571955 - DNA, 25 bp, Rattus norvegicus
tatttatttacatactgaagtccta

SEQ ID NO: 571956 - DNA, 25 bp, Rattus norvegicus
tatttatttcttatccttcccattc

SEQ ID NO: 571957 - DNA, 25 bp, Rattus norvegicus
tatttatttcttttccttcccattc

SEQ ID NO: 571958 - DNA, 25 bp, Rattus norvegicus
tatttattttgtagttcggaaggag

SEQ ID NO: 571959 - DNA, 25 bp, Rattus norvegicus
tatttattttgttgttcggaaggag

SEQ ID NO: 571960 - DNA, 25 bp, Rattus norvegicus
tatttatttttcactgtacagtatt

SEQ ID NO: 571961 - DNA, 25 bp, Rattus norvegicus
tatttatttttctctgtacagtatt

SEQ ID NO: 571962 - DNA, 25 bp, Rattus norvegicus
tatttcaaaaccattgtccctcagt

SEQ ID NO: 571963 - DNA, 25 bp, Rattus norvegicus
tatttcaaaacctttgtccctcagt

SEQ ID NO: 571964 - DNA, 25 bp, Rattus norvegicus
tatttcaaagacacgcttctgcgta

SEQ ID NO: 571965 - DNA, 25 bp, Rattus norvegicus
tatttcaaagactcgcttctgcgta

SEQ ID NO: 571966 - DNA, 25 bp, Rattus norvegicus
tatttcaacccgcaatgacatattt

SEQ ID NO: 571967 - DNA, 25 bp, Rattus norvegicus
tatttcaacccggaatgacatattt

SEQ ID NO: 571968 - DNA, 25 bp, Rattus norvegicus
tatttcaagcagcatcacccaactg

SEQ ID NO: 571969 - DNA, 25 bp, Rattus norvegicus
tatttcaagcaggatcacccaactg

SEQ ID NO: 571970 - DNA, 25 bp, Rattus norvegicus
tatttcaagttgagcctgctggttc

SEQ ID NO: 571971 - DNA, 25 bp, Rattus norvegicus
tatttcaagttgtgcctgctggttc

SEQ ID NO: 571972 - DNA, 25 bp, Rattus norvegicus
tatttcacacacactgttggtcaca

SEQ ID NO: 571973 - DNA, 25 bp, Rattus norvegicus
tatttcacacactctgttggtcaca

SEQ ID NO: 571974 - DNA, 25 bp, Rattus norvegicus
tatttcacaggcatcttaacatttt

SEQ ID NO: 571975 - DNA, 25 bp, Rattus norvegicus
tatttcacaggcttcttaacatttt

SEQ ID NO: 571976 - DNA, 25 bp, Rattus norvegicus
tatttcacaggtccagaggaaccct

SEQ ID NO: 571977 - DNA, 25 bp, Rattus norvegicus
tatttcacaggtgcagaggaaccct

SEQ ID NO: 571978 - DNA, 25 bp, Rattus norvegicus
tatttcaccgagatgcttagctgcc

SEQ ID NO: 571979 - DNA, 25 bp, Rattus norvegicus
tatttcaccgagttgcttagctgcc

SEQ ID NO: 571980 - DNA, 25 bp, Rattus norvegicus
tatttcaccggcactcaagtacagt

SEQ ID NO: 571981 - DNA, 25 bp, Rattus norvegicus
tatttcaccggctctcaagtacagt

SEQ ID NO: 571982 - DNA, 25 bp, Rattus norvegicus
tatttcacctcacggatctgtctgt

SEQ ID NO: 571983 - DNA, 25 bp, Rattus norvegicus
tatttcacctcagggatctgtctgt

SEQ ID NO: 571984 - DNA, 25 bp, Rattus norvegicus
tatttcaccttaacacccaacagat

SEQ ID NO: 571985 - DNA, 25 bp, Rattus norvegicus
tatttcaccttatcacccaacagat

SEQ ID NO: 571986 - DNA, 25 bp, Rattus norvegicus
tatttcactcttaatttgggtccca

SEQ ID NO: 571987 - DNA, 25 bp, Rattus norvegicus
tatttcactctttatttgggtccca

SEQ ID NO: 571988 - DNA, 25 bp, Rattus norvegicus
tatttcagacacattccggtttttc

SEQ ID NO: 571989 - DNA, 25 bp, Rattus norvegicus
tatttcagacactttccggtttttc

SEQ ID NO: 571990 - DNA, 25 bp, Rattus norvegicus
tatttcagaccaatcaggcctacgt

SEQ ID NO: 571991 - DNA, 25 bp, Rattus norvegicus
tatttcagaccattcaggcctacgt

SEQ ID NO: 571992 - DNA, 25 bp, Rattus norvegicus
tatttcagggccctttgacaattaa

SEQ ID NO: 571993 - DNA, 25 bp, Rattus norvegicus
tatttcagggccgtttgacaattaa

SEQ ID NO: 571994 - DNA, 25 bp, Rattus norvegicus
tatttcataacgaccacctgtcaca

SEQ ID NO: 571995 - DNA, 25 bp, Rattus norvegicus
tatttcataacgtccacctgtcaca

SEQ ID NO: 571996 - DNA, 25 bp, Rattus norvegicus
tatttcatatgtactagttggctaa

SEQ ID NO: 571997 - DNA, 25 bp, Rattus norvegicus
tatttcatatgttctagttggctaa

SEQ ID NO: 571998 - DNA, 25 bp, Rattus norvegicus
tatttcatattcagttcattcactg

SEQ ID NO: 571999 - DNA, 25 bp, Rattus norvegicus
tatttcatattctgttcattcactg

SEQ ID NO: 572000 - DNA, 25 bp, Rattus norvegicus
tatttcatccatatactgtagcaaa

SEQ ID NO: 572001 - DNA, 25 bp, Rattus norvegicus
tatttcatccatttactgtagcaaa

SEQ ID NO: 572002 - DNA, 25 bp, Rattus norvegicus
tatttcatccccagtatcggtttga

SEQ ID NO: 572003 - DNA, 25 bp, Rattus norvegicus
tatttcatcccctgtatcggtttga

SEQ ID NO: 572004 - DNA, 25 bp, Rattus norvegicus
tatttcatcccgctaagtccaaagg

SEQ ID NO: 572005 - DNA, 25 bp, Rattus norvegicus
tatttcatcccggtaagtccaaagg

SEQ ID NO: 572006 - DNA, 25 bp, Rattus norvegicus
tatttcatgattcccaaggtcccaa

SEQ ID NO: 572007 - DNA, 25 bp, Rattus norvegicus
tatttcatgattgccaaggtcccaa

SEQ ID NO: 572008 - DNA, 25 bp, Rattus norvegicus
tatttcatgtaactgggctggcctc

SEQ ID NO: 572009 - DNA, 25 bp, Rattus norvegicus
tatttcatgtaagtgggctggcctc

SEQ ID NO: 572010 - DNA, 25 bp, Rattus norvegicus
tatttcatgtcgctggagggcttgt

SEQ ID NO: 572011 - DNA, 25 bp, Rattus norvegicus
tatttcatgtcggtggagggcttgt

SEQ ID NO: 572012 - DNA, 25 bp, Rattus norvegicus
tatttcattcctattgtctcactga

SEQ ID NO: 572013 - DNA, 25 bp, Rattus norvegicus
tatttcattccttttgtctcactga

SEQ ID NO: 572014 - DNA, 25 bp, Rattus norvegicus
tatttcattggtaggctcgtgctca

SEQ ID NO: 572015 - DNA, 25 bp, Rattus norvegicus
tatttcattggttggctcgtgctca

SEQ ID NO: 572016 - DNA, 25 bp, Rattus norvegicus
tatttccaaagtcccgttgcccaga

SEQ ID NO: 572017 - DNA, 25 bp, Rattus norvegicus
tatttccaaagtgccgttgcccaga

SEQ ID NO: 572018 - DNA, 25 bp, Rattus norvegicus
tatttccaagtaagtgcgcctcctg

SEQ ID NO: 572019 - DNA, 25 bp, Rattus norvegicus
tatttccaagtatgtgcgcctcctg

SEQ ID NO: 572020 - DNA, 25 bp, Rattus norvegicus
tatttccactgaattctgcactggc

SEQ ID NO: 572021 - DNA, 25 bp, Rattus norvegicus
tatttccactgatttctgcactggc

SEQ ID NO: 572022 - DNA, 25 bp, Rattus norvegicus
tatttccagaaaaggcctttagcct

SEQ ID NO: 572023 - DNA, 25 bp, Rattus norvegicus
tatttccagaaatggcctttagcct

SEQ ID NO: 572024 - DNA, 25 bp, Rattus norvegicus
tatttccagcgcctttgcaatgatc

SEQ ID NO: 572025 - DNA, 25 bp, Rattus norvegicus
tatttccagcgcgtttgcaatgatc

SEQ ID NO: 572026 - DNA, 25 bp, Rattus norvegicus
tatttccagggaatatgcagatact

SEQ ID NO: 572027 - DNA, 25 bp, Rattus norvegicus
tatttccagggattatgcagatact

SEQ ID NO: 572028 - DNA, 25 bp, Rattus norvegicus
tatttccagggtaaccttcctgcca

SEQ ID NO: 572029 - DNA, 25 bp, Rattus norvegicus
tatttccagggttaccttcctgcca

SEQ ID NO: 572030 - DNA, 25 bp, Rattus norvegicus
tatttccaggtgatgccagctgaag

SEQ ID NO: 572031 - DNA, 25 bp, Rattus norvegicus
tatttccaggtgttgccagctgaag

SEQ ID NO: 572032 - DNA, 25 bp, Rattus norvegicus
tatttccagtttcttctccccaaat

SEQ ID NO: 572033 - DNA, 25 bp, Rattus norvegicus
tatttccagtttgttctccccaaat

SEQ ID NO: 572034 - DNA, 25 bp, Rattus norvegicus
tatttccatatgatttcactttaga

SEQ ID NO: 572035 - DNA, 25 bp, Rattus norvegicus
tatttccatatgttttcactttaga

SEQ ID NO: 572036 - DNA, 25 bp, Rattus norvegicus
tatttcccatatcttgcatgcactg

SEQ ID NO: 572037 - DNA, 25 bp, Rattus norvegicus
tatttcccatatgttgcatgcactg

SEQ ID NO: 572038 - DNA, 25 bp, Rattus norvegicus
tatttcccatttcctttttcgttca

SEQ ID NO: 572039 - DNA, 25 bp, Rattus norvegicus
tatttcccatttgctttttcgttca

SEQ ID NO: 572040 - DNA, 25 bp, Rattus norvegicus
tatttccccataacatgtgatgtta

SEQ ID NO: 572041 - DNA, 25 bp, Rattus norvegicus
tatttccccatatcatgtgatgtta

SEQ ID NO: 572042 - DNA, 25 bp, Rattus norvegicus
tatttcccctgcagtggcacagagg

SEQ ID NO: 572043 - DNA, 25 bp, Rattus norvegicus
tatttcccctgctgtggcacagagg

SEQ ID NO: 572044 - DNA, 25 bp, Rattus norvegicus
tatttccccttacagcaaccagggt

SEQ ID NO: 572045 - DNA, 25 bp, Rattus norvegicus
tatttccccttagagcaaccagggt

SEQ ID NO: 572046 - DNA, 25 bp, Rattus norvegicus
tatttccctagtcgcttccacacag

SEQ ID NO: 572047 - DNA, 25 bp, Rattus norvegicus
tatttccctagtggcttccacacag

SEQ ID NO: 572048 - DNA, 25 bp, Rattus norvegicus
tatttccctgaaactttacctctct

SEQ ID NO: 572049 - DNA, 25 bp, Rattus norvegicus
tatttccctgaatctttacctctct

SEQ ID NO: 572050 - DNA, 25 bp, Rattus norvegicus
tatttcccttctacgctgaatttta

SEQ ID NO: 572051 - DNA, 25 bp, Rattus norvegicus
tatttcccttcttcgctgaatttta

SEQ ID NO: 572052 - DNA, 25 bp, Rattus norvegicus
tatttccgctgcactacaccgggag

SEQ ID NO: 572053 - DNA, 25 bp, Rattus norvegicus
tatttccgctgctctacaccgggag

SEQ ID NO: 572054 - DNA, 25 bp, Rattus norvegicus
tatttccgtggtaagctttcagaga

SEQ ID NO: 572055 - DNA, 25 bp, Rattus norvegicus
tatttccgtggttagctttcagaga

SEQ ID NO: 572056 - DNA, 25 bp, Rattus norvegicus
tatttccgtttccaagacacttgga

SEQ ID NO: 572057 - DNA, 25 bp, Rattus norvegicus
tatttccgtttcgaagacacttgga

SEQ ID NO: 572058 - DNA, 25 bp, Rattus norvegicus
tatttcctaggcctggtgatgctga

SEQ ID NO: 572059 - DNA, 25 bp, Rattus norvegicus
tatttcctaggcgtggtgatgctga

SEQ ID NO: 572060 - DNA, 25 bp, Rattus norvegicus
tatttcctaggtagttatcaactgt

SEQ ID NO: 572061 - DNA, 25 bp, Rattus norvegicus
tatttcctaggttgttatcaactgt

SEQ ID NO: 572062 - DNA, 25 bp, Rattus norvegicus
tatttcctccaaactgtatctgtca

SEQ ID NO: 572063 - DNA, 25 bp, Rattus norvegicus
tatttcctccaatctgtatctgtca

SEQ ID NO: 572064 - DNA, 25 bp, Rattus norvegicus
tatttcctcccactttatctacagg

SEQ ID NO: 572065 - DNA, 25 bp, Rattus norvegicus
tatttcctcccagtttatctacagg

SEQ ID NO: 572066 - DNA, 25 bp, Rattus norvegicus
tatttcctcgagaaaaaatttggag

SEQ ID NO: 572067 - DNA, 25 bp, Rattus norvegicus
tatttcctcgagtaaaaatttggag

SEQ ID NO: 572068 - DNA, 25 bp, Rattus norvegicus
tatttcctgaatatgccacttaaag

SEQ ID NO: 572069 - DNA, 25 bp, Rattus norvegicus
tatttcctgaatttgccacttaaag

SEQ ID NO: 572070 - DNA, 25 bp, Rattus norvegicus
tatttcctgtcccattccgcttttt

SEQ ID NO: 572071 - DNA, 25 bp, Rattus norvegicus
tatttcctgtccgattccgcttttt

SEQ ID NO: 572072 - DNA, 25 bp, Rattus norvegicus
tatttcctgtctctgaattgcccgg

SEQ ID NO: 572073 - DNA, 25 bp, Rattus norvegicus
tatttcctgtctgtgaattgcccgg

SEQ ID NO: 572074 - DNA, 25 bp, Rattus norvegicus
tatttccttatgatttgttcttatt

SEQ ID NO: 572075 - DNA, 25 bp, Rattus norvegicus
tatttccttatgttttgttcttatt

SEQ ID NO: 572076 - DNA, 25 bp, Rattus norvegicus
tatttccttcttcgttcactacaca

SEQ ID NO: 572077 - DNA, 25 bp, Rattus norvegicus
tatttccttcttggttcactacaca

SEQ ID NO: 572078 - DNA, 25 bp, Rattus norvegicus
tatttccttgttattgctgatgctg

SEQ ID NO: 572079 - DNA, 25 bp, Rattus norvegicus
tatttccttgtttttgctgatgctg

SEQ ID NO: 572080 - DNA, 25 bp, Rattus norvegicus
tatttcctttggatgcttttcaaga

SEQ ID NO: 572081 - DNA, 25 bp, Rattus norvegicus
tatttcctttggttgcttttcaaga

SEQ ID NO: 572082 - DNA, 25 bp, Rattus norvegicus
tatttccttttacagaccctaagat

SEQ ID NO: 572083 - DNA, 25 bp, Rattus norvegicus
tatttccttttactttccttcacag

SEQ ID NO: 572084 - DNA, 25 bp, Rattus norvegicus
tatttccttttagagaccctaagat

SEQ ID NO: 572085 - DNA, 25 bp, Rattus norvegicus
tatttccttttagtttccttcacag

SEQ ID NO: 572086 - DNA, 25 bp, Rattus norvegicus
tatttcctttttcttgtcgttcatt

SEQ ID NO: 572087 - DNA, 25 bp, Rattus norvegicus
tatttcctttttgttgtcgttcatt

SEQ ID NO: 572088 - DNA, 25 bp, Rattus norvegicus
tatttcgatgtaagtggtcactaac

SEQ ID NO: 572089 - DNA, 25 bp, Rattus norvegicus
tatttcgatgtatgtggtcactaac

SEQ ID NO: 572090 - DNA, 25 bp, Rattus norvegicus
tatttcggcggccttcagttcttcc

SEQ ID NO: 572091 - DNA, 25 bp, Rattus norvegicus
tatttcggcggcgttcagttcttcc

SEQ ID NO: 572092 - DNA, 25 bp, Rattus norvegicus
tatttcgggttgacccaaggaagca

SEQ ID NO: 572093 - DNA, 25 bp, Rattus norvegicus
tatttcgggttgtcccaaggaagca

SEQ ID NO: 572094 - DNA, 25 bp, Rattus norvegicus
tatttcgtccccatcaatgaaccgt

SEQ ID NO: 572095 - DNA, 25 bp, Rattus norvegicus
tatttcgtccccttcaatgaaccgt

SEQ ID NO: 572096 - DNA, 25 bp, Rattus norvegicus
tatttcgtctgtactgagtctttgg

SEQ ID NO: 572097 - DNA, 25 bp, Rattus norvegicus
tatttcgtctgttctgagtctttgg

SEQ ID NO: 572098 - DNA, 25 bp, Rattus norvegicus
tatttctaaatcagcctgacccatc

SEQ ID NO: 572099 - DNA, 25 bp, Rattus norvegicus
tatttctaaatctgcctgacccatc

SEQ ID NO: 572100 - DNA, 25 bp, Rattus norvegicus
tatttctaagagatttgctgtccct

SEQ ID NO: 572101 - DNA, 25 bp, Rattus norvegicus
tatttctaagagttttgctgtccct

SEQ ID NO: 572102 - DNA, 25 bp, Rattus norvegicus
tatttctacatgctaatctctcggc

SEQ ID NO: 572103 - DNA, 25 bp, Rattus norvegicus
tatttctacatggtaatctctcggc

SEQ ID NO: 572104 - DNA, 25 bp, Rattus norvegicus
tatttctaccatctgagtttcaggg

SEQ ID NO: 572105 - DNA, 25 bp, Rattus norvegicus
tatttctaccatcttgtttctgctg

SEQ ID NO: 572106 - DNA, 25 bp, Rattus norvegicus
tatttctaccatgtgagtttcaggg

SEQ ID NO: 572107 - DNA, 25 bp, Rattus norvegicus
tatttctaccatgttgtttctgctg

SEQ ID NO: 572108 - DNA, 25 bp, Rattus norvegicus
tatttctagaatccagtttgcctgt

SEQ ID NO: 572109 - DNA, 25 bp, Rattus norvegicus
tatttctagaatgcagtttgcctgt

SEQ ID NO: 572110 - DNA, 25 bp, Rattus norvegicus
tatttctagccccatttcttggaga

SEQ ID NO: 572111 - DNA, 25 bp, Rattus norvegicus
tatttctagcccgatttcttggaga

SEQ ID NO: 572112 - DNA, 25 bp, Rattus norvegicus
tatttctaggcactctgatcccatc

SEQ ID NO: 572113 - DNA, 25 bp, Rattus norvegicus
tatttctaggcagtctgatcccatc

SEQ ID NO: 572114 - DNA, 25 bp, Rattus norvegicus
tatttctattatattgatttggcat

SEQ ID NO: 572115 - DNA, 25 bp, Rattus norvegicus
tatttctattattttgatttggcat

SEQ ID NO: 572116 - DNA, 25 bp, Rattus norvegicus
tatttctcaattattgccgaccgct

SEQ ID NO: 572117 - DNA, 25 bp, Rattus norvegicus
tatttctcaatttttgccgaccgct

SEQ ID NO: 572118 - DNA, 25 bp, Rattus norvegicus
tatttctcagccatagcaacctctc

SEQ ID NO: 572119 - DNA, 25 bp, Rattus norvegicus
tatttctcagccttagcaacctctc

SEQ ID NO: 572120 - DNA, 25 bp, Rattus norvegicus
tatttctccaaccaccaaagagcat

SEQ ID NO: 572121 - DNA, 25 bp, Rattus norvegicus
tatttctccaacgaccaaagagcat

SEQ ID NO: 572122 - DNA, 25 bp, Rattus norvegicus
tatttctccgacctggacctcgagc

SEQ ID NO: 572123 - DNA, 25 bp, Rattus norvegicus
tatttctccgacgtggacctcgagc

SEQ ID NO: 572124 - DNA, 25 bp, Rattus norvegicus
tatttctcctccactgtgtatcaag

SEQ ID NO: 572125 - DNA, 25 bp, Rattus norvegicus
tatttctcctcctctgtgtatcaag

SEQ ID NO: 572126 - DNA, 25 bp, Rattus norvegicus
tatttctctatacccaggctttgga

SEQ ID NO: 572127 - DNA, 25 bp, Rattus norvegicus
tatttctctatagccaggctttgga

SEQ ID NO: 572128 - DNA, 25 bp, Rattus norvegicus
tatttctctcccctgatttaatgtt

SEQ ID NO: 572129 - DNA, 25 bp, Rattus norvegicus
tatttctctcccgtgatttaatgtt

SEQ ID NO: 572130 - DNA, 25 bp, Rattus norvegicus
tatttctctctgatccaagtgtgtg

SEQ ID NO: 572131 - DNA, 25 bp, Rattus norvegicus
tatttctctctgttccaagtgtgtg

SEQ ID NO: 572132 - DNA, 25 bp, Rattus norvegicus
tatttctgactgaatgttccctctt

SEQ ID NO: 572133 - DNA, 25 bp, Rattus norvegicus
tatttctgactgtatgttccctctt

SEQ ID NO: 572134 - DNA, 25 bp, Rattus norvegicus
tatttctgcagaacaggtatctatc

SEQ ID NO: 572135 - DNA, 25 bp, Rattus norvegicus
tatttctgcagatcaggtatctatc

SEQ ID NO: 572136 - DNA, 25 bp, Rattus norvegicus
tatttctgcgttcacaagctcatga

SEQ ID NO: 572137 - DNA, 25 bp, Rattus norvegicus
tatttctgcgttgacaagctcatga

SEQ ID NO: 572138 - DNA, 25 bp, Rattus norvegicus
tatttctgcttcatttaggacctga

SEQ ID NO: 572139 - DNA, 25 bp, Rattus norvegicus
tatttctgcttcttttaggacctga

SEQ ID NO: 572140 - DNA, 25 bp, Rattus norvegicus
tatttctgggataaggccgtatcaa

SEQ ID NO: 572141 - DNA, 25 bp, Rattus norvegicus
tatttctgggattaggccgtatcaa

SEQ ID NO: 572142 - DNA, 25 bp, Rattus norvegicus
tatttctggtttcttgcaagatcag

SEQ ID NO: 572143 - DNA, 25 bp, Rattus norvegicus
tatttctggtttgttgcaagatcag

SEQ ID NO: 572144 - DNA, 25 bp, Rattus norvegicus
tatttctgtaagctctactacctcg

SEQ ID NO: 572145 - DNA, 25 bp, Rattus norvegicus
tatttctgtaaggtctactacctcg

SEQ ID NO: 572146 - DNA, 25 bp, Rattus norvegicus
tatttctgtcagatcctgtcttgcc

SEQ ID NO: 572147 - DNA, 25 bp, Rattus norvegicus
tatttctgtcagttcctgtcttgcc

SEQ ID NO: 572148 - DNA, 25 bp, Rattus norvegicus
tatttctgtctgacacacctttcca

SEQ ID NO: 572149 - DNA, 25 bp, Rattus norvegicus
tatttctgtctgtcacacctttcca

SEQ ID NO: 572150 - DNA, 25 bp, Rattus norvegicus
tatttcttatatcgccaaggatgat

SEQ ID NO: 572151 - DNA, 25 bp, Rattus norvegicus
tatttcttatatggccaaggatgat

SEQ ID NO: 572152 - DNA, 25 bp, Rattus norvegicus
tatttcttatttctggctgcctttc

SEQ ID NO: 572153 - DNA, 25 bp, Rattus norvegicus
tatttcttatttgtggctgcctttc

SEQ ID NO: 572154 - DNA, 25 bp, Rattus norvegicus
tatttcttcagtcacattgcattta

SEQ ID NO: 572155 - DNA, 25 bp, Rattus norvegicus
tatttcttcagtgacattgcattta

SEQ ID NO: 572156 - DNA, 25 bp, Rattus norvegicus
tatttcttccctcatgatccaccta

SEQ ID NO: 572157 - DNA, 25 bp, Rattus norvegicus
tatttcttccctgatgatccaccta

SEQ ID NO: 572158 - DNA, 25 bp, Rattus norvegicus
tatttcttctttcctctttgacgtt

SEQ ID NO: 572159 - DNA, 25 bp, Rattus norvegicus
tatttcttctttgctctttgacgtt

SEQ ID NO: 572160 - DNA, 25 bp, Rattus norvegicus
tatttcttgcaaaactcctctactc

SEQ ID NO: 572161 - DNA, 25 bp, Rattus norvegicus
tatttcttgcaatactcctctactc

SEQ ID NO: 572162 - DNA, 25 bp, Rattus norvegicus
tatttctttactacacaccacacca

SEQ ID NO: 572163 - DNA, 25 bp, Rattus norvegicus
tatttctttacttcacaccacacca

SEQ ID NO: 572164 - DNA, 25 bp, Rattus norvegicus
tatttctttcctacacttgcttaac

SEQ ID NO: 572165 - DNA, 25 bp, Rattus norvegicus
tatttctttccttcacttgcttaac

SEQ ID NO: 572166 - DNA, 25 bp, Rattus norvegicus
tatttctttcttaacacacatgcac

SEQ ID NO: 572167 - DNA, 25 bp, Rattus norvegicus
tatttctttctttacacacatgcac

SEQ ID NO: 572168 - DNA, 25 bp, Rattus norvegicus
tatttcttttatctccatctacctt

SEQ ID NO: 572169 - DNA, 25 bp, Rattus norvegicus
tatttcttttatgtccatctacctt

SEQ ID NO: 572170 - DNA, 25 bp, Rattus norvegicus
tatttcttttgaactttacaggaca

SEQ ID NO: 572171 - DNA, 25 bp, Rattus norvegicus
tatttcttttgaatggacttcctac

SEQ ID NO: 572172 - DNA, 25 bp, Rattus norvegicus
tatttcttttgatctttacaggaca

SEQ ID NO: 572173 - DNA, 25 bp, Rattus norvegicus
tatttcttttgattggacttcctac

SEQ ID NO: 572174 - DNA, 25 bp, Rattus norvegicus
tatttgaacaaccttacgggacttg

SEQ ID NO: 572175 - DNA, 25 bp, Rattus norvegicus
tatttgaacaacgttacgggacttg

SEQ ID NO: 572176 - DNA, 25 bp, Rattus norvegicus
tatttgaacagcaccacagactctt

SEQ ID NO: 572177 - DNA, 25 bp, Rattus norvegicus
tatttgaacagctccacagactctt

SEQ ID NO: 572178 - DNA, 25 bp, Rattus norvegicus
tatttgaacggcagttaccctttgt

SEQ ID NO: 572179 - DNA, 25 bp, Rattus norvegicus
tatttgaacggctgttaccctttgt

SEQ ID NO: 572180 - DNA, 25 bp, Rattus norvegicus
tatttgaacgttaagcagaaccctt

SEQ ID NO: 572181 - DNA, 25 bp, Rattus norvegicus
tatttgaacgtttagcagaaccctt

SEQ ID NO: 572182 - DNA, 25 bp, Rattus norvegicus
tatttgaatagcacttccttcctcc

SEQ ID NO: 572183 - DNA, 25 bp, Rattus norvegicus
tatttgaatagctcttccttcctcc

SEQ ID NO: 572184 - DNA, 25 bp, Rattus norvegicus
tatttgaatctgacacccacgtaca

SEQ ID NO: 572185 - DNA, 25 bp, Rattus norvegicus
tatttgaatctgtcacccacgtaca

SEQ ID NO: 572186 - DNA, 25 bp, Rattus norvegicus
tatttgacatcacaagatctggtga

SEQ ID NO: 572187 - DNA, 25 bp, Rattus norvegicus
tatttgacatcagaagatctggtga

SEQ ID NO: 572188 - DNA, 25 bp, Rattus norvegicus
tatttgaccagaatttactgaaaat

SEQ ID NO: 572189 - DNA, 25 bp, Rattus norvegicus
tatttgaccagattttactgaaaat

SEQ ID NO: 572190 - DNA, 25 bp, Rattus norvegicus
tatttgaccaggacctgtgcagtgc

SEQ ID NO: 572191 - DNA, 25 bp, Rattus norvegicus
tatttgaccaggtcctgtgcagtgc

SEQ ID NO: 572192 - DNA, 25 bp, Rattus norvegicus
tatttgaccggtctgtctgtcgcca

SEQ ID NO: 572193 - DNA, 25 bp, Rattus norvegicus
tatttgaccggtgtgtctgtcgcca

SEQ ID NO: 572194 - DNA, 25 bp, Rattus norvegicus
tatttgactctcctaggtttcgttt

SEQ ID NO: 572195 - DNA, 25 bp, Rattus norvegicus
tatttgactctcgtaggtttcgttt

SEQ ID NO: 572196 - DNA, 25 bp, Rattus norvegicus
tatttgagctgtattctagatacca

SEQ ID NO: 572197 - DNA, 25 bp, Rattus norvegicus
tatttgagctgttttctagatacca

SEQ ID NO: 572198 - DNA, 25 bp, Rattus norvegicus
tatttgagtagtaccctcccaggtg

SEQ ID NO: 572199 - DNA, 25 bp, Rattus norvegicus
tatttgagtagttccctcccaggtg

SEQ ID NO: 572200 - DNA, 25 bp, Rattus norvegicus
tatttgatcagtaacacccgcagca

SEQ ID NO: 572201 - DNA, 25 bp, Rattus norvegicus
tatttgatcagttacacccgcagca

SEQ ID NO: 572202 - DNA, 25 bp, Rattus norvegicus
tatttgattatgacctctcctagct

SEQ ID NO: 572203 - DNA, 25 bp, Rattus norvegicus
tatttgattatgtcctctcctagct

SEQ ID NO: 572204 - DNA, 25 bp, Rattus norvegicus
tatttgattgcaaagttgggccata

SEQ ID NO: 572205 - DNA, 25 bp, Rattus norvegicus
tatttgattgcatagttgggccata

SEQ ID NO: 572206 - DNA, 25 bp, Rattus norvegicus
tatttgcaagttatggagcccagtt

SEQ ID NO: 572207 - DNA, 25 bp, Rattus norvegicus
tatttgcaagttttggagcccagtt

SEQ ID NO: 572208 - DNA, 25 bp, Rattus norvegicus
tatttgcactgcactgattccttac

SEQ ID NO: 572209 - DNA, 25 bp, Rattus norvegicus
tatttgcactgctctgattccttac

SEQ ID NO: 572210 - DNA, 25 bp, Rattus norvegicus
tatttgcatggacagccctaggctt

SEQ ID NO: 572211 - DNA, 25 bp, Rattus norvegicus
tatttgcatggagagccctaggctt

SEQ ID NO: 572212 - DNA, 25 bp, Rattus norvegicus
tatttgcatgttagcgtgtgtgtgt

SEQ ID NO: 572213 - DNA, 25 bp, Rattus norvegicus
tatttgcatgtttgcgtgtgtgtgt

SEQ ID NO: 572214 - DNA, 25 bp, Rattus norvegicus
tatttgccaaacatacccttgcctt

SEQ ID NO: 572215 - DNA, 25 bp, Rattus norvegicus
tatttgccaaacttacccttgcctt

SEQ ID NO: 572216 - DNA, 25 bp, Rattus norvegicus
tatttgccaactcctggtcgcatga

SEQ ID NO: 572217 - DNA, 25 bp, Rattus norvegicus
tatttgccaactgctggtcgcatga

SEQ ID NO: 572218 - DNA, 25 bp, Rattus norvegicus
tatttgccatccactggactcggag

SEQ ID NO: 572219 - DNA, 25 bp, Rattus norvegicus
tatttgccatcctctggactcggag

SEQ ID NO: 572220 - DNA, 25 bp, Rattus norvegicus
tatttgccccgacgctggtccagga

SEQ ID NO: 572221 - DNA, 25 bp, Rattus norvegicus
tatttgccccgaggctggtccagga

SEQ ID NO: 572222 - DNA, 25 bp, Rattus norvegicus
tatttgcccggactgattctcaata

SEQ ID NO: 572223 - DNA, 25 bp, Rattus norvegicus
tatttgcccggagtgattctcaata

SEQ ID NO: 572224 - DNA, 25 bp, Rattus norvegicus
tatttgcccttcatcttgcttgcaa

SEQ ID NO: 572225 - DNA, 25 bp, Rattus norvegicus
tatttgcccttcttcttgcttgcaa

SEQ ID NO: 572226 - DNA, 25 bp, Rattus norvegicus
tatttgccctttcacctttaacttg

SEQ ID NO: 572227 - DNA, 25 bp, Rattus norvegicus
tatttgccctttgacctttaacttg

SEQ ID NO: 572228 - DNA, 25 bp, Rattus norvegicus
tatttgcctagtattgtatagtccc

SEQ ID NO: 572229 - DNA, 25 bp, Rattus norvegicus
tatttgcctagttttgtatagtccc

SEQ ID NO: 572230 - DNA, 25 bp, Rattus norvegicus
tatttgctaaggcttgcttcttcaa

SEQ ID NO: 572231 - DNA, 25 bp, Rattus norvegicus
tatttgctaagggttgcttcttcaa

SEQ ID NO: 572232 - DNA, 25 bp, Rattus norvegicus
tatttgctacttatgatttgggaac

SEQ ID NO: 572233 - DNA, 25 bp, Rattus norvegicus
tatttgctacttttgatttgggaac

SEQ ID NO: 572234 - DNA, 25 bp, Rattus norvegicus
tatttgctcaagcacaagcctggtc

SEQ ID NO: 572235 - DNA, 25 bp, Rattus norvegicus
tatttgctcaaggacaagcctggtc

SEQ ID NO: 572236 - DNA, 25 bp, Rattus norvegicus
tatttgctccctcctagaatcctta

SEQ ID NO: 572237 - DNA, 25 bp, Rattus norvegicus
tatttgctccctgctagaatcctta

SEQ ID NO: 572238 - DNA, 25 bp, Rattus norvegicus
tatttgctgccgagtgaccagagat

SEQ ID NO: 572239 - DNA, 25 bp, Rattus norvegicus
tatttgctgccgtgtgaccagagat

SEQ ID NO: 572240 - DNA, 25 bp, Rattus norvegicus
tatttgctgcttcggaggtggccaa

SEQ ID NO: 572241 - DNA, 25 bp, Rattus norvegicus
tatttgctgcttgggaggtggccaa

SEQ ID NO: 572242 - DNA, 25 bp, Rattus norvegicus
tatttgctgtatattttcctgtgtg

SEQ ID NO: 572243 - DNA, 25 bp, Rattus norvegicus
tatttgctgtattttttcctgtgtg

SEQ ID NO: 572244 - DNA, 25 bp, Rattus norvegicus
tatttgcttcttacttttccaccga

SEQ ID NO: 572245 - DNA, 25 bp, Rattus norvegicus
tatttgcttctttcttttccaccga

SEQ ID NO: 572246 - DNA, 25 bp, Rattus norvegicus
tatttgcttgagcagggcactctgt

SEQ ID NO: 572247 - DNA, 25 bp, Rattus norvegicus
tatttgcttgaggagggcactctgt

SEQ ID NO: 572248 - DNA, 25 bp, Rattus norvegicus
tatttgctttcacaaaccccgacgg

SEQ ID NO: 572249 - DNA, 25 bp, Rattus norvegicus
tatttgctttcagaaaccccgacgg

SEQ ID NO: 572250 - DNA, 25 bp, Rattus norvegicus
tatttgcttttacttctgccctgga

SEQ ID NO: 572251 - DNA, 25 bp, Rattus norvegicus
tatttgcttttagttctgccctgga

SEQ ID NO: 572252 - DNA, 25 bp, Rattus norvegicus
tatttggaaactctctgcctctcta

SEQ ID NO: 572253 - DNA, 25 bp, Rattus norvegicus
tatttggaaactgtctgcctctcta

SEQ ID NO: 572254 - DNA, 25 bp, Rattus norvegicus
tatttggacatacccatcacgcctc

SEQ ID NO: 572255 - DNA, 25 bp, Rattus norvegicus
tatttggacatagccatcacgcctc

SEQ ID NO: 572256 - DNA, 25 bp, Rattus norvegicus
tatttggactcacagtcgtctctgt

SEQ ID NO: 572257 - DNA, 25 bp, Rattus norvegicus
tatttggactcagagtcgtctctgt

SEQ ID NO: 572258 - DNA, 25 bp, Rattus norvegicus
tatttggatcatcccagtccaggta

SEQ ID NO: 572259 - DNA, 25 bp, Rattus norvegicus
tatttggatcatgccagtccaggta

SEQ ID NO: 572260 - DNA, 25 bp, Rattus norvegicus
tatttggcacgaacacctgaggatc

SEQ ID NO: 572261 - DNA, 25 bp, Rattus norvegicus
tatttggcacgatcacctgaggatc

SEQ ID NO: 572262 - DNA, 25 bp, Rattus norvegicus
tatttggcatgcaaaatcagcctgc

SEQ ID NO: 572263 - DNA, 25 bp, Rattus norvegicus
tatttggcatgctaaatcagcctgc

SEQ ID NO: 572264 - DNA, 25 bp, Rattus norvegicus
tatttggccaggaaagggtcaagat

SEQ ID NO: 572265 - DNA, 25 bp, Rattus norvegicus
tatttggccaggtaagggtcaagat

SEQ ID NO: 572266 - DNA, 25 bp, Rattus norvegicus
tatttggctcttcacatctgggcat

SEQ ID NO: 572267 - DNA, 25 bp, Rattus norvegicus
tatttggctcttgacatctgggcat

SEQ ID NO: 572268 - DNA, 25 bp, Rattus norvegicus
tatttggctgaccatcatcctgacg

SEQ ID NO: 572269 - DNA, 25 bp, Rattus norvegicus
tatttggctgacgatcatcctgacg

SEQ ID NO: 572270 - DNA, 25 bp, Rattus norvegicus
tatttggcttttactctacttcttt

SEQ ID NO: 572271 - DNA, 25 bp, Rattus norvegicus
tatttggcttttctgcacatactta

SEQ ID NO: 572272 - DNA, 25 bp, Rattus norvegicus
tatttggcttttgtgcacatactta

SEQ ID NO: 572273 - DNA, 25 bp, Rattus norvegicus
tatttggctttttctctacttcttt

SEQ ID NO: 572274 - DNA, 25 bp, Rattus norvegicus
tatttgggtcctatgggttcgcaat

SEQ ID NO: 572275 - DNA, 25 bp, Rattus norvegicus
tatttgggtcctttgggttcgcaat

SEQ ID NO: 572276 - DNA, 25 bp, Rattus norvegicus
tatttgggtctaacttgatcctgag

SEQ ID NO: 572277 - DNA, 25 bp, Rattus norvegicus
tatttgggtctatcttgatcctgag

SEQ ID NO: 572278 - DNA, 25 bp, Rattus norvegicus
tatttggtcagcattaccacaccgc

SEQ ID NO: 572279 - DNA, 25 bp, Rattus norvegicus
tatttggtcagctttaccacaccgc

SEQ ID NO: 572280 - DNA, 25 bp, Rattus norvegicus
tatttggtctctcaccccgcggaga

SEQ ID NO: 572281 - DNA, 25 bp, Rattus norvegicus
tatttggtctctgaccccgcggaga

SEQ ID NO: 572282 - DNA, 25 bp, Rattus norvegicus
tatttggtggacacagaagactgca

SEQ ID NO: 572283 - DNA, 25 bp, Rattus norvegicus
tatttggtggactcagaagactgca

SEQ ID NO: 572284 - DNA, 25 bp, Rattus norvegicus
tatttggtggccatatttgttctaa

SEQ ID NO: 572285 - DNA, 25 bp, Rattus norvegicus
tatttggtggccttatttgttctaa

SEQ ID NO: 572286 - DNA, 25 bp, Rattus norvegicus
tatttggtgtggaggatttctcatc

SEQ ID NO: 572287 - DNA, 25 bp, Rattus norvegicus
tatttggtgtggtggatttctcatc

SEQ ID NO: 572288 - DNA, 25 bp, Rattus norvegicus
tatttggtgttcatcaacggcctgt

SEQ ID NO: 572289 - DNA, 25 bp, Rattus norvegicus
tatttggtgttcttcaacggcctgt

SEQ ID NO: 572290 - DNA, 25 bp, Rattus norvegicus
tatttggttccaagtcccttttatt

SEQ ID NO: 572291 - DNA, 25 bp, Rattus norvegicus
tatttggttccatgtcccttttatt

SEQ ID NO: 572292 - DNA, 25 bp, Rattus norvegicus
tatttggttgccaacaaaacgccaa

SEQ ID NO: 572293 - DNA, 25 bp, Rattus norvegicus
tatttggttgcctacaaaacgccaa

SEQ ID NO: 572294 - DNA, 25 bp, Rattus norvegicus
tatttgtaacaacggtacagcccga

SEQ ID NO: 572295 - DNA, 25 bp, Rattus norvegicus
tatttgtaacaagggtacagcccga

SEQ ID NO: 572296 - DNA, 25 bp, Rattus norvegicus
tatttgtacaatcgccttttcgttc

SEQ ID NO: 572297 - DNA, 25 bp, Rattus norvegicus
tatttgtacaatggccttttcgttc

SEQ ID NO: 572298 - DNA, 25 bp, Rattus norvegicus
tatttgtacgtgctggccaacctct

SEQ ID NO: 572299 - DNA, 25 bp, Rattus norvegicus
tatttgtacgtggtggccaacctct

SEQ ID NO: 572300 - DNA, 25 bp, Rattus norvegicus
tatttgtactcacaactcttactaa

SEQ ID NO: 572301 - DNA, 25 bp, Rattus norvegicus
tatttgtactcagaactcttactaa

SEQ ID NO: 572302 - DNA, 25 bp, Rattus norvegicus
tatttgtagattccttgtacttcaa

SEQ ID NO: 572303 - DNA, 25 bp, Rattus norvegicus
tatttgtagattgcttgtacttcaa

SEQ ID NO: 572304 - DNA, 25 bp, Rattus norvegicus
tatttgtcctcaacccaaggagctg

SEQ ID NO: 572305 - DNA, 25 bp, Rattus norvegicus
tatttgtcctcatcccaaggagctg

SEQ ID NO: 572306 - DNA, 25 bp, Rattus norvegicus
tatttgtctgacatgttgcagcaac

SEQ ID NO: 572307 - DNA, 25 bp, Rattus norvegicus
tatttgtctgacttgttgcagcaac

SEQ ID NO: 572308 - DNA, 25 bp, Rattus norvegicus
tatttgtgcacaactgactcctttg

SEQ ID NO: 572309 - DNA, 25 bp, Rattus norvegicus
tatttgtgcacatctgactcctttg

SEQ ID NO: 572310 - DNA, 25 bp, Rattus norvegicus
tatttgtgcataccctgccacctaa

SEQ ID NO: 572311 - DNA, 25 bp, Rattus norvegicus
tatttgtgcatagcctgccacctaa

SEQ ID NO: 572312 - DNA, 25 bp, Rattus norvegicus
tatttgtggcaaacctcttgccttt

SEQ ID NO: 572313 - DNA, 25 bp, Rattus norvegicus
tatttgtggcaatcctcttgccttt

SEQ ID NO: 572314 - DNA, 25 bp, Rattus norvegicus
tatttgtgtgttctgacattgcccc

SEQ ID NO: 572315 - DNA, 25 bp, Rattus norvegicus
tatttgtgtgttgtgacattgcccc

SEQ ID NO: 572316 - DNA, 25 bp, Rattus norvegicus
tatttgttaaggctgactcatggaa

SEQ ID NO: 572317 - DNA, 25 bp, Rattus norvegicus
tatttgttaagggtgactcatggaa

SEQ ID NO: 572318 - DNA, 25 bp, Rattus norvegicus
tatttgttcctcagtccttccagca

SEQ ID NO: 572319 - DNA, 25 bp, Rattus norvegicus
tatttgttcctctgtccttccagca

SEQ ID NO: 572320 - DNA, 25 bp, Rattus norvegicus
tatttgttgccactaccaataaatc

SEQ ID NO: 572321 - DNA, 25 bp, Rattus norvegicus
tatttgttgccagtaccaataaatc

SEQ ID NO: 572322 - DNA, 25 bp, Rattus norvegicus
tatttgtttggaatactcattgtac

SEQ ID NO: 572323 - DNA, 25 bp, Rattus norvegicus
tatttgtttggattactcattgtac

SEQ ID NO: 572324 - DNA, 25 bp, Rattus norvegicus
tatttgtttgggaactgatgtctaa

SEQ ID NO: 572325 - DNA, 25 bp, Rattus norvegicus
tatttgtttgggtactgatgtctaa

SEQ ID NO: 572326 - DNA, 25 bp, Rattus norvegicus
tatttgttttccatgacctggtgta

SEQ ID NO: 572327 - DNA, 25 bp, Rattus norvegicus
tatttgttttccttgacctggtgta

SEQ ID NO: 572328 - DNA, 25 bp, Rattus norvegicus
tattttaaccctagagtggcttctt

SEQ ID NO: 572329 - DNA, 25 bp, Rattus norvegicus
tattttaacccttgagtggcttctt

SEQ ID NO: 572330 - DNA, 25 bp, Rattus norvegicus
tattttaagttcattgtgtctacag

SEQ ID NO: 572331 - DNA, 25 bp, Rattus norvegicus
tattttaagttctttgtgtctacag

SEQ ID NO: 572332 - DNA, 25 bp, Rattus norvegicus
tattttaattagcatctttccccgt

SEQ ID NO: 572333 - DNA, 25 bp, Rattus norvegicus
tattttaattaggatctttccccgt

SEQ ID NO: 572334 - DNA, 25 bp, Rattus norvegicus
tattttaattgtcctgcccagtctg

SEQ ID NO: 572335 - DNA, 25 bp, Rattus norvegicus
tattttaattgtgctgcccagtctg

SEQ ID NO: 572336 - DNA, 25 bp, Rattus norvegicus
tattttacagaacttccgtttcaag

SEQ ID NO: 572337 - DNA, 25 bp, Rattus norvegicus
tattttacagaagttccgtttcaag

SEQ ID NO: 572338 - DNA, 25 bp, Rattus norvegicus
tattttacagctattgtccaaggag

SEQ ID NO: 572339 - DNA, 25 bp, Rattus norvegicus
tattttacagcttttgtccaaggag

SEQ ID NO: 572340 - DNA, 25 bp, Rattus norvegicus
tattttacctaaactcatgcccatt

SEQ ID NO: 572341 - DNA, 25 bp, Rattus norvegicus
tattttacctaatctcatgcccatt

SEQ ID NO: 572342 - DNA, 25 bp, Rattus norvegicus
tattttacctcacattctgcctatc

SEQ ID NO: 572343 - DNA, 25 bp, Rattus norvegicus
tattttacctcagattctgcctatc

SEQ ID NO: 572344 - DNA, 25 bp, Rattus norvegicus
tattttactttcattggtactcccg

SEQ ID NO: 572345 - DNA, 25 bp, Rattus norvegicus
tattttactttctttggtactcccg

SEQ ID NO: 572346 - DNA, 25 bp, Rattus norvegicus
tattttagagctccctccttttcca

SEQ ID NO: 572347 - DNA, 25 bp, Rattus norvegicus
tattttagagctgcctccttttcca

SEQ ID NO: 572348 - DNA, 25 bp, Rattus norvegicus
tattttagccttattctctaatcct

SEQ ID NO: 572349 - DNA, 25 bp, Rattus norvegicus
tattttagcctttttctctaatcct

SEQ ID NO: 572350 - DNA, 25 bp, Rattus norvegicus
tattttaggcatagcccatctccca

SEQ ID NO: 572351 - DNA, 25 bp, Rattus norvegicus
tattttaggcattgcccatctccca

SEQ ID NO: 572352 - DNA, 25 bp, Rattus norvegicus
tattttaggtgcctcgacatccatt

SEQ ID NO: 572353 - DNA, 25 bp, Rattus norvegicus
tattttaggtgcgtcgacatccatt

SEQ ID NO: 572354 - DNA, 25 bp, Rattus norvegicus
tattttagttacagtgggttcctga

SEQ ID NO: 572355 - DNA, 25 bp, Rattus norvegicus
tattttagttactgtgggttcctga

SEQ ID NO: 572356 - DNA, 25 bp, Rattus norvegicus
tattttatagatcttgatttgctga

SEQ ID NO: 572357 - DNA, 25 bp, Rattus norvegicus
tattttatagatgttgatttgctga

SEQ ID NO: 572358 - DNA, 25 bp, Rattus norvegicus
tattttatcaccatccactacgaac

SEQ ID NO: 572359 - DNA, 25 bp, Rattus norvegicus
tattttatcaccttccactacgaac

SEQ ID NO: 572360 - DNA, 25 bp, Rattus norvegicus
tattttatccaactaccctagtgaa

SEQ ID NO: 572361 - DNA, 25 bp, Rattus norvegicus
tattttatccaagtaccctagtgaa

SEQ ID NO: 572362 - DNA, 25 bp, Rattus norvegicus
tattttatcgtaactttttgcatta

SEQ ID NO: 572363 - DNA, 25 bp, Rattus norvegicus
tattttatcgtatctttttgcatta

SEQ ID NO: 572364 - DNA, 25 bp, Rattus norvegicus
tattttatctccactcatccattta

SEQ ID NO: 572365 - DNA, 25 bp, Rattus norvegicus
tattttatctccatcagtaactctg

SEQ ID NO: 572366 - DNA, 25 bp, Rattus norvegicus
tattttatctcctctcatccattta

SEQ ID NO: 572367 - DNA, 25 bp, Rattus norvegicus
tattttatctccttcagtaactctg

SEQ ID NO: 572368 - DNA, 25 bp, Rattus norvegicus
tattttatggaacattctactcccc

SEQ ID NO: 572369 - DNA, 25 bp, Rattus norvegicus
tattttatggaagattctactcccc

SEQ ID NO: 572370 - DNA, 25 bp, Rattus norvegicus
tattttatggacactgcgttgctca

SEQ ID NO: 572371 - DNA, 25 bp, Rattus norvegicus
tattttatggactctgcgttgctca

SEQ ID NO: 572372 - DNA, 25 bp, Rattus norvegicus
tattttatgtcgagtgtgtcctctc

SEQ ID NO: 572373 - DNA, 25 bp, Rattus norvegicus
tattttatgtcgtgtgtgtcctctc

SEQ ID NO: 572374 - DNA, 25 bp, Rattus norvegicus
tattttattgcaacacaaggtacca

SEQ ID NO: 572375 - DNA, 25 bp, Rattus norvegicus
tattttattgcatcacaaggtacca

SEQ ID NO: 572376 - DNA, 25 bp, Rattus norvegicus
tattttcacagcacctttatttcat

SEQ ID NO: 572377 - DNA, 25 bp, Rattus norvegicus
tattttcacagctcctttatttcat

SEQ ID NO: 572378 - DNA, 25 bp, Rattus norvegicus
tattttcaggtgaccctacactggg

SEQ ID NO: 572379 - DNA, 25 bp, Rattus norvegicus
tattttcaggtgtccctacactggg

SEQ ID NO: 572380 - DNA, 25 bp, Rattus norvegicus
tattttcagtctcttctgtgggcta

SEQ ID NO: 572381 - DNA, 25 bp, Rattus norvegicus
tattttcagtctgttctgtgggcta

SEQ ID NO: 572382 - DNA, 25 bp, Rattus norvegicus
tattttcagttcactgagacttccg

SEQ ID NO: 572383 - DNA, 25 bp, Rattus norvegicus
tattttcagttctctgagacttccg

SEQ ID NO: 572384 - DNA, 25 bp, Rattus norvegicus
tattttcatagtcctctgtgctcca

SEQ ID NO: 572385 - DNA, 25 bp, Rattus norvegicus
tattttcatagtgctctgtgctcca

SEQ ID NO: 572386 - DNA, 25 bp, Rattus norvegicus
tattttcatatgatcactttctcag

SEQ ID NO: 572387 - DNA, 25 bp, Rattus norvegicus
tattttcatatgttcactttctcag

SEQ ID NO: 572388 - DNA, 25 bp, Rattus norvegicus
tattttcatgacacgctgcctgcta

SEQ ID NO: 572389 - DNA, 25 bp, Rattus norvegicus
tattttcatgactcgctgcctgcta

SEQ ID NO: 572390 - DNA, 25 bp, Rattus norvegicus
tattttccaaacaagatataccggt

SEQ ID NO: 572391 - DNA, 25 bp, Rattus norvegicus
tattttccaaactagatataccggt

SEQ ID NO: 572392 - DNA, 25 bp, Rattus norvegicus
tattttccagtaactgtgtgcctct

SEQ ID NO: 572393 - DNA, 25 bp, Rattus norvegicus
tattttccagtatctgtgtgcctct

SEQ ID NO: 572394 - DNA, 25 bp, Rattus norvegicus
tattttccattcatgctcaatggaa

SEQ ID NO: 572395 - DNA, 25 bp, Rattus norvegicus
tattttccattcttgctcaatggaa

SEQ ID NO: 572396 - DNA, 25 bp, Rattus norvegicus
tattttcccagtcagctttgccata

SEQ ID NO: 572397 - DNA, 25 bp, Rattus norvegicus
tattttcccagtgagctttgccata

SEQ ID NO: 572398 - DNA, 25 bp, Rattus norvegicus
tattttcccatgctttggttctcat

SEQ ID NO: 572399 - DNA, 25 bp, Rattus norvegicus
tattttcccatggtttggttctcat

SEQ ID NO: 572400 - DNA, 25 bp, Rattus norvegicus
tattttcccattcacccttctgagg

SEQ ID NO: 572401 - DNA, 25 bp, Rattus norvegicus
tattttcccattgacccttctgagg

SEQ ID NO: 572402 - DNA, 25 bp, Rattus norvegicus
tattttccccaaccatataagcatg

SEQ ID NO: 572403 - DNA, 25 bp, Rattus norvegicus
tattttccccaagcatataagcatg

SEQ ID NO: 572404 - DNA, 25 bp, Rattus norvegicus
tattttcccctcactcttggaataa

SEQ ID NO: 572405 - DNA, 25 bp, Rattus norvegicus
tattttcccctctctcttggaataa

SEQ ID NO: 572406 - DNA, 25 bp, Rattus norvegicus
tattttccctgaagtgtgctgtaga

SEQ ID NO: 572407 - DNA, 25 bp, Rattus norvegicus
tattttccctgaatcactactgtag

SEQ ID NO: 572408 - DNA, 25 bp, Rattus norvegicus
tattttccctgatgtgtgctgtaga

SEQ ID NO: 572409 - DNA, 25 bp, Rattus norvegicus
tattttccctgattcactactgtag

SEQ ID NO: 572410 - DNA, 25 bp, Rattus norvegicus
tattttcctaatctaaatccgacct

SEQ ID NO: 572411 - DNA, 25 bp, Rattus norvegicus
tattttcctaatgtaaatccgacct

SEQ ID NO: 572412 - DNA, 25 bp, Rattus norvegicus
tattttcctataatcagctccctga

SEQ ID NO: 572413 - DNA, 25 bp, Rattus norvegicus
tattttcctatattcagctccctga

SEQ ID NO: 572414 - DNA, 25 bp, Rattus norvegicus
tattttcctattactttccaactcg

SEQ ID NO: 572415 - DNA, 25 bp, Rattus norvegicus
tattttcctatttctttccaactcg

SEQ ID NO: 572416 - DNA, 25 bp, Rattus norvegicus
tattttcctcacatctgttttgctg

SEQ ID NO: 572417 - DNA, 25 bp, Rattus norvegicus
tattttcctcacttctgttttgctg

SEQ ID NO: 572418 - DNA, 25 bp, Rattus norvegicus
tattttcctcttacctattcattta

SEQ ID NO: 572419 - DNA, 25 bp, Rattus norvegicus
tattttcctctttcctattcattta

SEQ ID NO: 572420 - DNA, 25 bp, Rattus norvegicus
tattttccttctagtagtagttgag

SEQ ID NO: 572421 - DNA, 25 bp, Rattus norvegicus
tattttccttcttgtagtagttgag

SEQ ID NO: 572422 - DNA, 25 bp, Rattus norvegicus
tattttcctttcaaactcttcatct

SEQ ID NO: 572423 - DNA, 25 bp, Rattus norvegicus
tattttcctttctaactcttcatct

SEQ ID NO: 572424 - DNA, 25 bp, Rattus norvegicus
tattttcgcagtcatctcatgtccc

SEQ ID NO: 572425 - DNA, 25 bp, Rattus norvegicus
tattttcgcagtgatctcatgtccc

SEQ ID NO: 572426 - DNA, 25 bp, Rattus norvegicus
tattttcgtcggaatgtttctatat

SEQ ID NO: 572427 - DNA, 25 bp, Rattus norvegicus
tattttcgtcggtatgtttctatat

SEQ ID NO: 572428 - DNA, 25 bp, Rattus norvegicus
tattttcgtgatattactgaggttc

SEQ ID NO: 572429 - DNA, 25 bp, Rattus norvegicus
tattttcgtgattttactgaggttc

SEQ ID NO: 572430 - DNA, 25 bp, Rattus norvegicus
tattttcgtgcaattgtgagccaaa

SEQ ID NO: 572431 - DNA, 25 bp, Rattus norvegicus
tattttcgtgcatttgtgagccaaa

SEQ ID NO: 572432 - DNA, 25 bp, Rattus norvegicus
tattttctacctcaacatcccaagc

SEQ ID NO: 572433 - DNA, 25 bp, Rattus norvegicus
tattttctacctgaacatcccaagc

SEQ ID NO: 572434 - DNA, 25 bp, Rattus norvegicus
tattttctaggaacccaggctactt

SEQ ID NO: 572435 - DNA, 25 bp, Rattus norvegicus
tattttctaggatcccaggctactt

SEQ ID NO: 572436 - DNA, 25 bp, Rattus norvegicus
tattttctatcactgccaagggctt

SEQ ID NO: 572437 - DNA, 25 bp, Rattus norvegicus
tattttctatcagtgccaagggctt

SEQ ID NO: 572438 - DNA, 25 bp, Rattus norvegicus
tattttctatccacttggcttttgc

SEQ ID NO: 572439 - DNA, 25 bp, Rattus norvegicus
tattttctatcctcttggcttttgc

SEQ ID NO: 572440 - DNA, 25 bp, Rattus norvegicus
tattttctatctctctgctttctgt

SEQ ID NO: 572441 - DNA, 25 bp, Rattus norvegicus
tattttctatctgtctgctttctgt

SEQ ID NO: 572442 - DNA, 25 bp, Rattus norvegicus
tattttctcaccctcatcatgcaag

SEQ ID NO: 572443 - DNA, 25 bp, Rattus norvegicus
tattttctcaccgtcatcatgcaag

SEQ ID NO: 572444 - DNA, 25 bp, Rattus norvegicus
tattttctcactatggatgtacctt

SEQ ID NO: 572445 - DNA, 25 bp, Rattus norvegicus
tattttctcactttggatgtacctt

SEQ ID NO: 572446 - DNA, 25 bp, Rattus norvegicus
tattttctcattacgttttaccctg

SEQ ID NO: 572447 - DNA, 25 bp, Rattus norvegicus
tattttctcatttcgttttaccctg

SEQ ID NO: 572448 - DNA, 25 bp, Rattus norvegicus
tattttctcctgatttcattccttt

SEQ ID NO: 572449 - DNA, 25 bp, Rattus norvegicus
tattttctcctgttttcattccttt

SEQ ID NO: 572450 - DNA, 25 bp, Rattus norvegicus
tattttctctgtataggcctgagga

SEQ ID NO: 572451 - DNA, 25 bp, Rattus norvegicus
tattttctctgtttaggcctgagga

SEQ ID NO: 572452 - DNA, 25 bp, Rattus norvegicus
tattttctgactcgcatcctatgga

SEQ ID NO: 572453 - DNA, 25 bp, Rattus norvegicus
tattttctgactggcatcctatgga

SEQ ID NO: 572454 - DNA, 25 bp, Rattus norvegicus
tattttctgagcacgcctcccggtt

SEQ ID NO: 572455 - DNA, 25 bp, Rattus norvegicus
tattttctgagctcgcctcccggtt

SEQ ID NO: 572456 - DNA, 25 bp, Rattus norvegicus
tattttctggacctgcctccatagg

SEQ ID NO: 572457 - DNA, 25 bp, Rattus norvegicus
tattttctggacgtgcctccatagg

SEQ ID NO: 572458 - DNA, 25 bp, Rattus norvegicus
tattttcttaacatctgcactccag

SEQ ID NO: 572459 - DNA, 25 bp, Rattus norvegicus
tattttcttaacttctgcactccag

SEQ ID NO: 572460 - DNA, 25 bp, Rattus norvegicus
tattttcttacaattgactgctgga

SEQ ID NO: 572461 - DNA, 25 bp, Rattus norvegicus
tattttcttacatttgactgctgga

SEQ ID NO: 572462 - DNA, 25 bp, Rattus norvegicus
tattttcttattatagagcgcttaa

SEQ ID NO: 572463 - DNA, 25 bp, Rattus norvegicus
tattttcttattttagagcgcttaa

SEQ ID NO: 572464 - DNA, 25 bp, Rattus norvegicus
tattttcttcacatctgtttactat

SEQ ID NO: 572465 - DNA, 25 bp, Rattus norvegicus
tattttcttcacttctgtttactat

SEQ ID NO: 572466 - DNA, 25 bp, Rattus norvegicus
tattttcttctgaattccatggccc

SEQ ID NO: 572467 - DNA, 25 bp, Rattus norvegicus
tattttcttctgtattccatggccc

SEQ ID NO: 572468 - DNA, 25 bp, Rattus norvegicus
tattttcttgtgacttctcttctgg

SEQ ID NO: 572469 - DNA, 25 bp, Rattus norvegicus
tattttcttgtgctccaatcccttc

SEQ ID NO: 572470 - DNA, 25 bp, Rattus norvegicus
tattttcttgtggtccaatcccttc

SEQ ID NO: 572471 - DNA, 25 bp, Rattus norvegicus
tattttcttgtgtcttctcttctgg

SEQ ID NO: 572472 - DNA, 25 bp, Rattus norvegicus
tattttctttacacataccccagga

SEQ ID NO: 572473 - DNA, 25 bp, Rattus norvegicus
tattttctttacatctggtcatcag

SEQ ID NO: 572474 - DNA, 25 bp, Rattus norvegicus
tattttctttactcataccccagga

SEQ ID NO: 572475 - DNA, 25 bp, Rattus norvegicus
tattttctttacttctggtcatcag

SEQ ID NO: 572476 - DNA, 25 bp, Rattus norvegicus
tattttctttcacactttctctcca

SEQ ID NO: 572477 - DNA, 25 bp, Rattus norvegicus
tattttctttcagactttctctcca

SEQ ID NO: 572478 - DNA, 25 bp, Rattus norvegicus
tattttgaatccacaggcctctggt

SEQ ID NO: 572479 - DNA, 25 bp, Rattus norvegicus
tattttgaatcctcaggcctctggt

SEQ ID NO: 572480 - DNA, 25 bp, Rattus norvegicus
tattttgaccagattctaccctgta

SEQ ID NO: 572481 - DNA, 25 bp, Rattus norvegicus
tattttgaccagtttctaccctgta

SEQ ID NO: 572482 - DNA, 25 bp, Rattus norvegicus
tattttgactgccttagcctcgaac

SEQ ID NO: 572483 - DNA, 25 bp, Rattus norvegicus
tattttgactgcgttagcctcgaac

SEQ ID NO: 572484 - DNA, 25 bp, Rattus norvegicus
tattttgagaacactgccattggaa

SEQ ID NO: 572485 - DNA, 25 bp, Rattus norvegicus
tattttgagaactctgccattggaa

SEQ ID NO: 572486 - DNA, 25 bp, Rattus norvegicus
tattttgagcgacttgggcctgtcc

SEQ ID NO: 572487 - DNA, 25 bp, Rattus norvegicus
tattttgagcgagttgggcctgtcc

SEQ ID NO: 572488 - DNA, 25 bp, Rattus norvegicus
tattttgagcttatgaccattagaa

SEQ ID NO: 572489 - DNA, 25 bp, Rattus norvegicus
tattttgagcttttgaccattagaa

SEQ ID NO: 572490 - DNA, 25 bp, Rattus norvegicus
tattttgaggtcattgtgtccaagg

SEQ ID NO: 572491 - DNA, 25 bp, Rattus norvegicus
tattttgaggtctttgtgtccaagg

SEQ ID NO: 572492 - DNA, 25 bp, Rattus norvegicus
tattttgatgacagtagcgtctcca

SEQ ID NO: 572493 - DNA, 25 bp, Rattus norvegicus
tattttgatgactgtagcgtctcca

SEQ ID NO: 572494 - DNA, 25 bp, Rattus norvegicus
tattttgatgagaacttgcactagt

SEQ ID NO: 572495 - DNA, 25 bp, Rattus norvegicus
tattttgatgagtacttgcactagt

SEQ ID NO: 572496 - DNA, 25 bp, Rattus norvegicus
tattttgcacaaacatctcacccca

SEQ ID NO: 572497 - DNA, 25 bp, Rattus norvegicus
tattttgcacaatcatctcacccca

SEQ ID NO: 572498 - DNA, 25 bp, Rattus norvegicus
tattttgcactcatctcaccaataa

SEQ ID NO: 572499 - DNA, 25 bp, Rattus norvegicus
tattttgcactcttctcaccaataa

SEQ ID NO: 572500 - DNA, 25 bp, Rattus norvegicus
tattttgcagaaagttgtcgagagc

SEQ ID NO: 572501 - DNA, 25 bp, Rattus norvegicus
tattttgcagaatgttgtcgagagc

SEQ ID NO: 572502 - DNA, 25 bp, Rattus norvegicus
tattttgcagtcagcccagttcagg

SEQ ID NO: 572503 - DNA, 25 bp, Rattus norvegicus
tattttgcagtctgcccagttcagg

SEQ ID NO: 572504 - DNA, 25 bp, Rattus norvegicus
tattttgcatccagggccctgagta

SEQ ID NO: 572505 - DNA, 25 bp, Rattus norvegicus
tattttgcatcctgggccctgagta

SEQ ID NO: 572506 - DNA, 25 bp, Rattus norvegicus
tattttgcccttaacaaagatggct

SEQ ID NO: 572507 - DNA, 25 bp, Rattus norvegicus
tattttgccctttacaaagatggct

SEQ ID NO: 572508 - DNA, 25 bp, Rattus norvegicus
tattttgcctttaactgataatgtg

SEQ ID NO: 572509 - DNA, 25 bp, Rattus norvegicus
tattttgccttttactgataatgtg

SEQ ID NO: 572510 - DNA, 25 bp, Rattus norvegicus
tattttgctactatgcagtattcgt

SEQ ID NO: 572511 - DNA, 25 bp, Rattus norvegicus
tattttgctactttgcagtattcgt

SEQ ID NO: 572512 - DNA, 25 bp, Rattus norvegicus
tattttgcttccaacatgttccaga

SEQ ID NO: 572513 - DNA, 25 bp, Rattus norvegicus
tattttgcttcctacatgttccaga

SEQ ID NO: 572514 - DNA, 25 bp, Rattus norvegicus
tattttgctttaagagcctccctca

SEQ ID NO: 572515 - DNA, 25 bp, Rattus norvegicus
tattttgctttatgagcctccctca

SEQ ID NO: 572516 - DNA, 25 bp, Rattus norvegicus
tattttggacgtagtggctatacac

SEQ ID NO: 572517 - DNA, 25 bp, Rattus norvegicus
tattttggacgttgtggctatacac

SEQ ID NO: 572518 - DNA, 25 bp, Rattus norvegicus
tattttggattgatcacctttgtaa

SEQ ID NO: 572519 - DNA, 25 bp, Rattus norvegicus
tattttggattgttcacctttgtaa

SEQ ID NO: 572520 - DNA, 25 bp, Rattus norvegicus
tattttggcaacaaggtccctcctc

SEQ ID NO: 572521 - DNA, 25 bp, Rattus norvegicus
tattttggcaactaggtccctcctc

SEQ ID NO: 572522 - DNA, 25 bp, Rattus norvegicus
tattttggcaccagaccagctgatg

SEQ ID NO: 572523 - DNA, 25 bp, Rattus norvegicus
tattttggcacctgaccagctgatg

SEQ ID NO: 572524 - DNA, 25 bp, Rattus norvegicus
tattttggccaaatgccttttttag

SEQ ID NO: 572525 - DNA, 25 bp, Rattus norvegicus
tattttggccaattgccttttttag

SEQ ID NO: 572526 - DNA, 25 bp, Rattus norvegicus
tattttggcctgaaaacagtggaac

SEQ ID NO: 572527 - DNA, 25 bp, Rattus norvegicus
tattttggcctgtaaacagtggaac

SEQ ID NO: 572528 - DNA, 25 bp, Rattus norvegicus
tattttggcttacgcatcagggtga

SEQ ID NO: 572529 - DNA, 25 bp, Rattus norvegicus
tattttggcttaggcatcagggtga

SEQ ID NO: 572530 - DNA, 25 bp, Rattus norvegicus
tattttggtcagactggctgggcca

SEQ ID NO: 572531 - DNA, 25 bp, Rattus norvegicus
tattttggtcagtctggctgggcca

SEQ ID NO: 572532 - DNA, 25 bp, Rattus norvegicus
tattttggtggcattggtcatcgtc

SEQ ID NO: 572533 - DNA, 25 bp, Rattus norvegicus
tattttggtggctttggtcatcgtc

SEQ ID NO: 572534 - DNA, 25 bp, Rattus norvegicus
tattttggtggtactgcagcagtgc

SEQ ID NO: 572535 - DNA, 25 bp, Rattus norvegicus
tattttggtggttctgcagcagtgc

SEQ ID NO: 572536 - DNA, 25 bp, Rattus norvegicus
tattttgtaacgagctgcgtctcct

SEQ ID NO: 572537 - DNA, 25 bp, Rattus norvegicus
tattttgtaacgtgctgcgtctcct

SEQ ID NO: 572538 - DNA, 25 bp, Rattus norvegicus
tattttgtagttacagcctgtacca

SEQ ID NO: 572539 - DNA, 25 bp, Rattus norvegicus
tattttgtagtttcagcctgtacca

SEQ ID NO: 572540 - DNA, 25 bp, Rattus norvegicus
tattttgtatacacctgacttcccc

SEQ ID NO: 572541 - DNA, 25 bp, Rattus norvegicus
tattttgtatactcctgacttcccc

SEQ ID NO: 572542 - DNA, 25 bp, Rattus norvegicus
tattttgtatataaggcccgtccag

SEQ ID NO: 572543 - DNA, 25 bp, Rattus norvegicus
tattttgtatattaggcccgtccag

SEQ ID NO: 572544 - DNA, 25 bp, Rattus norvegicus
tattttgtcactccacaggtgccat

SEQ ID NO: 572545 - DNA, 25 bp, Rattus norvegicus
tattttgtcactgcacaggtgccat

SEQ ID NO: 572546 - DNA, 25 bp, Rattus norvegicus
tattttgtcatcaatcccaatactt

SEQ ID NO: 572547 - DNA, 25 bp, Rattus norvegicus
tattttgtcatctatcccaatactt

SEQ ID NO: 572548 - DNA, 25 bp, Rattus norvegicus
tattttgtcctgaatatatgtctgt

SEQ ID NO: 572549 - DNA, 25 bp, Rattus norvegicus
tattttgtcctgtatatatgtctgt

SEQ ID NO: 572550 - DNA, 25 bp, Rattus norvegicus
tattttgtcgtgagactgccatgcg

SEQ ID NO: 572551 - DNA, 25 bp, Rattus norvegicus
tattttgtcgtgtgactgccatgcg

SEQ ID NO: 572552 - DNA, 25 bp, Rattus norvegicus
tattttgtctagagaggctggccag

SEQ ID NO: 572553 - DNA, 25 bp, Rattus norvegicus
tattttgtctagtgaggctggccag

SEQ ID NO: 572554 - DNA, 25 bp, Rattus norvegicus
tattttgtcttaactccctgcttaa

SEQ ID NO: 572555 - DNA, 25 bp, Rattus norvegicus
tattttgtcttatctccctgcttaa

SEQ ID NO: 572556 - DNA, 25 bp, Rattus norvegicus
tattttgtgctgactcatctgtgaa

SEQ ID NO: 572557 - DNA, 25 bp, Rattus norvegicus
tattttgtgctgtctcatctgtgaa

SEQ ID NO: 572558 - DNA, 25 bp, Rattus norvegicus
tattttgtggctccaaggccgaagt

SEQ ID NO: 572559 - DNA, 25 bp, Rattus norvegicus
tattttgtggctgcaaggccgaagt

SEQ ID NO: 572560 - DNA, 25 bp, Rattus norvegicus
tattttgtgtttccacttgtcctcc

SEQ ID NO: 572561 - DNA, 25 bp, Rattus norvegicus
tattttgtgtttgcacttgtcctcc

SEQ ID NO: 572562 - DNA, 25 bp, Rattus norvegicus
tattttgttatgactcagcccatac

SEQ ID NO: 572563 - DNA, 25 bp, Rattus norvegicus
tattttgttatgtctcagcccatac

SEQ ID NO: 572564 - DNA, 25 bp, Rattus norvegicus
tattttgttgtgacaaactggacca

SEQ ID NO: 572565 - DNA, 25 bp, Rattus norvegicus
tattttgttgtgtcaaactggacca

SEQ ID NO: 572566 - DNA, 25 bp, Rattus norvegicus
tattttgtttgtatccactgtccct

SEQ ID NO: 572567 - DNA, 25 bp, Rattus norvegicus
tattttgtttgtttccactgtccct

SEQ ID NO: 572568 - DNA, 25 bp, Rattus norvegicus
tatttttaatgtcccttcgcagtat

SEQ ID NO: 572569 - DNA, 25 bp, Rattus norvegicus
tatttttaatgtctgttcccgtggg

SEQ ID NO: 572570 - DNA, 25 bp, Rattus norvegicus
tatttttaatgtgccttcgcagtat

SEQ ID NO: 572571 - DNA, 25 bp, Rattus norvegicus
tatttttaatgtgtgttcccgtggg

SEQ ID NO: 572572 - DNA, 25 bp, Rattus norvegicus
tatttttaattgaggattgctggaa

SEQ ID NO: 572573 - DNA, 25 bp, Rattus norvegicus
tatttttaattgtggattgctggaa

SEQ ID NO: 572574 - DNA, 25 bp, Rattus norvegicus
tatttttacagcctcttcccactaa

SEQ ID NO: 572575 - DNA, 25 bp, Rattus norvegicus
tatttttacagcgtcttcccactaa

SEQ ID NO: 572576 - DNA, 25 bp, Rattus norvegicus
tatttttacattatggcaccagttt

SEQ ID NO: 572577 - DNA, 25 bp, Rattus norvegicus
tatttttacattttggcaccagttt

SEQ ID NO: 572578 - DNA, 25 bp, Rattus norvegicus
tatttttaccccaaattcctgtctg

SEQ ID NO: 572579 - DNA, 25 bp, Rattus norvegicus
tatttttacccctaattcctgtctg

SEQ ID NO: 572580 - DNA, 25 bp, Rattus norvegicus
tatttttacctcaaagtgatgtcgt

SEQ ID NO: 572581 - DNA, 25 bp, Rattus norvegicus
tatttttacctctaagtgatgtcgt

SEQ ID NO: 572582 - DNA, 25 bp, Rattus norvegicus
tatttttacttgcactgttgctgca

SEQ ID NO: 572583 - DNA, 25 bp, Rattus norvegicus
tatttttacttggactgttgctgca

SEQ ID NO: 572584 - DNA, 25 bp, Rattus norvegicus
tatttttagctcatcggtgtgaaca

SEQ ID NO: 572585 - DNA, 25 bp, Rattus norvegicus
tatttttagctcttcggtgtgaaca

SEQ ID NO: 572586 - DNA, 25 bp, Rattus norvegicus
tatttttatacactttcacctttgg

SEQ ID NO: 572587 - DNA, 25 bp, Rattus norvegicus
tatttttatacagtttcacctttgg

SEQ ID NO: 572588 - DNA, 25 bp, Rattus norvegicus
tatttttatccccaaattgttgcta

SEQ ID NO: 572589 - DNA, 25 bp, Rattus norvegicus
tatttttatcccgaaattgttgcta

SEQ ID NO: 572590 - DNA, 25 bp, Rattus norvegicus
tatttttcacttattggcagatgct

SEQ ID NO: 572591 - DNA, 25 bp, Rattus norvegicus
tatttttcactttttggcagatgct

SEQ ID NO: 572592 - DNA, 25 bp, Rattus norvegicus
tatttttccaatatgactcccggct

SEQ ID NO: 572593 - DNA, 25 bp, Rattus norvegicus
tatttttccaatttgactcccggct

SEQ ID NO: 572594 - DNA, 25 bp, Rattus norvegicus
tatttttccacaacagccctgagtt

SEQ ID NO: 572595 - DNA, 25 bp, Rattus norvegicus
tatttttccacatcagccctgagtt

SEQ ID NO: 572596 - DNA, 25 bp, Rattus norvegicus
tatttttccatcatcacgagataga

SEQ ID NO: 572597 - DNA, 25 bp, Rattus norvegicus
tatttttccatcttcacgagataga

SEQ ID NO: 572598 - DNA, 25 bp, Rattus norvegicus
tatttttcccctaatactctagaag

SEQ ID NO: 572599 - DNA, 25 bp, Rattus norvegicus
tatttttccccttatactctagaag

SEQ ID NO: 572600 - DNA, 25 bp, Rattus norvegicus
tatttttccctgaggtcctgtggac

SEQ ID NO: 572601 - DNA, 25 bp, Rattus norvegicus
tatttttccctgtggtcctgtggac

SEQ ID NO: 572602 - DNA, 25 bp, Rattus norvegicus
tatttttcctaaagccagtgtgctg

SEQ ID NO: 572603 - DNA, 25 bp, Rattus norvegicus
tatttttcctaatgccagtgtgctg

SEQ ID NO: 572604 - DNA, 25 bp, Rattus norvegicus
tatttttcctgcatttaatccccag

SEQ ID NO: 572605 - DNA, 25 bp, Rattus norvegicus
tatttttcctgcttttaatccccag

SEQ ID NO: 572606 - DNA, 25 bp, Rattus norvegicus
tatttttctctgatacatctctatt

SEQ ID NO: 572607 - DNA, 25 bp, Rattus norvegicus
tatttttctctgttacatctctatt

SEQ ID NO: 572608 - DNA, 25 bp, Rattus norvegicus
tatttttctttaacataccttggag

SEQ ID NO: 572609 - DNA, 25 bp, Rattus norvegicus
tatttttctttatcataccttggag

SEQ ID NO: 572610 - DNA, 25 bp, Rattus norvegicus
tatttttgatatcagctttgaccaa

SEQ ID NO: 572611 - DNA, 25 bp, Rattus norvegicus
tatttttgatatgagctttgaccaa

SEQ ID NO: 572612 - DNA, 25 bp, Rattus norvegicus
tatttttgcgagagtatctgtcccc

SEQ ID NO: 572613 - DNA, 25 bp, Rattus norvegicus
tatttttgcgagtgtatctgtcccc

SEQ ID NO: 572614 - DNA, 25 bp, Rattus norvegicus
tatttttgcttccagacagccgaca

SEQ ID NO: 572615 - DNA, 25 bp, Rattus norvegicus
tatttttgcttcgagacagccgaca

SEQ ID NO: 572616 - DNA, 25 bp, Rattus norvegicus
tatttttggcaaatgctcacatcag

SEQ ID NO: 572617 - DNA, 25 bp, Rattus norvegicus
tatttttggcaattgctcacatcag

SEQ ID NO: 572618 - DNA, 25 bp, Rattus norvegicus
tatttttgtatcacgtgcactatat

SEQ ID NO: 572619 - DNA, 25 bp, Rattus norvegicus
tatttttgtatctcgtgcactatat

SEQ ID NO: 572620 - DNA, 25 bp, Rattus norvegicus
tatttttgtcaactttttagatatt

SEQ ID NO: 572621 - DNA, 25 bp, Rattus norvegicus
tatttttgtcaagtttttagatatt

SEQ ID NO: 572622 - DNA, 25 bp, Rattus norvegicus
tatttttgtccaaggtgctctgaaa

SEQ ID NO: 572623 - DNA, 25 bp, Rattus norvegicus
tatttttgtccatggtgctctgaaa

SEQ ID NO: 572624 - DNA, 25 bp, Rattus norvegicus
tatttttgtggaacacttgagaata

SEQ ID NO: 572625 - DNA, 25 bp, Rattus norvegicus
tatttttgtggatcacttgagaata

SEQ ID NO: 572626 - DNA, 25 bp, Rattus norvegicus
tatttttgttgtcttgctccctaaa

SEQ ID NO: 572627 - DNA, 25 bp, Rattus norvegicus
tatttttgttgtgttgctccctaaa

SEQ ID NO: 572628 - DNA, 25 bp, Rattus norvegicus
tattttttaagtccagctgagaact

SEQ ID NO: 572629 - DNA, 25 bp, Rattus norvegicus
tattttttaagtcggctcctgacaa

SEQ ID NO: 572630 - DNA, 25 bp, Rattus norvegicus
tattttttaagtgcagctgagaact

SEQ ID NO: 572631 - DNA, 25 bp, Rattus norvegicus
tattttttaagtgggctcctgacaa

SEQ ID NO: 572632 - DNA, 25 bp, Rattus norvegicus
tattttttcctcctggtactggcaa

SEQ ID NO: 572633 - DNA, 25 bp, Rattus norvegicus
tattttttcctcgtggtactggcaa

SEQ ID NO: 572634 - DNA, 25 bp, Rattus norvegicus
tattttttctcactggttaagtaag

SEQ ID NO: 572635 - DNA, 25 bp, Rattus norvegicus
tattttttctcagtggttaagtaag

SEQ ID NO: 572636 - DNA, 25 bp, Rattus norvegicus
tcaaaaaccgggaccagcatgggca

SEQ ID NO: 572637 - DNA, 25 bp, Rattus norvegicus
tcaaaaaccgggtccagcatgggca

SEQ ID NO: 572638 - DNA, 25 bp, Rattus norvegicus
tcaaaaaccttgcatttggcctttt

SEQ ID NO: 572639 - DNA, 25 bp, Rattus norvegicus
tcaaaaaccttggatttggcctttt

SEQ ID NO: 572640 - DNA, 25 bp, Rattus norvegicus
tcaaaaagcgctacttccagctgac

SEQ ID NO: 572641 - DNA, 25 bp, Rattus norvegicus
tcaaaaagcgcttcttccagctgac

SEQ ID NO: 572642 - DNA, 25 bp, Rattus norvegicus
tcaaaaagtctgatgcacatgcgtc

SEQ ID NO: 572643 - DNA, 25 bp, Rattus norvegicus
tcaaaaagtctgttgcacatgcgtc

SEQ ID NO: 572644 - DNA, 25 bp, Rattus norvegicus
tcaaaaatattcattcccgtcagcc

SEQ ID NO: 572645 - DNA, 25 bp, Rattus norvegicus
tcaaaaatattctttcccgtcagcc

SEQ ID NO: 572646 - DNA, 25 bp, Rattus norvegicus
tcaaaaatgtgaatgctgagcagga

SEQ ID NO: 572647 - DNA, 25 bp, Rattus norvegicus
tcaaaaatgtgattgctgagcagga

SEQ ID NO: 572648 - DNA, 25 bp, Rattus norvegicus
tcaaaaattgagacacgtccgacta

SEQ ID NO: 572649 - DNA, 25 bp, Rattus norvegicus
tcaaaaattgagtcacgtccgacta

SEQ ID NO: 572650 - DNA, 25 bp, Rattus norvegicus
tcaaaaattggtcttccattcccca

SEQ ID NO: 572651 - DNA, 25 bp, Rattus norvegicus
tcaaaaattggtgttccattcccca

SEQ ID NO: 572652 - DNA, 25 bp, Rattus norvegicus
tcaaaacacggcctattgaccctaa

SEQ ID NO: 572653 - DNA, 25 bp, Rattus norvegicus
tcaaaacacggcgtattgaccctaa

SEQ ID NO: 572654 - DNA, 25 bp, Rattus norvegicus
tcaaaacattctcaccatcctgtgc

SEQ ID NO: 572655 - DNA, 25 bp, Rattus norvegicus
tcaaaacattctgaccatcctgtgc

SEQ ID NO: 572656 - DNA, 25 bp, Rattus norvegicus
tcaaaaccaaacaggaagcccctct

SEQ ID NO: 572657 - DNA, 25 bp, Rattus norvegicus
tcaaaaccaaactggaagcccctct

SEQ ID NO: 572658 - DNA, 25 bp, Rattus norvegicus
tcaaaaccacatacttcctgctgct

SEQ ID NO: 572659 - DNA, 25 bp, Rattus norvegicus
tcaaaaccacattcttcctgctgct

SEQ ID NO: 572660 - DNA, 25 bp, Rattus norvegicus
tcaaaaccataaatagctcagctct

SEQ ID NO: 572661 - DNA, 25 bp, Rattus norvegicus
tcaaaaccataattagctcagctct

SEQ ID NO: 572662 - DNA, 25 bp, Rattus norvegicus
tcaaaaccatccaggtatcctggtc

SEQ ID NO: 572663 - DNA, 25 bp, Rattus norvegicus
tcaaaaccatcctggtatcctggtc

SEQ ID NO: 572664 - DNA, 25 bp, Rattus norvegicus
tcaaaaccccaactcagttcaactt

SEQ ID NO: 572665 - DNA, 25 bp, Rattus norvegicus
tcaaaaccccaagtcagttcaactt

SEQ ID NO: 572666 - DNA, 25 bp, Rattus norvegicus
tcaaaacccgtgatagcatatcccc

SEQ ID NO: 572667 - DNA, 25 bp, Rattus norvegicus
tcaaaacccgtgttagcatatcccc

SEQ ID NO: 572668 - DNA, 25 bp, Rattus norvegicus
tcaaaaccctatccctttgtgcttg

SEQ ID NO: 572669 - DNA, 25 bp, Rattus norvegicus
tcaaaaccctatgcctttgtgcttg

SEQ ID NO: 572670 - DNA, 25 bp, Rattus norvegicus
tcaaaacctctcaatatatctctat

SEQ ID NO: 572671 - DNA, 25 bp, Rattus norvegicus
tcaaaacctctctatatatctctat

SEQ ID NO: 572672 - DNA, 25 bp, Rattus norvegicus
tcaaaacggcgccgaacatgttgct

SEQ ID NO: 572673 - DNA, 25 bp, Rattus norvegicus
tcaaaacggcgcggaacatgttgct

SEQ ID NO: 572674 - DNA, 25 bp, Rattus norvegicus
tcaaaacgtttcaccgagcgtcgct

SEQ ID NO: 572675 - DNA, 25 bp, Rattus norvegicus
tcaaaacgtttctccgagcgtcgct

SEQ ID NO: 572676 - DNA, 25 bp, Rattus norvegicus
tcaaaactactaaattccgcccata

SEQ ID NO: 572677 - DNA, 25 bp, Rattus norvegicus
tcaaaactactatattccgcccata

SEQ ID NO: 572678 - DNA, 25 bp, Rattus norvegicus
tcaaaactagggaccgctcaggctg

SEQ ID NO: 572679 - DNA, 25 bp, Rattus norvegicus
tcaaaactagggtccgctcaggctg

SEQ ID NO: 572680 - DNA, 25 bp, Rattus norvegicus
tcaaaactcactatacccatgcctt

SEQ ID NO: 572681 - DNA, 25 bp, Rattus norvegicus
tcaaaactcactttacccatgcctt

SEQ ID NO: 572682 - DNA, 25 bp, Rattus norvegicus
tcaaaactgctgagtctggtacagt

SEQ ID NO: 572683 - DNA, 25 bp, Rattus norvegicus
tcaaaactgctgtgtctggtacagt

SEQ ID NO: 572684 - DNA, 25 bp, Rattus norvegicus
tcaaaactgcttaatcctctgagcc

SEQ ID NO: 572685 - DNA, 25 bp, Rattus norvegicus
tcaaaactgctttatcctctgagcc

SEQ ID NO: 572686 - DNA, 25 bp, Rattus norvegicus
tcaaaacttgttcatcagcttataa

SEQ ID NO: 572687 - DNA, 25 bp, Rattus norvegicus
tcaaaacttgttgatcagcttataa

SEQ ID NO: 572688 - DNA, 25 bp, Rattus norvegicus
tcaaaagaatgcataggacaattcc

SEQ ID NO: 572689 - DNA, 25 bp, Rattus norvegicus
tcaaaagaatgcttaggacaattcc

SEQ ID NO: 572690 - DNA, 25 bp, Rattus norvegicus
tcaaaagacattcctttacccctgg

SEQ ID NO: 572691 - DNA, 25 bp, Rattus norvegicus
tcaaaagacattgctttacccctgg

SEQ ID NO: 572692 - DNA, 25 bp, Rattus norvegicus
tcaaaagatcctctgtgggctgggc

SEQ ID NO: 572693 - DNA, 25 bp, Rattus norvegicus
tcaaaagatcctgtgtgggctgggc

SEQ ID NO: 572694 - DNA, 25 bp, Rattus norvegicus
tcaaaagcaaccatgcctctggcat

SEQ ID NO: 572695 - DNA, 25 bp, Rattus norvegicus
tcaaaagcaaccttgcctctggcat

SEQ ID NO: 572696 - DNA, 25 bp, Rattus norvegicus
tcaaaagcagctcggacgacgtccg

SEQ ID NO: 572697 - DNA, 25 bp, Rattus norvegicus
tcaaaagcagctgggacgacgtccg

SEQ ID NO: 572698 - DNA, 25 bp, Rattus norvegicus
tcaaaagcaggaacaggcacgggtt

SEQ ID NO: 572699 - DNA, 25 bp, Rattus norvegicus
tcaaaagcaggatcaggcacgggtt

SEQ ID NO: 572700 - DNA, 25 bp, Rattus norvegicus
tcaaaagcagttaccattccctagg

SEQ ID NO: 572701 - DNA, 25 bp, Rattus norvegicus
tcaaaagcagtttccattccctagg

SEQ ID NO: 572702 - DNA, 25 bp, Rattus norvegicus
tcaaaagcctctaacgggatttcca

SEQ ID NO: 572703 - DNA, 25 bp, Rattus norvegicus
tcaaaagcctcttacgggatttcca

SEQ ID NO: 572704 - DNA, 25 bp, Rattus norvegicus
tcaaaagctggacaggctggcccct

SEQ ID NO: 572705 - DNA, 25 bp, Rattus norvegicus
tcaaaagctggagaggctggcccct

SEQ ID NO: 572706 - DNA, 25 bp, Rattus norvegicus
tcaaaaggaactaacttgccgtcca

SEQ ID NO: 572707 - DNA, 25 bp, Rattus norvegicus
tcaaaaggaacttacttgccgtcca

SEQ ID NO: 572708 - DNA, 25 bp, Rattus norvegicus
tcaaaaggcccaagaatgcagtccc

SEQ ID NO: 572709 - DNA, 25 bp, Rattus norvegicus
tcaaaaggcccatgaatgcagtccc

SEQ ID NO: 572710 - DNA, 25 bp, Rattus norvegicus
tcaaaaggcctcagcaaccgtgggt

SEQ ID NO: 572711 - DNA, 25 bp, Rattus norvegicus
tcaaaaggcctctgcaaccgtgggt

SEQ ID NO: 572712 - DNA, 25 bp, Rattus norvegicus
tcaaaaggcctgaaggactcctaag

SEQ ID NO: 572713 - DNA, 25 bp, Rattus norvegicus
tcaaaaggcctgtaggactcctaag

SEQ ID NO: 572714 - DNA, 25 bp, Rattus norvegicus
tcaaaaggctgtcggcagggtcctc

SEQ ID NO: 572715 - DNA, 25 bp, Rattus norvegicus
tcaaaaggctgtgggcagggtcctc

SEQ ID NO: 572716 - DNA, 25 bp, Rattus norvegicus
tcaaaaggcttgatcttcctcacca

SEQ ID NO: 572717 - DNA, 25 bp, Rattus norvegicus
tcaaaaggcttgttcttcctcacca

SEQ ID NO: 572718 - DNA, 25 bp, Rattus norvegicus
tcaaaagtcaaaacggtttcccagg

SEQ ID NO: 572719 - DNA, 25 bp, Rattus norvegicus
tcaaaagtcaaatcggtttcccagg

SEQ ID NO: 572720 - DNA, 25 bp, Rattus norvegicus
tcaaaagtgatcacggagccgccgc

SEQ ID NO: 572721 - DNA, 25 bp, Rattus norvegicus
tcaaaagtgatctcggagccgccgc

SEQ ID NO: 572722 - DNA, 25 bp, Rattus norvegicus
tcaaaagttacccggcttctactgt

SEQ ID NO: 572723 - DNA, 25 bp, Rattus norvegicus
tcaaaagttaccgggcttctactgt

SEQ ID NO: 572724 - DNA, 25 bp, Rattus norvegicus
tcaaaatacaacatagcccagccta

SEQ ID NO: 572725 - DNA, 25 bp, Rattus norvegicus
tcaaaatacaacttagcccagccta

SEQ ID NO: 572726 - DNA, 25 bp, Rattus norvegicus
tcaaaatcagcaactcttaccactt

SEQ ID NO: 572727 - DNA, 25 bp, Rattus norvegicus
tcaaaatcagcatctcttaccactt

SEQ ID NO: 572728 - DNA, 25 bp, Rattus norvegicus
tcaaaatcatggagacaaaggtccc

SEQ ID NO: 572729 - DNA, 25 bp, Rattus norvegicus
tcaaaatcatggtgacaaaggtccc

SEQ ID NO: 572730 - DNA, 25 bp, Rattus norvegicus
tcaaaatcccgacttccatccgtgg

SEQ ID NO: 572731 - DNA, 25 bp, Rattus norvegicus
tcaaaatcccgagttccatccgtgg

SEQ ID NO: 572732 - DNA, 25 bp, Rattus norvegicus
tcaaaatcccttaccatgtgtattc

SEQ ID NO: 572733 - DNA, 25 bp, Rattus norvegicus
tcaaaatcccttacccaacgtgatg

SEQ ID NO: 572734 - DNA, 25 bp, Rattus norvegicus
tcaaaatccctttccatgtgtattc

SEQ ID NO: 572735 - DNA, 25 bp, Rattus norvegicus
tcaaaatccctttcccaacgtgatg

SEQ ID NO: 572736 - DNA, 25 bp, Rattus norvegicus
tcaaaatcctctctaaaccccatat

SEQ ID NO: 572737 - DNA, 25 bp, Rattus norvegicus
tcaaaatcctctgtaaaccccatat

SEQ ID NO: 572738 - DNA, 25 bp, Rattus norvegicus
tcaaaatcgtggacctatttttata

SEQ ID NO: 572739 - DNA, 25 bp, Rattus norvegicus
tcaaaatcgtggtcctatttttata

SEQ ID NO: 572740 - DNA, 25 bp, Rattus norvegicus
tcaaaatgccatactcttactgccc

SEQ ID NO: 572741 - DNA, 25 bp, Rattus norvegicus
tcaaaatgccattctcttactgccc

SEQ ID NO: 572742 - DNA, 25 bp, Rattus norvegicus
tcaaaatggcttctcccgagagttc

SEQ ID NO: 572743 - DNA, 25 bp, Rattus norvegicus
tcaaaatggcttgtcccgagagttc

SEQ ID NO: 572744 - DNA, 25 bp, Rattus norvegicus
tcaaaatgtgaaacccacacccggg

SEQ ID NO: 572745 - DNA, 25 bp, Rattus norvegicus
tcaaaatgtgaatcccacacccggg

SEQ ID NO: 572746 - DNA, 25 bp, Rattus norvegicus
tcaaaattcttgcagctcaactccc

SEQ ID NO: 572747 - DNA, 25 bp, Rattus norvegicus
tcaaaattcttggagctcaactccc

SEQ ID NO: 572748 - DNA, 25 bp, Rattus norvegicus
tcaaacaagggacaagcaggctcaa

SEQ ID NO: 572749 - DNA, 25 bp, Rattus norvegicus
tcaaacaagggagaagcaggctcaa

SEQ ID NO: 572750 - DNA, 25 bp, Rattus norvegicus
tcaaacaaggttcttcccgaactct

SEQ ID NO: 572751 - DNA, 25 bp, Rattus norvegicus
tcaaacaaggttgttcccgaactct

SEQ ID NO: 572752 - DNA, 25 bp, Rattus norvegicus
tcaaacacatgcatctctgtctgta

SEQ ID NO: 572753 - DNA, 25 bp, Rattus norvegicus
tcaaacacatgcttctctgtctgta

SEQ ID NO: 572754 - DNA, 25 bp, Rattus norvegicus
tcaaacaccagaaacactcttcttc

SEQ ID NO: 572755 - DNA, 25 bp, Rattus norvegicus
tcaaacaccagatacactcttcttc

SEQ ID NO: 572756 - DNA, 25 bp, Rattus norvegicus
tcaaacagaaagacctcagccacgt

SEQ ID NO: 572757 - DNA, 25 bp, Rattus norvegicus
tcaaacagaaagtcctcagccacgt

SEQ ID NO: 572758 - DNA, 25 bp, Rattus norvegicus
tcaaacagccagaatatatgcatat

SEQ ID NO: 572759 - DNA, 25 bp, Rattus norvegicus
tcaaacagccagtatatatgcatat

SEQ ID NO: 572760 - DNA, 25 bp, Rattus norvegicus
tcaaacagctggcagagtgcctttc

SEQ ID NO: 572761 - DNA, 25 bp, Rattus norvegicus
tcaaacagctgggagagtgcctttc

SEQ ID NO: 572762 - DNA, 25 bp, Rattus norvegicus
tcaaacatcccgacttgaaatccaa

SEQ ID NO: 572763 - DNA, 25 bp, Rattus norvegicus
tcaaacatcccgtcttgaaatccaa

SEQ ID NO: 572764 - DNA, 25 bp, Rattus norvegicus
tcaaacatgaagacccctgtgccaa

SEQ ID NO: 572765 - DNA, 25 bp, Rattus norvegicus
tcaaacatgaagtcccctgtgccaa

SEQ ID NO: 572766 - DNA, 25 bp, Rattus norvegicus
tcaaacatggttagtggcttacaac

SEQ ID NO: 572767 - DNA, 25 bp, Rattus norvegicus
tcaaacatggtttgtggcttacaac

SEQ ID NO: 572768 - DNA, 25 bp, Rattus norvegicus
tcaaacattttcatgcagcctggtt

SEQ ID NO: 572769 - DNA, 25 bp, Rattus norvegicus
tcaaacattttcttgcagcctggtt

SEQ ID NO: 572770 - DNA, 25 bp, Rattus norvegicus
tcaaaccacaacactggttcttctc

SEQ ID NO: 572771 - DNA, 25 bp, Rattus norvegicus
tcaaaccacaactctggttcttctc

SEQ ID NO: 572772 - DNA, 25 bp, Rattus norvegicus
tcaaaccaccttaatctcttttcct

SEQ ID NO: 572773 - DNA, 25 bp, Rattus norvegicus
tcaaaccacctttatctcttttcct

SEQ ID NO: 572774 - DNA, 25 bp, Rattus norvegicus
tcaaacccaccaaacacttttgtct

SEQ ID NO: 572775 - DNA, 25 bp, Rattus norvegicus
tcaaacccaccatacacttttgtct

SEQ ID NO: 572776 - DNA, 25 bp, Rattus norvegicus
tcaaacccaggaaagcatgccagct

SEQ ID NO: 572777 - DNA, 25 bp, Rattus norvegicus
tcaaacccaggatagcatgccagct

SEQ ID NO: 572778 - DNA, 25 bp, Rattus norvegicus
tcaaaccccaggagacagctcctgt

SEQ ID NO: 572779 - DNA, 25 bp, Rattus norvegicus
tcaaaccccaggtgacagctcctgt

SEQ ID NO: 572780 - DNA, 25 bp, Rattus norvegicus
tcaaacccctcaccttcttaaagtt

SEQ ID NO: 572781 - DNA, 25 bp, Rattus norvegicus
tcaaacccctcagcttcttaaagtt

SEQ ID NO: 572782 - DNA, 25 bp, Rattus norvegicus
tcaaaccgtgagcaatttcctgtgg

SEQ ID NO: 572783 - DNA, 25 bp, Rattus norvegicus
tcaaaccgtgaggaatttcctgtgg

SEQ ID NO: 572784 - DNA, 25 bp, Rattus norvegicus
tcaaacctcattccttatcatctac

SEQ ID NO: 572785 - DNA, 25 bp, Rattus norvegicus
tcaaacctcattgcttatcatctac

SEQ ID NO: 572786 - DNA, 25 bp, Rattus norvegicus
tcaaacctctccagactctaattta

SEQ ID NO: 572787 - DNA, 25 bp, Rattus norvegicus
tcaaacctctcctgactctaattta

SEQ ID NO: 572788 - DNA, 25 bp, Rattus norvegicus
tcaaaccttggcacacaggtgtgat

SEQ ID NO: 572789 - DNA, 25 bp, Rattus norvegicus
tcaaaccttggctcacaggtgtgat

SEQ ID NO: 572790 - DNA, 25 bp, Rattus norvegicus
tcaaaccttttcagggtaccctcat

SEQ ID NO: 572791 - DNA, 25 bp, Rattus norvegicus
tcaaaccttttctgggtaccctcat

SEQ ID NO: 572792 - DNA, 25 bp, Rattus norvegicus
tcaaacgaagaaacctgggcccgtg

SEQ ID NO: 572793 - DNA, 25 bp, Rattus norvegicus
tcaaacgaagaatcctgggcccgtg

SEQ ID NO: 572794 - DNA, 25 bp, Rattus norvegicus
tcaaacgcatcaccagcctggaggt

SEQ ID NO: 572795 - DNA, 25 bp, Rattus norvegicus
tcaaacgcatcagcagcctggaggt

SEQ ID NO: 572796 - DNA, 25 bp, Rattus norvegicus
tcaaacggacttaggtgccacctac

SEQ ID NO: 572797 - DNA, 25 bp, Rattus norvegicus
tcaaacggactttggtgccacctac

SEQ ID NO: 572798 - DNA, 25 bp, Rattus norvegicus
tcaaacggccttaatggctttggtt

SEQ ID NO: 572799 - DNA, 25 bp, Rattus norvegicus
tcaaacggcctttatggctttggtt

SEQ ID NO: 572800 - DNA, 25 bp, Rattus norvegicus
tcaaacgtaattccatggcgctctc

SEQ ID NO: 572801 - DNA, 25 bp, Rattus norvegicus
tcaaacgtaattgcatggcgctctc

SEQ ID NO: 572802 - DNA, 25 bp, Rattus norvegicus
tcaaacgtgctacagatcccagtac

SEQ ID NO: 572803 - DNA, 25 bp, Rattus norvegicus
tcaaacgtgctaccataactggttt

SEQ ID NO: 572804 - DNA, 25 bp, Rattus norvegicus
tcaaacgtgctagagatcccagtac

SEQ ID NO: 572805 - DNA, 25 bp, Rattus norvegicus
tcaaacgtgctagcataactggttt

SEQ ID NO: 572806 - DNA, 25 bp, Rattus norvegicus
tcaaacgttttcatctctcttgtct

SEQ ID NO: 572807 - DNA, 25 bp, Rattus norvegicus
tcaaacgttttcttctctcttgtct

SEQ ID NO: 572808 - DNA, 25 bp, Rattus norvegicus
tcaaactacgtcacccaaacaaaat

SEQ ID NO: 572809 - DNA, 25 bp, Rattus norvegicus
tcaaactacgtctcccaaacaaaat

SEQ ID NO: 572810 - DNA, 25 bp, Rattus norvegicus
tcaaactcaaaaatcctcttgccct

SEQ ID NO: 572811 - DNA, 25 bp, Rattus norvegicus
tcaaactcaaaattcctcttgccct

SEQ ID NO: 572812 - DNA, 25 bp, Rattus norvegicus
tcaaactcacagcttgcttcactct

SEQ ID NO: 572813 - DNA, 25 bp, Rattus norvegicus
tcaaactcacaggttgcttcactct

SEQ ID NO: 572814 - DNA, 25 bp, Rattus norvegicus
tcaaactcacttagccccattggtt

SEQ ID NO: 572815 - DNA, 25 bp, Rattus norvegicus
tcaaactcactttgccccattggtt

SEQ ID NO: 572816 - DNA, 25 bp, Rattus norvegicus
tcaaactctagcatggcctcttttt

SEQ ID NO: 572817 - DNA, 25 bp, Rattus norvegicus
tcaaactctagcttggcctcttttt

SEQ ID NO: 572818 - DNA, 25 bp, Rattus norvegicus
tcaaactcttaacgctggaccgggt

SEQ ID NO: 572819 - DNA, 25 bp, Rattus norvegicus
tcaaactcttaaggctggaccgggt

SEQ ID NO: 572820 - DNA, 25 bp, Rattus norvegicus
tcaaactgctccacgatgaagcgaa

SEQ ID NO: 572821 - DNA, 25 bp, Rattus norvegicus
tcaaactgctcctcgatgaagcgaa

SEQ ID NO: 572822 - DNA, 25 bp, Rattus norvegicus
tcaaactggtgaacaaggcgctgct

SEQ ID NO: 572823 - DNA, 25 bp, Rattus norvegicus
tcaaactggtgatcaaggcgctgct

SEQ ID NO: 572824 - DNA, 25 bp, Rattus norvegicus
tcaaactgttgtctgactggagata

SEQ ID NO: 572825 - DNA, 25 bp, Rattus norvegicus
tcaaactgttgtgtgactggagata

SEQ ID NO: 572826 - DNA, 25 bp, Rattus norvegicus
tcaaacttcattacgctttcgtgtg

SEQ ID NO: 572827 - DNA, 25 bp, Rattus norvegicus
tcaaacttcatttcgctttcgtgtg

SEQ ID NO: 572828 - DNA, 25 bp, Rattus norvegicus
tcaaacttgcatctctatccatatc

SEQ ID NO: 572829 - DNA, 25 bp, Rattus norvegicus
tcaaacttgcatgtctatccatatc

SEQ ID NO: 572830 - DNA, 25 bp, Rattus norvegicus
tcaaacttgctaccccagcagggaa

SEQ ID NO: 572831 - DNA, 25 bp, Rattus norvegicus
tcaaacttgctagcccagcagggaa

SEQ ID NO: 572832 - DNA, 25 bp, Rattus norvegicus
tcaaagaatattatattgggcccaa

SEQ ID NO: 572833 - DNA, 25 bp, Rattus norvegicus
tcaaagaatattttattgggcccaa

SEQ ID NO: 572834 - DNA, 25 bp, Rattus norvegicus
tcaaagaattctacactccggcagt

SEQ ID NO: 572835 - DNA, 25 bp, Rattus norvegicus
tcaaagaattcttcactccggcagt

SEQ ID NO: 572836 - DNA, 25 bp, Rattus norvegicus
tcaaagacaagcagatccacccggg

SEQ ID NO: 572837 - DNA, 25 bp, Rattus norvegicus
tcaaagacaagctgatccacccggg

SEQ ID NO: 572838 - DNA, 25 bp, Rattus norvegicus
tcaaagacacacaggatccccgagg

SEQ ID NO: 572839 - DNA, 25 bp, Rattus norvegicus
tcaaagacacactggatccccgagg

SEQ ID NO: 572840 - DNA, 25 bp, Rattus norvegicus
tcaaagacccatacatcacggtgcc

SEQ ID NO: 572841 - DNA, 25 bp, Rattus norvegicus
tcaaagacccattcatcacggtgcc

SEQ ID NO: 572842 - DNA, 25 bp, Rattus norvegicus
tcaaagacccttcgcaaaccctgaa

SEQ ID NO: 572843 - DNA, 25 bp, Rattus norvegicus
tcaaagacccttggcaaaccctgaa

SEQ ID NO: 572844 - DNA, 25 bp, Rattus norvegicus
tcaaagactcagaagacctctccac

SEQ ID NO: 572845 - DNA, 25 bp, Rattus norvegicus
tcaaagactcagtagacctctccac

SEQ ID NO: 572846 - DNA, 25 bp, Rattus norvegicus
tcaaagagagctccacgtttcacct

SEQ ID NO: 572847 - DNA, 25 bp, Rattus norvegicus
tcaaagagagctgcacgtttcacct

SEQ ID NO: 572848 - DNA, 25 bp, Rattus norvegicus
tcaaagagatcaaccctctgggctt

SEQ ID NO: 572849 - DNA, 25 bp, Rattus norvegicus
tcaaagagatcatccctctgggctt

SEQ ID NO: 572850 - DNA, 25 bp, Rattus norvegicus
tcaaagaggctgctgtctctgccaa

SEQ ID NO: 572851 - DNA, 25 bp, Rattus norvegicus
tcaaagaggctggtgtctctgccaa

SEQ ID NO: 572852 - DNA, 25 bp, Rattus norvegicus
tcaaagaggttactgactgtgtctc

SEQ ID NO: 572853 - DNA, 25 bp, Rattus norvegicus
tcaaagaggttagtgactgtgtctc

SEQ ID NO: 572854 - DNA, 25 bp, Rattus norvegicus
tcaaagagtcagcaagccctctggg

SEQ ID NO: 572855 - DNA, 25 bp, Rattus norvegicus
tcaaagagtcaggaagccctctggg

SEQ ID NO: 572856 - DNA, 25 bp, Rattus norvegicus
tcaaagatctgacacccacagccat

SEQ ID NO: 572857 - DNA, 25 bp, Rattus norvegicus
tcaaagatctgagacccacagccat

SEQ ID NO: 572858 - DNA, 25 bp, Rattus norvegicus
tcaaagattctgacgcctgtgtcat

SEQ ID NO: 572859 - DNA, 25 bp, Rattus norvegicus
tcaaagattctgtcgcctgtgtcat

SEQ ID NO: 572860 - DNA, 25 bp, Rattus norvegicus
tcaaagcagcccctgcaaagcaatg

SEQ ID NO: 572861 - DNA, 25 bp, Rattus norvegicus
tcaaagcagcccgtgcaaagcaatg

SEQ ID NO: 572862 - DNA, 25 bp, Rattus norvegicus
tcaaagcatggtctctcactccatt

SEQ ID NO: 572863 - DNA, 25 bp, Rattus norvegicus
tcaaagcatggtgtctcactccatt

SEQ ID NO: 572864 - DNA, 25 bp, Rattus norvegicus
tcaaagccaaccagggtaacttagt

SEQ ID NO: 572865 - DNA, 25 bp, Rattus norvegicus
tcaaagccaacctgggtaacttagt

SEQ ID NO: 572866 - DNA, 25 bp, Rattus norvegicus
tcaaagccaaggatgtctgcgacag

SEQ ID NO: 572867 - DNA, 25 bp, Rattus norvegicus
tcaaagccaaggcagtgtcgccgcc

SEQ ID NO: 572868 - DNA, 25 bp, Rattus norvegicus
tcaaagccaagggagtgtcgccgcc

SEQ ID NO: 572869 - DNA, 25 bp, Rattus norvegicus
tcaaagccaaggttgtctgcgacag

SEQ ID NO: 572870 - DNA, 25 bp, Rattus norvegicus
tcaaagcccgggatgtcgcggctcc

SEQ ID NO: 572871 - DNA, 25 bp, Rattus norvegicus
tcaaagcccgggttgtcgcggctcc

SEQ ID NO: 572872 - DNA, 25 bp, Rattus norvegicus
tcaaagcctgcaacactacttgtgt

SEQ ID NO: 572873 - DNA, 25 bp, Rattus norvegicus
tcaaagcctgcatcactacttgtgt

SEQ ID NO: 572874 - DNA, 25 bp, Rattus norvegicus
tcaaagccttctacagacatcatca

SEQ ID NO: 572875 - DNA, 25 bp, Rattus norvegicus
tcaaagccttcttcagacatcatca

SEQ ID NO: 572876 - DNA, 25 bp, Rattus norvegicus
tcaaagcctttacttgtcccaggtt

SEQ ID NO: 572877 - DNA, 25 bp, Rattus norvegicus
tcaaagcctttagttgtcccaggtt

SEQ ID NO: 572878 - DNA, 25 bp, Rattus norvegicus
tcaaagcggctcagctggatgggct

SEQ ID NO: 572879 - DNA, 25 bp, Rattus norvegicus
tcaaagcggctctgctggatgggct

SEQ ID NO: 572880 - DNA, 25 bp, Rattus norvegicus
tcaaagcggttacggaggccagcac

SEQ ID NO: 572881 - DNA, 25 bp, Rattus norvegicus
tcaaagcggttagggaggccagcac

SEQ ID NO: 572882 - DNA, 25 bp, Rattus norvegicus
tcaaagcggttgcagaggccacacc

SEQ ID NO: 572883 - DNA, 25 bp, Rattus norvegicus
tcaaagcggttggagaggccacacc

SEQ ID NO: 572884 - DNA, 25 bp, Rattus norvegicus
tcaaagctaatcctcccttttgagg

SEQ ID NO: 572885 - DNA, 25 bp, Rattus norvegicus
tcaaagctaatcgtcccttttgagg

SEQ ID NO: 572886 - DNA, 25 bp, Rattus norvegicus
tcaaagctagctaatcctcttctca

SEQ ID NO: 572887 - DNA, 25 bp, Rattus norvegicus
tcaaagctagcttatcctcttctca

SEQ ID NO: 572888 - DNA, 25 bp, Rattus norvegicus
tcaaagctcagtattcctcaaatct

SEQ ID NO: 572889 - DNA, 25 bp, Rattus norvegicus
tcaaagctcagttttcctcaaatct

SEQ ID NO: 572890 - DNA, 25 bp, Rattus norvegicus
tcaaagctccttccatcgagactgt

SEQ ID NO: 572891 - DNA, 25 bp, Rattus norvegicus
tcaaagctccttgcatcgagactgt

SEQ ID NO: 572892 - DNA, 25 bp, Rattus norvegicus
tcaaagcttttcactaccatgtttc

SEQ ID NO: 572893 - DNA, 25 bp, Rattus norvegicus
tcaaagcttttctctaccatgtttc

SEQ ID NO: 572894 - DNA, 25 bp, Rattus norvegicus
tcaaaggaacgcaccatggcttctt

SEQ ID NO: 572895 - DNA, 25 bp, Rattus norvegicus
tcaaaggaacgctccatggcttctt

SEQ ID NO: 572896 - DNA, 25 bp, Rattus norvegicus
tcaaaggaatccagcacttccgcct

SEQ ID NO: 572897 - DNA, 25 bp, Rattus norvegicus
tcaaaggaatcctgcacttccgcct

SEQ ID NO: 572898 - DNA, 25 bp, Rattus norvegicus
tcaaaggactcccttctgggtgaaa

SEQ ID NO: 572899 - DNA, 25 bp, Rattus norvegicus
tcaaaggactccgttctgggtgaaa

SEQ ID NO: 572900 - DNA, 25 bp, Rattus norvegicus
tcaaaggactgaacttggcaacaag

SEQ ID NO: 572901 - DNA, 25 bp, Rattus norvegicus
tcaaaggactgatcttggcaacaag

SEQ ID NO: 572902 - DNA, 25 bp, Rattus norvegicus
tcaaaggacttgaatttcccctgct

SEQ ID NO: 572903 - DNA, 25 bp, Rattus norvegicus
tcaaaggacttgtatttcccctgct

SEQ ID NO: 572904 - DNA, 25 bp, Rattus norvegicus
tcaaaggagttcctagggtggctaa

SEQ ID NO: 572905 - DNA, 25 bp, Rattus norvegicus
tcaaaggagttcgtagggtggctaa

SEQ ID NO: 572906 - DNA, 25 bp, Rattus norvegicus
tcaaaggcatccattttctatcaga

SEQ ID NO: 572907 - DNA, 25 bp, Rattus norvegicus
tcaaaggcatcctttttctatcaga

SEQ ID NO: 572908 - DNA, 25 bp, Rattus norvegicus
tcaaaggcccagagaccaatgcagc

SEQ ID NO: 572909 - DNA, 25 bp, Rattus norvegicus
tcaaaggcccagtgaccaatgcagc

SEQ ID NO: 572910 - DNA, 25 bp, Rattus norvegicus
tcaaaggcccgaccactacagtggt

SEQ ID NO: 572911 - DNA, 25 bp, Rattus norvegicus
tcaaaggcccgagcactacagtggt

SEQ ID NO: 572912 - DNA, 25 bp, Rattus norvegicus
tcaaaggccgccatgaactcagcga

SEQ ID NO: 572913 - DNA, 25 bp, Rattus norvegicus
tcaaaggccgccttgaactcagcga

SEQ ID NO: 572914 - DNA, 25 bp, Rattus norvegicus
tcaaaggccggacagctctcgagag

SEQ ID NO: 572915 - DNA, 25 bp, Rattus norvegicus
tcaaaggccggagagctctcgagag

SEQ ID NO: 572916 - DNA, 25 bp, Rattus norvegicus
tcaaaggcgtgtatcgatactgcaa

SEQ ID NO: 572917 - DNA, 25 bp, Rattus norvegicus
tcaaaggcgtgtttcgatactgcaa

SEQ ID NO: 572918 - DNA, 25 bp, Rattus norvegicus
tcaaagggaggtcaagctccatgcc

SEQ ID NO: 572919 - DNA, 25 bp, Rattus norvegicus
tcaaagggaggtgaagctccatgcc

SEQ ID NO: 572920 - DNA, 25 bp, Rattus norvegicus
tcaaagggttgtatgcctctcccag

SEQ ID NO: 572921 - DNA, 25 bp, Rattus norvegicus
tcaaagggttgtttgcctctcccag

SEQ ID NO: 572922 - DNA, 25 bp, Rattus norvegicus
tcaaaggtacatctttcatcctctc

SEQ ID NO: 572923 - DNA, 25 bp, Rattus norvegicus
tcaaaggtacatgtttcatcctctc

SEQ ID NO: 572924 - DNA, 25 bp, Rattus norvegicus
tcaaaggtagtcacttgtcccagtc

SEQ ID NO: 572925 - DNA, 25 bp, Rattus norvegicus
tcaaaggtagtctcttgtcccagtc

SEQ ID NO: 572926 - DNA, 25 bp, Rattus norvegicus
tcaaaggttcacacactgggccagt

SEQ ID NO: 572927 - DNA, 25 bp, Rattus norvegicus
tcaaaggttcactcactgggccagt

SEQ ID NO: 572928 - DNA, 25 bp, Rattus norvegicus
tcaaaggttgctacactctgagtgg

SEQ ID NO: 572929 - DNA, 25 bp, Rattus norvegicus
tcaaaggttgcttcactctgagtgg

SEQ ID NO: 572930 - DNA, 25 bp, Rattus norvegicus
tcaaaggttttgaccccaaccatga

SEQ ID NO: 572931 - DNA, 25 bp, Rattus norvegicus
tcaaaggttttgtccccaaccatga

SEQ ID NO: 572932 - DNA, 25 bp, Rattus norvegicus
tcaaagtacctgctccctgaagctt

SEQ ID NO: 572933 - DNA, 25 bp, Rattus norvegicus
tcaaagtacctggtccctgaagctt

SEQ ID NO: 572934 - DNA, 25 bp, Rattus norvegicus
tcaaagtccacaacttaccagaaga

SEQ ID NO: 572935 - DNA, 25 bp, Rattus norvegicus
tcaaagtccacatcttaccagaaga

SEQ ID NO: 572936 - DNA, 25 bp, Rattus norvegicus
tcaaagtcccagatctcctaggcat

SEQ ID NO: 572937 - DNA, 25 bp, Rattus norvegicus
tcaaagtcccagttctcctaggcat

SEQ ID NO: 572938 - DNA, 25 bp, Rattus norvegicus
tcaaagtcctttcttcccataagtt

SEQ ID NO: 572939 - DNA, 25 bp, Rattus norvegicus
tcaaagtcctttgttcccataagtt

SEQ ID NO: 572940 - DNA, 25 bp, Rattus norvegicus
tcaaagtctgaacttctttttccaa

SEQ ID NO: 572941 - DNA, 25 bp, Rattus norvegicus
tcaaagtctgaagttctttttccaa

SEQ ID NO: 572942 - DNA, 25 bp, Rattus norvegicus
tcaaagtctgtaaatgggaacctat

SEQ ID NO: 572943 - DNA, 25 bp, Rattus norvegicus
tcaaagtctgtatatgggaacctat

SEQ ID NO: 572944 - DNA, 25 bp, Rattus norvegicus
tcaaagtcttatcgcccggctcata

SEQ ID NO: 572945 - DNA, 25 bp, Rattus norvegicus
tcaaagtcttatggcccggctcata

SEQ ID NO: 572946 - DNA, 25 bp, Rattus norvegicus
tcaaagtcttgactccaggcactgt

SEQ ID NO: 572947 - DNA, 25 bp, Rattus norvegicus
tcaaagtcttgagtccaggcactgt

SEQ ID NO: 572948 - DNA, 25 bp, Rattus norvegicus
tcaaagtgactacgtgactctgggc

SEQ ID NO: 572949 - DNA, 25 bp, Rattus norvegicus
tcaaagtgactaggtgactctgggc

SEQ ID NO: 572950 - DNA, 25 bp, Rattus norvegicus
tcaaagtgccttaccttagtcggcc

SEQ ID NO: 572951 - DNA, 25 bp, Rattus norvegicus
tcaaagtgcctttccttagtcggcc

SEQ ID NO: 572952 - DNA, 25 bp, Rattus norvegicus
tcaaagtgctttaagaatctagact

SEQ ID NO: 572953 - DNA, 25 bp, Rattus norvegicus
tcaaagtgcttttagaatctagact

SEQ ID NO: 572954 - DNA, 25 bp, Rattus norvegicus
tcaaagtgtagccaggttccctctg

SEQ ID NO: 572955 - DNA, 25 bp, Rattus norvegicus
tcaaagtgtagcgaggttccctctg

SEQ ID NO: 572956 - DNA, 25 bp, Rattus norvegicus
tcaaagtgtctgactcaaattccca

SEQ ID NO: 572957 - DNA, 25 bp, Rattus norvegicus
tcaaagtgtctgtctcaaattccca

SEQ ID NO: 572958 - DNA, 25 bp, Rattus norvegicus
tcaaagtttctgctacacagtgaat

SEQ ID NO: 572959 - DNA, 25 bp, Rattus norvegicus
tcaaagtttctggtacacagtgaat

SEQ ID NO: 572960 - DNA, 25 bp, Rattus norvegicus
tcaaataccaatcctcccaggtctg

SEQ ID NO: 572961 - DNA, 25 bp, Rattus norvegicus
tcaaataccaatgctcccaggtctg

SEQ ID NO: 572962 - DNA, 25 bp, Rattus norvegicus
tcaaatacctggagtgctcagcact

SEQ ID NO: 572963 - DNA, 25 bp, Rattus norvegicus
tcaaatacctggtgtgctcagcact

SEQ ID NO: 572964 - DNA, 25 bp, Rattus norvegicus
tcaaatatcttgaactgccctgtca

SEQ ID NO: 572965 - DNA, 25 bp, Rattus norvegicus
tcaaatatcttgtactgccctgtca

SEQ ID NO: 572966 - DNA, 25 bp, Rattus norvegicus
tcaaatatgatgctgtctcctgctg

SEQ ID NO: 572967 - DNA, 25 bp, Rattus norvegicus
tcaaatatgatggtgtctcctgctg

SEQ ID NO: 572968 - DNA, 25 bp, Rattus norvegicus
tcaaatcaatgtacagaggtgggcg

SEQ ID NO: 572969 - DNA, 25 bp, Rattus norvegicus
tcaaatcaatgttcagaggtgggcg

SEQ ID NO: 572970 - DNA, 25 bp, Rattus norvegicus
tcaaatcagtggcatggacggtcat

SEQ ID NO: 572971 - DNA, 25 bp, Rattus norvegicus
tcaaatcagtgggatggacggtcat

SEQ ID NO: 572972 - DNA, 25 bp, Rattus norvegicus
tcaaatcagtgtcaccactcgcagc

SEQ ID NO: 572973 - DNA, 25 bp, Rattus norvegicus
tcaaatcagtgtgaccactcgcagc

SEQ ID NO: 572974 - DNA, 25 bp, Rattus norvegicus
tcaaatccaggaactctcttgcact

SEQ ID NO: 572975 - DNA, 25 bp, Rattus norvegicus
tcaaatccaggatctctcttgcact

SEQ ID NO: 572976 - DNA, 25 bp, Rattus norvegicus
tcaaatccagtgattgaagctggga

SEQ ID NO: 572977 - DNA, 25 bp, Rattus norvegicus
tcaaatccagtgtttgaagctggga

SEQ ID NO: 572978 - DNA, 25 bp, Rattus norvegicus
tcaaatccccagaacccgtgtgaaa

SEQ ID NO: 572979 - DNA, 25 bp, Rattus norvegicus
tcaaatccccagtacccgtgtgaaa

SEQ ID NO: 572980 - DNA, 25 bp, Rattus norvegicus
tcaaatccccggacccatagagcag

SEQ ID NO: 572981 - DNA, 25 bp, Rattus norvegicus
tcaaatccccggtcccatagagcag

SEQ ID NO: 572982 - DNA, 25 bp, Rattus norvegicus
tcaaatctcatcatggaaacgtcca

SEQ ID NO: 572983 - DNA, 25 bp, Rattus norvegicus
tcaaatctcatcttggaaacgtcca

SEQ ID NO: 572984 - DNA, 25 bp, Rattus norvegicus
tcaaatctgaagagggactgcctgt

SEQ ID NO: 572985 - DNA, 25 bp, Rattus norvegicus
tcaaatctgaagtgggactgcctgt

SEQ ID NO: 572986 - DNA, 25 bp, Rattus norvegicus
tcaaatctttatattacaccactta

SEQ ID NO: 572987 - DNA, 25 bp, Rattus norvegicus
tcaaatctttattttacaccactta

SEQ ID NO: 572988 - DNA, 25 bp, Rattus norvegicus
tcaaatgaagccaaacagactcccc

SEQ ID NO: 572989 - DNA, 25 bp, Rattus norvegicus
tcaaatgaagcctaacagactcccc

SEQ ID NO: 572990 - DNA, 25 bp, Rattus norvegicus
tcaaatgacaaccaccactcctgag

SEQ ID NO: 572991 - DNA, 25 bp, Rattus norvegicus
tcaaatgacaacgaccactcctgag

SEQ ID NO: 572992 - DNA, 25 bp, Rattus norvegicus
tcaaatgacgatatctcgcttctgc

SEQ ID NO: 572993 - DNA, 25 bp, Rattus norvegicus
tcaaatgacgatttctcgcttctgc

SEQ ID NO: 572994 - DNA, 25 bp, Rattus norvegicus
tcaaatgagtcacctgggttctctt

SEQ ID NO: 572995 - DNA, 25 bp, Rattus norvegicus
tcaaatgagtcagctgggttctctt

SEQ ID NO: 572996 - DNA, 25 bp, Rattus norvegicus
tcaaatgatgtgattcctcctggaa

SEQ ID NO: 572997 - DNA, 25 bp, Rattus norvegicus
tcaaatgatgtgtttcctcctggaa

SEQ ID NO: 572998 - DNA, 25 bp, Rattus norvegicus
tcaaatgcaccgctcttgccgtagg

SEQ ID NO: 572999 - DNA, 25 bp, Rattus norvegicus
tcaaatgcaccggtcttgccgtagg

SEQ ID NO: 573000 - DNA, 25 bp, Rattus norvegicus
tcaaatgcaggtctgcttacctctg

SEQ ID NO: 573001 - DNA, 25 bp, Rattus norvegicus
tcaaatgcaggtgtgcttacctctg

SEQ ID NO: 573002 - DNA, 25 bp, Rattus norvegicus
tcaaatgcattgatctcagggctgt

SEQ ID NO: 573003 - DNA, 25 bp, Rattus norvegicus
tcaaatgcattgttctcagggctgt

SEQ ID NO: 573004 - DNA, 25 bp, Rattus norvegicus
tcaaatgccattatcagacctacct

SEQ ID NO: 573005 - DNA, 25 bp, Rattus norvegicus
tcaaatgccattttcagacctacct

SEQ ID NO: 573006 - DNA, 25 bp, Rattus norvegicus
tcaaatgcttatattcataggagct

SEQ ID NO: 573007 - DNA, 25 bp, Rattus norvegicus
tcaaatgcttattttcataggagct

SEQ ID NO: 573008 - DNA, 25 bp, Rattus norvegicus
tcaaatgtctgaaggtcacccctaa

SEQ ID NO: 573009 - DNA, 25 bp, Rattus norvegicus
tcaaatgtctgatggtcacccctaa

SEQ ID NO: 573010 - DNA, 25 bp, Rattus norvegicus
tcaaatgtgtgtagcaggtcatggg

SEQ ID NO: 573011 - DNA, 25 bp, Rattus norvegicus
tcaaatgtgtgttgcaggtcatggg

SEQ ID NO: 573012 - DNA, 25 bp, Rattus norvegicus
tcaaatgttaggctagactccgttt

SEQ ID NO: 573013 - DNA, 25 bp, Rattus norvegicus
tcaaatgttagggtagactccgttt

SEQ ID NO: 573014 - DNA, 25 bp, Rattus norvegicus
tcaaatgttatcacttttcccttct

SEQ ID NO: 573015 - DNA, 25 bp, Rattus norvegicus
tcaaatgttatctcttttcccttct

SEQ ID NO: 573016 - DNA, 25 bp, Rattus norvegicus
tcaaatgttttcattagggctggag

SEQ ID NO: 573017 - DNA, 25 bp, Rattus norvegicus
tcaaatgttttctttagggctggag

SEQ ID NO: 573018 - DNA, 25 bp, Rattus norvegicus
tcaaattccaccaggtaccctgctg

SEQ ID NO: 573019 - DNA, 25 bp, Rattus norvegicus
tcaaattccacctggtaccctgctg

SEQ ID NO: 573020 - DNA, 25 bp, Rattus norvegicus
tcaaattccctgacacagagattgt

SEQ ID NO: 573021 - DNA, 25 bp, Rattus norvegicus
tcaaattccctgtcacagagattgt

SEQ ID NO: 573022 - DNA, 25 bp, Rattus norvegicus
tcaaattctgatcattgctgagtca

SEQ ID NO: 573023 - DNA, 25 bp, Rattus norvegicus
tcaaattctgatgattgctgagtca

SEQ ID NO: 573024 - DNA, 25 bp, Rattus norvegicus
tcaaattgatgtaagccacggcact

SEQ ID NO: 573025 - DNA, 25 bp, Rattus norvegicus
tcaaattgatgtagggattttcccc

SEQ ID NO: 573026 - DNA, 25 bp, Rattus norvegicus
tcaaattgatgttagccacggcact

SEQ ID NO: 573027 - DNA, 25 bp, Rattus norvegicus
tcaaattgatgttgggattttcccc

SEQ ID NO: 573028 - DNA, 25 bp, Rattus norvegicus
tcaaattgccaaagtagtctcataa

SEQ ID NO: 573029 - DNA, 25 bp, Rattus norvegicus
tcaaattgccaatgtagtctcataa

SEQ ID NO: 573030 - DNA, 25 bp, Rattus norvegicus
tcaaattgggtgacgctggtgagta

SEQ ID NO: 573031 - DNA, 25 bp, Rattus norvegicus
tcaaattgggtgtcgctggtgagta

SEQ ID NO: 573032 - DNA, 25 bp, Rattus norvegicus
tcaaatttacctcaaactctcattt

SEQ ID NO: 573033 - DNA, 25 bp, Rattus norvegicus
tcaaatttacctgaaactctcattt

SEQ ID NO: 573034 - DNA, 25 bp, Rattus norvegicus
tcaaatttatcccaagccaactcat

SEQ ID NO: 573035 - DNA, 25 bp, Rattus norvegicus
tcaaatttatccgaagccaactcat

SEQ ID NO: 573036 - DNA, 25 bp, Rattus norvegicus
tcaaattttaccaagctctgcacca

SEQ ID NO: 573037 - DNA, 25 bp, Rattus norvegicus
tcaaattttacctagctctgcacca

SEQ ID NO: 573038 - DNA, 25 bp, Rattus norvegicus
tcaacaaagcgaacccaggtgcaac

SEQ ID NO: 573039 - DNA, 25 bp, Rattus norvegicus
tcaacaaagcgatcccaggtgcaac

SEQ ID NO: 573040 - DNA, 25 bp, Rattus norvegicus
tcaacaaagggaatcctcgttcgcc

SEQ ID NO: 573041 - DNA, 25 bp, Rattus norvegicus
tcaacaaagggattcctcgttcgcc

SEQ ID NO: 573042 - DNA, 25 bp, Rattus norvegicus
tcaacaaatggtcctagtctaactg

SEQ ID NO: 573043 - DNA, 25 bp, Rattus norvegicus
tcaacaaatggtgctagtctaactg

SEQ ID NO: 573044 - DNA, 25 bp, Rattus norvegicus
tcaacaaccacaaccgttacgtcat

SEQ ID NO: 573045 - DNA, 25 bp, Rattus norvegicus
tcaacaaccacatccgttacgtcat

SEQ ID NO: 573046 - DNA, 25 bp, Rattus norvegicus
tcaacaactcttatgattgagctgt

SEQ ID NO: 573047 - DNA, 25 bp, Rattus norvegicus
tcaacaactcttttgattgagctgt

SEQ ID NO: 573048 - DNA, 25 bp, Rattus norvegicus
tcaacaagaatgctcgggctaccct

SEQ ID NO: 573049 - DNA, 25 bp, Rattus norvegicus
tcaacaagaatggtcgggctaccct

SEQ ID NO: 573050 - DNA, 25 bp, Rattus norvegicus
tcaacaagacatagtccagggacat

SEQ ID NO: 573051 - DNA, 25 bp, Rattus norvegicus
tcaacaagacattgtccagggacat

SEQ ID NO: 573052 - DNA, 25 bp, Rattus norvegicus
tcaacaagatatcctccactctgta

SEQ ID NO: 573053 - DNA, 25 bp, Rattus norvegicus
tcaacaagatatgctccactctgta

SEQ ID NO: 573054 - DNA, 25 bp, Rattus norvegicus
tcaacaaggcccagtgtcctgctgc

SEQ ID NO: 573055 - DNA, 25 bp, Rattus norvegicus
tcaacaaggccctgtgtcctgctgc

SEQ ID NO: 573056 - DNA, 25 bp, Rattus norvegicus
tcaacaaggctgagcggagcaacct

SEQ ID NO: 573057 - DNA, 25 bp, Rattus norvegicus
tcaacaaggctgtgcggagcaacct

SEQ ID NO: 573058 - DNA, 25 bp, Rattus norvegicus
tcaacaatccttccctcagaaatta

SEQ ID NO: 573059 - DNA, 25 bp, Rattus norvegicus
tcaacaatccttgcctcagaaatta

SEQ ID NO: 573060 - DNA, 25 bp, Rattus norvegicus
tcaacaatcgacactggcaactaca

SEQ ID NO: 573061 - DNA, 25 bp, Rattus norvegicus
tcaacaatcgactctggcaactaca

SEQ ID NO: 573062 - DNA, 25 bp, Rattus norvegicus
tcaacaatgcatatgcagaggtctt

SEQ ID NO: 573063 - DNA, 25 bp, Rattus norvegicus
tcaacaatgcatttgcagaggtctt

SEQ ID NO: 573064 - DNA, 25 bp, Rattus norvegicus
tcaacacactgaccaggcctaggta

SEQ ID NO: 573065 - DNA, 25 bp, Rattus norvegicus
tcaacacactgagcaggcctaggta

SEQ ID NO: 573066 - DNA, 25 bp, Rattus norvegicus
tcaacacaggtcatctgacgctgcg

SEQ ID NO: 573067 - DNA, 25 bp, Rattus norvegicus
tcaacacaggtcttctgacgctgcg

SEQ ID NO: 573068 - DNA, 25 bp, Rattus norvegicus
tcaacaccaacaattgccctagatg

SEQ ID NO: 573069 - DNA, 25 bp, Rattus norvegicus
tcaacaccaacatttgccctagatg

SEQ ID NO: 573070 - DNA, 25 bp, Rattus norvegicus
tcaacaccacatacctgtagggttt

SEQ ID NO: 573071 - DNA, 25 bp, Rattus norvegicus
tcaacaccacattcctgtagggttt

SEQ ID NO: 573072 - DNA, 25 bp, Rattus norvegicus
tcaacaccattgactgcttgtcaga

SEQ ID NO: 573073 - DNA, 25 bp, Rattus norvegicus
tcaacaccattgtctgcttgtcaga

SEQ ID NO: 573074 - DNA, 25 bp, Rattus norvegicus
tcaacaccctcaaccagcaagagaa

SEQ ID NO: 573075 - DNA, 25 bp, Rattus norvegicus
tcaacaccctcatccagcaagagaa

SEQ ID NO: 573076 - DNA, 25 bp, Rattus norvegicus
tcaacaccgtccactttcaggaaag

SEQ ID NO: 573077 - DNA, 25 bp, Rattus norvegicus
tcaacaccgtcctctttcaggaaag

SEQ ID NO: 573078 - DNA, 25 bp, Rattus norvegicus
tcaacacctaagagcccttgctgtt

SEQ ID NO: 573079 - DNA, 25 bp, Rattus norvegicus
tcaacacctaagtgcccttgctgtt

SEQ ID NO: 573080 - DNA, 25 bp, Rattus norvegicus
tcaacacctcttactaatcataaaa

SEQ ID NO: 573081 - DNA, 25 bp, Rattus norvegicus
tcaacacctctttctaatcataaaa

SEQ ID NO: 573082 - DNA, 25 bp, Rattus norvegicus
tcaacacctggaatgagcttcggat

SEQ ID NO: 573083 - DNA, 25 bp, Rattus norvegicus
tcaacacctggattgagcttcggat

SEQ ID NO: 573084 - DNA, 25 bp, Rattus norvegicus
tcaacaccttccaggccagagttag

SEQ ID NO: 573085 - DNA, 25 bp, Rattus norvegicus
tcaacaccttcctggccagagttag

SEQ ID NO: 573086 - DNA, 25 bp, Rattus norvegicus
tcaacacgtcacagtggagccaaga

SEQ ID NO: 573087 - DNA, 25 bp, Rattus norvegicus
tcaacacgtcactgtggagccaaga

SEQ ID NO: 573088 - DNA, 25 bp, Rattus norvegicus
tcaacactacttacctgacacaagg

SEQ ID NO: 573089 - DNA, 25 bp, Rattus norvegicus
tcaacactactttcctgacacaagg

SEQ ID NO: 573090 - DNA, 25 bp, Rattus norvegicus
tcaacactagaaccctgtcatgcgg

SEQ ID NO: 573091 - DNA, 25 bp, Rattus norvegicus
tcaacactagaagcctgtcatgcgg

SEQ ID NO: 573092 - DNA, 25 bp, Rattus norvegicus
tcaacactgaatccctagtgagcga

SEQ ID NO: 573093 - DNA, 25 bp, Rattus norvegicus
tcaacactgaatgcctagtgagcga

SEQ ID NO: 573094 - DNA, 25 bp, Rattus norvegicus
tcaacactgcatacctgagggatgt

SEQ ID NO: 573095 - DNA, 25 bp, Rattus norvegicus
tcaacactgcattcctgagggatgt

SEQ ID NO: 573096 - DNA, 25 bp, Rattus norvegicus
tcaacactgctactttgttttgctt

SEQ ID NO: 573097 - DNA, 25 bp, Rattus norvegicus
tcaacactgctagtttgttttgctt

SEQ ID NO: 573098 - DNA, 25 bp, Rattus norvegicus
tcaacactgcttacttactctttaa

SEQ ID NO: 573099 - DNA, 25 bp, Rattus norvegicus
tcaacactgctttcttactctttaa

SEQ ID NO: 573100 - DNA, 25 bp, Rattus norvegicus
tcaacactgggcatttaggtctgtt

SEQ ID NO: 573101 - DNA, 25 bp, Rattus norvegicus
tcaacactgggcttttaggtctgtt

SEQ ID NO: 573102 - DNA, 25 bp, Rattus norvegicus
tcaacactgtttaggatggagcctg

SEQ ID NO: 573103 - DNA, 25 bp, Rattus norvegicus
tcaacactgttttggatggagcctg

SEQ ID NO: 573104 - DNA, 25 bp, Rattus norvegicus
tcaacacttcgacatgaaactggtg

SEQ ID NO: 573105 - DNA, 25 bp, Rattus norvegicus
tcaacacttcgagatgaaactggtg

SEQ ID NO: 573106 - DNA, 25 bp, Rattus norvegicus
tcaacagacctaacagatcagatgc

SEQ ID NO: 573107 - DNA, 25 bp, Rattus norvegicus
tcaacagacctatcagatcagatgc

SEQ ID NO: 573108 - DNA, 25 bp, Rattus norvegicus
tcaacagccaccatttccaatggag

SEQ ID NO: 573109 - DNA, 25 bp, Rattus norvegicus
tcaacagccaccttttccaatggag

SEQ ID NO: 573110 - DNA, 25 bp, Rattus norvegicus
tcaacagcccttatccttgagaaag

SEQ ID NO: 573111 - DNA, 25 bp, Rattus norvegicus
tcaacagcccttttccttgagaaag

SEQ ID NO: 573112 - DNA, 25 bp, Rattus norvegicus
tcaacagcggagattggttcaccaa

SEQ ID NO: 573113 - DNA, 25 bp, Rattus norvegicus
tcaacagcggagtttggttcaccaa

SEQ ID NO: 573114 - DNA, 25 bp, Rattus norvegicus
tcaacagctacgcactcaaggcaga

SEQ ID NO: 573115 - DNA, 25 bp, Rattus norvegicus
tcaacagctacggactcaaggcaga

SEQ ID NO: 573116 - DNA, 25 bp, Rattus norvegicus
tcaacagctgaactgggtcatcctc

SEQ ID NO: 573117 - DNA, 25 bp, Rattus norvegicus
tcaacagctgaagtgggtcatcctc

SEQ ID NO: 573118 - DNA, 25 bp, Rattus norvegicus
tcaacagctgctactttttccttta

SEQ ID NO: 573119 - DNA, 25 bp, Rattus norvegicus
tcaacagctgcttctttttccttta

SEQ ID NO: 573120 - DNA, 25 bp, Rattus norvegicus
tcaacagctgtgaacaccatccaca

SEQ ID NO: 573121 - DNA, 25 bp, Rattus norvegicus
tcaacagctgtgtacaccatccaca

SEQ ID NO: 573122 - DNA, 25 bp, Rattus norvegicus
tcaacaggaaaaccacgcccgtgta

SEQ ID NO: 573123 - DNA, 25 bp, Rattus norvegicus
tcaacaggaaaagcacgcccgtgta

SEQ ID NO: 573124 - DNA, 25 bp, Rattus norvegicus
tcaacaggagaccttttcccaggac

SEQ ID NO: 573125 - DNA, 25 bp, Rattus norvegicus
tcaacaggagacgttttcccaggac

SEQ ID NO: 573126 - DNA, 25 bp, Rattus norvegicus
tcaacaggccaaagtctgactcctt

SEQ ID NO: 573127 - DNA, 25 bp, Rattus norvegicus
tcaacaggccaatgtctgactcctt

SEQ ID NO: 573128 - DNA, 25 bp, Rattus norvegicus
tcaacaggcgcaaagggagaaacat

SEQ ID NO: 573129 - DNA, 25 bp, Rattus norvegicus
tcaacaggcgcatagggagaaacat

SEQ ID NO: 573130 - DNA, 25 bp, Rattus norvegicus
tcaacagtaaacctttttcctggcg

SEQ ID NO: 573131 - DNA, 25 bp, Rattus norvegicus
tcaacagtaaacgtttttcctggcg

SEQ ID NO: 573132 - DNA, 25 bp, Rattus norvegicus
tcaacagtcagccaatgttgtcttt

SEQ ID NO: 573133 - DNA, 25 bp, Rattus norvegicus
tcaacagtcagcgaatgttgtcttt

SEQ ID NO: 573134 - DNA, 25 bp, Rattus norvegicus
tcaacagtcctgattcatggcaatt

SEQ ID NO: 573135 - DNA, 25 bp, Rattus norvegicus
tcaacagtcctgtttcatggcaatt

SEQ ID NO: 573136 - DNA, 25 bp, Rattus norvegicus
tcaacagtttcactcatcagggtgt

SEQ ID NO: 573137 - DNA, 25 bp, Rattus norvegicus
tcaacagtttcagtcatcagggtgt

SEQ ID NO: 573138 - DNA, 25 bp, Rattus norvegicus
tcaacataaaggcatttcactgctt

SEQ ID NO: 573139 - DNA, 25 bp, Rattus norvegicus
tcaacataaagggatttcactgctt

SEQ ID NO: 573140 - DNA, 25 bp, Rattus norvegicus
tcaacatattgcctctaagctttcc

SEQ ID NO: 573141 - DNA, 25 bp, Rattus norvegicus
tcaacatattgcgtctaagctttcc

SEQ ID NO: 573142 - DNA, 25 bp, Rattus norvegicus
tcaacatcagctacgccaacgtggc

SEQ ID NO: 573143 - DNA, 25 bp, Rattus norvegicus
tcaacatcagcttcgccaacgtggc

SEQ ID NO: 573144 - DNA, 25 bp, Rattus norvegicus
tcaacatccccaacaacgacattgt

SEQ ID NO: 573145 - DNA, 25 bp, Rattus norvegicus
tcaacatccccatcaacgacattgt

SEQ ID NO: 573146 - DNA, 25 bp, Rattus norvegicus
tcaacatccctacgcaggagctgtt

SEQ ID NO: 573147 - DNA, 25 bp, Rattus norvegicus
tcaacatccctaggcaggagctgtt

SEQ ID NO: 573148 - DNA, 25 bp, Rattus norvegicus
tcaacatccggtaccatgaggactg

SEQ ID NO: 573149 - DNA, 25 bp, Rattus norvegicus
tcaacatccggttccatgaggactg

SEQ ID NO: 573150 - DNA, 25 bp, Rattus norvegicus
tcaacatcgctcagcaggtggagta

SEQ ID NO: 573151 - DNA, 25 bp, Rattus norvegicus
tcaacatcgctctgcaggtggagta

SEQ ID NO: 573152 - DNA, 25 bp, Rattus norvegicus
tcaacatctgacctcctatttttct

SEQ ID NO: 573153 - DNA, 25 bp, Rattus norvegicus
tcaacatctgacgtcctatttttct

SEQ ID NO: 573154 - DNA, 25 bp, Rattus norvegicus
tcaacatgaaccagggtggccacgt

SEQ ID NO: 573155 - DNA, 25 bp, Rattus norvegicus
tcaacatgaacctgggtggccacgt

SEQ ID NO: 573156 - DNA, 25 bp, Rattus norvegicus
tcaacatgacagctggcctgtggtc

SEQ ID NO: 573157 - DNA, 25 bp, Rattus norvegicus
tcaacatgacaggtggcctgtggtc

SEQ ID NO: 573158 - DNA, 25 bp, Rattus norvegicus
tcaacatgactgcttctgcacgcat

SEQ ID NO: 573159 - DNA, 25 bp, Rattus norvegicus
tcaacatgactggttctgcacgcat

SEQ ID NO: 573160 - DNA, 25 bp, Rattus norvegicus
tcaacatggacacgcgtgctctcgg

SEQ ID NO: 573161 - DNA, 25 bp, Rattus norvegicus
tcaacatggacaggcgtgctctcgg

SEQ ID NO: 573162 - DNA, 25 bp, Rattus norvegicus
tcaacatgtgagaggactcccaggt

SEQ ID NO: 573163 - DNA, 25 bp, Rattus norvegicus
tcaacatgtgagtggactcccaggt

SEQ ID NO: 573164 - DNA, 25 bp, Rattus norvegicus
tcaacatttcggcttttggctgttt

SEQ ID NO: 573165 - DNA, 25 bp, Rattus norvegicus
tcaacatttcgggttttggctgttt

SEQ ID NO: 573166 - DNA, 25 bp, Rattus norvegicus
tcaacatttgtcacctatctgcaga

SEQ ID NO: 573167 - DNA, 25 bp, Rattus norvegicus
tcaacatttgtctcctatctgcaga

SEQ ID NO: 573168 - DNA, 25 bp, Rattus norvegicus
tcaaccaaatcccagttcaactcag

SEQ ID NO: 573169 - DNA, 25 bp, Rattus norvegicus
tcaaccaaatccgagttcaactcag

SEQ ID NO: 573170 - DNA, 25 bp, Rattus norvegicus
tcaaccaaccacacgattaatcttt

SEQ ID NO: 573171 - DNA, 25 bp, Rattus norvegicus
tcaaccaaccactcgattaatcttt

SEQ ID NO: 573172 - DNA, 25 bp, Rattus norvegicus
tcaaccaacttcacactattaccta

SEQ ID NO: 573173 - DNA, 25 bp, Rattus norvegicus
tcaaccaacttctcactattaccta

SEQ ID NO: 573174 - DNA, 25 bp, Rattus norvegicus
tcaaccaagattaagcaccgtccct

SEQ ID NO: 573175 - DNA, 25 bp, Rattus norvegicus
tcaaccaagatttagcaccgtccct

SEQ ID NO: 573176 - DNA, 25 bp, Rattus norvegicus
tcaaccaagcttccaatttctcgtg

SEQ ID NO: 573177 - DNA, 25 bp, Rattus norvegicus
tcaaccaagcttgcaatttctcgtg

SEQ ID NO: 573178 - DNA, 25 bp, Rattus norvegicus
tcaaccaatacaatctagcttcctc

SEQ ID NO: 573179 - DNA, 25 bp, Rattus norvegicus
tcaaccaatacattctagcttcctc

SEQ ID NO: 573180 - DNA, 25 bp, Rattus norvegicus
tcaaccaatcatcccattgtgcaga

SEQ ID NO: 573181 - DNA, 25 bp, Rattus norvegicus
tcaaccaatcatgccattgtgcaga

SEQ ID NO: 573182 - DNA, 25 bp, Rattus norvegicus
tcaaccacatataagggcaggcctg

SEQ ID NO: 573183 - DNA, 25 bp, Rattus norvegicus
tcaaccacatattagggcaggcctg

SEQ ID NO: 573184 - DNA, 25 bp, Rattus norvegicus
tcaaccacatctcgtcatgacaaat

SEQ ID NO: 573185 - DNA, 25 bp, Rattus norvegicus
tcaaccacatctggtcatgacaaat

SEQ ID NO: 573186 - DNA, 25 bp, Rattus norvegicus
tcaaccaccctgacttgagaaggat

SEQ ID NO: 573187 - DNA, 25 bp, Rattus norvegicus
tcaaccaccctgtcttgagaaggat

SEQ ID NO: 573188 - DNA, 25 bp, Rattus norvegicus
tcaaccacgggaacagcgaaggcac

SEQ ID NO: 573189 - DNA, 25 bp, Rattus norvegicus
tcaaccacgggatcagcgaaggcac

SEQ ID NO: 573190 - DNA, 25 bp, Rattus norvegicus
tcaaccacgtcgatggctctaccaa

SEQ ID NO: 573191 - DNA, 25 bp, Rattus norvegicus
tcaaccacgtcgttggctctaccaa

SEQ ID NO: 573192 - DNA, 25 bp, Rattus norvegicus
tcaaccacttttcactttatctcaa

SEQ ID NO: 573193 - DNA, 25 bp, Rattus norvegicus
tcaaccacttttgactttatctcaa

SEQ ID NO: 573194 - DNA, 25 bp, Rattus norvegicus
tcaaccagctgtcccatgatgatgg

SEQ ID NO: 573195 - DNA, 25 bp, Rattus norvegicus
tcaaccagctgtgccatgatgatgg

SEQ ID NO: 573196 - DNA, 25 bp, Rattus norvegicus
tcaaccaggagactatccagcggct

SEQ ID NO: 573197 - DNA, 25 bp, Rattus norvegicus
tcaaccaggagagtatccagcggct

SEQ ID NO: 573198 - DNA, 25 bp, Rattus norvegicus
tcaaccagggctatgaggctgtcta

SEQ ID NO: 573199 - DNA, 25 bp, Rattus norvegicus
tcaaccagggctttgaggctgtcta

SEQ ID NO: 573200 - DNA, 25 bp, Rattus norvegicus
tcaaccaggtggctactgcaacgat

SEQ ID NO: 573201 - DNA, 25 bp, Rattus norvegicus
tcaaccaggtgggtactgcaacgat

SEQ ID NO: 573202 - DNA, 25 bp, Rattus norvegicus
tcaaccagtattcagcgtctgtcca

SEQ ID NO: 573203 - DNA, 25 bp, Rattus norvegicus
tcaaccagtattgagcgtctgtcca

SEQ ID NO: 573204 - DNA, 25 bp, Rattus norvegicus
tcaaccatcaaacagctctcggagt

SEQ ID NO: 573205 - DNA, 25 bp, Rattus norvegicus
tcaaccatcaaagagctctcggagt

SEQ ID NO: 573206 - DNA, 25 bp, Rattus norvegicus
tcaaccatgactacttctggtcgga

SEQ ID NO: 573207 - DNA, 25 bp, Rattus norvegicus
tcaaccatgacttcttctggtcgga

SEQ ID NO: 573208 - DNA, 25 bp, Rattus norvegicus
tcaaccatggccctaattaaagatt

SEQ ID NO: 573209 - DNA, 25 bp, Rattus norvegicus
tcaaccatggccgtaattaaagatt

SEQ ID NO: 573210 - DNA, 25 bp, Rattus norvegicus
tcaacccacaaaatgcctacacagt

SEQ ID NO: 573211 - DNA, 25 bp, Rattus norvegicus
tcaacccacaaattgcctacacagt

SEQ ID NO: 573212 - DNA, 25 bp, Rattus norvegicus
tcaacccacaggcttgagaactggt

SEQ ID NO: 573213 - DNA, 25 bp, Rattus norvegicus
tcaacccacagggttgagaactggt

SEQ ID NO: 573214 - DNA, 25 bp, Rattus norvegicus
tcaacccacctaatatttccagatt

SEQ ID NO: 573215 - DNA, 25 bp, Rattus norvegicus
tcaacccacctattatttccagatt

SEQ ID NO: 573216 - DNA, 25 bp, Rattus norvegicus
tcaacccaggttccagtagtcgtgt

SEQ ID NO: 573217 - DNA, 25 bp, Rattus norvegicus
tcaacccaggttgcagtagtcgtgt

SEQ ID NO: 573218 - DNA, 25 bp, Rattus norvegicus
tcaaccccattcagtacaacatcat

SEQ ID NO: 573219 - DNA, 25 bp, Rattus norvegicus
tcaaccccattctgtacaacatcat

SEQ ID NO: 573220 - DNA, 25 bp, Rattus norvegicus
tcaacccctatcctgtcctggagag

SEQ ID NO: 573221 - DNA, 25 bp, Rattus norvegicus
tcaacccctatcgtgtcctggagag

SEQ ID NO: 573222 - DNA, 25 bp, Rattus norvegicus
tcaacccgccttatcttgtattaat

SEQ ID NO: 573223 - DNA, 25 bp, Rattus norvegicus
tcaacccgccttttcttgtattaat

SEQ ID NO: 573224 - DNA, 25 bp, Rattus norvegicus
tcaacccgtactattccaggcactc

SEQ ID NO: 573225 - DNA, 25 bp, Rattus norvegicus
tcaacccgtacttttccaggcactc

SEQ ID NO: 573226 - DNA, 25 bp, Rattus norvegicus
tcaacccgtatcaccctatttgtta

SEQ ID NO: 573227 - DNA, 25 bp, Rattus norvegicus
tcaacccgtatctccctatttgtta

SEQ ID NO: 573228 - DNA, 25 bp, Rattus norvegicus
tcaacccgtggcaacctgttaagtt

SEQ ID NO: 573229 - DNA, 25 bp, Rattus norvegicus
tcaacccgtggctacctgttaagtt

SEQ ID NO: 573230 - DNA, 25 bp, Rattus norvegicus
tcaaccctaccacagtggaggacgt

SEQ ID NO: 573231 - DNA, 25 bp, Rattus norvegicus
tcaaccctaccagagtggaggacgt

SEQ ID NO: 573232 - DNA, 25 bp, Rattus norvegicus
tcaaccctagaccatgagatctctg

SEQ ID NO: 573233 - DNA, 25 bp, Rattus norvegicus
tcaaccctagacgatgagatctctg

SEQ ID NO: 573234 - DNA, 25 bp, Rattus norvegicus
tcaaccctctttatatgctgcatat

SEQ ID NO: 573235 - DNA, 25 bp, Rattus norvegicus
tcaaccctctttttatgctgcatat

SEQ ID NO: 573236 - DNA, 25 bp, Rattus norvegicus
tcaaccctgcgacctgaagacatgt

SEQ ID NO: 573237 - DNA, 25 bp, Rattus norvegicus
tcaaccctgcgagctgaagacatgt

SEQ ID NO: 573238 - DNA, 25 bp, Rattus norvegicus
tcaaccctgggcaccagggatagtt

SEQ ID NO: 573239 - DNA, 25 bp, Rattus norvegicus
tcaaccctgggctccagggatagtt

SEQ ID NO: 573240 - DNA, 25 bp, Rattus norvegicus
tcaacccttacgaacaatggcctag

SEQ ID NO: 573241 - DNA, 25 bp, Rattus norvegicus
tcaacccttacgtacaatggcctag

SEQ ID NO: 573242 - DNA, 25 bp, Rattus norvegicus
tcaacccttagtcaacaccagagaa

SEQ ID NO: 573243 - DNA, 25 bp, Rattus norvegicus
tcaacccttagtgaacaccagagaa

SEQ ID NO: 573244 - DNA, 25 bp, Rattus norvegicus
tcaaccgatgctattccagtcaggg

SEQ ID NO: 573245 - DNA, 25 bp, Rattus norvegicus
tcaaccgatgcttttccagtcaggg

SEQ ID NO: 573246 - DNA, 25 bp, Rattus norvegicus
tcaaccgcctggaactactgaggat

SEQ ID NO: 573247 - DNA, 25 bp, Rattus norvegicus
tcaaccgcctggtactactgaggat

SEQ ID NO: 573248 - DNA, 25 bp, Rattus norvegicus
tcaaccgggttcagttctgccaaga

SEQ ID NO: 573249 - DNA, 25 bp, Rattus norvegicus
tcaaccgggttctgttctgccaaga

SEQ ID NO: 573250 - DNA, 25 bp, Rattus norvegicus
tcaaccgttaccaggacgtggtcaa

SEQ ID NO: 573251 - DNA, 25 bp, Rattus norvegicus
tcaaccgttacctggacgtggtcaa

SEQ ID NO: 573252 - DNA, 25 bp, Rattus norvegicus
tcaacctaggaaccagagccgcctt

SEQ ID NO: 573253 - DNA, 25 bp, Rattus norvegicus
tcaacctaggaagcagagccgcctt

SEQ ID NO: 573254 - DNA, 25 bp, Rattus norvegicus
tcaacctatgggaggcacggcactt

SEQ ID NO: 573255 - DNA, 25 bp, Rattus norvegicus
tcaacctatgggtggcacggcactt

SEQ ID NO: 573256 - DNA, 25 bp, Rattus norvegicus
tcaacctcctccaaacttgagcgga

SEQ ID NO: 573257 - DNA, 25 bp, Rattus norvegicus
tcaacctcctcctaacttgagcgga

SEQ ID NO: 573258 - DNA, 25 bp, Rattus norvegicus
tcaacctctctgctgacacagtagg

SEQ ID NO: 573259 - DNA, 25 bp, Rattus norvegicus
tcaacctctctggtgacacagtagg

SEQ ID NO: 573260 - DNA, 25 bp, Rattus norvegicus
tcaacctctgttagcctaactggtt

SEQ ID NO: 573261 - DNA, 25 bp, Rattus norvegicus
tcaacctctgtttgcctaactggtt

SEQ ID NO: 573262 - DNA, 25 bp, Rattus norvegicus
tcaacctcttcccttcagagttaat

SEQ ID NO: 573263 - DNA, 25 bp, Rattus norvegicus
tcaacctcttccgttcagagttaat

SEQ ID NO: 573264 - DNA, 25 bp, Rattus norvegicus
tcaacctctttacccggatccgata

SEQ ID NO: 573265 - DNA, 25 bp, Rattus norvegicus
tcaacctctttagccggatccgata

SEQ ID NO: 573266 - DNA, 25 bp, Rattus norvegicus
tcaacctgagtaattttcctccaca

SEQ ID NO: 573267 - DNA, 25 bp, Rattus norvegicus
tcaacctgagtatttttcctccaca

SEQ ID NO: 573268 - DNA, 25 bp, Rattus norvegicus
tcaacctgagtgcttcacagtccaa

SEQ ID NO: 573269 - DNA, 25 bp, Rattus norvegicus
tcaacctgagtggttcacagtccaa

SEQ ID NO: 573270 - DNA, 25 bp, Rattus norvegicus
tcaacctgcaggagcgcgtggtgac

SEQ ID NO: 573271 - DNA, 25 bp, Rattus norvegicus
tcaacctgcaggtgcgcgtggtgac

SEQ ID NO: 573272 - DNA, 25 bp, Rattus norvegicus
tcaacctgcctaatggagacccaaa

SEQ ID NO: 573273 - DNA, 25 bp, Rattus norvegicus
tcaacctgcctattggagacccaaa

SEQ ID NO: 573274 - DNA, 25 bp, Rattus norvegicus
tcaacctgcctcagtgaaactcttt

SEQ ID NO: 573275 - DNA, 25 bp, Rattus norvegicus
tcaacctgcctctgtgaaactcttt

SEQ ID NO: 573276 - DNA, 25 bp, Rattus norvegicus
tcaacctggaggagtttcagcaact

SEQ ID NO: 573277 - DNA, 25 bp, Rattus norvegicus
tcaacctggaggtgtttcagcaact

SEQ ID NO: 573278 - DNA, 25 bp, Rattus norvegicus
tcaacctggtttattgtctgtgccc

SEQ ID NO: 573279 - DNA, 25 bp, Rattus norvegicus
tcaacctggttttttgtctgtgccc

SEQ ID NO: 573280 - DNA, 25 bp, Rattus norvegicus
tcaacctgtctacttggcagctttg

SEQ ID NO: 573281 - DNA, 25 bp, Rattus norvegicus
tcaacctgtctagttggcagctttg

SEQ ID NO: 573282 - DNA, 25 bp, Rattus norvegicus
tcaacctgttcactttggcgctggt

SEQ ID NO: 573283 - DNA, 25 bp, Rattus norvegicus
tcaacctgttcagtttggcgctggt

SEQ ID NO: 573284 - DNA, 25 bp, Rattus norvegicus
tcaacctgttctcgctcggctagac

SEQ ID NO: 573285 - DNA, 25 bp, Rattus norvegicus
tcaacctgttctggctcggctagac

SEQ ID NO: 573286 - DNA, 25 bp, Rattus norvegicus
tcaaccttcacaagcagcaagagac

SEQ ID NO: 573287 - DNA, 25 bp, Rattus norvegicus
tcaaccttcacaagccctggaatat

SEQ ID NO: 573288 - DNA, 25 bp, Rattus norvegicus
tcaaccttcacatgcagcaagagac

SEQ ID NO: 573289 - DNA, 25 bp, Rattus norvegicus
tcaaccttcacatgccctggaatat

SEQ ID NO: 573290 - DNA, 25 bp, Rattus norvegicus
tcaaccttccccaacagcttaagaa

SEQ ID NO: 573291 - DNA, 25 bp, Rattus norvegicus
tcaaccttcccctacagcttaagaa

SEQ ID NO: 573292 - DNA, 25 bp, Rattus norvegicus
tcaaccttcggtatgcagcatccag

SEQ ID NO: 573293 - DNA, 25 bp, Rattus norvegicus
tcaaccttcggtttgcagcatccag

SEQ ID NO: 573294 - DNA, 25 bp, Rattus norvegicus
tcaaccttgatcctcatttttctca

SEQ ID NO: 573295 - DNA, 25 bp, Rattus norvegicus
tcaaccttgatcgtcatttttctca

SEQ ID NO: 573296 - DNA, 25 bp, Rattus norvegicus
tcaaccttgcccaggactggaaagt

SEQ ID NO: 573297 - DNA, 25 bp, Rattus norvegicus
tcaaccttgccctggactggaaagt

SEQ ID NO: 573298 - DNA, 25 bp, Rattus norvegicus
tcaaccttgggtcccgggataagtc

SEQ ID NO: 573299 - DNA, 25 bp, Rattus norvegicus
tcaaccttgggtgccgggataagtc

SEQ ID NO: 573300 - DNA, 25 bp, Rattus norvegicus
tcaaccttgtttaccggttctgcgg

SEQ ID NO: 573301 - DNA, 25 bp, Rattus norvegicus
tcaaccttgttttccggttctgcgg

SEQ ID NO: 573302 - DNA, 25 bp, Rattus norvegicus
tcaacctttcccagtagactgtttt

SEQ ID NO: 573303 - DNA, 25 bp, Rattus norvegicus
tcaacctttccctgtagactgtttt

SEQ ID NO: 573304 - DNA, 25 bp, Rattus norvegicus
tcaacgaaatccacagtgacccaga

SEQ ID NO: 573305 - DNA, 25 bp, Rattus norvegicus
tcaacgaaatcctcagtgacccaga

SEQ ID NO: 573306 - DNA, 25 bp, Rattus norvegicus
tcaacgacattgaccaccccaagta

SEQ ID NO: 573307 - DNA, 25 bp, Rattus norvegicus
tcaacgacattgtccaccccaagta

SEQ ID NO: 573308 - DNA, 25 bp, Rattus norvegicus
tcaacgacctcacagggcacaagga

SEQ ID NO: 573309 - DNA, 25 bp, Rattus norvegicus
tcaacgacctcagagggcacaagga

SEQ ID NO: 573310 - DNA, 25 bp, Rattus norvegicus
tcaacgacttctacagctatcacat

SEQ ID NO: 573311 - DNA, 25 bp, Rattus norvegicus
tcaacgacttcttcagctatcacat

SEQ ID NO: 573312 - DNA, 25 bp, Rattus norvegicus
tcaacgatgcccaagtgtacttcac

SEQ ID NO: 573313 - DNA, 25 bp, Rattus norvegicus
tcaacgatgccctagtgtacttcac

SEQ ID NO: 573314 - DNA, 25 bp, Rattus norvegicus
tcaacgatttctaagttccttcctc

SEQ ID NO: 573315 - DNA, 25 bp, Rattus norvegicus
tcaacgatttcttagttccttcctc

SEQ ID NO: 573316 - DNA, 25 bp, Rattus norvegicus
tcaacgccttcaaggtgtttgaccc

SEQ ID NO: 573317 - DNA, 25 bp, Rattus norvegicus
tcaacgccttcatggtgtttgaccc

SEQ ID NO: 573318 - DNA, 25 bp, Rattus norvegicus
tcaacgcgccagatcaaggagcaca

SEQ ID NO: 573319 - DNA, 25 bp, Rattus norvegicus
tcaacgcgccagttcaaggagcaca

SEQ ID NO: 573320 - DNA, 25 bp, Rattus norvegicus
tcaacgctaaggacacactgtggct

SEQ ID NO: 573321 - DNA, 25 bp, Rattus norvegicus
tcaacgctaaggtcacactgtggct

SEQ ID NO: 573322 - DNA, 25 bp, Rattus norvegicus
tcaacgctgcatcaggcaccattat

SEQ ID NO: 573323 - DNA, 25 bp, Rattus norvegicus
tcaacgctgcatgaggcaccattat

SEQ ID NO: 573324 - DNA, 25 bp, Rattus norvegicus
tcaacgctttccacagagatctgag

SEQ ID NO: 573325 - DNA, 25 bp, Rattus norvegicus
tcaacgctttcctcagagatctgag

SEQ ID NO: 573326 - DNA, 25 bp, Rattus norvegicus
tcaacggaccaacctgcaatgcagt

SEQ ID NO: 573327 - DNA, 25 bp, Rattus norvegicus
tcaacggaccaagctgcaatgcagt

SEQ ID NO: 573328 - DNA, 25 bp, Rattus norvegicus
tcaacggcagccacagggatgcaga

SEQ ID NO: 573329 - DNA, 25 bp, Rattus norvegicus
tcaacggcagcctcagggatgcaga

SEQ ID NO: 573330 - DNA, 25 bp, Rattus norvegicus
tcaacggccaggagggcttcgagac

SEQ ID NO: 573331 - DNA, 25 bp, Rattus norvegicus
tcaacggccaggtgggcttcgagac

SEQ ID NO: 573332 - DNA, 25 bp, Rattus norvegicus
tcaacggcggctatgaccagatggc

SEQ ID NO: 573333 - DNA, 25 bp, Rattus norvegicus
tcaacggcggctttgaccagatggc

SEQ ID NO: 573334 - DNA, 25 bp, Rattus norvegicus
tcaacggctctgactactgtgagga

SEQ ID NO: 573335 - DNA, 25 bp, Rattus norvegicus
tcaacggctctgtctactgtgagga

SEQ ID NO: 573336 - DNA, 25 bp, Rattus norvegicus
tcaacgggccatagaagcaactccc

SEQ ID NO: 573337 - DNA, 25 bp, Rattus norvegicus
tcaacgggccattgaagcaactccc

SEQ ID NO: 573338 - DNA, 25 bp, Rattus norvegicus
tcaacggttttcactagactgtcag

SEQ ID NO: 573339 - DNA, 25 bp, Rattus norvegicus
tcaacggttttctctagactgtcag

SEQ ID NO: 573340 - DNA, 25 bp, Rattus norvegicus
tcaacggtttttctgtcaccttctg

SEQ ID NO: 573341 - DNA, 25 bp, Rattus norvegicus
tcaacggtttttgtgtcaccttctg

SEQ ID NO: 573342 - DNA, 25 bp, Rattus norvegicus
tcaacgtagtgtaccaagtctgggc

SEQ ID NO: 573343 - DNA, 25 bp, Rattus norvegicus
tcaacgtagtgttccaagtctgggc

SEQ ID NO: 573344 - DNA, 25 bp, Rattus norvegicus
tcaacgtattctatcctctggtatc

SEQ ID NO: 573345 - DNA, 25 bp, Rattus norvegicus
tcaacgtattctttcctctggtatc

SEQ ID NO: 573346 - DNA, 25 bp, Rattus norvegicus
tcaacgtctgtaccttcggcacaca

SEQ ID NO: 573347 - DNA, 25 bp, Rattus norvegicus
tcaacgtctgtagcttcggcacaca

SEQ ID NO: 573348 - DNA, 25 bp, Rattus norvegicus
tcaacgtgaagaacgtgtacttcgc

SEQ ID NO: 573349 - DNA, 25 bp, Rattus norvegicus
tcaacgtgaagatcgtgtacttcgc

SEQ ID NO: 573350 - DNA, 25 bp, Rattus norvegicus
tcaacgtgcatgacgtctcaaagct

SEQ ID NO: 573351 - DNA, 25 bp, Rattus norvegicus
tcaacgtgcatgtcgtctcaaagct

SEQ ID NO: 573352 - DNA, 25 bp, Rattus norvegicus
tcaacgtggcctatgacgatcttaa

SEQ ID NO: 573353 - DNA, 25 bp, Rattus norvegicus
tcaacgtggcctttgacgatcttaa

SEQ ID NO: 573354 - DNA, 25 bp, Rattus norvegicus
tcaacgtgtacaacgccagctttat

SEQ ID NO: 573355 - DNA, 25 bp, Rattus norvegicus
tcaacgtgtacatcgccagctttat

SEQ ID NO: 573356 - DNA, 25 bp, Rattus norvegicus
tcaacgtttcttcacttttgcaagg

SEQ ID NO: 573357 - DNA, 25 bp, Rattus norvegicus
tcaacgtttcttgacttttgcaagg

SEQ ID NO: 573358 - DNA, 25 bp, Rattus norvegicus
tcaacgttttccagaagtcgcgaca

SEQ ID NO: 573359 - DNA, 25 bp, Rattus norvegicus
tcaacgttttcctgaagtcgcgaca

SEQ ID NO: 573360 - DNA, 25 bp, Rattus norvegicus
tcaactacatccacaacgctgatgg

SEQ ID NO: 573361 - DNA, 25 bp, Rattus norvegicus
tcaactacatcctcaacgctgatgg

SEQ ID NO: 573362 - DNA, 25 bp, Rattus norvegicus
tcaactacggtgagggccccagagc

SEQ ID NO: 573363 - DNA, 25 bp, Rattus norvegicus
tcaactacggtgtgggccccagagc

SEQ ID NO: 573364 - DNA, 25 bp, Rattus norvegicus
tcaactatgtcacacaggtctcgtc

SEQ ID NO: 573365 - DNA, 25 bp, Rattus norvegicus
tcaactatgtcagacaggtctcgtc

SEQ ID NO: 573366 - DNA, 25 bp, Rattus norvegicus
tcaactattggcaactggcagatca

SEQ ID NO: 573367 - DNA, 25 bp, Rattus norvegicus
tcaactattggctactggcagatca

SEQ ID NO: 573368 - DNA, 25 bp, Rattus norvegicus
tcaactcaagagcttctggtaggca

SEQ ID NO: 573369 - DNA, 25 bp, Rattus norvegicus
tcaactcaagaggttctggtaggca

SEQ ID NO: 573370 - DNA, 25 bp, Rattus norvegicus
tcaactcacttgaccttaaggttcc

SEQ ID NO: 573371 - DNA, 25 bp, Rattus norvegicus
tcaactcacttgtccttaaggttcc

SEQ ID NO: 573372 - DNA, 25 bp, Rattus norvegicus
tcaactcagtagaggcgactggcct

SEQ ID NO: 573373 - DNA, 25 bp, Rattus norvegicus
tcaactcagtagtggcgactggcct

SEQ ID NO: 573374 - DNA, 25 bp, Rattus norvegicus
tcaactccagatcctccggtgtgag

SEQ ID NO: 573375 - DNA, 25 bp, Rattus norvegicus
tcaactccagatgctccggtgtgag

SEQ ID NO: 573376 - DNA, 25 bp, Rattus norvegicus
tcaactccagcaagtaccgcaagag

SEQ ID NO: 573377 - DNA, 25 bp, Rattus norvegicus
tcaactccagcaatctgttcagcag

SEQ ID NO: 573378 - DNA, 25 bp, Rattus norvegicus
tcaactccagcatgtaccgcaagag

SEQ ID NO: 573379 - DNA, 25 bp, Rattus norvegicus
tcaactccagcattctgttcagcag

SEQ ID NO: 573380 - DNA, 25 bp, Rattus norvegicus
tcaactccagccactgtttatgtgt

SEQ ID NO: 573381 - DNA, 25 bp, Rattus norvegicus
tcaactccagcctctgtttatgtgt

SEQ ID NO: 573382 - DNA, 25 bp, Rattus norvegicus
tcaactccatcgaaccaggtgaact

SEQ ID NO: 573383 - DNA, 25 bp, Rattus norvegicus
tcaactccatcgtaccaggtgaact

SEQ ID NO: 573384 - DNA, 25 bp, Rattus norvegicus
tcaactcgactgcatttagaaggac

SEQ ID NO: 573385 - DNA, 25 bp, Rattus norvegicus
tcaactcgactggatttagaaggac

SEQ ID NO: 573386 - DNA, 25 bp, Rattus norvegicus
tcaactctaggcatctgggaagaaa

SEQ ID NO: 573387 - DNA, 25 bp, Rattus norvegicus
tcaactctaggcttctgggaagaaa

SEQ ID NO: 573388 - DNA, 25 bp, Rattus norvegicus
tcaactctcatcacaagctaggctt

SEQ ID NO: 573389 - DNA, 25 bp, Rattus norvegicus
tcaactctcatctcaagctaggctt

SEQ ID NO: 573390 - DNA, 25 bp, Rattus norvegicus
tcaactctcggtcgacgtctcaagg

SEQ ID NO: 573391 - DNA, 25 bp, Rattus norvegicus
tcaactctcggtggacgtctcaagg

SEQ ID NO: 573392 - DNA, 25 bp, Rattus norvegicus
tcaactctgggtcagtcaatcctcc

SEQ ID NO: 573393 - DNA, 25 bp, Rattus norvegicus
tcaactctgggtgagtcaatcctcc

SEQ ID NO: 573394 - DNA, 25 bp, Rattus norvegicus
tcaactctgtcgctgtgtttttaat

SEQ ID NO: 573395 - DNA, 25 bp, Rattus norvegicus
tcaactctgtcggtgtgtttttaat

SEQ ID NO: 573396 - DNA, 25 bp, Rattus norvegicus
tcaactcttagaagtagagcagcag

SEQ ID NO: 573397 - DNA, 25 bp, Rattus norvegicus
tcaactcttagatgtagagcagcag

SEQ ID NO: 573398 - DNA, 25 bp, Rattus norvegicus
tcaactcttaggaacacaggcggat

SEQ ID NO: 573399 - DNA, 25 bp, Rattus norvegicus
tcaactcttaggtacacaggcggat

SEQ ID NO: 573400 - DNA, 25 bp, Rattus norvegicus
tcaactctttatagtgcccatgtca

SEQ ID NO: 573401 - DNA, 25 bp, Rattus norvegicus
tcaactctttattgtgcccatgtca

SEQ ID NO: 573402 - DNA, 25 bp, Rattus norvegicus
tcaactgaatgtcggacgtcactgt

SEQ ID NO: 573403 - DNA, 25 bp, Rattus norvegicus
tcaactgaatgtgggacgtcactgt

SEQ ID NO: 573404 - DNA, 25 bp, Rattus norvegicus
tcaactgacacaagccggagtcgtt

SEQ ID NO: 573405 - DNA, 25 bp, Rattus norvegicus
tcaactgacacatgccggagtcgtt

SEQ ID NO: 573406 - DNA, 25 bp, Rattus norvegicus
tcaactgaccggctggacagtgtct

SEQ ID NO: 573407 - DNA, 25 bp, Rattus norvegicus
tcaactgaccgggtggacagtgtct

SEQ ID NO: 573408 - DNA, 25 bp, Rattus norvegicus
tcaactgacttccaggtggttccca

SEQ ID NO: 573409 - DNA, 25 bp, Rattus norvegicus
tcaactgacttcgaggtggttccca

SEQ ID NO: 573410 - DNA, 25 bp, Rattus norvegicus
tcaactgagtccagtagatgaggag

SEQ ID NO: 573411 - DNA, 25 bp, Rattus norvegicus
tcaactgagtcctgtagatgaggag

SEQ ID NO: 573412 - DNA, 25 bp, Rattus norvegicus
tcaactgcaaatctcacctttatgt

SEQ ID NO: 573413 - DNA, 25 bp, Rattus norvegicus
tcaactgcaaatgtcacctttatgt

SEQ ID NO: 573414 - DNA, 25 bp, Rattus norvegicus
tcaactgcagttctccatgtgggac

SEQ ID NO: 573415 - DNA, 25 bp, Rattus norvegicus
tcaactgcagttgtccatgtgggac

SEQ ID NO: 573416 - DNA, 25 bp, Rattus norvegicus
tcaactgcccagcacaattcagatg

SEQ ID NO: 573417 - DNA, 25 bp, Rattus norvegicus
tcaactgcccaggacaattcagatg

SEQ ID NO: 573418 - DNA, 25 bp, Rattus norvegicus
tcaactgccccgagtagctgaaagt

SEQ ID NO: 573419 - DNA, 25 bp, Rattus norvegicus
tcaactgccccgtgtagctgaaagt

SEQ ID NO: 573420 - DNA, 25 bp, Rattus norvegicus
tcaactgccctgagggtcctaaagg

SEQ ID NO: 573421 - DNA, 25 bp, Rattus norvegicus
tcaactgccctgtgggtcctaaagg

SEQ ID NO: 573422 - DNA, 25 bp, Rattus norvegicus
tcaactgcggcacatcagactggag

SEQ ID NO: 573423 - DNA, 25 bp, Rattus norvegicus
tcaactgcggcagatcagactggag

SEQ ID NO: 573424 - DNA, 25 bp, Rattus norvegicus
tcaactgctacactcttggcatgca

SEQ ID NO: 573425 - DNA, 25 bp, Rattus norvegicus
tcaactgctacagtcttggcatgca

SEQ ID NO: 573426 - DNA, 25 bp, Rattus norvegicus
tcaactgcttgccaatagctcttca

SEQ ID NO: 573427 - DNA, 25 bp, Rattus norvegicus
tcaactgcttgcgaatagctcttca

SEQ ID NO: 573428 - DNA, 25 bp, Rattus norvegicus
tcaactggacgcatagcactttgtt

SEQ ID NO: 573429 - DNA, 25 bp, Rattus norvegicus
tcaactggacgcttagcactttgtt

SEQ ID NO: 573430 - DNA, 25 bp, Rattus norvegicus
tcaactggattgcactggtcctggg

SEQ ID NO: 573431 - DNA, 25 bp, Rattus norvegicus
tcaactggattggactggtcctggg

SEQ ID NO: 573432 - DNA, 25 bp, Rattus norvegicus
tcaactggcctccatgtagagtggt

SEQ ID NO: 573433 - DNA, 25 bp, Rattus norvegicus
tcaactggcctcgatgtagagtggt

SEQ ID NO: 573434 - DNA, 25 bp, Rattus norvegicus
tcaactggctggaaggtccctttta

SEQ ID NO: 573435 - DNA, 25 bp, Rattus norvegicus
tcaactggctggtaggtccctttta

SEQ ID NO: 573436 - DNA, 25 bp, Rattus norvegicus
tcaactgggacgaatacaccctatt

SEQ ID NO: 573437 - DNA, 25 bp, Rattus norvegicus
tcaactgggacgtatacaccctatt

SEQ ID NO: 573438 - DNA, 25 bp, Rattus norvegicus
tcaactggtgctaggctgatggcta

SEQ ID NO: 573439 - DNA, 25 bp, Rattus norvegicus
tcaactggtgcttggctgatggcta

SEQ ID NO: 573440 - DNA, 25 bp, Rattus norvegicus
tcaactgtaacacctactatggtga

SEQ ID NO: 573441 - DNA, 25 bp, Rattus norvegicus
tcaactgtaacagctactatggtga

SEQ ID NO: 573442 - DNA, 25 bp, Rattus norvegicus
tcaactgtaatcaaaaccccgcaag

SEQ ID NO: 573443 - DNA, 25 bp, Rattus norvegicus
tcaactgtaatctaaaccccgcaag

SEQ ID NO: 573444 - DNA, 25 bp, Rattus norvegicus
tcaactgtacccctgtctggcgtga

SEQ ID NO: 573445 - DNA, 25 bp, Rattus norvegicus
tcaactgtacccgtgtctggcgtga

SEQ ID NO: 573446 - DNA, 25 bp, Rattus norvegicus
tcaactgtaccgaagatacccaggg

SEQ ID NO: 573447 - DNA, 25 bp, Rattus norvegicus
tcaactgtaccgtagatacccaggg

SEQ ID NO: 573448 - DNA, 25 bp, Rattus norvegicus
tcaactgtcacgcttccaaatggaa

SEQ ID NO: 573449 - DNA, 25 bp, Rattus norvegicus
tcaactgtcacggttccaaatggaa

SEQ ID NO: 573450 - DNA, 25 bp, Rattus norvegicus
tcaactgtccttctggtttcttata

SEQ ID NO: 573451 - DNA, 25 bp, Rattus norvegicus
tcaactgtccttgtggtttcttata

SEQ ID NO: 573452 - DNA, 25 bp, Rattus norvegicus
tcaactgtctgcaggaagctggcca

SEQ ID NO: 573453 - DNA, 25 bp, Rattus norvegicus
tcaactgtctgctggaagctggcca

SEQ ID NO: 573454 - DNA, 25 bp, Rattus norvegicus
tcaactgtgattaccgtctttccaa

SEQ ID NO: 573455 - DNA, 25 bp, Rattus norvegicus
tcaactgtgatttccgtctttccaa

SEQ ID NO: 573456 - DNA, 25 bp, Rattus norvegicus
tcaactgtgctgagggatctcctga

SEQ ID NO: 573457 - DNA, 25 bp, Rattus norvegicus
tcaactgtgctgtgggatctcctga

SEQ ID NO: 573458 - DNA, 25 bp, Rattus norvegicus
tcaactgtggcaattatggctggac

SEQ ID NO: 573459 - DNA, 25 bp, Rattus norvegicus
tcaactgtggcatttatggctggac

SEQ ID NO: 573460 - DNA, 25 bp, Rattus norvegicus
tcaactgtgttgctcctgggaccat

SEQ ID NO: 573461 - DNA, 25 bp, Rattus norvegicus
tcaactgtgttggtcctgggaccat

SEQ ID NO: 573462 - DNA, 25 bp, Rattus norvegicus
tcaacttatcctcactttctacaag

SEQ ID NO: 573463 - DNA, 25 bp, Rattus norvegicus
tcaacttatcctgactttctacaag

SEQ ID NO: 573464 - DNA, 25 bp, Rattus norvegicus
tcaacttccagtcacatatgccatt

SEQ ID NO: 573465 - DNA, 25 bp, Rattus norvegicus
tcaacttccagtgacatatgccatt

SEQ ID NO: 573466 - DNA, 25 bp, Rattus norvegicus
tcaacttccccaactacaatttgga

SEQ ID NO: 573467 - DNA, 25 bp, Rattus norvegicus
tcaacttccccatctacaatttgga

SEQ ID NO: 573468 - DNA, 25 bp, Rattus norvegicus
tcaacttcctgcctgacagtgctgg

SEQ ID NO: 573469 - DNA, 25 bp, Rattus norvegicus
tcaacttcctgcgtgacagtgctgg

SEQ ID NO: 573470 - DNA, 25 bp, Rattus norvegicus
tcaacttcctggctaagtctctgtc

SEQ ID NO: 573471 - DNA, 25 bp, Rattus norvegicus
tcaacttcctgggtaagtctctgtc

SEQ ID NO: 573472 - DNA, 25 bp, Rattus norvegicus
tcaacttcctgtcccttgcaaatga

SEQ ID NO: 573473 - DNA, 25 bp, Rattus norvegicus
tcaacttcctgtgccttgcaaatga

SEQ ID NO: 573474 - DNA, 25 bp, Rattus norvegicus
tcaacttcttgcctttattctttaa

SEQ ID NO: 573475 - DNA, 25 bp, Rattus norvegicus
tcaacttcttgcgtttattctttaa

SEQ ID NO: 573476 - DNA, 25 bp, Rattus norvegicus
tcaacttgacacaagctaaaggcaa

SEQ ID NO: 573477 - DNA, 25 bp, Rattus norvegicus
tcaacttgacactagctaaaggcaa

SEQ ID NO: 573478 - DNA, 25 bp, Rattus norvegicus
tcaacttgtagtcctgaagcaccta

SEQ ID NO: 573479 - DNA, 25 bp, Rattus norvegicus
tcaacttgtagtgctgaagcaccta

SEQ ID NO: 573480 - DNA, 25 bp, Rattus norvegicus
tcaacttgtgatctttaccacccca

SEQ ID NO: 573481 - DNA, 25 bp, Rattus norvegicus
tcaacttgtgatgtttaccacccca

SEQ ID NO: 573482 - DNA, 25 bp, Rattus norvegicus
tcaactttccttcagaccatctgga

SEQ ID NO: 573483 - DNA, 25 bp, Rattus norvegicus
tcaactttccttgagaccatctgga

SEQ ID NO: 573484 - DNA, 25 bp, Rattus norvegicus
tcaactttcgagacaacccactaag

SEQ ID NO: 573485 - DNA, 25 bp, Rattus norvegicus
tcaactttcgagtcaacccactaag

SEQ ID NO: 573486 - DNA, 25 bp, Rattus norvegicus
tcaactttgcctcctttaatttcct

SEQ ID NO: 573487 - DNA, 25 bp, Rattus norvegicus
tcaactttgcctgctttaatttcct

SEQ ID NO: 573488 - DNA, 25 bp, Rattus norvegicus
tcaactttgcgtatagtggagccaa

SEQ ID NO: 573489 - DNA, 25 bp, Rattus norvegicus
tcaactttgcgtttagtggagccaa

SEQ ID NO: 573490 - DNA, 25 bp, Rattus norvegicus
tcaactttgtacatgtggaaactaa

SEQ ID NO: 573491 - DNA, 25 bp, Rattus norvegicus
tcaactttgtacttgtggaaactaa

SEQ ID NO: 573492 - DNA, 25 bp, Rattus norvegicus
tcaagaaaatttcccggctggctgg

SEQ ID NO: 573493 - DNA, 25 bp, Rattus norvegicus
tcaagaaaatttgccggctggctgg

SEQ ID NO: 573494 - DNA, 25 bp, Rattus norvegicus
tcaagaaacttccacgctctagtca

SEQ ID NO: 573495 - DNA, 25 bp, Rattus norvegicus
tcaagaaacttcgacgctctagtca

SEQ ID NO: 573496 - DNA, 25 bp, Rattus norvegicus
tcaagaaagacacatccccgggttt

SEQ ID NO: 573497 - DNA, 25 bp, Rattus norvegicus
tcaagaaagacagatccccgggttt

SEQ ID NO: 573498 - DNA, 25 bp, Rattus norvegicus
tcaagaaagcgcaggctgccgccgg

SEQ ID NO: 573499 - DNA, 25 bp, Rattus norvegicus
tcaagaaagcgctggctgccgccgg

SEQ ID NO: 573500 - DNA, 25 bp, Rattus norvegicus
tcaagaaatcagctcgggctggaga

SEQ ID NO: 573501 - DNA, 25 bp, Rattus norvegicus
tcaagaaatcaggtcgggctggaga

SEQ ID NO: 573502 - DNA, 25 bp, Rattus norvegicus
tcaagaacagacaggcgctcctgga

SEQ ID NO: 573503 - DNA, 25 bp, Rattus norvegicus
tcaagaacagactggcgctcctgga

SEQ ID NO: 573504 - DNA, 25 bp, Rattus norvegicus
tcaagaacagatattcccgacgata

SEQ ID NO: 573505 - DNA, 25 bp, Rattus norvegicus
tcaagaacagattttcccgacgata

SEQ ID NO: 573506 - DNA, 25 bp, Rattus norvegicus
tcaagaaccccaactgggaccagat

SEQ ID NO: 573507 - DNA, 25 bp, Rattus norvegicus
tcaagaaccccatctgggaccagat

SEQ ID NO: 573508 - DNA, 25 bp, Rattus norvegicus
tcaagaaccgagatatctgtgctga

SEQ ID NO: 573509 - DNA, 25 bp, Rattus norvegicus
tcaagaaccgagttatctgtgctga

SEQ ID NO: 573510 - DNA, 25 bp, Rattus norvegicus
tcaagaacctttcgctacttcctgc

SEQ ID NO: 573511 - DNA, 25 bp, Rattus norvegicus
tcaagaacctttggctacttcctgc

SEQ ID NO: 573512 - DNA, 25 bp, Rattus norvegicus
tcaagaacgagtcattggcccattt

SEQ ID NO: 573513 - DNA, 25 bp, Rattus norvegicus
tcaagaacgagtgattggcccattt

SEQ ID NO: 573514 - DNA, 25 bp, Rattus norvegicus
tcaagaactaccaagctgctgcact

SEQ ID NO: 573515 - DNA, 25 bp, Rattus norvegicus
tcaagaactacctagctgctgcact

SEQ ID NO: 573516 - DNA, 25 bp, Rattus norvegicus
tcaagaactctgacaaggctgtaat

SEQ ID NO: 573517 - DNA, 25 bp, Rattus norvegicus
tcaagaactctgtcaaggctgtaat

SEQ ID NO: 573518 - DNA, 25 bp, Rattus norvegicus
tcaagaacttctcaactatgctcag

SEQ ID NO: 573519 - DNA, 25 bp, Rattus norvegicus
tcaagaacttctgaactatgctcag

SEQ ID NO: 573520 - DNA, 25 bp, Rattus norvegicus
tcaagaagattgagtatgctggact

SEQ ID NO: 573521 - DNA, 25 bp, Rattus norvegicus
tcaagaagattgtgtatgctggact

SEQ ID NO: 573522 - DNA, 25 bp, Rattus norvegicus
tcaagaagcctgaagtccagaccct

SEQ ID NO: 573523 - DNA, 25 bp, Rattus norvegicus
tcaagaagcctgtagtccagaccct

SEQ ID NO: 573524 - DNA, 25 bp, Rattus norvegicus
tcaagaagtaagcactacgacccct

SEQ ID NO: 573525 - DNA, 25 bp, Rattus norvegicus
tcaagaagtaaggactacgacccct

SEQ ID NO: 573526 - DNA, 25 bp, Rattus norvegicus
tcaagaattcaccacgatcagccag

SEQ ID NO: 573527 - DNA, 25 bp, Rattus norvegicus
tcaagaattcacgacgatcagccag

SEQ ID NO: 573528 - DNA, 25 bp, Rattus norvegicus
tcaagaattcttccagtaagctggg

SEQ ID NO: 573529 - DNA, 25 bp, Rattus norvegicus
tcaagaattcttgcagtaagctggg

SEQ ID NO: 573530 - DNA, 25 bp, Rattus norvegicus
tcaagacaagataagccgccagcct

SEQ ID NO: 573531 - DNA, 25 bp, Rattus norvegicus
tcaagacaagattagccgccagcct

SEQ ID NO: 573532 - DNA, 25 bp, Rattus norvegicus
tcaagacacaggacaccagcatact

SEQ ID NO: 573533 - DNA, 25 bp, Rattus norvegicus
tcaagacacaggtcaccagcatact

SEQ ID NO: 573534 - DNA, 25 bp, Rattus norvegicus
tcaagacagggcacacagggtagga

SEQ ID NO: 573535 - DNA, 25 bp, Rattus norvegicus
tcaagacagggctcacagggtagga

SEQ ID NO: 573536 - DNA, 25 bp, Rattus norvegicus
tcaagaccaacacccttttcatcga

SEQ ID NO: 573537 - DNA, 25 bp, Rattus norvegicus
tcaagaccaacagccttttcatcga

SEQ ID NO: 573538 - DNA, 25 bp, Rattus norvegicus
tcaagaccacctataatcctacagt

SEQ ID NO: 573539 - DNA, 25 bp, Rattus norvegicus
tcaagaccacctttaatcctacagt

SEQ ID NO: 573540 - DNA, 25 bp, Rattus norvegicus
tcaagaccatccaaagcctagttca

SEQ ID NO: 573541 - DNA, 25 bp, Rattus norvegicus
tcaagaccatcctaagcctagttca

SEQ ID NO: 573542 - DNA, 25 bp, Rattus norvegicus
tcaagacccgatatttagcacagaa

SEQ ID NO: 573543 - DNA, 25 bp, Rattus norvegicus
tcaagacccgatttttagcacagaa

SEQ ID NO: 573544 - DNA, 25 bp, Rattus norvegicus
tcaagacctcttcaaagcccaaagt

SEQ ID NO: 573545 - DNA, 25 bp, Rattus norvegicus
tcaagacctcttgaaagcccaaagt

SEQ ID NO: 573546 - DNA, 25 bp, Rattus norvegicus
tcaagacctgtcacggagcctacca

SEQ ID NO: 573547 - DNA, 25 bp, Rattus norvegicus
tcaagacctgtctcggagcctacca

SEQ ID NO: 573548 - DNA, 25 bp, Rattus norvegicus
tcaagacgatttcccacaaacatgg

SEQ ID NO: 573549 - DNA, 25 bp, Rattus norvegicus
tcaagacgatttgccacaaacatgg

SEQ ID NO: 573550 - DNA, 25 bp, Rattus norvegicus
tcaagacggtacacattctcttcca

SEQ ID NO: 573551 - DNA, 25 bp, Rattus norvegicus
tcaagacggtactcattctcttcca

SEQ ID NO: 573552 - DNA, 25 bp, Rattus norvegicus
tcaagacgtcttcgctggtgcagca

SEQ ID NO: 573553 - DNA, 25 bp, Rattus norvegicus
tcaagacgtcttggctggtgcagca

SEQ ID NO: 573554 - DNA, 25 bp, Rattus norvegicus
tcaagactatggctgtctgcgcctt

SEQ ID NO: 573555 - DNA, 25 bp, Rattus norvegicus
tcaagactatgggtgtctgcgcctt

SEQ ID NO: 573556 - DNA, 25 bp, Rattus norvegicus
tcaagactcatcctgaggctcaacg

SEQ ID NO: 573557 - DNA, 25 bp, Rattus norvegicus
tcaagactcatcgtgaggctcaacg

SEQ ID NO: 573558 - DNA, 25 bp, Rattus norvegicus
tcaagactggcaagactggatgaat

SEQ ID NO: 573559 - DNA, 25 bp, Rattus norvegicus
tcaagactggcatgactggatgaat

SEQ ID NO: 573560 - DNA, 25 bp, Rattus norvegicus
tcaagactgtgtcgttgtccttcag

SEQ ID NO: 573561 - DNA, 25 bp, Rattus norvegicus
tcaagactgtgtggttgtccttcag

SEQ ID NO: 573562 - DNA, 25 bp, Rattus norvegicus
tcaagacttgaaaacccaccaactc

SEQ ID NO: 573563 - DNA, 25 bp, Rattus norvegicus
tcaagacttgaatacccaccaactc

SEQ ID NO: 573564 - DNA, 25 bp, Rattus norvegicus
tcaagactttccatcttttcagtaa

SEQ ID NO: 573565 - DNA, 25 bp, Rattus norvegicus
tcaagactttccttcttttcagtaa

SEQ ID NO: 573566 - DNA, 25 bp, Rattus norvegicus
tcaagagaccgaagcactcctgcac

SEQ ID NO: 573567 - DNA, 25 bp, Rattus norvegicus
tcaagagaccgatgcactcctgcac

SEQ ID NO: 573568 - DNA, 25 bp, Rattus norvegicus
tcaagagagagacaactggttcagc

SEQ ID NO: 573569 - DNA, 25 bp, Rattus norvegicus
tcaagagagagagaactggttcagc

SEQ ID NO: 573570 - DNA, 25 bp, Rattus norvegicus
tcaagagagcatctgaaaggaaaat

SEQ ID NO: 573571 - DNA, 25 bp, Rattus norvegicus
tcaagagagcatgtgaaaggaaaat

SEQ ID NO: 573572 - DNA, 25 bp, Rattus norvegicus
tcaagagatgccaaagaccccttct

SEQ ID NO: 573573 - DNA, 25 bp, Rattus norvegicus
tcaagagatgcctaagaccccttct

SEQ ID NO: 573574 - DNA, 25 bp, Rattus norvegicus
tcaagagcagaaacagcagcctccc

SEQ ID NO: 573575 - DNA, 25 bp, Rattus norvegicus
tcaagagcagaatcagcagcctccc

SEQ ID NO: 573576 - DNA, 25 bp, Rattus norvegicus
tcaagagcatccacagactccagag

SEQ ID NO: 573577 - DNA, 25 bp, Rattus norvegicus
tcaagagcatcctcagactccagag

SEQ ID NO: 573578 - DNA, 25 bp, Rattus norvegicus
tcaagagccaccacattactcgtca

SEQ ID NO: 573579 - DNA, 25 bp, Rattus norvegicus
tcaagagccacctcattactcgtca

SEQ ID NO: 573580 - DNA, 25 bp, Rattus norvegicus
tcaagagccctcatgtgggtgtggc

SEQ ID NO: 573581 - DNA, 25 bp, Rattus norvegicus
tcaagagccctcttgtgggtgtggc

SEQ ID NO: 573582 - DNA, 25 bp, Rattus norvegicus
tcaagagcctgcagtatttgcctgc

SEQ ID NO: 573583 - DNA, 25 bp, Rattus norvegicus
tcaagagcctgctgtatttgcctgc

SEQ ID NO: 573584 - DNA, 25 bp, Rattus norvegicus
tcaagagcctggctgccctgaagaa

SEQ ID NO: 573585 - DNA, 25 bp, Rattus norvegicus
tcaagagcctgggtgccctgaagaa

SEQ ID NO: 573586 - DNA, 25 bp, Rattus norvegicus
tcaagagcgggaccacttcctaata

SEQ ID NO: 573587 - DNA, 25 bp, Rattus norvegicus
tcaagagcgggagcacttcctaata

SEQ ID NO: 573588 - DNA, 25 bp, Rattus norvegicus
tcaagagctagaacagacgcgccta

SEQ ID NO: 573589 - DNA, 25 bp, Rattus norvegicus
tcaagagctagatcagacgcgccta

SEQ ID NO: 573590 - DNA, 25 bp, Rattus norvegicus
tcaagagctctgactgtttccaaat

SEQ ID NO: 573591 - DNA, 25 bp, Rattus norvegicus
tcaagagctctgtctgtttccaaat

SEQ ID NO: 573592 - DNA, 25 bp, Rattus norvegicus
tcaagagctgctcgtcatccagaaa

SEQ ID NO: 573593 - DNA, 25 bp, Rattus norvegicus
tcaagagctgctggtcatccagaaa

SEQ ID NO: 573594 - DNA, 25 bp, Rattus norvegicus
tcaagaggaaacaccctcggcgggc

SEQ ID NO: 573595 - DNA, 25 bp, Rattus norvegicus
tcaagaggaaactccctcggcgggc

SEQ ID NO: 573596 - DNA, 25 bp, Rattus norvegicus
tcaagaggatccagcggctccagtg

SEQ ID NO: 573597 - DNA, 25 bp, Rattus norvegicus
tcaagaggatcctgcggctccagtg

SEQ ID NO: 573598 - DNA, 25 bp, Rattus norvegicus
tcaagaggccgcagccccgcagaga

SEQ ID NO: 573599 - DNA, 25 bp, Rattus norvegicus
tcaagaggccgctgccccgcagaga

SEQ ID NO: 573600 - DNA, 25 bp, Rattus norvegicus
tcaagaggtcgaagccccaacagag

SEQ ID NO: 573601 - DNA, 25 bp, Rattus norvegicus
tcaagaggtcgatgccccaacagag

SEQ ID NO: 573602 - DNA, 25 bp, Rattus norvegicus
tcaagagtatcgaagatggcggagt

SEQ ID NO: 573603 - DNA, 25 bp, Rattus norvegicus
tcaagagtatcgtagatggcggagt

SEQ ID NO: 573604 - DNA, 25 bp, Rattus norvegicus
tcaagagtgaatcgctgcagcccat

SEQ ID NO: 573605 - DNA, 25 bp, Rattus norvegicus
tcaagagtgaatggctgcagcccat

SEQ ID NO: 573606 - DNA, 25 bp, Rattus norvegicus
tcaagagtgtctccgtcagggatat

SEQ ID NO: 573607 - DNA, 25 bp, Rattus norvegicus
tcaagagtgtctgcgtcagggatat

SEQ ID NO: 573608 - DNA, 25 bp, Rattus norvegicus
tcaagataggctcgacctggtggca

SEQ ID NO: 573609 - DNA, 25 bp, Rattus norvegicus
tcaagataggctggacctggtggca

SEQ ID NO: 573610 - DNA, 25 bp, Rattus norvegicus
tcaagatcatccctgaggcgtacaa

SEQ ID NO: 573611 - DNA, 25 bp, Rattus norvegicus
tcaagatcatccgtgaggcgtacaa

SEQ ID NO: 573612 - DNA, 25 bp, Rattus norvegicus
tcaagatctgataagcgaggagcca

SEQ ID NO: 573613 - DNA, 25 bp, Rattus norvegicus
tcaagatctgattagcgaggagcca

SEQ ID NO: 573614 - DNA, 25 bp, Rattus norvegicus
tcaagatgactgagctaagtccggg

SEQ ID NO: 573615 - DNA, 25 bp, Rattus norvegicus
tcaagatgactgtgctaagtccggg

SEQ ID NO: 573616 - DNA, 18 bp, Rattus norvegicus
tcaagatgctaccgttca

SEQ ID NO: 573617 - DNA, 25 bp, Rattus norvegicus
tcaagatgttctcccagcaagtgca

SEQ ID NO: 573618 - DNA, 25 bp, Rattus norvegicus
tcaagatgttctgccagcaagtgca

SEQ ID NO: 573619 - DNA, 25 bp, Rattus norvegicus
tcaagattattgctcctccagaacg

SEQ ID NO: 573620 - DNA, 25 bp, Rattus norvegicus
tcaagattattggtcctccagaacg

SEQ ID NO: 573621 - DNA, 25 bp, Rattus norvegicus
tcaagattgtggaagggtgtcagac

SEQ ID NO: 573622 - DNA, 25 bp, Rattus norvegicus
tcaagattgtggtagggtgtcagac

SEQ ID NO: 573623 - DNA, 25 bp, Rattus norvegicus
tcaagcaacctgaagagtcccaccg

SEQ ID NO: 573624 - DNA, 25 bp, Rattus norvegicus
tcaagcaacctgtagagtcccaccg

SEQ ID NO: 573625 - DNA, 25 bp, Rattus norvegicus
tcaagcaacgctccaggtcgtgtca

SEQ ID NO: 573626 - DNA, 25 bp, Rattus norvegicus
tcaagcaacgctgcaggtcgtgtca

SEQ ID NO: 573627 - DNA, 25 bp, Rattus norvegicus
tcaagcacaaacagggaccttatgg

SEQ ID NO: 573628 - DNA, 25 bp, Rattus norvegicus
tcaagcacaaactgggaccttatgg

SEQ ID NO: 573629 - DNA, 25 bp, Rattus norvegicus
tcaagcacacataatttcatcccac

SEQ ID NO: 573630 - DNA, 25 bp, Rattus norvegicus
tcaagcacacattatttcatcccac

SEQ ID NO: 573631 - DNA, 25 bp, Rattus norvegicus
tcaagcaccgttatttcatttggca

SEQ ID NO: 573632 - DNA, 25 bp, Rattus norvegicus
tcaagcaccgttttttcatttggca

SEQ ID NO: 573633 - DNA, 25 bp, Rattus norvegicus
tcaagcacctcccatggaagcactg

SEQ ID NO: 573634 - DNA, 25 bp, Rattus norvegicus
tcaagcacctccgatggaagcactg

SEQ ID NO: 573635 - DNA, 25 bp, Rattus norvegicus
tcaagcaccttgagcatgcctcaga

SEQ ID NO: 573636 - DNA, 25 bp, Rattus norvegicus
tcaagcaccttgtgcatgcctcaga

SEQ ID NO: 573637 - DNA, 25 bp, Rattus norvegicus
tcaagcacgcacaacagagagacat

SEQ ID NO: 573638 - DNA, 25 bp, Rattus norvegicus
tcaagcacgcactacagagagacat

SEQ ID NO: 573639 - DNA, 25 bp, Rattus norvegicus
tcaagcagaaccagcagtcgtccta

SEQ ID NO: 573640 - DNA, 25 bp, Rattus norvegicus
tcaagcagaacctgcagtcgtccta

SEQ ID NO: 573641 - DNA, 25 bp, Rattus norvegicus
tcaagcagcaggcttacaccatcat

SEQ ID NO: 573642 - DNA, 25 bp, Rattus norvegicus
tcaagcagcagggttacaccatcat

SEQ ID NO: 573643 - DNA, 25 bp, Rattus norvegicus
tcaagcagcctccatatagacacag

SEQ ID NO: 573644 - DNA, 25 bp, Rattus norvegicus
tcaagcagcctcgatatagacacag

SEQ ID NO: 573645 - DNA, 25 bp, Rattus norvegicus
tcaagcagctccactgtaaagtgag

SEQ ID NO: 573646 - DNA, 25 bp, Rattus norvegicus
tcaagcagctcctctgtaaagtgag

SEQ ID NO: 573647 - DNA, 25 bp, Rattus norvegicus
tcaagcagggctcggtttttactct

SEQ ID NO: 573648 - DNA, 25 bp, Rattus norvegicus
tcaagcagggctgggtttttactct

SEQ ID NO: 573649 - DNA, 25 bp, Rattus norvegicus
tcaagcagtgaacagtctgggccct

SEQ ID NO: 573650 - DNA, 25 bp, Rattus norvegicus
tcaagcagtgaagagtctgggccct

SEQ ID NO: 573651 - DNA, 25 bp, Rattus norvegicus
tcaagcatcactcaggtgacctgaa

SEQ ID NO: 573652 - DNA, 25 bp, Rattus norvegicus
tcaagcatcactgaggtgacctgaa

SEQ ID NO: 573653 - DNA, 25 bp, Rattus norvegicus
tcaagcattgttcttctgactccta

SEQ ID NO: 573654 - DNA, 25 bp, Rattus norvegicus
tcaagcattgttgttctgactccta

SEQ ID NO: 573655 - DNA, 25 bp, Rattus norvegicus
tcaagccacccaagatcacatttaa

SEQ ID NO: 573656 - DNA, 25 bp, Rattus norvegicus
tcaagccacccatgatcacatttaa

SEQ ID NO: 573657 - DNA, 25 bp, Rattus norvegicus
tcaagccactcacctatgatgacta

SEQ ID NO: 573658 - DNA, 25 bp, Rattus norvegicus
tcaagccactcagctatgatgacta

SEQ ID NO: 573659 - DNA, 25 bp, Rattus norvegicus
tcaagccagaggcagcctgctcctg

SEQ ID NO: 573660 - DNA, 25 bp, Rattus norvegicus
tcaagccagagggagcctgctcctg

SEQ ID NO: 573661 - DNA, 25 bp, Rattus norvegicus
tcaagccagagtatctcatccttgt

SEQ ID NO: 573662 - DNA, 25 bp, Rattus norvegicus
tcaagccagagtttctcatccttgt

SEQ ID NO: 573663 - DNA, 25 bp, Rattus norvegicus
tcaagccagcccactaaatttcaaa

SEQ ID NO: 573664 - DNA, 25 bp, Rattus norvegicus
tcaagccagccctctaaatttcaaa

SEQ ID NO: 573665 - DNA, 25 bp, Rattus norvegicus
tcaagccaggagagcactgctgcaa

SEQ ID NO: 573666 - DNA, 25 bp, Rattus norvegicus
tcaagccaggagtgcactgctgcaa

SEQ ID NO: 573667 - DNA, 25 bp, Rattus norvegicus
tcaagccaggcccattctttgtggt

SEQ ID NO: 573668 - DNA, 25 bp, Rattus norvegicus
tcaagccaggccgattctttgtggt

SEQ ID NO: 573669 - DNA, 25 bp, Rattus norvegicus
tcaagccatctcagattgcatcctt

SEQ ID NO: 573670 - DNA, 25 bp, Rattus norvegicus
tcaagccatctctgattgcatcctt

SEQ ID NO: 573671 - DNA, 25 bp, Rattus norvegicus
tcaagccatgcgcacgttgctggtc

SEQ ID NO: 573672 - DNA, 25 bp, Rattus norvegicus
tcaagccatgcggacgttgctggtc

SEQ ID NO: 573673 - DNA, 25 bp, Rattus norvegicus
tcaagcccagctcgtggttctgtgc

SEQ ID NO: 573674 - DNA, 25 bp, Rattus norvegicus
tcaagcccagctggtggttctgtgc

SEQ ID NO: 573675 - DNA, 25 bp, Rattus norvegicus
tcaagcccgtacatttttcttacag

SEQ ID NO: 573676 - DNA, 25 bp, Rattus norvegicus
tcaagcccgtacttttttcttacag

SEQ ID NO: 573677 - DNA, 25 bp, Rattus norvegicus
tcaagccctgatatctttgactccc

SEQ ID NO: 573678 - DNA, 25 bp, Rattus norvegicus
tcaagccctgatttctttgactccc

SEQ ID NO: 573679 - DNA, 25 bp, Rattus norvegicus
tcaagccctggtatgagcccatgta

SEQ ID NO: 573680 - DNA, 25 bp, Rattus norvegicus
tcaagccctggtttgagcccatgta

SEQ ID NO: 573681 - DNA, 25 bp, Rattus norvegicus
tcaagccctgtgataagcccttcgt

SEQ ID NO: 573682 - DNA, 25 bp, Rattus norvegicus
tcaagccctgtgttaagcccttcgt

SEQ ID NO: 573683 - DNA, 25 bp, Rattus norvegicus
tcaagccctgttatagctccaaagc

SEQ ID NO: 573684 - DNA, 25 bp, Rattus norvegicus
tcaagccctgttttagctccaaagc

SEQ ID NO: 573685 - DNA, 25 bp, Rattus norvegicus
tcaagcccttccaggtggagagctg

SEQ ID NO: 573686 - DNA, 25 bp, Rattus norvegicus
tcaagcccttcctggtggagagctg

SEQ ID NO: 573687 - DNA, 25 bp, Rattus norvegicus
tcaagcctaggcagctgtggtcaca

SEQ ID NO: 573688 - DNA, 25 bp, Rattus norvegicus
tcaagcctaggctgctgtggtcaca

SEQ ID NO: 573689 - DNA, 25 bp, Rattus norvegicus
tcaagcctattactaccgggattat

SEQ ID NO: 573690 - DNA, 25 bp, Rattus norvegicus
tcaagcctattagtaccgggattat

SEQ ID NO: 573691 - DNA, 25 bp, Rattus norvegicus
tcaagcctcaagatagaaatgccag

SEQ ID NO: 573692 - DNA, 25 bp, Rattus norvegicus
tcaagcctcaagttagaaatgccag

SEQ ID NO: 573693 - DNA, 25 bp, Rattus norvegicus
tcaagcctcacgatgacagtgtcaa

SEQ ID NO: 573694 - DNA, 25 bp, Rattus norvegicus
tcaagcctcacgttgacagtgtcaa

SEQ ID NO: 573695 - DNA, 25 bp, Rattus norvegicus
tcaagcctcagaccttgtcagacaa

SEQ ID NO: 573696 - DNA, 25 bp, Rattus norvegicus
tcaagcctcagagcttgtcagacaa

SEQ ID NO: 573697 - DNA, 25 bp, Rattus norvegicus
tcaagcctcaggatttctttttatt

SEQ ID NO: 573698 - DNA, 25 bp, Rattus norvegicus
tcaagcctcaggttttctttttatt

SEQ ID NO: 573699 - DNA, 25 bp, Rattus norvegicus
tcaagcctccagactggtgggaggt

SEQ ID NO: 573700 - DNA, 25 bp, Rattus norvegicus
tcaagcctccagtctggtgggaggt

SEQ ID NO: 573701 - DNA, 25 bp, Rattus norvegicus
tcaagcctccctcagggatcaagat

SEQ ID NO: 573702 - DNA, 25 bp, Rattus norvegicus
tcaagcctccctgagggatcaagat

SEQ ID NO: 573703 - DNA, 25 bp, Rattus norvegicus
tcaagcctccttagcgtcactttaa

SEQ ID NO: 573704 - DNA, 25 bp, Rattus norvegicus
tcaagcctcctttgcgtcactttaa

SEQ ID NO: 573705 - DNA, 25 bp, Rattus norvegicus
tcaagcctgcgtctttaaagcacat

SEQ ID NO: 573706 - DNA, 25 bp, Rattus norvegicus
tcaagcctgcgtgtttaaagcacat

SEQ ID NO: 573707 - DNA, 25 bp, Rattus norvegicus
tcaagcctgggcacttcaagaagtt

SEQ ID NO: 573708 - DNA, 25 bp, Rattus norvegicus
tcaagcctgggctcttcaagaagtt

SEQ ID NO: 573709 - DNA, 25 bp, Rattus norvegicus
tcaagcctgtgcctgacttctggac

SEQ ID NO: 573710 - DNA, 25 bp, Rattus norvegicus
tcaagcctgtgcgtgacttctggac

SEQ ID NO: 573711 - DNA, 25 bp, Rattus norvegicus
tcaagcctgtggaatatcatcgagt

SEQ ID NO: 573712 - DNA, 25 bp, Rattus norvegicus
tcaagcctgtggtatatcatcgagt

SEQ ID NO: 573713 - DNA, 25 bp, Rattus norvegicus
tcaagccttcacaacccaattgtaa

SEQ ID NO: 573714 - DNA, 25 bp, Rattus norvegicus
tcaagccttcactacccaattgtaa

SEQ ID NO: 573715 - DNA, 25 bp, Rattus norvegicus
tcaagcgacctcatctttctgggct

SEQ ID NO: 573716 - DNA, 25 bp, Rattus norvegicus
tcaagcgacctcttctttctgggct

SEQ ID NO: 573717 - DNA, 25 bp, Rattus norvegicus
tcaagcgcagcaagcagaccaagga

SEQ ID NO: 573718 - DNA, 25 bp, Rattus norvegicus
tcaagcgcagcatgcagaccaagga

SEQ ID NO: 573719 - DNA, 25 bp, Rattus norvegicus
tcaagcgccctgaggtataggagat

SEQ ID NO: 573720 - DNA, 25 bp, Rattus norvegicus
tcaagcgccctgtggtataggagat

SEQ ID NO: 573721 - DNA, 25 bp, Rattus norvegicus
tcaagcgtggcgagctgcagacgca

SEQ ID NO: 573722 - DNA, 25 bp, Rattus norvegicus
tcaagcgtggcgtgctgcagacgca

SEQ ID NO: 573723 - DNA, 25 bp, Rattus norvegicus
tcaagcgtggtgattcctggtcagt

SEQ ID NO: 573724 - DNA, 25 bp, Rattus norvegicus
tcaagcgtggtgtttcctggtcagt

SEQ ID NO: 573725 - DNA, 25 bp, Rattus norvegicus
tcaagctagctgactctctcttttt

SEQ ID NO: 573726 - DNA, 25 bp, Rattus norvegicus
tcaagctagctgtctctctcttttt

SEQ ID NO: 573727 - DNA, 25 bp, Rattus norvegicus
tcaagctagggcaacatgctcggta

SEQ ID NO: 573728 - DNA, 25 bp, Rattus norvegicus
tcaagctagggctacatgctcggta

SEQ ID NO: 573729 - DNA, 25 bp, Rattus norvegicus
tcaagctagtgaaccctgtcttctc

SEQ ID NO: 573730 - DNA, 25 bp, Rattus norvegicus
tcaagctagtgatccctgtcttctc

SEQ ID NO: 573731 - DNA, 25 bp, Rattus norvegicus
tcaagctccacgaagatcaccaagt

SEQ ID NO: 573732 - DNA, 25 bp, Rattus norvegicus
tcaagctccacgtagatcaccaagt

SEQ ID NO: 573733 - DNA, 25 bp, Rattus norvegicus
tcaagctcctccatcccatggtggt

SEQ ID NO: 573734 - DNA, 25 bp, Rattus norvegicus
tcaagctcctccttcccatggtggt

SEQ ID NO: 573735 - DNA, 25 bp, Rattus norvegicus
tcaagctcgggcagaagagcctggt

SEQ ID NO: 573736 - DNA, 25 bp, Rattus norvegicus
tcaagctcgggctgaagagcctggt

SEQ ID NO: 573737 - DNA, 25 bp, Rattus norvegicus
tcaagctctcccatggtttttgaaa

SEQ ID NO: 573738 - DNA, 25 bp, Rattus norvegicus
tcaagctctcccttggtttttgaaa

SEQ ID NO: 573739 - DNA, 25 bp, Rattus norvegicus
tcaagctctctgaaaactgaagcta

SEQ ID NO: 573740 - DNA, 25 bp, Rattus norvegicus
tcaagctctctgtaaactgaagcta

SEQ ID NO: 573741 - DNA, 25 bp, Rattus norvegicus
tcaagctctcttctgggtaccaaag

SEQ ID NO: 573742 - DNA, 25 bp, Rattus norvegicus
tcaagctctcttgtgggtaccaaag

SEQ ID NO: 573743 - DNA, 25 bp, Rattus norvegicus
tcaagctctttcatgtaggaggcct

SEQ ID NO: 573744 - DNA, 25 bp, Rattus norvegicus
tcaagctctttcttgtaggaggcct

SEQ ID NO: 573745 - DNA, 25 bp, Rattus norvegicus
tcaagctgacccagaagctgcgaga

SEQ ID NO: 573746 - DNA, 25 bp, Rattus norvegicus
tcaagctgaccctgaagctgcgaga

SEQ ID NO: 573747 - DNA, 25 bp, Rattus norvegicus
tcaagctgctgacgaaccatgcctt

SEQ ID NO: 573748 - DNA, 25 bp, Rattus norvegicus
tcaagctgctgaggaaccatgcctt

SEQ ID NO: 573749 - DNA, 25 bp, Rattus norvegicus
tcaagctggtgaaaacccctttcca

SEQ ID NO: 573750 - DNA, 25 bp, Rattus norvegicus
tcaagctggtgataacccctttcca

SEQ ID NO: 573751 - DNA, 25 bp, Rattus norvegicus
tcaagctgtagcatgtgtgtgggct

SEQ ID NO: 573752 - DNA, 25 bp, Rattus norvegicus
tcaagctgtagcttgtgtgtgggct

SEQ ID NO: 573753 - DNA, 25 bp, Rattus norvegicus
tcaagctgtgccaggacatcttctt

SEQ ID NO: 573754 - DNA, 25 bp, Rattus norvegicus
tcaagctgtgcctggacatcttctt

SEQ ID NO: 573755 - DNA, 25 bp, Rattus norvegicus
tcaagctgtgggatgttcgggattc

SEQ ID NO: 573756 - DNA, 25 bp, Rattus norvegicus
tcaagctgtgggttgttcgggattc

SEQ ID NO: 573757 - DNA, 25 bp, Rattus norvegicus
tcaagcttccctcagtttcgctgac

SEQ ID NO: 573758 - DNA, 25 bp, Rattus norvegicus
tcaagcttccctgagtttcgctgac

SEQ ID NO: 573759 - DNA, 25 bp, Rattus norvegicus
tcaagctttaaacgcagcgcaccct

SEQ ID NO: 573760 - DNA, 25 bp, Rattus norvegicus
tcaagctttaaaggcagcgcaccct

SEQ ID NO: 573761 - DNA, 25 bp, Rattus norvegicus
tcaaggacacttcggtaggctttcc

SEQ ID NO: 573762 - DNA, 25 bp, Rattus norvegicus
tcaaggacacttgggtaggctttcc

SEQ ID NO: 573763 - DNA, 25 bp, Rattus norvegicus
tcaaggacagtcaaatctacataat

SEQ ID NO: 573764 - DNA, 25 bp, Rattus norvegicus
tcaaggacagtctaatctacataat

SEQ ID NO: 573765 - DNA, 25 bp, Rattus norvegicus
tcaaggacatctccgagggctacat

SEQ ID NO: 573766 - DNA, 25 bp, Rattus norvegicus
tcaaggacatctgcgagggctacat

SEQ ID NO: 573767 - DNA, 25 bp, Rattus norvegicus
tcaaggacatggaccctctgtctca

SEQ ID NO: 573768 - DNA, 25 bp, Rattus norvegicus
tcaaggacatggtccctctgtctca

SEQ ID NO: 573769 - DNA, 25 bp, Rattus norvegicus
tcaaggaccctcagtgatgtgatca

SEQ ID NO: 573770 - DNA, 25 bp, Rattus norvegicus
tcaaggaccctctgtgatgtgatca

SEQ ID NO: 573771 - DNA, 25 bp, Rattus norvegicus
tcaaggaccttcagcggaatctgct

SEQ ID NO: 573772 - DNA, 25 bp, Rattus norvegicus
tcaaggaccttctgcggaatctgct

SEQ ID NO: 573773 - DNA, 25 bp, Rattus norvegicus
tcaaggacgtgcagctgaacctgcg

SEQ ID NO: 573774 - DNA, 25 bp, Rattus norvegicus
tcaaggacgtgctgctgaacctgcg

SEQ ID NO: 573775 - DNA, 25 bp, Rattus norvegicus
tcaaggactcttccacaggagcaaa

SEQ ID NO: 573776 - DNA, 25 bp, Rattus norvegicus
tcaaggactcttgcacaggagcaaa

SEQ ID NO: 573777 - DNA, 25 bp, Rattus norvegicus
tcaaggactgttaccgggaggagcc

SEQ ID NO: 573778 - DNA, 25 bp, Rattus norvegicus
tcaaggactgtttccgggaggagcc

SEQ ID NO: 573779 - DNA, 25 bp, Rattus norvegicus
tcaaggagagctacagggtccatct

SEQ ID NO: 573780 - DNA, 25 bp, Rattus norvegicus
tcaaggagagcttcagggtccatct

SEQ ID NO: 573781 - DNA, 25 bp, Rattus norvegicus
tcaaggagatccagggtactgcaca

SEQ ID NO: 573782 - DNA, 25 bp, Rattus norvegicus
tcaaggagatcctgggtactgcaca

SEQ ID NO: 573783 - DNA, 25 bp, Rattus norvegicus
tcaaggagatggacccggagttcgt

SEQ ID NO: 573784 - DNA, 25 bp, Rattus norvegicus
tcaaggagatggtcccggagttcgt

SEQ ID NO: 573785 - DNA, 25 bp, Rattus norvegicus
tcaaggagctctctaggctctgttt

SEQ ID NO: 573786 - DNA, 25 bp, Rattus norvegicus
tcaaggagctctgtaggctctgttt

SEQ ID NO: 573787 - DNA, 25 bp, Rattus norvegicus
tcaaggagggccctgagccgtcatc

SEQ ID NO: 573788 - DNA, 25 bp, Rattus norvegicus
tcaaggagggccgtgagccgtcatc

SEQ ID NO: 573789 - DNA, 25 bp, Rattus norvegicus
tcaaggatcactccaacccaggatt

SEQ ID NO: 573790 - DNA, 25 bp, Rattus norvegicus
tcaaggatcactgcaacccaggatt

SEQ ID NO: 573791 - DNA, 25 bp, Rattus norvegicus
tcaaggatccttacactcatgatgg

SEQ ID NO: 573792 - DNA, 25 bp, Rattus norvegicus
tcaaggatcctttcactcatgatgg

SEQ ID NO: 573793 - DNA, 25 bp, Rattus norvegicus
tcaaggatcggcattgactacacag

SEQ ID NO: 573794 - DNA, 25 bp, Rattus norvegicus
tcaaggatcggctttgactacacag

SEQ ID NO: 573795 - DNA, 25 bp, Rattus norvegicus
tcaaggatgaagacacaggtgtgca

SEQ ID NO: 573796 - DNA, 25 bp, Rattus norvegicus
tcaaggatgaagtcacaggtgtgca

SEQ ID NO: 573797 - DNA, 25 bp, Rattus norvegicus
tcaaggatgatcaggctgcggcaca

SEQ ID NO: 573798 - DNA, 25 bp, Rattus norvegicus
tcaaggatgatctggctgcggcaca

SEQ ID NO: 573799 - DNA, 25 bp, Rattus norvegicus
tcaaggatgtgtcgcagatgctgct

SEQ ID NO: 573800 - DNA, 25 bp, Rattus norvegicus
tcaaggatgtgtggcagatgctgct

SEQ ID NO: 573801 - DNA, 25 bp, Rattus norvegicus
tcaaggatttccacttccaagccaa

SEQ ID NO: 573802 - DNA, 25 bp, Rattus norvegicus
tcaaggatttcctcttccaagccaa

SEQ ID NO: 573803 - DNA, 25 bp, Rattus norvegicus
tcaaggattttcagcggaggatact

SEQ ID NO: 573804 - DNA, 25 bp, Rattus norvegicus
tcaaggattttctgcggaggatact

SEQ ID NO: 573805 - DNA, 25 bp, Rattus norvegicus
tcaaggcacttaaagaggaccaggt

SEQ ID NO: 573806 - DNA, 25 bp, Rattus norvegicus
tcaaggcacttatagaggaccaggt

SEQ ID NO: 573807 - DNA, 25 bp, Rattus norvegicus
tcaaggcaggtccagcccgctgagt

SEQ ID NO: 573808 - DNA, 25 bp, Rattus norvegicus
tcaaggcaggtcgagcccgctgagt

SEQ ID NO: 573809 - DNA, 25 bp, Rattus norvegicus
tcaaggcatacaccatattgtcccc

SEQ ID NO: 573810 - DNA, 25 bp, Rattus norvegicus
tcaaggcatacagcatattgtcccc

SEQ ID NO: 573811 - DNA, 25 bp, Rattus norvegicus
tcaaggccaaaacgcccagctctga

SEQ ID NO: 573812 - DNA, 25 bp, Rattus norvegicus
tcaaggccaaaaggcccagctctga

SEQ ID NO: 573813 - DNA, 25 bp, Rattus norvegicus
tcaaggccaatgaggctcaccttcc

SEQ ID NO: 573814 - DNA, 25 bp, Rattus norvegicus
tcaaggccaatgtggctcaccttcc

SEQ ID NO: 573815 - DNA, 25 bp, Rattus norvegicus
tcaaggccactgaccctgaaaggag

SEQ ID NO: 573816 - DNA, 25 bp, Rattus norvegicus
tcaaggccactgtccctgaaaggag

SEQ ID NO: 573817 - DNA, 25 bp, Rattus norvegicus
tcaaggccagcaagctgtaactcgt

SEQ ID NO: 573818 - DNA, 25 bp, Rattus norvegicus
tcaaggccagcacagactacaaaat

SEQ ID NO: 573819 - DNA, 25 bp, Rattus norvegicus
tcaaggccagcagagactacaaaat

SEQ ID NO: 573820 - DNA, 25 bp, Rattus norvegicus
tcaaggccagcatgctgtaactcgt

SEQ ID NO: 573821 - DNA, 25 bp, Rattus norvegicus
tcaaggccagccacagtgatagtct

SEQ ID NO: 573822 - DNA, 25 bp, Rattus norvegicus
tcaaggccagccactattgattgag

SEQ ID NO: 573823 - DNA, 25 bp, Rattus norvegicus
tcaaggccagcctcagtgatagtct

SEQ ID NO: 573824 - DNA, 25 bp, Rattus norvegicus
tcaaggccagcctctattgattgag

SEQ ID NO: 573825 - DNA, 25 bp, Rattus norvegicus
tcaaggccagctaagtaacagcaaa

SEQ ID NO: 573826 - DNA, 25 bp, Rattus norvegicus
tcaaggccagcttagtaacagcaaa

SEQ ID NO: 573827 - DNA, 25 bp, Rattus norvegicus
tcaaggccatcgagggctaccttag

SEQ ID NO: 573828 - DNA, 25 bp, Rattus norvegicus
tcaaggccatcgtgggctaccttag

SEQ ID NO: 573829 - DNA, 25 bp, Rattus norvegicus
tcaaggccattaatcccatcaacac

SEQ ID NO: 573830 - DNA, 25 bp, Rattus norvegicus
tcaaggccattattcccatcaacac

SEQ ID NO: 573831 - DNA, 25 bp, Rattus norvegicus
tcaaggccgcaaacgcagaggagca

SEQ ID NO: 573832 - DNA, 25 bp, Rattus norvegicus
tcaaggccgcaatcgcagaggagca

SEQ ID NO: 573833 - DNA, 25 bp, Rattus norvegicus
tcaaggccggccagtagtcagatat

SEQ ID NO: 573834 - DNA, 25 bp, Rattus norvegicus
tcaaggccggcctgtagtcagatat

SEQ ID NO: 573835 - DNA, 25 bp, Rattus norvegicus
tcaaggcctcatcccaggagagtat

SEQ ID NO: 573836 - DNA, 25 bp, Rattus norvegicus
tcaaggcctcatgccaggagagtat

SEQ ID NO: 573837 - DNA, 25 bp, Rattus norvegicus
tcaaggcctgagacgacgacaataa

SEQ ID NO: 573838 - DNA, 25 bp, Rattus norvegicus
tcaaggcctgagtcgacgacaataa

SEQ ID NO: 573839 - DNA, 25 bp, Rattus norvegicus
tcaaggctacagctgaagatcccag

SEQ ID NO: 573840 - DNA, 25 bp, Rattus norvegicus
tcaaggctacaggtgaagatcccag

SEQ ID NO: 573841 - DNA, 25 bp, Rattus norvegicus
tcaaggctcagcctcagtaatcctt

SEQ ID NO: 573842 - DNA, 25 bp, Rattus norvegicus
tcaaggctcagcgtcagtaatcctt

SEQ ID NO: 573843 - DNA, 25 bp, Rattus norvegicus
tcaaggctgcagattcagtgttact

SEQ ID NO: 573844 - DNA, 25 bp, Rattus norvegicus
tcaaggctgcagtttcagtgttact

SEQ ID NO: 573845 - DNA, 25 bp, Rattus norvegicus
tcaaggctgggaatgcatgcccctc

SEQ ID NO: 573846 - DNA, 25 bp, Rattus norvegicus
tcaaggctgggattgcatgcccctc

SEQ ID NO: 573847 - DNA, 25 bp, Rattus norvegicus
tcaaggctgggtaggtctacataca

SEQ ID NO: 573848 - DNA, 25 bp, Rattus norvegicus
tcaaggctgggttggtctacataca

SEQ ID NO: 573849 - DNA, 25 bp, Rattus norvegicus
tcaaggctggttaacttatgcaaag

SEQ ID NO: 573850 - DNA, 25 bp, Rattus norvegicus
tcaaggctggtttacttatgcaaag

SEQ ID NO: 573851 - DNA, 25 bp, Rattus norvegicus
tcaaggctgtctagagaagttcccc

SEQ ID NO: 573852 - DNA, 25 bp, Rattus norvegicus
tcaaggctgtcttgagaagttcccc

SEQ ID NO: 573853 - DNA, 25 bp, Rattus norvegicus
tcaaggcttctaaaccgtgaggtga

SEQ ID NO: 573854 - DNA, 25 bp, Rattus norvegicus
tcaaggcttctataccgtgaggtga

SEQ ID NO: 573855 - DNA, 25 bp, Rattus norvegicus
tcaagggacaccactctgtcttgga

SEQ ID NO: 573856 - DNA, 25 bp, Rattus norvegicus
tcaagggacacctctctgtcttgga

SEQ ID NO: 573857 - DNA, 25 bp, Rattus norvegicus
tcaagggaccctccaagttggtgga

SEQ ID NO: 573858 - DNA, 25 bp, Rattus norvegicus
tcaagggaccctgcaagttggtgga

SEQ ID NO: 573859 - DNA, 25 bp, Rattus norvegicus
tcaagggacgtgagcctcccggtga

SEQ ID NO: 573860 - DNA, 25 bp, Rattus norvegicus
tcaagggacgtgtgcctcccggtga

SEQ ID NO: 573861 - DNA, 25 bp, Rattus norvegicus
tcaagggacttccaagcacctacaa

SEQ ID NO: 573862 - DNA, 25 bp, Rattus norvegicus
tcaagggacttcgaagcacctacaa

SEQ ID NO: 573863 - DNA, 25 bp, Rattus norvegicus
tcaagggagtacaggctcctgccaa

SEQ ID NO: 573864 - DNA, 25 bp, Rattus norvegicus
tcaagggagtactggctcctgccaa

SEQ ID NO: 573865 - DNA, 25 bp, Rattus norvegicus
tcaagggatgggatacttcgtaaag

SEQ ID NO: 573866 - DNA, 25 bp, Rattus norvegicus
tcaagggatgggttacttcgtaaag

SEQ ID NO: 573867 - DNA, 25 bp, Rattus norvegicus
tcaagggccagaacctgatgcccaa

SEQ ID NO: 573868 - DNA, 25 bp, Rattus norvegicus
tcaagggccagatcctgatgcccaa

SEQ ID NO: 573869 - DNA, 25 bp, Rattus norvegicus
tcaagggcggccagtttgccatccg

SEQ ID NO: 573870 - DNA, 25 bp, Rattus norvegicus
tcaagggcggcctgtttgccatccg

SEQ ID NO: 573871 - DNA, 25 bp, Rattus norvegicus
tcaagggctactatgatgagcaact

SEQ ID NO: 573872 - DNA, 25 bp, Rattus norvegicus
tcaagggctactttgatgagcaact

SEQ ID NO: 573873 - DNA, 25 bp, Rattus norvegicus
tcaagggcttctagcctgctggtgc

SEQ ID NO: 573874 - DNA, 25 bp, Rattus norvegicus
tcaagggcttcttgcctgctggtgc

SEQ ID NO: 573875 - DNA, 25 bp, Rattus norvegicus
tcaagggcttggctggtccgcaccc

SEQ ID NO: 573876 - DNA, 25 bp, Rattus norvegicus
tcaagggcttgggtggtccgcaccc

SEQ ID NO: 573877 - DNA, 25 bp, Rattus norvegicus
tcaagggtatcgatctgccattgtc

SEQ ID NO: 573878 - DNA, 25 bp, Rattus norvegicus
tcaagggtatcgttctgccattgtc

SEQ ID NO: 573879 - DNA, 25 bp, Rattus norvegicus
tcaagggtcctaccaagtgccactt

SEQ ID NO: 573880 - DNA, 25 bp, Rattus norvegicus
tcaagggtcctagcaagtgccactt

SEQ ID NO: 573881 - DNA, 25 bp, Rattus norvegicus
tcaagggtgcgtccccattgggcta

SEQ ID NO: 573882 - DNA, 25 bp, Rattus norvegicus
tcaagggtgcgtgcccattgggcta

SEQ ID NO: 573883 - DNA, 25 bp, Rattus norvegicus
tcaagggtgtggatcatcatggcag

SEQ ID NO: 573884 - DNA, 25 bp, Rattus norvegicus
tcaagggtgtggttcatcatggcag

SEQ ID NO: 573885 - DNA, 25 bp, Rattus norvegicus
tcaagggttggtctctgaattcaca

SEQ ID NO: 573886 - DNA, 25 bp, Rattus norvegicus
tcaagggttggtgtctgaattcaca

SEQ ID NO: 573887 - DNA, 25 bp, Rattus norvegicus
tcaagggttttcatcagggcccaaa

SEQ ID NO: 573888 - DNA, 25 bp, Rattus norvegicus
tcaagggttttcttcagggcccaaa

SEQ ID NO: 573889 - DNA, 25 bp, Rattus norvegicus
tcaaggtagcttatgttgcttttaa

SEQ ID NO: 573890 - DNA, 25 bp, Rattus norvegicus
tcaaggtagcttttgttgcttttaa

SEQ ID NO: 573891 - DNA, 25 bp, Rattus norvegicus
tcaaggtcaagtcagcattcctgct

SEQ ID NO: 573892 - DNA, 25 bp, Rattus norvegicus
tcaaggtcaagtgagcattcctgct

SEQ ID NO: 573893 - DNA, 25 bp, Rattus norvegicus
tcaaggtcaccacggctcgggaaaa

SEQ ID NO: 573894 - DNA, 25 bp, Rattus norvegicus
tcaaggtcaccagggctcgggaaaa

SEQ ID NO: 573895 - DNA, 25 bp, Rattus norvegicus
tcaaggtcatgacatttcctgtgct

SEQ ID NO: 573896 - DNA, 25 bp, Rattus norvegicus
tcaaggtcatgagatttcctgtgct

SEQ ID NO: 573897 - DNA, 25 bp, Rattus norvegicus
tcaaggtccccaagggccacacttg

SEQ ID NO: 573898 - DNA, 25 bp, Rattus norvegicus
tcaaggtccccatgggccacacttg

SEQ ID NO: 573899 - DNA, 25 bp, Rattus norvegicus
tcaaggtcctttatgtggctgaaaa

SEQ ID NO: 573900 - DNA, 25 bp, Rattus norvegicus
tcaaggtcctttttgtggctgaaaa

SEQ ID NO: 573901 - DNA, 25 bp, Rattus norvegicus
tcaaggtcgcccactagtttacaga

SEQ ID NO: 573902 - DNA, 25 bp, Rattus norvegicus
tcaaggtcgccctctagtttacaga

SEQ ID NO: 573903 - DNA, 25 bp, Rattus norvegicus
tcaaggtcttaaatgattcaggcat

SEQ ID NO: 573904 - DNA, 25 bp, Rattus norvegicus
tcaaggtcttaattgattcaggcat

SEQ ID NO: 573905 - DNA, 25 bp, Rattus norvegicus
tcaaggtgaccacgtccatcccgta

SEQ ID NO: 573906 - DNA, 25 bp, Rattus norvegicus
tcaaggtgaccaggtccatcccgta

SEQ ID NO: 573907 - DNA, 25 bp, Rattus norvegicus
tcaaggtgacttcccggtgacgcag

SEQ ID NO: 573908 - DNA, 25 bp, Rattus norvegicus
tcaaggtgacttgccggtgacgcag

SEQ ID NO: 573909 - DNA, 25 bp, Rattus norvegicus
tcaaggtgccggaaaacttcatttt

SEQ ID NO: 573910 - DNA, 25 bp, Rattus norvegicus
tcaaggtgccggtaaacttcatttt

SEQ ID NO: 573911 - DNA, 25 bp, Rattus norvegicus
tcaaggtgtctgatatggcccgcgc

SEQ ID NO: 573912 - DNA, 25 bp, Rattus norvegicus
tcaaggtgtctgttatggcccgcgc

SEQ ID NO: 573913 - DNA, 25 bp, Rattus norvegicus
tcaaggtgtggccaacctgtctgat

SEQ ID NO: 573914 - DNA, 25 bp, Rattus norvegicus
tcaaggtgtggcgaacctgtctgat

SEQ ID NO: 573915 - DNA, 25 bp, Rattus norvegicus
tcaaggttcatgctgtaagttcaag

SEQ ID NO: 573916 - DNA, 25 bp, Rattus norvegicus
tcaaggttcatggtgtaagttcaag

SEQ ID NO: 573917 - DNA, 25 bp, Rattus norvegicus
tcaaggttcctcatagttacccaca

SEQ ID NO: 573918 - DNA, 25 bp, Rattus norvegicus
tcaaggttcctcttagttacccaca

SEQ ID NO: 573919 - DNA, 25 bp, Rattus norvegicus
tcaaggttgcatatcgcacccttcc

SEQ ID NO: 573920 - DNA, 25 bp, Rattus norvegicus
tcaaggttgcatttcgcacccttcc

SEQ ID NO: 573921 - DNA, 25 bp, Rattus norvegicus
tcaaggttgggcaccgattcctgca

SEQ ID NO: 573922 - DNA, 25 bp, Rattus norvegicus
tcaaggttgggctccgattcctgca

SEQ ID NO: 573923 - DNA, 25 bp, Rattus norvegicus
tcaaggttgtccaccagtaagggtt

SEQ ID NO: 573924 - DNA, 25 bp, Rattus norvegicus
tcaaggttgtcctccagtaagggtt

SEQ ID NO: 573925 - DNA, 25 bp, Rattus norvegicus
tcaaggtttaatcaccctttggtca

SEQ ID NO: 573926 - DNA, 25 bp, Rattus norvegicus
tcaaggtttaatgaccctttggtca

SEQ ID NO: 573927 - DNA, 25 bp, Rattus norvegicus
tcaaggtttattcggctctggtctt

SEQ ID NO: 573928 - DNA, 25 bp, Rattus norvegicus
tcaaggtttattgggctctggtctt

SEQ ID NO: 573929 - DNA, 25 bp, Rattus norvegicus
tcaaggtttcccattacattccagg

SEQ ID NO: 573930 - DNA, 25 bp, Rattus norvegicus
tcaaggtttccctttacattccagg

SEQ ID NO: 573931 - DNA, 25 bp, Rattus norvegicus
tcaaggtttcttacagatgctggat

SEQ ID NO: 573932 - DNA, 25 bp, Rattus norvegicus
tcaaggtttctttcagatgctggat

SEQ ID NO: 573933 - DNA, 25 bp, Rattus norvegicus
tcaagtacaggtattattccagaaa

SEQ ID NO: 573934 - DNA, 25 bp, Rattus norvegicus
tcaagtacaggttttattccagaaa

SEQ ID NO: 573935 - DNA, 25 bp, Rattus norvegicus
tcaagtaccgctctaacgacaccat

SEQ ID NO: 573936 - DNA, 25 bp, Rattus norvegicus
tcaagtaccgctgtaacgacaccat

SEQ ID NO: 573937 - DNA, 25 bp, Rattus norvegicus
tcaagtaccgtcaggtctgctggat

SEQ ID NO: 573938 - DNA, 25 bp, Rattus norvegicus
tcaagtaccgtctggtctgctggat

SEQ ID NO: 573939 - DNA, 25 bp, Rattus norvegicus
tcaagtaccgtgaccagccagcctg

SEQ ID NO: 573940 - DNA, 25 bp, Rattus norvegicus
tcaagtaccgtgtccagccagcctg

SEQ ID NO: 573941 - DNA, 25 bp, Rattus norvegicus
tcaagtatatgccatgcccagtaaa

SEQ ID NO: 573942 - DNA, 25 bp, Rattus norvegicus
tcaagtatatgcgatgcccagtaaa

SEQ ID NO: 573943 - DNA, 25 bp, Rattus norvegicus
tcaagtatgagtccagagatgccta

SEQ ID NO: 573944 - DNA, 25 bp, Rattus norvegicus
tcaagtatgagtgcagagatgccta

SEQ ID NO: 573945 - DNA, 25 bp, Rattus norvegicus
tcaagtatgtggagtgttccgccct

SEQ ID NO: 573946 - DNA, 25 bp, Rattus norvegicus
tcaagtatgtggtgtgttccgccct

SEQ ID NO: 573947 - DNA, 25 bp, Rattus norvegicus
tcaagtattttgacctatgtataac

SEQ ID NO: 573948 - DNA, 25 bp, Rattus norvegicus
tcaagtattttgtcctatgtataac

SEQ ID NO: 573949 - DNA, 25 bp, Rattus norvegicus
tcaagtcactttacctacaatgctc

SEQ ID NO: 573950 - DNA, 25 bp, Rattus norvegicus
tcaagtcacttttcctacaatgctc

SEQ ID NO: 573951 - DNA, 25 bp, Rattus norvegicus
tcaagtcagctcaacaggccaaaca

SEQ ID NO: 573952 - DNA, 25 bp, Rattus norvegicus
tcaagtcagctctacaggccaaaca

SEQ ID NO: 573953 - DNA, 25 bp, Rattus norvegicus
tcaagtcatagacattaccccacct

SEQ ID NO: 573954 - DNA, 25 bp, Rattus norvegicus
tcaagtcatagagattaccccacct

SEQ ID NO: 573955 - DNA, 25 bp, Rattus norvegicus
tcaagtcatcagcatcatctacagg

SEQ ID NO: 573956 - DNA, 25 bp, Rattus norvegicus
tcaagtcatcaggatcatctacagg

SEQ ID NO: 573957 - DNA, 25 bp, Rattus norvegicus
tcaagtccaagtcaaccagggtgct

SEQ ID NO: 573958 - DNA, 25 bp, Rattus norvegicus
tcaagtccaagtgaaccagggtgct

SEQ ID NO: 573959 - DNA, 25 bp, Rattus norvegicus
tcaagtcccctccaagggcagctgt

SEQ ID NO: 573960 - DNA, 25 bp, Rattus norvegicus
tcaagtcccctcgaagggcagctgt

SEQ ID NO: 573961 - DNA, 25 bp, Rattus norvegicus
tcaagtcctacaaggcccagatgga

SEQ ID NO: 573962 - DNA, 25 bp, Rattus norvegicus
tcaagtcctacatggcccagatgga

SEQ ID NO: 573963 - DNA, 25 bp, Rattus norvegicus
tcaagtcctgttatgcctttgccaa

SEQ ID NO: 573964 - DNA, 25 bp, Rattus norvegicus
tcaagtcctgttttgcctttgccaa

SEQ ID NO: 573965 - DNA, 25 bp, Rattus norvegicus
tcaagtccttcacacctttgctggg

SEQ ID NO: 573966 - DNA, 25 bp, Rattus norvegicus
tcaagtccttcagacctttgctggg

SEQ ID NO: 573967 - DNA, 25 bp, Rattus norvegicus
tcaagtccttgactgggaagtcctc

SEQ ID NO: 573968 - DNA, 25 bp, Rattus norvegicus
tcaagtccttgagtgggaagtcctc

SEQ ID NO: 573969 - DNA, 25 bp, Rattus norvegicus
tcaagtcgctgaaagcctcagagga

SEQ ID NO: 573970 - DNA, 25 bp, Rattus norvegicus
tcaagtcgctgatagcctcagagga

SEQ ID NO: 573971 - DNA, 25 bp, Rattus norvegicus
tcaagtcgtcgcaggacaaatattg

SEQ ID NO: 573972 - DNA, 25 bp, Rattus norvegicus
tcaagtcgtcgctggacaaatattg

SEQ ID NO: 573973 - DNA, 25 bp, Rattus norvegicus
tcaagtctcaacagaactgccttct

SEQ ID NO: 573974 - DNA, 25 bp, Rattus norvegicus
tcaagtctcaactgaactgccttct

SEQ ID NO: 573975 - DNA, 25 bp, Rattus norvegicus
tcaagtctctaaacacccagggatt

SEQ ID NO: 573976 - DNA, 25 bp, Rattus norvegicus
tcaagtctctaatcacccagggatt

SEQ ID NO: 573977 - DNA, 25 bp, Rattus norvegicus
tcaagtctctctctttcaagttgtc

SEQ ID NO: 573978 - DNA, 25 bp, Rattus norvegicus
tcaagtctctctgtttcaagttgtc

SEQ ID NO: 573979 - DNA, 25 bp, Rattus norvegicus
tcaagtctgcagagagcatgccctc

SEQ ID NO: 573980 - DNA, 25 bp, Rattus norvegicus
tcaagtctgcagtgagcatgccctc

SEQ ID NO: 573981 - DNA, 25 bp, Rattus norvegicus
tcaagtctggctcgctctacaaggg

SEQ ID NO: 573982 - DNA, 25 bp, Rattus norvegicus
tcaagtctggctggctctacaaggg

SEQ ID NO: 573983 - DNA, 25 bp, Rattus norvegicus
tcaagtctgggcagcccctagttca

SEQ ID NO: 573984 - DNA, 25 bp, Rattus norvegicus
tcaagtctgggctgcccctagttca

SEQ ID NO: 573985 - DNA, 25 bp, Rattus norvegicus
tcaagtctgtccaagagccttcctc

SEQ ID NO: 573986 - DNA, 25 bp, Rattus norvegicus
tcaagtctgtcctagagccttcctc

SEQ ID NO: 573987 - DNA, 25 bp, Rattus norvegicus
tcaagtcttaccctcagcatgtgga

SEQ ID NO: 573988 - DNA, 25 bp, Rattus norvegicus
tcaagtcttaccgtcagcatgtgga

SEQ ID NO: 573989 - DNA, 25 bp, Rattus norvegicus
tcaagtcttcatctgtcttgggacc

SEQ ID NO: 573990 - DNA, 25 bp, Rattus norvegicus
tcaagtcttcatgtgtcttgggacc

SEQ ID NO: 573991 - DNA, 25 bp, Rattus norvegicus
tcaagtcttcgcctgcacagaattc

SEQ ID NO: 573992 - DNA, 25 bp, Rattus norvegicus
tcaagtcttcgcgtgcacagaattc

SEQ ID NO: 573993 - DNA, 25 bp, Rattus norvegicus
tcaagtcttgttacacgggtgtggt

SEQ ID NO: 573994 - DNA, 25 bp, Rattus norvegicus
tcaagtcttgttatacgtaatggct

SEQ ID NO: 573995 - DNA, 25 bp, Rattus norvegicus
tcaagtcttgtttcacgggtgtggt

SEQ ID NO: 573996 - DNA, 25 bp, Rattus norvegicus
tcaagtcttgttttacgtaatggct

SEQ ID NO: 573997 - DNA, 25 bp, Rattus norvegicus
tcaagtctttctcaacccaaactgt

SEQ ID NO: 573998 - DNA, 25 bp, Rattus norvegicus
tcaagtctttctgaacccaaactgt

SEQ ID NO: 573999 - DNA, 25 bp, Rattus norvegicus
tcaagtctttggcgcctttaccttg

SEQ ID NO: 574000 - DNA, 25 bp, Rattus norvegicus
tcaagtctttggggcctttaccttg

SEQ ID NO: 574001 - DNA, 25 bp, Rattus norvegicus
tcaagtgacaatcttctccttggcc

SEQ ID NO: 574002 - DNA, 25 bp, Rattus norvegicus
tcaagtgacaatgttctccttggcc

SEQ ID NO: 574003 - DNA, 25 bp, Rattus norvegicus
tcaagtgaccaacagcttcgaaata

SEQ ID NO: 574004 - DNA, 25 bp, Rattus norvegicus
tcaagtgaccaagagcttcgaaata

SEQ ID NO: 574005 - DNA, 25 bp, Rattus norvegicus
tcaagtgaccctatgcttgatcctc

SEQ ID NO: 574006 - DNA, 25 bp, Rattus norvegicus
tcaagtgaccctttgcttgatcctc

SEQ ID NO: 574007 - DNA, 25 bp, Rattus norvegicus
tcaagtgactttattcttactacag

SEQ ID NO: 574008 - DNA, 25 bp, Rattus norvegicus
tcaagtgacttttttcttactacag

SEQ ID NO: 574009 - DNA, 25 bp, Rattus norvegicus
tcaagtgagcacagcctctttcaga

SEQ ID NO: 574010 - DNA, 25 bp, Rattus norvegicus
tcaagtgagcactgcctctttcaga

SEQ ID NO: 574011 - DNA, 25 bp, Rattus norvegicus
tcaagtgagcttatgatatctctaa

SEQ ID NO: 574012 - DNA, 25 bp, Rattus norvegicus
tcaagtgagcttttgatatctctaa

SEQ ID NO: 574013 - DNA, 25 bp, Rattus norvegicus
tcaagtgaggtcatcacctcctggg

SEQ ID NO: 574014 - DNA, 25 bp, Rattus norvegicus
tcaagtgaggtcttcacctcctggg

SEQ ID NO: 574015 - DNA, 25 bp, Rattus norvegicus
tcaagtgcccacacctgaagacagg

SEQ ID NO: 574016 - DNA, 25 bp, Rattus norvegicus
tcaagtgcccactcctgaagacagg

SEQ ID NO: 574017 - DNA, 25 bp, Rattus norvegicus
tcaagtgcctgtaactgatctgtac

SEQ ID NO: 574018 - DNA, 25 bp, Rattus norvegicus
tcaagtgcctgttactgatctgtac

SEQ ID NO: 574019 - DNA, 25 bp, Rattus norvegicus
tcaagtgctctacaggccattggtt

SEQ ID NO: 574020 - DNA, 25 bp, Rattus norvegicus
tcaagtgctctagaggccattggtt

SEQ ID NO: 574021 - DNA, 25 bp, Rattus norvegicus
tcaagtgctgtgcagagatatgtct

SEQ ID NO: 574022 - DNA, 25 bp, Rattus norvegicus
tcaagtgctgtggagagatatgtct

SEQ ID NO: 574023 - DNA, 25 bp, Rattus norvegicus
tcaagtggcataagactcgcagtcc

SEQ ID NO: 574024 - DNA, 25 bp, Rattus norvegicus
tcaagtggcatatgactcgcagtcc

SEQ ID NO: 574025 - DNA, 25 bp, Rattus norvegicus
tcaagtggctacagcattgcgctca

SEQ ID NO: 574026 - DNA, 25 bp, Rattus norvegicus
tcaagtggctactgcattgcgctca

SEQ ID NO: 574027 - DNA, 25 bp, Rattus norvegicus
tcaagtggctgtccacagcagctct

SEQ ID NO: 574028 - DNA, 25 bp, Rattus norvegicus
tcaagtggctgtgcacagcagctct

SEQ ID NO: 574029 - DNA, 25 bp, Rattus norvegicus
tcaagtgggcctcagggactgtcca

SEQ ID NO: 574030 - DNA, 25 bp, Rattus norvegicus
tcaagtgggcctcctccatttggag

SEQ ID NO: 574031 - DNA, 25 bp, Rattus norvegicus
tcaagtgggcctgagggactgtcca

SEQ ID NO: 574032 - DNA, 25 bp, Rattus norvegicus
tcaagtgggcctgctccatttggag

SEQ ID NO: 574033 - DNA, 25 bp, Rattus norvegicus
tcaagtgggtccatccaatggaacc

SEQ ID NO: 574034 - DNA, 25 bp, Rattus norvegicus
tcaagtgggtccttccaatggaacc

SEQ ID NO: 574035 - DNA, 25 bp, Rattus norvegicus
tcaagtgtaatcattggctcagtgc

SEQ ID NO: 574036 - DNA, 25 bp, Rattus norvegicus
tcaagtgtaatctttggctcagtgc

SEQ ID NO: 574037 - DNA, 25 bp, Rattus norvegicus
tcaagtgtacgtagctctggtctgt

SEQ ID NO: 574038 - DNA, 25 bp, Rattus norvegicus
tcaagtgtacgttgctctggtctgt

SEQ ID NO: 574039 - DNA, 25 bp, Rattus norvegicus
tcaagtgtcctccatacaaccaggg

SEQ ID NO: 574040 - DNA, 25 bp, Rattus norvegicus
tcaagtgtcctcgatacaaccaggg

SEQ ID NO: 574041 - DNA, 25 bp, Rattus norvegicus
tcaagtgtctgtcgcactgagcaga

SEQ ID NO: 574042 - DNA, 25 bp, Rattus norvegicus
tcaagtgtctgtggcactgagcaga

SEQ ID NO: 574043 - DNA, 25 bp, Rattus norvegicus
tcaagtgtgagcagtggtttctgtt

SEQ ID NO: 574044 - DNA, 25 bp, Rattus norvegicus
tcaagtgtgagctgtggtttctgtt

SEQ ID NO: 574045 - DNA, 25 bp, Rattus norvegicus
tcaagtgtgctgaactgcgtcacag

SEQ ID NO: 574046 - DNA, 25 bp, Rattus norvegicus
tcaagtgtgctgtactgcgtcacag

SEQ ID NO: 574047 - DNA, 25 bp, Rattus norvegicus
tcaagtgtgttgaggcctgttctct

SEQ ID NO: 574048 - DNA, 25 bp, Rattus norvegicus
tcaagtgtgttgtggcctgttctct

SEQ ID NO: 574049 - DNA, 25 bp, Rattus norvegicus
tcaagtgttaccatttcctgtggtt

SEQ ID NO: 574050 - DNA, 25 bp, Rattus norvegicus
tcaagtgttaccttttcctgtggtt

SEQ ID NO: 574051 - DNA, 25 bp, Rattus norvegicus
tcaagtgttcaactggttctcccaa

SEQ ID NO: 574052 - DNA, 25 bp, Rattus norvegicus
tcaagtgttcaagtggttctcccaa

SEQ ID NO: 574053 - DNA, 25 bp, Rattus norvegicus
tcaagtgttgcaagtattgtactgt

SEQ ID NO: 574054 - DNA, 25 bp, Rattus norvegicus
tcaagtgttgcatgtattgtactgt

SEQ ID NO: 574055 - DNA, 25 bp, Rattus norvegicus
tcaagtgtttgtcgctttacctcac

SEQ ID NO: 574056 - DNA, 25 bp, Rattus norvegicus
tcaagtgtttgtggctttacctcac

SEQ ID NO: 574057 - DNA, 25 bp, Rattus norvegicus
tcaagttacctgagttaccgtttag

SEQ ID NO: 574058 - DNA, 25 bp, Rattus norvegicus
tcaagttacctgtgttaccgtttag

SEQ ID NO: 574059 - DNA, 25 bp, Rattus norvegicus
tcaagttactcccattgcacagtgg

SEQ ID NO: 574060 - DNA, 25 bp, Rattus norvegicus
tcaagttactccgattgcacagtgg

SEQ ID NO: 574061 - DNA, 25 bp, Rattus norvegicus
tcaagttagattccaagcttagaac

SEQ ID NO: 574062 - DNA, 25 bp, Rattus norvegicus
tcaagttagattgcaagcttagaac

SEQ ID NO: 574063 - DNA, 25 bp, Rattus norvegicus
tcaagttcactgcagtcatctcagg

SEQ ID NO: 574064 - DNA, 25 bp, Rattus norvegicus
tcaagttcactggagtcatctcagg

SEQ ID NO: 574065 - DNA, 25 bp, Rattus norvegicus
tcaagttccactcatgttggtgcat

SEQ ID NO: 574066 - DNA, 25 bp, Rattus norvegicus
tcaagttccactgatgttggtgcat

SEQ ID NO: 574067 - DNA, 25 bp, Rattus norvegicus
tcaagttccctcactaggtcacggt

SEQ ID NO: 574068 - DNA, 25 bp, Rattus norvegicus
tcaagttccctctctaggtcacggt

SEQ ID NO: 574069 - DNA, 25 bp, Rattus norvegicus
tcaagttccctgatccatgggcaag

SEQ ID NO: 574070 - DNA, 25 bp, Rattus norvegicus
tcaagttccctgttccatgggcaag

SEQ ID NO: 574071 - DNA, 25 bp, Rattus norvegicus
tcaagttcctccagtctcacattag

SEQ ID NO: 574072 - DNA, 25 bp, Rattus norvegicus
tcaagttcctcctgtctcacattag

SEQ ID NO: 574073 - DNA, 25 bp, Rattus norvegicus
tcaagttcctctctactatttaaat

SEQ ID NO: 574074 - DNA, 25 bp, Rattus norvegicus
tcaagttcctctgtactatttaaat

SEQ ID NO: 574075 - DNA, 25 bp, Rattus norvegicus
tcaagttccttgcttatcaccacac

SEQ ID NO: 574076 - DNA, 25 bp, Rattus norvegicus
tcaagttccttggttatcaccacac

SEQ ID NO: 574077 - DNA, 25 bp, Rattus norvegicus
tcaagttctcaacgccaggtcatat

SEQ ID NO: 574078 - DNA, 25 bp, Rattus norvegicus
tcaagttctcaaggccaggtcatat

SEQ ID NO: 574079 - DNA, 25 bp, Rattus norvegicus
tcaagttcttccctgcaggacctga

SEQ ID NO: 574080 - DNA, 25 bp, Rattus norvegicus
tcaagttcttccgtgcaggacctga

SEQ ID NO: 574081 - DNA, 25 bp, Rattus norvegicus
tcaagttgaaatccgcttcacccac

SEQ ID NO: 574082 - DNA, 25 bp, Rattus norvegicus
tcaagttgaaatgcgcttcacccac

SEQ ID NO: 574083 - DNA, 25 bp, Rattus norvegicus
tcaagttgctgcacctgggtctggt

SEQ ID NO: 574084 - DNA, 25 bp, Rattus norvegicus
tcaagttgctgctcctgggtctggt

SEQ ID NO: 574085 - DNA, 25 bp, Rattus norvegicus
tcaagttgtaaaaccccataccttt

SEQ ID NO: 574086 - DNA, 25 bp, Rattus norvegicus
tcaagttgtaaatccccataccttt

SEQ ID NO: 574087 - DNA, 25 bp, Rattus norvegicus
tcaagttgtactacgtggttccttc

SEQ ID NO: 574088 - DNA, 25 bp, Rattus norvegicus
tcaagttgtacttcgtggttccttc

SEQ ID NO: 574089 - DNA, 25 bp, Rattus norvegicus
tcaagttgtgacctttctactccag

SEQ ID NO: 574090 - DNA, 25 bp, Rattus norvegicus
tcaagttgtgacgtttctactccag

SEQ ID NO: 574091 - DNA, 25 bp, Rattus norvegicus
tcaagtttaccaccgtgaagcaaaa

SEQ ID NO: 574092 - DNA, 25 bp, Rattus norvegicus
tcaagtttaccagcgtgaagcaaaa

SEQ ID NO: 574093 - DNA, 25 bp, Rattus norvegicus
tcaagtttcggcatctgtgcacagg

SEQ ID NO: 574094 - DNA, 25 bp, Rattus norvegicus
tcaagtttcggcttctgtgcacagg

SEQ ID NO: 574095 - DNA, 25 bp, Rattus norvegicus
tcaagtttgagactgcctggactac

SEQ ID NO: 574096 - DNA, 25 bp, Rattus norvegicus
tcaagtttgagagtgcctggactac

SEQ ID NO: 574097 - DNA, 25 bp, Rattus norvegicus
tcaagtttggtcacccagttctcaa

SEQ ID NO: 574098 - DNA, 25 bp, Rattus norvegicus
tcaagtttggtctcccagttctcaa

SEQ ID NO: 574099 - DNA, 25 bp, Rattus norvegicus
tcaagtttgtggacctggcagatcc

SEQ ID NO: 574100 - DNA, 25 bp, Rattus norvegicus
tcaagtttgtggtcctggcagatcc

SEQ ID NO: 574101 - DNA, 25 bp, Rattus norvegicus
tcaagttttaacagcatgtggacaa

SEQ ID NO: 574102 - DNA, 25 bp, Rattus norvegicus
tcaagttttaactgcatgtggacaa

SEQ ID NO: 574103 - DNA, 25 bp, Rattus norvegicus
tcaagttttccgatgctcctatgaa

SEQ ID NO: 574104 - DNA, 25 bp, Rattus norvegicus
tcaagttttccgttgctcctatgaa

SEQ ID NO: 574105 - DNA, 25 bp, Rattus norvegicus
tcaagttttgagctccagcttccac

SEQ ID NO: 574106 - DNA, 25 bp, Rattus norvegicus
tcaagttttgaggtccagcttccac

SEQ ID NO: 574107 - DNA, 25 bp, Rattus norvegicus
tcaataaaaacaagccgtatagccc

SEQ ID NO: 574108 - DNA, 25 bp, Rattus norvegicus
tcaataaaaacatgccgtatagccc

SEQ ID NO: 574109 - DNA, 25 bp, Rattus norvegicus
tcaataaacttgcagctgggctgga

SEQ ID NO: 574110 - DNA, 25 bp, Rattus norvegicus
tcaataaacttggagctgggctgga

SEQ ID NO: 574111 - DNA, 25 bp, Rattus norvegicus
tcaataacatccattggcaccttcc

SEQ ID NO: 574112 - DNA, 25 bp, Rattus norvegicus
tcaataacatcctttggcaccttcc

SEQ ID NO: 574113 - DNA, 25 bp, Rattus norvegicus
tcaataacatgcagcgccagcttgc

SEQ ID NO: 574114 - DNA, 25 bp, Rattus norvegicus
tcaataacatgctgcgccagcttgc

SEQ ID NO: 574115 - DNA, 25 bp, Rattus norvegicus
tcaataactgatcacgcggagtcaa

SEQ ID NO: 574116 - DNA, 25 bp, Rattus norvegicus
tcaataactgatgacgcggagtcaa

SEQ ID NO: 574117 - DNA, 25 bp, Rattus norvegicus
tcaataactttaaccagccttttaa

SEQ ID NO: 574118 - DNA, 25 bp, Rattus norvegicus
tcaataactttatccagccttttaa

SEQ ID NO: 574119 - DNA, 25 bp, Rattus norvegicus
tcaataagtcctaaattttttctag

SEQ ID NO: 574120 - DNA, 25 bp, Rattus norvegicus
tcaataagtccttaattttttctag

SEQ ID NO: 574121 - DNA, 25 bp, Rattus norvegicus
tcaataattttcactttcctctcct

SEQ ID NO: 574122 - DNA, 25 bp, Rattus norvegicus
tcaataattttctctttcctctcct

SEQ ID NO: 574123 - DNA, 25 bp, Rattus norvegicus
tcaataattttgctcagacacacag

SEQ ID NO: 574124 - DNA, 25 bp, Rattus norvegicus
tcaataattttggtcagacacacag

SEQ ID NO: 574125 - DNA, 25 bp, Rattus norvegicus
tcaatacagcatcttcccaaccagg

SEQ ID NO: 574126 - DNA, 25 bp, Rattus norvegicus
tcaatacagcatgttcccaaccagg

SEQ ID NO: 574127 - DNA, 25 bp, Rattus norvegicus
tcaatacatctgatcatctgcggcc

SEQ ID NO: 574128 - DNA, 25 bp, Rattus norvegicus
tcaatacatctgttcatctgcggcc

SEQ ID NO: 574129 - DNA, 25 bp, Rattus norvegicus
tcaataccttctaatgctgcttcag

SEQ ID NO: 574130 - DNA, 25 bp, Rattus norvegicus
tcaataccttcttatgctgcttcag

SEQ ID NO: 574131 - DNA, 25 bp, Rattus norvegicus
tcaatactgactactgaagttgaaa

SEQ ID NO: 574132 - DNA, 25 bp, Rattus norvegicus
tcaatactgacttctgaagttgaaa

SEQ ID NO: 574133 - DNA, 25 bp, Rattus norvegicus
tcaatacttatcaatgccaccaacc

SEQ ID NO: 574134 - DNA, 25 bp, Rattus norvegicus
tcaatacttatctatgccaccaacc

SEQ ID NO: 574135 - DNA, 25 bp, Rattus norvegicus
tcaatagaagaacaccctcctcata

SEQ ID NO: 574136 - DNA, 25 bp, Rattus norvegicus
tcaatagaagaagaccctcctcata

SEQ ID NO: 574137 - DNA, 25 bp, Rattus norvegicus
tcaatagcagcaacccgaaggacta

SEQ ID NO: 574138 - DNA, 25 bp, Rattus norvegicus
tcaatagcagcatcccgaaggacta

SEQ ID NO: 574139 - DNA, 25 bp, Rattus norvegicus
tcaataggtagcacaagggtggact

SEQ ID NO: 574140 - DNA, 25 bp, Rattus norvegicus
tcaataggtagctcaagggtggact

SEQ ID NO: 574141 - DNA, 25 bp, Rattus norvegicus
tcaatataatccagccttagccttt

SEQ ID NO: 574142 - DNA, 25 bp, Rattus norvegicus
tcaatataatcctgccttagccttt

SEQ ID NO: 574143 - DNA, 25 bp, Rattus norvegicus
tcaatatgatgcactgtagcggagc

SEQ ID NO: 574144 - DNA, 25 bp, Rattus norvegicus
tcaatatgatgctctgtagcggagc

SEQ ID NO: 574145 - DNA, 25 bp, Rattus norvegicus
tcaatattaaaaaccgcccgcacac

SEQ ID NO: 574146 - DNA, 25 bp, Rattus norvegicus
tcaatattaaaatccgcccgcacac

SEQ ID NO: 574147 - DNA, 25 bp, Rattus norvegicus
tcaatcaaatcacccaggctggacg

SEQ ID NO: 574148 - DNA, 25 bp, Rattus norvegicus
tcaatcaaatcagccaggctggacg

SEQ ID NO: 574149 - DNA, 25 bp, Rattus norvegicus
tcaatcaaggccctgatccatggtc

SEQ ID NO: 574150 - DNA, 25 bp, Rattus norvegicus
tcaatcaaggccgtgatccatggtc

SEQ ID NO: 574151 - DNA, 25 bp, Rattus norvegicus
tcaatcaatactcatccttcctgac

SEQ ID NO: 574152 - DNA, 25 bp, Rattus norvegicus
tcaatcaatactgatccttcctgac

SEQ ID NO: 574153 - DNA, 25 bp, Rattus norvegicus
tcaatcacccatcagcacaacatgt

SEQ ID NO: 574154 - DNA, 25 bp, Rattus norvegicus
tcaatcacccatgagcacaacatgt

SEQ ID NO: 574155 - DNA, 25 bp, Rattus norvegicus
tcaatcagccccacctaggaaggaa

SEQ ID NO: 574156 - DNA, 25 bp, Rattus norvegicus
tcaatcagcccctcctaggaaggaa

SEQ ID NO: 574157 - DNA, 25 bp, Rattus norvegicus
tcaatcaggctaaggcagtcatcaa

SEQ ID NO: 574158 - DNA, 25 bp, Rattus norvegicus
tcaatcaggctatggcagtcatcaa

SEQ ID NO: 574159 - DNA, 25 bp, Rattus norvegicus
tcaatcagtaccaaacaagcgctct

SEQ ID NO: 574160 - DNA, 25 bp, Rattus norvegicus
tcaatcagtacctaacaagcgctct

SEQ ID NO: 574161 - DNA, 25 bp, Rattus norvegicus
tcaatcatccctcacttcttcagcc

SEQ ID NO: 574162 - DNA, 25 bp, Rattus norvegicus
tcaatcatccctgacttcttcagcc

SEQ ID NO: 574163 - DNA, 25 bp, Rattus norvegicus
tcaatcatctgcatagttcccaggc

SEQ ID NO: 574164 - DNA, 25 bp, Rattus norvegicus
tcaatcatctgcttagttcccaggc

SEQ ID NO: 574165 - DNA, 25 bp, Rattus norvegicus
tcaatcatgtaacggcaacgccacg

SEQ ID NO: 574166 - DNA, 25 bp, Rattus norvegicus
tcaatcatgtaagggcaacgccacg

SEQ ID NO: 574167 - DNA, 25 bp, Rattus norvegicus
tcaatcattgaaccccacacggtgg

SEQ ID NO: 574168 - DNA, 25 bp, Rattus norvegicus
tcaatcattgaagcccacacggtgg

SEQ ID NO: 574169 - DNA, 25 bp, Rattus norvegicus
tcaatccaagtaagtctgcgcacgg

SEQ ID NO: 574170 - DNA, 25 bp, Rattus norvegicus
tcaatccaagtatgtctgcgcacgg

SEQ ID NO: 574171 - DNA, 25 bp, Rattus norvegicus
tcaatccatgggacatatgagtaaa

SEQ ID NO: 574172 - DNA, 25 bp, Rattus norvegicus
tcaatccatgggtcatatgagtaaa

SEQ ID NO: 574173 - DNA, 25 bp, Rattus norvegicus
tcaatcccaaccagccgagtagata

SEQ ID NO: 574174 - DNA, 25 bp, Rattus norvegicus
tcaatcccaacctgccgagtagata

SEQ ID NO: 574175 - DNA, 25 bp, Rattus norvegicus
tcaatccccgggatggaactcactg

SEQ ID NO: 574176 - DNA, 25 bp, Rattus norvegicus
tcaatccccgggttggaactcactg

SEQ ID NO: 574177 - DNA, 25 bp, Rattus norvegicus
tcaatccgcctgagccatatgtggg

SEQ ID NO: 574178 - DNA, 25 bp, Rattus norvegicus
tcaatccgcctgtgccatatgtggg

SEQ ID NO: 574179 - DNA, 25 bp, Rattus norvegicus
tcaatccggtgcagtatgctttttt

SEQ ID NO: 574180 - DNA, 25 bp, Rattus norvegicus
tcaatccggtgctgtatgctttttt

SEQ ID NO: 574181 - DNA, 25 bp, Rattus norvegicus
tcaatcctactacttttccacaaaa

SEQ ID NO: 574182 - DNA, 25 bp, Rattus norvegicus
tcaatcctactagttttccacaaaa

SEQ ID NO: 574183 - DNA, 25 bp, Rattus norvegicus
tcaatcgatcgaacagtggcagtgt

SEQ ID NO: 574184 - DNA, 25 bp, Rattus norvegicus
tcaatcgatcgatcagtggcagtgt

SEQ ID NO: 574185 - DNA, 25 bp, Rattus norvegicus
tcaatcgtcactaagccactgctgt

SEQ ID NO: 574186 - DNA, 25 bp, Rattus norvegicus
tcaatcgtcacttagccactgctgt

SEQ ID NO: 574187 - DNA, 25 bp, Rattus norvegicus
tcaatctacatgcaggcttgttccc

SEQ ID NO: 574188 - DNA, 25 bp, Rattus norvegicus
tcaatctacatggaggcttgttccc

SEQ ID NO: 574189 - DNA, 25 bp, Rattus norvegicus
tcaatctcacacagtccactgtaaa

SEQ ID NO: 574190 - DNA, 25 bp, Rattus norvegicus
tcaatctcacactgtccactgtaaa

SEQ ID NO: 574191 - DNA, 25 bp, Rattus norvegicus
tcaatctcacccagaatgcaagcat

SEQ ID NO: 574192 - DNA, 25 bp, Rattus norvegicus
tcaatctcaccctgaatgcaagcat

SEQ ID NO: 574193 - DNA, 25 bp, Rattus norvegicus
tcaatctgaaatatcccacacgggc

SEQ ID NO: 574194 - DNA, 25 bp, Rattus norvegicus
tcaatctgaaatttcccacacgggc

SEQ ID NO: 574195 - DNA, 25 bp, Rattus norvegicus
tcaatctgcttcaccactaaagaca

SEQ ID NO: 574196 - DNA, 25 bp, Rattus norvegicus
tcaatctgcttctccactaaagaca

SEQ ID NO: 574197 - DNA, 25 bp, Rattus norvegicus
tcaatctgtcccactgaacttcagg

SEQ ID NO: 574198 - DNA, 25 bp, Rattus norvegicus
tcaatctgtccctctgaacttcagg

SEQ ID NO: 574199 - DNA, 25 bp, Rattus norvegicus
tcaatctgtcgcaacatgttcctag

SEQ ID NO: 574200 - DNA, 25 bp, Rattus norvegicus
tcaatctgtcgctacatgttcctag

SEQ ID NO: 574201 - DNA, 25 bp, Rattus norvegicus
tcaatcttaagaacctgctccatct

SEQ ID NO: 574202 - DNA, 25 bp, Rattus norvegicus
tcaatcttaagatcctgctccatct

SEQ ID NO: 574203 - DNA, 25 bp, Rattus norvegicus
tcaatctttacgagtgtgtggaaac

SEQ ID NO: 574204 - DNA, 25 bp, Rattus norvegicus
tcaatctttacgtgtgtgtggaaac

SEQ ID NO: 574205 - DNA, 25 bp, Rattus norvegicus
tcaatctttttcagacactctctct

SEQ ID NO: 574206 - DNA, 25 bp, Rattus norvegicus
tcaatctttttctgacactctctct

SEQ ID NO: 574207 - DNA, 25 bp, Rattus norvegicus
tcaatgacactgatctgccactctg

SEQ ID NO: 574208 - DNA, 25 bp, Rattus norvegicus
tcaatgacactgttctgccactctg

SEQ ID NO: 574209 - DNA, 25 bp, Rattus norvegicus
tcaatgacatcgagggagagggaca

SEQ ID NO: 574210 - DNA, 25 bp, Rattus norvegicus
tcaatgacatcgtgggagagggaca

SEQ ID NO: 574211 - DNA, 25 bp, Rattus norvegicus
tcaatgacccctacaagttctgtag

SEQ ID NO: 574212 - DNA, 25 bp, Rattus norvegicus
tcaatgaccccttcaagttctgtag

SEQ ID NO: 574213 - DNA, 25 bp, Rattus norvegicus
tcaatgagcacgatggagccgcacc

SEQ ID NO: 574214 - DNA, 25 bp, Rattus norvegicus
tcaatgagcacgttggagccgcacc

SEQ ID NO: 574215 - DNA, 25 bp, Rattus norvegicus
tcaatgaggcgcaaccggacggtgt

SEQ ID NO: 574216 - DNA, 25 bp, Rattus norvegicus
tcaatgaggcgctaccggacggtgt

SEQ ID NO: 574217 - DNA, 25 bp, Rattus norvegicus
tcaatgagtggtatgtctcggcctt

SEQ ID NO: 574218 - DNA, 25 bp, Rattus norvegicus
tcaatgagtggtttgtctcggcctt

SEQ ID NO: 574219 - DNA, 25 bp, Rattus norvegicus
tcaatgatgatgcttccaggacaaa

SEQ ID NO: 574220 - DNA, 25 bp, Rattus norvegicus
tcaatgatgatggttccaggacaaa

SEQ ID NO: 574221 - DNA, 25 bp, Rattus norvegicus
tcaatgcagtcaagatccgagcctt

SEQ ID NO: 574222 - DNA, 25 bp, Rattus norvegicus
tcaatgcagtcatgatccgagcctt

SEQ ID NO: 574223 - DNA, 25 bp, Rattus norvegicus
tcaatgccaagaagcggaaccccta

SEQ ID NO: 574224 - DNA, 25 bp, Rattus norvegicus
tcaatgccaagatgcggaaccccta

SEQ ID NO: 574225 - DNA, 25 bp, Rattus norvegicus
tcaatgccaaggctgagcgcctgaa

SEQ ID NO: 574226 - DNA, 25 bp, Rattus norvegicus
tcaatgccaagggtgagcgcctgaa

SEQ ID NO: 574227 - DNA, 25 bp, Rattus norvegicus
tcaatgccactcatcatcagaaaat

SEQ ID NO: 574228 - DNA, 25 bp, Rattus norvegicus
tcaatgccactcttcatcagaaaat

SEQ ID NO: 574229 - DNA, 25 bp, Rattus norvegicus
tcaatgcccgagaggcccctgtagc

SEQ ID NO: 574230 - DNA, 25 bp, Rattus norvegicus
tcaatgcccgagtggcccctgtagc

SEQ ID NO: 574231 - DNA, 25 bp, Rattus norvegicus
tcaatgcccggcattatgagtacgt

SEQ ID NO: 574232 - DNA, 25 bp, Rattus norvegicus
tcaatgcccggctttatgagtacgt

SEQ ID NO: 574233 - DNA, 25 bp, Rattus norvegicus
tcaatgccctttctctaggagccct

SEQ ID NO: 574234 - DNA, 25 bp, Rattus norvegicus
tcaatgccctttgtctaggagccct

SEQ ID NO: 574235 - DNA, 25 bp, Rattus norvegicus
tcaatgcctggaccttaaaacaaag

SEQ ID NO: 574236 - DNA, 25 bp, Rattus norvegicus
tcaatgcctggagcttaaaacaaag

SEQ ID NO: 574237 - DNA, 25 bp, Rattus norvegicus
tcaatgcgcccaaccagaggacaga

SEQ ID NO: 574238 - DNA, 25 bp, Rattus norvegicus
tcaatgcgcccatccagaggacaga

SEQ ID NO: 574239 - DNA, 25 bp, Rattus norvegicus
tcaatgctctggatggcaagcccta

SEQ ID NO: 574240 - DNA, 25 bp, Rattus norvegicus
tcaatgctctggttggcaagcccta

SEQ ID NO: 574241 - DNA, 25 bp, Rattus norvegicus
tcaatgctggtcaagtctggctgtt

SEQ ID NO: 574242 - DNA, 25 bp, Rattus norvegicus
tcaatgctggtctagtctggctgtt

SEQ ID NO: 574243 - DNA, 25 bp, Rattus norvegicus
tcaatggaacggaaggcctgtggtt

SEQ ID NO: 574244 - DNA, 25 bp, Rattus norvegicus
tcaatggaacggtaggcctgtggtt

SEQ ID NO: 574245 - DNA, 25 bp, Rattus norvegicus
tcaatggaagtgacatggctgccct

SEQ ID NO: 574246 - DNA, 25 bp, Rattus norvegicus
tcaatggaagtgtcatggctgccct

SEQ ID NO: 574247 - DNA, 25 bp, Rattus norvegicus
tcaatggagagccatttgcccactc

SEQ ID NO: 574248 - DNA, 25 bp, Rattus norvegicus
tcaatggagagcgatttgcccactc

SEQ ID NO: 574249 - DNA, 25 bp, Rattus norvegicus
tcaatggagcacactgacctgtgaa

SEQ ID NO: 574250 - DNA, 25 bp, Rattus norvegicus
tcaatggagcactctgacctgtgaa

SEQ ID NO: 574251 - DNA, 25 bp, Rattus norvegicus
tcaatggaggcaccgctacgaaaca

SEQ ID NO: 574252 - DNA, 25 bp, Rattus norvegicus
tcaatggaggcagcgctacgaaaca

SEQ ID NO: 574253 - DNA, 25 bp, Rattus norvegicus
tcaatggagtggagccaagagaaat

SEQ ID NO: 574254 - DNA, 25 bp, Rattus norvegicus
tcaatggagtggtgccaagagaaat

SEQ ID NO: 574255 - DNA, 25 bp, Rattus norvegicus
tcaatggcacctatgtgaagctcaa

SEQ ID NO: 574256 - DNA, 25 bp, Rattus norvegicus
tcaatggcacctttgtgaagctcaa

SEQ ID NO: 574257 - DNA, 25 bp, Rattus norvegicus
tcaatggcatggctagtcaaattca

SEQ ID NO: 574258 - DNA, 25 bp, Rattus norvegicus
tcaatggcatgggtagtcaaattca

SEQ ID NO: 574259 - DNA, 25 bp, Rattus norvegicus
tcaatggccgaacagaataagtttt

SEQ ID NO: 574260 - DNA, 25 bp, Rattus norvegicus
tcaatggccgaagagaataagtttt

SEQ ID NO: 574261 - DNA, 25 bp, Rattus norvegicus
tcaatggccgagcaccgttaggata

SEQ ID NO: 574262 - DNA, 25 bp, Rattus norvegicus
tcaatggccgaggaccgttaggata

SEQ ID NO: 574263 - DNA, 25 bp, Rattus norvegicus
tcaatggctgttcttcatgttttag

SEQ ID NO: 574264 - DNA, 25 bp, Rattus norvegicus
tcaatggctgttgttcatgttttag

SEQ ID NO: 574265 - DNA, 25 bp, Rattus norvegicus
tcaatggcttgtacatcctccagat

SEQ ID NO: 574266 - DNA, 25 bp, Rattus norvegicus
tcaatggcttgttcatcctccagat

SEQ ID NO: 574267 - DNA, 25 bp, Rattus norvegicus
tcaatgggcagcaggtgttctccaa

SEQ ID NO: 574268 - DNA, 25 bp, Rattus norvegicus
tcaatgggcagctggtgttctccaa

SEQ ID NO: 574269 - DNA, 25 bp, Rattus norvegicus
tcaatgggctggctgactgtctcac

SEQ ID NO: 574270 - DNA, 25 bp, Rattus norvegicus
tcaatgggctgggtgactgtctcac

SEQ ID NO: 574271 - DNA, 25 bp, Rattus norvegicus
tcaatgggtttccatgtcctttggc

SEQ ID NO: 574272 - DNA, 25 bp, Rattus norvegicus
tcaatgggtttcgatgtcctttggc

SEQ ID NO: 574273 - DNA, 25 bp, Rattus norvegicus
tcaatggtggctccgtgtgctcttc

SEQ ID NO: 574274 - DNA, 25 bp, Rattus norvegicus
tcaatggtggctgcgtgtgctcttc

SEQ ID NO: 574275 - DNA, 25 bp, Rattus norvegicus
tcaatggtgtgtatgcggtctcttc

SEQ ID NO: 574276 - DNA, 25 bp, Rattus norvegicus
tcaatggtgtgtttgcggtctcttc

SEQ ID NO: 574277 - DNA, 25 bp, Rattus norvegicus
tcaatggtttacactctgggaaatg

SEQ ID NO: 574278 - DNA, 25 bp, Rattus norvegicus
tcaatggtttactctctgggaaatg

SEQ ID NO: 574279 - DNA, 25 bp, Rattus norvegicus
tcaatggtttctatgcggaacgcct

SEQ ID NO: 574280 - DNA, 25 bp, Rattus norvegicus
tcaatggtttctttgcggaacgcct

SEQ ID NO: 574281 - DNA, 25 bp, Rattus norvegicus
tcaatggtttgtctgctatgtgctt

SEQ ID NO: 574282 - DNA, 25 bp, Rattus norvegicus
tcaatggtttgtgtgctatgtgctt

SEQ ID NO: 574283 - DNA, 25 bp, Rattus norvegicus
tcaatgtatcagctgtgggcagatg

SEQ ID NO: 574284 - DNA, 25 bp, Rattus norvegicus
tcaatgtatcaggtgtgggcagatg

SEQ ID NO: 574285 - DNA, 25 bp, Rattus norvegicus
tcaatgtcaacgaccctagtccagt

SEQ ID NO: 574286 - DNA, 25 bp, Rattus norvegicus
tcaatgtcaacgtccctagtccagt

SEQ ID NO: 574287 - DNA, 25 bp, Rattus norvegicus
tcaatgtcacacaagcatacccagt

SEQ ID NO: 574288 - DNA, 25 bp, Rattus norvegicus
tcaatgtcacactagcatacccagt

SEQ ID NO: 574289 - DNA, 25 bp, Rattus norvegicus
tcaatgtccccaaagggttaaattg

SEQ ID NO: 574290 - DNA, 25 bp, Rattus norvegicus
tcaatgtccccatagggttaaattg

SEQ ID NO: 574291 - DNA, 25 bp, Rattus norvegicus
tcaatgtctcatatgtctactcacc

SEQ ID NO: 574292 - DNA, 25 bp, Rattus norvegicus
tcaatgtctcatttgtctactcacc

SEQ ID NO: 574293 - DNA, 25 bp, Rattus norvegicus
tcaatgtctgatataaatttctgtg

SEQ ID NO: 574294 - DNA, 25 bp, Rattus norvegicus
tcaatgtctgatttaaatttctgtg

SEQ ID NO: 574295 - DNA, 25 bp, Rattus norvegicus
tcaatgtgctgaatgaccacatcat

SEQ ID NO: 574296 - DNA, 25 bp, Rattus norvegicus
tcaatgtgctgattgaccacatcat

SEQ ID NO: 574297 - DNA, 25 bp, Rattus norvegicus
tcaatgtggacgcaggccaggctct

SEQ ID NO: 574298 - DNA, 25 bp, Rattus norvegicus
tcaatgtggacggaggccaggctct

SEQ ID NO: 574299 - DNA, 25 bp, Rattus norvegicus
tcaatgtggcccagaggtacgtggt

SEQ ID NO: 574300 - DNA, 25 bp, Rattus norvegicus
tcaatgtggccctgaggtacgtggt

SEQ ID NO: 574301 - DNA, 25 bp, Rattus norvegicus
tcaatgttacttacatgcccttcac

SEQ ID NO: 574302 - DNA, 25 bp, Rattus norvegicus
tcaatgttactttcatgcccttcac

SEQ ID NO: 574303 - DNA, 25 bp, Rattus norvegicus
tcaattaagcacaaggataccctgg

SEQ ID NO: 574304 - DNA, 25 bp, Rattus norvegicus
tcaattaagcactaggataccctgg

SEQ ID NO: 574305 - DNA, 25 bp, Rattus norvegicus
tcaattacaaaacatggctcatagg

SEQ ID NO: 574306 - DNA, 25 bp, Rattus norvegicus
tcaattacaaaagatggctcatagg

SEQ ID NO: 574307 - DNA, 25 bp, Rattus norvegicus
tcaattacaaggcttttggtctccc

SEQ ID NO: 574308 - DNA, 25 bp, Rattus norvegicus
tcaattacaagggttttggtctccc

SEQ ID NO: 574309 - DNA, 25 bp, Rattus norvegicus
tcaattagacaccatttcagccctc

SEQ ID NO: 574310 - DNA, 25 bp, Rattus norvegicus
tcaattagacacgatttcagccctc

SEQ ID NO: 574311 - DNA, 25 bp, Rattus norvegicus
tcaattataacacccactgcctgtt

SEQ ID NO: 574312 - DNA, 25 bp, Rattus norvegicus
tcaattataacagccactgcctgtt

SEQ ID NO: 574313 - DNA, 25 bp, Rattus norvegicus
tcaattatcctcattctcataccaa

SEQ ID NO: 574314 - DNA, 25 bp, Rattus norvegicus
tcaattatcctctttctcataccaa

SEQ ID NO: 574315 - DNA, 25 bp, Rattus norvegicus
tcaattatgtctctggctgagtaca

SEQ ID NO: 574316 - DNA, 25 bp, Rattus norvegicus
tcaattatgtctgtggctgagtaca

SEQ ID NO: 574317 - DNA, 25 bp, Rattus norvegicus
tcaattccaacgacgccttgcgtag

SEQ ID NO: 574318 - DNA, 25 bp, Rattus norvegicus
tcaattccaacgtcgccttgcgtag

SEQ ID NO: 574319 - DNA, 25 bp, Rattus norvegicus
tcaattcccttgaagctcagactgg

SEQ ID NO: 574320 - DNA, 25 bp, Rattus norvegicus
tcaattcccttgtagctcagactgg

SEQ ID NO: 574321 - DNA, 25 bp, Rattus norvegicus
tcaattccttgcactctttttctag

SEQ ID NO: 574322 - DNA, 25 bp, Rattus norvegicus
tcaattccttgctctctttttctag

SEQ ID NO: 574323 - DNA, 25 bp, Rattus norvegicus
tcaattctcgagagtccactgtctc

SEQ ID NO: 574324 - DNA, 25 bp, Rattus norvegicus
tcaattctcgagtgtccactgtctc

SEQ ID NO: 574325 - DNA, 25 bp, Rattus norvegicus
tcaattctgccacccaaagacgtct

SEQ ID NO: 574326 - DNA, 25 bp, Rattus norvegicus
tcaattctgccagccaaagacgtct

SEQ ID NO: 574327 - DNA, 25 bp, Rattus norvegicus
tcaattctttagacgtttccttaca

SEQ ID NO: 574328 - DNA, 25 bp, Rattus norvegicus
tcaattctttagtcgtttccttaca

SEQ ID NO: 574329 - DNA, 25 bp, Rattus norvegicus
tcaattgccccgagaagaatggaca

SEQ ID NO: 574330 - DNA, 25 bp, Rattus norvegicus
tcaattgccccgtgaagaatggaca

SEQ ID NO: 574331 - DNA, 25 bp, Rattus norvegicus
tcaattggagctacacgaaggacgt

SEQ ID NO: 574332 - DNA, 25 bp, Rattus norvegicus
tcaattggagcttcacgaaggacgt

SEQ ID NO: 574333 - DNA, 25 bp, Rattus norvegicus
tcaattggccatataagtttaatag

SEQ ID NO: 574334 - DNA, 25 bp, Rattus norvegicus
tcaattggccatttaagtttaatag

SEQ ID NO: 574335 - DNA, 25 bp, Rattus norvegicus
tcaattggccggagccgggcgccaa

SEQ ID NO: 574336 - DNA, 25 bp, Rattus norvegicus
tcaattggccggtgccgggcgccaa

SEQ ID NO: 574337 - DNA, 25 bp, Rattus norvegicus
tcaattgggtacaactgacagacat

SEQ ID NO: 574338 - DNA, 25 bp, Rattus norvegicus
tcaattgggtactactgacagacat

SEQ ID NO: 574339 - DNA, 25 bp, Rattus norvegicus
tcaattggttttcctcgttctgtag

SEQ ID NO: 574340 - DNA, 25 bp, Rattus norvegicus
tcaattggttttgctcgttctgtag

SEQ ID NO: 574341 - DNA, 25 bp, Rattus norvegicus
tcaattgtcactctcatcagaatct

SEQ ID NO: 574342 - DNA, 25 bp, Rattus norvegicus
tcaattgtcactgtcatcagaatct

SEQ ID NO: 574343 - DNA, 25 bp, Rattus norvegicus
tcaatttaatctactcccgagacca

SEQ ID NO: 574344 - DNA, 25 bp, Rattus norvegicus
tcaatttaatcttctcccgagacca

SEQ ID NO: 574345 - DNA, 25 bp, Rattus norvegicus
tcaatttacgacagcctatcgggat

SEQ ID NO: 574346 - DNA, 25 bp, Rattus norvegicus
tcaatttacgactgcctatcgggat

SEQ ID NO: 574347 - DNA, 25 bp, Rattus norvegicus
tcaatttcaagtccacagtggtgtt

SEQ ID NO: 574348 - DNA, 25 bp, Rattus norvegicus
tcaatttcaagtgcacagtggtgtt

SEQ ID NO: 574349 - DNA, 25 bp, Rattus norvegicus
tcaatttcctgtactcctgtttatt

SEQ ID NO: 574350 - DNA, 25 bp, Rattus norvegicus
tcaatttcctgttctcctgtttatt

SEQ ID NO: 574351 - DNA, 25 bp, Rattus norvegicus
tcaatttcgggaaccggccgtcggt

SEQ ID NO: 574352 - DNA, 25 bp, Rattus norvegicus
tcaatttcgggatccggccgtcggt

SEQ ID NO: 574353 - DNA, 25 bp, Rattus norvegicus
tcaatttctgtgagacgctgcgtct

SEQ ID NO: 574354 - DNA, 25 bp, Rattus norvegicus
tcaatttctgtgtgacgctgcgtct

SEQ ID NO: 574355 - DNA, 25 bp, Rattus norvegicus
tcaatttggggaacgactcgccggg

SEQ ID NO: 574356 - DNA, 25 bp, Rattus norvegicus
tcaatttggggatcgactcgccggg

SEQ ID NO: 574357 - DNA, 25 bp, Rattus norvegicus
tcaatttgttccatgggctccaaaa

SEQ ID NO: 574358 - DNA, 25 bp, Rattus norvegicus
tcaatttgttccttgggctccaaaa

SEQ ID NO: 574359 - DNA, 25 bp, Rattus norvegicus
tcaattttaaccattaactccacat

SEQ ID NO: 574360 - DNA, 25 bp, Rattus norvegicus
tcaattttaacctttaactccacat

SEQ ID NO: 574361 - DNA, 25 bp, Rattus norvegicus
tcaattttgaccatcctgtggacaa

SEQ ID NO: 574362 - DNA, 25 bp, Rattus norvegicus
tcaattttgaccttcctgtggacaa

SEQ ID NO: 574363 - DNA, 25 bp, Rattus norvegicus
tcaattttgactctttttccttcct

SEQ ID NO: 574364 - DNA, 25 bp, Rattus norvegicus
tcaattttgactgtttttccttcct

SEQ ID NO: 574365 - DNA, 25 bp, Rattus norvegicus
tcaatttttacaatcatcatggctg

SEQ ID NO: 574366 - DNA, 25 bp, Rattus norvegicus
tcaatttttacattcatcatggctg

SEQ ID NO: 574367 - DNA, 25 bp, Rattus norvegicus
tcaatttttgtcatccaaggcctca

SEQ ID NO: 574368 - DNA, 25 bp, Rattus norvegicus
tcaatttttgtcttccaaggcctca

SEQ ID NO: 574369 - DNA, 25 bp, Rattus norvegicus
tcacaaaaagtacttgacctcacat

SEQ ID NO: 574370 - DNA, 25 bp, Rattus norvegicus
tcacaaaaagtagttgacctcacat

SEQ ID NO: 574371 - DNA, 25 bp, Rattus norvegicus
tcacaaaaattgctcgtcaggtctg

SEQ ID NO: 574372 - DNA, 25 bp, Rattus norvegicus
tcacaaaaattggtcgtcaggtctg

SEQ ID NO: 574373 - DNA, 25 bp, Rattus norvegicus
tcacaaacccggcactcagaggact

SEQ ID NO: 574374 - DNA, 25 bp, Rattus norvegicus
tcacaaacccgggactcagaggact

SEQ ID NO: 574375 - DNA, 25 bp, Rattus norvegicus
tcacaaacctccattgggccttagg

SEQ ID NO: 574376 - DNA, 25 bp, Rattus norvegicus
tcacaaacctcctttgggccttagg

SEQ ID NO: 574377 - DNA, 25 bp, Rattus norvegicus
tcacaaaccttgctagctaacctag

SEQ ID NO: 574378 - DNA, 25 bp, Rattus norvegicus
tcacaaaccttggtagctaacctag

SEQ ID NO: 574379 - DNA, 25 bp, Rattus norvegicus
tcacaaagacccatgcaggcaagtt

SEQ ID NO: 574380 - DNA, 25 bp, Rattus norvegicus
tcacaaagacccttgcaggcaagtt

SEQ ID NO: 574381 - DNA, 25 bp, Rattus norvegicus
tcacaaagtgtcagcagtaccccat

SEQ ID NO: 574382 - DNA, 25 bp, Rattus norvegicus
tcacaaagtgtctgcagtaccccat

SEQ ID NO: 574383 - DNA, 25 bp, Rattus norvegicus
tcacaaatgcctaaaacttcctctt

SEQ ID NO: 574384 - DNA, 25 bp, Rattus norvegicus
tcacaaatgccttaaacttcctctt

SEQ ID NO: 574385 - DNA, 25 bp, Rattus norvegicus
tcacaacaatgcattgcgccaattt

SEQ ID NO: 574386 - DNA, 25 bp, Rattus norvegicus
tcacaacaatgctttgcgccaattt

SEQ ID NO: 574387 - DNA, 25 bp, Rattus norvegicus
tcacaacatttgacaccaccacggg

SEQ ID NO: 574388 - DNA, 25 bp, Rattus norvegicus
tcacaacatttgtcaccaccacggg

SEQ ID NO: 574389 - DNA, 25 bp, Rattus norvegicus
tcacaaccagtgagggaatgtccct

SEQ ID NO: 574390 - DNA, 25 bp, Rattus norvegicus
tcacaaccagtgtgggaatgtccct

SEQ ID NO: 574391 - DNA, 25 bp, Rattus norvegicus
tcacaaccgctcaattcattctttt

SEQ ID NO: 574392 - DNA, 25 bp, Rattus norvegicus
tcacaaccgctctattcattctttt

SEQ ID NO: 574393 - DNA, 25 bp, Rattus norvegicus
tcacaacctcaaaggaaggaggaga

SEQ ID NO: 574394 - DNA, 25 bp, Rattus norvegicus
tcacaacctcaatggaaggaggaga

SEQ ID NO: 574395 - DNA, 25 bp, Rattus norvegicus
tcacaacgcttcaatcaacttacaa

SEQ ID NO: 574396 - DNA, 25 bp, Rattus norvegicus
tcacaacgcttctatcaacttacaa

SEQ ID NO: 574397 - DNA, 25 bp, Rattus norvegicus
tcacaacgggcacggtctcagggct

SEQ ID NO: 574398 - DNA, 25 bp, Rattus norvegicus
tcacaacgggcagggtctcagggct

SEQ ID NO: 574399 - DNA, 25 bp, Rattus norvegicus
tcacaacgtccaccaatgactgggt

SEQ ID NO: 574400 - DNA, 25 bp, Rattus norvegicus
tcacaacgtccagcaatgactgggt

SEQ ID NO: 574401 - DNA, 25 bp, Rattus norvegicus
tcacaactgaggactccagtcctag

SEQ ID NO: 574402 - DNA, 25 bp, Rattus norvegicus
tcacaactgaggtctccagtcctag

SEQ ID NO: 574403 - DNA, 25 bp, Rattus norvegicus
tcacaacttctcagttcagccttaa

SEQ ID NO: 574404 - DNA, 25 bp, Rattus norvegicus
tcacaacttctctgttcagccttaa

SEQ ID NO: 574405 - DNA, 25 bp, Rattus norvegicus
tcacaactttcaaaccttcaacagg

SEQ ID NO: 574406 - DNA, 25 bp, Rattus norvegicus
tcacaactttcataccttcaacagg

SEQ ID NO: 574407 - DNA, 25 bp, Rattus norvegicus
tcacaagaccttcaaggcctctggg

SEQ ID NO: 574408 - DNA, 25 bp, Rattus norvegicus
tcacaagaccttgaaggcctctggg

SEQ ID NO: 574409 - DNA, 25 bp, Rattus norvegicus
tcacaagccaggcagcaccagagtt

SEQ ID NO: 574410 - DNA, 25 bp, Rattus norvegicus
tcacaagccagggagcaccagagtt

SEQ ID NO: 574411 - DNA, 25 bp, Rattus norvegicus
tcacaagccgggagcatcaccagag

SEQ ID NO: 574412 - DNA, 25 bp, Rattus norvegicus
tcacaagccgggtgcatcaccagag

SEQ ID NO: 574413 - DNA, 25 bp, Rattus norvegicus
tcacaagctgtcatggtggctgttt

SEQ ID NO: 574414 - DNA, 25 bp, Rattus norvegicus
tcacaagctgtcttggtggctgttt

SEQ ID NO: 574415 - DNA, 25 bp, Rattus norvegicus
tcacaagcttaacactatcctcagt

SEQ ID NO: 574416 - DNA, 25 bp, Rattus norvegicus
tcacaagcttaagactatcctcagt

SEQ ID NO: 574417 - DNA, 25 bp, Rattus norvegicus
tcacaagcttctagaaatcccttcc

SEQ ID NO: 574418 - DNA, 25 bp, Rattus norvegicus
tcacaagcttcttgaaatcccttcc

SEQ ID NO: 574419 - DNA, 25 bp, Rattus norvegicus
tcacaaggaaaccaggctcccaggg

SEQ ID NO: 574420 - DNA, 25 bp, Rattus norvegicus
tcacaaggaaacgaggctcccaggg

SEQ ID NO: 574421 - DNA, 25 bp, Rattus norvegicus
tcacaaggagacatttgccccaatt

SEQ ID NO: 574422 - DNA, 25 bp, Rattus norvegicus
tcacaaggagacttttgccccaatt

SEQ ID NO: 574423 - DNA, 25 bp, Rattus norvegicus
tcacaaggcagaccttcggagatta

SEQ ID NO: 574424 - DNA, 25 bp, Rattus norvegicus
tcacaaggcagagcttcggagatta

SEQ ID NO: 574425 - DNA, 25 bp, Rattus norvegicus
tcacaaggcctcagtgtgcagatgt

SEQ ID NO: 574426 - DNA, 25 bp, Rattus norvegicus
tcacaaggcctctgtgtgcagatgt

SEQ ID NO: 574427 - DNA, 25 bp, Rattus norvegicus
tcacaagggcctcctttcagttctg

SEQ ID NO: 574428 - DNA, 25 bp, Rattus norvegicus
tcacaagggcctgctttcagttctg

SEQ ID NO: 574429 - DNA, 25 bp, Rattus norvegicus
tcacaagtccttcttgcccacaaga

SEQ ID NO: 574430 - DNA, 25 bp, Rattus norvegicus
tcacaagtccttgttgcccacaaga

SEQ ID NO: 574431 - DNA, 25 bp, Rattus norvegicus
tcacaagtggagatcaggtcagcaa

SEQ ID NO: 574432 - DNA, 25 bp, Rattus norvegicus
tcacaagtggagcagggcctgcctt

SEQ ID NO: 574433 - DNA, 25 bp, Rattus norvegicus
tcacaagtggaggagggcctgcctt

SEQ ID NO: 574434 - DNA, 25 bp, Rattus norvegicus
tcacaagtggagttcaggtcagcaa

SEQ ID NO: 574435 - DNA, 25 bp, Rattus norvegicus
tcacaagttcgacgcctggctggct

SEQ ID NO: 574436 - DNA, 25 bp, Rattus norvegicus
tcacaagttcgaggcctggctggct

SEQ ID NO: 574437 - DNA, 25 bp, Rattus norvegicus
tcacaagttgatcagtctggcgact

SEQ ID NO: 574438 - DNA, 25 bp, Rattus norvegicus
tcacaagttgatgagtctggcgact

SEQ ID NO: 574439 - DNA, 25 bp, Rattus norvegicus
tcacaagtttgcatccagcttttag

SEQ ID NO: 574440 - DNA, 25 bp, Rattus norvegicus
tcacaagtttgcttccagcttttag

SEQ ID NO: 574441 - DNA, 25 bp, Rattus norvegicus
tcacaatattgtcagttccgaaatg

SEQ ID NO: 574442 - DNA, 25 bp, Rattus norvegicus
tcacaatattgtgagttccgaaatg

SEQ ID NO: 574443 - DNA, 25 bp, Rattus norvegicus
tcacaatcagttcttaactctataa

SEQ ID NO: 574444 - DNA, 25 bp, Rattus norvegicus
tcacaatcagttgttaactctataa

SEQ ID NO: 574445 - DNA, 25 bp, Rattus norvegicus
tcacaatccatccttgagagaagtc

SEQ ID NO: 574446 - DNA, 25 bp, Rattus norvegicus
tcacaatccatcgttgagagaagtc

SEQ ID NO: 574447 - DNA, 25 bp, Rattus norvegicus
tcacaatctgtgagtgccctcaaaa

SEQ ID NO: 574448 - DNA, 25 bp, Rattus norvegicus
tcacaatctgtgtgtgccctcaaaa

SEQ ID NO: 574449 - DNA, 25 bp, Rattus norvegicus
tcacaatgagataccacagcacacc

SEQ ID NO: 574450 - DNA, 25 bp, Rattus norvegicus
tcacaatgagattccacagcacacc

SEQ ID NO: 574451 - DNA, 25 bp, Rattus norvegicus
tcacaatgtaacctgggctggctta

SEQ ID NO: 574452 - DNA, 25 bp, Rattus norvegicus
tcacaatgtaacgtgggctggctta

SEQ ID NO: 574453 - DNA, 25 bp, Rattus norvegicus
tcacaatgttccaagttctttaccc

SEQ ID NO: 574454 - DNA, 25 bp, Rattus norvegicus
tcacaatgttcctagttctttaccc

SEQ ID NO: 574455 - DNA, 25 bp, Rattus norvegicus
tcacaatttgggacagctctctctg

SEQ ID NO: 574456 - DNA, 25 bp, Rattus norvegicus
tcacaatttgggtcagctctctctg

SEQ ID NO: 574457 - DNA, 25 bp, Rattus norvegicus
tcacacaaaatcattccaccatggt

SEQ ID NO: 574458 - DNA, 25 bp, Rattus norvegicus
tcacacaaaatctttccaccatggt

SEQ ID NO: 574459 - DNA, 25 bp, Rattus norvegicus
tcacacaacacaaggacttgctctc

SEQ ID NO: 574460 - DNA, 25 bp, Rattus norvegicus
tcacacaacacatggacttgctctc

SEQ ID NO: 574461 - DNA, 25 bp, Rattus norvegicus
tcacacaagcgcaaccgaatggtct

SEQ ID NO: 574462 - DNA, 25 bp, Rattus norvegicus
tcacacaagcgctaccgaatggtct

SEQ ID NO: 574463 - DNA, 25 bp, Rattus norvegicus
tcacacaagtttctttaccttccct

SEQ ID NO: 574464 - DNA, 25 bp, Rattus norvegicus
tcacacaagtttgtttaccttccct

SEQ ID NO: 574465 - DNA, 25 bp, Rattus norvegicus
tcacacaatgatacactggttcctg

SEQ ID NO: 574466 - DNA, 25 bp, Rattus norvegicus
tcacacaatgattcactggttcctg

SEQ ID NO: 574467 - DNA, 25 bp, Rattus norvegicus
tcacacacacatagggataagcatt

SEQ ID NO: 574468 - DNA, 25 bp, Rattus norvegicus
tcacacacacattgggataagcatt

SEQ ID NO: 574469 - DNA, 25 bp, Rattus norvegicus
tcacacacagacaccggttaatgct

SEQ ID NO: 574470 - DNA, 25 bp, Rattus norvegicus
tcacacacagactccggttaatgct

SEQ ID NO: 574471 - DNA, 25 bp, Rattus norvegicus
tcacacactcgcacgggacaaaata

SEQ ID NO: 574472 - DNA, 25 bp, Rattus norvegicus
tcacacactcgctcgggacaaaata

SEQ ID NO: 574473 - DNA, 25 bp, Rattus norvegicus
tcacacacttagcagagacttagag

SEQ ID NO: 574474 - DNA, 25 bp, Rattus norvegicus
tcacacacttaggagagacttagag

SEQ ID NO: 574475 - DNA, 25 bp, Rattus norvegicus
tcacacagacttagagaagactaga

SEQ ID NO: 574476 - DNA, 25 bp, Rattus norvegicus
tcacacagactttgagaagactaga

SEQ ID NO: 574477 - DNA, 25 bp, Rattus norvegicus
tcacacagcctaatgactcacgttg

SEQ ID NO: 574478 - DNA, 25 bp, Rattus norvegicus
tcacacagcctattgactcacgttg

SEQ ID NO: 574479 - DNA, 25 bp, Rattus norvegicus
tcacacagcctgaactagtaactat

SEQ ID NO: 574480 - DNA, 25 bp, Rattus norvegicus
tcacacagcctgtactagtaactat

SEQ ID NO: 574481 - DNA, 25 bp, Rattus norvegicus
tcacacaggcttcccctttaaagaa

SEQ ID NO: 574482 - DNA, 25 bp, Rattus norvegicus
tcacacaggcttgccctttaaagaa

SEQ ID NO: 574483 - DNA, 25 bp, Rattus norvegicus
tcacacaggttacaatatggtcagt

SEQ ID NO: 574484 - DNA, 25 bp, Rattus norvegicus
tcacacaggttagaatatggtcagt

SEQ ID NO: 574485 - DNA, 25 bp, Rattus norvegicus
tcacacagtgataccttctagcgac

SEQ ID NO: 574486 - DNA, 25 bp, Rattus norvegicus
tcacacagtgattccttctagcgac

SEQ ID NO: 574487 - DNA, 25 bp, Rattus norvegicus
tcacacagttcccttcgaagtttat

SEQ ID NO: 574488 - DNA, 25 bp, Rattus norvegicus
tcacacagttccgttcgaagtttat

SEQ ID NO: 574489 - DNA, 25 bp, Rattus norvegicus
tcacacagttgaatcttatgtagag

SEQ ID NO: 574490 - DNA, 25 bp, Rattus norvegicus
tcacacagttgattcttatgtagag

SEQ ID NO: 574491 - DNA, 25 bp, Rattus norvegicus
tcacacatattcacactcgcctagt

SEQ ID NO: 574492 - DNA, 25 bp, Rattus norvegicus
tcacacatattctcactcgcctagt

SEQ ID NO: 574493 - DNA, 25 bp, Rattus norvegicus
tcacacatctgtagccctgatgaca

SEQ ID NO: 574494 - DNA, 25 bp, Rattus norvegicus
tcacacatctgttgccctgatgaca

SEQ ID NO: 574495 - DNA, 25 bp, Rattus norvegicus
tcacacatttacactcaattgccag

SEQ ID NO: 574496 - DNA, 25 bp, Rattus norvegicus
tcacacatttactctcaattgccag

SEQ ID NO: 574497 - DNA, 25 bp, Rattus norvegicus
tcacacattttgaacatctgggaat

SEQ ID NO: 574498 - DNA, 25 bp, Rattus norvegicus
tcacacattttgtacatctgggaat

SEQ ID NO: 574499 - DNA, 25 bp, Rattus norvegicus
tcacaccacatcacatctgaagaat

SEQ ID NO: 574500 - DNA, 25 bp, Rattus norvegicus
tcacaccacatctcatctgaagaat

SEQ ID NO: 574501 - DNA, 25 bp, Rattus norvegicus
tcacaccactttagctgtctttaag

SEQ ID NO: 574502 - DNA, 25 bp, Rattus norvegicus
tcacaccacttttgctgtctttaag

SEQ ID NO: 574503 - DNA, 25 bp, Rattus norvegicus
tcacaccagtagcacacttgagaat

SEQ ID NO: 574504 - DNA, 25 bp, Rattus norvegicus
tcacaccagtaggacacttgagaat

SEQ ID NO: 574505 - DNA, 25 bp, Rattus norvegicus
tcacaccagtgacacagttccagaa

SEQ ID NO: 574506 - DNA, 25 bp, Rattus norvegicus
tcacaccagtgagacagttccagaa

SEQ ID NO: 574507 - DNA, 25 bp, Rattus norvegicus
tcacacccaaaccttcagattcaag

SEQ ID NO: 574508 - DNA, 25 bp, Rattus norvegicus
tcacacccaaacgttcagattcaag

SEQ ID NO: 574509 - DNA, 25 bp, Rattus norvegicus
tcacacccaagtaactatccaggag

SEQ ID NO: 574510 - DNA, 25 bp, Rattus norvegicus
tcacacccaagttactatccaggag

SEQ ID NO: 574511 - DNA, 25 bp, Rattus norvegicus
tcacaccccaggaggattgtctaga

SEQ ID NO: 574512 - DNA, 25 bp, Rattus norvegicus
tcacaccccaggtggattgtctaga

SEQ ID NO: 574513 - DNA, 25 bp, Rattus norvegicus
tcacacccctctatttgagatctgt

SEQ ID NO: 574514 - DNA, 25 bp, Rattus norvegicus
tcacacccctctttttgagatctgt

SEQ ID NO: 574515 - DNA, 25 bp, Rattus norvegicus
tcacacccttgacgaaagtcgaggc

SEQ ID NO: 574516 - DNA, 25 bp, Rattus norvegicus
tcacacccttgaggaaagtcgaggc

SEQ ID NO: 574517 - DNA, 25 bp, Rattus norvegicus
tcacaccgccacctgggtttggttt

SEQ ID NO: 574518 - DNA, 25 bp, Rattus norvegicus
tcacaccgccacgtgggtttggttt

SEQ ID NO: 574519 - DNA, 25 bp, Rattus norvegicus
tcacacctggctcagacttctaatt

SEQ ID NO: 574520 - DNA, 25 bp, Rattus norvegicus
tcacacctggctgagacttctaatt

SEQ ID NO: 574521 - DNA, 25 bp, Rattus norvegicus
tcacacctgtgtcgaccaaagagta

SEQ ID NO: 574522 - DNA, 25 bp, Rattus norvegicus
tcacacctgtgtggaccaaagagta

SEQ ID NO: 574523 - DNA, 25 bp, Rattus norvegicus
tcacaccttgtcacccattattgat

SEQ ID NO: 574524 - DNA, 25 bp, Rattus norvegicus
tcacaccttgtctcccattattgat

SEQ ID NO: 574525 - DNA, 25 bp, Rattus norvegicus
tcacaccttttaccggtttaggcca

SEQ ID NO: 574526 - DNA, 25 bp, Rattus norvegicus
tcacaccttttagcggtttaggcca

SEQ ID NO: 574527 - DNA, 25 bp, Rattus norvegicus
tcacacgaacgcctggtagacgaac

SEQ ID NO: 574528 - DNA, 25 bp, Rattus norvegicus
tcacacgaacgcgtggtagacgaac

SEQ ID NO: 574529 - DNA, 25 bp, Rattus norvegicus
tcacacgcaccaaatccatcgatat

SEQ ID NO: 574530 - DNA, 25 bp, Rattus norvegicus
tcacacgcaccatatccatcgatat

SEQ ID NO: 574531 - DNA, 25 bp, Rattus norvegicus
tcacacgcatttatactccctaaac

SEQ ID NO: 574532 - DNA, 25 bp, Rattus norvegicus
tcacacgcatttttactccctaaac

SEQ ID NO: 574533 - DNA, 25 bp, Rattus norvegicus
tcacacgcgctccaagtttgttatg

SEQ ID NO: 574534 - DNA, 25 bp, Rattus norvegicus
tcacacgcgctcgaagtttgttatg

SEQ ID NO: 574535 - DNA, 25 bp, Rattus norvegicus
tcacacggctaactttttagtctca

SEQ ID NO: 574536 - DNA, 25 bp, Rattus norvegicus
tcacacggctaagtttttagtctca

SEQ ID NO: 574537 - DNA, 25 bp, Rattus norvegicus
tcacacgtgctacacacagacatat

SEQ ID NO: 574538 - DNA, 25 bp, Rattus norvegicus
tcacacgtgctagacacagacatat

SEQ ID NO: 574539 - DNA, 25 bp, Rattus norvegicus
tcacactacctaaccctcaaagaaa

SEQ ID NO: 574540 - DNA, 25 bp, Rattus norvegicus
tcacactacctatccctcaaagaaa

SEQ ID NO: 574541 - DNA, 25 bp, Rattus norvegicus
tcacactagttgagttcaccaccca

SEQ ID NO: 574542 - DNA, 25 bp, Rattus norvegicus
tcacactagttgtgttcaccaccca

SEQ ID NO: 574543 - DNA, 25 bp, Rattus norvegicus
tcacactatcagaaggcagcgttat

SEQ ID NO: 574544 - DNA, 25 bp, Rattus norvegicus
tcacactatcagtaggcagcgttat

SEQ ID NO: 574545 - DNA, 25 bp, Rattus norvegicus
tcacactcaaaacactagcaggcag

SEQ ID NO: 574546 - DNA, 25 bp, Rattus norvegicus
tcacactcaaaagactagcaggcag

SEQ ID NO: 574547 - DNA, 25 bp, Rattus norvegicus
tcacactcacatacgtcagggacac

SEQ ID NO: 574548 - DNA, 25 bp, Rattus norvegicus
tcacactcacattcgtcagggacac

SEQ ID NO: 574549 - DNA, 25 bp, Rattus norvegicus
tcacactcagccagtggcagggtca

SEQ ID NO: 574550 - DNA, 25 bp, Rattus norvegicus
tcacactcagcctgtggcagggtca

SEQ ID NO: 574551 - DNA, 25 bp, Rattus norvegicus
tcacactccactatggaactaccag

SEQ ID NO: 574552 - DNA, 25 bp, Rattus norvegicus
tcacactccactttggaactaccag

SEQ ID NO: 574553 - DNA, 25 bp, Rattus norvegicus
tcacactcctttacatatgcttctt

SEQ ID NO: 574554 - DNA, 25 bp, Rattus norvegicus
tcacactccttttcatatgcttctt

SEQ ID NO: 574555 - DNA, 25 bp, Rattus norvegicus
tcacactctcttacttgctgaggaa

SEQ ID NO: 574556 - DNA, 25 bp, Rattus norvegicus
tcacactctctttcttgctgaggaa

SEQ ID NO: 574557 - DNA, 25 bp, Rattus norvegicus
tcacactctgtgcactgtctagata

SEQ ID NO: 574558 - DNA, 25 bp, Rattus norvegicus
tcacactctgtggactgtctagata

SEQ ID NO: 574559 - DNA, 25 bp, Rattus norvegicus
tcacactcttttactgtcacaatag

SEQ ID NO: 574560 - DNA, 25 bp, Rattus norvegicus
tcacactctttttctgtcacaatag

SEQ ID NO: 574561 - DNA, 25 bp, Rattus norvegicus
tcacactgacgtacgtgcagcttcc

SEQ ID NO: 574562 - DNA, 25 bp, Rattus norvegicus
tcacactgacgttcgtgcagcttcc

SEQ ID NO: 574563 - DNA, 25 bp, Rattus norvegicus
tcacactgcaccatctatgtggcaa

SEQ ID NO: 574564 - DNA, 25 bp, Rattus norvegicus
tcacactgcaccttctatgtggcaa

SEQ ID NO: 574565 - DNA, 25 bp, Rattus norvegicus
tcacactgcttcagactctttttgt

SEQ ID NO: 574566 - DNA, 25 bp, Rattus norvegicus
tcacactgcttctgactctttttgt

SEQ ID NO: 574567 - DNA, 25 bp, Rattus norvegicus
tcacactggaatctccatccattgg

SEQ ID NO: 574568 - DNA, 25 bp, Rattus norvegicus
tcacactggaatgtccatccattgg

SEQ ID NO: 574569 - DNA, 25 bp, Rattus norvegicus
tcacactggacactgttctcatcaa

SEQ ID NO: 574570 - DNA, 25 bp, Rattus norvegicus
tcacactggacagtgttctcatcaa

SEQ ID NO: 574571 - DNA, 25 bp, Rattus norvegicus
tcacactggcgacaggccctatgag

SEQ ID NO: 574572 - DNA, 25 bp, Rattus norvegicus
tcacactggcgagaggccctatgag

SEQ ID NO: 574573 - DNA, 25 bp, Rattus norvegicus
tcacactgtactcatcgggcgcagg

SEQ ID NO: 574574 - DNA, 25 bp, Rattus norvegicus
tcacactgtactcctagggcccagg

SEQ ID NO: 574575 - DNA, 25 bp, Rattus norvegicus
tcacactgtactctgaggtccaaat

SEQ ID NO: 574576 - DNA, 25 bp, Rattus norvegicus
tcacactgtactgatcgggcgcagg

SEQ ID NO: 574577 - DNA, 25 bp, Rattus norvegicus
tcacactgtactgctagggcccagg

SEQ ID NO: 574578 - DNA, 25 bp, Rattus norvegicus
tcacactgtactgtgaggtccaaat

SEQ ID NO: 574579 - DNA, 25 bp, Rattus norvegicus
tcacactgtggcaatgtcctgtttg

SEQ ID NO: 574580 - DNA, 25 bp, Rattus norvegicus
tcacactgtggctatgtcctgtttg

SEQ ID NO: 574581 - DNA, 25 bp, Rattus norvegicus
tcacacttatctacgcttctttctt

SEQ ID NO: 574582 - DNA, 25 bp, Rattus norvegicus
tcacacttatcttcgcttctttctt

SEQ ID NO: 574583 - DNA, 25 bp, Rattus norvegicus
tcacacttcggaatgtccctcatgg

SEQ ID NO: 574584 - DNA, 25 bp, Rattus norvegicus
tcacacttcggattgtccctcatgg

SEQ ID NO: 574585 - DNA, 25 bp, Rattus norvegicus
tcacacttgccacgtccagaatttg

SEQ ID NO: 574586 - DNA, 25 bp, Rattus norvegicus
tcacacttgccaggtccagaatttg

SEQ ID NO: 574587 - DNA, 25 bp, Rattus norvegicus
tcacacttgcggatgaattaccttt

SEQ ID NO: 574588 - DNA, 25 bp, Rattus norvegicus
tcacacttgcggttgaattaccttt

SEQ ID NO: 574589 - DNA, 25 bp, Rattus norvegicus
tcacacttgtttctgcctctttttt

SEQ ID NO: 574590 - DNA, 25 bp, Rattus norvegicus
tcacacttgtttgtgcctctttttt

SEQ ID NO: 574591 - DNA, 25 bp, Rattus norvegicus
tcacactttggaagatctttgcagt

SEQ ID NO: 574592 - DNA, 25 bp, Rattus norvegicus
tcacactttggatgatctttgcagt

SEQ ID NO: 574593 - DNA, 25 bp, Rattus norvegicus
tcacagaactggactgacactggtt

SEQ ID NO: 574594 - DNA, 25 bp, Rattus norvegicus
tcacagaactggtctgacactggtt

SEQ ID NO: 574595 - DNA, 25 bp, Rattus norvegicus
tcacagaacttgacatagctgccct

SEQ ID NO: 574596 - DNA, 25 bp, Rattus norvegicus
tcacagaacttgtcatagctgccct

SEQ ID NO: 574597 - DNA, 25 bp, Rattus norvegicus
tcacagaattctcatgtctcaccat

SEQ ID NO: 574598 - DNA, 25 bp, Rattus norvegicus
tcacagaattctgatgtctcaccat

SEQ ID NO: 574599 - DNA, 25 bp, Rattus norvegicus
tcacagacaggtcggcgtggccttc

SEQ ID NO: 574600 - DNA, 25 bp, Rattus norvegicus
tcacagacaggtgggcgtggccttc

SEQ ID NO: 574601 - DNA, 25 bp, Rattus norvegicus
tcacagacatccctggaggactcgc

SEQ ID NO: 574602 - DNA, 25 bp, Rattus norvegicus
tcacagacatccgtggaggactcgc

SEQ ID NO: 574603 - DNA, 25 bp, Rattus norvegicus
tcacagaccttcaacaccaatggaa

SEQ ID NO: 574604 - DNA, 25 bp, Rattus norvegicus
tcacagaccttctacaccaatggaa

SEQ ID NO: 574605 - DNA, 25 bp, Rattus norvegicus
tcacagacgccgagtccagatgata

SEQ ID NO: 574606 - DNA, 25 bp, Rattus norvegicus
tcacagacgccgtgtccagatgata

SEQ ID NO: 574607 - DNA, 25 bp, Rattus norvegicus
tcacagactcagaggcgtccagtgt

SEQ ID NO: 574608 - DNA, 25 bp, Rattus norvegicus
tcacagactcagtggcgtccagtgt

SEQ ID NO: 574609 - DNA, 25 bp, Rattus norvegicus
tcacagagatgaccccacttctact

SEQ ID NO: 574610 - DNA, 25 bp, Rattus norvegicus
tcacagagatgagcccacttctact

SEQ ID NO: 574611 - DNA, 25 bp, Rattus norvegicus
tcacagagcactcagatgcctggcc

SEQ ID NO: 574612 - DNA, 25 bp, Rattus norvegicus
tcacagagcactgagatgcctggcc

SEQ ID NO: 574613 - DNA, 25 bp, Rattus norvegicus
tcacagagcagaacaatggacccaa

SEQ ID NO: 574614 - DNA, 25 bp, Rattus norvegicus
tcacagagcagatcaatggacccaa

SEQ ID NO: 574615 - DNA, 25 bp, Rattus norvegicus
tcacagaggccccagaggacatgat

SEQ ID NO: 574616 - DNA, 25 bp, Rattus norvegicus
tcacagaggcccgagaggacatgat

SEQ ID NO: 574617 - DNA, 25 bp, Rattus norvegicus
tcacagagtgggacttcaacaccat

SEQ ID NO: 574618 - DNA, 25 bp, Rattus norvegicus
tcacagagtgggtcttcaacaccat

SEQ ID NO: 574619 - DNA, 25 bp, Rattus norvegicus
tcacagagtttcacccgtagcaaag

SEQ ID NO: 574620 - DNA, 25 bp, Rattus norvegicus
tcacagagtttctcccgtagcaaag

SEQ ID NO: 574621 - DNA, 25 bp, Rattus norvegicus
tcacagatccgcctgactgttcgac

SEQ ID NO: 574622 - DNA, 25 bp, Rattus norvegicus
tcacagatccgcgtgactgttcgac

SEQ ID NO: 574623 - DNA, 25 bp, Rattus norvegicus
tcacagatggcacgagctccggcga

SEQ ID NO: 574624 - DNA, 25 bp, Rattus norvegicus
tcacagatggcaggagctccggcga

SEQ ID NO: 574625 - DNA, 25 bp, Rattus norvegicus
tcacagcaacagcttcctttcaaat

SEQ ID NO: 574626 - DNA, 25 bp, Rattus norvegicus
tcacagcaacaggttcctttcaaat

SEQ ID NO: 574627 - DNA, 25 bp, Rattus norvegicus
tcacagcagcatattcaaaccatcc

SEQ ID NO: 574628 - DNA, 25 bp, Rattus norvegicus
tcacagcagcattttcaaaccatcc

SEQ ID NO: 574629 - DNA, 25 bp, Rattus norvegicus
tcacagcagctcaagactcactgtt

SEQ ID NO: 574630 - DNA, 25 bp, Rattus norvegicus
tcacagcagctctagactcactgtt

SEQ ID NO: 574631 - DNA, 25 bp, Rattus norvegicus
tcacagcagctgcattttatgaatc

SEQ ID NO: 574632 - DNA, 25 bp, Rattus norvegicus
tcacagcagctggattttatgaatc

SEQ ID NO: 574633 - DNA, 25 bp, Rattus norvegicus
tcacagcaggagagcagcacccgaa

SEQ ID NO: 574634 - DNA, 25 bp, Rattus norvegicus
tcacagcaggagtgcagcacccgaa

SEQ ID NO: 574635 - DNA, 25 bp, Rattus norvegicus
tcacagcagtgtaatctccaggaga

SEQ ID NO: 574636 - DNA, 25 bp, Rattus norvegicus
tcacagcagtgttatctccaggaga

SEQ ID NO: 574637 - DNA, 25 bp, Rattus norvegicus
tcacagcagtttaagcactcctggg

SEQ ID NO: 574638 - DNA, 25 bp, Rattus norvegicus
tcacagcagttttagcactcctggg

SEQ ID NO: 574639 - DNA, 25 bp, Rattus norvegicus
tcacagcatctacgtgtccaggagt

SEQ ID NO: 574640 - DNA, 25 bp, Rattus norvegicus
tcacagcatctaggtgtccaggagt

SEQ ID NO: 574641 - DNA, 25 bp, Rattus norvegicus
tcacagcattccagggctagtctag

SEQ ID NO: 574642 - DNA, 25 bp, Rattus norvegicus
tcacagcattcctgggctagtctag

SEQ ID NO: 574643 - DNA, 25 bp, Rattus norvegicus
tcacagcatttcagtgtcggtcaca

SEQ ID NO: 574644 - DNA, 25 bp, Rattus norvegicus
tcacagcatttctgtgtcggtcaca

SEQ ID NO: 574645 - DNA, 25 bp, Rattus norvegicus
tcacagccagccaggctaagagtga

SEQ ID NO: 574646 - DNA, 25 bp, Rattus norvegicus
tcacagccagcctggctaagagtga

SEQ ID NO: 574647 - DNA, 25 bp, Rattus norvegicus
tcacagccccagactagattatttt

SEQ ID NO: 574648 - DNA, 25 bp, Rattus norvegicus
tcacagccccagtctagattatttt

SEQ ID NO: 574649 - DNA, 25 bp, Rattus norvegicus
tcacagccgctccaggtttgagaga

SEQ ID NO: 574650 - DNA, 25 bp, Rattus norvegicus
tcacagccgctcgaggtttgagaga

SEQ ID NO: 574651 - DNA, 25 bp, Rattus norvegicus
tcacagcctctgctctatggaaaga

SEQ ID NO: 574652 - DNA, 25 bp, Rattus norvegicus
tcacagcctctggtctatggaaaga

SEQ ID NO: 574653 - DNA, 25 bp, Rattus norvegicus
tcacagcgtgacaccttacaagaag

SEQ ID NO: 574654 - DNA, 25 bp, Rattus norvegicus
tcacagcgtgactccttacaagaag

SEQ ID NO: 574655 - DNA, 25 bp, Rattus norvegicus
tcacagcgttttaggaaagcatagc

SEQ ID NO: 574656 - DNA, 25 bp, Rattus norvegicus
tcacagcgtttttggaaagcatagc

SEQ ID NO: 574657 - DNA, 25 bp, Rattus norvegicus
tcacagctactcagcgaggcagtgt

SEQ ID NO: 574658 - DNA, 25 bp, Rattus norvegicus
tcacagctactctgcgaggcagtgt

SEQ ID NO: 574659 - DNA, 25 bp, Rattus norvegicus
tcacagctagcccactggaagaaga

SEQ ID NO: 574660 - DNA, 25 bp, Rattus norvegicus
tcacagctagccgactggaagaaga

SEQ ID NO: 574661 - DNA, 25 bp, Rattus norvegicus
tcacagctagctccactagggttct

SEQ ID NO: 574662 - DNA, 25 bp, Rattus norvegicus
tcacagctagctgcactagggttct

SEQ ID NO: 574663 - DNA, 25 bp, Rattus norvegicus
tcacagctatctaattccagttcct

SEQ ID NO: 574664 - DNA, 25 bp, Rattus norvegicus
tcacagctatcttattccagttcct

SEQ ID NO: 574665 - DNA, 25 bp, Rattus norvegicus
tcacagctcaaacttgccattcata

SEQ ID NO: 574666 - DNA, 25 bp, Rattus norvegicus
tcacagctcaaagttgccattcata

SEQ ID NO: 574667 - DNA, 25 bp, Rattus norvegicus
tcacagctcagtacctatagtaaaa

SEQ ID NO: 574668 - DNA, 25 bp, Rattus norvegicus
tcacagctcagttcctatagtaaaa

SEQ ID NO: 574669 - DNA, 25 bp, Rattus norvegicus
tcacagctcatcagtcactgcaaat

SEQ ID NO: 574670 - DNA, 25 bp, Rattus norvegicus
tcacagctcatctgtcactgcaaat

SEQ ID NO: 574671 - DNA, 25 bp, Rattus norvegicus
tcacagctgtcaatgggatcgtaaa

SEQ ID NO: 574672 - DNA, 25 bp, Rattus norvegicus
tcacagctgtcattgggatcgtaaa

SEQ ID NO: 574673 - DNA, 25 bp, Rattus norvegicus
tcacagcttgtgctctttaggagac

SEQ ID NO: 574674 - DNA, 25 bp, Rattus norvegicus
tcacagcttgtggtctttaggagac

SEQ ID NO: 574675 - DNA, 25 bp, Rattus norvegicus
tcacagcttgttcagcttccacaac

SEQ ID NO: 574676 - DNA, 25 bp, Rattus norvegicus
tcacagcttgttgagcttccacaac

SEQ ID NO: 574677 - DNA, 25 bp, Rattus norvegicus
tcacaggaagtcaagccccagattc

SEQ ID NO: 574678 - DNA, 25 bp, Rattus norvegicus
tcacaggaagtctagccccagattc

SEQ ID NO: 574679 - DNA, 25 bp, Rattus norvegicus
tcacaggaatccaactactggtgtt

SEQ ID NO: 574680 - DNA, 25 bp, Rattus norvegicus
tcacaggaatcctactactggtgtt

SEQ ID NO: 574681 - DNA, 25 bp, Rattus norvegicus
tcacaggacctgaagaggcctttgt

SEQ ID NO: 574682 - DNA, 25 bp, Rattus norvegicus
tcacaggacctgtagaggcctttgt

SEQ ID NO: 574683 - DNA, 25 bp, Rattus norvegicus
tcacaggacgagctgaggtgcccat

SEQ ID NO: 574684 - DNA, 25 bp, Rattus norvegicus
tcacaggacgaggtgaggtgcccat

SEQ ID NO: 574685 - DNA, 25 bp, Rattus norvegicus
tcacaggacgtacatttcgtaaccc

SEQ ID NO: 574686 - DNA, 25 bp, Rattus norvegicus
tcacaggacgtagatttcgtaaccc

SEQ ID NO: 574687 - DNA, 25 bp, Rattus norvegicus
tcacaggagcccattctcttagagg

SEQ ID NO: 574688 - DNA, 25 bp, Rattus norvegicus
tcacaggagccctttctcttagagg

SEQ ID NO: 574689 - DNA, 25 bp, Rattus norvegicus
tcacaggagcttcacttggtctctc

SEQ ID NO: 574690 - DNA, 25 bp, Rattus norvegicus
tcacaggagcttgacttggtctctc

SEQ ID NO: 574691 - DNA, 25 bp, Rattus norvegicus
tcacaggatgctaggactggctcca

SEQ ID NO: 574692 - DNA, 25 bp, Rattus norvegicus
tcacaggatgcttggactggctcca

SEQ ID NO: 574693 - DNA, 25 bp, Rattus norvegicus
tcacaggcatggatcctttaaggaa

SEQ ID NO: 574694 - DNA, 25 bp, Rattus norvegicus
tcacaggcatggttcctttaaggaa

SEQ ID NO: 574695 - DNA, 25 bp, Rattus norvegicus
tcacaggccagtctctggagttcgt

SEQ ID NO: 574696 - DNA, 25 bp, Rattus norvegicus
tcacaggccagtgtctggagttcgt

SEQ ID NO: 574697 - DNA, 25 bp, Rattus norvegicus
tcacaggctggacacttttacaaag

SEQ ID NO: 574698 - DNA, 25 bp, Rattus norvegicus
tcacaggctggagacttttacaaag

SEQ ID NO: 574699 - DNA, 25 bp, Rattus norvegicus
tcacaggctggtactgatgctgcta

SEQ ID NO: 574700 - DNA, 25 bp, Rattus norvegicus
tcacaggctggttctgatgctgcta

SEQ ID NO: 574701 - DNA, 25 bp, Rattus norvegicus
tcacaggcttatctttgtttcccgc

SEQ ID NO: 574702 - DNA, 25 bp, Rattus norvegicus
tcacaggcttatgtttgtttcccgc

SEQ ID NO: 574703 - DNA, 25 bp, Rattus norvegicus
tcacagggaacacaccatcatcaga

SEQ ID NO: 574704 - DNA, 25 bp, Rattus norvegicus
tcacagggaacagaccatcatcaga

SEQ ID NO: 574705 - DNA, 25 bp, Rattus norvegicus
tcacagggatgtacctcaccagctg

SEQ ID NO: 574706 - DNA, 25 bp, Rattus norvegicus
tcacagggatgtcaagccccactgt

SEQ ID NO: 574707 - DNA, 25 bp, Rattus norvegicus
tcacagggatgtgaagccccactgt

SEQ ID NO: 574708 - DNA, 25 bp, Rattus norvegicus
tcacagggatgttcctcaccagctg

SEQ ID NO: 574709 - DNA, 25 bp, Rattus norvegicus
tcacagggcaggagttgattccgca

SEQ ID NO: 574710 - DNA, 25 bp, Rattus norvegicus
tcacagggcaggtgttgattccgca

SEQ ID NO: 574711 - DNA, 25 bp, Rattus norvegicus
tcacagggccggcagccatgtggtg

SEQ ID NO: 574712 - DNA, 25 bp, Rattus norvegicus
tcacagggccgggagccatgtggtg

SEQ ID NO: 574713 - DNA, 25 bp, Rattus norvegicus
tcacagggctgtccatttcggtttc

SEQ ID NO: 574714 - DNA, 25 bp, Rattus norvegicus
tcacagggctgtgcatttcggtttc

SEQ ID NO: 574715 - DNA, 25 bp, Rattus norvegicus
tcacagggtacccagatccagacag

SEQ ID NO: 574716 - DNA, 25 bp, Rattus norvegicus
tcacagggtaccgagatccagacag

SEQ ID NO: 574717 - DNA, 25 bp, Rattus norvegicus
tcacagggtggcaacagtcggaaca

SEQ ID NO: 574718 - DNA, 25 bp, Rattus norvegicus
tcacagggtggctacagtcggaaca

SEQ ID NO: 574719 - DNA, 25 bp, Rattus norvegicus
tcacagggtgtgaggcttcatgtta

SEQ ID NO: 574720 - DNA, 25 bp, Rattus norvegicus
tcacagggtgtgtggcttcatgtta

SEQ ID NO: 574721 - DNA, 25 bp, Rattus norvegicus
tcacagggttcacggctctgtgctg

SEQ ID NO: 574722 - DNA, 25 bp, Rattus norvegicus
tcacagggttcagggctctgtgctg

SEQ ID NO: 574723 - DNA, 25 bp, Rattus norvegicus
tcacaggtagagcactacaggccaa

SEQ ID NO: 574724 - DNA, 25 bp, Rattus norvegicus
tcacaggtagaggactacaggccaa

SEQ ID NO: 574725 - DNA, 25 bp, Rattus norvegicus
tcacaggtcatcagccacaattcta

SEQ ID NO: 574726 - DNA, 25 bp, Rattus norvegicus
tcacaggtcatctgccacaattcta

SEQ ID NO: 574727 - DNA, 25 bp, Rattus norvegicus
tcacaggtgttgcatgatgaagaca

SEQ ID NO: 574728 - DNA, 25 bp, Rattus norvegicus
tcacaggtgttggatgatgaagaca

SEQ ID NO: 574729 - DNA, 25 bp, Rattus norvegicus
tcacaggttaggctgcccatccttc

SEQ ID NO: 574730 - DNA, 25 bp, Rattus norvegicus
tcacaggttagggtgcccatccttc

SEQ ID NO: 574731 - DNA, 25 bp, Rattus norvegicus
tcacagtagccacagagcccaggac

SEQ ID NO: 574732 - DNA, 25 bp, Rattus norvegicus
tcacagtagccagagagcccaggac

SEQ ID NO: 574733 - DNA, 25 bp, Rattus norvegicus
tcacagtattgaactccctttttgc

SEQ ID NO: 574734 - DNA, 25 bp, Rattus norvegicus
tcacagtattgatctccctttttgc

SEQ ID NO: 574735 - DNA, 25 bp, Rattus norvegicus
tcacagtatttaatatcctccgcca

SEQ ID NO: 574736 - DNA, 25 bp, Rattus norvegicus
tcacagtatttattatcctccgcca

SEQ ID NO: 574737 - DNA, 25 bp, Rattus norvegicus
tcacagtcatccactgctgagtgtc

SEQ ID NO: 574738 - DNA, 25 bp, Rattus norvegicus
tcacagtcatcctctgctgagtgtc

SEQ ID NO: 574739 - DNA, 25 bp, Rattus norvegicus
tcacagtccttgacacactttgtaa

SEQ ID NO: 574740 - DNA, 25 bp, Rattus norvegicus
tcacagtccttgtcacactttgtaa

SEQ ID NO: 574741 - DNA, 25 bp, Rattus norvegicus
tcacagtctatacgttagttcctaa

SEQ ID NO: 574742 - DNA, 25 bp, Rattus norvegicus
tcacagtctataggttagttcctaa

SEQ ID NO: 574743 - DNA, 25 bp, Rattus norvegicus
tcacagtctgatcaccgggattcca

SEQ ID NO: 574744 - DNA, 25 bp, Rattus norvegicus
tcacagtctgatgaccgggattcca

SEQ ID NO: 574745 - DNA, 25 bp, Rattus norvegicus
tcacagtcttgaaaagcggttgtct

SEQ ID NO: 574746 - DNA, 25 bp, Rattus norvegicus
tcacagtcttgataagcggttgtct

SEQ ID NO: 574747 - DNA, 25 bp, Rattus norvegicus
tcacagtctttgatgtgagctctct

SEQ ID NO: 574748 - DNA, 25 bp, Rattus norvegicus
tcacagtctttgttgtgagctctct

SEQ ID NO: 574749 - DNA, 25 bp, Rattus norvegicus
tcacagtgacacaaagctttttctt

SEQ ID NO: 574750 - DNA, 25 bp, Rattus norvegicus
tcacagtgacactaagctttttctt

SEQ ID NO: 574751 - DNA, 25 bp, Rattus norvegicus
tcacagtgctctctgagtctgagtc

SEQ ID NO: 574752 - DNA, 25 bp, Rattus norvegicus
tcacagtgctctgtgagtctgagtc

SEQ ID NO: 574753 - DNA, 25 bp, Rattus norvegicus
tcacagtgcttaactgcctatcttt

SEQ ID NO: 574754 - DNA, 25 bp, Rattus norvegicus
tcacagtgcttatctgcctatcttt

SEQ ID NO: 574755 - DNA, 25 bp, Rattus norvegicus
tcacagtggaccagccagatgcaat

SEQ ID NO: 574756 - DNA, 25 bp, Rattus norvegicus
tcacagtggacctgccagatgcaat

SEQ ID NO: 574757 - DNA, 25 bp, Rattus norvegicus
tcacagtggctgagggccatgctca

SEQ ID NO: 574758 - DNA, 25 bp, Rattus norvegicus
tcacagtggctgtgggccatgctca

SEQ ID NO: 574759 - DNA, 25 bp, Rattus norvegicus
tcacagtgggaaccacactgttgtc

SEQ ID NO: 574760 - DNA, 25 bp, Rattus norvegicus
tcacagtgggaagcacactgttgtc

SEQ ID NO: 574761 - DNA, 25 bp, Rattus norvegicus
tcacagtggtacatcttcttggtgt

SEQ ID NO: 574762 - DNA, 25 bp, Rattus norvegicus
tcacagtggtacttcttcttggtgt

SEQ ID NO: 574763 - DNA, 25 bp, Rattus norvegicus
tcacagtgtaccactgagcacaata

SEQ ID NO: 574764 - DNA, 25 bp, Rattus norvegicus
tcacagtgtacctctgagcacaata

SEQ ID NO: 574765 - DNA, 25 bp, Rattus norvegicus
tcacagtgtgccaggctgtctctta

SEQ ID NO: 574766 - DNA, 25 bp, Rattus norvegicus
tcacagtgtgcctggctgtctctta

SEQ ID NO: 574767 - DNA, 25 bp, Rattus norvegicus
tcacagtgttaaccagcagcctccg

SEQ ID NO: 574768 - DNA, 25 bp, Rattus norvegicus
tcacagtgttaagcagcagcctccg

SEQ ID NO: 574769 - DNA, 25 bp, Rattus norvegicus
tcacagtgtttgcacagggccagaa

SEQ ID NO: 574770 - DNA, 25 bp, Rattus norvegicus
tcacagtgtttggacagggccagaa

SEQ ID NO: 574771 - DNA, 25 bp, Rattus norvegicus
tcacagttcagtcactgcagctctg

SEQ ID NO: 574772 - DNA, 25 bp, Rattus norvegicus
tcacagttcagtgactgcagctctg

SEQ ID NO: 574773 - DNA, 25 bp, Rattus norvegicus
tcacagtttcagatttcatggttaa

SEQ ID NO: 574774 - DNA, 25 bp, Rattus norvegicus
tcacagtttcagttttcatggttaa

SEQ ID NO: 574775 - DNA, 25 bp, Rattus norvegicus
tcacatacagagcagttctagaggg

SEQ ID NO: 574776 - DNA, 25 bp, Rattus norvegicus
tcacatacagaggagttctagaggg

SEQ ID NO: 574777 - DNA, 25 bp, Rattus norvegicus
tcacataccagacggagcttccgtt

SEQ ID NO: 574778 - DNA, 25 bp, Rattus norvegicus
tcacataccagagggagcttccgtt

SEQ ID NO: 574779 - DNA, 25 bp, Rattus norvegicus
tcacatacttggaactgattcaaac

SEQ ID NO: 574780 - DNA, 25 bp, Rattus norvegicus
tcacatacttggtactgattcaaac

SEQ ID NO: 574781 - DNA, 25 bp, Rattus norvegicus
tcacatagccttctcattcctcttt

SEQ ID NO: 574782 - DNA, 25 bp, Rattus norvegicus
tcacatagccttgtcattcctcttt

SEQ ID NO: 574783 - DNA, 25 bp, Rattus norvegicus
tcacatagcttgatgccccgtaaaa

SEQ ID NO: 574784 - DNA, 25 bp, Rattus norvegicus
tcacatagcttgttgccccgtaaaa

SEQ ID NO: 574785 - DNA, 25 bp, Rattus norvegicus
tcacatatggcaactaagagctctg

SEQ ID NO: 574786 - DNA, 25 bp, Rattus norvegicus
tcacatatggcatctaagagctctg

SEQ ID NO: 574787 - DNA, 25 bp, Rattus norvegicus
tcacatcactgtacctcagctttct

SEQ ID NO: 574788 - DNA, 25 bp, Rattus norvegicus
tcacatcactgttcctcagctttct

SEQ ID NO: 574789 - DNA, 25 bp, Rattus norvegicus
tcacatcatttcattctggtctgga

SEQ ID NO: 574790 - DNA, 25 bp, Rattus norvegicus
tcacatcatttctttctggtctgga

SEQ ID NO: 574791 - DNA, 25 bp, Rattus norvegicus
tcacatccacagagaatccatccat

SEQ ID NO: 574792 - DNA, 25 bp, Rattus norvegicus
tcacatccacagtgaatccatccat

SEQ ID NO: 574793 - DNA, 25 bp, Rattus norvegicus
tcacatccagaaagtacattatcaa

SEQ ID NO: 574794 - DNA, 25 bp, Rattus norvegicus
tcacatccagaatgtacattatcaa

SEQ ID NO: 574795 - DNA, 25 bp, Rattus norvegicus
tcacatccagctccacttcaaagag

SEQ ID NO: 574796 - DNA, 25 bp, Rattus norvegicus
tcacatccagctgcacttcaaagag

SEQ ID NO: 574797 - DNA, 25 bp, Rattus norvegicus
tcacatccatgcactcaggaaggga

SEQ ID NO: 574798 - DNA, 25 bp, Rattus norvegicus
tcacatccatgctctcaggaaggga

SEQ ID NO: 574799 - DNA, 25 bp, Rattus norvegicus
tcacatccgtgtccattaatttaag

SEQ ID NO: 574800 - DNA, 25 bp, Rattus norvegicus
tcacatccgtgtgcattaatttaag

SEQ ID NO: 574801 - DNA, 25 bp, Rattus norvegicus
tcacatcctgtcatcgatgcagcaa

SEQ ID NO: 574802 - DNA, 25 bp, Rattus norvegicus
tcacatcctgtcttcgatgcagcaa

SEQ ID NO: 574803 - DNA, 25 bp, Rattus norvegicus
tcacatcgagtgcacagaccaggaa

SEQ ID NO: 574804 - DNA, 25 bp, Rattus norvegicus
tcacatcgagtggacagaccaggaa

SEQ ID NO: 574805 - DNA, 25 bp, Rattus norvegicus
tcacatcgcctgcaggctgactggg

SEQ ID NO: 574806 - DNA, 25 bp, Rattus norvegicus
tcacatcgcctggaggctgactggg

SEQ ID NO: 574807 - DNA, 25 bp, Rattus norvegicus
tcacatctacccaaaccagttttta

SEQ ID NO: 574808 - DNA, 25 bp, Rattus norvegicus
tcacatctaccctaaccagttttta

SEQ ID NO: 574809 - DNA, 25 bp, Rattus norvegicus
tcacatctagacatttttaaggtgt

SEQ ID NO: 574810 - DNA, 25 bp, Rattus norvegicus
tcacatctagacttttttaaggtgt

SEQ ID NO: 574811 - DNA, 25 bp, Rattus norvegicus
tcacatctcacccaaactgttggct

SEQ ID NO: 574812 - DNA, 25 bp, Rattus norvegicus
tcacatctcaccgaaactgttggct

SEQ ID NO: 574813 - DNA, 25 bp, Rattus norvegicus
tcacatctccccaattggagctaag

SEQ ID NO: 574814 - DNA, 25 bp, Rattus norvegicus
tcacatctcccctattggagctaag

SEQ ID NO: 574815 - DNA, 25 bp, Rattus norvegicus
tcacatctcttgatcctgtaagtag

SEQ ID NO: 574816 - DNA, 25 bp, Rattus norvegicus
tcacatctcttgttcctgtaagtag

SEQ ID NO: 574817 - DNA, 25 bp, Rattus norvegicus
tcacatctgtgtacagtcaccgtta

SEQ ID NO: 574818 - DNA, 25 bp, Rattus norvegicus
tcacatctgtgttcagtcaccgtta

SEQ ID NO: 574819 - DNA, 25 bp, Rattus norvegicus
tcacatcttattaccaccttgaagg

SEQ ID NO: 574820 - DNA, 25 bp, Rattus norvegicus
tcacatcttatttccaccttgaagg

SEQ ID NO: 574821 - DNA, 25 bp, Rattus norvegicus
tcacatgacatccatctcctgaaga

SEQ ID NO: 574822 - DNA, 25 bp, Rattus norvegicus
tcacatgacatcgatctcctgaaga

SEQ ID NO: 574823 - DNA, 25 bp, Rattus norvegicus
tcacatgaccatcgcgggcacagaa

SEQ ID NO: 574824 - DNA, 25 bp, Rattus norvegicus
tcacatgaccatggcgggcacagaa

SEQ ID NO: 574825 - DNA, 25 bp, Rattus norvegicus
tcacatgagtacaggactggtcctt

SEQ ID NO: 574826 - DNA, 25 bp, Rattus norvegicus
tcacatgagtactggactggtcctt

SEQ ID NO: 574827 - DNA, 25 bp, Rattus norvegicus
tcacatgcatggactcacactcgga

SEQ ID NO: 574828 - DNA, 25 bp, Rattus norvegicus
tcacatgcatggtctcacactcgga

SEQ ID NO: 574829 - DNA, 25 bp, Rattus norvegicus
tcacatgctggaatggagccggtgt

SEQ ID NO: 574830 - DNA, 25 bp, Rattus norvegicus
tcacatgctggattggagccggtgt

SEQ ID NO: 574831 - DNA, 25 bp, Rattus norvegicus
tcacatgctgttactgcctcaggga

SEQ ID NO: 574832 - DNA, 25 bp, Rattus norvegicus
tcacatgctgtttctgcctcaggga

SEQ ID NO: 574833 - DNA, 25 bp, Rattus norvegicus
tcacatgcttgcctggatctgaact

SEQ ID NO: 574834 - DNA, 25 bp, Rattus norvegicus
tcacatgcttgcgtggatctgaact

SEQ ID NO: 574835 - DNA, 25 bp, Rattus norvegicus
tcacatgtacgaagatgcccagctt

SEQ ID NO: 574836 - DNA, 25 bp, Rattus norvegicus
tcacatgtacgatgatgcccagctt

SEQ ID NO: 574837 - DNA, 25 bp, Rattus norvegicus
tcacatgtcgccagaacgtcagggt

SEQ ID NO: 574838 - DNA, 25 bp, Rattus norvegicus
tcacatgtcgcctgaacgtcagggt

SEQ ID NO: 574839 - DNA, 25 bp, Rattus norvegicus
tcacattattacattccttctgctg

SEQ ID NO: 574840 - DNA, 25 bp, Rattus norvegicus
tcacattattactttccttctgctg

SEQ ID NO: 574841 - DNA, 25 bp, Rattus norvegicus
tcacattattgactcctggcttcta

SEQ ID NO: 574842 - DNA, 25 bp, Rattus norvegicus
tcacattattgagtcctggcttcta

SEQ ID NO: 574843 - DNA, 25 bp, Rattus norvegicus
tcacattcacacccgattgcgcaat

SEQ ID NO: 574844 - DNA, 25 bp, Rattus norvegicus
tcacattcacacgcgattgcgcaat

SEQ ID NO: 574845 - DNA, 25 bp, Rattus norvegicus
tcacattccacacgcctgattttta

SEQ ID NO: 574846 - DNA, 25 bp, Rattus norvegicus
tcacattccacaggcctgattttta

SEQ ID NO: 574847 - DNA, 25 bp, Rattus norvegicus
tcacattccttgaagctatgagcat

SEQ ID NO: 574848 - DNA, 25 bp, Rattus norvegicus
tcacattccttgtagctatgagcat

SEQ ID NO: 574849 - DNA, 25 bp, Rattus norvegicus
tcacattctcttatccagacttcaa

SEQ ID NO: 574850 - DNA, 25 bp, Rattus norvegicus
tcacattctcttttccagacttcaa

SEQ ID NO: 574851 - DNA, 25 bp, Rattus norvegicus
tcacattctgacatctggctatcaa

SEQ ID NO: 574852 - DNA, 25 bp, Rattus norvegicus
tcacattctgacttctggctatcaa

SEQ ID NO: 574853 - DNA, 25 bp, Rattus norvegicus
tcacattgatgtaagccccggctct

SEQ ID NO: 574854 - DNA, 25 bp, Rattus norvegicus
tcacattgatgttagccccggctct

SEQ ID NO: 574855 - DNA, 25 bp, Rattus norvegicus
tcacattgccccactggagaacaag

SEQ ID NO: 574856 - DNA, 25 bp, Rattus norvegicus
tcacattgcccctctggagaacaag

SEQ ID NO: 574857 - DNA, 25 bp, Rattus norvegicus
tcacattggacaatttctggcttgc

SEQ ID NO: 574858 - DNA, 25 bp, Rattus norvegicus
tcacattggacattttctggcttgc

SEQ ID NO: 574859 - DNA, 25 bp, Rattus norvegicus
tcacatttaattatcgcactcaccc

SEQ ID NO: 574860 - DNA, 25 bp, Rattus norvegicus
tcacatttaattttcgcactcaccc

SEQ ID NO: 574861 - DNA, 25 bp, Rattus norvegicus
tcacatttcaaacagcgggagccat

SEQ ID NO: 574862 - DNA, 25 bp, Rattus norvegicus
tcacatttcaaagagcgggagccat

SEQ ID NO: 574863 - DNA, 25 bp, Rattus norvegicus
tcacatttccataaggtcatgcatt

SEQ ID NO: 574864 - DNA, 25 bp, Rattus norvegicus
tcacatttccattaggtcatgcatt

SEQ ID NO: 574865 - DNA, 25 bp, Rattus norvegicus
tcaccaaagcacaagatgtcagaag

SEQ ID NO: 574866 - DNA, 25 bp, Rattus norvegicus
tcaccaaagcactagatgtcagaag

SEQ ID NO: 574867 - DNA, 25 bp, Rattus norvegicus
tcaccaaatacaccagcgctaagta

SEQ ID NO: 574868 - DNA, 25 bp, Rattus norvegicus
tcaccaaatacagcagcgctaagta

SEQ ID NO: 574869 - DNA, 25 bp, Rattus norvegicus
tcaccaaccccacctctttgtgttt

SEQ ID NO: 574870 - DNA, 25 bp, Rattus norvegicus
tcaccaaccccagctctttgtgttt

SEQ ID NO: 574871 - DNA, 25 bp, Rattus norvegicus
tcaccaagacatagacttcctcatt

SEQ ID NO: 574872 - DNA, 25 bp, Rattus norvegicus
tcaccaagacattgacttcctcatt

SEQ ID NO: 574873 - DNA, 25 bp, Rattus norvegicus
tcaccaagactcctttcggaccgaa

SEQ ID NO: 574874 - DNA, 25 bp, Rattus norvegicus
tcaccaagactcgtttcggaccgaa

SEQ ID NO: 574875 - DNA, 25 bp, Rattus norvegicus
tcaccaagagctatgactttcctgc

SEQ ID NO: 574876 - DNA, 25 bp, Rattus norvegicus
tcaccaagagctttgactttcctgc

SEQ ID NO: 574877 - DNA, 25 bp, Rattus norvegicus
tcaccaagctacctgtctggctagg

SEQ ID NO: 574878 - DNA, 25 bp, Rattus norvegicus
tcaccaagctacgtgtctggctagg

SEQ ID NO: 574879 - DNA, 25 bp, Rattus norvegicus
tcaccaagctgtaccagagtgctgg

SEQ ID NO: 574880 - DNA, 25 bp, Rattus norvegicus
tcaccaagctgttccagagtgctgg

SEQ ID NO: 574881 - DNA, 25 bp, Rattus norvegicus
tcaccaaggatgctgaagtcaccat

SEQ ID NO: 574882 - DNA, 25 bp, Rattus norvegicus
tcaccaaggatggtgaagtcaccat

SEQ ID NO: 574883 - DNA, 25 bp, Rattus norvegicus
tcaccaaggcaccttttctttctaa

SEQ ID NO: 574884 - DNA, 25 bp, Rattus norvegicus
tcaccaaggcacgttttctttctaa

SEQ ID NO: 574885 - DNA, 25 bp, Rattus norvegicus
tcaccaaggtgtatgtggtccctgt

SEQ ID NO: 574886 - DNA, 25 bp, Rattus norvegicus
tcaccaaggtgtttgtggtccctgt

SEQ ID NO: 574887 - DNA, 25 bp, Rattus norvegicus
tcaccaagtctccttatcaggaatt

SEQ ID NO: 574888 - DNA, 25 bp, Rattus norvegicus
tcaccaagtctcgttatcaggaatt

SEQ ID NO: 574889 - DNA, 25 bp, Rattus norvegicus
tcaccaagtgctccctttgtggaat

SEQ ID NO: 574890 - DNA, 25 bp, Rattus norvegicus
tcaccaagtgctctagtgggtccct

SEQ ID NO: 574891 - DNA, 25 bp, Rattus norvegicus
tcaccaagtgctgcctttgtggaat

SEQ ID NO: 574892 - DNA, 25 bp, Rattus norvegicus
tcaccaagtgctgtagtgggtccct

SEQ ID NO: 574893 - DNA, 25 bp, Rattus norvegicus
tcaccaatacccattactgttacag

SEQ ID NO: 574894 - DNA, 25 bp, Rattus norvegicus
tcaccaataccctttactgttacag

SEQ ID NO: 574895 - DNA, 25 bp, Rattus norvegicus
tcaccaatcagcagacacgggagtt

SEQ ID NO: 574896 - DNA, 25 bp, Rattus norvegicus
tcaccaatcagctgacacgggagtt

SEQ ID NO: 574897 - DNA, 25 bp, Rattus norvegicus
tcaccaatgcctcgtaaccttcata

SEQ ID NO: 574898 - DNA, 25 bp, Rattus norvegicus
tcaccaatgcctggtaaccttcata

SEQ ID NO: 574899 - DNA, 25 bp, Rattus norvegicus
tcaccaattgctaccttttcttttt

SEQ ID NO: 574900 - DNA, 25 bp, Rattus norvegicus
tcaccaattgcttccttttcttttt

SEQ ID NO: 574901 - DNA, 25 bp, Rattus norvegicus
tcaccacacgtaagtctgtctgatt

SEQ ID NO: 574902 - DNA, 25 bp, Rattus norvegicus
tcaccacacgtatgtctgtctgatt

SEQ ID NO: 574903 - DNA, 25 bp, Rattus norvegicus
tcaccacagcaaaggtctgcatcag

SEQ ID NO: 574904 - DNA, 25 bp, Rattus norvegicus
tcaccacagcaatggtctgcatcag

SEQ ID NO: 574905 - DNA, 25 bp, Rattus norvegicus
tcaccacagcttcttcagtatgttg

SEQ ID NO: 574906 - DNA, 25 bp, Rattus norvegicus
tcaccacagcttgttcagtatgttg

SEQ ID NO: 574907 - DNA, 25 bp, Rattus norvegicus
tcaccacaggaaactgatctccatg

SEQ ID NO: 574908 - DNA, 25 bp, Rattus norvegicus
tcaccacaggaatctgatctccatg

SEQ ID NO: 574909 - DNA, 25 bp, Rattus norvegicus
tcaccacagtttccagtcagccgag

SEQ ID NO: 574910 - DNA, 25 bp, Rattus norvegicus
tcaccacagtttgcagtcagccgag

SEQ ID NO: 574911 - DNA, 25 bp, Rattus norvegicus
tcaccacatggaagccgtcaaactg

SEQ ID NO: 574912 - DNA, 25 bp, Rattus norvegicus
tcaccacatggatgccgtcaaactg

SEQ ID NO: 574913 - DNA, 25 bp, Rattus norvegicus
tcaccacatggtacatcccctttta

SEQ ID NO: 574914 - DNA, 25 bp, Rattus norvegicus
tcaccacatggttcatcccctttta

SEQ ID NO: 574915 - DNA, 25 bp, Rattus norvegicus
tcaccacattgcatctttgtcagag

SEQ ID NO: 574916 - DNA, 25 bp, Rattus norvegicus
tcaccacattgcttctttgtcagag

SEQ ID NO: 574917 - DNA, 25 bp, Rattus norvegicus
tcaccaccaaaaacttcatcttctg

SEQ ID NO: 574918 - DNA, 25 bp, Rattus norvegicus
tcaccaccaaaatcttcatcttctg

SEQ ID NO: 574919 - DNA, 25 bp, Rattus norvegicus
tcaccaccaagaaggtcgtggacaa

SEQ ID NO: 574920 - DNA, 25 bp, Rattus norvegicus
tcaccaccaagatggtcgtggacaa

SEQ ID NO: 574921 - DNA, 25 bp, Rattus norvegicus
tcaccaccatcaatatcctcattat

SEQ ID NO: 574922 - DNA, 25 bp, Rattus norvegicus
tcaccaccatcattatcctcattat

SEQ ID NO: 574923 - DNA, 25 bp, Rattus norvegicus
tcaccacccatgagtatgacggaca

SEQ ID NO: 574924 - DNA, 25 bp, Rattus norvegicus
tcaccacccatgtgtatgacggaca

SEQ ID NO: 574925 - DNA, 25 bp, Rattus norvegicus
tcaccaccctgcacaggatggctta

SEQ ID NO: 574926 - DNA, 25 bp, Rattus norvegicus
tcaccaccctgctcaggatggctta

SEQ ID NO: 574927 - DNA, 25 bp, Rattus norvegicus
tcaccaccgggtagtcagaacttga

SEQ ID NO: 574928 - DNA, 25 bp, Rattus norvegicus
tcaccaccgggttgtcagaacttga

SEQ ID NO: 574929 - DNA, 25 bp, Rattus norvegicus
tcaccacctagccatatctgcaatg

SEQ ID NO: 574930 - DNA, 25 bp, Rattus norvegicus
tcaccacctagcgatatctgcaatg

SEQ ID NO: 574931 - DNA, 25 bp, Rattus norvegicus
tcaccacgatgtcatgttctgccga

SEQ ID NO: 574932 - DNA, 25 bp, Rattus norvegicus
tcaccacgatgtgatgttctgccga

SEQ ID NO: 574933 - DNA, 25 bp, Rattus norvegicus
tcaccacggaggagcctggatcttg

SEQ ID NO: 574934 - DNA, 25 bp, Rattus norvegicus
tcaccacggaggtgcctggatcttg

SEQ ID NO: 574935 - DNA, 25 bp, Rattus norvegicus
tcaccacgtgcacagctgctacagg

SEQ ID NO: 574936 - DNA, 25 bp, Rattus norvegicus
tcaccacgtgcagagctgctacagg

SEQ ID NO: 574937 - DNA, 25 bp, Rattus norvegicus
tcaccactatttaacagaacttccg

SEQ ID NO: 574938 - DNA, 25 bp, Rattus norvegicus
tcaccactattttacagaacttccg

SEQ ID NO: 574939 - DNA, 25 bp, Rattus norvegicus
tcaccactcaggatgtgcctggagc

SEQ ID NO: 574940 - DNA, 25 bp, Rattus norvegicus
tcaccactcaggttgtgcctggagc

SEQ ID NO: 574941 - DNA, 25 bp, Rattus norvegicus
tcaccactccatacatgaccaagta

SEQ ID NO: 574942 - DNA, 25 bp, Rattus norvegicus
tcaccactccattcatgaccaagta

SEQ ID NO: 574943 - DNA, 25 bp, Rattus norvegicus
tcaccactcgccagcaaagtttgga

SEQ ID NO: 574944 - DNA, 25 bp, Rattus norvegicus
tcaccactcgcctgcaaagtttgga

SEQ ID NO: 574945 - DNA, 25 bp, Rattus norvegicus
tcaccactctaactattcaacctaa

SEQ ID NO: 574946 - DNA, 25 bp, Rattus norvegicus
tcaccactctaagtattcaacctaa

SEQ ID NO: 574947 - DNA, 25 bp, Rattus norvegicus
tcaccactctacatggctcaattta

SEQ ID NO: 574948 - DNA, 25 bp, Rattus norvegicus
tcaccactctacttggctcaattta

SEQ ID NO: 574949 - DNA, 25 bp, Rattus norvegicus
tcaccactctctattattccattta

SEQ ID NO: 574950 - DNA, 25 bp, Rattus norvegicus
tcaccactctcttttattccattta

SEQ ID NO: 574951 - DNA, 25 bp, Rattus norvegicus
tcaccactgagcctaacaacttgag

SEQ ID NO: 574952 - DNA, 25 bp, Rattus norvegicus
tcaccactgagcgtaacaacttgag

SEQ ID NO: 574953 - DNA, 25 bp, Rattus norvegicus
tcaccactgccaaagacaccgagaa

SEQ ID NO: 574954 - DNA, 25 bp, Rattus norvegicus
tcaccactgccatagacaccgagaa

SEQ ID NO: 574955 - DNA, 25 bp, Rattus norvegicus
tcaccactgcctctgaatactttca

SEQ ID NO: 574956 - DNA, 25 bp, Rattus norvegicus
tcaccactgcctgtgaatactttca

SEQ ID NO: 574957 - DNA, 25 bp, Rattus norvegicus
tcaccactgcttagtaccttgtttg

SEQ ID NO: 574958 - DNA, 25 bp, Rattus norvegicus
tcaccactgctttgtaccttgtttg

SEQ ID NO: 574959 - DNA, 25 bp, Rattus norvegicus
tcaccactggacacagcttactgat

SEQ ID NO: 574960 - DNA, 25 bp, Rattus norvegicus
tcaccactggactcagcttactgat

SEQ ID NO: 574961 - DNA, 25 bp, Rattus norvegicus
tcaccactggtgaattcagccggtt

SEQ ID NO: 574962 - DNA, 25 bp, Rattus norvegicus
tcaccactggtgtattcagccggtt

SEQ ID NO: 574963 - DNA, 25 bp, Rattus norvegicus
tcaccactgtatatccttgtttaag

SEQ ID NO: 574964 - DNA, 25 bp, Rattus norvegicus
tcaccactgtatttccttgtttaag

SEQ ID NO: 574965 - DNA, 25 bp, Rattus norvegicus
tcaccactgtgtactgtccaaacaa

SEQ ID NO: 574966 - DNA, 25 bp, Rattus norvegicus
tcaccactgtgttctgtccaaacaa

SEQ ID NO: 574967 - DNA, 25 bp, Rattus norvegicus
tcaccacttggtaggaatttctctt

SEQ ID NO: 574968 - DNA, 25 bp, Rattus norvegicus
tcaccacttggttggaatttctctt

SEQ ID NO: 574969 - DNA, 25 bp, Rattus norvegicus
tcaccagaactccatgtttcctgaa

SEQ ID NO: 574970 - DNA, 25 bp, Rattus norvegicus
tcaccagaactcgatgtttcctgaa

SEQ ID NO: 574971 - DNA, 25 bp, Rattus norvegicus
tcaccagacctgagcatgatgcagc

SEQ ID NO: 574972 - DNA, 25 bp, Rattus norvegicus
tcaccagacctgtgcatgatgcagc

SEQ ID NO: 574973 - DNA, 25 bp, Rattus norvegicus
tcaccagaggaaagggcttgcggcc

SEQ ID NO: 574974 - DNA, 25 bp, Rattus norvegicus
tcaccagaggaatgggcttgcggcc

SEQ ID NO: 574975 - DNA, 25 bp, Rattus norvegicus
tcaccagatatactgtctcccaaat

SEQ ID NO: 574976 - DNA, 25 bp, Rattus norvegicus
tcaccagatatagtgtctcccaaat

SEQ ID NO: 574977 - DNA, 25 bp, Rattus norvegicus
tcaccagcaaacacgtcttaaccag

SEQ ID NO: 574978 - DNA, 25 bp, Rattus norvegicus
tcaccagcaaactcgtcttaaccag

SEQ ID NO: 574979 - DNA, 25 bp, Rattus norvegicus
tcaccagcagccacacgatgagcgg

SEQ ID NO: 574980 - DNA, 25 bp, Rattus norvegicus
tcaccagcagccagcgagggaatgt

SEQ ID NO: 574981 - DNA, 25 bp, Rattus norvegicus
tcaccagcagccagggatacttcag

SEQ ID NO: 574982 - DNA, 25 bp, Rattus norvegicus
tcaccagcagcctcacgatgagcgg

SEQ ID NO: 574983 - DNA, 25 bp, Rattus norvegicus
tcaccagcagcctgcgagggaatgt

SEQ ID NO: 574984 - DNA, 25 bp, Rattus norvegicus
tcaccagcagcctgggatacttcag

SEQ ID NO: 574985 - DNA, 25 bp, Rattus norvegicus
tcaccagcagtgaggattgacatga

SEQ ID NO: 574986 - DNA, 25 bp, Rattus norvegicus
tcaccagcagtgtggattgacatga

SEQ ID NO: 574987 - DNA, 25 bp, Rattus norvegicus
tcaccagcccagatctgtgcaataa

SEQ ID NO: 574988 - DNA, 25 bp, Rattus norvegicus
tcaccagcccagttctgtgcaataa

SEQ ID NO: 574989 - DNA, 25 bp, Rattus norvegicus
tcaccagccctccttttagatttta

SEQ ID NO: 574990 - DNA, 25 bp, Rattus norvegicus
tcaccagccctcgttttagatttta

SEQ ID NO: 574991 - DNA, 25 bp, Rattus norvegicus
tcaccagcccttatttctgcagata

SEQ ID NO: 574992 - DNA, 25 bp, Rattus norvegicus
tcaccagcccttttttctgcagata

SEQ ID NO: 574993 - DNA, 25 bp, Rattus norvegicus
tcaccagccgtgaagctgcatgatg

SEQ ID NO: 574994 - DNA, 25 bp, Rattus norvegicus
tcaccagccgtgtagctgcatgatg

SEQ ID NO: 574995 - DNA, 25 bp, Rattus norvegicus
tcaccagcctcaattgcgtggctga

SEQ ID NO: 574996 - DNA, 25 bp, Rattus norvegicus
tcaccagcctcatttgcgtggctga

SEQ ID NO: 574997 - DNA, 25 bp, Rattus norvegicus
tcaccagctaaaatgttcaagttct

SEQ ID NO: 574998 - DNA, 25 bp, Rattus norvegicus
tcaccagctaaattgttcaagttct

SEQ ID NO: 574999 - DNA, 25 bp, Rattus norvegicus
tcaccagctctgcagctcttcaggg

SEQ ID NO: 575000 - DNA, 25 bp, Rattus norvegicus
tcaccagctctggagctcttcaggg

SEQ ID NO: 575001 - DNA, 25 bp, Rattus norvegicus
tcaccagctgctatatttttctatt

SEQ ID NO: 575002 - DNA, 25 bp, Rattus norvegicus
tcaccagctgctttatttttctatt

SEQ ID NO: 575003 - DNA, 25 bp, Rattus norvegicus
tcaccagctggacatctagacaaac

SEQ ID NO: 575004 - DNA, 25 bp, Rattus norvegicus
tcaccagctggagatctagacaaac

SEQ ID NO: 575005 - DNA, 25 bp, Rattus norvegicus
tcaccagctgtcaccaagtgtatac

SEQ ID NO: 575006 - DNA, 25 bp, Rattus norvegicus
tcaccagctgtctccaagtgtatac

SEQ ID NO: 575007 - DNA, 25 bp, Rattus norvegicus
tcaccaggagaaccggaagaccatc

SEQ ID NO: 575008 - DNA, 25 bp, Rattus norvegicus
tcaccaggagaagcggaagaccatc

SEQ ID NO: 575009 - DNA, 25 bp, Rattus norvegicus
tcaccaggcccacgtccaagaagga

SEQ ID NO: 575010 - DNA, 25 bp, Rattus norvegicus
tcaccaggcccaggtccaagaagga

SEQ ID NO: 575011 - DNA, 25 bp, Rattus norvegicus
tcaccaggccttcactctaagaaca

SEQ ID NO: 575012 - DNA, 25 bp, Rattus norvegicus
tcaccaggccttgactctaagaaca

SEQ ID NO: 575013 - DNA, 25 bp, Rattus norvegicus
tcaccagggcacattcaaggtccag

SEQ ID NO: 575014 - DNA, 25 bp, Rattus norvegicus
tcaccagggcactttcaaggtccag

SEQ ID NO: 575015 - DNA, 25 bp, Rattus norvegicus
tcaccaggtagaacaggctgacctt

SEQ ID NO: 575016 - DNA, 25 bp, Rattus norvegicus
tcaccaggtagatcaggctgacctt

SEQ ID NO: 575017 - DNA, 25 bp, Rattus norvegicus
tcaccaggtctcagtgcgcggagtg

SEQ ID NO: 575018 - DNA, 25 bp, Rattus norvegicus
tcaccaggtctctgtgcgcggagtg

SEQ ID NO: 575019 - DNA, 25 bp, Rattus norvegicus
tcaccagtaggtctttatcccgatt

SEQ ID NO: 575020 - DNA, 25 bp, Rattus norvegicus
tcaccagtaggtgtttatcccgatt

SEQ ID NO: 575021 - DNA, 25 bp, Rattus norvegicus
tcaccagtcatgcagtgttcacttc

SEQ ID NO: 575022 - DNA, 25 bp, Rattus norvegicus
tcaccagtcatggagtgttcacttc

SEQ ID NO: 575023 - DNA, 25 bp, Rattus norvegicus
tcaccagtccagcaagtgctcagat

SEQ ID NO: 575024 - DNA, 25 bp, Rattus norvegicus
tcaccagtccaggaagtgctcagat

SEQ ID NO: 575025 - DNA, 25 bp, Rattus norvegicus
tcaccagtccgcctttgaagaggga

SEQ ID NO: 575026 - DNA, 25 bp, Rattus norvegicus
tcaccagtccgcgtttgaagaggga

SEQ ID NO: 575027 - DNA, 25 bp, Rattus norvegicus
tcaccagtgctgaccgacttttgcg

SEQ ID NO: 575028 - DNA, 25 bp, Rattus norvegicus
tcaccagtgctgtccgacttttgcg

SEQ ID NO: 575029 - DNA, 25 bp, Rattus norvegicus
tcaccagtgggaatatatatcatgt

SEQ ID NO: 575030 - DNA, 25 bp, Rattus norvegicus
tcaccagtgggattatatatcatgt

SEQ ID NO: 575031 - DNA, 25 bp, Rattus norvegicus
tcaccagtgtctagggccgaatagc

SEQ ID NO: 575032 - DNA, 25 bp, Rattus norvegicus
tcaccagtgtcttgggccgaatagc

SEQ ID NO: 575033 - DNA, 25 bp, Rattus norvegicus
tcaccagttcttaccggccgggtga

SEQ ID NO: 575034 - DNA, 25 bp, Rattus norvegicus
tcaccagttctttccggccgggtga

SEQ ID NO: 575035 - DNA, 25 bp, Rattus norvegicus
tcaccatcacacagccggaagagtt

SEQ ID NO: 575036 - DNA, 25 bp, Rattus norvegicus
tcaccatcacactgccggaagagtt

SEQ ID NO: 575037 - DNA, 25 bp, Rattus norvegicus
tcaccatcactgctctggataggaa

SEQ ID NO: 575038 - DNA, 25 bp, Rattus norvegicus
tcaccatcactggtctggataggaa

SEQ ID NO: 575039 - DNA, 25 bp, Rattus norvegicus
tcaccatcagagaccaccgaataat

SEQ ID NO: 575040 - DNA, 25 bp, Rattus norvegicus
tcaccatcagagtccaccgaataat

SEQ ID NO: 575041 - DNA, 25 bp, Rattus norvegicus
tcaccatcatctacatctacgagaa

SEQ ID NO: 575042 - DNA, 25 bp, Rattus norvegicus
tcaccatcatcttcatctacgagaa

SEQ ID NO: 575043 - DNA, 25 bp, Rattus norvegicus
tcaccatcgatcagttccagtcctt

SEQ ID NO: 575044 - DNA, 25 bp, Rattus norvegicus
tcaccatcgatctgttccagtcctt

SEQ ID NO: 575045 - DNA, 25 bp, Rattus norvegicus
tcaccatctccaagcttctgggcaa

SEQ ID NO: 575046 - DNA, 25 bp, Rattus norvegicus
tcaccatctccatgcttctgggcaa

SEQ ID NO: 575047 - DNA, 25 bp, Rattus norvegicus
tcaccatctgtcacaagaccgaggt

SEQ ID NO: 575048 - DNA, 25 bp, Rattus norvegicus
tcaccatctgtctcaagaccgaggt

SEQ ID NO: 575049 - DNA, 25 bp, Rattus norvegicus
tcaccatctgttcgatgccctttga

SEQ ID NO: 575050 - DNA, 25 bp, Rattus norvegicus
tcaccatctgttggatgccctttga

SEQ ID NO: 575051 - DNA, 25 bp, Rattus norvegicus
tcaccatcttcaacagagtatccac

SEQ ID NO: 575052 - DNA, 25 bp, Rattus norvegicus
tcaccatcttcatcagagtatccac

SEQ ID NO: 575053 - DNA, 25 bp, Rattus norvegicus
tcaccatcttgtctcactaacttac

SEQ ID NO: 575054 - DNA, 25 bp, Rattus norvegicus
tcaccatcttgtgtcactaacttac

SEQ ID NO: 575055 - DNA, 25 bp, Rattus norvegicus
tcaccatcttttaccgttcaccggg

SEQ ID NO: 575056 - DNA, 25 bp, Rattus norvegicus
tcaccatctttttccgttcaccggg

SEQ ID NO: 575057 - DNA, 25 bp, Rattus norvegicus
tcaccatggaagcagccaactggcc

SEQ ID NO: 575058 - DNA, 25 bp, Rattus norvegicus
tcaccatggaaggagccaactggcc

SEQ ID NO: 575059 - DNA, 25 bp, Rattus norvegicus
tcaccatggagacgtacagtactgc

SEQ ID NO: 575060 - DNA, 25 bp, Rattus norvegicus
tcaccatggagaggtacagtactgc

SEQ ID NO: 575061 - DNA, 25 bp, Rattus norvegicus
tcaccatggcagactgcattctggg

SEQ ID NO: 575062 - DNA, 25 bp, Rattus norvegicus
tcaccatggcagtctgcattctggg

SEQ ID NO: 575063 - DNA, 25 bp, Rattus norvegicus
tcaccatggtgacgagcatcctcat

SEQ ID NO: 575064 - DNA, 25 bp, Rattus norvegicus
tcaccatggtgaggagcatcctcat

SEQ ID NO: 575065 - DNA, 25 bp, Rattus norvegicus
tcaccatggttgcagcacaaagcaa

SEQ ID NO: 575066 - DNA, 25 bp, Rattus norvegicus
tcaccatggttggagcacaaagcaa

SEQ ID NO: 575067 - DNA, 25 bp, Rattus norvegicus
tcaccattagtgactccagggactg

SEQ ID NO: 575068 - DNA, 25 bp, Rattus norvegicus
tcaccattagtgtctccagggactg

SEQ ID NO: 575069 - DNA, 25 bp, Rattus norvegicus
tcaccattgaacaagtgccacctca

SEQ ID NO: 575070 - DNA, 25 bp, Rattus norvegicus
tcaccattgaactagtgccacctca

SEQ ID NO: 575071 - DNA, 25 bp, Rattus norvegicus
tcaccattgggaacgcgagcggagt

SEQ ID NO: 575072 - DNA, 25 bp, Rattus norvegicus
tcaccattgggatcgcgagcggagt

SEQ ID NO: 575073 - DNA, 25 bp, Rattus norvegicus
tcaccattggtgctaagctgcagga

SEQ ID NO: 575074 - DNA, 25 bp, Rattus norvegicus
tcaccattggtggtaagctgcagga

SEQ ID NO: 575075 - DNA, 25 bp, Rattus norvegicus
tcaccatttccaactctaaccaaga

SEQ ID NO: 575076 - DNA, 25 bp, Rattus norvegicus
tcaccatttccatctctaaccaaga

SEQ ID NO: 575077 - DNA, 25 bp, Rattus norvegicus
tcaccatttgatcatcttcatccac

SEQ ID NO: 575078 - DNA, 25 bp, Rattus norvegicus
tcaccatttgatgatcttcatccac

SEQ ID NO: 575079 - DNA, 25 bp, Rattus norvegicus
tcacccaaagtccatgaccttgata

SEQ ID NO: 575080 - DNA, 25 bp, Rattus norvegicus
tcacccaaagtcgatgaccttgata

SEQ ID NO: 575081 - DNA, 25 bp, Rattus norvegicus
tcacccaaggagataaacatgaaat

SEQ ID NO: 575082 - DNA, 25 bp, Rattus norvegicus
tcacccaaggagttaaacatgaaat

SEQ ID NO: 575083 - DNA, 25 bp, Rattus norvegicus
tcacccaagtcacttccttgagtaa

SEQ ID NO: 575084 - DNA, 25 bp, Rattus norvegicus
tcacccaagtcagttccttgagtaa

SEQ ID NO: 575085 - DNA, 25 bp, Rattus norvegicus
tcacccaagtggagagtttttacgg

SEQ ID NO: 575086 - DNA, 25 bp, Rattus norvegicus
tcacccaagtggtgagtttttacgg

SEQ ID NO: 575087 - DNA, 25 bp, Rattus norvegicus
tcacccaagtgtctgtatttatcct

SEQ ID NO: 575088 - DNA, 25 bp, Rattus norvegicus
tcacccaagtgtgtgtatttatcct

SEQ ID NO: 575089 - DNA, 25 bp, Rattus norvegicus
tcacccaatattccccattagctta

SEQ ID NO: 575090 - DNA, 25 bp, Rattus norvegicus
tcacccaatattgcccattagctta

SEQ ID NO: 575091 - DNA, 25 bp, Rattus norvegicus
tcacccaatgttcgtccttaagagt

SEQ ID NO: 575092 - DNA, 25 bp, Rattus norvegicus
tcacccaatgttggtccttaagagt

SEQ ID NO: 575093 - DNA, 25 bp, Rattus norvegicus
tcacccacaatgaccacttttggaa

SEQ ID NO: 575094 - DNA, 25 bp, Rattus norvegicus
tcacccacaatgtccacttttggaa

SEQ ID NO: 575095 - DNA, 25 bp, Rattus norvegicus
tcacccacacggagcgcaggaagga

SEQ ID NO: 575096 - DNA, 25 bp, Rattus norvegicus
tcacccacacggtgcgcaggaagga

SEQ ID NO: 575097 - DNA, 25 bp, Rattus norvegicus
tcacccacagttctggcattgctga

SEQ ID NO: 575098 - DNA, 25 bp, Rattus norvegicus
tcacccacagttgtggcattgctga

SEQ ID NO: 575099 - DNA, 25 bp, Rattus norvegicus
tcacccacatccatattgttgcagg

SEQ ID NO: 575100 - DNA, 25 bp, Rattus norvegicus
tcacccacatccttattgttgcagg

SEQ ID NO: 575101 - DNA, 25 bp, Rattus norvegicus
tcacccacctcgaggatgagatcaa

SEQ ID NO: 575102 - DNA, 25 bp, Rattus norvegicus
tcacccacctcgtggatgagatcaa

SEQ ID NO: 575103 - DNA, 25 bp, Rattus norvegicus
tcacccagacctacatgagctgtaa

SEQ ID NO: 575104 - DNA, 25 bp, Rattus norvegicus
tcacccagaccttcatgagctgtaa

SEQ ID NO: 575105 - DNA, 25 bp, Rattus norvegicus
tcacccagagggagcagagactaca

SEQ ID NO: 575106 - DNA, 25 bp, Rattus norvegicus
tcacccagagggtgcagagactaca

SEQ ID NO: 575107 - DNA, 25 bp, Rattus norvegicus
tcacccagcaacaccacagagatgg

SEQ ID NO: 575108 - DNA, 25 bp, Rattus norvegicus
tcacccagcaactccacagagatgg

SEQ ID NO: 575109 - DNA, 25 bp, Rattus norvegicus
tcacccagcaagaccgagctgtgaa

SEQ ID NO: 575110 - DNA, 25 bp, Rattus norvegicus
tcacccagcaagtccgagctgtgaa

SEQ ID NO: 575111 - DNA, 25 bp, Rattus norvegicus
tcacccagccttctagtgtttttaa

SEQ ID NO: 575112 - DNA, 25 bp, Rattus norvegicus
tcacccagccttgtagtgtttttaa

SEQ ID NO: 575113 - DNA, 25 bp, Rattus norvegicus
tcacccagggcacgcaggtgactgt

SEQ ID NO: 575114 - DNA, 25 bp, Rattus norvegicus
tcacccagggcaggcaggtgactgt

SEQ ID NO: 575115 - DNA, 25 bp, Rattus norvegicus
tcacccagggtcaccatgtgtggaa

SEQ ID NO: 575116 - DNA, 25 bp, Rattus norvegicus
tcacccagggtctccatgtgtggaa

SEQ ID NO: 575117 - DNA, 25 bp, Rattus norvegicus
tcacccagggtgatgcttgcagagg

SEQ ID NO: 575118 - DNA, 25 bp, Rattus norvegicus
tcacccagggtgttgcttgcagagg

SEQ ID NO: 575119 - DNA, 25 bp, Rattus norvegicus
tcacccaggtgcaatcagatgacca

SEQ ID NO: 575120 - DNA, 25 bp, Rattus norvegicus
tcacccaggtgctatcagatgacca

SEQ ID NO: 575121 - DNA, 25 bp, Rattus norvegicus
tcacccatagccagcataagtggtt

SEQ ID NO: 575122 - DNA, 25 bp, Rattus norvegicus
tcacccatagcctgcataagtggtt

SEQ ID NO: 575123 - DNA, 25 bp, Rattus norvegicus
tcacccatcaagaggtaccgttttt

SEQ ID NO: 575124 - DNA, 25 bp, Rattus norvegicus
tcacccatcaagtggtaccgttttt

SEQ ID NO: 575125 - DNA, 25 bp, Rattus norvegicus
tcacccatcctgattcttgtgttat

SEQ ID NO: 575126 - DNA, 25 bp, Rattus norvegicus
tcacccatcctgtttcttgtgttat

SEQ ID NO: 575127 - DNA, 25 bp, Rattus norvegicus
tcacccattacaagcatcctgttaa

SEQ ID NO: 575128 - DNA, 25 bp, Rattus norvegicus
tcacccattacatgcatcctgttaa

SEQ ID NO: 575129 - DNA, 25 bp, Rattus norvegicus
tcacccattcatcgtgcagttcaat

SEQ ID NO: 575130 - DNA, 25 bp, Rattus norvegicus
tcacccattcatggtgcagttcaat

SEQ ID NO: 575131 - DNA, 25 bp, Rattus norvegicus
tcaccccaatgcagtacaaggccat

SEQ ID NO: 575132 - DNA, 25 bp, Rattus norvegicus
tcaccccaatgctgtacaaggccat

SEQ ID NO: 575133 - DNA, 25 bp, Rattus norvegicus
tcaccccacaggacctagagaggat

SEQ ID NO: 575134 - DNA, 25 bp, Rattus norvegicus
tcaccccacaggtcctagagaggat

SEQ ID NO: 575135 - DNA, 25 bp, Rattus norvegicus
tcaccccacgacagcagggtagaag

SEQ ID NO: 575136 - DNA, 25 bp, Rattus norvegicus
tcaccccacgactgcagggtagaag

SEQ ID NO: 575137 - DNA, 25 bp, Rattus norvegicus
tcaccccacttgaaagcttcagggt

SEQ ID NO: 575138 - DNA, 25 bp, Rattus norvegicus
tcaccccacttgtaagcttcagggt

SEQ ID NO: 575139 - DNA, 25 bp, Rattus norvegicus
tcaccccagcagcatgtttcagtgg

SEQ ID NO: 575140 - DNA, 25 bp, Rattus norvegicus
tcaccccagcaggatgtttcagtgg

SEQ ID NO: 575141 - DNA, 25 bp, Rattus norvegicus
tcaccccagcccatagagtagagga

SEQ ID NO: 575142 - DNA, 25 bp, Rattus norvegicus
tcaccccagcccttagagtagagga

SEQ ID NO: 575143 - DNA, 25 bp, Rattus norvegicus
tcaccccaggataagctcagcagaa

SEQ ID NO: 575144 - DNA, 25 bp, Rattus norvegicus
tcaccccaggattagctcagcagaa

SEQ ID NO: 575145 - DNA, 25 bp, Rattus norvegicus
tcaccccagggacagcttgataaat

SEQ ID NO: 575146 - DNA, 25 bp, Rattus norvegicus
tcaccccagggacagtatctaccag

SEQ ID NO: 575147 - DNA, 25 bp, Rattus norvegicus
tcaccccagggagagcttgataaat

SEQ ID NO: 575148 - DNA, 25 bp, Rattus norvegicus
tcaccccagggagagtatctaccag

SEQ ID NO: 575149 - DNA, 25 bp, Rattus norvegicus
tcaccccaggttctgattttaccgg

SEQ ID NO: 575150 - DNA, 25 bp, Rattus norvegicus
tcaccccaggttgtgattttaccgg

SEQ ID NO: 575151 - DNA, 25 bp, Rattus norvegicus
tcaccccagtagagatggcgcaggt

SEQ ID NO: 575152 - DNA, 25 bp, Rattus norvegicus
tcaccccagtagtgatggcgcaggt

SEQ ID NO: 575153 - DNA, 25 bp, Rattus norvegicus
tcaccccagtcaagcacatctgatg

SEQ ID NO: 575154 - DNA, 25 bp, Rattus norvegicus
tcaccccagtcatgcacatctgatg

SEQ ID NO: 575155 - DNA, 25 bp, Rattus norvegicus
tcaccccatataaggccaagtccag

SEQ ID NO: 575156 - DNA, 25 bp, Rattus norvegicus
tcaccccatatatggccaagtccag

SEQ ID NO: 575157 - DNA, 25 bp, Rattus norvegicus
tcaccccatcaccaggcaggaaggg

SEQ ID NO: 575158 - DNA, 25 bp, Rattus norvegicus
tcaccccatcacgaggcaggaaggg

SEQ ID NO: 575159 - DNA, 25 bp, Rattus norvegicus
tcaccccattccatatgttgaacaa

SEQ ID NO: 575160 - DNA, 25 bp, Rattus norvegicus
tcaccccattccttatgttgaacaa

SEQ ID NO: 575161 - DNA, 25 bp, Rattus norvegicus
tcaccccgaactcttggccaaaaag

SEQ ID NO: 575162 - DNA, 25 bp, Rattus norvegicus
tcaccccgaactgttggccaaaaag

SEQ ID NO: 575163 - DNA, 25 bp, Rattus norvegicus
tcaccccggtgcagttcgtggagga

SEQ ID NO: 575164 - DNA, 25 bp, Rattus norvegicus
tcaccccggtgctgttcgtggagga

SEQ ID NO: 575165 - DNA, 25 bp, Rattus norvegicus
tcaccccgtcttacacaggagagaa

SEQ ID NO: 575166 - DNA, 25 bp, Rattus norvegicus
tcaccccgtcttcctgtgtcagtag

SEQ ID NO: 575167 - DNA, 25 bp, Rattus norvegicus
tcaccccgtcttgctgtgtcagtag

SEQ ID NO: 575168 - DNA, 25 bp, Rattus norvegicus
tcaccccgtctttcacaggagagaa

SEQ ID NO: 575169 - DNA, 25 bp, Rattus norvegicus
tcacccctcattaggatgattccat

SEQ ID NO: 575170 - DNA, 25 bp, Rattus norvegicus
tcacccctcatttggatgattccat

SEQ ID NO: 575171 - DNA, 25 bp, Rattus norvegicus
tcacccctggaacttgccaagcaga

SEQ ID NO: 575172 - DNA, 25 bp, Rattus norvegicus
tcacccctggaagttgccaagcaga

SEQ ID NO: 575173 - DNA, 25 bp, Rattus norvegicus
tcaccccttctcagtgtactttttg

SEQ ID NO: 575174 - DNA, 25 bp, Rattus norvegicus
tcaccccttctctgtgtactttttg

SEQ ID NO: 575175 - DNA, 25 bp, Rattus norvegicus
tcaccccttcttacagctaatggaa

SEQ ID NO: 575176 - DNA, 25 bp, Rattus norvegicus
tcaccccttctttcagctaatggaa

SEQ ID NO: 575177 - DNA, 25 bp, Rattus norvegicus
tcaccccttttgatttgaagagtcg

SEQ ID NO: 575178 - DNA, 25 bp, Rattus norvegicus
tcaccccttttgttttgaagagtcg

SEQ ID NO: 575179 - DNA, 25 bp, Rattus norvegicus
tcacccctttttacggcatagaatt

SEQ ID NO: 575180 - DNA, 25 bp, Rattus norvegicus
tcaccccttttttcggcatagaatt

SEQ ID NO: 575181 - DNA, 25 bp, Rattus norvegicus
tcacccgaaaccatgctgttcaaaa

SEQ ID NO: 575182 - DNA, 25 bp, Rattus norvegicus
tcacccgaaaccttgctgttcaaaa

SEQ ID NO: 575183 - DNA, 25 bp, Rattus norvegicus
tcacccgaacgaagtaagagacccc

SEQ ID NO: 575184 - DNA, 25 bp, Rattus norvegicus
tcacccgaacgatgtaagagacccc

SEQ ID NO: 575185 - DNA, 25 bp, Rattus norvegicus
tcacccgagtcacgtttgggcggaa

SEQ ID NO: 575186 - DNA, 25 bp, Rattus norvegicus
tcacccgagtcaggtttgggcggaa

SEQ ID NO: 575187 - DNA, 25 bp, Rattus norvegicus
tcacccgcagggagccgaagaaagg

SEQ ID NO: 575188 - DNA, 25 bp, Rattus norvegicus
tcacccgcagggtgccgaagaaagg

SEQ ID NO: 575189 - DNA, 25 bp, Rattus norvegicus
tcacccgccaagaagcgcacggtgg

SEQ ID NO: 575190 - DNA, 25 bp, Rattus norvegicus
tcacccgccaagtagcgcacggtgg

SEQ ID NO: 575191 - DNA, 25 bp, Rattus norvegicus
tcacccgggcagcatccagtaaata

SEQ ID NO: 575192 - DNA, 25 bp, Rattus norvegicus
tcacccgggcaggatccagtaaata

SEQ ID NO: 575193 - DNA, 25 bp, Rattus norvegicus
tcacccgtgcccatggattagctgg

SEQ ID NO: 575194 - DNA, 25 bp, Rattus norvegicus
tcacccgtgcccttggattagctgg

SEQ ID NO: 575195 - DNA, 25 bp, Rattus norvegicus
tcacccgtgtgtcgtgacctgtaca

SEQ ID NO: 575196 - DNA, 25 bp, Rattus norvegicus
tcacccgtgtgtggtgacctgtaca

SEQ ID NO: 575197 - DNA, 25 bp, Rattus norvegicus
tcacccgttttgagcccagaaagct

SEQ ID NO: 575198 - DNA, 25 bp, Rattus norvegicus
tcacccgttttgtgcccagaaagct

SEQ ID NO: 575199 - DNA, 25 bp, Rattus norvegicus
tcaccctagcagctgaggctggctt

SEQ ID NO: 575200 - DNA, 25 bp, Rattus norvegicus
tcaccctagcaggtgaggctggctt

SEQ ID NO: 575201 - DNA, 25 bp, Rattus norvegicus
tcaccctaggttacaatggtctcca

SEQ ID NO: 575202 - DNA, 25 bp, Rattus norvegicus
tcaccctaggtttcaatggtctcca

SEQ ID NO: 575203 - DNA, 25 bp, Rattus norvegicus
tcaccctcatctagttcatactgat

SEQ ID NO: 575204 - DNA, 25 bp, Rattus norvegicus
tcaccctcatcttgttcatactgat

SEQ ID NO: 575205 - DNA, 25 bp, Rattus norvegicus
tcaccctccaaaagttcaacggcag

SEQ ID NO: 575206 - DNA, 25 bp, Rattus norvegicus
tcaccctccaaatgttcaacggcag

SEQ ID NO: 575207 - DNA, 25 bp, Rattus norvegicus
tcaccctcgtgaattctagttgcag

SEQ ID NO: 575208 - DNA, 25 bp, Rattus norvegicus
tcaccctcgtgatttctagttgcag

SEQ ID NO: 575209 - DNA, 25 bp, Rattus norvegicus
tcaccctgactccaagcacaatttt

SEQ ID NO: 575210 - DNA, 25 bp, Rattus norvegicus
tcaccctgactcgaagcacaatttt

SEQ ID NO: 575211 - DNA, 25 bp, Rattus norvegicus
tcaccctgatgaattactccggttt

SEQ ID NO: 575212 - DNA, 25 bp, Rattus norvegicus
tcaccctgatgatttactccggttt

SEQ ID NO: 575213 - DNA, 25 bp, Rattus norvegicus
tcaccctgcaggatgtccttcatga

SEQ ID NO: 575214 - DNA, 25 bp, Rattus norvegicus
tcaccctgcaggttgtccttcatga

SEQ ID NO: 575215 - DNA, 25 bp, Rattus norvegicus
tcaccctgcgagcagtcatcagctg

SEQ ID NO: 575216 - DNA, 25 bp, Rattus norvegicus
tcaccctgcgaggagtcatcagctg

SEQ ID NO: 575217 - DNA, 25 bp, Rattus norvegicus
tcaccctgcggaagctgatgcatgg

SEQ ID NO: 575218 - DNA, 25 bp, Rattus norvegicus
tcaccctgcggatgctgatgcatgg

SEQ ID NO: 575219 - DNA, 25 bp, Rattus norvegicus
tcaccctgcggtcacagggacagct

SEQ ID NO: 575220 - DNA, 25 bp, Rattus norvegicus
tcaccctgcggtgacagggacagct

SEQ ID NO: 575221 - DNA, 25 bp, Rattus norvegicus
tcaccctgctgcagtagtcatgaaa

SEQ ID NO: 575222 - DNA, 25 bp, Rattus norvegicus
tcaccctgctgctgtagtcatgaaa

SEQ ID NO: 575223 - DNA, 25 bp, Rattus norvegicus
tcaccctggaggatcatagttattg

SEQ ID NO: 575224 - DNA, 25 bp, Rattus norvegicus
tcaccctggaggttcatagttattg

SEQ ID NO: 575225 - DNA, 25 bp, Rattus norvegicus
tcaccctggcggactacttttaagg

SEQ ID NO: 575226 - DNA, 25 bp, Rattus norvegicus
tcaccctggcggtctacttttaagg

SEQ ID NO: 575227 - DNA, 25 bp, Rattus norvegicus
tcaccctgtcacctcacagagagag

SEQ ID NO: 575228 - DNA, 25 bp, Rattus norvegicus
tcaccctgtcacgtcacagagagag

SEQ ID NO: 575229 - DNA, 25 bp, Rattus norvegicus
tcaccctgtcataactgcatactga

SEQ ID NO: 575230 - DNA, 25 bp, Rattus norvegicus
tcaccctgtcattactgcatactga

SEQ ID NO: 575231 - DNA, 25 bp, Rattus norvegicus
tcaccctgtcctccatagtagaaac

SEQ ID NO: 575232 - DNA, 25 bp, Rattus norvegicus
tcaccctgtcctgcatagtagaaac

SEQ ID NO: 575233 - DNA, 25 bp, Rattus norvegicus
tcacccttcgcccttctgtttttcg

SEQ ID NO: 575234 - DNA, 25 bp, Rattus norvegicus
tcacccttcgccgttctgtttttcg

SEQ ID NO: 575235 - DNA, 25 bp, Rattus norvegicus
tcacccttctgaactatttggcttc

SEQ ID NO: 575236 - DNA, 25 bp, Rattus norvegicus
tcacccttctgatctatttggcttc

SEQ ID NO: 575237 - DNA, 25 bp, Rattus norvegicus
tcacccttgactacctggcaagttt

SEQ ID NO: 575238 - DNA, 25 bp, Rattus norvegicus
tcacccttgacttcctggcaagttt

SEQ ID NO: 575239 - DNA, 25 bp, Rattus norvegicus
tcacccttgtctattctgagaactg

SEQ ID NO: 575240 - DNA, 25 bp, Rattus norvegicus
tcacccttgtcttttctgagaactg

SEQ ID NO: 575241 - DNA, 25 bp, Rattus norvegicus
tcaccctttagaccactgatcagga

SEQ ID NO: 575242 - DNA, 25 bp, Rattus norvegicus
tcaccctttagagcactgatcagga

SEQ ID NO: 575243 - DNA, 25 bp, Rattus norvegicus
tcaccctttggtctttgtaatgtcc

SEQ ID NO: 575244 - DNA, 25 bp, Rattus norvegicus
tcaccctttggtgtttgtaatgtcc

SEQ ID NO: 575245 - DNA, 25 bp, Rattus norvegicus
tcacccttttcccaaagaagcatca

SEQ ID NO: 575246 - DNA, 25 bp, Rattus norvegicus
tcacccttttccgaaagaagcatca

SEQ ID NO: 575247 - DNA, 25 bp, Rattus norvegicus
tcaccgaccttgactactggaagtg

SEQ ID NO: 575248 - DNA, 25 bp, Rattus norvegicus
tcaccgaccttgtctactggaagtg

SEQ ID NO: 575249 - DNA, 25 bp, Rattus norvegicus
tcaccgacgagccaattgtgctttt

SEQ ID NO: 575250 - DNA, 25 bp, Rattus norvegicus
tcaccgacgagcgaattgtgctttt

SEQ ID NO: 575251 - DNA, 25 bp, Rattus norvegicus
tcaccgactcccatggaaagacttt

SEQ ID NO: 575252 - DNA, 25 bp, Rattus norvegicus
tcaccgactcccttggaaagacttt

SEQ ID NO: 575253 - DNA, 25 bp, Rattus norvegicus
tcaccgactccgacattctagtttg

SEQ ID NO: 575254 - DNA, 25 bp, Rattus norvegicus
tcaccgactccgtcattctagtttg

SEQ ID NO: 575255 - DNA, 25 bp, Rattus norvegicus
tcaccgagaagtacttgcgcgcctg

SEQ ID NO: 575256 - DNA, 25 bp, Rattus norvegicus
tcaccgagaagttcttgcgcgcctg

SEQ ID NO: 575257 - DNA, 25 bp, Rattus norvegicus
tcaccgagctctcttgacgagcaat

SEQ ID NO: 575258 - DNA, 25 bp, Rattus norvegicus
tcaccgagctctgttgacgagcaat

SEQ ID NO: 575259 - DNA, 25 bp, Rattus norvegicus
tcaccgaggcggcagagaagaccaa

SEQ ID NO: 575260 - DNA, 25 bp, Rattus norvegicus
tcaccgaggcgggagagaagaccaa

SEQ ID NO: 575261 - DNA, 25 bp, Rattus norvegicus
tcaccgagtcggagaagcggccgtt

SEQ ID NO: 575262 - DNA, 25 bp, Rattus norvegicus
tcaccgagtcggtgaagcggccgtt

SEQ ID NO: 575263 - DNA, 25 bp, Rattus norvegicus
tcaccgatctttcccgagaaagagt

SEQ ID NO: 575264 - DNA, 25 bp, Rattus norvegicus
tcaccgatctttgccgagaaagagt

SEQ ID NO: 575265 - DNA, 25 bp, Rattus norvegicus
tcaccgcaatgacgttgttccctaa

SEQ ID NO: 575266 - DNA, 25 bp, Rattus norvegicus
tcaccgcaatgaggttgttccctaa

SEQ ID NO: 575267 - DNA, 25 bp, Rattus norvegicus
tcaccgcatgatagagactggcctc

SEQ ID NO: 575268 - DNA, 25 bp, Rattus norvegicus
tcaccgcatgattgagactggcctc

SEQ ID NO: 575269 - DNA, 25 bp, Rattus norvegicus
tcaccgcatgcaccttacttcggtt

SEQ ID NO: 575270 - DNA, 25 bp, Rattus norvegicus
tcaccgcatgcagcttacttcggtt

SEQ ID NO: 575271 - DNA, 25 bp, Rattus norvegicus
tcaccgcccatgagtaagacagaca

SEQ ID NO: 575272 - DNA, 25 bp, Rattus norvegicus
tcaccgcccatgtgtaagacagaca

SEQ ID NO: 575273 - DNA, 25 bp, Rattus norvegicus
tcaccgcctctgaaagttctgaaga

SEQ ID NO: 575274 - DNA, 25 bp, Rattus norvegicus
tcaccgcctctgtaagttctgaaga

SEQ ID NO: 575275 - DNA, 25 bp, Rattus norvegicus
tcaccgcctttcagacttgtggaaa

SEQ ID NO: 575276 - DNA, 25 bp, Rattus norvegicus
tcaccgcctttctgacttgtggaaa

SEQ ID NO: 575277 - DNA, 25 bp, Rattus norvegicus
tcaccgcggtgaagacgttccttaa

SEQ ID NO: 575278 - DNA, 25 bp, Rattus norvegicus
tcaccgcggtgatgacgttccttaa

SEQ ID NO: 575279 - DNA, 25 bp, Rattus norvegicus
tcaccgctcctcaaaatgtcaaatt

SEQ ID NO: 575280 - DNA, 25 bp, Rattus norvegicus
tcaccgctcctctaaatgtcaaatt

SEQ ID NO: 575281 - DNA, 25 bp, Rattus norvegicus
tcaccgctggaaatttgatgacctt

SEQ ID NO: 575282 - DNA, 25 bp, Rattus norvegicus
tcaccgctggaattttgatgacctt

SEQ ID NO: 575283 - DNA, 25 bp, Rattus norvegicus
tcaccgctgggcatctgtgctgagg

SEQ ID NO: 575284 - DNA, 25 bp, Rattus norvegicus
tcaccgctgggcttctgtgctgagg

SEQ ID NO: 575285 - DNA, 25 bp, Rattus norvegicus
tcaccggagggccatatgtttgcat

SEQ ID NO: 575286 - DNA, 25 bp, Rattus norvegicus
tcaccggagggcgatatgtttgcat

SEQ ID NO: 575287 - DNA, 25 bp, Rattus norvegicus
tcaccggcgggccagtctctgaaga

SEQ ID NO: 575288 - DNA, 25 bp, Rattus norvegicus
tcaccggcgggcgagtctctgaaga

SEQ ID NO: 575289 - DNA, 25 bp, Rattus norvegicus
tcaccggctggcagtggataactta

SEQ ID NO: 575290 - DNA, 25 bp, Rattus norvegicus
tcaccggctggctgtggataactta

SEQ ID NO: 575291 - DNA, 25 bp, Rattus norvegicus
tcaccggcttatagaaactctcaaa

SEQ ID NO: 575292 - DNA, 25 bp, Rattus norvegicus
tcaccggcttattgaaactctcaaa

SEQ ID NO: 575293 - DNA, 25 bp, Rattus norvegicus
tcaccgggacctaaatgtacacaga

SEQ ID NO: 575294 - DNA, 25 bp, Rattus norvegicus
tcaccgggaccttaatgtacacaga

SEQ ID NO: 575295 - DNA, 25 bp, Rattus norvegicus
tcaccggtcgcgaccttagggaggc

SEQ ID NO: 575296 - DNA, 25 bp, Rattus norvegicus
tcaccggtcgcgtccttagggaggc

SEQ ID NO: 575297 - DNA, 25 bp, Rattus norvegicus
tcaccggtggttatcttagcagaca

SEQ ID NO: 575298 - DNA, 25 bp, Rattus norvegicus
tcaccggtggttttcttagcagaca

SEQ ID NO: 575299 - DNA, 25 bp, Rattus norvegicus
tcaccgtcaccaaggtgcgaatgaa

SEQ ID NO: 575300 - DNA, 25 bp, Rattus norvegicus
tcaccgtcaccatggtgcgaatgaa

SEQ ID NO: 575301 - DNA, 25 bp, Rattus norvegicus
tcaccgtcaggcagtgggatccaaa

SEQ ID NO: 575302 - DNA, 25 bp, Rattus norvegicus
tcaccgtcaggctgtgggatccaaa

SEQ ID NO: 575303 - DNA, 25 bp, Rattus norvegicus
tcaccgtcctcacaggtaacatgga

SEQ ID NO: 575304 - DNA, 25 bp, Rattus norvegicus
tcaccgtcctcagaggtaacatgga

SEQ ID NO: 575305 - DNA, 25 bp, Rattus norvegicus
tcaccgtctggtatgcttgtttaaa

SEQ ID NO: 575306 - DNA, 25 bp, Rattus norvegicus
tcaccgtctggtttgcttgtttaaa

SEQ ID NO: 575307 - DNA, 25 bp, Rattus norvegicus
tcaccgtcttccatttccgggagtt

SEQ ID NO: 575308 - DNA, 25 bp, Rattus norvegicus
tcaccgtcttccttttccgggagtt

SEQ ID NO: 575309 - DNA, 25 bp, Rattus norvegicus
tcaccgtgcttcatgtttactactt

SEQ ID NO: 575310 - DNA, 25 bp, Rattus norvegicus
tcaccgtgcttcttgtttactactt

SEQ ID NO: 575311 - DNA, 25 bp, Rattus norvegicus
tcaccgtgtccacgaacgggattgc

SEQ ID NO: 575312 - DNA, 25 bp, Rattus norvegicus
tcaccgtgtccaggaacgggattgc

SEQ ID NO: 575313 - DNA, 25 bp, Rattus norvegicus
tcaccgtgttccacattattgcgat

SEQ ID NO: 575314 - DNA, 25 bp, Rattus norvegicus
tcaccgtgttcctcattattgcgat

SEQ ID NO: 575315 - DNA, 25 bp, Rattus norvegicus
tcaccgttacctccagaaggcattg

SEQ ID NO: 575316 - DNA, 25 bp, Rattus norvegicus
tcaccgttacctgcagaaggcattg

SEQ ID NO: 575317 - DNA, 25 bp, Rattus norvegicus
tcaccgttctccacagatgaatttg

SEQ ID NO: 575318 - DNA, 25 bp, Rattus norvegicus
tcaccgttctcctcagatgaatttg

SEQ ID NO: 575319 - DNA, 25 bp, Rattus norvegicus
tcaccgttctgtcggctttgaatag

SEQ ID NO: 575320 - DNA, 25 bp, Rattus norvegicus
tcaccgttctgtgggctttgaatag

SEQ ID NO: 575321 - DNA, 25 bp, Rattus norvegicus
tcaccgttcttcctggagctagaag

SEQ ID NO: 575322 - DNA, 25 bp, Rattus norvegicus
tcaccgttcttcgtggagctagaag

SEQ ID NO: 575323 - DNA, 25 bp, Rattus norvegicus
tcaccgttgcgcagttggtgtaggt

SEQ ID NO: 575324 - DNA, 25 bp, Rattus norvegicus
tcaccgttgcgctgttggtgtaggt

SEQ ID NO: 575325 - DNA, 25 bp, Rattus norvegicus
tcacctaaacatcctgtccctaata

SEQ ID NO: 575326 - DNA, 25 bp, Rattus norvegicus
tcacctaaacatgctgtccctaata

SEQ ID NO: 575327 - DNA, 25 bp, Rattus norvegicus
tcacctaagctcacactatttggaa

SEQ ID NO: 575328 - DNA, 25 bp, Rattus norvegicus
tcacctaagctctcactatttggaa

SEQ ID NO: 575329 - DNA, 25 bp, Rattus norvegicus
tcacctacaatcacacaggaccagt

SEQ ID NO: 575330 - DNA, 25 bp, Rattus norvegicus
tcacctacaatctcacaggaccagt

SEQ ID NO: 575331 - DNA, 25 bp, Rattus norvegicus
tcacctaccttgcagatccctgaaa

SEQ ID NO: 575332 - DNA, 25 bp, Rattus norvegicus
tcacctaccttggagatccctgaaa

SEQ ID NO: 575333 - DNA, 25 bp, Rattus norvegicus
tcacctacgcaaaggagtggacatt

SEQ ID NO: 575334 - DNA, 25 bp, Rattus norvegicus
tcacctacgcaatggagtggacatt

SEQ ID NO: 575335 - DNA, 25 bp, Rattus norvegicus
tcacctacgctgcatcttgctaaag

SEQ ID NO: 575336 - DNA, 25 bp, Rattus norvegicus
tcacctacgctggatcttgctaaag

SEQ ID NO: 575337 - DNA, 25 bp, Rattus norvegicus
tcacctacgtgcaatcgctgtacaa

SEQ ID NO: 575338 - DNA, 25 bp, Rattus norvegicus
tcacctacgtgctatcgctgtacaa

SEQ ID NO: 575339 - DNA, 25 bp, Rattus norvegicus
tcacctactcctaagaccagttgta

SEQ ID NO: 575340 - DNA, 25 bp, Rattus norvegicus
tcacctactccttagaccagttgta

SEQ ID NO: 575341 - DNA, 25 bp, Rattus norvegicus
tcacctactgtaactgttaaccctt

SEQ ID NO: 575342 - DNA, 25 bp, Rattus norvegicus
tcacctactgtatctgttaaccctt

SEQ ID NO: 575343 - DNA, 25 bp, Rattus norvegicus
tcacctactttgcactgatggatgg

SEQ ID NO: 575344 - DNA, 25 bp, Rattus norvegicus
tcacctactttggactgatggatgg

SEQ ID NO: 575345 - DNA, 25 bp, Rattus norvegicus
tcacctagtggtccaggccaagggc

SEQ ID NO: 575346 - DNA, 25 bp, Rattus norvegicus
tcacctagtggtgcaggccaagggc

SEQ ID NO: 575347 - DNA, 25 bp, Rattus norvegicus
tcacctatctttaccctttcagaat

SEQ ID NO: 575348 - DNA, 25 bp, Rattus norvegicus
tcacctatcttttccctttcagaat

SEQ ID NO: 575349 - DNA, 25 bp, Rattus norvegicus
tcacctatgagaaagaccctgtctt

SEQ ID NO: 575350 - DNA, 25 bp, Rattus norvegicus
tcacctatgagatagaccctgtctt

SEQ ID NO: 575351 - DNA, 25 bp, Rattus norvegicus
tcacctcaacctagtgcgagcacag

SEQ ID NO: 575352 - DNA, 25 bp, Rattus norvegicus
tcacctcaaccttgtgcgagcacag

SEQ ID NO: 575353 - DNA, 25 bp, Rattus norvegicus
tcacctcacatgattggccagtggg

SEQ ID NO: 575354 - DNA, 25 bp, Rattus norvegicus
tcacctcacatgtttggccagtggg

SEQ ID NO: 575355 - DNA, 25 bp, Rattus norvegicus
tcacctcaccatacaagaccatgaa

SEQ ID NO: 575356 - DNA, 25 bp, Rattus norvegicus
tcacctcaccattcaagaccatgaa

SEQ ID NO: 575357 - DNA, 25 bp, Rattus norvegicus
tcacctcagatgagtgtggctcacc

SEQ ID NO: 575358 - DNA, 25 bp, Rattus norvegicus
tcacctcagatgtgtgtggctcacc

SEQ ID NO: 575359 - DNA, 25 bp, Rattus norvegicus
tcacctcaggtgacactgaaacaca

SEQ ID NO: 575360 - DNA, 25 bp, Rattus norvegicus
tcacctcaggtgtcactgaaacaca

SEQ ID NO: 575361 - DNA, 25 bp, Rattus norvegicus
tcacctcatgtcagtttccattaga

SEQ ID NO: 575362 - DNA, 25 bp, Rattus norvegicus
tcacctcatgtctgtttccattaga

SEQ ID NO: 575363 - DNA, 25 bp, Rattus norvegicus
tcacctccaatgctgtgcgtagaga

SEQ ID NO: 575364 - DNA, 25 bp, Rattus norvegicus
tcacctccaatggtgtgcgtagaga

SEQ ID NO: 575365 - DNA, 25 bp, Rattus norvegicus
tcacctccatgcactatgtacaaga

SEQ ID NO: 575366 - DNA, 25 bp, Rattus norvegicus
tcacctccatgctctatgtacaaga

SEQ ID NO: 575367 - DNA, 25 bp, Rattus norvegicus
tcacctccattcatgaagctgcaca

SEQ ID NO: 575368 - DNA, 25 bp, Rattus norvegicus
tcacctccattcttgaagctgcaca

SEQ ID NO: 575369 - DNA, 25 bp, Rattus norvegicus
tcacctccatttcctgtggtacatg

SEQ ID NO: 575370 - DNA, 25 bp, Rattus norvegicus
tcacctccatttgctgtggtacatg

SEQ ID NO: 575371 - DNA, 25 bp, Rattus norvegicus
tcacctcccacaaagaaatcacagt

SEQ ID NO: 575372 - DNA, 25 bp, Rattus norvegicus
tcacctcccacatagaaatcacagt

SEQ ID NO: 575373 - DNA, 25 bp, Rattus norvegicus
tcacctcccactctaattaagacaa

SEQ ID NO: 575374 - DNA, 25 bp, Rattus norvegicus
tcacctcccactgtaattaagacaa

SEQ ID NO: 575375 - DNA, 25 bp, Rattus norvegicus
tcacctccctatacttctaaaatca

SEQ ID NO: 575376 - DNA, 25 bp, Rattus norvegicus
tcacctccctattcttctaaaatca

SEQ ID NO: 575377 - DNA, 25 bp, Rattus norvegicus
tcacctcccttaatcagcagaagat

SEQ ID NO: 575378 - DNA, 25 bp, Rattus norvegicus
tcacctcccttattcagcagaagat

SEQ ID NO: 575379 - DNA, 25 bp, Rattus norvegicus
tcacctccgaacagacctgtggaaa

SEQ ID NO: 575380 - DNA, 25 bp, Rattus norvegicus
tcacctccgaactgacctgtggaaa

SEQ ID NO: 575381 - DNA, 25 bp, Rattus norvegicus
tcacctcctcatagcaacaaaattc

SEQ ID NO: 575382 - DNA, 25 bp, Rattus norvegicus
tcacctcctcattgcaacaaaattc

SEQ ID NO: 575383 - DNA, 25 bp, Rattus norvegicus
tcacctcctttcaatatccattaaa

SEQ ID NO: 575384 - DNA, 25 bp, Rattus norvegicus
tcacctcctttctatatccattaaa

SEQ ID NO: 575385 - DNA, 25 bp, Rattus norvegicus
tcacctcgatatagccagccagagc

SEQ ID NO: 575386 - DNA, 25 bp, Rattus norvegicus
tcacctcgatattgccagccagagc

SEQ ID NO: 575387 - DNA, 25 bp, Rattus norvegicus
tcacctcgatgaaaggctgtactgt

SEQ ID NO: 575388 - DNA, 25 bp, Rattus norvegicus
tcacctcgatgataggctgtactgt

SEQ ID NO: 575389 - DNA, 25 bp, Rattus norvegicus
tcacctcgctgaacatttaccttgg

SEQ ID NO: 575390 - DNA, 25 bp, Rattus norvegicus
tcacctcgctgatcatttaccttgg

SEQ ID NO: 575391 - DNA, 25 bp, Rattus norvegicus
tcacctcgtgttcctttctttaaga

SEQ ID NO: 575392 - DNA, 25 bp, Rattus norvegicus
tcacctcgtgttgctttctttaaga

SEQ ID NO: 575393 - DNA, 25 bp, Rattus norvegicus
tcacctctagcactctgacacagag

SEQ ID NO: 575394 - DNA, 25 bp, Rattus norvegicus
tcacctctagcagtctgacacagag

SEQ ID NO: 575395 - DNA, 25 bp, Rattus norvegicus
tcacctctagttagggacaccggag

SEQ ID NO: 575396 - DNA, 25 bp, Rattus norvegicus
tcacctctagtttgggacaccggag

SEQ ID NO: 575397 - DNA, 25 bp, Rattus norvegicus
tcacctctatctaaagcttttctgg

SEQ ID NO: 575398 - DNA, 25 bp, Rattus norvegicus
tcacctctatcttaagcttttctgg

SEQ ID NO: 575399 - DNA, 25 bp, Rattus norvegicus
tcacctctcagaacttttctttggg

SEQ ID NO: 575400 - DNA, 25 bp, Rattus norvegicus
tcacctctcagatcttttctttggg

SEQ ID NO: 575401 - DNA, 25 bp, Rattus norvegicus
tcacctctccaccttgttatcaaaa

SEQ ID NO: 575402 - DNA, 25 bp, Rattus norvegicus
tcacctctccacgttgttatcaaaa

SEQ ID NO: 575403 - DNA, 25 bp, Rattus norvegicus
tcacctctccctaattttgtatttt

SEQ ID NO: 575404 - DNA, 25 bp, Rattus norvegicus
tcacctctcccttattttgtatttt

SEQ ID NO: 575405 - DNA, 25 bp, Rattus norvegicus
tcacctctcttcaacatgcacatgt

SEQ ID NO: 575406 - DNA, 25 bp, Rattus norvegicus
tcacctctcttctacatgcacatgt

SEQ ID NO: 575407 - DNA, 25 bp, Rattus norvegicus
tcacctctgagtacgttcatgacat

SEQ ID NO: 575408 - DNA, 25 bp, Rattus norvegicus
tcacctctgagttcgttcatgacat

SEQ ID NO: 575409 - DNA, 25 bp, Rattus norvegicus
tcacctctgcggattgcggaacaca

SEQ ID NO: 575410 - DNA, 25 bp, Rattus norvegicus
tcacctctgcggtttgcggaacaca

SEQ ID NO: 575411 - DNA, 25 bp, Rattus norvegicus
tcacctctgctcattgtcatgagca

SEQ ID NO: 575412 - DNA, 25 bp, Rattus norvegicus
tcacctctgctctttgtcatgagca

SEQ ID NO: 575413 - DNA, 25 bp, Rattus norvegicus
tcacctctgctgatcaggccttggg

SEQ ID NO: 575414 - DNA, 25 bp, Rattus norvegicus
tcacctctgctgttcaggccttggg

SEQ ID NO: 575415 - DNA, 25 bp, Rattus norvegicus
tcacctctgtacagacctttctata

SEQ ID NO: 575416 - DNA, 25 bp, Rattus norvegicus
tcacctctgtactgacctttctata

SEQ ID NO: 575417 - DNA, 25 bp, Rattus norvegicus
tcacctctgttcatagcaggctttt

SEQ ID NO: 575418 - DNA, 25 bp, Rattus norvegicus
tcacctctgttcttagcaggctttt

SEQ ID NO: 575419 - DNA, 25 bp, Rattus norvegicus
tcacctcttgtgacagtggacatct

SEQ ID NO: 575420 - DNA, 25 bp, Rattus norvegicus
tcacctcttgtgtcagtggacatct

SEQ ID NO: 575421 - DNA, 25 bp, Rattus norvegicus
tcacctctttttcggaatagctgtc

SEQ ID NO: 575422 - DNA, 25 bp, Rattus norvegicus
tcacctctttttgggaatagctgtc

SEQ ID NO: 575423 - DNA, 25 bp, Rattus norvegicus
tcacctgaacctatgccatattttg

SEQ ID NO: 575424 - DNA, 25 bp, Rattus norvegicus
tcacctgaacctttgccatattttg

SEQ ID NO: 575425 - DNA, 25 bp, Rattus norvegicus
tcacctgacacacacggtagtgtat

SEQ ID NO: 575426 - DNA, 25 bp, Rattus norvegicus
tcacctgacacagacggtagtgtat

SEQ ID NO: 575427 - DNA, 25 bp, Rattus norvegicus
tcacctgacattcctgagtgtgcag

SEQ ID NO: 575428 - DNA, 25 bp, Rattus norvegicus
tcacctgacattgctgagtgtgcag

SEQ ID NO: 575429 - DNA, 25 bp, Rattus norvegicus
tcacctgaccagcatggtcctacat

SEQ ID NO: 575430 - DNA, 25 bp, Rattus norvegicus
tcacctgaccaggatggtcctacat

SEQ ID NO: 575431 - DNA, 25 bp, Rattus norvegicus
tcacctgaccggatagctgaatagg

SEQ ID NO: 575432 - DNA, 25 bp, Rattus norvegicus
tcacctgaccggttagctgaatagg

SEQ ID NO: 575433 - DNA, 25 bp, Rattus norvegicus
tcacctgacgttatcaaccttttat

SEQ ID NO: 575434 - DNA, 25 bp, Rattus norvegicus
tcacctgacgttttcaaccttttat

SEQ ID NO: 575435 - DNA, 25 bp, Rattus norvegicus
tcacctgatgtcagagattttcttc

SEQ ID NO: 575436 - DNA, 25 bp, Rattus norvegicus
tcacctgatgtctgagattttcttc

SEQ ID NO: 575437 - DNA, 25 bp, Rattus norvegicus
tcacctgcagccagagcctgaaaat

SEQ ID NO: 575438 - DNA, 25 bp, Rattus norvegicus
tcacctgcagcctgagcctgaaaat

SEQ ID NO: 575439 - DNA, 25 bp, Rattus norvegicus
tcacctgccaacaactgtctcagag

SEQ ID NO: 575440 - DNA, 25 bp, Rattus norvegicus
tcacctgccaactactgtctcagag

SEQ ID NO: 575441 - DNA, 25 bp, Rattus norvegicus
tcacctgcggctagccaataagaga

SEQ ID NO: 575442 - DNA, 25 bp, Rattus norvegicus
tcacctgcggcttgccaataagaga

SEQ ID NO: 575443 - DNA, 25 bp, Rattus norvegicus
tcacctgctaccatagctggagcca

SEQ ID NO: 575444 - DNA, 25 bp, Rattus norvegicus
tcacctgctaccttagctggagcca

SEQ ID NO: 575445 - DNA, 25 bp, Rattus norvegicus
tcacctgctctaagcttgcaagaca

SEQ ID NO: 575446 - DNA, 25 bp, Rattus norvegicus
tcacctgctctatgcttgcaagaca

SEQ ID NO: 575447 - DNA, 25 bp, Rattus norvegicus
tcacctgctcttccaggatgcagaa

SEQ ID NO: 575448 - DNA, 25 bp, Rattus norvegicus
tcacctgctcttgcaggatgcagaa

SEQ ID NO: 575449 - DNA, 25 bp, Rattus norvegicus
tcacctgctggtcgaatcctgggac

SEQ ID NO: 575450 - DNA, 25 bp, Rattus norvegicus
tcacctgctggtggaatcctgggac

SEQ ID NO: 575451 - DNA, 25 bp, Rattus norvegicus
tcacctgctgttctgattggcctgg

SEQ ID NO: 575452 - DNA, 25 bp, Rattus norvegicus
tcacctgctgttgtgattggcctgg

SEQ ID NO: 575453 - DNA, 25 bp, Rattus norvegicus
tcacctggaaggctggcctctggct

SEQ ID NO: 575454 - DNA, 25 bp, Rattus norvegicus
tcacctggaagggtggcctctggct

SEQ ID NO: 575455 - DNA, 25 bp, Rattus norvegicus
tcacctggagccagggttgagagaa

SEQ ID NO: 575456 - DNA, 25 bp, Rattus norvegicus
tcacctggagcctgggttgagagaa

SEQ ID NO: 575457 - DNA, 25 bp, Rattus norvegicus
tcacctggagctagattttctcttt

SEQ ID NO: 575458 - DNA, 25 bp, Rattus norvegicus
tcacctggagcttgattttctcttt

SEQ ID NO: 575459 - DNA, 25 bp, Rattus norvegicus
tcacctggagtcagagctgtcagtg

SEQ ID NO: 575460 - DNA, 25 bp, Rattus norvegicus
tcacctggagtctgagctgtcagtg

SEQ ID NO: 575461 - DNA, 25 bp, Rattus norvegicus
tcacctggagtgacctttttcatac

SEQ ID NO: 575462 - DNA, 25 bp, Rattus norvegicus
tcacctggagtgtcctttttcatac

SEQ ID NO: 575463 - DNA, 25 bp, Rattus norvegicus
tcacctggatctaggctcagagtcc

SEQ ID NO: 575464 - DNA, 25 bp, Rattus norvegicus
tcacctggatcttggctcagagtcc

SEQ ID NO: 575465 - DNA, 25 bp, Rattus norvegicus
tcacctggcaaacatttggttccca

SEQ ID NO: 575466 - DNA, 25 bp, Rattus norvegicus
tcacctggcaaagatttggttccca

SEQ ID NO: 575467 - DNA, 25 bp, Rattus norvegicus
tcacctggcatgaagacttgtccta

SEQ ID NO: 575468 - DNA, 25 bp, Rattus norvegicus
tcacctggcatgtagacttgtccta

SEQ ID NO: 575469 - DNA, 25 bp, Rattus norvegicus
tcacctggcggaagtacagctgctg

SEQ ID NO: 575470 - DNA, 25 bp, Rattus norvegicus
tcacctggcggatgtacagctgctg

SEQ ID NO: 575471 - DNA, 25 bp, Rattus norvegicus
tcacctgggtgtcctgctaagctga

SEQ ID NO: 575472 - DNA, 25 bp, Rattus norvegicus
tcacctgggtgtgctgctaagctga

SEQ ID NO: 575473 - DNA, 25 bp, Rattus norvegicus
tcacctggtcagctattgagaactt

SEQ ID NO: 575474 - DNA, 25 bp, Rattus norvegicus
tcacctggtcaggtattgagaactt

SEQ ID NO: 575475 - DNA, 25 bp, Rattus norvegicus
tcacctggtggacgctctgtacctg

SEQ ID NO: 575476 - DNA, 25 bp, Rattus norvegicus
tcacctggtggaggctctgtacctg

SEQ ID NO: 575477 - DNA, 25 bp, Rattus norvegicus
tcacctgtaaggactgcgtgcggca

SEQ ID NO: 575478 - DNA, 25 bp, Rattus norvegicus
tcacctgtaaggtctgcgtgcggca

SEQ ID NO: 575479 - DNA, 25 bp, Rattus norvegicus
tcacctgtaccaccagcatcgtgga

SEQ ID NO: 575480 - DNA, 25 bp, Rattus norvegicus
tcacctgtaccagcagcatcgtgga

SEQ ID NO: 575481 - DNA, 25 bp, Rattus norvegicus
tcacctgtagtgagttggcaactgg

SEQ ID NO: 575482 - DNA, 25 bp, Rattus norvegicus
tcacctgtagtgtgttggcaactgg

SEQ ID NO: 575483 - DNA, 25 bp, Rattus norvegicus
tcacctgtatagacctgcgcatgtt

SEQ ID NO: 575484 - DNA, 25 bp, Rattus norvegicus
tcacctgtatagtcctgcgcatgtt

SEQ ID NO: 575485 - DNA, 25 bp, Rattus norvegicus
tcacctgtcgtaacaagggagcagt

SEQ ID NO: 575486 - DNA, 25 bp, Rattus norvegicus
tcacctgtcgtatcaagggagcagt

SEQ ID NO: 575487 - DNA, 25 bp, Rattus norvegicus
tcacctgtcgtgagcacctgcagga

SEQ ID NO: 575488 - DNA, 25 bp, Rattus norvegicus
tcacctgtcgtgtgcacctgcagga

SEQ ID NO: 575489 - DNA, 25 bp, Rattus norvegicus
tcacctgtctttaatgccttatgga

SEQ ID NO: 575490 - DNA, 25 bp, Rattus norvegicus
tcacctgtcttttatgccttatgga

SEQ ID NO: 575491 - DNA, 25 bp, Rattus norvegicus
tcacctgtgattctttcgacggcta

SEQ ID NO: 575492 - DNA, 25 bp, Rattus norvegicus
tcacctgtgattgtttcgacggcta

SEQ ID NO: 575493 - DNA, 25 bp, Rattus norvegicus
tcacctgtggacatgaacttgcctt

SEQ ID NO: 575494 - DNA, 25 bp, Rattus norvegicus
tcacctgtggacttgaacttgcctt

SEQ ID NO: 575495 - DNA, 25 bp, Rattus norvegicus
tcacctgtgtctccacttaggagtt

SEQ ID NO: 575496 - DNA, 25 bp, Rattus norvegicus
tcacctgtgtctgcacttaggagtt

SEQ ID NO: 575497 - DNA, 25 bp, Rattus norvegicus
tcacctgttacactgccttttaggg

SEQ ID NO: 575498 - DNA, 25 bp, Rattus norvegicus
tcacctgttacagtgccttttaggg

SEQ ID NO: 575499 - DNA, 25 bp, Rattus norvegicus
tcacctgttcctcgagagtggacat

SEQ ID NO: 575500 - DNA, 25 bp, Rattus norvegicus
tcacctgttcctggagagtggacat

SEQ ID NO: 575501 - DNA, 25 bp, Rattus norvegicus
tcacctgttctgaggcagtagagca

SEQ ID NO: 575502 - DNA, 25 bp, Rattus norvegicus
tcacctgttctgtggcagtagagca

SEQ ID NO: 575503 - DNA, 25 bp, Rattus norvegicus
tcacctgttttcagctatgcgttgc

SEQ ID NO: 575504 - DNA, 25 bp, Rattus norvegicus
tcacctgttttctgctatgcgttgc

SEQ ID NO: 575505 - DNA, 25 bp, Rattus norvegicus
tcaccttacccaagcttagaagtca

SEQ ID NO: 575506 - DNA, 25 bp, Rattus norvegicus
tcaccttacccatgcttagaagtca

SEQ ID NO: 575507 - DNA, 25 bp, Rattus norvegicus
tcaccttactgacaacgggctgcgc

SEQ ID NO: 575508 - DNA, 25 bp, Rattus norvegicus
tcaccttactgagaacgggctgcgc

SEQ ID NO: 575509 - DNA, 25 bp, Rattus norvegicus
tcaccttaggtgatacatgctggaa

SEQ ID NO: 575510 - DNA, 25 bp, Rattus norvegicus
tcaccttaggtgttacatgctggaa

SEQ ID NO: 575511 - DNA, 25 bp, Rattus norvegicus
tcaccttatgaaaacagacgtaact

SEQ ID NO: 575512 - DNA, 25 bp, Rattus norvegicus
tcaccttatgaatacagacgtaact

SEQ ID NO: 575513 - DNA, 25 bp, Rattus norvegicus
tcaccttatgggactgtctgcagag

SEQ ID NO: 575514 - DNA, 25 bp, Rattus norvegicus
tcaccttatgggtctgtctgcagag

SEQ ID NO: 575515 - DNA, 25 bp, Rattus norvegicus
tcaccttattccctgggtttctata

SEQ ID NO: 575516 - DNA, 25 bp, Rattus norvegicus
tcaccttattccgtgggtttctata

SEQ ID NO: 575517 - DNA, 25 bp, Rattus norvegicus
tcaccttcacacacattatggcgag

SEQ ID NO: 575518 - DNA, 25 bp, Rattus norvegicus
tcaccttcacactcattatggcgag

SEQ ID NO: 575519 - DNA, 25 bp, Rattus norvegicus
tcaccttcagaacgcttggatccag

SEQ ID NO: 575520 - DNA, 25 bp, Rattus norvegicus
tcaccttcagaaggcttggatccag

SEQ ID NO: 575521 - DNA, 25 bp, Rattus norvegicus
tcaccttcaggtccagcagtgaaca

SEQ ID NO: 575522 - DNA, 25 bp, Rattus norvegicus
tcaccttcaggtgcagcagtgaaca

SEQ ID NO: 575523 - DNA, 25 bp, Rattus norvegicus
tcaccttccaggcatcttccaatag

SEQ ID NO: 575524 - DNA, 25 bp, Rattus norvegicus
tcaccttccagggatcttccaatag

SEQ ID NO: 575525 - DNA, 25 bp, Rattus norvegicus
tcaccttccattaaccaggcttaaa

SEQ ID NO: 575526 - DNA, 25 bp, Rattus norvegicus
tcaccttccatttaccaggcttaaa

SEQ ID NO: 575527 - DNA, 25 bp, Rattus norvegicus
tcaccttccctcaaaagcagcaaag

SEQ ID NO: 575528 - DNA, 25 bp, Rattus norvegicus
tcaccttccctctaaagcagcaaag

SEQ ID NO: 575529 - DNA, 25 bp, Rattus norvegicus
tcaccttcgaccaatacaggctgaa

SEQ ID NO: 575530 - DNA, 25 bp, Rattus norvegicus
tcaccttcgacctatacaggctgaa

SEQ ID NO: 575531 - DNA, 25 bp, Rattus norvegicus
tcaccttcgattacggtaccatttt

SEQ ID NO: 575532 - DNA, 25 bp, Rattus norvegicus
tcaccttcgatttcggtaccatttt

SEQ ID NO: 575533 - DNA, 25 bp, Rattus norvegicus
tcaccttctggactcatgcatgagc

SEQ ID NO: 575534 - DNA, 25 bp, Rattus norvegicus
tcaccttctggagtcatgcatgagc

SEQ ID NO: 575535 - DNA, 25 bp, Rattus norvegicus
tcaccttctgttctaaacccgatga

SEQ ID NO: 575536 - DNA, 25 bp, Rattus norvegicus
tcaccttctgttgtaaacccgatga

SEQ ID NO: 575537 - DNA, 25 bp, Rattus norvegicus
tcaccttcttccaaggagaccacaa

SEQ ID NO: 575538 - DNA, 25 bp, Rattus norvegicus
tcaccttcttcctaggagaccacaa

SEQ ID NO: 575539 - DNA, 25 bp, Rattus norvegicus
tcaccttctttaaccagcatgctgt

SEQ ID NO: 575540 - DNA, 25 bp, Rattus norvegicus
tcaccttctttactggacctacaat

SEQ ID NO: 575541 - DNA, 25 bp, Rattus norvegicus
tcaccttctttagtggacctacaat

SEQ ID NO: 575542 - DNA, 25 bp, Rattus norvegicus
tcaccttctttatccagcatgctgt

SEQ ID NO: 575543 - DNA, 25 bp, Rattus norvegicus
tcaccttgagggaatctgatcagga

SEQ ID NO: 575544 - DNA, 25 bp, Rattus norvegicus
tcaccttgagggtatctgatcagga

SEQ ID NO: 575545 - DNA, 25 bp, Rattus norvegicus
tcaccttggactacagcttatagcg

SEQ ID NO: 575546 - DNA, 25 bp, Rattus norvegicus
tcaccttggacttcagcttatagcg

SEQ ID NO: 575547 - DNA, 25 bp, Rattus norvegicus
tcaccttggagcctcacagtttggg

SEQ ID NO: 575548 - DNA, 25 bp, Rattus norvegicus
tcaccttggagcgtcacagtttggg

SEQ ID NO: 575549 - DNA, 25 bp, Rattus norvegicus
tcaccttggcgtatcacatatgcag

SEQ ID NO: 575550 - DNA, 25 bp, Rattus norvegicus
tcaccttggcgtttcacatatgcag

SEQ ID NO: 575551 - DNA, 25 bp, Rattus norvegicus
tcaccttggcttagataaccaccac

SEQ ID NO: 575552 - DNA, 25 bp, Rattus norvegicus
tcaccttggctttgataaccaccac

SEQ ID NO: 575553 - DNA, 25 bp, Rattus norvegicus
tcaccttgtgctagatccagtctaa

SEQ ID NO: 575554 - DNA, 25 bp, Rattus norvegicus
tcaccttgtgcttgatccagtctaa

SEQ ID NO: 575555 - DNA, 25 bp, Rattus norvegicus
tcaccttgttctatttggcacttgg

SEQ ID NO: 575556 - DNA, 25 bp, Rattus norvegicus
tcaccttgttctttttggcacttgg

SEQ ID NO: 575557 - DNA, 25 bp, Rattus norvegicus
tcacctttacagcatggaagccatc

SEQ ID NO: 575558 - DNA, 25 bp, Rattus norvegicus
tcacctttacaggatggaagccatc

SEQ ID NO: 575559 - DNA, 25 bp, Rattus norvegicus
tcacctttactcactgggcaggaaa

SEQ ID NO: 575560 - DNA, 25 bp, Rattus norvegicus
tcacctttactctctgggcaggaaa

SEQ ID NO: 575561 - DNA, 25 bp, Rattus norvegicus
tcacctttatgcaacttgaccagaa

SEQ ID NO: 575562 - DNA, 25 bp, Rattus norvegicus
tcacctttatgctacttgaccagaa

SEQ ID NO: 575563 - DNA, 25 bp, Rattus norvegicus
tcacctttgaagaggccgtggccac

SEQ ID NO: 575564 - DNA, 25 bp, Rattus norvegicus
tcacctttgaagtggccgtggccac

SEQ ID NO: 575565 - DNA, 25 bp, Rattus norvegicus
tcacctttgaggcagctgtagctac

SEQ ID NO: 575566 - DNA, 25 bp, Rattus norvegicus
tcacctttgagggagctgtagctac

SEQ ID NO: 575567 - DNA, 25 bp, Rattus norvegicus
tcacctttgggtcgatattctccat

SEQ ID NO: 575568 - DNA, 25 bp, Rattus norvegicus
tcacctttgggtggatattctccat

SEQ ID NO: 575569 - DNA, 25 bp, Rattus norvegicus
tcacctttgtggactcttggctaag

SEQ ID NO: 575570 - DNA, 25 bp, Rattus norvegicus
tcacctttgtggtctcttggctaag

SEQ ID NO: 575571 - DNA, 25 bp, Rattus norvegicus
tcacctttgttcctcatgggagaaa

SEQ ID NO: 575572 - DNA, 25 bp, Rattus norvegicus
tcacctttgttcgtcatgggagaaa

SEQ ID NO: 575573 - DNA, 25 bp, Rattus norvegicus
tcaccttttgtgacccgagaaatcc

SEQ ID NO: 575574 - DNA, 25 bp, Rattus norvegicus
tcaccttttgtgagatggcctggca

SEQ ID NO: 575575 - DNA, 25 bp, Rattus norvegicus
tcaccttttgtgtcccgagaaatcc

SEQ ID NO: 575576 - DNA, 25 bp, Rattus norvegicus
tcaccttttgtgtgatggcctggca

SEQ ID NO: 575577 - DNA, 25 bp, Rattus norvegicus
tcaccttttgttatctttcctgtag

SEQ ID NO: 575578 - DNA, 25 bp, Rattus norvegicus
tcaccttttgttttctttcctgtag

SEQ ID NO: 575579 - DNA, 25 bp, Rattus norvegicus
tcacgaaagactactcatagtactt

SEQ ID NO: 575580 - DNA, 25 bp, Rattus norvegicus
tcacgaaagacttctcatagtactt

SEQ ID NO: 575581 - DNA, 25 bp, Rattus norvegicus
tcacgaaaggcgcttcttcttgcac

SEQ ID NO: 575582 - DNA, 25 bp, Rattus norvegicus
tcacgaaaggcggttcttcttgcac

SEQ ID NO: 575583 - DNA, 25 bp, Rattus norvegicus
tcacgaagcatacacggacacggtc

SEQ ID NO: 575584 - DNA, 25 bp, Rattus norvegicus
tcacgaagcatagacggacacggtc

SEQ ID NO: 575585 - DNA, 25 bp, Rattus norvegicus
tcacgaatcattcaagggacttcag

SEQ ID NO: 575586 - DNA, 25 bp, Rattus norvegicus
tcacgaatcattgaagggacttcag

SEQ ID NO: 575587 - DNA, 25 bp, Rattus norvegicus
tcacgaatccgtaaaggctaacatt

SEQ ID NO: 575588 - DNA, 25 bp, Rattus norvegicus
tcacgaatccgttaaggctaacatt

SEQ ID NO: 575589 - DNA, 25 bp, Rattus norvegicus
tcacgaatgatacctgcagacagct

SEQ ID NO: 575590 - DNA, 25 bp, Rattus norvegicus
tcacgaatgatagctgcagacagct

SEQ ID NO: 575591 - DNA, 25 bp, Rattus norvegicus
tcacgaatgtgtccatggccccggg

SEQ ID NO: 575592 - DNA, 25 bp, Rattus norvegicus
tcacgaatgtgtgcatggccccggg

SEQ ID NO: 575593 - DNA, 25 bp, Rattus norvegicus
tcacgacaaccaattgagcccttga

SEQ ID NO: 575594 - DNA, 25 bp, Rattus norvegicus
tcacgacaaccatttgagcccttga

SEQ ID NO: 575595 - DNA, 25 bp, Rattus norvegicus
tcacgagccccgcagagaaagagga

SEQ ID NO: 575596 - DNA, 25 bp, Rattus norvegicus
tcacgagccccggagagaaagagga

SEQ ID NO: 575597 - DNA, 25 bp, Rattus norvegicus
tcacgagcgtgaaggccctggtgac

SEQ ID NO: 575598 - DNA, 25 bp, Rattus norvegicus
tcacgagcgtgatggccctggtgac

SEQ ID NO: 575599 - DNA, 25 bp, Rattus norvegicus
tcacgagctcagcacagatgggttc

SEQ ID NO: 575600 - DNA, 25 bp, Rattus norvegicus
tcacgagctcaggacagatgggttc

SEQ ID NO: 575601 - DNA, 25 bp, Rattus norvegicus
tcacgaggtgatccgggctatccag

SEQ ID NO: 575602 - DNA, 25 bp, Rattus norvegicus
tcacgaggtgatgcgggctatccag

SEQ ID NO: 575603 - DNA, 25 bp, Rattus norvegicus
tcacgagtaatgagggccacttagt

SEQ ID NO: 575604 - DNA, 25 bp, Rattus norvegicus
tcacgagtaatgtgggccacttagt

SEQ ID NO: 575605 - DNA, 25 bp, Rattus norvegicus
tcacgagtccccatggtttggagtt

SEQ ID NO: 575606 - DNA, 25 bp, Rattus norvegicus
tcacgagtccccttggtttggagtt

SEQ ID NO: 575607 - DNA, 25 bp, Rattus norvegicus
tcacgagtgcacaggcaaagaggcc

SEQ ID NO: 575608 - DNA, 25 bp, Rattus norvegicus
tcacgagtgcactggcaaagaggcc

SEQ ID NO: 575609 - DNA, 25 bp, Rattus norvegicus
tcacgatactgaacaactatgggtt

SEQ ID NO: 575610 - DNA, 25 bp, Rattus norvegicus
tcacgatactgatcaactatgggtt

SEQ ID NO: 575611 - DNA, 25 bp, Rattus norvegicus
tcacgcaccttcaatgctagctaat

SEQ ID NO: 575612 - DNA, 25 bp, Rattus norvegicus
tcacgcaccttctatgctagctaat

SEQ ID NO: 575613 - DNA, 25 bp, Rattus norvegicus
tcacgcatgtgtacctgtctcagga

SEQ ID NO: 575614 - DNA, 25 bp, Rattus norvegicus
tcacgcatgtgttcctgtctcagga

SEQ ID NO: 575615 - DNA, 25 bp, Rattus norvegicus
tcacgcattcttaggcacactagga

SEQ ID NO: 575616 - DNA, 25 bp, Rattus norvegicus
tcacgcattctttggcacactagga

SEQ ID NO: 575617 - DNA, 25 bp, Rattus norvegicus
tcacgccattgaaattttgcctgat

SEQ ID NO: 575618 - DNA, 25 bp, Rattus norvegicus
tcacgccattgatattttgcctgat

SEQ ID NO: 575619 - DNA, 25 bp, Rattus norvegicus
tcacgccccacgcaagagcagaaag

SEQ ID NO: 575620 - DNA, 25 bp, Rattus norvegicus
tcacgccccacggaagagcagaaag

SEQ ID NO: 575621 - DNA, 25 bp, Rattus norvegicus
tcacgccctgctctgtaaaggtctg

SEQ ID NO: 575622 - DNA, 25 bp, Rattus norvegicus
tcacgccctgctgtgtaaaggtctg

SEQ ID NO: 575623 - DNA, 25 bp, Rattus norvegicus
tcacgcctaccaagcgggacataaa

SEQ ID NO: 575624 - DNA, 25 bp, Rattus norvegicus
tcacgcctaccatgcgggacataaa

SEQ ID NO: 575625 - DNA, 25 bp, Rattus norvegicus
tcacgcctgcgtccacagagaaact

SEQ ID NO: 575626 - DNA, 25 bp, Rattus norvegicus
tcacgcctgcgtgcacagagaaact

SEQ ID NO: 575627 - DNA, 25 bp, Rattus norvegicus
tcacgcctggttaactttaaatgta

SEQ ID NO: 575628 - DNA, 25 bp, Rattus norvegicus
tcacgcctggtttactttaaatgta

SEQ ID NO: 575629 - DNA, 25 bp, Rattus norvegicus
tcacgcctgtctagttttctagaca

SEQ ID NO: 575630 - DNA, 25 bp, Rattus norvegicus
tcacgcctgtcttgttttctagaca

SEQ ID NO: 575631 - DNA, 25 bp, Rattus norvegicus
tcacgccttaaacccacacttttta

SEQ ID NO: 575632 - DNA, 25 bp, Rattus norvegicus
tcacgccttaaagccacacttttta

SEQ ID NO: 575633 - DNA, 25 bp, Rattus norvegicus
tcacgccttctgaggttgtccactt

SEQ ID NO: 575634 - DNA, 25 bp, Rattus norvegicus
tcacgccttctgtggttgtccactt

SEQ ID NO: 575635 - DNA, 25 bp, Rattus norvegicus
tcacgcctttcaccttgggcaagga

SEQ ID NO: 575636 - DNA, 25 bp, Rattus norvegicus
tcacgcctttcagcttgggcaagga

SEQ ID NO: 575637 - DNA, 25 bp, Rattus norvegicus
tcacgccttttcatctagttttcat

SEQ ID NO: 575638 - DNA, 25 bp, Rattus norvegicus
tcacgccttttcttctagttttcat

SEQ ID NO: 575639 - DNA, 25 bp, Rattus norvegicus
tcacgcgagcttacatgttcggcat

SEQ ID NO: 575640 - DNA, 25 bp, Rattus norvegicus
tcacgcgagctttcatgttcggcat

SEQ ID NO: 575641 - DNA, 25 bp, Rattus norvegicus
tcacgcggtttcatcagctggaatg

SEQ ID NO: 575642 - DNA, 25 bp, Rattus norvegicus
tcacgcggtttcttcagctggaatg

SEQ ID NO: 575643 - DNA, 25 bp, Rattus norvegicus
tcacgcgtgatgatgcaccggtggc

SEQ ID NO: 575644 - DNA, 25 bp, Rattus norvegicus
tcacgcgtgatgttgcaccggtggc

SEQ ID NO: 575645 - DNA, 25 bp, Rattus norvegicus
tcacgcgtgggaactcttcctgtgc

SEQ ID NO: 575646 - DNA, 25 bp, Rattus norvegicus
tcacgcgtgggatctcttcctgtgc

SEQ ID NO: 575647 - DNA, 25 bp, Rattus norvegicus
tcacgctaacatacgccatgtgtgt

SEQ ID NO: 575648 - DNA, 25 bp, Rattus norvegicus
tcacgctaacattcgccatgtgtgt

SEQ ID NO: 575649 - DNA, 25 bp, Rattus norvegicus
tcacgctagaaccaagatctcctgt

SEQ ID NO: 575650 - DNA, 25 bp, Rattus norvegicus
tcacgctagaacgaagatctcctgt

SEQ ID NO: 575651 - DNA, 25 bp, Rattus norvegicus
tcacgctaggttacagggtctggga

SEQ ID NO: 575652 - DNA, 25 bp, Rattus norvegicus
tcacgctaggtttcagggtctggga

SEQ ID NO: 575653 - DNA, 25 bp, Rattus norvegicus
tcacgctatagaaactccagttcca

SEQ ID NO: 575654 - DNA, 25 bp, Rattus norvegicus
tcacgctatagatactccagttcca

SEQ ID NO: 575655 - DNA, 25 bp, Rattus norvegicus
tcacgctatggtccagcttgggaga

SEQ ID NO: 575656 - DNA, 25 bp, Rattus norvegicus
tcacgctatggtgcagcttgggaga

SEQ ID NO: 575657 - DNA, 25 bp, Rattus norvegicus
tcacgctcagttcctttcaaagatg

SEQ ID NO: 575658 - DNA, 25 bp, Rattus norvegicus
tcacgctcagttgctttcaaagatg

SEQ ID NO: 575659 - DNA, 25 bp, Rattus norvegicus
tcacgctccactaactaaattctag

SEQ ID NO: 575660 - DNA, 25 bp, Rattus norvegicus
tcacgctccacttactaaattctag

SEQ ID NO: 575661 - DNA, 25 bp, Rattus norvegicus
tcacgctcggatacaggcagctgct

SEQ ID NO: 575662 - DNA, 25 bp, Rattus norvegicus
tcacgctcggattcaggcagctgct

SEQ ID NO: 575663 - DNA, 25 bp, Rattus norvegicus
tcacgctgaataaatgaccacgctc

SEQ ID NO: 575664 - DNA, 25 bp, Rattus norvegicus
tcacgctgaatatatgaccacgctc

SEQ ID NO: 575665 - DNA, 25 bp, Rattus norvegicus
tcacgctgcaaccactgtactaagg

SEQ ID NO: 575666 - DNA, 25 bp, Rattus norvegicus
tcacgctgcaacgactgtactaagg

SEQ ID NO: 575667 - DNA, 25 bp, Rattus norvegicus
tcacgctgcttaaattgttcccaat

SEQ ID NO: 575668 - DNA, 25 bp, Rattus norvegicus
tcacgctgcttatattgttcccaat

SEQ ID NO: 575669 - DNA, 25 bp, Rattus norvegicus
tcacgctgtataacccactgaggga

SEQ ID NO: 575670 - DNA, 25 bp, Rattus norvegicus
tcacgctgtatatcccactgaggga

SEQ ID NO: 575671 - DNA, 25 bp, Rattus norvegicus
tcacgctgtctacagagcactggaa

SEQ ID NO: 575672 - DNA, 25 bp, Rattus norvegicus
tcacgctgtctagagagcactggaa

SEQ ID NO: 575673 - DNA, 25 bp, Rattus norvegicus
tcacggaaaccacacagactgattt

SEQ ID NO: 575674 - DNA, 25 bp, Rattus norvegicus
tcacggaaaccagacagactgattt

SEQ ID NO: 575675 - DNA, 25 bp, Rattus norvegicus
tcacggaacaggagctcttcttctt

SEQ ID NO: 575676 - DNA, 25 bp, Rattus norvegicus
tcacggaacaggtgctcttcttctt

SEQ ID NO: 575677 - DNA, 25 bp, Rattus norvegicus
tcacggaacgggagacccaggctgt

SEQ ID NO: 575678 - DNA, 25 bp, Rattus norvegicus
tcacggaacgggtgacccaggctgt

SEQ ID NO: 575679 - DNA, 25 bp, Rattus norvegicus
tcacggaactgcagggcctgagatt

SEQ ID NO: 575680 - DNA, 25 bp, Rattus norvegicus
tcacggaactgctgggcctgagatt

SEQ ID NO: 575681 - DNA, 25 bp, Rattus norvegicus
tcacggaaggcacgacaggtttttg

SEQ ID NO: 575682 - DNA, 25 bp, Rattus norvegicus
tcacggaaggcaggacaggtttttg

SEQ ID NO: 575683 - DNA, 25 bp, Rattus norvegicus
tcacggaaggctctccagccaggag

SEQ ID NO: 575684 - DNA, 25 bp, Rattus norvegicus
tcacggaaggctgtccagccaggag

SEQ ID NO: 575685 - DNA, 25 bp, Rattus norvegicus
tcacggacagttaccttgttacttt

SEQ ID NO: 575686 - DNA, 25 bp, Rattus norvegicus
tcacggacagtttccttgttacttt

SEQ ID NO: 575687 - DNA, 25 bp, Rattus norvegicus
tcacggagcactcccgccattatga

SEQ ID NO: 575688 - DNA, 25 bp, Rattus norvegicus
tcacggagcactgccgccattatga

SEQ ID NO: 575689 - DNA, 25 bp, Rattus norvegicus
tcacggagcttcctgactggtcttt

SEQ ID NO: 575690 - DNA, 25 bp, Rattus norvegicus
tcacggagcttcgtgactggtcttt

SEQ ID NO: 575691 - DNA, 25 bp, Rattus norvegicus
tcacggaggcggctgagggcccagg

SEQ ID NO: 575692 - DNA, 25 bp, Rattus norvegicus
tcacggaggcgggtgagggcccagg

SEQ ID NO: 575693 - DNA, 25 bp, Rattus norvegicus
tcacggatgggaaacttagggcttt

SEQ ID NO: 575694 - DNA, 25 bp, Rattus norvegicus
tcacggatgggatacttagggcttt

SEQ ID NO: 575695 - DNA, 25 bp, Rattus norvegicus
tcacggattatcaaaaaccccttcg

SEQ ID NO: 575696 - DNA, 25 bp, Rattus norvegicus
tcacggattatctaaaaccccttcg

SEQ ID NO: 575697 - DNA, 25 bp, Rattus norvegicus
tcacggcagagcacagggtcatggc

SEQ ID NO: 575698 - DNA, 25 bp, Rattus norvegicus
tcacggcagagctcagggtcatggc

SEQ ID NO: 575699 - DNA, 25 bp, Rattus norvegicus
tcacggcagtagattcgagatcctt

SEQ ID NO: 575700 - DNA, 25 bp, Rattus norvegicus
tcacggcagtagtttcgagatcctt

SEQ ID NO: 575701 - DNA, 25 bp, Rattus norvegicus
tcacggccatctccgctaggagaag

SEQ ID NO: 575702 - DNA, 25 bp, Rattus norvegicus
tcacggccatctgcgctaggagaag

SEQ ID NO: 575703 - DNA, 25 bp, Rattus norvegicus
tcacggccctgtctgcaaaatcagt

SEQ ID NO: 575704 - DNA, 25 bp, Rattus norvegicus
tcacggccctgtgtgcaaaatcagt

SEQ ID NO: 575705 - DNA, 25 bp, Rattus norvegicus
tcacggcctccacacaatttaatgt

SEQ ID NO: 575706 - DNA, 25 bp, Rattus norvegicus
tcacggcctccagacaatttaatgt

SEQ ID NO: 575707 - DNA, 25 bp, Rattus norvegicus
tcacggcgcggacaaccctaggttc

SEQ ID NO: 575708 - DNA, 25 bp, Rattus norvegicus
tcacggcgcggagaaccctaggttc

SEQ ID NO: 575709 - DNA, 25 bp, Rattus norvegicus
tcacggctcttcagtaaacctcaga

SEQ ID NO: 575710 - DNA, 25 bp, Rattus norvegicus
tcacggctcttctgtaaacctcaga

SEQ ID NO: 575711 - DNA, 25 bp, Rattus norvegicus
tcacggctgctccagatggacaaag

SEQ ID NO: 575712 - DNA, 25 bp, Rattus norvegicus
tcacggctgctcgagatggacaaag

SEQ ID NO: 575713 - DNA, 25 bp, Rattus norvegicus
tcacggctggctacactacagatgt

SEQ ID NO: 575714 - DNA, 25 bp, Rattus norvegicus
tcacggctggcttcactacagatgt

SEQ ID NO: 575715 - DNA, 25 bp, Rattus norvegicus
tcacggctgggcagtcaagtttgtc

SEQ ID NO: 575716 - DNA, 25 bp, Rattus norvegicus
tcacggctgggctgtcaagtttgtc

SEQ ID NO: 575717 - DNA, 25 bp, Rattus norvegicus
tcacgggccgaacaggagcacctga

SEQ ID NO: 575718 - DNA, 25 bp, Rattus norvegicus
tcacgggccgaagaggagcacctga

SEQ ID NO: 575719 - DNA, 25 bp, Rattus norvegicus
tcacgggccgacaagatacctctcg

SEQ ID NO: 575720 - DNA, 25 bp, Rattus norvegicus
tcacgggccgactagatacctctcg

SEQ ID NO: 575721 - DNA, 25 bp, Rattus norvegicus
tcacgggctctccaatagtgtcgga

SEQ ID NO: 575722 - DNA, 25 bp, Rattus norvegicus
tcacgggctctcgaatagtgtcgga

SEQ ID NO: 575723 - DNA, 25 bp, Rattus norvegicus
tcacgggcttggcaaatctcgctag

SEQ ID NO: 575724 - DNA, 25 bp, Rattus norvegicus
tcacgggcttgggaaatctcgctag

SEQ ID NO: 575725 - DNA, 25 bp, Rattus norvegicus
tcacgggtcaccaataaacttgtta

SEQ ID NO: 575726 - DNA, 25 bp, Rattus norvegicus
tcacgggtcacctataaacttgtta

SEQ ID NO: 575727 - DNA, 25 bp, Rattus norvegicus
tcacgggtcttgatttcactttata

SEQ ID NO: 575728 - DNA, 25 bp, Rattus norvegicus
tcacgggtcttgttttcactttata

SEQ ID NO: 575729 - DNA, 25 bp, Rattus norvegicus
tcacgggttattctacagagctttt

SEQ ID NO: 575730 - DNA, 25 bp, Rattus norvegicus
tcacgggttattgtacagagctttt

SEQ ID NO: 575731 - DNA, 25 bp, Rattus norvegicus
tcacggtatgagcttataatccatt

SEQ ID NO: 575732 - DNA, 25 bp, Rattus norvegicus
tcacggtatgaggttataatccatt

SEQ ID NO: 575733 - DNA, 25 bp, Rattus norvegicus
tcacggtcaccgcttttattagaca

SEQ ID NO: 575734 - DNA, 25 bp, Rattus norvegicus
tcacggtcaccggttttattagaca

SEQ ID NO: 575735 - DNA, 25 bp, Rattus norvegicus
tcacggtccaggctgcatggctaga

SEQ ID NO: 575736 - DNA, 25 bp, Rattus norvegicus
tcacggtccagggtgcatggctaga

SEQ ID NO: 575737 - DNA, 25 bp, Rattus norvegicus
tcacggtgccttattacacggaagt

SEQ ID NO: 575738 - DNA, 25 bp, Rattus norvegicus
tcacggtgcctttttacacggaagt

SEQ ID NO: 575739 - DNA, 25 bp, Rattus norvegicus
tcacggtgtccacaggtggctgtta

SEQ ID NO: 575740 - DNA, 25 bp, Rattus norvegicus
tcacggtgtccacattcacagccag

SEQ ID NO: 575741 - DNA, 25 bp, Rattus norvegicus
tcacggtgtccagaggtggctgtta

SEQ ID NO: 575742 - DNA, 25 bp, Rattus norvegicus
tcacggtgtccagattcacagccag

SEQ ID NO: 575743 - DNA, 25 bp, Rattus norvegicus
tcacggttgtttcaacccagtccct

SEQ ID NO: 575744 - DNA, 25 bp, Rattus norvegicus
tcacggttgtttgaacccagtccct

SEQ ID NO: 575745 - DNA, 25 bp, Rattus norvegicus
tcacgtacgacgctgaaaacttagc

SEQ ID NO: 575746 - DNA, 25 bp, Rattus norvegicus
tcacgtacgacggtgaaaacttagc

SEQ ID NO: 575747 - DNA, 25 bp, Rattus norvegicus
tcacgtactgccatcagcttctttt

SEQ ID NO: 575748 - DNA, 25 bp, Rattus norvegicus
tcacgtactgccttcagcttctttt

SEQ ID NO: 575749 - DNA, 25 bp, Rattus norvegicus
tcacgtatcacgactaccaataaga

SEQ ID NO: 575750 - DNA, 25 bp, Rattus norvegicus
tcacgtatcacgtctaccaataaga

SEQ ID NO: 575751 - DNA, 25 bp, Rattus norvegicus
tcacgtatttgacacgagcattata

SEQ ID NO: 575752 - DNA, 25 bp, Rattus norvegicus
tcacgtatttgagacgagcattata

SEQ ID NO: 575753 - DNA, 25 bp, Rattus norvegicus
tcacgtcaaagcaatactgcagttg

SEQ ID NO: 575754 - DNA, 25 bp, Rattus norvegicus
tcacgtcaaagctatactgcagttg

SEQ ID NO: 575755 - DNA, 25 bp, Rattus norvegicus
tcacgtcacagcaaagcacctttag

SEQ ID NO: 575756 - DNA, 25 bp, Rattus norvegicus
tcacgtcacagctaagcacctttag

SEQ ID NO: 575757 - DNA, 25 bp, Rattus norvegicus
tcacgtccattaaacagggcttgtt

SEQ ID NO: 575758 - DNA, 25 bp, Rattus norvegicus
tcacgtccattatacagggcttgtt

SEQ ID NO: 575759 - DNA, 25 bp, Rattus norvegicus
tcacgtccattcactctgtagaggg

SEQ ID NO: 575760 - DNA, 25 bp, Rattus norvegicus
tcacgtccattctctctgtagaggg

SEQ ID NO: 575761 - DNA, 25 bp, Rattus norvegicus
tcacgtcccacaacaggtgcgggca

SEQ ID NO: 575762 - DNA, 25 bp, Rattus norvegicus
tcacgtcccacatcaggtgcgggca

SEQ ID NO: 575763 - DNA, 25 bp, Rattus norvegicus
tcacgtcggcagagctttgatgtgg

SEQ ID NO: 575764 - DNA, 25 bp, Rattus norvegicus
tcacgtcggcagtgctttgatgtgg

SEQ ID NO: 575765 - DNA, 25 bp, Rattus norvegicus
tcacgtcgtagtcgtcacacacgcg

SEQ ID NO: 575766 - DNA, 25 bp, Rattus norvegicus
tcacgtcgtagtggtcacacacgcg

SEQ ID NO: 575767 - DNA, 25 bp, Rattus norvegicus
tcacgtctgcagcttagattggctt

SEQ ID NO: 575768 - DNA, 25 bp, Rattus norvegicus
tcacgtctgcaggttagattggctt

SEQ ID NO: 575769 - DNA, 25 bp, Rattus norvegicus
tcacgtctgctcatcgcctaaccag

SEQ ID NO: 575770 - DNA, 25 bp, Rattus norvegicus
tcacgtctgctcttcgcctaaccag

SEQ ID NO: 575771 - DNA, 25 bp, Rattus norvegicus
tcacgtcttcacagactttggcaag

SEQ ID NO: 575772 - DNA, 25 bp, Rattus norvegicus
tcacgtcttcactgactttggcaag

SEQ ID NO: 575773 - DNA, 25 bp, Rattus norvegicus
tcacgtgaccttctgcactgggaaa

SEQ ID NO: 575774 - DNA, 25 bp, Rattus norvegicus
tcacgtgaccttgtgcactgggaaa

SEQ ID NO: 575775 - DNA, 25 bp, Rattus norvegicus
tcacgtgagcggaagatggcggccc

SEQ ID NO: 575776 - DNA, 25 bp, Rattus norvegicus
tcacgtgagcggtagatggcggccc

SEQ ID NO: 575777 - DNA, 25 bp, Rattus norvegicus
tcacgtgcacccatatactcataca

SEQ ID NO: 575778 - DNA, 25 bp, Rattus norvegicus
tcacgtgcacccctgctggaaggaa

SEQ ID NO: 575779 - DNA, 25 bp, Rattus norvegicus
tcacgtgcacccgtgctggaaggaa

SEQ ID NO: 575780 - DNA, 25 bp, Rattus norvegicus
tcacgtgcacccttatactcataca

SEQ ID NO: 575781 - DNA, 25 bp, Rattus norvegicus
tcacgtgctataatactgagccttg

SEQ ID NO: 575782 - DNA, 25 bp, Rattus norvegicus
tcacgtgctatattactgagccttg

SEQ ID NO: 575783 - DNA, 25 bp, Rattus norvegicus
tcacgtgctctcatgtttgttctct

SEQ ID NO: 575784 - DNA, 25 bp, Rattus norvegicus
tcacgtgctctcttgtttgttctct

SEQ ID NO: 575785 - DNA, 25 bp, Rattus norvegicus
tcacgtgctgaaaatggagaccctg

SEQ ID NO: 575786 - DNA, 25 bp, Rattus norvegicus
tcacgtgctgaatatggagaccctg

SEQ ID NO: 575787 - DNA, 25 bp, Rattus norvegicus
tcacgtgcttgaaccttactatggt

SEQ ID NO: 575788 - DNA, 25 bp, Rattus norvegicus
tcacgtgcttgatccttactatggt

SEQ ID NO: 575789 - DNA, 25 bp, Rattus norvegicus
tcacgtggagtcatcctctagaatg

SEQ ID NO: 575790 - DNA, 25 bp, Rattus norvegicus
tcacgtggagtcttcctctagaatg

SEQ ID NO: 575791 - DNA, 25 bp, Rattus norvegicus
tcacgtggtcgtaactcttcataat

SEQ ID NO: 575792 - DNA, 25 bp, Rattus norvegicus
tcacgtggtcgttactcttcataat

SEQ ID NO: 575793 - DNA, 25 bp, Rattus norvegicus
tcacgtgtacagctggcccaagaat

SEQ ID NO: 575794 - DNA, 25 bp, Rattus norvegicus
tcacgtgtacaggtggcccaagaat

SEQ ID NO: 575795 - DNA, 25 bp, Rattus norvegicus
tcacgtgtgagcaggttttgctttc

SEQ ID NO: 575796 - DNA, 25 bp, Rattus norvegicus
tcacgtgtgagctggttttgctttc

SEQ ID NO: 575797 - DNA, 25 bp, Rattus norvegicus
tcacgtgtgcgcaatgtactgtagt

SEQ ID NO: 575798 - DNA, 25 bp, Rattus norvegicus
tcacgtgtgcgctatgtactgtagt

SEQ ID NO: 575799 - DNA, 25 bp, Rattus norvegicus
tcacgttacactagactaaactagt

SEQ ID NO: 575800 - DNA, 25 bp, Rattus norvegicus
tcacgttacacttgactaaactagt

SEQ ID NO: 575801 - DNA, 25 bp, Rattus norvegicus
tcacgttagataccatttcccctgt

SEQ ID NO: 575802 - DNA, 25 bp, Rattus norvegicus
tcacgttagatagcatttcccctgt

SEQ ID NO: 575803 - DNA, 25 bp, Rattus norvegicus
tcacgttctgcaaatcatggccatg

SEQ ID NO: 575804 - DNA, 25 bp, Rattus norvegicus
tcacgttctgcatatcatggccatg

SEQ ID NO: 575805 - DNA, 25 bp, Rattus norvegicus
tcacgttgccacactgatatgatca

SEQ ID NO: 575806 - DNA, 25 bp, Rattus norvegicus
tcacgttgccactctgatatgatca

SEQ ID NO: 575807 - DNA, 25 bp, Rattus norvegicus
tcacgttgctttctatctttcatgt

SEQ ID NO: 575808 - DNA, 25 bp, Rattus norvegicus
tcacgttgctttgtatctttcatgt

SEQ ID NO: 575809 - DNA, 25 bp, Rattus norvegicus
tcacgttgtccgagtcggaatcgta

SEQ ID NO: 575810 - DNA, 25 bp, Rattus norvegicus
tcacgttgtccgtgtcggaatcgta

SEQ ID NO: 575811 - DNA, 25 bp, Rattus norvegicus
tcacgtttggtgacattttcctctt

SEQ ID NO: 575812 - DNA, 25 bp, Rattus norvegicus
tcacgtttggtgtcattttcctctt

SEQ ID NO: 575813 - DNA, 25 bp, Rattus norvegicus
tcactaacagccagtactgctccag

SEQ ID NO: 575814 - DNA, 25 bp, Rattus norvegicus
tcactaacagcctgtactgctccag

SEQ ID NO: 575815 - DNA, 25 bp, Rattus norvegicus
tcactaacccatcttaccttgacaa

SEQ ID NO: 575816 - DNA, 25 bp, Rattus norvegicus
tcactaacccatgttaccttgacaa

SEQ ID NO: 575817 - DNA, 25 bp, Rattus norvegicus
tcactaaccccacatctgatagagg

SEQ ID NO: 575818 - DNA, 25 bp, Rattus norvegicus
tcactaaccccagatctgatagagg

SEQ ID NO: 575819 - DNA, 25 bp, Rattus norvegicus
tcactaactcttcctgagggcccta

SEQ ID NO: 575820 - DNA, 25 bp, Rattus norvegicus
tcactaactcttgctgagggcccta

SEQ ID NO: 575821 - DNA, 25 bp, Rattus norvegicus
tcactaagttccagagacacggcct

SEQ ID NO: 575822 - DNA, 25 bp, Rattus norvegicus
tcactaagttcctgagacacggcct

SEQ ID NO: 575823 - DNA, 25 bp, Rattus norvegicus
tcactaattttcagcctccgttttc

SEQ ID NO: 575824 - DNA, 25 bp, Rattus norvegicus
tcactaattttctgcctccgttttc

SEQ ID NO: 575825 - DNA, 25 bp, Rattus norvegicus
tcactacagccccaccaataaaggt

SEQ ID NO: 575826 - DNA, 25 bp, Rattus norvegicus
tcactacagcccgaccaataaaggt

SEQ ID NO: 575827 - DNA, 25 bp, Rattus norvegicus
tcactacagtggcatgctgtcccct

SEQ ID NO: 575828 - DNA, 25 bp, Rattus norvegicus
tcactacagtgggatgctgtcccct

SEQ ID NO: 575829 - DNA, 25 bp, Rattus norvegicus
tcactaccacccagggctttgagtt

SEQ ID NO: 575830 - DNA, 25 bp, Rattus norvegicus
tcactaccaccctgggctttgagtt

SEQ ID NO: 575831 - DNA, 25 bp, Rattus norvegicus
tcactacctgctctgtaattacttt

SEQ ID NO: 575832 - DNA, 25 bp, Rattus norvegicus
tcactacctgctgtgtaattacttt

SEQ ID NO: 575833 - DNA, 25 bp, Rattus norvegicus
tcactactacacacaggcccaaagg

SEQ ID NO: 575834 - DNA, 25 bp, Rattus norvegicus
tcactactacactcaggcccaaagg

SEQ ID NO: 575835 - DNA, 25 bp, Rattus norvegicus
tcactactctccagctttatcaggg

SEQ ID NO: 575836 - DNA, 25 bp, Rattus norvegicus
tcactactctcctgctttatcaggg

SEQ ID NO: 575837 - DNA, 25 bp, Rattus norvegicus
tcactactcttaacctggcagctgg

SEQ ID NO: 575838 - DNA, 25 bp, Rattus norvegicus
tcactactcttatcctggcagctgg

SEQ ID NO: 575839 - DNA, 25 bp, Rattus norvegicus
tcactactgtgcagccaagggtgca

SEQ ID NO: 575840 - DNA, 25 bp, Rattus norvegicus
tcactactgtgctgccaagggtgca

SEQ ID NO: 575841 - DNA, 25 bp, Rattus norvegicus
tcactagagaccagggaatgaactg

SEQ ID NO: 575842 - DNA, 25 bp, Rattus norvegicus
tcactagagacctgggaatgaactg

SEQ ID NO: 575843 - DNA, 25 bp, Rattus norvegicus
tcactagctcctatattttcttcag

SEQ ID NO: 575844 - DNA, 25 bp, Rattus norvegicus
tcactagctcctttattttcttcag

SEQ ID NO: 575845 - DNA, 25 bp, Rattus norvegicus
tcactaggaaccaggccaagctctt

SEQ ID NO: 575846 - DNA, 25 bp, Rattus norvegicus
tcactaggaacctggccaagctctt

SEQ ID NO: 575847 - DNA, 25 bp, Rattus norvegicus
tcactaggctttccagggctaagtc

SEQ ID NO: 575848 - DNA, 25 bp, Rattus norvegicus
tcactaggctttgcagggctaagtc

SEQ ID NO: 575849 - DNA, 25 bp, Rattus norvegicus
tcactagtcctgagcttctggccac

SEQ ID NO: 575850 - DNA, 25 bp, Rattus norvegicus
tcactagtcctgtgcttctggccac

SEQ ID NO: 575851 - DNA, 25 bp, Rattus norvegicus
tcactagtctccactctgaagtaaa

SEQ ID NO: 575852 - DNA, 25 bp, Rattus norvegicus
tcactagtctcctctctgaagtaaa

SEQ ID NO: 575853 - DNA, 25 bp, Rattus norvegicus
tcactatcccttctgtgccaaagtt

SEQ ID NO: 575854 - DNA, 25 bp, Rattus norvegicus
tcactatcccttgtgtgccaaagtt

SEQ ID NO: 575855 - DNA, 25 bp, Rattus norvegicus
tcactatctgcaacactctggagag

SEQ ID NO: 575856 - DNA, 25 bp, Rattus norvegicus
tcactatctgcatcactctggagag

SEQ ID NO: 575857 - DNA, 25 bp, Rattus norvegicus
tcactatgccatcagctccaactat

SEQ ID NO: 575858 - DNA, 25 bp, Rattus norvegicus
tcactatgccatgagctccaactat

SEQ ID NO: 575859 - DNA, 25 bp, Rattus norvegicus
tcactatgctccaggtctagcctgt

SEQ ID NO: 575860 - DNA, 25 bp, Rattus norvegicus
tcactatgctcctggtctagcctgt

SEQ ID NO: 575861 - DNA, 25 bp, Rattus norvegicus
tcactatggactacaagcaccggca

SEQ ID NO: 575862 - DNA, 25 bp, Rattus norvegicus
tcactatggacttcaagcaccggca

SEQ ID NO: 575863 - DNA, 25 bp, Rattus norvegicus
tcactatgtaacccttgacgtagat

SEQ ID NO: 575864 - DNA, 25 bp, Rattus norvegicus
tcactatgtaaccttggccttaaga

SEQ ID NO: 575865 - DNA, 25 bp, Rattus norvegicus
tcactatgtaacgcttgacgtagat

SEQ ID NO: 575866 - DNA, 25 bp, Rattus norvegicus
tcactatgtaacgttggccttaaga

SEQ ID NO: 575867 - DNA, 25 bp, Rattus norvegicus
tcactattctctagctcgatggcta

SEQ ID NO: 575868 - DNA, 25 bp, Rattus norvegicus
tcactattctcttgctcgatggcta

SEQ ID NO: 575869 - DNA, 25 bp, Rattus norvegicus
tcactatttcatcgtcttgccttca

SEQ ID NO: 575870 - DNA, 25 bp, Rattus norvegicus
tcactatttcatggtcttgccttca

SEQ ID NO: 575871 - DNA, 25 bp, Rattus norvegicus
tcactatttgtcattccgatggcca

SEQ ID NO: 575872 - DNA, 25 bp, Rattus norvegicus
tcactatttgtctttccgatggcca

SEQ ID NO: 575873 - DNA, 25 bp, Rattus norvegicus
tcactcaaagcaaccatgaggctgt

SEQ ID NO: 575874 - DNA, 25 bp, Rattus norvegicus
tcactcaaagcatccatgaggctgt

SEQ ID NO: 575875 - DNA, 25 bp, Rattus norvegicus
tcactcaactcacgtggcatttggg

SEQ ID NO: 575876 - DNA, 25 bp, Rattus norvegicus
tcactcaactcaggtggcatttggg

SEQ ID NO: 575877 - DNA, 25 bp, Rattus norvegicus
tcactcaagcagctgaagggtcctt

SEQ ID NO: 575878 - DNA, 25 bp, Rattus norvegicus
tcactcaagcaggtgaagggtcctt

SEQ ID NO: 575879 - DNA, 25 bp, Rattus norvegicus
tcactcaatggaagacagttcagag

SEQ ID NO: 575880 - DNA, 25 bp, Rattus norvegicus
tcactcaatggatgacagttcagag

SEQ ID NO: 575881 - DNA, 25 bp, Rattus norvegicus
tcactcacacttacttcaatccaga

SEQ ID NO: 575882 - DNA, 25 bp, Rattus norvegicus
tcactcacactttcttcaatccaga

SEQ ID NO: 575883 - DNA, 25 bp, Rattus norvegicus
tcactcacagaacagacacaccaag

SEQ ID NO: 575884 - DNA, 25 bp, Rattus norvegicus
tcactcacagaagagacacaccaag

SEQ ID NO: 575885 - DNA, 25 bp, Rattus norvegicus
tcactcaccgtgataaatgtctgtt

SEQ ID NO: 575886 - DNA, 25 bp, Rattus norvegicus
tcactcaccgtgttaaatgtctgtt

SEQ ID NO: 575887 - DNA, 25 bp, Rattus norvegicus
tcactcagactccatttccgtaagg

SEQ ID NO: 575888 - DNA, 25 bp, Rattus norvegicus
tcactcagactcgatttccgtaagg

SEQ ID NO: 575889 - DNA, 25 bp, Rattus norvegicus
tcactcagatcacgctcagactcag

SEQ ID NO: 575890 - DNA, 25 bp, Rattus norvegicus
tcactcagatcaggctcagactcag

SEQ ID NO: 575891 - DNA, 25 bp, Rattus norvegicus
tcactcagatgacccagcagatggc

SEQ ID NO: 575892 - DNA, 25 bp, Rattus norvegicus
tcactcagatgagccagcagatggc

SEQ ID NO: 575893 - DNA, 25 bp, Rattus norvegicus
tcactcaggcttatgctgcatgacg

SEQ ID NO: 575894 - DNA, 25 bp, Rattus norvegicus
tcactcaggcttttgctgcatgacg

SEQ ID NO: 575895 - DNA, 25 bp, Rattus norvegicus
tcactcagtgctcctctgagctgca

SEQ ID NO: 575896 - DNA, 25 bp, Rattus norvegicus
tcactcagtgctgctctgagctgca

SEQ ID NO: 575897 - DNA, 25 bp, Rattus norvegicus
tcactcagtggtcctttgaactgca

SEQ ID NO: 575898 - DNA, 25 bp, Rattus norvegicus
tcactcagtggtgctttgaactgca

SEQ ID NO: 575899 - DNA, 25 bp, Rattus norvegicus
tcactcattctgaacattctttgtt

SEQ ID NO: 575900 - DNA, 25 bp, Rattus norvegicus
tcactcattctgtacattctttgtt

SEQ ID NO: 575901 - DNA, 25 bp, Rattus norvegicus
tcactcattgtaaacaccgctgcag

SEQ ID NO: 575902 - DNA, 25 bp, Rattus norvegicus
tcactcattgtatacaccgctgcag

SEQ ID NO: 575903 - DNA, 25 bp, Rattus norvegicus
tcactccaacttcgatggctgcgtt

SEQ ID NO: 575904 - DNA, 25 bp, Rattus norvegicus
tcactccaacttggatggctgcgtt

SEQ ID NO: 575905 - DNA, 25 bp, Rattus norvegicus
tcactccaataaagcttgaccctgc

SEQ ID NO: 575906 - DNA, 25 bp, Rattus norvegicus
tcactccaataatgcttgaccctgc

SEQ ID NO: 575907 - DNA, 25 bp, Rattus norvegicus
tcactccactgccttgttgtataag

SEQ ID NO: 575908 - DNA, 25 bp, Rattus norvegicus
tcactccactgcgttgttgtataag

SEQ ID NO: 575909 - DNA, 25 bp, Rattus norvegicus
tcactccagcatattcctcaagggt

SEQ ID NO: 575910 - DNA, 25 bp, Rattus norvegicus
tcactccagcattttcctcaagggt

SEQ ID NO: 575911 - DNA, 25 bp, Rattus norvegicus
tcactccagtgccattgtctttata

SEQ ID NO: 575912 - DNA, 25 bp, Rattus norvegicus
tcactccagtgcgattgtctttata

SEQ ID NO: 575913 - DNA, 25 bp, Rattus norvegicus
tcactccattacaaccatcggtagt

SEQ ID NO: 575914 - DNA, 25 bp, Rattus norvegicus
tcactccattactaccatcggtagt

SEQ ID NO: 575915 - DNA, 25 bp, Rattus norvegicus
tcactcccactgatgttagccagga

SEQ ID NO: 575916 - DNA, 25 bp, Rattus norvegicus
tcactcccactgttgttagccagga

SEQ ID NO: 575917 - DNA, 25 bp, Rattus norvegicus
tcactcccagcgatctatagagcag

SEQ ID NO: 575918 - DNA, 25 bp, Rattus norvegicus
tcactcccagcgttctatagagcag

SEQ ID NO: 575919 - DNA, 25 bp, Rattus norvegicus
tcactcccagctagaactgcaattg

SEQ ID NO: 575920 - DNA, 25 bp, Rattus norvegicus
tcactcccagcttgaactgcaattg

SEQ ID NO: 575921 - DNA, 25 bp, Rattus norvegicus
tcactccccacaagatttagcagtt

SEQ ID NO: 575922 - DNA, 25 bp, Rattus norvegicus
tcactccccacatgatttagcagtt

SEQ ID NO: 575923 - DNA, 25 bp, Rattus norvegicus
tcactccccgggaccgagaggtgga

SEQ ID NO: 575924 - DNA, 25 bp, Rattus norvegicus
tcactccccgggtccgagaggtgga

SEQ ID NO: 575925 - DNA, 25 bp, Rattus norvegicus
tcactccctgggattaagtatggct

SEQ ID NO: 575926 - DNA, 25 bp, Rattus norvegicus
tcactccctgggtttaagtatggct

SEQ ID NO: 575927 - DNA, 25 bp, Rattus norvegicus
tcactcccttctagggctggtttat

SEQ ID NO: 575928 - DNA, 25 bp, Rattus norvegicus
tcactcccttcttgggctggtttat

SEQ ID NO: 575929 - DNA, 25 bp, Rattus norvegicus
tcactccggagtcacaacaagcaag

SEQ ID NO: 575930 - DNA, 25 bp, Rattus norvegicus
tcactccggagtgacaacaagcaag

SEQ ID NO: 575931 - DNA, 25 bp, Rattus norvegicus
tcactccgtggaactattctgaagc

SEQ ID NO: 575932 - DNA, 25 bp, Rattus norvegicus
tcactccgtggatctattctgaagc

SEQ ID NO: 575933 - DNA, 25 bp, Rattus norvegicus
tcactcctagtcacggtatctgggc

SEQ ID NO: 575934 - DNA, 25 bp, Rattus norvegicus
tcactcctagtctcggtatctgggc

SEQ ID NO: 575935 - DNA, 25 bp, Rattus norvegicus
tcactcctagttccactgtttatga

SEQ ID NO: 575936 - DNA, 25 bp, Rattus norvegicus
tcactcctagttgcactgtttatga

SEQ ID NO: 575937 - DNA, 25 bp, Rattus norvegicus
tcactcctgagtacaatttccataa

SEQ ID NO: 575938 - DNA, 25 bp, Rattus norvegicus
tcactcctgagtctagacgcctaaa

SEQ ID NO: 575939 - DNA, 25 bp, Rattus norvegicus
tcactcctgagtgtagacgcctaaa

SEQ ID NO: 575940 - DNA, 25 bp, Rattus norvegicus
tcactcctgagttcaatttccataa

SEQ ID NO: 575941 - DNA, 25 bp, Rattus norvegicus
tcactcctgccactatattcttggg

SEQ ID NO: 575942 - DNA, 25 bp, Rattus norvegicus
tcactcctgccagtatattcttggg

SEQ ID NO: 575943 - DNA, 25 bp, Rattus norvegicus
tcactcctggatccttggaagggta

SEQ ID NO: 575944 - DNA, 25 bp, Rattus norvegicus
tcactcctggatgcttggaagggta

SEQ ID NO: 575945 - DNA, 25 bp, Rattus norvegicus
tcactcctgtgcctgttggaatgga

SEQ ID NO: 575946 - DNA, 25 bp, Rattus norvegicus
tcactcctgtgcgtgttggaatgga

SEQ ID NO: 575947 - DNA, 25 bp, Rattus norvegicus
tcactccttgatacacagggacatt

SEQ ID NO: 575948 - DNA, 25 bp, Rattus norvegicus
tcactccttgattcacagggacatt

SEQ ID NO: 575949 - DNA, 25 bp, Rattus norvegicus
tcactccttttcatcgctattatta

SEQ ID NO: 575950 - DNA, 25 bp, Rattus norvegicus
tcactccttttcttcgctattatta

SEQ ID NO: 575951 - DNA, 25 bp, Rattus norvegicus
tcactcgactctacgaaggctctgg

SEQ ID NO: 575952 - DNA, 25 bp, Rattus norvegicus
tcactcgactcttcgaaggctctgg

SEQ ID NO: 575953 - DNA, 25 bp, Rattus norvegicus
tcactcgcccacagctggaaggaag

SEQ ID NO: 575954 - DNA, 25 bp, Rattus norvegicus
tcactcgcccactgctggaaggaag

SEQ ID NO: 575955 - DNA, 25 bp, Rattus norvegicus
tcactcggtccacacagtacaaatg

SEQ ID NO: 575956 - DNA, 25 bp, Rattus norvegicus
tcactcggtccagacagtacaaatg

SEQ ID NO: 575957 - DNA, 25 bp, Rattus norvegicus
tcactcgtcttcctttgggcttttt

SEQ ID NO: 575958 - DNA, 25 bp, Rattus norvegicus
tcactcgtcttcgtttgggcttttt

SEQ ID NO: 575959 - DNA, 25 bp, Rattus norvegicus
tcactcgtgcttcgatctctgtaaa

SEQ ID NO: 575960 - DNA, 25 bp, Rattus norvegicus
tcactcgtgcttggatctctgtaaa

SEQ ID NO: 575961 - DNA, 25 bp, Rattus norvegicus
tcactctaaaggcagggcacgcttg

SEQ ID NO: 575962 - DNA, 25 bp, Rattus norvegicus
tcactctaaagggagggcacgcttg

SEQ ID NO: 575963 - DNA, 25 bp, Rattus norvegicus
tcactctaccatcctgtttttcttg

SEQ ID NO: 575964 - DNA, 25 bp, Rattus norvegicus
tcactctaccatgctgtttttcttg

SEQ ID NO: 575965 - DNA, 25 bp, Rattus norvegicus
tcactctaccttacagactctgtct

SEQ ID NO: 575966 - DNA, 25 bp, Rattus norvegicus
tcactctacctttcagactctgtct

SEQ ID NO: 575967 - DNA, 25 bp, Rattus norvegicus
tcactctaggacatgtccctggctc

SEQ ID NO: 575968 - DNA, 25 bp, Rattus norvegicus
tcactctaggacttgtccctggctc

SEQ ID NO: 575969 - DNA, 25 bp, Rattus norvegicus
tcactctatgccaaatgtcctgcag

SEQ ID NO: 575970 - DNA, 25 bp, Rattus norvegicus
tcactctatgcctaatgtcctgcag

SEQ ID NO: 575971 - DNA, 25 bp, Rattus norvegicus
tcactctcacggaaaggctggaaca

SEQ ID NO: 575972 - DNA, 25 bp, Rattus norvegicus
tcactctcacggtaaggctggaaca

SEQ ID NO: 575973 - DNA, 25 bp, Rattus norvegicus
tcactctcatgtcaacctgggttat

SEQ ID NO: 575974 - DNA, 25 bp, Rattus norvegicus
tcactctcatgtgaacctgggttat

SEQ ID NO: 575975 - DNA, 25 bp, Rattus norvegicus
tcactctccaggctagtctcagggc

SEQ ID NO: 575976 - DNA, 25 bp, Rattus norvegicus
tcactctccagggtagtctcagggc

SEQ ID NO: 575977 - DNA, 25 bp, Rattus norvegicus
tcactctcctctatctagcaagaag

SEQ ID NO: 575978 - DNA, 25 bp, Rattus norvegicus
tcactctcctctttctagcaagaag

SEQ ID NO: 575979 - DNA, 25 bp, Rattus norvegicus
tcactctcggtgctcacttctacaa

SEQ ID NO: 575980 - DNA, 25 bp, Rattus norvegicus
tcactctcggtggtcacttctacaa

SEQ ID NO: 575981 - DNA, 25 bp, Rattus norvegicus
tcactctctgacctttatatatgcc

SEQ ID NO: 575982 - DNA, 25 bp, Rattus norvegicus
tcactctctgacgtttatatatgcc

SEQ ID NO: 575983 - DNA, 25 bp, Rattus norvegicus
tcactctctgatcacacactagaac

SEQ ID NO: 575984 - DNA, 25 bp, Rattus norvegicus
tcactctctgatgacacactagaac

SEQ ID NO: 575985 - DNA, 25 bp, Rattus norvegicus
tcactctgacagatatactttggca

SEQ ID NO: 575986 - DNA, 25 bp, Rattus norvegicus
tcactctgacagttatactttggca

SEQ ID NO: 575987 - DNA, 25 bp, Rattus norvegicus
tcactctgagatctgtttgacaccc

SEQ ID NO: 575988 - DNA, 25 bp, Rattus norvegicus
tcactctgagatgtgtttgacaccc

SEQ ID NO: 575989 - DNA, 25 bp, Rattus norvegicus
tcactctgagggagacatcacggtt

SEQ ID NO: 575990 - DNA, 25 bp, Rattus norvegicus
tcactctgagggtgacatcacggtt

SEQ ID NO: 575991 - DNA, 25 bp, Rattus norvegicus
tcactctgctgtacattcgacatgt

SEQ ID NO: 575992 - DNA, 25 bp, Rattus norvegicus
tcactctgctgttcattcgacatgt

SEQ ID NO: 575993 - DNA, 25 bp, Rattus norvegicus
tcactctgcttcagttgaacaccta

SEQ ID NO: 575994 - DNA, 25 bp, Rattus norvegicus
tcactctgcttctgttgaacaccta

SEQ ID NO: 575995 - DNA, 25 bp, Rattus norvegicus
tcactctggatgacgagcccagtgt

SEQ ID NO: 575996 - DNA, 25 bp, Rattus norvegicus
tcactctggatgtcgagcccagtgt

SEQ ID NO: 575997 - DNA, 25 bp, Rattus norvegicus
tcactctggcatcttgctgcttaat

SEQ ID NO: 575998 - DNA, 25 bp, Rattus norvegicus
tcactctggcatgttgctgcttaat

SEQ ID NO: 575999 - DNA, 25 bp, Rattus norvegicus
tcactctgggtgacttggtctttta

SEQ ID NO: 576000 - DNA, 25 bp, Rattus norvegicus
tcactctgggtgtcttggtctttta

SEQ ID NO: 576001 - DNA, 25 bp, Rattus norvegicus
tcactctgtcacacaagttggctca

SEQ ID NO: 576002 - DNA, 25 bp, Rattus norvegicus
tcactctgtcactcaagttggctca

SEQ ID NO: 576003 - DNA, 25 bp, Rattus norvegicus
tcactctgtcccagataagagctag

SEQ ID NO: 576004 - DNA, 25 bp, Rattus norvegicus
tcactctgtccctgataagagctag

SEQ ID NO: 576005 - DNA, 25 bp, Rattus norvegicus
tcactctgtcgcacggcaagaagtt

SEQ ID NO: 576006 - DNA, 25 bp, Rattus norvegicus
tcactctgtcgctcggcaagaagtt

SEQ ID NO: 576007 - DNA, 25 bp, Rattus norvegicus
tcactcttaacaacctcctggtgtt

SEQ ID NO: 576008 - DNA, 25 bp, Rattus norvegicus
tcactcttaacatcctcctggtgtt

SEQ ID NO: 576009 - DNA, 25 bp, Rattus norvegicus
tcactcttctaacccctacataagt

SEQ ID NO: 576010 - DNA, 25 bp, Rattus norvegicus
tcactcttctaagccctacataagt

SEQ ID NO: 576011 - DNA, 25 bp, Rattus norvegicus
tcactcttctgcaggttcactagaa

SEQ ID NO: 576012 - DNA, 25 bp, Rattus norvegicus
tcactcttctgctggttcactagaa

SEQ ID NO: 576013 - DNA, 25 bp, Rattus norvegicus
tcactcttctggaccgtctgcaagg

SEQ ID NO: 576014 - DNA, 25 bp, Rattus norvegicus
tcactcttctggtccgtctgcaagg

SEQ ID NO: 576015 - DNA, 25 bp, Rattus norvegicus
tcactcttctttatctgcccagaat

SEQ ID NO: 576016 - DNA, 25 bp, Rattus norvegicus
tcactcttctttttctgcccagaat

SEQ ID NO: 576017 - DNA, 25 bp, Rattus norvegicus
tcactcttgggcctggaagctgaga

SEQ ID NO: 576018 - DNA, 25 bp, Rattus norvegicus
tcactcttgggcgtggaagctgaga

SEQ ID NO: 576019 - DNA, 25 bp, Rattus norvegicus
tcactcttggtgacccacaggataa

SEQ ID NO: 576020 - DNA, 25 bp, Rattus norvegicus
tcactcttggtgtcccacaggataa

SEQ ID NO: 576021 - DNA, 25 bp, Rattus norvegicus
tcactcttgttcattgccagatacg

SEQ ID NO: 576022 - DNA, 25 bp, Rattus norvegicus
tcactcttgttctttgccagatacg

SEQ ID NO: 576023 - DNA, 25 bp, Rattus norvegicus
tcactctttaaacactatctccctt

SEQ ID NO: 576024 - DNA, 25 bp, Rattus norvegicus
tcactctttaaagactatctccctt

SEQ ID NO: 576025 - DNA, 25 bp, Rattus norvegicus
tcactctttaatacggcccgaccga

SEQ ID NO: 576026 - DNA, 25 bp, Rattus norvegicus
tcactctttaattcggcccgaccga

SEQ ID NO: 576027 - DNA, 25 bp, Rattus norvegicus
tcactctttcaaacactgcaatgca

SEQ ID NO: 576028 - DNA, 25 bp, Rattus norvegicus
tcactctttcaatcactgcaatgca

SEQ ID NO: 576029 - DNA, 25 bp, Rattus norvegicus
tcactctttccgactgaagcgaggt

SEQ ID NO: 576030 - DNA, 25 bp, Rattus norvegicus
tcactctttccgtctgaagcgaggt

SEQ ID NO: 576031 - DNA, 25 bp, Rattus norvegicus
tcactctttgcaaagcttccagcat

SEQ ID NO: 576032 - DNA, 25 bp, Rattus norvegicus
tcactctttgcatagcttccagcat

SEQ ID NO: 576033 - DNA, 25 bp, Rattus norvegicus
tcactcttttgaatcctgggcctgt

SEQ ID NO: 576034 - DNA, 25 bp, Rattus norvegicus
tcactcttttgattcctgggcctgt

SEQ ID NO: 576035 - DNA, 25 bp, Rattus norvegicus
tcactgaacaacattgaagcccctt

SEQ ID NO: 576036 - DNA, 25 bp, Rattus norvegicus
tcactgaacaactttgaagcccctt

SEQ ID NO: 576037 - DNA, 25 bp, Rattus norvegicus
tcactgaacgccagttctgtctgta

SEQ ID NO: 576038 - DNA, 25 bp, Rattus norvegicus
tcactgaacgcctgttctgtctgta

SEQ ID NO: 576039 - DNA, 25 bp, Rattus norvegicus
tcactgaactcaacttgctgccgga

SEQ ID NO: 576040 - DNA, 25 bp, Rattus norvegicus
tcactgaactcatcttgctgccgga

SEQ ID NO: 576041 - DNA, 25 bp, Rattus norvegicus
tcactgaaggcacacttttgaaggt

SEQ ID NO: 576042 - DNA, 25 bp, Rattus norvegicus
tcactgaaggcagacttttgaaggt

SEQ ID NO: 576043 - DNA, 25 bp, Rattus norvegicus
tcactgaagtttaccctgaaagcac

SEQ ID NO: 576044 - DNA, 25 bp, Rattus norvegicus
tcactgaagttttccctgaaagcac

SEQ ID NO: 576045 - DNA, 25 bp, Rattus norvegicus
tcactgaatcgcaggtaccatttgt

SEQ ID NO: 576046 - DNA, 25 bp, Rattus norvegicus
tcactgaatcgctggtaccatttgt

SEQ ID NO: 576047 - DNA, 25 bp, Rattus norvegicus
tcactgaatgtcagcggagcggaga

SEQ ID NO: 576048 - DNA, 25 bp, Rattus norvegicus
tcactgaatgtctgcggagcggaga

SEQ ID NO: 576049 - DNA, 25 bp, Rattus norvegicus
tcactgaattaactctactccctgg

SEQ ID NO: 576050 - DNA, 25 bp, Rattus norvegicus
tcactgaattaagtctactccctgg

SEQ ID NO: 576051 - DNA, 25 bp, Rattus norvegicus
tcactgacacagctgagcttgttat

SEQ ID NO: 576052 - DNA, 25 bp, Rattus norvegicus
tcactgacacaggtgagcttgttat

SEQ ID NO: 576053 - DNA, 25 bp, Rattus norvegicus
tcactgaccactcacttcggagtta

SEQ ID NO: 576054 - DNA, 25 bp, Rattus norvegicus
tcactgaccactgacttcggagtta

SEQ ID NO: 576055 - DNA, 25 bp, Rattus norvegicus
tcactgacctgaagatgccctaact

SEQ ID NO: 576056 - DNA, 25 bp, Rattus norvegicus
tcactgacctgatgatgccctaact

SEQ ID NO: 576057 - DNA, 25 bp, Rattus norvegicus
tcactgacctggagccttttaaggg

SEQ ID NO: 576058 - DNA, 25 bp, Rattus norvegicus
tcactgacctggtgccttttaaggg

SEQ ID NO: 576059 - DNA, 25 bp, Rattus norvegicus
tcactgacgctcagcagctctctga

SEQ ID NO: 576060 - DNA, 25 bp, Rattus norvegicus
tcactgacgctctgcagctctctga

SEQ ID NO: 576061 - DNA, 25 bp, Rattus norvegicus
tcactgactcaaccccgggaggatg

SEQ ID NO: 576062 - DNA, 25 bp, Rattus norvegicus
tcactgactcaagcccgggaggatg

SEQ ID NO: 576063 - DNA, 25 bp, Rattus norvegicus
tcactgactggtatgactttcatgt

SEQ ID NO: 576064 - DNA, 25 bp, Rattus norvegicus
tcactgactggtttgactttcatgt

SEQ ID NO: 576065 - DNA, 25 bp, Rattus norvegicus
tcactgagactcattcatgcggtca

SEQ ID NO: 576066 - DNA, 25 bp, Rattus norvegicus
tcactgagactctttcatgcggtca

SEQ ID NO: 576067 - DNA, 25 bp, Rattus norvegicus
tcactgagcacgaggctgatgctga

SEQ ID NO: 576068 - DNA, 25 bp, Rattus norvegicus
tcactgagcacgtggctgatgctga

SEQ ID NO: 576069 - DNA, 25 bp, Rattus norvegicus
tcactgagcatgactgtctacgttt

SEQ ID NO: 576070 - DNA, 25 bp, Rattus norvegicus
tcactgagcatgtctgtctacgttt

SEQ ID NO: 576071 - DNA, 25 bp, Rattus norvegicus
tcactgagctccagacacagaacta

SEQ ID NO: 576072 - DNA, 25 bp, Rattus norvegicus
tcactgagctcctgacacagaacta

SEQ ID NO: 576073 - DNA, 25 bp, Rattus norvegicus
tcactgagtcacacccgagggtctg

SEQ ID NO: 576074 - DNA, 25 bp, Rattus norvegicus
tcactgagtcactcccgagggtctg

SEQ ID NO: 576075 - DNA, 25 bp, Rattus norvegicus
tcactgagtgccatccgtagatgac

SEQ ID NO: 576076 - DNA, 25 bp, Rattus norvegicus
tcactgagtgccatcttaaagtcca

SEQ ID NO: 576077 - DNA, 25 bp, Rattus norvegicus
tcactgagtgccttccgtagatgac

SEQ ID NO: 576078 - DNA, 25 bp, Rattus norvegicus
tcactgagtgccttcttaaagtcca

SEQ ID NO: 576079 - DNA, 25 bp, Rattus norvegicus
tcactgatgaggagctgctgggcct

SEQ ID NO: 576080 - DNA, 25 bp, Rattus norvegicus
tcactgatgaggtgctgctgggcct

SEQ ID NO: 576081 - DNA, 25 bp, Rattus norvegicus
tcactgatggagcaccggtctcact

SEQ ID NO: 576082 - DNA, 25 bp, Rattus norvegicus
tcactgatggaggaccggtctcact

SEQ ID NO: 576083 - DNA, 25 bp, Rattus norvegicus
tcactgattagcaagcctggctgtc

SEQ ID NO: 576084 - DNA, 25 bp, Rattus norvegicus
tcactgattagctagcctggctgtc

SEQ ID NO: 576085 - DNA, 25 bp, Rattus norvegicus
tcactgattatgagctgtgcttcat

SEQ ID NO: 576086 - DNA, 25 bp, Rattus norvegicus
tcactgattatgtgctgtgcttcat

SEQ ID NO: 576087 - DNA, 25 bp, Rattus norvegicus
tcactgcaaatcactgagatcctgg

SEQ ID NO: 576088 - DNA, 25 bp, Rattus norvegicus
tcactgcaaatctctgagatcctgg

SEQ ID NO: 576089 - DNA, 25 bp, Rattus norvegicus
tcactgcagagccacaagaaactca

SEQ ID NO: 576090 - DNA, 25 bp, Rattus norvegicus
tcactgcagagcgacaagaaactca

SEQ ID NO: 576091 - DNA, 25 bp, Rattus norvegicus
tcactgcagagtccttcctgggagg

SEQ ID NO: 576092 - DNA, 25 bp, Rattus norvegicus
tcactgcagagtgcttcctgggagg

SEQ ID NO: 576093 - DNA, 25 bp, Rattus norvegicus
tcactgcataccagaggctctttct

SEQ ID NO: 576094 - DNA, 25 bp, Rattus norvegicus
tcactgcatacctgaggctctttct

SEQ ID NO: 576095 - DNA, 25 bp, Rattus norvegicus
tcactgcatctcagctgaatgtcct

SEQ ID NO: 576096 - DNA, 25 bp, Rattus norvegicus
tcactgcatctctgctgaatgtcct

SEQ ID NO: 576097 - DNA, 25 bp, Rattus norvegicus
tcactgcatgcccaggacaggtaca

SEQ ID NO: 576098 - DNA, 25 bp, Rattus norvegicus
tcactgcatgccgaggacaggtaca

SEQ ID NO: 576099 - DNA, 25 bp, Rattus norvegicus
tcactgccaaggagcagggcttaca

SEQ ID NO: 576100 - DNA, 25 bp, Rattus norvegicus
tcactgccaaggtgcagggcttaca

SEQ ID NO: 576101 - DNA, 25 bp, Rattus norvegicus
tcactgccacatacctgtcagatgg

SEQ ID NO: 576102 - DNA, 25 bp, Rattus norvegicus
tcactgccacattcctgtcagatgg

SEQ ID NO: 576103 - DNA, 25 bp, Rattus norvegicus
tcactgccactcagaagactgtgga

SEQ ID NO: 576104 - DNA, 25 bp, Rattus norvegicus
tcactgccactctgaagactgtgga

SEQ ID NO: 576105 - DNA, 25 bp, Rattus norvegicus
tcactgccagtgaggagcactttct

SEQ ID NO: 576106 - DNA, 25 bp, Rattus norvegicus
tcactgccagtgtggagcactttct

SEQ ID NO: 576107 - DNA, 25 bp, Rattus norvegicus
tcactgccatcaattcactctaaga

SEQ ID NO: 576108 - DNA, 25 bp, Rattus norvegicus
tcactgccatcatttcactctaaga

SEQ ID NO: 576109 - DNA, 25 bp, Rattus norvegicus
tcactgcccgtgatcactttagaaa

SEQ ID NO: 576110 - DNA, 25 bp, Rattus norvegicus
tcactgcccgtgttcactttagaaa

SEQ ID NO: 576111 - DNA, 25 bp, Rattus norvegicus
tcactgccctagagaggcaggcgtc

SEQ ID NO: 576112 - DNA, 25 bp, Rattus norvegicus
tcactgccctagtgaggcaggcgtc

SEQ ID NO: 576113 - DNA, 25 bp, Rattus norvegicus
tcactgccctgtaagacctaggata

SEQ ID NO: 576114 - DNA, 25 bp, Rattus norvegicus
tcactgccctgttagacctaggata

SEQ ID NO: 576115 - DNA, 25 bp, Rattus norvegicus
tcactgccgctcatgcttagagtcc

SEQ ID NO: 576116 - DNA, 25 bp, Rattus norvegicus
tcactgccgctcttgcttagagtcc

SEQ ID NO: 576117 - DNA, 25 bp, Rattus norvegicus
tcactgcctccaaggatggcaagat

SEQ ID NO: 576118 - DNA, 25 bp, Rattus norvegicus
tcactgcctccatggatggcaagat

SEQ ID NO: 576119 - DNA, 25 bp, Rattus norvegicus
tcactgcctgagaaatacaacacca

SEQ ID NO: 576120 - DNA, 25 bp, Rattus norvegicus
tcactgcctgagtaatacaacacca

SEQ ID NO: 576121 - DNA, 25 bp, Rattus norvegicus
tcactgcctgttattgttgctttat

SEQ ID NO: 576122 - DNA, 25 bp, Rattus norvegicus
tcactgcctgtttttgttgctttat

SEQ ID NO: 576123 - DNA, 25 bp, Rattus norvegicus
tcactgccttcaaagcctctggtct

SEQ ID NO: 576124 - DNA, 25 bp, Rattus norvegicus
tcactgccttcaatgtctgacgtat

SEQ ID NO: 576125 - DNA, 25 bp, Rattus norvegicus
tcactgccttcatagcctctggtct

SEQ ID NO: 576126 - DNA, 25 bp, Rattus norvegicus
tcactgccttcattgtctgacgtat

SEQ ID NO: 576127 - DNA, 25 bp, Rattus norvegicus
tcactgccttgtacctctgctttgg

SEQ ID NO: 576128 - DNA, 25 bp, Rattus norvegicus
tcactgccttgttcctctgctttgg

SEQ ID NO: 576129 - DNA, 25 bp, Rattus norvegicus
tcactgcgctgcaatgagactaggg

SEQ ID NO: 576130 - DNA, 25 bp, Rattus norvegicus
tcactgcgctgctatgagactaggg

SEQ ID NO: 576131 - DNA, 25 bp, Rattus norvegicus
tcactgcgggctacggactcgggct

SEQ ID NO: 576132 - DNA, 25 bp, Rattus norvegicus
tcactgcgggcttcggactcgggct

SEQ ID NO: 576133 - DNA, 25 bp, Rattus norvegicus
tcactgctaacaaatgcccaagacc

SEQ ID NO: 576134 - DNA, 25 bp, Rattus norvegicus
tcactgctaacatatgcccaagacc

SEQ ID NO: 576135 - DNA, 25 bp, Rattus norvegicus
tcactgctatccaaaaacacctcaa

SEQ ID NO: 576136 - DNA, 25 bp, Rattus norvegicus
tcactgctatcctaaaacacctcaa

SEQ ID NO: 576137 - DNA, 25 bp, Rattus norvegicus
tcactgctcagccaagcgattgtct

SEQ ID NO: 576138 - DNA, 25 bp, Rattus norvegicus
tcactgctcagcgaagcgattgtct

SEQ ID NO: 576139 - DNA, 25 bp, Rattus norvegicus
tcactgctgaaacccctagggaagt

SEQ ID NO: 576140 - DNA, 25 bp, Rattus norvegicus
tcactgctgaaagccctagggaagt

SEQ ID NO: 576141 - DNA, 25 bp, Rattus norvegicus
tcactgctgaggacccgggatcata

SEQ ID NO: 576142 - DNA, 25 bp, Rattus norvegicus
tcactgctgaggtcccgggatcata

SEQ ID NO: 576143 - DNA, 25 bp, Rattus norvegicus
tcactgctgcaacgcctgggccata

SEQ ID NO: 576144 - DNA, 25 bp, Rattus norvegicus
tcactgctgcaaggcctgggccata

SEQ ID NO: 576145 - DNA, 25 bp, Rattus norvegicus
tcactgctgcttacgatatctttta

SEQ ID NO: 576146 - DNA, 25 bp, Rattus norvegicus
tcactgctgcttctggagctggaca

SEQ ID NO: 576147 - DNA, 25 bp, Rattus norvegicus
tcactgctgcttgtggagctggaca

SEQ ID NO: 576148 - DNA, 25 bp, Rattus norvegicus
tcactgctgctttcgatatctttta

SEQ ID NO: 576149 - DNA, 25 bp, Rattus norvegicus
tcactgctgttcctaaggcgtcatc

SEQ ID NO: 576150 - DNA, 25 bp, Rattus norvegicus
tcactgctgttcgtaaggcgtcatc

SEQ ID NO: 576151 - DNA, 25 bp, Rattus norvegicus
tcactgcttctccttaaaactgttt

SEQ ID NO: 576152 - DNA, 25 bp, Rattus norvegicus
tcactgcttctcgttaaaactgttt

SEQ ID NO: 576153 - DNA, 25 bp, Rattus norvegicus
tcactggaagcgcaacggaagccca

SEQ ID NO: 576154 - DNA, 25 bp, Rattus norvegicus
tcactggaagcggaacggaagccca

SEQ ID NO: 576155 - DNA, 25 bp, Rattus norvegicus
tcactggacatcctgagggcagctg

SEQ ID NO: 576156 - DNA, 25 bp, Rattus norvegicus
tcactggacatcgtgagggcagctg

SEQ ID NO: 576157 - DNA, 25 bp, Rattus norvegicus
tcactggagagaacatgcatgcgct

SEQ ID NO: 576158 - DNA, 25 bp, Rattus norvegicus
tcactggagagatcatgcatgcgct

SEQ ID NO: 576159 - DNA, 25 bp, Rattus norvegicus
tcactggatagtccctctctttctt

SEQ ID NO: 576160 - DNA, 25 bp, Rattus norvegicus
tcactggatagtgcctctctttctt

SEQ ID NO: 576161 - DNA, 25 bp, Rattus norvegicus
tcactggatgctacaggatgcccct

SEQ ID NO: 576162 - DNA, 25 bp, Rattus norvegicus
tcactggatgcttcaggatgcccct

SEQ ID NO: 576163 - DNA, 25 bp, Rattus norvegicus
tcactggcacaacagccttttgtat

SEQ ID NO: 576164 - DNA, 25 bp, Rattus norvegicus
tcactggcacaagagccttttgtat

SEQ ID NO: 576165 - DNA, 25 bp, Rattus norvegicus
tcactggcagatcagactccctgca

SEQ ID NO: 576166 - DNA, 25 bp, Rattus norvegicus
tcactggcagatgagactccctgca

SEQ ID NO: 576167 - DNA, 25 bp, Rattus norvegicus
tcactggcatgtcggccgaggcctc

SEQ ID NO: 576168 - DNA, 25 bp, Rattus norvegicus
tcactggcatgtgggccgaggcctc

SEQ ID NO: 576169 - DNA, 25 bp, Rattus norvegicus
tcactggcatttataagactctaac

SEQ ID NO: 576170 - DNA, 25 bp, Rattus norvegicus
tcactggcatttttaagactctaac

SEQ ID NO: 576171 - DNA, 25 bp, Rattus norvegicus
tcactggccttgactgttcagcagg

SEQ ID NO: 576172 - DNA, 25 bp, Rattus norvegicus
tcactggccttgtctgttcagcagg

SEQ ID NO: 576173 - DNA, 25 bp, Rattus norvegicus
tcactggctacaatctgctggtatc

SEQ ID NO: 576174 - DNA, 25 bp, Rattus norvegicus
tcactggctacattctgctggtatc

SEQ ID NO: 576175 - DNA, 25 bp, Rattus norvegicus
tcactggctttcactatgaggcaat

SEQ ID NO: 576176 - DNA, 25 bp, Rattus norvegicus
tcactggctttctctatgaggcaat

SEQ ID NO: 576177 - DNA, 25 bp, Rattus norvegicus
tcactgggatgtatgaggctcctca

SEQ ID NO: 576178 - DNA, 25 bp, Rattus norvegicus
tcactgggatgtttgaggctcctca

SEQ ID NO: 576179 - DNA, 25 bp, Rattus norvegicus
tcactgggctgcctgattcgcccat

SEQ ID NO: 576180 - DNA, 25 bp, Rattus norvegicus
tcactgggctgcgtgattcgcccat

SEQ ID NO: 576181 - DNA, 25 bp, Rattus norvegicus
tcactgggctggagcacgtacctaa

SEQ ID NO: 576182 - DNA, 25 bp, Rattus norvegicus
tcactgggctggtgcacgtacctaa

SEQ ID NO: 576183 - DNA, 25 bp, Rattus norvegicus
tcactgggctgtcctgaggatcaaa

SEQ ID NO: 576184 - DNA, 25 bp, Rattus norvegicus
tcactgggctgtgctgaggatcaaa

SEQ ID NO: 576185 - DNA, 25 bp, Rattus norvegicus
tcactgggctttctagtctgagcag

SEQ ID NO: 576186 - DNA, 25 bp, Rattus norvegicus
tcactgggctttgtagtctgagcag

SEQ ID NO: 576187 - DNA, 25 bp, Rattus norvegicus
tcactgggtgacaggctgcaagcca

SEQ ID NO: 576188 - DNA, 25 bp, Rattus norvegicus
tcactgggtgactggctgcaagcca

SEQ ID NO: 576189 - DNA, 25 bp, Rattus norvegicus
tcactggtattgacctaaaagctgt

SEQ ID NO: 576190 - DNA, 25 bp, Rattus norvegicus
tcactggtattgtcctaaaagctgt

SEQ ID NO: 576191 - DNA, 25 bp, Rattus norvegicus
tcactggtccacaaaaggcagtatt

SEQ ID NO: 576192 - DNA, 25 bp, Rattus norvegicus
tcactggtccactaaaggcagtatt

SEQ ID NO: 576193 - DNA, 25 bp, Rattus norvegicus
tcactggtccctagagtgtcccttt

SEQ ID NO: 576194 - DNA, 25 bp, Rattus norvegicus
tcactggtcccttgagtgtcccttt

SEQ ID NO: 576195 - DNA, 25 bp, Rattus norvegicus
tcactggtgagaaccctctgcaggt

SEQ ID NO: 576196 - DNA, 25 bp, Rattus norvegicus
tcactggtgagatccctctgcaggt

SEQ ID NO: 576197 - DNA, 25 bp, Rattus norvegicus
tcactggtgcaccatgctggagttg

SEQ ID NO: 576198 - DNA, 25 bp, Rattus norvegicus
tcactggtgcacgatgctggagttg

SEQ ID NO: 576199 - DNA, 25 bp, Rattus norvegicus
tcactggtgtgaccttttgtgctgt

SEQ ID NO: 576200 - DNA, 25 bp, Rattus norvegicus
tcactggtgtgagcttttgtgctgt

SEQ ID NO: 576201 - DNA, 25 bp, Rattus norvegicus
tcactggttgggatctgattgcctc

SEQ ID NO: 576202 - DNA, 25 bp, Rattus norvegicus
tcactggttgggttctgattgcctc

SEQ ID NO: 576203 - DNA, 25 bp, Rattus norvegicus
tcactgtaaggacttaaggcacgct

SEQ ID NO: 576204 - DNA, 25 bp, Rattus norvegicus
tcactgtaaggagttaaggcacgct

SEQ ID NO: 576205 - DNA, 25 bp, Rattus norvegicus
tcactgtagtttatgcggttttagc

SEQ ID NO: 576206 - DNA, 25 bp, Rattus norvegicus
tcactgtagtttttgcggttttagc

SEQ ID NO: 576207 - DNA, 25 bp, Rattus norvegicus
tcactgtataagatccttttccccg

SEQ ID NO: 576208 - DNA, 25 bp, Rattus norvegicus
tcactgtataagttccttttccccg

SEQ ID NO: 576209 - DNA, 25 bp, Rattus norvegicus
tcactgtattttatgacccagataa

SEQ ID NO: 576210 - DNA, 25 bp, Rattus norvegicus
tcactgtattttttgacccagataa

SEQ ID NO: 576211 - DNA, 25 bp, Rattus norvegicus
tcactgtcacagctcacgtgggtaa

SEQ ID NO: 576212 - DNA, 25 bp, Rattus norvegicus
tcactgtcacaggtcacgtgggtaa

SEQ ID NO: 576213 - DNA, 25 bp, Rattus norvegicus
tcactgtcactgctattgctcctgg

SEQ ID NO: 576214 - DNA, 25 bp, Rattus norvegicus
tcactgtcactggtattgctcctgg

SEQ ID NO: 576215 - DNA, 25 bp, Rattus norvegicus
tcactgtcccatcatctgtaacaaa

SEQ ID NO: 576216 - DNA, 25 bp, Rattus norvegicus
tcactgtcccatgatctgtaacaaa

SEQ ID NO: 576217 - DNA, 25 bp, Rattus norvegicus
tcactgtccgtgatgctggaagctg

SEQ ID NO: 576218 - DNA, 25 bp, Rattus norvegicus
tcactgtccgtgttgctggaagctg

SEQ ID NO: 576219 - DNA, 25 bp, Rattus norvegicus
tcactgtcgggtatttgtgcctttt

SEQ ID NO: 576220 - DNA, 25 bp, Rattus norvegicus
tcactgtcgggtttttgtgcctttt

SEQ ID NO: 576221 - DNA, 25 bp, Rattus norvegicus
tcactgtcgttcaccatcaatacat

SEQ ID NO: 576222 - DNA, 25 bp, Rattus norvegicus
tcactgtcgttctccatcaatacat

SEQ ID NO: 576223 - DNA, 25 bp, Rattus norvegicus
tcactgtcttagaggctccggagaa

SEQ ID NO: 576224 - DNA, 25 bp, Rattus norvegicus
tcactgtcttagtggctccggagaa

SEQ ID NO: 576225 - DNA, 25 bp, Rattus norvegicus
tcactgtcttctctgtgctgactgt

SEQ ID NO: 576226 - DNA, 25 bp, Rattus norvegicus
tcactgtcttctgtgtgctgactgt

SEQ ID NO: 576227 - DNA, 25 bp, Rattus norvegicus
tcactgtgaatcaacttccttcttc

SEQ ID NO: 576228 - DNA, 25 bp, Rattus norvegicus
tcactgtgaatctacttccttcttc

SEQ ID NO: 576229 - DNA, 25 bp, Rattus norvegicus
tcactgtgacagattcatgctgtaa

SEQ ID NO: 576230 - DNA, 25 bp, Rattus norvegicus
tcactgtgacagtttcatgctgtaa

SEQ ID NO: 576231 - DNA, 25 bp, Rattus norvegicus
tcactgtgatctcgtctgctgctca

SEQ ID NO: 576232 - DNA, 25 bp, Rattus norvegicus
tcactgtgatctggtctgctgctca

SEQ ID NO: 576233 - DNA, 25 bp, Rattus norvegicus
tcactgtgcgcgcagacactgaggc

SEQ ID NO: 576234 - DNA, 25 bp, Rattus norvegicus
tcactgtgcgcggagacactgaggc

SEQ ID NO: 576235 - DNA, 25 bp, Rattus norvegicus
tcactgtgctctctgaggacgctca

SEQ ID NO: 576236 - DNA, 25 bp, Rattus norvegicus
tcactgtgctctgtgaggacgctca

SEQ ID NO: 576237 - DNA, 25 bp, Rattus norvegicus
tcactgtggagccttgaacctgatc

SEQ ID NO: 576238 - DNA, 25 bp, Rattus norvegicus
tcactgtggagcgttgaacctgatc

SEQ ID NO: 576239 - DNA, 25 bp, Rattus norvegicus
tcactgtgggctcaaggctatgtca

SEQ ID NO: 576240 - DNA, 25 bp, Rattus norvegicus
tcactgtgggctgaaggctatgtca

SEQ ID NO: 576241 - DNA, 25 bp, Rattus norvegicus
tcactgtgtagcacaagatggtctt

SEQ ID NO: 576242 - DNA, 25 bp, Rattus norvegicus
tcactgtgtagcaggatatgactcc

SEQ ID NO: 576243 - DNA, 25 bp, Rattus norvegicus
tcactgtgtagccatgattggccta

SEQ ID NO: 576244 - DNA, 25 bp, Rattus norvegicus
tcactgtgtagcgatgattggccta

SEQ ID NO: 576245 - DNA, 25 bp, Rattus norvegicus
tcactgtgtagctcaagatggtctt

SEQ ID NO: 576246 - DNA, 25 bp, Rattus norvegicus
tcactgtgtagctggatatgactcc

SEQ ID NO: 576247 - DNA, 25 bp, Rattus norvegicus
tcactgtgtgaacgacggatgtttt

SEQ ID NO: 576248 - DNA, 25 bp, Rattus norvegicus
tcactgtgtgaaggacggatgtttt

SEQ ID NO: 576249 - DNA, 25 bp, Rattus norvegicus
tcactgtgtggcacaagaagtttac

SEQ ID NO: 576250 - DNA, 25 bp, Rattus norvegicus
tcactgtgtggctcaagaagtttac

SEQ ID NO: 576251 - DNA, 25 bp, Rattus norvegicus
tcactgtgtggtctggaagcttcca

SEQ ID NO: 576252 - DNA, 25 bp, Rattus norvegicus
tcactgtgtggtgtggaagcttcca

SEQ ID NO: 576253 - DNA, 25 bp, Rattus norvegicus
tcactgtgtttgaggcaggccttga

SEQ ID NO: 576254 - DNA, 25 bp, Rattus norvegicus
tcactgtgtttgtggcaggccttga

SEQ ID NO: 576255 - DNA, 25 bp, Rattus norvegicus
tcactgttactgaagaaagcaccaa

SEQ ID NO: 576256 - DNA, 25 bp, Rattus norvegicus
tcactgttactgtagaaagcaccaa

SEQ ID NO: 576257 - DNA, 25 bp, Rattus norvegicus
tcactgttcccaatgtctctagaag

SEQ ID NO: 576258 - DNA, 25 bp, Rattus norvegicus
tcactgttcccattgtctctagaag

SEQ ID NO: 576259 - DNA, 25 bp, Rattus norvegicus
tcactgttgccaacggccataaaag

SEQ ID NO: 576260 - DNA, 25 bp, Rattus norvegicus
tcactgttgccatcggccataaaag

SEQ ID NO: 576261 - DNA, 25 bp, Rattus norvegicus
tcactgttgcctctcacttttttct

SEQ ID NO: 576262 - DNA, 25 bp, Rattus norvegicus
tcactgttgcctgtcacttttttct

SEQ ID NO: 576263 - DNA, 25 bp, Rattus norvegicus
tcactgttgtgaagagcgtctgcca

SEQ ID NO: 576264 - DNA, 25 bp, Rattus norvegicus
tcactgttgtgatgagcgtctgcca

SEQ ID NO: 576265 - DNA, 25 bp, Rattus norvegicus
tcactgttgttgcttcttgcctctc

SEQ ID NO: 576266 - DNA, 25 bp, Rattus norvegicus
tcactgttgttggttcttgcctctc

SEQ ID NO: 576267 - DNA, 25 bp, Rattus norvegicus
tcactgtttcgtatgctttaatttc

SEQ ID NO: 576268 - DNA, 25 bp, Rattus norvegicus
tcactgtttcgtttgctttaatttc

SEQ ID NO: 576269 - DNA, 25 bp, Rattus norvegicus
tcacttaaaatactttcctctcagg

SEQ ID NO: 576270 - DNA, 25 bp, Rattus norvegicus
tcacttaaaatagtttcctctcagg

SEQ ID NO: 576271 - DNA, 25 bp, Rattus norvegicus
tcacttaataaaactctgccgctcg

SEQ ID NO: 576272 - DNA, 25 bp, Rattus norvegicus
tcacttaataaatctctgccgctcg

SEQ ID NO: 576273 - DNA, 25 bp, Rattus norvegicus
tcacttacgatcacaacctgtgtgg

SEQ ID NO: 576274 - DNA, 25 bp, Rattus norvegicus
tcacttacgatctcaacctgtgtgg

SEQ ID NO: 576275 - DNA, 25 bp, Rattus norvegicus
tcacttacttttaattcccaacagg

SEQ ID NO: 576276 - DNA, 25 bp, Rattus norvegicus
tcacttactttttattcccaacagg

SEQ ID NO: 576277 - DNA, 25 bp, Rattus norvegicus
tcacttagaaaacgcccaaattgct

SEQ ID NO: 576278 - DNA, 25 bp, Rattus norvegicus
tcacttagaaaaggcccaaattgct

SEQ ID NO: 576279 - DNA, 25 bp, Rattus norvegicus
tcacttatccacagacagcaacggt

SEQ ID NO: 576280 - DNA, 25 bp, Rattus norvegicus
tcacttatccactgacagcaacggt

SEQ ID NO: 576281 - DNA, 25 bp, Rattus norvegicus
tcacttatcgctccgtgtcataaca

SEQ ID NO: 576282 - DNA, 25 bp, Rattus norvegicus
tcacttatcgctgcgtgtcataaca

SEQ ID NO: 576283 - DNA, 25 bp, Rattus norvegicus
tcacttatctttatgttcactcgcc

SEQ ID NO: 576284 - DNA, 25 bp, Rattus norvegicus
tcacttatctttttgttcactcgcc

SEQ ID NO: 576285 - DNA, 25 bp, Rattus norvegicus
tcacttatgcctagatgccacacaa

SEQ ID NO: 576286 - DNA, 25 bp, Rattus norvegicus
tcacttatgccttgatgccacacaa

SEQ ID NO: 576287 - DNA, 25 bp, Rattus norvegicus
tcacttattcaaccctattccacta

SEQ ID NO: 576288 - DNA, 25 bp, Rattus norvegicus
tcacttattcaagcctattccacta

SEQ ID NO: 576289 - DNA, 25 bp, Rattus norvegicus
tcacttcacccaaactgtacagaga

SEQ ID NO: 576290 - DNA, 25 bp, Rattus norvegicus
tcacttcacccatactgtacagaga

SEQ ID NO: 576291 - DNA, 25 bp, Rattus norvegicus
tcacttcacggaaggagatgactcc

SEQ ID NO: 576292 - DNA, 25 bp, Rattus norvegicus
tcacttcacggatggagatgactcc

SEQ ID NO: 576293 - DNA, 25 bp, Rattus norvegicus
tcacttcactgaatagccaagggta

SEQ ID NO: 576294 - DNA, 25 bp, Rattus norvegicus
tcacttcactgattagccaagggta

SEQ ID NO: 576295 - DNA, 25 bp, Rattus norvegicus
tcacttcactttcccagctttgtgg

SEQ ID NO: 576296 - DNA, 25 bp, Rattus norvegicus
tcacttcactttgccagctttgtgg

SEQ ID NO: 576297 - DNA, 25 bp, Rattus norvegicus
tcacttcagagaaggcggcatgttt

SEQ ID NO: 576298 - DNA, 25 bp, Rattus norvegicus
tcacttcagagatggcggcatgttt

SEQ ID NO: 576299 - DNA, 25 bp, Rattus norvegicus
tcacttcatacgaacagcagatcct

SEQ ID NO: 576300 - DNA, 25 bp, Rattus norvegicus
tcacttcatacgtacagcagatcct

SEQ ID NO: 576301 - DNA, 25 bp, Rattus norvegicus
tcacttcattttcttcagcgtcatt

SEQ ID NO: 576302 - DNA, 25 bp, Rattus norvegicus
tcacttcattttgttcagcgtcatt

SEQ ID NO: 576303 - DNA, 25 bp, Rattus norvegicus
tcacttccaaatatgagtatagcgg

SEQ ID NO: 576304 - DNA, 25 bp, Rattus norvegicus
tcacttccaaatttgagtatagcgg

SEQ ID NO: 576305 - DNA, 25 bp, Rattus norvegicus
tcacttccacatctgttctcataca

SEQ ID NO: 576306 - DNA, 25 bp, Rattus norvegicus
tcacttccacatgtgttctcataca

SEQ ID NO: 576307 - DNA, 25 bp, Rattus norvegicus
tcacttccctatcaacgtcgttatt

SEQ ID NO: 576308 - DNA, 25 bp, Rattus norvegicus
tcacttccctatgaacgtcgttatt

SEQ ID NO: 576309 - DNA, 25 bp, Rattus norvegicus
tcacttccggtgacgtggtggccag

SEQ ID NO: 576310 - DNA, 25 bp, Rattus norvegicus
tcacttccggtgtcgtggtggccag

SEQ ID NO: 576311 - DNA, 25 bp, Rattus norvegicus
tcacttcctagcagagcccagtttg

SEQ ID NO: 576312 - DNA, 25 bp, Rattus norvegicus
tcacttcctagctgagcccagtttg

SEQ ID NO: 576313 - DNA, 25 bp, Rattus norvegicus
tcacttcctgacctgatgatgatat

SEQ ID NO: 576314 - DNA, 25 bp, Rattus norvegicus
tcacttcctgacgtgatgatgatat

SEQ ID NO: 576315 - DNA, 25 bp, Rattus norvegicus
tcacttccttcgctgttagggacga

SEQ ID NO: 576316 - DNA, 25 bp, Rattus norvegicus
tcacttccttcggtgttagggacga

SEQ ID NO: 576317 - DNA, 25 bp, Rattus norvegicus
tcacttcggtccagtacagacacaa

SEQ ID NO: 576318 - DNA, 25 bp, Rattus norvegicus
tcacttcggtcctgtacagacacaa

SEQ ID NO: 576319 - DNA, 25 bp, Rattus norvegicus
tcacttctaccacgcttaagggata

SEQ ID NO: 576320 - DNA, 25 bp, Rattus norvegicus
tcacttctaccaggcttaagggata

SEQ ID NO: 576321 - DNA, 25 bp, Rattus norvegicus
tcacttctgcctcttgacttcaaaa

SEQ ID NO: 576322 - DNA, 25 bp, Rattus norvegicus
tcacttctgcctgttgacttcaaaa

SEQ ID NO: 576323 - DNA, 25 bp, Rattus norvegicus
tcacttctgctcagaatgacctgaa

SEQ ID NO: 576324 - DNA, 25 bp, Rattus norvegicus
tcacttctgctcagagtctatctag

SEQ ID NO: 576325 - DNA, 25 bp, Rattus norvegicus
tcacttctgctctgaatgacctgaa

SEQ ID NO: 576326 - DNA, 25 bp, Rattus norvegicus
tcacttctgctctgagtctatctag

SEQ ID NO: 576327 - DNA, 25 bp, Rattus norvegicus
tcacttctgggaaacgttgcaaata

SEQ ID NO: 576328 - DNA, 25 bp, Rattus norvegicus
tcacttctgggaattcagatctctc

SEQ ID NO: 576329 - DNA, 25 bp, Rattus norvegicus
tcacttctgggatacgttgcaaata

SEQ ID NO: 576330 - DNA, 25 bp, Rattus norvegicus
tcacttctgggatttcagatctctc

SEQ ID NO: 576331 - DNA, 25 bp, Rattus norvegicus
tcacttctggttactgtttcgtttt

SEQ ID NO: 576332 - DNA, 25 bp, Rattus norvegicus
tcacttctggtttctgtttcgtttt

SEQ ID NO: 576333 - DNA, 25 bp, Rattus norvegicus
tcacttctgtcaacttcagcatcag

SEQ ID NO: 576334 - DNA, 25 bp, Rattus norvegicus
tcacttctgtcatcttcagcatcag

SEQ ID NO: 576335 - DNA, 25 bp, Rattus norvegicus
tcacttcttctcataaggccacatg

SEQ ID NO: 576336 - DNA, 25 bp, Rattus norvegicus
tcacttcttctcttaaggccacatg

SEQ ID NO: 576337 - DNA, 25 bp, Rattus norvegicus
tcacttcttgtaaattttgctgcat

SEQ ID NO: 576338 - DNA, 25 bp, Rattus norvegicus
tcacttcttgtatattttgctgcat

SEQ ID NO: 576339 - DNA, 25 bp, Rattus norvegicus
tcacttgaagggacctcgcagggaa

SEQ ID NO: 576340 - DNA, 25 bp, Rattus norvegicus
tcacttgaagggtcctcgcagggaa

SEQ ID NO: 576341 - DNA, 25 bp, Rattus norvegicus
tcacttgaagttaggcttcccatct

SEQ ID NO: 576342 - DNA, 25 bp, Rattus norvegicus
tcacttgaagtttggcttcccatct

SEQ ID NO: 576343 - DNA, 25 bp, Rattus norvegicus
tcacttgaatctcctaccttatgta

SEQ ID NO: 576344 - DNA, 25 bp, Rattus norvegicus
tcacttgaatctgctaccttatgta

SEQ ID NO: 576345 - DNA, 25 bp, Rattus norvegicus
tcacttgacagtaaactactacctt

SEQ ID NO: 576346 - DNA, 25 bp, Rattus norvegicus
tcacttgacagttaactactacctt

SEQ ID NO: 576347 - DNA, 25 bp, Rattus norvegicus
tcacttgccaatctacataccttgt

SEQ ID NO: 576348 - DNA, 25 bp, Rattus norvegicus
tcacttgccaatgtacataccttgt

SEQ ID NO: 576349 - DNA, 25 bp, Rattus norvegicus
tcacttgccgtcactagagattagg

SEQ ID NO: 576350 - DNA, 25 bp, Rattus norvegicus
tcacttgccgtctctagagattagg

SEQ ID NO: 576351 - DNA, 25 bp, Rattus norvegicus
tcacttgcttctatttccaggacaa

SEQ ID NO: 576352 - DNA, 25 bp, Rattus norvegicus
tcacttgcttctttttccaggacaa

SEQ ID NO: 576353 - DNA, 25 bp, Rattus norvegicus
tcacttggaaacagctgggccacca

SEQ ID NO: 576354 - DNA, 25 bp, Rattus norvegicus
tcacttggaaactgctgggccacca

SEQ ID NO: 576355 - DNA, 25 bp, Rattus norvegicus
tcacttggctgaattgctgacaaca

SEQ ID NO: 576356 - DNA, 25 bp, Rattus norvegicus
tcacttggctgatttgctgacaaca

SEQ ID NO: 576357 - DNA, 25 bp, Rattus norvegicus
tcacttggctttaccatcagatgag

SEQ ID NO: 576358 - DNA, 25 bp, Rattus norvegicus
tcacttggcttttccatcagatgag

SEQ ID NO: 576359 - DNA, 25 bp, Rattus norvegicus
tcacttgggatgatcttctggacat

SEQ ID NO: 576360 - DNA, 25 bp, Rattus norvegicus
tcacttgggatgttcttctggacat

SEQ ID NO: 576361 - DNA, 25 bp, Rattus norvegicus
tcacttgggtttctgtacttgacag

SEQ ID NO: 576362 - DNA, 25 bp, Rattus norvegicus
tcacttgggtttgtgtacttgacag

SEQ ID NO: 576363 - DNA, 25 bp, Rattus norvegicus
tcacttggtcaacggtactctggcc

SEQ ID NO: 576364 - DNA, 25 bp, Rattus norvegicus
tcacttggtcaagggtactctggcc

SEQ ID NO: 576365 - DNA, 25 bp, Rattus norvegicus
tcacttggtggaagctctctacctg

SEQ ID NO: 576366 - DNA, 25 bp, Rattus norvegicus
tcacttggtggatgctctctacctg

SEQ ID NO: 576367 - DNA, 25 bp, Rattus norvegicus
tcacttggttggatactttcttggc

SEQ ID NO: 576368 - DNA, 25 bp, Rattus norvegicus
tcacttggttggttactttcttggc

SEQ ID NO: 576369 - DNA, 25 bp, Rattus norvegicus
tcacttgtcctcaggtaggccaggg

SEQ ID NO: 576370 - DNA, 25 bp, Rattus norvegicus
tcacttgtcctctggtaggccaggg

SEQ ID NO: 576371 - DNA, 25 bp, Rattus norvegicus
tcacttgtcttacggctcagtggta

SEQ ID NO: 576372 - DNA, 25 bp, Rattus norvegicus
tcacttgtcttagggctcagtggta

SEQ ID NO: 576373 - DNA, 25 bp, Rattus norvegicus
tcacttgtcttcaggaggcgagcac

SEQ ID NO: 576374 - DNA, 25 bp, Rattus norvegicus
tcacttgtcttctggaggcgagcac

SEQ ID NO: 576375 - DNA, 25 bp, Rattus norvegicus
tcacttgtgcagatacttctgttta

SEQ ID NO: 576376 - DNA, 25 bp, Rattus norvegicus
tcacttgtgcagttacttctgttta

SEQ ID NO: 576377 - DNA, 25 bp, Rattus norvegicus
tcacttgtgctaaggagagacgacc

SEQ ID NO: 576378 - DNA, 25 bp, Rattus norvegicus
tcacttgtgctatggagagacgacc

SEQ ID NO: 576379 - DNA, 25 bp, Rattus norvegicus
tcacttgtgggcatttcccgggctt

SEQ ID NO: 576380 - DNA, 25 bp, Rattus norvegicus
tcacttgtgggcttttcccgggctt

SEQ ID NO: 576381 - DNA, 25 bp, Rattus norvegicus
tcacttgttggccagtattgtttct

SEQ ID NO: 576382 - DNA, 25 bp, Rattus norvegicus
tcacttgttggcgagtattgtttct

SEQ ID NO: 576383 - DNA, 25 bp, Rattus norvegicus
tcactttatacccatcttttttctt

SEQ ID NO: 576384 - DNA, 25 bp, Rattus norvegicus
tcactttataccgatcttttttctt

SEQ ID NO: 576385 - DNA, 25 bp, Rattus norvegicus
tcactttattatacccaggttccca

SEQ ID NO: 576386 - DNA, 25 bp, Rattus norvegicus
tcactttattattcccaggttccca

SEQ ID NO: 576387 - DNA, 25 bp, Rattus norvegicus
tcactttcaccccaagactttatta

SEQ ID NO: 576388 - DNA, 25 bp, Rattus norvegicus
tcactttcacccgaagactttatta

SEQ ID NO: 576389 - DNA, 25 bp, Rattus norvegicus
tcactttcagaaatccagaggccat

SEQ ID NO: 576390 - DNA, 25 bp, Rattus norvegicus
tcactttcagaattccagaggccat

SEQ ID NO: 576391 - DNA, 25 bp, Rattus norvegicus
tcactttcaggcacacttctgagta

SEQ ID NO: 576392 - DNA, 25 bp, Rattus norvegicus
tcactttcaggctcacttctgagta

SEQ ID NO: 576393 - DNA, 25 bp, Rattus norvegicus
tcactttcagtacagagctcagcct

SEQ ID NO: 576394 - DNA, 25 bp, Rattus norvegicus
tcactttcagtagagagctcagcct

SEQ ID NO: 576395 - DNA, 25 bp, Rattus norvegicus
tcactttccacgaggaggctctaag

SEQ ID NO: 576396 - DNA, 25 bp, Rattus norvegicus
tcactttccacgtggaggctctaag

SEQ ID NO: 576397 - DNA, 25 bp, Rattus norvegicus
tcactttcctcactcatttctgaac

SEQ ID NO: 576398 - DNA, 25 bp, Rattus norvegicus
tcactttcctcagtcatttctgaac

SEQ ID NO: 576399 - DNA, 25 bp, Rattus norvegicus
tcactttcctgtagcatcttgctta

SEQ ID NO: 576400 - DNA, 25 bp, Rattus norvegicus
tcactttcctgttgcatcttgctta

SEQ ID NO: 576401 - DNA, 25 bp, Rattus norvegicus
tcactttcctttaatccgcagagaa

SEQ ID NO: 576402 - DNA, 25 bp, Rattus norvegicus
tcactttccttttatccgcagagaa

SEQ ID NO: 576403 - DNA, 25 bp, Rattus norvegicus
tcactttctcagacatttccaggga

SEQ ID NO: 576404 - DNA, 25 bp, Rattus norvegicus
tcactttctcagtcatttccaggga

SEQ ID NO: 576405 - DNA, 25 bp, Rattus norvegicus
tcactttctgttctagccttctgta

SEQ ID NO: 576406 - DNA, 25 bp, Rattus norvegicus
tcactttctgttgtagccttctgta

SEQ ID NO: 576407 - DNA, 25 bp, Rattus norvegicus
tcactttgagcacaggccgtggtaa

SEQ ID NO: 576408 - DNA, 25 bp, Rattus norvegicus
tcactttgagcagaggccgtggtaa

SEQ ID NO: 576409 - DNA, 25 bp, Rattus norvegicus
tcactttgcggtcacttgcattgta

SEQ ID NO: 576410 - DNA, 25 bp, Rattus norvegicus
tcactttgcggtgacttgcattgta

SEQ ID NO: 576411 - DNA, 25 bp, Rattus norvegicus
tcactttgctctaagaaggagtcaa

SEQ ID NO: 576412 - DNA, 25 bp, Rattus norvegicus
tcactttgctcttagaaggagtcaa

SEQ ID NO: 576413 - DNA, 25 bp, Rattus norvegicus
tcactttggcctctggtgagaacct

SEQ ID NO: 576414 - DNA, 25 bp, Rattus norvegicus
tcactttggcctgtggtgagaacct

SEQ ID NO: 576415 - DNA, 25 bp, Rattus norvegicus
tcactttgtaagaaaactctcggag

SEQ ID NO: 576416 - DNA, 25 bp, Rattus norvegicus
tcactttgtaagtaaactctcggag

SEQ ID NO: 576417 - DNA, 25 bp, Rattus norvegicus
tcactttgtactcccaatctgttgg

SEQ ID NO: 576418 - DNA, 25 bp, Rattus norvegicus
tcactttgtactgccaatctgttgg

SEQ ID NO: 576419 - DNA, 25 bp, Rattus norvegicus
tcactttgtattctctatccagggc

SEQ ID NO: 576420 - DNA, 25 bp, Rattus norvegicus
tcactttgtattgtctatccagggc

SEQ ID NO: 576421 - DNA, 25 bp, Rattus norvegicus
tcactttgtcctagctgtggttaaa

SEQ ID NO: 576422 - DNA, 25 bp, Rattus norvegicus
tcactttgtccttgctgtggttaaa

SEQ ID NO: 576423 - DNA, 25 bp, Rattus norvegicus
tcactttgtgtcattggattttggg

SEQ ID NO: 576424 - DNA, 25 bp, Rattus norvegicus
tcactttgtgtctttggattttggg

SEQ ID NO: 576425 - DNA, 25 bp, Rattus norvegicus
tcactttgtgttatctgtttcctgg

SEQ ID NO: 576426 - DNA, 25 bp, Rattus norvegicus
tcactttgtgttttctgtttcctgg

SEQ ID NO: 576427 - DNA, 25 bp, Rattus norvegicus
tcacttttaaccaactggagccctc

SEQ ID NO: 576428 - DNA, 25 bp, Rattus norvegicus
tcacttttaacctactggagccctc

SEQ ID NO: 576429 - DNA, 25 bp, Rattus norvegicus
tcactttttacccaggccagtagat

SEQ ID NO: 576430 - DNA, 25 bp, Rattus norvegicus
tcactttttaccgaggccagtagat

SEQ ID NO: 576431 - DNA, 25 bp, Rattus norvegicus
tcactttttagtctcagactcctcc

SEQ ID NO: 576432 - DNA, 25 bp, Rattus norvegicus
tcactttttagtgtcagactcctcc

SEQ ID NO: 576433 - DNA, 25 bp, Rattus norvegicus
tcactttttcacaaactttgcccaa

SEQ ID NO: 576434 - DNA, 25 bp, Rattus norvegicus
tcactttttcacactcactgggact

SEQ ID NO: 576435 - DNA, 25 bp, Rattus norvegicus
tcactttttcactaactttgcccaa

SEQ ID NO: 576436 - DNA, 25 bp, Rattus norvegicus
tcactttttcactctcactgggact

SEQ ID NO: 576437 - DNA, 25 bp, Rattus norvegicus
tcactttttgggaaactagccctgg

SEQ ID NO: 576438 - DNA, 25 bp, Rattus norvegicus
tcactttttgggtaactagccctgg

SEQ ID NO: 576439 - DNA, 25 bp, Rattus norvegicus
tcagaaaaattgaccagacccctac

SEQ ID NO: 576440 - DNA, 25 bp, Rattus norvegicus
tcagaaaaattgtccagacccctac

SEQ ID NO: 576441 - DNA, 25 bp, Rattus norvegicus
tcagaaaacagtcacttgccccatg

SEQ ID NO: 576442 - DNA, 25 bp, Rattus norvegicus
tcagaaaacagtgacttgccccatg

SEQ ID NO: 576443 - DNA, 25 bp, Rattus norvegicus
tcagaaaatttcacaggcagccaat

SEQ ID NO: 576444 - DNA, 25 bp, Rattus norvegicus
tcagaaaatttctcaggcagccaat

SEQ ID NO: 576445 - DNA, 25 bp, Rattus norvegicus
tcagaaaccagcaactccagaaacc

SEQ ID NO: 576446 - DNA, 25 bp, Rattus norvegicus
tcagaaaccagctactccagaaacc

SEQ ID NO: 576447 - DNA, 25 bp, Rattus norvegicus
tcagaaacccagagagaccggctgc

SEQ ID NO: 576448 - DNA, 25 bp, Rattus norvegicus
tcagaaacccagtgagaccggctgc

SEQ ID NO: 576449 - DNA, 25 bp, Rattus norvegicus
tcagaaacttctcaggaccgataaa

SEQ ID NO: 576450 - DNA, 25 bp, Rattus norvegicus
tcagaaacttctgaggaccgataaa

SEQ ID NO: 576451 - DNA, 25 bp, Rattus norvegicus
tcagaaaggtgtctcgctagaggct

SEQ ID NO: 576452 - DNA, 25 bp, Rattus norvegicus
tcagaaaggtgtgtcgctagaggct

SEQ ID NO: 576453 - DNA, 25 bp, Rattus norvegicus
tcagaaagttccctatctaccccat

SEQ ID NO: 576454 - DNA, 25 bp, Rattus norvegicus
tcagaaagttccgtatctaccccat

SEQ ID NO: 576455 - DNA, 25 bp, Rattus norvegicus
tcagaaatcaagcctgtcacattgc

SEQ ID NO: 576456 - DNA, 25 bp, Rattus norvegicus
tcagaaatcaaggctgtcacattgc

SEQ ID NO: 576457 - DNA, 25 bp, Rattus norvegicus
tcagaaatccttcgagggcactccc

SEQ ID NO: 576458 - DNA, 25 bp, Rattus norvegicus
tcagaaatccttggagggcactccc

SEQ ID NO: 576459 - DNA, 25 bp, Rattus norvegicus
tcagaaatctgaacatcgaaacgaa

SEQ ID NO: 576460 - DNA, 25 bp, Rattus norvegicus
tcagaaatctgatcatcgaaacgaa

SEQ ID NO: 576461 - DNA, 25 bp, Rattus norvegicus
tcagaaatggccatggctgttttca

SEQ ID NO: 576462 - DNA, 25 bp, Rattus norvegicus
tcagaaatggccttggctgttttca

SEQ ID NO: 576463 - DNA, 25 bp, Rattus norvegicus
tcagaacaacccactgatgccacgg

SEQ ID NO: 576464 - DNA, 25 bp, Rattus norvegicus
tcagaacaaccctctgatgccacgg

SEQ ID NO: 576465 - DNA, 25 bp, Rattus norvegicus
tcagaacaactccagttctttccca

SEQ ID NO: 576466 - DNA, 25 bp, Rattus norvegicus
tcagaacaactcgagttctttccca

SEQ ID NO: 576467 - DNA, 25 bp, Rattus norvegicus
tcagaacacgttcccggtcaagatc

SEQ ID NO: 576468 - DNA, 25 bp, Rattus norvegicus
tcagaacacgttgccggtcaagatc

SEQ ID NO: 576469 - DNA, 25 bp, Rattus norvegicus
tcagaacagggcactcctacttaga

SEQ ID NO: 576470 - DNA, 25 bp, Rattus norvegicus
tcagaacagggctctcctacttaga

SEQ ID NO: 576471 - DNA, 25 bp, Rattus norvegicus
tcagaaccactgagcatcatgcaga

SEQ ID NO: 576472 - DNA, 25 bp, Rattus norvegicus
tcagaaccactgtgcatcatgcaga

SEQ ID NO: 576473 - DNA, 25 bp, Rattus norvegicus
tcagaaccccaacttccaatagagt

SEQ ID NO: 576474 - DNA, 25 bp, Rattus norvegicus
tcagaaccccaagttccaatagagt

SEQ ID NO: 576475 - DNA, 25 bp, Rattus norvegicus
tcagaaccctccatcttgttaacgg

SEQ ID NO: 576476 - DNA, 25 bp, Rattus norvegicus
tcagaaccctccttcttgttaacgg

SEQ ID NO: 576477 - DNA, 25 bp, Rattus norvegicus
tcagaaccggagcttcaacgcagaa

SEQ ID NO: 576478 - DNA, 25 bp, Rattus norvegicus
tcagaaccggaggttcaacgcagaa

SEQ ID NO: 576479 - DNA, 25 bp, Rattus norvegicus
tcagaaccgtgtcgctaaagctgcc

SEQ ID NO: 576480 - DNA, 25 bp, Rattus norvegicus
tcagaaccgtgtggctaaagctgcc

SEQ ID NO: 576481 - DNA, 25 bp, Rattus norvegicus
tcagaacctcagctcatcatgtatg

SEQ ID NO: 576482 - DNA, 25 bp, Rattus norvegicus
tcagaacctcaggtcatcatgtatg

SEQ ID NO: 576483 - DNA, 25 bp, Rattus norvegicus
tcagaacctggtcacagcgtgtcca

SEQ ID NO: 576484 - DNA, 25 bp, Rattus norvegicus
tcagaacctggtgacagcgtgtcca

SEQ ID NO: 576485 - DNA, 25 bp, Rattus norvegicus
tcagaacctttcattggaatcgttt

SEQ ID NO: 576486 - DNA, 25 bp, Rattus norvegicus
tcagaacctttctttggaatcgttt

SEQ ID NO: 576487 - DNA, 25 bp, Rattus norvegicus
tcagaacgggagagccttcctgcag

SEQ ID NO: 576488 - DNA, 25 bp, Rattus norvegicus
tcagaacgggagtgccttcctgcag

SEQ ID NO: 576489 - DNA, 25 bp, Rattus norvegicus
tcagaacgtctaatgcgcttgcttt

SEQ ID NO: 576490 - DNA, 25 bp, Rattus norvegicus
tcagaacgtctattgcgcttgcttt

SEQ ID NO: 576491 - DNA, 25 bp, Rattus norvegicus
tcagaactactgagtgcctttagct

SEQ ID NO: 576492 - DNA, 25 bp, Rattus norvegicus
tcagaactactgtgtgcctttagct

SEQ ID NO: 576493 - DNA, 25 bp, Rattus norvegicus
tcagaactgcatcacgaccgtagta

SEQ ID NO: 576494 - DNA, 25 bp, Rattus norvegicus
tcagaactgcatgacgaccgtagta

SEQ ID NO: 576495 - DNA, 25 bp, Rattus norvegicus
tcagaactgcgtcctgtctttcttc

SEQ ID NO: 576496 - DNA, 25 bp, Rattus norvegicus
tcagaactgcgtgctgtctttcttc

SEQ ID NO: 576497 - DNA, 25 bp, Rattus norvegicus
tcagaactgctcatcttcaccaaag

SEQ ID NO: 576498 - DNA, 25 bp, Rattus norvegicus
tcagaactgctcttcttcaccaaag

SEQ ID NO: 576499 - DNA, 25 bp, Rattus norvegicus
tcagaactgcttctcataggctgct

SEQ ID NO: 576500 - DNA, 25 bp, Rattus norvegicus
tcagaactgcttgtcataggctgct

SEQ ID NO: 576501 - DNA, 25 bp, Rattus norvegicus
tcagaagacccgaccgtcctgggaa

SEQ ID NO: 576502 - DNA, 25 bp, Rattus norvegicus
tcagaagacccgtccgtcctgggaa

SEQ ID NO: 576503 - DNA, 25 bp, Rattus norvegicus
tcagaagagattccttcccctgggt

SEQ ID NO: 576504 - DNA, 25 bp, Rattus norvegicus
tcagaagagattgcttcccctgggt

SEQ ID NO: 576505 - DNA, 25 bp, Rattus norvegicus
tcagaagatcaacactgagtcctga

SEQ ID NO: 576506 - DNA, 25 bp, Rattus norvegicus
tcagaagatcaagactgagtcctga

SEQ ID NO: 576507 - DNA, 25 bp, Rattus norvegicus
tcagaagatgcgagccgtgggccaa

SEQ ID NO: 576508 - DNA, 25 bp, Rattus norvegicus
tcagaagatgcgtgccgtgggccaa

SEQ ID NO: 576509 - DNA, 25 bp, Rattus norvegicus
tcagaagattctccatatgtacccc

SEQ ID NO: 576510 - DNA, 25 bp, Rattus norvegicus
tcagaagattctgcatatgtacccc

SEQ ID NO: 576511 - DNA, 25 bp, Rattus norvegicus
tcagaagcaataccagcctgcctca

SEQ ID NO: 576512 - DNA, 25 bp, Rattus norvegicus
tcagaagcaatagcagcctgcctca

SEQ ID NO: 576513 - DNA, 25 bp, Rattus norvegicus
tcagaagcatccacctcttcactgg

SEQ ID NO: 576514 - DNA, 25 bp, Rattus norvegicus
tcagaagcatcctcctcttcactgg

SEQ ID NO: 576515 - DNA, 25 bp, Rattus norvegicus
tcagaagcattcatttcaccacaag

SEQ ID NO: 576516 - DNA, 25 bp, Rattus norvegicus
tcagaagcattcttttcaccacaag

SEQ ID NO: 576517 - DNA, 25 bp, Rattus norvegicus
tcagaagccaagagatgtcctctgc

SEQ ID NO: 576518 - DNA, 25 bp, Rattus norvegicus
tcagaagccaagtgatgtcctctgc

SEQ ID NO: 576519 - DNA, 25 bp, Rattus norvegicus
tcagaagccactatagcgtctctct

SEQ ID NO: 576520 - DNA, 25 bp, Rattus norvegicus
tcagaagccactttagcgtctctct

SEQ ID NO: 576521 - DNA, 25 bp, Rattus norvegicus
tcagaagccattcccgagggccaga

SEQ ID NO: 576522 - DNA, 25 bp, Rattus norvegicus
tcagaagccattgccgagggccaga

SEQ ID NO: 576523 - DNA, 25 bp, Rattus norvegicus
tcagaagccctactgaccttggttg

SEQ ID NO: 576524 - DNA, 25 bp, Rattus norvegicus
tcagaagccctagtgaccttggttg

SEQ ID NO: 576525 - DNA, 25 bp, Rattus norvegicus
tcagaagccgcaacatcacctgtgg

SEQ ID NO: 576526 - DNA, 25 bp, Rattus norvegicus
tcagaagccgcatcatcacctgtgg

SEQ ID NO: 576527 - DNA, 25 bp, Rattus norvegicus
tcagaagctatcatggtcccaggga

SEQ ID NO: 576528 - DNA, 25 bp, Rattus norvegicus
tcagaagctatcttggtcccaggga

SEQ ID NO: 576529 - DNA, 25 bp, Rattus norvegicus
tcagaagctgggaactggccttgga

SEQ ID NO: 576530 - DNA, 25 bp, Rattus norvegicus
tcagaagctgggtactggccttgga

SEQ ID NO: 576531 - DNA, 25 bp, Rattus norvegicus
tcagaagcttcaagtgtcctgcaca

SEQ ID NO: 576532 - DNA, 25 bp, Rattus norvegicus
tcagaagcttcatgtgtcctgcaca

SEQ ID NO: 576533 - DNA, 25 bp, Rattus norvegicus
tcagaaggaaccagggctctctaac

SEQ ID NO: 576534 - DNA, 25 bp, Rattus norvegicus
tcagaaggaacctgggctctctaac

SEQ ID NO: 576535 - DNA, 25 bp, Rattus norvegicus
tcagaaggaagacagcgtcctctgt

SEQ ID NO: 576536 - DNA, 25 bp, Rattus norvegicus
tcagaaggaagagagcgtcctctgt

SEQ ID NO: 576537 - DNA, 25 bp, Rattus norvegicus
tcagaaggacccagggtgggcccct

SEQ ID NO: 576538 - DNA, 25 bp, Rattus norvegicus
tcagaaggaccctgggtgggcccct

SEQ ID NO: 576539 - DNA, 25 bp, Rattus norvegicus
tcagaaggacctcccttaccaataa

SEQ ID NO: 576540 - DNA, 25 bp, Rattus norvegicus
tcagaaggacctgccttaccaataa

SEQ ID NO: 576541 - DNA, 25 bp, Rattus norvegicus
tcagaaggagctccaggcattccca

SEQ ID NO: 576542 - DNA, 25 bp, Rattus norvegicus
tcagaaggagctgcaggcattccca

SEQ ID NO: 576543 - DNA, 25 bp, Rattus norvegicus
tcagaaggatggctcagatcccagt

SEQ ID NO: 576544 - DNA, 25 bp, Rattus norvegicus
tcagaaggatgggtcagatcccagt

SEQ ID NO: 576545 - DNA, 25 bp, Rattus norvegicus
tcagaaggcatgaaaccgcaggtta

SEQ ID NO: 576546 - DNA, 25 bp, Rattus norvegicus
tcagaaggcatgtaaccgcaggtta

SEQ ID NO: 576547 - DNA, 25 bp, Rattus norvegicus
tcagaaggcctccagtctctcaaac

SEQ ID NO: 576548 - DNA, 25 bp, Rattus norvegicus
tcagaaggcctcgagtctctcaaac

SEQ ID NO: 576549 - DNA, 25 bp, Rattus norvegicus
tcagaaggctgtccccgaaattgtt

SEQ ID NO: 576550 - DNA, 25 bp, Rattus norvegicus
tcagaaggctgtgcccgaaattgtt

SEQ ID NO: 576551 - DNA, 25 bp, Rattus norvegicus
tcagaagggcccaaggttcctggag

SEQ ID NO: 576552 - DNA, 25 bp, Rattus norvegicus
tcagaagggccctaggttcctggag

SEQ ID NO: 576553 - DNA, 25 bp, Rattus norvegicus
tcagaagggtcgactgctctatgcc

SEQ ID NO: 576554 - DNA, 25 bp, Rattus norvegicus
tcagaagggtcgtctgctctatgcc

SEQ ID NO: 576555 - DNA, 25 bp, Rattus norvegicus
tcagaagggtgaagcccgtaacttt

SEQ ID NO: 576556 - DNA, 25 bp, Rattus norvegicus
tcagaagggtgatgcccgtaacttt

SEQ ID NO: 576557 - DNA, 25 bp, Rattus norvegicus
tcagaagtactacttcgcagcgaac

SEQ ID NO: 576558 - DNA, 25 bp, Rattus norvegicus
tcagaagtactagttcgcagcgaac

SEQ ID NO: 576559 - DNA, 25 bp, Rattus norvegicus
tcagaagtcagtatccttttttaat

SEQ ID NO: 576560 - DNA, 25 bp, Rattus norvegicus
tcagaagtcagtcctctactccatt

SEQ ID NO: 576561 - DNA, 25 bp, Rattus norvegicus
tcagaagtcagtgctctactccatt

SEQ ID NO: 576562 - DNA, 25 bp, Rattus norvegicus
tcagaagtcagtttccttttttaat

SEQ ID NO: 576563 - DNA, 25 bp, Rattus norvegicus
tcagaagtgctgaggatcctaggca

SEQ ID NO: 576564 - DNA, 25 bp, Rattus norvegicus
tcagaagtgctgtggatcctaggca

SEQ ID NO: 576565 - DNA, 25 bp, Rattus norvegicus
tcagaagtggatcatctcccttctc

SEQ ID NO: 576566 - DNA, 25 bp, Rattus norvegicus
tcagaagtggatgatctcccttctc

SEQ ID NO: 576567 - DNA, 25 bp, Rattus norvegicus
tcagaagttgggagctgccctccag

SEQ ID NO: 576568 - DNA, 25 bp, Rattus norvegicus
tcagaagttgggtgctgccctccag

SEQ ID NO: 576569 - DNA, 25 bp, Rattus norvegicus
tcagaatatttcctgccacatctat

SEQ ID NO: 576570 - DNA, 25 bp, Rattus norvegicus
tcagaatatttcgtgccacatctat

SEQ ID NO: 576571 - DNA, 25 bp, Rattus norvegicus
tcagaatcacccagggcttccatca

SEQ ID NO: 576572 - DNA, 25 bp, Rattus norvegicus
tcagaatcaccctgggcttccatca

SEQ ID NO: 576573 - DNA, 25 bp, Rattus norvegicus
tcagaatccgacaggcaggtggcct

SEQ ID NO: 576574 - DNA, 25 bp, Rattus norvegicus
tcagaatccgactggcaggtggcct

SEQ ID NO: 576575 - DNA, 25 bp, Rattus norvegicus
tcagaatctggcaatatttttcatt

SEQ ID NO: 576576 - DNA, 25 bp, Rattus norvegicus
tcagaatctggctatatttttcatt

SEQ ID NO: 576577 - DNA, 25 bp, Rattus norvegicus
tcagaatgcaagctggagtgtccac

SEQ ID NO: 576578 - DNA, 25 bp, Rattus norvegicus
tcagaatgcaaggtggagtgtccac

SEQ ID NO: 576579 - DNA, 25 bp, Rattus norvegicus
tcagaatggttcactttggtttggt

SEQ ID NO: 576580 - DNA, 25 bp, Rattus norvegicus
tcagaatggttctctttggtttggt

SEQ ID NO: 576581 - DNA, 25 bp, Rattus norvegicus
tcagaatgttttaggctctcccagt

SEQ ID NO: 576582 - DNA, 25 bp, Rattus norvegicus
tcagaatgtttttggctctcccagt

SEQ ID NO: 576583 - DNA, 25 bp, Rattus norvegicus
tcagaattaagcactcctttccaca

SEQ ID NO: 576584 - DNA, 25 bp, Rattus norvegicus
tcagaattaagctctcctttccaca

SEQ ID NO: 576585 - DNA, 25 bp, Rattus norvegicus
tcagaattcatacgtctcagcctca

SEQ ID NO: 576586 - DNA, 25 bp, Rattus norvegicus
tcagaattcataggtctcagcctca

SEQ ID NO: 576587 - DNA, 25 bp, Rattus norvegicus
tcagaattcatcctctcaccattgg

SEQ ID NO: 576588 - DNA, 25 bp, Rattus norvegicus
tcagaattcatcgtctcaccattgg

SEQ ID NO: 576589 - DNA, 25 bp, Rattus norvegicus
tcagaattctgtccctatcttgaaa

SEQ ID NO: 576590 - DNA, 25 bp, Rattus norvegicus
tcagaattctgtgcctatcttgaaa

SEQ ID NO: 576591 - DNA, 25 bp, Rattus norvegicus
tcagacaaatacatccatgctcggg

SEQ ID NO: 576592 - DNA, 25 bp, Rattus norvegicus
tcagacaaatacttccatgctcggg

SEQ ID NO: 576593 - DNA, 25 bp, Rattus norvegicus
tcagacaacacgcactctatggaaa

SEQ ID NO: 576594 - DNA, 25 bp, Rattus norvegicus
tcagacaacacggactctatggaaa

SEQ ID NO: 576595 - DNA, 25 bp, Rattus norvegicus
tcagacaaccagaccaccttttagt

SEQ ID NO: 576596 - DNA, 25 bp, Rattus norvegicus
tcagacaaccagtccaccttttagt

SEQ ID NO: 576597 - DNA, 25 bp, Rattus norvegicus
tcagacaactagagcagtccttgcc

SEQ ID NO: 576598 - DNA, 25 bp, Rattus norvegicus
tcagacaactagtgcagtccttgcc

SEQ ID NO: 576599 - DNA, 25 bp, Rattus norvegicus
tcagacaagctcacattggcaggat

SEQ ID NO: 576600 - DNA, 25 bp, Rattus norvegicus
tcagacaagctctcattggcaggat

SEQ ID NO: 576601 - DNA, 25 bp, Rattus norvegicus
tcagacaagcttcatgctccttcca

SEQ ID NO: 576602 - DNA, 25 bp, Rattus norvegicus
tcagacaagcttgatgctccttcca

SEQ ID NO: 576603 - DNA, 25 bp, Rattus norvegicus
tcagacaagtacatcgacgagcact

SEQ ID NO: 576604 - DNA, 25 bp, Rattus norvegicus
tcagacaagtacttcgacgagcact

SEQ ID NO: 576605 - DNA, 25 bp, Rattus norvegicus
tcagacaatgctcttcaaatgaatt

SEQ ID NO: 576606 - DNA, 25 bp, Rattus norvegicus
tcagacaatgctgttcaaatgaatt

SEQ ID NO: 576607 - DNA, 25 bp, Rattus norvegicus
tcagacaccacgagggctggctttc

SEQ ID NO: 576608 - DNA, 25 bp, Rattus norvegicus
tcagacaccacgtgggctggctttc

SEQ ID NO: 576609 - DNA, 25 bp, Rattus norvegicus
tcagacacctggacctagctattgt

SEQ ID NO: 576610 - DNA, 25 bp, Rattus norvegicus
tcagacacctggtcctagctattgt

SEQ ID NO: 576611 - DNA, 25 bp, Rattus norvegicus
tcagacacgcctcaagaagacttag

SEQ ID NO: 576612 - DNA, 25 bp, Rattus norvegicus
tcagacacgcctgaagaagacttag

SEQ ID NO: 576613 - DNA, 25 bp, Rattus norvegicus
tcagacacggacattctctttatag

SEQ ID NO: 576614 - DNA, 25 bp, Rattus norvegicus
tcagacacggactttctctttatag

SEQ ID NO: 576615 - DNA, 25 bp, Rattus norvegicus
tcagacagacagatggcccagagcc

SEQ ID NO: 576616 - DNA, 25 bp, Rattus norvegicus
tcagacagacagttggcccagagcc

SEQ ID NO: 576617 - DNA, 25 bp, Rattus norvegicus
tcagacagagcacagccagcaccaa

SEQ ID NO: 576618 - DNA, 25 bp, Rattus norvegicus
tcagacagagcagagccagcaccaa

SEQ ID NO: 576619 - DNA, 25 bp, Rattus norvegicus
tcagacagcaggcatgtatccccat

SEQ ID NO: 576620 - DNA, 25 bp, Rattus norvegicus
tcagacagcagggatgtatccccat

SEQ ID NO: 576621 - DNA, 25 bp, Rattus norvegicus
tcagacaggctgagtttccagttgt

SEQ ID NO: 576622 - DNA, 25 bp, Rattus norvegicus
tcagacaggctgtgtttccagttgt

SEQ ID NO: 576623 - DNA, 25 bp, Rattus norvegicus
tcagacagtgatcagccagcttccc

SEQ ID NO: 576624 - DNA, 25 bp, Rattus norvegicus
tcagacagtgatgagccagcttccc

SEQ ID NO: 576625 - DNA, 25 bp, Rattus norvegicus
tcagacagttgacgcgcatacagac

SEQ ID NO: 576626 - DNA, 25 bp, Rattus norvegicus
tcagacagttgaggcgcatacagac

SEQ ID NO: 576627 - DNA, 25 bp, Rattus norvegicus
tcagacatagcactcccattgggaa

SEQ ID NO: 576628 - DNA, 25 bp, Rattus norvegicus
tcagacatagcagtcccattgggaa

SEQ ID NO: 576629 - DNA, 25 bp, Rattus norvegicus
tcagacatcaatcggacaggaggcc

SEQ ID NO: 576630 - DNA, 25 bp, Rattus norvegicus
tcagacatcaatgggacaggaggcc

SEQ ID NO: 576631 - DNA, 25 bp, Rattus norvegicus
tcagacatcacacccggaactggaa

SEQ ID NO: 576632 - DNA, 25 bp, Rattus norvegicus
tcagacatcacagccggaactggaa

SEQ ID NO: 576633 - DNA, 25 bp, Rattus norvegicus
tcagacatctacaatggcttcgaag

SEQ ID NO: 576634 - DNA, 25 bp, Rattus norvegicus
tcagacatctactatggcttcgaag

SEQ ID NO: 576635 - DNA, 25 bp, Rattus norvegicus
tcagacatgcagctccatcaggaaa

SEQ ID NO: 576636 - DNA, 25 bp, Rattus norvegicus
tcagacatgcaggtccatcaggaaa

SEQ ID NO: 576637 - DNA, 25 bp, Rattus norvegicus
tcagacatgctgaaggtgccattaa

SEQ ID NO: 576638 - DNA, 25 bp, Rattus norvegicus
tcagacatgctgtaggtgccattaa

SEQ ID NO: 576639 - DNA, 25 bp, Rattus norvegicus
tcagacatgtttaggacggaggctt

SEQ ID NO: 576640 - DNA, 25 bp, Rattus norvegicus
tcagacatgttttggacggaggctt

SEQ ID NO: 576641 - DNA, 25 bp, Rattus norvegicus
tcagacattctgaaactcgcagctc

SEQ ID NO: 576642 - DNA, 25 bp, Rattus norvegicus
tcagacattctgtaactcgcagctc

SEQ ID NO: 576643 - DNA, 25 bp, Rattus norvegicus
tcagacattgttaggcacttttgca

SEQ ID NO: 576644 - DNA, 25 bp, Rattus norvegicus
tcagacattgtttggcacttttgca

SEQ ID NO: 576645 - DNA, 25 bp, Rattus norvegicus
tcagacatttcacatgcccgtcaat

SEQ ID NO: 576646 - DNA, 25 bp, Rattus norvegicus
tcagacatttcagatgcccgtcaat

SEQ ID NO: 576647 - DNA, 25 bp, Rattus norvegicus
tcagaccacaagacagccattgcca

SEQ ID NO: 576648 - DNA, 25 bp, Rattus norvegicus
tcagaccacaagtcagccattgcca

SEQ ID NO: 576649 - DNA, 25 bp, Rattus norvegicus
tcagaccactttctcctttaagttt

SEQ ID NO: 576650 - DNA, 25 bp, Rattus norvegicus
tcagaccactttgtcctttaagttt

SEQ ID NO: 576651 - DNA, 25 bp, Rattus norvegicus
tcagaccagcaaacacccttgggag

SEQ ID NO: 576652 - DNA, 25 bp, Rattus norvegicus
tcagaccagcaatcacccttgggag

SEQ ID NO: 576653 - DNA, 25 bp, Rattus norvegicus
tcagaccatgtaccagtgctctctg

SEQ ID NO: 576654 - DNA, 25 bp, Rattus norvegicus
tcagaccatgtagcagtgctctctg

SEQ ID NO: 576655 - DNA, 25 bp, Rattus norvegicus
tcagacccaagaagagagtccctat

SEQ ID NO: 576656 - DNA, 25 bp, Rattus norvegicus
tcagacccaagatgagagtccctat

SEQ ID NO: 576657 - DNA, 25 bp, Rattus norvegicus
tcagacccacgcaacaaggttggaa

SEQ ID NO: 576658 - DNA, 25 bp, Rattus norvegicus
tcagacccacgctacaaggttggaa

SEQ ID NO: 576659 - DNA, 25 bp, Rattus norvegicus
tcagacccctgtcggaaacctgaga

SEQ ID NO: 576660 - DNA, 25 bp, Rattus norvegicus
tcagacccctgtgggaaacctgaga

SEQ ID NO: 576661 - DNA, 25 bp, Rattus norvegicus
tcagaccctgccagttgtcatttca

SEQ ID NO: 576662 - DNA, 25 bp, Rattus norvegicus
tcagaccctgcctgttgtcatttca

SEQ ID NO: 576663 - DNA, 25 bp, Rattus norvegicus
tcagaccctgggacgagcccggaaa

SEQ ID NO: 576664 - DNA, 25 bp, Rattus norvegicus
tcagaccctgggtcgagcccggaaa

SEQ ID NO: 576665 - DNA, 25 bp, Rattus norvegicus
tcagacccttctcttcttgtaaata

SEQ ID NO: 576666 - DNA, 25 bp, Rattus norvegicus
tcagacccttctgttcttgtaaata

SEQ ID NO: 576667 - DNA, 25 bp, Rattus norvegicus
tcagacccttttatgccgtgcaaag

SEQ ID NO: 576668 - DNA, 25 bp, Rattus norvegicus
tcagacccttttttgccgtgcaaag

SEQ ID NO: 576669 - DNA, 25 bp, Rattus norvegicus
tcagaccgagtcacccgaagaaact

SEQ ID NO: 576670 - DNA, 25 bp, Rattus norvegicus
tcagaccgagtctcccgaagaaact

SEQ ID NO: 576671 - DNA, 25 bp, Rattus norvegicus
tcagaccgccccatgtgtggaagaa

SEQ ID NO: 576672 - DNA, 25 bp, Rattus norvegicus
tcagaccgccccttgtgtggaagaa

SEQ ID NO: 576673 - DNA, 25 bp, Rattus norvegicus
tcagaccgtttcattaaagggctct

SEQ ID NO: 576674 - DNA, 25 bp, Rattus norvegicus
tcagaccgtttctttaaagggctct

SEQ ID NO: 576675 - DNA, 25 bp, Rattus norvegicus
tcagacctcagtccagcctggacag

SEQ ID NO: 576676 - DNA, 25 bp, Rattus norvegicus
tcagacctcagtgcagcctggacag

SEQ ID NO: 576677 - DNA, 25 bp, Rattus norvegicus
tcagacctcctgctgtagtacacta

SEQ ID NO: 576678 - DNA, 25 bp, Rattus norvegicus
tcagacctcctggtgtagtacacta

SEQ ID NO: 576679 - DNA, 25 bp, Rattus norvegicus
tcagacctgactaagagctgctcct

SEQ ID NO: 576680 - DNA, 25 bp, Rattus norvegicus
tcagacctgacttagagctgctcct

SEQ ID NO: 576681 - DNA, 25 bp, Rattus norvegicus
tcagacctgagccaagtggtccagt

SEQ ID NO: 576682 - DNA, 25 bp, Rattus norvegicus
tcagacctgagcgaagtggtccagt

SEQ ID NO: 576683 - DNA, 25 bp, Rattus norvegicus
tcagacctgaggctcaaagctcaag

SEQ ID NO: 576684 - DNA, 25 bp, Rattus norvegicus
tcagacctgagggtcaaagctcaag

SEQ ID NO: 576685 - DNA, 25 bp, Rattus norvegicus
tcagacctgccaaatggttgcatgg

SEQ ID NO: 576686 - DNA, 25 bp, Rattus norvegicus
tcagacctgccatatggttgcatgg

SEQ ID NO: 576687 - DNA, 25 bp, Rattus norvegicus
tcagacctgcttaggcttcgagcac

SEQ ID NO: 576688 - DNA, 25 bp, Rattus norvegicus
tcagacctgctttggcttcgagcac

SEQ ID NO: 576689 - DNA, 25 bp, Rattus norvegicus
tcagacctttgactcactcttcagg

SEQ ID NO: 576690 - DNA, 25 bp, Rattus norvegicus
tcagacctttgagtcactcttcagg

SEQ ID NO: 576691 - DNA, 25 bp, Rattus norvegicus
tcagacgaccgtcctccatgcttgt

SEQ ID NO: 576692 - DNA, 25 bp, Rattus norvegicus
tcagacgaccgtgctccatgcttgt

SEQ ID NO: 576693 - DNA, 25 bp, Rattus norvegicus
tcagacgactcactgggactcagca

SEQ ID NO: 576694 - DNA, 25 bp, Rattus norvegicus
tcagacgactcagtgggactcagca

SEQ ID NO: 576695 - DNA, 25 bp, Rattus norvegicus
tcagacgagactacaggctccttgc

SEQ ID NO: 576696 - DNA, 25 bp, Rattus norvegicus
tcagacgagacttcaggctccttgc

SEQ ID NO: 576697 - DNA, 25 bp, Rattus norvegicus
tcagacgagtggattttggttaaat

SEQ ID NO: 576698 - DNA, 25 bp, Rattus norvegicus
tcagacgagtggtttttggttaaat

SEQ ID NO: 576699 - DNA, 25 bp, Rattus norvegicus
tcagacgagtttatcctggaacata

SEQ ID NO: 576700 - DNA, 25 bp, Rattus norvegicus
tcagacgagtttttcctggaacata

SEQ ID NO: 576701 - DNA, 25 bp, Rattus norvegicus
tcagacgattctaacacctgctcac

SEQ ID NO: 576702 - DNA, 25 bp, Rattus norvegicus
tcagacgattcttacacctgctcac

SEQ ID NO: 576703 - DNA, 25 bp, Rattus norvegicus
tcagacgcacctcaaacatgctgtg

SEQ ID NO: 576704 - DNA, 25 bp, Rattus norvegicus
tcagacgcacctgaaacatgctgtg

SEQ ID NO: 576705 - DNA, 25 bp, Rattus norvegicus
tcagacgcagcaaccagaaaaacat

SEQ ID NO: 576706 - DNA, 25 bp, Rattus norvegicus
tcagacgcagcatccagaaaaacat

SEQ ID NO: 576707 - DNA, 25 bp, Rattus norvegicus
tcagacgcctggagtcctggaagat

SEQ ID NO: 576708 - DNA, 25 bp, Rattus norvegicus
tcagacgcctggtgtcctggaagat

SEQ ID NO: 576709 - DNA, 25 bp, Rattus norvegicus
tcagacgctgctaggaagatgacag

SEQ ID NO: 576710 - DNA, 25 bp, Rattus norvegicus
tcagacgctgcttggaagatgacag

SEQ ID NO: 576711 - DNA, 25 bp, Rattus norvegicus
tcagacgggaatctcggcagccatt

SEQ ID NO: 576712 - DNA, 25 bp, Rattus norvegicus
tcagacgggaatgtcggcagccatt

SEQ ID NO: 576713 - DNA, 25 bp, Rattus norvegicus
tcagacgggcttacctttctaggtt

SEQ ID NO: 576714 - DNA, 25 bp, Rattus norvegicus
tcagacgggctttcctttctaggtt

SEQ ID NO: 576715 - DNA, 25 bp, Rattus norvegicus
tcagacgtcgaaccagtggtttaca

SEQ ID NO: 576716 - DNA, 25 bp, Rattus norvegicus
tcagacgtcgaagcagtggtttaca

SEQ ID NO: 576717 - DNA, 25 bp, Rattus norvegicus
tcagacgtgcagacagttgacccat

SEQ ID NO: 576718 - DNA, 25 bp, Rattus norvegicus
tcagacgtgcagtcagttgacccat

SEQ ID NO: 576719 - DNA, 25 bp, Rattus norvegicus
tcagactcaaggatccccttaccat

SEQ ID NO: 576720 - DNA, 25 bp, Rattus norvegicus
tcagactcaaggctcattggtctac

SEQ ID NO: 576721 - DNA, 25 bp, Rattus norvegicus
tcagactcaagggtcattggtctac

SEQ ID NO: 576722 - DNA, 25 bp, Rattus norvegicus
tcagactcaaggttccccttaccat

SEQ ID NO: 576723 - DNA, 25 bp, Rattus norvegicus
tcagactcaccaaattgctcacggt

SEQ ID NO: 576724 - DNA, 25 bp, Rattus norvegicus
tcagactcaccatattgctcacggt

SEQ ID NO: 576725 - DNA, 25 bp, Rattus norvegicus
tcagactcagtcaggcagtgctgac

SEQ ID NO: 576726 - DNA, 25 bp, Rattus norvegicus
tcagactcagtctggcagtgctgac

SEQ ID NO: 576727 - DNA, 25 bp, Rattus norvegicus
tcagactccattcccaaaacaaatt

SEQ ID NO: 576728 - DNA, 25 bp, Rattus norvegicus
tcagactccattgccaaaacaaatt

SEQ ID NO: 576729 - DNA, 25 bp, Rattus norvegicus
tcagactcccagagctgcatggtga

SEQ ID NO: 576730 - DNA, 25 bp, Rattus norvegicus
tcagactcccagtgctgcatggtga

SEQ ID NO: 576731 - DNA, 25 bp, Rattus norvegicus
tcagactcctccacctaaggatgga

SEQ ID NO: 576732 - DNA, 25 bp, Rattus norvegicus
tcagactcctcctcctaaggatgga

SEQ ID NO: 576733 - DNA, 25 bp, Rattus norvegicus
tcagactctcgccaaggttctacaa

SEQ ID NO: 576734 - DNA, 25 bp, Rattus norvegicus
tcagactctcgcgaaggttctacaa

SEQ ID NO: 576735 - DNA, 25 bp, Rattus norvegicus
tcagactctgtcacacttcaaattc

SEQ ID NO: 576736 - DNA, 25 bp, Rattus norvegicus
tcagactctgtctcacttcaaattc

SEQ ID NO: 576737 - DNA, 25 bp, Rattus norvegicus
tcagactctttgatgcatgggcagc

SEQ ID NO: 576738 - DNA, 25 bp, Rattus norvegicus
tcagactctttgttgcatgggcagc

SEQ ID NO: 576739 - DNA, 25 bp, Rattus norvegicus
tcagactgacagcaccctaaggtgg

SEQ ID NO: 576740 - DNA, 25 bp, Rattus norvegicus
tcagactgacaggaccctaaggtgg

SEQ ID NO: 576741 - DNA, 25 bp, Rattus norvegicus
tcagactgaggaagggcccaccctt

SEQ ID NO: 576742 - DNA, 25 bp, Rattus norvegicus
tcagactgaggatgggcccaccctt

SEQ ID NO: 576743 - DNA, 25 bp, Rattus norvegicus
tcagactgccaactgtgtcacagac

SEQ ID NO: 576744 - DNA, 25 bp, Rattus norvegicus
tcagactgccaagtgtgtcacagac

SEQ ID NO: 576745 - DNA, 25 bp, Rattus norvegicus
tcagactgcccacaattttctctac

SEQ ID NO: 576746 - DNA, 25 bp, Rattus norvegicus
tcagactgcccagaattttctctac

SEQ ID NO: 576747 - DNA, 25 bp, Rattus norvegicus
tcagactgctcccatctgggtataa

SEQ ID NO: 576748 - DNA, 25 bp, Rattus norvegicus
tcagactgctccgatctgggtataa

SEQ ID NO: 576749 - DNA, 25 bp, Rattus norvegicus
tcagactggatgagcctttatcctc

SEQ ID NO: 576750 - DNA, 25 bp, Rattus norvegicus
tcagactggatgtgcctttatcctc

SEQ ID NO: 576751 - DNA, 25 bp, Rattus norvegicus
tcagactggattccttcaccaatgg

SEQ ID NO: 576752 - DNA, 25 bp, Rattus norvegicus
tcagactggattgcttcaccaatgg

SEQ ID NO: 576753 - DNA, 25 bp, Rattus norvegicus
tcagactggctcaagggcacaagtt

SEQ ID NO: 576754 - DNA, 25 bp, Rattus norvegicus
tcagactggctctagggcacaagtt

SEQ ID NO: 576755 - DNA, 25 bp, Rattus norvegicus
tcagacttagcaaacagcgctggct

SEQ ID NO: 576756 - DNA, 25 bp, Rattus norvegicus
tcagacttagcatacagcgctggct

SEQ ID NO: 576757 - DNA, 25 bp, Rattus norvegicus
tcagacttcaagattgacaccccag

SEQ ID NO: 576758 - DNA, 25 bp, Rattus norvegicus
tcagacttcaagtttgacaccccag

SEQ ID NO: 576759 - DNA, 25 bp, Rattus norvegicus
tcagacttcctgagagttgattgat

SEQ ID NO: 576760 - DNA, 25 bp, Rattus norvegicus
tcagacttcctgtgagttgattgat

SEQ ID NO: 576761 - DNA, 25 bp, Rattus norvegicus
tcagacttgagtatcctgctctctt

SEQ ID NO: 576762 - DNA, 25 bp, Rattus norvegicus
tcagacttgagtttcctgctctctt

SEQ ID NO: 576763 - DNA, 25 bp, Rattus norvegicus
tcagacttggaaatgttcgctcaat

SEQ ID NO: 576764 - DNA, 25 bp, Rattus norvegicus
tcagacttggaattgttcgctcaat

SEQ ID NO: 576765 - DNA, 25 bp, Rattus norvegicus
tcagacttggtgactggtgccagta

SEQ ID NO: 576766 - DNA, 25 bp, Rattus norvegicus
tcagacttggtgtctggtgccagta

SEQ ID NO: 576767 - DNA, 25 bp, Rattus norvegicus
tcagactttctacaacgttcccttt

SEQ ID NO: 576768 - DNA, 25 bp, Rattus norvegicus
tcagactttctagaacgttcccttt

SEQ ID NO: 576769 - DNA, 25 bp, Rattus norvegicus
tcagagaacacacatgcagggtcat

SEQ ID NO: 576770 - DNA, 25 bp, Rattus norvegicus
tcagagaacacagatgcagggtcat

SEQ ID NO: 576771 - DNA, 25 bp, Rattus norvegicus
tcagagaacgggaccccggcgccag

SEQ ID NO: 576772 - DNA, 25 bp, Rattus norvegicus
tcagagaacgggtccccggcgccag

SEQ ID NO: 576773 - DNA, 25 bp, Rattus norvegicus
tcagagaacttcagtgtcccaggct

SEQ ID NO: 576774 - DNA, 25 bp, Rattus norvegicus
tcagagaacttctgtgtcccaggct

SEQ ID NO: 576775 - DNA, 25 bp, Rattus norvegicus
tcagagaagctcagggtctacccag

SEQ ID NO: 576776 - DNA, 25 bp, Rattus norvegicus
tcagagaagctctgggtctacccag

SEQ ID NO: 576777 - DNA, 25 bp, Rattus norvegicus
tcagagaagtcccagcgtgctgtcg

SEQ ID NO: 576778 - DNA, 25 bp, Rattus norvegicus
tcagagaagtccgagcgtgctgtcg

SEQ ID NO: 576779 - DNA, 25 bp, Rattus norvegicus
tcagagaataccattgcctccaaca

SEQ ID NO: 576780 - DNA, 25 bp, Rattus norvegicus
tcagagaatacctttgcctccaaca

SEQ ID NO: 576781 - DNA, 25 bp, Rattus norvegicus
tcagagacacagaccgaagcccaag

SEQ ID NO: 576782 - DNA, 25 bp, Rattus norvegicus
tcagagacacagtccgaagcccaag

SEQ ID NO: 576783 - DNA, 25 bp, Rattus norvegicus
tcagagacagttcttgtgatcagct

SEQ ID NO: 576784 - DNA, 25 bp, Rattus norvegicus
tcagagacagttgttgtgatcagct

SEQ ID NO: 576785 - DNA, 25 bp, Rattus norvegicus
tcagagacatggaacctagctcctt

SEQ ID NO: 576786 - DNA, 25 bp, Rattus norvegicus
tcagagacatggtacctagctcctt

SEQ ID NO: 576787 - DNA, 25 bp, Rattus norvegicus
tcagagaccaccacaacctggaaac

SEQ ID NO: 576788 - DNA, 25 bp, Rattus norvegicus
tcagagaccacctcaacctggaaac

SEQ ID NO: 576789 - DNA, 25 bp, Rattus norvegicus
tcagagaccttgactttgagggcaa

SEQ ID NO: 576790 - DNA, 25 bp, Rattus norvegicus
tcagagaccttgtctttgagggcaa

SEQ ID NO: 576791 - DNA, 25 bp, Rattus norvegicus
tcagagacggctctactacatccag

SEQ ID NO: 576792 - DNA, 25 bp, Rattus norvegicus
tcagagacggctgtactacatccag

SEQ ID NO: 576793 - DNA, 25 bp, Rattus norvegicus
tcagagactcagaactactcagcct

SEQ ID NO: 576794 - DNA, 25 bp, Rattus norvegicus
tcagagactcagtactactcagcct

SEQ ID NO: 576795 - DNA, 25 bp, Rattus norvegicus
tcagagactgtcaaatgtgtaccat

SEQ ID NO: 576796 - DNA, 25 bp, Rattus norvegicus
tcagagactgtctaatgtgtaccat

SEQ ID NO: 576797 - DNA, 25 bp, Rattus norvegicus
tcagagagaaagcaccgccatccat

SEQ ID NO: 576798 - DNA, 25 bp, Rattus norvegicus
tcagagagaaaggaccgccatccat

SEQ ID NO: 576799 - DNA, 25 bp, Rattus norvegicus
tcagagagacagagcccatctccag

SEQ ID NO: 576800 - DNA, 25 bp, Rattus norvegicus
tcagagagacagtgcccatctccag

SEQ ID NO: 576801 - DNA, 25 bp, Rattus norvegicus
tcagagagagcaacctgcgagggtc

SEQ ID NO: 576802 - DNA, 25 bp, Rattus norvegicus
tcagagagagcatcctgcgagggtc

SEQ ID NO: 576803 - DNA, 25 bp, Rattus norvegicus
tcagagagagccaccgtgcagatgc

SEQ ID NO: 576804 - DNA, 25 bp, Rattus norvegicus
tcagagagagcctccgtgcagatgc

SEQ ID NO: 576805 - DNA, 25 bp, Rattus norvegicus
tcagagagcactccaggtcctcact

SEQ ID NO: 576806 - DNA, 25 bp, Rattus norvegicus
tcagagagcactgcaggtcctcact

SEQ ID NO: 576807 - DNA, 25 bp, Rattus norvegicus
tcagagagcatgatgagtgccctgg

SEQ ID NO: 576808 - DNA, 25 bp, Rattus norvegicus
tcagagagcatgttgagtgccctgg

SEQ ID NO: 576809 - DNA, 25 bp, Rattus norvegicus
tcagagagccttattaccatcttcc

SEQ ID NO: 576810 - DNA, 25 bp, Rattus norvegicus
tcagagagcctttttaccatcttcc

SEQ ID NO: 576811 - DNA, 25 bp, Rattus norvegicus
tcagagagcgtcacttgcccagcaa

SEQ ID NO: 576812 - DNA, 25 bp, Rattus norvegicus
tcagagagcgtctcttgcccagcaa

SEQ ID NO: 576813 - DNA, 25 bp, Rattus norvegicus
tcagagatacttcatgttggtggtc

SEQ ID NO: 576814 - DNA, 25 bp, Rattus norvegicus
tcagagatacttgatgttggtggtc

SEQ ID NO: 576815 - DNA, 25 bp, Rattus norvegicus
tcagagatccatacaagcttgcaga

SEQ ID NO: 576816 - DNA, 25 bp, Rattus norvegicus
tcagagatccattcaagcttgcaga

SEQ ID NO: 576817 - DNA, 25 bp, Rattus norvegicus
tcagagatccgacagacggccgatc

SEQ ID NO: 576818 - DNA, 25 bp, Rattus norvegicus
tcagagatccgagagacggccgatc

SEQ ID NO: 576819 - DNA, 25 bp, Rattus norvegicus
tcagagatcctgaattcaaatccca

SEQ ID NO: 576820 - DNA, 25 bp, Rattus norvegicus
tcagagatcctgtattcaaatccca

SEQ ID NO: 576821 - DNA, 25 bp, Rattus norvegicus
tcagagatctaactgccactgcttc

SEQ ID NO: 576822 - DNA, 25 bp, Rattus norvegicus
tcagagatctaagtgccactgcttc

SEQ ID NO: 576823 - DNA, 25 bp, Rattus norvegicus
tcagagatctatcagctttgatcca

SEQ ID NO: 576824 - DNA, 25 bp, Rattus norvegicus
tcagagatctatgagctttgatcca

SEQ ID NO: 576825 - DNA, 25 bp, Rattus norvegicus
tcagagatctgcctatactaagagc

SEQ ID NO: 576826 - DNA, 25 bp, Rattus norvegicus
tcagagatctgcgtatactaagagc

SEQ ID NO: 576827 - DNA, 25 bp, Rattus norvegicus
tcagagatgaatactgcccttcctt

SEQ ID NO: 576828 - DNA, 25 bp, Rattus norvegicus
tcagagatgaattctgcccttcctt

SEQ ID NO: 576829 - DNA, 25 bp, Rattus norvegicus
tcagagatgcccagtacagtgtccg

SEQ ID NO: 576830 - DNA, 25 bp, Rattus norvegicus
tcagagatgccctgtacagtgtccg

SEQ ID NO: 576831 - DNA, 25 bp, Rattus norvegicus
tcagagattagtccgattgttgcag

SEQ ID NO: 576832 - DNA, 25 bp, Rattus norvegicus
tcagagattagtgcgattgttgcag

SEQ ID NO: 576833 - DNA, 25 bp, Rattus norvegicus
tcagagattgatacccagaacacac

SEQ ID NO: 576834 - DNA, 25 bp, Rattus norvegicus
tcagagattgattcccagaacacac

SEQ ID NO: 576835 - DNA, 25 bp, Rattus norvegicus
tcagagattgctataatgctagaca

SEQ ID NO: 576836 - DNA, 25 bp, Rattus norvegicus
tcagagattgctttaatgctagaca

SEQ ID NO: 576837 - DNA, 25 bp, Rattus norvegicus
tcagagcaaaacacactggcctcag

SEQ ID NO: 576838 - DNA, 25 bp, Rattus norvegicus
tcagagcaaaactcactggcctcag

SEQ ID NO: 576839 - DNA, 25 bp, Rattus norvegicus
tcagagcacccacggcagtcttgga

SEQ ID NO: 576840 - DNA, 25 bp, Rattus norvegicus
tcagagcacccagggcagtcttgga

SEQ ID NO: 576841 - DNA, 25 bp, Rattus norvegicus
tcagagcacggcagagggaagcacc

SEQ ID NO: 576842 - DNA, 25 bp, Rattus norvegicus
tcagagcacggctgagggaagcacc

SEQ ID NO: 576843 - DNA, 25 bp, Rattus norvegicus
tcagagcactgtagctgcttcaggg

SEQ ID NO: 576844 - DNA, 25 bp, Rattus norvegicus
tcagagcactgttgctgcttcaggg

SEQ ID NO: 576845 - DNA, 25 bp, Rattus norvegicus
tcagagcagcgtcccatgcaaggca

SEQ ID NO: 576846 - DNA, 25 bp, Rattus norvegicus
tcagagcagcgtgccatgcaaggca

SEQ ID NO: 576847 - DNA, 25 bp, Rattus norvegicus
tcagagcagtgacctcgtgggcttt

SEQ ID NO: 576848 - DNA, 25 bp, Rattus norvegicus
tcagagcagtgagctcgtgggcttt

SEQ ID NO: 576849 - DNA, 25 bp, Rattus norvegicus
tcagagcatctaaagtggtgccttt

SEQ ID NO: 576850 - DNA, 25 bp, Rattus norvegicus
tcagagcatctatagtggtgccttt

SEQ ID NO: 576851 - DNA, 25 bp, Rattus norvegicus
tcagagcatggaaccctcctgattc

SEQ ID NO: 576852 - DNA, 25 bp, Rattus norvegicus
tcagagcatggatccctcctgattc

SEQ ID NO: 576853 - DNA, 25 bp, Rattus norvegicus
tcagagcattctcaagagtcatctt

SEQ ID NO: 576854 - DNA, 25 bp, Rattus norvegicus
tcagagcattctgaagagtcatctt

SEQ ID NO: 576855 - DNA, 25 bp, Rattus norvegicus
tcagagcattgcctttgggttcttg

SEQ ID NO: 576856 - DNA, 25 bp, Rattus norvegicus
tcagagcattgcgtttgggttcttg

SEQ ID NO: 576857 - DNA, 25 bp, Rattus norvegicus
tcagagccagtccttagagccagtc

SEQ ID NO: 576858 - DNA, 25 bp, Rattus norvegicus
tcagagccagtcgttagagccagtc

SEQ ID NO: 576859 - DNA, 25 bp, Rattus norvegicus
tcagagccctccaaatctggaaagt

SEQ ID NO: 576860 - DNA, 25 bp, Rattus norvegicus
tcagagccctcctaatctggaaagt

SEQ ID NO: 576861 - DNA, 25 bp, Rattus norvegicus
tcagagccggtgagcgccaatatag

SEQ ID NO: 576862 - DNA, 25 bp, Rattus norvegicus
tcagagccggtgtgcgccaatatag

SEQ ID NO: 576863 - DNA, 25 bp, Rattus norvegicus
tcagagcctcagagcctcatgcata

SEQ ID NO: 576864 - DNA, 25 bp, Rattus norvegicus
tcagagcctcagtgcctcatgcata

SEQ ID NO: 576865 - DNA, 25 bp, Rattus norvegicus
tcagagcctgacagggccaaaccta

SEQ ID NO: 576866 - DNA, 25 bp, Rattus norvegicus
tcagagcctgactgggccaaaccta

SEQ ID NO: 576867 - DNA, 25 bp, Rattus norvegicus
tcagagcctgagagtctttcccaag

SEQ ID NO: 576868 - DNA, 25 bp, Rattus norvegicus
tcagagcctgagtgtctttcccaag

SEQ ID NO: 576869 - DNA, 25 bp, Rattus norvegicus
tcagagcctgatcctggagctgcga

SEQ ID NO: 576870 - DNA, 25 bp, Rattus norvegicus
tcagagcctgatgctggagctgcga

SEQ ID NO: 576871 - DNA, 25 bp, Rattus norvegicus
tcagagcgacagcacagcggctgcc

SEQ ID NO: 576872 - DNA, 25 bp, Rattus norvegicus
tcagagcgacaggacagcggctgcc

SEQ ID NO: 576873 - DNA, 25 bp, Rattus norvegicus
tcagagcgcccgagcctgcagaagt

SEQ ID NO: 576874 - DNA, 25 bp, Rattus norvegicus
tcagagcgcccgtgcctgcagaagt

SEQ ID NO: 576875 - DNA, 25 bp, Rattus norvegicus
tcagagcgctcacaagagtcgcgtt

SEQ ID NO: 576876 - DNA, 25 bp, Rattus norvegicus
tcagagcgctcagaagagtcgcgtt

SEQ ID NO: 576877 - DNA, 25 bp, Rattus norvegicus
tcagagcggtggaaccccacgcaga

SEQ ID NO: 576878 - DNA, 25 bp, Rattus norvegicus
tcagagcggtggtaccccacgcaga

SEQ ID NO: 576879 - DNA, 25 bp, Rattus norvegicus
tcagagctatggaggatctatcggt

SEQ ID NO: 576880 - DNA, 25 bp, Rattus norvegicus
tcagagctatggtggatctatcggt

SEQ ID NO: 576881 - DNA, 25 bp, Rattus norvegicus
tcagagctcctgcaagaccagacat

SEQ ID NO: 576882 - DNA, 25 bp, Rattus norvegicus
tcagagctcctggaagaccagacat

SEQ ID NO: 576883 - DNA, 25 bp, Rattus norvegicus
tcagagctctggaattaacggcata

SEQ ID NO: 576884 - DNA, 25 bp, Rattus norvegicus
tcagagctctggcatgggacatgct

SEQ ID NO: 576885 - DNA, 25 bp, Rattus norvegicus
tcagagctctgggatgggacatgct

SEQ ID NO: 576886 - DNA, 25 bp, Rattus norvegicus
tcagagctctggtattaacggcata

SEQ ID NO: 576887 - DNA, 25 bp, Rattus norvegicus
tcagagctcttgagttgtgtggtcc

SEQ ID NO: 576888 - DNA, 25 bp, Rattus norvegicus
tcagagctcttgtgttgtgtggtcc

SEQ ID NO: 576889 - DNA, 25 bp, Rattus norvegicus
tcagagctctttcattgtgaccctg

SEQ ID NO: 576890 - DNA, 25 bp, Rattus norvegicus
tcagagctctttccatgggatccta

SEQ ID NO: 576891 - DNA, 25 bp, Rattus norvegicus
tcagagctctttgattgtgaccctg

SEQ ID NO: 576892 - DNA, 25 bp, Rattus norvegicus
tcagagctctttgcatgggatccta

SEQ ID NO: 576893 - DNA, 25 bp, Rattus norvegicus
tcagagctgctgagacttacagaat

SEQ ID NO: 576894 - DNA, 25 bp, Rattus norvegicus
tcagagctgctgtgacttacagaat

SEQ ID NO: 576895 - DNA, 25 bp, Rattus norvegicus
tcagagctggatactaaagtcaggc

SEQ ID NO: 576896 - DNA, 25 bp, Rattus norvegicus
tcagagctggatcgcgcacgtagac

SEQ ID NO: 576897 - DNA, 25 bp, Rattus norvegicus
tcagagctggatggcgcacgtagac

SEQ ID NO: 576898 - DNA, 25 bp, Rattus norvegicus
tcagagctggattctaaagtcaggc

SEQ ID NO: 576899 - DNA, 25 bp, Rattus norvegicus
tcagagctgggaagcctcaggtcga

SEQ ID NO: 576900 - DNA, 25 bp, Rattus norvegicus
tcagagctgggatgcctcaggtcga

SEQ ID NO: 576901 - DNA, 25 bp, Rattus norvegicus
tcagagctggtaacaagctggcctt

SEQ ID NO: 576902 - DNA, 25 bp, Rattus norvegicus
tcagagctggtatcaagctggcctt

SEQ ID NO: 576903 - DNA, 25 bp, Rattus norvegicus
tcagagctgtccacagtatccagaa

SEQ ID NO: 576904 - DNA, 25 bp, Rattus norvegicus
tcagagctgtcctcagtatccagaa

SEQ ID NO: 576905 - DNA, 25 bp, Rattus norvegicus
tcagagctgtgactaaatcattaga

SEQ ID NO: 576906 - DNA, 25 bp, Rattus norvegicus
tcagagctgtgagtaaatcattaga

SEQ ID NO: 576907 - DNA, 25 bp, Rattus norvegicus
tcagagcttagcctggcttttccca

SEQ ID NO: 576908 - DNA, 25 bp, Rattus norvegicus
tcagagcttagcgtggcttttccca

SEQ ID NO: 576909 - DNA, 25 bp, Rattus norvegicus
tcagagcttataagatccccacgtc

SEQ ID NO: 576910 - DNA, 25 bp, Rattus norvegicus
tcagagcttatatgatccccacgtc

SEQ ID NO: 576911 - DNA, 25 bp, Rattus norvegicus
tcagagcttgagaggcctaaagact

SEQ ID NO: 576912 - DNA, 25 bp, Rattus norvegicus
tcagagcttgagtggcctaaagact

SEQ ID NO: 576913 - DNA, 25 bp, Rattus norvegicus
tcagagcttgcgctcactctcaatg

SEQ ID NO: 576914 - DNA, 25 bp, Rattus norvegicus
tcagagcttgcggtcactctcaatg

SEQ ID NO: 576915 - DNA, 25 bp, Rattus norvegicus
tcagagcttttgctcctccttggag

SEQ ID NO: 576916 - DNA, 25 bp, Rattus norvegicus
tcagagcttttggtcctccttggag

SEQ ID NO: 576917 - DNA, 25 bp, Rattus norvegicus
tcagaggaaaacactatgactcatt

SEQ ID NO: 576918 - DNA, 25 bp, Rattus norvegicus
tcagaggaaaactctatgactcatt

SEQ ID NO: 576919 - DNA, 25 bp, Rattus norvegicus
tcagaggaaaataggcccttggctc

SEQ ID NO: 576920 - DNA, 25 bp, Rattus norvegicus
tcagaggaaaattggcccttggctc

SEQ ID NO: 576921 - DNA, 25 bp, Rattus norvegicus
tcagaggaagcccagtcccagcagc

SEQ ID NO: 576922 - DNA, 25 bp, Rattus norvegicus
tcagaggaagcccttgtcacagttc

SEQ ID NO: 576923 - DNA, 25 bp, Rattus norvegicus
tcagaggaagccgagtcccagcagc

SEQ ID NO: 576924 - DNA, 25 bp, Rattus norvegicus
tcagaggaagccgttgtcacagttc

SEQ ID NO: 576925 - DNA, 25 bp, Rattus norvegicus
tcagaggacaccaagcgctggctga

SEQ ID NO: 576926 - DNA, 25 bp, Rattus norvegicus
tcagaggacacctagcgctggctga

SEQ ID NO: 576927 - DNA, 25 bp, Rattus norvegicus
tcagaggacaggctcagcccagtct

SEQ ID NO: 576928 - DNA, 25 bp, Rattus norvegicus
tcagaggacagggtcagcccagtct

SEQ ID NO: 576929 - DNA, 25 bp, Rattus norvegicus
tcagaggaccatacttgccttcgtt

SEQ ID NO: 576930 - DNA, 25 bp, Rattus norvegicus
tcagaggaccattcttgccttcgtt

SEQ ID NO: 576931 - DNA, 25 bp, Rattus norvegicus
tcagaggacgctctccatgttgcat

SEQ ID NO: 576932 - DNA, 25 bp, Rattus norvegicus
tcagaggacgctgtccatgttgcat

SEQ ID NO: 576933 - DNA, 25 bp, Rattus norvegicus
tcagaggactccagccacagtgctt

SEQ ID NO: 576934 - DNA, 25 bp, Rattus norvegicus
tcagaggactcctgccacagtgctt

SEQ ID NO: 576935 - DNA, 25 bp, Rattus norvegicus
tcagaggactgaaatggatcttaat

SEQ ID NO: 576936 - DNA, 25 bp, Rattus norvegicus
tcagaggactgatatggatcttaat

SEQ ID NO: 576937 - DNA, 25 bp, Rattus norvegicus
tcagaggactggagcttgttttcca

SEQ ID NO: 576938 - DNA, 25 bp, Rattus norvegicus
tcagaggactggatcacagggagca

SEQ ID NO: 576939 - DNA, 25 bp, Rattus norvegicus
tcagaggactggtgcttgttttcca

SEQ ID NO: 576940 - DNA, 25 bp, Rattus norvegicus
tcagaggactggttcacagggagca

SEQ ID NO: 576941 - DNA, 25 bp, Rattus norvegicus
tcagaggataacatggagtgagtca

SEQ ID NO: 576942 - DNA, 25 bp, Rattus norvegicus
tcagaggataacttggagtgagtca

SEQ ID NO: 576943 - DNA, 25 bp, Rattus norvegicus
tcagaggatctgcagtagccaccca

SEQ ID NO: 576944 - DNA, 25 bp, Rattus norvegicus
tcagaggatctggagtagccaccca

SEQ ID NO: 576945 - DNA, 25 bp, Rattus norvegicus
tcagaggcagctacagttaccttcc

SEQ ID NO: 576946 - DNA, 25 bp, Rattus norvegicus
tcagaggcagcttcagttaccttcc

SEQ ID NO: 576947 - DNA, 25 bp, Rattus norvegicus
tcagaggcccaaatgtttggcatag

SEQ ID NO: 576948 - DNA, 25 bp, Rattus norvegicus
tcagaggcccaattgtttggcatag

SEQ ID NO: 576949 - DNA, 25 bp, Rattus norvegicus
tcagaggcccttcctcgttttaatt

SEQ ID NO: 576950 - DNA, 25 bp, Rattus norvegicus
tcagaggcccttgctcgttttaatt

SEQ ID NO: 576951 - DNA, 25 bp, Rattus norvegicus
tcagaggccttcaccttgtctttca

SEQ ID NO: 576952 - DNA, 25 bp, Rattus norvegicus
tcagaggccttctccttgtctttca

SEQ ID NO: 576953 - DNA, 25 bp, Rattus norvegicus
tcagaggcgtcaagtttccgattaa

SEQ ID NO: 576954 - DNA, 25 bp, Rattus norvegicus
tcagaggcgtcatgtttccgattaa

SEQ ID NO: 576955 - DNA, 25 bp, Rattus norvegicus
tcagaggctaacactcgctgtcaga

SEQ ID NO: 576956 - DNA, 25 bp, Rattus norvegicus
tcagaggctaactctcgctgtcaga

SEQ ID NO: 576957 - DNA, 25 bp, Rattus norvegicus
tcagaggctagacaggacgccacag

SEQ ID NO: 576958 - DNA, 25 bp, Rattus norvegicus
tcagaggctagagaggacgccacag

SEQ ID NO: 576959 - DNA, 25 bp, Rattus norvegicus
tcagaggctgctatttagaaccaaa

SEQ ID NO: 576960 - DNA, 25 bp, Rattus norvegicus
tcagaggctgctttttagaaccaaa

SEQ ID NO: 576961 - DNA, 25 bp, Rattus norvegicus
tcagaggctgtacagatggccgctc

SEQ ID NO: 576962 - DNA, 25 bp, Rattus norvegicus
tcagaggctgtagagatggccgctc

SEQ ID NO: 576963 - DNA, 25 bp, Rattus norvegicus
tcagaggctgtcattcacggagagg

SEQ ID NO: 576964 - DNA, 25 bp, Rattus norvegicus
tcagaggctgtctttcacggagagg

SEQ ID NO: 576965 - DNA, 25 bp, Rattus norvegicus
tcagaggctgtgacctagtcgctgc

SEQ ID NO: 576966 - DNA, 25 bp, Rattus norvegicus
tcagaggctgtgtcctagtcgctgc

SEQ ID NO: 576967 - DNA, 25 bp, Rattus norvegicus
tcagaggcttggcagaattctccag

SEQ ID NO: 576968 - DNA, 25 bp, Rattus norvegicus
tcagaggcttgggagaattctccag

SEQ ID NO: 576969 - DNA, 25 bp, Rattus norvegicus
tcagaggctttgactccgggtgcac

SEQ ID NO: 576970 - DNA, 25 bp, Rattus norvegicus
tcagaggctttgtctccgggtgcac

SEQ ID NO: 576971 - DNA, 25 bp, Rattus norvegicus
tcagagggaactagggctcaggacc

SEQ ID NO: 576972 - DNA, 25 bp, Rattus norvegicus
tcagagggaacttgggctcaggacc

SEQ ID NO: 576973 - DNA, 25 bp, Rattus norvegicus
tcagagggagcactgcctcacaaac

SEQ ID NO: 576974 - DNA, 25 bp, Rattus norvegicus
tcagagggagcagtgcctcacaaac

SEQ ID NO: 576975 - DNA, 25 bp, Rattus norvegicus
tcagagggcacgagacccagggtat

SEQ ID NO: 576976 - DNA, 25 bp, Rattus norvegicus
tcagagggcacgtgacccagggtat

SEQ ID NO: 576977 - DNA, 25 bp, Rattus norvegicus
tcagagggcccaagaaggcgaagca

SEQ ID NO: 576978 - DNA, 25 bp, Rattus norvegicus
tcagagggcccatgaaggcgaagca

SEQ ID NO: 576979 - DNA, 25 bp, Rattus norvegicus
tcagagggccttctctgatctcttt

SEQ ID NO: 576980 - DNA, 25 bp, Rattus norvegicus
tcagagggccttgtctgatctcttt

SEQ ID NO: 576981 - DNA, 25 bp, Rattus norvegicus
tcagagggctctatggatcgattat

SEQ ID NO: 576982 - DNA, 25 bp, Rattus norvegicus
tcagagggctctttggatcgattat

SEQ ID NO: 576983 - DNA, 25 bp, Rattus norvegicus
tcagagggtcatagctttgtggttt

SEQ ID NO: 576984 - DNA, 25 bp, Rattus norvegicus
tcagagggtcattgctttgtggttt

SEQ ID NO: 576985 - DNA, 25 bp, Rattus norvegicus
tcagaggtagtgatggaaccctgga

SEQ ID NO: 576986 - DNA, 25 bp, Rattus norvegicus
tcagaggtagtgttggaaccctgga

SEQ ID NO: 576987 - DNA, 25 bp, Rattus norvegicus
tcagaggtctcaccgcaggctgcct

SEQ ID NO: 576988 - DNA, 25 bp, Rattus norvegicus
tcagaggtctcagcgcaggctgcct

SEQ ID NO: 576989 - DNA, 25 bp, Rattus norvegicus
tcagaggtctctccaggtcttgctg

SEQ ID NO: 576990 - DNA, 25 bp, Rattus norvegicus
tcagaggtctctgcaggtcttgctg

SEQ ID NO: 576991 - DNA, 25 bp, Rattus norvegicus
tcagaggtctggacccagtggcaga

SEQ ID NO: 576992 - DNA, 25 bp, Rattus norvegicus
tcagaggtctggtcccagtggcaga

SEQ ID NO: 576993 - DNA, 25 bp, Rattus norvegicus
tcagaggtgaacaccggccagacgc

SEQ ID NO: 576994 - DNA, 25 bp, Rattus norvegicus
tcagaggtgaactccggccagacgc

SEQ ID NO: 576995 - DNA, 25 bp, Rattus norvegicus
tcagaggtgaagaaccttgacctgg

SEQ ID NO: 576996 - DNA, 25 bp, Rattus norvegicus
tcagaggtgaagtaccttgacctgg

SEQ ID NO: 576997 - DNA, 25 bp, Rattus norvegicus
tcagaggttaaaagtcctttgcttt

SEQ ID NO: 576998 - DNA, 25 bp, Rattus norvegicus
tcagaggttaaatgtcctttgcttt

SEQ ID NO: 576999 - DNA, 25 bp, Rattus norvegicus
tcagaggttcggaccctgggagtca

SEQ ID NO: 577000 - DNA, 25 bp, Rattus norvegicus
tcagaggttcggtccctgggagtca

SEQ ID NO: 577001 - DNA, 25 bp, Rattus norvegicus
tcagaggttttccagttcctttcca

SEQ ID NO: 577002 - DNA, 25 bp, Rattus norvegicus
tcagaggttttcgagttcctttcca

SEQ ID NO: 577003 - DNA, 25 bp, Rattus norvegicus
tcagagtacgtgcagtctcgtggcc

SEQ ID NO: 577004 - DNA, 25 bp, Rattus norvegicus
tcagagtacgtggagtctcgtggcc

SEQ ID NO: 577005 - DNA, 25 bp, Rattus norvegicus
tcagagtactgcatatgcccacagc

SEQ ID NO: 577006 - DNA, 25 bp, Rattus norvegicus
tcagagtactgcttatgcccacagc

SEQ ID NO: 577007 - DNA, 25 bp, Rattus norvegicus
tcagagtagtgacagggcctttatc

SEQ ID NO: 577008 - DNA, 25 bp, Rattus norvegicus
tcagagtagtgagagggcctttatc

SEQ ID NO: 577009 - DNA, 25 bp, Rattus norvegicus
tcagagtattctatcacagccacag

SEQ ID NO: 577010 - DNA, 25 bp, Rattus norvegicus
tcagagtattctttcacagccacag

SEQ ID NO: 577011 - DNA, 25 bp, Rattus norvegicus
tcagagtcaatcaggatcgaaggcc

SEQ ID NO: 577012 - DNA, 25 bp, Rattus norvegicus
tcagagtcaatctggatcgaaggcc

SEQ ID NO: 577013 - DNA, 25 bp, Rattus norvegicus
tcagagtcaggacccgtgatggctc

SEQ ID NO: 577014 - DNA, 25 bp, Rattus norvegicus
tcagagtcaggagccgtgatggctc

SEQ ID NO: 577015 - DNA, 25 bp, Rattus norvegicus
tcagagtcatggatgcagcttcctc

SEQ ID NO: 577016 - DNA, 25 bp, Rattus norvegicus
tcagagtcatggttgcagcttcctc

SEQ ID NO: 577017 - DNA, 25 bp, Rattus norvegicus
tcagagtccagcatatccacatttg

SEQ ID NO: 577018 - DNA, 25 bp, Rattus norvegicus
tcagagtccagcttatccacatttg

SEQ ID NO: 577019 - DNA, 25 bp, Rattus norvegicus
tcagagtcccaactacagtagccat

SEQ ID NO: 577020 - DNA, 25 bp, Rattus norvegicus
tcagagtcccaagtacagtagccat

SEQ ID NO: 577021 - DNA, 25 bp, Rattus norvegicus
tcagagtcctgtaccagactgaacg

SEQ ID NO: 577022 - DNA, 25 bp, Rattus norvegicus
tcagagtcctgtcgccgaggtaggc

SEQ ID NO: 577023 - DNA, 25 bp, Rattus norvegicus
tcagagtcctgtggccgaggtaggc

SEQ ID NO: 577024 - DNA, 25 bp, Rattus norvegicus
tcagagtcctgttccagactgaacg

SEQ ID NO: 577025 - DNA, 25 bp, Rattus norvegicus
tcagagtcggaacctccctcgtgag

SEQ ID NO: 577026 - DNA, 25 bp, Rattus norvegicus
tcagagtcggaagctccctcgtgag

SEQ ID NO: 577027 - DNA, 25 bp, Rattus norvegicus
tcagagtgagagaaggtccccagag

SEQ ID NO: 577028 - DNA, 25 bp, Rattus norvegicus
tcagagtgagagtaggtccccagag

SEQ ID NO: 577029 - DNA, 25 bp, Rattus norvegicus
tcagagtgcagcagcgtctacggaa

SEQ ID NO: 577030 - DNA, 25 bp, Rattus norvegicus
tcagagtgcagctgcgtctacggaa

SEQ ID NO: 577031 - DNA, 25 bp, Rattus norvegicus
tcagagtgcagtaaagcccaaccct

SEQ ID NO: 577032 - DNA, 25 bp, Rattus norvegicus
tcagagtgcagtccccagagatgtg

SEQ ID NO: 577033 - DNA, 25 bp, Rattus norvegicus
tcagagtgcagtgcccagagatgtg

SEQ ID NO: 577034 - DNA, 25 bp, Rattus norvegicus
tcagagtgcagttaagcccaaccct

SEQ ID NO: 577035 - DNA, 25 bp, Rattus norvegicus
tcagagtgtcaaacataatgtgggc

SEQ ID NO: 577036 - DNA, 25 bp, Rattus norvegicus
tcagagtgtcaatcataatgtgggc

SEQ ID NO: 577037 - DNA, 25 bp, Rattus norvegicus
tcagagttactgctgccaagccgag

SEQ ID NO: 577038 - DNA, 25 bp, Rattus norvegicus
tcagagttactggtgccaagccgag

SEQ ID NO: 577039 - DNA, 25 bp, Rattus norvegicus
tcagagttatgtaccctgtcacctc

SEQ ID NO: 577040 - DNA, 25 bp, Rattus norvegicus
tcagagttatgttccctgtcacctc

SEQ ID NO: 577041 - DNA, 25 bp, Rattus norvegicus
tcagagttcttaactgctgacccat

SEQ ID NO: 577042 - DNA, 25 bp, Rattus norvegicus
tcagagttcttatctgctgacccat

SEQ ID NO: 577043 - DNA, 25 bp, Rattus norvegicus
tcagagtttacaaaattccccttct

SEQ ID NO: 577044 - DNA, 25 bp, Rattus norvegicus
tcagagtttacataattccccttct

SEQ ID NO: 577045 - DNA, 25 bp, Rattus norvegicus
tcagagtttctgagcgctaacggtc

SEQ ID NO: 577046 - DNA, 25 bp, Rattus norvegicus
tcagagtttctgtgcgctaacggtc

SEQ ID NO: 577047 - DNA, 25 bp, Rattus norvegicus
tcagataagagtattgaccagcccc

SEQ ID NO: 577048 - DNA, 25 bp, Rattus norvegicus
tcagataagagttttgaccagcccc

SEQ ID NO: 577049 - DNA, 25 bp, Rattus norvegicus
tcagataagcctcgtactttgagca

SEQ ID NO: 577050 - DNA, 25 bp, Rattus norvegicus
tcagataagcctggtactttgagca

SEQ ID NO: 577051 - DNA, 25 bp, Rattus norvegicus
tcagataccgtcacggccagcacgg

SEQ ID NO: 577052 - DNA, 25 bp, Rattus norvegicus
tcagataccgtctcggccagcacgg

SEQ ID NO: 577053 - DNA, 25 bp, Rattus norvegicus
tcagatactgggacctgcctagcag

SEQ ID NO: 577054 - DNA, 25 bp, Rattus norvegicus
tcagatactgggtcctgcctagcag

SEQ ID NO: 577055 - DNA, 25 bp, Rattus norvegicus
tcagatactgtgctccgtttttgga

SEQ ID NO: 577056 - DNA, 25 bp, Rattus norvegicus
tcagatactgtggtccgtttttgga

SEQ ID NO: 577057 - DNA, 25 bp, Rattus norvegicus
tcagatagacgacgccgggtccgtc

SEQ ID NO: 577058 - DNA, 25 bp, Rattus norvegicus
tcagatagacgaggccgggtccgtc

SEQ ID NO: 577059 - DNA, 25 bp, Rattus norvegicus
tcagatagctgactcccatagactc

SEQ ID NO: 577060 - DNA, 25 bp, Rattus norvegicus
tcagatagctgagtcccatagactc

SEQ ID NO: 577061 - DNA, 25 bp, Rattus norvegicus
tcagatagctgtactccaagggtgt

SEQ ID NO: 577062 - DNA, 25 bp, Rattus norvegicus
tcagatagctgttctccaagggtgt

SEQ ID NO: 577063 - DNA, 25 bp, Rattus norvegicus
tcagatagggcacacataggttggt

SEQ ID NO: 577064 - DNA, 25 bp, Rattus norvegicus
tcagatagggcagacataggttggt

SEQ ID NO: 577065 - DNA, 25 bp, Rattus norvegicus
tcagatagtctaaacgttgtcaaag

SEQ ID NO: 577066 - DNA, 25 bp, Rattus norvegicus
tcagatagtctatacgttgtcaaag

SEQ ID NO: 577067 - DNA, 25 bp, Rattus norvegicus
tcagatatcctgatagatttggatt

SEQ ID NO: 577068 - DNA, 25 bp, Rattus norvegicus
tcagatatcctgttagatttggatt

SEQ ID NO: 577069 - DNA, 25 bp, Rattus norvegicus
tcagatatgggacacccctccaggg

SEQ ID NO: 577070 - DNA, 25 bp, Rattus norvegicus
tcagatatgggagacccctccaggg

SEQ ID NO: 577071 - DNA, 25 bp, Rattus norvegicus
tcagatcaagctcggtgtttgttgc

SEQ ID NO: 577072 - DNA, 25 bp, Rattus norvegicus
tcagatcaagctgggtgtttgttgc

SEQ ID NO: 577073 - DNA, 25 bp, Rattus norvegicus
tcagatcataacacatttgcccaga

SEQ ID NO: 577074 - DNA, 25 bp, Rattus norvegicus
tcagatcataactcatttgcccaga

SEQ ID NO: 577075 - DNA, 25 bp, Rattus norvegicus
tcagatcatgttactgcgccaagca

SEQ ID NO: 577076 - DNA, 25 bp, Rattus norvegicus
tcagatcatgtttctgcgccaagca

SEQ ID NO: 577077 - DNA, 25 bp, Rattus norvegicus
tcagatccaatcaattcgccgaata

SEQ ID NO: 577078 - DNA, 25 bp, Rattus norvegicus
tcagatccaatctattcgccgaata

SEQ ID NO: 577079 - DNA, 25 bp, Rattus norvegicus
tcagatccacacatgatacgctcag

SEQ ID NO: 577080 - DNA, 25 bp, Rattus norvegicus
tcagatccacacttgatacgctcag

SEQ ID NO: 577081 - DNA, 25 bp, Rattus norvegicus
tcagatccactcagaagtttcctct

SEQ ID NO: 577082 - DNA, 25 bp, Rattus norvegicus
tcagatccactctgaagtttcctct

SEQ ID NO: 577083 - DNA, 25 bp, Rattus norvegicus
tcagatccaggcagttagtgacgct

SEQ ID NO: 577084 - DNA, 25 bp, Rattus norvegicus
tcagatccaggctgttagtgacgct

SEQ ID NO: 577085 - DNA, 25 bp, Rattus norvegicus
tcagatccatgtcgccttaaatggc

SEQ ID NO: 577086 - DNA, 25 bp, Rattus norvegicus
tcagatccatgtggccttaaatggc

SEQ ID NO: 577087 - DNA, 25 bp, Rattus norvegicus
tcagatccctcacttgaccagtaat

SEQ ID NO: 577088 - DNA, 25 bp, Rattus norvegicus
tcagatccctcagttgaccagtaat

SEQ ID NO: 577089 - DNA, 25 bp, Rattus norvegicus
tcagatcctgttaggcccccgaggt

SEQ ID NO: 577090 - DNA, 25 bp, Rattus norvegicus
tcagatcctgtttggcccccgaggt

SEQ ID NO: 577091 - DNA, 25 bp, Rattus norvegicus
tcagatctcatcaccaatgtgctca

SEQ ID NO: 577092 - DNA, 25 bp, Rattus norvegicus
tcagatctcatctccaatgtgctca

SEQ ID NO: 577093 - DNA, 25 bp, Rattus norvegicus
tcagatctcattccggatgaagccc

SEQ ID NO: 577094 - DNA, 25 bp, Rattus norvegicus
tcagatctcattgcggatgaagccc

SEQ ID NO: 577095 - DNA, 25 bp, Rattus norvegicus
tcagatctctggcagggtcttgctt

SEQ ID NO: 577096 - DNA, 25 bp, Rattus norvegicus
tcagatctctgggagggtcttgctt

SEQ ID NO: 577097 - DNA, 25 bp, Rattus norvegicus
tcagatctggaaaggcggcctgacc

SEQ ID NO: 577098 - DNA, 25 bp, Rattus norvegicus
tcagatctggaatggcggcctgacc

SEQ ID NO: 577099 - DNA, 25 bp, Rattus norvegicus
tcagatcttcgtctgagcgcactac

SEQ ID NO: 577100 - DNA, 25 bp, Rattus norvegicus
tcagatcttcgtgtgagcgcactac

SEQ ID NO: 577101 - DNA, 25 bp, Rattus norvegicus
tcagatcttgtactgcctgacagca

SEQ ID NO: 577102 - DNA, 25 bp, Rattus norvegicus
tcagatcttgtagtgcctgacagca

SEQ ID NO: 577103 - DNA, 25 bp, Rattus norvegicus
tcagatgaaatgaccccagcgctgg

SEQ ID NO: 577104 - DNA, 25 bp, Rattus norvegicus
tcagatgaaatgtccccagcgctgg

SEQ ID NO: 577105 - DNA, 25 bp, Rattus norvegicus
tcagatgaccccagatgaccctcag

SEQ ID NO: 577106 - DNA, 25 bp, Rattus norvegicus
tcagatgacccctgatgaccctcag

SEQ ID NO: 577107 - DNA, 25 bp, Rattus norvegicus
tcagatgacctcctttacttggaat

SEQ ID NO: 577108 - DNA, 25 bp, Rattus norvegicus
tcagatgacctcgtttacttggaat

SEQ ID NO: 577109 - DNA, 25 bp, Rattus norvegicus
tcagatgacgcacaggaaccagaaa

SEQ ID NO: 577110 - DNA, 25 bp, Rattus norvegicus
tcagatgacgcagaggaaccagaaa

SEQ ID NO: 577111 - DNA, 25 bp, Rattus norvegicus
tcagatgactccatggctaaacttt

SEQ ID NO: 577112 - DNA, 25 bp, Rattus norvegicus
tcagatgactccttggctaaacttt

SEQ ID NO: 577113 - DNA, 25 bp, Rattus norvegicus
tcagatgactcgctcctgctgggag

SEQ ID NO: 577114 - DNA, 25 bp, Rattus norvegicus
tcagatgactcggtcctgctgggag

SEQ ID NO: 577115 - DNA, 25 bp, Rattus norvegicus
tcagatgagactcctttccgtgctc

SEQ ID NO: 577116 - DNA, 25 bp, Rattus norvegicus
tcagatgagactgctttccgtgctc

SEQ ID NO: 577117 - DNA, 25 bp, Rattus norvegicus
tcagatgagggcagctcccagaaga

SEQ ID NO: 577118 - DNA, 25 bp, Rattus norvegicus
tcagatgagggctgctcccagaaga

SEQ ID NO: 577119 - DNA, 25 bp, Rattus norvegicus
tcagatgcaagtccaacaggcagat

SEQ ID NO: 577120 - DNA, 25 bp, Rattus norvegicus
tcagatgcaagtgcaacaggcagat

SEQ ID NO: 577121 - DNA, 25 bp, Rattus norvegicus
tcagatgcagctagttgattccata

SEQ ID NO: 577122 - DNA, 25 bp, Rattus norvegicus
tcagatgcagcttgttgattccata

SEQ ID NO: 577123 - DNA, 25 bp, Rattus norvegicus
tcagatgcagttcgcgatgtcgccg

SEQ ID NO: 577124 - DNA, 25 bp, Rattus norvegicus
tcagatgcagttggcgatgtcgccg

SEQ ID NO: 577125 - DNA, 25 bp, Rattus norvegicus
tcagatgcatctagtggtggaccaa

SEQ ID NO: 577126 - DNA, 25 bp, Rattus norvegicus
tcagatgcatcttgtggtggaccaa

SEQ ID NO: 577127 - DNA, 25 bp, Rattus norvegicus
tcagatgcatgtactcagaggaact

SEQ ID NO: 577128 - DNA, 25 bp, Rattus norvegicus
tcagatgcatgttctcagaggaact

SEQ ID NO: 577129 - DNA, 25 bp, Rattus norvegicus
tcagatgcctccataggaccaagtc

SEQ ID NO: 577130 - DNA, 25 bp, Rattus norvegicus
tcagatgcctccttaggaccaagtc

SEQ ID NO: 577131 - DNA, 25 bp, Rattus norvegicus
tcagatgcctgccagtcacttaaca

SEQ ID NO: 577132 - DNA, 25 bp, Rattus norvegicus
tcagatgcctgcgagtcacttaaca

SEQ ID NO: 577133 - DNA, 25 bp, Rattus norvegicus
tcagatgcctttaactaccgaacca

SEQ ID NO: 577134 - DNA, 25 bp, Rattus norvegicus
tcagatgccttttactaccgaacca

SEQ ID NO: 577135 - DNA, 25 bp, Rattus norvegicus
tcagatgctaaaagaaccggttcag

SEQ ID NO: 577136 - DNA, 25 bp, Rattus norvegicus
tcagatgctaaatgaaccggttcag

SEQ ID NO: 577137 - DNA, 25 bp, Rattus norvegicus
tcagatggaaatccttgtcctccac

SEQ ID NO: 577138 - DNA, 25 bp, Rattus norvegicus
tcagatggaaatgcttgtcctccac

SEQ ID NO: 577139 - DNA, 25 bp, Rattus norvegicus
tcagatggaccaacttaccttctca

SEQ ID NO: 577140 - DNA, 25 bp, Rattus norvegicus
tcagatggaccatcttaccttctca

SEQ ID NO: 577141 - DNA, 25 bp, Rattus norvegicus
tcagatggcatcctggtacccacag

SEQ ID NO: 577142 - DNA, 25 bp, Rattus norvegicus
tcagatggcatcgtggtacccacag

SEQ ID NO: 577143 - DNA, 25 bp, Rattus norvegicus
tcagatggccaacaccggtgggacc

SEQ ID NO: 577144 - DNA, 25 bp, Rattus norvegicus
tcagatggccaagaccggtgggacc

SEQ ID NO: 577145 - DNA, 25 bp, Rattus norvegicus
tcagatggcggccacttgcttccag

SEQ ID NO: 577146 - DNA, 25 bp, Rattus norvegicus
tcagatggcggcgacttgcttccag

SEQ ID NO: 577147 - DNA, 25 bp, Rattus norvegicus
tcagatggcgtcattttcaccaacc

SEQ ID NO: 577148 - DNA, 25 bp, Rattus norvegicus
tcagatggcgtctttttcaccaacc

SEQ ID NO: 577149 - DNA, 25 bp, Rattus norvegicus
tcagatgggagcagcacgctcgtct

SEQ ID NO: 577150 - DNA, 25 bp, Rattus norvegicus
tcagatgggagctgcacgctcgtct

SEQ ID NO: 577151 - DNA, 25 bp, Rattus norvegicus
tcagatgggaggaccttcctgtcga

SEQ ID NO: 577152 - DNA, 25 bp, Rattus norvegicus
tcagatgggaggtccttcctgtcga

SEQ ID NO: 577153 - DNA, 25 bp, Rattus norvegicus
tcagatggtacgctcccagaggtca

SEQ ID NO: 577154 - DNA, 25 bp, Rattus norvegicus
tcagatggtacggtcccagaggtca

SEQ ID NO: 577155 - DNA, 25 bp, Rattus norvegicus
tcagatgtaattctgcctccttgtg

SEQ ID NO: 577156 - DNA, 25 bp, Rattus norvegicus
tcagatgtaattgtgcctccttgtg

SEQ ID NO: 577157 - DNA, 25 bp, Rattus norvegicus
tcagatgtacagactcaccttgcgt

SEQ ID NO: 577158 - DNA, 25 bp, Rattus norvegicus
tcagatgtacagtctcaccttgcgt

SEQ ID NO: 577159 - DNA, 25 bp, Rattus norvegicus
tcagatgtacctaggttggacccca

SEQ ID NO: 577160 - DNA, 25 bp, Rattus norvegicus
tcagatgtaccttggttggacccca

SEQ ID NO: 577161 - DNA, 25 bp, Rattus norvegicus
tcagatgtatcgatatcatttcccc

SEQ ID NO: 577162 - DNA, 25 bp, Rattus norvegicus
tcagatgtatcgttatcatttcccc

SEQ ID NO: 577163 - DNA, 25 bp, Rattus norvegicus
tcagatgtatgaccctggttggttt

SEQ ID NO: 577164 - DNA, 25 bp, Rattus norvegicus
tcagatgtatgagcctggttggttt

SEQ ID NO: 577165 - DNA, 25 bp, Rattus norvegicus
tcagatgtgctacagcagcctctgc

SEQ ID NO: 577166 - DNA, 25 bp, Rattus norvegicus
tcagatgtgctagagcagcctctgc

SEQ ID NO: 577167 - DNA, 25 bp, Rattus norvegicus
tcagatgtttgtcccacactacaga

SEQ ID NO: 577168 - DNA, 25 bp, Rattus norvegicus
tcagatgtttgtgccacactacaga

SEQ ID NO: 577169 - DNA, 25 bp, Rattus norvegicus
tcagattagataatcccagggcgtt

SEQ ID NO: 577170 - DNA, 25 bp, Rattus norvegicus
tcagattagatattcccagggcgtt

SEQ ID NO: 577171 - DNA, 25 bp, Rattus norvegicus
tcagattatgcccaacagctatagg

SEQ ID NO: 577172 - DNA, 25 bp, Rattus norvegicus
tcagattatgccgaacagctatagg

SEQ ID NO: 577173 - DNA, 25 bp, Rattus norvegicus
tcagattccattcttcgttagctca

SEQ ID NO: 577174 - DNA, 25 bp, Rattus norvegicus
tcagattccattgttcgttagctca

SEQ ID NO: 577175 - DNA, 25 bp, Rattus norvegicus
tcagattcctgtaagtcacccagac

SEQ ID NO: 577176 - DNA, 25 bp, Rattus norvegicus
tcagattcctgttagtcacccagac

SEQ ID NO: 577177 - DNA, 25 bp, Rattus norvegicus
tcagattctgaacggagtggtaatg

SEQ ID NO: 577178 - DNA, 25 bp, Rattus norvegicus
tcagattctgaagggagtggtaatg

SEQ ID NO: 577179 - DNA, 25 bp, Rattus norvegicus
tcagattcttgaagccagtttcccc

SEQ ID NO: 577180 - DNA, 25 bp, Rattus norvegicus
tcagattcttgatgccagtttcccc

SEQ ID NO: 577181 - DNA, 25 bp, Rattus norvegicus
tcagattgatggacccttggactct

SEQ ID NO: 577182 - DNA, 25 bp, Rattus norvegicus
tcagattgatggtcccttggactct

SEQ ID NO: 577183 - DNA, 25 bp, Rattus norvegicus
tcagattgtaaaaagcgcgtcagcg

SEQ ID NO: 577184 - DNA, 25 bp, Rattus norvegicus
tcagattgtaaatagcgcgtcagcg

SEQ ID NO: 577185 - DNA, 25 bp, Rattus norvegicus
tcagatttacagaaggcggtcacct

SEQ ID NO: 577186 - DNA, 25 bp, Rattus norvegicus
tcagatttacagtaggcggtcacct

SEQ ID NO: 577187 - DNA, 25 bp, Rattus norvegicus
tcagatttcctgaccttcttaattt

SEQ ID NO: 577188 - DNA, 25 bp, Rattus norvegicus
tcagatttcctgtccttcttaattt

SEQ ID NO: 577189 - DNA, 25 bp, Rattus norvegicus
tcagatttctacattgggctcatat

SEQ ID NO: 577190 - DNA, 25 bp, Rattus norvegicus
tcagatttctactttgggctcatat

SEQ ID NO: 577191 - DNA, 25 bp, Rattus norvegicus
tcagatttctataaaagttttccct

SEQ ID NO: 577192 - DNA, 25 bp, Rattus norvegicus
tcagatttctattaaagttttccct

SEQ ID NO: 577193 - DNA, 25 bp, Rattus norvegicus
tcagatttgatacaggcagaccgcc

SEQ ID NO: 577194 - DNA, 25 bp, Rattus norvegicus
tcagatttgatagaggcagaccgcc

SEQ ID NO: 577195 - DNA, 25 bp, Rattus norvegicus
tcagatttgggaagtacctgcctcc

SEQ ID NO: 577196 - DNA, 25 bp, Rattus norvegicus
tcagatttgggatgtacctgcctcc

SEQ ID NO: 577197 - DNA, 25 bp, Rattus norvegicus
tcagattttctgaacttgtgtagct

SEQ ID NO: 577198 - DNA, 25 bp, Rattus norvegicus
tcagattttctgtacttgtgtagct

SEQ ID NO: 577199 - DNA, 25 bp, Rattus norvegicus
tcagcaaaaaccatgttgcccttcc

SEQ ID NO: 577200 - DNA, 25 bp, Rattus norvegicus
tcagcaaaaaccttgttgcccttcc

SEQ ID NO: 577201 - DNA, 25 bp, Rattus norvegicus
tcagcaaagatgcttccctggtggt

SEQ ID NO: 577202 - DNA, 25 bp, Rattus norvegicus
tcagcaaagatggttccctggtggt

SEQ ID NO: 577203 - DNA, 25 bp, Rattus norvegicus
tcagcaaagccccagagtcaaagtg

SEQ ID NO: 577204 - DNA, 25 bp, Rattus norvegicus
tcagcaaagcccgagagtcaaagtg

SEQ ID NO: 577205 - DNA, 25 bp, Rattus norvegicus
tcagcaaaggagcaagccgcttcgt

SEQ ID NO: 577206 - DNA, 25 bp, Rattus norvegicus
tcagcaaaggaggaagccgcttcgt

SEQ ID NO: 577207 - DNA, 25 bp, Rattus norvegicus
tcagcaaagtgaagcaaccccgcag

SEQ ID NO: 577208 - DNA, 25 bp, Rattus norvegicus
tcagcaaagtgatgcaaccccgcag

SEQ ID NO: 577209 - DNA, 25 bp, Rattus norvegicus
tcagcaaatggactgccccagagac

SEQ ID NO: 577210 - DNA, 25 bp, Rattus norvegicus
tcagcaaatggagtgccccagagac

SEQ ID NO: 577211 - DNA, 25 bp, Rattus norvegicus
tcagcaaccccacggctgatgtggg

SEQ ID NO: 577212 - DNA, 25 bp, Rattus norvegicus
tcagcaaccccagggctgatgtggg

SEQ ID NO: 577213 - DNA, 25 bp, Rattus norvegicus
tcagcaacgcaactcccagaggaaa

SEQ ID NO: 577214 - DNA, 25 bp, Rattus norvegicus
tcagcaacgcaagtcccagaggaaa

SEQ ID NO: 577215 - DNA, 25 bp, Rattus norvegicus
tcagcaacgcagagccaaggcgccg

SEQ ID NO: 577216 - DNA, 25 bp, Rattus norvegicus
tcagcaacgcagtgccaaggcgccg

SEQ ID NO: 577217 - DNA, 25 bp, Rattus norvegicus
tcagcaactgagaattccaagggtg

SEQ ID NO: 577218 - DNA, 25 bp, Rattus norvegicus
tcagcaactgagtattccaagggtg

SEQ ID NO: 577219 - DNA, 25 bp, Rattus norvegicus
tcagcaacttggcaacgtgttgaca

SEQ ID NO: 577220 - DNA, 25 bp, Rattus norvegicus
tcagcaacttgggaacgtgttgaca

SEQ ID NO: 577221 - DNA, 25 bp, Rattus norvegicus
tcagcaagagtcatcagtaccagaa

SEQ ID NO: 577222 - DNA, 25 bp, Rattus norvegicus
tcagcaagagtcttcagtaccagaa

SEQ ID NO: 577223 - DNA, 25 bp, Rattus norvegicus
tcagcaagcggccaatggtccaaac

SEQ ID NO: 577224 - DNA, 25 bp, Rattus norvegicus
tcagcaagcggcgaatggtccaaac

SEQ ID NO: 577225 - DNA, 25 bp, Rattus norvegicus
tcagcaaggatccacgcttttctaa

SEQ ID NO: 577226 - DNA, 25 bp, Rattus norvegicus
tcagcaaggatcgacgcttttctaa

SEQ ID NO: 577227 - DNA, 25 bp, Rattus norvegicus
tcagcaaggccaagcgggatctgct

SEQ ID NO: 577228 - DNA, 25 bp, Rattus norvegicus
tcagcaaggccatgcgggatctgct

SEQ ID NO: 577229 - DNA, 25 bp, Rattus norvegicus
tcagcaaggtctatttgttggcctt

SEQ ID NO: 577230 - DNA, 25 bp, Rattus norvegicus
tcagcaaggtctttttgttggcctt

SEQ ID NO: 577231 - DNA, 25 bp, Rattus norvegicus
tcagcaagtcctaggctctggttaa

SEQ ID NO: 577232 - DNA, 25 bp, Rattus norvegicus
tcagcaagtccttggctctggttaa

SEQ ID NO: 577233 - DNA, 25 bp, Rattus norvegicus
tcagcaagtgtacaccgcagtttta

SEQ ID NO: 577234 - DNA, 25 bp, Rattus norvegicus
tcagcaagtgtagaccgcagtttta

SEQ ID NO: 577235 - DNA, 25 bp, Rattus norvegicus
tcagcaagttccatctccaaagatc

SEQ ID NO: 577236 - DNA, 25 bp, Rattus norvegicus
tcagcaagttccttctccaaagatc

SEQ ID NO: 577237 - DNA, 25 bp, Rattus norvegicus
tcagcaatactaacgcaactggttg

SEQ ID NO: 577238 - DNA, 25 bp, Rattus norvegicus
tcagcaatactatcgcaactggttg

SEQ ID NO: 577239 - DNA, 25 bp, Rattus norvegicus
tcagcaatggttatttgttccctaa

SEQ ID NO: 577240 - DNA, 25 bp, Rattus norvegicus
tcagcaatggttttttgttccctaa

SEQ ID NO: 577241 - DNA, 25 bp, Rattus norvegicus
tcagcacacagcacttgagtaactg

SEQ ID NO: 577242 - DNA, 25 bp, Rattus norvegicus
tcagcacacagctcttgagtaactg

SEQ ID NO: 577243 - DNA, 25 bp, Rattus norvegicus
tcagcacacaggaagccccgaattt

SEQ ID NO: 577244 - DNA, 25 bp, Rattus norvegicus
tcagcacacaggtagccccgaattt

SEQ ID NO: 577245 - DNA, 25 bp, Rattus norvegicus
tcagcacacctgacctgacataggt

SEQ ID NO: 577246 - DNA, 25 bp, Rattus norvegicus
tcagcacacctgtcctgacataggt

SEQ ID NO: 577247 - DNA, 25 bp, Rattus norvegicus
tcagcacactgtccctggatgctgc

SEQ ID NO: 577248 - DNA, 25 bp, Rattus norvegicus
tcagcacactgtgcctggatgctgc

SEQ ID NO: 577249 - DNA, 25 bp, Rattus norvegicus
tcagcacagcttcccatggcagcaa

SEQ ID NO: 577250 - DNA, 25 bp, Rattus norvegicus
tcagcacagcttgccatggcagcaa

SEQ ID NO: 577251 - DNA, 25 bp, Rattus norvegicus
tcagcacagtgcaaaagttctttaa

SEQ ID NO: 577252 - DNA, 25 bp, Rattus norvegicus
tcagcacagtgctaaagttctttaa

SEQ ID NO: 577253 - DNA, 25 bp, Rattus norvegicus
tcagcacagttgcaagagttgtctt

SEQ ID NO: 577254 - DNA, 25 bp, Rattus norvegicus
tcagcacagttggaagagttgtctt

SEQ ID NO: 577255 - DNA, 25 bp, Rattus norvegicus
tcagcacatgtaagggtgacctctt

SEQ ID NO: 577256 - DNA, 25 bp, Rattus norvegicus
tcagcacatgtacgcggactccagt

SEQ ID NO: 577257 - DNA, 25 bp, Rattus norvegicus
tcagcacatgtaggcggactccagt

SEQ ID NO: 577258 - DNA, 25 bp, Rattus norvegicus
tcagcacatgtatgggtgacctctt

SEQ ID NO: 577259 - DNA, 25 bp, Rattus norvegicus
tcagcaccactgctgtgagtgcccg

SEQ ID NO: 577260 - DNA, 25 bp, Rattus norvegicus
tcagcaccactggtgtgagtgcccg

SEQ ID NO: 577261 - DNA, 25 bp, Rattus norvegicus
tcagcaccacttcacgaaggcattt

SEQ ID NO: 577262 - DNA, 25 bp, Rattus norvegicus
tcagcaccacttgacgaaggcattt

SEQ ID NO: 577263 - DNA, 25 bp, Rattus norvegicus
tcagcaccagtgacccaaaaagcag

SEQ ID NO: 577264 - DNA, 25 bp, Rattus norvegicus
tcagcaccagtgtcccaaaaagcag

SEQ ID NO: 577265 - DNA, 25 bp, Rattus norvegicus
tcagcacccacacaggaggagaaag

SEQ ID NO: 577266 - DNA, 25 bp, Rattus norvegicus
tcagcacccacagaggaggagaaag

SEQ ID NO: 577267 - DNA, 25 bp, Rattus norvegicus
tcagcacccgctaagcagcttataa

SEQ ID NO: 577268 - DNA, 25 bp, Rattus norvegicus
tcagcacccgcttagcagcttataa

SEQ ID NO: 577269 - DNA, 25 bp, Rattus norvegicus
tcagcacctcggacaattcccggag

SEQ ID NO: 577270 - DNA, 25 bp, Rattus norvegicus
tcagcacctcggtcaattcccggag

SEQ ID NO: 577271 - DNA, 25 bp, Rattus norvegicus
tcagcaccttttaatctccatcttc

SEQ ID NO: 577272 - DNA, 25 bp, Rattus norvegicus
tcagcaccttttactttgcaactca

SEQ ID NO: 577273 - DNA, 25 bp, Rattus norvegicus
tcagcacctttttatctccatcttc

SEQ ID NO: 577274 - DNA, 25 bp, Rattus norvegicus
tcagcacctttttctttgcaactca

SEQ ID NO: 577275 - DNA, 25 bp, Rattus norvegicus
tcagcacgatgcagctcagcttaaa

SEQ ID NO: 577276 - DNA, 25 bp, Rattus norvegicus
tcagcacgatgctgctcagcttaaa

SEQ ID NO: 577277 - DNA, 25 bp, Rattus norvegicus
tcagcacgatggcttctagcgacat

SEQ ID NO: 577278 - DNA, 25 bp, Rattus norvegicus
tcagcacgatgggttctagcgacat

SEQ ID NO: 577279 - DNA, 25 bp, Rattus norvegicus
tcagcacgccgacttgatctttgag

SEQ ID NO: 577280 - DNA, 25 bp, Rattus norvegicus
tcagcacgccgagttgatctttgag

SEQ ID NO: 577281 - DNA, 25 bp, Rattus norvegicus
tcagcactagacacatcctgtatgt

SEQ ID NO: 577282 - DNA, 25 bp, Rattus norvegicus
tcagcactagactcatcctgtatgt

SEQ ID NO: 577283 - DNA, 25 bp, Rattus norvegicus
tcagcactaggaccacaaagggcct

SEQ ID NO: 577284 - DNA, 25 bp, Rattus norvegicus
tcagcactaggagcacaaagggcct

SEQ ID NO: 577285 - DNA, 25 bp, Rattus norvegicus
tcagcactagggattggagttcagc

SEQ ID NO: 577286 - DNA, 25 bp, Rattus norvegicus
tcagcactagggtttggagttcagc

SEQ ID NO: 577287 - DNA, 25 bp, Rattus norvegicus
tcagcactcacacttttagcagaca

SEQ ID NO: 577288 - DNA, 25 bp, Rattus norvegicus
tcagcactcacagttttagcagaca

SEQ ID NO: 577289 - DNA, 25 bp, Rattus norvegicus
tcagcactgaatcaggccctcgggt

SEQ ID NO: 577290 - DNA, 25 bp, Rattus norvegicus
tcagcactgaatgaggccctcgggt

SEQ ID NO: 577291 - DNA, 25 bp, Rattus norvegicus
tcagcactgagaagccgcagaccaa

SEQ ID NO: 577292 - DNA, 25 bp, Rattus norvegicus
tcagcactgagatgccgcagaccaa

SEQ ID NO: 577293 - DNA, 25 bp, Rattus norvegicus
tcagcactgcagatgccttcgccat

SEQ ID NO: 577294 - DNA, 25 bp, Rattus norvegicus
tcagcactgcagttgccttcgccat

SEQ ID NO: 577295 - DNA, 25 bp, Rattus norvegicus
tcagcactgcccaaataataacttg

SEQ ID NO: 577296 - DNA, 25 bp, Rattus norvegicus
tcagcactgccctaataataacttg

SEQ ID NO: 577297 - DNA, 25 bp, Rattus norvegicus
tcagcactgctgctcatggaaagga

SEQ ID NO: 577298 - DNA, 25 bp, Rattus norvegicus
tcagcactgctggtcatggaaagga

SEQ ID NO: 577299 - DNA, 25 bp, Rattus norvegicus
tcagcactggtgagggcagagaccc

SEQ ID NO: 577300 - DNA, 25 bp, Rattus norvegicus
tcagcactggtgtgggcagagaccc

SEQ ID NO: 577301 - DNA, 25 bp, Rattus norvegicus
tcagcactgtggacaggacagcgct

SEQ ID NO: 577302 - DNA, 25 bp, Rattus norvegicus
tcagcactgtggtcaggacagcgct

SEQ ID NO: 577303 - DNA, 25 bp, Rattus norvegicus
tcagcacttaagagtctgtgacagg

SEQ ID NO: 577304 - DNA, 25 bp, Rattus norvegicus
tcagcacttaagtgtctgtgacagg

SEQ ID NO: 577305 - DNA, 25 bp, Rattus norvegicus
tcagcacttatacatctttcagaat

SEQ ID NO: 577306 - DNA, 25 bp, Rattus norvegicus
tcagcacttatagatctttcagaat

SEQ ID NO: 577307 - DNA, 25 bp, Rattus norvegicus
tcagcagaatttcaagcgaggctct

SEQ ID NO: 577308 - DNA, 25 bp, Rattus norvegicus
tcagcagaatttgaagcgaggctct

SEQ ID NO: 577309 - DNA, 25 bp, Rattus norvegicus
tcagcagacagccttttctcagcag

SEQ ID NO: 577310 - DNA, 25 bp, Rattus norvegicus
tcagcagacagcgttttctcagcag

SEQ ID NO: 577311 - DNA, 25 bp, Rattus norvegicus
tcagcagacatacgacagcccaggt

SEQ ID NO: 577312 - DNA, 25 bp, Rattus norvegicus
tcagcagacataggacagcccaggt

SEQ ID NO: 577313 - DNA, 25 bp, Rattus norvegicus
tcagcagactggctcctgtgtcaac

SEQ ID NO: 577314 - DNA, 25 bp, Rattus norvegicus
tcagcagactgggtcctgtgtcaac

SEQ ID NO: 577315 - DNA, 25 bp, Rattus norvegicus
tcagcagagctgatcctaagggcct

SEQ ID NO: 577316 - DNA, 25 bp, Rattus norvegicus
tcagcagagctgttcctaagggcct

SEQ ID NO: 577317 - DNA, 25 bp, Rattus norvegicus
tcagcagagcttccgcataatttgg

SEQ ID NO: 577318 - DNA, 25 bp, Rattus norvegicus
tcagcagagcttgcgcataatttgg

SEQ ID NO: 577319 - DNA, 25 bp, Rattus norvegicus
tcagcagcaaagatgtccagtgggc

SEQ ID NO: 577320 - DNA, 25 bp, Rattus norvegicus
tcagcagcaaagttgtccagtgggc

SEQ ID NO: 577321 - DNA, 25 bp, Rattus norvegicus
tcagcagcacatattcacagacaga

SEQ ID NO: 577322 - DNA, 25 bp, Rattus norvegicus
tcagcagcacattttcacagacaga

SEQ ID NO: 577323 - DNA, 25 bp, Rattus norvegicus
tcagcagcaccgagctatgagctaa

SEQ ID NO: 577324 - DNA, 25 bp, Rattus norvegicus
tcagcagcaccgtgctatgagctaa

SEQ ID NO: 577325 - DNA, 25 bp, Rattus norvegicus
tcagcagcagccagttgacttcaga

SEQ ID NO: 577326 - DNA, 25 bp, Rattus norvegicus
tcagcagcagcctgttgacttcaga

SEQ ID NO: 577327 - DNA, 25 bp, Rattus norvegicus
tcagcagcatttctcttgggcactc

SEQ ID NO: 577328 - DNA, 25 bp, Rattus norvegicus
tcagcagcatttgtcttgggcactc

SEQ ID NO: 577329 - DNA, 25 bp, Rattus norvegicus
tcagcagccactaccatcatcagga

SEQ ID NO: 577330 - DNA, 25 bp, Rattus norvegicus
tcagcagccacttccatcatcagga

SEQ ID NO: 577331 - DNA, 25 bp, Rattus norvegicus
tcagcagccaggagcacttgttgct

SEQ ID NO: 577332 - DNA, 25 bp, Rattus norvegicus
tcagcagccaggtgcacttgttgct

SEQ ID NO: 577333 - DNA, 25 bp, Rattus norvegicus
tcagcagcccaaaggtgcaggtttc

SEQ ID NO: 577334 - DNA, 25 bp, Rattus norvegicus
tcagcagcccaatggtgcaggtttc

SEQ ID NO: 577335 - DNA, 25 bp, Rattus norvegicus
tcagcagccgtcacagacagtgcgt

SEQ ID NO: 577336 - DNA, 25 bp, Rattus norvegicus
tcagcagccgtctcagacagtgcgt

SEQ ID NO: 577337 - DNA, 25 bp, Rattus norvegicus
tcagcagcctaaactgttgccaggt

SEQ ID NO: 577338 - DNA, 25 bp, Rattus norvegicus
tcagcagcctaatctgttgccaggt

SEQ ID NO: 577339 - DNA, 25 bp, Rattus norvegicus
tcagcagcctctatgacgtggaagc

SEQ ID NO: 577340 - DNA, 25 bp, Rattus norvegicus
tcagcagcctctttgacgtggaagc

SEQ ID NO: 577341 - DNA, 25 bp, Rattus norvegicus
tcagcagcctgcctatcagaggtgg

SEQ ID NO: 577342 - DNA, 25 bp, Rattus norvegicus
tcagcagcctgcgtatcagaggtgg

SEQ ID NO: 577343 - DNA, 25 bp, Rattus norvegicus
tcagcagcgccacatcttagaggag

SEQ ID NO: 577344 - DNA, 25 bp, Rattus norvegicus
tcagcagcgccagatcttagaggag

SEQ ID NO: 577345 - DNA, 25 bp, Rattus norvegicus
tcagcagcgtgtcttactggactct

SEQ ID NO: 577346 - DNA, 25 bp, Rattus norvegicus
tcagcagcgtgtgttactggactct

SEQ ID NO: 577347 - DNA, 25 bp, Rattus norvegicus
tcagcagctaagatagtctcttgta

SEQ ID NO: 577348 - DNA, 25 bp, Rattus norvegicus
tcagcagctaagttagtctcttgta

SEQ ID NO: 577349 - DNA, 25 bp, Rattus norvegicus
tcagcagctcataaggcattcagac

SEQ ID NO: 577350 - DNA, 25 bp, Rattus norvegicus
tcagcagctcattaggcattcagac

SEQ ID NO: 577351 - DNA, 25 bp, Rattus norvegicus
tcagcagctcggagttgcgcacctg

SEQ ID NO: 577352 - DNA, 25 bp, Rattus norvegicus
tcagcagctcggtgttgcgcacctg

SEQ ID NO: 577353 - DNA, 25 bp, Rattus norvegicus
tcagcagctcttcggacgtggcgaa

SEQ ID NO: 577354 - DNA, 25 bp, Rattus norvegicus
tcagcagctcttgggacgtggcgaa

SEQ ID NO: 577355 - DNA, 25 bp, Rattus norvegicus
tcagcagctgatctttttgaggatt

SEQ ID NO: 577356 - DNA, 25 bp, Rattus norvegicus
tcagcagctgatgtttttgaggatt

SEQ ID NO: 577357 - DNA, 25 bp, Rattus norvegicus
tcagcagcttccatcagggaggtgt

SEQ ID NO: 577358 - DNA, 25 bp, Rattus norvegicus
tcagcagcttccttcagggaggtgt

SEQ ID NO: 577359 - DNA, 25 bp, Rattus norvegicus
tcagcagcttgcaaccatagacagc

SEQ ID NO: 577360 - DNA, 25 bp, Rattus norvegicus
tcagcagcttgctaccatagacagc

SEQ ID NO: 577361 - DNA, 25 bp, Rattus norvegicus
tcagcaggacttcaggtgcccttcc

SEQ ID NO: 577362 - DNA, 25 bp, Rattus norvegicus
tcagcaggacttgaggtgcccttcc

SEQ ID NO: 577363 - DNA, 25 bp, Rattus norvegicus
tcagcaggaggcatctgtgggaaat

SEQ ID NO: 577364 - DNA, 25 bp, Rattus norvegicus
tcagcaggaggcttctgtgggaaat

SEQ ID NO: 577365 - DNA, 25 bp, Rattus norvegicus
tcagcaggcacaccgcgctggtaag

SEQ ID NO: 577366 - DNA, 25 bp, Rattus norvegicus
tcagcaggcacagcgcgctggtaag

SEQ ID NO: 577367 - DNA, 25 bp, Rattus norvegicus
tcagcaggcctgacccctggagagg

SEQ ID NO: 577368 - DNA, 25 bp, Rattus norvegicus
tcagcaggcctgtcccctggagagg

SEQ ID NO: 577369 - DNA, 25 bp, Rattus norvegicus
tcagcaggcgcccactttatcatca

SEQ ID NO: 577370 - DNA, 25 bp, Rattus norvegicus
tcagcaggcgccgactttatcatca

SEQ ID NO: 577371 - DNA, 25 bp, Rattus norvegicus
tcagcaggctgcagaattgtttctt

SEQ ID NO: 577372 - DNA, 25 bp, Rattus norvegicus
tcagcaggctgctgaattgtttctt

SEQ ID NO: 577373 - DNA, 25 bp, Rattus norvegicus
tcagcagggttcctcttccttgaat

SEQ ID NO: 577374 - DNA, 25 bp, Rattus norvegicus
tcagcagggttcgtcttccttgaat

SEQ ID NO: 577375 - DNA, 25 bp, Rattus norvegicus
tcagcaggtcagcttgcccgcagtg

SEQ ID NO: 577376 - DNA, 25 bp, Rattus norvegicus
tcagcaggtcaggttgcccgcagtg

SEQ ID NO: 577377 - DNA, 25 bp, Rattus norvegicus
tcagcaggtcttccaaccaagtctg

SEQ ID NO: 577378 - DNA, 25 bp, Rattus norvegicus
tcagcaggtcttgcaaccaagtctg

SEQ ID NO: 577379 - DNA, 25 bp, Rattus norvegicus
tcagcaggttctcacagcacagggt

SEQ ID NO: 577380 - DNA, 25 bp, Rattus norvegicus
tcagcaggttctgacagcacagggt

SEQ ID NO: 577381 - DNA, 25 bp, Rattus norvegicus
tcagcagtatccctcagagcgggaa

SEQ ID NO: 577382 - DNA, 25 bp, Rattus norvegicus
tcagcagtatccgtcagagcgggaa

SEQ ID NO: 577383 - DNA, 25 bp, Rattus norvegicus
tcagcagtcgtcagggcatttgcaa

SEQ ID NO: 577384 - DNA, 25 bp, Rattus norvegicus
tcagcagtcgtcctacacagagcag

SEQ ID NO: 577385 - DNA, 25 bp, Rattus norvegicus
tcagcagtcgtcgtacacagagcag

SEQ ID NO: 577386 - DNA, 25 bp, Rattus norvegicus
tcagcagtcgtctgggcatttgcaa

SEQ ID NO: 577387 - DNA, 25 bp, Rattus norvegicus
tcagcagtgctgagtcatttttgac

SEQ ID NO: 577388 - DNA, 25 bp, Rattus norvegicus
tcagcagtgctgtgtcatttttgac

SEQ ID NO: 577389 - DNA, 25 bp, Rattus norvegicus
tcagcagtggccagacagtttcact

SEQ ID NO: 577390 - DNA, 25 bp, Rattus norvegicus
tcagcagtggcctgacagtttcact

SEQ ID NO: 577391 - DNA, 25 bp, Rattus norvegicus
tcagcagttccgatgatggtctcaa

SEQ ID NO: 577392 - DNA, 25 bp, Rattus norvegicus
tcagcagttccgttgatggtctcaa

SEQ ID NO: 577393 - DNA, 25 bp, Rattus norvegicus
tcagcataatgtcagccaccaggat

SEQ ID NO: 577394 - DNA, 25 bp, Rattus norvegicus
tcagcataatgtgagccaccaggat

SEQ ID NO: 577395 - DNA, 25 bp, Rattus norvegicus
tcagcatatggtcctcctcaggagt

SEQ ID NO: 577396 - DNA, 25 bp, Rattus norvegicus
tcagcatatggtgctcctcaggagt

SEQ ID NO: 577397 - DNA, 25 bp, Rattus norvegicus
tcagcatcacgaacatcctcaaatt

SEQ ID NO: 577398 - DNA, 25 bp, Rattus norvegicus
tcagcatcacgatcatcctcaaatt

SEQ ID NO: 577399 - DNA, 25 bp, Rattus norvegicus
tcagcatcacgtcagaactcatact

SEQ ID NO: 577400 - DNA, 25 bp, Rattus norvegicus
tcagcatcacgtgagaactcatact

SEQ ID NO: 577401 - DNA, 25 bp, Rattus norvegicus
tcagcatcagagatgaatgtacttc

SEQ ID NO: 577402 - DNA, 25 bp, Rattus norvegicus
tcagcatcagagttgaatgtacttc

SEQ ID NO: 577403 - DNA, 25 bp, Rattus norvegicus
tcagcatcagcaacattaccatcat

SEQ ID NO: 577404 - DNA, 25 bp, Rattus norvegicus
tcagcatcagcactgcagtgtgcac

SEQ ID NO: 577405 - DNA, 25 bp, Rattus norvegicus
tcagcatcagcagtgcagtgtgcac

SEQ ID NO: 577406 - DNA, 25 bp, Rattus norvegicus
tcagcatcagcatcattaccatcat

SEQ ID NO: 577407 - DNA, 25 bp, Rattus norvegicus
tcagcatcatttattgcgcacctgc

SEQ ID NO: 577408 - DNA, 25 bp, Rattus norvegicus
tcagcatcattttttgcgcacctgc

SEQ ID NO: 577409 - DNA, 25 bp, Rattus norvegicus
tcagcatccacaaagcagttcacca

SEQ ID NO: 577410 - DNA, 25 bp, Rattus norvegicus
tcagcatccacatagcagttcacca

SEQ ID NO: 577411 - DNA, 25 bp, Rattus norvegicus
tcagcatccgccaggtttgcagttt

SEQ ID NO: 577412 - DNA, 25 bp, Rattus norvegicus
tcagcatccgcctggtttgcagttt

SEQ ID NO: 577413 - DNA, 25 bp, Rattus norvegicus
tcagcatccttgaccatgggtaagt

SEQ ID NO: 577414 - DNA, 25 bp, Rattus norvegicus
tcagcatccttgtccatgggtaagt

SEQ ID NO: 577415 - DNA, 25 bp, Rattus norvegicus
tcagcatctgtactctgtccacata

SEQ ID NO: 577416 - DNA, 25 bp, Rattus norvegicus
tcagcatctgtagtctgtccacata

SEQ ID NO: 577417 - DNA, 25 bp, Rattus norvegicus
tcagcatctgtgacggttcagccaa

SEQ ID NO: 577418 - DNA, 25 bp, Rattus norvegicus
tcagcatctgtgtcggttcagccaa

SEQ ID NO: 577419 - DNA, 25 bp, Rattus norvegicus
tcagcatcttcacattacctacaag

SEQ ID NO: 577420 - DNA, 25 bp, Rattus norvegicus
tcagcatcttcagattacctacaag

SEQ ID NO: 577421 - DNA, 25 bp, Rattus norvegicus
tcagcatgactgagctagccgagat

SEQ ID NO: 577422 - DNA, 25 bp, Rattus norvegicus
tcagcatgactgtgctagccgagat

SEQ ID NO: 577423 - DNA, 25 bp, Rattus norvegicus
tcagcatgagccctacttcagtgtg

SEQ ID NO: 577424 - DNA, 25 bp, Rattus norvegicus
tcagcatgagccgtacttcagtgtg

SEQ ID NO: 577425 - DNA, 25 bp, Rattus norvegicus
tcagcatggacaacagaccctgtta

SEQ ID NO: 577426 - DNA, 25 bp, Rattus norvegicus
tcagcatggacatcagaccctgtta

SEQ ID NO: 577427 - DNA, 25 bp, Rattus norvegicus
tcagcatggattccccctagagtca

SEQ ID NO: 577428 - DNA, 25 bp, Rattus norvegicus
tcagcatggattgcccctagagtca

SEQ ID NO: 577429 - DNA, 25 bp, Rattus norvegicus
tcagcatggccccaagtgcagtacc

SEQ ID NO: 577430 - DNA, 25 bp, Rattus norvegicus
tcagcatggcccgaagtgcagtacc

SEQ ID NO: 577431 - DNA, 25 bp, Rattus norvegicus
tcagcatggctgagtgttcgctaca

SEQ ID NO: 577432 - DNA, 25 bp, Rattus norvegicus
tcagcatggctgtgtgttcgctaca

SEQ ID NO: 577433 - DNA, 25 bp, Rattus norvegicus
tcagcatggttgaaggccagctcaa

SEQ ID NO: 577434 - DNA, 25 bp, Rattus norvegicus
tcagcatggttgtaggccagctcaa

SEQ ID NO: 577435 - DNA, 25 bp, Rattus norvegicus
tcagcatgtggtcctgagacattct

SEQ ID NO: 577436 - DNA, 25 bp, Rattus norvegicus
tcagcatgtggtgctgagacattct

SEQ ID NO: 577437 - DNA, 25 bp, Rattus norvegicus
tcagcatgtgtgagctttctctctc

SEQ ID NO: 577438 - DNA, 25 bp, Rattus norvegicus
tcagcatgtgtgcagacatcactgt

SEQ ID NO: 577439 - DNA, 25 bp, Rattus norvegicus
tcagcatgtgtggagacatcactgt

SEQ ID NO: 577440 - DNA, 25 bp, Rattus norvegicus
tcagcatgtgtgtgctttctctctc

SEQ ID NO: 577441 - DNA, 25 bp, Rattus norvegicus
tcagcattagagaccagcagtttat

SEQ ID NO: 577442 - DNA, 25 bp, Rattus norvegicus
tcagcattagagtccagcagtttat

SEQ ID NO: 577443 - DNA, 25 bp, Rattus norvegicus
tcagcattcatcaagcccctaagga

SEQ ID NO: 577444 - DNA, 25 bp, Rattus norvegicus
tcagcattcatctagcccctaagga

SEQ ID NO: 577445 - DNA, 25 bp, Rattus norvegicus
tcagcattctggcacacctattctg

SEQ ID NO: 577446 - DNA, 25 bp, Rattus norvegicus
tcagcattctgggacacctattctg

SEQ ID NO: 577447 - DNA, 25 bp, Rattus norvegicus
tcagcattgcaactgtgtcctccca

SEQ ID NO: 577448 - DNA, 25 bp, Rattus norvegicus
tcagcattgcaagtgtgtcctccca

SEQ ID NO: 577449 - DNA, 25 bp, Rattus norvegicus
tcagcattgcggagcctggctgcgt

SEQ ID NO: 577450 - DNA, 25 bp, Rattus norvegicus
tcagcattgcggtgcctggctgcgt

SEQ ID NO: 577451 - DNA, 25 bp, Rattus norvegicus
tcagcattgctacttcttggtcaga

SEQ ID NO: 577452 - DNA, 25 bp, Rattus norvegicus
tcagcattgctagttcttggtcaga

SEQ ID NO: 577453 - DNA, 25 bp, Rattus norvegicus
tcagcattttagctgcgcatccatg

SEQ ID NO: 577454 - DNA, 25 bp, Rattus norvegicus
tcagcattttaggtgcgcatccatg

SEQ ID NO: 577455 - DNA, 25 bp, Rattus norvegicus
tcagccaaatgacccgggacgagat

SEQ ID NO: 577456 - DNA, 25 bp, Rattus norvegicus
tcagccaaatgagccgggacgagat

SEQ ID NO: 577457 - DNA, 25 bp, Rattus norvegicus
tcagccaacagccaggagcagtgac

SEQ ID NO: 577458 - DNA, 25 bp, Rattus norvegicus
tcagccaacagcgaggagcagtgac

SEQ ID NO: 577459 - DNA, 25 bp, Rattus norvegicus
tcagccaagaacagtggcggaggct

SEQ ID NO: 577460 - DNA, 25 bp, Rattus norvegicus
tcagccaagaactgtggcggaggct

SEQ ID NO: 577461 - DNA, 25 bp, Rattus norvegicus
tcagccaagcgaatgtctccctcag

SEQ ID NO: 577462 - DNA, 25 bp, Rattus norvegicus
tcagccaagcgattgtctccctcag

SEQ ID NO: 577463 - DNA, 25 bp, Rattus norvegicus
tcagccaagctgacgtctagggtgc

SEQ ID NO: 577464 - DNA, 25 bp, Rattus norvegicus
tcagccaagctgtcgtctagggtgc

SEQ ID NO: 577465 - DNA, 25 bp, Rattus norvegicus
tcagccaatagaagtgacagcatta

SEQ ID NO: 577466 - DNA, 25 bp, Rattus norvegicus
tcagccaatagatgtgacagcatta

SEQ ID NO: 577467 - DNA, 25 bp, Rattus norvegicus
tcagccaatctgcacacttctatta

SEQ ID NO: 577468 - DNA, 25 bp, Rattus norvegicus
tcagccaatctggacacttctatta

SEQ ID NO: 577469 - DNA, 25 bp, Rattus norvegicus
tcagccacagggagatgccggacca

SEQ ID NO: 577470 - DNA, 25 bp, Rattus norvegicus
tcagccacagggtgatgccggacca

SEQ ID NO: 577471 - DNA, 25 bp, Rattus norvegicus
tcagccaccctactgtggagtcagg

SEQ ID NO: 577472 - DNA, 25 bp, Rattus norvegicus
tcagccaccctagtgtggagtcagg

SEQ ID NO: 577473 - DNA, 25 bp, Rattus norvegicus
tcagccactagcagacggaagagac

SEQ ID NO: 577474 - DNA, 25 bp, Rattus norvegicus
tcagccactagctgacggaagagac

SEQ ID NO: 577475 - DNA, 25 bp, Rattus norvegicus
tcagccagcaaccaccagagtatta

SEQ ID NO: 577476 - DNA, 25 bp, Rattus norvegicus
tcagccagcaacgaccagagtatta

SEQ ID NO: 577477 - DNA, 25 bp, Rattus norvegicus
tcagccagcacgctaagtacacttg

SEQ ID NO: 577478 - DNA, 25 bp, Rattus norvegicus
tcagccagcacggtaagtacacttg

SEQ ID NO: 577479 - DNA, 25 bp, Rattus norvegicus
tcagccagctgacggagtatgattt

SEQ ID NO: 577480 - DNA, 25 bp, Rattus norvegicus
tcagccagctgagggagtatgattt

SEQ ID NO: 577481 - DNA, 25 bp, Rattus norvegicus
tcagccaggctgaggacggcctcca

SEQ ID NO: 577482 - DNA, 25 bp, Rattus norvegicus
tcagccaggctgtggacggcctcca

SEQ ID NO: 577483 - DNA, 25 bp, Rattus norvegicus
tcagccagggcacggagatgactct

SEQ ID NO: 577484 - DNA, 25 bp, Rattus norvegicus
tcagccagggcagggagatgactct

SEQ ID NO: 577485 - DNA, 25 bp, Rattus norvegicus
tcagccaggtttctggtgtccattg

SEQ ID NO: 577486 - DNA, 25 bp, Rattus norvegicus
tcagccaggtttgtggtgtccattg

SEQ ID NO: 577487 - DNA, 25 bp, Rattus norvegicus
tcagccagtcgcctgtagatgtgga

SEQ ID NO: 577488 - DNA, 25 bp, Rattus norvegicus
tcagccagtcgcgtgtagatgtgga

SEQ ID NO: 577489 - DNA, 25 bp, Rattus norvegicus
tcagccagtggcctttgcagacagc

SEQ ID NO: 577490 - DNA, 25 bp, Rattus norvegicus
tcagccagtggcgtttgcagacagc

SEQ ID NO: 577491 - DNA, 25 bp, Rattus norvegicus
tcagccagtgtgcacctaccgtgag

SEQ ID NO: 577492 - DNA, 25 bp, Rattus norvegicus
tcagccagtgtggacctaccgtgag

SEQ ID NO: 577493 - DNA, 25 bp, Rattus norvegicus
tcagccagtttccatgggactccag

SEQ ID NO: 577494 - DNA, 25 bp, Rattus norvegicus
tcagccagtttcgatgggactccag

SEQ ID NO: 577495 - DNA, 25 bp, Rattus norvegicus
tcagccatcactcacattctaagaa

SEQ ID NO: 577496 - DNA, 25 bp, Rattus norvegicus
tcagccatcactgacattctaagaa

SEQ ID NO: 577497 - DNA, 25 bp, Rattus norvegicus
tcagccatcctgcaagtccgggaca

SEQ ID NO: 577498 - DNA, 25 bp, Rattus norvegicus
tcagccatcctggaagtccgggaca

SEQ ID NO: 577499 - DNA, 25 bp, Rattus norvegicus
tcagccatcgtcaccaatgtagacc

SEQ ID NO: 577500 - DNA, 25 bp, Rattus norvegicus
tcagccatcgtctccaatgtagacc

SEQ ID NO: 577501 - DNA, 25 bp, Rattus norvegicus
tcagccatgaccctgggatgtacat

SEQ ID NO: 577502 - DNA, 25 bp, Rattus norvegicus
tcagccatgaccgtgggatgtacat

SEQ ID NO: 577503 - DNA, 25 bp, Rattus norvegicus
tcagccatgattctcgttgggtggt

SEQ ID NO: 577504 - DNA, 25 bp, Rattus norvegicus
tcagccatgattgtcgttgggtggt

SEQ ID NO: 577505 - DNA, 25 bp, Rattus norvegicus
tcagccatgctaaccttgagcttag

SEQ ID NO: 577506 - DNA, 25 bp, Rattus norvegicus
tcagccatgctatccttgagcttag

SEQ ID NO: 577507 - DNA, 25 bp, Rattus norvegicus
tcagccatgctgatcatcatcctga

SEQ ID NO: 577508 - DNA, 25 bp, Rattus norvegicus
tcagccatgctgttcatcatcctga

SEQ ID NO: 577509 - DNA, 25 bp, Rattus norvegicus
tcagccatgcttcggtagacatctt

SEQ ID NO: 577510 - DNA, 25 bp, Rattus norvegicus
tcagccatgcttgggtagacatctt

SEQ ID NO: 577511 - DNA, 25 bp, Rattus norvegicus
tcagccatggcacctctgtcagtgg

SEQ ID NO: 577512 - DNA, 25 bp, Rattus norvegicus
tcagccatggcagctctgtcagtgg

SEQ ID NO: 577513 - DNA, 25 bp, Rattus norvegicus
tcagccatgggcaaagagctgtcat

SEQ ID NO: 577514 - DNA, 25 bp, Rattus norvegicus
tcagccatgggctaagagctgtcat

SEQ ID NO: 577515 - DNA, 25 bp, Rattus norvegicus
tcagccatgttccagcttcaaaaca

SEQ ID NO: 577516 - DNA, 25 bp, Rattus norvegicus
tcagccatgttcgagcttcaaaaca

SEQ ID NO: 577517 - DNA, 25 bp, Rattus norvegicus
tcagccattcgcagagtggcttcag

SEQ ID NO: 577518 - DNA, 25 bp, Rattus norvegicus
tcagccattcgctgagtggcttcag

SEQ ID NO: 577519 - DNA, 25 bp, Rattus norvegicus
tcagccattgtcaggtcggccagcc

SEQ ID NO: 577520 - DNA, 25 bp, Rattus norvegicus
tcagccattgtctggtcggccagcc

SEQ ID NO: 577521 - DNA, 25 bp, Rattus norvegicus
tcagccatttggacttactattagg

SEQ ID NO: 577522 - DNA, 25 bp, Rattus norvegicus
tcagccatttggtcttactattagg

SEQ ID NO: 577523 - DNA, 25 bp, Rattus norvegicus
tcagcccaacctcgagggacatcta

SEQ ID NO: 577524 - DNA, 25 bp, Rattus norvegicus
tcagcccaacctggagggacatcta

SEQ ID NO: 577525 - DNA, 25 bp, Rattus norvegicus
tcagcccaagagctcattccaagag

SEQ ID NO: 577526 - DNA, 25 bp, Rattus norvegicus
tcagcccaagaggtcattccaagag

SEQ ID NO: 577527 - DNA, 25 bp, Rattus norvegicus
tcagcccaagcccactgttatggga

SEQ ID NO: 577528 - DNA, 25 bp, Rattus norvegicus
tcagcccaagccgactgttatggga

SEQ ID NO: 577529 - DNA, 25 bp, Rattus norvegicus
tcagcccaccaaacactacgtagaa

SEQ ID NO: 577530 - DNA, 25 bp, Rattus norvegicus
tcagcccaccaatcactacgtagaa

SEQ ID NO: 577531 - DNA, 25 bp, Rattus norvegicus
tcagcccaccaccaaagtatggcat

SEQ ID NO: 577532 - DNA, 25 bp, Rattus norvegicus
tcagcccaccacgaaagtatggcat

SEQ ID NO: 577533 - DNA, 25 bp, Rattus norvegicus
tcagcccacctcaggcaatggtaac

SEQ ID NO: 577534 - DNA, 25 bp, Rattus norvegicus
tcagcccacctctggcaatggtaac

SEQ ID NO: 577535 - DNA, 25 bp, Rattus norvegicus
tcagcccactcacatactcaggatg

SEQ ID NO: 577536 - DNA, 25 bp, Rattus norvegicus
tcagcccactcagatactcaggatg

SEQ ID NO: 577537 - DNA, 25 bp, Rattus norvegicus
tcagcccactggagggtttggtcca

SEQ ID NO: 577538 - DNA, 25 bp, Rattus norvegicus
tcagcccactggtgggtttggtcca

SEQ ID NO: 577539 - DNA, 25 bp, Rattus norvegicus
tcagcccactgtattactctgcgtt

SEQ ID NO: 577540 - DNA, 25 bp, Rattus norvegicus
tcagcccactgttttactctgcgtt

SEQ ID NO: 577541 - DNA, 25 bp, Rattus norvegicus
tcagcccagaagacggagcctagat

SEQ ID NO: 577542 - DNA, 25 bp, Rattus norvegicus
tcagcccagaagtcggagcctagat

SEQ ID NO: 577543 - DNA, 25 bp, Rattus norvegicus
tcagcccagctaaaaccagtatcag

SEQ ID NO: 577544 - DNA, 25 bp, Rattus norvegicus
tcagcccagctataaccagtatcag

SEQ ID NO: 577545 - DNA, 25 bp, Rattus norvegicus
tcagcccagggaagtggcactttta

SEQ ID NO: 577546 - DNA, 25 bp, Rattus norvegicus
tcagcccagggatgtggcactttta

SEQ ID NO: 577547 - DNA, 25 bp, Rattus norvegicus
tcagcccagtgtcgcaagtatccag

SEQ ID NO: 577548 - DNA, 25 bp, Rattus norvegicus
tcagcccagtgtggcaagtatccag

SEQ ID NO: 577549 - DNA, 25 bp, Rattus norvegicus
tcagcccattttacttatgtcctgc

SEQ ID NO: 577550 - DNA, 25 bp, Rattus norvegicus
tcagcccatttttcttatgtcctgc

SEQ ID NO: 577551 - DNA, 25 bp, Rattus norvegicus
tcagccccacttacaaggagttgtt

SEQ ID NO: 577552 - DNA, 25 bp, Rattus norvegicus
tcagccccactttcaaggagttgtt

SEQ ID NO: 577553 - DNA, 25 bp, Rattus norvegicus
tcagcccctaagaccaatgtctaga

SEQ ID NO: 577554 - DNA, 25 bp, Rattus norvegicus
tcagcccctaagtccaatgtctaga

SEQ ID NO: 577555 - DNA, 25 bp, Rattus norvegicus
tcagcccctggaccactggagaaaa

SEQ ID NO: 577556 - DNA, 25 bp, Rattus norvegicus
tcagcccctggagcactggagaaaa

SEQ ID NO: 577557 - DNA, 25 bp, Rattus norvegicus
tcagcccctgggaagtcttaaagca

SEQ ID NO: 577558 - DNA, 25 bp, Rattus norvegicus
tcagcccctgggtagtcttaaagca

SEQ ID NO: 577559 - DNA, 25 bp, Rattus norvegicus
tcagcccgtgacacagcaagacaga

SEQ ID NO: 577560 - DNA, 25 bp, Rattus norvegicus
tcagcccgtgactcagcaagacaga

SEQ ID NO: 577561 - DNA, 25 bp, Rattus norvegicus
tcagcccgttgcctcatactgtcga

SEQ ID NO: 577562 - DNA, 25 bp, Rattus norvegicus
tcagcccgttgcgtcatactgtcga

SEQ ID NO: 577563 - DNA, 25 bp, Rattus norvegicus
tcagccctacatacatctgtgatca

SEQ ID NO: 577564 - DNA, 25 bp, Rattus norvegicus
tcagccctacattcatctgtgatca

SEQ ID NO: 577565 - DNA, 25 bp, Rattus norvegicus
tcagccctagccaatgatacacact

SEQ ID NO: 577566 - DNA, 25 bp, Rattus norvegicus
tcagccctagcctatgatacacact

SEQ ID NO: 577567 - DNA, 25 bp, Rattus norvegicus
tcagccctcactccaatgtttaaca

SEQ ID NO: 577568 - DNA, 25 bp, Rattus norvegicus
tcagccctcactgcaatgtttaaca

SEQ ID NO: 577569 - DNA, 25 bp, Rattus norvegicus
tcagccctcatgatttggactacat

SEQ ID NO: 577570 - DNA, 25 bp, Rattus norvegicus
tcagccctcatgttttggactacat

SEQ ID NO: 577571 - DNA, 25 bp, Rattus norvegicus
tcagccctctataccatttggtaat

SEQ ID NO: 577572 - DNA, 25 bp, Rattus norvegicus
tcagccctctattccatttggtaat

SEQ ID NO: 577573 - DNA, 25 bp, Rattus norvegicus
tcagccctcttaagttttgttgttc

SEQ ID NO: 577574 - DNA, 25 bp, Rattus norvegicus
tcagccctcttatgttttgttgttc

SEQ ID NO: 577575 - DNA, 25 bp, Rattus norvegicus
tcagccctgggtccttaatgatagt

SEQ ID NO: 577576 - DNA, 25 bp, Rattus norvegicus
tcagccctgggtgcttaatgatagt

SEQ ID NO: 577577 - DNA, 25 bp, Rattus norvegicus
tcagccctggtcatgttctaagcac

SEQ ID NO: 577578 - DNA, 25 bp, Rattus norvegicus
tcagccctggtcttgttctaagcac

SEQ ID NO: 577579 - DNA, 25 bp, Rattus norvegicus
tcagccctgtcaaatctcagtctaa

SEQ ID NO: 577580 - DNA, 25 bp, Rattus norvegicus
tcagccctgtcatatctcagtctaa

SEQ ID NO: 577581 - DNA, 25 bp, Rattus norvegicus
tcagcccttattaccaccaatatgg

SEQ ID NO: 577582 - DNA, 25 bp, Rattus norvegicus
tcagcccttatttccaccaatatgg

SEQ ID NO: 577583 - DNA, 25 bp, Rattus norvegicus
tcagcccttccgaggacacgagaag

SEQ ID NO: 577584 - DNA, 25 bp, Rattus norvegicus
tcagcccttccgtggacacgagaag

SEQ ID NO: 577585 - DNA, 25 bp, Rattus norvegicus
tcagccgagtttacatagttccagg

SEQ ID NO: 577586 - DNA, 25 bp, Rattus norvegicus
tcagccgagttttcatagttccagg

SEQ ID NO: 577587 - DNA, 25 bp, Rattus norvegicus
tcagccgcaccgatttttagtgtgg

SEQ ID NO: 577588 - DNA, 25 bp, Rattus norvegicus
tcagccgcaccgttttttagtgtgg

SEQ ID NO: 577589 - DNA, 25 bp, Rattus norvegicus
tcagccgcatagatcccagcttgat

SEQ ID NO: 577590 - DNA, 25 bp, Rattus norvegicus
tcagccgcatagttcccagcttgat

SEQ ID NO: 577591 - DNA, 25 bp, Rattus norvegicus
tcagccgcccgtcaagtgtgtgcct

SEQ ID NO: 577592 - DNA, 25 bp, Rattus norvegicus
tcagccgcccgtgaagtgtgtgcct

SEQ ID NO: 577593 - DNA, 25 bp, Rattus norvegicus
tcagccgcctgcagctggacgagtt

SEQ ID NO: 577594 - DNA, 25 bp, Rattus norvegicus
tcagccgcctgctgctggacgagtt

SEQ ID NO: 577595 - DNA, 25 bp, Rattus norvegicus
tcagccgcctgtcgagtggacagct

SEQ ID NO: 577596 - DNA, 25 bp, Rattus norvegicus
tcagccgcctgtggagtggacagct

SEQ ID NO: 577597 - DNA, 25 bp, Rattus norvegicus
tcagccgcgctgactaaattatcag

SEQ ID NO: 577598 - DNA, 25 bp, Rattus norvegicus
tcagccgcgctgtctaaattatcag

SEQ ID NO: 577599 - DNA, 25 bp, Rattus norvegicus
tcagccgcgtgtacccagataagga

SEQ ID NO: 577600 - DNA, 25 bp, Rattus norvegicus
tcagccgcgtgttcccagataagga

SEQ ID NO: 577601 - DNA, 25 bp, Rattus norvegicus
tcagccgctgtacttgggttttcta

SEQ ID NO: 577602 - DNA, 25 bp, Rattus norvegicus
tcagccgctgtagttgggttttcta

SEQ ID NO: 577603 - DNA, 25 bp, Rattus norvegicus
tcagccggaccaaactcctttaata

SEQ ID NO: 577604 - DNA, 25 bp, Rattus norvegicus
tcagccggaccatactcctttaata

SEQ ID NO: 577605 - DNA, 25 bp, Rattus norvegicus
tcagccggataccacacttgtaggg

SEQ ID NO: 577606 - DNA, 25 bp, Rattus norvegicus
tcagccggatacgacacttgtaggg

SEQ ID NO: 577607 - DNA, 25 bp, Rattus norvegicus
tcagccggatctactgtgtccagaa

SEQ ID NO: 577608 - DNA, 25 bp, Rattus norvegicus
tcagccggatcttctgtgtccagaa

SEQ ID NO: 577609 - DNA, 25 bp, Rattus norvegicus
tcagccgtacacagtgaggaagaca

SEQ ID NO: 577610 - DNA, 25 bp, Rattus norvegicus
tcagccgtacactgtgaggaagaca

SEQ ID NO: 577611 - DNA, 25 bp, Rattus norvegicus
tcagccgtattcactcatcaagagc

SEQ ID NO: 577612 - DNA, 25 bp, Rattus norvegicus
tcagccgtattctctcatcaagagc

SEQ ID NO: 577613 - DNA, 25 bp, Rattus norvegicus
tcagccgtcttcaccagggtgcaaa

SEQ ID NO: 577614 - DNA, 25 bp, Rattus norvegicus
tcagccgtcttctccagggtgcaaa

SEQ ID NO: 577615 - DNA, 25 bp, Rattus norvegicus
tcagccgtgccaattgtcacagtaa

SEQ ID NO: 577616 - DNA, 25 bp, Rattus norvegicus
tcagccgtgccatttgtcacagtaa

SEQ ID NO: 577617 - DNA, 25 bp, Rattus norvegicus
tcagccgtttccacataaggtaggg

SEQ ID NO: 577618 - DNA, 25 bp, Rattus norvegicus
tcagccgtttcctcataaggtaggg

SEQ ID NO: 577619 - DNA, 25 bp, Rattus norvegicus
tcagcctaacctcacggatagatca

SEQ ID NO: 577620 - DNA, 25 bp, Rattus norvegicus
tcagcctaacctgacggatagatca

SEQ ID NO: 577621 - DNA, 25 bp, Rattus norvegicus
tcagcctaatctacgtgctcaagtg

SEQ ID NO: 577622 - DNA, 25 bp, Rattus norvegicus
tcagcctaatcttcgtgctcaagtg

SEQ ID NO: 577623 - DNA, 25 bp, Rattus norvegicus
tcagcctcaagaactccctggaata

SEQ ID NO: 577624 - DNA, 25 bp, Rattus norvegicus
tcagcctcaagatctccctggaata

SEQ ID NO: 577625 - DNA, 25 bp, Rattus norvegicus
tcagcctcacacaagttctggtact

SEQ ID NO: 577626 - DNA, 25 bp, Rattus norvegicus
tcagcctcacactagttctggtact

SEQ ID NO: 577627 - DNA, 25 bp, Rattus norvegicus
tcagcctcagaactgttgctcagac

SEQ ID NO: 577628 - DNA, 25 bp, Rattus norvegicus
tcagcctcagaagtgttgctcagac

SEQ ID NO: 577629 - DNA, 25 bp, Rattus norvegicus
tcagcctcagctatgccaaggcaaa

SEQ ID NO: 577630 - DNA, 25 bp, Rattus norvegicus
tcagcctcagctttgccaaggcaaa

SEQ ID NO: 577631 - DNA, 25 bp, Rattus norvegicus
tcagcctcatccacagtgaagtagg

SEQ ID NO: 577632 - DNA, 25 bp, Rattus norvegicus
tcagcctcatcctcagtgaagtagg

SEQ ID NO: 577633 - DNA, 25 bp, Rattus norvegicus
tcagcctccactctagcagggatgg

SEQ ID NO: 577634 - DNA, 25 bp, Rattus norvegicus
tcagcctccactgtagcagggatgg

SEQ ID NO: 577635 - DNA, 25 bp, Rattus norvegicus
tcagcctcccagagtttaatatttt

SEQ ID NO: 577636 - DNA, 25 bp, Rattus norvegicus
tcagcctcccagtgtttaatatttt

SEQ ID NO: 577637 - DNA, 25 bp, Rattus norvegicus
tcagcctcccatatagtaacctaaa

SEQ ID NO: 577638 - DNA, 25 bp, Rattus norvegicus
tcagcctcccatttagtaacctaaa

SEQ ID NO: 577639 - DNA, 25 bp, Rattus norvegicus
tcagcctcccgaagctcgtatgagt

SEQ ID NO: 577640 - DNA, 25 bp, Rattus norvegicus
tcagcctcccgatgctcgtatgagt

SEQ ID NO: 577641 - DNA, 25 bp, Rattus norvegicus
tcagcctcggaaccccttggaagag

SEQ ID NO: 577642 - DNA, 25 bp, Rattus norvegicus
tcagcctcggaagcccttggaagag

SEQ ID NO: 577643 - DNA, 25 bp, Rattus norvegicus
tcagcctcgtcactgggaatcggaa

SEQ ID NO: 577644 - DNA, 25 bp, Rattus norvegicus
tcagcctcgtcagtgggaatcggaa

SEQ ID NO: 577645 - DNA, 25 bp, Rattus norvegicus
tcagcctcgtggacaatgtgaagaa

SEQ ID NO: 577646 - DNA, 25 bp, Rattus norvegicus
tcagcctcgtggtcaatgtgaagaa

SEQ ID NO: 577647 - DNA, 25 bp, Rattus norvegicus
tcagcctctcgacatggaattccat

SEQ ID NO: 577648 - DNA, 25 bp, Rattus norvegicus
tcagcctctcgagatggaattccat

SEQ ID NO: 577649 - DNA, 25 bp, Rattus norvegicus
tcagcctctgaacttgagctcacaa

SEQ ID NO: 577650 - DNA, 25 bp, Rattus norvegicus
tcagcctctgaagttgagctcacaa

SEQ ID NO: 577651 - DNA, 25 bp, Rattus norvegicus
tcagcctctggaaagtccaccaaga

SEQ ID NO: 577652 - DNA, 25 bp, Rattus norvegicus
tcagcctctggatagtccaccaaga

SEQ ID NO: 577653 - DNA, 25 bp, Rattus norvegicus
tcagcctctgtgatggccgtgtaag

SEQ ID NO: 577654 - DNA, 25 bp, Rattus norvegicus
tcagcctctgtgttggccgtgtaag

SEQ ID NO: 577655 - DNA, 25 bp, Rattus norvegicus
tcagcctctttgatcgccaagataa

SEQ ID NO: 577656 - DNA, 25 bp, Rattus norvegicus
tcagcctctttgttcgccaagataa

SEQ ID NO: 577657 - DNA, 25 bp, Rattus norvegicus
tcagcctgacccaaaagccagtaaa

SEQ ID NO: 577658 - DNA, 25 bp, Rattus norvegicus
tcagcctgaccctaaagccagtaaa

SEQ ID NO: 577659 - DNA, 25 bp, Rattus norvegicus
tcagcctgacctaattggagacaag

SEQ ID NO: 577660 - DNA, 25 bp, Rattus norvegicus
tcagcctgaccttattggagacaag

SEQ ID NO: 577661 - DNA, 25 bp, Rattus norvegicus
tcagcctgagccagacccttctggg

SEQ ID NO: 577662 - DNA, 25 bp, Rattus norvegicus
tcagcctgagcctgacccttctggg

SEQ ID NO: 577663 - DNA, 25 bp, Rattus norvegicus
tcagcctgagctatgagacgtgtct

SEQ ID NO: 577664 - DNA, 25 bp, Rattus norvegicus
tcagcctgagctttgagacgtgtct

SEQ ID NO: 577665 - DNA, 25 bp, Rattus norvegicus
tcagcctgaggtcgccgactggtct

SEQ ID NO: 577666 - DNA, 25 bp, Rattus norvegicus
tcagcctgaggtggccgactggtct

SEQ ID NO: 577667 - DNA, 25 bp, Rattus norvegicus
tcagcctgagttaccttctgcaagg

SEQ ID NO: 577668 - DNA, 25 bp, Rattus norvegicus
tcagcctgagtttccttctgcaagg

SEQ ID NO: 577669 - DNA, 25 bp, Rattus norvegicus
tcagcctgatcccaatggtggacaa

SEQ ID NO: 577670 - DNA, 25 bp, Rattus norvegicus
tcagcctgatccgaatggtggacaa

SEQ ID NO: 577671 - DNA, 25 bp, Rattus norvegicus
tcagcctgcaatcgagcctgtgctc

SEQ ID NO: 577672 - DNA, 25 bp, Rattus norvegicus
tcagcctgcaatggagcctgtgctc

SEQ ID NO: 577673 - DNA, 25 bp, Rattus norvegicus
tcagcctgcagaagggagtcaacat

SEQ ID NO: 577674 - DNA, 25 bp, Rattus norvegicus
tcagcctgcagactggtcatgccgt

SEQ ID NO: 577675 - DNA, 25 bp, Rattus norvegicus
tcagcctgcagagtggtcatgccgt

SEQ ID NO: 577676 - DNA, 25 bp, Rattus norvegicus
tcagcctgcagatgggagtcaacat

SEQ ID NO: 577677 - DNA, 25 bp, Rattus norvegicus
tcagcctgccaactgtatgagccac

SEQ ID NO: 577678 - DNA, 25 bp, Rattus norvegicus
tcagcctgccaagtgtatgagccac

SEQ ID NO: 577679 - DNA, 25 bp, Rattus norvegicus
tcagcctgccagatctaaagactta

SEQ ID NO: 577680 - DNA, 25 bp, Rattus norvegicus
tcagcctgccagttctaaagactta

SEQ ID NO: 577681 - DNA, 25 bp, Rattus norvegicus
tcagcctgccgaaagcatgatgttc

SEQ ID NO: 577682 - DNA, 25 bp, Rattus norvegicus
tcagcctgccgatagcatgatgttc

SEQ ID NO: 577683 - DNA, 25 bp, Rattus norvegicus
tcagcctgctcgcagttcctaaagt

SEQ ID NO: 577684 - DNA, 25 bp, Rattus norvegicus
tcagcctgctcggagttcctaaagt

SEQ ID NO: 577685 - DNA, 25 bp, Rattus norvegicus
tcagcctggaagcttctttcactgt

SEQ ID NO: 577686 - DNA, 25 bp, Rattus norvegicus
tcagcctggaaggttctttcactgt

SEQ ID NO: 577687 - DNA, 25 bp, Rattus norvegicus
tcagcctggatcaccatgaaggtct

SEQ ID NO: 577688 - DNA, 25 bp, Rattus norvegicus
tcagcctggatctccatgaaggtct

SEQ ID NO: 577689 - DNA, 25 bp, Rattus norvegicus
tcagcctggcagagcatgtatgcaa

SEQ ID NO: 577690 - DNA, 25 bp, Rattus norvegicus
tcagcctggcagtgcatgtatgcaa

SEQ ID NO: 577691 - DNA, 25 bp, Rattus norvegicus
tcagcctggccaactagttttgtat

SEQ ID NO: 577692 - DNA, 25 bp, Rattus norvegicus
tcagcctggccatctagttttgtat

SEQ ID NO: 577693 - DNA, 25 bp, Rattus norvegicus
tcagcctgggacatgatctcatcgt

SEQ ID NO: 577694 - DNA, 25 bp, Rattus norvegicus
tcagcctgggacttgatctcatcgt

SEQ ID NO: 577695 - DNA, 25 bp, Rattus norvegicus
tcagcctgggcaacctaactctgga

SEQ ID NO: 577696 - DNA, 25 bp, Rattus norvegicus
tcagcctgggcatcctaactctgga

SEQ ID NO: 577697 - DNA, 25 bp, Rattus norvegicus
tcagcctgggtgacatcacagcatt

SEQ ID NO: 577698 - DNA, 25 bp, Rattus norvegicus
tcagcctgggtgtcatcacagcatt

SEQ ID NO: 577699 - DNA, 25 bp, Rattus norvegicus
tcagcctgtcagacgtctgccatta

SEQ ID NO: 577700 - DNA, 25 bp, Rattus norvegicus
tcagcctgtcagtcgtctgccatta

SEQ ID NO: 577701 - DNA, 25 bp, Rattus norvegicus
tcagcctgtcggaggagcacatcag

SEQ ID NO: 577702 - DNA, 25 bp, Rattus norvegicus
tcagcctgtcggtggagcacatcag

SEQ ID NO: 577703 - DNA, 25 bp, Rattus norvegicus
tcagcctgtcttacaagcgctatgt

SEQ ID NO: 577704 - DNA, 25 bp, Rattus norvegicus
tcagcctgtctttcaagcgctatgt

SEQ ID NO: 577705 - DNA, 25 bp, Rattus norvegicus
tcagcctgtttgaggactccctaga

SEQ ID NO: 577706 - DNA, 25 bp, Rattus norvegicus
tcagcctgtttgtggactccctaga

SEQ ID NO: 577707 - DNA, 25 bp, Rattus norvegicus
tcagccttcaagatgctgtccttga

SEQ ID NO: 577708 - DNA, 25 bp, Rattus norvegicus
tcagccttcaagttgctgtccttga

SEQ ID NO: 577709 - DNA, 25 bp, Rattus norvegicus
tcagccttccttagtagtcccggga

SEQ ID NO: 577710 - DNA, 25 bp, Rattus norvegicus
tcagccttccttatctaccatatgt

SEQ ID NO: 577711 - DNA, 25 bp, Rattus norvegicus
tcagccttcctttgtagtcccggga

SEQ ID NO: 577712 - DNA, 25 bp, Rattus norvegicus
tcagccttccttttctaccatatgt

SEQ ID NO: 577713 - DNA, 25 bp, Rattus norvegicus
tcagccttcggaaactctcacaagt

SEQ ID NO: 577714 - DNA, 25 bp, Rattus norvegicus
tcagccttcggatactctcacaagt

SEQ ID NO: 577715 - DNA, 25 bp, Rattus norvegicus
tcagccttcttgactagctggccag

SEQ ID NO: 577716 - DNA, 25 bp, Rattus norvegicus
tcagccttcttgtctagctggccag

SEQ ID NO: 577717 - DNA, 25 bp, Rattus norvegicus
tcagccttgccacgtgcagatgtcc

SEQ ID NO: 577718 - DNA, 25 bp, Rattus norvegicus
tcagccttgccaggtgcagatgtcc

SEQ ID NO: 577719 - DNA, 25 bp, Rattus norvegicus
tcagccttgcctctctttatacaga

SEQ ID NO: 577720 - DNA, 25 bp, Rattus norvegicus
tcagccttgcctgtctttatacaga

SEQ ID NO: 577721 - DNA, 25 bp, Rattus norvegicus
tcagccttgcgccttaacactaagc

SEQ ID NO: 577722 - DNA, 25 bp, Rattus norvegicus
tcagccttgcgcgttaacactaagc

SEQ ID NO: 577723 - DNA, 25 bp, Rattus norvegicus
tcagccttggctcccagtgggcaag

SEQ ID NO: 577724 - DNA, 25 bp, Rattus norvegicus
tcagccttggctgccagtgggcaag

SEQ ID NO: 577725 - DNA, 25 bp, Rattus norvegicus
tcagcctttaggaagcatcgtctca

SEQ ID NO: 577726 - DNA, 25 bp, Rattus norvegicus
tcagcctttaggacacacaccaaag

SEQ ID NO: 577727 - DNA, 25 bp, Rattus norvegicus
tcagcctttaggtagcatcgtctca

SEQ ID NO: 577728 - DNA, 25 bp, Rattus norvegicus
tcagcctttaggtcacacaccaaag

SEQ ID NO: 577729 - DNA, 25 bp, Rattus norvegicus
tcagcctttcagctccttgatgtac

SEQ ID NO: 577730 - DNA, 25 bp, Rattus norvegicus
tcagcctttcaggtccttgatgtac

SEQ ID NO: 577731 - DNA, 25 bp, Rattus norvegicus
tcagcctttccactcctaaaagaaa

SEQ ID NO: 577732 - DNA, 25 bp, Rattus norvegicus
tcagcctttccagtcctaaaagaaa

SEQ ID NO: 577733 - DNA, 25 bp, Rattus norvegicus
tcagcctttcctacatggcactaag

SEQ ID NO: 577734 - DNA, 25 bp, Rattus norvegicus
tcagcctttccttcatggcactaag

SEQ ID NO: 577735 - DNA, 25 bp, Rattus norvegicus
tcagcctttgctcctataaaactgt

SEQ ID NO: 577736 - DNA, 25 bp, Rattus norvegicus
tcagcctttgctcttaggttgccct

SEQ ID NO: 577737 - DNA, 25 bp, Rattus norvegicus
tcagcctttgctgctataaaactgt

SEQ ID NO: 577738 - DNA, 25 bp, Rattus norvegicus
tcagcctttgctgttaggttgccct

SEQ ID NO: 577739 - DNA, 25 bp, Rattus norvegicus
tcagcctttggtaacacctatgcca

SEQ ID NO: 577740 - DNA, 25 bp, Rattus norvegicus
tcagcctttggttacacctatgcca

SEQ ID NO: 577741 - DNA, 25 bp, Rattus norvegicus
tcagcctttgtgatctgacctctca

SEQ ID NO: 577742 - DNA, 25 bp, Rattus norvegicus
tcagcctttgtgttctgacctctca

SEQ ID NO: 577743 - DNA, 25 bp, Rattus norvegicus
tcagcgaagacacagagcccagcag

SEQ ID NO: 577744 - DNA, 25 bp, Rattus norvegicus
tcagcgaagacagagagcccagcag

SEQ ID NO: 577745 - DNA, 25 bp, Rattus norvegicus
tcagcgaagtgccagttgcataatt

SEQ ID NO: 577746 - DNA, 25 bp, Rattus norvegicus
tcagcgaagtgcgagttgcataatt

SEQ ID NO: 577747 - DNA, 25 bp, Rattus norvegicus
tcagcgacacagctggcagcttctc

SEQ ID NO: 577748 - DNA, 25 bp, Rattus norvegicus
tcagcgacacaggtggcagcttctc

SEQ ID NO: 577749 - DNA, 25 bp, Rattus norvegicus
tcagcgacatcgatgaccacagcag

SEQ ID NO: 577750 - DNA, 25 bp, Rattus norvegicus
tcagcgacatcgttgaccacagcag

SEQ ID NO: 577751 - DNA, 25 bp, Rattus norvegicus
tcagcgacctttacgggcacatggg

SEQ ID NO: 577752 - DNA, 25 bp, Rattus norvegicus
tcagcgaccttttcgggcacatggg

SEQ ID NO: 577753 - DNA, 25 bp, Rattus norvegicus
tcagcgactcggactctgacctcag

SEQ ID NO: 577754 - DNA, 25 bp, Rattus norvegicus
tcagcgactcggtctctgacctcag

SEQ ID NO: 577755 - DNA, 25 bp, Rattus norvegicus
tcagcgactctaagacagctcggag

SEQ ID NO: 577756 - DNA, 25 bp, Rattus norvegicus
tcagcgactctatgacagctcggag

SEQ ID NO: 577757 - DNA, 25 bp, Rattus norvegicus
tcagcgactgccaatagacccaaga

SEQ ID NO: 577758 - DNA, 25 bp, Rattus norvegicus
tcagcgactgcctatagacccaaga

SEQ ID NO: 577759 - DNA, 25 bp, Rattus norvegicus
tcagcgagacggcacagcaggccat

SEQ ID NO: 577760 - DNA, 25 bp, Rattus norvegicus
tcagcgagacgggacagcaggccat

SEQ ID NO: 577761 - DNA, 25 bp, Rattus norvegicus
tcagcgagagctccagagtctactg

SEQ ID NO: 577762 - DNA, 25 bp, Rattus norvegicus
tcagcgagagctgcagagtctactg

SEQ ID NO: 577763 - DNA, 25 bp, Rattus norvegicus
tcagcgagccacacaggtaactgtc

SEQ ID NO: 577764 - DNA, 25 bp, Rattus norvegicus
tcagcgagccactcaggtaactgtc

SEQ ID NO: 577765 - DNA, 25 bp, Rattus norvegicus
tcagcgagccgcaggagcaaggccc

SEQ ID NO: 577766 - DNA, 25 bp, Rattus norvegicus
tcagcgagccgctggagcaaggccc

SEQ ID NO: 577767 - DNA, 25 bp, Rattus norvegicus
tcagcgagctgcattgtgtgctttt

SEQ ID NO: 577768 - DNA, 25 bp, Rattus norvegicus
tcagcgagctgctttgtgtgctttt

SEQ ID NO: 577769 - DNA, 25 bp, Rattus norvegicus
tcagcgagggaaatgccttccacat

SEQ ID NO: 577770 - DNA, 25 bp, Rattus norvegicus
tcagcgagggaattgccttccacat

SEQ ID NO: 577771 - DNA, 25 bp, Rattus norvegicus
tcagcgagtcccaaggcaatgcaat

SEQ ID NO: 577772 - DNA, 25 bp, Rattus norvegicus
tcagcgagtccctaggcaatgcaat

SEQ ID NO: 577773 - DNA, 25 bp, Rattus norvegicus
tcagcgagtttcacatcaacaccta

SEQ ID NO: 577774 - DNA, 25 bp, Rattus norvegicus
tcagcgagtttctcatcaacaccta

SEQ ID NO: 577775 - DNA, 25 bp, Rattus norvegicus
tcagcgatgaggaccgtcccacgta

SEQ ID NO: 577776 - DNA, 25 bp, Rattus norvegicus
tcagcgatgaggtccgtcccacgta

SEQ ID NO: 577777 - DNA, 25 bp, Rattus norvegicus
tcagcgatgcacctgttttgtacat

SEQ ID NO: 577778 - DNA, 25 bp, Rattus norvegicus
tcagcgatgcacgtgttttgtacat

SEQ ID NO: 577779 - DNA, 25 bp, Rattus norvegicus
tcagcgcacttcaaagagacaattt

SEQ ID NO: 577780 - DNA, 25 bp, Rattus norvegicus
tcagcgcacttctaagagacaattt

SEQ ID NO: 577781 - DNA, 25 bp, Rattus norvegicus
tcagcgcagctactctgggaacagg

SEQ ID NO: 577782 - DNA, 25 bp, Rattus norvegicus
tcagcgcagctagtctgggaacagg

SEQ ID NO: 577783 - DNA, 25 bp, Rattus norvegicus
tcagcgcagctgcacaagtcactgt

SEQ ID NO: 577784 - DNA, 25 bp, Rattus norvegicus
tcagcgcagctggacaagtcactgt

SEQ ID NO: 577785 - DNA, 25 bp, Rattus norvegicus
tcagcgcagtttcagaagtccaccg

SEQ ID NO: 577786 - DNA, 25 bp, Rattus norvegicus
tcagcgcagtttgagaagtccaccg

SEQ ID NO: 577787 - DNA, 25 bp, Rattus norvegicus
tcagcgccaaggagtatcactctgc

SEQ ID NO: 577788 - DNA, 25 bp, Rattus norvegicus
tcagcgccaaggtgtatcactctgc

SEQ ID NO: 577789 - DNA, 25 bp, Rattus norvegicus
tcagcgccgcatactactttggtaa

SEQ ID NO: 577790 - DNA, 25 bp, Rattus norvegicus
tcagcgccgcattctactttggtaa

SEQ ID NO: 577791 - DNA, 25 bp, Rattus norvegicus
tcagcgcggcctcgagggtgacgag

SEQ ID NO: 577792 - DNA, 25 bp, Rattus norvegicus
tcagcgcggcctggagggtgacgag

SEQ ID NO: 577793 - DNA, 25 bp, Rattus norvegicus
tcagcgctcaggctgcttcctggaa

SEQ ID NO: 577794 - DNA, 25 bp, Rattus norvegicus
tcagcgctcagggtgcttcctggaa

SEQ ID NO: 577795 - DNA, 25 bp, Rattus norvegicus
tcagcgctgcgaagcaatcagttgt

SEQ ID NO: 577796 - DNA, 25 bp, Rattus norvegicus
tcagcgctgcgatgcaatcagttgt

SEQ ID NO: 577797 - DNA, 25 bp, Rattus norvegicus
tcagcgctgtggagagacaagtcct

SEQ ID NO: 577798 - DNA, 25 bp, Rattus norvegicus
tcagcgctgtggtgagacaagtcct

SEQ ID NO: 577799 - DNA, 25 bp, Rattus norvegicus
tcagcgcttcacagttggcagacat

SEQ ID NO: 577800 - DNA, 25 bp, Rattus norvegicus
tcagcgcttcactgttggcagacat

SEQ ID NO: 577801 - DNA, 25 bp, Rattus norvegicus
tcagcggacgacaagcttccatcaa

SEQ ID NO: 577802 - DNA, 25 bp, Rattus norvegicus
tcagcggacgactagcttccatcaa

SEQ ID NO: 577803 - DNA, 25 bp, Rattus norvegicus
tcagcggagagtatgggccattatc

SEQ ID NO: 577804 - DNA, 25 bp, Rattus norvegicus
tcagcggagagtttgggccattatc

SEQ ID NO: 577805 - DNA, 25 bp, Rattus norvegicus
tcagcggcgctcaggagaggacaat

SEQ ID NO: 577806 - DNA, 25 bp, Rattus norvegicus
tcagcggcgctctggagaggacaat

SEQ ID NO: 577807 - DNA, 25 bp, Rattus norvegicus
tcagcgggaccaatcggaacacgaa

SEQ ID NO: 577808 - DNA, 25 bp, Rattus norvegicus
tcagcgggaccattcggaacacgaa

SEQ ID NO: 577809 - DNA, 25 bp, Rattus norvegicus
tcagcggtgagcacttgctcatcaa

SEQ ID NO: 577810 - DNA, 25 bp, Rattus norvegicus
tcagcggtgagctcttgctcatcaa

SEQ ID NO: 577811 - DNA, 25 bp, Rattus norvegicus
tcagcggtgctgatttccttatcat

SEQ ID NO: 577812 - DNA, 25 bp, Rattus norvegicus
tcagcggtgctgttttccttatcat

SEQ ID NO: 577813 - DNA, 25 bp, Rattus norvegicus
tcagcggtgcttccacagtgaatat

SEQ ID NO: 577814 - DNA, 25 bp, Rattus norvegicus
tcagcggtgcttgcacagtgaatat

SEQ ID NO: 577815 - DNA, 25 bp, Rattus norvegicus
tcagcggtgtcaactttgttaacag

SEQ ID NO: 577816 - DNA, 25 bp, Rattus norvegicus
tcagcggtgtcatctttgttaacag

SEQ ID NO: 577817 - DNA, 25 bp, Rattus norvegicus
tcagcgtagttacagttaccccaaa

SEQ ID NO: 577818 - DNA, 25 bp, Rattus norvegicus
tcagcgtagttagagttaccccaaa

SEQ ID NO: 577819 - DNA, 25 bp, Rattus norvegicus
tcagcgtatatccacctgtgtgtca

SEQ ID NO: 577820 - DNA, 25 bp, Rattus norvegicus
tcagcgtatatcgacctgtgtgtca

SEQ ID NO: 577821 - DNA, 25 bp, Rattus norvegicus
tcagcgtatccaagcagcccagaaa

SEQ ID NO: 577822 - DNA, 25 bp, Rattus norvegicus
tcagcgtatccatgcagcccagaaa

SEQ ID NO: 577823 - DNA, 25 bp, Rattus norvegicus
tcagcgtcaaccagaactgtcacag

SEQ ID NO: 577824 - DNA, 25 bp, Rattus norvegicus
tcagcgtcaacctgaactgtcacag

SEQ ID NO: 577825 - DNA, 25 bp, Rattus norvegicus
tcagcgtcccgaaggcctcgaagtg

SEQ ID NO: 577826 - DNA, 25 bp, Rattus norvegicus
tcagcgtcccgatggcctcgaagtg

SEQ ID NO: 577827 - DNA, 25 bp, Rattus norvegicus
tcagcgtcggacatgcatcactggt

SEQ ID NO: 577828 - DNA, 25 bp, Rattus norvegicus
tcagcgtcggacttgcatcactggt

SEQ ID NO: 577829 - DNA, 25 bp, Rattus norvegicus
tcagcgtctccccaaggaaggcagt

SEQ ID NO: 577830 - DNA, 25 bp, Rattus norvegicus
tcagcgtctcccgaaggaaggcagt

SEQ ID NO: 577831 - DNA, 25 bp, Rattus norvegicus
tcagcgtgcttcctcttttatctca

SEQ ID NO: 577832 - DNA, 25 bp, Rattus norvegicus
tcagcgtgcttcgtcttttatctca

SEQ ID NO: 577833 - DNA, 25 bp, Rattus norvegicus
tcagcgtggaaaccccgagtctgtc

SEQ ID NO: 577834 - DNA, 25 bp, Rattus norvegicus
tcagcgtggaaagcccgagtctgtc

SEQ ID NO: 577835 - DNA, 25 bp, Rattus norvegicus
tcagcgtggtcaaggcggaagttca

SEQ ID NO: 577836 - DNA, 25 bp, Rattus norvegicus
tcagcgtggtcatggcggaagttca

SEQ ID NO: 577837 - DNA, 25 bp, Rattus norvegicus
tcagcgtggtccagaacgcattctt

SEQ ID NO: 577838 - DNA, 25 bp, Rattus norvegicus
tcagcgtggtcctgaacgcattctt

SEQ ID NO: 577839 - DNA, 25 bp, Rattus norvegicus
tcagcgttagttctgtgctctgtca

SEQ ID NO: 577840 - DNA, 25 bp, Rattus norvegicus
tcagcgttagttgtgtgctctgtca

SEQ ID NO: 577841 - DNA, 25 bp, Rattus norvegicus
tcagcgttatttacctgcacagtgc

SEQ ID NO: 577842 - DNA, 25 bp, Rattus norvegicus
tcagcgttattttcctgcacagtgc

SEQ ID NO: 577843 - DNA, 25 bp, Rattus norvegicus
tcagcgttgcagaggctacaggctt

SEQ ID NO: 577844 - DNA, 25 bp, Rattus norvegicus
tcagcgttgcagtggctacaggctt

SEQ ID NO: 577845 - DNA, 25 bp, Rattus norvegicus
tcagcgttgcatctcgtgaccaatt

SEQ ID NO: 577846 - DNA, 25 bp, Rattus norvegicus
tcagcgttgcatgtcgtgaccaatt

SEQ ID NO: 577847 - DNA, 25 bp, Rattus norvegicus
tcagcgttgctgacttgatgggact

SEQ ID NO: 577848 - DNA, 25 bp, Rattus norvegicus
tcagcgttgctgtcttgatgggact

SEQ ID NO: 577849 - DNA, 25 bp, Rattus norvegicus
tcagcgtttcagctaatgttaaaga

SEQ ID NO: 577850 - DNA, 25 bp, Rattus norvegicus
tcagcgtttcaggtaatgttaaaga

SEQ ID NO: 577851 - DNA, 25 bp, Rattus norvegicus
tcagctaacaataaccttttcccag

SEQ ID NO: 577852 - DNA, 25 bp, Rattus norvegicus
tcagctaacaattaccttttcccag

SEQ ID NO: 577853 - DNA, 25 bp, Rattus norvegicus
tcagctaacagcaagcacagatgtt

SEQ ID NO: 577854 - DNA, 25 bp, Rattus norvegicus
tcagctaacagctagcacagatgtt

SEQ ID NO: 577855 - DNA, 25 bp, Rattus norvegicus
tcagctaaggtgagtgtagaagcca

SEQ ID NO: 577856 - DNA, 25 bp, Rattus norvegicus
tcagctaaggtgtgtgtagaagcca

SEQ ID NO: 577857 - DNA, 25 bp, Rattus norvegicus
tcagctacacggctacacgcggatc

SEQ ID NO: 577858 - DNA, 25 bp, Rattus norvegicus
tcagctacacgggtacacgcggatc

SEQ ID NO: 577859 - DNA, 25 bp, Rattus norvegicus
tcagctacccttcattttctagagg

SEQ ID NO: 577860 - DNA, 25 bp, Rattus norvegicus
tcagctacccttgattttctagagg

SEQ ID NO: 577861 - DNA, 25 bp, Rattus norvegicus
tcagctacggcacttcagcaaacag

SEQ ID NO: 577862 - DNA, 25 bp, Rattus norvegicus
tcagctacggcagttcagcaaacag

SEQ ID NO: 577863 - DNA, 25 bp, Rattus norvegicus
tcagctactagtcagacccgggtct

SEQ ID NO: 577864 - DNA, 25 bp, Rattus norvegicus
tcagctactagtgagacccgggtct

SEQ ID NO: 577865 - DNA, 25 bp, Rattus norvegicus
tcagctacttctcgagcatcatgtt

SEQ ID NO: 577866 - DNA, 25 bp, Rattus norvegicus
tcagctacttctggagcatcatgtt

SEQ ID NO: 577867 - DNA, 25 bp, Rattus norvegicus
tcagctagacctctgcagagactcc

SEQ ID NO: 577868 - DNA, 25 bp, Rattus norvegicus
tcagctagacctgtgcagagactcc

SEQ ID NO: 577869 - DNA, 25 bp, Rattus norvegicus
tcagctagggtcactcccatagact

SEQ ID NO: 577870 - DNA, 25 bp, Rattus norvegicus
tcagctagggtctctcccatagact

SEQ ID NO: 577871 - DNA, 25 bp, Rattus norvegicus
tcagctatccagaagagatcctcaa

SEQ ID NO: 577872 - DNA, 25 bp, Rattus norvegicus
tcagctatccagtagagatcctcaa

SEQ ID NO: 577873 - DNA, 25 bp, Rattus norvegicus
tcagctatctctagtggaaatcact

SEQ ID NO: 577874 - DNA, 25 bp, Rattus norvegicus
tcagctatctcttgtggaaatcact

SEQ ID NO: 577875 - DNA, 25 bp, Rattus norvegicus
tcagctatgccacccttctttaagg

SEQ ID NO: 577876 - DNA, 25 bp, Rattus norvegicus
tcagctatgccagccttctttaagg

SEQ ID NO: 577877 - DNA, 25 bp, Rattus norvegicus
tcagctatgctgaatccctgtgcaa

SEQ ID NO: 577878 - DNA, 25 bp, Rattus norvegicus
tcagctatgctgaggagtttcaccc

SEQ ID NO: 577879 - DNA, 25 bp, Rattus norvegicus
tcagctatgctgtatccctgtgcaa

SEQ ID NO: 577880 - DNA, 25 bp, Rattus norvegicus
tcagctatgctgtggagtttcaccc

SEQ ID NO: 577881 - DNA, 25 bp, Rattus norvegicus
tcagctcaaggtccacgtcccgaat

SEQ ID NO: 577882 - DNA, 25 bp, Rattus norvegicus
tcagctcaaggtgcacgtcccgaat

SEQ ID NO: 577883 - DNA, 25 bp, Rattus norvegicus
tcagctcacaccatcttatgccatg

SEQ ID NO: 577884 - DNA, 25 bp, Rattus norvegicus
tcagctcacaccttcttatgccatg

SEQ ID NO: 577885 - DNA, 25 bp, Rattus norvegicus
tcagctcacagtactctatgtacac

SEQ ID NO: 577886 - DNA, 25 bp, Rattus norvegicus
tcagctcacagttctctatgtacac

SEQ ID NO: 577887 - DNA, 25 bp, Rattus norvegicus
tcagctcaccatagggatcgcgagc

SEQ ID NO: 577888 - DNA, 25 bp, Rattus norvegicus
tcagctcaccattgggatcgcgagc

SEQ ID NO: 577889 - DNA, 25 bp, Rattus norvegicus
tcagctcagaaacccagtgggttct

SEQ ID NO: 577890 - DNA, 25 bp, Rattus norvegicus
tcagctcagaaagccagtgggttct

SEQ ID NO: 577891 - DNA, 25 bp, Rattus norvegicus
tcagctcagcgaagaccgtgttggt

SEQ ID NO: 577892 - DNA, 25 bp, Rattus norvegicus
tcagctcagcgatgaccgtgttggt

SEQ ID NO: 577893 - DNA, 25 bp, Rattus norvegicus
tcagctcaggcgcaccgtttagatt

SEQ ID NO: 577894 - DNA, 25 bp, Rattus norvegicus
tcagctcaggcggaccgtttagatt

SEQ ID NO: 577895 - DNA, 25 bp, Rattus norvegicus
tcagctcagtgcacagttgggcttg

SEQ ID NO: 577896 - DNA, 25 bp, Rattus norvegicus
tcagctcagtgctcagttgggcttg

SEQ ID NO: 577897 - DNA, 25 bp, Rattus norvegicus
tcagctcatgatatcttggtaaaga

SEQ ID NO: 577898 - DNA, 25 bp, Rattus norvegicus
tcagctcatgatttcttggtaaaga

SEQ ID NO: 577899 - DNA, 25 bp, Rattus norvegicus
tcagctccaagcacctcaagaagga

SEQ ID NO: 577900 - DNA, 25 bp, Rattus norvegicus
tcagctccaagctcctcaagaagga

SEQ ID NO: 577901 - DNA, 25 bp, Rattus norvegicus
tcagctccacgtcgcctgtgttgtt

SEQ ID NO: 577902 - DNA, 25 bp, Rattus norvegicus
tcagctccacgtggcctgtgttgtt

SEQ ID NO: 577903 - DNA, 25 bp, Rattus norvegicus
tcagctccatccagaatttccaaaa

SEQ ID NO: 577904 - DNA, 25 bp, Rattus norvegicus
tcagctccatcctgaatttccaaaa

SEQ ID NO: 577905 - DNA, 25 bp, Rattus norvegicus
tcagctccatgtagcccagagatag

SEQ ID NO: 577906 - DNA, 25 bp, Rattus norvegicus
tcagctccatgttgcccagagatag

SEQ ID NO: 577907 - DNA, 25 bp, Rattus norvegicus
tcagctcccacgagaaacgttgttg

SEQ ID NO: 577908 - DNA, 25 bp, Rattus norvegicus
tcagctcccacgtgaaacgttgttg

SEQ ID NO: 577909 - DNA, 25 bp, Rattus norvegicus
tcagctcccctgactatattagatg

SEQ ID NO: 577910 - DNA, 25 bp, Rattus norvegicus
tcagctcccctgtctatattagatg

SEQ ID NO: 577911 - DNA, 25 bp, Rattus norvegicus
tcagctccctgtacagatacaagca

SEQ ID NO: 577912 - DNA, 25 bp, Rattus norvegicus
tcagctccctgttcagatacaagca

SEQ ID NO: 577913 - DNA, 25 bp, Rattus norvegicus
tcagctccgtgtctttcgaactaac

SEQ ID NO: 577914 - DNA, 25 bp, Rattus norvegicus
tcagctccgtgtgtttcgaactaac

SEQ ID NO: 577915 - DNA, 25 bp, Rattus norvegicus
tcagctcctcctacaacagttgatt

SEQ ID NO: 577916 - DNA, 25 bp, Rattus norvegicus
tcagctcctccttcaacagttgatt

SEQ ID NO: 577917 - DNA, 25 bp, Rattus norvegicus
tcagctcctgcccattgtaataggc

SEQ ID NO: 577918 - DNA, 25 bp, Rattus norvegicus
tcagctcctgccgattgtaataggc

SEQ ID NO: 577919 - DNA, 25 bp, Rattus norvegicus
tcagctccttctcgacagtaggtga

SEQ ID NO: 577920 - DNA, 25 bp, Rattus norvegicus
tcagctccttctggacagtaggtga

SEQ ID NO: 577921 - DNA, 25 bp, Rattus norvegicus
tcagctccttgcaccagaaggtaga

SEQ ID NO: 577922 - DNA, 25 bp, Rattus norvegicus
tcagctccttgctccagaaggtaga

SEQ ID NO: 577923 - DNA, 25 bp, Rattus norvegicus
tcagctcgtagaaccagaggttaac

SEQ ID NO: 577924 - DNA, 25 bp, Rattus norvegicus
tcagctcgtagatccagaggttaac

SEQ ID NO: 577925 - DNA, 25 bp, Rattus norvegicus
tcagctctaaacaagccttgaagtt

SEQ ID NO: 577926 - DNA, 25 bp, Rattus norvegicus
tcagctctaaactagccttgaagtt

SEQ ID NO: 577927 - DNA, 25 bp, Rattus norvegicus
tcagctctacctatcgagatcgaga

SEQ ID NO: 577928 - DNA, 25 bp, Rattus norvegicus
tcagctctacctttcgagatcgaga

SEQ ID NO: 577929 - DNA, 25 bp, Rattus norvegicus
tcagctctaggaagggacttagcag

SEQ ID NO: 577930 - DNA, 25 bp, Rattus norvegicus
tcagctctaggatgggacttagcag

SEQ ID NO: 577931 - DNA, 25 bp, Rattus norvegicus
tcagctctcaacacctaagtcgaag

SEQ ID NO: 577932 - DNA, 25 bp, Rattus norvegicus
tcagctctcaactcctaagtcgaag

SEQ ID NO: 577933 - DNA, 25 bp, Rattus norvegicus
tcagctctcctgaagatgactgtac

SEQ ID NO: 577934 - DNA, 25 bp, Rattus norvegicus
tcagctctcctgtagatgactgtac

SEQ ID NO: 577935 - DNA, 25 bp, Rattus norvegicus
tcagctctcgcgcaatctgcagaag

SEQ ID NO: 577936 - DNA, 25 bp, Rattus norvegicus
tcagctctcgcggaatctgcagaag

SEQ ID NO: 577937 - DNA, 25 bp, Rattus norvegicus
tcagctctcgttcgtttgttcttgg

SEQ ID NO: 577938 - DNA, 25 bp, Rattus norvegicus
tcagctctcgttggtttgttcttgg

SEQ ID NO: 577939 - DNA, 25 bp, Rattus norvegicus
tcagctctctagaggctggagggca

SEQ ID NO: 577940 - DNA, 25 bp, Rattus norvegicus
tcagctctctagtggctggagggca

SEQ ID NO: 577941 - DNA, 25 bp, Rattus norvegicus
tcagctctcttacaccaacactagt

SEQ ID NO: 577942 - DNA, 25 bp, Rattus norvegicus
tcagctctcttagaccaacactagt

SEQ ID NO: 577943 - DNA, 25 bp, Rattus norvegicus
tcagctctcttgaaacctatgcaga

SEQ ID NO: 577944 - DNA, 25 bp, Rattus norvegicus
tcagctctcttgtaacctatgcaga

SEQ ID NO: 577945 - DNA, 25 bp, Rattus norvegicus
tcagctctggataaccccagtgaga

SEQ ID NO: 577946 - DNA, 25 bp, Rattus norvegicus
tcagctctggattaccccagtgaga

SEQ ID NO: 577947 - DNA, 25 bp, Rattus norvegicus
tcagctctggccatgaagtcaaaag

SEQ ID NO: 577948 - DNA, 25 bp, Rattus norvegicus
tcagctctggccttgaagtcaaaag

SEQ ID NO: 577949 - DNA, 25 bp, Rattus norvegicus
tcagctctgggcataagaggtcaga

SEQ ID NO: 577950 - DNA, 25 bp, Rattus norvegicus
tcagctctgggcttaagaggtcaga

SEQ ID NO: 577951 - DNA, 25 bp, Rattus norvegicus
tcagctctggtgaccttgagagacg

SEQ ID NO: 577952 - DNA, 25 bp, Rattus norvegicus
tcagctctggtgtccttgagagacg

SEQ ID NO: 577953 - DNA, 25 bp, Rattus norvegicus
tcagctctgtcacctccaggctgtg

SEQ ID NO: 577954 - DNA, 25 bp, Rattus norvegicus
tcagctctgtcagctccaggctgtg

SEQ ID NO: 577955 - DNA, 25 bp, Rattus norvegicus
tcagctctgtggatcccttaagacc

SEQ ID NO: 577956 - DNA, 25 bp, Rattus norvegicus
tcagctctgtggttcccttaagacc

SEQ ID NO: 577957 - DNA, 25 bp, Rattus norvegicus
tcagctctgttgatccaaagtttta

SEQ ID NO: 577958 - DNA, 25 bp, Rattus norvegicus
tcagctctgttgttccaaagtttta

SEQ ID NO: 577959 - DNA, 25 bp, Rattus norvegicus
tcagctcttcctcacaggcaatgta

SEQ ID NO: 577960 - DNA, 25 bp, Rattus norvegicus
tcagctcttcctgacaggcaatgta

SEQ ID NO: 577961 - DNA, 25 bp, Rattus norvegicus
tcagctcttttaaggcttgggtctc

SEQ ID NO: 577962 - DNA, 25 bp, Rattus norvegicus
tcagctcttttaatcagccagccag

SEQ ID NO: 577963 - DNA, 25 bp, Rattus norvegicus
tcagctcttttatggcttgggtctc

SEQ ID NO: 577964 - DNA, 25 bp, Rattus norvegicus
tcagctcttttattcagccagccag

SEQ ID NO: 577965 - DNA, 25 bp, Rattus norvegicus
tcagctgaactccagaaccatcaaa

SEQ ID NO: 577966 - DNA, 25 bp, Rattus norvegicus
tcagctgaactcgagaaccatcaaa

SEQ ID NO: 577967 - DNA, 25 bp, Rattus norvegicus
tcagctgacatgaagatcttccttt

SEQ ID NO: 577968 - DNA, 25 bp, Rattus norvegicus
tcagctgacatgcactcttctagtt

SEQ ID NO: 577969 - DNA, 25 bp, Rattus norvegicus
tcagctgacatggactcttctagtt

SEQ ID NO: 577970 - DNA, 25 bp, Rattus norvegicus
tcagctgacatgtagatcttccttt

SEQ ID NO: 577971 - DNA, 25 bp, Rattus norvegicus
tcagctgagaatagttttctagact

SEQ ID NO: 577972 - DNA, 25 bp, Rattus norvegicus
tcagctgagaattgttttctagact

SEQ ID NO: 577973 - DNA, 25 bp, Rattus norvegicus
tcagctgagcccacggtggaatcaa

SEQ ID NO: 577974 - DNA, 25 bp, Rattus norvegicus
tcagctgagccctcggtggaatcaa

SEQ ID NO: 577975 - DNA, 25 bp, Rattus norvegicus
tcagctgagtttataacatatgtcc

SEQ ID NO: 577976 - DNA, 25 bp, Rattus norvegicus
tcagctgagtttttaacatatgtcc

SEQ ID NO: 577977 - DNA, 25 bp, Rattus norvegicus
tcagctgatggtacgcggcaggtca

SEQ ID NO: 577978 - DNA, 25 bp, Rattus norvegicus
tcagctgatggttcgcggcaggtca

SEQ ID NO: 577979 - DNA, 25 bp, Rattus norvegicus
tcagctgcacatcgtcagtattact

SEQ ID NO: 577980 - DNA, 25 bp, Rattus norvegicus
tcagctgcacatggtcagtattact

SEQ ID NO: 577981 - DNA, 25 bp, Rattus norvegicus
tcagctgcagcaattcatcgaggtg

SEQ ID NO: 577982 - DNA, 25 bp, Rattus norvegicus
tcagctgcagcatttcatcgaggtg

SEQ ID NO: 577983 - DNA, 25 bp, Rattus norvegicus
tcagctgccagccacgcatgagaat

SEQ ID NO: 577984 - DNA, 25 bp, Rattus norvegicus
tcagctgccagcgacgcatgagaat

SEQ ID NO: 577985 - DNA, 25 bp, Rattus norvegicus
tcagctgccatgcaagcagggcact

SEQ ID NO: 577986 - DNA, 25 bp, Rattus norvegicus
tcagctgccatggaagcagggcact

SEQ ID NO: 577987 - DNA, 25 bp, Rattus norvegicus
tcagctgcctacagttgggaccaag

SEQ ID NO: 577988 - DNA, 25 bp, Rattus norvegicus
tcagctgcctactgttgggaccaag

SEQ ID NO: 577989 - DNA, 25 bp, Rattus norvegicus
tcagctgcctctcggacatggatgg

SEQ ID NO: 577990 - DNA, 25 bp, Rattus norvegicus
tcagctgcctctgggacatggatgg

SEQ ID NO: 577991 - DNA, 25 bp, Rattus norvegicus
tcagctgcctggagtctttaataac

SEQ ID NO: 577992 - DNA, 25 bp, Rattus norvegicus
tcagctgcctggtgtctttaataac

SEQ ID NO: 577993 - DNA, 25 bp, Rattus norvegicus
tcagctgcgtgcacaggaggccgac

SEQ ID NO: 577994 - DNA, 25 bp, Rattus norvegicus
tcagctgcgtgctcaggaggccgac

SEQ ID NO: 577995 - DNA, 25 bp, Rattus norvegicus
tcagctgctcctcgacttctagagt

SEQ ID NO: 577996 - DNA, 25 bp, Rattus norvegicus
tcagctgctcctggacttctagagt

SEQ ID NO: 577997 - DNA, 25 bp, Rattus norvegicus
tcagctgctcgcacgacggcttaga

SEQ ID NO: 577998 - DNA, 25 bp, Rattus norvegicus
tcagctgctcgctcgacggcttaga

SEQ ID NO: 577999 - DNA, 25 bp, Rattus norvegicus
tcagctgctctaaggcctctgaaga

SEQ ID NO: 578000 - DNA, 25 bp, Rattus norvegicus
tcagctgctctatggcctctgaaga

SEQ ID NO: 578001 - DNA, 25 bp, Rattus norvegicus
tcagctgctcttaaagatattggcc

SEQ ID NO: 578002 - DNA, 25 bp, Rattus norvegicus
tcagctgctctttaagatattggcc

SEQ ID NO: 578003 - DNA, 25 bp, Rattus norvegicus
tcagctgctggtcccggaacatgaa

SEQ ID NO: 578004 - DNA, 25 bp, Rattus norvegicus
tcagctgctggtcctaggtgctctt

SEQ ID NO: 578005 - DNA, 25 bp, Rattus norvegicus
tcagctgctggtccttcttaaaggc

SEQ ID NO: 578006 - DNA, 25 bp, Rattus norvegicus
tcagctgctggtgccggaacatgaa

SEQ ID NO: 578007 - DNA, 25 bp, Rattus norvegicus
tcagctgctggtgctaggtgctctt

SEQ ID NO: 578008 - DNA, 25 bp, Rattus norvegicus
tcagctgctggtgcttcttaaaggc

SEQ ID NO: 578009 - DNA, 25 bp, Rattus norvegicus
tcagctgctgtgaccaaaggcttca

SEQ ID NO: 578010 - DNA, 25 bp, Rattus norvegicus
tcagctgctgtgtccaaaggcttca

SEQ ID NO: 578011 - DNA, 25 bp, Rattus norvegicus
tcagctgcttacattccaagggacg

SEQ ID NO: 578012 - DNA, 25 bp, Rattus norvegicus
tcagctgcttactttccaagggacg

SEQ ID NO: 578013 - DNA, 25 bp, Rattus norvegicus
tcagctgcttcaaccacacaaaggg

SEQ ID NO: 578014 - DNA, 25 bp, Rattus norvegicus
tcagctgcttcatccacacaaaggg

SEQ ID NO: 578015 - DNA, 25 bp, Rattus norvegicus
tcagctggactgagagtttgggaac

SEQ ID NO: 578016 - DNA, 25 bp, Rattus norvegicus
tcagctggactgtgagtttgggaac

SEQ ID NO: 578017 - DNA, 25 bp, Rattus norvegicus
tcagctggaggaaccttcactgtga

SEQ ID NO: 578018 - DNA, 25 bp, Rattus norvegicus
tcagctggaggatccttcactgtga

SEQ ID NO: 578019 - DNA, 25 bp, Rattus norvegicus
tcagctggcaaaccgttttgggaaa

SEQ ID NO: 578020 - DNA, 25 bp, Rattus norvegicus
tcagctggcaaagcgttttgggaaa

SEQ ID NO: 578021 - DNA, 25 bp, Rattus norvegicus
tcagctgggagtcatgacattacat

SEQ ID NO: 578022 - DNA, 25 bp, Rattus norvegicus
tcagctgggagtgatgacattacat

SEQ ID NO: 578023 - DNA, 25 bp, Rattus norvegicus
tcagctgggcagaaatcaatctaat

SEQ ID NO: 578024 - DNA, 25 bp, Rattus norvegicus
tcagctgggcagtaatcaatctaat

SEQ ID NO: 578025 - DNA, 25 bp, Rattus norvegicus
tcagctgggctgcatggtgccatcc

SEQ ID NO: 578026 - DNA, 25 bp, Rattus norvegicus
tcagctgggctggatggtgccatcc

SEQ ID NO: 578027 - DNA, 25 bp, Rattus norvegicus
tcagctgggtttacttccctaatga

SEQ ID NO: 578028 - DNA, 25 bp, Rattus norvegicus
tcagctgggttttcttccctaatga

SEQ ID NO: 578029 - DNA, 25 bp, Rattus norvegicus
tcagctggtcagaaaaggcctctaa

SEQ ID NO: 578030 - DNA, 25 bp, Rattus norvegicus
tcagctggtcagcaggtgccacctt

SEQ ID NO: 578031 - DNA, 25 bp, Rattus norvegicus
tcagctggtcaggaggtgccacctt

SEQ ID NO: 578032 - DNA, 25 bp, Rattus norvegicus
tcagctggtcagtaaaggcctctaa

SEQ ID NO: 578033 - DNA, 25 bp, Rattus norvegicus
tcagctggtcatcaaagaggccctt

SEQ ID NO: 578034 - DNA, 25 bp, Rattus norvegicus
tcagctggtcatcagaaggcacctt

SEQ ID NO: 578035 - DNA, 25 bp, Rattus norvegicus
tcagctggtcatgaaagaggccctt

SEQ ID NO: 578036 - DNA, 25 bp, Rattus norvegicus
tcagctggtcatgagaaggcacctt

SEQ ID NO: 578037 - DNA, 25 bp, Rattus norvegicus
tcagctggtctgacggatttaagaa

SEQ ID NO: 578038 - DNA, 25 bp, Rattus norvegicus
tcagctggtctgtcggatttaagaa

SEQ ID NO: 578039 - DNA, 25 bp, Rattus norvegicus
tcagctgtaagtatgccctcccgaa

SEQ ID NO: 578040 - DNA, 25 bp, Rattus norvegicus
tcagctgtaagtttgccctcccgaa

SEQ ID NO: 578041 - DNA, 25 bp, Rattus norvegicus
tcagctgtaccactctctgtgtcaa

SEQ ID NO: 578042 - DNA, 25 bp, Rattus norvegicus
tcagctgtaccagtctctgtgtcaa

SEQ ID NO: 578043 - DNA, 25 bp, Rattus norvegicus
tcagctgtaggcacaatccctgggt

SEQ ID NO: 578044 - DNA, 25 bp, Rattus norvegicus
tcagctgtaggcagtgcccaagcaa

SEQ ID NO: 578045 - DNA, 25 bp, Rattus norvegicus
tcagctgtaggctcaatccctgggt

SEQ ID NO: 578046 - DNA, 25 bp, Rattus norvegicus
tcagctgtaggctgtgcccaagcaa

SEQ ID NO: 578047 - DNA, 25 bp, Rattus norvegicus
tcagctgtcaggctcggctgtaaac

SEQ ID NO: 578048 - DNA, 25 bp, Rattus norvegicus
tcagctgtcagggtcggctgtaaac

SEQ ID NO: 578049 - DNA, 25 bp, Rattus norvegicus
tcagctgtcgtgatgtgtctccgaa

SEQ ID NO: 578050 - DNA, 25 bp, Rattus norvegicus
tcagctgtcgtgttgtgtctccgaa

SEQ ID NO: 578051 - DNA, 25 bp, Rattus norvegicus
tcagctgtctccagcccagtgagag

SEQ ID NO: 578052 - DNA, 25 bp, Rattus norvegicus
tcagctgtctcctgcccagtgagag

SEQ ID NO: 578053 - DNA, 25 bp, Rattus norvegicus
tcagctgtgaacatttgcagcacaa

SEQ ID NO: 578054 - DNA, 25 bp, Rattus norvegicus
tcagctgtgaacttttgcagcacaa

SEQ ID NO: 578055 - DNA, 25 bp, Rattus norvegicus
tcagctgtgacaagagcgtgtgcac

SEQ ID NO: 578056 - DNA, 25 bp, Rattus norvegicus
tcagctgtgacatgagcgtgtgcac

SEQ ID NO: 578057 - DNA, 25 bp, Rattus norvegicus
tcagctgtgagtagtctaccctggg

SEQ ID NO: 578058 - DNA, 25 bp, Rattus norvegicus
tcagctgtgagttgtctaccctggg

SEQ ID NO: 578059 - DNA, 25 bp, Rattus norvegicus
tcagctgtgatgaaatcccaggcca

SEQ ID NO: 578060 - DNA, 25 bp, Rattus norvegicus
tcagctgtgatgtaatcccaggcca

SEQ ID NO: 578061 - DNA, 25 bp, Rattus norvegicus
tcagctgtgctccatgctagagttt

SEQ ID NO: 578062 - DNA, 25 bp, Rattus norvegicus
tcagctgtgctcgatgctagagttt

SEQ ID NO: 578063 - DNA, 25 bp, Rattus norvegicus
tcagctgtgggaactccatcatgat

SEQ ID NO: 578064 - DNA, 25 bp, Rattus norvegicus
tcagctgtgggatctccatcatgat

SEQ ID NO: 578065 - DNA, 25 bp, Rattus norvegicus
tcagctgtgggtcagactcccgttt

SEQ ID NO: 578066 - DNA, 25 bp, Rattus norvegicus
tcagctgtgggtgagactcccgttt

SEQ ID NO: 578067 - DNA, 25 bp, Rattus norvegicus
tcagctgtggtgagcgaccttaata

SEQ ID NO: 578068 - DNA, 25 bp, Rattus norvegicus
tcagctgtggtgagggccccaccag

SEQ ID NO: 578069 - DNA, 25 bp, Rattus norvegicus
tcagctgtggtgtgcgaccttaata

SEQ ID NO: 578070 - DNA, 25 bp, Rattus norvegicus
tcagctgtggtgtgggccccaccag

SEQ ID NO: 578071 - DNA, 25 bp, Rattus norvegicus
tcagctgtgtgcaagcaggagcatt

SEQ ID NO: 578072 - DNA, 25 bp, Rattus norvegicus
tcagctgtgtgctagcaggagcatt

SEQ ID NO: 578073 - DNA, 25 bp, Rattus norvegicus
tcagctgttagcataggcgggaacg

SEQ ID NO: 578074 - DNA, 25 bp, Rattus norvegicus
tcagctgttagcttaggcgggaacg

SEQ ID NO: 578075 - DNA, 25 bp, Rattus norvegicus
tcagctgttccaatccagtgggttt

SEQ ID NO: 578076 - DNA, 25 bp, Rattus norvegicus
tcagctgttccattccagtgggttt

SEQ ID NO: 578077 - DNA, 25 bp, Rattus norvegicus
tcagctgttcctcaagcttctggat

SEQ ID NO: 578078 - DNA, 25 bp, Rattus norvegicus
tcagctgttcctgaagcttctggat

SEQ ID NO: 578079 - DNA, 25 bp, Rattus norvegicus
tcagctgttctcaaatgtgcagaag

SEQ ID NO: 578080 - DNA, 25 bp, Rattus norvegicus
tcagctgttctctaatgtgcagaag

SEQ ID NO: 578081 - DNA, 25 bp, Rattus norvegicus
tcagctgttgaccagcagaagtcca

SEQ ID NO: 578082 - DNA, 25 bp, Rattus norvegicus
tcagctgttgacgagcagaagtcca

SEQ ID NO: 578083 - DNA, 25 bp, Rattus norvegicus
tcagctgttggactgagaagctcca

SEQ ID NO: 578084 - DNA, 25 bp, Rattus norvegicus
tcagctgttggagtgagaagctcca

SEQ ID NO: 578085 - DNA, 25 bp, Rattus norvegicus
tcagctgttgggagtccttttatga

SEQ ID NO: 578086 - DNA, 25 bp, Rattus norvegicus
tcagctgttgggtgtccttttatga

SEQ ID NO: 578087 - DNA, 25 bp, Rattus norvegicus
tcagctgttgtcagttgaatccaca

SEQ ID NO: 578088 - DNA, 25 bp, Rattus norvegicus
tcagctgttgtctgttgaatccaca

SEQ ID NO: 578089 - DNA, 25 bp, Rattus norvegicus
tcagcttacctgagaggatggctaa

SEQ ID NO: 578090 - DNA, 25 bp, Rattus norvegicus
tcagcttacctgtgaggatggctaa

SEQ ID NO: 578091 - DNA, 25 bp, Rattus norvegicus
tcagcttacgtgagcgtactcgagt

SEQ ID NO: 578092 - DNA, 25 bp, Rattus norvegicus
tcagcttacgtgtgcgtactcgagt

SEQ ID NO: 578093 - DNA, 25 bp, Rattus norvegicus
tcagcttagactcagaaggccccag

SEQ ID NO: 578094 - DNA, 25 bp, Rattus norvegicus
tcagcttagactgagaaggccccag

SEQ ID NO: 578095 - DNA, 25 bp, Rattus norvegicus
tcagcttagatgatttgtcttctcc

SEQ ID NO: 578096 - DNA, 25 bp, Rattus norvegicus
tcagcttagatgttttgtcttctcc

SEQ ID NO: 578097 - DNA, 25 bp, Rattus norvegicus
tcagcttcagataagagggcccttt

SEQ ID NO: 578098 - DNA, 25 bp, Rattus norvegicus
tcagcttcagattagagggcccttt

SEQ ID NO: 578099 - DNA, 25 bp, Rattus norvegicus
tcagcttcagcgcagtaaaaaggct

SEQ ID NO: 578100 - DNA, 25 bp, Rattus norvegicus
tcagcttcagcggagtaaaaaggct

SEQ ID NO: 578101 - DNA, 25 bp, Rattus norvegicus
tcagcttcaggaaattgccggtcag

SEQ ID NO: 578102 - DNA, 25 bp, Rattus norvegicus
tcagcttcaggatattgccggtcag

SEQ ID NO: 578103 - DNA, 25 bp, Rattus norvegicus
tcagcttcaggcatacatttgtgtt

SEQ ID NO: 578104 - DNA, 25 bp, Rattus norvegicus
tcagcttcaggcttacatttgtgtt

SEQ ID NO: 578105 - DNA, 25 bp, Rattus norvegicus
tcagcttcagggagtgacttggtcc

SEQ ID NO: 578106 - DNA, 25 bp, Rattus norvegicus
tcagcttcagggtgtgacttggtcc

SEQ ID NO: 578107 - DNA, 25 bp, Rattus norvegicus
tcagcttcccagcatgagggactac

SEQ ID NO: 578108 - DNA, 25 bp, Rattus norvegicus
tcagcttcccaggatgagggactac

SEQ ID NO: 578109 - DNA, 25 bp, Rattus norvegicus
tcagcttcccggcttctgatggagg

SEQ ID NO: 578110 - DNA, 25 bp, Rattus norvegicus
tcagcttcccgggttctgatggagg

SEQ ID NO: 578111 - DNA, 25 bp, Rattus norvegicus
tcagcttccctgagacatcagattt

SEQ ID NO: 578112 - DNA, 25 bp, Rattus norvegicus
tcagcttccctgtgacatcagattt

SEQ ID NO: 578113 - DNA, 25 bp, Rattus norvegicus
tcagcttccgttatgtggatggcgt

SEQ ID NO: 578114 - DNA, 25 bp, Rattus norvegicus
tcagcttccgttttgtggatggcgt

SEQ ID NO: 578115 - DNA, 25 bp, Rattus norvegicus
tcagcttcctgcaatggtggcatcc

SEQ ID NO: 578116 - DNA, 25 bp, Rattus norvegicus
tcagcttcctgctatggtggcatcc

SEQ ID NO: 578117 - DNA, 25 bp, Rattus norvegicus
tcagcttcctgtagggatgctcaga

SEQ ID NO: 578118 - DNA, 25 bp, Rattus norvegicus
tcagcttcctgttgggatgctcaga

SEQ ID NO: 578119 - DNA, 25 bp, Rattus norvegicus
tcagcttctagacgccaccaatttt

SEQ ID NO: 578120 - DNA, 25 bp, Rattus norvegicus
tcagcttctagaggccaccaatttt

SEQ ID NO: 578121 - DNA, 25 bp, Rattus norvegicus
tcagcttctatcagtgggagcccat

SEQ ID NO: 578122 - DNA, 25 bp, Rattus norvegicus
tcagcttctatctgtgggagcccat

SEQ ID NO: 578123 - DNA, 25 bp, Rattus norvegicus
tcagcttctcagatttgcagcggaa

SEQ ID NO: 578124 - DNA, 25 bp, Rattus norvegicus
tcagcttctcagttttgcagcggaa

SEQ ID NO: 578125 - DNA, 25 bp, Rattus norvegicus
tcagcttctcataattcattcccgg

SEQ ID NO: 578126 - DNA, 25 bp, Rattus norvegicus
tcagcttctcattattcattcccgg

SEQ ID NO: 578127 - DNA, 25 bp, Rattus norvegicus
tcagcttctcccatgaagagacctt

SEQ ID NO: 578128 - DNA, 25 bp, Rattus norvegicus
tcagcttctcccttgaagagacctt

SEQ ID NO: 578129 - DNA, 25 bp, Rattus norvegicus
tcagcttctcggcataggaacccaa

SEQ ID NO: 578130 - DNA, 25 bp, Rattus norvegicus
tcagcttctcgggataggaacccaa

SEQ ID NO: 578131 - DNA, 25 bp, Rattus norvegicus
tcagcttctctaacagccaggaact

SEQ ID NO: 578132 - DNA, 25 bp, Rattus norvegicus
tcagcttctctaatagtcccctgtc

SEQ ID NO: 578133 - DNA, 25 bp, Rattus norvegicus
tcagcttctctatcagccaggaact

SEQ ID NO: 578134 - DNA, 25 bp, Rattus norvegicus
tcagcttctctattagtcccctgtc

SEQ ID NO: 578135 - DNA, 25 bp, Rattus norvegicus
tcagcttctgaaccccacagttgtg

SEQ ID NO: 578136 - DNA, 25 bp, Rattus norvegicus
tcagcttctgaagcccacagttgtg

SEQ ID NO: 578137 - DNA, 25 bp, Rattus norvegicus
tcagcttctgagcaactgccagcag

SEQ ID NO: 578138 - DNA, 25 bp, Rattus norvegicus
tcagcttctgaggaactgccagcag

SEQ ID NO: 578139 - DNA, 25 bp, Rattus norvegicus
tcagcttcttctcatacacatcttg

SEQ ID NO: 578140 - DNA, 25 bp, Rattus norvegicus
tcagcttcttctcggctatcttcaa

SEQ ID NO: 578141 - DNA, 25 bp, Rattus norvegicus
tcagcttcttctgatacacatcttg

SEQ ID NO: 578142 - DNA, 25 bp, Rattus norvegicus
tcagcttcttctgggctatcttcaa

SEQ ID NO: 578143 - DNA, 25 bp, Rattus norvegicus
tcagcttgacaaagactggatccag

SEQ ID NO: 578144 - DNA, 25 bp, Rattus norvegicus
tcagcttgacaatgactggatccag

SEQ ID NO: 578145 - DNA, 25 bp, Rattus norvegicus
tcagcttgactactcttctggacaa

SEQ ID NO: 578146 - DNA, 25 bp, Rattus norvegicus
tcagcttgactagtcttctggacaa

SEQ ID NO: 578147 - DNA, 25 bp, Rattus norvegicus
tcagcttgatggacttggcccgact

SEQ ID NO: 578148 - DNA, 25 bp, Rattus norvegicus
tcagcttgatggtcttggcccgact

SEQ ID NO: 578149 - DNA, 25 bp, Rattus norvegicus
tcagcttgcccacaagtacaactgt

SEQ ID NO: 578150 - DNA, 25 bp, Rattus norvegicus
tcagcttgcccagaagtacaactgt

SEQ ID NO: 578151 - DNA, 25 bp, Rattus norvegicus
tcagcttgccttccatgacaacaca

SEQ ID NO: 578152 - DNA, 25 bp, Rattus norvegicus
tcagcttgccttgcatgacaacaca

SEQ ID NO: 578153 - DNA, 25 bp, Rattus norvegicus
tcagcttgctgtcagagcccatagt

SEQ ID NO: 578154 - DNA, 25 bp, Rattus norvegicus
tcagcttgctgtgagagcccatagt

SEQ ID NO: 578155 - DNA, 25 bp, Rattus norvegicus
tcagcttggagtaagagcctggtcc

SEQ ID NO: 578156 - DNA, 25 bp, Rattus norvegicus
tcagcttggagttagagcctggtcc

SEQ ID NO: 578157 - DNA, 25 bp, Rattus norvegicus
tcagcttggccaccaaagccgagtt

SEQ ID NO: 578158 - DNA, 25 bp, Rattus norvegicus
tcagcttggccagcaaagccgagtt

SEQ ID NO: 578159 - DNA, 25 bp, Rattus norvegicus
tcagcttggtttcgacttttggacc

SEQ ID NO: 578160 - DNA, 25 bp, Rattus norvegicus
tcagcttggtttggacttttggacc

SEQ ID NO: 578161 - DNA, 25 bp, Rattus norvegicus
tcagcttgtaggattctcaccaaaa

SEQ ID NO: 578162 - DNA, 25 bp, Rattus norvegicus
tcagcttgtaggtttctcaccaaaa

SEQ ID NO: 578163 - DNA, 25 bp, Rattus norvegicus
tcagcttgtcccaaaactttttaat

SEQ ID NO: 578164 - DNA, 25 bp, Rattus norvegicus
tcagcttgtccctaaactttttaat

SEQ ID NO: 578165 - DNA, 25 bp, Rattus norvegicus
tcagcttgttggaccgtcatggttg

SEQ ID NO: 578166 - DNA, 25 bp, Rattus norvegicus
tcagcttgttggtccgtcatggttg

SEQ ID NO: 578167 - DNA, 25 bp, Rattus norvegicus
tcagctttaagaagccctcacaggg

SEQ ID NO: 578168 - DNA, 25 bp, Rattus norvegicus
tcagctttaagatgccctcacaggg

SEQ ID NO: 578169 - DNA, 25 bp, Rattus norvegicus
tcagctttactgatttttgatgcat

SEQ ID NO: 578170 - DNA, 25 bp, Rattus norvegicus
tcagctttactgttttttgatgcat

SEQ ID NO: 578171 - DNA, 25 bp, Rattus norvegicus
tcagctttagtacacccatccaggg

SEQ ID NO: 578172 - DNA, 25 bp, Rattus norvegicus
tcagctttagtagacccatccaggg

SEQ ID NO: 578173 - DNA, 25 bp, Rattus norvegicus
tcagctttcagcaaggccagaaggg

SEQ ID NO: 578174 - DNA, 25 bp, Rattus norvegicus
tcagctttcagctaggccagaaggg

SEQ ID NO: 578175 - DNA, 25 bp, Rattus norvegicus
tcagctttccaaccatcttgatgtg

SEQ ID NO: 578176 - DNA, 25 bp, Rattus norvegicus
tcagctttccaagcatcttgatgtg

SEQ ID NO: 578177 - DNA, 25 bp, Rattus norvegicus
tcagctttccttcttacaagggaca

SEQ ID NO: 578178 - DNA, 25 bp, Rattus norvegicus
tcagctttccttgttacaagggaca

SEQ ID NO: 578179 - DNA, 25 bp, Rattus norvegicus
tcagctttctgtaccttaagccaaa

SEQ ID NO: 578180 - DNA, 25 bp, Rattus norvegicus
tcagctttctgttccttaagccaaa

SEQ ID NO: 578181 - DNA, 25 bp, Rattus norvegicus
tcagctttgacacccttgtggataa

SEQ ID NO: 578182 - DNA, 25 bp, Rattus norvegicus
tcagctttgacagccttgtggataa

SEQ ID NO: 578183 - DNA, 25 bp, Rattus norvegicus
tcagctttgctgagggctccaggag

SEQ ID NO: 578184 - DNA, 25 bp, Rattus norvegicus
tcagctttgctgtgggctccaggag

SEQ ID NO: 578185 - DNA, 25 bp, Rattus norvegicus
tcagctttggttccccatggtttac

SEQ ID NO: 578186 - DNA, 25 bp, Rattus norvegicus
tcagctttggttgcccatggtttac

SEQ ID NO: 578187 - DNA, 25 bp, Rattus norvegicus
tcagcttttagtccactgtgcaaat

SEQ ID NO: 578188 - DNA, 25 bp, Rattus norvegicus
tcagcttttagtgcactgtgcaaat

SEQ ID NO: 578189 - DNA, 25 bp, Rattus norvegicus
tcagcttttcccatcattctttatg

SEQ ID NO: 578190 - DNA, 25 bp, Rattus norvegicus
tcagcttttcccttcattctttatg

SEQ ID NO: 578191 - DNA, 25 bp, Rattus norvegicus
tcagcttttctgagttcttgtggct

SEQ ID NO: 578192 - DNA, 25 bp, Rattus norvegicus
tcagcttttctgtgttcttgtggct

SEQ ID NO: 578193 - DNA, 25 bp, Rattus norvegicus
tcagcttttgctcccatgaaggcca

SEQ ID NO: 578194 - DNA, 25 bp, Rattus norvegicus
tcagcttttgctgccatgaaggcca

SEQ ID NO: 578195 - DNA, 25 bp, Rattus norvegicus
tcagctttttacaggcagacaatta

SEQ ID NO: 578196 - DNA, 25 bp, Rattus norvegicus
tcagctttttactggcagacaatta

SEQ ID NO: 578197 - DNA, 25 bp, Rattus norvegicus
tcaggaaacacgatggacccacagt

SEQ ID NO: 578198 - DNA, 25 bp, Rattus norvegicus
tcaggaaacacgttggacccacagt

SEQ ID NO: 578199 - DNA, 25 bp, Rattus norvegicus
tcaggaaatggtatccttccgtccg

SEQ ID NO: 578200 - DNA, 25 bp, Rattus norvegicus
tcaggaaatggtttccttccgtccg

SEQ ID NO: 578201 - DNA, 25 bp, Rattus norvegicus
tcaggaacacctcatggacgacgat

SEQ ID NO: 578202 - DNA, 25 bp, Rattus norvegicus
tcaggaacacctgatggacgacgat

SEQ ID NO: 578203 - DNA, 25 bp, Rattus norvegicus
tcaggaacagtaagatgggcatagt

SEQ ID NO: 578204 - DNA, 25 bp, Rattus norvegicus
tcaggaacagtatgatgggcatagt

SEQ ID NO: 578205 - DNA, 25 bp, Rattus norvegicus
tcaggaacatggactgtgccgttta

SEQ ID NO: 578206 - DNA, 25 bp, Rattus norvegicus
tcaggaacatggtctgtgccgttta

SEQ ID NO: 578207 - DNA, 25 bp, Rattus norvegicus
tcaggaacattcctatattgagtcc

SEQ ID NO: 578208 - DNA, 25 bp, Rattus norvegicus
tcaggaacattcgtatattgagtcc

SEQ ID NO: 578209 - DNA, 25 bp, Rattus norvegicus
tcaggaacctgccagagtacaccct

SEQ ID NO: 578210 - DNA, 25 bp, Rattus norvegicus
tcaggaacctgcgagagtacaccct

SEQ ID NO: 578211 - DNA, 25 bp, Rattus norvegicus
tcaggaacctggactcctacttaaa

SEQ ID NO: 578212 - DNA, 25 bp, Rattus norvegicus
tcaggaacctggtctcctacttaaa

SEQ ID NO: 578213 - DNA, 25 bp, Rattus norvegicus
tcaggaacgggcaccaggtaaccca

SEQ ID NO: 578214 - DNA, 25 bp, Rattus norvegicus
tcaggaacgggctccaggtaaccca

SEQ ID NO: 578215 - DNA, 25 bp, Rattus norvegicus
tcaggaacgggtaggaagctccacc

SEQ ID NO: 578216 - DNA, 25 bp, Rattus norvegicus
tcaggaacgggttggaagctccacc

SEQ ID NO: 578217 - DNA, 25 bp, Rattus norvegicus
tcaggaactgagctctggcaaacct

SEQ ID NO: 578218 - DNA, 25 bp, Rattus norvegicus
tcaggaactgaggtctggcaaacct

SEQ ID NO: 578219 - DNA, 25 bp, Rattus norvegicus
tcaggaacttgacgcctttttgtca

SEQ ID NO: 578220 - DNA, 25 bp, Rattus norvegicus
tcaggaacttgaggcctttttgtca

SEQ ID NO: 578221 - DNA, 25 bp, Rattus norvegicus
tcaggaagcaataccgggtccggtc

SEQ ID NO: 578222 - DNA, 25 bp, Rattus norvegicus
tcaggaagcaatcagctttgctgtc

SEQ ID NO: 578223 - DNA, 25 bp, Rattus norvegicus
tcaggaagcaatgagctttgctgtc

SEQ ID NO: 578224 - DNA, 25 bp, Rattus norvegicus
tcaggaagcaattccgggtccggtc

SEQ ID NO: 578225 - DNA, 25 bp, Rattus norvegicus
tcaggaagccacagaggctggactg

SEQ ID NO: 578226 - DNA, 25 bp, Rattus norvegicus
tcaggaagccactgaggctggactg

SEQ ID NO: 578227 - DNA, 25 bp, Rattus norvegicus
tcaggaagcggcagctcaaactctt

SEQ ID NO: 578228 - DNA, 25 bp, Rattus norvegicus
tcaggaagcggctgctcaaactctt

SEQ ID NO: 578229 - DNA, 25 bp, Rattus norvegicus
tcaggaagctgacaaccttgaattt

SEQ ID NO: 578230 - DNA, 25 bp, Rattus norvegicus
tcaggaagctgagaaccttgaattt

SEQ ID NO: 578231 - DNA, 25 bp, Rattus norvegicus
tcaggaaggcttctcacccggtggc

SEQ ID NO: 578232 - DNA, 25 bp, Rattus norvegicus
tcaggaaggcttgtcacccggtggc

SEQ ID NO: 578233 - DNA, 25 bp, Rattus norvegicus
tcaggaagggctctggcccgcatct

SEQ ID NO: 578234 - DNA, 25 bp, Rattus norvegicus
tcaggaagggctgtggcccgcatct

SEQ ID NO: 578235 - DNA, 25 bp, Rattus norvegicus
tcaggaaggtcacaagttcagccaa

SEQ ID NO: 578236 - DNA, 25 bp, Rattus norvegicus
tcaggaaggtcagaagttcagccaa

SEQ ID NO: 578237 - DNA, 25 bp, Rattus norvegicus
tcaggaatagggatcccgggtcctc

SEQ ID NO: 578238 - DNA, 25 bp, Rattus norvegicus
tcaggaatagggttcccgggtcctc

SEQ ID NO: 578239 - DNA, 25 bp, Rattus norvegicus
tcaggaatagtgctcttacccctcc

SEQ ID NO: 578240 - DNA, 25 bp, Rattus norvegicus
tcaggaatagtggtcttacccctcc

SEQ ID NO: 578241 - DNA, 25 bp, Rattus norvegicus
tcaggaatcacactcaggccatcag

SEQ ID NO: 578242 - DNA, 25 bp, Rattus norvegicus
tcaggaatcacagtcaggccatcag

SEQ ID NO: 578243 - DNA, 25 bp, Rattus norvegicus
tcaggaattcccacatattctcacg

SEQ ID NO: 578244 - DNA, 25 bp, Rattus norvegicus
tcaggaattccctcatattctcacg

SEQ ID NO: 578245 - DNA, 25 bp, Rattus norvegicus
tcaggaattgccactgcctcgttaa

SEQ ID NO: 578246 - DNA, 25 bp, Rattus norvegicus
tcaggaattgcctctgcctcgttaa

SEQ ID NO: 578247 - DNA, 25 bp, Rattus norvegicus
tcaggacaagtcagccattttgctg

SEQ ID NO: 578248 - DNA, 25 bp, Rattus norvegicus
tcaggacaagtctgccattttgctg

SEQ ID NO: 578249 - DNA, 25 bp, Rattus norvegicus
tcaggacacaccatgctgaccggcg

SEQ ID NO: 578250 - DNA, 25 bp, Rattus norvegicus
tcaggacacaccttgctgaccggcg

SEQ ID NO: 578251 - DNA, 25 bp, Rattus norvegicus
tcaggacactgtagccaaccgtgca

SEQ ID NO: 578252 - DNA, 25 bp, Rattus norvegicus
tcaggacactgttgccaaccgtgca

SEQ ID NO: 578253 - DNA, 25 bp, Rattus norvegicus
tcaggacaggagaatgcgagtgcat

SEQ ID NO: 578254 - DNA, 25 bp, Rattus norvegicus
tcaggacaggagtatgcgagtgcat

SEQ ID NO: 578255 - DNA, 25 bp, Rattus norvegicus
tcaggaccacagacaggccactggg

SEQ ID NO: 578256 - DNA, 25 bp, Rattus norvegicus
tcaggaccacagtcaggccactggg

SEQ ID NO: 578257 - DNA, 25 bp, Rattus norvegicus
tcaggaccagaacagccatgcacta

SEQ ID NO: 578258 - DNA, 25 bp, Rattus norvegicus
tcaggaccagaagagccatgcacta

SEQ ID NO: 578259 - DNA, 25 bp, Rattus norvegicus
tcaggaccctgaacattcactgtga

SEQ ID NO: 578260 - DNA, 25 bp, Rattus norvegicus
tcaggaccctgatcattcactgtga

SEQ ID NO: 578261 - DNA, 25 bp, Rattus norvegicus
tcaggaccgcctcgatctggaagtt

SEQ ID NO: 578262 - DNA, 25 bp, Rattus norvegicus
tcaggaccgcctggatctggaagtt

SEQ ID NO: 578263 - DNA, 25 bp, Rattus norvegicus
tcaggaccggacaccgatcggaaac

SEQ ID NO: 578264 - DNA, 25 bp, Rattus norvegicus
tcaggaccggactccgatcggaaac

SEQ ID NO: 578265 - DNA, 25 bp, Rattus norvegicus
tcaggacctgccaacatccaatagt

SEQ ID NO: 578266 - DNA, 25 bp, Rattus norvegicus
tcaggacctgcctacatccaatagt

SEQ ID NO: 578267 - DNA, 25 bp, Rattus norvegicus
tcaggacctgggatctgttgccgag

SEQ ID NO: 578268 - DNA, 25 bp, Rattus norvegicus
tcaggacctgggttctgttgccgag

SEQ ID NO: 578269 - DNA, 25 bp, Rattus norvegicus
tcaggacgcaatccccgagagtttc

SEQ ID NO: 578270 - DNA, 25 bp, Rattus norvegicus
tcaggacgcaatgcccgagagtttc

SEQ ID NO: 578271 - DNA, 25 bp, Rattus norvegicus
tcaggacgttcgcagtggcccagct

SEQ ID NO: 578272 - DNA, 25 bp, Rattus norvegicus
tcaggacgttcggagtggcccagct

SEQ ID NO: 578273 - DNA, 25 bp, Rattus norvegicus
tcaggactactgcaggtgactcagg

SEQ ID NO: 578274 - DNA, 25 bp, Rattus norvegicus
tcaggactactggaggtgactcagg

SEQ ID NO: 578275 - DNA, 25 bp, Rattus norvegicus
tcaggactcgtcatgctcggcattc

SEQ ID NO: 578276 - DNA, 25 bp, Rattus norvegicus
tcaggactcgtcttgctcggcattc

SEQ ID NO: 578277 - DNA, 25 bp, Rattus norvegicus
tcaggactgggccttgttgcactgt

SEQ ID NO: 578278 - DNA, 25 bp, Rattus norvegicus
tcaggactgggcgttgttgcactgt

SEQ ID NO: 578279 - DNA, 25 bp, Rattus norvegicus
tcaggactggtcattgaggataagc

SEQ ID NO: 578280 - DNA, 25 bp, Rattus norvegicus
tcaggactggtctttgaggataagc

SEQ ID NO: 578281 - DNA, 25 bp, Rattus norvegicus
tcaggactgtagcagtcattcccct

SEQ ID NO: 578282 - DNA, 25 bp, Rattus norvegicus
tcaggactgtaggagtcattcccct

SEQ ID NO: 578283 - DNA, 25 bp, Rattus norvegicus
tcaggactgtctcaccgttggtgtg

SEQ ID NO: 578284 - DNA, 25 bp, Rattus norvegicus
tcaggactgtctgaccgttggtgtg

SEQ ID NO: 578285 - DNA, 25 bp, Rattus norvegicus
tcaggactgttaacccgctcgtagc

SEQ ID NO: 578286 - DNA, 25 bp, Rattus norvegicus
tcaggactgttatcccgctcgtagc

SEQ ID NO: 578287 - DNA, 25 bp, Rattus norvegicus
tcaggacttcagaattccggatgtt

SEQ ID NO: 578288 - DNA, 25 bp, Rattus norvegicus
tcaggacttcagtattccggatgtt

SEQ ID NO: 578289 - DNA, 25 bp, Rattus norvegicus
tcaggacttctgacttgcccctaag

SEQ ID NO: 578290 - DNA, 25 bp, Rattus norvegicus
tcaggacttctgtcttgcccctaag

SEQ ID NO: 578291 - DNA, 25 bp, Rattus norvegicus
tcaggagaaacacttgctggtcttg

SEQ ID NO: 578292 - DNA, 25 bp, Rattus norvegicus
tcaggagaaacagttgctggtcttg

SEQ ID NO: 578293 - DNA, 25 bp, Rattus norvegicus
tcaggagaagaaccctctgaagccc

SEQ ID NO: 578294 - DNA, 25 bp, Rattus norvegicus
tcaggagaagaagcctctgaagccc

SEQ ID NO: 578295 - DNA, 25 bp, Rattus norvegicus
tcaggagacacgatgtgatgataat

SEQ ID NO: 578296 - DNA, 25 bp, Rattus norvegicus
tcaggagacacgttgtgatgataat

SEQ ID NO: 578297 - DNA, 25 bp, Rattus norvegicus
tcaggagacagcagggctcactcca

SEQ ID NO: 578298 - DNA, 25 bp, Rattus norvegicus
tcaggagacagctgggctcactcca

SEQ ID NO: 578299 - DNA, 25 bp, Rattus norvegicus
tcaggagacctcacagaacagcaag

SEQ ID NO: 578300 - DNA, 25 bp, Rattus norvegicus
tcaggagacctctcagaacagcaag

SEQ ID NO: 578301 - DNA, 25 bp, Rattus norvegicus
tcaggagacttgaacacccaggcag

SEQ ID NO: 578302 - DNA, 25 bp, Rattus norvegicus
tcaggagacttgtacacccaggcag

SEQ ID NO: 578303 - DNA, 25 bp, Rattus norvegicus
tcaggagagaccatcggaagccaac

SEQ ID NO: 578304 - DNA, 25 bp, Rattus norvegicus
tcaggagagaccttcggaagccaac

SEQ ID NO: 578305 - DNA, 25 bp, Rattus norvegicus
tcaggagagcctcggtggccaacaa

SEQ ID NO: 578306 - DNA, 25 bp, Rattus norvegicus
tcaggagagcctgggtggccaacaa

SEQ ID NO: 578307 - DNA, 25 bp, Rattus norvegicus
tcaggagcacgccatgtagccgatg

SEQ ID NO: 578308 - DNA, 25 bp, Rattus norvegicus
tcaggagcacgcgatgtagccgatg

SEQ ID NO: 578309 - DNA, 25 bp, Rattus norvegicus
tcaggagcagcaacacccagggtga

SEQ ID NO: 578310 - DNA, 25 bp, Rattus norvegicus
tcaggagcagcatcacccagggtga

SEQ ID NO: 578311 - DNA, 25 bp, Rattus norvegicus
tcaggagcaggtctgatgacgccca

SEQ ID NO: 578312 - DNA, 25 bp, Rattus norvegicus
tcaggagcaggtgtgatgacgccca

SEQ ID NO: 578313 - DNA, 25 bp, Rattus norvegicus
tcaggagcatggctgcagctgtccc

SEQ ID NO: 578314 - DNA, 25 bp, Rattus norvegicus
tcaggagcatgggtgcagctgtccc

SEQ ID NO: 578315 - DNA, 25 bp, Rattus norvegicus
tcaggagccaccaatgcagattctt

SEQ ID NO: 578316 - DNA, 25 bp, Rattus norvegicus
tcaggagccacctatgcagattctt

SEQ ID NO: 578317 - DNA, 25 bp, Rattus norvegicus
tcaggagccctgaaatggccggaca

SEQ ID NO: 578318 - DNA, 25 bp, Rattus norvegicus
tcaggagccctgatcaatgattgct

SEQ ID NO: 578319 - DNA, 25 bp, Rattus norvegicus
tcaggagccctgtaatggccggaca

SEQ ID NO: 578320 - DNA, 25 bp, Rattus norvegicus
tcaggagccctgttcaatgattgct

SEQ ID NO: 578321 - DNA, 25 bp, Rattus norvegicus
tcaggagccgccagaagactcaact

SEQ ID NO: 578322 - DNA, 25 bp, Rattus norvegicus
tcaggagccgcctgaagactcaact

SEQ ID NO: 578323 - DNA, 25 bp, Rattus norvegicus
tcaggagctcagcatggagcagaaa

SEQ ID NO: 578324 - DNA, 25 bp, Rattus norvegicus
tcaggagctcaggatggagcagaaa

SEQ ID NO: 578325 - DNA, 25 bp, Rattus norvegicus
tcaggaggacatcgtgctgcacccc

SEQ ID NO: 578326 - DNA, 25 bp, Rattus norvegicus
tcaggaggacatggtgctgcacccc

SEQ ID NO: 578327 - DNA, 25 bp, Rattus norvegicus
tcaggaggacctcggctccgctgct

SEQ ID NO: 578328 - DNA, 25 bp, Rattus norvegicus
tcaggaggacctgggctccgctgct

SEQ ID NO: 578329 - DNA, 25 bp, Rattus norvegicus
tcaggaggacgcactgggactttca

SEQ ID NO: 578330 - DNA, 25 bp, Rattus norvegicus
tcaggaggacgctctgggactttca

SEQ ID NO: 578331 - DNA, 25 bp, Rattus norvegicus
tcaggaggatacagctgccctttta

SEQ ID NO: 578332 - DNA, 25 bp, Rattus norvegicus
tcaggaggatactgctgccctttta

SEQ ID NO: 578333 - DNA, 25 bp, Rattus norvegicus
tcaggaggcaggaggcagccttctt

SEQ ID NO: 578334 - DNA, 25 bp, Rattus norvegicus
tcaggaggcaggtggcagccttctt

SEQ ID NO: 578335 - DNA, 25 bp, Rattus norvegicus
tcaggaggcctgagtgctttaacaa

SEQ ID NO: 578336 - DNA, 25 bp, Rattus norvegicus
tcaggaggcctgtgtgctttaacaa

SEQ ID NO: 578337 - DNA, 25 bp, Rattus norvegicus
tcaggaggcgcacagccagcctgta

SEQ ID NO: 578338 - DNA, 25 bp, Rattus norvegicus
tcaggaggcgcagagccagcctgta

SEQ ID NO: 578339 - DNA, 25 bp, Rattus norvegicus
tcaggaggctcacagacttcatcgg

SEQ ID NO: 578340 - DNA, 25 bp, Rattus norvegicus
tcaggaggctcagagacttcatcgg

SEQ ID NO: 578341 - DNA, 25 bp, Rattus norvegicus
tcaggaggctcccacctaagcctgg

SEQ ID NO: 578342 - DNA, 25 bp, Rattus norvegicus
tcaggaggctccgacctaagcctgg

SEQ ID NO: 578343 - DNA, 25 bp, Rattus norvegicus
tcaggaggctggcacaatgttgttt

SEQ ID NO: 578344 - DNA, 25 bp, Rattus norvegicus
tcaggaggctgggacaatgttgttt

SEQ ID NO: 578345 - DNA, 25 bp, Rattus norvegicus
tcaggagggagcacacctactttgg

SEQ ID NO: 578346 - DNA, 25 bp, Rattus norvegicus
tcaggagggagctcacctactttgg

SEQ ID NO: 578347 - DNA, 25 bp, Rattus norvegicus
tcaggagggcagcttgtgccaccaa

SEQ ID NO: 578348 - DNA, 25 bp, Rattus norvegicus
tcaggagggcaggttgtgccaccaa

SEQ ID NO: 578349 - DNA, 25 bp, Rattus norvegicus
tcaggaggtctacttttgcttgcac

SEQ ID NO: 578350 - DNA, 25 bp, Rattus norvegicus
tcaggaggtctagttttgcttgcac

SEQ ID NO: 578351 - DNA, 25 bp, Rattus norvegicus
tcaggaggtctgcagatagagccat

SEQ ID NO: 578352 - DNA, 25 bp, Rattus norvegicus
tcaggaggtctggagatagagccat

SEQ ID NO: 578353 - DNA, 25 bp, Rattus norvegicus
tcaggaggttgaaatgtcacttact

SEQ ID NO: 578354 - DNA, 25 bp, Rattus norvegicus
tcaggaggttgatatgtcacttact

SEQ ID NO: 578355 - DNA, 25 bp, Rattus norvegicus
tcaggagtaccaaatacgtttccca

SEQ ID NO: 578356 - DNA, 25 bp, Rattus norvegicus
tcaggagtaccatatacgtttccca

SEQ ID NO: 578357 - DNA, 25 bp, Rattus norvegicus
tcaggagtacgcagtggaagcccac

SEQ ID NO: 578358 - DNA, 25 bp, Rattus norvegicus
tcaggagtacgctgtggaagcccac

SEQ ID NO: 578359 - DNA, 25 bp, Rattus norvegicus
tcaggagtccagcaggcactcgaga

SEQ ID NO: 578360 - DNA, 25 bp, Rattus norvegicus
tcaggagtccaggaggcactcgaga

SEQ ID NO: 578361 - DNA, 25 bp, Rattus norvegicus
tcaggagtccctccatgattgggat

SEQ ID NO: 578362 - DNA, 25 bp, Rattus norvegicus
tcaggagtccctgcatgattgggat

SEQ ID NO: 578363 - DNA, 25 bp, Rattus norvegicus
tcaggagtcctgaagagctcagctc

SEQ ID NO: 578364 - DNA, 25 bp, Rattus norvegicus
tcaggagtcctgtagagctcagctc

SEQ ID NO: 578365 - DNA, 25 bp, Rattus norvegicus
tcaggagtctttctcattgtgtact

SEQ ID NO: 578366 - DNA, 25 bp, Rattus norvegicus
tcaggagtctttgtcattgtgtact

SEQ ID NO: 578367 - DNA, 25 bp, Rattus norvegicus
tcaggagttgctagggcatccccat

SEQ ID NO: 578368 - DNA, 25 bp, Rattus norvegicus
tcaggagttgcttgggcatccccat

SEQ ID NO: 578369 - DNA, 25 bp, Rattus norvegicus
tcaggatcagcaccctccattgagc

SEQ ID NO: 578370 - DNA, 25 bp, Rattus norvegicus
tcaggatcagcagcctccattgagc

SEQ ID NO: 578371 - DNA, 25 bp, Rattus norvegicus
tcaggatcagctcccatcatggcaa

SEQ ID NO: 578372 - DNA, 25 bp, Rattus norvegicus
tcaggatcagctgccatcatggcaa

SEQ ID NO: 578373 - DNA, 25 bp, Rattus norvegicus
tcaggatcatctatcactcttgcag

SEQ ID NO: 578374 - DNA, 25 bp, Rattus norvegicus
tcaggatcatctttcactcttgcag

SEQ ID NO: 578375 - DNA, 25 bp, Rattus norvegicus
tcaggatcccctcaactgcacgtgt

SEQ ID NO: 578376 - DNA, 25 bp, Rattus norvegicus
tcaggatcccctgaactgcacgtgt

SEQ ID NO: 578377 - DNA, 25 bp, Rattus norvegicus
tcaggatcccgtattgctcccttga

SEQ ID NO: 578378 - DNA, 25 bp, Rattus norvegicus
tcaggatcccgttttgctcccttga

SEQ ID NO: 578379 - DNA, 25 bp, Rattus norvegicus
tcaggatcctccaaaggcacatgtg

SEQ ID NO: 578380 - DNA, 25 bp, Rattus norvegicus
tcaggatcctcctaaggcacatgtg

SEQ ID NO: 578381 - DNA, 25 bp, Rattus norvegicus
tcaggatcgaagaaacaggcacatg

SEQ ID NO: 578382 - DNA, 25 bp, Rattus norvegicus
tcaggatcgaagtaacaggcacatg

SEQ ID NO: 578383 - DNA, 25 bp, Rattus norvegicus
tcaggatcgtatatgctgcacctca

SEQ ID NO: 578384 - DNA, 25 bp, Rattus norvegicus
tcaggatcgtatttgctgcacctca

SEQ ID NO: 578385 - DNA, 25 bp, Rattus norvegicus
tcaggatcgtccatttgtacttgat

SEQ ID NO: 578386 - DNA, 25 bp, Rattus norvegicus
tcaggatcgtccttttgtacttgat

SEQ ID NO: 578387 - DNA, 25 bp, Rattus norvegicus
tcaggatcgtgtacctttggcttac

SEQ ID NO: 578388 - DNA, 25 bp, Rattus norvegicus
tcaggatcgtgttcctttggcttac

SEQ ID NO: 578389 - DNA, 25 bp, Rattus norvegicus
tcaggatctaatactccgttgcaga

SEQ ID NO: 578390 - DNA, 25 bp, Rattus norvegicus
tcaggatctaattctccgttgcaga

SEQ ID NO: 578391 - DNA, 25 bp, Rattus norvegicus
tcaggatctgcaacgtgaccaaaga

SEQ ID NO: 578392 - DNA, 25 bp, Rattus norvegicus
tcaggatctgcatcgtgaccaaaga

SEQ ID NO: 578393 - DNA, 25 bp, Rattus norvegicus
tcaggatgcaggatcccacaggtgc

SEQ ID NO: 578394 - DNA, 25 bp, Rattus norvegicus
tcaggatgcaggttcccacaggtgc

SEQ ID NO: 578395 - DNA, 25 bp, Rattus norvegicus
tcaggatgccccagtggaagtggaa

SEQ ID NO: 578396 - DNA, 25 bp, Rattus norvegicus
tcaggatgcccctgtggaagtggaa

SEQ ID NO: 578397 - DNA, 25 bp, Rattus norvegicus
tcaggatgccttcggagttgcccag

SEQ ID NO: 578398 - DNA, 25 bp, Rattus norvegicus
tcaggatgccttgggagttgcccag

SEQ ID NO: 578399 - DNA, 25 bp, Rattus norvegicus
tcaggatgggccacaaagttctcat

SEQ ID NO: 578400 - DNA, 25 bp, Rattus norvegicus
tcaggatgggcctcaaagttctcat

SEQ ID NO: 578401 - DNA, 25 bp, Rattus norvegicus
tcaggatgtcatcagctctgtggaa

SEQ ID NO: 578402 - DNA, 25 bp, Rattus norvegicus
tcaggatgtcatgagctctgtggaa

SEQ ID NO: 578403 - DNA, 25 bp, Rattus norvegicus
tcaggatgtctccatatgtctatat

SEQ ID NO: 578404 - DNA, 25 bp, Rattus norvegicus
tcaggatgtctcgatatgtctatat

SEQ ID NO: 578405 - DNA, 25 bp, Rattus norvegicus
tcaggattatcccacgcttgtaaat

SEQ ID NO: 578406 - DNA, 25 bp, Rattus norvegicus
tcaggattatccgacgcttgtaaat

SEQ ID NO: 578407 - DNA, 25 bp, Rattus norvegicus
tcaggattcactcagggcacccgac

SEQ ID NO: 578408 - DNA, 25 bp, Rattus norvegicus
tcaggattcactgagggcacccgac

SEQ ID NO: 578409 - DNA, 25 bp, Rattus norvegicus
tcaggattccagactaccagatctc

SEQ ID NO: 578410 - DNA, 25 bp, Rattus norvegicus
tcaggattccagatgatcccttcaa

SEQ ID NO: 578411 - DNA, 25 bp, Rattus norvegicus
tcaggattccagtctaccagatctc

SEQ ID NO: 578412 - DNA, 25 bp, Rattus norvegicus
tcaggattccagttgatcccttcaa

SEQ ID NO: 578413 - DNA, 25 bp, Rattus norvegicus
tcaggattcctaacttgattcaaat

SEQ ID NO: 578414 - DNA, 25 bp, Rattus norvegicus
tcaggattcctatcttgattcaaat

SEQ ID NO: 578415 - DNA, 25 bp, Rattus norvegicus
tcaggattcctgactttcactacca

SEQ ID NO: 578416 - DNA, 25 bp, Rattus norvegicus
tcaggattcctgtctttcactacca

SEQ ID NO: 578417 - DNA, 25 bp, Rattus norvegicus
tcaggattctgtctgtgtgcgtgtt

SEQ ID NO: 578418 - DNA, 25 bp, Rattus norvegicus
tcaggattctgtgtgtgtgcgtgtt

SEQ ID NO: 578419 - DNA, 25 bp, Rattus norvegicus
tcaggattcttcagccagccactgt

SEQ ID NO: 578420 - DNA, 25 bp, Rattus norvegicus
tcaggattcttctgccagccactgt

SEQ ID NO: 578421 - DNA, 25 bp, Rattus norvegicus
tcaggattgctcatggatatttttt

SEQ ID NO: 578422 - DNA, 25 bp, Rattus norvegicus
tcaggattgctcttggatatttttt

SEQ ID NO: 578423 - DNA, 25 bp, Rattus norvegicus
tcaggattgtgaccagttttcccat

SEQ ID NO: 578424 - DNA, 25 bp, Rattus norvegicus
tcaggattgtgagcagttttcccat

SEQ ID NO: 578425 - DNA, 25 bp, Rattus norvegicus
tcaggattgtgccttcagcctctcg

SEQ ID NO: 578426 - DNA, 25 bp, Rattus norvegicus
tcaggattgtgcgttcagcctctcg

SEQ ID NO: 578427 - DNA, 25 bp, Rattus norvegicus
tcaggcaacctgagcagacaactgt

SEQ ID NO: 578428 - DNA, 25 bp, Rattus norvegicus
tcaggcaacctgtgcagacaactgt

SEQ ID NO: 578429 - DNA, 25 bp, Rattus norvegicus
tcaggcaatggccagctattctcat

SEQ ID NO: 578430 - DNA, 25 bp, Rattus norvegicus
tcaggcaatggcgagctattctcat

SEQ ID NO: 578431 - DNA, 25 bp, Rattus norvegicus
tcaggcaatggtacacctcctacag

SEQ ID NO: 578432 - DNA, 25 bp, Rattus norvegicus
tcaggcaatggttcacctcctacag

SEQ ID NO: 578433 - DNA, 25 bp, Rattus norvegicus
tcaggcacagcaaggcgcccggcaa

SEQ ID NO: 578434 - DNA, 25 bp, Rattus norvegicus
tcaggcacagcatggcgcccggcaa

SEQ ID NO: 578435 - DNA, 25 bp, Rattus norvegicus
tcaggcacggctcgtcttcaggaag

SEQ ID NO: 578436 - DNA, 25 bp, Rattus norvegicus
tcaggcacggctggtcttcaggaag

SEQ ID NO: 578437 - DNA, 25 bp, Rattus norvegicus
tcaggcactagaaagagttccttca

SEQ ID NO: 578438 - DNA, 25 bp, Rattus norvegicus
tcaggcactagatagagttccttca

SEQ ID NO: 578439 - DNA, 25 bp, Rattus norvegicus
tcaggcagaagcatcaaccgtgaca

SEQ ID NO: 578440 - DNA, 25 bp, Rattus norvegicus
tcaggcagaagcttcaaccgtgaca

SEQ ID NO: 578441 - DNA, 25 bp, Rattus norvegicus
tcaggcagatcccgcagagaagcta

SEQ ID NO: 578442 - DNA, 25 bp, Rattus norvegicus
tcaggcagatccggcagagaagcta

SEQ ID NO: 578443 - DNA, 25 bp, Rattus norvegicus
tcaggcagcgacacctccgagtcgg

SEQ ID NO: 578444 - DNA, 25 bp, Rattus norvegicus
tcaggcagcgactcctccgagtcgg

SEQ ID NO: 578445 - DNA, 25 bp, Rattus norvegicus
tcaggcagcgctagaagtcattcag

SEQ ID NO: 578446 - DNA, 25 bp, Rattus norvegicus
tcaggcagcgcttgaagtcattcag

SEQ ID NO: 578447 - DNA, 25 bp, Rattus norvegicus
tcaggcagcgttacagagcagttgg

SEQ ID NO: 578448 - DNA, 25 bp, Rattus norvegicus
tcaggcagcgtttcagagcagttgg

SEQ ID NO: 578449 - DNA, 25 bp, Rattus norvegicus
tcaggcagctatcacggctctccta

SEQ ID NO: 578450 - DNA, 25 bp, Rattus norvegicus
tcaggcagctatgacggctctccta

SEQ ID NO: 578451 - DNA, 25 bp, Rattus norvegicus
tcaggcagctctaagacgccagtga

SEQ ID NO: 578452 - DNA, 25 bp, Rattus norvegicus
tcaggcagctcttagacgccagtga

SEQ ID NO: 578453 - DNA, 25 bp, Rattus norvegicus
tcaggcagctggagccggcacagaa

SEQ ID NO: 578454 - DNA, 25 bp, Rattus norvegicus
tcaggcagctggtgccggcacagaa

SEQ ID NO: 578455 - DNA, 25 bp, Rattus norvegicus
tcaggcagcttgagggccaggtaaa

SEQ ID NO: 578456 - DNA, 25 bp, Rattus norvegicus
tcaggcagcttgtgggccaggtaaa

SEQ ID NO: 578457 - DNA, 25 bp, Rattus norvegicus
tcaggcaggactatttcacttggct

SEQ ID NO: 578458 - DNA, 25 bp, Rattus norvegicus
tcaggcaggactttttcacttggct

SEQ ID NO: 578459 - DNA, 25 bp, Rattus norvegicus
tcaggcagtcagaagcaaccatagc

SEQ ID NO: 578460 - DNA, 25 bp, Rattus norvegicus
tcaggcagtcagtagcaaccatagc

SEQ ID NO: 578461 - DNA, 25 bp, Rattus norvegicus
tcaggcagtgagatgaggctcccaa

SEQ ID NO: 578462 - DNA, 25 bp, Rattus norvegicus
tcaggcagtgagttgaggctcccaa

SEQ ID NO: 578463 - DNA, 25 bp, Rattus norvegicus
tcaggcagtggtccatctagccaag

SEQ ID NO: 578464 - DNA, 25 bp, Rattus norvegicus
tcaggcagtggtgcatctagccaag

SEQ ID NO: 578465 - DNA, 25 bp, Rattus norvegicus
tcaggcagtgtgactgagagctttt

SEQ ID NO: 578466 - DNA, 25 bp, Rattus norvegicus
tcaggcagtgtgtctgagagctttt

SEQ ID NO: 578467 - DNA, 25 bp, Rattus norvegicus
tcaggcatcaggcacacctctggta

SEQ ID NO: 578468 - DNA, 25 bp, Rattus norvegicus
tcaggcatcagggacacctctggta

SEQ ID NO: 578469 - DNA, 25 bp, Rattus norvegicus
tcaggcatccatacagcttgtgcat

SEQ ID NO: 578470 - DNA, 25 bp, Rattus norvegicus
tcaggcatccattcagcttgtgcat

SEQ ID NO: 578471 - DNA, 25 bp, Rattus norvegicus
tcaggcatgctgaatatggaaggca

SEQ ID NO: 578472 - DNA, 25 bp, Rattus norvegicus
tcaggcatgctgtatatggaaggca

SEQ ID NO: 578473 - DNA, 25 bp, Rattus norvegicus
tcaggcatggttctgtgccctggaa

SEQ ID NO: 578474 - DNA, 25 bp, Rattus norvegicus
tcaggcatggttgtgtgccctggaa

SEQ ID NO: 578475 - DNA, 25 bp, Rattus norvegicus
tcaggccaaacacataaaacgtctt

SEQ ID NO: 578476 - DNA, 25 bp, Rattus norvegicus
tcaggccaaacagataaaacgtctt

SEQ ID NO: 578477 - DNA, 25 bp, Rattus norvegicus
tcaggccacagcagcatgttgcatt

SEQ ID NO: 578478 - DNA, 25 bp, Rattus norvegicus
tcaggccacagctgcatgttgcatt

SEQ ID NO: 578479 - DNA, 25 bp, Rattus norvegicus
tcaggccacaggcaccttgttgaga

SEQ ID NO: 578480 - DNA, 25 bp, Rattus norvegicus
tcaggccacagggaccttgttgaga

SEQ ID NO: 578481 - DNA, 25 bp, Rattus norvegicus
tcaggccagaccacggtcatatcat

SEQ ID NO: 578482 - DNA, 25 bp, Rattus norvegicus
tcaggccagacctcggtcatatcat

SEQ ID NO: 578483 - DNA, 25 bp, Rattus norvegicus
tcaggccagcccaatgcactttttt

SEQ ID NO: 578484 - DNA, 25 bp, Rattus norvegicus
tcaggccagccctatgcactttttt

SEQ ID NO: 578485 - DNA, 25 bp, Rattus norvegicus
tcaggccagccgaccttgggagaga

SEQ ID NO: 578486 - DNA, 25 bp, Rattus norvegicus
tcaggccagccgtccttgggagaga

SEQ ID NO: 578487 - DNA, 25 bp, Rattus norvegicus
tcaggccaggcccagagtatttcta

SEQ ID NO: 578488 - DNA, 25 bp, Rattus norvegicus
tcaggccaggccgagagtatttcta

SEQ ID NO: 578489 - DNA, 25 bp, Rattus norvegicus
tcaggccaggtgacagcatgagaaa

SEQ ID NO: 578490 - DNA, 25 bp, Rattus norvegicus
tcaggccaggtgtcagcatgagaaa

SEQ ID NO: 578491 - DNA, 25 bp, Rattus norvegicus
tcaggccaggttcttgtcgtcttga

SEQ ID NO: 578492 - DNA, 25 bp, Rattus norvegicus
tcaggccaggttgttgtcgtcttga

SEQ ID NO: 578493 - DNA, 25 bp, Rattus norvegicus
tcaggccagtgaatgttctccatta

SEQ ID NO: 578494 - DNA, 25 bp, Rattus norvegicus
tcaggccagtgattgttctccatta

SEQ ID NO: 578495 - DNA, 25 bp, Rattus norvegicus
tcaggccatcatacattcagccatg

SEQ ID NO: 578496 - DNA, 25 bp, Rattus norvegicus
tcaggccatcattcattcagccatg

SEQ ID NO: 578497 - DNA, 25 bp, Rattus norvegicus
tcaggcccaagcctggccggcagtt

SEQ ID NO: 578498 - DNA, 25 bp, Rattus norvegicus
tcaggcccaagcgtggccggcagtt

SEQ ID NO: 578499 - DNA, 25 bp, Rattus norvegicus
tcaggcccactgctgccagaagaaa

SEQ ID NO: 578500 - DNA, 25 bp, Rattus norvegicus
tcaggcccactggtgccagaagaaa

SEQ ID NO: 578501 - DNA, 25 bp, Rattus norvegicus
tcaggcccagctcagtttaattttt

SEQ ID NO: 578502 - DNA, 25 bp, Rattus norvegicus
tcaggcccagctgagtttaattttt

SEQ ID NO: 578503 - DNA, 25 bp, Rattus norvegicus
tcaggccccaatattctaatcagga

SEQ ID NO: 578504 - DNA, 25 bp, Rattus norvegicus
tcaggccccaattttctaatcagga

SEQ ID NO: 578505 - DNA, 25 bp, Rattus norvegicus
tcaggcccgggacgagaaacaccag

SEQ ID NO: 578506 - DNA, 25 bp, Rattus norvegicus
tcaggcccgggaggagaaacaccag

SEQ ID NO: 578507 - DNA, 25 bp, Rattus norvegicus
tcaggccctctcacaacaaagaaaa

SEQ ID NO: 578508 - DNA, 25 bp, Rattus norvegicus
tcaggccctctctcaacaaagaaaa

SEQ ID NO: 578509 - DNA, 25 bp, Rattus norvegicus
tcaggccctgaaccgccatgcagaa

SEQ ID NO: 578510 - DNA, 25 bp, Rattus norvegicus
tcaggccctgaagcgccatgcagaa

SEQ ID NO: 578511 - DNA, 25 bp, Rattus norvegicus
tcaggccctgacaccagattttgag

SEQ ID NO: 578512 - DNA, 25 bp, Rattus norvegicus
tcaggccctgactccagattttgag

SEQ ID NO: 578513 - DNA, 25 bp, Rattus norvegicus
tcaggccgagcacagaatcgggttc

SEQ ID NO: 578514 - DNA, 25 bp, Rattus norvegicus
tcaggccgagcagagaatcgggttc

SEQ ID NO: 578515 - DNA, 25 bp, Rattus norvegicus
tcaggccgctttaggatacctttag

SEQ ID NO: 578516 - DNA, 25 bp, Rattus norvegicus
tcaggccgcttttggatacctttag

SEQ ID NO: 578517 - DNA, 25 bp, Rattus norvegicus
tcaggccgggtcatcacaggacgaa

SEQ ID NO: 578518 - DNA, 25 bp, Rattus norvegicus
tcaggccgggtcttcacaggacgaa

SEQ ID NO: 578519 - DNA, 25 bp, Rattus norvegicus
tcaggccgtatacatcgacagctac

SEQ ID NO: 578520 - DNA, 25 bp, Rattus norvegicus
tcaggccgtatagatcgacagctac

SEQ ID NO: 578521 - DNA, 25 bp, Rattus norvegicus
tcaggcctagctcgacggccaggaa

SEQ ID NO: 578522 - DNA, 25 bp, Rattus norvegicus
tcaggcctagctggacggccaggaa

SEQ ID NO: 578523 - DNA, 25 bp, Rattus norvegicus
tcaggcctcaaccatgttacgagca

SEQ ID NO: 578524 - DNA, 25 bp, Rattus norvegicus
tcaggcctcaacgatgttacgagca

SEQ ID NO: 578525 - DNA, 25 bp, Rattus norvegicus
tcaggcctcagtcgctgcagagata

SEQ ID NO: 578526 - DNA, 25 bp, Rattus norvegicus
tcaggcctcagtggctgcagagata

SEQ ID NO: 578527 - DNA, 25 bp, Rattus norvegicus
tcaggcctcgataccacagccatgg

SEQ ID NO: 578528 - DNA, 25 bp, Rattus norvegicus
tcaggcctcgattccacagccatgg

SEQ ID NO: 578529 - DNA, 25 bp, Rattus norvegicus
tcaggcctctgcattgttttctgaa

SEQ ID NO: 578530 - DNA, 25 bp, Rattus norvegicus
tcaggcctctgctttgttttctgaa

SEQ ID NO: 578531 - DNA, 25 bp, Rattus norvegicus
tcaggcctcttgcttgggccagcaa

SEQ ID NO: 578532 - DNA, 25 bp, Rattus norvegicus
tcaggcctcttggttgggccagcaa

SEQ ID NO: 578533 - DNA, 25 bp, Rattus norvegicus
tcaggcctgagtcattcccacaaaa

SEQ ID NO: 578534 - DNA, 25 bp, Rattus norvegicus
tcaggcctgagtgattcccacaaaa

SEQ ID NO: 578535 - DNA, 25 bp, Rattus norvegicus
tcaggcctgcccaagacaggttttt

SEQ ID NO: 578536 - DNA, 25 bp, Rattus norvegicus
tcaggcctgccctagacaggttttt

SEQ ID NO: 578537 - DNA, 25 bp, Rattus norvegicus
tcaggcctgcctattggttattaaa

SEQ ID NO: 578538 - DNA, 25 bp, Rattus norvegicus
tcaggcctgccttttggttattaaa

SEQ ID NO: 578539 - DNA, 25 bp, Rattus norvegicus
tcaggcctgcttattcttttagaga

SEQ ID NO: 578540 - DNA, 25 bp, Rattus norvegicus
tcaggcctgctttttcttttagaga

SEQ ID NO: 578541 - DNA, 25 bp, Rattus norvegicus
tcaggcctggaacatgagttactat

SEQ ID NO: 578542 - DNA, 25 bp, Rattus norvegicus
tcaggcctggaagatgagttactat

SEQ ID NO: 578543 - DNA, 25 bp, Rattus norvegicus
tcaggcctggtcactttcatgttga

SEQ ID NO: 578544 - DNA, 25 bp, Rattus norvegicus
tcaggcctggtctctttcatgttga

SEQ ID NO: 578545 - DNA, 25 bp, Rattus norvegicus
tcaggccttatccagtatctcaaag

SEQ ID NO: 578546 - DNA, 25 bp, Rattus norvegicus
tcaggccttatcgagtatctcaaag

SEQ ID NO: 578547 - DNA, 25 bp, Rattus norvegicus
tcaggccttcctcagacacatgtgg

SEQ ID NO: 578548 - DNA, 25 bp, Rattus norvegicus
tcaggccttcctgagacacatgtgg

SEQ ID NO: 578549 - DNA, 25 bp, Rattus norvegicus
tcaggccttctgattgtgacaccaa

SEQ ID NO: 578550 - DNA, 25 bp, Rattus norvegicus
tcaggccttctgtttgtgacaccaa

SEQ ID NO: 578551 - DNA, 25 bp, Rattus norvegicus
tcaggccttgctctaagacagctgt

SEQ ID NO: 578552 - DNA, 25 bp, Rattus norvegicus
tcaggccttgctgtaagacagctgt

SEQ ID NO: 578553 - DNA, 25 bp, Rattus norvegicus
tcaggcgatgtgctttatggcaggc

SEQ ID NO: 578554 - DNA, 25 bp, Rattus norvegicus
tcaggcgatgtggtttatggcaggc

SEQ ID NO: 578555 - DNA, 25 bp, Rattus norvegicus
tcaggcgcagtgatgacagaccgtt

SEQ ID NO: 578556 - DNA, 25 bp, Rattus norvegicus
tcaggcgcagtgttgacagaccgtt

SEQ ID NO: 578557 - DNA, 25 bp, Rattus norvegicus
tcaggcggccagagttcccaggtga

SEQ ID NO: 578558 - DNA, 25 bp, Rattus norvegicus
tcaggcggccagtgttcccaggtga

SEQ ID NO: 578559 - DNA, 25 bp, Rattus norvegicus
tcaggcgtaacacccacactaagta

SEQ ID NO: 578560 - DNA, 25 bp, Rattus norvegicus
tcaggcgtaacagccacactaagta

SEQ ID NO: 578561 - DNA, 25 bp, Rattus norvegicus
tcaggcgtacagaaactttcagagc

SEQ ID NO: 578562 - DNA, 25 bp, Rattus norvegicus
tcaggcgtacagtaactttcagagc

SEQ ID NO: 578563 - DNA, 25 bp, Rattus norvegicus
tcaggcgtgtttaagcatgccctca

SEQ ID NO: 578564 - DNA, 25 bp, Rattus norvegicus
tcaggcgtgttttagcatgccctca

SEQ ID NO: 578565 - DNA, 25 bp, Rattus norvegicus
tcaggcgtttacaggagcactctgc

SEQ ID NO: 578566 - DNA, 25 bp, Rattus norvegicus
tcaggcgtttactggagcactctgc

SEQ ID NO: 578567 - DNA, 25 bp, Rattus norvegicus
tcaggctacttgctgtcagtgctca

SEQ ID NO: 578568 - DNA, 25 bp, Rattus norvegicus
tcaggctacttggtgtcagtgctca

SEQ ID NO: 578569 - DNA, 25 bp, Rattus norvegicus
tcaggctatcccaatgatcccaaga

SEQ ID NO: 578570 - DNA, 25 bp, Rattus norvegicus
tcaggctatccctatgatcccaaga

SEQ ID NO: 578571 - DNA, 25 bp, Rattus norvegicus
tcaggctatgaaacagcaccagata

SEQ ID NO: 578572 - DNA, 25 bp, Rattus norvegicus
tcaggctatgaatcagcaccagata

SEQ ID NO: 578573 - DNA, 25 bp, Rattus norvegicus
tcaggctcaaatctctctcatgtgt

SEQ ID NO: 578574 - DNA, 25 bp, Rattus norvegicus
tcaggctcaaatgtctctcatgtgt

SEQ ID NO: 578575 - DNA, 25 bp, Rattus norvegicus
tcaggctcacttcgaggtccagcaa

SEQ ID NO: 578576 - DNA, 25 bp, Rattus norvegicus
tcaggctcacttggaggtccagcaa

SEQ ID NO: 578577 - DNA, 25 bp, Rattus norvegicus
tcaggctcagacaacaggcatgggt

SEQ ID NO: 578578 - DNA, 25 bp, Rattus norvegicus
tcaggctcagactacaggcatgggt

SEQ ID NO: 578579 - DNA, 25 bp, Rattus norvegicus
tcaggctccagaagtttttatggtt

SEQ ID NO: 578580 - DNA, 25 bp, Rattus norvegicus
tcaggctccagatgtttttatggtt

SEQ ID NO: 578581 - DNA, 25 bp, Rattus norvegicus
tcaggctccagcatcgaggacatgg

SEQ ID NO: 578582 - DNA, 25 bp, Rattus norvegicus
tcaggctccagcttcgaggacatgg

SEQ ID NO: 578583 - DNA, 25 bp, Rattus norvegicus
tcaggctcctccatagcagagagat

SEQ ID NO: 578584 - DNA, 25 bp, Rattus norvegicus
tcaggctcctccttagcagagagat

SEQ ID NO: 578585 - DNA, 25 bp, Rattus norvegicus
tcaggctcctggatggtgggcccca

SEQ ID NO: 578586 - DNA, 25 bp, Rattus norvegicus
tcaggctcctggttggtgggcccca

SEQ ID NO: 578587 - DNA, 25 bp, Rattus norvegicus
tcaggctccttcaagcttagcaaga

SEQ ID NO: 578588 - DNA, 25 bp, Rattus norvegicus
tcaggctccttctagcttagcaaga

SEQ ID NO: 578589 - DNA, 25 bp, Rattus norvegicus
tcaggctcctttacatcgttggtaa

SEQ ID NO: 578590 - DNA, 25 bp, Rattus norvegicus
tcaggctccttttcatcgttggtaa

SEQ ID NO: 578591 - DNA, 25 bp, Rattus norvegicus
tcaggctcggtgacgtcagaaaacg

SEQ ID NO: 578592 - DNA, 25 bp, Rattus norvegicus
tcaggctcggtgtcgtcagaaaacg

SEQ ID NO: 578593 - DNA, 25 bp, Rattus norvegicus
tcaggctctatgcaatctgacttcc

SEQ ID NO: 578594 - DNA, 25 bp, Rattus norvegicus
tcaggctctatggaatctgacttcc

SEQ ID NO: 578595 - DNA, 25 bp, Rattus norvegicus
tcaggctctccacctagagttgtgt

SEQ ID NO: 578596 - DNA, 25 bp, Rattus norvegicus
tcaggctctccagctagagttgtgt

SEQ ID NO: 578597 - DNA, 25 bp, Rattus norvegicus
tcaggctcttggagactgtggcagc

SEQ ID NO: 578598 - DNA, 25 bp, Rattus norvegicus
tcaggctcttggtgactgtggcagc

SEQ ID NO: 578599 - DNA, 25 bp, Rattus norvegicus
tcaggctcttttccagggcgaagga

SEQ ID NO: 578600 - DNA, 25 bp, Rattus norvegicus
tcaggctcttttgcagggcgaagga

SEQ ID NO: 578601 - DNA, 25 bp, Rattus norvegicus
tcaggctgactgagaagccgcctac

SEQ ID NO: 578602 - DNA, 25 bp, Rattus norvegicus
tcaggctgactgtgaagccgcctac

SEQ ID NO: 578603 - DNA, 25 bp, Rattus norvegicus
tcaggctgagcacagaggctcctgt

SEQ ID NO: 578604 - DNA, 25 bp, Rattus norvegicus
tcaggctgagcagagaggctcctgt

SEQ ID NO: 578605 - DNA, 25 bp, Rattus norvegicus
tcaggctgcagacagacactttcca

SEQ ID NO: 578606 - DNA, 25 bp, Rattus norvegicus
tcaggctgcagagagacactttcca

SEQ ID NO: 578607 - DNA, 25 bp, Rattus norvegicus
tcaggctgccagacagttgctgaga

SEQ ID NO: 578608 - DNA, 25 bp, Rattus norvegicus
tcaggctgccagtcagttgctgaga

SEQ ID NO: 578609 - DNA, 25 bp, Rattus norvegicus
tcaggctgcctccttaatcaagaag

SEQ ID NO: 578610 - DNA, 25 bp, Rattus norvegicus
tcaggctgcctcgttaatcaagaag

SEQ ID NO: 578611 - DNA, 25 bp, Rattus norvegicus
tcaggctgcctgagaactatgtagc

SEQ ID NO: 578612 - DNA, 25 bp, Rattus norvegicus
tcaggctgcctgtgaactatgtagc

SEQ ID NO: 578613 - DNA, 25 bp, Rattus norvegicus
tcaggctgccttctagtgactttct

SEQ ID NO: 578614 - DNA, 25 bp, Rattus norvegicus
tcaggctgccttgtagtgactttct

SEQ ID NO: 578615 - DNA, 25 bp, Rattus norvegicus
tcaggctgctccagtcagcgagtgg

SEQ ID NO: 578616 - DNA, 25 bp, Rattus norvegicus
tcaggctgctcctgtcagcgagtgg

SEQ ID NO: 578617 - DNA, 25 bp, Rattus norvegicus
tcaggctgctgaagtcttggtcttt

SEQ ID NO: 578618 - DNA, 25 bp, Rattus norvegicus
tcaggctgctgatgtcttggtcttt

SEQ ID NO: 578619 - DNA, 25 bp, Rattus norvegicus
tcaggctgctttagctgcctttggc

SEQ ID NO: 578620 - DNA, 25 bp, Rattus norvegicus
tcaggctgcttttgctgcctttggc

SEQ ID NO: 578621 - DNA, 25 bp, Rattus norvegicus
tcaggctggcttagagctcactctg

SEQ ID NO: 578622 - DNA, 25 bp, Rattus norvegicus
tcaggctggctttgagctcactctg

SEQ ID NO: 578623 - DNA, 25 bp, Rattus norvegicus
tcaggctggtgaattagactattac

SEQ ID NO: 578624 - DNA, 25 bp, Rattus norvegicus
tcaggctggtgatttagactattac

SEQ ID NO: 578625 - DNA, 25 bp, Rattus norvegicus
tcaggctggtttcgcacagcactgt

SEQ ID NO: 578626 - DNA, 25 bp, Rattus norvegicus
tcaggctggtttggcacagcactgt

SEQ ID NO: 578627 - DNA, 25 bp, Rattus norvegicus
tcaggctgtacgacaggtgttctca

SEQ ID NO: 578628 - DNA, 25 bp, Rattus norvegicus
tcaggctgtacgtcaggtgttctca

SEQ ID NO: 578629 - DNA, 25 bp, Rattus norvegicus
tcaggctgtctgcatattagctcag

SEQ ID NO: 578630 - DNA, 25 bp, Rattus norvegicus
tcaggctgtctggatattagctcag

SEQ ID NO: 578631 - DNA, 25 bp, Rattus norvegicus
tcaggctgtgtcagaggccaaattc

SEQ ID NO: 578632 - DNA, 25 bp, Rattus norvegicus
tcaggctgtgtctgaggccaaattc

SEQ ID NO: 578633 - DNA, 25 bp, Rattus norvegicus
tcaggcttaccaccaagcaccttta

SEQ ID NO: 578634 - DNA, 25 bp, Rattus norvegicus
tcaggcttaccagcaagcaccttta

SEQ ID NO: 578635 - DNA, 25 bp, Rattus norvegicus
tcaggcttcaatctcaggcttcacg

SEQ ID NO: 578636 - DNA, 25 bp, Rattus norvegicus
tcaggcttcaatgtcaggcttcacg

SEQ ID NO: 578637 - DNA, 25 bp, Rattus norvegicus
tcaggcttcactcttgtctcggaca

SEQ ID NO: 578638 - DNA, 25 bp, Rattus norvegicus
tcaggcttcactgttgtctcggaca

SEQ ID NO: 578639 - DNA, 25 bp, Rattus norvegicus
tcaggcttcagcactggctctggct

SEQ ID NO: 578640 - DNA, 25 bp, Rattus norvegicus
tcaggcttcagctctggctctggct

SEQ ID NO: 578641 - DNA, 25 bp, Rattus norvegicus
tcaggcttctgtcgtgtctggcaag

SEQ ID NO: 578642 - DNA, 25 bp, Rattus norvegicus
tcaggcttctgtggtgtctggcaag

SEQ ID NO: 578643 - DNA, 25 bp, Rattus norvegicus
tcaggcttcttcagactgttccttt

SEQ ID NO: 578644 - DNA, 25 bp, Rattus norvegicus
tcaggcttcttctgactgttccttt

SEQ ID NO: 578645 - DNA, 25 bp, Rattus norvegicus
tcaggcttcttgactgctttgcaag

SEQ ID NO: 578646 - DNA, 25 bp, Rattus norvegicus
tcaggcttcttgtctgctttgcaag

SEQ ID NO: 578647 - DNA, 25 bp, Rattus norvegicus
tcaggcttctttccgatttgtgtgt

SEQ ID NO: 578648 - DNA, 25 bp, Rattus norvegicus
tcaggcttctttgcgatttgtgtgt

SEQ ID NO: 578649 - DNA, 25 bp, Rattus norvegicus
tcaggcttgcaaagccctccttggc

SEQ ID NO: 578650 - DNA, 25 bp, Rattus norvegicus
tcaggcttgcaatgccctccttggc

SEQ ID NO: 578651 - DNA, 25 bp, Rattus norvegicus
tcaggcttgcctcgcctgaggaacc

SEQ ID NO: 578652 - DNA, 25 bp, Rattus norvegicus
tcaggcttgcctggcctgaggaacc

SEQ ID NO: 578653 - DNA, 25 bp, Rattus norvegicus
tcaggcttgggcagtaccatgagac

SEQ ID NO: 578654 - DNA, 25 bp, Rattus norvegicus
tcaggcttgggctgtaccatgagac

SEQ ID NO: 578655 - DNA, 25 bp, Rattus norvegicus
tcaggcttgtggcaaccttatccat

SEQ ID NO: 578656 - DNA, 25 bp, Rattus norvegicus
tcaggcttgtgggaaccttatccat

SEQ ID NO: 578657 - DNA, 25 bp, Rattus norvegicus
tcagggaacagactctggctggcca

SEQ ID NO: 578658 - DNA, 25 bp, Rattus norvegicus
tcagggaacagagtctggctggcca

SEQ ID NO: 578659 - DNA, 25 bp, Rattus norvegicus
tcagggaacatgctcggtttgctat

SEQ ID NO: 578660 - DNA, 25 bp, Rattus norvegicus
tcagggaacatggtcggtttgctat

SEQ ID NO: 578661 - DNA, 25 bp, Rattus norvegicus
tcagggaacctaaccccagctagaa

SEQ ID NO: 578662 - DNA, 25 bp, Rattus norvegicus
tcagggaacctatccccagctagaa

SEQ ID NO: 578663 - DNA, 25 bp, Rattus norvegicus
tcagggaaccttagtagtaaaatca

SEQ ID NO: 578664 - DNA, 25 bp, Rattus norvegicus
tcagggaacctttgtagtaaaatca

SEQ ID NO: 578665 - DNA, 25 bp, Rattus norvegicus
tcagggaacttgatgtactgtcagt

SEQ ID NO: 578666 - DNA, 25 bp, Rattus norvegicus
tcagggaacttgttgtactgtcagt

SEQ ID NO: 578667 - DNA, 25 bp, Rattus norvegicus
tcagggaagcttcccatagggacat

SEQ ID NO: 578668 - DNA, 25 bp, Rattus norvegicus
tcagggaagcttgccatagggacat

SEQ ID NO: 578669 - DNA, 25 bp, Rattus norvegicus
tcagggaaggatcgactctgctctt

SEQ ID NO: 578670 - DNA, 25 bp, Rattus norvegicus
tcagggaaggatggactctgctctt

SEQ ID NO: 578671 - DNA, 25 bp, Rattus norvegicus
tcagggaaggttcagtctccccact

SEQ ID NO: 578672 - DNA, 25 bp, Rattus norvegicus
tcagggaaggttgagtctccccact

SEQ ID NO: 578673 - DNA, 25 bp, Rattus norvegicus
tcagggaatcagactggctcccggg

SEQ ID NO: 578674 - DNA, 25 bp, Rattus norvegicus
tcagggaatcagtctggctcccggg

SEQ ID NO: 578675 - DNA, 25 bp, Rattus norvegicus
tcagggaattcccacatttctggct

SEQ ID NO: 578676 - DNA, 25 bp, Rattus norvegicus
tcagggaattccgacatttctggct

SEQ ID NO: 578677 - DNA, 25 bp, Rattus norvegicus
tcagggacagttcaggcttggcctc

SEQ ID NO: 578678 - DNA, 25 bp, Rattus norvegicus
tcagggacagttgaggcttggcctc

SEQ ID NO: 578679 - DNA, 25 bp, Rattus norvegicus
tcagggaccaggcacgcagcacagc

SEQ ID NO: 578680 - DNA, 25 bp, Rattus norvegicus
tcagggaccagggacgcagcacagc

SEQ ID NO: 578681 - DNA, 25 bp, Rattus norvegicus
tcagggacccagcaacacggatgtg

SEQ ID NO: 578682 - DNA, 25 bp, Rattus norvegicus
tcagggacccaggaacacggatgtg

SEQ ID NO: 578683 - DNA, 25 bp, Rattus norvegicus
tcagggacccctatggatgaattag

SEQ ID NO: 578684 - DNA, 25 bp, Rattus norvegicus
tcagggacccctttggatgaattag

SEQ ID NO: 578685 - DNA, 25 bp, Rattus norvegicus
tcagggaccgaacggactcctggaa

SEQ ID NO: 578686 - DNA, 25 bp, Rattus norvegicus
tcagggaccgaagggactcctggaa

SEQ ID NO: 578687 - DNA, 25 bp, Rattus norvegicus
tcagggacgtccagattggcgacat

SEQ ID NO: 578688 - DNA, 25 bp, Rattus norvegicus
tcagggacgtcctgattggcgacat

SEQ ID NO: 578689 - DNA, 25 bp, Rattus norvegicus
tcagggactgtcacaacgtgtctgt

SEQ ID NO: 578690 - DNA, 25 bp, Rattus norvegicus
tcagggactgtctcaacgtgtctgt

SEQ ID NO: 578691 - DNA, 25 bp, Rattus norvegicus
tcagggagcattatcaggagtgcct

SEQ ID NO: 578692 - DNA, 25 bp, Rattus norvegicus
tcagggagcattttcaggagtgcct

SEQ ID NO: 578693 - DNA, 25 bp, Rattus norvegicus
tcagggagcccacacaagtgcatca

SEQ ID NO: 578694 - DNA, 25 bp, Rattus norvegicus
tcagggagcccagacaagtgcatca

SEQ ID NO: 578695 - DNA, 25 bp, Rattus norvegicus
tcagggaggcggcagtccaacctaa

SEQ ID NO: 578696 - DNA, 25 bp, Rattus norvegicus
tcagggaggcgggagtccaacctaa

SEQ ID NO: 578697 - DNA, 25 bp, Rattus norvegicus
tcagggagggcaacttagaccaagc

SEQ ID NO: 578698 - DNA, 25 bp, Rattus norvegicus
tcagggagggcatcttagaccaagc

SEQ ID NO: 578699 - DNA, 25 bp, Rattus norvegicus
tcagggatacccacaagcctagcta

SEQ ID NO: 578700 - DNA, 25 bp, Rattus norvegicus
tcagggataccctcaagcctagcta

SEQ ID NO: 578701 - DNA, 25 bp, Rattus norvegicus
tcagggatactgctctctaacctag

SEQ ID NO: 578702 - DNA, 25 bp, Rattus norvegicus
tcagggatactggtctctaacctag

SEQ ID NO: 578703 - DNA, 25 bp, Rattus norvegicus
tcagggatctacacatggcacacac

SEQ ID NO: 578704 - DNA, 25 bp, Rattus norvegicus
tcagggatctactcatggcacacac

SEQ ID NO: 578705 - DNA, 25 bp, Rattus norvegicus
tcagggatctgcagtgtgacattct

SEQ ID NO: 578706 - DNA, 25 bp, Rattus norvegicus
tcagggatctgctgtgtgacattct

SEQ ID NO: 578707 - DNA, 25 bp, Rattus norvegicus
tcagggatgcgcctactgctggctt

SEQ ID NO: 578708 - DNA, 25 bp, Rattus norvegicus
tcagggatgcgcgtactgctggctt

SEQ ID NO: 578709 - DNA, 25 bp, Rattus norvegicus
tcagggatgctcaccaaacaggcag

SEQ ID NO: 578710 - DNA, 25 bp, Rattus norvegicus
tcagggatgctctccaaacaggcag

SEQ ID NO: 578711 - DNA, 25 bp, Rattus norvegicus
tcagggatgctgaaccttgttggca

SEQ ID NO: 578712 - DNA, 25 bp, Rattus norvegicus
tcagggatgctgtaccttgttggca

SEQ ID NO: 578713 - DNA, 25 bp, Rattus norvegicus
tcagggattcctccattttcaaata

SEQ ID NO: 578714 - DNA, 25 bp, Rattus norvegicus
tcagggattcctgcattttcaaata

SEQ ID NO: 578715 - DNA, 25 bp, Rattus norvegicus
tcagggattcgcactcagtgcacag

SEQ ID NO: 578716 - DNA, 25 bp, Rattus norvegicus
tcagggattcgctctcagtgcacag

SEQ ID NO: 578717 - DNA, 25 bp, Rattus norvegicus
tcagggattgagagctgccttcagt

SEQ ID NO: 578718 - DNA, 25 bp, Rattus norvegicus
tcagggattgagtgctgccttcagt

SEQ ID NO: 578719 - DNA, 25 bp, Rattus norvegicus
tcagggattggtatcttctctttaa

SEQ ID NO: 578720 - DNA, 25 bp, Rattus norvegicus
tcagggattggtttcttctctttaa

SEQ ID NO: 578721 - DNA, 25 bp, Rattus norvegicus
tcagggcaagcgcagccacctcgta

SEQ ID NO: 578722 - DNA, 25 bp, Rattus norvegicus
tcagggcaagcggagccacctcgta

SEQ ID NO: 578723 - DNA, 25 bp, Rattus norvegicus
tcagggcacagtaactccagaattt

SEQ ID NO: 578724 - DNA, 25 bp, Rattus norvegicus
tcagggcacagtcctatccaaggca

SEQ ID NO: 578725 - DNA, 25 bp, Rattus norvegicus
tcagggcacagtgctatccaaggca

SEQ ID NO: 578726 - DNA, 25 bp, Rattus norvegicus
tcagggcacagttactccagaattt

SEQ ID NO: 578727 - DNA, 25 bp, Rattus norvegicus
tcagggcagcatccaccattgtagt

SEQ ID NO: 578728 - DNA, 25 bp, Rattus norvegicus
tcagggcagcatgcaccattgtagt

SEQ ID NO: 578729 - DNA, 25 bp, Rattus norvegicus
tcagggcagcctctctgcctcggag

SEQ ID NO: 578730 - DNA, 25 bp, Rattus norvegicus
tcagggcagcctgtctgcctcggag

SEQ ID NO: 578731 - DNA, 25 bp, Rattus norvegicus
tcagggcagctaagggaaagaattc

SEQ ID NO: 578732 - DNA, 25 bp, Rattus norvegicus
tcagggcagctatgggaaagaattc

SEQ ID NO: 578733 - DNA, 25 bp, Rattus norvegicus
tcagggcagctcacatggaagatgg

SEQ ID NO: 578734 - DNA, 25 bp, Rattus norvegicus
tcagggcagctccagtatattccag

SEQ ID NO: 578735 - DNA, 25 bp, Rattus norvegicus
tcagggcagctcgagtatattccag

SEQ ID NO: 578736 - DNA, 25 bp, Rattus norvegicus
tcagggcagctctcatggaagatgg

SEQ ID NO: 578737 - DNA, 25 bp, Rattus norvegicus
tcagggcaggagaagggtcgttcac

SEQ ID NO: 578738 - DNA, 25 bp, Rattus norvegicus
tcagggcaggagtagggtcgttcac

SEQ ID NO: 578739 - DNA, 25 bp, Rattus norvegicus
tcagggcatggtctcatctctgcat

SEQ ID NO: 578740 - DNA, 25 bp, Rattus norvegicus
tcagggcatggtgtcatctctgcat

SEQ ID NO: 578741 - DNA, 25 bp, Rattus norvegicus
tcagggcatgtaaaccttattatat

SEQ ID NO: 578742 - DNA, 25 bp, Rattus norvegicus
tcagggcatgtataccttattatat

SEQ ID NO: 578743 - DNA, 25 bp, Rattus norvegicus
tcagggcattagcaccacgcagtga

SEQ ID NO: 578744 - DNA, 25 bp, Rattus norvegicus
tcagggcattaggaccacgcagtga

SEQ ID NO: 578745 - DNA, 25 bp, Rattus norvegicus
tcagggcatttgctggtcccaggaa

SEQ ID NO: 578746 - DNA, 25 bp, Rattus norvegicus
tcagggcatttggtggtcccaggaa

SEQ ID NO: 578747 - DNA, 25 bp, Rattus norvegicus
tcagggccagacaggattccagagt

SEQ ID NO: 578748 - DNA, 25 bp, Rattus norvegicus
tcagggccagactggattccagagt

SEQ ID NO: 578749 - DNA, 25 bp, Rattus norvegicus
tcagggccaggcatcactggtaata

SEQ ID NO: 578750 - DNA, 25 bp, Rattus norvegicus
tcagggccaggcttcactggtaata

SEQ ID NO: 578751 - DNA, 25 bp, Rattus norvegicus
tcagggccagtaccagcaacaggac

SEQ ID NO: 578752 - DNA, 25 bp, Rattus norvegicus
tcagggccagtagcagcaacaggac

SEQ ID NO: 578753 - DNA, 25 bp, Rattus norvegicus
tcagggcccaaaattgctgtgaact

SEQ ID NO: 578754 - DNA, 25 bp, Rattus norvegicus
tcagggcccaaatttgctgtgaact

SEQ ID NO: 578755 - DNA, 25 bp, Rattus norvegicus
tcagggcccggaagccatcttttta

SEQ ID NO: 578756 - DNA, 25 bp, Rattus norvegicus
tcagggcccggatgccatcttttta

SEQ ID NO: 578757 - DNA, 25 bp, Rattus norvegicus
tcagggcccggtcacatgatgaatc

SEQ ID NO: 578758 - DNA, 25 bp, Rattus norvegicus
tcagggcccggtgacatgatgaatc

SEQ ID NO: 578759 - DNA, 25 bp, Rattus norvegicus
tcagggccctgaagagcatcgcaaa

SEQ ID NO: 578760 - DNA, 25 bp, Rattus norvegicus
tcagggccctgatgagcatcgcaaa

SEQ ID NO: 578761 - DNA, 25 bp, Rattus norvegicus
tcagggccctttcacaattaaagtt

SEQ ID NO: 578762 - DNA, 25 bp, Rattus norvegicus
tcagggccctttgacaattaaagtt

SEQ ID NO: 578763 - DNA, 25 bp, Rattus norvegicus
tcagggcctcaaacacgaagctggt

SEQ ID NO: 578764 - DNA, 25 bp, Rattus norvegicus
tcagggcctcaatcacgaagctggt

SEQ ID NO: 578765 - DNA, 25 bp, Rattus norvegicus
tcagggcctcatagaaacaccagca

SEQ ID NO: 578766 - DNA, 25 bp, Rattus norvegicus
tcagggcctcattgaaacaccagca

SEQ ID NO: 578767 - DNA, 25 bp, Rattus norvegicus
tcagggccttgcagactcttcagct

SEQ ID NO: 578768 - DNA, 25 bp, Rattus norvegicus
tcagggccttgctgactcttcagct

SEQ ID NO: 578769 - DNA, 25 bp, Rattus norvegicus
tcagggcctttcacatgctagtcaa

SEQ ID NO: 578770 - DNA, 25 bp, Rattus norvegicus
tcagggcctttctcatgctagtcaa

SEQ ID NO: 578771 - DNA, 25 bp, Rattus norvegicus
tcagggcgacagagtaccaccgagg

SEQ ID NO: 578772 - DNA, 25 bp, Rattus norvegicus
tcagggcgacagtgtaccaccgagg

SEQ ID NO: 578773 - DNA, 25 bp, Rattus norvegicus
tcagggcgcgacaagaagctctcaa

SEQ ID NO: 578774 - DNA, 25 bp, Rattus norvegicus
tcagggcgcgactagaagctctcaa

SEQ ID NO: 578775 - DNA, 25 bp, Rattus norvegicus
tcagggcggctgagttttctgctca

SEQ ID NO: 578776 - DNA, 25 bp, Rattus norvegicus
tcagggcggctgtgttttctgctca

SEQ ID NO: 578777 - DNA, 25 bp, Rattus norvegicus
tcagggctcacaagacttatccaaa

SEQ ID NO: 578778 - DNA, 25 bp, Rattus norvegicus
tcagggctcacatgacttatccaaa

SEQ ID NO: 578779 - DNA, 25 bp, Rattus norvegicus
tcagggctcagcacacgcattggct

SEQ ID NO: 578780 - DNA, 25 bp, Rattus norvegicus
tcagggctcagctcacgcattggct

SEQ ID NO: 578781 - DNA, 25 bp, Rattus norvegicus
tcagggctccaacggccagagaagc

SEQ ID NO: 578782 - DNA, 25 bp, Rattus norvegicus
tcagggctccaagggccagagaagc

SEQ ID NO: 578783 - DNA, 25 bp, Rattus norvegicus
tcagggctccctccagaggttgtct

SEQ ID NO: 578784 - DNA, 25 bp, Rattus norvegicus
tcagggctccctgcagaggttgtct

SEQ ID NO: 578785 - DNA, 25 bp, Rattus norvegicus
tcagggctccgcagaagcagaggca

SEQ ID NO: 578786 - DNA, 25 bp, Rattus norvegicus
tcagggctccgctgaagcagaggca

SEQ ID NO: 578787 - DNA, 25 bp, Rattus norvegicus
tcagggctcctgaaaagcagcactt

SEQ ID NO: 578788 - DNA, 25 bp, Rattus norvegicus
tcagggctcctgtaaagcagcactt

SEQ ID NO: 578789 - DNA, 25 bp, Rattus norvegicus
tcagggctcttgaacctgctctaga

SEQ ID NO: 578790 - DNA, 25 bp, Rattus norvegicus
tcagggctcttgtacctgctctaga

SEQ ID NO: 578791 - DNA, 25 bp, Rattus norvegicus
tcagggctgactaagctagtcccaa

SEQ ID NO: 578792 - DNA, 25 bp, Rattus norvegicus
tcagggctgacttagctagtcccaa

SEQ ID NO: 578793 - DNA, 25 bp, Rattus norvegicus
tcagggctgagccatttcctttgga

SEQ ID NO: 578794 - DNA, 25 bp, Rattus norvegicus
tcagggctgagcgatttcctttgga

SEQ ID NO: 578795 - DNA, 25 bp, Rattus norvegicus
tcagggctgcagagaacctggtccc

SEQ ID NO: 578796 - DNA, 25 bp, Rattus norvegicus
tcagggctgcagtgaacctggtccc

SEQ ID NO: 578797 - DNA, 25 bp, Rattus norvegicus
tcagggctgcccaacctacggatga

SEQ ID NO: 578798 - DNA, 25 bp, Rattus norvegicus
tcagggctgccctacctacggatga

SEQ ID NO: 578799 - DNA, 25 bp, Rattus norvegicus
tcagggctggccattaacgcagatg

SEQ ID NO: 578800 - DNA, 25 bp, Rattus norvegicus
tcagggctggcctttaacgcagatg

SEQ ID NO: 578801 - DNA, 25 bp, Rattus norvegicus
tcagggctgtccattggagcagttc

SEQ ID NO: 578802 - DNA, 25 bp, Rattus norvegicus
tcagggctgtcctttggagcagttc

SEQ ID NO: 578803 - DNA, 25 bp, Rattus norvegicus
tcagggctgtgtatcacttccatac

SEQ ID NO: 578804 - DNA, 25 bp, Rattus norvegicus
tcagggctgtgtttcacttccatac

SEQ ID NO: 578805 - DNA, 25 bp, Rattus norvegicus
tcagggcttatgaccttccagaagg

SEQ ID NO: 578806 - DNA, 25 bp, Rattus norvegicus
tcagggcttatgtccttccagaagg

SEQ ID NO: 578807 - DNA, 25 bp, Rattus norvegicus
tcagggcttcaaccaagtctctgct

SEQ ID NO: 578808 - DNA, 25 bp, Rattus norvegicus
tcagggcttcaagcaagtctctgct

SEQ ID NO: 578809 - DNA, 25 bp, Rattus norvegicus
tcagggcttgtaactcagtgttcac

SEQ ID NO: 578810 - DNA, 25 bp, Rattus norvegicus
tcagggcttgtatctcagtgttcac

SEQ ID NO: 578811 - DNA, 25 bp, Rattus norvegicus
tcagggtagaaaccttcctccacct

SEQ ID NO: 578812 - DNA, 25 bp, Rattus norvegicus
tcagggtagaaagcttcctccacct

SEQ ID NO: 578813 - DNA, 25 bp, Rattus norvegicus
tcagggtatcctctcttggttacaa

SEQ ID NO: 578814 - DNA, 25 bp, Rattus norvegicus
tcagggtatcctgtcttggttacaa

SEQ ID NO: 578815 - DNA, 25 bp, Rattus norvegicus
tcagggtatgtgagtggtctttcca

SEQ ID NO: 578816 - DNA, 25 bp, Rattus norvegicus
tcagggtatgtgtgtggtctttcca

SEQ ID NO: 578817 - DNA, 25 bp, Rattus norvegicus
tcagggtcagaacccgcatcatcac

SEQ ID NO: 578818 - DNA, 25 bp, Rattus norvegicus
tcagggtcagaagccgcatcatcac

SEQ ID NO: 578819 - DNA, 25 bp, Rattus norvegicus
tcagggtcatgtccgcctggactct

SEQ ID NO: 578820 - DNA, 25 bp, Rattus norvegicus
tcagggtcatgtgcgcctggactct

SEQ ID NO: 578821 - DNA, 25 bp, Rattus norvegicus
tcagggtcccctcttctcagattgt

SEQ ID NO: 578822 - DNA, 25 bp, Rattus norvegicus
tcagggtcccctgttctcagattgt

SEQ ID NO: 578823 - DNA, 25 bp, Rattus norvegicus
tcagggtccttaattttcaggcgtg

SEQ ID NO: 578824 - DNA, 25 bp, Rattus norvegicus
tcagggtccttatttttcaggcgtg

SEQ ID NO: 578825 - DNA, 25 bp, Rattus norvegicus
tcagggtcctttatctacaactctc

SEQ ID NO: 578826 - DNA, 25 bp, Rattus norvegicus
tcagggtcctttttctacaactctc

SEQ ID NO: 578827 - DNA, 25 bp, Rattus norvegicus
tcagggtcggcgctacatgcctttg

SEQ ID NO: 578828 - DNA, 25 bp, Rattus norvegicus
tcagggtcggcggtacatgcctttg

SEQ ID NO: 578829 - DNA, 25 bp, Rattus norvegicus
tcagggtcgttgagcagccaccaag

SEQ ID NO: 578830 - DNA, 25 bp, Rattus norvegicus
tcagggtcgttgtgcagccaccaag

SEQ ID NO: 578831 - DNA, 25 bp, Rattus norvegicus
tcagggtctcttactttacgggcat

SEQ ID NO: 578832 - DNA, 25 bp, Rattus norvegicus
tcagggtctctttctttacgggcat

SEQ ID NO: 578833 - DNA, 25 bp, Rattus norvegicus
tcagggtctgtgagccaagtacttt

SEQ ID NO: 578834 - DNA, 25 bp, Rattus norvegicus
tcagggtctgtgtgccaagtacttt

SEQ ID NO: 578835 - DNA, 25 bp, Rattus norvegicus
tcagggtgacatcagagcacctctg

SEQ ID NO: 578836 - DNA, 25 bp, Rattus norvegicus
tcagggtgacatgagagcacctctg

SEQ ID NO: 578837 - DNA, 25 bp, Rattus norvegicus
tcagggtgacctatgggtttgtctt

SEQ ID NO: 578838 - DNA, 25 bp, Rattus norvegicus
tcagggtgacctttgggtttgtctt

SEQ ID NO: 578839 - DNA, 25 bp, Rattus norvegicus
tcagggtgtgtcatcacagcagttt

SEQ ID NO: 578840 - DNA, 25 bp, Rattus norvegicus
tcagggtgtgtcttcacagcagttt

SEQ ID NO: 578841 - DNA, 25 bp, Rattus norvegicus
tcagggttaaagatatctcacgtac

SEQ ID NO: 578842 - DNA, 25 bp, Rattus norvegicus
tcagggttaaagttatctcacgtac

SEQ ID NO: 578843 - DNA, 25 bp, Rattus norvegicus
tcagggttactgactttgcttggca

SEQ ID NO: 578844 - DNA, 25 bp, Rattus norvegicus
tcagggttactgtctttgcttggca

SEQ ID NO: 578845 - DNA, 25 bp, Rattus norvegicus
tcagggttaggcactgacttaacac

SEQ ID NO: 578846 - DNA, 25 bp, Rattus norvegicus
tcagggttaggctctgacttaacac

SEQ ID NO: 578847 - DNA, 25 bp, Rattus norvegicus
tcagggttccgacccagaagtggca

SEQ ID NO: 578848 - DNA, 25 bp, Rattus norvegicus
tcagggttccgagccagaagtggca

SEQ ID NO: 578849 - DNA, 25 bp, Rattus norvegicus
tcagggttctgacactctaggagcc

SEQ ID NO: 578850 - DNA, 25 bp, Rattus norvegicus
tcagggttctgagactctaggagcc

SEQ ID NO: 578851 - DNA, 25 bp, Rattus norvegicus
tcagggttgcttcagctctggctct

SEQ ID NO: 578852 - DNA, 25 bp, Rattus norvegicus
tcagggttgcttgagctctggctct

SEQ ID NO: 578853 - DNA, 25 bp, Rattus norvegicus
tcagggtttccccttctagtatgta

SEQ ID NO: 578854 - DNA, 25 bp, Rattus norvegicus
tcagggtttcccgttctagtatgta

SEQ ID NO: 578855 - DNA, 25 bp, Rattus norvegicus
tcagggtttcctaagtgcctgtgtg

SEQ ID NO: 578856 - DNA, 25 bp, Rattus norvegicus
tcagggtttccttagtgcctgtgtg

SEQ ID NO: 578857 - DNA, 25 bp, Rattus norvegicus
tcagggtttgaaccatggctccgcc

SEQ ID NO: 578858 - DNA, 25 bp, Rattus norvegicus
tcagggtttgaagcatggctccgcc

SEQ ID NO: 578859 - DNA, 25 bp, Rattus norvegicus
tcagggttttcgagttgagttcaaa

SEQ ID NO: 578860 - DNA, 25 bp, Rattus norvegicus
tcagggttttcgtgttgagttcaaa

SEQ ID NO: 578861 - DNA, 25 bp, Rattus norvegicus
tcagggttttctccttccttccagt

SEQ ID NO: 578862 - DNA, 25 bp, Rattus norvegicus
tcagggttttctgcttccttccagt

SEQ ID NO: 578863 - DNA, 25 bp, Rattus norvegicus
tcagggttttgcctttgtccatggg

SEQ ID NO: 578864 - DNA, 25 bp, Rattus norvegicus
tcagggttttgcgtttgtccatggg

SEQ ID NO: 578865 - DNA, 25 bp, Rattus norvegicus
tcaggtaattttatcccaagccgtg

SEQ ID NO: 578866 - DNA, 25 bp, Rattus norvegicus
tcaggtaattttttcccaagccgtg

SEQ ID NO: 578867 - DNA, 25 bp, Rattus norvegicus
tcaggtacagtaaagctatagccag

SEQ ID NO: 578868 - DNA, 25 bp, Rattus norvegicus
tcaggtacagtatagctatagccag

SEQ ID NO: 578869 - DNA, 25 bp, Rattus norvegicus
tcaggtactgaacgatgatgccgat

SEQ ID NO: 578870 - DNA, 25 bp, Rattus norvegicus
tcaggtactgaaggatgatgccgat

SEQ ID NO: 578871 - DNA, 25 bp, Rattus norvegicus
tcaggtagcagacggctggacctaa

SEQ ID NO: 578872 - DNA, 25 bp, Rattus norvegicus
tcaggtagcagagggctggacctaa

SEQ ID NO: 578873 - DNA, 25 bp, Rattus norvegicus
tcaggtagtcgcagtcgctcggcgt

SEQ ID NO: 578874 - DNA, 25 bp, Rattus norvegicus
tcaggtagtcgctgtcgctcggcgt

SEQ ID NO: 578875 - DNA, 25 bp, Rattus norvegicus
tcaggtatagccatctcttctagca

SEQ ID NO: 578876 - DNA, 25 bp, Rattus norvegicus
tcaggtatagccttctcttctagca

SEQ ID NO: 578877 - DNA, 25 bp, Rattus norvegicus
tcaggtatccagcagggccacaaga

SEQ ID NO: 578878 - DNA, 25 bp, Rattus norvegicus
tcaggtatccaggagggccacaaga

SEQ ID NO: 578879 - DNA, 25 bp, Rattus norvegicus
tcaggtatcccactgcttctaggaa

SEQ ID NO: 578880 - DNA, 25 bp, Rattus norvegicus
tcaggtatcccagtgcttctaggaa

SEQ ID NO: 578881 - DNA, 25 bp, Rattus norvegicus
tcaggtatgctgagatcacatgact

SEQ ID NO: 578882 - DNA, 25 bp, Rattus norvegicus
tcaggtatgctgtgatcacatgact

SEQ ID NO: 578883 - DNA, 25 bp, Rattus norvegicus
tcaggtattccgaggcagcagcagc

SEQ ID NO: 578884 - DNA, 25 bp, Rattus norvegicus
tcaggtattccgtggcagcagcagc

SEQ ID NO: 578885 - DNA, 25 bp, Rattus norvegicus
tcaggtcaccaaagccaaatgtcat

SEQ ID NO: 578886 - DNA, 25 bp, Rattus norvegicus
tcaggtcaccaatgccaaatgtcat

SEQ ID NO: 578887 - DNA, 25 bp, Rattus norvegicus
tcaggtcacctgaagctgtacggtt

SEQ ID NO: 578888 - DNA, 25 bp, Rattus norvegicus
tcaggtcacctgtagctgtacggtt

SEQ ID NO: 578889 - DNA, 25 bp, Rattus norvegicus
tcaggtcactggaattgagttttac

SEQ ID NO: 578890 - DNA, 25 bp, Rattus norvegicus
tcaggtcactggtattgagttttac

SEQ ID NO: 578891 - DNA, 25 bp, Rattus norvegicus
tcaggtcactgtattgaggctcttt

SEQ ID NO: 578892 - DNA, 25 bp, Rattus norvegicus
tcaggtcactgttttgaggctcttt

SEQ ID NO: 578893 - DNA, 25 bp, Rattus norvegicus
tcaggtcagcaccagttctttgggc

SEQ ID NO: 578894 - DNA, 25 bp, Rattus norvegicus
tcaggtcagcacgagttctttgggc

SEQ ID NO: 578895 - DNA, 25 bp, Rattus norvegicus
tcaggtcagcctcagcatgggcaat

SEQ ID NO: 578896 - DNA, 25 bp, Rattus norvegicus
tcaggtcagcctgagcatgggcaat

SEQ ID NO: 578897 - DNA, 25 bp, Rattus norvegicus
tcaggtcagtttcagtatttttcaa

SEQ ID NO: 578898 - DNA, 25 bp, Rattus norvegicus
tcaggtcagtttgagtatttttcaa

SEQ ID NO: 578899 - DNA, 25 bp, Rattus norvegicus
tcaggtcatctgctcttgtaggcat

SEQ ID NO: 578900 - DNA, 25 bp, Rattus norvegicus
tcaggtcatctggtcttgtaggcat

SEQ ID NO: 578901 - DNA, 25 bp, Rattus norvegicus
tcaggtccacacacagtgagcatcc

SEQ ID NO: 578902 - DNA, 25 bp, Rattus norvegicus
tcaggtccacactcagtgagcatcc

SEQ ID NO: 578903 - DNA, 25 bp, Rattus norvegicus
tcaggtccccagagcactaggaggg

SEQ ID NO: 578904 - DNA, 25 bp, Rattus norvegicus
tcaggtccccagtgcactaggaggg

SEQ ID NO: 578905 - DNA, 25 bp, Rattus norvegicus
tcaggtcctgcgcatcccagatggg

SEQ ID NO: 578906 - DNA, 25 bp, Rattus norvegicus
tcaggtcctgcggatcccagatggg

SEQ ID NO: 578907 - DNA, 25 bp, Rattus norvegicus
tcaggtcctggcagagttttgggat

SEQ ID NO: 578908 - DNA, 25 bp, Rattus norvegicus
tcaggtcctggctgagttttgggat

SEQ ID NO: 578909 - DNA, 25 bp, Rattus norvegicus
tcaggtcctggtcggcattgtcaaa

SEQ ID NO: 578910 - DNA, 25 bp, Rattus norvegicus
tcaggtcctggtgggcattgtcaaa

SEQ ID NO: 578911 - DNA, 25 bp, Rattus norvegicus
tcaggtcgggagctctcagctgtta

SEQ ID NO: 578912 - DNA, 25 bp, Rattus norvegicus
tcaggtcgggaggtctcagctgtta

SEQ ID NO: 578913 - DNA, 25 bp, Rattus norvegicus
tcaggtctacttccctagtgctgag

SEQ ID NO: 578914 - DNA, 25 bp, Rattus norvegicus
tcaggtctacttgcctagtgctgag

SEQ ID NO: 578915 - DNA, 25 bp, Rattus norvegicus
tcaggtctagcacgccacacagaat

SEQ ID NO: 578916 - DNA, 25 bp, Rattus norvegicus
tcaggtctagcaggccacacagaat

SEQ ID NO: 578917 - DNA, 25 bp, Rattus norvegicus
tcaggtctaggcagctgtgaccatt

SEQ ID NO: 578918 - DNA, 25 bp, Rattus norvegicus
tcaggtctaggctgctgtgaccatt

SEQ ID NO: 578919 - DNA, 25 bp, Rattus norvegicus
tcaggtctcatcatgagtctgaact

SEQ ID NO: 578920 - DNA, 25 bp, Rattus norvegicus
tcaggtctcatcttgagtctgaact

SEQ ID NO: 578921 - DNA, 25 bp, Rattus norvegicus
tcaggtctcctgacttaagcatatg

SEQ ID NO: 578922 - DNA, 25 bp, Rattus norvegicus
tcaggtctcctgtcttaagcatatg

SEQ ID NO: 578923 - DNA, 25 bp, Rattus norvegicus
tcaggtctgactacatatctcaaga

SEQ ID NO: 578924 - DNA, 25 bp, Rattus norvegicus
tcaggtctgacttcatatctcaaga

SEQ ID NO: 578925 - DNA, 25 bp, Rattus norvegicus
tcaggtctgctgaaagtttgtccat

SEQ ID NO: 578926 - DNA, 25 bp, Rattus norvegicus
tcaggtctgctgatcatgggagctg

SEQ ID NO: 578927 - DNA, 25 bp, Rattus norvegicus
tcaggtctgctgtaagtttgtccat

SEQ ID NO: 578928 - DNA, 25 bp, Rattus norvegicus
tcaggtctgctgttcatgggagctg

SEQ ID NO: 578929 - DNA, 25 bp, Rattus norvegicus
tcaggtcttactatgccatcttcga

SEQ ID NO: 578930 - DNA, 25 bp, Rattus norvegicus
tcaggtcttactttgccatcttcga

SEQ ID NO: 578931 - DNA, 25 bp, Rattus norvegicus
tcaggtcttgttacaggatgggtct

SEQ ID NO: 578932 - DNA, 25 bp, Rattus norvegicus
tcaggtcttgtttcaggatgggtct

SEQ ID NO: 578933 - DNA, 25 bp, Rattus norvegicus
tcaggtcttttccatcttcggtttc

SEQ ID NO: 578934 - DNA, 25 bp, Rattus norvegicus
tcaggtcttttcgatcttcggtttc

SEQ ID NO: 578935 - DNA, 25 bp, Rattus norvegicus
tcaggtgaacctcgtggcctctaga

SEQ ID NO: 578936 - DNA, 25 bp, Rattus norvegicus
tcaggtgaacctggtggcctctaga

SEQ ID NO: 578937 - DNA, 25 bp, Rattus norvegicus
tcaggtgaactcaagctacttaaac

SEQ ID NO: 578938 - DNA, 25 bp, Rattus norvegicus
tcaggtgaactctagctacttaaac

SEQ ID NO: 578939 - DNA, 25 bp, Rattus norvegicus
tcaggtgacatcaggccatgggcca

SEQ ID NO: 578940 - DNA, 25 bp, Rattus norvegicus
tcaggtgacatctggccatgggcca

SEQ ID NO: 578941 - DNA, 25 bp, Rattus norvegicus
tcaggtgacctgatgacattgtatt

SEQ ID NO: 578942 - DNA, 25 bp, Rattus norvegicus
tcaggtgacctgttgacattgtatt

SEQ ID NO: 578943 - DNA, 25 bp, Rattus norvegicus
tcaggtgactagatacttgggtata

SEQ ID NO: 578944 - DNA, 25 bp, Rattus norvegicus
tcaggtgactagttacttgggtata

SEQ ID NO: 578945 - DNA, 25 bp, Rattus norvegicus
tcaggtgacttgagggcttttgttt

SEQ ID NO: 578946 - DNA, 25 bp, Rattus norvegicus
tcaggtgacttgtgggcttttgttt

SEQ ID NO: 578947 - DNA, 25 bp, Rattus norvegicus
tcaggtgagacactgctccactgga

SEQ ID NO: 578948 - DNA, 25 bp, Rattus norvegicus
tcaggtgagacagtgctccactgga

SEQ ID NO: 578949 - DNA, 25 bp, Rattus norvegicus
tcaggtgagcctcctacatcagcag

SEQ ID NO: 578950 - DNA, 25 bp, Rattus norvegicus
tcaggtgagcctgctacatcagcag

SEQ ID NO: 578951 - DNA, 25 bp, Rattus norvegicus
tcaggtgataacctagcatccccag

SEQ ID NO: 578952 - DNA, 25 bp, Rattus norvegicus
tcaggtgataacgtagcatccccag

SEQ ID NO: 578953 - DNA, 25 bp, Rattus norvegicus
tcaggtgatcggctcttagagacat

SEQ ID NO: 578954 - DNA, 25 bp, Rattus norvegicus
tcaggtgatcgggtcttagagacat

SEQ ID NO: 578955 - DNA, 25 bp, Rattus norvegicus
tcaggtgcaatgctggactgtgtca

SEQ ID NO: 578956 - DNA, 25 bp, Rattus norvegicus
tcaggtgcaatggtggactgtgtca

SEQ ID NO: 578957 - DNA, 25 bp, Rattus norvegicus
tcaggtgccacgctgttgttgagat

SEQ ID NO: 578958 - DNA, 25 bp, Rattus norvegicus
tcaggtgccacggtgttgttgagat

SEQ ID NO: 578959 - DNA, 25 bp, Rattus norvegicus
tcaggtgcgtgcaggtgaccaccag

SEQ ID NO: 578960 - DNA, 25 bp, Rattus norvegicus
tcaggtgcgtgctggtgaccaccag

SEQ ID NO: 578961 - DNA, 25 bp, Rattus norvegicus
tcaggtgctaccagaggacttccgt

SEQ ID NO: 578962 - DNA, 25 bp, Rattus norvegicus
tcaggtgctacctgaggacttccgt

SEQ ID NO: 578963 - DNA, 25 bp, Rattus norvegicus
tcaggtgctataacccaagagccat

SEQ ID NO: 578964 - DNA, 25 bp, Rattus norvegicus
tcaggtgctatatcccaagagccat

SEQ ID NO: 578965 - DNA, 25 bp, Rattus norvegicus
tcaggtgctgtcactagccttgaag

SEQ ID NO: 578966 - DNA, 25 bp, Rattus norvegicus
tcaggtgctgtctctagccttgaag

SEQ ID NO: 578967 - DNA, 25 bp, Rattus norvegicus
tcaggtgcttttcatcctcttaaaa

SEQ ID NO: 578968 - DNA, 25 bp, Rattus norvegicus
tcaggtgcttttgatcctcttaaaa

SEQ ID NO: 578969 - DNA, 25 bp, Rattus norvegicus
tcaggtggagcgattcctctggtta

SEQ ID NO: 578970 - DNA, 25 bp, Rattus norvegicus
tcaggtggagcgtttcctctggtta

SEQ ID NO: 578971 - DNA, 25 bp, Rattus norvegicus
tcaggtggccaactgcccttgaagt

SEQ ID NO: 578972 - DNA, 25 bp, Rattus norvegicus
tcaggtggccaagtgcccttgaagt

SEQ ID NO: 578973 - DNA, 25 bp, Rattus norvegicus
tcaggtggctcactaatttctgcag

SEQ ID NO: 578974 - DNA, 25 bp, Rattus norvegicus
tcaggtggctcagtaatttctgcag

SEQ ID NO: 578975 - DNA, 25 bp, Rattus norvegicus
tcaggtggctgacagtcaccttgga

SEQ ID NO: 578976 - DNA, 25 bp, Rattus norvegicus
tcaggtggctgagagtcaccttgga

SEQ ID NO: 578977 - DNA, 25 bp, Rattus norvegicus
tcaggtgggaaaccttacctcctct

SEQ ID NO: 578978 - DNA, 25 bp, Rattus norvegicus
tcaggtgggaaagcttacctcctct

SEQ ID NO: 578979 - DNA, 25 bp, Rattus norvegicus
tcaggtgggccacctggtaagcaac

SEQ ID NO: 578980 - DNA, 25 bp, Rattus norvegicus
tcaggtgggccagctggtaagcaac

SEQ ID NO: 578981 - DNA, 25 bp, Rattus norvegicus
tcaggtggtagtcgcccacaccttt

SEQ ID NO: 578982 - DNA, 25 bp, Rattus norvegicus
tcaggtggtagtggcccacaccttt

SEQ ID NO: 578983 - DNA, 25 bp, Rattus norvegicus
tcaggtggtctgacctggagctgtc

SEQ ID NO: 578984 - DNA, 25 bp, Rattus norvegicus
tcaggtggtctgagctttcttctct

SEQ ID NO: 578985 - DNA, 25 bp, Rattus norvegicus
tcaggtggtctgtcctggagctgtc

SEQ ID NO: 578986 - DNA, 25 bp, Rattus norvegicus
tcaggtggtctgtgctttcttctct

SEQ ID NO: 578987 - DNA, 25 bp, Rattus norvegicus
tcaggtggtgctccaggcagccaac

SEQ ID NO: 578988 - DNA, 25 bp, Rattus norvegicus
tcaggtggtgctgcaggcagccaac

SEQ ID NO: 578989 - DNA, 25 bp, Rattus norvegicus
tcaggtgtagggagctcttgacttt

SEQ ID NO: 578990 - DNA, 25 bp, Rattus norvegicus
tcaggtgtagggtgctcttgacttt

SEQ ID NO: 578991 - DNA, 25 bp, Rattus norvegicus
tcaggtgtatgtcgctacagcctct

SEQ ID NO: 578992 - DNA, 25 bp, Rattus norvegicus
tcaggtgtatgtggctacagcctct

SEQ ID NO: 578993 - DNA, 25 bp, Rattus norvegicus
tcaggtgtccaaagtgttcttcttc

SEQ ID NO: 578994 - DNA, 25 bp, Rattus norvegicus
tcaggtgtccaatgtgttcttcttc

SEQ ID NO: 578995 - DNA, 25 bp, Rattus norvegicus
tcaggtgtccacagtctttgttaga

SEQ ID NO: 578996 - DNA, 25 bp, Rattus norvegicus
tcaggtgtccactgtctttgttaga

SEQ ID NO: 578997 - DNA, 25 bp, Rattus norvegicus
tcaggtgtcccaacaaatgttccag

SEQ ID NO: 578998 - DNA, 25 bp, Rattus norvegicus
tcaggtgtcccatcaaatgttccag

SEQ ID NO: 578999 - DNA, 25 bp, Rattus norvegicus
tcaggtgtccctcatcattaactat

SEQ ID NO: 579000 - DNA, 25 bp, Rattus norvegicus
tcaggtgtccctgatcattaactat

SEQ ID NO: 579001 - DNA, 25 bp, Rattus norvegicus
tcaggtgtcctgcttgcctacgaag

SEQ ID NO: 579002 - DNA, 25 bp, Rattus norvegicus
tcaggtgtcctggttgcctacgaag

SEQ ID NO: 579003 - DNA, 25 bp, Rattus norvegicus
tcaggtgtccttagcatctcttaaa

SEQ ID NO: 579004 - DNA, 25 bp, Rattus norvegicus
tcaggtgtcctttgcatctcttaaa

SEQ ID NO: 579005 - DNA, 25 bp, Rattus norvegicus
tcaggtgtctgtagctgtgccatgg

SEQ ID NO: 579006 - DNA, 25 bp, Rattus norvegicus
tcaggtgtctgttgctgtgccatgg

SEQ ID NO: 579007 - DNA, 25 bp, Rattus norvegicus
tcaggtgtgagcatccaatttggct

SEQ ID NO: 579008 - DNA, 25 bp, Rattus norvegicus
tcaggtgtgagcttccaatttggct

SEQ ID NO: 579009 - DNA, 25 bp, Rattus norvegicus
tcaggtgttcctaagaggtggctac

SEQ ID NO: 579010 - DNA, 25 bp, Rattus norvegicus
tcaggtgttccttagaggtggctac

SEQ ID NO: 579011 - DNA, 25 bp, Rattus norvegicus
tcaggtgttgttagtttgctctttt

SEQ ID NO: 579012 - DNA, 25 bp, Rattus norvegicus
tcaggtgttgtttgtttgctctttt

SEQ ID NO: 579013 - DNA, 25 bp, Rattus norvegicus
tcaggtgtttggcactggacccatc

SEQ ID NO: 579014 - DNA, 25 bp, Rattus norvegicus
tcaggtgtttgggactggacccatc

SEQ ID NO: 579015 - DNA, 25 bp, Rattus norvegicus
tcaggttaatggaccctgtccgttg

SEQ ID NO: 579016 - DNA, 25 bp, Rattus norvegicus
tcaggttaatggtccctgtccgttg

SEQ ID NO: 579017 - DNA, 25 bp, Rattus norvegicus
tcaggttatgttcactggtctggcc

SEQ ID NO: 579018 - DNA, 25 bp, Rattus norvegicus
tcaggttatgttgactggtctggcc

SEQ ID NO: 579019 - DNA, 25 bp, Rattus norvegicus
tcaggttattatacacactcagtta

SEQ ID NO: 579020 - DNA, 25 bp, Rattus norvegicus
tcaggttattattcacactcagtta

SEQ ID NO: 579021 - DNA, 25 bp, Rattus norvegicus
tcaggttcacagacccagcctgcta

SEQ ID NO: 579022 - DNA, 25 bp, Rattus norvegicus
tcaggttcacagtcccagcctgcta

SEQ ID NO: 579023 - DNA, 25 bp, Rattus norvegicus
tcaggttcaccaacctcacaaggaa

SEQ ID NO: 579024 - DNA, 25 bp, Rattus norvegicus
tcaggttcaccatcctcacaaggaa

SEQ ID NO: 579025 - DNA, 25 bp, Rattus norvegicus
tcaggttcctgtatataagcccctt

SEQ ID NO: 579026 - DNA, 25 bp, Rattus norvegicus
tcaggttcctgtttataagcccctt

SEQ ID NO: 579027 - DNA, 25 bp, Rattus norvegicus
tcaggttcgtgtatggctctggtaa

SEQ ID NO: 579028 - DNA, 25 bp, Rattus norvegicus
tcaggttcgtgtttggctctggtaa

SEQ ID NO: 579029 - DNA, 25 bp, Rattus norvegicus
tcaggttctattcagctcagtcttc

SEQ ID NO: 579030 - DNA, 25 bp, Rattus norvegicus
tcaggttctattgagctcagtcttc

SEQ ID NO: 579031 - DNA, 25 bp, Rattus norvegicus
tcaggttctcaccatttccatgaat

SEQ ID NO: 579032 - DNA, 25 bp, Rattus norvegicus
tcaggttctcacgatttccatgaat

SEQ ID NO: 579033 - DNA, 25 bp, Rattus norvegicus
tcaggttctccacctcagagttatt

SEQ ID NO: 579034 - DNA, 25 bp, Rattus norvegicus
tcaggttctccagctcagagttatt

SEQ ID NO: 579035 - DNA, 25 bp, Rattus norvegicus
tcaggttctgtaagcttctgggttt

SEQ ID NO: 579036 - DNA, 25 bp, Rattus norvegicus
tcaggttctgtatgcttctgggttt

SEQ ID NO: 579037 - DNA, 25 bp, Rattus norvegicus
tcaggttgccctcgccttttgcttg

SEQ ID NO: 579038 - DNA, 25 bp, Rattus norvegicus
tcaggttgccctggccttttgcttg

SEQ ID NO: 579039 - DNA, 25 bp, Rattus norvegicus
tcaggttgcctaatgttatgacaaa

SEQ ID NO: 579040 - DNA, 25 bp, Rattus norvegicus
tcaggttgcctattgttatgacaaa

SEQ ID NO: 579041 - DNA, 25 bp, Rattus norvegicus
tcaggttggaagctgcgtgcactca

SEQ ID NO: 579042 - DNA, 25 bp, Rattus norvegicus
tcaggttggaaggtgcgtgcactca

SEQ ID NO: 579043 - DNA, 25 bp, Rattus norvegicus
tcaggtttacccagccagagagcac

SEQ ID NO: 579044 - DNA, 25 bp, Rattus norvegicus
tcaggtttaccctgccagagagcac

SEQ ID NO: 579045 - DNA, 25 bp, Rattus norvegicus
tcaggtttccagagtccttgctgct

SEQ ID NO: 579046 - DNA, 25 bp, Rattus norvegicus
tcaggtttccagtgtccttgctgct

SEQ ID NO: 579047 - DNA, 25 bp, Rattus norvegicus
tcaggtttccttaactctcctattt

SEQ ID NO: 579048 - DNA, 25 bp, Rattus norvegicus
tcaggtttcctttactctcctattt

SEQ ID NO: 579049 - DNA, 25 bp, Rattus norvegicus
tcaggtttgaacatccttttgtcaa

SEQ ID NO: 579050 - DNA, 25 bp, Rattus norvegicus
tcaggtttgaacttccttttgtcaa

SEQ ID NO: 579051 - DNA, 25 bp, Rattus norvegicus
tcaggtttgcaaaggtccatcgact

SEQ ID NO: 579052 - DNA, 25 bp, Rattus norvegicus
tcaggtttgcaatggtccatcgact

SEQ ID NO: 579053 - DNA, 25 bp, Rattus norvegicus
tcaggtttgctgatctgactcccag

SEQ ID NO: 579054 - DNA, 25 bp, Rattus norvegicus
tcaggtttgctgttctgactcccag

SEQ ID NO: 579055 - DNA, 25 bp, Rattus norvegicus
tcaggtttggccactgtgcctggga

SEQ ID NO: 579056 - DNA, 25 bp, Rattus norvegicus
tcaggtttggcctctgtgcctggga

SEQ ID NO: 579057 - DNA, 25 bp, Rattus norvegicus
tcaggtttgtccctctgcccatagc

SEQ ID NO: 579058 - DNA, 25 bp, Rattus norvegicus
tcaggtttgtccgtctgcccatagc

SEQ ID NO: 579059 - DNA, 25 bp, Rattus norvegicus
tcaggttttatcaccccttttctgt

SEQ ID NO: 579060 - DNA, 25 bp, Rattus norvegicus
tcaggttttatctccccttttctgt

SEQ ID NO: 579061 - DNA, 25 bp, Rattus norvegicus
tcaggttttccaagtagatccccac

SEQ ID NO: 579062 - DNA, 25 bp, Rattus norvegicus
tcaggttttccatgtagatccccac

SEQ ID NO: 579063 - DNA, 25 bp, Rattus norvegicus
tcaggttttcctagagcggctcggg

SEQ ID NO: 579064 - DNA, 25 bp, Rattus norvegicus
tcaggttttccttgagcggctcggg

SEQ ID NO: 579065 - DNA, 25 bp, Rattus norvegicus
tcagtaaattgacctgcctgggtgt

SEQ ID NO: 579066 - DNA, 25 bp, Rattus norvegicus
tcagtaaattgagctgcctgggtgt

SEQ ID NO: 579067 - DNA, 25 bp, Rattus norvegicus
tcagtaacaagcctttgcctgccag

SEQ ID NO: 579068 - DNA, 25 bp, Rattus norvegicus
tcagtaacaagcgtttgcctgccag

SEQ ID NO: 579069 - DNA, 25 bp, Rattus norvegicus
tcagtaaccgagcatccaaggccct

SEQ ID NO: 579070 - DNA, 25 bp, Rattus norvegicus
tcagtaaccgaggatccaaggccct

SEQ ID NO: 579071 - DNA, 25 bp, Rattus norvegicus
tcagtaagacgtccctggaaaccat

SEQ ID NO: 579072 - DNA, 25 bp, Rattus norvegicus
tcagtaagacgtgcctggaaaccat

SEQ ID NO: 579073 - DNA, 25 bp, Rattus norvegicus
tcagtaagccccagtacttatcaga

SEQ ID NO: 579074 - DNA, 25 bp, Rattus norvegicus
tcagtaagcccctgtacttatcaga

SEQ ID NO: 579075 - DNA, 25 bp, Rattus norvegicus
tcagtaagcctgagaaagtctacat

SEQ ID NO: 579076 - DNA, 25 bp, Rattus norvegicus
tcagtaagcctgtgaaagtctacat

SEQ ID NO: 579077 - DNA, 25 bp, Rattus norvegicus
tcagtaagtcatacccgttcctgta

SEQ ID NO: 579078 - DNA, 25 bp, Rattus norvegicus
tcagtaagtcattcccgttcctgta

SEQ ID NO: 579079 - DNA, 25 bp, Rattus norvegicus
tcagtaattggcagtctgtctctct

SEQ ID NO: 579080 - DNA, 25 bp, Rattus norvegicus
tcagtaattggctgtctgtctctct

SEQ ID NO: 579081 - DNA, 25 bp, Rattus norvegicus
tcagtacaccccaaagtgtgtcttt

SEQ ID NO: 579082 - DNA, 25 bp, Rattus norvegicus
tcagtacacccctaagtgtgtcttt

SEQ ID NO: 579083 - DNA, 25 bp, Rattus norvegicus
tcagtacattcaaggcgacggcggg

SEQ ID NO: 579084 - DNA, 25 bp, Rattus norvegicus
tcagtacattcatggcgacggcggg

SEQ ID NO: 579085 - DNA, 25 bp, Rattus norvegicus
tcagtaccagagacgcctctttata

SEQ ID NO: 579086 - DNA, 25 bp, Rattus norvegicus
tcagtaccagagtcgcctctttata

SEQ ID NO: 579087 - DNA, 25 bp, Rattus norvegicus
tcagtaccaggaagagggctgctct

SEQ ID NO: 579088 - DNA, 25 bp, Rattus norvegicus
tcagtaccaggatgagggctgctct

SEQ ID NO: 579089 - DNA, 25 bp, Rattus norvegicus
tcagtacctccaataaagtgttttc

SEQ ID NO: 579090 - DNA, 25 bp, Rattus norvegicus
tcagtacctccattaaagtgttttc

SEQ ID NO: 579091 - DNA, 25 bp, Rattus norvegicus
tcagtacctcgtacctttgtagaga

SEQ ID NO: 579092 - DNA, 25 bp, Rattus norvegicus
tcagtacctcgttcctttgtagaga

SEQ ID NO: 579093 - DNA, 25 bp, Rattus norvegicus
tcagtacgtataagtgtccggcaca

SEQ ID NO: 579094 - DNA, 25 bp, Rattus norvegicus
tcagtacgtatatgtgtccggcaca

SEQ ID NO: 579095 - DNA, 25 bp, Rattus norvegicus
tcagtacgtggtccctcagacaaga

SEQ ID NO: 579096 - DNA, 25 bp, Rattus norvegicus
tcagtacgtggtgcctcagacaaga

SEQ ID NO: 579097 - DNA, 25 bp, Rattus norvegicus
tcagtactcagcacatacctggatt

SEQ ID NO: 579098 - DNA, 25 bp, Rattus norvegicus
tcagtactcagctcatacctggatt

SEQ ID NO: 579099 - DNA, 25 bp, Rattus norvegicus
tcagtactgaggatcatctgcctgt

SEQ ID NO: 579100 - DNA, 25 bp, Rattus norvegicus
tcagtactgaggttcatctgcctgt

SEQ ID NO: 579101 - DNA, 25 bp, Rattus norvegicus
tcagtagacgtcacctttcaggatg

SEQ ID NO: 579102 - DNA, 25 bp, Rattus norvegicus
tcagtagacgtctcctttcaggatg

SEQ ID NO: 579103 - DNA, 25 bp, Rattus norvegicus
tcagtagatccccagcagtcctgaa

SEQ ID NO: 579104 - DNA, 25 bp, Rattus norvegicus
tcagtagatcccgagcagtcctgaa

SEQ ID NO: 579105 - DNA, 25 bp, Rattus norvegicus
tcagtagcagatccctgaggacctt

SEQ ID NO: 579106 - DNA, 25 bp, Rattus norvegicus
tcagtagcagatgcctgaggacctt

SEQ ID NO: 579107 - DNA, 25 bp, Rattus norvegicus
tcagtagcagtgactcctcggagtt

SEQ ID NO: 579108 - DNA, 25 bp, Rattus norvegicus
tcagtagcagtgtctcctcggagtt

SEQ ID NO: 579109 - DNA, 25 bp, Rattus norvegicus
tcagtagccaacagcttcaggagct

SEQ ID NO: 579110 - DNA, 25 bp, Rattus norvegicus
tcagtagccaactgcttcaggagct

SEQ ID NO: 579111 - DNA, 25 bp, Rattus norvegicus
tcagtagcccagatggtgggccaat

SEQ ID NO: 579112 - DNA, 25 bp, Rattus norvegicus
tcagtagcccagttggtgggccaat

SEQ ID NO: 579113 - DNA, 25 bp, Rattus norvegicus
tcagtagctcataaaccattgcaga

SEQ ID NO: 579114 - DNA, 25 bp, Rattus norvegicus
tcagtagctcattaaccattgcaga

SEQ ID NO: 579115 - DNA, 25 bp, Rattus norvegicus
tcagtaggaaagaccctgcccattg

SEQ ID NO: 579116 - DNA, 25 bp, Rattus norvegicus
tcagtaggaaagtccctgcccattg

SEQ ID NO: 579117 - DNA, 25 bp, Rattus norvegicus
tcagtagggtgcctttggaccagca

SEQ ID NO: 579118 - DNA, 25 bp, Rattus norvegicus
tcagtagggtgcgtttggaccagca

SEQ ID NO: 579119 - DNA, 25 bp, Rattus norvegicus
tcagtaggtaggcagtgtctccatt

SEQ ID NO: 579120 - DNA, 25 bp, Rattus norvegicus
tcagtaggtagggagtgtctccatt

SEQ ID NO: 579121 - DNA, 25 bp, Rattus norvegicus
tcagtaggtccgagagcttccaggc

SEQ ID NO: 579122 - DNA, 25 bp, Rattus norvegicus
tcagtaggtccgtgagcttccaggc

SEQ ID NO: 579123 - DNA, 25 bp, Rattus norvegicus
tcagtaggtttccactgttttccct

SEQ ID NO: 579124 - DNA, 25 bp, Rattus norvegicus
tcagtaggtttcgactgttttccct

SEQ ID NO: 579125 - DNA, 25 bp, Rattus norvegicus
tcagtagtggacaagagttcccaaa

SEQ ID NO: 579126 - DNA, 25 bp, Rattus norvegicus
tcagtagtggactagagttcccaaa

SEQ ID NO: 579127 - DNA, 25 bp, Rattus norvegicus
tcagtagttcaacgctgttcttgga

SEQ ID NO: 579128 - DNA, 25 bp, Rattus norvegicus
tcagtagttcaaggctgttcttgga

SEQ ID NO: 579129 - DNA, 25 bp, Rattus norvegicus
tcagtataaaatctttatatgtccc

SEQ ID NO: 579130 - DNA, 25 bp, Rattus norvegicus
tcagtataaaatgtttatatgtccc

SEQ ID NO: 579131 - DNA, 25 bp, Rattus norvegicus
tcagtatacttaatttctgggttat

SEQ ID NO: 579132 - DNA, 25 bp, Rattus norvegicus
tcagtatacttattttctgggttat

SEQ ID NO: 579133 - DNA, 25 bp, Rattus norvegicus
tcagtatctctgagttgaggccagc

SEQ ID NO: 579134 - DNA, 25 bp, Rattus norvegicus
tcagtatctctgtgttgaggccagc

SEQ ID NO: 579135 - DNA, 25 bp, Rattus norvegicus
tcagtatctgccctctgtgtttaca

SEQ ID NO: 579136 - DNA, 25 bp, Rattus norvegicus
tcagtatctgccgtctgtgtttaca

SEQ ID NO: 579137 - DNA, 25 bp, Rattus norvegicus
tcagtatgatggctctatagtcgtc

SEQ ID NO: 579138 - DNA, 25 bp, Rattus norvegicus
tcagtatgatgggtctatagtcgtc

SEQ ID NO: 579139 - DNA, 25 bp, Rattus norvegicus
tcagtatgcactattcaatttccag

SEQ ID NO: 579140 - DNA, 25 bp, Rattus norvegicus
tcagtatgcacttttcaatttccag

SEQ ID NO: 579141 - DNA, 25 bp, Rattus norvegicus
tcagtatgccctacagtatgctggg

SEQ ID NO: 579142 - DNA, 25 bp, Rattus norvegicus
tcagtatgcccttcagtatgctggg

SEQ ID NO: 579143 - DNA, 25 bp, Rattus norvegicus
tcagtatgctcccagtgatatgccg

SEQ ID NO: 579144 - DNA, 25 bp, Rattus norvegicus
tcagtatgctccgagtgatatgccg

SEQ ID NO: 579145 - DNA, 25 bp, Rattus norvegicus
tcagtatgtctgataatgtgcgatt

SEQ ID NO: 579146 - DNA, 25 bp, Rattus norvegicus
tcagtatgtctgttaatgtgcgatt

SEQ ID NO: 579147 - DNA, 25 bp, Rattus norvegicus
tcagtattactgagcctcggtttcc

SEQ ID NO: 579148 - DNA, 25 bp, Rattus norvegicus
tcagtattactgtgcctcggtttcc

SEQ ID NO: 579149 - DNA, 25 bp, Rattus norvegicus
tcagtattgcccacttctgcaaatg

SEQ ID NO: 579150 - DNA, 25 bp, Rattus norvegicus
tcagtattgccctcttctgcaaatg

SEQ ID NO: 579151 - DNA, 25 bp, Rattus norvegicus
tcagtattgtagctttcgtccgcat

SEQ ID NO: 579152 - DNA, 25 bp, Rattus norvegicus
tcagtattgtaggtttcgtccgcat

SEQ ID NO: 579153 - DNA, 25 bp, Rattus norvegicus
tcagtatttcagaggcctccaggca

SEQ ID NO: 579154 - DNA, 25 bp, Rattus norvegicus
tcagtatttcagtggcctccaggca

SEQ ID NO: 579155 - DNA, 25 bp, Rattus norvegicus
tcagtatttttgagtttttgtagcc

SEQ ID NO: 579156 - DNA, 25 bp, Rattus norvegicus
tcagtatttttgtgtttttgtagcc

SEQ ID NO: 579157 - DNA, 25 bp, Rattus norvegicus
tcagtcaaaaagactgttgcacatg

SEQ ID NO: 579158 - DNA, 25 bp, Rattus norvegicus
tcagtcaaaaagtctgttgcacatg

SEQ ID NO: 579159 - DNA, 25 bp, Rattus norvegicus
tcagtcaacacaaactcccttttaa

SEQ ID NO: 579160 - DNA, 25 bp, Rattus norvegicus
tcagtcaacacatactcccttttaa

SEQ ID NO: 579161 - DNA, 25 bp, Rattus norvegicus
tcagtcaaccctaaccgcattgaag

SEQ ID NO: 579162 - DNA, 25 bp, Rattus norvegicus
tcagtcaacccttaccgcattgaag

SEQ ID NO: 579163 - DNA, 25 bp, Rattus norvegicus
tcagtcaaccggcactcaagatgga

SEQ ID NO: 579164 - DNA, 25 bp, Rattus norvegicus
tcagtcaaccgggactcaagatgga

SEQ ID NO: 579165 - DNA, 25 bp, Rattus norvegicus
tcagtcaatccccatcgcagatgga

SEQ ID NO: 579166 - DNA, 25 bp, Rattus norvegicus
tcagtcaatcccgatcgcagatgga

SEQ ID NO: 579167 - DNA, 25 bp, Rattus norvegicus
tcagtcacagacaatcctcgggcat

SEQ ID NO: 579168 - DNA, 25 bp, Rattus norvegicus
tcagtcacagacatagcagctctta

SEQ ID NO: 579169 - DNA, 25 bp, Rattus norvegicus
tcagtcacagactatcctcgggcat

SEQ ID NO: 579170 - DNA, 25 bp, Rattus norvegicus
tcagtcacagacttagcagctctta

SEQ ID NO: 579171 - DNA, 25 bp, Rattus norvegicus
tcagtcaccactactttctacagat

SEQ ID NO: 579172 - DNA, 25 bp, Rattus norvegicus
tcagtcaccacttctttctacagat

SEQ ID NO: 579173 - DNA, 25 bp, Rattus norvegicus
tcagtcaccgtcagtggttccagca

SEQ ID NO: 579174 - DNA, 25 bp, Rattus norvegicus
tcagtcaccgtctgtggttccagca

SEQ ID NO: 579175 - DNA, 25 bp, Rattus norvegicus
tcagtcacctccatcatatagccag

SEQ ID NO: 579176 - DNA, 25 bp, Rattus norvegicus
tcagtcacctccttcatatagccag

SEQ ID NO: 579177 - DNA, 25 bp, Rattus norvegicus
tcagtcacggaacgttaccccatgt

SEQ ID NO: 579178 - DNA, 25 bp, Rattus norvegicus
tcagtcacggaaggttaccccatgt

SEQ ID NO: 579179 - DNA, 25 bp, Rattus norvegicus
tcagtcactcaccttattgcaggag

SEQ ID NO: 579180 - DNA, 25 bp, Rattus norvegicus
tcagtcactcacgttattgcaggag

SEQ ID NO: 579181 - DNA, 25 bp, Rattus norvegicus
tcagtcactcttcttgggttgtgtt

SEQ ID NO: 579182 - DNA, 25 bp, Rattus norvegicus
tcagtcactcttgttgggttgtgtt

SEQ ID NO: 579183 - DNA, 25 bp, Rattus norvegicus
tcagtcactgggacgttttttaagt

SEQ ID NO: 579184 - DNA, 25 bp, Rattus norvegicus
tcagtcactgggtcgttttttaagt

SEQ ID NO: 579185 - DNA, 25 bp, Rattus norvegicus
tcagtcagagataatgcagccacaa

SEQ ID NO: 579186 - DNA, 25 bp, Rattus norvegicus
tcagtcagagattatgcagccacaa

SEQ ID NO: 579187 - DNA, 25 bp, Rattus norvegicus
tcagtcagcgaccttttaatctccc

SEQ ID NO: 579188 - DNA, 25 bp, Rattus norvegicus
tcagtcagcgacgttttaatctccc

SEQ ID NO: 579189 - DNA, 25 bp, Rattus norvegicus
tcagtcaggccaatcactttgcaaa

SEQ ID NO: 579190 - DNA, 25 bp, Rattus norvegicus
tcagtcaggccattcactttgcaaa

SEQ ID NO: 579191 - DNA, 25 bp, Rattus norvegicus
tcagtcaggtgtcggtctgtgttct

SEQ ID NO: 579192 - DNA, 25 bp, Rattus norvegicus
tcagtcaggtgtgggtctgtgttct

SEQ ID NO: 579193 - DNA, 25 bp, Rattus norvegicus
tcagtcagtgcgatgaccctagcaa

SEQ ID NO: 579194 - DNA, 25 bp, Rattus norvegicus
tcagtcagtgcgttgaccctagcaa

SEQ ID NO: 579195 - DNA, 25 bp, Rattus norvegicus
tcagtcatctgacattgcctggcag

SEQ ID NO: 579196 - DNA, 25 bp, Rattus norvegicus
tcagtcatctgagattgcctggcag

SEQ ID NO: 579197 - DNA, 25 bp, Rattus norvegicus
tcagtcatgcatacgtgtctggaat

SEQ ID NO: 579198 - DNA, 25 bp, Rattus norvegicus
tcagtcatgcattcgtgtctggaat

SEQ ID NO: 579199 - DNA, 25 bp, Rattus norvegicus
tcagtcatttctcctatagctggaa

SEQ ID NO: 579200 - DNA, 25 bp, Rattus norvegicus
tcagtcatttctgctatagctggaa

SEQ ID NO: 579201 - DNA, 25 bp, Rattus norvegicus
tcagtccaagccacaacacttatat

SEQ ID NO: 579202 - DNA, 25 bp, Rattus norvegicus
tcagtccaagcctcaacacttatat

SEQ ID NO: 579203 - DNA, 25 bp, Rattus norvegicus
tcagtccacagacggcatcctggtt

SEQ ID NO: 579204 - DNA, 25 bp, Rattus norvegicus
tcagtccacagagggcatcctggtt

SEQ ID NO: 579205 - DNA, 25 bp, Rattus norvegicus
tcagtccacatcattctttaagaga

SEQ ID NO: 579206 - DNA, 25 bp, Rattus norvegicus
tcagtccacatctttctttaagaga

SEQ ID NO: 579207 - DNA, 25 bp, Rattus norvegicus
tcagtccagagcctgacctgatggg

SEQ ID NO: 579208 - DNA, 25 bp, Rattus norvegicus
tcagtccagagcgtgacctgatggg

SEQ ID NO: 579209 - DNA, 25 bp, Rattus norvegicus
tcagtccatgctcgctccctgaaga

SEQ ID NO: 579210 - DNA, 25 bp, Rattus norvegicus
tcagtccatgctggctccctgaaga

SEQ ID NO: 579211 - DNA, 25 bp, Rattus norvegicus
tcagtccattccattcccaaaatat

SEQ ID NO: 579212 - DNA, 25 bp, Rattus norvegicus
tcagtccattcctttcccaaaatat

SEQ ID NO: 579213 - DNA, 25 bp, Rattus norvegicus
tcagtcccatcactccaaggagaga

SEQ ID NO: 579214 - DNA, 25 bp, Rattus norvegicus
tcagtcccatcagtccaaggagaga

SEQ ID NO: 579215 - DNA, 25 bp, Rattus norvegicus
tcagtccccaatccagacattgttt

SEQ ID NO: 579216 - DNA, 25 bp, Rattus norvegicus
tcagtccccaatgcagacattgttt

SEQ ID NO: 579217 - DNA, 25 bp, Rattus norvegicus
tcagtccccacactcattattattg

SEQ ID NO: 579218 - DNA, 25 bp, Rattus norvegicus
tcagtccccacagtcattattattg

SEQ ID NO: 579219 - DNA, 25 bp, Rattus norvegicus
tcagtccccaggcttattggatcaa

SEQ ID NO: 579220 - DNA, 25 bp, Rattus norvegicus
tcagtccccagggttattggatcaa

SEQ ID NO: 579221 - DNA, 25 bp, Rattus norvegicus
tcagtccccatccatgcttagtggc

SEQ ID NO: 579222 - DNA, 25 bp, Rattus norvegicus
tcagtccccatcgatgcttagtggc

SEQ ID NO: 579223 - DNA, 25 bp, Rattus norvegicus
tcagtccccatgctttttgtctttt

SEQ ID NO: 579224 - DNA, 25 bp, Rattus norvegicus
tcagtccccatggtttttgtctttt

SEQ ID NO: 579225 - DNA, 25 bp, Rattus norvegicus
tcagtccctaggatggtccgacgcc

SEQ ID NO: 579226 - DNA, 25 bp, Rattus norvegicus
tcagtccctaggttggtccgacgcc

SEQ ID NO: 579227 - DNA, 25 bp, Rattus norvegicus
tcagtccctgccaaagcactaaaat

SEQ ID NO: 579228 - DNA, 25 bp, Rattus norvegicus
tcagtccctgcctaagcactaaaat

SEQ ID NO: 579229 - DNA, 25 bp, Rattus norvegicus
tcagtccctggcagtgtgaaatcca

SEQ ID NO: 579230 - DNA, 25 bp, Rattus norvegicus
tcagtccctggctgtgtgaaatcca

SEQ ID NO: 579231 - DNA, 25 bp, Rattus norvegicus
tcagtcctcagaacttgcctagcat

SEQ ID NO: 579232 - DNA, 25 bp, Rattus norvegicus
tcagtcctcagatcttgcctagcat

SEQ ID NO: 579233 - DNA, 25 bp, Rattus norvegicus
tcagtcctcagcattttctgttcag

SEQ ID NO: 579234 - DNA, 25 bp, Rattus norvegicus
tcagtcctcagctttttctgttcag

SEQ ID NO: 579235 - DNA, 25 bp, Rattus norvegicus
tcagtcctcagtcgcacgggaaaca

SEQ ID NO: 579236 - DNA, 25 bp, Rattus norvegicus
tcagtcctcagtggcacgggaaaca

SEQ ID NO: 579237 - DNA, 25 bp, Rattus norvegicus
tcagtcctcatcagtagtgttgttg

SEQ ID NO: 579238 - DNA, 25 bp, Rattus norvegicus
tcagtcctcatctgtagtgttgttg

SEQ ID NO: 579239 - DNA, 25 bp, Rattus norvegicus
tcagtcctgtgaagcttatccccaa

SEQ ID NO: 579240 - DNA, 25 bp, Rattus norvegicus
tcagtcctgtgatgcttatccccaa

SEQ ID NO: 579241 - DNA, 25 bp, Rattus norvegicus
tcagtccttcatcgcccttagtagg

SEQ ID NO: 579242 - DNA, 25 bp, Rattus norvegicus
tcagtccttcatggcccttagtagg

SEQ ID NO: 579243 - DNA, 25 bp, Rattus norvegicus
tcagtccttcttctgcatcaagatt

SEQ ID NO: 579244 - DNA, 25 bp, Rattus norvegicus
tcagtccttcttgtgcatcaagatt

SEQ ID NO: 579245 - DNA, 25 bp, Rattus norvegicus
tcagtccttgtgaactagagcctta

SEQ ID NO: 579246 - DNA, 25 bp, Rattus norvegicus
tcagtccttgtgtactagagcctta

SEQ ID NO: 579247 - DNA, 25 bp, Rattus norvegicus
tcagtcctttgaacacatccagaac

SEQ ID NO: 579248 - DNA, 25 bp, Rattus norvegicus
tcagtcctttgatcacatccagaac

SEQ ID NO: 579249 - DNA, 25 bp, Rattus norvegicus
tcagtcgcaccacagtcaagaacat

SEQ ID NO: 579250 - DNA, 25 bp, Rattus norvegicus
tcagtcgcaccagagtcaagaacat

SEQ ID NO: 579251 - DNA, 25 bp, Rattus norvegicus
tcagtcgcttctcagtgttttgtga

SEQ ID NO: 579252 - DNA, 25 bp, Rattus norvegicus
tcagtcgcttctgagtgttttgtga

SEQ ID NO: 579253 - DNA, 25 bp, Rattus norvegicus
tcagtcggaatgccgctcagcagat

SEQ ID NO: 579254 - DNA, 25 bp, Rattus norvegicus
tcagtcggaatggcgctcagcagat

SEQ ID NO: 579255 - DNA, 25 bp, Rattus norvegicus
tcagtcggactcaccgccatcgctg

SEQ ID NO: 579256 - DNA, 25 bp, Rattus norvegicus
tcagtcggactctccgccatcgctg

SEQ ID NO: 579257 - DNA, 25 bp, Rattus norvegicus
tcagtctacctgatgatgccttgga

SEQ ID NO: 579258 - DNA, 25 bp, Rattus norvegicus
tcagtctacctgttgatgccttgga

SEQ ID NO: 579259 - DNA, 25 bp, Rattus norvegicus
tcagtctaccttcgagcaggtcttc

SEQ ID NO: 579260 - DNA, 25 bp, Rattus norvegicus
tcagtctaccttggagcaggtcttc

SEQ ID NO: 579261 - DNA, 25 bp, Rattus norvegicus
tcagtctagcttcactttgatgtgc

SEQ ID NO: 579262 - DNA, 25 bp, Rattus norvegicus
tcagtctagcttgactttgatgtgc

SEQ ID NO: 579263 - DNA, 25 bp, Rattus norvegicus
tcagtctatcctcgcgccagagaag

SEQ ID NO: 579264 - DNA, 25 bp, Rattus norvegicus
tcagtctatcctggcgccagagaag

SEQ ID NO: 579265 - DNA, 25 bp, Rattus norvegicus
tcagtctcacacctgctttatagaa

SEQ ID NO: 579266 - DNA, 25 bp, Rattus norvegicus
tcagtctcacacgtgctttatagaa

SEQ ID NO: 579267 - DNA, 25 bp, Rattus norvegicus
tcagtctcagttctcctcatgtagc

SEQ ID NO: 579268 - DNA, 25 bp, Rattus norvegicus
tcagtctcagttgtcctcatgtagc

SEQ ID NO: 579269 - DNA, 25 bp, Rattus norvegicus
tcagtctcatccatgtctgtgaaga

SEQ ID NO: 579270 - DNA, 25 bp, Rattus norvegicus
tcagtctcatccttgtctgtgaaga

SEQ ID NO: 579271 - DNA, 25 bp, Rattus norvegicus
tcagtctccccacctgtaaagtggg

SEQ ID NO: 579272 - DNA, 25 bp, Rattus norvegicus
tcagtctccccagctgtaaagtggg

SEQ ID NO: 579273 - DNA, 25 bp, Rattus norvegicus
tcagtctccctaactgagcaatggg

SEQ ID NO: 579274 - DNA, 25 bp, Rattus norvegicus
tcagtctccctatctgagcaatggg

SEQ ID NO: 579275 - DNA, 25 bp, Rattus norvegicus
tcagtctccggtaccaaaggcagaa

SEQ ID NO: 579276 - DNA, 25 bp, Rattus norvegicus
tcagtctccggttccaaaggcagaa

SEQ ID NO: 579277 - DNA, 25 bp, Rattus norvegicus
tcagtctcctcacgtaggctgtgcc

SEQ ID NO: 579278 - DNA, 25 bp, Rattus norvegicus
tcagtctcctcaggtaggctgtgcc

SEQ ID NO: 579279 - DNA, 25 bp, Rattus norvegicus
tcagtctcctgcactgttagggtgt

SEQ ID NO: 579280 - DNA, 25 bp, Rattus norvegicus
tcagtctcctgctctgttagggtgt

SEQ ID NO: 579281 - DNA, 25 bp, Rattus norvegicus
tcagtctcctggctgtctacaaaac

SEQ ID NO: 579282 - DNA, 25 bp, Rattus norvegicus
tcagtctcctgggtgtctacaaaac

SEQ ID NO: 579283 - DNA, 25 bp, Rattus norvegicus
tcagtctccttgatggttagctcat

SEQ ID NO: 579284 - DNA, 25 bp, Rattus norvegicus
tcagtctccttgttggttagctcat

SEQ ID NO: 579285 - DNA, 25 bp, Rattus norvegicus
tcagtctcgctcagggaggaaggct

SEQ ID NO: 579286 - DNA, 25 bp, Rattus norvegicus
tcagtctcgctctgggaggaaggct

SEQ ID NO: 579287 - DNA, 25 bp, Rattus norvegicus
tcagtctctaaaacgtgcagctccc

SEQ ID NO: 579288 - DNA, 25 bp, Rattus norvegicus
tcagtctctaaactgaccctggcta

SEQ ID NO: 579289 - DNA, 25 bp, Rattus norvegicus
tcagtctctaaagtgaccctggcta

SEQ ID NO: 579290 - DNA, 25 bp, Rattus norvegicus
tcagtctctaaatcgtgcagctccc

SEQ ID NO: 579291 - DNA, 25 bp, Rattus norvegicus
tcagtctctcagagcctgtgctgac

SEQ ID NO: 579292 - DNA, 25 bp, Rattus norvegicus
tcagtctctcagtgcctgtgctgac

SEQ ID NO: 579293 - DNA, 25 bp, Rattus norvegicus
tcagtctctgctcacaagtcaggag

SEQ ID NO: 579294 - DNA, 25 bp, Rattus norvegicus
tcagtctctgctgacaagtcaggag

SEQ ID NO: 579295 - DNA, 25 bp, Rattus norvegicus
tcagtctgagccatcagagcagctt

SEQ ID NO: 579296 - DNA, 25 bp, Rattus norvegicus
tcagtctgagccttcagagcagctt

SEQ ID NO: 579297 - DNA, 25 bp, Rattus norvegicus
tcagtctgcttgaagcccttaaaga

SEQ ID NO: 579298 - DNA, 25 bp, Rattus norvegicus
tcagtctgcttgtagcccttaaaga

SEQ ID NO: 579299 - DNA, 25 bp, Rattus norvegicus
tcagtctggcgcctgggtttgttcc

SEQ ID NO: 579300 - DNA, 25 bp, Rattus norvegicus
tcagtctggcgcgtgggtttgttcc

SEQ ID NO: 579301 - DNA, 25 bp, Rattus norvegicus
tcagtctgggctatatgtttgctaa

SEQ ID NO: 579302 - DNA, 25 bp, Rattus norvegicus
tcagtctgggctttatgtttgctaa

SEQ ID NO: 579303 - DNA, 25 bp, Rattus norvegicus
tcagtctgtattcaaggatgccctt

SEQ ID NO: 579304 - DNA, 25 bp, Rattus norvegicus
tcagtctgtattgaaggatgccctt

SEQ ID NO: 579305 - DNA, 25 bp, Rattus norvegicus
tcagtctgtcgtccaccgatgagaa

SEQ ID NO: 579306 - DNA, 25 bp, Rattus norvegicus
tcagtctgtcgtgcaccgatgagaa

SEQ ID NO: 579307 - DNA, 25 bp, Rattus norvegicus
tcagtcttaaaaatgcttgcagcca

SEQ ID NO: 579308 - DNA, 25 bp, Rattus norvegicus
tcagtcttaaaattgcttgcagcca

SEQ ID NO: 579309 - DNA, 25 bp, Rattus norvegicus
tcagtcttaggactttccgatcctt

SEQ ID NO: 579310 - DNA, 25 bp, Rattus norvegicus
tcagtcttaggagtttccgatcctt

SEQ ID NO: 579311 - DNA, 25 bp, Rattus norvegicus
tcagtcttccacaatgaaccccgtt

SEQ ID NO: 579312 - DNA, 25 bp, Rattus norvegicus
tcagtcttccactatgaaccccgtt

SEQ ID NO: 579313 - DNA, 25 bp, Rattus norvegicus
tcagtcttccccattatttatatag

SEQ ID NO: 579314 - DNA, 25 bp, Rattus norvegicus
tcagtcttcccctttatttatatag

SEQ ID NO: 579315 - DNA, 25 bp, Rattus norvegicus
tcagtcttcctcactgccctagtga

SEQ ID NO: 579316 - DNA, 25 bp, Rattus norvegicus
tcagtcttcctcaggtccagtattt

SEQ ID NO: 579317 - DNA, 25 bp, Rattus norvegicus
tcagtcttcctctctgccctagtga

SEQ ID NO: 579318 - DNA, 25 bp, Rattus norvegicus
tcagtcttcctctggtccagtattt

SEQ ID NO: 579319 - DNA, 25 bp, Rattus norvegicus
tcagtcttgattctgttcagccaat

SEQ ID NO: 579320 - DNA, 25 bp, Rattus norvegicus
tcagtcttgattgtgttcagccaat

SEQ ID NO: 579321 - DNA, 25 bp, Rattus norvegicus
tcagtcttgcagctccgtttaaaga

SEQ ID NO: 579322 - DNA, 25 bp, Rattus norvegicus
tcagtcttgcaggtccgtttaaaga

SEQ ID NO: 579323 - DNA, 25 bp, Rattus norvegicus
tcagtctttgccctcaaggtttcaa

SEQ ID NO: 579324 - DNA, 25 bp, Rattus norvegicus
tcagtctttgccgtcaaggtttcaa

SEQ ID NO: 579325 - DNA, 25 bp, Rattus norvegicus
tcagtgaaactgctggtgcgctaca

SEQ ID NO: 579326 - DNA, 25 bp, Rattus norvegicus
tcagtgaaactggtggtgcgctaca

SEQ ID NO: 579327 - DNA, 25 bp, Rattus norvegicus
tcagtgaacagtcccagcgcatcgt

SEQ ID NO: 579328 - DNA, 25 bp, Rattus norvegicus
tcagtgaacagtgccagcgcatcgt

SEQ ID NO: 579329 - DNA, 25 bp, Rattus norvegicus
tcagtgaacctcattgcgattattt

SEQ ID NO: 579330 - DNA, 25 bp, Rattus norvegicus
tcagtgaacctctttgcgattattt

SEQ ID NO: 579331 - DNA, 25 bp, Rattus norvegicus
tcagtgaatcatctcccaggtctag

SEQ ID NO: 579332 - DNA, 25 bp, Rattus norvegicus
tcagtgaatcatgtcccaggtctag

SEQ ID NO: 579333 - DNA, 25 bp, Rattus norvegicus
tcagtgaatctgatgagctaataac

SEQ ID NO: 579334 - DNA, 25 bp, Rattus norvegicus
tcagtgaatctgttgagctaataac

SEQ ID NO: 579335 - DNA, 25 bp, Rattus norvegicus
tcagtgaattccaaacatgtgtgtg

SEQ ID NO: 579336 - DNA, 25 bp, Rattus norvegicus
tcagtgaattcctaacatgtgtgtg

SEQ ID NO: 579337 - DNA, 25 bp, Rattus norvegicus
tcagtgaccacactttgagcccagg

SEQ ID NO: 579338 - DNA, 25 bp, Rattus norvegicus
tcagtgaccacagtttgagcccagg

SEQ ID NO: 579339 - DNA, 25 bp, Rattus norvegicus
tcagtgaccaggatggctccccaga

SEQ ID NO: 579340 - DNA, 25 bp, Rattus norvegicus
tcagtgaccaggttggctccccaga

SEQ ID NO: 579341 - DNA, 25 bp, Rattus norvegicus
tcagtgaccggaagtctcgacctaa

SEQ ID NO: 579342 - DNA, 25 bp, Rattus norvegicus
tcagtgaccggatgtctcgacctaa

SEQ ID NO: 579343 - DNA, 25 bp, Rattus norvegicus
tcagtgacctctccatcaagtcctg

SEQ ID NO: 579344 - DNA, 25 bp, Rattus norvegicus
tcagtgacctctgcatcaagtcctg

SEQ ID NO: 579345 - DNA, 25 bp, Rattus norvegicus
tcagtgacctgtcctgctctgtatg

SEQ ID NO: 579346 - DNA, 25 bp, Rattus norvegicus
tcagtgacctgtgctgctctgtatg

SEQ ID NO: 579347 - DNA, 25 bp, Rattus norvegicus
tcagtgactgtcagtccagctgcag

SEQ ID NO: 579348 - DNA, 25 bp, Rattus norvegicus
tcagtgactgtcctttactacccat

SEQ ID NO: 579349 - DNA, 25 bp, Rattus norvegicus
tcagtgactgtcgtttactacccat

SEQ ID NO: 579350 - DNA, 25 bp, Rattus norvegicus
tcagtgactgtctgtccagctgcag

SEQ ID NO: 579351 - DNA, 25 bp, Rattus norvegicus
tcagtgacttctcggcagctgggct

SEQ ID NO: 579352 - DNA, 25 bp, Rattus norvegicus
tcagtgacttctgggcagctgggct

SEQ ID NO: 579353 - DNA, 25 bp, Rattus norvegicus
tcagtgacttgactgcttgcttagc

SEQ ID NO: 579354 - DNA, 25 bp, Rattus norvegicus
tcagtgacttgagtgcttgcttagc

SEQ ID NO: 579355 - DNA, 25 bp, Rattus norvegicus
tcagtgacttttacagccttcatca

SEQ ID NO: 579356 - DNA, 25 bp, Rattus norvegicus
tcagtgactttttcagccttcatca

SEQ ID NO: 579357 - DNA, 25 bp, Rattus norvegicus
tcagtgagagtgaccgtatgtgtac

SEQ ID NO: 579358 - DNA, 25 bp, Rattus norvegicus
tcagtgagagtgtccgtatgtgtac

SEQ ID NO: 579359 - DNA, 25 bp, Rattus norvegicus
tcagtgagcccgaggagcaggccaa

SEQ ID NO: 579360 - DNA, 25 bp, Rattus norvegicus
tcagtgagcccgtggagcaggccaa

SEQ ID NO: 579361 - DNA, 25 bp, Rattus norvegicus
tcagtgaggcctagtatgtccaggc

SEQ ID NO: 579362 - DNA, 25 bp, Rattus norvegicus
tcagtgaggccttgtatgtccaggc

SEQ ID NO: 579363 - DNA, 25 bp, Rattus norvegicus
tcagtgaggtcaaggccgtgtctgt

SEQ ID NO: 579364 - DNA, 25 bp, Rattus norvegicus
tcagtgaggtcatggccgtgtctgt

SEQ ID NO: 579365 - DNA, 25 bp, Rattus norvegicus
tcagtgagtctgctttaatcctaaa

SEQ ID NO: 579366 - DNA, 25 bp, Rattus norvegicus
tcagtgagtctggtttaatcctaaa

SEQ ID NO: 579367 - DNA, 25 bp, Rattus norvegicus
tcagtgatgcctagtgaggctgtgt

SEQ ID NO: 579368 - DNA, 25 bp, Rattus norvegicus
tcagtgatgccttgtgaggctgtgt

SEQ ID NO: 579369 - DNA, 25 bp, Rattus norvegicus
tcagtgatggacaccttgtagccaa

SEQ ID NO: 579370 - DNA, 25 bp, Rattus norvegicus
tcagtgatggactccttgtagccaa

SEQ ID NO: 579371 - DNA, 25 bp, Rattus norvegicus
tcagtgatggttactcgcctcataa

SEQ ID NO: 579372 - DNA, 25 bp, Rattus norvegicus
tcagtgatggtttctcgcctcataa

SEQ ID NO: 579373 - DNA, 25 bp, Rattus norvegicus
tcagtgatgtggaccaggaggaacc

SEQ ID NO: 579374 - DNA, 25 bp, Rattus norvegicus
tcagtgatgtggtccaggaggaacc

SEQ ID NO: 579375 - DNA, 25 bp, Rattus norvegicus
tcagtgcaagtgactttctttggaa

SEQ ID NO: 579376 - DNA, 25 bp, Rattus norvegicus
tcagtgcaagtgtctttctttggaa

SEQ ID NO: 579377 - DNA, 25 bp, Rattus norvegicus
tcagtgcaataacctcttggtcatt

SEQ ID NO: 579378 - DNA, 25 bp, Rattus norvegicus
tcagtgcaataagctcttggtcatt

SEQ ID NO: 579379 - DNA, 25 bp, Rattus norvegicus
tcagtgcagcctaactcctgagaag

SEQ ID NO: 579380 - DNA, 25 bp, Rattus norvegicus
tcagtgcagccttactcctgagaag

SEQ ID NO: 579381 - DNA, 25 bp, Rattus norvegicus
tcagtgcaggtgatcttagagtcca

SEQ ID NO: 579382 - DNA, 25 bp, Rattus norvegicus
tcagtgcaggtgttcttagagtcca

SEQ ID NO: 579383 - DNA, 25 bp, Rattus norvegicus
tcagtgcagtgtatgagaccagtct

SEQ ID NO: 579384 - DNA, 25 bp, Rattus norvegicus
tcagtgcagtgtttgagaccagtct

SEQ ID NO: 579385 - DNA, 25 bp, Rattus norvegicus
tcagtgcatctcacaggtcagcagt

SEQ ID NO: 579386 - DNA, 25 bp, Rattus norvegicus
tcagtgcatctctcaggtcagcagt

SEQ ID NO: 579387 - DNA, 25 bp, Rattus norvegicus
tcagtgccacacaggatcctagcgc

SEQ ID NO: 579388 - DNA, 25 bp, Rattus norvegicus
tcagtgccacactggatcctagcgc

SEQ ID NO: 579389 - DNA, 25 bp, Rattus norvegicus
tcagtgccagcaacgtggcagggcc

SEQ ID NO: 579390 - DNA, 25 bp, Rattus norvegicus
tcagtgccagcatcgtggcagggcc

SEQ ID NO: 579391 - DNA, 25 bp, Rattus norvegicus
tcagtgccagtgagccctagaggca

SEQ ID NO: 579392 - DNA, 25 bp, Rattus norvegicus
tcagtgccagtgtgccctagaggca

SEQ ID NO: 579393 - DNA, 25 bp, Rattus norvegicus
tcagtgcccagcaggtggcttattc

SEQ ID NO: 579394 - DNA, 25 bp, Rattus norvegicus
tcagtgcccagctggtggcttattc

SEQ ID NO: 579395 - DNA, 25 bp, Rattus norvegicus
tcagtgccccaccaggcgtgggtct

SEQ ID NO: 579396 - DNA, 25 bp, Rattus norvegicus
tcagtgccccacgaggcgtgggtct

SEQ ID NO: 579397 - DNA, 25 bp, Rattus norvegicus
tcagtgccctctatcggatgcaaga

SEQ ID NO: 579398 - DNA, 25 bp, Rattus norvegicus
tcagtgccctctttcggatgcaaga

SEQ ID NO: 579399 - DNA, 25 bp, Rattus norvegicus
tcagtgcccttgaagactaacccag

SEQ ID NO: 579400 - DNA, 25 bp, Rattus norvegicus
tcagtgcccttgtagactaacccag

SEQ ID NO: 579401 - DNA, 25 bp, Rattus norvegicus
tcagtgcctcttactcattttcttg

SEQ ID NO: 579402 - DNA, 25 bp, Rattus norvegicus
tcagtgcctctttctcattttcttg

SEQ ID NO: 579403 - DNA, 25 bp, Rattus norvegicus
tcagtgcctgccacatggcaaatca

SEQ ID NO: 579404 - DNA, 25 bp, Rattus norvegicus
tcagtgcctgcctcatggcaaatca

SEQ ID NO: 579405 - DNA, 25 bp, Rattus norvegicus
tcagtgcctttgctcactaggttaa

SEQ ID NO: 579406 - DNA, 25 bp, Rattus norvegicus
tcagtgcctttggtcactaggttaa

SEQ ID NO: 579407 - DNA, 25 bp, Rattus norvegicus
tcagtgcgatctctcggtgcaggtc

SEQ ID NO: 579408 - DNA, 25 bp, Rattus norvegicus
tcagtgcgatctgtcggtgcaggtc

SEQ ID NO: 579409 - DNA, 25 bp, Rattus norvegicus
tcagtgcgggagacatttgactctt

SEQ ID NO: 579410 - DNA, 25 bp, Rattus norvegicus
tcagtgcgggagtcatttgactctt

SEQ ID NO: 579411 - DNA, 25 bp, Rattus norvegicus
tcagtgcgtcttctggagcgtgccc

SEQ ID NO: 579412 - DNA, 25 bp, Rattus norvegicus
tcagtgcgtcttgtggagcgtgccc

SEQ ID NO: 579413 - DNA, 25 bp, Rattus norvegicus
tcagtgctatccctgacacggagga

SEQ ID NO: 579414 - DNA, 25 bp, Rattus norvegicus
tcagtgctatccgtgacacggagga

SEQ ID NO: 579415 - DNA, 25 bp, Rattus norvegicus
tcagtgctcaaaagcctggctcaca

SEQ ID NO: 579416 - DNA, 25 bp, Rattus norvegicus
tcagtgctcaaatgcctggctcaca

SEQ ID NO: 579417 - DNA, 25 bp, Rattus norvegicus
tcagtgctccgacttgagctcagct

SEQ ID NO: 579418 - DNA, 25 bp, Rattus norvegicus
tcagtgctccgagttgagctcagct

SEQ ID NO: 579419 - DNA, 25 bp, Rattus norvegicus
tcagtgctctgcacccatgcttgga

SEQ ID NO: 579420 - DNA, 25 bp, Rattus norvegicus
tcagtgctctgctcccatgcttgga

SEQ ID NO: 579421 - DNA, 25 bp, Rattus norvegicus
tcagtgctctggctaatggcaaatg

SEQ ID NO: 579422 - DNA, 25 bp, Rattus norvegicus
tcagtgctctgggtaatggcaaatg

SEQ ID NO: 579423 - DNA, 25 bp, Rattus norvegicus
tcagtgctgcagatcgggtatggtt

SEQ ID NO: 579424 - DNA, 25 bp, Rattus norvegicus
tcagtgctgcagttcgggtatggtt

SEQ ID NO: 579425 - DNA, 25 bp, Rattus norvegicus
tcagtgctgctcagagctgcaactc

SEQ ID NO: 579426 - DNA, 25 bp, Rattus norvegicus
tcagtgctgctctgagctgcaactc

SEQ ID NO: 579427 - DNA, 25 bp, Rattus norvegicus
tcagtgctgcttctagctgcaactc

SEQ ID NO: 579428 - DNA, 25 bp, Rattus norvegicus
tcagtgctgcttgtagctgcaactc

SEQ ID NO: 579429 - DNA, 25 bp, Rattus norvegicus
tcagtgctggcaacggaacccaggt

SEQ ID NO: 579430 - DNA, 25 bp, Rattus norvegicus
tcagtgctggcatcggaacccaggt

SEQ ID NO: 579431 - DNA, 25 bp, Rattus norvegicus
tcagtgctggctactttgaatctaa

SEQ ID NO: 579432 - DNA, 25 bp, Rattus norvegicus
tcagtgctggcttctttgaatctaa

SEQ ID NO: 579433 - DNA, 25 bp, Rattus norvegicus
tcagtgctgggccaaagttgtctct

SEQ ID NO: 579434 - DNA, 25 bp, Rattus norvegicus
tcagtgctgggcgaaagttgtctct

SEQ ID NO: 579435 - DNA, 25 bp, Rattus norvegicus
tcagtgctggtgacgaatattcccg

SEQ ID NO: 579436 - DNA, 25 bp, Rattus norvegicus
tcagtgctggtgtcgaatattcccg

SEQ ID NO: 579437 - DNA, 25 bp, Rattus norvegicus
tcagtgctgtgtacttgttgtggag

SEQ ID NO: 579438 - DNA, 25 bp, Rattus norvegicus
tcagtgctgtgttcttgttgtggag

SEQ ID NO: 579439 - DNA, 25 bp, Rattus norvegicus
tcagtgcttcacctgattcggcagc

SEQ ID NO: 579440 - DNA, 25 bp, Rattus norvegicus
tcagtgcttcacgtgattcggcagc

SEQ ID NO: 579441 - DNA, 25 bp, Rattus norvegicus
tcagtgcttcccaggctccttatct

SEQ ID NO: 579442 - DNA, 25 bp, Rattus norvegicus
tcagtgcttccctggctccttatct

SEQ ID NO: 579443 - DNA, 25 bp, Rattus norvegicus
tcagtgcttcggctcttggtgaaga

SEQ ID NO: 579444 - DNA, 25 bp, Rattus norvegicus
tcagtgcttcgggtcttggtgaaga

SEQ ID NO: 579445 - DNA, 25 bp, Rattus norvegicus
tcagtgcttctcacactaggttaat

SEQ ID NO: 579446 - DNA, 25 bp, Rattus norvegicus
tcagtgcttctcagggcagtacaca

SEQ ID NO: 579447 - DNA, 25 bp, Rattus norvegicus
tcagtgcttctctcactaggttaat

SEQ ID NO: 579448 - DNA, 25 bp, Rattus norvegicus
tcagtgcttctctgggcagtacaca

SEQ ID NO: 579449 - DNA, 25 bp, Rattus norvegicus
tcagtggaacagcatattttaattt

SEQ ID NO: 579450 - DNA, 25 bp, Rattus norvegicus
tcagtggaacaggatattttaattt

SEQ ID NO: 579451 - DNA, 25 bp, Rattus norvegicus
tcagtggactgacctcctggatggc

SEQ ID NO: 579452 - DNA, 25 bp, Rattus norvegicus
tcagtggactgagctcctggatggc

SEQ ID NO: 579453 - DNA, 25 bp, Rattus norvegicus
tcagtggattgacccctaagttctg

SEQ ID NO: 579454 - DNA, 25 bp, Rattus norvegicus
tcagtggattgagccctaagttctg

SEQ ID NO: 579455 - DNA, 25 bp, Rattus norvegicus
tcagtggcaggaagctagtggtccc

SEQ ID NO: 579456 - DNA, 25 bp, Rattus norvegicus
tcagtggcaggatgctagtggtccc

SEQ ID NO: 579457 - DNA, 25 bp, Rattus norvegicus
tcagtggcatctctgatctcactca

SEQ ID NO: 579458 - DNA, 25 bp, Rattus norvegicus
tcagtggcatctctttcaaccggat

SEQ ID NO: 579459 - DNA, 25 bp, Rattus norvegicus
tcagtggcatctgtgatctcactca

SEQ ID NO: 579460 - DNA, 25 bp, Rattus norvegicus
tcagtggcatctgtttcaaccggat

SEQ ID NO: 579461 - DNA, 25 bp, Rattus norvegicus
tcagtggccctgaatgacatccgga

SEQ ID NO: 579462 - DNA, 25 bp, Rattus norvegicus
tcagtggccctgtatgacatccgga

SEQ ID NO: 579463 - DNA, 25 bp, Rattus norvegicus
tcagtggcggtaactcagtttcctt

SEQ ID NO: 579464 - DNA, 25 bp, Rattus norvegicus
tcagtggcggtatctcagtttcctt

SEQ ID NO: 579465 - DNA, 25 bp, Rattus norvegicus
tcagtggcttgtcgcttcctgctaa

SEQ ID NO: 579466 - DNA, 25 bp, Rattus norvegicus
tcagtggcttgtggcttcctgctaa

SEQ ID NO: 579467 - DNA, 25 bp, Rattus norvegicus
tcagtgggatggctagccaaagaaa

SEQ ID NO: 579468 - DNA, 25 bp, Rattus norvegicus
tcagtgggatgggtagccaaagaaa

SEQ ID NO: 579469 - DNA, 25 bp, Rattus norvegicus
tcagtgggattcatcttggtcaaat

SEQ ID NO: 579470 - DNA, 25 bp, Rattus norvegicus
tcagtgggattcttcttggtcaaat

SEQ ID NO: 579471 - DNA, 25 bp, Rattus norvegicus
tcagtgggcacgactggtgctgttt

SEQ ID NO: 579472 - DNA, 25 bp, Rattus norvegicus
tcagtgggcacgtctggtgctgttt

SEQ ID NO: 579473 - DNA, 25 bp, Rattus norvegicus
tcagtgggccacagatctccacagg

SEQ ID NO: 579474 - DNA, 25 bp, Rattus norvegicus
tcagtgggccactgatctccacagg

SEQ ID NO: 579475 - DNA, 25 bp, Rattus norvegicus
tcagtgggttggatccatacctttc

SEQ ID NO: 579476 - DNA, 25 bp, Rattus norvegicus
tcagtgggttggttccatacctttc

SEQ ID NO: 579477 - DNA, 25 bp, Rattus norvegicus
tcagtggtagaccttgctctcctgt

SEQ ID NO: 579478 - DNA, 25 bp, Rattus norvegicus
tcagtggtagacgttgctctcctgt

SEQ ID NO: 579479 - DNA, 25 bp, Rattus norvegicus
tcagtggtcataagctacgcctgac

SEQ ID NO: 579480 - DNA, 25 bp, Rattus norvegicus
tcagtggtcatatgctacgcctgac

SEQ ID NO: 579481 - DNA, 25 bp, Rattus norvegicus
tcagtggtcctaactcctttttgta

SEQ ID NO: 579482 - DNA, 25 bp, Rattus norvegicus
tcagtggtcctatctcctttttgta

SEQ ID NO: 579483 - DNA, 25 bp, Rattus norvegicus
tcagtggtctctaggcaacggcatt

SEQ ID NO: 579484 - DNA, 25 bp, Rattus norvegicus
tcagtggtctctcggctcatacttc

SEQ ID NO: 579485 - DNA, 25 bp, Rattus norvegicus
tcagtggtctctgggctcatacttc

SEQ ID NO: 579486 - DNA, 25 bp, Rattus norvegicus
tcagtggtctcttggcaacggcatt

SEQ ID NO: 579487 - DNA, 25 bp, Rattus norvegicus
tcagtggtgatgcttgccagtgaca

SEQ ID NO: 579488 - DNA, 25 bp, Rattus norvegicus
tcagtggtgatggttgccagtgaca

SEQ ID NO: 579489 - DNA, 25 bp, Rattus norvegicus
tcagtggtgcttagaactgcagctc

SEQ ID NO: 579490 - DNA, 25 bp, Rattus norvegicus
tcagtggtgctttgaactgcagctc

SEQ ID NO: 579491 - DNA, 25 bp, Rattus norvegicus
tcagtggtggccagttctcaaggga

SEQ ID NO: 579492 - DNA, 25 bp, Rattus norvegicus
tcagtggtggccatgatgcggtaca

SEQ ID NO: 579493 - DNA, 25 bp, Rattus norvegicus
tcagtggtggcctgttctcaaggga

SEQ ID NO: 579494 - DNA, 25 bp, Rattus norvegicus
tcagtggtggccttgatgcggtaca

SEQ ID NO: 579495 - DNA, 25 bp, Rattus norvegicus
tcagtggtggtacctcaaggagcca

SEQ ID NO: 579496 - DNA, 25 bp, Rattus norvegicus
tcagtggtggtagctcaaggagcca

SEQ ID NO: 579497 - DNA, 25 bp, Rattus norvegicus
tcagtggttcccaaaccccaggttg

SEQ ID NO: 579498 - DNA, 25 bp, Rattus norvegicus
tcagtggttccctaaccccaggttg

SEQ ID NO: 579499 - DNA, 25 bp, Rattus norvegicus
tcagtggttgctaaaggccattgtg

SEQ ID NO: 579500 - DNA, 25 bp, Rattus norvegicus
tcagtggttgcttaaggccattgtg

SEQ ID NO: 579501 - DNA, 25 bp, Rattus norvegicus
tcagtggtttaaatctcgcctgcac

SEQ ID NO: 579502 - DNA, 25 bp, Rattus norvegicus
tcagtggtttaattctcgcctgcac

SEQ ID NO: 579503 - DNA, 25 bp, Rattus norvegicus
tcagtgtaaaccaaaccttctcaac

SEQ ID NO: 579504 - DNA, 25 bp, Rattus norvegicus
tcagtgtaaacctaaccttctcaac

SEQ ID NO: 579505 - DNA, 25 bp, Rattus norvegicus
tcagtgtaaactaggaggagagatt

SEQ ID NO: 579506 - DNA, 25 bp, Rattus norvegicus
tcagtgtaaacttggaggagagatt

SEQ ID NO: 579507 - DNA, 25 bp, Rattus norvegicus
tcagtgtccctgacggtttacaagt

SEQ ID NO: 579508 - DNA, 25 bp, Rattus norvegicus
tcagtgtccctgtcggtttacaagt

SEQ ID NO: 579509 - DNA, 25 bp, Rattus norvegicus
tcagtgtcctgaatctgtaccttcc

SEQ ID NO: 579510 - DNA, 25 bp, Rattus norvegicus
tcagtgtcctgattctgtaccttcc

SEQ ID NO: 579511 - DNA, 25 bp, Rattus norvegicus
tcagtgtcgctcagctggtggccca

SEQ ID NO: 579512 - DNA, 25 bp, Rattus norvegicus
tcagtgtcgctctgctggtggccca

SEQ ID NO: 579513 - DNA, 25 bp, Rattus norvegicus
tcagtgtctcaccatcagctgggat

SEQ ID NO: 579514 - DNA, 25 bp, Rattus norvegicus
tcagtgtctcacgatcagctgggat

SEQ ID NO: 579515 - DNA, 25 bp, Rattus norvegicus
tcagtgtctcagagggtcgacttta

SEQ ID NO: 579516 - DNA, 25 bp, Rattus norvegicus
tcagtgtctcagtgggtcgacttta

SEQ ID NO: 579517 - DNA, 25 bp, Rattus norvegicus
tcagtgtctcgaagtacctcccgaa

SEQ ID NO: 579518 - DNA, 25 bp, Rattus norvegicus
tcagtgtctcgatgtacctcccgaa

SEQ ID NO: 579519 - DNA, 25 bp, Rattus norvegicus
tcagtgtgaaccagtcctcagtggg

SEQ ID NO: 579520 - DNA, 25 bp, Rattus norvegicus
tcagtgtgaacctgtcctcagtggg

SEQ ID NO: 579521 - DNA, 25 bp, Rattus norvegicus
tcagtgtgacaacccagtgaccctt

SEQ ID NO: 579522 - DNA, 25 bp, Rattus norvegicus
tcagtgtgacaagccagtgaccctt

SEQ ID NO: 579523 - DNA, 25 bp, Rattus norvegicus
tcagtgtgactgaatccttaaagca

SEQ ID NO: 579524 - DNA, 25 bp, Rattus norvegicus
tcagtgtgactgtatccttaaagca

SEQ ID NO: 579525 - DNA, 25 bp, Rattus norvegicus
tcagtgtgcgcacgtctctgtatgt

SEQ ID NO: 579526 - DNA, 25 bp, Rattus norvegicus
tcagtgtgcgcaggtctctgtatgt

SEQ ID NO: 579527 - DNA, 25 bp, Rattus norvegicus
tcagtgtggcctcccgttagcttca

SEQ ID NO: 579528 - DNA, 25 bp, Rattus norvegicus
tcagtgtggcctgccgttagcttca

SEQ ID NO: 579529 - DNA, 25 bp, Rattus norvegicus
tcagtgtgtacaacagtggccatcc

SEQ ID NO: 579530 - DNA, 25 bp, Rattus norvegicus
tcagtgtgtacatcagtggccatcc

SEQ ID NO: 579531 - DNA, 25 bp, Rattus norvegicus
tcagtgtgtcagacctgtatgctaa

SEQ ID NO: 579532 - DNA, 25 bp, Rattus norvegicus
tcagtgtgtcagtcctgtatgctaa

SEQ ID NO: 579533 - DNA, 25 bp, Rattus norvegicus
tcagtgttaactccctgagacaggg

SEQ ID NO: 579534 - DNA, 25 bp, Rattus norvegicus
tcagtgttaactgcctgagacaggg

SEQ ID NO: 579535 - DNA, 25 bp, Rattus norvegicus
tcagtgttactcaccgacgcggttg

SEQ ID NO: 579536 - DNA, 25 bp, Rattus norvegicus
tcagtgttactcatctgccctgtta

SEQ ID NO: 579537 - DNA, 25 bp, Rattus norvegicus
tcagtgttactctccgacgcggttg

SEQ ID NO: 579538 - DNA, 25 bp, Rattus norvegicus
tcagtgttactcttctgccctgtta

SEQ ID NO: 579539 - DNA, 25 bp, Rattus norvegicus
tcagtgttccagcagatctggacct

SEQ ID NO: 579540 - DNA, 25 bp, Rattus norvegicus
tcagtgttccaggagatctggacct

SEQ ID NO: 579541 - DNA, 25 bp, Rattus norvegicus
tcagtgttgcagagtaaggtaagga

SEQ ID NO: 579542 - DNA, 25 bp, Rattus norvegicus
tcagtgttgcagtgtaaggtaagga

SEQ ID NO: 579543 - DNA, 25 bp, Rattus norvegicus
tcagtgtttccgagtaccaaaggtt

SEQ ID NO: 579544 - DNA, 25 bp, Rattus norvegicus
tcagtgtttccgtgtaccaaaggtt

SEQ ID NO: 579545 - DNA, 25 bp, Rattus norvegicus
tcagtgtttggcctcagggaagcca

SEQ ID NO: 579546 - DNA, 25 bp, Rattus norvegicus
tcagtgtttggcgtcagggaagcca

SEQ ID NO: 579547 - DNA, 25 bp, Rattus norvegicus
tcagtgttttgcatgcctgttgcaa

SEQ ID NO: 579548 - DNA, 25 bp, Rattus norvegicus
tcagtgttttgcttgcctgttgcaa

SEQ ID NO: 579549 - DNA, 25 bp, Rattus norvegicus
tcagttaatattcgccacctggact

SEQ ID NO: 579550 - DNA, 25 bp, Rattus norvegicus
tcagttaatattggccacctggact

SEQ ID NO: 579551 - DNA, 25 bp, Rattus norvegicus
tcagttaatgcccaggaagcccctt

SEQ ID NO: 579552 - DNA, 25 bp, Rattus norvegicus
tcagttaatgccgaggaagcccctt

SEQ ID NO: 579553 - DNA, 25 bp, Rattus norvegicus
tcagttaattctccggctaaggtcc

SEQ ID NO: 579554 - DNA, 25 bp, Rattus norvegicus
tcagttaattctgcggctaaggtcc

SEQ ID NO: 579555 - DNA, 25 bp, Rattus norvegicus
tcagttacactcatctctacagctg

SEQ ID NO: 579556 - DNA, 25 bp, Rattus norvegicus
tcagttacactcttctctacagctg

SEQ ID NO: 579557 - DNA, 25 bp, Rattus norvegicus
tcagttacagcaacccttgggatgt

SEQ ID NO: 579558 - DNA, 25 bp, Rattus norvegicus
tcagttacagcatcccttgggatgt

SEQ ID NO: 579559 - DNA, 25 bp, Rattus norvegicus
tcagttacctgcattattgctccat

SEQ ID NO: 579560 - DNA, 25 bp, Rattus norvegicus
tcagttacctgctttattgctccat

SEQ ID NO: 579561 - DNA, 25 bp, Rattus norvegicus
tcagttacctttcgcagatattaga

SEQ ID NO: 579562 - DNA, 25 bp, Rattus norvegicus
tcagttacctttggcagatattaga

SEQ ID NO: 579563 - DNA, 25 bp, Rattus norvegicus
tcagttactggtccctggtatctaa

SEQ ID NO: 579564 - DNA, 25 bp, Rattus norvegicus
tcagttactggtgcctggtatctaa

SEQ ID NO: 579565 - DNA, 25 bp, Rattus norvegicus
tcagttaggactatcggcgcgcgaa

SEQ ID NO: 579566 - DNA, 25 bp, Rattus norvegicus
tcagttaggactccatccctgtgaa

SEQ ID NO: 579567 - DNA, 25 bp, Rattus norvegicus
tcagttaggactgcatccctgtgaa

SEQ ID NO: 579568 - DNA, 25 bp, Rattus norvegicus
tcagttaggactttcggcgcgcgaa

SEQ ID NO: 579569 - DNA, 25 bp, Rattus norvegicus
tcagttagtcaactccaggctggac

SEQ ID NO: 579570 - DNA, 25 bp, Rattus norvegicus
tcagttagtcaagtccaggctggac

SEQ ID NO: 579571 - DNA, 25 bp, Rattus norvegicus
tcagttatacatcaccagacggtca

SEQ ID NO: 579572 - DNA, 25 bp, Rattus norvegicus
tcagttatacatgaccagacggtca

SEQ ID NO: 579573 - DNA, 25 bp, Rattus norvegicus
tcagttatcccaccagtaaagtttt

SEQ ID NO: 579574 - DNA, 25 bp, Rattus norvegicus
tcagttatcccagcagtaaagtttt

SEQ ID NO: 579575 - DNA, 25 bp, Rattus norvegicus
tcagttatgttgctctggtcactcc

SEQ ID NO: 579576 - DNA, 25 bp, Rattus norvegicus
tcagttatgttggtctggtcactcc

SEQ ID NO: 579577 - DNA, 25 bp, Rattus norvegicus
tcagttattgaacctttccaacgtt

SEQ ID NO: 579578 - DNA, 25 bp, Rattus norvegicus
tcagttattgaagctttccaacgtt

SEQ ID NO: 579579 - DNA, 25 bp, Rattus norvegicus
tcagttcaaaagacatgtcggcatt

SEQ ID NO: 579580 - DNA, 25 bp, Rattus norvegicus
tcagttcaaaagtcatgtcggcatt

SEQ ID NO: 579581 - DNA, 25 bp, Rattus norvegicus
tcagttcactctacttttgttgcat

SEQ ID NO: 579582 - DNA, 25 bp, Rattus norvegicus
tcagttcactcttcttttgttgcat

SEQ ID NO: 579583 - DNA, 25 bp, Rattus norvegicus
tcagttcagaacaagctcgcactaa

SEQ ID NO: 579584 - DNA, 25 bp, Rattus norvegicus
tcagttcagaactagctcgcactaa

SEQ ID NO: 579585 - DNA, 25 bp, Rattus norvegicus
tcagttcagggtatggatccccagc

SEQ ID NO: 579586 - DNA, 25 bp, Rattus norvegicus
tcagttcagggtttggatccccagc

SEQ ID NO: 579587 - DNA, 25 bp, Rattus norvegicus
tcagttcatagtcacgcccaggagc

SEQ ID NO: 579588 - DNA, 25 bp, Rattus norvegicus
tcagttcatagtgacgcccaggagc

SEQ ID NO: 579589 - DNA, 25 bp, Rattus norvegicus
tcagttccaccacgactcatattga

SEQ ID NO: 579590 - DNA, 25 bp, Rattus norvegicus
tcagttccaccaggactcatattga

SEQ ID NO: 579591 - DNA, 25 bp, Rattus norvegicus
tcagttccacggatgctaaattata

SEQ ID NO: 579592 - DNA, 25 bp, Rattus norvegicus
tcagttccacggttgctaaattata

SEQ ID NO: 579593 - DNA, 25 bp, Rattus norvegicus
tcagttccagcacgcctggatgcaa

SEQ ID NO: 579594 - DNA, 25 bp, Rattus norvegicus
tcagttccagcaggcctggatgcaa

SEQ ID NO: 579595 - DNA, 25 bp, Rattus norvegicus
tcagttccagctatccttcaaaaat

SEQ ID NO: 579596 - DNA, 25 bp, Rattus norvegicus
tcagttccagctttccttcaaaaat

SEQ ID NO: 579597 - DNA, 25 bp, Rattus norvegicus
tcagttccaggcatgtacaccggga

SEQ ID NO: 579598 - DNA, 25 bp, Rattus norvegicus
tcagttccaggcttgtacaccggga

SEQ ID NO: 579599 - DNA, 25 bp, Rattus norvegicus
tcagttccagttatgtacgttcctc

SEQ ID NO: 579600 - DNA, 25 bp, Rattus norvegicus
tcagttccagttttgtacgttcctc

SEQ ID NO: 579601 - DNA, 25 bp, Rattus norvegicus
tcagttccatgaccagatgaccaag

SEQ ID NO: 579602 - DNA, 25 bp, Rattus norvegicus
tcagttccatgagcagatgaccaag

SEQ ID NO: 579603 - DNA, 25 bp, Rattus norvegicus
tcagttcccaacacttgactcagag

SEQ ID NO: 579604 - DNA, 25 bp, Rattus norvegicus
tcagttcccaactcttgactcagag

SEQ ID NO: 579605 - DNA, 25 bp, Rattus norvegicus
tcagttcccaagctcatggactatt

SEQ ID NO: 579606 - DNA, 25 bp, Rattus norvegicus
tcagttcccaaggtcatggactatt

SEQ ID NO: 579607 - DNA, 25 bp, Rattus norvegicus
tcagttccccaacgcttattgatgt

SEQ ID NO: 579608 - DNA, 25 bp, Rattus norvegicus
tcagttccccaaggcttattgatgt

SEQ ID NO: 579609 - DNA, 25 bp, Rattus norvegicus
tcagttcccggaagataccttgctt

SEQ ID NO: 579610 - DNA, 25 bp, Rattus norvegicus
tcagttcccggatgataccttgctt

SEQ ID NO: 579611 - DNA, 25 bp, Rattus norvegicus
tcagttcccttcagtattctcaaat

SEQ ID NO: 579612 - DNA, 25 bp, Rattus norvegicus
tcagttcccttctgtattctcaaat

SEQ ID NO: 579613 - DNA, 25 bp, Rattus norvegicus
tcagttccgtgcagtgaaggtcttt

SEQ ID NO: 579614 - DNA, 25 bp, Rattus norvegicus
tcagttccgtgctgtgaaggtcttt

SEQ ID NO: 579615 - DNA, 25 bp, Rattus norvegicus
tcagttcctacgaggcctatagcaa

SEQ ID NO: 579616 - DNA, 25 bp, Rattus norvegicus
tcagttcctacgtggcctatagcaa

SEQ ID NO: 579617 - DNA, 25 bp, Rattus norvegicus
tcagttcctctcagctggagctgta

SEQ ID NO: 579618 - DNA, 25 bp, Rattus norvegicus
tcagttcctctctgctggagctgta

SEQ ID NO: 579619 - DNA, 25 bp, Rattus norvegicus
tcagttccttcaaccctgtaagaat

SEQ ID NO: 579620 - DNA, 25 bp, Rattus norvegicus
tcagttccttcatccctgtaagaat

SEQ ID NO: 579621 - DNA, 25 bp, Rattus norvegicus
tcagttctcagactcttgggacaat

SEQ ID NO: 579622 - DNA, 25 bp, Rattus norvegicus
tcagttctcagagtcttgggacaat

SEQ ID NO: 579623 - DNA, 25 bp, Rattus norvegicus
tcagttctcataactcattatctgg

SEQ ID NO: 579624 - DNA, 25 bp, Rattus norvegicus
tcagttctcatatctcattatctgg

SEQ ID NO: 579625 - DNA, 25 bp, Rattus norvegicus
tcagttctctaacgcgtgagctcct

SEQ ID NO: 579626 - DNA, 25 bp, Rattus norvegicus
tcagttctctaaggcgtgagctcct

SEQ ID NO: 579627 - DNA, 25 bp, Rattus norvegicus
tcagttctcttcagaccacagggtt

SEQ ID NO: 579628 - DNA, 25 bp, Rattus norvegicus
tcagttctcttctgaccacagggtt

SEQ ID NO: 579629 - DNA, 25 bp, Rattus norvegicus
tcagttctctttattccgtttgtcg

SEQ ID NO: 579630 - DNA, 25 bp, Rattus norvegicus
tcagttctcttttttccgtttgtcg

SEQ ID NO: 579631 - DNA, 25 bp, Rattus norvegicus
tcagttctgcatcctttgtgagcct

SEQ ID NO: 579632 - DNA, 25 bp, Rattus norvegicus
tcagttctgcatgctttgtgagcct

SEQ ID NO: 579633 - DNA, 25 bp, Rattus norvegicus
tcagttcttcatcttgttccaagtc

SEQ ID NO: 579634 - DNA, 25 bp, Rattus norvegicus
tcagttcttcatgttgttccaagtc

SEQ ID NO: 579635 - DNA, 25 bp, Rattus norvegicus
tcagttcttcccctggcgtcaggga

SEQ ID NO: 579636 - DNA, 25 bp, Rattus norvegicus
tcagttcttcccgtggcgtcaggga

SEQ ID NO: 579637 - DNA, 25 bp, Rattus norvegicus
tcagttctttccaaggagcgtccag

SEQ ID NO: 579638 - DNA, 25 bp, Rattus norvegicus
tcagttctttcctaggagcgtccag

SEQ ID NO: 579639 - DNA, 25 bp, Rattus norvegicus
tcagttgaggccctgtgagtgccaa

SEQ ID NO: 579640 - DNA, 25 bp, Rattus norvegicus
tcagttgaggccgtgtgagtgccaa

SEQ ID NO: 579641 - DNA, 25 bp, Rattus norvegicus
tcagttgcaaggcaaagacgaaatt

SEQ ID NO: 579642 - DNA, 25 bp, Rattus norvegicus
tcagttgcaagggaaagacgaaatt

SEQ ID NO: 579643 - DNA, 25 bp, Rattus norvegicus
tcagttgcagccatgcttatagcag

SEQ ID NO: 579644 - DNA, 25 bp, Rattus norvegicus
tcagttgcagccttgcttatagcag

SEQ ID NO: 579645 - DNA, 25 bp, Rattus norvegicus
tcagttgcccggcacaaagaggcac

SEQ ID NO: 579646 - DNA, 25 bp, Rattus norvegicus
tcagttgcccgggacaaagaggcac

SEQ ID NO: 579647 - DNA, 25 bp, Rattus norvegicus
tcagttgctcagaggtcgctcggaa

SEQ ID NO: 579648 - DNA, 25 bp, Rattus norvegicus
tcagttgctcagtggtcgctcggaa

SEQ ID NO: 579649 - DNA, 25 bp, Rattus norvegicus
tcagttggcatcaccatggtacatt

SEQ ID NO: 579650 - DNA, 25 bp, Rattus norvegicus
tcagttggcatctccatggtacatt

SEQ ID NO: 579651 - DNA, 25 bp, Rattus norvegicus
tcagttggcccaagcttttggatta

SEQ ID NO: 579652 - DNA, 25 bp, Rattus norvegicus
tcagttggcccatgcttttggatta

SEQ ID NO: 579653 - DNA, 25 bp, Rattus norvegicus
tcagttggttgtctagctcttgcct

SEQ ID NO: 579654 - DNA, 25 bp, Rattus norvegicus
tcagttggttgtgtagctcttgcct

SEQ ID NO: 579655 - DNA, 25 bp, Rattus norvegicus
tcagttgtaagaagcccggtgttgg

SEQ ID NO: 579656 - DNA, 25 bp, Rattus norvegicus
tcagttgtaagatgcccggtgttgg

SEQ ID NO: 579657 - DNA, 25 bp, Rattus norvegicus
tcagttgtctccagcacagcaagtc

SEQ ID NO: 579658 - DNA, 25 bp, Rattus norvegicus
tcagttgtctcctgcacagcaagtc

SEQ ID NO: 579659 - DNA, 25 bp, Rattus norvegicus
tcagttgtgaaaccttttgtccaaa

SEQ ID NO: 579660 - DNA, 25 bp, Rattus norvegicus
tcagttgtgaaagcttttgtccaaa

SEQ ID NO: 579661 - DNA, 25 bp, Rattus norvegicus
tcagttgtggaaattccttcctgag

SEQ ID NO: 579662 - DNA, 25 bp, Rattus norvegicus
tcagttgtggaatttccttcctgag

SEQ ID NO: 579663 - DNA, 25 bp, Rattus norvegicus
tcagttgttaagacctccgactgct

SEQ ID NO: 579664 - DNA, 25 bp, Rattus norvegicus
tcagttgttaagtcctccgactgct

SEQ ID NO: 579665 - DNA, 25 bp, Rattus norvegicus
tcagttgttccaaggtagtaaccag

SEQ ID NO: 579666 - DNA, 25 bp, Rattus norvegicus
tcagttgttccatggtagtaaccag

SEQ ID NO: 579667 - DNA, 25 bp, Rattus norvegicus
tcagtttaatgtccccatgctctac

SEQ ID NO: 579668 - DNA, 25 bp, Rattus norvegicus
tcagtttaatgtgcccatgctctac

SEQ ID NO: 579669 - DNA, 25 bp, Rattus norvegicus
tcagtttacctgcatttgtggccat

SEQ ID NO: 579670 - DNA, 25 bp, Rattus norvegicus
tcagtttacctggatttgtggccat

SEQ ID NO: 579671 - DNA, 25 bp, Rattus norvegicus
tcagtttaccttatgttttatgatt

SEQ ID NO: 579672 - DNA, 25 bp, Rattus norvegicus
tcagtttaccttttgttttatgatt

SEQ ID NO: 579673 - DNA, 25 bp, Rattus norvegicus
tcagtttactgcctctcagattggg

SEQ ID NO: 579674 - DNA, 25 bp, Rattus norvegicus
tcagtttactgcgtctcagattggg

SEQ ID NO: 579675 - DNA, 25 bp, Rattus norvegicus
tcagtttagatgatcgttccttcag

SEQ ID NO: 579676 - DNA, 25 bp, Rattus norvegicus
tcagtttagatgttcgttccttcag

SEQ ID NO: 579677 - DNA, 25 bp, Rattus norvegicus
tcagtttagcttagtgctgtatgct

SEQ ID NO: 579678 - DNA, 25 bp, Rattus norvegicus
tcagtttagctttgtgctgtatgct

SEQ ID NO: 579679 - DNA, 25 bp, Rattus norvegicus
tcagtttagtcccacaggtgcctgg

SEQ ID NO: 579680 - DNA, 25 bp, Rattus norvegicus
tcagtttagtccgacaggtgcctgg

SEQ ID NO: 579681 - DNA, 25 bp, Rattus norvegicus
tcagtttattctattttgttggcaa

SEQ ID NO: 579682 - DNA, 25 bp, Rattus norvegicus
tcagtttattcttttttgttggcaa

SEQ ID NO: 579683 - DNA, 25 bp, Rattus norvegicus
tcagtttcaaatatagacccgacca

SEQ ID NO: 579684 - DNA, 25 bp, Rattus norvegicus
tcagtttcaaatttagacccgacca

SEQ ID NO: 579685 - DNA, 25 bp, Rattus norvegicus
tcagtttccacacccctgaaaggga

SEQ ID NO: 579686 - DNA, 25 bp, Rattus norvegicus
tcagtttccacagccctgaaaggga

SEQ ID NO: 579687 - DNA, 25 bp, Rattus norvegicus
tcagtttccagcacccagtttggca

SEQ ID NO: 579688 - DNA, 25 bp, Rattus norvegicus
tcagtttccagctcccagtttggca

SEQ ID NO: 579689 - DNA, 25 bp, Rattus norvegicus
tcagtttcccctaccagaggaggaa

SEQ ID NO: 579690 - DNA, 25 bp, Rattus norvegicus
tcagtttcccctcttgttacctcta

SEQ ID NO: 579691 - DNA, 25 bp, Rattus norvegicus
tcagtttcccctgttgttacctcta

SEQ ID NO: 579692 - DNA, 25 bp, Rattus norvegicus
tcagtttccccttccagaggaggaa

SEQ ID NO: 579693 - DNA, 25 bp, Rattus norvegicus
tcagtttccctccacatgggagtct

SEQ ID NO: 579694 - DNA, 25 bp, Rattus norvegicus
tcagtttccctcgacatgggagtct

SEQ ID NO: 579695 - DNA, 25 bp, Rattus norvegicus
tcagtttcctcaacctctttttctt

SEQ ID NO: 579696 - DNA, 25 bp, Rattus norvegicus
tcagtttcctcatcctctttttctt

SEQ ID NO: 579697 - DNA, 25 bp, Rattus norvegicus
tcagtttccttaacagtccatctcc

SEQ ID NO: 579698 - DNA, 25 bp, Rattus norvegicus
tcagtttccttaaccgtgtcacaga

SEQ ID NO: 579699 - DNA, 25 bp, Rattus norvegicus
tcagtttccttatcagtccatctcc

SEQ ID NO: 579700 - DNA, 25 bp, Rattus norvegicus
tcagtttccttatccgtgtcacaga

SEQ ID NO: 579701 - DNA, 25 bp, Rattus norvegicus
tcagtttctggtcgcttctatttca

SEQ ID NO: 579702 - DNA, 25 bp, Rattus norvegicus
tcagtttctggtggcttctatttca

SEQ ID NO: 579703 - DNA, 25 bp, Rattus norvegicus
tcagtttgaactatgtgcttggcag

SEQ ID NO: 579704 - DNA, 25 bp, Rattus norvegicus
tcagtttgaactttgtgcttggcag

SEQ ID NO: 579705 - DNA, 25 bp, Rattus norvegicus
tcagtttgactgcagtgccatcgct

SEQ ID NO: 579706 - DNA, 25 bp, Rattus norvegicus
tcagtttgactggagtgccatcgct

SEQ ID NO: 579707 - DNA, 25 bp, Rattus norvegicus
tcagtttggtttctccccgtcagtt

SEQ ID NO: 579708 - DNA, 25 bp, Rattus norvegicus
tcagtttggtttgtccccgtcagtt

SEQ ID NO: 579709 - DNA, 25 bp, Rattus norvegicus
tcagtttgtaaaagcaccagatctc

SEQ ID NO: 579710 - DNA, 25 bp, Rattus norvegicus
tcagtttgtaaatgcaccagatctc

SEQ ID NO: 579711 - DNA, 25 bp, Rattus norvegicus
tcagtttgtagcagtagcttgcttt

SEQ ID NO: 579712 - DNA, 25 bp, Rattus norvegicus
tcagtttgtagctgtagcttgcttt

SEQ ID NO: 579713 - DNA, 25 bp, Rattus norvegicus
tcagtttgtttcatacctgtgctgt

SEQ ID NO: 579714 - DNA, 25 bp, Rattus norvegicus
tcagtttgtttcttacctgtgctgt

SEQ ID NO: 579715 - DNA, 25 bp, Rattus norvegicus
tcagttttatacagtccaggaccca

SEQ ID NO: 579716 - DNA, 25 bp, Rattus norvegicus
tcagttttatactgtccaggaccca

SEQ ID NO: 579717 - DNA, 25 bp, Rattus norvegicus
tcagttttatttacccacttaagag

SEQ ID NO: 579718 - DNA, 25 bp, Rattus norvegicus
tcagttttattttcccacttaagag

SEQ ID NO: 579719 - DNA, 25 bp, Rattus norvegicus
tcagttttccctcagtaggcctggg

SEQ ID NO: 579720 - DNA, 25 bp, Rattus norvegicus
tcagttttccctgagtaggcctggg

SEQ ID NO: 579721 - DNA, 25 bp, Rattus norvegicus
tcagttttcctcacatttccgagaa

SEQ ID NO: 579722 - DNA, 25 bp, Rattus norvegicus
tcagttttcctctcatttccgagaa

SEQ ID NO: 579723 - DNA, 25 bp, Rattus norvegicus
tcagttttcggactcccgaggtgag

SEQ ID NO: 579724 - DNA, 25 bp, Rattus norvegicus
tcagttttcggagtcccgaggtgag

SEQ ID NO: 579725 - DNA, 25 bp, Rattus norvegicus
tcagttttctgcaggatgacatgaa

SEQ ID NO: 579726 - DNA, 25 bp, Rattus norvegicus
tcagttttctgctggatgacatgaa

SEQ ID NO: 579727 - DNA, 25 bp, Rattus norvegicus
tcagttttgatcattgcctcctaaa

SEQ ID NO: 579728 - DNA, 25 bp, Rattus norvegicus
tcagttttgatctttgcctcctaaa

SEQ ID NO: 579729 - DNA, 25 bp, Rattus norvegicus
tcagtttttaggacccctgtgttag

SEQ ID NO: 579730 - DNA, 25 bp, Rattus norvegicus
tcagtttttaggtcccctgtgttag

SEQ ID NO: 579731 - DNA, 25 bp, Rattus norvegicus
tcagtttttccaaaaaggaaccact

SEQ ID NO: 579732 - DNA, 25 bp, Rattus norvegicus
tcagtttttccataaaggaaccact

SEQ ID NO: 579733 - DNA, 25 bp, Rattus norvegicus
tcataaaacgacaccatgcctctta

SEQ ID NO: 579734 - DNA, 25 bp, Rattus norvegicus
tcataaaacgactccatgcctctta

SEQ ID NO: 579735 - DNA, 25 bp, Rattus norvegicus
tcataaaagcctcagtctttacggg

SEQ ID NO: 579736 - DNA, 25 bp, Rattus norvegicus
tcataaaagcctgagtctttacggg

SEQ ID NO: 579737 - DNA, 25 bp, Rattus norvegicus
tcataaaccatcacagcagctcttg

SEQ ID NO: 579738 - DNA, 25 bp, Rattus norvegicus
tcataaaccatctcagcagctcttg

SEQ ID NO: 579739 - DNA, 25 bp, Rattus norvegicus
tcataaacctttatgtaagtaactg

SEQ ID NO: 579740 - DNA, 25 bp, Rattus norvegicus
tcataaacctttttgtaagtaactg

SEQ ID NO: 579741 - DNA, 25 bp, Rattus norvegicus
tcataaacgctaattccccagaacc

SEQ ID NO: 579742 - DNA, 25 bp, Rattus norvegicus
tcataaacgctatttccccagaacc

SEQ ID NO: 579743 - DNA, 25 bp, Rattus norvegicus
tcataaacggttatctacaagaatt

SEQ ID NO: 579744 - DNA, 25 bp, Rattus norvegicus
tcataaacggttttctacaagaatt

SEQ ID NO: 579745 - DNA, 25 bp, Rattus norvegicus
tcataaagtgacatccagcccaagt

SEQ ID NO: 579746 - DNA, 25 bp, Rattus norvegicus
tcataaagtgacttccagcccaagt

SEQ ID NO: 579747 - DNA, 25 bp, Rattus norvegicus
tcataaatgcttaccccgggtaaat

SEQ ID NO: 579748 - DNA, 25 bp, Rattus norvegicus
tcataaatgctttccccgggtaaat

SEQ ID NO: 579749 - DNA, 25 bp, Rattus norvegicus
tcataaccccagagacaccaagaat

SEQ ID NO: 579750 - DNA, 25 bp, Rattus norvegicus
tcataaccccagtgacaccaagaat

SEQ ID NO: 579751 - DNA, 25 bp, Rattus norvegicus
tcataacctatcaactttcttccag

SEQ ID NO: 579752 - DNA, 25 bp, Rattus norvegicus
tcataacctatctactttcttccag

SEQ ID NO: 579753 - DNA, 25 bp, Rattus norvegicus
tcataactcccaaggctttgcttga

SEQ ID NO: 579754 - DNA, 25 bp, Rattus norvegicus
tcataactcccatggctttgcttga

SEQ ID NO: 579755 - DNA, 25 bp, Rattus norvegicus
tcataactgcttactgttcccaaat

SEQ ID NO: 579756 - DNA, 25 bp, Rattus norvegicus
tcataactgctttctgttcccaaat

SEQ ID NO: 579757 - DNA, 25 bp, Rattus norvegicus
tcataacttcctcggtattaaaggc

SEQ ID NO: 579758 - DNA, 25 bp, Rattus norvegicus
tcataacttcctgggtattaaaggc

SEQ ID NO: 579759 - DNA, 25 bp, Rattus norvegicus
tcataacttgttaccgcctcacaaa

SEQ ID NO: 579760 - DNA, 25 bp, Rattus norvegicus
tcataacttgtttccgcctcacaaa

SEQ ID NO: 579761 - DNA, 25 bp, Rattus norvegicus
tcataagagccaccaccgtcaaagg

SEQ ID NO: 579762 - DNA, 25 bp, Rattus norvegicus
tcataagagccagcaccgtcaaagg

SEQ ID NO: 579763 - DNA, 25 bp, Rattus norvegicus
tcataagcacttactgtcacctcgt

SEQ ID NO: 579764 - DNA, 25 bp, Rattus norvegicus
tcataagcactttctgtcacctcgt

SEQ ID NO: 579765 - DNA, 25 bp, Rattus norvegicus
tcataagcttttcccagaaacctgg

SEQ ID NO: 579766 - DNA, 25 bp, Rattus norvegicus
tcataagcttttgccagaaacctgg

SEQ ID NO: 579767 - DNA, 25 bp, Rattus norvegicus
tcataaggctgcaactttcttgtcc

SEQ ID NO: 579768 - DNA, 25 bp, Rattus norvegicus
tcataaggctgctactttcttgtcc

SEQ ID NO: 579769 - DNA, 25 bp, Rattus norvegicus
tcataagtggatctgctgccctgtg

SEQ ID NO: 579770 - DNA, 25 bp, Rattus norvegicus
tcataagtggatgtgctgccctgtg

SEQ ID NO: 579771 - DNA, 25 bp, Rattus norvegicus
tcataataccttccatttcacctca

SEQ ID NO: 579772 - DNA, 25 bp, Rattus norvegicus
tcataataccttgcatttcacctca

SEQ ID NO: 579773 - DNA, 25 bp, Rattus norvegicus
tcataatcacggacactgggagcta

SEQ ID NO: 579774 - DNA, 25 bp, Rattus norvegicus
tcataatcacggtcactgggagcta

SEQ ID NO: 579775 - DNA, 25 bp, Rattus norvegicus
tcataatccccaattttcaggccac

SEQ ID NO: 579776 - DNA, 25 bp, Rattus norvegicus
tcataatccccatttttcaggccac

SEQ ID NO: 579777 - DNA, 25 bp, Rattus norvegicus
tcataatgccagcagcagcctttgc

SEQ ID NO: 579778 - DNA, 25 bp, Rattus norvegicus
tcataatgccaggagcagcctttgc

SEQ ID NO: 579779 - DNA, 25 bp, Rattus norvegicus
tcataatgccatctttttgtacctg

SEQ ID NO: 579780 - DNA, 25 bp, Rattus norvegicus
tcataatgccatgtttttgtacctg

SEQ ID NO: 579781 - DNA, 25 bp, Rattus norvegicus
tcataatgtttgactacctgctgcc

SEQ ID NO: 579782 - DNA, 25 bp, Rattus norvegicus
tcataatgtttgtctacctgctgcc

SEQ ID NO: 579783 - DNA, 25 bp, Rattus norvegicus
tcataattcctgatcagaatagata

SEQ ID NO: 579784 - DNA, 25 bp, Rattus norvegicus
tcataattcctgttcagaatagata

SEQ ID NO: 579785 - DNA, 25 bp, Rattus norvegicus
tcataattcttaataaatgctggtt

SEQ ID NO: 579786 - DNA, 25 bp, Rattus norvegicus
tcataattcttattaaatgctggtt

SEQ ID NO: 579787 - DNA, 25 bp, Rattus norvegicus
tcataatttgttaaagtgttccctt

SEQ ID NO: 579788 - DNA, 25 bp, Rattus norvegicus
tcataatttgtttaagtgttccctt

SEQ ID NO: 579789 - DNA, 25 bp, Rattus norvegicus
tcatacaactctaccaaccactaag

SEQ ID NO: 579790 - DNA, 25 bp, Rattus norvegicus
tcatacaactcttccaaccactaag

SEQ ID NO: 579791 - DNA, 25 bp, Rattus norvegicus
tcatacaagggcctcaggttttacc

SEQ ID NO: 579792 - DNA, 25 bp, Rattus norvegicus
tcatacaagggcgtcaggttttacc

SEQ ID NO: 579793 - DNA, 25 bp, Rattus norvegicus
tcatacacaccaaaagaggacatta

SEQ ID NO: 579794 - DNA, 25 bp, Rattus norvegicus
tcatacacaccataagaggacatta

SEQ ID NO: 579795 - DNA, 25 bp, Rattus norvegicus
tcatacactgtcctttgctaacctg

SEQ ID NO: 579796 - DNA, 25 bp, Rattus norvegicus
tcatacactgtcgtttgctaacctg

SEQ ID NO: 579797 - DNA, 25 bp, Rattus norvegicus
tcatacagctgtacagtgtcgggat

SEQ ID NO: 579798 - DNA, 25 bp, Rattus norvegicus
tcatacagctgttcagtgtcgggat

SEQ ID NO: 579799 - DNA, 25 bp, Rattus norvegicus
tcatacaggtgacagcaggtacaag

SEQ ID NO: 579800 - DNA, 25 bp, Rattus norvegicus
tcatacaggtgagagcaggtacaag

SEQ ID NO: 579801 - DNA, 25 bp, Rattus norvegicus
tcatacagtcttcagcaaggtgcag

SEQ ID NO: 579802 - DNA, 25 bp, Rattus norvegicus
tcatacagtcttgagcaaggtgcag

SEQ ID NO: 579803 - DNA, 25 bp, Rattus norvegicus
tcatacccatttctgtgcccttgag

SEQ ID NO: 579804 - DNA, 25 bp, Rattus norvegicus
tcatacccatttgtgtgcccttgag

SEQ ID NO: 579805 - DNA, 25 bp, Rattus norvegicus
tcataccctggaaatcacattttgt

SEQ ID NO: 579806 - DNA, 25 bp, Rattus norvegicus
tcataccctggatatcacattttgt

SEQ ID NO: 579807 - DNA, 25 bp, Rattus norvegicus
tcatacctcaaacgatggagcgcat

SEQ ID NO: 579808 - DNA, 25 bp, Rattus norvegicus
tcatacctcaaaggatggagcgcat

SEQ ID NO: 579809 - DNA, 25 bp, Rattus norvegicus
tcatacctgtctagctgcttagaag

SEQ ID NO: 579810 - DNA, 25 bp, Rattus norvegicus
tcatacctgtcttgctgcttagaag

SEQ ID NO: 579811 - DNA, 25 bp, Rattus norvegicus
tcataccttgccacacatacaaaag

SEQ ID NO: 579812 - DNA, 25 bp, Rattus norvegicus
tcataccttgcctcacatacaaaag

SEQ ID NO: 579813 - DNA, 25 bp, Rattus norvegicus
tcataccttgtgcaggtcccgggaa

SEQ ID NO: 579814 - DNA, 25 bp, Rattus norvegicus
tcataccttgtggaggtcccgggaa

SEQ ID NO: 579815 - DNA, 25 bp, Rattus norvegicus
tcataccttgttacagtctggacac

SEQ ID NO: 579816 - DNA, 25 bp, Rattus norvegicus
tcataccttgtttcagtctggacac

SEQ ID NO: 579817 - DNA, 25 bp, Rattus norvegicus
tcatacgatctgaatcctccaggac

SEQ ID NO: 579818 - DNA, 25 bp, Rattus norvegicus
tcatacgatctgtatcctccaggac

SEQ ID NO: 579819 - DNA, 25 bp, Rattus norvegicus
tcatacggccacagatacttggtct

SEQ ID NO: 579820 - DNA, 25 bp, Rattus norvegicus
tcatacggccactgatacttggtct

SEQ ID NO: 579821 - DNA, 25 bp, Rattus norvegicus
tcatacgtctagatctcccaaaaca

SEQ ID NO: 579822 - DNA, 25 bp, Rattus norvegicus
tcatacgtctagttctcccaaaaca

SEQ ID NO: 579823 - DNA, 25 bp, Rattus norvegicus
tcatacgtgaccattgtggactgta

SEQ ID NO: 579824 - DNA, 25 bp, Rattus norvegicus
tcatacgtgacctttgtggactgta

SEQ ID NO: 579825 - DNA, 25 bp, Rattus norvegicus
tcatactcatatccacacagtggta

SEQ ID NO: 579826 - DNA, 25 bp, Rattus norvegicus
tcatactcatatgcacacagtggta

SEQ ID NO: 579827 - DNA, 25 bp, Rattus norvegicus
tcatactccactcctggccagagaa

SEQ ID NO: 579828 - DNA, 25 bp, Rattus norvegicus
tcatactccactgctggccagagaa

SEQ ID NO: 579829 - DNA, 25 bp, Rattus norvegicus
tcatactctcacatctagcttttag

SEQ ID NO: 579830 - DNA, 25 bp, Rattus norvegicus
tcatactctcacttctagcttttag

SEQ ID NO: 579831 - DNA, 25 bp, Rattus norvegicus
tcatactggcaaatggttcccactc

SEQ ID NO: 579832 - DNA, 25 bp, Rattus norvegicus
tcatactggcaattggttcccactc

SEQ ID NO: 579833 - DNA, 25 bp, Rattus norvegicus
tcatactgtcgtaggtttcaaccac

SEQ ID NO: 579834 - DNA, 25 bp, Rattus norvegicus
tcatactgtcgttggtttcaaccac

SEQ ID NO: 579835 - DNA, 25 bp, Rattus norvegicus
tcatacttgaagaagcctctgcctt

SEQ ID NO: 579836 - DNA, 25 bp, Rattus norvegicus
tcatacttgaagtagcctctgcctt

SEQ ID NO: 579837 - DNA, 25 bp, Rattus norvegicus
tcatacttgagtccatctggagata

SEQ ID NO: 579838 - DNA, 25 bp, Rattus norvegicus
tcatacttgagtgcatctggagata

SEQ ID NO: 579839 - DNA, 25 bp, Rattus norvegicus
tcatagaagtctagcagtctcccag

SEQ ID NO: 579840 - DNA, 25 bp, Rattus norvegicus
tcatagaagtcttgcagtctcccag

SEQ ID NO: 579841 - DNA, 25 bp, Rattus norvegicus
tcatagaagttcaactgcacctcct

SEQ ID NO: 579842 - DNA, 25 bp, Rattus norvegicus
tcatagaagttctactgcacctcct

SEQ ID NO: 579843 - DNA, 25 bp, Rattus norvegicus
tcatagacactcactggttctgttt

SEQ ID NO: 579844 - DNA, 25 bp, Rattus norvegicus
tcatagacactctctggttctgttt

SEQ ID NO: 579845 - DNA, 25 bp, Rattus norvegicus
tcatagagaccgagtaccgtggcgc

SEQ ID NO: 579846 - DNA, 25 bp, Rattus norvegicus
tcatagagaccgtgtaccgtggcgc

SEQ ID NO: 579847 - DNA, 25 bp, Rattus norvegicus
tcatagagagcaagcgagccagcct

SEQ ID NO: 579848 - DNA, 25 bp, Rattus norvegicus
tcatagagagcatgcgagccagcct

SEQ ID NO: 579849 - DNA, 25 bp, Rattus norvegicus
tcatagcacctgagggctgcggtca

SEQ ID NO: 579850 - DNA, 25 bp, Rattus norvegicus
tcatagcacctgtgggctgcggtca

SEQ ID NO: 579851 - DNA, 25 bp, Rattus norvegicus
tcatagcagcctcctgtagtccata

SEQ ID NO: 579852 - DNA, 25 bp, Rattus norvegicus
tcatagcagcctgctgtagtccata

SEQ ID NO: 579853 - DNA, 25 bp, Rattus norvegicus
tcatagcagctgctgtatgctgctt

SEQ ID NO: 579854 - DNA, 25 bp, Rattus norvegicus
tcatagcagctggtgtatgctgctt

SEQ ID NO: 579855 - DNA, 25 bp, Rattus norvegicus
tcatagcagtagaggcttcgccatt

SEQ ID NO: 579856 - DNA, 25 bp, Rattus norvegicus
tcatagcagtagtggcttcgccatt

SEQ ID NO: 579857 - DNA, 25 bp, Rattus norvegicus
tcatagcgagcgactgggcagcagc

SEQ ID NO: 579858 - DNA, 25 bp, Rattus norvegicus
tcatagcgagcgtctgggcagcagc

SEQ ID NO: 579859 - DNA, 25 bp, Rattus norvegicus
tcatagcgataactctccgaaggga

SEQ ID NO: 579860 - DNA, 25 bp, Rattus norvegicus
tcatagcgataagtctccgaaggga

SEQ ID NO: 579861 - DNA, 25 bp, Rattus norvegicus
tcatagcgtgcactgccagcaaaat

SEQ ID NO: 579862 - DNA, 25 bp, Rattus norvegicus
tcatagcgtgcagtgccagcaaaat

SEQ ID NO: 579863 - DNA, 25 bp, Rattus norvegicus
tcatagctctgactgtcatggaact

SEQ ID NO: 579864 - DNA, 25 bp, Rattus norvegicus
tcatagctctgagtgtcatggaact

SEQ ID NO: 579865 - DNA, 25 bp, Rattus norvegicus
tcatagctgtctccgatgatgccag

SEQ ID NO: 579866 - DNA, 25 bp, Rattus norvegicus
tcatagctgtctgcgatgatgccag

SEQ ID NO: 579867 - DNA, 25 bp, Rattus norvegicus
tcataggattatcgccaccatcatc

SEQ ID NO: 579868 - DNA, 25 bp, Rattus norvegicus
tcataggattatggccaccatcatc

SEQ ID NO: 579869 - DNA, 25 bp, Rattus norvegicus
tcataggcacacagtccagtctcag

SEQ ID NO: 579870 - DNA, 25 bp, Rattus norvegicus
tcataggcacactgtccagtctcag

SEQ ID NO: 579871 - DNA, 25 bp, Rattus norvegicus
tcataggcacctcactgggaattat

SEQ ID NO: 579872 - DNA, 25 bp, Rattus norvegicus
tcataggcacctgactgggaattat

SEQ ID NO: 579873 - DNA, 25 bp, Rattus norvegicus
tcataggccctgatcagtgttcagc

SEQ ID NO: 579874 - DNA, 25 bp, Rattus norvegicus
tcataggccctgttcagtgttcagc

SEQ ID NO: 579875 - DNA, 25 bp, Rattus norvegicus
tcataggcctggatggctgcctgtt

SEQ ID NO: 579876 - DNA, 25 bp, Rattus norvegicus
tcataggcctggttggctgcctgtt

SEQ ID NO: 579877 - DNA, 25 bp, Rattus norvegicus
tcataggctactcttgctgtcaaga

SEQ ID NO: 579878 - DNA, 25 bp, Rattus norvegicus
tcataggctactgttgctgtcaaga

SEQ ID NO: 579879 - DNA, 25 bp, Rattus norvegicus
tcatagtaacctaacccgactgacg

SEQ ID NO: 579880 - DNA, 25 bp, Rattus norvegicus
tcatagtaaccttacccgactgacg

SEQ ID NO: 579881 - DNA, 25 bp, Rattus norvegicus
tcatagtactggagcgggcattatt

SEQ ID NO: 579882 - DNA, 25 bp, Rattus norvegicus
tcatagtactggtgcgggcattatt

SEQ ID NO: 579883 - DNA, 25 bp, Rattus norvegicus
tcatagtcatgaaggttacctgcat

SEQ ID NO: 579884 - DNA, 25 bp, Rattus norvegicus
tcatagtcatgatggttacctgcat

SEQ ID NO: 579885 - DNA, 25 bp, Rattus norvegicus
tcatagtccaacactctcaaactgt

SEQ ID NO: 579886 - DNA, 25 bp, Rattus norvegicus
tcatagtccaactctctcaaactgt

SEQ ID NO: 579887 - DNA, 25 bp, Rattus norvegicus
tcatagtgcttcactgttccgtccg

SEQ ID NO: 579888 - DNA, 25 bp, Rattus norvegicus
tcatagtgcttctctgttccgtccg

SEQ ID NO: 579889 - DNA, 25 bp, Rattus norvegicus
tcatatacaggcacgtgcgcacgca

SEQ ID NO: 579890 - DNA, 25 bp, Rattus norvegicus
tcatatacaggctcgtgcgcacgca

SEQ ID NO: 579891 - DNA, 25 bp, Rattus norvegicus
tcatatcacctgacctttattcttg

SEQ ID NO: 579892 - DNA, 25 bp, Rattus norvegicus
tcatatcacctgtcctttattcttg

SEQ ID NO: 579893 - DNA, 25 bp, Rattus norvegicus
tcatatccaataaaccaccttgtgt

SEQ ID NO: 579894 - DNA, 25 bp, Rattus norvegicus
tcatatccaatataccaccttgtgt

SEQ ID NO: 579895 - DNA, 25 bp, Rattus norvegicus
tcatatccatgaacgcttccagatt

SEQ ID NO: 579896 - DNA, 25 bp, Rattus norvegicus
tcatatccatgatcgcttccagatt

SEQ ID NO: 579897 - DNA, 25 bp, Rattus norvegicus
tcatatccccagcaccatatgggaa

SEQ ID NO: 579898 - DNA, 25 bp, Rattus norvegicus
tcatatccccaggaccatatgggaa

SEQ ID NO: 579899 - DNA, 25 bp, Rattus norvegicus
tcatatcctaggctggcttcagcag

SEQ ID NO: 579900 - DNA, 25 bp, Rattus norvegicus
tcatatcctagggtggcttcagcag

SEQ ID NO: 579901 - DNA, 25 bp, Rattus norvegicus
tcatatctgttcataagcttatcaa

SEQ ID NO: 579902 - DNA, 25 bp, Rattus norvegicus
tcatatctgttcttaagcttatcaa

SEQ ID NO: 579903 - DNA, 25 bp, Rattus norvegicus
tcatatcttgtcagccctttctttt

SEQ ID NO: 579904 - DNA, 25 bp, Rattus norvegicus
tcatatcttgtctgccctttctttt

SEQ ID NO: 579905 - DNA, 25 bp, Rattus norvegicus
tcatatctttgtctgaccatcccta

SEQ ID NO: 579906 - DNA, 25 bp, Rattus norvegicus
tcatatctttgtgtgaccatcccta

SEQ ID NO: 579907 - DNA, 25 bp, Rattus norvegicus
tcatatgccatgatgcttccattgg

SEQ ID NO: 579908 - DNA, 25 bp, Rattus norvegicus
tcatatgccatgttgcttccattgg

SEQ ID NO: 579909 - DNA, 25 bp, Rattus norvegicus
tcatatgccccacaagttccttgat

SEQ ID NO: 579910 - DNA, 25 bp, Rattus norvegicus
tcatatgccccagaagttccttgat

SEQ ID NO: 579911 - DNA, 25 bp, Rattus norvegicus
tcatatgctatgacggtgttgcctt

SEQ ID NO: 579912 - DNA, 25 bp, Rattus norvegicus
tcatatgctatgtcggtgttgcctt

SEQ ID NO: 579913 - DNA, 25 bp, Rattus norvegicus
tcatatgctccaatagtttcaccca

SEQ ID NO: 579914 - DNA, 25 bp, Rattus norvegicus
tcatatgctccattagtttcaccca

SEQ ID NO: 579915 - DNA, 25 bp, Rattus norvegicus
tcatatggcgttctttattctgtgt

SEQ ID NO: 579916 - DNA, 25 bp, Rattus norvegicus
tcatatggcgttgtttattctgtgt

SEQ ID NO: 579917 - DNA, 25 bp, Rattus norvegicus
tcatatggttcccagttactccact

SEQ ID NO: 579918 - DNA, 25 bp, Rattus norvegicus
tcatatggttccgagttactccact

SEQ ID NO: 579919 - DNA, 25 bp, Rattus norvegicus
tcatatgtataaactcagccctgga

SEQ ID NO: 579920 - DNA, 25 bp, Rattus norvegicus
tcatatgtataacctcatgtggagt

SEQ ID NO: 579921 - DNA, 25 bp, Rattus norvegicus
tcatatgtataagctcatgtggagt

SEQ ID NO: 579922 - DNA, 25 bp, Rattus norvegicus
tcatatgtataatctcagccctgga

SEQ ID NO: 579923 - DNA, 25 bp, Rattus norvegicus
tcatatgtgtgcagtgttaacattt

SEQ ID NO: 579924 - DNA, 25 bp, Rattus norvegicus
tcatatgtgtgctgtgttaacattt

SEQ ID NO: 579925 - DNA, 25 bp, Rattus norvegicus
tcatatgttactactgtgtccaggt

SEQ ID NO: 579926 - DNA, 25 bp, Rattus norvegicus
tcatatgttacttctgtgtccaggt

SEQ ID NO: 579927 - DNA, 25 bp, Rattus norvegicus
tcatattacccacaagtcccagttc

SEQ ID NO: 579928 - DNA, 25 bp, Rattus norvegicus
tcatattacccagaagtcccagttc

SEQ ID NO: 579929 - DNA, 25 bp, Rattus norvegicus
tcatattagggaaataggcagccat

SEQ ID NO: 579930 - DNA, 25 bp, Rattus norvegicus
tcatattagggatataggcagccat

SEQ ID NO: 579931 - DNA, 25 bp, Rattus norvegicus
tcatattcacaccatttctccaaaa

SEQ ID NO: 579932 - DNA, 25 bp, Rattus norvegicus
tcatattcacacgatttctccaaaa

SEQ ID NO: 579933 - DNA, 25 bp, Rattus norvegicus
tcatattcacgacttcatctaggcc

SEQ ID NO: 579934 - DNA, 25 bp, Rattus norvegicus
tcatattcacgagttcatctaggcc

SEQ ID NO: 579935 - DNA, 25 bp, Rattus norvegicus
tcatattcagcccatcacgctgtgg

SEQ ID NO: 579936 - DNA, 25 bp, Rattus norvegicus
tcatattcagccgatcacgctgtgg

SEQ ID NO: 579937 - DNA, 25 bp, Rattus norvegicus
tcatattcccacatgtatcacacag

SEQ ID NO: 579938 - DNA, 25 bp, Rattus norvegicus
tcatattcccacttgtatcacacag

SEQ ID NO: 579939 - DNA, 25 bp, Rattus norvegicus
tcatattctcccagtgcatgtgcac

SEQ ID NO: 579940 - DNA, 25 bp, Rattus norvegicus
tcatattctccctgtgcatgtgcac

SEQ ID NO: 579941 - DNA, 25 bp, Rattus norvegicus
tcatattcttgactcgtcttgagag

SEQ ID NO: 579942 - DNA, 25 bp, Rattus norvegicus
tcatattcttgagtcgtcttgagag

SEQ ID NO: 579943 - DNA, 25 bp, Rattus norvegicus
tcatattggcttaagaggccccggg

SEQ ID NO: 579944 - DNA, 25 bp, Rattus norvegicus
tcatattggctttagaggccccggg

SEQ ID NO: 579945 - DNA, 25 bp, Rattus norvegicus
tcatattgtcataaaaccacccctc

SEQ ID NO: 579946 - DNA, 25 bp, Rattus norvegicus
tcatattgtcattaaaccacccctc

SEQ ID NO: 579947 - DNA, 25 bp, Rattus norvegicus
tcatatttcaaaccgcctcgccaaa

SEQ ID NO: 579948 - DNA, 25 bp, Rattus norvegicus
tcatatttcaaagcgcctcgccaaa

SEQ ID NO: 579949 - DNA, 25 bp, Rattus norvegicus
tcatattttcctatgcgatgttggg

SEQ ID NO: 579950 - DNA, 25 bp, Rattus norvegicus
tcatattttcctttgcgatgttggg

SEQ ID NO: 579951 - DNA, 25 bp, Rattus norvegicus
tcatattttgctctgtagccctggc

SEQ ID NO: 579952 - DNA, 25 bp, Rattus norvegicus
tcatattttgctgtgtagccctggc

SEQ ID NO: 579953 - DNA, 25 bp, Rattus norvegicus
tcatattttggacggtttcttgtgt

SEQ ID NO: 579954 - DNA, 25 bp, Rattus norvegicus
tcatattttggagggtttcttgtgt

SEQ ID NO: 579955 - DNA, 25 bp, Rattus norvegicus
tcatcaaactccaccgccagggtta

SEQ ID NO: 579956 - DNA, 25 bp, Rattus norvegicus
tcatcaaactcctccgccagggtta

SEQ ID NO: 579957 - DNA, 25 bp, Rattus norvegicus
tcatcaaactgcagctcttgcatgg

SEQ ID NO: 579958 - DNA, 25 bp, Rattus norvegicus
tcatcaaactgctgctcttgcatgg

SEQ ID NO: 579959 - DNA, 25 bp, Rattus norvegicus
tcatcaaatatcatttccacccttt

SEQ ID NO: 579960 - DNA, 25 bp, Rattus norvegicus
tcatcaaatatcttttccacccttt

SEQ ID NO: 579961 - DNA, 25 bp, Rattus norvegicus
tcatcaaatggcaacttggacgtgg

SEQ ID NO: 579962 - DNA, 25 bp, Rattus norvegicus
tcatcaaatggctacttggacgtgg

SEQ ID NO: 579963 - DNA, 25 bp, Rattus norvegicus
tcatcaacctgtcgtccgtgctgaa

SEQ ID NO: 579964 - DNA, 25 bp, Rattus norvegicus
tcatcaacctgtggtccgtgctgaa

SEQ ID NO: 579965 - DNA, 25 bp, Rattus norvegicus
tcatcaacttccaggtcaccagaga

SEQ ID NO: 579966 - DNA, 25 bp, Rattus norvegicus
tcatcaacttcctggtcaccagaga

SEQ ID NO: 579967 - DNA, 25 bp, Rattus norvegicus
tcatcaagactcagctctctggtat

SEQ ID NO: 579968 - DNA, 25 bp, Rattus norvegicus
tcatcaagactctgctctctggtat

SEQ ID NO: 579969 - DNA, 25 bp, Rattus norvegicus
tcatcaagaggactcgtggcggcaa

SEQ ID NO: 579970 - DNA, 25 bp, Rattus norvegicus
tcatcaagaggagtcgtggcggcaa

SEQ ID NO: 579971 - DNA, 25 bp, Rattus norvegicus
tcatcaagagtgcagctgtggcaga

SEQ ID NO: 579972 - DNA, 25 bp, Rattus norvegicus
tcatcaagagtggagctgtggcaga

SEQ ID NO: 579973 - DNA, 25 bp, Rattus norvegicus
tcatcaagatttactgccagcctgg

SEQ ID NO: 579974 - DNA, 25 bp, Rattus norvegicus
tcatcaagattttctgccagcctgg

SEQ ID NO: 579975 - DNA, 25 bp, Rattus norvegicus
tcatcaagcactcaccgaaggtcaa

SEQ ID NO: 579976 - DNA, 25 bp, Rattus norvegicus
tcatcaagcactgaccgaaggtcaa

SEQ ID NO: 579977 - DNA, 25 bp, Rattus norvegicus
tcatcaagcagaagccacccagaaa

SEQ ID NO: 579978 - DNA, 25 bp, Rattus norvegicus
tcatcaagcagacgactgccatcct

SEQ ID NO: 579979 - DNA, 25 bp, Rattus norvegicus
tcatcaagcagaggactgccatcct

SEQ ID NO: 579980 - DNA, 25 bp, Rattus norvegicus
tcatcaagcagatgccacccagaaa

SEQ ID NO: 579981 - DNA, 25 bp, Rattus norvegicus
tcatcaagctagaggcctcctgtaa

SEQ ID NO: 579982 - DNA, 25 bp, Rattus norvegicus
tcatcaagctagtggcctcctgtaa

SEQ ID NO: 579983 - DNA, 25 bp, Rattus norvegicus
tcatcaagcttacctgataggccag

SEQ ID NO: 579984 - DNA, 25 bp, Rattus norvegicus
tcatcaagcttagctgataggccag

SEQ ID NO: 579985 - DNA, 25 bp, Rattus norvegicus
tcatcaagtaccattgctccaaggc

SEQ ID NO: 579986 - DNA, 25 bp, Rattus norvegicus
tcatcaagtacctttgctccaaggc

SEQ ID NO: 579987 - DNA, 25 bp, Rattus norvegicus
tcatcaagtgtgacccggactgcct

SEQ ID NO: 579988 - DNA, 25 bp, Rattus norvegicus
tcatcaagtgtgtcccggactgcct

SEQ ID NO: 579989 - DNA, 25 bp, Rattus norvegicus
tcatcaatcagaatccccacatagt

SEQ ID NO: 579990 - DNA, 25 bp, Rattus norvegicus
tcatcaatcagattccccacatagt

SEQ ID NO: 579991 - DNA, 25 bp, Rattus norvegicus
tcatcacaacaactacgtacttctc

SEQ ID NO: 579992 - DNA, 25 bp, Rattus norvegicus
tcatcacaacaagtacgtacttctc

SEQ ID NO: 579993 - DNA, 25 bp, Rattus norvegicus
tcatcacaccgaagcttctacagaa

SEQ ID NO: 579994 - DNA, 25 bp, Rattus norvegicus
tcatcacaccgatgcttctacagaa

SEQ ID NO: 579995 - DNA, 25 bp, Rattus norvegicus
tcatcacaggttaccctacagagca

SEQ ID NO: 579996 - DNA, 25 bp, Rattus norvegicus
tcatcacaggtttccctacagagca

SEQ ID NO: 579997 - DNA, 25 bp, Rattus norvegicus
tcatcacatcccagtatctgacttg

SEQ ID NO: 579998 - DNA, 25 bp, Rattus norvegicus
tcatcacatccctgtatctgacttg

SEQ ID NO: 579999 - DNA, 25 bp, Rattus norvegicus
tcatcacatcgcaaactaaacttcc

SEQ ID NO: 580000 - DNA, 25 bp, Rattus norvegicus
tcatcacatcgctaactaaacttcc

SEQ ID NO: 580001 - DNA, 25 bp, Rattus norvegicus
tcatcacatgacctcttgcggtggt

SEQ ID NO: 580002 - DNA, 25 bp, Rattus norvegicus
tcatcacatgacgtcttgcggtggt

SEQ ID NO: 580003 - DNA, 25 bp, Rattus norvegicus
tcatcaccaaaccaaccagttgagt

SEQ ID NO: 580004 - DNA, 25 bp, Rattus norvegicus
tcatcaccaaacgaaccagttgagt

SEQ ID NO: 580005 - DNA, 25 bp, Rattus norvegicus
tcatcaccaagcatcttctgtggag

SEQ ID NO: 580006 - DNA, 25 bp, Rattus norvegicus
tcatcaccaagcttcttctgtggag

SEQ ID NO: 580007 - DNA, 25 bp, Rattus norvegicus
tcatcaccacctactagagtcaaga

SEQ ID NO: 580008 - DNA, 25 bp, Rattus norvegicus
tcatcaccaccttctagagtcaaga

SEQ ID NO: 580009 - DNA, 25 bp, Rattus norvegicus
tcatcaccatatccgtgccatgtaa

SEQ ID NO: 580010 - DNA, 25 bp, Rattus norvegicus
tcatcaccatatgcgtgccatgtaa

SEQ ID NO: 580011 - DNA, 25 bp, Rattus norvegicus
tcatcaccatgccagcacaagtgtg

SEQ ID NO: 580012 - DNA, 25 bp, Rattus norvegicus
tcatcaccatgcgagcacaagtgtg

SEQ ID NO: 580013 - DNA, 25 bp, Rattus norvegicus
tcatcaccctgaagagcgggattca

SEQ ID NO: 580014 - DNA, 25 bp, Rattus norvegicus
tcatcaccctgatgagcgggattca

SEQ ID NO: 580015 - DNA, 25 bp, Rattus norvegicus
tcatcaccttagacttgtcccagtt

SEQ ID NO: 580016 - DNA, 25 bp, Rattus norvegicus
tcatcaccttagtcttgtcccagtt

SEQ ID NO: 580017 - DNA, 25 bp, Rattus norvegicus
tcatcaccttggagtccagcagcag

SEQ ID NO: 580018 - DNA, 25 bp, Rattus norvegicus
tcatcaccttggctacctttggtat

SEQ ID NO: 580019 - DNA, 25 bp, Rattus norvegicus
tcatcaccttgggtacctttggtat

SEQ ID NO: 580020 - DNA, 25 bp, Rattus norvegicus
tcatcaccttggtgtccagcagcag

SEQ ID NO: 580021 - DNA, 25 bp, Rattus norvegicus
tcatcacgagagcaccagacttggg

SEQ ID NO: 580022 - DNA, 25 bp, Rattus norvegicus
tcatcacgagaggaccagacttggg

SEQ ID NO: 580023 - DNA, 25 bp, Rattus norvegicus
tcatcacgctgcagggcaagcagga

SEQ ID NO: 580024 - DNA, 25 bp, Rattus norvegicus
tcatcacgctgctgggcaagcagga

SEQ ID NO: 580025 - DNA, 25 bp, Rattus norvegicus
tcatcacgggctctttgcatcttat

SEQ ID NO: 580026 - DNA, 25 bp, Rattus norvegicus
tcatcacgggctgtttgcatcttat

SEQ ID NO: 580027 - DNA, 25 bp, Rattus norvegicus
tcatcactaatgatgggagcagacc

SEQ ID NO: 580028 - DNA, 25 bp, Rattus norvegicus
tcatcactaatgttgggagcagacc

SEQ ID NO: 580029 - DNA, 25 bp, Rattus norvegicus
tcatcactaggtcctttgtcctttt

SEQ ID NO: 580030 - DNA, 25 bp, Rattus norvegicus
tcatcactaggtgctttgtcctttt

SEQ ID NO: 580031 - DNA, 25 bp, Rattus norvegicus
tcatcactcaaaagttccgaacact

SEQ ID NO: 580032 - DNA, 25 bp, Rattus norvegicus
tcatcactcaaatgttccgaacact

SEQ ID NO: 580033 - DNA, 25 bp, Rattus norvegicus
tcatcactccaaatcttttaagttt

SEQ ID NO: 580034 - DNA, 25 bp, Rattus norvegicus
tcatcactccaattcttttaagttt

SEQ ID NO: 580035 - DNA, 25 bp, Rattus norvegicus
tcatcactgtatcatttggtatcac

SEQ ID NO: 580036 - DNA, 25 bp, Rattus norvegicus
tcatcactgtatgatttggtatcac

SEQ ID NO: 580037 - DNA, 25 bp, Rattus norvegicus
tcatcacttaccactgttcctcttt

SEQ ID NO: 580038 - DNA, 25 bp, Rattus norvegicus
tcatcacttaccagtttctctgtgc

SEQ ID NO: 580039 - DNA, 25 bp, Rattus norvegicus
tcatcacttacctctgttcctcttt

SEQ ID NO: 580040 - DNA, 25 bp, Rattus norvegicus
tcatcacttacctgtttctctgtgc

SEQ ID NO: 580041 - DNA, 25 bp, Rattus norvegicus
tcatcagacagcctcgggtcctact

SEQ ID NO: 580042 - DNA, 25 bp, Rattus norvegicus
tcatcagacagcgtcgggtcctact

SEQ ID NO: 580043 - DNA, 25 bp, Rattus norvegicus
tcatcagaggtaacctggagtgcgt

SEQ ID NO: 580044 - DNA, 25 bp, Rattus norvegicus
tcatcagaggtatcctggagtgcgt

SEQ ID NO: 580045 - DNA, 25 bp, Rattus norvegicus
tcatcagatgtgcttcagagactac

SEQ ID NO: 580046 - DNA, 25 bp, Rattus norvegicus
tcatcagatgtggttcagagactac

SEQ ID NO: 580047 - DNA, 25 bp, Rattus norvegicus
tcatcagcacccaagactactaatc

SEQ ID NO: 580048 - DNA, 25 bp, Rattus norvegicus
tcatcagcaccctagactactaatc

SEQ ID NO: 580049 - DNA, 25 bp, Rattus norvegicus
tcatcagcactcagatccgtatgga

SEQ ID NO: 580050 - DNA, 25 bp, Rattus norvegicus
tcatcagcactctgatccgtatgga

SEQ ID NO: 580051 - DNA, 25 bp, Rattus norvegicus
tcatcagcagtaacccagacagtct

SEQ ID NO: 580052 - DNA, 25 bp, Rattus norvegicus
tcatcagcagtatcccagacagtct

SEQ ID NO: 580053 - DNA, 25 bp, Rattus norvegicus
tcatcagcatctattcctctgttat

SEQ ID NO: 580054 - DNA, 25 bp, Rattus norvegicus
tcatcagcatcttttcctctgttat

SEQ ID NO: 580055 - DNA, 25 bp, Rattus norvegicus
tcatcagccagaatcagtgcaagga

SEQ ID NO: 580056 - DNA, 25 bp, Rattus norvegicus
tcatcagccagattcagtgcaagga

SEQ ID NO: 580057 - DNA, 25 bp, Rattus norvegicus
tcatcagccctgagccggatacaaa

SEQ ID NO: 580058 - DNA, 25 bp, Rattus norvegicus
tcatcagccctgatttctaattcca

SEQ ID NO: 580059 - DNA, 25 bp, Rattus norvegicus
tcatcagccctgtgccggatacaaa

SEQ ID NO: 580060 - DNA, 25 bp, Rattus norvegicus
tcatcagccctgttttctaattcca

SEQ ID NO: 580061 - DNA, 25 bp, Rattus norvegicus
tcatcagccggaatttgttattgat

SEQ ID NO: 580062 - DNA, 25 bp, Rattus norvegicus
tcatcagccggattttgttattgat

SEQ ID NO: 580063 - DNA, 25 bp, Rattus norvegicus
tcatcagcctgtcggaggagcacat

SEQ ID NO: 580064 - DNA, 25 bp, Rattus norvegicus
tcatcagcctgtgggaggagcacat

SEQ ID NO: 580065 - DNA, 25 bp, Rattus norvegicus
tcatcagccttcactagttccctag

SEQ ID NO: 580066 - DNA, 25 bp, Rattus norvegicus
tcatcagccttctctagttccctag

SEQ ID NO: 580067 - DNA, 25 bp, Rattus norvegicus
tcatcagcgatgcagctcagcttca

SEQ ID NO: 580068 - DNA, 25 bp, Rattus norvegicus
tcatcagcgatggagctcagcttca

SEQ ID NO: 580069 - DNA, 25 bp, Rattus norvegicus
tcatcagcggccacatgtacatgat

SEQ ID NO: 580070 - DNA, 25 bp, Rattus norvegicus
tcatcagcggcctcatgtacatgat

SEQ ID NO: 580071 - DNA, 25 bp, Rattus norvegicus
tcatcagctttgctcttggcatcgt

SEQ ID NO: 580072 - DNA, 25 bp, Rattus norvegicus
tcatcagctttggtcttggcatcgt

SEQ ID NO: 580073 - DNA, 25 bp, Rattus norvegicus
tcatcaggatttcccctgcagactt

SEQ ID NO: 580074 - DNA, 25 bp, Rattus norvegicus
tcatcaggatttgccctgcagactt

SEQ ID NO: 580075 - DNA, 25 bp, Rattus norvegicus
tcatcaggccgaccttgccgaggga

SEQ ID NO: 580076 - DNA, 25 bp, Rattus norvegicus
tcatcaggccgagcttgccgaggga

SEQ ID NO: 580077 - DNA, 25 bp, Rattus norvegicus
tcatcaggccgtcttccaaagtcat

SEQ ID NO: 580078 - DNA, 25 bp, Rattus norvegicus
tcatcaggccgtgttccaaagtcat

SEQ ID NO: 580079 - DNA, 25 bp, Rattus norvegicus
tcatcaggctagacggatgtcctcc

SEQ ID NO: 580080 - DNA, 25 bp, Rattus norvegicus
tcatcaggctagtcggatgtcctcc

SEQ ID NO: 580081 - DNA, 25 bp, Rattus norvegicus
tcatcagggtgcagtttgtggataa

SEQ ID NO: 580082 - DNA, 25 bp, Rattus norvegicus
tcatcagggtgctgtttgtggataa

SEQ ID NO: 580083 - DNA, 25 bp, Rattus norvegicus
tcatcaggtgagactagagggcttc

SEQ ID NO: 580084 - DNA, 25 bp, Rattus norvegicus
tcatcaggtgagattacatcacaca

SEQ ID NO: 580085 - DNA, 25 bp, Rattus norvegicus
tcatcaggtgagtctagagggcttc

SEQ ID NO: 580086 - DNA, 25 bp, Rattus norvegicus
tcatcaggtgagtttacatcacaca

SEQ ID NO: 580087 - DNA, 25 bp, Rattus norvegicus
tcatcagtacgtctctccgattcat

SEQ ID NO: 580088 - DNA, 25 bp, Rattus norvegicus
tcatcagtacgtgtctccgattcat

SEQ ID NO: 580089 - DNA, 25 bp, Rattus norvegicus
tcatcagtcccgaggcttgggtgaa

SEQ ID NO: 580090 - DNA, 25 bp, Rattus norvegicus
tcatcagtcccgtggcttgggtgaa

SEQ ID NO: 580091 - DNA, 25 bp, Rattus norvegicus
tcatcagtctgcaggttatgcctta

SEQ ID NO: 580092 - DNA, 25 bp, Rattus norvegicus
tcatcagtctgctggttatgcctta

SEQ ID NO: 580093 - DNA, 25 bp, Rattus norvegicus
tcatcagtcttgaaattccagggta

SEQ ID NO: 580094 - DNA, 25 bp, Rattus norvegicus
tcatcagtcttgtaattccagggta

SEQ ID NO: 580095 - DNA, 25 bp, Rattus norvegicus
tcatcagtgcatatataatctgagg

SEQ ID NO: 580096 - DNA, 25 bp, Rattus norvegicus
tcatcagtgcatttataatctgagg

SEQ ID NO: 580097 - DNA, 25 bp, Rattus norvegicus
tcatcagtggttcagaccccagctt

SEQ ID NO: 580098 - DNA, 25 bp, Rattus norvegicus
tcatcagtggttgagaccccagctt

SEQ ID NO: 580099 - DNA, 25 bp, Rattus norvegicus
tcatcatagtgaacgagcccgggct

SEQ ID NO: 580100 - DNA, 25 bp, Rattus norvegicus
tcatcatagtgatcgagcccgggct

SEQ ID NO: 580101 - DNA, 25 bp, Rattus norvegicus
tcatcatatccaagaccgagctcat

SEQ ID NO: 580102 - DNA, 25 bp, Rattus norvegicus
tcatcatatccatgaccgagctcat

SEQ ID NO: 580103 - DNA, 25 bp, Rattus norvegicus
tcatcatatctgactccaccatgtt

SEQ ID NO: 580104 - DNA, 25 bp, Rattus norvegicus
tcatcatatctgtctccaccatgtt

SEQ ID NO: 580105 - DNA, 25 bp, Rattus norvegicus
tcatcatcacatcgaccccttataa

SEQ ID NO: 580106 - DNA, 25 bp, Rattus norvegicus
tcatcatcacatggaccccttataa

SEQ ID NO: 580107 - DNA, 25 bp, Rattus norvegicus
tcatcatcactactactgagggcaa

SEQ ID NO: 580108 - DNA, 25 bp, Rattus norvegicus
tcatcatcactagtactgagggcaa

SEQ ID NO: 580109 - DNA, 25 bp, Rattus norvegicus
tcatcatcactcaaagctgaaaagg

SEQ ID NO: 580110 - DNA, 25 bp, Rattus norvegicus
tcatcatcactctaagctgaaaagg

SEQ ID NO: 580111 - DNA, 25 bp, Rattus norvegicus
tcatcatcattgcaggtcttagctt

SEQ ID NO: 580112 - DNA, 25 bp, Rattus norvegicus
tcatcatcattggaggtcttagctt

SEQ ID NO: 580113 - DNA, 25 bp, Rattus norvegicus
tcatcatcccagacttcgctaagag

SEQ ID NO: 580114 - DNA, 25 bp, Rattus norvegicus
tcatcatcccagtcttcgctaagag

SEQ ID NO: 580115 - DNA, 25 bp, Rattus norvegicus
tcatcatccgttaagctgtgagctt

SEQ ID NO: 580116 - DNA, 25 bp, Rattus norvegicus
tcatcatccgtttagctgtgagctt

SEQ ID NO: 580117 - DNA, 25 bp, Rattus norvegicus
tcatcatcctgacccttgtctaatc

SEQ ID NO: 580118 - DNA, 25 bp, Rattus norvegicus
tcatcatcctgagccttgtctaatc

SEQ ID NO: 580119 - DNA, 25 bp, Rattus norvegicus
tcatcatcgctccacttgcaaaaga

SEQ ID NO: 580120 - DNA, 25 bp, Rattus norvegicus
tcatcatcgctcgacttgcaaaaga

SEQ ID NO: 580121 - DNA, 25 bp, Rattus norvegicus
tcatcatctcctctgggtattaaga

SEQ ID NO: 580122 - DNA, 25 bp, Rattus norvegicus
tcatcatctcctgtgggtattaaga

SEQ ID NO: 580123 - DNA, 25 bp, Rattus norvegicus
tcatcatcttcacctactcagggat

SEQ ID NO: 580124 - DNA, 25 bp, Rattus norvegicus
tcatcatcttcagctactcagggat

SEQ ID NO: 580125 - DNA, 25 bp, Rattus norvegicus
tcatcatgaagactgatctcatcag

SEQ ID NO: 580126 - DNA, 25 bp, Rattus norvegicus
tcatcatgaagagtgatctcatcag

SEQ ID NO: 580127 - DNA, 25 bp, Rattus norvegicus
tcatcatgaccacaagcttgacgca

SEQ ID NO: 580128 - DNA, 25 bp, Rattus norvegicus
tcatcatgaccagaagcttgacgca

SEQ ID NO: 580129 - DNA, 25 bp, Rattus norvegicus
tcatcatgcatcaaaggcgctgcct

SEQ ID NO: 580130 - DNA, 25 bp, Rattus norvegicus
tcatcatgcatctaaggcgctgcct

SEQ ID NO: 580131 - DNA, 25 bp, Rattus norvegicus
tcatcatgccttccaactggtgggt

SEQ ID NO: 580132 - DNA, 25 bp, Rattus norvegicus
tcatcatgccttgcaactggtgggt

SEQ ID NO: 580133 - DNA, 25 bp, Rattus norvegicus
tcatcatgctcactgtggccacaca

SEQ ID NO: 580134 - DNA, 25 bp, Rattus norvegicus
tcatcatgctcagtgtggccacaca

SEQ ID NO: 580135 - DNA, 25 bp, Rattus norvegicus
tcatcatgtgtcagtaccataccaa

SEQ ID NO: 580136 - DNA, 25 bp, Rattus norvegicus
tcatcatgtgtctgtaccataccaa

SEQ ID NO: 580137 - DNA, 25 bp, Rattus norvegicus
tcatcatgttaactggcctctgaag

SEQ ID NO: 580138 - DNA, 25 bp, Rattus norvegicus
tcatcatgttaagtggcctctgaag

SEQ ID NO: 580139 - DNA, 25 bp, Rattus norvegicus
tcatcatgtttacagctgctctcac

SEQ ID NO: 580140 - DNA, 25 bp, Rattus norvegicus
tcatcatgtttagagctgctctcac

SEQ ID NO: 580141 - DNA, 25 bp, Rattus norvegicus
tcatcattccgtagctggacgtggc

SEQ ID NO: 580142 - DNA, 25 bp, Rattus norvegicus
tcatcattccgttgctggacgtggc

SEQ ID NO: 580143 - DNA, 25 bp, Rattus norvegicus
tcatcattgtaccagaagtttcttc

SEQ ID NO: 580144 - DNA, 25 bp, Rattus norvegicus
tcatcattgtacgagaagtttcttc

SEQ ID NO: 580145 - DNA, 25 bp, Rattus norvegicus
tcatcattgtgaagagtcgccccag

SEQ ID NO: 580146 - DNA, 25 bp, Rattus norvegicus
tcatcattgtgatgagtcgccccag

SEQ ID NO: 580147 - DNA, 25 bp, Rattus norvegicus
tcatcatttgctatgtctgtcccaa

SEQ ID NO: 580148 - DNA, 25 bp, Rattus norvegicus
tcatcatttgctttgtctgtcccaa

SEQ ID NO: 580149 - DNA, 25 bp, Rattus norvegicus
tcatccaagatcaagcggcacgtgt

SEQ ID NO: 580150 - DNA, 25 bp, Rattus norvegicus
tcatccaagatctagcggcacgtgt

SEQ ID NO: 580151 - DNA, 25 bp, Rattus norvegicus
tcatccaagggacagctgagctgtg

SEQ ID NO: 580152 - DNA, 25 bp, Rattus norvegicus
tcatccaagggagagctgagctgtg

SEQ ID NO: 580153 - DNA, 25 bp, Rattus norvegicus
tcatccacaacgcagacgagcggcg

SEQ ID NO: 580154 - DNA, 25 bp, Rattus norvegicus
tcatccacaacggagacgagcggcg

SEQ ID NO: 580155 - DNA, 25 bp, Rattus norvegicus
tcatccacaattcagccgtagcggg

SEQ ID NO: 580156 - DNA, 25 bp, Rattus norvegicus
tcatccacaattgagccgtagcggg

SEQ ID NO: 580157 - DNA, 25 bp, Rattus norvegicus
tcatccacgggccttgtgaagttgg

SEQ ID NO: 580158 - DNA, 25 bp, Rattus norvegicus
tcatccacgggcgttgtgaagttgg

SEQ ID NO: 580159 - DNA, 25 bp, Rattus norvegicus
tcatccagcaggcacttaataaatg

SEQ ID NO: 580160 - DNA, 25 bp, Rattus norvegicus
tcatccagcagggacttaataaatg

SEQ ID NO: 580161 - DNA, 25 bp, Rattus norvegicus
tcatccagccacagcaaatcttatt

SEQ ID NO: 580162 - DNA, 25 bp, Rattus norvegicus
tcatccagccactgcaaatcttatt

SEQ ID NO: 580163 - DNA, 25 bp, Rattus norvegicus
tcatccaggtttcagcacccaggct

SEQ ID NO: 580164 - DNA, 25 bp, Rattus norvegicus
tcatccaggtttgagcacccaggct

SEQ ID NO: 580165 - DNA, 25 bp, Rattus norvegicus
tcatccagtcgtatgaaggacctgc

SEQ ID NO: 580166 - DNA, 25 bp, Rattus norvegicus
tcatccagtcgtttgaaggacctgc

SEQ ID NO: 580167 - DNA, 25 bp, Rattus norvegicus
tcatccagtggcagccgacctagaa

SEQ ID NO: 580168 - DNA, 25 bp, Rattus norvegicus
tcatccagtggctgccgacctagaa

SEQ ID NO: 580169 - DNA, 25 bp, Rattus norvegicus
tcatccataggaagtgcgtctaaat

SEQ ID NO: 580170 - DNA, 25 bp, Rattus norvegicus
tcatccataggatgtgcgtctaaat

SEQ ID NO: 580171 - DNA, 25 bp, Rattus norvegicus
tcatccatagttactgctccttcag

SEQ ID NO: 580172 - DNA, 25 bp, Rattus norvegicus
tcatccatagtttctgctccttcag

SEQ ID NO: 580173 - DNA, 25 bp, Rattus norvegicus
tcatccatcagtactgccagggtta

SEQ ID NO: 580174 - DNA, 25 bp, Rattus norvegicus
tcatccatcagttctgccagggtta

SEQ ID NO: 580175 - DNA, 25 bp, Rattus norvegicus
tcatccatccctcaaagctcaatga

SEQ ID NO: 580176 - DNA, 25 bp, Rattus norvegicus
tcatccatccctgaaagctcaatga

SEQ ID NO: 580177 - DNA, 25 bp, Rattus norvegicus
tcatccatgacaactttggcatcgt

SEQ ID NO: 580178 - DNA, 25 bp, Rattus norvegicus
tcatccatgacatctttggcatcgt

SEQ ID NO: 580179 - DNA, 25 bp, Rattus norvegicus
tcatccatgacgaccgacctgagga

SEQ ID NO: 580180 - DNA, 25 bp, Rattus norvegicus
tcatccatgacgtccgacctgagga

SEQ ID NO: 580181 - DNA, 25 bp, Rattus norvegicus
tcatccatgttcatacactccagat

SEQ ID NO: 580182 - DNA, 25 bp, Rattus norvegicus
tcatccatgttcttacactccagat

SEQ ID NO: 580183 - DNA, 25 bp, Rattus norvegicus
tcatccattcacctctcaacaggag

SEQ ID NO: 580184 - DNA, 25 bp, Rattus norvegicus
tcatccattcacgtctcaacaggag

SEQ ID NO: 580185 - DNA, 25 bp, Rattus norvegicus
tcatcccaaagcacctgcctgtgtt

SEQ ID NO: 580186 - DNA, 25 bp, Rattus norvegicus
tcatcccaaagctcctgcctgtgtt

SEQ ID NO: 580187 - DNA, 25 bp, Rattus norvegicus
tcatcccaacaacccttcttttatg

SEQ ID NO: 580188 - DNA, 25 bp, Rattus norvegicus
tcatcccaacaagccttcttttatg

SEQ ID NO: 580189 - DNA, 25 bp, Rattus norvegicus
tcatcccaacccagtatttttctaa

SEQ ID NO: 580190 - DNA, 25 bp, Rattus norvegicus
tcatcccaaccctgtatttttctaa

SEQ ID NO: 580191 - DNA, 25 bp, Rattus norvegicus
tcatcccaagctctggagacagcag

SEQ ID NO: 580192 - DNA, 25 bp, Rattus norvegicus
tcatcccaagctgtggagacagcag

SEQ ID NO: 580193 - DNA, 25 bp, Rattus norvegicus
tcatcccacaccaatggacgtagaa

SEQ ID NO: 580194 - DNA, 25 bp, Rattus norvegicus
tcatcccacacctatggacgtagaa

SEQ ID NO: 580195 - DNA, 25 bp, Rattus norvegicus
tcatcccacgggattctattgagaa

SEQ ID NO: 580196 - DNA, 25 bp, Rattus norvegicus
tcatcccacgggtttctattgagaa

SEQ ID NO: 580197 - DNA, 25 bp, Rattus norvegicus
tcatcccactttacactgacattgg

SEQ ID NO: 580198 - DNA, 25 bp, Rattus norvegicus
tcatcccactttctgcgggtttgaa

SEQ ID NO: 580199 - DNA, 25 bp, Rattus norvegicus
tcatcccactttgtgcgggtttgaa

SEQ ID NO: 580200 - DNA, 25 bp, Rattus norvegicus
tcatcccacttttcactgacattgg

SEQ ID NO: 580201 - DNA, 25 bp, Rattus norvegicus
tcatcccagaatccaactctttcag

SEQ ID NO: 580202 - DNA, 25 bp, Rattus norvegicus
tcatcccagaatgcaactctttcag

SEQ ID NO: 580203 - DNA, 25 bp, Rattus norvegicus
tcatcccagagcctgttgttgtagg

SEQ ID NO: 580204 - DNA, 25 bp, Rattus norvegicus
tcatcccagagcgtgttgttgtagg

SEQ ID NO: 580205 - DNA, 25 bp, Rattus norvegicus
tcatcccagcaaaccattggcagat

SEQ ID NO: 580206 - DNA, 25 bp, Rattus norvegicus
tcatcccagcaatccattggcagat

SEQ ID NO: 580207 - DNA, 25 bp, Rattus norvegicus
tcatcccagctgaggtttatagttt

SEQ ID NO: 580208 - DNA, 25 bp, Rattus norvegicus
tcatcccagctgtggtttatagttt

SEQ ID NO: 580209 - DNA, 25 bp, Rattus norvegicus
tcatcccaggacacaatatcgcaga

SEQ ID NO: 580210 - DNA, 25 bp, Rattus norvegicus
tcatcccaggactcaatatcgcaga

SEQ ID NO: 580211 - DNA, 25 bp, Rattus norvegicus
tcatcccaggatctagtggtaccca

SEQ ID NO: 580212 - DNA, 25 bp, Rattus norvegicus
tcatcccaggatgtagtggtaccca

SEQ ID NO: 580213 - DNA, 25 bp, Rattus norvegicus
tcatcccatacgactggtctctggt

SEQ ID NO: 580214 - DNA, 25 bp, Rattus norvegicus
tcatcccatacgtctggtctctggt

SEQ ID NO: 580215 - DNA, 25 bp, Rattus norvegicus
tcatcccatatccagtttcttcttc

SEQ ID NO: 580216 - DNA, 25 bp, Rattus norvegicus
tcatcccatatcgagtttcttcttc

SEQ ID NO: 580217 - DNA, 25 bp, Rattus norvegicus
tcatcccatcatctattgccattaa

SEQ ID NO: 580218 - DNA, 25 bp, Rattus norvegicus
tcatcccatcatgtattgccattaa

SEQ ID NO: 580219 - DNA, 25 bp, Rattus norvegicus
tcatcccatccactgaagttctgat

SEQ ID NO: 580220 - DNA, 25 bp, Rattus norvegicus
tcatcccatccagtgaagttctgat

SEQ ID NO: 580221 - DNA, 25 bp, Rattus norvegicus
tcatcccatggcaatctctagtaac

SEQ ID NO: 580222 - DNA, 25 bp, Rattus norvegicus
tcatcccatggctatctctagtaac

SEQ ID NO: 580223 - DNA, 25 bp, Rattus norvegicus
tcatcccatgttcagcaggttgcag

SEQ ID NO: 580224 - DNA, 25 bp, Rattus norvegicus
tcatcccatgttgagcaggttgcag

SEQ ID NO: 580225 - DNA, 25 bp, Rattus norvegicus
tcatccccacagctgtgcttggaag

SEQ ID NO: 580226 - DNA, 25 bp, Rattus norvegicus
tcatccccacaggtgtgcttggaag

SEQ ID NO: 580227 - DNA, 25 bp, Rattus norvegicus
tcatccccagctacacatggagtta

SEQ ID NO: 580228 - DNA, 25 bp, Rattus norvegicus
tcatccccagcttcacatggagtta

SEQ ID NO: 580229 - DNA, 25 bp, Rattus norvegicus
tcatccccagttcatgagaagccac

SEQ ID NO: 580230 - DNA, 25 bp, Rattus norvegicus
tcatccccagttgatgagaagccac

SEQ ID NO: 580231 - DNA, 25 bp, Rattus norvegicus
tcatccccatccacaaactggaaaa

SEQ ID NO: 580232 - DNA, 25 bp, Rattus norvegicus
tcatccccatcctcaaactggaaaa

SEQ ID NO: 580233 - DNA, 25 bp, Rattus norvegicus
tcatcccctcagatatgggcagtgt

SEQ ID NO: 580234 - DNA, 25 bp, Rattus norvegicus
tcatcccctcagttatgggcagtgt

SEQ ID NO: 580235 - DNA, 25 bp, Rattus norvegicus
tcatcccctttgagcccaaggaaaa

SEQ ID NO: 580236 - DNA, 25 bp, Rattus norvegicus
tcatcccctttgtgcccaaggaaaa

SEQ ID NO: 580237 - DNA, 25 bp, Rattus norvegicus
tcatcccgacatcgtggactacagg

SEQ ID NO: 580238 - DNA, 25 bp, Rattus norvegicus
tcatcccgacatggtggactacagg

SEQ ID NO: 580239 - DNA, 25 bp, Rattus norvegicus
tcatcccgcgaacgccgtggtggca

SEQ ID NO: 580240 - DNA, 25 bp, Rattus norvegicus
tcatcccgcgaaggccgtggtggca

SEQ ID NO: 580241 - DNA, 25 bp, Rattus norvegicus
tcatcccgggagcaggtccaccaga

SEQ ID NO: 580242 - DNA, 25 bp, Rattus norvegicus
tcatcccgggaggaggtccaccaga

SEQ ID NO: 580243 - DNA, 25 bp, Rattus norvegicus
tcatccctaacccttttggtgatag

SEQ ID NO: 580244 - DNA, 25 bp, Rattus norvegicus
tcatccctaaccgttttggtgatag

SEQ ID NO: 580245 - DNA, 25 bp, Rattus norvegicus
tcatccctcaacaagttatcgcatt

SEQ ID NO: 580246 - DNA, 25 bp, Rattus norvegicus
tcatccctcaactagttatcgcatt

SEQ ID NO: 580247 - DNA, 25 bp, Rattus norvegicus
tcatccctcctgctgtatattttct

SEQ ID NO: 580248 - DNA, 25 bp, Rattus norvegicus
tcatccctcctggtgtatattttct

SEQ ID NO: 580249 - DNA, 25 bp, Rattus norvegicus
tcatcccttccacgcaagacatatg

SEQ ID NO: 580250 - DNA, 25 bp, Rattus norvegicus
tcatcccttccaggcaagacatatg

SEQ ID NO: 580251 - DNA, 25 bp, Rattus norvegicus
tcatcccttgacatgtgtgaggaaa

SEQ ID NO: 580252 - DNA, 25 bp, Rattus norvegicus
tcatcccttgacttgtgtgaggaaa

SEQ ID NO: 580253 - DNA, 25 bp, Rattus norvegicus
tcatcccttttcctaacctaaatgt

SEQ ID NO: 580254 - DNA, 25 bp, Rattus norvegicus
tcatcccttttcgtaacctaaatgt

SEQ ID NO: 580255 - DNA, 25 bp, Rattus norvegicus
tcatccgaaacgacaaaggccctgt

SEQ ID NO: 580256 - DNA, 25 bp, Rattus norvegicus
tcatccgaaacgtcaaaggccctgt

SEQ ID NO: 580257 - DNA, 25 bp, Rattus norvegicus
tcatccgcagtgacacgggaggcat

SEQ ID NO: 580258 - DNA, 25 bp, Rattus norvegicus
tcatccgcagtgtcacgggaggcat

SEQ ID NO: 580259 - DNA, 25 bp, Rattus norvegicus
tcatccgctccacaatgcagttaag

SEQ ID NO: 580260 - DNA, 25 bp, Rattus norvegicus
tcatccgctccagaatgcagttaag

SEQ ID NO: 580261 - DNA, 25 bp, Rattus norvegicus
tcatccggaggccaaactactttga

SEQ ID NO: 580262 - DNA, 25 bp, Rattus norvegicus
tcatccggaggcgaaactactttga

SEQ ID NO: 580263 - DNA, 25 bp, Rattus norvegicus
tcatccggctgcagaagtgcaaacg

SEQ ID NO: 580264 - DNA, 25 bp, Rattus norvegicus
tcatccggctgctgaagtgcaaacg

SEQ ID NO: 580265 - DNA, 25 bp, Rattus norvegicus
tcatccgtatgacccacctatatat

SEQ ID NO: 580266 - DNA, 25 bp, Rattus norvegicus
tcatccgtatgagccacctatatat

SEQ ID NO: 580267 - DNA, 25 bp, Rattus norvegicus
tcatccgtgcgtctccaagagtgga

SEQ ID NO: 580268 - DNA, 25 bp, Rattus norvegicus
tcatccgtgcgtgtccaagagtgga

SEQ ID NO: 580269 - DNA, 25 bp, Rattus norvegicus
tcatccgtgggtcgtaattcccacc

SEQ ID NO: 580270 - DNA, 25 bp, Rattus norvegicus
tcatccgtgggtggtaattcccacc

SEQ ID NO: 580271 - DNA, 25 bp, Rattus norvegicus
tcatccgttcatatgagcatcgaaa

SEQ ID NO: 580272 - DNA, 25 bp, Rattus norvegicus
tcatccgttcatttgagcatcgaaa

SEQ ID NO: 580273 - DNA, 25 bp, Rattus norvegicus
tcatccgtttttaccttagttagca

SEQ ID NO: 580274 - DNA, 25 bp, Rattus norvegicus
tcatccgttttttccttagttagca

SEQ ID NO: 580275 - DNA, 25 bp, Rattus norvegicus
tcatcctcagcccatcatttgtgaa

SEQ ID NO: 580276 - DNA, 25 bp, Rattus norvegicus
tcatcctcagccgatcatttgtgaa

SEQ ID NO: 580277 - DNA, 25 bp, Rattus norvegicus
tcatcctcatctctcagtattctgc

SEQ ID NO: 580278 - DNA, 25 bp, Rattus norvegicus
tcatcctcatctgtcagtattctgc

SEQ ID NO: 580279 - DNA, 25 bp, Rattus norvegicus
tcatcctcctctatgccatgtacaa

SEQ ID NO: 580280 - DNA, 25 bp, Rattus norvegicus
tcatcctcctctttgccatgtacaa

SEQ ID NO: 580281 - DNA, 25 bp, Rattus norvegicus
tcatcctcctgaatttgcctgtatt

SEQ ID NO: 580282 - DNA, 25 bp, Rattus norvegicus
tcatcctcctgattttgcctgtatt

SEQ ID NO: 580283 - DNA, 25 bp, Rattus norvegicus
tcatcctcctggagcaaaggcctaa

SEQ ID NO: 580284 - DNA, 25 bp, Rattus norvegicus
tcatcctcctggtgcaaaggcctaa

SEQ ID NO: 580285 - DNA, 25 bp, Rattus norvegicus
tcatcctccttcactaattcattga

SEQ ID NO: 580286 - DNA, 25 bp, Rattus norvegicus
tcatcctccttctctaattcattga

SEQ ID NO: 580287 - DNA, 25 bp, Rattus norvegicus
tcatcctcctttatcgaactcgaaa

SEQ ID NO: 580288 - DNA, 25 bp, Rattus norvegicus
tcatcctcctttttcgaactcgaaa

SEQ ID NO: 580289 - DNA, 25 bp, Rattus norvegicus
tcatcctcggagctttccaggtttt

SEQ ID NO: 580290 - DNA, 25 bp, Rattus norvegicus
tcatcctcggaggtttccaggtttt

SEQ ID NO: 580291 - DNA, 25 bp, Rattus norvegicus
tcatcctcgggccttaagcggaaag

SEQ ID NO: 580292 - DNA, 25 bp, Rattus norvegicus
tcatcctcgggcgttaagcggaaag

SEQ ID NO: 580293 - DNA, 25 bp, Rattus norvegicus
tcatcctcgggtactgctaaatcag

SEQ ID NO: 580294 - DNA, 25 bp, Rattus norvegicus
tcatcctcgggttctgctaaatcag

SEQ ID NO: 580295 - DNA, 25 bp, Rattus norvegicus
tcatcctcgtcccatgtggagaaat

SEQ ID NO: 580296 - DNA, 25 bp, Rattus norvegicus
tcatcctcgtccgatgtggagaaat

SEQ ID NO: 580297 - DNA, 25 bp, Rattus norvegicus
tcatcctctatgaactgacttctag

SEQ ID NO: 580298 - DNA, 25 bp, Rattus norvegicus
tcatcctctatgtactgacttctag

SEQ ID NO: 580299 - DNA, 25 bp, Rattus norvegicus
tcatcctcttacctgtcatgtgtta

SEQ ID NO: 580300 - DNA, 25 bp, Rattus norvegicus
tcatcctcttacgtgtcatgtgtta

SEQ ID NO: 580301 - DNA, 25 bp, Rattus norvegicus
tcatcctgaaagacctacagcttag

SEQ ID NO: 580302 - DNA, 25 bp, Rattus norvegicus
tcatcctgaaagtcctacagcttag

SEQ ID NO: 580303 - DNA, 25 bp, Rattus norvegicus
tcatcctgacagcttgcagcagaca

SEQ ID NO: 580304 - DNA, 25 bp, Rattus norvegicus
tcatcctgacaggttgcagcagaca

SEQ ID NO: 580305 - DNA, 25 bp, Rattus norvegicus
tcatcctgacggatgcagtttgctt

SEQ ID NO: 580306 - DNA, 25 bp, Rattus norvegicus
tcatcctgacggttgcagtttgctt

SEQ ID NO: 580307 - DNA, 25 bp, Rattus norvegicus
tcatcctgagctcacagaaatgctt

SEQ ID NO: 580308 - DNA, 25 bp, Rattus norvegicus
tcatcctgagctgacagaaatgctt

SEQ ID NO: 580309 - DNA, 25 bp, Rattus norvegicus
tcatcctgatgcctgagaagcctat

SEQ ID NO: 580310 - DNA, 25 bp, Rattus norvegicus
tcatcctgatgcgtgagaagcctat

SEQ ID NO: 580311 - DNA, 25 bp, Rattus norvegicus
tcatcctgatgtcgtttctttccta

SEQ ID NO: 580312 - DNA, 25 bp, Rattus norvegicus
tcatcctgatgtggtttctttccta

SEQ ID NO: 580313 - DNA, 25 bp, Rattus norvegicus
tcatcctgcgctaccagaaggagtt

SEQ ID NO: 580314 - DNA, 25 bp, Rattus norvegicus
tcatcctgcgcttccagaaggagtt

SEQ ID NO: 580315 - DNA, 25 bp, Rattus norvegicus
tcatcctgctacagcgtcctgagtg

SEQ ID NO: 580316 - DNA, 25 bp, Rattus norvegicus
tcatcctgctactgcgtcctgagtg

SEQ ID NO: 580317 - DNA, 25 bp, Rattus norvegicus
tcatcctgctgcagttcgtggctgt

SEQ ID NO: 580318 - DNA, 25 bp, Rattus norvegicus
tcatcctgctgctgttcgtggctgt

SEQ ID NO: 580319 - DNA, 25 bp, Rattus norvegicus
tcatcctgctttcatgaccattggg

SEQ ID NO: 580320 - DNA, 25 bp, Rattus norvegicus
tcatcctgctttgatgaccattggg

SEQ ID NO: 580321 - DNA, 25 bp, Rattus norvegicus
tcatcctggaggatccccggaagtg

SEQ ID NO: 580322 - DNA, 25 bp, Rattus norvegicus
tcatcctggaggttccccggaagtg

SEQ ID NO: 580323 - DNA, 25 bp, Rattus norvegicus
tcatcctggctaccgactctagaga

SEQ ID NO: 580324 - DNA, 25 bp, Rattus norvegicus
tcatcctggctagcgactctagaga

SEQ ID NO: 580325 - DNA, 25 bp, Rattus norvegicus
tcatcctggctgaggtggttgatta

SEQ ID NO: 580326 - DNA, 25 bp, Rattus norvegicus
tcatcctggctgtggtggttgatta

SEQ ID NO: 580327 - DNA, 25 bp, Rattus norvegicus
tcatcctgggcactggatacaataa

SEQ ID NO: 580328 - DNA, 25 bp, Rattus norvegicus
tcatcctgggcagtggatacaataa

SEQ ID NO: 580329 - DNA, 25 bp, Rattus norvegicus
tcatcctgggctagagtattctaac

SEQ ID NO: 580330 - DNA, 25 bp, Rattus norvegicus
tcatcctgggctctagggcctttat

SEQ ID NO: 580331 - DNA, 25 bp, Rattus norvegicus
tcatcctgggctgtagggcctttat

SEQ ID NO: 580332 - DNA, 25 bp, Rattus norvegicus
tcatcctgggcttgagtattctaac

SEQ ID NO: 580333 - DNA, 25 bp, Rattus norvegicus
tcatcctggttaatgtcctgcaacg

SEQ ID NO: 580334 - DNA, 25 bp, Rattus norvegicus
tcatcctggttattgtcctgcaacg

SEQ ID NO: 580335 - DNA, 25 bp, Rattus norvegicus
tcatcctgtactccgtggtgacatc

SEQ ID NO: 580336 - DNA, 25 bp, Rattus norvegicus
tcatcctgtactgcgtggtgacatc

SEQ ID NO: 580337 - DNA, 25 bp, Rattus norvegicus
tcatcctgtgaaaccagtctgcctg

SEQ ID NO: 580338 - DNA, 25 bp, Rattus norvegicus
tcatcctgtgaatccagtctgcctg

SEQ ID NO: 580339 - DNA, 25 bp, Rattus norvegicus
tcatcctgttgtaggtgtaccgcat

SEQ ID NO: 580340 - DNA, 25 bp, Rattus norvegicus
tcatcctgttgttggtgtaccgcat

SEQ ID NO: 580341 - DNA, 25 bp, Rattus norvegicus
tcatccttaaacacacagggccagg

SEQ ID NO: 580342 - DNA, 25 bp, Rattus norvegicus
tcatccttaaactcacagggccagg

SEQ ID NO: 580343 - DNA, 25 bp, Rattus norvegicus
tcatccttacggctggagcaggcac

SEQ ID NO: 580344 - DNA, 25 bp, Rattus norvegicus
tcatccttacgggtggagcaggcac

SEQ ID NO: 580345 - DNA, 25 bp, Rattus norvegicus
tcatccttagaacacttgccttgct

SEQ ID NO: 580346 - DNA, 25 bp, Rattus norvegicus
tcatccttagaagacttgccttgct

SEQ ID NO: 580347 - DNA, 25 bp, Rattus norvegicus
tcatccttatagctgagcacgcgcc

SEQ ID NO: 580348 - DNA, 25 bp, Rattus norvegicus
tcatccttataggtgagcacgcgcc

SEQ ID NO: 580349 - DNA, 25 bp, Rattus norvegicus
tcatccttatggattcactcgggta

SEQ ID NO: 580350 - DNA, 25 bp, Rattus norvegicus
tcatccttatggtttcactcgggta

SEQ ID NO: 580351 - DNA, 25 bp, Rattus norvegicus
tcatccttcaagattgttctttggt

SEQ ID NO: 580352 - DNA, 25 bp, Rattus norvegicus
tcatccttcaagtttgttctttggt

SEQ ID NO: 580353 - DNA, 25 bp, Rattus norvegicus
tcatccttcagaacacatctcagtg

SEQ ID NO: 580354 - DNA, 25 bp, Rattus norvegicus
tcatccttcagatcacatctcagtg

SEQ ID NO: 580355 - DNA, 25 bp, Rattus norvegicus
tcatccttcccactgattacatcag

SEQ ID NO: 580356 - DNA, 25 bp, Rattus norvegicus
tcatccttcccagtgattacatcag

SEQ ID NO: 580357 - DNA, 25 bp, Rattus norvegicus
tcatccttcgtgacatcgcagagga

SEQ ID NO: 580358 - DNA, 25 bp, Rattus norvegicus
tcatccttcgtgtcatcgcagagga

SEQ ID NO: 580359 - DNA, 25 bp, Rattus norvegicus
tcatccttctgccacatgtacatat

SEQ ID NO: 580360 - DNA, 25 bp, Rattus norvegicus
tcatccttctgcgacatgtacatat

SEQ ID NO: 580361 - DNA, 25 bp, Rattus norvegicus
tcatccttgagcaagtttccggagg

SEQ ID NO: 580362 - DNA, 25 bp, Rattus norvegicus
tcatccttgagctagtttccggagg

SEQ ID NO: 580363 - DNA, 25 bp, Rattus norvegicus
tcatccttgcttagaaccacctggg

SEQ ID NO: 580364 - DNA, 25 bp, Rattus norvegicus
tcatccttgctttgaaccacctggg

SEQ ID NO: 580365 - DNA, 25 bp, Rattus norvegicus
tcatccttggatacatagtgggttc

SEQ ID NO: 580366 - DNA, 25 bp, Rattus norvegicus
tcatccttggattcatagtgggttc

SEQ ID NO: 580367 - DNA, 25 bp, Rattus norvegicus
tcatccttggcacccacacaggtga

SEQ ID NO: 580368 - DNA, 25 bp, Rattus norvegicus
tcatccttggcagccacacaggtga

SEQ ID NO: 580369 - DNA, 25 bp, Rattus norvegicus
tcatccttggctactttttcctcat

SEQ ID NO: 580370 - DNA, 25 bp, Rattus norvegicus
tcatccttggcttctttttcctcat

SEQ ID NO: 580371 - DNA, 25 bp, Rattus norvegicus
tcatccttgtttatctccacagggc

SEQ ID NO: 580372 - DNA, 25 bp, Rattus norvegicus
tcatccttgtttttctccacagggc

SEQ ID NO: 580373 - DNA, 25 bp, Rattus norvegicus
tcatcctttgacaagaccactcttg

SEQ ID NO: 580374 - DNA, 25 bp, Rattus norvegicus
tcatcctttgactagaccactcttg

SEQ ID NO: 580375 - DNA, 25 bp, Rattus norvegicus
tcatcgaacacaccttcgagggcat

SEQ ID NO: 580376 - DNA, 25 bp, Rattus norvegicus
tcatcgaacacagcttcgagggcat

SEQ ID NO: 580377 - DNA, 25 bp, Rattus norvegicus
tcatcgaagctcacttcctgcacgg

SEQ ID NO: 580378 - DNA, 25 bp, Rattus norvegicus
tcatcgaagctctcttcctgcacgg

SEQ ID NO: 580379 - DNA, 25 bp, Rattus norvegicus
tcatcgacactcagggcatcggctg

SEQ ID NO: 580380 - DNA, 25 bp, Rattus norvegicus
tcatcgacactctgggcatcggctg

SEQ ID NO: 580381 - DNA, 25 bp, Rattus norvegicus
tcatcgacagtgaggtggtttgaca

SEQ ID NO: 580382 - DNA, 25 bp, Rattus norvegicus
tcatcgacagtgtggtggtttgaca

SEQ ID NO: 580383 - DNA, 25 bp, Rattus norvegicus
tcatcgactcctaggcatttacagc

SEQ ID NO: 580384 - DNA, 25 bp, Rattus norvegicus
tcatcgactccttggcatttacagc

SEQ ID NO: 580385 - DNA, 25 bp, Rattus norvegicus
tcatcgagatgtaccgagacctctt

SEQ ID NO: 580386 - DNA, 25 bp, Rattus norvegicus
tcatcgagatgttccgagacctctt

SEQ ID NO: 580387 - DNA, 25 bp, Rattus norvegicus
tcatcgaggcccacaaggagtgcat

SEQ ID NO: 580388 - DNA, 25 bp, Rattus norvegicus
tcatcgaggccctcaaggagtgcat

SEQ ID NO: 580389 - DNA, 25 bp, Rattus norvegicus
tcatcgatacctccatcattctctt

SEQ ID NO: 580390 - DNA, 25 bp, Rattus norvegicus
tcatcgatacctgcatcattctctt

SEQ ID NO: 580391 - DNA, 25 bp, Rattus norvegicus
tcatcgatgacaccgacctggaaga

SEQ ID NO: 580392 - DNA, 25 bp, Rattus norvegicus
tcatcgatgacagcgacctggaaga

SEQ ID NO: 580393 - DNA, 25 bp, Rattus norvegicus
tcatcgcagctacttgggaggccca

SEQ ID NO: 580394 - DNA, 25 bp, Rattus norvegicus
tcatcgcagctagttgggaggccca

SEQ ID NO: 580395 - DNA, 25 bp, Rattus norvegicus
tcatcgccacctctacaaaagttga

SEQ ID NO: 580396 - DNA, 25 bp, Rattus norvegicus
tcatcgccacctgtacaaaagttga

SEQ ID NO: 580397 - DNA, 25 bp, Rattus norvegicus
tcatcgccgaggcaagacaggacag

SEQ ID NO: 580398 - DNA, 25 bp, Rattus norvegicus
tcatcgccgagggaagacaggacag

SEQ ID NO: 580399 - DNA, 25 bp, Rattus norvegicus
tcatcgcctttcatcacaacaaaat

SEQ ID NO: 580400 - DNA, 25 bp, Rattus norvegicus
tcatcgcctttcttcacaacaaaat

SEQ ID NO: 580401 - DNA, 25 bp, Rattus norvegicus
tcatcgcgccaaattttgcgctcgg

SEQ ID NO: 580402 - DNA, 25 bp, Rattus norvegicus
tcatcgcgccaatttttgcgctcgg

SEQ ID NO: 580403 - DNA, 25 bp, Rattus norvegicus
tcatcgcggcagaaaggagcttcac

SEQ ID NO: 580404 - DNA, 25 bp, Rattus norvegicus
tcatcgcggcagtaaggagcttcac

SEQ ID NO: 580405 - DNA, 25 bp, Rattus norvegicus
tcatcgctcaccagggaggcatcat

SEQ ID NO: 580406 - DNA, 25 bp, Rattus norvegicus
tcatcgctcacctgggaggcatcat

SEQ ID NO: 580407 - DNA, 25 bp, Rattus norvegicus
tcatcggaaattaagcatcgtagtg

SEQ ID NO: 580408 - DNA, 25 bp, Rattus norvegicus
tcatcggaaatttagcatcgtagtg

SEQ ID NO: 580409 - DNA, 25 bp, Rattus norvegicus
tcatcggattgtacctctcttagga

SEQ ID NO: 580410 - DNA, 25 bp, Rattus norvegicus
tcatcggattgttcctctcttagga

SEQ ID NO: 580411 - DNA, 25 bp, Rattus norvegicus
tcatcggtttgcaggtggcttcatc

SEQ ID NO: 580412 - DNA, 25 bp, Rattus norvegicus
tcatcggtttgctggtggcttcatc

SEQ ID NO: 580413 - DNA, 25 bp, Rattus norvegicus
tcatcgtcagccctgtactcgggag

SEQ ID NO: 580414 - DNA, 25 bp, Rattus norvegicus
tcatcgtcagccgtgtactcgggag

SEQ ID NO: 580415 - DNA, 25 bp, Rattus norvegicus
tcatcgtcagtcacacaacttctaa

SEQ ID NO: 580416 - DNA, 25 bp, Rattus norvegicus
tcatcgtcagtctcacaacttctaa

SEQ ID NO: 580417 - DNA, 25 bp, Rattus norvegicus
tcatcgtcccaaagagttgacagct

SEQ ID NO: 580418 - DNA, 25 bp, Rattus norvegicus
tcatcgtcccaatgagttgacagct

SEQ ID NO: 580419 - DNA, 25 bp, Rattus norvegicus
tcatcgtccgagaccgattcactct

SEQ ID NO: 580420 - DNA, 25 bp, Rattus norvegicus
tcatcgtccgagtccgattcactct

SEQ ID NO: 580421 - DNA, 25 bp, Rattus norvegicus
tcatcgtcgtccacgctctcgtggt

SEQ ID NO: 580422 - DNA, 25 bp, Rattus norvegicus
tcatcgtcgtcctcgctctcgtggt

SEQ ID NO: 580423 - DNA, 25 bp, Rattus norvegicus
tcatcgtctcctcgttttttcctaa

SEQ ID NO: 580424 - DNA, 25 bp, Rattus norvegicus
tcatcgtctcctggttttttcctaa

SEQ ID NO: 580425 - DNA, 25 bp, Rattus norvegicus
tcatcgtgcacaacctgcagggagg

SEQ ID NO: 580426 - DNA, 25 bp, Rattus norvegicus
tcatcgtgcacatcctgcagggagg

SEQ ID NO: 580427 - DNA, 25 bp, Rattus norvegicus
tcatcgtgccctcagactactatag

SEQ ID NO: 580428 - DNA, 25 bp, Rattus norvegicus
tcatcgtgccctgagactactatag

SEQ ID NO: 580429 - DNA, 25 bp, Rattus norvegicus
tcatcgtgctgtacccaatgggagt

SEQ ID NO: 580430 - DNA, 25 bp, Rattus norvegicus
tcatcgtgctgttcccaatgggagt

SEQ ID NO: 580431 - DNA, 25 bp, Rattus norvegicus
tcatcgttacacaatgctgcatgtt

SEQ ID NO: 580432 - DNA, 25 bp, Rattus norvegicus
tcatcgttacactatgctgcatgtt

SEQ ID NO: 580433 - DNA, 25 bp, Rattus norvegicus
tcatcgttcggcaggtccgtcgtcg

SEQ ID NO: 580434 - DNA, 25 bp, Rattus norvegicus
tcatcgttcggctggtccgtcgtcg

SEQ ID NO: 580435 - DNA, 25 bp, Rattus norvegicus
tcatcgtttcctacgactggctgat

SEQ ID NO: 580436 - DNA, 25 bp, Rattus norvegicus
tcatcgtttccttcgactggctgat

SEQ ID NO: 580437 - DNA, 25 bp, Rattus norvegicus
tcatctaaatcgatgggttcccacc

SEQ ID NO: 580438 - DNA, 25 bp, Rattus norvegicus
tcatctaaatcgttgggttcccacc

SEQ ID NO: 580439 - DNA, 25 bp, Rattus norvegicus
tcatctaaggccaaaacattctcaa

SEQ ID NO: 580440 - DNA, 25 bp, Rattus norvegicus
tcatctaaggcctaaacattctcaa

SEQ ID NO: 580441 - DNA, 25 bp, Rattus norvegicus
tcatctaccgctagggcggcgagga

SEQ ID NO: 580442 - DNA, 25 bp, Rattus norvegicus
tcatctaccgcttgggcggcgagga

SEQ ID NO: 580443 - DNA, 25 bp, Rattus norvegicus
tcatctactcgacctggccaatgag

SEQ ID NO: 580444 - DNA, 25 bp, Rattus norvegicus
tcatctactcgagctggccaatgag

SEQ ID NO: 580445 - DNA, 25 bp, Rattus norvegicus
tcatctagcaagagactttaaccat

SEQ ID NO: 580446 - DNA, 25 bp, Rattus norvegicus
tcatctagcaagtgactttaaccat

SEQ ID NO: 580447 - DNA, 25 bp, Rattus norvegicus
tcatctaggaacaaggatcgccaca

SEQ ID NO: 580448 - DNA, 25 bp, Rattus norvegicus
tcatctaggaactaggatcgccaca

SEQ ID NO: 580449 - DNA, 25 bp, Rattus norvegicus
tcatctagggttcagtaggtagcat

SEQ ID NO: 580450 - DNA, 25 bp, Rattus norvegicus
tcatctagggttgagtaggtagcat

SEQ ID NO: 580451 - DNA, 25 bp, Rattus norvegicus
tcatctagtctcagtattcctacca

SEQ ID NO: 580452 - DNA, 25 bp, Rattus norvegicus
tcatctagtctcagtgggcacgcac

SEQ ID NO: 580453 - DNA, 25 bp, Rattus norvegicus
tcatctagtctctgtattcctacca

SEQ ID NO: 580454 - DNA, 25 bp, Rattus norvegicus
tcatctagtctctgtgggcacgcac

SEQ ID NO: 580455 - DNA, 25 bp, Rattus norvegicus
tcatctatgacaacgaaggcgcggg

SEQ ID NO: 580456 - DNA, 25 bp, Rattus norvegicus
tcatctatgacatcgaaggcgcggg

SEQ ID NO: 580457 - DNA, 25 bp, Rattus norvegicus
tcatctatgcatcaactgtagctgc

SEQ ID NO: 580458 - DNA, 25 bp, Rattus norvegicus
tcatctatgcatgaactgtagctgc

SEQ ID NO: 580459 - DNA, 25 bp, Rattus norvegicus
tcatctcacatgactcaagtacctg

SEQ ID NO: 580460 - DNA, 25 bp, Rattus norvegicus
tcatctcacatgtctcaagtacctg

SEQ ID NO: 580461 - DNA, 25 bp, Rattus norvegicus
tcatctcactgtattacttcatcag

SEQ ID NO: 580462 - DNA, 25 bp, Rattus norvegicus
tcatctcactgttttacttcatcag

SEQ ID NO: 580463 - DNA, 25 bp, Rattus norvegicus
tcatctcagaatctgactgcctcag

SEQ ID NO: 580464 - DNA, 25 bp, Rattus norvegicus
tcatctcagaatgtgactgcctcag

SEQ ID NO: 580465 - DNA, 25 bp, Rattus norvegicus
tcatctcagcccagtaacatcagca

SEQ ID NO: 580466 - DNA, 25 bp, Rattus norvegicus
tcatctcagccctgtaacatcagca

SEQ ID NO: 580467 - DNA, 25 bp, Rattus norvegicus
tcatctcatgccatcagatgccttt

SEQ ID NO: 580468 - DNA, 25 bp, Rattus norvegicus
tcatctcatgccttcagatgccttt

SEQ ID NO: 580469 - DNA, 25 bp, Rattus norvegicus
tcatctcattcaccaggcacatgtt

SEQ ID NO: 580470 - DNA, 25 bp, Rattus norvegicus
tcatctcattcagcaggcacatgtt

SEQ ID NO: 580471 - DNA, 25 bp, Rattus norvegicus
tcatctccacgcaatctaagcacat

SEQ ID NO: 580472 - DNA, 25 bp, Rattus norvegicus
tcatctccacgctatctaagcacat

SEQ ID NO: 580473 - DNA, 25 bp, Rattus norvegicus
tcatctccactgcacatactactgg

SEQ ID NO: 580474 - DNA, 25 bp, Rattus norvegicus
tcatctccactggacatactactgg

SEQ ID NO: 580475 - DNA, 25 bp, Rattus norvegicus
tcatctccagtcatgctgacatcca

SEQ ID NO: 580476 - DNA, 25 bp, Rattus norvegicus
tcatctccagtcttgctgacatcca

SEQ ID NO: 580477 - DNA, 25 bp, Rattus norvegicus
tcatctccataactcttcccactca

SEQ ID NO: 580478 - DNA, 25 bp, Rattus norvegicus
tcatctccataagtcttcccactca

SEQ ID NO: 580479 - DNA, 25 bp, Rattus norvegicus
tcatctccatcaagaggctgacctt

SEQ ID NO: 580480 - DNA, 25 bp, Rattus norvegicus
tcatctccatcatgaggctgacctt

SEQ ID NO: 580481 - DNA, 25 bp, Rattus norvegicus
tcatctccatggctggtcacggcaa

SEQ ID NO: 580482 - DNA, 25 bp, Rattus norvegicus
tcatctccatgggtggtcacggcaa

SEQ ID NO: 580483 - DNA, 25 bp, Rattus norvegicus
tcatctcccacaagctaggattact

SEQ ID NO: 580484 - DNA, 25 bp, Rattus norvegicus
tcatctcccacatgctaggattact

SEQ ID NO: 580485 - DNA, 25 bp, Rattus norvegicus
tcatctccgagaaccctcccttcgg

SEQ ID NO: 580486 - DNA, 25 bp, Rattus norvegicus
tcatctccgagatccctcccttcgg

SEQ ID NO: 580487 - DNA, 25 bp, Rattus norvegicus
tcatctcctctgctgtggtgaagat

SEQ ID NO: 580488 - DNA, 25 bp, Rattus norvegicus
tcatctcctctggtgtggtgaagat

SEQ ID NO: 580489 - DNA, 25 bp, Rattus norvegicus
tcatctcctggcattggttttgtat

SEQ ID NO: 580490 - DNA, 25 bp, Rattus norvegicus
tcatctcctggctttggttttgtat

SEQ ID NO: 580491 - DNA, 25 bp, Rattus norvegicus
tcatctccttgacccttgagcagga

SEQ ID NO: 580492 - DNA, 25 bp, Rattus norvegicus
tcatctccttgagccttgagcagga

SEQ ID NO: 580493 - DNA, 25 bp, Rattus norvegicus
tcatctcgcttcaggagctgtagct

SEQ ID NO: 580494 - DNA, 25 bp, Rattus norvegicus
tcatctcgcttctggagctgtagct

SEQ ID NO: 580495 - DNA, 25 bp, Rattus norvegicus
tcatctcggacgctaggcccgtaaa

SEQ ID NO: 580496 - DNA, 25 bp, Rattus norvegicus
tcatctcggacggtaggcccgtaaa

SEQ ID NO: 580497 - DNA, 25 bp, Rattus norvegicus
tcatctcggcgcacacctggaagcg

SEQ ID NO: 580498 - DNA, 25 bp, Rattus norvegicus
tcatctcggcgctcacctggaagcg

SEQ ID NO: 580499 - DNA, 25 bp, Rattus norvegicus
tcatctcggcttctcagttattttt

SEQ ID NO: 580500 - DNA, 25 bp, Rattus norvegicus
tcatctcggcttgtcagttattttt

SEQ ID NO: 580501 - DNA, 25 bp, Rattus norvegicus
tcatctcgttaaattcaaggacggg

SEQ ID NO: 580502 - DNA, 25 bp, Rattus norvegicus
tcatctcgttaatttcaaggacggg

SEQ ID NO: 580503 - DNA, 25 bp, Rattus norvegicus
tcatctctatcacgtcgcgctgggt

SEQ ID NO: 580504 - DNA, 25 bp, Rattus norvegicus
tcatctctatcaggtcgcgctgggt

SEQ ID NO: 580505 - DNA, 25 bp, Rattus norvegicus
tcatctctattcactggtcaccaga

SEQ ID NO: 580506 - DNA, 25 bp, Rattus norvegicus
tcatctctattctctggtcaccaga

SEQ ID NO: 580507 - DNA, 25 bp, Rattus norvegicus
tcatctctctacctgttgtcatttg

SEQ ID NO: 580508 - DNA, 25 bp, Rattus norvegicus
tcatctctctacgtgttgtcatttg

SEQ ID NO: 580509 - DNA, 25 bp, Rattus norvegicus
tcatctctctatacctcatcaacaa

SEQ ID NO: 580510 - DNA, 25 bp, Rattus norvegicus
tcatctctctattcctcatcaacaa

SEQ ID NO: 580511 - DNA, 25 bp, Rattus norvegicus
tcatctctctcactcacagagggag

SEQ ID NO: 580512 - DNA, 25 bp, Rattus norvegicus
tcatctctctcagtcacagagggag

SEQ ID NO: 580513 - DNA, 25 bp, Rattus norvegicus
tcatctctcttcattgctagctaat

SEQ ID NO: 580514 - DNA, 25 bp, Rattus norvegicus
tcatctctcttctttgctagctaat

SEQ ID NO: 580515 - DNA, 25 bp, Rattus norvegicus
tcatctctgaggaactgtgttccgc

SEQ ID NO: 580516 - DNA, 25 bp, Rattus norvegicus
tcatctctgaggtactgtgttccgc

SEQ ID NO: 580517 - DNA, 25 bp, Rattus norvegicus
tcatctctgagtacccgcataagtt

SEQ ID NO: 580518 - DNA, 25 bp, Rattus norvegicus
tcatctctgagttcccgcataagtt

SEQ ID NO: 580519 - DNA, 25 bp, Rattus norvegicus
tcatctctgatccttgtgacgtggg

SEQ ID NO: 580520 - DNA, 25 bp, Rattus norvegicus
tcatctctgatcgttgtgacgtggg

SEQ ID NO: 580521 - DNA, 25 bp, Rattus norvegicus
tcatctctgggacagtcagcatcag

SEQ ID NO: 580522 - DNA, 25 bp, Rattus norvegicus
tcatctctgggagagtcagcatcag

SEQ ID NO: 580523 - DNA, 25 bp, Rattus norvegicus
tcatctctgtgaatgtgatacgcag

SEQ ID NO: 580524 - DNA, 25 bp, Rattus norvegicus
tcatctctgtgattgtgatacgcag

SEQ ID NO: 580525 - DNA, 25 bp, Rattus norvegicus
tcatctctgtggcaactgacacttc

SEQ ID NO: 580526 - DNA, 25 bp, Rattus norvegicus
tcatctctgtgggaactgacacttc

SEQ ID NO: 580527 - DNA, 25 bp, Rattus norvegicus
tcatctcttaagatgcctcttgcaa

SEQ ID NO: 580528 - DNA, 25 bp, Rattus norvegicus
tcatctcttaagttgcctcttgcaa

SEQ ID NO: 580529 - DNA, 25 bp, Rattus norvegicus
tcatctgagcacattgtattgtctt

SEQ ID NO: 580530 - DNA, 25 bp, Rattus norvegicus
tcatctgagcactttgtattgtctt

SEQ ID NO: 580531 - DNA, 25 bp, Rattus norvegicus
tcatctgagcctcgagaccctgact

SEQ ID NO: 580532 - DNA, 25 bp, Rattus norvegicus
tcatctgagcctggagaccctgact

SEQ ID NO: 580533 - DNA, 25 bp, Rattus norvegicus
tcatctgagggcataagagtcctta

SEQ ID NO: 580534 - DNA, 25 bp, Rattus norvegicus
tcatctgagggcttaagagtcctta

SEQ ID NO: 580535 - DNA, 25 bp, Rattus norvegicus
tcatctgatctcacgggccgacaag

SEQ ID NO: 580536 - DNA, 25 bp, Rattus norvegicus
tcatctgatctctcgggccgacaag

SEQ ID NO: 580537 - DNA, 25 bp, Rattus norvegicus
tcatctgattgtatctgtgtctgcc

SEQ ID NO: 580538 - DNA, 25 bp, Rattus norvegicus
tcatctgattgtttctgtgtctgcc

SEQ ID NO: 580539 - DNA, 25 bp, Rattus norvegicus
tcatctgcaagtaagcggctctcag

SEQ ID NO: 580540 - DNA, 25 bp, Rattus norvegicus
tcatctgcaagttagcggctctcag

SEQ ID NO: 580541 - DNA, 25 bp, Rattus norvegicus
tcatctgcacccatcagagtttaat

SEQ ID NO: 580542 - DNA, 25 bp, Rattus norvegicus
tcatctgcacccttcagagtttaat

SEQ ID NO: 580543 - DNA, 25 bp, Rattus norvegicus
tcatctgcagggatactgggtgata

SEQ ID NO: 580544 - DNA, 25 bp, Rattus norvegicus
tcatctgcagggttactgggtgata

SEQ ID NO: 580545 - DNA, 25 bp, Rattus norvegicus
tcatctgcatcgcttgagagctggg

SEQ ID NO: 580546 - DNA, 25 bp, Rattus norvegicus
tcatctgcatcggttgagagctggg

SEQ ID NO: 580547 - DNA, 25 bp, Rattus norvegicus
tcatctgcccacattacgaggacga

SEQ ID NO: 580548 - DNA, 25 bp, Rattus norvegicus
tcatctgcccactttacgaggacga

SEQ ID NO: 580549 - DNA, 25 bp, Rattus norvegicus
tcatctgcccgcaggatggcatgga

SEQ ID NO: 580550 - DNA, 25 bp, Rattus norvegicus
tcatctgcccgctggatggcatgga

SEQ ID NO: 580551 - DNA, 25 bp, Rattus norvegicus
tcatctgcccgtcttttaactctga

SEQ ID NO: 580552 - DNA, 25 bp, Rattus norvegicus
tcatctgcccgtgttttaactctga

SEQ ID NO: 580553 - DNA, 25 bp, Rattus norvegicus
tcatctgccgtgattgcttggacaa

SEQ ID NO: 580554 - DNA, 25 bp, Rattus norvegicus
tcatctgccgtgtttgcttggacaa

SEQ ID NO: 580555 - DNA, 25 bp, Rattus norvegicus
tcatctgccttgacctccaacagtg

SEQ ID NO: 580556 - DNA, 25 bp, Rattus norvegicus
tcatctgccttgtcctccaacagtg

SEQ ID NO: 580557 - DNA, 25 bp, Rattus norvegicus
tcatctgcgaacatcttctggtctt

SEQ ID NO: 580558 - DNA, 25 bp, Rattus norvegicus
tcatctgcgaacttcttctggtctt

SEQ ID NO: 580559 - DNA, 25 bp, Rattus norvegicus
tcatctgcgcgtaggtgatctgcag

SEQ ID NO: 580560 - DNA, 25 bp, Rattus norvegicus
tcatctgcgcgttggtgatctgcag

SEQ ID NO: 580561 - DNA, 25 bp, Rattus norvegicus
tcatctgctgttctgagtccttgaa

SEQ ID NO: 580562 - DNA, 25 bp, Rattus norvegicus
tcatctgctgttgtgagtccttgaa

SEQ ID NO: 580563 - DNA, 25 bp, Rattus norvegicus
tcatctggagatcgtcctgactgag

SEQ ID NO: 580564 - DNA, 25 bp, Rattus norvegicus
tcatctggagatggtcctgactgag

SEQ ID NO: 580565 - DNA, 25 bp, Rattus norvegicus
tcatctggatggatcaacttactgg

SEQ ID NO: 580566 - DNA, 25 bp, Rattus norvegicus
tcatctggatggttcaacttactgg

SEQ ID NO: 580567 - DNA, 25 bp, Rattus norvegicus
tcatctgggacaccgctggtcagga

SEQ ID NO: 580568 - DNA, 25 bp, Rattus norvegicus
tcatctgggacagcgctggtcagga

SEQ ID NO: 580569 - DNA, 25 bp, Rattus norvegicus
tcatctggtcagacgttgggattag

SEQ ID NO: 580570 - DNA, 25 bp, Rattus norvegicus
tcatctggtcagtcgttgggattag

SEQ ID NO: 580571 - DNA, 25 bp, Rattus norvegicus
tcatctggtttgagactggtggaac

SEQ ID NO: 580572 - DNA, 25 bp, Rattus norvegicus
tcatctggtttgtgactggtggaac

SEQ ID NO: 580573 - DNA, 25 bp, Rattus norvegicus
tcatctgtaactataattccggggg

SEQ ID NO: 580574 - DNA, 25 bp, Rattus norvegicus
tcatctgtaactttaattccggggg

SEQ ID NO: 580575 - DNA, 25 bp, Rattus norvegicus
tcatctgtccatatcgtttgcaaag

SEQ ID NO: 580576 - DNA, 25 bp, Rattus norvegicus
tcatctgtccatttcgtttgcaaag

SEQ ID NO: 580577 - DNA, 25 bp, Rattus norvegicus
tcatctgtctctctggtactttctt

SEQ ID NO: 580578 - DNA, 25 bp, Rattus norvegicus
tcatctgtctctgtggtactttctt

SEQ ID NO: 580579 - DNA, 25 bp, Rattus norvegicus
tcatctgtctgcaaacctcagaagc

SEQ ID NO: 580580 - DNA, 25 bp, Rattus norvegicus
tcatctgtctgctaacctcagaagc

SEQ ID NO: 580581 - DNA, 25 bp, Rattus norvegicus
tcatctgtgcccaggactactagac

SEQ ID NO: 580582 - DNA, 25 bp, Rattus norvegicus
tcatctgtgccctggactactagac

SEQ ID NO: 580583 - DNA, 25 bp, Rattus norvegicus
tcatctgtgtacaaggaaccttcct

SEQ ID NO: 580584 - DNA, 25 bp, Rattus norvegicus
tcatctgtgtactaggaaccttcct

SEQ ID NO: 580585 - DNA, 25 bp, Rattus norvegicus
tcatctgttacaatcaagttagctt

SEQ ID NO: 580586 - DNA, 25 bp, Rattus norvegicus
tcatctgttacattcaagttagctt

SEQ ID NO: 580587 - DNA, 25 bp, Rattus norvegicus
tcatctgttctcaggacattgtctg

SEQ ID NO: 580588 - DNA, 25 bp, Rattus norvegicus
tcatctgttctctggacattgtctg

SEQ ID NO: 580589 - DNA, 25 bp, Rattus norvegicus
tcatcttagttgctgttgggttttc

SEQ ID NO: 580590 - DNA, 25 bp, Rattus norvegicus
tcatcttagttggtgttgggttttc

SEQ ID NO: 580591 - DNA, 25 bp, Rattus norvegicus
tcatcttcaaagcatactactctcc

SEQ ID NO: 580592 - DNA, 25 bp, Rattus norvegicus
tcatcttcaaaggatactactctcc

SEQ ID NO: 580593 - DNA, 25 bp, Rattus norvegicus
tcatcttcaactatgtcctcttcag

SEQ ID NO: 580594 - DNA, 25 bp, Rattus norvegicus
tcatcttcaactttgtcctcttcag

SEQ ID NO: 580595 - DNA, 25 bp, Rattus norvegicus
tcatcttcaccaagtaagtcccaag

SEQ ID NO: 580596 - DNA, 25 bp, Rattus norvegicus
tcatcttcaccatgtaagtcccaag

SEQ ID NO: 580597 - DNA, 25 bp, Rattus norvegicus
tcatcttcactgagtatctgtgcag

SEQ ID NO: 580598 - DNA, 25 bp, Rattus norvegicus
tcatcttcactgtgtatctgtgcag

SEQ ID NO: 580599 - DNA, 25 bp, Rattus norvegicus
tcatcttcagaaattttgcatcttt

SEQ ID NO: 580600 - DNA, 25 bp, Rattus norvegicus
tcatcttcagaatttttgcatcttt

SEQ ID NO: 580601 - DNA, 25 bp, Rattus norvegicus
tcatcttcagacaggtttctcacgc

SEQ ID NO: 580602 - DNA, 25 bp, Rattus norvegicus
tcatcttcagacattcagggcctgg

SEQ ID NO: 580603 - DNA, 25 bp, Rattus norvegicus
tcatcttcagactggtttctcacgc

SEQ ID NO: 580604 - DNA, 25 bp, Rattus norvegicus
tcatcttcagactttcagggcctgg

SEQ ID NO: 580605 - DNA, 25 bp, Rattus norvegicus
tcatcttcagctacttggtgagttt

SEQ ID NO: 580606 - DNA, 25 bp, Rattus norvegicus
tcatcttcagcttcttggtgagttt

SEQ ID NO: 580607 - DNA, 25 bp, Rattus norvegicus
tcatcttcatgtatcttgcctcact

SEQ ID NO: 580608 - DNA, 25 bp, Rattus norvegicus
tcatcttcatgtttcttgcctcact

SEQ ID NO: 580609 - DNA, 25 bp, Rattus norvegicus
tcatcttcattgctcatggtgggtt

SEQ ID NO: 580610 - DNA, 25 bp, Rattus norvegicus
tcatcttcattggtcatggtgggtt

SEQ ID NO: 580611 - DNA, 25 bp, Rattus norvegicus
tcatcttccccacgttgtagctgag

SEQ ID NO: 580612 - DNA, 25 bp, Rattus norvegicus
tcatcttccccaggttgtagctgag

SEQ ID NO: 580613 - DNA, 25 bp, Rattus norvegicus
tcatcttcccctctgcacatgttta

SEQ ID NO: 580614 - DNA, 25 bp, Rattus norvegicus
tcatcttcccctgtgcacatgttta

SEQ ID NO: 580615 - DNA, 25 bp, Rattus norvegicus
tcatcttccgacctatacaatcttg

SEQ ID NO: 580616 - DNA, 25 bp, Rattus norvegicus
tcatcttccgacgtatacaatcttg

SEQ ID NO: 580617 - DNA, 25 bp, Rattus norvegicus
tcatcttcctgcatttagtgcatta

SEQ ID NO: 580618 - DNA, 25 bp, Rattus norvegicus
tcatcttcctgcttttagtgcatta

SEQ ID NO: 580619 - DNA, 25 bp, Rattus norvegicus
tcatcttcgcgactattctaggctt

SEQ ID NO: 580620 - DNA, 25 bp, Rattus norvegicus
tcatcttcgcgagtattctaggctt

SEQ ID NO: 580621 - DNA, 25 bp, Rattus norvegicus
tcatcttctgcgagctcactggcaa

SEQ ID NO: 580622 - DNA, 25 bp, Rattus norvegicus
tcatcttctgcgtgctcactggcaa

SEQ ID NO: 580623 - DNA, 25 bp, Rattus norvegicus
tcatcttcttacatctggtttttaa

SEQ ID NO: 580624 - DNA, 25 bp, Rattus norvegicus
tcatcttcttacttctggtttttaa

SEQ ID NO: 580625 - DNA, 25 bp, Rattus norvegicus
tcatcttcttcacacaccagcgatt

SEQ ID NO: 580626 - DNA, 25 bp, Rattus norvegicus
tcatcttcttcagacaccagcgatt

SEQ ID NO: 580627 - DNA, 25 bp, Rattus norvegicus
tcatcttcttccattgagctcaaat

SEQ ID NO: 580628 - DNA, 25 bp, Rattus norvegicus
tcatcttcttcctttgagctcaaat

SEQ ID NO: 580629 - DNA, 25 bp, Rattus norvegicus
tcatcttcttctacggaagcgactt

SEQ ID NO: 580630 - DNA, 25 bp, Rattus norvegicus
tcatcttcttcttcggaagcgactt

SEQ ID NO: 580631 - DNA, 25 bp, Rattus norvegicus
tcatcttcttttcacctgggattta

SEQ ID NO: 580632 - DNA, 25 bp, Rattus norvegicus
tcatcttcttttgacctgggattta

SEQ ID NO: 580633 - DNA, 25 bp, Rattus norvegicus
tcatcttgaattactaaccacaccc

SEQ ID NO: 580634 - DNA, 25 bp, Rattus norvegicus
tcatcttgaatttctaaccacaccc

SEQ ID NO: 580635 - DNA, 25 bp, Rattus norvegicus
tcatcttgacgcagtctctcattct

SEQ ID NO: 580636 - DNA, 25 bp, Rattus norvegicus
tcatcttgacgctgtctctcattct

SEQ ID NO: 580637 - DNA, 25 bp, Rattus norvegicus
tcatcttgactgacctgtgtctaag

SEQ ID NO: 580638 - DNA, 25 bp, Rattus norvegicus
tcatcttgactgtcctgtgtctaag

SEQ ID NO: 580639 - DNA, 25 bp, Rattus norvegicus
tcatcttgagtcagaactgaggagt

SEQ ID NO: 580640 - DNA, 25 bp, Rattus norvegicus
tcatcttgagtctgaactgaggagt

SEQ ID NO: 580641 - DNA, 25 bp, Rattus norvegicus
tcatcttgagtgagtaggctttcct

SEQ ID NO: 580642 - DNA, 25 bp, Rattus norvegicus
tcatcttgagtgtgtaggctttcct

SEQ ID NO: 580643 - DNA, 25 bp, Rattus norvegicus
tcatcttggaccctgcctaatttaa

SEQ ID NO: 580644 - DNA, 25 bp, Rattus norvegicus
tcatcttggaccgtgcctaatttaa

SEQ ID NO: 580645 - DNA, 25 bp, Rattus norvegicus
tcatcttggcttagctggcatccag

SEQ ID NO: 580646 - DNA, 25 bp, Rattus norvegicus
tcatcttggcttcttggcttctgta

SEQ ID NO: 580647 - DNA, 25 bp, Rattus norvegicus
tcatcttggcttgttggcttctgta

SEQ ID NO: 580648 - DNA, 25 bp, Rattus norvegicus
tcatcttggctttgctggcatccag

SEQ ID NO: 580649 - DNA, 25 bp, Rattus norvegicus
tcatcttgggctacatcactggcta

SEQ ID NO: 580650 - DNA, 25 bp, Rattus norvegicus
tcatcttgggcttcatcactggcta

SEQ ID NO: 580651 - DNA, 25 bp, Rattus norvegicus
tcatcttggtctcgtgttcactact

SEQ ID NO: 580652 - DNA, 25 bp, Rattus norvegicus
tcatcttggtctggtgttcactact

SEQ ID NO: 580653 - DNA, 25 bp, Rattus norvegicus
tcatcttgtccactgttgtgaccac

SEQ ID NO: 580654 - DNA, 25 bp, Rattus norvegicus
tcatcttgtccagtgttgtgaccac

SEQ ID NO: 580655 - DNA, 25 bp, Rattus norvegicus
tcatcttgtctgctgtcttgttcaa

SEQ ID NO: 580656 - DNA, 25 bp, Rattus norvegicus
tcatcttgtctggtgtcttgttcaa

SEQ ID NO: 580657 - DNA, 25 bp, Rattus norvegicus
tcatctttaattacctattcctcag

SEQ ID NO: 580658 - DNA, 25 bp, Rattus norvegicus
tcatctttaatttcctattcctcag

SEQ ID NO: 580659 - DNA, 25 bp, Rattus norvegicus
tcatctttacacaagctacctaacc

SEQ ID NO: 580660 - DNA, 25 bp, Rattus norvegicus
tcatctttacactagctacctaacc

SEQ ID NO: 580661 - DNA, 25 bp, Rattus norvegicus
tcatctttcccaaagccctttaatt

SEQ ID NO: 580662 - DNA, 25 bp, Rattus norvegicus
tcatctttcccatagccctttaatt

SEQ ID NO: 580663 - DNA, 25 bp, Rattus norvegicus
tcatctttctaaaccctttggcttt

SEQ ID NO: 580664 - DNA, 25 bp, Rattus norvegicus
tcatctttctaatccctttggcttt

SEQ ID NO: 580665 - DNA, 25 bp, Rattus norvegicus
tcatctttctagcacacgcctcaag

SEQ ID NO: 580666 - DNA, 25 bp, Rattus norvegicus
tcatctttctaggacacgcctcaag

SEQ ID NO: 580667 - DNA, 25 bp, Rattus norvegicus
tcatctttcttactgggctccctgc

SEQ ID NO: 580668 - DNA, 25 bp, Rattus norvegicus
tcatctttcttagtgggctccctgc

SEQ ID NO: 580669 - DNA, 25 bp, Rattus norvegicus
tcatctttctttccctcttatacag

SEQ ID NO: 580670 - DNA, 25 bp, Rattus norvegicus
tcatctttctttgcctcttatacag

SEQ ID NO: 580671 - DNA, 25 bp, Rattus norvegicus
tcatctttgccaatggaacctccag

SEQ ID NO: 580672 - DNA, 25 bp, Rattus norvegicus
tcatctttgccattggaacctccag

SEQ ID NO: 580673 - DNA, 25 bp, Rattus norvegicus
tcatctttgcggcactcgtcttctc

SEQ ID NO: 580674 - DNA, 25 bp, Rattus norvegicus
tcatctttgcgggactcgtcttctc

SEQ ID NO: 580675 - DNA, 25 bp, Rattus norvegicus
tcatctttgtgcatgagccttccag

SEQ ID NO: 580676 - DNA, 25 bp, Rattus norvegicus
tcatctttgtgcttgagccttccag

SEQ ID NO: 580677 - DNA, 25 bp, Rattus norvegicus
tcatctttgtggagatccttctgcc

SEQ ID NO: 580678 - DNA, 25 bp, Rattus norvegicus
tcatctttgtggtgatccttctgcc

SEQ ID NO: 580679 - DNA, 25 bp, Rattus norvegicus
tcatctttgttcacacctcagaggg

SEQ ID NO: 580680 - DNA, 25 bp, Rattus norvegicus
tcatctttgttctcacctcagaggg

SEQ ID NO: 580681 - DNA, 25 bp, Rattus norvegicus
tcatcttttaccacagcccgaggaa

SEQ ID NO: 580682 - DNA, 25 bp, Rattus norvegicus
tcatcttttacctcagcccgaggaa

SEQ ID NO: 580683 - DNA, 25 bp, Rattus norvegicus
tcatcttttgtcatggacaagtcgg

SEQ ID NO: 580684 - DNA, 25 bp, Rattus norvegicus
tcatcttttgtcttggacaagtcgg

SEQ ID NO: 580685 - DNA, 25 bp, Rattus norvegicus
tcatctttttcacggtgctatccct

SEQ ID NO: 580686 - DNA, 25 bp, Rattus norvegicus
tcatctttttcagggtgctatccct

SEQ ID NO: 580687 - DNA, 25 bp, Rattus norvegicus
tcatgaaaacttcatcgtcacaaat

SEQ ID NO: 580688 - DNA, 25 bp, Rattus norvegicus
tcatgaaaacttgatcgtcacaaat

SEQ ID NO: 580689 - DNA, 25 bp, Rattus norvegicus
tcatgaacaagtccttcaccctgtt

SEQ ID NO: 580690 - DNA, 25 bp, Rattus norvegicus
tcatgaacaagtgcttcaccctgtt

SEQ ID NO: 580691 - DNA, 25 bp, Rattus norvegicus
tcatgaacaggcctgttttctcttt

SEQ ID NO: 580692 - DNA, 25 bp, Rattus norvegicus
tcatgaacaggcgtgttttctcttt

SEQ ID NO: 580693 - DNA, 25 bp, Rattus norvegicus
tcatgaacatgaccagccagcacat

SEQ ID NO: 580694 - DNA, 25 bp, Rattus norvegicus
tcatgaacatgagcagccagcacat

SEQ ID NO: 580695 - DNA, 25 bp, Rattus norvegicus
tcatgaaccaggaggtggcccactg

SEQ ID NO: 580696 - DNA, 25 bp, Rattus norvegicus
tcatgaaccaggtggtggcccactg

SEQ ID NO: 580697 - DNA, 25 bp, Rattus norvegicus
tcatgaacctaaactgtgacccaga

SEQ ID NO: 580698 - DNA, 25 bp, Rattus norvegicus
tcatgaacctaatctgtgacccaga

SEQ ID NO: 580699 - DNA, 25 bp, Rattus norvegicus
tcatgaacgccaagagcctgtaatt

SEQ ID NO: 580700 - DNA, 25 bp, Rattus norvegicus
tcatgaacgccatgagcctgtaatt

SEQ ID NO: 580701 - DNA, 25 bp, Rattus norvegicus
tcatgaacgctgagctttggctgca

SEQ ID NO: 580702 - DNA, 25 bp, Rattus norvegicus
tcatgaacgctgtgctttggctgca

SEQ ID NO: 580703 - DNA, 25 bp, Rattus norvegicus
tcatgaacggtgctacgtttgtctt

SEQ ID NO: 580704 - DNA, 25 bp, Rattus norvegicus
tcatgaacggtggtacgtttgtctt

SEQ ID NO: 580705 - DNA, 25 bp, Rattus norvegicus
tcatgaacgtcaacgggcgcagcgt

SEQ ID NO: 580706 - DNA, 25 bp, Rattus norvegicus
tcatgaacgtcatcgggcgcagcgt

SEQ ID NO: 580707 - DNA, 25 bp, Rattus norvegicus
tcatgaactaggatgtgaagccctt

SEQ ID NO: 580708 - DNA, 25 bp, Rattus norvegicus
tcatgaactaggttgtgaagccctt

SEQ ID NO: 580709 - DNA, 25 bp, Rattus norvegicus
tcatgaagaggcactgccccagaag

SEQ ID NO: 580710 - DNA, 25 bp, Rattus norvegicus
tcatgaagaggctctgccccagaag

SEQ ID NO: 580711 - DNA, 25 bp, Rattus norvegicus
tcatgaagaggtatctcctggccac

SEQ ID NO: 580712 - DNA, 25 bp, Rattus norvegicus
tcatgaagaggtttctcctggccac

SEQ ID NO: 580713 - DNA, 25 bp, Rattus norvegicus
tcatgaagataaccccgaggactat

SEQ ID NO: 580714 - DNA, 25 bp, Rattus norvegicus
tcatgaagataagcccgaggactat

SEQ ID NO: 580715 - DNA, 25 bp, Rattus norvegicus
tcatgaagatcacacttgagtgaag

SEQ ID NO: 580716 - DNA, 25 bp, Rattus norvegicus
tcatgaagatcagacttgagtgaag

SEQ ID NO: 580717 - DNA, 25 bp, Rattus norvegicus
tcatgaagattcagtgcctgcacac

SEQ ID NO: 580718 - DNA, 25 bp, Rattus norvegicus
tcatgaagattctgtgcctgcacac

SEQ ID NO: 580719 - DNA, 25 bp, Rattus norvegicus
tcatgaagctgaataaccgccccat

SEQ ID NO: 580720 - DNA, 25 bp, Rattus norvegicus
tcatgaagctgattaaccgccccat

SEQ ID NO: 580721 - DNA, 25 bp, Rattus norvegicus
tcatgaagtacccttgaaacccaga

SEQ ID NO: 580722 - DNA, 25 bp, Rattus norvegicus
tcatgaagtaccgttgaaacccaga

SEQ ID NO: 580723 - DNA, 25 bp, Rattus norvegicus
tcatgaagtgtcacccaatggtgat

SEQ ID NO: 580724 - DNA, 25 bp, Rattus norvegicus
tcatgaagtgtctcccaatggtgat

SEQ ID NO: 580725 - DNA, 25 bp, Rattus norvegicus
tcatgaatgatcctatcccaaccta

SEQ ID NO: 580726 - DNA, 25 bp, Rattus norvegicus
tcatgaatgatcgtatcccaaccta

SEQ ID NO: 580727 - DNA, 25 bp, Rattus norvegicus
tcatgaattcctatgctcatctgtg

SEQ ID NO: 580728 - DNA, 25 bp, Rattus norvegicus
tcatgaattcctttgctcatctgtg

SEQ ID NO: 580729 - DNA, 25 bp, Rattus norvegicus
tcatgaattgatccgccctaatagc

SEQ ID NO: 580730 - DNA, 25 bp, Rattus norvegicus
tcatgaattgatgcgccctaatagc

SEQ ID NO: 580731 - DNA, 25 bp, Rattus norvegicus
tcatgacagcctatgcggatcgcac

SEQ ID NO: 580732 - DNA, 25 bp, Rattus norvegicus
tcatgacagcctttgcggatcgcac

SEQ ID NO: 580733 - DNA, 25 bp, Rattus norvegicus
tcatgacatcctatcatctgtgttt

SEQ ID NO: 580734 - DNA, 25 bp, Rattus norvegicus
tcatgacatcctttcatctgtgttt

SEQ ID NO: 580735 - DNA, 25 bp, Rattus norvegicus
tcatgacatcttcaacacgactggg

SEQ ID NO: 580736 - DNA, 25 bp, Rattus norvegicus
tcatgacatcttgaacacgactggg

SEQ ID NO: 580737 - DNA, 25 bp, Rattus norvegicus
tcatgacatttcacgacaggccggt

SEQ ID NO: 580738 - DNA, 25 bp, Rattus norvegicus
tcatgacatttctcgacaggccggt

SEQ ID NO: 580739 - DNA, 25 bp, Rattus norvegicus
tcatgaccatgaacgccgaggacga

SEQ ID NO: 580740 - DNA, 25 bp, Rattus norvegicus
tcatgaccatgatcgccgaggacga

SEQ ID NO: 580741 - DNA, 25 bp, Rattus norvegicus
tcatgacccatcatcagagactgac

SEQ ID NO: 580742 - DNA, 25 bp, Rattus norvegicus
tcatgacccatcttcagagactgac

SEQ ID NO: 580743 - DNA, 25 bp, Rattus norvegicus
tcatgaccccagagcccaagtgttt

SEQ ID NO: 580744 - DNA, 25 bp, Rattus norvegicus
tcatgaccccagtgcccaagtgttt

SEQ ID NO: 580745 - DNA, 25 bp, Rattus norvegicus
tcatgaccgtaacagatccactata

SEQ ID NO: 580746 - DNA, 25 bp, Rattus norvegicus
tcatgaccgtaagagatccactata

SEQ ID NO: 580747 - DNA, 25 bp, Rattus norvegicus
tcatgacctcagaagcaatcacaga

SEQ ID NO: 580748 - DNA, 25 bp, Rattus norvegicus
tcatgacctcagtagcaatcacaga

SEQ ID NO: 580749 - DNA, 25 bp, Rattus norvegicus
tcatgacctcccaactttacttttt

SEQ ID NO: 580750 - DNA, 25 bp, Rattus norvegicus
tcatgacctccctactttacttttt

SEQ ID NO: 580751 - DNA, 25 bp, Rattus norvegicus
tcatgacgatggcagacagaacagt

SEQ ID NO: 580752 - DNA, 25 bp, Rattus norvegicus
tcatgacgatgggagacagaacagt

SEQ ID NO: 580753 - DNA, 25 bp, Rattus norvegicus
tcatgacgtctccattcgttgacaa

SEQ ID NO: 580754 - DNA, 25 bp, Rattus norvegicus
tcatgacgtctcgattcgttgacaa

SEQ ID NO: 580755 - DNA, 25 bp, Rattus norvegicus
tcatgactcacaagcccttggaatt

SEQ ID NO: 580756 - DNA, 25 bp, Rattus norvegicus
tcatgactcacatgcccttggaatt

SEQ ID NO: 580757 - DNA, 25 bp, Rattus norvegicus
tcatgactgagtatggcctgtaaat

SEQ ID NO: 580758 - DNA, 25 bp, Rattus norvegicus
tcatgactgagtttggcctgtaaat

SEQ ID NO: 580759 - DNA, 25 bp, Rattus norvegicus
tcatgactgcccaggtggtctggag

SEQ ID NO: 580760 - DNA, 25 bp, Rattus norvegicus
tcatgactgccctggtggtctggag

SEQ ID NO: 580761 - DNA, 25 bp, Rattus norvegicus
tcatgacttgtaagtgttggttcct

SEQ ID NO: 580762 - DNA, 25 bp, Rattus norvegicus
tcatgacttgtatgtgttggttcct

SEQ ID NO: 580763 - DNA, 25 bp, Rattus norvegicus
tcatgagacatgctgaacttcctgc

SEQ ID NO: 580764 - DNA, 25 bp, Rattus norvegicus
tcatgagacatggtgaacttcctgc

SEQ ID NO: 580765 - DNA, 25 bp, Rattus norvegicus
tcatgagcttggcttgccgcctaag

SEQ ID NO: 580766 - DNA, 25 bp, Rattus norvegicus
tcatgagcttgggttgccgcctaag

SEQ ID NO: 580767 - DNA, 25 bp, Rattus norvegicus
tcatgaggcgttctgtgggacaacc

SEQ ID NO: 580768 - DNA, 25 bp, Rattus norvegicus
tcatgaggcgttgtgtgggacaacc

SEQ ID NO: 580769 - DNA, 25 bp, Rattus norvegicus
tcatgaggtggcactctttttggtg

SEQ ID NO: 580770 - DNA, 25 bp, Rattus norvegicus
tcatgaggtggctctctttttggtg

SEQ ID NO: 580771 - DNA, 25 bp, Rattus norvegicus
tcatgagtacaacgcattcaccttc

SEQ ID NO: 580772 - DNA, 25 bp, Rattus norvegicus
tcatgagtacaaggcattcaccttc

SEQ ID NO: 580773 - DNA, 25 bp, Rattus norvegicus
tcatgagtactcacttcagtctgta

SEQ ID NO: 580774 - DNA, 25 bp, Rattus norvegicus
tcatgagtactctcttcagtctgta

SEQ ID NO: 580775 - DNA, 25 bp, Rattus norvegicus
tcatgagtcagcacttcgagccaag

SEQ ID NO: 580776 - DNA, 25 bp, Rattus norvegicus
tcatgagtcagctcttcgagccaag

SEQ ID NO: 580777 - DNA, 25 bp, Rattus norvegicus
tcatgagtcgtgacgtttgactggt

SEQ ID NO: 580778 - DNA, 25 bp, Rattus norvegicus
tcatgagtcgtgtcgtttgactggt

SEQ ID NO: 580779 - DNA, 25 bp, Rattus norvegicus
tcatgagttgtacttgcccactagc

SEQ ID NO: 580780 - DNA, 25 bp, Rattus norvegicus
tcatgagttgtagttgcccactagc

SEQ ID NO: 580781 - DNA, 25 bp, Rattus norvegicus
tcatgatcaaaactcgccgtaggaa

SEQ ID NO: 580782 - DNA, 25 bp, Rattus norvegicus
tcatgatcaaaagtcgccgtaggaa

SEQ ID NO: 580783 - DNA, 25 bp, Rattus norvegicus
tcatgatccgaccacgacggtgggt

SEQ ID NO: 580784 - DNA, 25 bp, Rattus norvegicus
tcatgatccgacgacgacggtgggt

SEQ ID NO: 580785 - DNA, 25 bp, Rattus norvegicus
tcatgatctatacgcaaccggaacc

SEQ ID NO: 580786 - DNA, 25 bp, Rattus norvegicus
tcatgatctataggcaaccggaacc

SEQ ID NO: 580787 - DNA, 25 bp, Rattus norvegicus
tcatgatgactactgcttggcctat

SEQ ID NO: 580788 - DNA, 25 bp, Rattus norvegicus
tcatgatgactagtgcttggcctat

SEQ ID NO: 580789 - DNA, 25 bp, Rattus norvegicus
tcatgatgccctactacctgatgaa

SEQ ID NO: 580790 - DNA, 25 bp, Rattus norvegicus
tcatgatgcccttctacctgatgaa

SEQ ID NO: 580791 - DNA, 25 bp, Rattus norvegicus
tcatgatgccttaactcgttctggg

SEQ ID NO: 580792 - DNA, 25 bp, Rattus norvegicus
tcatgatgcctttactcgttctggg

SEQ ID NO: 580793 - DNA, 25 bp, Rattus norvegicus
tcatgatggcttatgctgggtggat

SEQ ID NO: 580794 - DNA, 25 bp, Rattus norvegicus
tcatgatggcttttgctgggtggat

SEQ ID NO: 580795 - DNA, 25 bp, Rattus norvegicus
tcatgatggtagaggctggcttctt

SEQ ID NO: 580796 - DNA, 25 bp, Rattus norvegicus
tcatgatggtagtggctggcttctt

SEQ ID NO: 580797 - DNA, 25 bp, Rattus norvegicus
tcatgatggtatccatggtcgccac

SEQ ID NO: 580798 - DNA, 25 bp, Rattus norvegicus
tcatgatggtatgcatggtcgccac

SEQ ID NO: 580799 - DNA, 25 bp, Rattus norvegicus
tcatgattaaacatacattactaat

SEQ ID NO: 580800 - DNA, 25 bp, Rattus norvegicus
tcatgattaaacttacattactaat

SEQ ID NO: 580801 - DNA, 25 bp, Rattus norvegicus
tcatgattatttcgacacgcagggt

SEQ ID NO: 580802 - DNA, 25 bp, Rattus norvegicus
tcatgattatttggacacgcagggt

SEQ ID NO: 580803 - DNA, 25 bp, Rattus norvegicus
tcatgattgtatactttctgcctaa

SEQ ID NO: 580804 - DNA, 25 bp, Rattus norvegicus
tcatgattgtattctttctgcctaa

SEQ ID NO: 580805 - DNA, 25 bp, Rattus norvegicus
tcatgatttatgctcctggctcctc

SEQ ID NO: 580806 - DNA, 25 bp, Rattus norvegicus
tcatgatttatggtcctggctcctc

SEQ ID NO: 580807 - DNA, 25 bp, Rattus norvegicus
tcatgattttccagggcagccgtaa

SEQ ID NO: 580808 - DNA, 25 bp, Rattus norvegicus
tcatgattttcctgggcagccgtaa

SEQ ID NO: 580809 - DNA, 25 bp, Rattus norvegicus
tcatgcaacactaagggtccttgtc

SEQ ID NO: 580810 - DNA, 25 bp, Rattus norvegicus
tcatgcaacacttagggtccttgtc

SEQ ID NO: 580811 - DNA, 25 bp, Rattus norvegicus
tcatgcaatggtatgcttacaaaca

SEQ ID NO: 580812 - DNA, 25 bp, Rattus norvegicus
tcatgcaatggtttgcttacaaaca

SEQ ID NO: 580813 - DNA, 25 bp, Rattus norvegicus
tcatgcacacggcaggagacctgga

SEQ ID NO: 580814 - DNA, 25 bp, Rattus norvegicus
tcatgcacacgggaggagacctgga

SEQ ID NO: 580815 - DNA, 25 bp, Rattus norvegicus
tcatgcacatatattccgctttcag

SEQ ID NO: 580816 - DNA, 25 bp, Rattus norvegicus
tcatgcacatattttccgctttcag

SEQ ID NO: 580817 - DNA, 25 bp, Rattus norvegicus
tcatgcaccaagacccaaggctatg

SEQ ID NO: 580818 - DNA, 25 bp, Rattus norvegicus
tcatgcaccaagtcccaaggctatg

SEQ ID NO: 580819 - DNA, 25 bp, Rattus norvegicus
tcatgcactgtaccgctatgctaac

SEQ ID NO: 580820 - DNA, 25 bp, Rattus norvegicus
tcatgcactgtagcgctatgctaac

SEQ ID NO: 580821 - DNA, 25 bp, Rattus norvegicus
tcatgcagaacccaatgtctctcca

SEQ ID NO: 580822 - DNA, 25 bp, Rattus norvegicus
tcatgcagaaccgaatgtctctcca

SEQ ID NO: 580823 - DNA, 25 bp, Rattus norvegicus
tcatgcagacccagagaggcccagg

SEQ ID NO: 580824 - DNA, 25 bp, Rattus norvegicus
tcatgcagaccctgagaggcccagg

SEQ ID NO: 580825 - DNA, 25 bp, Rattus norvegicus
tcatgcagggacactgcagccctga

SEQ ID NO: 580826 - DNA, 25 bp, Rattus norvegicus
tcatgcagggactctgcagccctga

SEQ ID NO: 580827 - DNA, 25 bp, Rattus norvegicus
tcatgcagggcaccggggatgagct

SEQ ID NO: 580828 - DNA, 25 bp, Rattus norvegicus
tcatgcagggcagcggggatgagct

SEQ ID NO: 580829 - DNA, 25 bp, Rattus norvegicus
tcatgcagggcgagatcgctaccat

SEQ ID NO: 580830 - DNA, 25 bp, Rattus norvegicus
tcatgcagggcgtgatcgctaccat

SEQ ID NO: 580831 - DNA, 25 bp, Rattus norvegicus
tcatgcagggtacagcagactacgg

SEQ ID NO: 580832 - DNA, 25 bp, Rattus norvegicus
tcatgcagggtagagcagactacgg

SEQ ID NO: 580833 - DNA, 25 bp, Rattus norvegicus
tcatgcagtgcaaccataccgtcat

SEQ ID NO: 580834 - DNA, 25 bp, Rattus norvegicus
tcatgcagtgcatccataccgtcat

SEQ ID NO: 580835 - DNA, 25 bp, Rattus norvegicus
tcatgcatctgaagccgatctcaag

SEQ ID NO: 580836 - DNA, 25 bp, Rattus norvegicus
tcatgcatctgatgccgatctcaag

SEQ ID NO: 580837 - DNA, 25 bp, Rattus norvegicus
tcatgccaatgcagtaaccactagt

SEQ ID NO: 580838 - DNA, 25 bp, Rattus norvegicus
tcatgccaatgctgtaaccactagt

SEQ ID NO: 580839 - DNA, 25 bp, Rattus norvegicus
tcatgccaattacctgagcctcacg

SEQ ID NO: 580840 - DNA, 25 bp, Rattus norvegicus
tcatgccaattagctgagcctcacg

SEQ ID NO: 580841 - DNA, 25 bp, Rattus norvegicus
tcatgccactgaatacgttgaaaaa

SEQ ID NO: 580842 - DNA, 25 bp, Rattus norvegicus
tcatgccactgattacgttgaaaaa

SEQ ID NO: 580843 - DNA, 25 bp, Rattus norvegicus
tcatgccactgtacacgagtgttgt

SEQ ID NO: 580844 - DNA, 25 bp, Rattus norvegicus
tcatgccactgttcacgagtgttgt

SEQ ID NO: 580845 - DNA, 25 bp, Rattus norvegicus
tcatgccagagaagcccctgaaact

SEQ ID NO: 580846 - DNA, 25 bp, Rattus norvegicus
tcatgccagagatgcccctgaaact

SEQ ID NO: 580847 - DNA, 25 bp, Rattus norvegicus
tcatgccagcctcacagtctcgtgt

SEQ ID NO: 580848 - DNA, 25 bp, Rattus norvegicus
tcatgccagcctgacagtctcgtgt

SEQ ID NO: 580849 - DNA, 25 bp, Rattus norvegicus
tcatgcccaacaagcagatcgcgga

SEQ ID NO: 580850 - DNA, 25 bp, Rattus norvegicus
tcatgcccaacatgcagatcgcgga

SEQ ID NO: 580851 - DNA, 25 bp, Rattus norvegicus
tcatgcccacatattgtccgtctga

SEQ ID NO: 580852 - DNA, 25 bp, Rattus norvegicus
tcatgcccacattttgtccgtctga

SEQ ID NO: 580853 - DNA, 25 bp, Rattus norvegicus
tcatgcccaggcacttttgggaact

SEQ ID NO: 580854 - DNA, 25 bp, Rattus norvegicus
tcatgcccaggctcttttgggaact

SEQ ID NO: 580855 - DNA, 25 bp, Rattus norvegicus
tcatgccccaaacaggaagtcccaa

SEQ ID NO: 580856 - DNA, 25 bp, Rattus norvegicus
tcatgccccaaagaggaagtcccaa

SEQ ID NO: 580857 - DNA, 25 bp, Rattus norvegicus
tcatgccccacgattgtgtttgaaa

SEQ ID NO: 580858 - DNA, 25 bp, Rattus norvegicus
tcatgccccacgtttgtgtttgaaa

SEQ ID NO: 580859 - DNA, 25 bp, Rattus norvegicus
tcatgccctatcacacatcattaaa

SEQ ID NO: 580860 - DNA, 25 bp, Rattus norvegicus
tcatgccctatctcacatcattaaa

SEQ ID NO: 580861 - DNA, 25 bp, Rattus norvegicus
tcatgccctgcacactcaataaagc

SEQ ID NO: 580862 - DNA, 25 bp, Rattus norvegicus
tcatgccctgcagactcaataaagc

SEQ ID NO: 580863 - DNA, 25 bp, Rattus norvegicus
tcatgccggccgaaagactgtgaag

SEQ ID NO: 580864 - DNA, 25 bp, Rattus norvegicus
tcatgccggccgtaagactgtgaag

SEQ ID NO: 580865 - DNA, 25 bp, Rattus norvegicus
tcatgcctcttgatcagattaatag

SEQ ID NO: 580866 - DNA, 25 bp, Rattus norvegicus
tcatgcctcttgttcagattaatag

SEQ ID NO: 580867 - DNA, 25 bp, Rattus norvegicus
tcatgccttctcactcaatgaggat

SEQ ID NO: 580868 - DNA, 25 bp, Rattus norvegicus
tcatgccttctctctcaatgaggat

SEQ ID NO: 580869 - DNA, 25 bp, Rattus norvegicus
tcatgccttcttagatgtgacctgc

SEQ ID NO: 580870 - DNA, 25 bp, Rattus norvegicus
tcatgccttctttgatgtgacctgc

SEQ ID NO: 580871 - DNA, 25 bp, Rattus norvegicus
tcatgccttgccaacctgagaaaat

SEQ ID NO: 580872 - DNA, 25 bp, Rattus norvegicus
tcatgccttgcctacctgagaaaat

SEQ ID NO: 580873 - DNA, 25 bp, Rattus norvegicus
tcatgcctttaacaacacagaacaa

SEQ ID NO: 580874 - DNA, 25 bp, Rattus norvegicus
tcatgcctttaagaacacagaacaa

SEQ ID NO: 580875 - DNA, 25 bp, Rattus norvegicus
tcatgcgaccttcttcgggttaaat

SEQ ID NO: 580876 - DNA, 25 bp, Rattus norvegicus
tcatgcgaccttgttcgggttaaat

SEQ ID NO: 580877 - DNA, 25 bp, Rattus norvegicus
tcatgcgcggtaagctttttgtaaa

SEQ ID NO: 580878 - DNA, 25 bp, Rattus norvegicus
tcatgcgcggtatgctttttgtaaa

SEQ ID NO: 580879 - DNA, 25 bp, Rattus norvegicus
tcatgcggcctcattgaaactttgc

SEQ ID NO: 580880 - DNA, 25 bp, Rattus norvegicus
tcatgcggcctctttgaaactttgc

SEQ ID NO: 580881 - DNA, 25 bp, Rattus norvegicus
tcatgcggtgtaacgacttttgact

SEQ ID NO: 580882 - DNA, 25 bp, Rattus norvegicus
tcatgcggtgtatcgacttttgact

SEQ ID NO: 580883 - DNA, 25 bp, Rattus norvegicus
tcatgcggttggacagctttctgga

SEQ ID NO: 580884 - DNA, 25 bp, Rattus norvegicus
tcatgcggttggtcagctttctgga

SEQ ID NO: 580885 - DNA, 25 bp, Rattus norvegicus
tcatgcgtgacccaaaagcacacaa

SEQ ID NO: 580886 - DNA, 25 bp, Rattus norvegicus
tcatgcgtgaccgaaaagcacacaa

SEQ ID NO: 580887 - DNA, 25 bp, Rattus norvegicus
tcatgcgtttggatatagctggtcg

SEQ ID NO: 580888 - DNA, 25 bp, Rattus norvegicus
tcatgcgtttggttatagctggtcg

SEQ ID NO: 580889 - DNA, 25 bp, Rattus norvegicus
tcatgctagcccacaggtggcaaag

SEQ ID NO: 580890 - DNA, 25 bp, Rattus norvegicus
tcatgctagccctcaggtggcaaag

SEQ ID NO: 580891 - DNA, 25 bp, Rattus norvegicus
tcatgctagcttcactatttccaca

SEQ ID NO: 580892 - DNA, 25 bp, Rattus norvegicus
tcatgctagcttgactatttccaca

SEQ ID NO: 580893 - DNA, 25 bp, Rattus norvegicus
tcatgctcacacaccaaatggtgta

SEQ ID NO: 580894 - DNA, 25 bp, Rattus norvegicus
tcatgctcacactccaaatggtgta

SEQ ID NO: 580895 - DNA, 25 bp, Rattus norvegicus
tcatgctcagcactaccgatggtac

SEQ ID NO: 580896 - DNA, 25 bp, Rattus norvegicus
tcatgctcagcagtaccgatggtac

SEQ ID NO: 580897 - DNA, 25 bp, Rattus norvegicus
tcatgctcagctctccaatggaatc

SEQ ID NO: 580898 - DNA, 25 bp, Rattus norvegicus
tcatgctcagctgtccaatggaatc

SEQ ID NO: 580899 - DNA, 25 bp, Rattus norvegicus
tcatgctcatgcatttctttcctga

SEQ ID NO: 580900 - DNA, 25 bp, Rattus norvegicus
tcatgctcatgcttttctttcctga

SEQ ID NO: 580901 - DNA, 25 bp, Rattus norvegicus
tcatgctcctggatgaggctcttga

SEQ ID NO: 580902 - DNA, 25 bp, Rattus norvegicus
tcatgctcctggttgaggctcttga

SEQ ID NO: 580903 - DNA, 25 bp, Rattus norvegicus
tcatgctccttcctttgggcaattc

SEQ ID NO: 580904 - DNA, 25 bp, Rattus norvegicus
tcatgctccttcgtttgggcaattc

SEQ ID NO: 580905 - DNA, 25 bp, Rattus norvegicus
tcatgctcgagactcagggtacagt

SEQ ID NO: 580906 - DNA, 25 bp, Rattus norvegicus
tcatgctcgagagtcagggtacagt

SEQ ID NO: 580907 - DNA, 25 bp, Rattus norvegicus
tcatgctcgtatcgtagactctcca

SEQ ID NO: 580908 - DNA, 25 bp, Rattus norvegicus
tcatgctcgtatggtagactctcca

SEQ ID NO: 580909 - DNA, 25 bp, Rattus norvegicus
tcatgctgaactcagtgactctgag

SEQ ID NO: 580910 - DNA, 25 bp, Rattus norvegicus
tcatgctgaactgagtgactctgag

SEQ ID NO: 580911 - DNA, 25 bp, Rattus norvegicus
tcatgctgcagcatgacttagtaat

SEQ ID NO: 580912 - DNA, 25 bp, Rattus norvegicus
tcatgctgcagcttgacttagtaat

SEQ ID NO: 580913 - DNA, 25 bp, Rattus norvegicus
tcatgctgctgacaaacttctctca

SEQ ID NO: 580914 - DNA, 25 bp, Rattus norvegicus
tcatgctgctgagaaacttctctca

SEQ ID NO: 580915 - DNA, 25 bp, Rattus norvegicus
tcatgctggagaccgtgctggacca

SEQ ID NO: 580916 - DNA, 25 bp, Rattus norvegicus
tcatgctggagagcgtgctggacca

SEQ ID NO: 580917 - DNA, 25 bp, Rattus norvegicus
tcatgctggatgatttctctcacga

SEQ ID NO: 580918 - DNA, 25 bp, Rattus norvegicus
tcatgctggatgttttctctcacga

SEQ ID NO: 580919 - DNA, 25 bp, Rattus norvegicus
tcatgctggcagacgacgactgctt

SEQ ID NO: 580920 - DNA, 25 bp, Rattus norvegicus
tcatgctggcagtcgacgactgctt

SEQ ID NO: 580921 - DNA, 25 bp, Rattus norvegicus
tcatgctggcttagatccggctgga

SEQ ID NO: 580922 - DNA, 25 bp, Rattus norvegicus
tcatgctggctttgatccggctgga

SEQ ID NO: 580923 - DNA, 25 bp, Rattus norvegicus
tcatgctggtcaaggactaactctc

SEQ ID NO: 580924 - DNA, 25 bp, Rattus norvegicus
tcatgctggtcatggactaactctc

SEQ ID NO: 580925 - DNA, 25 bp, Rattus norvegicus
tcatgctgtaatcctttttcccaaa

SEQ ID NO: 580926 - DNA, 25 bp, Rattus norvegicus
tcatgctgtaatgctttttcccaaa

SEQ ID NO: 580927 - DNA, 25 bp, Rattus norvegicus
tcatgcttatgaatttggtaaacaa

SEQ ID NO: 580928 - DNA, 25 bp, Rattus norvegicus
tcatgcttatgattttggtaaacaa

SEQ ID NO: 580929 - DNA, 25 bp, Rattus norvegicus
tcatgcttcagtaccctgtggtggt

SEQ ID NO: 580930 - DNA, 25 bp, Rattus norvegicus
tcatgcttcagttccctgtggtggt

SEQ ID NO: 580931 - DNA, 25 bp, Rattus norvegicus
tcatgcttctctagctgcacatata

SEQ ID NO: 580932 - DNA, 25 bp, Rattus norvegicus
tcatgcttctcttgctgcacatata

SEQ ID NO: 580933 - DNA, 25 bp, Rattus norvegicus
tcatgcttcttccttgaccagatgt

SEQ ID NO: 580934 - DNA, 25 bp, Rattus norvegicus
tcatgcttcttcgttgaccagatgt

SEQ ID NO: 580935 - DNA, 25 bp, Rattus norvegicus
tcatgcttgaggagtgggacccaac

SEQ ID NO: 580936 - DNA, 25 bp, Rattus norvegicus
tcatgcttgaggtgtgggacccaac

SEQ ID NO: 580937 - DNA, 25 bp, Rattus norvegicus
tcatgcttggctaatccagtggtct

SEQ ID NO: 580938 - DNA, 25 bp, Rattus norvegicus
tcatgcttggcttatccagtggtct

SEQ ID NO: 580939 - DNA, 25 bp, Rattus norvegicus
tcatgctttagcagactgtggtagc

SEQ ID NO: 580940 - DNA, 25 bp, Rattus norvegicus
tcatgctttagctgactgtggtagc

SEQ ID NO: 580941 - DNA, 25 bp, Rattus norvegicus
tcatgctttcgtattccttgtcaaa

SEQ ID NO: 580942 - DNA, 25 bp, Rattus norvegicus
tcatgctttcgttttccttgtcaaa

SEQ ID NO: 580943 - DNA, 25 bp, Rattus norvegicus
tcatgctttcttagtggttggtttt

SEQ ID NO: 580944 - DNA, 25 bp, Rattus norvegicus
tcatgctttctttgtggttggtttt

SEQ ID NO: 580945 - DNA, 25 bp, Rattus norvegicus
tcatgctttgctcggctctgagttc

SEQ ID NO: 580946 - DNA, 25 bp, Rattus norvegicus
tcatgctttgctgggctctgagttc

SEQ ID NO: 580947 - DNA, 25 bp, Rattus norvegicus
tcatgctttttgatcatctgataaa

SEQ ID NO: 580948 - DNA, 25 bp, Rattus norvegicus
tcatgctttttgttcatctgataaa

SEQ ID NO: 580949 - DNA, 25 bp, Rattus norvegicus
tcatggaagggaccctctccgggca

SEQ ID NO: 580950 - DNA, 25 bp, Rattus norvegicus
tcatggaagggagcctctccgggca

SEQ ID NO: 580951 - DNA, 25 bp, Rattus norvegicus
tcatggaagtgaacccaactcttgg

SEQ ID NO: 580952 - DNA, 25 bp, Rattus norvegicus
tcatggaagtgatcccaactcttgg

SEQ ID NO: 580953 - DNA, 25 bp, Rattus norvegicus
tcatggaatcatccccgagtcagga

SEQ ID NO: 580954 - DNA, 25 bp, Rattus norvegicus
tcatggaatcatgcccgagtcagga

SEQ ID NO: 580955 - DNA, 25 bp, Rattus norvegicus
tcatggaatggcattcaggaactat

SEQ ID NO: 580956 - DNA, 25 bp, Rattus norvegicus
tcatggaatggctttcaggaactat

SEQ ID NO: 580957 - DNA, 25 bp, Rattus norvegicus
tcatggacaatgaatcccgatacct

SEQ ID NO: 580958 - DNA, 25 bp, Rattus norvegicus
tcatggacaatgtatcccgatacct

SEQ ID NO: 580959 - DNA, 25 bp, Rattus norvegicus
tcatggaccaggagcacagggacaa

SEQ ID NO: 580960 - DNA, 25 bp, Rattus norvegicus
tcatggaccaggtgcacagggacaa

SEQ ID NO: 580961 - DNA, 25 bp, Rattus norvegicus
tcatggaccatcactgtggaaacgg

SEQ ID NO: 580962 - DNA, 25 bp, Rattus norvegicus
tcatggaccatctctgtggaaacgg

SEQ ID NO: 580963 - DNA, 25 bp, Rattus norvegicus
tcatggacccacctatagggcttag

SEQ ID NO: 580964 - DNA, 25 bp, Rattus norvegicus
tcatggacccacgtatagggcttag

SEQ ID NO: 580965 - DNA, 25 bp, Rattus norvegicus
tcatggacctcaactgaacccaaca

SEQ ID NO: 580966 - DNA, 25 bp, Rattus norvegicus
tcatggacctcatctgaacccaaca

SEQ ID NO: 580967 - DNA, 25 bp, Rattus norvegicus
tcatggactctactgtctatcatcc

SEQ ID NO: 580968 - DNA, 25 bp, Rattus norvegicus
tcatggactctagtgtctatcatcc

SEQ ID NO: 580969 - DNA, 25 bp, Rattus norvegicus
tcatggactgggacgagttaacaga

SEQ ID NO: 580970 - DNA, 25 bp, Rattus norvegicus
tcatggactgggtcgagttaacaga

SEQ ID NO: 580971 - DNA, 25 bp, Rattus norvegicus
tcatggagatgaacgcctctgccaa

SEQ ID NO: 580972 - DNA, 25 bp, Rattus norvegicus
tcatggagatgaccgaccccacagt

SEQ ID NO: 580973 - DNA, 25 bp, Rattus norvegicus
tcatggagatgagcgaccccacagt

SEQ ID NO: 580974 - DNA, 25 bp, Rattus norvegicus
tcatggagatgatcgcctctgccaa

SEQ ID NO: 580975 - DNA, 25 bp, Rattus norvegicus
tcatggagatgcaggaggccccaca

SEQ ID NO: 580976 - DNA, 25 bp, Rattus norvegicus
tcatggagatgctggaggccccaca

SEQ ID NO: 580977 - DNA, 25 bp, Rattus norvegicus
tcatggagattgactcaccttgaca

SEQ ID NO: 580978 - DNA, 25 bp, Rattus norvegicus
tcatggagattgtctcaccttgaca

SEQ ID NO: 580979 - DNA, 25 bp, Rattus norvegicus
tcatggagccctactattcttgtat

SEQ ID NO: 580980 - DNA, 25 bp, Rattus norvegicus
tcatggagcccttctattcttgtat

SEQ ID NO: 580981 - DNA, 25 bp, Rattus norvegicus
tcatggagctccatatgtctcccta

SEQ ID NO: 580982 - DNA, 25 bp, Rattus norvegicus
tcatggagctccttatgtctcccta

SEQ ID NO: 580983 - DNA, 25 bp, Rattus norvegicus
tcatggaggtctatcttggagggca

SEQ ID NO: 580984 - DNA, 25 bp, Rattus norvegicus
tcatggaggtctttcttggagggca

SEQ ID NO: 580985 - DNA, 25 bp, Rattus norvegicus
tcatggatcggtactcggctgtggt

SEQ ID NO: 580986 - DNA, 25 bp, Rattus norvegicus
tcatggatcggttctcggctgtggt

SEQ ID NO: 580987 - DNA, 25 bp, Rattus norvegicus
tcatggatgacgaccctgcacagac

SEQ ID NO: 580988 - DNA, 25 bp, Rattus norvegicus
tcatggatgacgtccctgcacagac

SEQ ID NO: 580989 - DNA, 25 bp, Rattus norvegicus
tcatggatgtgacccagcatatctg

SEQ ID NO: 580990 - DNA, 25 bp, Rattus norvegicus
tcatggatgtgagccagcatatctg

SEQ ID NO: 580991 - DNA, 25 bp, Rattus norvegicus
tcatggattctgaatacatctctaa

SEQ ID NO: 580992 - DNA, 25 bp, Rattus norvegicus
tcatggattctgtatacatctctaa

SEQ ID NO: 580993 - DNA, 25 bp, Rattus norvegicus
tcatggattgccaacctgaattccc

SEQ ID NO: 580994 - DNA, 25 bp, Rattus norvegicus
tcatggattgcctacctgaattccc

SEQ ID NO: 580995 - DNA, 25 bp, Rattus norvegicus
tcatggcaacagctttaaccctttc

SEQ ID NO: 580996 - DNA, 25 bp, Rattus norvegicus
tcatggcaacaggtttaaccctttc

SEQ ID NO: 580997 - DNA, 25 bp, Rattus norvegicus
tcatggcacatgagtcttttcctgt

SEQ ID NO: 580998 - DNA, 25 bp, Rattus norvegicus
tcatggcacatgtgtcttttcctgt

SEQ ID NO: 580999 - DNA, 25 bp, Rattus norvegicus
tcatggcaccatattacatccctgt

SEQ ID NO: 581000 - DNA, 25 bp, Rattus norvegicus
tcatggcaccattttacatccctgt

SEQ ID NO: 581001 - DNA, 25 bp, Rattus norvegicus
tcatggcactagctgctgctgcaca

SEQ ID NO: 581002 - DNA, 25 bp, Rattus norvegicus
tcatggcactaggtgctgctgcaca

SEQ ID NO: 581003 - DNA, 25 bp, Rattus norvegicus
tcatggcagaatactatggatccaa

SEQ ID NO: 581004 - DNA, 25 bp, Rattus norvegicus
tcatggcagaattctatggatccaa

SEQ ID NO: 581005 - DNA, 25 bp, Rattus norvegicus
tcatggcagaccctggacaaagctg

SEQ ID NO: 581006 - DNA, 25 bp, Rattus norvegicus
tcatggcagaccgtggacaaagctg

SEQ ID NO: 581007 - DNA, 25 bp, Rattus norvegicus
tcatggcagcttaagttataatttc

SEQ ID NO: 581008 - DNA, 25 bp, Rattus norvegicus
tcatggcagctttagttataatttc

SEQ ID NO: 581009 - DNA, 25 bp, Rattus norvegicus
tcatggcaggtgagcgttaagacaa

SEQ ID NO: 581010 - DNA, 25 bp, Rattus norvegicus
tcatggcaggtgtgcgttaagacaa

SEQ ID NO: 581011 - DNA, 25 bp, Rattus norvegicus
tcatggcagttcatgggagtttccc

SEQ ID NO: 581012 - DNA, 25 bp, Rattus norvegicus
tcatggcagttcttgggagtttccc

SEQ ID NO: 581013 - DNA, 25 bp, Rattus norvegicus
tcatggccaggcaagaccagttggt

SEQ ID NO: 581014 - DNA, 25 bp, Rattus norvegicus
tcatggccaggctagaccagttggt

SEQ ID NO: 581015 - DNA, 25 bp, Rattus norvegicus
tcatggccaggtctacggaactcta

SEQ ID NO: 581016 - DNA, 25 bp, Rattus norvegicus
tcatggccaggtgtacggaactcta

SEQ ID NO: 581017 - DNA, 25 bp, Rattus norvegicus
tcatggccatgtcttctgtgtacca

SEQ ID NO: 581018 - DNA, 25 bp, Rattus norvegicus
tcatggccatgtgttctgtgtacca

SEQ ID NO: 581019 - DNA, 25 bp, Rattus norvegicus
tcatggccccagaatcttctagagt

SEQ ID NO: 581020 - DNA, 25 bp, Rattus norvegicus
tcatggccccagtatcttctagagt

SEQ ID NO: 581021 - DNA, 25 bp, Rattus norvegicus
tcatggccccttaacattggagtat

SEQ ID NO: 581022 - DNA, 25 bp, Rattus norvegicus
tcatggcccctttacattggagtat

SEQ ID NO: 581023 - DNA, 25 bp, Rattus norvegicus
tcatggccctggaagaggaatcccc

SEQ ID NO: 581024 - DNA, 25 bp, Rattus norvegicus
tcatggccctggtagaggaatcccc

SEQ ID NO: 581025 - DNA, 25 bp, Rattus norvegicus
tcatggcgagctctctccaggaggc

SEQ ID NO: 581026 - DNA, 25 bp, Rattus norvegicus
tcatggcgagctgtctccaggaggc

SEQ ID NO: 581027 - DNA, 25 bp, Rattus norvegicus
tcatggcgcccaatacgtgcagaga

SEQ ID NO: 581028 - DNA, 25 bp, Rattus norvegicus
tcatggcgcccattacgtgcagaga

SEQ ID NO: 581029 - DNA, 25 bp, Rattus norvegicus
tcatggcgcggtccttaaagacttg

SEQ ID NO: 581030 - DNA, 25 bp, Rattus norvegicus
tcatggcgcggtgcttaaagacttg

SEQ ID NO: 581031 - DNA, 25 bp, Rattus norvegicus
tcatggcggctcaggtggtcaactt

SEQ ID NO: 581032 - DNA, 25 bp, Rattus norvegicus
tcatggcggctctggtggtcaactt

SEQ ID NO: 581033 - DNA, 25 bp, Rattus norvegicus
tcatggcgtcgcagactcttgtgac

SEQ ID NO: 581034 - DNA, 25 bp, Rattus norvegicus
tcatggcgtcgctgactcttgtgac

SEQ ID NO: 581035 - DNA, 25 bp, Rattus norvegicus
tcatggctaagcaggatccgtactt

SEQ ID NO: 581036 - DNA, 25 bp, Rattus norvegicus
tcatggctaagctggatccgtactt

SEQ ID NO: 581037 - DNA, 25 bp, Rattus norvegicus
tcatggctaccccactggcagtgag

SEQ ID NO: 581038 - DNA, 25 bp, Rattus norvegicus
tcatggctacccgactggcagtgag

SEQ ID NO: 581039 - DNA, 25 bp, Rattus norvegicus
tcatggctagccactatatcacagg

SEQ ID NO: 581040 - DNA, 25 bp, Rattus norvegicus
tcatggctagcctctatatcacagg

SEQ ID NO: 581041 - DNA, 25 bp, Rattus norvegicus
tcatggctcaacattcagaacccta

SEQ ID NO: 581042 - DNA, 25 bp, Rattus norvegicus
tcatggctcaactttcagaacccta

SEQ ID NO: 581043 - DNA, 25 bp, Rattus norvegicus
tcatggctcagcaggtcatcagcat

SEQ ID NO: 581044 - DNA, 25 bp, Rattus norvegicus
tcatggctcagctggtcatcagcat

SEQ ID NO: 581045 - DNA, 25 bp, Rattus norvegicus
tcatggctcaggctcttcaagaata

SEQ ID NO: 581046 - DNA, 25 bp, Rattus norvegicus
tcatggctcagggtcttcaagaata

SEQ ID NO: 581047 - DNA, 25 bp, Rattus norvegicus
tcatggctcagtatggaggacagaa

SEQ ID NO: 581048 - DNA, 25 bp, Rattus norvegicus
tcatggctcagtttggaggacagaa

SEQ ID NO: 581049 - DNA, 25 bp, Rattus norvegicus
tcatggctctcacgcccttggaatt

SEQ ID NO: 581050 - DNA, 25 bp, Rattus norvegicus
tcatggctctcaggcccttggaatt

SEQ ID NO: 581051 - DNA, 25 bp, Rattus norvegicus
tcatggctgctacctttctgaagaa

SEQ ID NO: 581052 - DNA, 25 bp, Rattus norvegicus
tcatggctgctagctttctgaagaa

SEQ ID NO: 581053 - DNA, 25 bp, Rattus norvegicus
tcatggcttcacacagcaatgtctg

SEQ ID NO: 581054 - DNA, 25 bp, Rattus norvegicus
tcatggcttcactcagcaatgtctg

SEQ ID NO: 581055 - DNA, 25 bp, Rattus norvegicus
tcatggcttcctactcagcatggaa

SEQ ID NO: 581056 - DNA, 25 bp, Rattus norvegicus
tcatggcttccttctcagcatggaa

SEQ ID NO: 581057 - DNA, 25 bp, Rattus norvegicus
tcatgggacccaaaagcttcatctg

SEQ ID NO: 581058 - DNA, 25 bp, Rattus norvegicus
tcatgggacccataagcttcatctg

SEQ ID NO: 581059 - DNA, 25 bp, Rattus norvegicus
tcatgggagaacagtggcctctgct

SEQ ID NO: 581060 - DNA, 25 bp, Rattus norvegicus
tcatgggagaactgtggcctctgct

SEQ ID NO: 581061 - DNA, 25 bp, Rattus norvegicus
tcatgggagcatacctgggccaggt

SEQ ID NO: 581062 - DNA, 25 bp, Rattus norvegicus
tcatgggagcattcctgggccaggt

SEQ ID NO: 581063 - DNA, 25 bp, Rattus norvegicus
tcatgggaggcaacctggaagccct

SEQ ID NO: 581064 - DNA, 25 bp, Rattus norvegicus
tcatgggaggcatcctggaagccct

SEQ ID NO: 581065 - DNA, 25 bp, Rattus norvegicus
tcatgggcaataatgtgtatgtcac

SEQ ID NO: 581066 - DNA, 25 bp, Rattus norvegicus
tcatgggcaatattgtgtatgtcac

SEQ ID NO: 581067 - DNA, 25 bp, Rattus norvegicus
tcatgggcaccaacgacggcaaagc

SEQ ID NO: 581068 - DNA, 25 bp, Rattus norvegicus
tcatgggcaccatcgacggcaaagc

SEQ ID NO: 581069 - DNA, 25 bp, Rattus norvegicus
tcatgggcatggactctggcactaa

SEQ ID NO: 581070 - DNA, 25 bp, Rattus norvegicus
tcatgggcatggtctctggcactaa

SEQ ID NO: 581071 - DNA, 25 bp, Rattus norvegicus
tcatgggccagtagctgcagttcga

SEQ ID NO: 581072 - DNA, 25 bp, Rattus norvegicus
tcatgggccagttgctgcagttcga

SEQ ID NO: 581073 - DNA, 25 bp, Rattus norvegicus
tcatgggccgcaccctgaaagctga

SEQ ID NO: 581074 - DNA, 25 bp, Rattus norvegicus
tcatgggccgcagcctgaaagctga

SEQ ID NO: 581075 - DNA, 25 bp, Rattus norvegicus
tcatgggtggtgctccccatgttaa

SEQ ID NO: 581076 - DNA, 25 bp, Rattus norvegicus
tcatgggtggtggtccccatgttaa

SEQ ID NO: 581077 - DNA, 25 bp, Rattus norvegicus
tcatgggtgtgcacggttttattta

SEQ ID NO: 581078 - DNA, 25 bp, Rattus norvegicus
tcatgggtgtgctcggttttattta

SEQ ID NO: 581079 - DNA, 25 bp, Rattus norvegicus
tcatgggttaaaagccctgggtttg

SEQ ID NO: 581080 - DNA, 25 bp, Rattus norvegicus
tcatgggttaaatgccctgggtttg

SEQ ID NO: 581081 - DNA, 25 bp, Rattus norvegicus
tcatggtaaagcattgcaatcgcgt

SEQ ID NO: 581082 - DNA, 25 bp, Rattus norvegicus
tcatggtaaagctttgcaatcgcgt

SEQ ID NO: 581083 - DNA, 25 bp, Rattus norvegicus
tcatggtaactgatggcccttggac

SEQ ID NO: 581084 - DNA, 25 bp, Rattus norvegicus
tcatggtaactgttggcccttggac

SEQ ID NO: 581085 - DNA, 25 bp, Rattus norvegicus
tcatggtagggaaacaaagccatct

SEQ ID NO: 581086 - DNA, 25 bp, Rattus norvegicus
tcatggtagggatacaaagccatct

SEQ ID NO: 581087 - DNA, 25 bp, Rattus norvegicus
tcatggtatgagattcttctatcga

SEQ ID NO: 581088 - DNA, 25 bp, Rattus norvegicus
tcatggtatgagtttcttctatcga

SEQ ID NO: 581089 - DNA, 25 bp, Rattus norvegicus
tcatggtcagagcacagcatttcat

SEQ ID NO: 581090 - DNA, 25 bp, Rattus norvegicus
tcatggtcagaggacagcatttcat

SEQ ID NO: 581091 - DNA, 25 bp, Rattus norvegicus
tcatggtcagatcctttccctcagg

SEQ ID NO: 581092 - DNA, 25 bp, Rattus norvegicus
tcatggtcagatgctttccctcagg

SEQ ID NO: 581093 - DNA, 25 bp, Rattus norvegicus
tcatggtcagcaaccccatggacac

SEQ ID NO: 581094 - DNA, 25 bp, Rattus norvegicus
tcatggtcagcatccccatggacac

SEQ ID NO: 581095 - DNA, 25 bp, Rattus norvegicus
tcatggtcatccatgactacttata

SEQ ID NO: 581096 - DNA, 25 bp, Rattus norvegicus
tcatggtcatccttgactacttata

SEQ ID NO: 581097 - DNA, 25 bp, Rattus norvegicus
tcatggtccccgaaagcaggatagg

SEQ ID NO: 581098 - DNA, 25 bp, Rattus norvegicus
tcatggtccccgtaagcaggatagg

SEQ ID NO: 581099 - DNA, 25 bp, Rattus norvegicus
tcatggtccctgatgtgtgtcttag

SEQ ID NO: 581100 - DNA, 25 bp, Rattus norvegicus
tcatggtccctgttgtgtgtcttag

SEQ ID NO: 581101 - DNA, 25 bp, Rattus norvegicus
tcatggtcctctcgacttgttacat

SEQ ID NO: 581102 - DNA, 25 bp, Rattus norvegicus
tcatggtcctctggacttgttacat

SEQ ID NO: 581103 - DNA, 25 bp, Rattus norvegicus
tcatggtctctcagtgcaagggtga

SEQ ID NO: 581104 - DNA, 25 bp, Rattus norvegicus
tcatggtctctctgtgcaagggtga

SEQ ID NO: 581105 - DNA, 25 bp, Rattus norvegicus
tcatggtcttcacagtttgcccctt

SEQ ID NO: 581106 - DNA, 25 bp, Rattus norvegicus
tcatggtcttcagagtttgcccctt

SEQ ID NO: 581107 - DNA, 25 bp, Rattus norvegicus
tcatggtcttgcacgctggtagtcc

SEQ ID NO: 581108 - DNA, 25 bp, Rattus norvegicus
tcatggtcttgctcgctggtagtcc

SEQ ID NO: 581109 - DNA, 25 bp, Rattus norvegicus
tcatggtgatgccaagccactgcca

SEQ ID NO: 581110 - DNA, 25 bp, Rattus norvegicus
tcatggtgatgcgaagccactgcca

SEQ ID NO: 581111 - DNA, 25 bp, Rattus norvegicus
tcatggtgcactccagctatgcgat

SEQ ID NO: 581112 - DNA, 25 bp, Rattus norvegicus
tcatggtgcactgcagctatgcgat

SEQ ID NO: 581113 - DNA, 25 bp, Rattus norvegicus
tcatggtgcagacagtgtttgctcc

SEQ ID NO: 581114 - DNA, 25 bp, Rattus norvegicus
tcatggtgcagagagtgtttgctcc

SEQ ID NO: 581115 - DNA, 25 bp, Rattus norvegicus
tcatggtgctataaccccttgggat

SEQ ID NO: 581116 - DNA, 25 bp, Rattus norvegicus
tcatggtgctattaccccttgggat

SEQ ID NO: 581117 - DNA, 25 bp, Rattus norvegicus
tcatggtgctgcagttctcggagga

SEQ ID NO: 581118 - DNA, 25 bp, Rattus norvegicus
tcatggtgctgctgttctcggagga

SEQ ID NO: 581119 - DNA, 25 bp, Rattus norvegicus
tcatggtgggcaaccaggatctcct

SEQ ID NO: 581120 - DNA, 25 bp, Rattus norvegicus
tcatggtgggcatccaggatctcct

SEQ ID NO: 581121 - DNA, 25 bp, Rattus norvegicus
tcatggtgtccaaggctaacctggt

SEQ ID NO: 581122 - DNA, 25 bp, Rattus norvegicus
tcatggtgtccatggctaacctggt

SEQ ID NO: 581123 - DNA, 25 bp, Rattus norvegicus
tcatggtgttcgatgttgagtgctt

SEQ ID NO: 581124 - DNA, 25 bp, Rattus norvegicus
tcatggtgttcgttgttgagtgctt

SEQ ID NO: 581125 - DNA, 25 bp, Rattus norvegicus
tcatggttagctctgtcccgggata

SEQ ID NO: 581126 - DNA, 25 bp, Rattus norvegicus
tcatggttagctgtgtcccgggata

SEQ ID NO: 581127 - DNA, 25 bp, Rattus norvegicus
tcatggttcatgattcagtggctac

SEQ ID NO: 581128 - DNA, 25 bp, Rattus norvegicus
tcatggttcatgtttcagtggctac

SEQ ID NO: 581129 - DNA, 25 bp, Rattus norvegicus
tcatggttgatgatacctgcttcca

SEQ ID NO: 581130 - DNA, 25 bp, Rattus norvegicus
tcatggttgatgttacctgcttcca

SEQ ID NO: 581131 - DNA, 25 bp, Rattus norvegicus
tcatgtaaactgatcttgggacttt

SEQ ID NO: 581132 - DNA, 25 bp, Rattus norvegicus
tcatgtaaactgttcttgggacttt

SEQ ID NO: 581133 - DNA, 25 bp, Rattus norvegicus
tcatgtaaatgtccgtgtcttccca

SEQ ID NO: 581134 - DNA, 25 bp, Rattus norvegicus
tcatgtaaatgtgcgtgtcttccca

SEQ ID NO: 581135 - DNA, 25 bp, Rattus norvegicus
tcatgtaacggaatgtgagtggcgc

SEQ ID NO: 581136 - DNA, 25 bp, Rattus norvegicus
tcatgtaacggattgtgagtggcgc

SEQ ID NO: 581137 - DNA, 25 bp, Rattus norvegicus
tcatgtaatcccagtgctttaagag

SEQ ID NO: 581138 - DNA, 25 bp, Rattus norvegicus
tcatgtaatccctgtgctttaagag

SEQ ID NO: 581139 - DNA, 25 bp, Rattus norvegicus
tcatgtaatcttagctcggatgccg

SEQ ID NO: 581140 - DNA, 25 bp, Rattus norvegicus
tcatgtaatctttgctcggatgccg

SEQ ID NO: 581141 - DNA, 25 bp, Rattus norvegicus
tcatgtaccagaagttccggaacca

SEQ ID NO: 581142 - DNA, 25 bp, Rattus norvegicus
tcatgtaccagatgttccggaacca

SEQ ID NO: 581143 - DNA, 25 bp, Rattus norvegicus
tcatgtaccatgatggccccactcc

SEQ ID NO: 581144 - DNA, 25 bp, Rattus norvegicus
tcatgtaccatgttggccccactcc

SEQ ID NO: 581145 - DNA, 25 bp, Rattus norvegicus
tcatgtactcttcccttctaattag

SEQ ID NO: 581146 - DNA, 25 bp, Rattus norvegicus
tcatgtactcttgccttctaattag

SEQ ID NO: 581147 - DNA, 25 bp, Rattus norvegicus
tcatgtactgttctaaagcggagac

SEQ ID NO: 581148 - DNA, 25 bp, Rattus norvegicus
tcatgtactgttgtaaagcggagac

SEQ ID NO: 581149 - DNA, 25 bp, Rattus norvegicus
tcatgtagaggccatggctgctcac

SEQ ID NO: 581150 - DNA, 25 bp, Rattus norvegicus
tcatgtagaggcgatggctgctcac

SEQ ID NO: 581151 - DNA, 25 bp, Rattus norvegicus
tcatgtagatttagccagtcagttc

SEQ ID NO: 581152 - DNA, 25 bp, Rattus norvegicus
tcatgtagattttgccagtcagttc

SEQ ID NO: 581153 - DNA, 25 bp, Rattus norvegicus
tcatgtatcttaaggccagctctgt

SEQ ID NO: 581154 - DNA, 25 bp, Rattus norvegicus
tcatgtatcttatggccagctctgt

SEQ ID NO: 581155 - DNA, 25 bp, Rattus norvegicus
tcatgtatgccaaacgggcctttgt

SEQ ID NO: 581156 - DNA, 25 bp, Rattus norvegicus
tcatgtatgccatacgggcctttgt

SEQ ID NO: 581157 - DNA, 25 bp, Rattus norvegicus
tcatgtatgtagatcattgcttttt

SEQ ID NO: 581158 - DNA, 25 bp, Rattus norvegicus
tcatgtatgtagttcattgcttttt

SEQ ID NO: 581159 - DNA, 25 bp, Rattus norvegicus
tcatgtattcacatccgggtccggt

SEQ ID NO: 581160 - DNA, 25 bp, Rattus norvegicus
tcatgtattcacttccgggtccggt

SEQ ID NO: 581161 - DNA, 25 bp, Rattus norvegicus
tcatgtatttccacatcacctttgg

SEQ ID NO: 581162 - DNA, 25 bp, Rattus norvegicus
tcatgtatttcctcatcacctttgg

SEQ ID NO: 581163 - DNA, 25 bp, Rattus norvegicus
tcatgtattttgactctgctcgtag

SEQ ID NO: 581164 - DNA, 25 bp, Rattus norvegicus
tcatgtattttgtctctgctcgtag

SEQ ID NO: 581165 - DNA, 25 bp, Rattus norvegicus
tcatgtcaagatccccagtaactca

SEQ ID NO: 581166 - DNA, 25 bp, Rattus norvegicus
tcatgtcaagatgcccagtaactca

SEQ ID NO: 581167 - DNA, 25 bp, Rattus norvegicus
tcatgtcaatgaagagtcgtgtaag

SEQ ID NO: 581168 - DNA, 25 bp, Rattus norvegicus
tcatgtcaatgatgagtcgtgtaag

SEQ ID NO: 581169 - DNA, 25 bp, Rattus norvegicus
tcatgtcacctcagggatgcaggga

SEQ ID NO: 581170 - DNA, 25 bp, Rattus norvegicus
tcatgtcacctctgggatgcaggga

SEQ ID NO: 581171 - DNA, 25 bp, Rattus norvegicus
tcatgtcacttcactgtacttttgt

SEQ ID NO: 581172 - DNA, 25 bp, Rattus norvegicus
tcatgtcacttctctgtacttttgt

SEQ ID NO: 581173 - DNA, 25 bp, Rattus norvegicus
tcatgtcagcttactaatccaaatt

SEQ ID NO: 581174 - DNA, 25 bp, Rattus norvegicus
tcatgtcagctttctaatccaaatt

SEQ ID NO: 581175 - DNA, 25 bp, Rattus norvegicus
tcatgtcagtaaatccaaccttcag

SEQ ID NO: 581176 - DNA, 25 bp, Rattus norvegicus
tcatgtcagtaattccaaccttcag

SEQ ID NO: 581177 - DNA, 25 bp, Rattus norvegicus
tcatgtcagtgtagctctctaaata

SEQ ID NO: 581178 - DNA, 25 bp, Rattus norvegicus
tcatgtcagtgttgctctctaaata

SEQ ID NO: 581179 - DNA, 25 bp, Rattus norvegicus
tcatgtcatattctgttcccttcaa

SEQ ID NO: 581180 - DNA, 25 bp, Rattus norvegicus
tcatgtcatattgtgttcccttcaa

SEQ ID NO: 581181 - DNA, 25 bp, Rattus norvegicus
tcatgtccaaccaagcgttctgttc

SEQ ID NO: 581182 - DNA, 25 bp, Rattus norvegicus
tcatgtccaacctagcgttctgttc

SEQ ID NO: 581183 - DNA, 25 bp, Rattus norvegicus
tcatgtccagtgaaaaacctgcaaa

SEQ ID NO: 581184 - DNA, 25 bp, Rattus norvegicus
tcatgtccagtgtaaaacctgcaaa

SEQ ID NO: 581185 - DNA, 25 bp, Rattus norvegicus
tcatgtccccgtcctcaaataaaaa

SEQ ID NO: 581186 - DNA, 25 bp, Rattus norvegicus
tcatgtccccgtgctcaaataaaaa

SEQ ID NO: 581187 - DNA, 25 bp, Rattus norvegicus
tcatgtcccgtaccctcagagatgc

SEQ ID NO: 581188 - DNA, 25 bp, Rattus norvegicus
tcatgtcccgtagcctcagagatgc

SEQ ID NO: 581189 - DNA, 25 bp, Rattus norvegicus
tcatgtcgctgactgcctgggagac

SEQ ID NO: 581190 - DNA, 25 bp, Rattus norvegicus
tcatgtcgctgagtgcctgggagac

SEQ ID NO: 581191 - DNA, 25 bp, Rattus norvegicus
tcatgtcgggacagtaagcttgttg

SEQ ID NO: 581192 - DNA, 25 bp, Rattus norvegicus
tcatgtcgggactgtaagcttgttg

SEQ ID NO: 581193 - DNA, 25 bp, Rattus norvegicus
tcatgtcgtcccagacaagtgagat

SEQ ID NO: 581194 - DNA, 25 bp, Rattus norvegicus
tcatgtcgtccctgacaagtgagat

SEQ ID NO: 581195 - DNA, 25 bp, Rattus norvegicus
tcatgtctatctctaacctccagct

SEQ ID NO: 581196 - DNA, 25 bp, Rattus norvegicus
tcatgtctatctgtaacctccagct

SEQ ID NO: 581197 - DNA, 25 bp, Rattus norvegicus
tcatgtctcaccacacagaacattg

SEQ ID NO: 581198 - DNA, 25 bp, Rattus norvegicus
tcatgtctcacctcacagaacattg

SEQ ID NO: 581199 - DNA, 25 bp, Rattus norvegicus
tcatgtctgagccacctgaagaaaa

SEQ ID NO: 581200 - DNA, 25 bp, Rattus norvegicus
tcatgtctgagcgacctgaagaaaa

SEQ ID NO: 581201 - DNA, 25 bp, Rattus norvegicus
tcatgtctgcatctggtggagaaca

SEQ ID NO: 581202 - DNA, 25 bp, Rattus norvegicus
tcatgtctgcatgtggtggagaaca

SEQ ID NO: 581203 - DNA, 25 bp, Rattus norvegicus
tcatgtctgggaatgtctgcttcaa

SEQ ID NO: 581204 - DNA, 25 bp, Rattus norvegicus
tcatgtctgggattgtctgcttcaa

SEQ ID NO: 581205 - DNA, 25 bp, Rattus norvegicus
tcatgtctgtcaacggagcggtgtg

SEQ ID NO: 581206 - DNA, 25 bp, Rattus norvegicus
tcatgtctgtcatcggagcggtgtg

SEQ ID NO: 581207 - DNA, 25 bp, Rattus norvegicus
tcatgtctgtccagctgcaagcaaa

SEQ ID NO: 581208 - DNA, 25 bp, Rattus norvegicus
tcatgtctgtcctgctgcaagcaaa

SEQ ID NO: 581209 - DNA, 25 bp, Rattus norvegicus
tcatgtcttaaaaatctcagatggg

SEQ ID NO: 581210 - DNA, 25 bp, Rattus norvegicus
tcatgtcttaaatatctcagatggg

SEQ ID NO: 581211 - DNA, 25 bp, Rattus norvegicus
tcatgtcttatcagtgttctgttca

SEQ ID NO: 581212 - DNA, 25 bp, Rattus norvegicus
tcatgtcttatctgtgttctgttca

SEQ ID NO: 581213 - DNA, 25 bp, Rattus norvegicus
tcatgtcttcctctctgtacagtaa

SEQ ID NO: 581214 - DNA, 25 bp, Rattus norvegicus
tcatgtcttcctgtctgtacagtaa

SEQ ID NO: 581215 - DNA, 25 bp, Rattus norvegicus
tcatgtctttttaactttacttggg

SEQ ID NO: 581216 - DNA, 25 bp, Rattus norvegicus
tcatgtcttttttactttacttggg

SEQ ID NO: 581217 - DNA, 25 bp, Rattus norvegicus
tcatgtgaaagaaactcttcagagt

SEQ ID NO: 581218 - DNA, 25 bp, Rattus norvegicus
tcatgtgaaagatactcttcagagt

SEQ ID NO: 581219 - DNA, 25 bp, Rattus norvegicus
tcatgtgaccctcgtgtggaagcga

SEQ ID NO: 581220 - DNA, 25 bp, Rattus norvegicus
tcatgtgaccctggtgtggaagcga

SEQ ID NO: 581221 - DNA, 25 bp, Rattus norvegicus
tcatgtgatctccttagaccatcgt

SEQ ID NO: 581222 - DNA, 25 bp, Rattus norvegicus
tcatgtgatctcgttagaccatcgt

SEQ ID NO: 581223 - DNA, 25 bp, Rattus norvegicus
tcatgtgatcttccctctgctgtgt

SEQ ID NO: 581224 - DNA, 25 bp, Rattus norvegicus
tcatgtgatcttgcctctgctgtgt

SEQ ID NO: 581225 - DNA, 25 bp, Rattus norvegicus
tcatgtgatgcaaatactccgtgtc

SEQ ID NO: 581226 - DNA, 25 bp, Rattus norvegicus
tcatgtgatgcatatactccgtgtc

SEQ ID NO: 581227 - DNA, 25 bp, Rattus norvegicus
tcatgtgcaattccgtgatcgatcc

SEQ ID NO: 581228 - DNA, 25 bp, Rattus norvegicus
tcatgtgcaattgcgtgatcgatcc

SEQ ID NO: 581229 - DNA, 25 bp, Rattus norvegicus
tcatgtgcactgcactccgtagcta

SEQ ID NO: 581230 - DNA, 25 bp, Rattus norvegicus
tcatgtgcactggactccgtagcta

SEQ ID NO: 581231 - DNA, 25 bp, Rattus norvegicus
tcatgtgcagccaactttcaaatat

SEQ ID NO: 581232 - DNA, 25 bp, Rattus norvegicus
tcatgtgcagcctactttcaaatat

SEQ ID NO: 581233 - DNA, 25 bp, Rattus norvegicus
tcatgtgcaggtactagattttaat

SEQ ID NO: 581234 - DNA, 25 bp, Rattus norvegicus
tcatgtgcaggttctagattttaat

SEQ ID NO: 581235 - DNA, 25 bp, Rattus norvegicus
tcatgtgcatacatatccacacacc

SEQ ID NO: 581236 - DNA, 25 bp, Rattus norvegicus
tcatgtgcatacttatccacacacc

SEQ ID NO: 581237 - DNA, 25 bp, Rattus norvegicus
tcatgtgccatgagtaggctgtcgt

SEQ ID NO: 581238 - DNA, 25 bp, Rattus norvegicus
tcatgtgccatgtgtaggctgtcgt

SEQ ID NO: 581239 - DNA, 25 bp, Rattus norvegicus
tcatgtgcccatatctagtttccta

SEQ ID NO: 581240 - DNA, 25 bp, Rattus norvegicus
tcatgtgcccatttctagtttccta

SEQ ID NO: 581241 - DNA, 25 bp, Rattus norvegicus
tcatgtgctactctcaaggtgcttt

SEQ ID NO: 581242 - DNA, 25 bp, Rattus norvegicus
tcatgtgctactgtcaaggtgcttt

SEQ ID NO: 581243 - DNA, 25 bp, Rattus norvegicus
tcatgtgctattctggtaactcctc

SEQ ID NO: 581244 - DNA, 25 bp, Rattus norvegicus
tcatgtgctattgtggtaactcctc

SEQ ID NO: 581245 - DNA, 25 bp, Rattus norvegicus
tcatgtggacttacctcgagcagta

SEQ ID NO: 581246 - DNA, 25 bp, Rattus norvegicus
tcatgtggactttcctcgagcagta

SEQ ID NO: 581247 - DNA, 25 bp, Rattus norvegicus
tcatgtgtacttaaacagccctcct

SEQ ID NO: 581248 - DNA, 25 bp, Rattus norvegicus
tcatgtgtactttaacagccctcct

SEQ ID NO: 581249 - DNA, 25 bp, Rattus norvegicus
tcatgtgtcatcaggtttttgggtt

SEQ ID NO: 581250 - DNA, 25 bp, Rattus norvegicus
tcatgtgtcatctggtttttgggtt

SEQ ID NO: 581251 - DNA, 25 bp, Rattus norvegicus
tcatgtgtcctgcttcttacatctt

SEQ ID NO: 581252 - DNA, 25 bp, Rattus norvegicus
tcatgtgtcctggttcttacatctt

SEQ ID NO: 581253 - DNA, 25 bp, Rattus norvegicus
tcatgtgtccttacgaatgctttct

SEQ ID NO: 581254 - DNA, 25 bp, Rattus norvegicus
tcatgtgtcctttcgaatgctttct

SEQ ID NO: 581255 - DNA, 25 bp, Rattus norvegicus
tcatgtgtgccaatgcccttctggt

SEQ ID NO: 581256 - DNA, 25 bp, Rattus norvegicus
tcatgtgtgccattgcccttctggt

SEQ ID NO: 581257 - DNA, 25 bp, Rattus norvegicus
tcatgtgtgtcaacctgtgtcaatc

SEQ ID NO: 581258 - DNA, 25 bp, Rattus norvegicus
tcatgtgtgtcatcctgtgtcaatc

SEQ ID NO: 581259 - DNA, 25 bp, Rattus norvegicus
tcatgtgtgtgaatgcctttgttaa

SEQ ID NO: 581260 - DNA, 25 bp, Rattus norvegicus
tcatgtgtgtgattgcctttgttaa

SEQ ID NO: 581261 - DNA, 25 bp, Rattus norvegicus
tcatgtgttcttcatgtccttgtct

SEQ ID NO: 581262 - DNA, 25 bp, Rattus norvegicus
tcatgtgttcttgatgtccttgtct

SEQ ID NO: 581263 - DNA, 25 bp, Rattus norvegicus
tcatgtgttgacaggccaggtctct

SEQ ID NO: 581264 - DNA, 25 bp, Rattus norvegicus
tcatgtgttgactggccaggtctct

SEQ ID NO: 581265 - DNA, 25 bp, Rattus norvegicus
tcatgtgttgtgatgcttgtgaccc

SEQ ID NO: 581266 - DNA, 25 bp, Rattus norvegicus
tcatgtgttgtgttgcttgtgaccc

SEQ ID NO: 581267 - DNA, 25 bp, Rattus norvegicus
tcatgtgttttcagaggctttgtat

SEQ ID NO: 581268 - DNA, 25 bp, Rattus norvegicus
tcatgtgttttctgaggctttgtat

SEQ ID NO: 581269 - DNA, 25 bp, Rattus norvegicus
tcatgttaggtcactgttctcatcc

SEQ ID NO: 581270 - DNA, 25 bp, Rattus norvegicus
tcatgttaggtctctgttctcatcc

SEQ ID NO: 581271 - DNA, 25 bp, Rattus norvegicus
tcatgttatgttcctccaaacttcc

SEQ ID NO: 581272 - DNA, 25 bp, Rattus norvegicus
tcatgttatgttgctccaaacttcc

SEQ ID NO: 581273 - DNA, 25 bp, Rattus norvegicus
tcatgttatttgatacgtcttctaa

SEQ ID NO: 581274 - DNA, 25 bp, Rattus norvegicus
tcatgttatttgttacgtcttctaa

SEQ ID NO: 581275 - DNA, 25 bp, Rattus norvegicus
tcatgttcacgtacagagagcggga

SEQ ID NO: 581276 - DNA, 25 bp, Rattus norvegicus
tcatgttcacgttcagagagcggga

SEQ ID NO: 581277 - DNA, 25 bp, Rattus norvegicus
tcatgttccggtccagtgccaactg

SEQ ID NO: 581278 - DNA, 25 bp, Rattus norvegicus
tcatgttccggtgcagtgccaactg

SEQ ID NO: 581279 - DNA, 25 bp, Rattus norvegicus
tcatgttcctctcaatgtgtctcaa

SEQ ID NO: 581280 - DNA, 25 bp, Rattus norvegicus
tcatgttcctctgaatgtgtctcaa

SEQ ID NO: 581281 - DNA, 25 bp, Rattus norvegicus
tcatgttctacaaatgggctttgtt

SEQ ID NO: 581282 - DNA, 25 bp, Rattus norvegicus
tcatgttctacatatgggctttgtt

SEQ ID NO: 581283 - DNA, 25 bp, Rattus norvegicus
tcatgttctaccacctggcaaagat

SEQ ID NO: 581284 - DNA, 25 bp, Rattus norvegicus
tcatgttctacctcctggcaaagat

SEQ ID NO: 581285 - DNA, 25 bp, Rattus norvegicus
tcatgttctccaccctttataggat

SEQ ID NO: 581286 - DNA, 25 bp, Rattus norvegicus
tcatgttctccagcctttataggat

SEQ ID NO: 581287 - DNA, 25 bp, Rattus norvegicus
tcatgttctggcattatatcaactt

SEQ ID NO: 581288 - DNA, 25 bp, Rattus norvegicus
tcatgttctggctttatatcaactt

SEQ ID NO: 581289 - DNA, 25 bp, Rattus norvegicus
tcatgttgatgtcaggtgattgcct

SEQ ID NO: 581290 - DNA, 25 bp, Rattus norvegicus
tcatgttgatgtgaggtgattgcct

SEQ ID NO: 581291 - DNA, 25 bp, Rattus norvegicus
tcatgttgcgtgatatggtccacct

SEQ ID NO: 581292 - DNA, 25 bp, Rattus norvegicus
tcatgttgcgtgttatggtccacct

SEQ ID NO: 581293 - DNA, 25 bp, Rattus norvegicus
tcatgttgctgccagtggctagttt

SEQ ID NO: 581294 - DNA, 25 bp, Rattus norvegicus
tcatgttgctgcgagtggctagttt

SEQ ID NO: 581295 - DNA, 25 bp, Rattus norvegicus
tcatgttgggacagggttggcttca

SEQ ID NO: 581296 - DNA, 25 bp, Rattus norvegicus
tcatgttgggactgggttggcttca

SEQ ID NO: 581297 - DNA, 25 bp, Rattus norvegicus
tcatgttgtattaaagacttagcta

SEQ ID NO: 581298 - DNA, 25 bp, Rattus norvegicus
tcatgttgtatttaagacttagcta

SEQ ID NO: 581299 - DNA, 25 bp, Rattus norvegicus
tcatgttgtgctctatcctgtgctt

SEQ ID NO: 581300 - DNA, 25 bp, Rattus norvegicus
tcatgttgtgctgtatcctgtgctt

SEQ ID NO: 581301 - DNA, 25 bp, Rattus norvegicus
tcatgttgtttgacgtttcctgcca

SEQ ID NO: 581302 - DNA, 25 bp, Rattus norvegicus
tcatgttgtttgtcgtttcctgcca

SEQ ID NO: 581303 - DNA, 25 bp, Rattus norvegicus
tcatgtttccatcgtttgctgccag

SEQ ID NO: 581304 - DNA, 25 bp, Rattus norvegicus
tcatgtttccatggtttgctgccag

SEQ ID NO: 581305 - DNA, 25 bp, Rattus norvegicus
tcatgtttctctcagtggcccgaag

SEQ ID NO: 581306 - DNA, 25 bp, Rattus norvegicus
tcatgtttctctgagtggcccgaag

SEQ ID NO: 581307 - DNA, 25 bp, Rattus norvegicus
tcatgtttgcctcctggagtccctt

SEQ ID NO: 581308 - DNA, 25 bp, Rattus norvegicus
tcatgtttgcctgctggagtccctt

SEQ ID NO: 581309 - DNA, 25 bp, Rattus norvegicus
tcatgtttgctgagtatctgcttca

SEQ ID NO: 581310 - DNA, 25 bp, Rattus norvegicus
tcatgtttgctgtgtatctgcttca

SEQ ID NO: 581311 - DNA, 25 bp, Rattus norvegicus
tcatgtttgggccagcttaggacct

SEQ ID NO: 581312 - DNA, 25 bp, Rattus norvegicus
tcatgtttgggcgagcttaggacct

SEQ ID NO: 581313 - DNA, 25 bp, Rattus norvegicus
tcatgtttgtcacagtgtgtgtaag

SEQ ID NO: 581314 - DNA, 25 bp, Rattus norvegicus
tcatgtttgtcagagtgtgtgtaag

SEQ ID NO: 581315 - DNA, 25 bp, Rattus norvegicus
tcatgttttcagcttcccgggagca

SEQ ID NO: 581316 - DNA, 25 bp, Rattus norvegicus
tcatgttttcaggttcccgggagca

SEQ ID NO: 581317 - DNA, 25 bp, Rattus norvegicus
tcattaaagtttaacctgtccctgg

SEQ ID NO: 581318 - DNA, 25 bp, Rattus norvegicus
tcattaaagttttacctgtccctgg

SEQ ID NO: 581319 - DNA, 25 bp, Rattus norvegicus
tcattaaatgttactgccagtccca

SEQ ID NO: 581320 - DNA, 25 bp, Rattus norvegicus
tcattaaatgtttctgccagtccca

SEQ ID NO: 581321 - DNA, 25 bp, Rattus norvegicus
tcattaacgttgaggctttctggaa

SEQ ID NO: 581322 - DNA, 25 bp, Rattus norvegicus
tcattaacgttgtggctttctggaa

SEQ ID NO: 581323 - DNA, 25 bp, Rattus norvegicus
tcattaactatgacctgcccaacaa

SEQ ID NO: 581324 - DNA, 25 bp, Rattus norvegicus
tcattaactatgtcctgcccaacaa

SEQ ID NO: 581325 - DNA, 25 bp, Rattus norvegicus
tcattaactgcaacctggccatgga

SEQ ID NO: 581326 - DNA, 25 bp, Rattus norvegicus
tcattaactgcatcctggccatgga

SEQ ID NO: 581327 - DNA, 25 bp, Rattus norvegicus
tcattaaggaagctggcccacaatt

SEQ ID NO: 581328 - DNA, 25 bp, Rattus norvegicus
tcattaaggaaggtggcccacaatt

SEQ ID NO: 581329 - DNA, 25 bp, Rattus norvegicus
tcattaataccaccgatccctaaat

SEQ ID NO: 581330 - DNA, 25 bp, Rattus norvegicus
tcattaataccagcgatccctaaat

SEQ ID NO: 581331 - DNA, 25 bp, Rattus norvegicus
tcattaattcgaacccatgttcaag

SEQ ID NO: 581332 - DNA, 25 bp, Rattus norvegicus
tcattaattcgatcccatgttcaag

SEQ ID NO: 581333 - DNA, 25 bp, Rattus norvegicus
tcattacaacgccagtttgaggatt

SEQ ID NO: 581334 - DNA, 25 bp, Rattus norvegicus
tcattacaacgcgagtttgaggatt

SEQ ID NO: 581335 - DNA, 25 bp, Rattus norvegicus
tcattacactacatgcagagagctc

SEQ ID NO: 581336 - DNA, 25 bp, Rattus norvegicus
tcattacactacttgcagagagctc

SEQ ID NO: 581337 - DNA, 25 bp, Rattus norvegicus
tcattacatgagcatcatgagcccc

SEQ ID NO: 581338 - DNA, 25 bp, Rattus norvegicus
tcattacatgaggatcatgagcccc

SEQ ID NO: 581339 - DNA, 25 bp, Rattus norvegicus
tcattaccgccgcatacgtgaaaat

SEQ ID NO: 581340 - DNA, 25 bp, Rattus norvegicus
tcattaccgccggatacgtgaaaat

SEQ ID NO: 581341 - DNA, 25 bp, Rattus norvegicus
tcattacgacgccatttgttctttg

SEQ ID NO: 581342 - DNA, 25 bp, Rattus norvegicus
tcattacgacgcgatttgttctttg

SEQ ID NO: 581343 - DNA, 25 bp, Rattus norvegicus
tcattactccatcttgcagatctgc

SEQ ID NO: 581344 - DNA, 25 bp, Rattus norvegicus
tcattactccatgttgcagatctgc

SEQ ID NO: 581345 - DNA, 25 bp, Rattus norvegicus
tcattacttcctctcgctgagttca

SEQ ID NO: 581346 - DNA, 25 bp, Rattus norvegicus
tcattacttcctgtcgctgagttca

SEQ ID NO: 581347 - DNA, 25 bp, Rattus norvegicus
tcattacttgacaagcagaccggcc

SEQ ID NO: 581348 - DNA, 25 bp, Rattus norvegicus
tcattacttgactagcagaccggcc

SEQ ID NO: 581349 - DNA, 25 bp, Rattus norvegicus
tcattacttttacagtgtcaggctc

SEQ ID NO: 581350 - DNA, 25 bp, Rattus norvegicus
tcattacttttagagtgtcaggctc

SEQ ID NO: 581351 - DNA, 25 bp, Rattus norvegicus
tcattacttttcagtgctgggagca

SEQ ID NO: 581352 - DNA, 25 bp, Rattus norvegicus
tcattacttttctgtgctgggagca

SEQ ID NO: 581353 - DNA, 25 bp, Rattus norvegicus
tcattagccttgactgcactttcag

SEQ ID NO: 581354 - DNA, 25 bp, Rattus norvegicus
tcattagccttgtctgcactttcag

SEQ ID NO: 581355 - DNA, 25 bp, Rattus norvegicus
tcattagctgctactgttcctctgt

SEQ ID NO: 581356 - DNA, 25 bp, Rattus norvegicus
tcattagctgcttctgttcctctgt

SEQ ID NO: 581357 - DNA, 25 bp, Rattus norvegicus
tcattaggattcaggctgctgtttc

SEQ ID NO: 581358 - DNA, 25 bp, Rattus norvegicus
tcattaggattctggctgctgtttc

SEQ ID NO: 581359 - DNA, 25 bp, Rattus norvegicus
tcattaggattgacgctgccagaac

SEQ ID NO: 581360 - DNA, 25 bp, Rattus norvegicus
tcattaggattgtcgctgccagaac

SEQ ID NO: 581361 - DNA, 25 bp, Rattus norvegicus
tcattaggccacatggcttcaaagt

SEQ ID NO: 581362 - DNA, 25 bp, Rattus norvegicus
tcattaggccacttggcttcaaagt

SEQ ID NO: 581363 - DNA, 25 bp, Rattus norvegicus
tcattaggtgacacggactccaggg

SEQ ID NO: 581364 - DNA, 25 bp, Rattus norvegicus
tcattaggtgactcggactccaggg

SEQ ID NO: 581365 - DNA, 25 bp, Rattus norvegicus
tcattagtccccaactggaagtttt

SEQ ID NO: 581366 - DNA, 25 bp, Rattus norvegicus
tcattagtcccctactggaagtttt

SEQ ID NO: 581367 - DNA, 25 bp, Rattus norvegicus
tcattagtccttccaaacatcgtgc

SEQ ID NO: 581368 - DNA, 25 bp, Rattus norvegicus
tcattagtccttgcaaacatcgtgc

SEQ ID NO: 581369 - DNA, 25 bp, Rattus norvegicus
tcattagtcggcattgtgctccatt

SEQ ID NO: 581370 - DNA, 25 bp, Rattus norvegicus
tcattagtcggctttgtgctccatt

SEQ ID NO: 581371 - DNA, 25 bp, Rattus norvegicus
tcattagtgatgctcaaggccaggg

SEQ ID NO: 581372 - DNA, 25 bp, Rattus norvegicus
tcattagtgatggtcaaggccaggg

SEQ ID NO: 581373 - DNA, 25 bp, Rattus norvegicus
tcattagttgagcagaagccagact

SEQ ID NO: 581374 - DNA, 25 bp, Rattus norvegicus
tcattagttgaggagaagccagact

SEQ ID NO: 581375 - DNA, 25 bp, Rattus norvegicus
tcattatcatgcatacttcctgggc

SEQ ID NO: 581376 - DNA, 25 bp, Rattus norvegicus
tcattatcatgcttacttcctgggc

SEQ ID NO: 581377 - DNA, 25 bp, Rattus norvegicus
tcattatccccgatctaagtgtggg

SEQ ID NO: 581378 - DNA, 25 bp, Rattus norvegicus
tcattatccccgttctaagtgtggg

SEQ ID NO: 581379 - DNA, 25 bp, Rattus norvegicus
tcattatccgtcctcagagctttct

SEQ ID NO: 581380 - DNA, 25 bp, Rattus norvegicus
tcattatccgtcgtcagagctttct

SEQ ID NO: 581381 - DNA, 25 bp, Rattus norvegicus
tcattatcctctattgttcctacct

SEQ ID NO: 581382 - DNA, 25 bp, Rattus norvegicus
tcattatcctcttttgttcctacct

SEQ ID NO: 581383 - DNA, 25 bp, Rattus norvegicus
tcattatctcctcggtcactaaggg

SEQ ID NO: 581384 - DNA, 25 bp, Rattus norvegicus
tcattatctcctgggtcactaaggg

SEQ ID NO: 581385 - DNA, 25 bp, Rattus norvegicus
tcattatctctcatactatcttgcc

SEQ ID NO: 581386 - DNA, 25 bp, Rattus norvegicus
tcattatctctcttactatcttgcc

SEQ ID NO: 581387 - DNA, 25 bp, Rattus norvegicus
tcattatgtattatgccggcgttta

SEQ ID NO: 581388 - DNA, 25 bp, Rattus norvegicus
tcattatgtattttgccggcgttta

SEQ ID NO: 581389 - DNA, 25 bp, Rattus norvegicus
tcattattacgacttttacattttt

SEQ ID NO: 581390 - DNA, 25 bp, Rattus norvegicus
tcattattacgagttttacattttt

SEQ ID NO: 581391 - DNA, 25 bp, Rattus norvegicus
tcattattccagaccttgcttggga

SEQ ID NO: 581392 - DNA, 25 bp, Rattus norvegicus
tcattattccagtccttgcttggga

SEQ ID NO: 581393 - DNA, 25 bp, Rattus norvegicus
tcattattgcttccctttgcacttc

SEQ ID NO: 581394 - DNA, 25 bp, Rattus norvegicus
tcattattgcttgcctttgcacttc

SEQ ID NO: 581395 - DNA, 25 bp, Rattus norvegicus
tcattcaataccaggcctagtgggc

SEQ ID NO: 581396 - DNA, 25 bp, Rattus norvegicus
tcattcaatacctggcctagtgggc

SEQ ID NO: 581397 - DNA, 25 bp, Rattus norvegicus
tcattcacaaacaccttccagtaga

SEQ ID NO: 581398 - DNA, 25 bp, Rattus norvegicus
tcattcacaaactccttccagtaga

SEQ ID NO: 581399 - DNA, 25 bp, Rattus norvegicus
tcattcacaatgacccttaacctgt

SEQ ID NO: 581400 - DNA, 25 bp, Rattus norvegicus
tcattcacaatgtcccttaacctgt

SEQ ID NO: 581401 - DNA, 25 bp, Rattus norvegicus
tcattcacacacctcttcattgtga

SEQ ID NO: 581402 - DNA, 25 bp, Rattus norvegicus
tcattcacacacgtcttcattgtga

SEQ ID NO: 581403 - DNA, 25 bp, Rattus norvegicus
tcattcactcatactgcaagcattc

SEQ ID NO: 581404 - DNA, 25 bp, Rattus norvegicus
tcattcactcattctgcaagcattc

SEQ ID NO: 581405 - DNA, 25 bp, Rattus norvegicus
tcattcacttttagcctttggttac

SEQ ID NO: 581406 - DNA, 25 bp, Rattus norvegicus
tcattcactttttgcctttggttac

SEQ ID NO: 581407 - DNA, 25 bp, Rattus norvegicus
tcattcagaaacacagggcacccga

SEQ ID NO: 581408 - DNA, 25 bp, Rattus norvegicus
tcattcagaaactcagggcacccga

SEQ ID NO: 581409 - DNA, 25 bp, Rattus norvegicus
tcattcagaaatctgcgcagtgcca

SEQ ID NO: 581410 - DNA, 25 bp, Rattus norvegicus
tcattcagaaatgtgcgcagtgcca

SEQ ID NO: 581411 - DNA, 25 bp, Rattus norvegicus
tcattcagcatactggcctctgtgc

SEQ ID NO: 581412 - DNA, 25 bp, Rattus norvegicus
tcattcagcatagtggcctctgtgc

SEQ ID NO: 581413 - DNA, 25 bp, Rattus norvegicus
tcattcagcgtcaccttccaactat

SEQ ID NO: 581414 - DNA, 25 bp, Rattus norvegicus
tcattcagcgtctccttccaactat

SEQ ID NO: 581415 - DNA, 25 bp, Rattus norvegicus
tcattcagctagctcagcacggaca

SEQ ID NO: 581416 - DNA, 25 bp, Rattus norvegicus
tcattcagctaggtcagcacggaca

SEQ ID NO: 581417 - DNA, 25 bp, Rattus norvegicus
tcattcaggagtcggaggcacagct

SEQ ID NO: 581418 - DNA, 25 bp, Rattus norvegicus
tcattcaggagtgggaggcacagct

SEQ ID NO: 581419 - DNA, 25 bp, Rattus norvegicus
tcattcaggcctcccgaggtacaga

SEQ ID NO: 581420 - DNA, 25 bp, Rattus norvegicus
tcattcaggcctgccgaggtacaga

SEQ ID NO: 581421 - DNA, 25 bp, Rattus norvegicus
tcattcagtcatatggttcccagtt

SEQ ID NO: 581422 - DNA, 25 bp, Rattus norvegicus
tcattcagtcatttggttcccagtt

SEQ ID NO: 581423 - DNA, 25 bp, Rattus norvegicus
tcattcagtggcactggcttaccta

SEQ ID NO: 581424 - DNA, 25 bp, Rattus norvegicus
tcattcagtggctctggcttaccta

SEQ ID NO: 581425 - DNA, 25 bp, Rattus norvegicus
tcattcatcattacagccaaagccc

SEQ ID NO: 581426 - DNA, 25 bp, Rattus norvegicus
tcattcatcatttcagccaaagccc

SEQ ID NO: 581427 - DNA, 25 bp, Rattus norvegicus
tcattcatccctatcttgagagctt

SEQ ID NO: 581428 - DNA, 25 bp, Rattus norvegicus
tcattcatccctttcttgagagctt

SEQ ID NO: 581429 - DNA, 25 bp, Rattus norvegicus
tcattcatgcggacagagggtaagt

SEQ ID NO: 581430 - DNA, 25 bp, Rattus norvegicus
tcattcatgcggtcagagggtaagt

SEQ ID NO: 581431 - DNA, 25 bp, Rattus norvegicus
tcattcattcagaggcctttctttc

SEQ ID NO: 581432 - DNA, 25 bp, Rattus norvegicus
tcattcattcagtggcctttctttc

SEQ ID NO: 581433 - DNA, 25 bp, Rattus norvegicus
tcattcatttgacagcggcatcgct

SEQ ID NO: 581434 - DNA, 25 bp, Rattus norvegicus
tcattcatttgagagcggcatcgct

SEQ ID NO: 581435 - DNA, 25 bp, Rattus norvegicus
tcattccaaaccaacgtttggttat

SEQ ID NO: 581436 - DNA, 25 bp, Rattus norvegicus
tcattccaaacctacgtttggttat

SEQ ID NO: 581437 - DNA, 25 bp, Rattus norvegicus
tcattccacatcagcttgctttaga

SEQ ID NO: 581438 - DNA, 25 bp, Rattus norvegicus
tcattccacatctgcttgctttaga

SEQ ID NO: 581439 - DNA, 25 bp, Rattus norvegicus
tcattccagacgcttactcaacaaa

SEQ ID NO: 581440 - DNA, 25 bp, Rattus norvegicus
tcattccagacggttactcaacaaa

SEQ ID NO: 581441 - DNA, 25 bp, Rattus norvegicus
tcattccagcccctaatttatagcc

SEQ ID NO: 581442 - DNA, 25 bp, Rattus norvegicus
tcattccagcccgtaatttatagcc

SEQ ID NO: 581443 - DNA, 25 bp, Rattus norvegicus
tcattccagtccaccggtggctgag

SEQ ID NO: 581444 - DNA, 25 bp, Rattus norvegicus
tcattccagtcctccggtggctgag

SEQ ID NO: 581445 - DNA, 25 bp, Rattus norvegicus
tcattcccactgcttatgggtctat

SEQ ID NO: 581446 - DNA, 25 bp, Rattus norvegicus
tcattcccactggttatgggtctat

SEQ ID NO: 581447 - DNA, 25 bp, Rattus norvegicus
tcattcccacttcaaccttaggttt

SEQ ID NO: 581448 - DNA, 25 bp, Rattus norvegicus
tcattcccacttgaaccttaggttt

SEQ ID NO: 581449 - DNA, 25 bp, Rattus norvegicus
tcattcccagaaaggcacagccttc

SEQ ID NO: 581450 - DNA, 25 bp, Rattus norvegicus
tcattcccagaatggcacagccttc

SEQ ID NO: 581451 - DNA, 25 bp, Rattus norvegicus
tcattcccataaactaagcgcctgg

SEQ ID NO: 581452 - DNA, 25 bp, Rattus norvegicus
tcattcccataatctaagcgcctgg

SEQ ID NO: 581453 - DNA, 25 bp, Rattus norvegicus
tcattcccatgtacacactgaggca

SEQ ID NO: 581454 - DNA, 25 bp, Rattus norvegicus
tcattcccatgttcacactgaggca

SEQ ID NO: 581455 - DNA, 25 bp, Rattus norvegicus
tcattccccactactatagagattg

SEQ ID NO: 581456 - DNA, 25 bp, Rattus norvegicus
tcattccccactactgtagaaacat

SEQ ID NO: 581457 - DNA, 25 bp, Rattus norvegicus
tcattccccacttctatagagattg

SEQ ID NO: 581458 - DNA, 25 bp, Rattus norvegicus
tcattccccacttctgtagaaacat

SEQ ID NO: 581459 - DNA, 25 bp, Rattus norvegicus
tcattccccttgctttgacttagaa

SEQ ID NO: 581460 - DNA, 25 bp, Rattus norvegicus
tcattccccttggtttgacttagaa

SEQ ID NO: 581461 - DNA, 25 bp, Rattus norvegicus
tcattccctaccattctattttgtg

SEQ ID NO: 581462 - DNA, 25 bp, Rattus norvegicus
tcattccctacctttctattttgtg

SEQ ID NO: 581463 - DNA, 25 bp, Rattus norvegicus
tcattcctacctccacattggaaat

SEQ ID NO: 581464 - DNA, 25 bp, Rattus norvegicus
tcattcctacctgcacattggaaat

SEQ ID NO: 581465 - DNA, 25 bp, Rattus norvegicus
tcattcctcatcagtgtgacgtcat

SEQ ID NO: 581466 - DNA, 25 bp, Rattus norvegicus
tcattcctcatctgtgtgacgtcat

SEQ ID NO: 581467 - DNA, 25 bp, Rattus norvegicus
tcattcctcgcacgatggctgacca

SEQ ID NO: 581468 - DNA, 25 bp, Rattus norvegicus
tcattcctcgcaggatggctgacca

SEQ ID NO: 581469 - DNA, 25 bp, Rattus norvegicus
tcattcctgcatcactaggaggctg

SEQ ID NO: 581470 - DNA, 25 bp, Rattus norvegicus
tcattcctgcatgactaggaggctg

SEQ ID NO: 581471 - DNA, 25 bp, Rattus norvegicus
tcattcctgccgagagttccctgta

SEQ ID NO: 581472 - DNA, 25 bp, Rattus norvegicus
tcattcctgccgtgagttccctgta

SEQ ID NO: 581473 - DNA, 25 bp, Rattus norvegicus
tcattcctggttcatctctatgcat

SEQ ID NO: 581474 - DNA, 25 bp, Rattus norvegicus
tcattcctggttgatctctatgcat

SEQ ID NO: 581475 - DNA, 25 bp, Rattus norvegicus
tcattcctgttgctcttttgggctt

SEQ ID NO: 581476 - DNA, 25 bp, Rattus norvegicus
tcattcctgttggtcttttgggctt

SEQ ID NO: 581477 - DNA, 25 bp, Rattus norvegicus
tcattccttaatcaccagcctttga

SEQ ID NO: 581478 - DNA, 25 bp, Rattus norvegicus
tcattccttaatgaccagcctttga

SEQ ID NO: 581479 - DNA, 25 bp, Rattus norvegicus
tcattccttaggaagggcccactaa

SEQ ID NO: 581480 - DNA, 25 bp, Rattus norvegicus
tcattccttaggtagggcccactaa

SEQ ID NO: 581481 - DNA, 25 bp, Rattus norvegicus
tcattccttcagaattcttgctata

SEQ ID NO: 581482 - DNA, 25 bp, Rattus norvegicus
tcattccttcagtattcttgctata

SEQ ID NO: 581483 - DNA, 25 bp, Rattus norvegicus
tcattccttgtcctcataatccaga

SEQ ID NO: 581484 - DNA, 25 bp, Rattus norvegicus
tcattccttgtcgtcataatccaga

SEQ ID NO: 581485 - DNA, 25 bp, Rattus norvegicus
tcattcctttgcatccctaagttta

SEQ ID NO: 581486 - DNA, 25 bp, Rattus norvegicus
tcattcctttgcttccctaagttta

SEQ ID NO: 581487 - DNA, 25 bp, Rattus norvegicus
tcattcgaggagacctcagagccct

SEQ ID NO: 581488 - DNA, 25 bp, Rattus norvegicus
tcattcgaggagtcctcagagccct

SEQ ID NO: 581489 - DNA, 25 bp, Rattus norvegicus
tcattcgctcacatctggccaagtg

SEQ ID NO: 581490 - DNA, 25 bp, Rattus norvegicus
tcattcgctcacttctggccaagtg

SEQ ID NO: 581491 - DNA, 25 bp, Rattus norvegicus
tcattcgcttcgcacacgactggga

SEQ ID NO: 581492 - DNA, 25 bp, Rattus norvegicus
tcattcgcttcggacacgactggga

SEQ ID NO: 581493 - DNA, 25 bp, Rattus norvegicus
tcattcggagctctgggctcaggaa

SEQ ID NO: 581494 - DNA, 25 bp, Rattus norvegicus
tcattcggagctgtgggctcaggaa

SEQ ID NO: 581495 - DNA, 25 bp, Rattus norvegicus
tcattcgtagagcacggagatgcga

SEQ ID NO: 581496 - DNA, 25 bp, Rattus norvegicus
tcattcgtagaggacggagatgcga

SEQ ID NO: 581497 - DNA, 25 bp, Rattus norvegicus
tcattcgtgcttactgttgcgagaa

SEQ ID NO: 581498 - DNA, 25 bp, Rattus norvegicus
tcattcgtgctttctgttgcgagaa

SEQ ID NO: 581499 - DNA, 25 bp, Rattus norvegicus
tcattcgtttgtactttcttcaggc

SEQ ID NO: 581500 - DNA, 25 bp, Rattus norvegicus
tcattcgtttgttctttcttcaggc

SEQ ID NO: 581501 - DNA, 25 bp, Rattus norvegicus
tcattctagaccagctgcccgtgga

SEQ ID NO: 581502 - DNA, 25 bp, Rattus norvegicus
tcattctagacctgctgcccgtgga

SEQ ID NO: 581503 - DNA, 25 bp, Rattus norvegicus
tcattctcagccagggtttagtctt

SEQ ID NO: 581504 - DNA, 25 bp, Rattus norvegicus
tcattctcagcctgggtttagtctt

SEQ ID NO: 581505 - DNA, 25 bp, Rattus norvegicus
tcattctccaacagcctactgaagg

SEQ ID NO: 581506 - DNA, 25 bp, Rattus norvegicus
tcattctccaactgcctactgaagg

SEQ ID NO: 581507 - DNA, 25 bp, Rattus norvegicus
tcattctccaagaccatggtcttag

SEQ ID NO: 581508 - DNA, 25 bp, Rattus norvegicus
tcattctccaagtccatggtcttag

SEQ ID NO: 581509 - DNA, 25 bp, Rattus norvegicus
tcattctccttgatccatcttgtat

SEQ ID NO: 581510 - DNA, 25 bp, Rattus norvegicus
tcattctccttgttccatcttgtat

SEQ ID NO: 581511 - DNA, 25 bp, Rattus norvegicus
tcattctcgattctcgctggtggca

SEQ ID NO: 581512 - DNA, 25 bp, Rattus norvegicus
tcattctcgattgtcgctggtggca

SEQ ID NO: 581513 - DNA, 25 bp, Rattus norvegicus
tcattctctgagattcctccaggca

SEQ ID NO: 581514 - DNA, 25 bp, Rattus norvegicus
tcattctctgagtttcctccaggca

SEQ ID NO: 581515 - DNA, 25 bp, Rattus norvegicus
tcattctctggcatgatctgcacag

SEQ ID NO: 581516 - DNA, 25 bp, Rattus norvegicus
tcattctctggcttgatctgcacag

SEQ ID NO: 581517 - DNA, 25 bp, Rattus norvegicus
tcattctctggtctgaaattaacag

SEQ ID NO: 581518 - DNA, 25 bp, Rattus norvegicus
tcattctctggtgtgaaattaacag

SEQ ID NO: 581519 - DNA, 25 bp, Rattus norvegicus
tcattctctgtaccccacagtagaa

SEQ ID NO: 581520 - DNA, 25 bp, Rattus norvegicus
tcattctctgtagcccacagtagaa

SEQ ID NO: 581521 - DNA, 25 bp, Rattus norvegicus
tcattctcttctacagtgcctggta

SEQ ID NO: 581522 - DNA, 25 bp, Rattus norvegicus
tcattctcttcttcagtgcctggta

SEQ ID NO: 581523 - DNA, 25 bp, Rattus norvegicus
tcattctgactcctggtccttctgc

SEQ ID NO: 581524 - DNA, 25 bp, Rattus norvegicus
tcattctgactcgtggtccttctgc

SEQ ID NO: 581525 - DNA, 25 bp, Rattus norvegicus
tcattctgagccactccatggaggg

SEQ ID NO: 581526 - DNA, 25 bp, Rattus norvegicus
tcattctgagcctctccatggaggg

SEQ ID NO: 581527 - DNA, 25 bp, Rattus norvegicus
tcattctgcatgatctgtacatagt

SEQ ID NO: 581528 - DNA, 25 bp, Rattus norvegicus
tcattctgcatgttctgtacatagt

SEQ ID NO: 581529 - DNA, 25 bp, Rattus norvegicus
tcattctgccacattcgtccacaaa

SEQ ID NO: 581530 - DNA, 25 bp, Rattus norvegicus
tcattctgccactttcgtccacaaa

SEQ ID NO: 581531 - DNA, 25 bp, Rattus norvegicus
tcattctgcctcattatgtgctcca

SEQ ID NO: 581532 - DNA, 25 bp, Rattus norvegicus
tcattctgcctctttatgtgctcca

SEQ ID NO: 581533 - DNA, 25 bp, Rattus norvegicus
tcattctgctcaatttccttggaca

SEQ ID NO: 581534 - DNA, 25 bp, Rattus norvegicus
tcattctgctcattttccttggaca

SEQ ID NO: 581535 - DNA, 25 bp, Rattus norvegicus
tcattctgggtgactgtgctttgac

SEQ ID NO: 581536 - DNA, 25 bp, Rattus norvegicus
tcattctgggtgtctgtgctttgac

SEQ ID NO: 581537 - DNA, 25 bp, Rattus norvegicus
tcattctgtcttcactgggatttta

SEQ ID NO: 581538 - DNA, 25 bp, Rattus norvegicus
tcattctgtcttcagtgtggctctg

SEQ ID NO: 581539 - DNA, 25 bp, Rattus norvegicus
tcattctgtcttgactgggatttta

SEQ ID NO: 581540 - DNA, 25 bp, Rattus norvegicus
tcattctgtcttgagtgtggctctg

SEQ ID NO: 581541 - DNA, 25 bp, Rattus norvegicus
tcattcttaggaagtgtctttctac

SEQ ID NO: 581542 - DNA, 25 bp, Rattus norvegicus
tcattcttaggatgtgtctttctac

SEQ ID NO: 581543 - DNA, 25 bp, Rattus norvegicus
tcattcttatatatacagtcactgg

SEQ ID NO: 581544 - DNA, 25 bp, Rattus norvegicus
tcattcttatatttacagtcactgg

SEQ ID NO: 581545 - DNA, 25 bp, Rattus norvegicus
tcattcttcatcaagccgtggcagt

SEQ ID NO: 581546 - DNA, 25 bp, Rattus norvegicus
tcattcttcatctagccgtggcagt

SEQ ID NO: 581547 - DNA, 25 bp, Rattus norvegicus
tcattcttcgttcccttttagttct

SEQ ID NO: 581548 - DNA, 25 bp, Rattus norvegicus
tcattcttcgttgccttttagttct

SEQ ID NO: 581549 - DNA, 25 bp, Rattus norvegicus
tcattcttctgcatcttggtatctt

SEQ ID NO: 581550 - DNA, 25 bp, Rattus norvegicus
tcattcttctgcttcttggtatctt

SEQ ID NO: 581551 - DNA, 25 bp, Rattus norvegicus
tcattcttgattaggacctttgccc

SEQ ID NO: 581552 - DNA, 25 bp, Rattus norvegicus
tcattcttgatttggacctttgccc

SEQ ID NO: 581553 - DNA, 25 bp, Rattus norvegicus
tcattcttttggaggtgtcagtgtg

SEQ ID NO: 581554 - DNA, 25 bp, Rattus norvegicus
tcattcttttggtggtgtcagtgtg

SEQ ID NO: 581555 - DNA, 25 bp, Rattus norvegicus
tcattctttttcaccaggtttttct

SEQ ID NO: 581556 - DNA, 25 bp, Rattus norvegicus
tcattctttttctccaggtttttct

SEQ ID NO: 581557 - DNA, 25 bp, Rattus norvegicus
tcattctttttgctttagggatgtt

SEQ ID NO: 581558 - DNA, 25 bp, Rattus norvegicus
tcattctttttggtttagggatgtt

SEQ ID NO: 581559 - DNA, 25 bp, Rattus norvegicus
tcattgaaaatgactaacaaggccc

SEQ ID NO: 581560 - DNA, 25 bp, Rattus norvegicus
tcattgaaaatgtctaacaaggccc

SEQ ID NO: 581561 - DNA, 25 bp, Rattus norvegicus
tcattgacaaacacctttgccaatt

SEQ ID NO: 581562 - DNA, 25 bp, Rattus norvegicus
tcattgacaaactcctttgccaatt

SEQ ID NO: 581563 - DNA, 25 bp, Rattus norvegicus
tcattgacacttactcgctcataga

SEQ ID NO: 581564 - DNA, 25 bp, Rattus norvegicus
tcattgacactttctcgctcataga

SEQ ID NO: 581565 - DNA, 25 bp, Rattus norvegicus
tcattgaccgaaagagttccctcct

SEQ ID NO: 581566 - DNA, 25 bp, Rattus norvegicus
tcattgaccgaatgagttccctcct

SEQ ID NO: 581567 - DNA, 25 bp, Rattus norvegicus
tcattgacctcaacttcgagaaagc

SEQ ID NO: 581568 - DNA, 25 bp, Rattus norvegicus
tcattgacctcatcttcgagaaagc

SEQ ID NO: 581569 - DNA, 25 bp, Rattus norvegicus
tcattgacgagcactttcttcacaa

SEQ ID NO: 581570 - DNA, 25 bp, Rattus norvegicus
tcattgacgagctctttcttcacaa

SEQ ID NO: 581571 - DNA, 25 bp, Rattus norvegicus
tcattgacgccacgcagcgggaaaa

SEQ ID NO: 581572 - DNA, 25 bp, Rattus norvegicus
tcattgacgccaggcagcgggaaaa

SEQ ID NO: 581573 - DNA, 25 bp, Rattus norvegicus
tcattgactggtagtgttgtaagca

SEQ ID NO: 581574 - DNA, 25 bp, Rattus norvegicus
tcattgactggttgtgttgtaagca

SEQ ID NO: 581575 - DNA, 25 bp, Rattus norvegicus
tcattgactgtcatagcagcccact

SEQ ID NO: 581576 - DNA, 25 bp, Rattus norvegicus
tcattgactgtcattgtccatgtgc

SEQ ID NO: 581577 - DNA, 25 bp, Rattus norvegicus
tcattgactgtcttagcagcccact

SEQ ID NO: 581578 - DNA, 25 bp, Rattus norvegicus
tcattgactgtctttgtccatgtgc

SEQ ID NO: 581579 - DNA, 25 bp, Rattus norvegicus
tcattgagattgatccagccccgga

SEQ ID NO: 581580 - DNA, 25 bp, Rattus norvegicus
tcattgagattgttccagccccgga

SEQ ID NO: 581581 - DNA, 25 bp, Rattus norvegicus
tcattgagccccaggctcccggagg

SEQ ID NO: 581582 - DNA, 25 bp, Rattus norvegicus
tcattgagcccctggctcccggagg

SEQ ID NO: 581583 - DNA, 25 bp, Rattus norvegicus
tcattgagggatcctgggcactgct

SEQ ID NO: 581584 - DNA, 25 bp, Rattus norvegicus
tcattgagggatgctgggcactgct

SEQ ID NO: 581585 - DNA, 25 bp, Rattus norvegicus
tcattgagggctcagatgggcatta

SEQ ID NO: 581586 - DNA, 25 bp, Rattus norvegicus
tcattgagggctgagatgggcatta

SEQ ID NO: 581587 - DNA, 25 bp, Rattus norvegicus
tcattgatctagacgaaaccttggt

SEQ ID NO: 581588 - DNA, 25 bp, Rattus norvegicus
tcattgatctagtcgaaaccttggt

SEQ ID NO: 581589 - DNA, 25 bp, Rattus norvegicus
tcattgatttgacacactacatagt

SEQ ID NO: 581590 - DNA, 25 bp, Rattus norvegicus
tcattgatttgagacactacatagt

SEQ ID NO: 581591 - DNA, 25 bp, Rattus norvegicus
tcattgcaagtactcaagtgtcact

SEQ ID NO: 581592 - DNA, 25 bp, Rattus norvegicus
tcattgcaagtagtcaagtgtcact

SEQ ID NO: 581593 - DNA, 25 bp, Rattus norvegicus
tcattgcaatccatgccgactcaaa

SEQ ID NO: 581594 - DNA, 25 bp, Rattus norvegicus
tcattgcaatccatgtagagtcaaa

SEQ ID NO: 581595 - DNA, 25 bp, Rattus norvegicus
tcattgcaatccttgccgactcaaa

SEQ ID NO: 581596 - DNA, 25 bp, Rattus norvegicus
tcattgcaatccttgtagagtcaaa

SEQ ID NO: 581597 - DNA, 25 bp, Rattus norvegicus
tcattgcagctgagatcattgcagc

SEQ ID NO: 581598 - DNA, 25 bp, Rattus norvegicus
tcattgcagctgtgatcattgcagc

SEQ ID NO: 581599 - DNA, 25 bp, Rattus norvegicus
tcattgcagggcctttctttctact

SEQ ID NO: 581600 - DNA, 25 bp, Rattus norvegicus
tcattgcagggcgtttctttctact

SEQ ID NO: 581601 - DNA, 25 bp, Rattus norvegicus
tcattgcccaaaaatcctgtcttcc

SEQ ID NO: 581602 - DNA, 25 bp, Rattus norvegicus
tcattgcccaaatatcctgtcttcc

SEQ ID NO: 581603 - DNA, 25 bp, Rattus norvegicus
tcattgcctggcactttataacaag

SEQ ID NO: 581604 - DNA, 25 bp, Rattus norvegicus
tcattgcctggctctttataacaag

SEQ ID NO: 581605 - DNA, 25 bp, Rattus norvegicus
tcattgcctgtgagggtaccccaga

SEQ ID NO: 581606 - DNA, 25 bp, Rattus norvegicus
tcattgcctgtgtgggtaccccaga

SEQ ID NO: 581607 - DNA, 25 bp, Rattus norvegicus
tcattgcgccctccgtatttcatgt

SEQ ID NO: 581608 - DNA, 25 bp, Rattus norvegicus
tcattgcgccctgcgtatttcatgt

SEQ ID NO: 581609 - DNA, 25 bp, Rattus norvegicus
tcattgcgtcttaccggaagcctgc

SEQ ID NO: 581610 - DNA, 25 bp, Rattus norvegicus
tcattgcgtctttccggaagcctgc

SEQ ID NO: 581611 - DNA, 25 bp, Rattus norvegicus
tcattgctctgcaatcacatctaag

SEQ ID NO: 581612 - DNA, 25 bp, Rattus norvegicus
tcattgctctgctatcacatctaag

SEQ ID NO: 581613 - DNA, 25 bp, Rattus norvegicus
tcattgctctttcctgaagctgctg

SEQ ID NO: 581614 - DNA, 25 bp, Rattus norvegicus
tcattgctctttgctgaagctgctg

SEQ ID NO: 581615 - DNA, 25 bp, Rattus norvegicus
tcattgctggcgctgtgattggctt

SEQ ID NO: 581616 - DNA, 25 bp, Rattus norvegicus
tcattgctggcggtgtgattggctt

SEQ ID NO: 581617 - DNA, 25 bp, Rattus norvegicus
tcattgctgtgtagatgcctgtcat

SEQ ID NO: 581618 - DNA, 25 bp, Rattus norvegicus
tcattgctgtgttgatgcctgtcat

SEQ ID NO: 581619 - DNA, 25 bp, Rattus norvegicus
tcattgctgttcagtaggcttgctg

SEQ ID NO: 581620 - DNA, 25 bp, Rattus norvegicus
tcattgctgttctgtaggcttgctg

SEQ ID NO: 581621 - DNA, 25 bp, Rattus norvegicus
tcattgctgttgacactgactggca

SEQ ID NO: 581622 - DNA, 25 bp, Rattus norvegicus
tcattgctgttgtcactgactggca

SEQ ID NO: 581623 - DNA, 25 bp, Rattus norvegicus
tcattggacggcatctgtctccttt

SEQ ID NO: 581624 - DNA, 25 bp, Rattus norvegicus
tcattggacggcttctgtctccttt

SEQ ID NO: 581625 - DNA, 25 bp, Rattus norvegicus
tcattggactaacagagaaagatgt

SEQ ID NO: 581626 - DNA, 25 bp, Rattus norvegicus
tcattggactaagagagaaagatgt

SEQ ID NO: 581627 - DNA, 25 bp, Rattus norvegicus
tcattggagacccaccccaagatag

SEQ ID NO: 581628 - DNA, 25 bp, Rattus norvegicus
tcattggagaccgaccccaagatag

SEQ ID NO: 581629 - DNA, 25 bp, Rattus norvegicus
tcattggagccaccttagaattctg

SEQ ID NO: 581630 - DNA, 25 bp, Rattus norvegicus
tcattggagccagcttagaattctg

SEQ ID NO: 581631 - DNA, 25 bp, Rattus norvegicus
tcattggcaaatactccctctgaaa

SEQ ID NO: 581632 - DNA, 25 bp, Rattus norvegicus
tcattggcaaattctccctctgaaa

SEQ ID NO: 581633 - DNA, 25 bp, Rattus norvegicus
tcattggcatggagtcagctggaat

SEQ ID NO: 581634 - DNA, 25 bp, Rattus norvegicus
tcattggcatggtgtcagctggaat

SEQ ID NO: 581635 - DNA, 25 bp, Rattus norvegicus
tcattggcattaattgtcctgtttt

SEQ ID NO: 581636 - DNA, 25 bp, Rattus norvegicus
tcattggcattatttgtcctgtttt

SEQ ID NO: 581637 - DNA, 25 bp, Rattus norvegicus
tcattggccacgatcaagttccagc

SEQ ID NO: 581638 - DNA, 25 bp, Rattus norvegicus
tcattggccacgttcaagttccagc

SEQ ID NO: 581639 - DNA, 25 bp, Rattus norvegicus
tcattggccgaaagggacgctccgc

SEQ ID NO: 581640 - DNA, 25 bp, Rattus norvegicus
tcattggccgaatgggacgctccgc

SEQ ID NO: 581641 - DNA, 25 bp, Rattus norvegicus
tcattggccgagacctgagtggctt

SEQ ID NO: 581642 - DNA, 25 bp, Rattus norvegicus
tcattggccgagtcctgagtggctt

SEQ ID NO: 581643 - DNA, 25 bp, Rattus norvegicus
tcattggcctgtcagcactttccta

SEQ ID NO: 581644 - DNA, 25 bp, Rattus norvegicus
tcattggcctgtgagcactttccta

SEQ ID NO: 581645 - DNA, 25 bp, Rattus norvegicus
tcattggcgagtctcctgcgggtgg

SEQ ID NO: 581646 - DNA, 25 bp, Rattus norvegicus
tcattggcgagtgtcctgcgggtgg

SEQ ID NO: 581647 - DNA, 25 bp, Rattus norvegicus
tcattggctctgatcactgtggatg

SEQ ID NO: 581648 - DNA, 25 bp, Rattus norvegicus
tcattggctctgttcactgtggatg

SEQ ID NO: 581649 - DNA, 25 bp, Rattus norvegicus
tcattggctcttccgtgtcagtttc

SEQ ID NO: 581650 - DNA, 25 bp, Rattus norvegicus
tcattggctcttgcgtgtcagtttc

SEQ ID NO: 581651 - DNA, 25 bp, Rattus norvegicus
tcattggctgtcacagttgcaggaa

SEQ ID NO: 581652 - DNA, 25 bp, Rattus norvegicus
tcattggctgtctcagttgcaggaa

SEQ ID NO: 581653 - DNA, 25 bp, Rattus norvegicus
tcattgggccccactcaaaccattt

SEQ ID NO: 581654 - DNA, 25 bp, Rattus norvegicus
tcattgggcccctctcaaaccattt

SEQ ID NO: 581655 - DNA, 25 bp, Rattus norvegicus
tcattgggtatgctaggcagtattc

SEQ ID NO: 581656 - DNA, 25 bp, Rattus norvegicus
tcattgggtatggtaggcagtattc

SEQ ID NO: 581657 - DNA, 25 bp, Rattus norvegicus
tcattgggtcgaccgcaacggcaat

SEQ ID NO: 581658 - DNA, 25 bp, Rattus norvegicus
tcattgggtcgagcgcaacggcaat

SEQ ID NO: 581659 - DNA, 25 bp, Rattus norvegicus
tcattggtgaacaacacttaccttt

SEQ ID NO: 581660 - DNA, 25 bp, Rattus norvegicus
tcattggtgaactacacttaccttt

SEQ ID NO: 581661 - DNA, 25 bp, Rattus norvegicus
tcattggtgctcctttgggttttcc

SEQ ID NO: 581662 - DNA, 25 bp, Rattus norvegicus
tcattggtgctcgtttgggttttcc

SEQ ID NO: 581663 - DNA, 25 bp, Rattus norvegicus
tcattggtgggcaccttcacattcc

SEQ ID NO: 581664 - DNA, 25 bp, Rattus norvegicus
tcattggtgggctccttcacattcc

SEQ ID NO: 581665 - DNA, 25 bp, Rattus norvegicus
tcattggtgtgtcatttgaatctca

SEQ ID NO: 581666 - DNA, 25 bp, Rattus norvegicus
tcattggtgtgtgatttgaatctca

SEQ ID NO: 581667 - DNA, 25 bp, Rattus norvegicus
tcattggttacgagcaccggttgct

SEQ ID NO: 581668 - DNA, 25 bp, Rattus norvegicus
tcattggttacgtgcaccggttgct

SEQ ID NO: 581669 - DNA, 25 bp, Rattus norvegicus
tcattgtaaaggaggcaacggcact

SEQ ID NO: 581670 - DNA, 25 bp, Rattus norvegicus
tcattgtaaaggtggcaacggcact

SEQ ID NO: 581671 - DNA, 25 bp, Rattus norvegicus
tcattgtcaacaacgtcaacctggc

SEQ ID NO: 581672 - DNA, 25 bp, Rattus norvegicus
tcattgtcaacatcgtcaacctggc

SEQ ID NO: 581673 - DNA, 25 bp, Rattus norvegicus
tcattgtcagcacctgatgccttaa

SEQ ID NO: 581674 - DNA, 25 bp, Rattus norvegicus
tcattgtcagcagctgatgccttaa

SEQ ID NO: 581675 - DNA, 25 bp, Rattus norvegicus
tcattgtcatgtctcttgtctacca

SEQ ID NO: 581676 - DNA, 25 bp, Rattus norvegicus
tcattgtcatgtgtcttgtctacca

SEQ ID NO: 581677 - DNA, 25 bp, Rattus norvegicus
tcattgtcccttccgtgttcaaaga

SEQ ID NO: 581678 - DNA, 25 bp, Rattus norvegicus
tcattgtcccttgcgtgttcaaaga

SEQ ID NO: 581679 - DNA, 25 bp, Rattus norvegicus
tcattgtcctatccttgctgcttct

SEQ ID NO: 581680 - DNA, 25 bp, Rattus norvegicus
tcattgtcctatgcttgctgcttct

SEQ ID NO: 581681 - DNA, 25 bp, Rattus norvegicus
tcattgtctgcaccaactctccgga

SEQ ID NO: 581682 - DNA, 25 bp, Rattus norvegicus
tcattgtctgcagcaactctccgga

SEQ ID NO: 581683 - DNA, 25 bp, Rattus norvegicus
tcattgtgccaacatctccagtttc

SEQ ID NO: 581684 - DNA, 25 bp, Rattus norvegicus
tcattgtgccaagatctccagtttc

SEQ ID NO: 581685 - DNA, 25 bp, Rattus norvegicus
tcattgtgccttaacctcggtaaat

SEQ ID NO: 581686 - DNA, 25 bp, Rattus norvegicus
tcattgtgcctttacctcggtaaat

SEQ ID NO: 581687 - DNA, 25 bp, Rattus norvegicus
tcattgtgggcacgctctacaactt

SEQ ID NO: 581688 - DNA, 25 bp, Rattus norvegicus
tcattgtgggcaggctctacaactt

SEQ ID NO: 581689 - DNA, 25 bp, Rattus norvegicus
tcattgtgggtcattttctgcttct

SEQ ID NO: 581690 - DNA, 25 bp, Rattus norvegicus
tcattgtgggtctttttctgcttct

SEQ ID NO: 581691 - DNA, 25 bp, Rattus norvegicus
tcattgtgtggtccatggagacttt

SEQ ID NO: 581692 - DNA, 25 bp, Rattus norvegicus
tcattgtgtggtgcatggagacttt

SEQ ID NO: 581693 - DNA, 25 bp, Rattus norvegicus
tcattgttcgccaggactctcagaa

SEQ ID NO: 581694 - DNA, 25 bp, Rattus norvegicus
tcattgttcgcctggactctcagaa

SEQ ID NO: 581695 - DNA, 25 bp, Rattus norvegicus
tcattgttctctctgtatcggccta

SEQ ID NO: 581696 - DNA, 25 bp, Rattus norvegicus
tcattgttctctgtgtatcggccta

SEQ ID NO: 581697 - DNA, 25 bp, Rattus norvegicus
tcattgttggctacatgcagcttct

SEQ ID NO: 581698 - DNA, 25 bp, Rattus norvegicus
tcattgttggcttcatgcagcttct

SEQ ID NO: 581699 - DNA, 25 bp, Rattus norvegicus
tcatttaacagcatcggtttctaca

SEQ ID NO: 581700 - DNA, 25 bp, Rattus norvegicus
tcatttaacagcttcggtttctaca

SEQ ID NO: 581701 - DNA, 25 bp, Rattus norvegicus
tcatttacactcaagcctggccaga

SEQ ID NO: 581702 - DNA, 25 bp, Rattus norvegicus
tcatttacactctagcctggccaga

SEQ ID NO: 581703 - DNA, 25 bp, Rattus norvegicus
tcatttaccaatcctactccaagtg

SEQ ID NO: 581704 - DNA, 25 bp, Rattus norvegicus
tcatttaccaatgctactccaagtg

SEQ ID NO: 581705 - DNA, 25 bp, Rattus norvegicus
tcatttactttaatactggtcctcc

SEQ ID NO: 581706 - DNA, 25 bp, Rattus norvegicus
tcatttactttattactggtcctcc

SEQ ID NO: 581707 - DNA, 25 bp, Rattus norvegicus
tcatttagctatcaatggctcccca

SEQ ID NO: 581708 - DNA, 25 bp, Rattus norvegicus
tcatttagctatgaatggctcccca

SEQ ID NO: 581709 - DNA, 25 bp, Rattus norvegicus
tcatttaggcaaacactcagatcca

SEQ ID NO: 581710 - DNA, 25 bp, Rattus norvegicus
tcatttaggcaatcactcagatcca

SEQ ID NO: 581711 - DNA, 25 bp, Rattus norvegicus
tcatttagtattagtgatgctttaa

SEQ ID NO: 581712 - DNA, 25 bp, Rattus norvegicus
tcatttagtatttgtgatgctttaa

SEQ ID NO: 581713 - DNA, 25 bp, Rattus norvegicus
tcatttagttctagacagtctggaa

SEQ ID NO: 581714 - DNA, 25 bp, Rattus norvegicus
tcatttagttctcgtgggtcatcaa

SEQ ID NO: 581715 - DNA, 25 bp, Rattus norvegicus
tcatttagttctggtgggtcatcaa

SEQ ID NO: 581716 - DNA, 25 bp, Rattus norvegicus
tcatttagttcttgacagtctggaa

SEQ ID NO: 581717 - DNA, 25 bp, Rattus norvegicus
tcatttatcatcctcttccgtgttt

SEQ ID NO: 581718 - DNA, 25 bp, Rattus norvegicus
tcatttatcatcgtcttccgtgttt

SEQ ID NO: 581719 - DNA, 25 bp, Rattus norvegicus
tcatttatccttaggtggtggccta

SEQ ID NO: 581720 - DNA, 25 bp, Rattus norvegicus
tcatttatcctttggtggtggccta

SEQ ID NO: 581721 - DNA, 25 bp, Rattus norvegicus
tcatttatgtcgaccttggagccat

SEQ ID NO: 581722 - DNA, 25 bp, Rattus norvegicus
tcatttatgtcgtccttggagccat

SEQ ID NO: 581723 - DNA, 25 bp, Rattus norvegicus
tcatttattataacagacaaggtgt

SEQ ID NO: 581724 - DNA, 25 bp, Rattus norvegicus
tcatttattatatcagacaaggtgt

SEQ ID NO: 581725 - DNA, 25 bp, Rattus norvegicus
tcatttattgagagaccaggcagtc

SEQ ID NO: 581726 - DNA, 25 bp, Rattus norvegicus
tcatttattgagtgaccaggcagtc

SEQ ID NO: 581727 - DNA, 25 bp, Rattus norvegicus
tcatttcaaagcaagggcaggccca

SEQ ID NO: 581728 - DNA, 25 bp, Rattus norvegicus
tcatttcaaagctagggcaggccca

SEQ ID NO: 581729 - DNA, 25 bp, Rattus norvegicus
tcatttcagggtcctgtgcgccggc

SEQ ID NO: 581730 - DNA, 25 bp, Rattus norvegicus
tcatttcagggtgctgtgcgccggc

SEQ ID NO: 581731 - DNA, 25 bp, Rattus norvegicus
tcatttcatccccaagtaacccagg

SEQ ID NO: 581732 - DNA, 25 bp, Rattus norvegicus
tcatttcatcccgaagtaacccagg

SEQ ID NO: 581733 - DNA, 25 bp, Rattus norvegicus
tcatttccaccaatgcagagcttct

SEQ ID NO: 581734 - DNA, 25 bp, Rattus norvegicus
tcatttccaccattgcagagcttct

SEQ ID NO: 581735 - DNA, 25 bp, Rattus norvegicus
tcatttccactgattctctttgaca

SEQ ID NO: 581736 - DNA, 25 bp, Rattus norvegicus
tcatttccactgtttctctttgaca

SEQ ID NO: 581737 - DNA, 25 bp, Rattus norvegicus
tcatttccaggacaagcacagccat

SEQ ID NO: 581738 - DNA, 25 bp, Rattus norvegicus
tcatttccaggagaagcacagccat

SEQ ID NO: 581739 - DNA, 25 bp, Rattus norvegicus
tcatttccatgaagtgagacacaga

SEQ ID NO: 581740 - DNA, 25 bp, Rattus norvegicus
tcatttccatgatgtgagacacaga

SEQ ID NO: 581741 - DNA, 25 bp, Rattus norvegicus
tcatttccccatcatgactgagggt

SEQ ID NO: 581742 - DNA, 25 bp, Rattus norvegicus
tcatttccccatgatgactgagggt

SEQ ID NO: 581743 - DNA, 25 bp, Rattus norvegicus
tcatttccctgcaacaagaccagtc

SEQ ID NO: 581744 - DNA, 25 bp, Rattus norvegicus
tcatttccctgctacaagaccagtc

SEQ ID NO: 581745 - DNA, 25 bp, Rattus norvegicus
tcatttccctttacgctttatggtt

SEQ ID NO: 581746 - DNA, 25 bp, Rattus norvegicus
tcatttcccttttcgctttatggtt

SEQ ID NO: 581747 - DNA, 25 bp, Rattus norvegicus
tcatttccggttacccaagtactgt

SEQ ID NO: 581748 - DNA, 25 bp, Rattus norvegicus
tcatttccggtttcccaagtactgt

SEQ ID NO: 581749 - DNA, 25 bp, Rattus norvegicus
tcatttccttcaaaggccctgggaa

SEQ ID NO: 581750 - DNA, 25 bp, Rattus norvegicus
tcatttccttcataggccctgggaa

SEQ ID NO: 581751 - DNA, 25 bp, Rattus norvegicus
tcatttcgccttctagtctatgtag

SEQ ID NO: 581752 - DNA, 25 bp, Rattus norvegicus
tcatttcgccttgtagtctatgtag

SEQ ID NO: 581753 - DNA, 25 bp, Rattus norvegicus
tcatttctcatacaactctaccaac

SEQ ID NO: 581754 - DNA, 25 bp, Rattus norvegicus
tcatttctcatagaactctaccaac

SEQ ID NO: 581755 - DNA, 25 bp, Rattus norvegicus
tcatttctcatcagtagtgtgcccc

SEQ ID NO: 581756 - DNA, 25 bp, Rattus norvegicus
tcatttctcatctgtagtgtgcccc

SEQ ID NO: 581757 - DNA, 25 bp, Rattus norvegicus
tcatttctcggcaggactgggtagg

SEQ ID NO: 581758 - DNA, 25 bp, Rattus norvegicus
tcatttctcggctggactgggtagg

SEQ ID NO: 581759 - DNA, 25 bp, Rattus norvegicus
tcatttctcttcaggagtgactcag

SEQ ID NO: 581760 - DNA, 25 bp, Rattus norvegicus
tcatttctcttctggagtgactcag

SEQ ID NO: 581761 - DNA, 25 bp, Rattus norvegicus
tcatttctgtctccatgcgctcaca

SEQ ID NO: 581762 - DNA, 25 bp, Rattus norvegicus
tcatttctgtctgcatgcgctcaca

SEQ ID NO: 581763 - DNA, 25 bp, Rattus norvegicus
tcatttcttcatcggtgtgctcaag

SEQ ID NO: 581764 - DNA, 25 bp, Rattus norvegicus
tcatttcttcatgggtgtgctcaag

SEQ ID NO: 581765 - DNA, 25 bp, Rattus norvegicus
tcatttcttcctctgcatgcaaaaa

SEQ ID NO: 581766 - DNA, 25 bp, Rattus norvegicus
tcatttcttcctgtgcatgcaaaaa

SEQ ID NO: 581767 - DNA, 25 bp, Rattus norvegicus
tcatttcttgaacggtggctgcaga

SEQ ID NO: 581768 - DNA, 25 bp, Rattus norvegicus
tcatttcttgaagggtggctgcaga

SEQ ID NO: 581769 - DNA, 25 bp, Rattus norvegicus
tcatttcttgctatctttttacttg

SEQ ID NO: 581770 - DNA, 25 bp, Rattus norvegicus
tcatttcttgctttctttttacttg

SEQ ID NO: 581771 - DNA, 25 bp, Rattus norvegicus
tcatttctttccatattttatttct

SEQ ID NO: 581772 - DNA, 25 bp, Rattus norvegicus
tcatttctttccttattttatttct

SEQ ID NO: 581773 - DNA, 25 bp, Rattus norvegicus
tcatttctttctagggctgggactt

SEQ ID NO: 581774 - DNA, 25 bp, Rattus norvegicus
tcatttctttcttgggctgggactt

SEQ ID NO: 581775 - DNA, 25 bp, Rattus norvegicus
tcatttcttttcatccctctgtagg

SEQ ID NO: 581776 - DNA, 25 bp, Rattus norvegicus
tcatttcttttcttccctctgtagg

SEQ ID NO: 581777 - DNA, 25 bp, Rattus norvegicus
tcatttgaaattctaggcccaccag

SEQ ID NO: 581778 - DNA, 25 bp, Rattus norvegicus
tcatttgaaattgtaggcccaccag

SEQ ID NO: 581779 - DNA, 25 bp, Rattus norvegicus
tcatttgaatgtagagcccgcccta

SEQ ID NO: 581780 - DNA, 25 bp, Rattus norvegicus
tcatttgaatgttgagcccgcccta

SEQ ID NO: 581781 - DNA, 25 bp, Rattus norvegicus
tcatttgaccatatttgttctgttc

SEQ ID NO: 581782 - DNA, 25 bp, Rattus norvegicus
tcatttgaccatttttgttctgttc

SEQ ID NO: 581783 - DNA, 25 bp, Rattus norvegicus
tcatttgagggcactgttcgtgcaa

SEQ ID NO: 581784 - DNA, 25 bp, Rattus norvegicus
tcatttgagggctctgttcgtgcaa

SEQ ID NO: 581785 - DNA, 25 bp, Rattus norvegicus
tcatttgatagactgctttcctcaa

SEQ ID NO: 581786 - DNA, 25 bp, Rattus norvegicus
tcatttgatagagtgctttcctcaa

SEQ ID NO: 581787 - DNA, 25 bp, Rattus norvegicus
tcatttgatggaaacacttgtgtat

SEQ ID NO: 581788 - DNA, 25 bp, Rattus norvegicus
tcatttgatggatacacttgtgtat

SEQ ID NO: 581789 - DNA, 25 bp, Rattus norvegicus
tcatttgcaggacctgttgcccagt

SEQ ID NO: 581790 - DNA, 25 bp, Rattus norvegicus
tcatttgcaggagctgttgcccagt

SEQ ID NO: 581791 - DNA, 25 bp, Rattus norvegicus
tcatttgccttaatttgttctttaa

SEQ ID NO: 581792 - DNA, 25 bp, Rattus norvegicus
tcatttgccttattttgttctttaa

SEQ ID NO: 581793 - DNA, 25 bp, Rattus norvegicus
tcatttgcggtccagatggcatctg

SEQ ID NO: 581794 - DNA, 25 bp, Rattus norvegicus
tcatttgcggtcgagatggcatctg

SEQ ID NO: 581795 - DNA, 25 bp, Rattus norvegicus
tcatttgcggttctctggactctga

SEQ ID NO: 581796 - DNA, 25 bp, Rattus norvegicus
tcatttgcggttgtctggactctga

SEQ ID NO: 581797 - DNA, 25 bp, Rattus norvegicus
tcatttgcttctaggctttctttgt

SEQ ID NO: 581798 - DNA, 25 bp, Rattus norvegicus
tcatttgcttcttggctttctttgt

SEQ ID NO: 581799 - DNA, 25 bp, Rattus norvegicus
tcatttggcatcattccaggtttaa

SEQ ID NO: 581800 - DNA, 25 bp, Rattus norvegicus
tcatttggcatctttccaggtttaa

SEQ ID NO: 581801 - DNA, 25 bp, Rattus norvegicus
tcatttgggctcatcttactccaat

SEQ ID NO: 581802 - DNA, 25 bp, Rattus norvegicus
tcatttgggctcttcttactccaat

SEQ ID NO: 581803 - DNA, 25 bp, Rattus norvegicus
tcatttggttagctttcatccccat

SEQ ID NO: 581804 - DNA, 25 bp, Rattus norvegicus
tcatttggttaggtttcatccccat

SEQ ID NO: 581805 - DNA, 25 bp, Rattus norvegicus
tcatttggttttcctgtttctttgg

SEQ ID NO: 581806 - DNA, 25 bp, Rattus norvegicus
tcatttggttttgctgtttctttgg

SEQ ID NO: 581807 - DNA, 25 bp, Rattus norvegicus
tcatttgtgcacctgtacagctcaa

SEQ ID NO: 581808 - DNA, 25 bp, Rattus norvegicus
tcatttgtgcacgtgtacagctcaa

SEQ ID NO: 581809 - DNA, 25 bp, Rattus norvegicus
tcatttgtgtgcctgggctgcaagt

SEQ ID NO: 581810 - DNA, 25 bp, Rattus norvegicus
tcatttgtgtgcgtgggctgcaagt

SEQ ID NO: 581811 - DNA, 25 bp, Rattus norvegicus
tcatttgttttaaactttgccaggt

SEQ ID NO: 581812 - DNA, 25 bp, Rattus norvegicus
tcatttgttttatactttgccaggt

SEQ ID NO: 581813 - DNA, 25 bp, Rattus norvegicus
tcattttaaggtccccgttgttcct

SEQ ID NO: 581814 - DNA, 25 bp, Rattus norvegicus
tcattttaaggtgcccgttgttcct

SEQ ID NO: 581815 - DNA, 25 bp, Rattus norvegicus
tcattttaattaccagttgtgtaga

SEQ ID NO: 581816 - DNA, 25 bp, Rattus norvegicus
tcattttaattagcagttgtgtaga

SEQ ID NO: 581817 - DNA, 25 bp, Rattus norvegicus
tcattttaccttaacctttgtctag

SEQ ID NO: 581818 - DNA, 25 bp, Rattus norvegicus
tcattttacctttacctttgtctag

SEQ ID NO: 581819 - DNA, 25 bp, Rattus norvegicus
tcattttatattatggacacctgcc

SEQ ID NO: 581820 - DNA, 25 bp, Rattus norvegicus
tcattttatattttggacacctgcc

SEQ ID NO: 581821 - DNA, 25 bp, Rattus norvegicus
tcattttatgtgcttgctgctgtcc

SEQ ID NO: 581822 - DNA, 25 bp, Rattus norvegicus
tcattttatgtggttgctgctgtcc

SEQ ID NO: 581823 - DNA, 25 bp, Rattus norvegicus
tcattttcaaatagcctggcccagg

SEQ ID NO: 581824 - DNA, 25 bp, Rattus norvegicus
tcattttcaaattgcctggcccagg

SEQ ID NO: 581825 - DNA, 25 bp, Rattus norvegicus
tcattttcaccaaccccgagtatag

SEQ ID NO: 581826 - DNA, 25 bp, Rattus norvegicus
tcattttcaccatccccgagtatag

SEQ ID NO: 581827 - DNA, 25 bp, Rattus norvegicus
tcattttcaccgacccaattgtagg

SEQ ID NO: 581828 - DNA, 25 bp, Rattus norvegicus
tcattttcaccgtcccaattgtagg

SEQ ID NO: 581829 - DNA, 25 bp, Rattus norvegicus
tcattttcaggcatctgcagctgta

SEQ ID NO: 581830 - DNA, 25 bp, Rattus norvegicus
tcattttcaggcttctgcagctgta

SEQ ID NO: 581831 - DNA, 25 bp, Rattus norvegicus
tcattttccctaaagactccagaga

SEQ ID NO: 581832 - DNA, 25 bp, Rattus norvegicus
tcattttccctatagactccagaga

SEQ ID NO: 581833 - DNA, 25 bp, Rattus norvegicus
tcattttccgtacaggagtcagcct

SEQ ID NO: 581834 - DNA, 25 bp, Rattus norvegicus
tcattttccgtagaggagtcagcct

SEQ ID NO: 581835 - DNA, 25 bp, Rattus norvegicus
tcattttcctgcagtggtattctgc

SEQ ID NO: 581836 - DNA, 25 bp, Rattus norvegicus
tcattttcctgctgtggtattctgc

SEQ ID NO: 581837 - DNA, 25 bp, Rattus norvegicus
tcattttcctttatcggccttctgc

SEQ ID NO: 581838 - DNA, 25 bp, Rattus norvegicus
tcattttcctttttcggccttctgc

SEQ ID NO: 581839 - DNA, 25 bp, Rattus norvegicus
tcattttcgaggacgatcggtgtct

SEQ ID NO: 581840 - DNA, 25 bp, Rattus norvegicus
tcattttcgaggtcgatcggtgtct

SEQ ID NO: 581841 - DNA, 25 bp, Rattus norvegicus
tcattttcgtctactgttgtggtcc

SEQ ID NO: 581842 - DNA, 25 bp, Rattus norvegicus
tcattttcgtcttctgttgtggtcc

SEQ ID NO: 581843 - DNA, 25 bp, Rattus norvegicus
tcattttctccaacggtgacctaga

SEQ ID NO: 581844 - DNA, 25 bp, Rattus norvegicus
tcattttctccatcggtgacctaga

SEQ ID NO: 581845 - DNA, 25 bp, Rattus norvegicus
tcattttctcccagggctctttttt

SEQ ID NO: 581846 - DNA, 25 bp, Rattus norvegicus
tcattttctccctgggctctttttt

SEQ ID NO: 581847 - DNA, 25 bp, Rattus norvegicus
tcattttctgacaaaggagctcatt

SEQ ID NO: 581848 - DNA, 25 bp, Rattus norvegicus
tcattttctgacatgttatccccgt

SEQ ID NO: 581849 - DNA, 25 bp, Rattus norvegicus
tcattttctgactaaggagctcatt

SEQ ID NO: 581850 - DNA, 25 bp, Rattus norvegicus
tcattttctgacttgttatccccgt

SEQ ID NO: 581851 - DNA, 25 bp, Rattus norvegicus
tcattttctggccttggactgagag

SEQ ID NO: 581852 - DNA, 25 bp, Rattus norvegicus
tcattttctggcgttggactgagag

SEQ ID NO: 581853 - DNA, 25 bp, Rattus norvegicus
tcattttgagccattgttttcccta

SEQ ID NO: 581854 - DNA, 25 bp, Rattus norvegicus
tcattttgagcctttgttttcccta

SEQ ID NO: 581855 - DNA, 25 bp, Rattus norvegicus
tcattttgccaacgaattcacccca

SEQ ID NO: 581856 - DNA, 25 bp, Rattus norvegicus
tcattttgccaaggaattcacccca

SEQ ID NO: 581857 - DNA, 25 bp, Rattus norvegicus
tcattttggtgacatcaaagccaga

SEQ ID NO: 581858 - DNA, 25 bp, Rattus norvegicus
tcattttggtgagatcaaagccaga

SEQ ID NO: 581859 - DNA, 25 bp, Rattus norvegicus
tcattttggtttccaggtccatgct

SEQ ID NO: 581860 - DNA, 25 bp, Rattus norvegicus
tcattttggtttgcaggtccatgct

SEQ ID NO: 581861 - DNA, 25 bp, Rattus norvegicus
tcattttgtaagacgaccctgcagt

SEQ ID NO: 581862 - DNA, 25 bp, Rattus norvegicus
tcattttgtaagtcgaccctgcagt

SEQ ID NO: 581863 - DNA, 25 bp, Rattus norvegicus
tcattttgtccactgtcccttaggg

SEQ ID NO: 581864 - DNA, 25 bp, Rattus norvegicus
tcattttgtccagtgtcccttaggg

SEQ ID NO: 581865 - DNA, 25 bp, Rattus norvegicus
tcattttgtgtaagactgtctaatt

SEQ ID NO: 581866 - DNA, 25 bp, Rattus norvegicus
tcattttgtgtatgactgtctaatt

SEQ ID NO: 581867 - DNA, 25 bp, Rattus norvegicus
tcattttgttgtaagaccctttaag

SEQ ID NO: 581868 - DNA, 25 bp, Rattus norvegicus
tcattttgttgttagaccctttaag

SEQ ID NO: 581869 - DNA, 25 bp, Rattus norvegicus
tcattttgtttactggatccttcct

SEQ ID NO: 581870 - DNA, 25 bp, Rattus norvegicus
tcattttgtttagtggatccttcct

SEQ ID NO: 581871 - DNA, 25 bp, Rattus norvegicus
tcatttttccaaactatatgccaat

SEQ ID NO: 581872 - DNA, 25 bp, Rattus norvegicus
tcatttttccaatctatatgccaat

SEQ ID NO: 581873 - DNA, 25 bp, Rattus norvegicus
tcatttttcttcacttaagatacaa

SEQ ID NO: 581874 - DNA, 25 bp, Rattus norvegicus
tcatttttcttctcttaagatacaa

SEQ ID NO: 581875 - DNA, 25 bp, Rattus norvegicus
tccaaaaaatggccggccccacttg

SEQ ID NO: 581876 - DNA, 25 bp, Rattus norvegicus
tccaaaaaatgggcggccccacttg

SEQ ID NO: 581877 - DNA, 25 bp, Rattus norvegicus
tccaaaacaatacctcctctggttt

SEQ ID NO: 581878 - DNA, 25 bp, Rattus norvegicus
tccaaaacaatagctcctctggttt

SEQ ID NO: 581879 - DNA, 25 bp, Rattus norvegicus
tccaaaacgtttagagaggacgctg

SEQ ID NO: 581880 - DNA, 25 bp, Rattus norvegicus
tccaaaacgttttgagaggacgctg

SEQ ID NO: 581881 - DNA, 25 bp, Rattus norvegicus
tccaaaactgtaccatttcacaaat

SEQ ID NO: 581882 - DNA, 25 bp, Rattus norvegicus
tccaaaactgtagcatttcacaaat

SEQ ID NO: 581883 - DNA, 25 bp, Rattus norvegicus
tccaaaagggcaactcatgtagtac

SEQ ID NO: 581884 - DNA, 25 bp, Rattus norvegicus
tccaaaagggcatctcatgtagtac

SEQ ID NO: 581885 - DNA, 25 bp, Rattus norvegicus
tccaaaatactgactacccacattc

SEQ ID NO: 581886 - DNA, 25 bp, Rattus norvegicus
tccaaaatactgtctacccacattc

SEQ ID NO: 581887 - DNA, 25 bp, Rattus norvegicus
tccaaaattcctacagccaagctat

SEQ ID NO: 581888 - DNA, 25 bp, Rattus norvegicus
tccaaaattccttcagccaagctat

SEQ ID NO: 581889 - DNA, 25 bp, Rattus norvegicus
tccaaacacatcagggtgcggccga

SEQ ID NO: 581890 - DNA, 25 bp, Rattus norvegicus
tccaaacacatctgggtgcggccga

SEQ ID NO: 581891 - DNA, 25 bp, Rattus norvegicus
tccaaacccagtatcttcagctttt

SEQ ID NO: 581892 - DNA, 25 bp, Rattus norvegicus
tccaaacccagtttcttcagctttt

SEQ ID NO: 581893 - DNA, 25 bp, Rattus norvegicus
tccaaacctaacctcaatgacattc

SEQ ID NO: 581894 - DNA, 25 bp, Rattus norvegicus
tccaaacctaacgtcaatgacattc

SEQ ID NO: 581895 - DNA, 25 bp, Rattus norvegicus
tccaaacctatgagaagatctcggg

SEQ ID NO: 581896 - DNA, 25 bp, Rattus norvegicus
tccaaacctatgtgaagatctcggg

SEQ ID NO: 581897 - DNA, 25 bp, Rattus norvegicus
tccaaaccttctcccagtaagtaag

SEQ ID NO: 581898 - DNA, 25 bp, Rattus norvegicus
tccaaaccttctgccagtaagtaag

SEQ ID NO: 581899 - DNA, 25 bp, Rattus norvegicus
tccaaacgcttaacggcaggttcca

SEQ ID NO: 581900 - DNA, 25 bp, Rattus norvegicus
tccaaacgcttatcggcaggttcca

SEQ ID NO: 581901 - DNA, 25 bp, Rattus norvegicus
tccaaacggaggcatgagtgacttc

SEQ ID NO: 581902 - DNA, 25 bp, Rattus norvegicus
tccaaacggagggatgagtgacttc

SEQ ID NO: 581903 - DNA, 25 bp, Rattus norvegicus
tccaaacttttacgtctcgacgctt

SEQ ID NO: 581904 - DNA, 25 bp, Rattus norvegicus
tccaaacttttaggtctcgacgctt

SEQ ID NO: 581905 - DNA, 25 bp, Rattus norvegicus
tccaaagagggcagagagatacatc

SEQ ID NO: 581906 - DNA, 25 bp, Rattus norvegicus
tccaaagagggctgagagatacatc

SEQ ID NO: 581907 - DNA, 25 bp, Rattus norvegicus
tccaaagcacccaattttctacagt

SEQ ID NO: 581908 - DNA, 25 bp, Rattus norvegicus
tccaaagcaccctattttctacagt

SEQ ID NO: 581909 - DNA, 25 bp, Rattus norvegicus
tccaaagccaccacacggtgagaga

SEQ ID NO: 581910 - DNA, 25 bp, Rattus norvegicus
tccaaagccacctcacggtgagaga

SEQ ID NO: 581911 - DNA, 25 bp, Rattus norvegicus
tccaaagccctacctgaagcagcag

SEQ ID NO: 581912 - DNA, 25 bp, Rattus norvegicus
tccaaagccctagctgaagcagcag

SEQ ID NO: 581913 - DNA, 25 bp, Rattus norvegicus
tccaaagctgaaccaactccaagta

SEQ ID NO: 581914 - DNA, 25 bp, Rattus norvegicus
tccaaagctgaagcaactccaagta

SEQ ID NO: 581915 - DNA, 25 bp, Rattus norvegicus
tccaaaggaggaagtcacccctgag

SEQ ID NO: 581916 - DNA, 25 bp, Rattus norvegicus
tccaaaggaggatgtcacccctgag

SEQ ID NO: 581917 - DNA, 25 bp, Rattus norvegicus
tccaaaggcagcatcgggcaccaag

SEQ ID NO: 581918 - DNA, 25 bp, Rattus norvegicus
tccaaaggcagcttcgggcaccaag

SEQ ID NO: 581919 - DNA, 25 bp, Rattus norvegicus
tccaaaggcaggagggcctcactgt

SEQ ID NO: 581920 - DNA, 25 bp, Rattus norvegicus
tccaaaggcaggtgggcctcactgt

SEQ ID NO: 581921 - DNA, 25 bp, Rattus norvegicus
tccaaaggccctattgtctcaagga

SEQ ID NO: 581922 - DNA, 25 bp, Rattus norvegicus
tccaaaggcccttttgtctcaagga

SEQ ID NO: 581923 - DNA, 25 bp, Rattus norvegicus
tccaaaggcttcaccaggaacagcg

SEQ ID NO: 581924 - DNA, 25 bp, Rattus norvegicus
tccaaaggcttctccaggaacagcg

SEQ ID NO: 581925 - DNA, 25 bp, Rattus norvegicus
tccaaagtaaaaagaccagccgtag

SEQ ID NO: 581926 - DNA, 25 bp, Rattus norvegicus
tccaaagtaaaatgaccagccgtag

SEQ ID NO: 581927 - DNA, 25 bp, Rattus norvegicus
tccaaagtacttactgacctctggg

SEQ ID NO: 581928 - DNA, 25 bp, Rattus norvegicus
tccaaagtactttctgacctctggg

SEQ ID NO: 581929 - DNA, 25 bp, Rattus norvegicus
tccaaagtagggaatctctgccttt

SEQ ID NO: 581930 - DNA, 25 bp, Rattus norvegicus
tccaaagtagggtatctctgccttt

SEQ ID NO: 581931 - DNA, 25 bp, Rattus norvegicus
tccaaagtggacagcaatgcggcgg

SEQ ID NO: 581932 - DNA, 25 bp, Rattus norvegicus
tccaaagtggactgcaatgcggcgg

SEQ ID NO: 581933 - DNA, 25 bp, Rattus norvegicus
tccaaagttcttagcctggcacaga

SEQ ID NO: 581934 - DNA, 25 bp, Rattus norvegicus
tccaaagttctttgcctggcacaga

SEQ ID NO: 581935 - DNA, 25 bp, Rattus norvegicus
tccaaagtttgtatcagtgctcata

SEQ ID NO: 581936 - DNA, 25 bp, Rattus norvegicus
tccaaagtttgtttcagtgctcata

SEQ ID NO: 581937 - DNA, 25 bp, Rattus norvegicus
tccaaatacaaaaagccaggaggcc

SEQ ID NO: 581938 - DNA, 25 bp, Rattus norvegicus
tccaaatacaaatagccaggaggcc

SEQ ID NO: 581939 - DNA, 25 bp, Rattus norvegicus
tccaaatatcagataatctcctgtg

SEQ ID NO: 581940 - DNA, 25 bp, Rattus norvegicus
tccaaatatcagttaatctcctgtg

SEQ ID NO: 581941 - DNA, 25 bp, Rattus norvegicus
tccaaatcccttatgtcactcaaga

SEQ ID NO: 581942 - DNA, 25 bp, Rattus norvegicus
tccaaatcccttttgtcactcaaga

SEQ ID NO: 581943 - DNA, 25 bp, Rattus norvegicus
tccaaatccggaacgaggccaatga

SEQ ID NO: 581944 - DNA, 25 bp, Rattus norvegicus
tccaaatccggatcgaggccaatga

SEQ ID NO: 581945 - DNA, 25 bp, Rattus norvegicus
tccaaatccttgctcgtgacctaag

SEQ ID NO: 581946 - DNA, 25 bp, Rattus norvegicus
tccaaatccttggtcgtgacctaag

SEQ ID NO: 581947 - DNA, 25 bp, Rattus norvegicus
tccaaattcaccatccaagtcctta

SEQ ID NO: 581948 - DNA, 25 bp, Rattus norvegicus
tccaaattcaccttccaagtcctta

SEQ ID NO: 581949 - DNA, 25 bp, Rattus norvegicus
tccaaattctcacaaggcacacagc

SEQ ID NO: 581950 - DNA, 25 bp, Rattus norvegicus
tccaaattctcagaaggcacacagc

SEQ ID NO: 581951 - DNA, 25 bp, Rattus norvegicus
tccaaattctgtatttcttatctga

SEQ ID NO: 581952 - DNA, 25 bp, Rattus norvegicus
tccaaattctgtttttcttatctga

SEQ ID NO: 581953 - DNA, 25 bp, Rattus norvegicus
tccaacaaaaatattttccccagag

SEQ ID NO: 581954 - DNA, 25 bp, Rattus norvegicus
tccaacaaaaattttttccccagag

SEQ ID NO: 581955 - DNA, 25 bp, Rattus norvegicus
tccaacaacagactcccattgagct

SEQ ID NO: 581956 - DNA, 25 bp, Rattus norvegicus
tccaacaacagagtcccattgagct

SEQ ID NO: 581957 - DNA, 25 bp, Rattus norvegicus
tccaacagcacaacgccaggactgg

SEQ ID NO: 581958 - DNA, 25 bp, Rattus norvegicus
tccaacagcacatcgccaggactgg

SEQ ID NO: 581959 - DNA, 25 bp, Rattus norvegicus
tccaacagcctccgtcaagatgctg

SEQ ID NO: 581960 - DNA, 25 bp, Rattus norvegicus
tccaacagcctcggtcaagatgctg

SEQ ID NO: 581961 - DNA, 25 bp, Rattus norvegicus
tccaacaggcctactttcaatcgaa

SEQ ID NO: 581962 - DNA, 25 bp, Rattus norvegicus
tccaacaggccttctttcaatcgaa

SEQ ID NO: 581963 - DNA, 25 bp, Rattus norvegicus
tccaacaggttgagccgggacacct

SEQ ID NO: 581964 - DNA, 25 bp, Rattus norvegicus
tccaacaggttgtgccgggacacct

SEQ ID NO: 581965 - DNA, 25 bp, Rattus norvegicus
tccaacagtcgcattcttgttttag

SEQ ID NO: 581966 - DNA, 25 bp, Rattus norvegicus
tccaacagtcgctttcttgttttag

SEQ ID NO: 581967 - DNA, 25 bp, Rattus norvegicus
tccaacagtgctctcttgggagaca

SEQ ID NO: 581968 - DNA, 25 bp, Rattus norvegicus
tccaacagtgctgtcttgggagaca

SEQ ID NO: 581969 - DNA, 25 bp, Rattus norvegicus
tccaacatgatccaagccagggcta

SEQ ID NO: 581970 - DNA, 25 bp, Rattus norvegicus
tccaacatgatcgaagccagggcta

SEQ ID NO: 581971 - DNA, 25 bp, Rattus norvegicus
tccaacatggttattctgcagggcc

SEQ ID NO: 581972 - DNA, 25 bp, Rattus norvegicus
tccaacatggtttttctgcagggcc

SEQ ID NO: 581973 - DNA, 25 bp, Rattus norvegicus
tccaaccacattccaagctgagata

SEQ ID NO: 581974 - DNA, 25 bp, Rattus norvegicus
tccaaccacattgcaagctgagata

SEQ ID NO: 581975 - DNA, 25 bp, Rattus norvegicus
tccaaccaggcccaaattaaaggat

SEQ ID NO: 581976 - DNA, 25 bp, Rattus norvegicus
tccaaccaggccgaaattaaaggat

SEQ ID NO: 581977 - DNA, 25 bp, Rattus norvegicus
tccaaccatcttcataatgccggtg

SEQ ID NO: 581978 - DNA, 25 bp, Rattus norvegicus
tccaaccatcttgataatgccggtg

SEQ ID NO: 581979 - DNA, 25 bp, Rattus norvegicus
tccaaccatgagcaatcagtaccag

SEQ ID NO: 581980 - DNA, 25 bp, Rattus norvegicus
tccaaccatgaggaatcagtaccag

SEQ ID NO: 581981 - DNA, 25 bp, Rattus norvegicus
tccaaccccattccttaaatgttag

SEQ ID NO: 581982 - DNA, 25 bp, Rattus norvegicus
tccaaccccattgcttaaatgttag

SEQ ID NO: 581983 - DNA, 25 bp, Rattus norvegicus
tccaaccccggaaactgactgtgaa

SEQ ID NO: 581984 - DNA, 25 bp, Rattus norvegicus
tccaaccccggatactgactgtgaa

SEQ ID NO: 581985 - DNA, 25 bp, Rattus norvegicus
tccaacccggagcatacttttacat

SEQ ID NO: 581986 - DNA, 25 bp, Rattus norvegicus
tccaacccggaggatacttttacat

SEQ ID NO: 581987 - DNA, 25 bp, Rattus norvegicus
tccaaccctgagctctttaaggagt

SEQ ID NO: 581988 - DNA, 25 bp, Rattus norvegicus
tccaaccctgaggtctttaaggagt

SEQ ID NO: 581989 - DNA, 25 bp, Rattus norvegicus
tccaacccttagaatagcatgcagt

SEQ ID NO: 581990 - DNA, 25 bp, Rattus norvegicus
tccaacccttagtatagcatgcagt

SEQ ID NO: 581991 - DNA, 25 bp, Rattus norvegicus
tccaaccgaggcaactgtgtcatca

SEQ ID NO: 581992 - DNA, 25 bp, Rattus norvegicus
tccaaccgaggcagtttccatgaga

SEQ ID NO: 581993 - DNA, 25 bp, Rattus norvegicus
tccaaccgaggctactgtgtcatca

SEQ ID NO: 581994 - DNA, 25 bp, Rattus norvegicus
tccaaccgaggctgtttccatgaga

SEQ ID NO: 581995 - DNA, 25 bp, Rattus norvegicus
tccaacctccatatgaatccagctt

SEQ ID NO: 581996 - DNA, 25 bp, Rattus norvegicus
tccaacctccatttgaatccagctt

SEQ ID NO: 581997 - DNA, 25 bp, Rattus norvegicus
tccaacctccggaaatccaatttct

SEQ ID NO: 581998 - DNA, 25 bp, Rattus norvegicus
tccaacctccggtaatccaatttct

SEQ ID NO: 581999 - DNA, 25 bp, Rattus norvegicus
tccaacctcttgctttttatgactt

SEQ ID NO: 582000 - DNA, 25 bp, Rattus norvegicus
tccaacctcttggtttttatgactt

SEQ ID NO: 582001 - DNA, 25 bp, Rattus norvegicus
tccaacctgtggcacttgagttcag

SEQ ID NO: 582002 - DNA, 25 bp, Rattus norvegicus
tccaacctgtgggacttgagttcag

SEQ ID NO: 582003 - DNA, 25 bp, Rattus norvegicus
tccaacgtatcccaccaaatatttt

SEQ ID NO: 582004 - DNA, 25 bp, Rattus norvegicus
tccaacgtatccgaccaaatatttt

SEQ ID NO: 582005 - DNA, 25 bp, Rattus norvegicus
tccaacgttgcaccacatgctatgg

SEQ ID NO: 582006 - DNA, 25 bp, Rattus norvegicus
tccaacgttgcagcacatgctatgg

SEQ ID NO: 582007 - DNA, 25 bp, Rattus norvegicus
tccaactatatccatcttttctgct

SEQ ID NO: 582008 - DNA, 25 bp, Rattus norvegicus
tccaactatatcgatcttttctgct

SEQ ID NO: 582009 - DNA, 25 bp, Rattus norvegicus
tccaactatccgctgcctaggaaat

SEQ ID NO: 582010 - DNA, 25 bp, Rattus norvegicus
tccaactatccggtgcctaggaaat

SEQ ID NO: 582011 - DNA, 25 bp, Rattus norvegicus
tccaactcacaccttttgtagaaaa

SEQ ID NO: 582012 - DNA, 25 bp, Rattus norvegicus
tccaactcacacgttttgtagaaaa

SEQ ID NO: 582013 - DNA, 25 bp, Rattus norvegicus
tccaactccctacttatgtagggct

SEQ ID NO: 582014 - DNA, 25 bp, Rattus norvegicus
tccaactccctagttatgtagggct

SEQ ID NO: 582015 - DNA, 25 bp, Rattus norvegicus
tccaactctcccagctgtaagagga

SEQ ID NO: 582016 - DNA, 25 bp, Rattus norvegicus
tccaactctccctgctgtaagagga

SEQ ID NO: 582017 - DNA, 25 bp, Rattus norvegicus
tccaactctcttcatacatctctga

SEQ ID NO: 582018 - DNA, 25 bp, Rattus norvegicus
tccaactctcttgatacatctctga

SEQ ID NO: 582019 - DNA, 25 bp, Rattus norvegicus
tccaactctttccttgctgggcttc

SEQ ID NO: 582020 - DNA, 25 bp, Rattus norvegicus
tccaactctttcgttgctgggcttc

SEQ ID NO: 582021 - DNA, 25 bp, Rattus norvegicus
tccaactgcctgcatacagtaggtg

SEQ ID NO: 582022 - DNA, 25 bp, Rattus norvegicus
tccaactgcctggatacagtaggtg

SEQ ID NO: 582023 - DNA, 25 bp, Rattus norvegicus
tccaactgctacagactgggttcaa

SEQ ID NO: 582024 - DNA, 25 bp, Rattus norvegicus
tccaactgctactgactgggttcaa

SEQ ID NO: 582025 - DNA, 25 bp, Rattus norvegicus
tccaactgctcgatcagggagatat

SEQ ID NO: 582026 - DNA, 25 bp, Rattus norvegicus
tccaactgctcgttcagggagatat

SEQ ID NO: 582027 - DNA, 25 bp, Rattus norvegicus
tccaactggtatcttcttttgcatg

SEQ ID NO: 582028 - DNA, 25 bp, Rattus norvegicus
tccaactggtatgttcttttgcatg

SEQ ID NO: 582029 - DNA, 25 bp, Rattus norvegicus
tccaacttagctcactttccgattt

SEQ ID NO: 582030 - DNA, 25 bp, Rattus norvegicus
tccaacttagctgactttccgattt

SEQ ID NO: 582031 - DNA, 25 bp, Rattus norvegicus
tccaacttatgtatctggatgtatc

SEQ ID NO: 582032 - DNA, 25 bp, Rattus norvegicus
tccaacttatgtttctggatgtatc

SEQ ID NO: 582033 - DNA, 25 bp, Rattus norvegicus
tccaacttcatcaccggagctggga

SEQ ID NO: 582034 - DNA, 25 bp, Rattus norvegicus
tccaacttcatctccggagctggga

SEQ ID NO: 582035 - DNA, 25 bp, Rattus norvegicus
tccaacttcattcgcgtctgcttca

SEQ ID NO: 582036 - DNA, 25 bp, Rattus norvegicus
tccaacttcattggcgtctgcttca

SEQ ID NO: 582037 - DNA, 25 bp, Rattus norvegicus
tccaacttcctcattgtgtttcaga

SEQ ID NO: 582038 - DNA, 25 bp, Rattus norvegicus
tccaacttcctctttgtgtttcaga

SEQ ID NO: 582039 - DNA, 25 bp, Rattus norvegicus
tccaacttctgcagtgggctacaag

SEQ ID NO: 582040 - DNA, 25 bp, Rattus norvegicus
tccaacttctgctgtgggctacaag

SEQ ID NO: 582041 - DNA, 25 bp, Rattus norvegicus
tccaacttgcgaaatactcatagaa

SEQ ID NO: 582042 - DNA, 25 bp, Rattus norvegicus
tccaacttgcgatatactcatagaa

SEQ ID NO: 582043 - DNA, 25 bp, Rattus norvegicus
tccaacttgcttcatgcttttctgg

SEQ ID NO: 582044 - DNA, 25 bp, Rattus norvegicus
tccaacttgcttgatgcttttctgg

SEQ ID NO: 582045 - DNA, 25 bp, Rattus norvegicus
tccaagaaagcgcttcactcgacag

SEQ ID NO: 582046 - DNA, 25 bp, Rattus norvegicus
tccaagaaagcggttcactcgacag

SEQ ID NO: 582047 - DNA, 25 bp, Rattus norvegicus
tccaagaagataattacacaacgtg

SEQ ID NO: 582048 - DNA, 25 bp, Rattus norvegicus
tccaagaagatatttacacaacgtg

SEQ ID NO: 582049 - DNA, 25 bp, Rattus norvegicus
tccaagaaggccctgaccaaggcgc

SEQ ID NO: 582050 - DNA, 25 bp, Rattus norvegicus
tccaagaaggccgtgaccaaggcgc

SEQ ID NO: 582051 - DNA, 25 bp, Rattus norvegicus
tccaagaagtgcataatgggttcct

SEQ ID NO: 582052 - DNA, 25 bp, Rattus norvegicus
tccaagaagtgcttaatgggttcct

SEQ ID NO: 582053 - DNA, 25 bp, Rattus norvegicus
tccaagaatgaacagttgacctact

SEQ ID NO: 582054 - DNA, 25 bp, Rattus norvegicus
tccaagaatgaagagttgacctact

SEQ ID NO: 582055 - DNA, 25 bp, Rattus norvegicus
tccaagacaaagcagtcttcacggg

SEQ ID NO: 582056 - DNA, 25 bp, Rattus norvegicus
tccaagacaaaggagtcttcacggg

SEQ ID NO: 582057 - DNA, 25 bp, Rattus norvegicus
tccaagacaagacaactgcccttag

SEQ ID NO: 582058 - DNA, 25 bp, Rattus norvegicus
tccaagacaagagaactgcccttag

SEQ ID NO: 582059 - DNA, 25 bp, Rattus norvegicus
tccaagacagctagcctgttaagca

SEQ ID NO: 582060 - DNA, 25 bp, Rattus norvegicus
tccaagacagcttgcctgttaagca

SEQ ID NO: 582061 - DNA, 25 bp, Rattus norvegicus
tccaagactggacagcacatgtgtg

SEQ ID NO: 582062 - DNA, 25 bp, Rattus norvegicus
tccaagactggagagcacatgtgtg

SEQ ID NO: 582063 - DNA, 25 bp, Rattus norvegicus
tccaagagatacaacggccgtcctg

SEQ ID NO: 582064 - DNA, 25 bp, Rattus norvegicus
tccaagagatactacggccgtcctg

SEQ ID NO: 582065 - DNA, 25 bp, Rattus norvegicus
tccaagagctggagaggctgagccc

SEQ ID NO: 582066 - DNA, 25 bp, Rattus norvegicus
tccaagagctggtgaggctgagccc

SEQ ID NO: 582067 - DNA, 25 bp, Rattus norvegicus
tccaagatcgcgatagcagccataa

SEQ ID NO: 582068 - DNA, 25 bp, Rattus norvegicus
tccaagatcgcgttagcagccataa

SEQ ID NO: 582069 - DNA, 25 bp, Rattus norvegicus
tccaagatggcccagctaagaaccg

SEQ ID NO: 582070 - DNA, 25 bp, Rattus norvegicus
tccaagatggccgagctaagaaccg

SEQ ID NO: 582071 - DNA, 25 bp, Rattus norvegicus
tccaagatgtaccttcctcctttat

SEQ ID NO: 582072 - DNA, 25 bp, Rattus norvegicus
tccaagatgtacgttcctcctttat

SEQ ID NO: 582073 - DNA, 25 bp, Rattus norvegicus
tccaagattccgaagtggcgaaaat

SEQ ID NO: 582074 - DNA, 25 bp, Rattus norvegicus
tccaagattccgtagtggcgaaaat

SEQ ID NO: 582075 - DNA, 25 bp, Rattus norvegicus
tccaagcagggacagctctgagagc

SEQ ID NO: 582076 - DNA, 25 bp, Rattus norvegicus
tccaagcagggagagctctgagagc

SEQ ID NO: 582077 - DNA, 25 bp, Rattus norvegicus
tccaagcagtgcaaaggcttcccaa

SEQ ID NO: 582078 - DNA, 25 bp, Rattus norvegicus
tccaagcagtgctaaggcttcccaa

SEQ ID NO: 582079 - DNA, 25 bp, Rattus norvegicus
tccaagcattgaaatctcagcgttt

SEQ ID NO: 582080 - DNA, 25 bp, Rattus norvegicus
tccaagcattgatatctcagcgttt

SEQ ID NO: 582081 - DNA, 25 bp, Rattus norvegicus
tccaagccaccgctgtgtcacagaa

SEQ ID NO: 582082 - DNA, 25 bp, Rattus norvegicus
tccaagccaccggtgtgtcacagaa

SEQ ID NO: 582083 - DNA, 25 bp, Rattus norvegicus
tccaagccagttaaatgcagttgaa

SEQ ID NO: 582084 - DNA, 25 bp, Rattus norvegicus
tccaagccagtttaatgcagttgaa

SEQ ID NO: 582085 - DNA, 25 bp, Rattus norvegicus
tccaagcctatgaggtgactgcagt

SEQ ID NO: 582086 - DNA, 25 bp, Rattus norvegicus
tccaagcctatgtggtgactgcagt

SEQ ID NO: 582087 - DNA, 25 bp, Rattus norvegicus
tccaagccttaaaccactgtgttag

SEQ ID NO: 582088 - DNA, 25 bp, Rattus norvegicus
tccaagccttaatccactgtgttag

SEQ ID NO: 582089 - DNA, 25 bp, Rattus norvegicus
tccaagcggaggaagagctaccagc

SEQ ID NO: 582090 - DNA, 25 bp, Rattus norvegicus
tccaagcggaggtagagctaccagc

SEQ ID NO: 582091 - DNA, 25 bp, Rattus norvegicus
tccaagctcctaattcagtgggttg

SEQ ID NO: 582092 - DNA, 25 bp, Rattus norvegicus
tccaagctcctatttcagtgggttg

SEQ ID NO: 582093 - DNA, 25 bp, Rattus norvegicus
tccaagctgtgtacatcgctgcata

SEQ ID NO: 582094 - DNA, 25 bp, Rattus norvegicus
tccaagctgtgttcatcgctgcata

SEQ ID NO: 582095 - DNA, 25 bp, Rattus norvegicus
tccaagctttcgatgctgccatgtt

SEQ ID NO: 582096 - DNA, 25 bp, Rattus norvegicus
tccaagctttcgttgctgccatgtt

SEQ ID NO: 582097 - DNA, 25 bp, Rattus norvegicus
tccaaggacctgagctgtgtgttag

SEQ ID NO: 582098 - DNA, 25 bp, Rattus norvegicus
tccaaggacctgtgctgtgtgttag

SEQ ID NO: 582099 - DNA, 25 bp, Rattus norvegicus
tccaaggagaagcaccgcagcctgc

SEQ ID NO: 582100 - DNA, 25 bp, Rattus norvegicus
tccaaggagaaggaccgcagcctgc

SEQ ID NO: 582101 - DNA, 25 bp, Rattus norvegicus
tccaaggagaggctgcctgacactc

SEQ ID NO: 582102 - DNA, 25 bp, Rattus norvegicus
tccaaggagagggtgcctgacactc

SEQ ID NO: 582103 - DNA, 25 bp, Rattus norvegicus
tccaaggcaagccacaggctataag

SEQ ID NO: 582104 - DNA, 25 bp, Rattus norvegicus
tccaaggcaagcgacaggctataag

SEQ ID NO: 582105 - DNA, 25 bp, Rattus norvegicus
tccaaggccaacattcccagtgtgg

SEQ ID NO: 582106 - DNA, 25 bp, Rattus norvegicus
tccaaggccaactttcccagtgtgg

SEQ ID NO: 582107 - DNA, 25 bp, Rattus norvegicus
tccaaggcccctaaaaactgcacaa

SEQ ID NO: 582108 - DNA, 25 bp, Rattus norvegicus
tccaaggccccttaaaactgcacaa

SEQ ID NO: 582109 - DNA, 25 bp, Rattus norvegicus
tccaaggcctgtccggaagactgca

SEQ ID NO: 582110 - DNA, 25 bp, Rattus norvegicus
tccaaggcctgtgcggaagactgca

SEQ ID NO: 582111 - DNA, 25 bp, Rattus norvegicus
tccaaggctcctccttaaagtcaat

SEQ ID NO: 582112 - DNA, 25 bp, Rattus norvegicus
tccaaggctcctgcttaaagtcaat

SEQ ID NO: 582113 - DNA, 25 bp, Rattus norvegicus
tccaaggctcttcggcaccagtagt

SEQ ID NO: 582114 - DNA, 25 bp, Rattus norvegicus
tccaaggctcttgggcaccagtagt

SEQ ID NO: 582115 - DNA, 25 bp, Rattus norvegicus
tccaaggcttgccttcaactgtctg

SEQ ID NO: 582116 - DNA, 25 bp, Rattus norvegicus
tccaaggcttgcgttcaactgtctg

SEQ ID NO: 582117 - DNA, 25 bp, Rattus norvegicus
tccaagggacggagccaggtccaaa

SEQ ID NO: 582118 - DNA, 25 bp, Rattus norvegicus
tccaagggacggtgccaggtccaaa

SEQ ID NO: 582119 - DNA, 25 bp, Rattus norvegicus
tccaagggagacctgtcggagacta

SEQ ID NO: 582120 - DNA, 25 bp, Rattus norvegicus
tccaagggagacgtgtcggagacta

SEQ ID NO: 582121 - DNA, 25 bp, Rattus norvegicus
tccaagggccttagtacccagtaca

SEQ ID NO: 582122 - DNA, 25 bp, Rattus norvegicus
tccaagggcctttgtacccagtaca

SEQ ID NO: 582123 - DNA, 25 bp, Rattus norvegicus
tccaagggtgtcagtattacatttt

SEQ ID NO: 582124 - DNA, 25 bp, Rattus norvegicus
tccaagggtgtctgtattacatttt

SEQ ID NO: 582125 - DNA, 25 bp, Rattus norvegicus
tccaaggtcagtctcaaggctttat

SEQ ID NO: 582126 - DNA, 25 bp, Rattus norvegicus
tccaaggtcagtgtcaaggctttat

SEQ ID NO: 582127 - DNA, 25 bp, Rattus norvegicus
tccaaggtccagctacatcgatatt

SEQ ID NO: 582128 - DNA, 25 bp, Rattus norvegicus
tccaaggtccaggtacatcgatatt

SEQ ID NO: 582129 - DNA, 25 bp, Rattus norvegicus
tccaaggtccgcattatgcaggagt

SEQ ID NO: 582130 - DNA, 25 bp, Rattus norvegicus
tccaaggtccgctttatgcaggagt

SEQ ID NO: 582131 - DNA, 25 bp, Rattus norvegicus
tccaaggtctccctgatcagtgtgg

SEQ ID NO: 582132 - DNA, 25 bp, Rattus norvegicus
tccaaggtctccgtgatcagtgtgg

SEQ ID NO: 582133 - DNA, 25 bp, Rattus norvegicus
tccaaggttctgcttttgctttcca

SEQ ID NO: 582134 - DNA, 25 bp, Rattus norvegicus
tccaaggttctggttttgctttcca

SEQ ID NO: 582135 - DNA, 25 bp, Rattus norvegicus
tccaaggtttctcatccagaggaga

SEQ ID NO: 582136 - DNA, 25 bp, Rattus norvegicus
tccaaggtttctgatccagaggaga

SEQ ID NO: 582137 - DNA, 25 bp, Rattus norvegicus
tccaagtccaacaagcagggcctct

SEQ ID NO: 582138 - DNA, 25 bp, Rattus norvegicus
tccaagtccaactagcagggcctct

SEQ ID NO: 582139 - DNA, 25 bp, Rattus norvegicus
tccaagtccagaactgcccgaagat

SEQ ID NO: 582140 - DNA, 25 bp, Rattus norvegicus
tccaagtccagatctgcccgaagat

SEQ ID NO: 582141 - DNA, 25 bp, Rattus norvegicus
tccaagtccctacagcaatacatag

SEQ ID NO: 582142 - DNA, 25 bp, Rattus norvegicus
tccaagtccctagagcaatacatag

SEQ ID NO: 582143 - DNA, 25 bp, Rattus norvegicus
tccaagtccttaacctctctttaaa

SEQ ID NO: 582144 - DNA, 25 bp, Rattus norvegicus
tccaagtccttatcctctctttaaa

SEQ ID NO: 582145 - DNA, 25 bp, Rattus norvegicus
tccaagtctgataagaaccgcccat

SEQ ID NO: 582146 - DNA, 25 bp, Rattus norvegicus
tccaagtctgattagaaccgcccat

SEQ ID NO: 582147 - DNA, 25 bp, Rattus norvegicus
tccaagtctgttaccaccctaaagc

SEQ ID NO: 582148 - DNA, 25 bp, Rattus norvegicus
tccaagtctgtttccaccctaaagc

SEQ ID NO: 582149 - DNA, 25 bp, Rattus norvegicus
tccaagtcttgaatctgggctcttc

SEQ ID NO: 582150 - DNA, 25 bp, Rattus norvegicus
tccaagtcttgattctgggctcttc

SEQ ID NO: 582151 - DNA, 25 bp, Rattus norvegicus
tccaagtgatcgagtgtcgctgcaa

SEQ ID NO: 582152 - DNA, 25 bp, Rattus norvegicus
tccaagtgatcgtgtgtcgctgcaa

SEQ ID NO: 582153 - DNA, 25 bp, Rattus norvegicus
tccaagtgatgtactgaggctccaa

SEQ ID NO: 582154 - DNA, 25 bp, Rattus norvegicus
tccaagtgatgttctgaggctccaa

SEQ ID NO: 582155 - DNA, 25 bp, Rattus norvegicus
tccaagtgctctcactacttcggtt

SEQ ID NO: 582156 - DNA, 25 bp, Rattus norvegicus
tccaagtgctctgactacttcggtt

SEQ ID NO: 582157 - DNA, 25 bp, Rattus norvegicus
tccaagtggaaacaggaccgtgtcc

SEQ ID NO: 582158 - DNA, 25 bp, Rattus norvegicus
tccaagtggaaagaggaccgtgtcc

SEQ ID NO: 582159 - DNA, 25 bp, Rattus norvegicus
tccaagtgggatcggttctgcttct

SEQ ID NO: 582160 - DNA, 25 bp, Rattus norvegicus
tccaagtgggatgggttctgcttct

SEQ ID NO: 582161 - DNA, 25 bp, Rattus norvegicus
tccaagtgggctatccttctttctt

SEQ ID NO: 582162 - DNA, 25 bp, Rattus norvegicus
tccaagtgggctttccttctttctt

SEQ ID NO: 582163 - DNA, 25 bp, Rattus norvegicus
tccaagtgtaggaactcacctttct

SEQ ID NO: 582164 - DNA, 25 bp, Rattus norvegicus
tccaagtgtaggtactcacctttct

SEQ ID NO: 582165 - DNA, 25 bp, Rattus norvegicus
tccaagtgtcttcatctgatctcag

SEQ ID NO: 582166 - DNA, 25 bp, Rattus norvegicus
tccaagtgtcttgatctgatctcag

SEQ ID NO: 582167 - DNA, 25 bp, Rattus norvegicus
tccaagtgtgggatttacctttatt

SEQ ID NO: 582168 - DNA, 25 bp, Rattus norvegicus
tccaagtgtgggttttacctttatt

SEQ ID NO: 582169 - DNA, 25 bp, Rattus norvegicus
tccaagttctaacacaccaccatag

SEQ ID NO: 582170 - DNA, 25 bp, Rattus norvegicus
tccaagttctaagacaccaccatag

SEQ ID NO: 582171 - DNA, 25 bp, Rattus norvegicus
tccaagtttctgatttgctggtgat

SEQ ID NO: 582172 - DNA, 25 bp, Rattus norvegicus
tccaagtttctgttttgctggtgat

SEQ ID NO: 582173 - DNA, 25 bp, Rattus norvegicus
tccaataaatgcatcaggcctgttc

SEQ ID NO: 582174 - DNA, 25 bp, Rattus norvegicus
tccaataaatgcttcaggcctgttc

SEQ ID NO: 582175 - DNA, 25 bp, Rattus norvegicus
tccaatatggcgcacgcggtcgagc

SEQ ID NO: 582176 - DNA, 25 bp, Rattus norvegicus
tccaatatggcggacgcggtcgagc

SEQ ID NO: 582177 - DNA, 25 bp, Rattus norvegicus
tccaatccagagctcttctgtcaaa

SEQ ID NO: 582178 - DNA, 25 bp, Rattus norvegicus
tccaatccagaggtcttctgtcaaa

SEQ ID NO: 582179 - DNA, 25 bp, Rattus norvegicus
tccaatccagtcagctcgaagacca

SEQ ID NO: 582180 - DNA, 25 bp, Rattus norvegicus
tccaatccagtctgctcgaagacca

SEQ ID NO: 582181 - DNA, 25 bp, Rattus norvegicus
tccaatccatccctatgagcgatca

SEQ ID NO: 582182 - DNA, 25 bp, Rattus norvegicus
tccaatccatccgtatgagcgatca

SEQ ID NO: 582183 - DNA, 25 bp, Rattus norvegicus
tccaatcccagccatgtgacaagta

SEQ ID NO: 582184 - DNA, 25 bp, Rattus norvegicus
tccaatcccagcgatgtgacaagta

SEQ ID NO: 582185 - DNA, 25 bp, Rattus norvegicus
tccaatcccattcctcttcaagaaa

SEQ ID NO: 582186 - DNA, 25 bp, Rattus norvegicus
tccaatcccattgctcttcaagaaa

SEQ ID NO: 582187 - DNA, 25 bp, Rattus norvegicus
tccaatccccatcctttatggtaca

SEQ ID NO: 582188 - DNA, 25 bp, Rattus norvegicus
tccaatccccatgctttatggtaca

SEQ ID NO: 582189 - DNA, 25 bp, Rattus norvegicus
tccaatcctgatctttctgtccaaa

SEQ ID NO: 582190 - DNA, 25 bp, Rattus norvegicus
tccaatcctgatgtttctgtccaaa

SEQ ID NO: 582191 - DNA, 25 bp, Rattus norvegicus
tccaatccttagcattcagcacatt

SEQ ID NO: 582192 - DNA, 25 bp, Rattus norvegicus
tccaatccttaggattcagcacatt

SEQ ID NO: 582193 - DNA, 25 bp, Rattus norvegicus
tccaatcctttgacttcttttcctt

SEQ ID NO: 582194 - DNA, 25 bp, Rattus norvegicus
tccaatcctttgtcttcttttcctt

SEQ ID NO: 582195 - DNA, 25 bp, Rattus norvegicus
tccaatcgtgcaagagctttcctga

SEQ ID NO: 582196 - DNA, 25 bp, Rattus norvegicus
tccaatcgtgcatgagctttcctga

SEQ ID NO: 582197 - DNA, 25 bp, Rattus norvegicus
tccaatgcaactcggcgtgactctt

SEQ ID NO: 582198 - DNA, 25 bp, Rattus norvegicus
tccaatgcaactgggcgtgactctt

SEQ ID NO: 582199 - DNA, 25 bp, Rattus norvegicus
tccaatgcatgtatgttctctatcc

SEQ ID NO: 582200 - DNA, 25 bp, Rattus norvegicus
tccaatgcatgtttgttctctatcc

SEQ ID NO: 582201 - DNA, 25 bp, Rattus norvegicus
tccaatgccaccacagtggcaagag

SEQ ID NO: 582202 - DNA, 25 bp, Rattus norvegicus
tccaatgccacctcagtggcaagag

SEQ ID NO: 582203 - DNA, 25 bp, Rattus norvegicus
tccaatgccgggacatctgctaaat

SEQ ID NO: 582204 - DNA, 25 bp, Rattus norvegicus
tccaatgccgggtcatctgctaaat

SEQ ID NO: 582205 - DNA, 25 bp, Rattus norvegicus
tccaatggaggcaggcgagtgtctc

SEQ ID NO: 582206 - DNA, 25 bp, Rattus norvegicus
tccaatggaggctggcgagtgtctc

SEQ ID NO: 582207 - DNA, 25 bp, Rattus norvegicus
tccaatggccatctttctgtacaga

SEQ ID NO: 582208 - DNA, 25 bp, Rattus norvegicus
tccaatggccatgtttctgtacaga

SEQ ID NO: 582209 - DNA, 25 bp, Rattus norvegicus
tccaatgtcagtagggattccccac

SEQ ID NO: 582210 - DNA, 25 bp, Rattus norvegicus
tccaatgtcagttgggattccccac

SEQ ID NO: 582211 - DNA, 25 bp, Rattus norvegicus
tccaatgtgaacactcgcctgagag

SEQ ID NO: 582212 - DNA, 25 bp, Rattus norvegicus
tccaatgtgaactctcgcctgagag

SEQ ID NO: 582213 - DNA, 25 bp, Rattus norvegicus
tccaatgtgggcaccgttgatatgg

SEQ ID NO: 582214 - DNA, 25 bp, Rattus norvegicus
tccaatgtgggctccgttgatatgg

SEQ ID NO: 582215 - DNA, 25 bp, Rattus norvegicus
tccaatgtttctactgggcagtttg

SEQ ID NO: 582216 - DNA, 25 bp, Rattus norvegicus
tccaatgtttcttctgggcagtttg

SEQ ID NO: 582217 - DNA, 25 bp, Rattus norvegicus
tccaattacattaaccttcctgcaa

SEQ ID NO: 582218 - DNA, 25 bp, Rattus norvegicus
tccaattacatttaccttcctgcaa

SEQ ID NO: 582219 - DNA, 25 bp, Rattus norvegicus
tccaattagtacattttgtaaactg

SEQ ID NO: 582220 - DNA, 25 bp, Rattus norvegicus
tccaattagtactttttgtaaactg

SEQ ID NO: 582221 - DNA, 25 bp, Rattus norvegicus
tccaattctggacctttctaaaact

SEQ ID NO: 582222 - DNA, 25 bp, Rattus norvegicus
tccaattctggagctttctaaaact

SEQ ID NO: 582223 - DNA, 25 bp, Rattus norvegicus
tccaattgtgttctctctggccaaa

SEQ ID NO: 582224 - DNA, 25 bp, Rattus norvegicus
tccaattgtgttgtctctggccaaa

SEQ ID NO: 582225 - DNA, 25 bp, Rattus norvegicus
tccacaaaggctcttttatttttca

SEQ ID NO: 582226 - DNA, 25 bp, Rattus norvegicus
tccacaaaggctgttttatttttca

SEQ ID NO: 582227 - DNA, 25 bp, Rattus norvegicus
tccacaactccaaacagaccgaatg

SEQ ID NO: 582228 - DNA, 25 bp, Rattus norvegicus
tccacaactccatacagaccgaatg

SEQ ID NO: 582229 - DNA, 25 bp, Rattus norvegicus
tccacaactgtaactgccctaataa

SEQ ID NO: 582230 - DNA, 25 bp, Rattus norvegicus
tccacaactgtatctgccctaataa

SEQ ID NO: 582231 - DNA, 25 bp, Rattus norvegicus
tccacaagcaagagttatgatcata

SEQ ID NO: 582232 - DNA, 25 bp, Rattus norvegicus
tccacaagcaagtgttatgatcata

SEQ ID NO: 582233 - DNA, 25 bp, Rattus norvegicus
tccacaaggctgacttcacactggg

SEQ ID NO: 582234 - DNA, 25 bp, Rattus norvegicus
tccacaaggctgtcttcacactggg

SEQ ID NO: 582235 - DNA, 25 bp, Rattus norvegicus
tccacaagtgctcctgctcagcttt

SEQ ID NO: 582236 - DNA, 25 bp, Rattus norvegicus
tccacaagtgctgctgctcagcttt

SEQ ID NO: 582237 - DNA, 25 bp, Rattus norvegicus
tccacaagttctcgttcttcagcgc

SEQ ID NO: 582238 - DNA, 25 bp, Rattus norvegicus
tccacaagttctggttcttcagcgc

SEQ ID NO: 582239 - DNA, 25 bp, Rattus norvegicus
tccacaatatacagtttccctaggg

SEQ ID NO: 582240 - DNA, 25 bp, Rattus norvegicus
tccacaatatactgtttccctaggg

SEQ ID NO: 582241 - DNA, 25 bp, Rattus norvegicus
tccacaatctgtcagttagccattt

SEQ ID NO: 582242 - DNA, 25 bp, Rattus norvegicus
tccacaatctgtctttcctgggttg

SEQ ID NO: 582243 - DNA, 25 bp, Rattus norvegicus
tccacaatctgtgagttagccattt

SEQ ID NO: 582244 - DNA, 25 bp, Rattus norvegicus
tccacaatctgtgtttcctgggttg

SEQ ID NO: 582245 - DNA, 25 bp, Rattus norvegicus
tccacaatgctgcttaacgctgttt

SEQ ID NO: 582246 - DNA, 25 bp, Rattus norvegicus
tccacaatgctggttaacgctgttt

SEQ ID NO: 582247 - DNA, 25 bp, Rattus norvegicus
tccacacacaaccaagatgatcttt

SEQ ID NO: 582248 - DNA, 25 bp, Rattus norvegicus
tccacacacaacgaagatgatcttt

SEQ ID NO: 582249 - DNA, 25 bp, Rattus norvegicus
tccacacacacaccttgggtgggag

SEQ ID NO: 582250 - DNA, 25 bp, Rattus norvegicus
tccacacacacagcttgggtgggag

SEQ ID NO: 582251 - DNA, 25 bp, Rattus norvegicus
tccacacacattcaggtggcatgct

SEQ ID NO: 582252 - DNA, 25 bp, Rattus norvegicus
tccacacacattgaggtggcatgct

SEQ ID NO: 582253 - DNA, 25 bp, Rattus norvegicus
tccacacaccctacctgaaggaaag

SEQ ID NO: 582254 - DNA, 25 bp, Rattus norvegicus
tccacacacccttcctgaaggaaag

SEQ ID NO: 582255 - DNA, 25 bp, Rattus norvegicus
tccacacagaaaagtctcatccttg

SEQ ID NO: 582256 - DNA, 25 bp, Rattus norvegicus
tccacacagaaatgtctcatccttg

SEQ ID NO: 582257 - DNA, 25 bp, Rattus norvegicus
tccacacagtcacacggtttttagc

SEQ ID NO: 582258 - DNA, 25 bp, Rattus norvegicus
tccacacagtcagacggtttttagc

SEQ ID NO: 582259 - DNA, 25 bp, Rattus norvegicus
tccacaccaggaaaatgacagcaga

SEQ ID NO: 582260 - DNA, 25 bp, Rattus norvegicus
tccacaccaggataatgacagcaga

SEQ ID NO: 582261 - DNA, 25 bp, Rattus norvegicus
tccacacccatgcatgcatacataa

SEQ ID NO: 582262 - DNA, 25 bp, Rattus norvegicus
tccacacccatggatgcatacataa

SEQ ID NO: 582263 - DNA, 25 bp, Rattus norvegicus
tccacaccccgtagtagacagtttg

SEQ ID NO: 582264 - DNA, 25 bp, Rattus norvegicus
tccacaccccgttgtagacagtttg

SEQ ID NO: 582265 - DNA, 25 bp, Rattus norvegicus
tccacaccggacagagaccctaaag

SEQ ID NO: 582266 - DNA, 25 bp, Rattus norvegicus
tccacaccggactgagaccctaaag

SEQ ID NO: 582267 - DNA, 25 bp, Rattus norvegicus
tccacaccgtcccatgaggagagaa

SEQ ID NO: 582268 - DNA, 25 bp, Rattus norvegicus
tccacaccgtccgatgaggagagaa

SEQ ID NO: 582269 - DNA, 25 bp, Rattus norvegicus
tccacacctgccagagagttgcaaa

SEQ ID NO: 582270 - DNA, 25 bp, Rattus norvegicus
tccacacctgcctgagagttgcaaa

SEQ ID NO: 582271 - DNA, 25 bp, Rattus norvegicus
tccacacctgctctgcttaggacag

SEQ ID NO: 582272 - DNA, 25 bp, Rattus norvegicus
tccacacctgctgtgcttaggacag

SEQ ID NO: 582273 - DNA, 25 bp, Rattus norvegicus
tccacaccttgaatcatgaagcaaa

SEQ ID NO: 582274 - DNA, 25 bp, Rattus norvegicus
tccacaccttgattcatgaagcaaa

SEQ ID NO: 582275 - DNA, 25 bp, Rattus norvegicus
tccacaccttgcacttttctctgtt

SEQ ID NO: 582276 - DNA, 25 bp, Rattus norvegicus
tccacaccttgctcttttctctgtt

SEQ ID NO: 582277 - DNA, 25 bp, Rattus norvegicus
tccacacgccacacaatatagctat

SEQ ID NO: 582278 - DNA, 25 bp, Rattus norvegicus
tccacacgccactcaatatagctat

SEQ ID NO: 582279 - DNA, 25 bp, Rattus norvegicus
tccacactacgcagatccagataaa

SEQ ID NO: 582280 - DNA, 25 bp, Rattus norvegicus
tccacactacgctgatccagataaa

SEQ ID NO: 582281 - DNA, 25 bp, Rattus norvegicus
tccacactcaggctcatctgataag

SEQ ID NO: 582282 - DNA, 25 bp, Rattus norvegicus
tccacactcagggtcatctgataag

SEQ ID NO: 582283 - DNA, 25 bp, Rattus norvegicus
tccacactgacgcttttagactttg

SEQ ID NO: 582284 - DNA, 25 bp, Rattus norvegicus
tccacactgacggttttagactttg

SEQ ID NO: 582285 - DNA, 25 bp, Rattus norvegicus
tccacactgtgtatcgtccattatg

SEQ ID NO: 582286 - DNA, 25 bp, Rattus norvegicus
tccacactgtgtttcgtccattatg

SEQ ID NO: 582287 - DNA, 25 bp, Rattus norvegicus
tccacagagaccagaggctccaaga

SEQ ID NO: 582288 - DNA, 25 bp, Rattus norvegicus
tccacagagacctgaggctccaaga

SEQ ID NO: 582289 - DNA, 25 bp, Rattus norvegicus
tccacagatgagagcttctttttaa

SEQ ID NO: 582290 - DNA, 25 bp, Rattus norvegicus
tccacagatgagtgcttctttttaa

SEQ ID NO: 582291 - DNA, 25 bp, Rattus norvegicus
tccacagatgccacaagtgtcgaag

SEQ ID NO: 582292 - DNA, 25 bp, Rattus norvegicus
tccacagatgcctcaagtgtcgaag

SEQ ID NO: 582293 - DNA, 25 bp, Rattus norvegicus
tccacagccatgctgtctttctttt

SEQ ID NO: 582294 - DNA, 25 bp, Rattus norvegicus
tccacagccatggtgtctttctttt

SEQ ID NO: 582295 - DNA, 25 bp, Rattus norvegicus
tccacagccctgctgtagtgcagag

SEQ ID NO: 582296 - DNA, 25 bp, Rattus norvegicus
tccacagccctggtgtagtgcagag

SEQ ID NO: 582297 - DNA, 25 bp, Rattus norvegicus
tccacagcggctaggagttgacttc

SEQ ID NO: 582298 - DNA, 25 bp, Rattus norvegicus
tccacagcggcttggagttgacttc

SEQ ID NO: 582299 - DNA, 25 bp, Rattus norvegicus
tccacagcttgactgtcccgagggc

SEQ ID NO: 582300 - DNA, 25 bp, Rattus norvegicus
tccacagcttgagtgtcccgagggc

SEQ ID NO: 582301 - DNA, 25 bp, Rattus norvegicus
tccacaggagtcacggaggactgta

SEQ ID NO: 582302 - DNA, 25 bp, Rattus norvegicus
tccacaggagtctcggaggactgta

SEQ ID NO: 582303 - DNA, 25 bp, Rattus norvegicus
tccacaggcaccaggagtaggcata

SEQ ID NO: 582304 - DNA, 25 bp, Rattus norvegicus
tccacaggcacctggagtaggcata

SEQ ID NO: 582305 - DNA, 25 bp, Rattus norvegicus
tccacaggcccaaatgaatgtacat

SEQ ID NO: 582306 - DNA, 25 bp, Rattus norvegicus
tccacaggcccatatgaatgtacat

SEQ ID NO: 582307 - DNA, 25 bp, Rattus norvegicus
tccacaggctgtctcatgaatgctc

SEQ ID NO: 582308 - DNA, 25 bp, Rattus norvegicus
tccacaggctgtgtcatgaatgctc

SEQ ID NO: 582309 - DNA, 25 bp, Rattus norvegicus
tccacagggctacggagcctggtta

SEQ ID NO: 582310 - DNA, 25 bp, Rattus norvegicus
tccacagggctagggagcctggtta

SEQ ID NO: 582311 - DNA, 25 bp, Rattus norvegicus
tccacagggtgtattctcagggcgt

SEQ ID NO: 582312 - DNA, 25 bp, Rattus norvegicus
tccacagggtgttttctcagggcgt

SEQ ID NO: 582313 - DNA, 25 bp, Rattus norvegicus
tccacaggtcttcacgagagtttta

SEQ ID NO: 582314 - DNA, 25 bp, Rattus norvegicus
tccacaggtcttgacgagagtttta

SEQ ID NO: 582315 - DNA, 25 bp, Rattus norvegicus
tccacagtacacacaggagagaatg

SEQ ID NO: 582316 - DNA, 25 bp, Rattus norvegicus
tccacagtacactcaggagagaatg

SEQ ID NO: 582317 - DNA, 25 bp, Rattus norvegicus
tccacagtcctaactcctgggagtg

SEQ ID NO: 582318 - DNA, 25 bp, Rattus norvegicus
tccacagtcctatctcctgggagtg

SEQ ID NO: 582319 - DNA, 25 bp, Rattus norvegicus
tccacagtgaggctttcttcctgct

SEQ ID NO: 582320 - DNA, 25 bp, Rattus norvegicus
tccacagtgagggtttcttcctgct

SEQ ID NO: 582321 - DNA, 25 bp, Rattus norvegicus
tccacagtgcaaacttctcttctac

SEQ ID NO: 582322 - DNA, 25 bp, Rattus norvegicus
tccacagtgcaatcttctcttctac

SEQ ID NO: 582323 - DNA, 25 bp, Rattus norvegicus
tccacagtgcaccttcattttatca

SEQ ID NO: 582324 - DNA, 25 bp, Rattus norvegicus
tccacagtgcacgttcattttatca

SEQ ID NO: 582325 - DNA, 25 bp, Rattus norvegicus
tccacagtgtgtcatccaggacctg

SEQ ID NO: 582326 - DNA, 25 bp, Rattus norvegicus
tccacagtgtgtgatccaggacctg

SEQ ID NO: 582327 - DNA, 25 bp, Rattus norvegicus
tccacataactgagtccccaaagac

SEQ ID NO: 582328 - DNA, 25 bp, Rattus norvegicus
tccacataactgtgtccccaaagac

SEQ ID NO: 582329 - DNA, 25 bp, Rattus norvegicus
tccacatacctcacacaactttgtg

SEQ ID NO: 582330 - DNA, 25 bp, Rattus norvegicus
tccacatacctctcacaactttgtg

SEQ ID NO: 582331 - DNA, 25 bp, Rattus norvegicus
tccacatcacgcatcttttgagaat

SEQ ID NO: 582332 - DNA, 25 bp, Rattus norvegicus
tccacatcacgcttcttttgagaat

SEQ ID NO: 582333 - DNA, 25 bp, Rattus norvegicus
tccacatcagttcgcctggtattgg

SEQ ID NO: 582334 - DNA, 25 bp, Rattus norvegicus
tccacatcagttggcctggtattgg

SEQ ID NO: 582335 - DNA, 25 bp, Rattus norvegicus
tccacatcccagactcggattgatg

SEQ ID NO: 582336 - DNA, 25 bp, Rattus norvegicus
tccacatcccagtctcggattgatg

SEQ ID NO: 582337 - DNA, 25 bp, Rattus norvegicus
tccacatcctcaaatgattcctcat

SEQ ID NO: 582338 - DNA, 25 bp, Rattus norvegicus
tccacatcctcatatgattcctcat

SEQ ID NO: 582339 - DNA, 25 bp, Rattus norvegicus
tccacatcctggacctctaagcaat

SEQ ID NO: 582340 - DNA, 25 bp, Rattus norvegicus
tccacatcctggtcctctaagcaat

SEQ ID NO: 582341 - DNA, 25 bp, Rattus norvegicus
tccacatctgcacaggctgggtcca

SEQ ID NO: 582342 - DNA, 25 bp, Rattus norvegicus
tccacatctgcagaggctgggtcca

SEQ ID NO: 582343 - DNA, 25 bp, Rattus norvegicus
tccacatgctagaatatcggtctca

SEQ ID NO: 582344 - DNA, 25 bp, Rattus norvegicus
tccacatgctagagcgtggcagctg

SEQ ID NO: 582345 - DNA, 25 bp, Rattus norvegicus
tccacatgctagtatatcggtctca

SEQ ID NO: 582346 - DNA, 25 bp, Rattus norvegicus
tccacatgctagtgcgtggcagctg

SEQ ID NO: 582347 - DNA, 25 bp, Rattus norvegicus
tccacatgctgacggtaagacttga

SEQ ID NO: 582348 - DNA, 25 bp, Rattus norvegicus
tccacatgctgagggtaagacttga

SEQ ID NO: 582349 - DNA, 25 bp, Rattus norvegicus
tccacatgggccctggaatcagtgt

SEQ ID NO: 582350 - DNA, 25 bp, Rattus norvegicus
tccacatgggccgtggaatcagtgt

SEQ ID NO: 582351 - DNA, 25 bp, Rattus norvegicus
tccacatgtgcactgaggctcgtgt

SEQ ID NO: 582352 - DNA, 25 bp, Rattus norvegicus
tccacatgtgcagtgaggctcgtgt

SEQ ID NO: 582353 - DNA, 25 bp, Rattus norvegicus
tccacattatcgactcaagccaaag

SEQ ID NO: 582354 - DNA, 25 bp, Rattus norvegicus
tccacattatcgtctcaagccaaag

SEQ ID NO: 582355 - DNA, 25 bp, Rattus norvegicus
tccacattcactcacattgctgagc

SEQ ID NO: 582356 - DNA, 25 bp, Rattus norvegicus
tccacattcactgacattgctgagc

SEQ ID NO: 582357 - DNA, 25 bp, Rattus norvegicus
tccacatttgaccttccttcttgtt

SEQ ID NO: 582358 - DNA, 25 bp, Rattus norvegicus
tccacatttgacgttccttcttgtt

SEQ ID NO: 582359 - DNA, 25 bp, Rattus norvegicus
tccacatttggaaggccctgactga

SEQ ID NO: 582360 - DNA, 25 bp, Rattus norvegicus
tccacatttggatggccctgactga

SEQ ID NO: 582361 - DNA, 25 bp, Rattus norvegicus
tccacattttaaactgagccttgca

SEQ ID NO: 582362 - DNA, 25 bp, Rattus norvegicus
tccacattttaatctgagccttgca

SEQ ID NO: 582363 - DNA, 25 bp, Rattus norvegicus
tccacatttttacgcagagaagtat

SEQ ID NO: 582364 - DNA, 25 bp, Rattus norvegicus
tccacatttttaggcagagaagtat

SEQ ID NO: 582365 - DNA, 25 bp, Rattus norvegicus
tccaccaaccatcttcttcagaaga

SEQ ID NO: 582366 - DNA, 25 bp, Rattus norvegicus
tccaccaaccatgttcttcagaaga

SEQ ID NO: 582367 - DNA, 25 bp, Rattus norvegicus
tccaccaaggctactgtggctattt

SEQ ID NO: 582368 - DNA, 25 bp, Rattus norvegicus
tccaccaaggcttctgtggctattt

SEQ ID NO: 582369 - DNA, 25 bp, Rattus norvegicus
tccaccacagagagctaatgccatt

SEQ ID NO: 582370 - DNA, 25 bp, Rattus norvegicus
tccaccacagagtgctaatgccatt

SEQ ID NO: 582371 - DNA, 25 bp, Rattus norvegicus
tccaccaccacaagagttctgtaac

SEQ ID NO: 582372 - DNA, 25 bp, Rattus norvegicus
tccaccaccacatgagttctgtaac

SEQ ID NO: 582373 - DNA, 25 bp, Rattus norvegicus
tccaccacggtgataaccagctgaa

SEQ ID NO: 582374 - DNA, 25 bp, Rattus norvegicus
tccaccacggtgttaaccagctgaa

SEQ ID NO: 582375 - DNA, 25 bp, Rattus norvegicus
tccaccacgtctcactcattgttat

SEQ ID NO: 582376 - DNA, 25 bp, Rattus norvegicus
tccaccacgtctgactcattgttat

SEQ ID NO: 582377 - DNA, 25 bp, Rattus norvegicus
tccaccactaagatgcctgcatttg

SEQ ID NO: 582378 - DNA, 25 bp, Rattus norvegicus
tccaccactaagttgcctgcatttg

SEQ ID NO: 582379 - DNA, 25 bp, Rattus norvegicus
tccaccacttctatgccactgaaga

SEQ ID NO: 582380 - DNA, 25 bp, Rattus norvegicus
tccaccacttctttgccactgaaga

SEQ ID NO: 582381 - DNA, 25 bp, Rattus norvegicus
tccaccacttggcaaacctactgtg

SEQ ID NO: 582382 - DNA, 25 bp, Rattus norvegicus
tccaccacttgggaaacctactgtg

SEQ ID NO: 582383 - DNA, 25 bp, Rattus norvegicus
tccaccaggccactgattcactgta

SEQ ID NO: 582384 - DNA, 25 bp, Rattus norvegicus
tccaccaggccagtgattcactgta

SEQ ID NO: 582385 - DNA, 25 bp, Rattus norvegicus
tccaccaggttgaaggcccagtctt

SEQ ID NO: 582386 - DNA, 25 bp, Rattus norvegicus
tccaccaggttgtaggcccagtctt

SEQ ID NO: 582387 - DNA, 25 bp, Rattus norvegicus
tccaccagtgccattcgaagagaga

SEQ ID NO: 582388 - DNA, 25 bp, Rattus norvegicus
tccaccagtgcctttcgaagagaga

SEQ ID NO: 582389 - DNA, 25 bp, Rattus norvegicus
tccaccagtttcctgatcctgagta

SEQ ID NO: 582390 - DNA, 25 bp, Rattus norvegicus
tccaccagtttcgtgatcctgagta

SEQ ID NO: 582391 - DNA, 25 bp, Rattus norvegicus
tccaccatcaagctggaggccctgg

SEQ ID NO: 582392 - DNA, 25 bp, Rattus norvegicus
tccaccatcaaggtggaggccctgg

SEQ ID NO: 582393 - DNA, 25 bp, Rattus norvegicus
tccaccatcctaagagcagagctgt

SEQ ID NO: 582394 - DNA, 25 bp, Rattus norvegicus
tccaccatcctatgagcagagctgt

SEQ ID NO: 582395 - DNA, 25 bp, Rattus norvegicus
tccaccatgggacagctcgagacct

SEQ ID NO: 582396 - DNA, 25 bp, Rattus norvegicus
tccaccatgggagagctcgagacct

SEQ ID NO: 582397 - DNA, 25 bp, Rattus norvegicus
tccaccatgtgcctcccaaagatgg

SEQ ID NO: 582398 - DNA, 25 bp, Rattus norvegicus
tccaccatgtgcgtcccaaagatgg

SEQ ID NO: 582399 - DNA, 25 bp, Rattus norvegicus
tccaccatgtttaatgctccttgtt

SEQ ID NO: 582400 - DNA, 25 bp, Rattus norvegicus
tccaccatgttttatgctccttgtt

SEQ ID NO: 582401 - DNA, 25 bp, Rattus norvegicus
tccacccaccagcttgttgcatttg

SEQ ID NO: 582402 - DNA, 25 bp, Rattus norvegicus
tccacccaccaggttgttgcatttg

SEQ ID NO: 582403 - DNA, 25 bp, Rattus norvegicus
tccacccaccggcttttgcctttgg

SEQ ID NO: 582404 - DNA, 25 bp, Rattus norvegicus
tccacccaccgggttttgcctttgg

SEQ ID NO: 582405 - DNA, 25 bp, Rattus norvegicus
tccacccacggtctgttttagactt

SEQ ID NO: 582406 - DNA, 25 bp, Rattus norvegicus
tccacccacggtgtgttttagactt

SEQ ID NO: 582407 - DNA, 25 bp, Rattus norvegicus
tccacccagactcggttttaactgg

SEQ ID NO: 582408 - DNA, 25 bp, Rattus norvegicus
tccacccagactgggttttaactgg

SEQ ID NO: 582409 - DNA, 25 bp, Rattus norvegicus
tccacccagaggctcgtagtacgtg

SEQ ID NO: 582410 - DNA, 25 bp, Rattus norvegicus
tccacccagagggtcgtagtacgtg

SEQ ID NO: 582411 - DNA, 25 bp, Rattus norvegicus
tccacccagagtcagcactgtgaag

SEQ ID NO: 582412 - DNA, 25 bp, Rattus norvegicus
tccacccagagtgagcactgtgaag

SEQ ID NO: 582413 - DNA, 25 bp, Rattus norvegicus
tccacccagctgaggtaggtttgct

SEQ ID NO: 582414 - DNA, 25 bp, Rattus norvegicus
tccacccagctgtggtaggtttgct

SEQ ID NO: 582415 - DNA, 25 bp, Rattus norvegicus
tccacccagcttacctgttaagaaa

SEQ ID NO: 582416 - DNA, 25 bp, Rattus norvegicus
tccacccagctttcctgttaagaaa

SEQ ID NO: 582417 - DNA, 25 bp, Rattus norvegicus
tccacccaggacatacccagggaga

SEQ ID NO: 582418 - DNA, 25 bp, Rattus norvegicus
tccacccaggacttacccagggaga

SEQ ID NO: 582419 - DNA, 25 bp, Rattus norvegicus
tccacccagtgaaagtatcagaact

SEQ ID NO: 582420 - DNA, 25 bp, Rattus norvegicus
tccacccagtgatagtatcagaact

SEQ ID NO: 582421 - DNA, 25 bp, Rattus norvegicus
tccaccccagatagggccagatgat

SEQ ID NO: 582422 - DNA, 25 bp, Rattus norvegicus
tccaccccagattgggccagatgat

SEQ ID NO: 582423 - DNA, 25 bp, Rattus norvegicus
tccaccccagtcatagaacctgaga

SEQ ID NO: 582424 - DNA, 25 bp, Rattus norvegicus
tccaccccagtcttagaacctgaga

SEQ ID NO: 582425 - DNA, 25 bp, Rattus norvegicus
tccaccccatgtattcttcataaag

SEQ ID NO: 582426 - DNA, 25 bp, Rattus norvegicus
tccaccccatgttttcttcataaag

SEQ ID NO: 582427 - DNA, 25 bp, Rattus norvegicus
tccaccccatttatctgacagggtt

SEQ ID NO: 582428 - DNA, 25 bp, Rattus norvegicus
tccaccccatttttctgacagggtt

SEQ ID NO: 582429 - DNA, 25 bp, Rattus norvegicus
tccaccccgagccaaggtagggagt

SEQ ID NO: 582430 - DNA, 25 bp, Rattus norvegicus
tccaccccgagcgaaggtagggagt

SEQ ID NO: 582431 - DNA, 25 bp, Rattus norvegicus
tccacccgccttagttgacaagaga

SEQ ID NO: 582432 - DNA, 25 bp, Rattus norvegicus
tccacccgcctttgttgacaagaga

SEQ ID NO: 582433 - DNA, 25 bp, Rattus norvegicus
tccacccgtggccatgttttagtaa

SEQ ID NO: 582434 - DNA, 25 bp, Rattus norvegicus
tccacccgtggcgatgttttagtaa

SEQ ID NO: 582435 - DNA, 25 bp, Rattus norvegicus
tccaccctagttactctgagacatg

SEQ ID NO: 582436 - DNA, 25 bp, Rattus norvegicus
tccaccctagtttctctgagacatg

SEQ ID NO: 582437 - DNA, 25 bp, Rattus norvegicus
tccaccctgaggacgccgtgctgag

SEQ ID NO: 582438 - DNA, 25 bp, Rattus norvegicus
tccaccctgaggtcgccgtgctgag

SEQ ID NO: 582439 - DNA, 25 bp, Rattus norvegicus
tccaccctggaacattcaagagcaa

SEQ ID NO: 582440 - DNA, 25 bp, Rattus norvegicus
tccaccctggaagattcaagagcaa

SEQ ID NO: 582441 - DNA, 25 bp, Rattus norvegicus
tccaccctgggcacgaggacaagaa

SEQ ID NO: 582442 - DNA, 25 bp, Rattus norvegicus
tccaccctgggcagccaagattaag

SEQ ID NO: 582443 - DNA, 25 bp, Rattus norvegicus
tccaccctgggctcgaggacaagaa

SEQ ID NO: 582444 - DNA, 25 bp, Rattus norvegicus
tccaccctgggctgccaagattaag

SEQ ID NO: 582445 - DNA, 25 bp, Rattus norvegicus
tccaccctgtttctttttatcttag

SEQ ID NO: 582446 - DNA, 25 bp, Rattus norvegicus
tccaccctgtttgtttttatcttag

SEQ ID NO: 582447 - DNA, 25 bp, Rattus norvegicus
tccaccgagggcaggctgcggctgc

SEQ ID NO: 582448 - DNA, 25 bp, Rattus norvegicus
tccaccgagggctggctgcggctgc

SEQ ID NO: 582449 - DNA, 25 bp, Rattus norvegicus
tccaccgccagtcagggcagcagga

SEQ ID NO: 582450 - DNA, 25 bp, Rattus norvegicus
tccaccgccagtgagggcagcagga

SEQ ID NO: 582451 - DNA, 25 bp, Rattus norvegicus
tccaccgccgtcaggaaactacaaa

SEQ ID NO: 582452 - DNA, 25 bp, Rattus norvegicus
tccaccgccgtctggaaactacaaa

SEQ ID NO: 582453 - DNA, 25 bp, Rattus norvegicus
tccaccgcgaagacgacgaggtcgg

SEQ ID NO: 582454 - DNA, 25 bp, Rattus norvegicus
tccaccgcgaagtcgacgaggtcgg

SEQ ID NO: 582455 - DNA, 25 bp, Rattus norvegicus
tccaccgcggaaagatgagcgtttt

SEQ ID NO: 582456 - DNA, 25 bp, Rattus norvegicus
tccaccgcggaatgatgagcgtttt

SEQ ID NO: 582457 - DNA, 25 bp, Rattus norvegicus
tccaccgggtttcgcctgtaaggag

SEQ ID NO: 582458 - DNA, 25 bp, Rattus norvegicus
tccaccgggtttggcctgtaaggag

SEQ ID NO: 582459 - DNA, 25 bp, Rattus norvegicus
tccaccggtggccaacagtgtaagc

SEQ ID NO: 582460 - DNA, 25 bp, Rattus norvegicus
tccaccggtggcgaacagtgtaagc

SEQ ID NO: 582461 - DNA, 25 bp, Rattus norvegicus
tccaccgtgaacatagactctggcg

SEQ ID NO: 582462 - DNA, 25 bp, Rattus norvegicus
tccaccgtgaacttagactctggcg

SEQ ID NO: 582463 - DNA, 25 bp, Rattus norvegicus
tccaccgtgactaccgggcgaaagg

SEQ ID NO: 582464 - DNA, 25 bp, Rattus norvegicus
tccaccgtgacttccgggcgaaagg

SEQ ID NO: 582465 - DNA, 25 bp, Rattus norvegicus
tccaccgtgattccttgtctagagc

SEQ ID NO: 582466 - DNA, 25 bp, Rattus norvegicus
tccaccgtgattgcttgtctagagc

SEQ ID NO: 582467 - DNA, 25 bp, Rattus norvegicus
tccaccgtgcaccagggatcaaagt

SEQ ID NO: 582468 - DNA, 25 bp, Rattus norvegicus
tccaccgtgcacgagggatcaaagt

SEQ ID NO: 582469 - DNA, 25 bp, Rattus norvegicus
tccacctaatggactcatcttttaa

SEQ ID NO: 582470 - DNA, 25 bp, Rattus norvegicus
tccacctaatggtctcatcttttaa

SEQ ID NO: 582471 - DNA, 25 bp, Rattus norvegicus
tccacctacactcctgtttacattg

SEQ ID NO: 582472 - DNA, 25 bp, Rattus norvegicus
tccacctacactgctgtttacattg

SEQ ID NO: 582473 - DNA, 25 bp, Rattus norvegicus
tccacctacgggagtgtgtgtctgg

SEQ ID NO: 582474 - DNA, 25 bp, Rattus norvegicus
tccacctacgggtgtgtgtgtctgg

SEQ ID NO: 582475 - DNA, 25 bp, Rattus norvegicus
tccacctagggtcaaaactgtctaa

SEQ ID NO: 582476 - DNA, 25 bp, Rattus norvegicus
tccacctagggtgaaaactgtctaa

SEQ ID NO: 582477 - DNA, 25 bp, Rattus norvegicus
tccacctattaacttgtttcaagta

SEQ ID NO: 582478 - DNA, 25 bp, Rattus norvegicus
tccacctattaagttgtttcaagta

SEQ ID NO: 582479 - DNA, 25 bp, Rattus norvegicus
tccacctcactcatacggaaggttg

SEQ ID NO: 582480 - DNA, 25 bp, Rattus norvegicus
tccacctcactcttacggaaggttg

SEQ ID NO: 582481 - DNA, 25 bp, Rattus norvegicus
tccacctcactgaacagtaagccag

SEQ ID NO: 582482 - DNA, 25 bp, Rattus norvegicus
tccacctcactgtacagtaagccag

SEQ ID NO: 582483 - DNA, 25 bp, Rattus norvegicus
tccacctcagggacctgggaaaaca

SEQ ID NO: 582484 - DNA, 25 bp, Rattus norvegicus
tccacctcagggtcctgggaaaaca

SEQ ID NO: 582485 - DNA, 25 bp, Rattus norvegicus
tccacctcaggtactacacagttta

SEQ ID NO: 582486 - DNA, 25 bp, Rattus norvegicus
tccacctcaggttctacacagttta

SEQ ID NO: 582487 - DNA, 25 bp, Rattus norvegicus
tccacctcagttatctgtcatctag

SEQ ID NO: 582488 - DNA, 25 bp, Rattus norvegicus
tccacctcagttttctgtcatctag

SEQ ID NO: 582489 - DNA, 25 bp, Rattus norvegicus
tccacctcattccagtgacttatgg

SEQ ID NO: 582490 - DNA, 25 bp, Rattus norvegicus
tccacctcattcgagtgacttatgg

SEQ ID NO: 582491 - DNA, 25 bp, Rattus norvegicus
tccacctccaggctgagcatgtaaa

SEQ ID NO: 582492 - DNA, 25 bp, Rattus norvegicus
tccacctccagggtgagcatgtaaa

SEQ ID NO: 582493 - DNA, 25 bp, Rattus norvegicus
tccacctccctcattttgaatagtt

SEQ ID NO: 582494 - DNA, 25 bp, Rattus norvegicus
tccacctccctctttttgaatagtt

SEQ ID NO: 582495 - DNA, 25 bp, Rattus norvegicus
tccacctcctggctagctaacagaa

SEQ ID NO: 582496 - DNA, 25 bp, Rattus norvegicus
tccacctcctgggtagctaacagaa

SEQ ID NO: 582497 - DNA, 25 bp, Rattus norvegicus
tccacctcggccaggtacagggcta

SEQ ID NO: 582498 - DNA, 25 bp, Rattus norvegicus
tccacctcggcctggtacagggcta

SEQ ID NO: 582499 - DNA, 25 bp, Rattus norvegicus
tccacctcgtatacatcatcaattt

SEQ ID NO: 582500 - DNA, 25 bp, Rattus norvegicus
tccacctcgtattcatcatcaattt

SEQ ID NO: 582501 - DNA, 25 bp, Rattus norvegicus
tccacctctgcaaattcttttcatt

SEQ ID NO: 582502 - DNA, 25 bp, Rattus norvegicus
tccacctctgcatattcttttcatt

SEQ ID NO: 582503 - DNA, 25 bp, Rattus norvegicus
tccacctggctgaattgctttttaa

SEQ ID NO: 582504 - DNA, 25 bp, Rattus norvegicus
tccacctggctgtattgctttttaa

SEQ ID NO: 582505 - DNA, 25 bp, Rattus norvegicus
tccacctggttgaacttgttgcgag

SEQ ID NO: 582506 - DNA, 25 bp, Rattus norvegicus
tccacctggttgtacttgttgcgag

SEQ ID NO: 582507 - DNA, 25 bp, Rattus norvegicus
tccacctgtcacatggttgaaacca

SEQ ID NO: 582508 - DNA, 25 bp, Rattus norvegicus
tccacctgtcacttggttgaaacca

SEQ ID NO: 582509 - DNA, 25 bp, Rattus norvegicus
tccacctgtcctcacgatgaagaga

SEQ ID NO: 582510 - DNA, 25 bp, Rattus norvegicus
tccacctgtcctgacgatgaagaga

SEQ ID NO: 582511 - DNA, 25 bp, Rattus norvegicus
tccaccttagtcacgggtcaatagc

SEQ ID NO: 582512 - DNA, 25 bp, Rattus norvegicus
tccaccttagtctcgggtcaatagc

SEQ ID NO: 582513 - DNA, 25 bp, Rattus norvegicus
tccaccttatatcaggagcaccact

SEQ ID NO: 582514 - DNA, 25 bp, Rattus norvegicus
tccaccttatatgaggagcaccact

SEQ ID NO: 582515 - DNA, 25 bp, Rattus norvegicus
tccaccttatggcttgcaactcttt

SEQ ID NO: 582516 - DNA, 25 bp, Rattus norvegicus
tccaccttatgggttgcaactcttt

SEQ ID NO: 582517 - DNA, 25 bp, Rattus norvegicus
tccaccttccctatgtttcattgtg

SEQ ID NO: 582518 - DNA, 25 bp, Rattus norvegicus
tccaccttccctttgtttcattgtg

SEQ ID NO: 582519 - DNA, 25 bp, Rattus norvegicus
tccaccttgcacatgttgcacatag

SEQ ID NO: 582520 - DNA, 25 bp, Rattus norvegicus
tccaccttgcacttgttgcacatag

SEQ ID NO: 582521 - DNA, 25 bp, Rattus norvegicus
tccaccttgcttagaatctcagact

SEQ ID NO: 582522 - DNA, 25 bp, Rattus norvegicus
tccaccttgctttgaatctcagact

SEQ ID NO: 582523 - DNA, 25 bp, Rattus norvegicus
tccaccttgtacaagtgttgccatg

SEQ ID NO: 582524 - DNA, 25 bp, Rattus norvegicus
tccaccttgtactagtgttgccatg

SEQ ID NO: 582525 - DNA, 25 bp, Rattus norvegicus
tccaccttgtgtacgctcagaaaaa

SEQ ID NO: 582526 - DNA, 25 bp, Rattus norvegicus
tccaccttgtgttcgctcagaaaaa

SEQ ID NO: 582527 - DNA, 25 bp, Rattus norvegicus
tccacctttagccttttgtgtacca

SEQ ID NO: 582528 - DNA, 25 bp, Rattus norvegicus
tccacctttagcgttttgtgtacca

SEQ ID NO: 582529 - DNA, 25 bp, Rattus norvegicus
tccacgaaaccacctataacagcat

SEQ ID NO: 582530 - DNA, 25 bp, Rattus norvegicus
tccacgaaaccagctataacagcat

SEQ ID NO: 582531 - DNA, 25 bp, Rattus norvegicus
tccacgacgaacattgcgctttcaa

SEQ ID NO: 582532 - DNA, 25 bp, Rattus norvegicus
tccacgacgaactttgcgctttcaa

SEQ ID NO: 582533 - DNA, 25 bp, Rattus norvegicus
tccacgacgttgcatcgcaggagat

SEQ ID NO: 582534 - DNA, 25 bp, Rattus norvegicus
tccacgacgttggatcgcaggagat

SEQ ID NO: 582535 - DNA, 25 bp, Rattus norvegicus
tccacgatcacaaacactctctgtt

SEQ ID NO: 582536 - DNA, 25 bp, Rattus norvegicus
tccacgatcacatacactctctgtt

SEQ ID NO: 582537 - DNA, 25 bp, Rattus norvegicus
tccacgatgcccatgtgattcatac

SEQ ID NO: 582538 - DNA, 25 bp, Rattus norvegicus
tccacgatgcccttgtgattcatac

SEQ ID NO: 582539 - DNA, 25 bp, Rattus norvegicus
tccacgccgtagactgcgaagcaga

SEQ ID NO: 582540 - DNA, 25 bp, Rattus norvegicus
tccacgccgtagtctgcgaagcaga

SEQ ID NO: 582541 - DNA, 25 bp, Rattus norvegicus
tccacgcgtgcgctgttccagggaa

SEQ ID NO: 582542 - DNA, 25 bp, Rattus norvegicus
tccacgcgtgcggtgttccagggaa

SEQ ID NO: 582543 - DNA, 25 bp, Rattus norvegicus
tccacgctatacacgcctgataagg

SEQ ID NO: 582544 - DNA, 25 bp, Rattus norvegicus
tccacgctatactcgcctgataagg

SEQ ID NO: 582545 - DNA, 25 bp, Rattus norvegicus
tccacgctctgtatcattcaggttt

SEQ ID NO: 582546 - DNA, 25 bp, Rattus norvegicus
tccacgctctgtttcattcaggttt

SEQ ID NO: 582547 - DNA, 25 bp, Rattus norvegicus
tccacggactccaggtaatgcagtt

SEQ ID NO: 582548 - DNA, 25 bp, Rattus norvegicus
tccacggactcctggtaatgcagtt

SEQ ID NO: 582549 - DNA, 25 bp, Rattus norvegicus
tccacggatggcagtgcttcctgaa

SEQ ID NO: 582550 - DNA, 25 bp, Rattus norvegicus
tccacggatggctgtgcttcctgaa

SEQ ID NO: 582551 - DNA, 25 bp, Rattus norvegicus
tccacggatgttcctgaccaaacca

SEQ ID NO: 582552 - DNA, 25 bp, Rattus norvegicus
tccacggatgttgctgaccaaacca

SEQ ID NO: 582553 - DNA, 25 bp, Rattus norvegicus
tccacggctaccattatttcatgag

SEQ ID NO: 582554 - DNA, 25 bp, Rattus norvegicus
tccacggctacctttatttcatgag

SEQ ID NO: 582555 - DNA, 25 bp, Rattus norvegicus
tccacgggctttaggcagtgtcgac

SEQ ID NO: 582556 - DNA, 25 bp, Rattus norvegicus
tccacgggcttttggcagtgtcgac

SEQ ID NO: 582557 - DNA, 25 bp, Rattus norvegicus
tccacgggtttccacatttattaat

SEQ ID NO: 582558 - DNA, 25 bp, Rattus norvegicus
tccacgggtttcgacatttattaat

SEQ ID NO: 582559 - DNA, 25 bp, Rattus norvegicus
tccacggtctttctgtgagcgttct

SEQ ID NO: 582560 - DNA, 25 bp, Rattus norvegicus
tccacggtctttgtgtgagcgttct

SEQ ID NO: 582561 - DNA, 25 bp, Rattus norvegicus
tccacggtgacacaggttccaagat

SEQ ID NO: 582562 - DNA, 25 bp, Rattus norvegicus
tccacggtgacagaggttccaagat

SEQ ID NO: 582563 - DNA, 25 bp, Rattus norvegicus
tccacgtaacgtccatttaacatgg

SEQ ID NO: 582564 - DNA, 25 bp, Rattus norvegicus
tccacgtaacgtgcatttaacatgg

SEQ ID NO: 582565 - DNA, 25 bp, Rattus norvegicus
tccacgtcatagacaagccacttgt

SEQ ID NO: 582566 - DNA, 25 bp, Rattus norvegicus
tccacgtcatagatggcagggccat

SEQ ID NO: 582567 - DNA, 25 bp, Rattus norvegicus
tccacgtcatagtcaagccacttgt

SEQ ID NO: 582568 - DNA, 25 bp, Rattus norvegicus
tccacgtcatagttggcagggccat

SEQ ID NO: 582569 - DNA, 25 bp, Rattus norvegicus
tccacgtccacgagtagacttcgga

SEQ ID NO: 582570 - DNA, 25 bp, Rattus norvegicus
tccacgtccacgtgtagacttcgga

SEQ ID NO: 582571 - DNA, 25 bp, Rattus norvegicus
tccacgtccagcactatcatgaaga

SEQ ID NO: 582572 - DNA, 25 bp, Rattus norvegicus
tccacgtccagctctatcatgaaga

SEQ ID NO: 582573 - DNA, 25 bp, Rattus norvegicus
tccacgtgtccccaaatcatgaaac

SEQ ID NO: 582574 - DNA, 25 bp, Rattus norvegicus
tccacgtgtcccgaaatcatgaaac

SEQ ID NO: 582575 - DNA, 25 bp, Rattus norvegicus
tccacgttcgctctgtgtcaacaaa

SEQ ID NO: 582576 - DNA, 25 bp, Rattus norvegicus
tccacgttcgctgtgtgtcaacaaa

SEQ ID NO: 582577 - DNA, 25 bp, Rattus norvegicus
tccacgttctggcttggctgtaaag

SEQ ID NO: 582578 - DNA, 25 bp, Rattus norvegicus
tccacgttctgggttggctgtaaag

SEQ ID NO: 582579 - DNA, 25 bp, Rattus norvegicus
tccacgttgggcagcacacaagtgt

SEQ ID NO: 582580 - DNA, 25 bp, Rattus norvegicus
tccacgttgggctgcacacaagtgt

SEQ ID NO: 582581 - DNA, 25 bp, Rattus norvegicus
tccactaagcaaaacacgggccctt

SEQ ID NO: 582582 - DNA, 25 bp, Rattus norvegicus
tccactaagcaatacacgggccctt

SEQ ID NO: 582583 - DNA, 25 bp, Rattus norvegicus
tccactaccctcaaagactgtttac

SEQ ID NO: 582584 - DNA, 25 bp, Rattus norvegicus
tccactaccctctaagactgtttac

SEQ ID NO: 582585 - DNA, 25 bp, Rattus norvegicus
tccactacctatcccattgagcagt

SEQ ID NO: 582586 - DNA, 25 bp, Rattus norvegicus
tccactacctatgccattgagcagt

SEQ ID NO: 582587 - DNA, 25 bp, Rattus norvegicus
tccactacctcgctcagattctgaa

SEQ ID NO: 582588 - DNA, 25 bp, Rattus norvegicus
tccactacctcggtcagattctgaa

SEQ ID NO: 582589 - DNA, 25 bp, Rattus norvegicus
tccactacttttcagggcatgccac

SEQ ID NO: 582590 - DNA, 25 bp, Rattus norvegicus
tccactacttttgagggcatgccac

SEQ ID NO: 582591 - DNA, 25 bp, Rattus norvegicus
tccactaggaccatggattccaaaa

SEQ ID NO: 582592 - DNA, 25 bp, Rattus norvegicus
tccactaggaccttggattccaaaa

SEQ ID NO: 582593 - DNA, 25 bp, Rattus norvegicus
tccactagtggcatgctcagtcagc

SEQ ID NO: 582594 - DNA, 25 bp, Rattus norvegicus
tccactagtggcttgctcagtcagc

SEQ ID NO: 582595 - DNA, 25 bp, Rattus norvegicus
tccactagttggactttgcctatgc

SEQ ID NO: 582596 - DNA, 25 bp, Rattus norvegicus
tccactagttggtctttgcctatgc

SEQ ID NO: 582597 - DNA, 25 bp, Rattus norvegicus
tccactatccccagcctaggtaaga

SEQ ID NO: 582598 - DNA, 25 bp, Rattus norvegicus
tccactatcccctgcctaggtaaga

SEQ ID NO: 582599 - DNA, 25 bp, Rattus norvegicus
tccactcacctcattagtatgtact

SEQ ID NO: 582600 - DNA, 25 bp, Rattus norvegicus
tccactcacctctttagtatgtact

SEQ ID NO: 582601 - DNA, 25 bp, Rattus norvegicus
tccactcatggacagaggcctctgg

SEQ ID NO: 582602 - DNA, 25 bp, Rattus norvegicus
tccactcatggagagaggcctctgg

SEQ ID NO: 582603 - DNA, 25 bp, Rattus norvegicus
tccactccagcccagagattggtgc

SEQ ID NO: 582604 - DNA, 25 bp, Rattus norvegicus
tccactccagccgagagattggtgc

SEQ ID NO: 582605 - DNA, 25 bp, Rattus norvegicus
tccactccctcgctggaagaacgtt

SEQ ID NO: 582606 - DNA, 25 bp, Rattus norvegicus
tccactccctcggtggaagaacgtt

SEQ ID NO: 582607 - DNA, 25 bp, Rattus norvegicus
tccactccgatcctcaggaaatagt

SEQ ID NO: 582608 - DNA, 25 bp, Rattus norvegicus
tccactccgatcgtcaggaaatagt

SEQ ID NO: 582609 - DNA, 25 bp, Rattus norvegicus
tccactccgttgcaatgttattctg

SEQ ID NO: 582610 - DNA, 25 bp, Rattus norvegicus
tccactccgttggaatgttattctg

SEQ ID NO: 582611 - DNA, 25 bp, Rattus norvegicus
tccactccttccagaacgacaatta

SEQ ID NO: 582612 - DNA, 25 bp, Rattus norvegicus
tccactccttcctgaacgacaatta

SEQ ID NO: 582613 - DNA, 25 bp, Rattus norvegicus
tccactccttggatattcctcgtat

SEQ ID NO: 582614 - DNA, 25 bp, Rattus norvegicus
tccactccttggttattcctcgtat

SEQ ID NO: 582615 - DNA, 25 bp, Rattus norvegicus
tccactcctttcatcttgtcagtga

SEQ ID NO: 582616 - DNA, 25 bp, Rattus norvegicus
tccactcctttcttcttgtcagtga

SEQ ID NO: 582617 - DNA, 25 bp, Rattus norvegicus
tccactctagccaaggtgtcagttg

SEQ ID NO: 582618 - DNA, 25 bp, Rattus norvegicus
tccactctagcctaggtgtcagttg

SEQ ID NO: 582619 - DNA, 25 bp, Rattus norvegicus
tccactctcaggagatctgtgctga

SEQ ID NO: 582620 - DNA, 25 bp, Rattus norvegicus
tccactctcaggtgatctgtgctga

SEQ ID NO: 582621 - DNA, 25 bp, Rattus norvegicus
tccactctcctacgtcttgactaaa

SEQ ID NO: 582622 - DNA, 25 bp, Rattus norvegicus
tccactctcctaggtcttgactaaa

SEQ ID NO: 582623 - DNA, 25 bp, Rattus norvegicus
tccactctctagatccagtactatg

SEQ ID NO: 582624 - DNA, 25 bp, Rattus norvegicus
tccactctctagttccagtactatg

SEQ ID NO: 582625 - DNA, 25 bp, Rattus norvegicus
tccactctcttcattgaagcttttg

SEQ ID NO: 582626 - DNA, 25 bp, Rattus norvegicus
tccactctcttctttgaagcttttg

SEQ ID NO: 582627 - DNA, 25 bp, Rattus norvegicus
tccactctgagtattgctttctgta

SEQ ID NO: 582628 - DNA, 25 bp, Rattus norvegicus
tccactctgagtcggaacccagact

SEQ ID NO: 582629 - DNA, 25 bp, Rattus norvegicus
tccactctgagtgggaacccagact

SEQ ID NO: 582630 - DNA, 25 bp, Rattus norvegicus
tccactctgagttttgctttctgta

SEQ ID NO: 582631 - DNA, 25 bp, Rattus norvegicus
tccactctgccgattagcaggaatt

SEQ ID NO: 582632 - DNA, 25 bp, Rattus norvegicus
tccactctgccgtttagcaggaatt

SEQ ID NO: 582633 - DNA, 25 bp, Rattus norvegicus
tccactctggccaacaactttttag

SEQ ID NO: 582634 - DNA, 25 bp, Rattus norvegicus
tccactctggcctacaactttttag

SEQ ID NO: 582635 - DNA, 25 bp, Rattus norvegicus
tccactctggtgatgactgtcgatg

SEQ ID NO: 582636 - DNA, 25 bp, Rattus norvegicus
tccactctggtgttgactgtcgatg

SEQ ID NO: 582637 - DNA, 25 bp, Rattus norvegicus
tccactctgtgtcccttgagaacca

SEQ ID NO: 582638 - DNA, 25 bp, Rattus norvegicus
tccactctgtgtgccttgagaacca

SEQ ID NO: 582639 - DNA, 25 bp, Rattus norvegicus
tccactgaatcacgacggtcttctc

SEQ ID NO: 582640 - DNA, 25 bp, Rattus norvegicus
tccactgaatcaggacggtcttctc

SEQ ID NO: 582641 - DNA, 25 bp, Rattus norvegicus
tccactgaccagactactgttgttt

SEQ ID NO: 582642 - DNA, 25 bp, Rattus norvegicus
tccactgaccagtctactgttgttt

SEQ ID NO: 582643 - DNA, 25 bp, Rattus norvegicus
tccactgaccggatgtaagaatctt

SEQ ID NO: 582644 - DNA, 25 bp, Rattus norvegicus
tccactgaccggttgtaagaatctt

SEQ ID NO: 582645 - DNA, 25 bp, Rattus norvegicus
tccactgacctgcttgccaagttaa

SEQ ID NO: 582646 - DNA, 25 bp, Rattus norvegicus
tccactgacctggttgccaagttaa

SEQ ID NO: 582647 - DNA, 25 bp, Rattus norvegicus
tccactgactcacgcatttgtccta

SEQ ID NO: 582648 - DNA, 25 bp, Rattus norvegicus
tccactgactcaggcatttgtccta

SEQ ID NO: 582649 - DNA, 25 bp, Rattus norvegicus
tccactgagctgcagtgtcagcact

SEQ ID NO: 582650 - DNA, 25 bp, Rattus norvegicus
tccactgagctggagtgtcagcact

SEQ ID NO: 582651 - DNA, 25 bp, Rattus norvegicus
tccactgcaggaagccgttcttttc

SEQ ID NO: 582652 - DNA, 25 bp, Rattus norvegicus
tccactgcaggatgccgttcttttc

SEQ ID NO: 582653 - DNA, 25 bp, Rattus norvegicus
tccactgcctctctgaatgggtgca

SEQ ID NO: 582654 - DNA, 25 bp, Rattus norvegicus
tccactgcctctgtgaatgggtgca

SEQ ID NO: 582655 - DNA, 25 bp, Rattus norvegicus
tccactgcctttacagagctgcttg

SEQ ID NO: 582656 - DNA, 25 bp, Rattus norvegicus
tccactgccttttcagagctgcttg

SEQ ID NO: 582657 - DNA, 25 bp, Rattus norvegicus
tccactgctgtgctaaacaccatga

SEQ ID NO: 582658 - DNA, 25 bp, Rattus norvegicus
tccactgctgtggtaaacaccatga

SEQ ID NO: 582659 - DNA, 25 bp, Rattus norvegicus
tccactggactaatgtttgttgatg

SEQ ID NO: 582660 - DNA, 25 bp, Rattus norvegicus
tccactggactattgtttgttgatg

SEQ ID NO: 582661 - DNA, 25 bp, Rattus norvegicus
tccactggcgagctacgggactaaa

SEQ ID NO: 582662 - DNA, 25 bp, Rattus norvegicus
tccactggcgaggtacgggactaaa

SEQ ID NO: 582663 - DNA, 25 bp, Rattus norvegicus
tccactggcgggataggagtcttca

SEQ ID NO: 582664 - DNA, 25 bp, Rattus norvegicus
tccactggcgggttaggagtcttca

SEQ ID NO: 582665 - DNA, 25 bp, Rattus norvegicus
tccactggctaacgttttcaacaca

SEQ ID NO: 582666 - DNA, 25 bp, Rattus norvegicus
tccactggctaaggttttcaacaca

SEQ ID NO: 582667 - DNA, 25 bp, Rattus norvegicus
tccactgggtctacacttgttcagg

SEQ ID NO: 582668 - DNA, 25 bp, Rattus norvegicus
tccactgggtcttcacttgttcagg

SEQ ID NO: 582669 - DNA, 25 bp, Rattus norvegicus
tccactggtcagagtgaggacactt

SEQ ID NO: 582670 - DNA, 25 bp, Rattus norvegicus
tccactggtcagtgtgaggacactt

SEQ ID NO: 582671 - DNA, 25 bp, Rattus norvegicus
tccactggtgtgcattgatttagac

SEQ ID NO: 582672 - DNA, 25 bp, Rattus norvegicus
tccactggtgtggattgatttagac

SEQ ID NO: 582673 - DNA, 25 bp, Rattus norvegicus
tccactgtctatacagcttgaactg

SEQ ID NO: 582674 - DNA, 25 bp, Rattus norvegicus
tccactgtctattcagcttgaactg

SEQ ID NO: 582675 - DNA, 25 bp, Rattus norvegicus
tccactgtgggtatgagatcaggct

SEQ ID NO: 582676 - DNA, 25 bp, Rattus norvegicus
tccactgtgggtttgagatcaggct

SEQ ID NO: 582677 - DNA, 25 bp, Rattus norvegicus
tccactgtttaccttggcactaaag

SEQ ID NO: 582678 - DNA, 25 bp, Rattus norvegicus
tccactgtttacgttggcactaaag

SEQ ID NO: 582679 - DNA, 25 bp, Rattus norvegicus
tccactgtttgcagcccaattaatt

SEQ ID NO: 582680 - DNA, 25 bp, Rattus norvegicus
tccactgtttgctgcccaattaatt

SEQ ID NO: 582681 - DNA, 25 bp, Rattus norvegicus
tccacttaaggtcctggctcaggga

SEQ ID NO: 582682 - DNA, 25 bp, Rattus norvegicus
tccacttaaggtgctggctcaggga

SEQ ID NO: 582683 - DNA, 25 bp, Rattus norvegicus
tccacttactgaactgacacctgag

SEQ ID NO: 582684 - DNA, 25 bp, Rattus norvegicus
tccacttactgatctgacacctgag

SEQ ID NO: 582685 - DNA, 25 bp, Rattus norvegicus
tccacttagcggagactctgtgaaa

SEQ ID NO: 582686 - DNA, 25 bp, Rattus norvegicus
tccacttagcggtgactctgtgaaa

SEQ ID NO: 582687 - DNA, 25 bp, Rattus norvegicus
tccacttaggagacgctggcacaga

SEQ ID NO: 582688 - DNA, 25 bp, Rattus norvegicus
tccacttaggagtcgctggcacaga

SEQ ID NO: 582689 - DNA, 25 bp, Rattus norvegicus
tccacttcaatgagatctactccct

SEQ ID NO: 582690 - DNA, 25 bp, Rattus norvegicus
tccacttcaatgtgatctactccct

SEQ ID NO: 582691 - DNA, 25 bp, Rattus norvegicus
tccacttcagggagcgtactggttt

SEQ ID NO: 582692 - DNA, 25 bp, Rattus norvegicus
tccacttcagggtgcgtactggttt

SEQ ID NO: 582693 - DNA, 25 bp, Rattus norvegicus
tccacttcccgtctcagaatttaaa

SEQ ID NO: 582694 - DNA, 25 bp, Rattus norvegicus
tccacttcccgtgtcagaatttaaa

SEQ ID NO: 582695 - DNA, 25 bp, Rattus norvegicus
tccacttccgacatgtacgtgatat

SEQ ID NO: 582696 - DNA, 25 bp, Rattus norvegicus
tccacttccgacttgtacgtgatat

SEQ ID NO: 582697 - DNA, 25 bp, Rattus norvegicus
tccacttcctccagaattggctgat

SEQ ID NO: 582698 - DNA, 25 bp, Rattus norvegicus
tccacttcctcctgaattggctgat

SEQ ID NO: 582699 - DNA, 25 bp, Rattus norvegicus
tccacttcctctacccaggattttt

SEQ ID NO: 582700 - DNA, 25 bp, Rattus norvegicus
tccacttcctcttcccaggattttt

SEQ ID NO: 582701 - DNA, 25 bp, Rattus norvegicus
tccacttcctggactttttatttca

SEQ ID NO: 582702 - DNA, 25 bp, Rattus norvegicus
tccacttcctggtctttttatttca

SEQ ID NO: 582703 - DNA, 25 bp, Rattus norvegicus
tccacttccttgcatcggagcatat

SEQ ID NO: 582704 - DNA, 25 bp, Rattus norvegicus
tccacttccttggatcggagcatat

SEQ ID NO: 582705 - DNA, 25 bp, Rattus norvegicus
tccacttctgtcatgatgctcagtg

SEQ ID NO: 582706 - DNA, 25 bp, Rattus norvegicus
tccacttctgtcttgatgctcagtg

SEQ ID NO: 582707 - DNA, 25 bp, Rattus norvegicus
tccacttgcaagaaaaggaagccat

SEQ ID NO: 582708 - DNA, 25 bp, Rattus norvegicus
tccacttgcaagtaaaggaagccat

SEQ ID NO: 582709 - DNA, 25 bp, Rattus norvegicus
tccacttggcctaccagatatacga

SEQ ID NO: 582710 - DNA, 25 bp, Rattus norvegicus
tccacttggccttccagatatacga

SEQ ID NO: 582711 - DNA, 25 bp, Rattus norvegicus
tccacttgggaaactcttctaggtt

SEQ ID NO: 582712 - DNA, 25 bp, Rattus norvegicus
tccacttgggaatctcttctaggtt

SEQ ID NO: 582713 - DNA, 25 bp, Rattus norvegicus
tccacttgtgacacagatttgcaga

SEQ ID NO: 582714 - DNA, 25 bp, Rattus norvegicus
tccacttgtgactcagatttgcaga

SEQ ID NO: 582715 - DNA, 25 bp, Rattus norvegicus
tccacttgtgtgctgaggtcctgta

SEQ ID NO: 582716 - DNA, 25 bp, Rattus norvegicus
tccacttgtgtggtgaggtcctgta

SEQ ID NO: 582717 - DNA, 25 bp, Rattus norvegicus
tccactttcctaaatcatccattaa

SEQ ID NO: 582718 - DNA, 25 bp, Rattus norvegicus
tccactttcctatatcatccattaa

SEQ ID NO: 582719 - DNA, 25 bp, Rattus norvegicus
tccactttctcccaggccgagatgg

SEQ ID NO: 582720 - DNA, 25 bp, Rattus norvegicus
tccactttctccgaggccgagatgg

SEQ ID NO: 582721 - DNA, 25 bp, Rattus norvegicus
tccactttgacaacatttgaatcag

SEQ ID NO: 582722 - DNA, 25 bp, Rattus norvegicus
tccactttgacatcatttgaatcag

SEQ ID NO: 582723 - DNA, 25 bp, Rattus norvegicus
tccactttgactatccctggttcct

SEQ ID NO: 582724 - DNA, 25 bp, Rattus norvegicus
tccactttgactttccctggttcct

SEQ ID NO: 582725 - DNA, 25 bp, Rattus norvegicus
tccactttgcccataagacgttctt

SEQ ID NO: 582726 - DNA, 25 bp, Rattus norvegicus
tccactttgcccttaagacgttctt

SEQ ID NO: 582727 - DNA, 25 bp, Rattus norvegicus
tccacttttgagatagcggcataac

SEQ ID NO: 582728 - DNA, 25 bp, Rattus norvegicus
tccacttttgagttagcggcataac

SEQ ID NO: 582729 - DNA, 25 bp, Rattus norvegicus
tccacttttgcgatttcatatttgt

SEQ ID NO: 582730 - DNA, 25 bp, Rattus norvegicus
tccacttttgcgttttcatatttgt

SEQ ID NO: 582731 - DNA, 25 bp, Rattus norvegicus
tccagaaaaaccagggtgctgcctc

SEQ ID NO: 582732 - DNA, 25 bp, Rattus norvegicus
tccagaaaaacctgggtgctgcctc

SEQ ID NO: 582733 - DNA, 25 bp, Rattus norvegicus
tccagaaataagagctctagcttct

SEQ ID NO: 582734 - DNA, 25 bp, Rattus norvegicus
tccagaaataagtgctctagcttct

SEQ ID NO: 582735 - DNA, 25 bp, Rattus norvegicus
tccagaacagtcatgctgatctcag

SEQ ID NO: 582736 - DNA, 25 bp, Rattus norvegicus
tccagaacagtcttgctgatctcag

SEQ ID NO: 582737 - DNA, 25 bp, Rattus norvegicus
tccagaacattcctcctctgtgtgc

SEQ ID NO: 582738 - DNA, 25 bp, Rattus norvegicus
tccagaacattcgtcctctgtgtgc

SEQ ID NO: 582739 - DNA, 25 bp, Rattus norvegicus
tccagaacccccagagaccggagaa

SEQ ID NO: 582740 - DNA, 25 bp, Rattus norvegicus
tccagaaccccctgagaccggagaa

SEQ ID NO: 582741 - DNA, 25 bp, Rattus norvegicus
tccagaacctctctgttgcatgtag

SEQ ID NO: 582742 - DNA, 25 bp, Rattus norvegicus
tccagaacctctgtgttgcatgtag

SEQ ID NO: 582743 - DNA, 25 bp, Rattus norvegicus
tccagaactgggaggttgcccaaaa

SEQ ID NO: 582744 - DNA, 25 bp, Rattus norvegicus
tccagaactgggtggttgcccaaaa

SEQ ID NO: 582745 - DNA, 25 bp, Rattus norvegicus
tccagaactgtaaacacacaggcct

SEQ ID NO: 582746 - DNA, 25 bp, Rattus norvegicus
tccagaactgtatacacacaggcct

SEQ ID NO: 582747 - DNA, 25 bp, Rattus norvegicus
tccagaactgttaggtaacctttcg

SEQ ID NO: 582748 - DNA, 25 bp, Rattus norvegicus
tccagaactgtttggtaacctttcg

SEQ ID NO: 582749 - DNA, 25 bp, Rattus norvegicus
tccagaacttgaccctaagctctaa

SEQ ID NO: 582750 - DNA, 25 bp, Rattus norvegicus
tccagaacttgagcctaagctctaa

SEQ ID NO: 582751 - DNA, 25 bp, Rattus norvegicus
tccagaagacttaccggactctctt

SEQ ID NO: 582752 - DNA, 25 bp, Rattus norvegicus
tccagaagactttccggactctctt

SEQ ID NO: 582753 - DNA, 25 bp, Rattus norvegicus
tccagaagctcccaatgcaataaaa

SEQ ID NO: 582754 - DNA, 25 bp, Rattus norvegicus
tccagaagctccgaatgcaataaaa

SEQ ID NO: 582755 - DNA, 25 bp, Rattus norvegicus
tccagaagtctgagttgaaatgcca

SEQ ID NO: 582756 - DNA, 25 bp, Rattus norvegicus
tccagaagtctgtgttgaaatgcca

SEQ ID NO: 582757 - DNA, 25 bp, Rattus norvegicus
tccagaatagtcaccacggacagat

SEQ ID NO: 582758 - DNA, 25 bp, Rattus norvegicus
tccagaatagtctccacggacagat

SEQ ID NO: 582759 - DNA, 25 bp, Rattus norvegicus
tccagaatctccctgaaagctgctt

SEQ ID NO: 582760 - DNA, 25 bp, Rattus norvegicus
tccagaatctccgtgaaagctgctt

SEQ ID NO: 582761 - DNA, 25 bp, Rattus norvegicus
tccagaattttaccacaagttgttg

SEQ ID NO: 582762 - DNA, 25 bp, Rattus norvegicus
tccagaattttagcacaagttgttg

SEQ ID NO: 582763 - DNA, 25 bp, Rattus norvegicus
tccagacaattccacgttcattcag

SEQ ID NO: 582764 - DNA, 25 bp, Rattus norvegicus
tccagacaattcgacgttcattcag

SEQ ID NO: 582765 - DNA, 25 bp, Rattus norvegicus
tccagacacagccacccatttaaaa

SEQ ID NO: 582766 - DNA, 25 bp, Rattus norvegicus
tccagacacagcgacccatttaaaa

SEQ ID NO: 582767 - DNA, 25 bp, Rattus norvegicus
tccagacactgaatcgcacgtaggt

SEQ ID NO: 582768 - DNA, 25 bp, Rattus norvegicus
tccagacactgattcgcacgtaggt

SEQ ID NO: 582769 - DNA, 25 bp, Rattus norvegicus
tccagacactggctatcgttatagg

SEQ ID NO: 582770 - DNA, 25 bp, Rattus norvegicus
tccagacactgggtatcgttatagg

SEQ ID NO: 582771 - DNA, 25 bp, Rattus norvegicus
tccagacagccacagccttgcaaag

SEQ ID NO: 582772 - DNA, 25 bp, Rattus norvegicus
tccagacagccagagccttgcaaag

SEQ ID NO: 582773 - DNA, 25 bp, Rattus norvegicus
tccagacatcatagtttgacctaat

SEQ ID NO: 582774 - DNA, 25 bp, Rattus norvegicus
tccagacatcattgtttgacctaat

SEQ ID NO: 582775 - DNA, 25 bp, Rattus norvegicus
tccagacatggaagtaggaaccaaa

SEQ ID NO: 582776 - DNA, 25 bp, Rattus norvegicus
tccagacatggatgtaggaaccaaa

SEQ ID NO: 582777 - DNA, 25 bp, Rattus norvegicus
tccagacatgtcacttggtgtgtgt

SEQ ID NO: 582778 - DNA, 25 bp, Rattus norvegicus
tccagacatgtctcttggtgtgtgt

SEQ ID NO: 582779 - DNA, 25 bp, Rattus norvegicus
tccagaccagtcattgtacagagtg

SEQ ID NO: 582780 - DNA, 25 bp, Rattus norvegicus
tccagaccagtctttgtacagagtg

SEQ ID NO: 582781 - DNA, 25 bp, Rattus norvegicus
tccagacctaggcaaccagactcag

SEQ ID NO: 582782 - DNA, 25 bp, Rattus norvegicus
tccagacctagggaaccagactcag

SEQ ID NO: 582783 - DNA, 25 bp, Rattus norvegicus
tccagacggaacagtacgtgccaca

SEQ ID NO: 582784 - DNA, 25 bp, Rattus norvegicus
tccagacggaactgtacgtgccaca

SEQ ID NO: 582785 - DNA, 25 bp, Rattus norvegicus
tccagacggtttagagttgccatgt

SEQ ID NO: 582786 - DNA, 25 bp, Rattus norvegicus
tccagacggttttgagttgccatgt

SEQ ID NO: 582787 - DNA, 25 bp, Rattus norvegicus
tccagacgtctgagggtaaggccct

SEQ ID NO: 582788 - DNA, 25 bp, Rattus norvegicus
tccagacgtctgtgggtaaggccct

SEQ ID NO: 582789 - DNA, 25 bp, Rattus norvegicus
tccagactcgacagcccatgggata

SEQ ID NO: 582790 - DNA, 25 bp, Rattus norvegicus
tccagactcgactgcccatgggata

SEQ ID NO: 582791 - DNA, 25 bp, Rattus norvegicus
tccagactcttccattcctgaagtg

SEQ ID NO: 582792 - DNA, 25 bp, Rattus norvegicus
tccagactcttcgattcctgaagtg

SEQ ID NO: 582793 - DNA, 25 bp, Rattus norvegicus
tccagactgcttccttcagattgta

SEQ ID NO: 582794 - DNA, 25 bp, Rattus norvegicus
tccagactgcttgcttcagattgta

SEQ ID NO: 582795 - DNA, 25 bp, Rattus norvegicus
tccagacttcagactttgacgacga

SEQ ID NO: 582796 - DNA, 25 bp, Rattus norvegicus
tccagacttcagtctttgacgacga

SEQ ID NO: 582797 - DNA, 25 bp, Rattus norvegicus
tccagagaaggtcgactctgcacag

SEQ ID NO: 582798 - DNA, 25 bp, Rattus norvegicus
tccagagaaggtggactctgcacag

SEQ ID NO: 582799 - DNA, 25 bp, Rattus norvegicus
tccagagaccacctcctaaacaaga

SEQ ID NO: 582800 - DNA, 25 bp, Rattus norvegicus
tccagagaccacgtcctaaacaaga

SEQ ID NO: 582801 - DNA, 25 bp, Rattus norvegicus
tccagagacccacgtgagggcacgc

SEQ ID NO: 582802 - DNA, 25 bp, Rattus norvegicus
tccagagacccaggtgagggcacgc

SEQ ID NO: 582803 - DNA, 25 bp, Rattus norvegicus
tccagagactccagtgtacccggct

SEQ ID NO: 582804 - DNA, 25 bp, Rattus norvegicus
tccagagactcctgtgtacccggct

SEQ ID NO: 582805 - DNA, 25 bp, Rattus norvegicus
tccagagactttatggctttaccgt

SEQ ID NO: 582806 - DNA, 25 bp, Rattus norvegicus
tccagagactttttggctttaccgt

SEQ ID NO: 582807 - DNA, 25 bp, Rattus norvegicus
tccagagcagccagccgcggagcga

SEQ ID NO: 582808 - DNA, 25 bp, Rattus norvegicus
tccagagcagcctgccgcggagcga

SEQ ID NO: 582809 - DNA, 25 bp, Rattus norvegicus
tccagagcatggagagccccggaat

SEQ ID NO: 582810 - DNA, 25 bp, Rattus norvegicus
tccagagcatggtgagccccggaat

SEQ ID NO: 582811 - DNA, 25 bp, Rattus norvegicus
tccagagcatttcggttccatcatc

SEQ ID NO: 582812 - DNA, 25 bp, Rattus norvegicus
tccagagcatttgggttccatcatc

SEQ ID NO: 582813 - DNA, 25 bp, Rattus norvegicus
tccagagcctccatccaagtacaat

SEQ ID NO: 582814 - DNA, 25 bp, Rattus norvegicus
tccagagcctccttccaagtacaat

SEQ ID NO: 582815 - DNA, 25 bp, Rattus norvegicus
tccagagctagccacttctgtctag

SEQ ID NO: 582816 - DNA, 25 bp, Rattus norvegicus
tccagagctagcgacttctgtctag

SEQ ID NO: 582817 - DNA, 25 bp, Rattus norvegicus
tccagaggaatcaagggtcacccag

SEQ ID NO: 582818 - DNA, 25 bp, Rattus norvegicus
tccagaggaatctagggtcacccag

SEQ ID NO: 582819 - DNA, 25 bp, Rattus norvegicus
tccagaggcccgagggaccgcctgt

SEQ ID NO: 582820 - DNA, 25 bp, Rattus norvegicus
tccagaggcccgtgggaccgcctgt

SEQ ID NO: 582821 - DNA, 25 bp, Rattus norvegicus
tccagaggctgtagaagcaaaccta

SEQ ID NO: 582822 - DNA, 25 bp, Rattus norvegicus
tccagaggctgttgaagcaaaccta

SEQ ID NO: 582823 - DNA, 25 bp, Rattus norvegicus
tccagagggaatactataacctaaa

SEQ ID NO: 582824 - DNA, 25 bp, Rattus norvegicus
tccagagggaattctataacctaaa

SEQ ID NO: 582825 - DNA, 25 bp, Rattus norvegicus
tccagagtagaacagggtcctgccc

SEQ ID NO: 582826 - DNA, 25 bp, Rattus norvegicus
tccagagtagaagagggtcctgccc

SEQ ID NO: 582827 - DNA, 25 bp, Rattus norvegicus
tccagagtagccaattagttactag

SEQ ID NO: 582828 - DNA, 25 bp, Rattus norvegicus
tccagagtagcctattagttactag

SEQ ID NO: 582829 - DNA, 25 bp, Rattus norvegicus
tccagagtcgataacaccgttcaat

SEQ ID NO: 582830 - DNA, 25 bp, Rattus norvegicus
tccagagtcgattacaccgttcaat

SEQ ID NO: 582831 - DNA, 25 bp, Rattus norvegicus
tccagagtgggtactgctcttgaca

SEQ ID NO: 582832 - DNA, 25 bp, Rattus norvegicus
tccagagtgggttctgctcttgaca

SEQ ID NO: 582833 - DNA, 25 bp, Rattus norvegicus
tccagagttcccatgtccgattggt

SEQ ID NO: 582834 - DNA, 25 bp, Rattus norvegicus
tccagagttcccttgtccgattggt

SEQ ID NO: 582835 - DNA, 25 bp, Rattus norvegicus
tccagagtttttcctgccaggctca

SEQ ID NO: 582836 - DNA, 25 bp, Rattus norvegicus
tccagagtttttgctgccaggctca

SEQ ID NO: 582837 - DNA, 25 bp, Rattus norvegicus
tccagataattcaggtcttcccaat

SEQ ID NO: 582838 - DNA, 25 bp, Rattus norvegicus
tccagataattctggtcttcccaat

SEQ ID NO: 582839 - DNA, 25 bp, Rattus norvegicus
tccagatcaggtcgctgcgtaggta

SEQ ID NO: 582840 - DNA, 25 bp, Rattus norvegicus
tccagatcaggtggctgcgtaggta

SEQ ID NO: 582841 - DNA, 25 bp, Rattus norvegicus
tccagatcccgtcgttcgaaatcaa

SEQ ID NO: 582842 - DNA, 25 bp, Rattus norvegicus
tccagatcccgtggttcgaaatcaa

SEQ ID NO: 582843 - DNA, 25 bp, Rattus norvegicus
tccagatccctcacggtgaaatgaa

SEQ ID NO: 582844 - DNA, 25 bp, Rattus norvegicus
tccagatccctctcggtgaaatgaa

SEQ ID NO: 582845 - DNA, 25 bp, Rattus norvegicus
tccagatccgctacattcagaacat

SEQ ID NO: 582846 - DNA, 25 bp, Rattus norvegicus
tccagatccgcttcattcagaacat

SEQ ID NO: 582847 - DNA, 25 bp, Rattus norvegicus
tccagatctctgactggcctcagaa

SEQ ID NO: 582848 - DNA, 25 bp, Rattus norvegicus
tccagatctctgtctggcctcagaa

SEQ ID NO: 582849 - DNA, 25 bp, Rattus norvegicus
tccagatctgcacctgagccaaaga

SEQ ID NO: 582850 - DNA, 25 bp, Rattus norvegicus
tccagatctgcagctgagccaaaga

SEQ ID NO: 582851 - DNA, 25 bp, Rattus norvegicus
tccagatctttgcagcactgctctg

SEQ ID NO: 582852 - DNA, 25 bp, Rattus norvegicus
tccagatctttggagcactgctctg

SEQ ID NO: 582853 - DNA, 25 bp, Rattus norvegicus
tccagatgctgcagtgcagtgacgt

SEQ ID NO: 582854 - DNA, 25 bp, Rattus norvegicus
tccagatgctgccagccaagtctga

SEQ ID NO: 582855 - DNA, 25 bp, Rattus norvegicus
tccagatgctgcgagccaagtctga

SEQ ID NO: 582856 - DNA, 25 bp, Rattus norvegicus
tccagatgctgctgtgcagtgacgt

SEQ ID NO: 582857 - DNA, 25 bp, Rattus norvegicus
tccagatgctggagccatcgtgatg

SEQ ID NO: 582858 - DNA, 25 bp, Rattus norvegicus
tccagatgctggtgccatcgtgatg

SEQ ID NO: 582859 - DNA, 25 bp, Rattus norvegicus
tccagatggccacggaagctctcag

SEQ ID NO: 582860 - DNA, 25 bp, Rattus norvegicus
tccagatggccagggaagctctcag

SEQ ID NO: 582861 - DNA, 25 bp, Rattus norvegicus
tccagatggccgatcacaactgtgt

SEQ ID NO: 582862 - DNA, 25 bp, Rattus norvegicus
tccagatggccgttcacaactgtgt

SEQ ID NO: 582863 - DNA, 25 bp, Rattus norvegicus
tccagattccagacagagttctatg

SEQ ID NO: 582864 - DNA, 25 bp, Rattus norvegicus
tccagattccagtcagagttctatg

SEQ ID NO: 582865 - DNA, 25 bp, Rattus norvegicus
tccagattctggaaaactgaagtga

SEQ ID NO: 582866 - DNA, 25 bp, Rattus norvegicus
tccagattctggtaaactgaagtga

SEQ ID NO: 582867 - DNA, 25 bp, Rattus norvegicus
tccagatttgttatcagtgcctccc

SEQ ID NO: 582868 - DNA, 25 bp, Rattus norvegicus
tccagatttgttttcagtgcctccc

SEQ ID NO: 582869 - DNA, 25 bp, Rattus norvegicus
tccagattttataatggccaaacaa

SEQ ID NO: 582870 - DNA, 25 bp, Rattus norvegicus
tccagattttattatggccaaacaa

SEQ ID NO: 582871 - DNA, 25 bp, Rattus norvegicus
tccagattttgaccacgacagagat

SEQ ID NO: 582872 - DNA, 25 bp, Rattus norvegicus
tccagattttgagcacgacagagat

SEQ ID NO: 582873 - DNA, 25 bp, Rattus norvegicus
tccagattttgtctgtgggctctgc

SEQ ID NO: 582874 - DNA, 25 bp, Rattus norvegicus
tccagattttgtgtgtgggctctgc

SEQ ID NO: 582875 - DNA, 25 bp, Rattus norvegicus
tccagcaacgacacgagaccagtgg

SEQ ID NO: 582876 - DNA, 25 bp, Rattus norvegicus
tccagcaacgactcgagaccagtgg

SEQ ID NO: 582877 - DNA, 25 bp, Rattus norvegicus
tccagcaatatgagggttcccggct

SEQ ID NO: 582878 - DNA, 25 bp, Rattus norvegicus
tccagcaatatgtgggttcccggct

SEQ ID NO: 582879 - DNA, 25 bp, Rattus norvegicus
tccagcacaaacatgccacagtgta

SEQ ID NO: 582880 - DNA, 25 bp, Rattus norvegicus
tccagcacaaacttgccacagtgta

SEQ ID NO: 582881 - DNA, 25 bp, Rattus norvegicus
tccagcacactccatacacttttaa

SEQ ID NO: 582882 - DNA, 25 bp, Rattus norvegicus
tccagcacactcgatacacttttaa

SEQ ID NO: 582883 - DNA, 25 bp, Rattus norvegicus
tccagcacagatcctttgtctagaa

SEQ ID NO: 582884 - DNA, 25 bp, Rattus norvegicus
tccagcacagatgctttgtctagaa

SEQ ID NO: 582885 - DNA, 25 bp, Rattus norvegicus
tccagcacatacatgtacttctcta

SEQ ID NO: 582886 - DNA, 25 bp, Rattus norvegicus
tccagcacatacttgtacttctcta

SEQ ID NO: 582887 - DNA, 25 bp, Rattus norvegicus
tccagcacatctccacgatcgtctc

SEQ ID NO: 582888 - DNA, 25 bp, Rattus norvegicus
tccagcacatctgcacgatcgtctc

SEQ ID NO: 582889 - DNA, 25 bp, Rattus norvegicus
tccagcaccagacgtacacataaat

SEQ ID NO: 582890 - DNA, 25 bp, Rattus norvegicus
tccagcaccagaggtacacataaat

SEQ ID NO: 582891 - DNA, 25 bp, Rattus norvegicus
tccagcacccacaaacttacaaatg

SEQ ID NO: 582892 - DNA, 25 bp, Rattus norvegicus
tccagcacccactaacttacaaatg

SEQ ID NO: 582893 - DNA, 25 bp, Rattus norvegicus
tccagcacccatcaagtagcagcag

SEQ ID NO: 582894 - DNA, 25 bp, Rattus norvegicus
tccagcacccatgaagtagcagcag

SEQ ID NO: 582895 - DNA, 25 bp, Rattus norvegicus
tccagcaccttcattcttgaagcaa

SEQ ID NO: 582896 - DNA, 25 bp, Rattus norvegicus
tccagcaccttctttcttgaagcaa

SEQ ID NO: 582897 - DNA, 25 bp, Rattus norvegicus
tccagcacgccaattgtgccaagaa

SEQ ID NO: 582898 - DNA, 25 bp, Rattus norvegicus
tccagcacgccatttgtgccaagaa

SEQ ID NO: 582899 - DNA, 25 bp, Rattus norvegicus
tccagcacggtgaggccgcacaaaa

SEQ ID NO: 582900 - DNA, 25 bp, Rattus norvegicus
tccagcacggtgtggccgcacaaaa

SEQ ID NO: 582901 - DNA, 25 bp, Rattus norvegicus
tccagcactgttacctaggaaccaa

SEQ ID NO: 582902 - DNA, 25 bp, Rattus norvegicus
tccagcactgtttcctaggaaccaa

SEQ ID NO: 582903 - DNA, 25 bp, Rattus norvegicus
tccagcagatgcaccagatgcagca

SEQ ID NO: 582904 - DNA, 25 bp, Rattus norvegicus
tccagcagatgctccagatgcagca

SEQ ID NO: 582905 - DNA, 25 bp, Rattus norvegicus
tccagcagctggacaggcagatccc

SEQ ID NO: 582906 - DNA, 25 bp, Rattus norvegicus
tccagcagctggtcaggcagatccc

SEQ ID NO: 582907 - DNA, 25 bp, Rattus norvegicus
tccagcaggaagaggccaggcagat

SEQ ID NO: 582908 - DNA, 25 bp, Rattus norvegicus
tccagcaggaagtggccaggcagat

SEQ ID NO: 582909 - DNA, 25 bp, Rattus norvegicus
tccagcaggctgatggctgcccaac

SEQ ID NO: 582910 - DNA, 25 bp, Rattus norvegicus
tccagcaggctgatgttcagactca

SEQ ID NO: 582911 - DNA, 25 bp, Rattus norvegicus
tccagcaggctgttggctgcccaac

SEQ ID NO: 582912 - DNA, 25 bp, Rattus norvegicus
tccagcaggctgttgttcagactca

SEQ ID NO: 582913 - DNA, 25 bp, Rattus norvegicus
tccagcagtgttcctacagagatgt

SEQ ID NO: 582914 - DNA, 25 bp, Rattus norvegicus
tccagcagtgttgctacagagatgt

SEQ ID NO: 582915 - DNA, 25 bp, Rattus norvegicus
tccagcataattacatggtagggaa

SEQ ID NO: 582916 - DNA, 25 bp, Rattus norvegicus
tccagcataatttcatggtagggaa

SEQ ID NO: 582917 - DNA, 25 bp, Rattus norvegicus
tccagcatcatcacctgtgacctta

SEQ ID NO: 582918 - DNA, 25 bp, Rattus norvegicus
tccagcatcatctcctgtgacctta

SEQ ID NO: 582919 - DNA, 25 bp, Rattus norvegicus
tccagcatcttcacaggttcgatga

SEQ ID NO: 582920 - DNA, 25 bp, Rattus norvegicus
tccagcatcttctcaggttcgatga

SEQ ID NO: 582921 - DNA, 25 bp, Rattus norvegicus
tccagcatggtcattctatttgtaa

SEQ ID NO: 582922 - DNA, 25 bp, Rattus norvegicus
tccagcatggtctttctatttgtaa

SEQ ID NO: 582923 - DNA, 25 bp, Rattus norvegicus
tccagcatgtagagtaagcctccca

SEQ ID NO: 582924 - DNA, 25 bp, Rattus norvegicus
tccagcatgtagtgtaagcctccca

SEQ ID NO: 582925 - DNA, 25 bp, Rattus norvegicus
tccagcatgtcccggcgaggcaagc

SEQ ID NO: 582926 - DNA, 25 bp, Rattus norvegicus
tccagcatgtccgggcgaggcaagc

SEQ ID NO: 582927 - DNA, 25 bp, Rattus norvegicus
tccagcatttctcccgtggtgaagg

SEQ ID NO: 582928 - DNA, 25 bp, Rattus norvegicus
tccagcatttctgccgtggtgaagg

SEQ ID NO: 582929 - DNA, 25 bp, Rattus norvegicus
tccagcatttgtagcaggtttgggt

SEQ ID NO: 582930 - DNA, 25 bp, Rattus norvegicus
tccagcatttgttgcaggtttgggt

SEQ ID NO: 582931 - DNA, 25 bp, Rattus norvegicus
tccagccaacccatgtgaattttga

SEQ ID NO: 582932 - DNA, 25 bp, Rattus norvegicus
tccagccaacccttgtgaattttga

SEQ ID NO: 582933 - DNA, 25 bp, Rattus norvegicus
tccagccaccatcctaacagatgaa

SEQ ID NO: 582934 - DNA, 25 bp, Rattus norvegicus
tccagccaccatgctaacagatgaa

SEQ ID NO: 582935 - DNA, 25 bp, Rattus norvegicus
tccagccaggccacttcctgtgaga

SEQ ID NO: 582936 - DNA, 25 bp, Rattus norvegicus
tccagccaggccagtgtagtaagac

SEQ ID NO: 582937 - DNA, 25 bp, Rattus norvegicus
tccagccaggcctcttcctgtgaga

SEQ ID NO: 582938 - DNA, 25 bp, Rattus norvegicus
tccagccaggcctgtgtagtaagac

SEQ ID NO: 582939 - DNA, 25 bp, Rattus norvegicus
tccagccagggtagctagtgctaga

SEQ ID NO: 582940 - DNA, 25 bp, Rattus norvegicus
tccagccagggttgctagtgctaga

SEQ ID NO: 582941 - DNA, 25 bp, Rattus norvegicus
tccagccatacaatgttacaggtgc

SEQ ID NO: 582942 - DNA, 25 bp, Rattus norvegicus
tccagccatacattgttacaggtgc

SEQ ID NO: 582943 - DNA, 25 bp, Rattus norvegicus
tccagccattttagtacatgttgta

SEQ ID NO: 582944 - DNA, 25 bp, Rattus norvegicus
tccagccatttttgtacatgttgta

SEQ ID NO: 582945 - DNA, 25 bp, Rattus norvegicus
tccagcccacagagctcggatgtac

SEQ ID NO: 582946 - DNA, 25 bp, Rattus norvegicus
tccagcccacagtgctcggatgtac

SEQ ID NO: 582947 - DNA, 25 bp, Rattus norvegicus
tccagcccagaaaattttcaatgta

SEQ ID NO: 582948 - DNA, 25 bp, Rattus norvegicus
tccagcccagaatattttcaatgta

SEQ ID NO: 582949 - DNA, 25 bp, Rattus norvegicus
tccagcccagcacgtttttcataag

SEQ ID NO: 582950 - DNA, 25 bp, Rattus norvegicus
tccagcccagcaggtttttcataag

SEQ ID NO: 582951 - DNA, 25 bp, Rattus norvegicus
tccagcccagctatgtgaaaatgaa

SEQ ID NO: 582952 - DNA, 25 bp, Rattus norvegicus
tccagcccagctcttgtgagaccag

SEQ ID NO: 582953 - DNA, 25 bp, Rattus norvegicus
tccagcccagctgttgtgagaccag

SEQ ID NO: 582954 - DNA, 25 bp, Rattus norvegicus
tccagcccagctttgtgaaaatgaa

SEQ ID NO: 582955 - DNA, 25 bp, Rattus norvegicus
tccagcccaggcagttagtcagaac

SEQ ID NO: 582956 - DNA, 25 bp, Rattus norvegicus
tccagcccaggctgttagtcagaac

SEQ ID NO: 582957 - DNA, 25 bp, Rattus norvegicus
tccagcccagtgaaatcttttaaaa

SEQ ID NO: 582958 - DNA, 25 bp, Rattus norvegicus
tccagcccagtgtaatcttttaaaa

SEQ ID NO: 582959 - DNA, 25 bp, Rattus norvegicus
tccagcccattgatacttgagtgat

SEQ ID NO: 582960 - DNA, 25 bp, Rattus norvegicus
tccagcccattgttacttgagtgat

SEQ ID NO: 582961 - DNA, 25 bp, Rattus norvegicus
tccagccccaataaacttgcattaa

SEQ ID NO: 582962 - DNA, 25 bp, Rattus norvegicus
tccagccccaatatattttatcctt

SEQ ID NO: 582963 - DNA, 25 bp, Rattus norvegicus
tccagccccaattaacttgcattaa

SEQ ID NO: 582964 - DNA, 25 bp, Rattus norvegicus
tccagccccaatttattttatcctt

SEQ ID NO: 582965 - DNA, 25 bp, Rattus norvegicus
tccagccccagtaaccacgattttt

SEQ ID NO: 582966 - DNA, 25 bp, Rattus norvegicus
tccagccccagttaccacgattttt

SEQ ID NO: 582967 - DNA, 25 bp, Rattus norvegicus
tccagccccgatcagactagagaga

SEQ ID NO: 582968 - DNA, 25 bp, Rattus norvegicus
tccagccccgatgagactagagaga

SEQ ID NO: 582969 - DNA, 25 bp, Rattus norvegicus
tccagcccctgtagtgtgtatgtgt

SEQ ID NO: 582970 - DNA, 25 bp, Rattus norvegicus
tccagcccctgttgtgtgtatgtgt

SEQ ID NO: 582971 - DNA, 25 bp, Rattus norvegicus
tccagccccttactgatacattttt

SEQ ID NO: 582972 - DNA, 25 bp, Rattus norvegicus
tccagccccttagtgatacattttt

SEQ ID NO: 582973 - DNA, 25 bp, Rattus norvegicus
tccagcccgaggatcggtgctcgtg

SEQ ID NO: 582974 - DNA, 25 bp, Rattus norvegicus
tccagcccgaggttcggtgctcgtg

SEQ ID NO: 582975 - DNA, 25 bp, Rattus norvegicus
tccagcccggtcatggctacatagt

SEQ ID NO: 582976 - DNA, 25 bp, Rattus norvegicus
tccagcccggtcttggctacatagt

SEQ ID NO: 582977 - DNA, 25 bp, Rattus norvegicus
tccagcccgtaaatgatacttctta

SEQ ID NO: 582978 - DNA, 25 bp, Rattus norvegicus
tccagcccgtaattgatacttctta

SEQ ID NO: 582979 - DNA, 25 bp, Rattus norvegicus
tccagccctcacaaaaacctttatt

SEQ ID NO: 582980 - DNA, 25 bp, Rattus norvegicus
tccagccctcactaaaacctttatt

SEQ ID NO: 582981 - DNA, 25 bp, Rattus norvegicus
tccagccctcagacagttgaattct

SEQ ID NO: 582982 - DNA, 25 bp, Rattus norvegicus
tccagccctcagtcagttgaattct

SEQ ID NO: 582983 - DNA, 25 bp, Rattus norvegicus
tccagccctcatctaaatcgttggg

SEQ ID NO: 582984 - DNA, 25 bp, Rattus norvegicus
tccagccctcatgtaaatcgttggg

SEQ ID NO: 582985 - DNA, 25 bp, Rattus norvegicus
tccagccctctgattacagttctta

SEQ ID NO: 582986 - DNA, 25 bp, Rattus norvegicus
tccagccctctgtttacagttctta

SEQ ID NO: 582987 - DNA, 25 bp, Rattus norvegicus
tccagccctgaaccaaatgtgtctc

SEQ ID NO: 582988 - DNA, 25 bp, Rattus norvegicus
tccagccctgaagcaaatgtgtctc

SEQ ID NO: 582989 - DNA, 25 bp, Rattus norvegicus
tccagccctggaatgaacagacagt

SEQ ID NO: 582990 - DNA, 25 bp, Rattus norvegicus
tccagccctggacagtgttaggtct

SEQ ID NO: 582991 - DNA, 25 bp, Rattus norvegicus
tccagccctggactaaatatcatga

SEQ ID NO: 582992 - DNA, 25 bp, Rattus norvegicus
tccagccctggagagtgttaggtct

SEQ ID NO: 582993 - DNA, 25 bp, Rattus norvegicus
tccagccctggagtaaatatcatga

SEQ ID NO: 582994 - DNA, 25 bp, Rattus norvegicus
tccagccctggattgaacagacagt

SEQ ID NO: 582995 - DNA, 25 bp, Rattus norvegicus
tccagccctgggaacctaatattta

SEQ ID NO: 582996 - DNA, 25 bp, Rattus norvegicus
tccagccctgggtacctaatattta

SEQ ID NO: 582997 - DNA, 25 bp, Rattus norvegicus
tccagcccttccagtgggaacctgg

SEQ ID NO: 582998 - DNA, 25 bp, Rattus norvegicus
tccagcccttcctgtgggaacctgg

SEQ ID NO: 582999 - DNA, 25 bp, Rattus norvegicus
tccagcccttggctacagggtctct

SEQ ID NO: 583000 - DNA, 25 bp, Rattus norvegicus
tccagcccttgggtacagggtctct

SEQ ID NO: 583001 - DNA, 25 bp, Rattus norvegicus
tccagccgccagagaggacagctat

SEQ ID NO: 583002 - DNA, 25 bp, Rattus norvegicus
tccagccgccagtgaggacagctat

SEQ ID NO: 583003 - DNA, 25 bp, Rattus norvegicus
tccagccggtatctgctcttcaaga

SEQ ID NO: 583004 - DNA, 25 bp, Rattus norvegicus
tccagccggtatgtgctcttcaaga

SEQ ID NO: 583005 - DNA, 25 bp, Rattus norvegicus
tccagccggtgccaacctgtgaatt

SEQ ID NO: 583006 - DNA, 25 bp, Rattus norvegicus
tccagccggtgcgaacctgtgaatt

SEQ ID NO: 583007 - DNA, 25 bp, Rattus norvegicus
tccagcctacttcggatccagagga

SEQ ID NO: 583008 - DNA, 25 bp, Rattus norvegicus
tccagcctacttgggatccagagga

SEQ ID NO: 583009 - DNA, 25 bp, Rattus norvegicus
tccagcctaggaacacaagtacagt

SEQ ID NO: 583010 - DNA, 25 bp, Rattus norvegicus
tccagcctaggatcacaagtacagt

SEQ ID NO: 583011 - DNA, 25 bp, Rattus norvegicus
tccagcctcaggcatgacaggcagt

SEQ ID NO: 583012 - DNA, 25 bp, Rattus norvegicus
tccagcctcagggatgacaggcagt

SEQ ID NO: 583013 - DNA, 25 bp, Rattus norvegicus
tccagcctcatactgtcattcagga

SEQ ID NO: 583014 - DNA, 25 bp, Rattus norvegicus
tccagcctcatagtgtcattcagga

SEQ ID NO: 583015 - DNA, 25 bp, Rattus norvegicus
tccagcctccgaagtcacagtaatg

SEQ ID NO: 583016 - DNA, 25 bp, Rattus norvegicus
tccagcctccgatgtcacagtaatg

SEQ ID NO: 583017 - DNA, 25 bp, Rattus norvegicus
tccagcctctgtaggtgtcagtcag

SEQ ID NO: 583018 - DNA, 25 bp, Rattus norvegicus
tccagcctctgttggtgtcagtcag

SEQ ID NO: 583019 - DNA, 25 bp, Rattus norvegicus
tccagcctggaacagccctttaatt

SEQ ID NO: 583020 - DNA, 25 bp, Rattus norvegicus
tccagcctggaagagccctttaatt

SEQ ID NO: 583021 - DNA, 25 bp, Rattus norvegicus
tccagcctggagaccgaggtatgac

SEQ ID NO: 583022 - DNA, 25 bp, Rattus norvegicus
tccagcctggagtccgaggtatgac

SEQ ID NO: 583023 - DNA, 25 bp, Rattus norvegicus
tccagcctggtcagtgttacagcat

SEQ ID NO: 583024 - DNA, 25 bp, Rattus norvegicus
tccagcctggtctgtgttacagcat

SEQ ID NO: 583025 - DNA, 25 bp, Rattus norvegicus
tccagcctggttacatctcttccga

SEQ ID NO: 583026 - DNA, 25 bp, Rattus norvegicus
tccagcctggtttcatctcttccga

SEQ ID NO: 583027 - DNA, 25 bp, Rattus norvegicus
tccagccttccaatatcactgcagg

SEQ ID NO: 583028 - DNA, 25 bp, Rattus norvegicus
tccagccttccattatcactgcagg

SEQ ID NO: 583029 - DNA, 25 bp, Rattus norvegicus
tccagccttcccatggattgaggaa

SEQ ID NO: 583030 - DNA, 25 bp, Rattus norvegicus
tccagccttcccttggattgaggaa

SEQ ID NO: 583031 - DNA, 25 bp, Rattus norvegicus
tccagccttgttatgggccaagttg

SEQ ID NO: 583032 - DNA, 25 bp, Rattus norvegicus
tccagccttgttttgggccaagttg

SEQ ID NO: 583033 - DNA, 25 bp, Rattus norvegicus
tccagcgaggctaacagaattttct

SEQ ID NO: 583034 - DNA, 25 bp, Rattus norvegicus
tccagcgaggcttacagaattttct

SEQ ID NO: 583035 - DNA, 25 bp, Rattus norvegicus
tccagcgagtgcagtgagcctcaag

SEQ ID NO: 583036 - DNA, 25 bp, Rattus norvegicus
tccagcgagtgctgtgagcctcaag

SEQ ID NO: 583037 - DNA, 25 bp, Rattus norvegicus
tccagcgcactgagaggctccgaac

SEQ ID NO: 583038 - DNA, 25 bp, Rattus norvegicus
tccagcgcactgtgaggctccgaac

SEQ ID NO: 583039 - DNA, 25 bp, Rattus norvegicus
tccagcgcctggagacagtgtcgga

SEQ ID NO: 583040 - DNA, 25 bp, Rattus norvegicus
tccagcgcctggtgacagtgtcgga

SEQ ID NO: 583041 - DNA, 25 bp, Rattus norvegicus
tccagcgctggaaccctgaggacag

SEQ ID NO: 583042 - DNA, 25 bp, Rattus norvegicus
tccagcgctggatccctgaggacag

SEQ ID NO: 583043 - DNA, 25 bp, Rattus norvegicus
tccagcggacacaagcatgcatcat

SEQ ID NO: 583044 - DNA, 25 bp, Rattus norvegicus
tccagcggacactagcatgcatcat

SEQ ID NO: 583045 - DNA, 25 bp, Rattus norvegicus
tccagcggagtcataggacacactt

SEQ ID NO: 583046 - DNA, 25 bp, Rattus norvegicus
tccagcggagtcttaggacacactt

SEQ ID NO: 583047 - DNA, 25 bp, Rattus norvegicus
tccagcggccagaccagcaagaata

SEQ ID NO: 583048 - DNA, 25 bp, Rattus norvegicus
tccagcggccagtccagcaagaata

SEQ ID NO: 583049 - DNA, 25 bp, Rattus norvegicus
tccagcggcgccatgagcaaatgaa

SEQ ID NO: 583050 - DNA, 25 bp, Rattus norvegicus
tccagcggcgccttgagcaaatgaa

SEQ ID NO: 583051 - DNA, 25 bp, Rattus norvegicus
tccagcggtcctatggttaactcag

SEQ ID NO: 583052 - DNA, 25 bp, Rattus norvegicus
tccagcggtcctttggttaactcag

SEQ ID NO: 583053 - DNA, 25 bp, Rattus norvegicus
tccagcgtaggaaacaaagtcttgt

SEQ ID NO: 583054 - DNA, 25 bp, Rattus norvegicus
tccagcgtaggatacaaagtcttgt

SEQ ID NO: 583055 - DNA, 25 bp, Rattus norvegicus
tccagcgtatacagaagaccttctg

SEQ ID NO: 583056 - DNA, 25 bp, Rattus norvegicus
tccagcgtatactgaagaccttctg

SEQ ID NO: 583057 - DNA, 25 bp, Rattus norvegicus
tccagcgtccccacgggtatgtaga

SEQ ID NO: 583058 - DNA, 25 bp, Rattus norvegicus
tccagcgtcccctcgggtatgtaga

SEQ ID NO: 583059 - DNA, 25 bp, Rattus norvegicus
tccagcgttgctactttttacatga

SEQ ID NO: 583060 - DNA, 25 bp, Rattus norvegicus
tccagcgttgcttctttttacatga

SEQ ID NO: 583061 - DNA, 25 bp, Rattus norvegicus
tccagctaccagagtccaaacgatg

SEQ ID NO: 583062 - DNA, 25 bp, Rattus norvegicus
tccagctaccagtgtccaaacgatg

SEQ ID NO: 583063 - DNA, 25 bp, Rattus norvegicus
tccagctactggctaggcttcaata

SEQ ID NO: 583064 - DNA, 25 bp, Rattus norvegicus
tccagctactgggtaggcttcaata

SEQ ID NO: 583065 - DNA, 25 bp, Rattus norvegicus
tccagctagcatctttatcgatcga

SEQ ID NO: 583066 - DNA, 25 bp, Rattus norvegicus
tccagctagcatgtttatcgatcga

SEQ ID NO: 583067 - DNA, 25 bp, Rattus norvegicus
tccagctatggcacttggccagcct

SEQ ID NO: 583068 - DNA, 25 bp, Rattus norvegicus
tccagctatggctcttggccagcct

SEQ ID NO: 583069 - DNA, 25 bp, Rattus norvegicus
tccagctcaattcttaagagtgctt

SEQ ID NO: 583070 - DNA, 25 bp, Rattus norvegicus
tccagctcaattgttaagagtgctt

SEQ ID NO: 583071 - DNA, 25 bp, Rattus norvegicus
tccagctcagatcttgctcagatgg

SEQ ID NO: 583072 - DNA, 25 bp, Rattus norvegicus
tccagctcagatgttgctcagatgg

SEQ ID NO: 583073 - DNA, 25 bp, Rattus norvegicus
tccagctccaaactgtcacaggatg

SEQ ID NO: 583074 - DNA, 25 bp, Rattus norvegicus
tccagctccaaagtgtcacaggatg

SEQ ID NO: 583075 - DNA, 25 bp, Rattus norvegicus
tccagctccagcagcgaatgaagca

SEQ ID NO: 583076 - DNA, 25 bp, Rattus norvegicus
tccagctccagcagtgtgctgccaa

SEQ ID NO: 583077 - DNA, 25 bp, Rattus norvegicus
tccagctccagctgcgaatgaagca

SEQ ID NO: 583078 - DNA, 25 bp, Rattus norvegicus
tccagctccagctgtgtgctgccaa

SEQ ID NO: 583079 - DNA, 25 bp, Rattus norvegicus
tccagctccctaatgctgggattat

SEQ ID NO: 583080 - DNA, 25 bp, Rattus norvegicus
tccagctccctattgctgggattat

SEQ ID NO: 583081 - DNA, 25 bp, Rattus norvegicus
tccagctcccttagagctctggaag

SEQ ID NO: 583082 - DNA, 25 bp, Rattus norvegicus
tccagctcccttcggtaaggaacca

SEQ ID NO: 583083 - DNA, 25 bp, Rattus norvegicus
tccagctcccttgggtaaggaacca

SEQ ID NO: 583084 - DNA, 25 bp, Rattus norvegicus
tccagctccctttgagctctggaag

SEQ ID NO: 583085 - DNA, 25 bp, Rattus norvegicus
tccagctcctctatggtacacaaga

SEQ ID NO: 583086 - DNA, 25 bp, Rattus norvegicus
tccagctcctctttggtacacaaga

SEQ ID NO: 583087 - DNA, 25 bp, Rattus norvegicus
tccagctctattacctgaaacggct

SEQ ID NO: 583088 - DNA, 25 bp, Rattus norvegicus
tccagctctatttcctgaaacggct

SEQ ID NO: 583089 - DNA, 25 bp, Rattus norvegicus
tccagctctcacagacaactgtgtt

SEQ ID NO: 583090 - DNA, 25 bp, Rattus norvegicus
tccagctctcactgacaactgtgtt

SEQ ID NO: 583091 - DNA, 25 bp, Rattus norvegicus
tccagctctgtcacgtagatcaggt

SEQ ID NO: 583092 - DNA, 25 bp, Rattus norvegicus
tccagctctgtcatgaacttatctt

SEQ ID NO: 583093 - DNA, 25 bp, Rattus norvegicus
tccagctctgtctcgtagatcaggt

SEQ ID NO: 583094 - DNA, 25 bp, Rattus norvegicus
tccagctctgtcttgaacttatctt

SEQ ID NO: 583095 - DNA, 25 bp, Rattus norvegicus
tccagctgacccagttgcctgacaa

SEQ ID NO: 583096 - DNA, 25 bp, Rattus norvegicus
tccagctgaccctgttgcctgacaa

SEQ ID NO: 583097 - DNA, 25 bp, Rattus norvegicus
tccagctgagctacttacctatgca

SEQ ID NO: 583098 - DNA, 25 bp, Rattus norvegicus
tccagctgagcttcttacctatgca

SEQ ID NO: 583099 - DNA, 25 bp, Rattus norvegicus
tccagctgccagaatgttaatgtta

SEQ ID NO: 583100 - DNA, 25 bp, Rattus norvegicus
tccagctgccagtatgttaatgtta

SEQ ID NO: 583101 - DNA, 25 bp, Rattus norvegicus
tccagctgcggacacccaagaaact

SEQ ID NO: 583102 - DNA, 25 bp, Rattus norvegicus
tccagctgcggagacccaagaaact

SEQ ID NO: 583103 - DNA, 25 bp, Rattus norvegicus
tccagctggaggagacgatgccctc

SEQ ID NO: 583104 - DNA, 25 bp, Rattus norvegicus
tccagctggaggtgacgatgccctc

SEQ ID NO: 583105 - DNA, 25 bp, Rattus norvegicus
tccagctgtgtgaagttactgccac

SEQ ID NO: 583106 - DNA, 25 bp, Rattus norvegicus
tccagctgtgtgtagttactgccac

SEQ ID NO: 583107 - DNA, 25 bp, Rattus norvegicus
tccagctgtttcattcatagatcat

SEQ ID NO: 583108 - DNA, 25 bp, Rattus norvegicus
tccagctgtttcattgtgaacttta

SEQ ID NO: 583109 - DNA, 25 bp, Rattus norvegicus
tccagctgtttctttcatagatcat

SEQ ID NO: 583110 - DNA, 25 bp, Rattus norvegicus
tccagctgtttctttgtgaacttta

SEQ ID NO: 583111 - DNA, 25 bp, Rattus norvegicus
tccagcttagcaacatgaggttttt

SEQ ID NO: 583112 - DNA, 25 bp, Rattus norvegicus
tccagcttagcatcatgaggttttt

SEQ ID NO: 583113 - DNA, 25 bp, Rattus norvegicus
tccagcttccagagagagaacactg

SEQ ID NO: 583114 - DNA, 25 bp, Rattus norvegicus
tccagcttccagtgagagaacactg

SEQ ID NO: 583115 - DNA, 25 bp, Rattus norvegicus
tccagcttccctcggatgggcaagt

SEQ ID NO: 583116 - DNA, 25 bp, Rattus norvegicus
tccagcttccctgggatgggcaagt

SEQ ID NO: 583117 - DNA, 25 bp, Rattus norvegicus
tccagcttcctcatcttacaaatga

SEQ ID NO: 583118 - DNA, 25 bp, Rattus norvegicus
tccagcttcctcttcttacaaatga

SEQ ID NO: 583119 - DNA, 25 bp, Rattus norvegicus
tccagcttccttagctgcgaaaata

SEQ ID NO: 583120 - DNA, 25 bp, Rattus norvegicus
tccagcttcctttgctgcgaaaata

SEQ ID NO: 583121 - DNA, 25 bp, Rattus norvegicus
tccagcttctgcagtgcattgttga

SEQ ID NO: 583122 - DNA, 25 bp, Rattus norvegicus
tccagcttctgctgtgcattgttga

SEQ ID NO: 583123 - DNA, 25 bp, Rattus norvegicus
tccagcttgcttagatcctgattta

SEQ ID NO: 583124 - DNA, 25 bp, Rattus norvegicus
tccagcttgctttgatcctgattta

SEQ ID NO: 583125 - DNA, 25 bp, Rattus norvegicus
tccagcttgttgagttacctttcag

SEQ ID NO: 583126 - DNA, 25 bp, Rattus norvegicus
tccagcttgttgtgttacctttcag

SEQ ID NO: 583127 - DNA, 25 bp, Rattus norvegicus
tccagctttctaccgtggcatcaaa

SEQ ID NO: 583128 - DNA, 25 bp, Rattus norvegicus
tccagctttctagcgtggcatcaaa

SEQ ID NO: 583129 - DNA, 25 bp, Rattus norvegicus
tccagctttgcacttcagagacagt

SEQ ID NO: 583130 - DNA, 25 bp, Rattus norvegicus
tccagctttgcagttcagagacagt

SEQ ID NO: 583131 - DNA, 25 bp, Rattus norvegicus
tccagctttgttagagacgctctta

SEQ ID NO: 583132 - DNA, 25 bp, Rattus norvegicus
tccagctttgttcggagtctccaga

SEQ ID NO: 583133 - DNA, 25 bp, Rattus norvegicus
tccagctttgttgggagtctccaga

SEQ ID NO: 583134 - DNA, 25 bp, Rattus norvegicus
tccagctttgtttgagacgctctta

SEQ ID NO: 583135 - DNA, 25 bp, Rattus norvegicus
tccaggaaacacactcagggacttt

SEQ ID NO: 583136 - DNA, 25 bp, Rattus norvegicus
tccaggaaacactctcagggacttt

SEQ ID NO: 583137 - DNA, 25 bp, Rattus norvegicus
tccaggaagttcaacacagttggct

SEQ ID NO: 583138 - DNA, 25 bp, Rattus norvegicus
tccaggaagttctacacagttggct

SEQ ID NO: 583139 - DNA, 25 bp, Rattus norvegicus
tccaggaatccaccttttgttactc

SEQ ID NO: 583140 - DNA, 25 bp, Rattus norvegicus
tccaggaatccagcttttgttactc

SEQ ID NO: 583141 - DNA, 25 bp, Rattus norvegicus
tccaggaatcctctcagcagaagtg

SEQ ID NO: 583142 - DNA, 25 bp, Rattus norvegicus
tccaggaatcctctggccataggcc

SEQ ID NO: 583143 - DNA, 25 bp, Rattus norvegicus
tccaggaatcctgtcagcagaagtg

SEQ ID NO: 583144 - DNA, 25 bp, Rattus norvegicus
tccaggaatcctgtggccataggcc

SEQ ID NO: 583145 - DNA, 25 bp, Rattus norvegicus
tccaggaatgggacttgtcatggcg

SEQ ID NO: 583146 - DNA, 25 bp, Rattus norvegicus
tccaggaatgggtcttgtcatggcg

SEQ ID NO: 583147 - DNA, 25 bp, Rattus norvegicus
tccaggacagctattattgcttttg

SEQ ID NO: 583148 - DNA, 25 bp, Rattus norvegicus
tccaggacagcttttattgcttttg

SEQ ID NO: 583149 - DNA, 25 bp, Rattus norvegicus
tccaggaccgcgaaaaaagcccatc

SEQ ID NO: 583150 - DNA, 25 bp, Rattus norvegicus
tccaggaccgcgtaaaaagcccatc

SEQ ID NO: 583151 - DNA, 25 bp, Rattus norvegicus
tccaggacgacccttggttttcatt

SEQ ID NO: 583152 - DNA, 25 bp, Rattus norvegicus
tccaggacgaccgttggttttcatt

SEQ ID NO: 583153 - DNA, 25 bp, Rattus norvegicus
tccaggacttggactcagtaagcgt

SEQ ID NO: 583154 - DNA, 25 bp, Rattus norvegicus
tccaggacttggtctcagtaagcgt

SEQ ID NO: 583155 - DNA, 25 bp, Rattus norvegicus
tccaggagaccacccatattggaaa

SEQ ID NO: 583156 - DNA, 25 bp, Rattus norvegicus
tccaggagaccagccatattggaaa

SEQ ID NO: 583157 - DNA, 25 bp, Rattus norvegicus
tccaggagccacaatggttctcttt

SEQ ID NO: 583158 - DNA, 25 bp, Rattus norvegicus
tccaggagccactatggttctcttt

SEQ ID NO: 583159 - DNA, 25 bp, Rattus norvegicus
tccaggagccgactcaggtacacta

SEQ ID NO: 583160 - DNA, 25 bp, Rattus norvegicus
tccaggagccgagtcaggtacacta

SEQ ID NO: 583161 - DNA, 25 bp, Rattus norvegicus
tccaggaggcagatgaagcgaagtt

SEQ ID NO: 583162 - DNA, 25 bp, Rattus norvegicus
tccaggaggcagttgaagcgaagtt

SEQ ID NO: 583163 - DNA, 25 bp, Rattus norvegicus
tccaggaggccgacgaagtgaagtt

SEQ ID NO: 583164 - DNA, 25 bp, Rattus norvegicus
tccaggaggccgtcgaagtgaagtt

SEQ ID NO: 583165 - DNA, 25 bp, Rattus norvegicus
tccaggagggcaaatcatatccatg

SEQ ID NO: 583166 - DNA, 25 bp, Rattus norvegicus
tccaggagggcatatcatatccatg

SEQ ID NO: 583167 - DNA, 25 bp, Rattus norvegicus
tccaggagggccaccttgatgtcat

SEQ ID NO: 583168 - DNA, 25 bp, Rattus norvegicus
tccaggagggcctccttgatgtcat

SEQ ID NO: 583169 - DNA, 25 bp, Rattus norvegicus
tccaggatagccacagccggagtga

SEQ ID NO: 583170 - DNA, 25 bp, Rattus norvegicus
tccaggatagcccatgcttaccaaa

SEQ ID NO: 583171 - DNA, 25 bp, Rattus norvegicus
tccaggatagccgatgcttaccaaa

SEQ ID NO: 583172 - DNA, 25 bp, Rattus norvegicus
tccaggatagcctcagccggagtga

SEQ ID NO: 583173 - DNA, 25 bp, Rattus norvegicus
tccaggatcaccaaccaaagggcag

SEQ ID NO: 583174 - DNA, 25 bp, Rattus norvegicus
tccaggatcacctaccaaagggcag

SEQ ID NO: 583175 - DNA, 25 bp, Rattus norvegicus
tccaggatgacgagctgagcctccg

SEQ ID NO: 583176 - DNA, 25 bp, Rattus norvegicus
tccaggatgacgtgctgagcctccg

SEQ ID NO: 583177 - DNA, 25 bp, Rattus norvegicus
tccaggatgaggacgccattcacat

SEQ ID NO: 583178 - DNA, 25 bp, Rattus norvegicus
tccaggatgaggtcgccattcacat

SEQ ID NO: 583179 - DNA, 25 bp, Rattus norvegicus
tccaggatgctgctgttaaaggtgt

SEQ ID NO: 583180 - DNA, 25 bp, Rattus norvegicus
tccaggatgctggtgttaaaggtgt

SEQ ID NO: 583181 - DNA, 25 bp, Rattus norvegicus
tccaggcaaaatatacacacacagt

SEQ ID NO: 583182 - DNA, 25 bp, Rattus norvegicus
tccaggcaaaatttacacacacagt

SEQ ID NO: 583183 - DNA, 25 bp, Rattus norvegicus
tccaggcaaagtccggtggccagac

SEQ ID NO: 583184 - DNA, 25 bp, Rattus norvegicus
tccaggcaaagtgcggtggccagac

SEQ ID NO: 583185 - DNA, 25 bp, Rattus norvegicus
tccaggcacagaagcatttagaatg

SEQ ID NO: 583186 - DNA, 25 bp, Rattus norvegicus
tccaggcacagatgcatttagaatg

SEQ ID NO: 583187 - DNA, 25 bp, Rattus norvegicus
tccaggcaccttcaagcatcagggt

SEQ ID NO: 583188 - DNA, 25 bp, Rattus norvegicus
tccaggcaccttgaagcatcagggt

SEQ ID NO: 583189 - DNA, 25 bp, Rattus norvegicus
tccaggcactaacacttgcagtcct

SEQ ID NO: 583190 - DNA, 25 bp, Rattus norvegicus
tccaggcactaagacttgcagtcct

SEQ ID NO: 583191 - DNA, 25 bp, Rattus norvegicus
tccaggcagcatagataccgtctag

SEQ ID NO: 583192 - DNA, 25 bp, Rattus norvegicus
tccaggcagcattgataccgtctag

SEQ ID NO: 583193 - DNA, 25 bp, Rattus norvegicus
tccaggcagggcatagtccaacctg

SEQ ID NO: 583194 - DNA, 25 bp, Rattus norvegicus
tccaggcagggcttagtccaacctg

SEQ ID NO: 583195 - DNA, 25 bp, Rattus norvegicus
tccaggcattatattagggcagatt

SEQ ID NO: 583196 - DNA, 25 bp, Rattus norvegicus
tccaggcattattttagggcagatt

SEQ ID NO: 583197 - DNA, 25 bp, Rattus norvegicus
tccaggccagtcaaagctacagagg

SEQ ID NO: 583198 - DNA, 25 bp, Rattus norvegicus
tccaggccagtccaggctatgttgt

SEQ ID NO: 583199 - DNA, 25 bp, Rattus norvegicus
tccaggccagtcgaggctatgttgt

SEQ ID NO: 583200 - DNA, 25 bp, Rattus norvegicus
tccaggccagtctaagctacagagg

SEQ ID NO: 583201 - DNA, 25 bp, Rattus norvegicus
tccaggccctgcactaattaggaag

SEQ ID NO: 583202 - DNA, 25 bp, Rattus norvegicus
tccaggccctgctctaattaggaag

SEQ ID NO: 583203 - DNA, 25 bp, Rattus norvegicus
tccaggcctctgaaaaggccggtgt

SEQ ID NO: 583204 - DNA, 25 bp, Rattus norvegicus
tccaggcctctgtaaaggccggtgt

SEQ ID NO: 583205 - DNA, 25 bp, Rattus norvegicus
tccaggcgaagaagcagcagagccc

SEQ ID NO: 583206 - DNA, 25 bp, Rattus norvegicus
tccaggcgaagatgcagcagagccc

SEQ ID NO: 583207 - DNA, 25 bp, Rattus norvegicus
tccaggcgcatgaagggcttgctca

SEQ ID NO: 583208 - DNA, 25 bp, Rattus norvegicus
tccaggcgcatgtagggcttgctca

SEQ ID NO: 583209 - DNA, 25 bp, Rattus norvegicus
tccaggcggcgtacacgctttggtg

SEQ ID NO: 583210 - DNA, 25 bp, Rattus norvegicus
tccaggcggcgttcacgctttggtg

SEQ ID NO: 583211 - DNA, 25 bp, Rattus norvegicus
tccaggcgtcggcaagtactccaaa

SEQ ID NO: 583212 - DNA, 25 bp, Rattus norvegicus
tccaggcgtcgggaagtactccaaa

SEQ ID NO: 583213 - DNA, 25 bp, Rattus norvegicus
tccaggctacatcccattgtgaatt

SEQ ID NO: 583214 - DNA, 25 bp, Rattus norvegicus
tccaggctacatgccattgtgaatt

SEQ ID NO: 583215 - DNA, 25 bp, Rattus norvegicus
tccaggctcacgctttttgtgatag

SEQ ID NO: 583216 - DNA, 25 bp, Rattus norvegicus
tccaggctcacggtttttgtgatag

SEQ ID NO: 583217 - DNA, 25 bp, Rattus norvegicus
tccaggctcctgagatgagtcccat

SEQ ID NO: 583218 - DNA, 25 bp, Rattus norvegicus
tccaggctcctgtgatgagtcccat

SEQ ID NO: 583219 - DNA, 25 bp, Rattus norvegicus
tccaggctgatgacgtccatgttga

SEQ ID NO: 583220 - DNA, 25 bp, Rattus norvegicus
tccaggctgatgtcgtccatgttga

SEQ ID NO: 583221 - DNA, 25 bp, Rattus norvegicus
tccaggctgcacacacagagctgct

SEQ ID NO: 583222 - DNA, 25 bp, Rattus norvegicus
tccaggctgcactcacagagctgct

SEQ ID NO: 583223 - DNA, 25 bp, Rattus norvegicus
tccaggctgcagatcccagatatac

SEQ ID NO: 583224 - DNA, 25 bp, Rattus norvegicus
tccaggctgcagttcccagatatac

SEQ ID NO: 583225 - DNA, 25 bp, Rattus norvegicus
tccaggctggacactttccactcta

SEQ ID NO: 583226 - DNA, 25 bp, Rattus norvegicus
tccaggctggactctttccactcta

SEQ ID NO: 583227 - DNA, 25 bp, Rattus norvegicus
tccaggctggctagatctccgtagt

SEQ ID NO: 583228 - DNA, 25 bp, Rattus norvegicus
tccaggctggcttgatctccgtagt

SEQ ID NO: 583229 - DNA, 25 bp, Rattus norvegicus
tccaggctgggaaactggtggccca

SEQ ID NO: 583230 - DNA, 25 bp, Rattus norvegicus
tccaggctgggatactggtggccca

SEQ ID NO: 583231 - DNA, 25 bp, Rattus norvegicus
tccaggctgtcgcaatagcttcttt

SEQ ID NO: 583232 - DNA, 25 bp, Rattus norvegicus
tccaggctgtcggaatagcttcttt

SEQ ID NO: 583233 - DNA, 25 bp, Rattus norvegicus
tccaggctgtgacggcctgtgcaca

SEQ ID NO: 583234 - DNA, 25 bp, Rattus norvegicus
tccaggctgtgacgttatggctcca

SEQ ID NO: 583235 - DNA, 25 bp, Rattus norvegicus
tccaggctgtgagggcctgtgcaca

SEQ ID NO: 583236 - DNA, 25 bp, Rattus norvegicus
tccaggctgtgaggttatggctcca

SEQ ID NO: 583237 - DNA, 25 bp, Rattus norvegicus
tccaggctgtgtacttattttattt

SEQ ID NO: 583238 - DNA, 25 bp, Rattus norvegicus
tccaggctgtgttcttattttattt

SEQ ID NO: 583239 - DNA, 25 bp, Rattus norvegicus
tccaggcttcctaaatcatggaggt

SEQ ID NO: 583240 - DNA, 25 bp, Rattus norvegicus
tccaggcttccttaatcatggaggt

SEQ ID NO: 583241 - DNA, 25 bp, Rattus norvegicus
tccaggcttggaacgcagattctca

SEQ ID NO: 583242 - DNA, 25 bp, Rattus norvegicus
tccaggcttggatcgcagattctca

SEQ ID NO: 583243 - DNA, 25 bp, Rattus norvegicus
tccaggctttggcttatgtactttt

SEQ ID NO: 583244 - DNA, 25 bp, Rattus norvegicus
tccaggctttgggttatgtactttt

SEQ ID NO: 583245 - DNA, 25 bp, Rattus norvegicus
tccagggaaaccactagcagctgcc

SEQ ID NO: 583246 - DNA, 25 bp, Rattus norvegicus
tccagggaaacctctagcagctgcc

SEQ ID NO: 583247 - DNA, 25 bp, Rattus norvegicus
tccagggacactccttggttggtga

SEQ ID NO: 583248 - DNA, 25 bp, Rattus norvegicus
tccagggacactgcttggttggtga

SEQ ID NO: 583249 - DNA, 25 bp, Rattus norvegicus
tccagggagcttcaggcaggcacat

SEQ ID NO: 583250 - DNA, 25 bp, Rattus norvegicus
tccagggagcttgaggcaggcacat

SEQ ID NO: 583251 - DNA, 25 bp, Rattus norvegicus
tccagggaggtaccctcagtatctt

SEQ ID NO: 583252 - DNA, 25 bp, Rattus norvegicus
tccagggaggtagcctcagtatctt

SEQ ID NO: 583253 - DNA, 25 bp, Rattus norvegicus
tccagggaggttaccgacggctgcc

SEQ ID NO: 583254 - DNA, 25 bp, Rattus norvegicus
tccagggaggtttccgacggctgcc

SEQ ID NO: 583255 - DNA, 25 bp, Rattus norvegicus
tccagggatcacctggtgccagata

SEQ ID NO: 583256 - DNA, 25 bp, Rattus norvegicus
tccagggatcacgtggtgccagata

SEQ ID NO: 583257 - DNA, 25 bp, Rattus norvegicus
tccagggattctacgtgtctattgt

SEQ ID NO: 583258 - DNA, 25 bp, Rattus norvegicus
tccagggattcttcgtgtctattgt

SEQ ID NO: 583259 - DNA, 25 bp, Rattus norvegicus
tccagggcatagaccagccactgga

SEQ ID NO: 583260 - DNA, 25 bp, Rattus norvegicus
tccagggcatagtccagccactgga

SEQ ID NO: 583261 - DNA, 25 bp, Rattus norvegicus
tccagggccactaacaagcagcgag

SEQ ID NO: 583262 - DNA, 25 bp, Rattus norvegicus
tccagggccacttacaagcagcgag

SEQ ID NO: 583263 - DNA, 25 bp, Rattus norvegicus
tccagggcccgcaagtgcaagacaa

SEQ ID NO: 583264 - DNA, 25 bp, Rattus norvegicus
tccagggcccgctagtgcaagacaa

SEQ ID NO: 583265 - DNA, 25 bp, Rattus norvegicus
tccagggccttgcagtctagttttc

SEQ ID NO: 583266 - DNA, 25 bp, Rattus norvegicus
tccagggccttggagtctagttttc

SEQ ID NO: 583267 - DNA, 25 bp, Rattus norvegicus
tccagggcggacatcagggtacagt

SEQ ID NO: 583268 - DNA, 25 bp, Rattus norvegicus
tccagggcggacttcagggtacagt

SEQ ID NO: 583269 - DNA, 25 bp, Rattus norvegicus
tccagggtagtaacttcctcttggg

SEQ ID NO: 583270 - DNA, 25 bp, Rattus norvegicus
tccagggtagtatcttcctcttggg

SEQ ID NO: 583271 - DNA, 25 bp, Rattus norvegicus
tccagggtatagatgccagcctcta

SEQ ID NO: 583272 - DNA, 25 bp, Rattus norvegicus
tccagggtatagttgccagcctcta

SEQ ID NO: 583273 - DNA, 25 bp, Rattus norvegicus
tccagggtctttagggagttctctc

SEQ ID NO: 583274 - DNA, 25 bp, Rattus norvegicus
tccagggtcttttgggagttctctc

SEQ ID NO: 583275 - DNA, 25 bp, Rattus norvegicus
tccagggtgccactcaaactctgaa

SEQ ID NO: 583276 - DNA, 25 bp, Rattus norvegicus
tccagggtgccagtcaaactctgaa

SEQ ID NO: 583277 - DNA, 25 bp, Rattus norvegicus
tccagggtgcctcaaagccagctag

SEQ ID NO: 583278 - DNA, 25 bp, Rattus norvegicus
tccagggtgcctgaaagccagctag

SEQ ID NO: 583279 - DNA, 25 bp, Rattus norvegicus
tccagggtggagaacagcaacgtgt

SEQ ID NO: 583280 - DNA, 25 bp, Rattus norvegicus
tccagggtggagtacagcaacgtgt

SEQ ID NO: 583281 - DNA, 25 bp, Rattus norvegicus
tccagggtggctacgatggctatgc

SEQ ID NO: 583282 - DNA, 25 bp, Rattus norvegicus
tccagggtggctcgcagggtcggct

SEQ ID NO: 583283 - DNA, 25 bp, Rattus norvegicus
tccagggtggctggcagggtcggct

SEQ ID NO: 583284 - DNA, 25 bp, Rattus norvegicus
tccagggtggcttcgatggctatgc

SEQ ID NO: 583285 - DNA, 25 bp, Rattus norvegicus
tccagggtgtgcatgtgccaagaaa

SEQ ID NO: 583286 - DNA, 25 bp, Rattus norvegicus
tccagggtgtgcttgtgccaagaaa

SEQ ID NO: 583287 - DNA, 25 bp, Rattus norvegicus
tccagggttgatcttcaactgctaa

SEQ ID NO: 583288 - DNA, 25 bp, Rattus norvegicus
tccagggttgatgttcaactgctaa

SEQ ID NO: 583289 - DNA, 25 bp, Rattus norvegicus
tccaggtaacgtaaggaaaggagct

SEQ ID NO: 583290 - DNA, 25 bp, Rattus norvegicus
tccaggtaacgttaggaaaggagct

SEQ ID NO: 583291 - DNA, 25 bp, Rattus norvegicus
tccaggtaatggaatcagctaattt

SEQ ID NO: 583292 - DNA, 25 bp, Rattus norvegicus
tccaggtaatggtatcagctaattt

SEQ ID NO: 583293 - DNA, 25 bp, Rattus norvegicus
tccaggtagcaaagactgttgcgtt

SEQ ID NO: 583294 - DNA, 25 bp, Rattus norvegicus
tccaggtagcaatgactgttgcgtt

SEQ ID NO: 583295 - DNA, 25 bp, Rattus norvegicus
tccaggtaggccaccaccagggtgg

SEQ ID NO: 583296 - DNA, 25 bp, Rattus norvegicus
tccaggtaggcctccaccagggtgg

SEQ ID NO: 583297 - DNA, 25 bp, Rattus norvegicus
tccaggtatcacaccaggttctgaa

SEQ ID NO: 583298 - DNA, 25 bp, Rattus norvegicus
tccaggtatcactccaggttctgaa

SEQ ID NO: 583299 - DNA, 25 bp, Rattus norvegicus
tccaggtatccccaacctgcaataa

SEQ ID NO: 583300 - DNA, 25 bp, Rattus norvegicus
tccaggtatcccgaacctgcaataa

SEQ ID NO: 583301 - DNA, 25 bp, Rattus norvegicus
tccaggtcagcactgaaggaattct

SEQ ID NO: 583302 - DNA, 25 bp, Rattus norvegicus
tccaggtcagcagtgaaggaattct

SEQ ID NO: 583303 - DNA, 25 bp, Rattus norvegicus
tccaggtcaggaatgagtgtccctt

SEQ ID NO: 583304 - DNA, 25 bp, Rattus norvegicus
tccaggtcaggattgagtgtccctt

SEQ ID NO: 583305 - DNA, 25 bp, Rattus norvegicus
tccaggtcatacacagacgccagct

SEQ ID NO: 583306 - DNA, 25 bp, Rattus norvegicus
tccaggtcatactcagacgccagct

SEQ ID NO: 583307 - DNA, 25 bp, Rattus norvegicus
tccaggtccaggacgcgatccagaa

SEQ ID NO: 583308 - DNA, 25 bp, Rattus norvegicus
tccaggtccaggaggtggctcaccg

SEQ ID NO: 583309 - DNA, 25 bp, Rattus norvegicus
tccaggtccaggtcgcgatccagaa

SEQ ID NO: 583310 - DNA, 25 bp, Rattus norvegicus
tccaggtccaggtggtggctcaccg

SEQ ID NO: 583311 - DNA, 25 bp, Rattus norvegicus
tccaggtcccgtacaagaagctctt

SEQ ID NO: 583312 - DNA, 25 bp, Rattus norvegicus
tccaggtcccgttcaagaagctctt

SEQ ID NO: 583313 - DNA, 25 bp, Rattus norvegicus
tccaggtccctaatgtaaattacat

SEQ ID NO: 583314 - DNA, 25 bp, Rattus norvegicus
tccaggtccctattgtaaattacat

SEQ ID NO: 583315 - DNA, 25 bp, Rattus norvegicus
tccaggtcttttatagtgagagttc

SEQ ID NO: 583316 - DNA, 25 bp, Rattus norvegicus
tccaggtcttttttagtgagagttc

SEQ ID NO: 583317 - DNA, 25 bp, Rattus norvegicus
tccaggtgcagcaagatctgtcgga

SEQ ID NO: 583318 - DNA, 25 bp, Rattus norvegicus
tccaggtgcagctagatctgtcgga

SEQ ID NO: 583319 - DNA, 25 bp, Rattus norvegicus
tccaggtgcccaatgcagcagaggt

SEQ ID NO: 583320 - DNA, 25 bp, Rattus norvegicus
tccaggtgcccattgcagcagaggt

SEQ ID NO: 583321 - DNA, 25 bp, Rattus norvegicus
tccaggtgctttactcagagctgat

SEQ ID NO: 583322 - DNA, 25 bp, Rattus norvegicus
tccaggtgcttttctcagagctgat

SEQ ID NO: 583323 - DNA, 25 bp, Rattus norvegicus
tccaggtggacgcttcccagagaat

SEQ ID NO: 583324 - DNA, 25 bp, Rattus norvegicus
tccaggtggacggttcccagagaat

SEQ ID NO: 583325 - DNA, 25 bp, Rattus norvegicus
tccaggtggcacagagactcagaga

SEQ ID NO: 583326 - DNA, 25 bp, Rattus norvegicus
tccaggtggcactgagactcagaga

SEQ ID NO: 583327 - DNA, 25 bp, Rattus norvegicus
tccaggtgggatcaggacagacctc

SEQ ID NO: 583328 - DNA, 25 bp, Rattus norvegicus
tccaggtgggatgaggacagacctc

SEQ ID NO: 583329 - DNA, 25 bp, Rattus norvegicus
tccaggtgggcaatctccagtgaga

SEQ ID NO: 583330 - DNA, 25 bp, Rattus norvegicus
tccaggtgggcattctccagtgaga

SEQ ID NO: 583331 - DNA, 25 bp, Rattus norvegicus
tccaggttatctcggccctgagaaa

SEQ ID NO: 583332 - DNA, 25 bp, Rattus norvegicus
tccaggttatctgggccctgagaaa

SEQ ID NO: 583333 - DNA, 25 bp, Rattus norvegicus
tccaggttatttcttcgctttgcgc

SEQ ID NO: 583334 - DNA, 25 bp, Rattus norvegicus
tccaggttatttgttcgctttgcgc

SEQ ID NO: 583335 - DNA, 25 bp, Rattus norvegicus
tccaggttccacagagtctgagcag

SEQ ID NO: 583336 - DNA, 25 bp, Rattus norvegicus
tccaggttccactgagtctgagcag

SEQ ID NO: 583337 - DNA, 25 bp, Rattus norvegicus
tccaggttcggcacccggcgtgagt

SEQ ID NO: 583338 - DNA, 25 bp, Rattus norvegicus
tccaggttcggctcccggcgtgagt

SEQ ID NO: 583339 - DNA, 25 bp, Rattus norvegicus
tccaggttctatctgagttcaatct

SEQ ID NO: 583340 - DNA, 25 bp, Rattus norvegicus
tccaggttctatgtgagttcaatct

SEQ ID NO: 583341 - DNA, 25 bp, Rattus norvegicus
tccaggttgctgctacaagcccatg

SEQ ID NO: 583342 - DNA, 25 bp, Rattus norvegicus
tccaggttgctggtacaagcccatg

SEQ ID NO: 583343 - DNA, 25 bp, Rattus norvegicus
tccaggtttcccctaggcatcttaa

SEQ ID NO: 583344 - DNA, 25 bp, Rattus norvegicus
tccaggtttcccgtaggcatcttaa

SEQ ID NO: 583345 - DNA, 25 bp, Rattus norvegicus
tccagtaaggctctcttcttgtcat

SEQ ID NO: 583346 - DNA, 25 bp, Rattus norvegicus
tccagtaaggctgtcttcttgtcat

SEQ ID NO: 583347 - DNA, 25 bp, Rattus norvegicus
tccagtaatcctcatcaaagtgcat

SEQ ID NO: 583348 - DNA, 25 bp, Rattus norvegicus
tccagtaatcctgatcaaagtgcat

SEQ ID NO: 583349 - DNA, 25 bp, Rattus norvegicus
tccagtaattacccttcgggaacag

SEQ ID NO: 583350 - DNA, 25 bp, Rattus norvegicus
tccagtaattacgcttcgggaacag

SEQ ID NO: 583351 - DNA, 25 bp, Rattus norvegicus
tccagtaggctgatttcttttttct

SEQ ID NO: 583352 - DNA, 25 bp, Rattus norvegicus
tccagtaggctgttttcttttttct

SEQ ID NO: 583353 - DNA, 25 bp, Rattus norvegicus
tccagtagtaccagcatcacatcga

SEQ ID NO: 583354 - DNA, 25 bp, Rattus norvegicus
tccagtagtacctgcatcacatcga

SEQ ID NO: 583355 - DNA, 25 bp, Rattus norvegicus
tccagtagtcctcccttattctagg

SEQ ID NO: 583356 - DNA, 25 bp, Rattus norvegicus
tccagtagtcctgccttattctagg

SEQ ID NO: 583357 - DNA, 25 bp, Rattus norvegicus
tccagtattccccaagctgctgtgt

SEQ ID NO: 583358 - DNA, 25 bp, Rattus norvegicus
tccagtattcccgaagctgctgtgt

SEQ ID NO: 583359 - DNA, 25 bp, Rattus norvegicus
tccagtattctgaaagccgagctat

SEQ ID NO: 583360 - DNA, 25 bp, Rattus norvegicus
tccagtattctgtaagccgagctat

SEQ ID NO: 583361 - DNA, 25 bp, Rattus norvegicus
tccagtcacagactggaccgcttat

SEQ ID NO: 583362 - DNA, 25 bp, Rattus norvegicus
tccagtcacagagtggaccgcttat

SEQ ID NO: 583363 - DNA, 25 bp, Rattus norvegicus
tccagtcactaaccgcggcgcgcgg

SEQ ID NO: 583364 - DNA, 25 bp, Rattus norvegicus
tccagtcactaagcgcggcgcgcgg

SEQ ID NO: 583365 - DNA, 25 bp, Rattus norvegicus
tccagtcattctcagggcacacgat

SEQ ID NO: 583366 - DNA, 25 bp, Rattus norvegicus
tccagtcattctgagggcacacgat

SEQ ID NO: 583367 - DNA, 25 bp, Rattus norvegicus
tccagtccaatcatcctactctgtg

SEQ ID NO: 583368 - DNA, 25 bp, Rattus norvegicus
tccagtccaatcttcctactctgtg

SEQ ID NO: 583369 - DNA, 25 bp, Rattus norvegicus
tccagtccagcaaactccagtagat

SEQ ID NO: 583370 - DNA, 25 bp, Rattus norvegicus
tccagtccagcatactccagtagat

SEQ ID NO: 583371 - DNA, 25 bp, Rattus norvegicus
tccagtccatgtcggctttggtgag

SEQ ID NO: 583372 - DNA, 25 bp, Rattus norvegicus
tccagtccatgtgggctttggtgag

SEQ ID NO: 583373 - DNA, 25 bp, Rattus norvegicus
tccagtcccaaaaagagatttcttg

SEQ ID NO: 583374 - DNA, 25 bp, Rattus norvegicus
tccagtcccaaatagagatttcttg

SEQ ID NO: 583375 - DNA, 25 bp, Rattus norvegicus
tccagtcccagaatcacagtcttaa

SEQ ID NO: 583376 - DNA, 25 bp, Rattus norvegicus
tccagtcccagattcacagtcttaa

SEQ ID NO: 583377 - DNA, 25 bp, Rattus norvegicus
tccagtcccctcctgggaagtgcag

SEQ ID NO: 583378 - DNA, 25 bp, Rattus norvegicus
tccagtcccctcgtgggaagtgcag

SEQ ID NO: 583379 - DNA, 25 bp, Rattus norvegicus
tccagtcctagcactgccatataaa

SEQ ID NO: 583380 - DNA, 25 bp, Rattus norvegicus
tccagtcctagcagggcagctgtga

SEQ ID NO: 583381 - DNA, 25 bp, Rattus norvegicus
tccagtcctagctctgccatataaa

SEQ ID NO: 583382 - DNA, 25 bp, Rattus norvegicus
tccagtcctagctgggcagctgtga

SEQ ID NO: 583383 - DNA, 25 bp, Rattus norvegicus
tccagtcctaggaaatcccatgaac

SEQ ID NO: 583384 - DNA, 25 bp, Rattus norvegicus
tccagtcctaggtaatcccatgaac

SEQ ID NO: 583385 - DNA, 25 bp, Rattus norvegicus
tccagtcctcacacctgaattcaga

SEQ ID NO: 583386 - DNA, 25 bp, Rattus norvegicus
tccagtcctcactcctgaattcaga

SEQ ID NO: 583387 - DNA, 25 bp, Rattus norvegicus
tccagtcctggtaccagctgtgcac

SEQ ID NO: 583388 - DNA, 25 bp, Rattus norvegicus
tccagtcctggttccagctgtgcac

SEQ ID NO: 583389 - DNA, 25 bp, Rattus norvegicus
tccagtccttgtccttgataaacct

SEQ ID NO: 583390 - DNA, 25 bp, Rattus norvegicus
tccagtccttgtgcttgataaacct

SEQ ID NO: 583391 - DNA, 25 bp, Rattus norvegicus
tccagtcgacgcatcttttttatac

SEQ ID NO: 583392 - DNA, 25 bp, Rattus norvegicus
tccagtcgacgcttcttttttatac

SEQ ID NO: 583393 - DNA, 25 bp, Rattus norvegicus
tccagtcgttctcccaactaaaaat

SEQ ID NO: 583394 - DNA, 25 bp, Rattus norvegicus
tccagtcgttctgccaactaaaaat

SEQ ID NO: 583395 - DNA, 25 bp, Rattus norvegicus
tccagtctccctccttaagtgatgg

SEQ ID NO: 583396 - DNA, 25 bp, Rattus norvegicus
tccagtctccctgcttaagtgatgg

SEQ ID NO: 583397 - DNA, 25 bp, Rattus norvegicus
tccagtctcctaaagccagggaaaa

SEQ ID NO: 583398 - DNA, 25 bp, Rattus norvegicus
tccagtctcctatagccagggaaaa

SEQ ID NO: 583399 - DNA, 25 bp, Rattus norvegicus
tccagtctctgcatcctgagtagca

SEQ ID NO: 583400 - DNA, 25 bp, Rattus norvegicus
tccagtctctgcttcctgagtagca

SEQ ID NO: 583401 - DNA, 25 bp, Rattus norvegicus
tccagtctgatgctgtcggagtctg

SEQ ID NO: 583402 - DNA, 25 bp, Rattus norvegicus
tccagtctgatggtgtcggagtctg

SEQ ID NO: 583403 - DNA, 25 bp, Rattus norvegicus
tccagtctgcacaattagccattca

SEQ ID NO: 583404 - DNA, 25 bp, Rattus norvegicus
tccagtctgcactattagccattca

SEQ ID NO: 583405 - DNA, 25 bp, Rattus norvegicus
tccagtctgccacgaggttggtcaa

SEQ ID NO: 583406 - DNA, 25 bp, Rattus norvegicus
tccagtctgccaggaggttggtcaa

SEQ ID NO: 583407 - DNA, 25 bp, Rattus norvegicus
tccagtcttcctctctaggctagaa

SEQ ID NO: 583408 - DNA, 25 bp, Rattus norvegicus
tccagtcttcctgtctaggctagaa

SEQ ID NO: 583409 - DNA, 25 bp, Rattus norvegicus
tccagtgagcaacgacatcccaggg

SEQ ID NO: 583410 - DNA, 25 bp, Rattus norvegicus
tccagtgagcaaggacatcccaggg

SEQ ID NO: 583411 - DNA, 25 bp, Rattus norvegicus
tccagtgaggccctcgggtcatata

SEQ ID NO: 583412 - DNA, 25 bp, Rattus norvegicus
tccagtgaggccgtcgggtcatata

SEQ ID NO: 583413 - DNA, 25 bp, Rattus norvegicus
tccagtgatggccaatgtacaaaat

SEQ ID NO: 583414 - DNA, 25 bp, Rattus norvegicus
tccagtgatggcgaatgtacaaaat

SEQ ID NO: 583415 - DNA, 25 bp, Rattus norvegicus
tccagtgcagccaactcggtgtgtg

SEQ ID NO: 583416 - DNA, 25 bp, Rattus norvegicus
tccagtgcagcctactcggtgtgtg

SEQ ID NO: 583417 - DNA, 25 bp, Rattus norvegicus
tccagtgcatgccagatgccagtaa

SEQ ID NO: 583418 - DNA, 25 bp, Rattus norvegicus
tccagtgcatgcgagatgccagtaa

SEQ ID NO: 583419 - DNA, 25 bp, Rattus norvegicus
tccagtgccatgagctcgattttgt

SEQ ID NO: 583420 - DNA, 25 bp, Rattus norvegicus
tccagtgccatgtgctcgattttgt

SEQ ID NO: 583421 - DNA, 25 bp, Rattus norvegicus
tccagtgcccatatggtgggttcaa

SEQ ID NO: 583422 - DNA, 25 bp, Rattus norvegicus
tccagtgcccatttggtgggttcaa

SEQ ID NO: 583423 - DNA, 25 bp, Rattus norvegicus
tccagtgccggaacaggctgcacaa

SEQ ID NO: 583424 - DNA, 25 bp, Rattus norvegicus
tccagtgccggatcaggctgcacaa

SEQ ID NO: 583425 - DNA, 25 bp, Rattus norvegicus
tccagtgcctcgagtaacagcttaa

SEQ ID NO: 583426 - DNA, 25 bp, Rattus norvegicus
tccagtgcctcgtgtaacagcttaa

SEQ ID NO: 583427 - DNA, 25 bp, Rattus norvegicus
tccagtgcgcgtataggctgttgag

SEQ ID NO: 583428 - DNA, 25 bp, Rattus norvegicus
tccagtgcgcgtttaggctgttgag

SEQ ID NO: 583429 - DNA, 25 bp, Rattus norvegicus
tccagtgctcctattggactgagtt

SEQ ID NO: 583430 - DNA, 25 bp, Rattus norvegicus
tccagtgctccttttggactgagtt

SEQ ID NO: 583431 - DNA, 25 bp, Rattus norvegicus
tccagtgctcttccctacgtagaga

SEQ ID NO: 583432 - DNA, 25 bp, Rattus norvegicus
tccagtgctcttgcctacgtagaga

SEQ ID NO: 583433 - DNA, 25 bp, Rattus norvegicus
tccagtgctgaaagtttgttttaaa

SEQ ID NO: 583434 - DNA, 25 bp, Rattus norvegicus
tccagtgctgaacaagttagatgag

SEQ ID NO: 583435 - DNA, 25 bp, Rattus norvegicus
tccagtgctgaagaagttagatgag

SEQ ID NO: 583436 - DNA, 25 bp, Rattus norvegicus
tccagtgctgaatgtttgttttaaa

SEQ ID NO: 583437 - DNA, 25 bp, Rattus norvegicus
tccagtgctgctattgtactcggac

SEQ ID NO: 583438 - DNA, 25 bp, Rattus norvegicus
tccagtgctgcttttgtactcggac

SEQ ID NO: 583439 - DNA, 25 bp, Rattus norvegicus
tccagtgctgggaacggtgtgttcc

SEQ ID NO: 583440 - DNA, 25 bp, Rattus norvegicus
tccagtgctgggtacggtgtgttcc

SEQ ID NO: 583441 - DNA, 25 bp, Rattus norvegicus
tccagtgctggtatcgtaccttata

SEQ ID NO: 583442 - DNA, 25 bp, Rattus norvegicus
tccagtgctggtttcgtaccttata

SEQ ID NO: 583443 - DNA, 25 bp, Rattus norvegicus
tccagtggactacaatcgccggcct

SEQ ID NO: 583444 - DNA, 25 bp, Rattus norvegicus
tccagtggactagaatcgccggcct

SEQ ID NO: 583445 - DNA, 25 bp, Rattus norvegicus
tccagtggagcaagggcactcactt

SEQ ID NO: 583446 - DNA, 25 bp, Rattus norvegicus
tccagtggagcatgggcactcactt

SEQ ID NO: 583447 - DNA, 25 bp, Rattus norvegicus
tccagtggattccacggaacctcag

SEQ ID NO: 583448 - DNA, 25 bp, Rattus norvegicus
tccagtggattcgacggaacctcag

SEQ ID NO: 583449 - DNA, 25 bp, Rattus norvegicus
tccagtggcgtcattgactttcaga

SEQ ID NO: 583450 - DNA, 25 bp, Rattus norvegicus
tccagtggcgtctttgactttcaga

SEQ ID NO: 583451 - DNA, 25 bp, Rattus norvegicus
tccagtggctggatggctttgtcta

SEQ ID NO: 583452 - DNA, 25 bp, Rattus norvegicus
tccagtggctggttggctttgtcta

SEQ ID NO: 583453 - DNA, 25 bp, Rattus norvegicus
tccagtggctgtcgccagttgtaca

SEQ ID NO: 583454 - DNA, 25 bp, Rattus norvegicus
tccagtggctgtggccagttgtaca

SEQ ID NO: 583455 - DNA, 25 bp, Rattus norvegicus
tccagtgggagtatctgttctgctt

SEQ ID NO: 583456 - DNA, 25 bp, Rattus norvegicus
tccagtgggagtttctgttctgctt

SEQ ID NO: 583457 - DNA, 25 bp, Rattus norvegicus
tccagtgggtgcaccgtacatggta

SEQ ID NO: 583458 - DNA, 25 bp, Rattus norvegicus
tccagtgggtgctccgtacatggta

SEQ ID NO: 583459 - DNA, 25 bp, Rattus norvegicus
tccagtggtctcatgccaattgttc

SEQ ID NO: 583460 - DNA, 25 bp, Rattus norvegicus
tccagtggtctcttgccaattgttc

SEQ ID NO: 583461 - DNA, 25 bp, Rattus norvegicus
tccagtggtgtcaagagcagctact

SEQ ID NO: 583462 - DNA, 25 bp, Rattus norvegicus
tccagtggtgtctagagcagctact

SEQ ID NO: 583463 - DNA, 25 bp, Rattus norvegicus
tccagtgtaactcaaagcggtccct

SEQ ID NO: 583464 - DNA, 25 bp, Rattus norvegicus
tccagtgtaactgaaagcggtccct

SEQ ID NO: 583465 - DNA, 25 bp, Rattus norvegicus
tccagtgtatgcctagagtctttgt

SEQ ID NO: 583466 - DNA, 25 bp, Rattus norvegicus
tccagtgtatgcgtagagtctttgt

SEQ ID NO: 583467 - DNA, 25 bp, Rattus norvegicus
tccagtgtcattacccagaagagat

SEQ ID NO: 583468 - DNA, 25 bp, Rattus norvegicus
tccagtgtcatttcccagaagagat

SEQ ID NO: 583469 - DNA, 25 bp, Rattus norvegicus
tccagtgtccttcaggaggtctgtg

SEQ ID NO: 583470 - DNA, 25 bp, Rattus norvegicus
tccagtgtccttgaggaggtctgtg

SEQ ID NO: 583471 - DNA, 25 bp, Rattus norvegicus
tccagtgtcggtctgcatgtattct

SEQ ID NO: 583472 - DNA, 25 bp, Rattus norvegicus
tccagtgtcggtgtgcatgtattct

SEQ ID NO: 583473 - DNA, 25 bp, Rattus norvegicus
tccagtgtcttacggctaaccatca

SEQ ID NO: 583474 - DNA, 25 bp, Rattus norvegicus
tccagtgtcttagggctaaccatca

SEQ ID NO: 583475 - DNA, 25 bp, Rattus norvegicus
tccagtgtgactcccattattacaa

SEQ ID NO: 583476 - DNA, 25 bp, Rattus norvegicus
tccagtgtgactgccattattacaa

SEQ ID NO: 583477 - DNA, 25 bp, Rattus norvegicus
tccagtgtgagcatctgggaccaca

SEQ ID NO: 583478 - DNA, 25 bp, Rattus norvegicus
tccagtgtgagcttctgggaccaca

SEQ ID NO: 583479 - DNA, 25 bp, Rattus norvegicus
tccagtgtgggaacggaggctgccc

SEQ ID NO: 583480 - DNA, 25 bp, Rattus norvegicus
tccagtgtgggatcggaggctgccc

SEQ ID NO: 583481 - DNA, 25 bp, Rattus norvegicus
tccagtgtttggctctgtgcgaaac

SEQ ID NO: 583482 - DNA, 25 bp, Rattus norvegicus
tccagtgtttgggtctgtgcgaaac

SEQ ID NO: 583483 - DNA, 25 bp, Rattus norvegicus
tccagttaactgatccttatttgtg

SEQ ID NO: 583484 - DNA, 25 bp, Rattus norvegicus
tccagttaactgttccttatttgtg

SEQ ID NO: 583485 - DNA, 25 bp, Rattus norvegicus
tccagttattaaacggtgcggattg

SEQ ID NO: 583486 - DNA, 25 bp, Rattus norvegicus
tccagttattaatcggtgcggattg

SEQ ID NO: 583487 - DNA, 25 bp, Rattus norvegicus
tccagttccaagcagcagtgtggca

SEQ ID NO: 583488 - DNA, 25 bp, Rattus norvegicus
tccagttccaaggagcagtgtggca

SEQ ID NO: 583489 - DNA, 25 bp, Rattus norvegicus
tccagttccagtacccgttccagtt

SEQ ID NO: 583490 - DNA, 25 bp, Rattus norvegicus
tccagttccagttcccgttccagtt

SEQ ID NO: 583491 - DNA, 25 bp, Rattus norvegicus
tccagttccgttactgttgtgttgt

SEQ ID NO: 583492 - DNA, 25 bp, Rattus norvegicus
tccagttccgtttctgttgtgttgt

SEQ ID NO: 583493 - DNA, 25 bp, Rattus norvegicus
tccagttcctgtcaccgtggcagtg

SEQ ID NO: 583494 - DNA, 25 bp, Rattus norvegicus
tccagttcctgtgaccgtggcagtg

SEQ ID NO: 583495 - DNA, 25 bp, Rattus norvegicus
tccagttcgtcgcagaagagcgctt

SEQ ID NO: 583496 - DNA, 25 bp, Rattus norvegicus
tccagttcgtcggagaagagcgctt

SEQ ID NO: 583497 - DNA, 25 bp, Rattus norvegicus
tccagttctccacctgcaagtggta

SEQ ID NO: 583498 - DNA, 25 bp, Rattus norvegicus
tccagttctccagctgcaagtggta

SEQ ID NO: 583499 - DNA, 25 bp, Rattus norvegicus
tccagttctggacagcaggcgtcaa

SEQ ID NO: 583500 - DNA, 25 bp, Rattus norvegicus
tccagttctggagagcaggcgtcaa

SEQ ID NO: 583501 - DNA, 25 bp, Rattus norvegicus
tccagttctgtacctgtgttttcaa

SEQ ID NO: 583502 - DNA, 25 bp, Rattus norvegicus
tccagttctgtagctgtgttttcaa

SEQ ID NO: 583503 - DNA, 25 bp, Rattus norvegicus
tccagttcttctaccttcattaaat

SEQ ID NO: 583504 - DNA, 25 bp, Rattus norvegicus
tccagttcttcttccttcattaaat

SEQ ID NO: 583505 - DNA, 25 bp, Rattus norvegicus
tccagttgacaacccaaatggcctt

SEQ ID NO: 583506 - DNA, 25 bp, Rattus norvegicus
tccagttgacaagccaaatggcctt

SEQ ID NO: 583507 - DNA, 25 bp, Rattus norvegicus
tccagttgcaatcccatccacagga

SEQ ID NO: 583508 - DNA, 25 bp, Rattus norvegicus
tccagttgcaatgccatccacagga

SEQ ID NO: 583509 - DNA, 25 bp, Rattus norvegicus
tccagttgcaccactcagagctgct

SEQ ID NO: 583510 - DNA, 25 bp, Rattus norvegicus
tccagttgcacctctcagagctgct

SEQ ID NO: 583511 - DNA, 25 bp, Rattus norvegicus
tccagttgctgtcagggacctcagt

SEQ ID NO: 583512 - DNA, 25 bp, Rattus norvegicus
tccagttgctgtgagggacctcagt

SEQ ID NO: 583513 - DNA, 25 bp, Rattus norvegicus
tccagttggactccgtgttcccggg

SEQ ID NO: 583514 - DNA, 25 bp, Rattus norvegicus
tccagttggactgcgtgttcccggg

SEQ ID NO: 583515 - DNA, 25 bp, Rattus norvegicus
tccagttgtcagactcagcttgaaa

SEQ ID NO: 583516 - DNA, 25 bp, Rattus norvegicus
tccagttgtcagtctcagcttgaaa

SEQ ID NO: 583517 - DNA, 25 bp, Rattus norvegicus
tccagtttacctacggagttggcct

SEQ ID NO: 583518 - DNA, 25 bp, Rattus norvegicus
tccagtttaccttcggagttggcct

SEQ ID NO: 583519 - DNA, 25 bp, Rattus norvegicus
tccagtttacttctgtaagccctta

SEQ ID NO: 583520 - DNA, 25 bp, Rattus norvegicus
tccagtttacttgtgtaagccctta

SEQ ID NO: 583521 - DNA, 25 bp, Rattus norvegicus
tccagtttatatagtggtcctaatt

SEQ ID NO: 583522 - DNA, 25 bp, Rattus norvegicus
tccagtttatattgtggtcctaatt

SEQ ID NO: 583523 - DNA, 25 bp, Rattus norvegicus
tccagtttatttacttctcgactct

SEQ ID NO: 583524 - DNA, 25 bp, Rattus norvegicus
tccagtttattttcttctcgactct

SEQ ID NO: 583525 - DNA, 25 bp, Rattus norvegicus
tccagtttcaggcttgctgatgccc

SEQ ID NO: 583526 - DNA, 25 bp, Rattus norvegicus
tccagtttcagggttgctgatgccc

SEQ ID NO: 583527 - DNA, 25 bp, Rattus norvegicus
tccagtttctggcactacagtagta

SEQ ID NO: 583528 - DNA, 25 bp, Rattus norvegicus
tccagtttctggcatcagagcccta

SEQ ID NO: 583529 - DNA, 25 bp, Rattus norvegicus
tccagtttctgggactacagtagta

SEQ ID NO: 583530 - DNA, 25 bp, Rattus norvegicus
tccagtttctgggatcagagcccta

SEQ ID NO: 583531 - DNA, 25 bp, Rattus norvegicus
tccagtttcttgctggttctttttt

SEQ ID NO: 583532 - DNA, 25 bp, Rattus norvegicus
tccagtttcttggtggttctttttt

SEQ ID NO: 583533 - DNA, 25 bp, Rattus norvegicus
tccagtttgtgccagaggcgctaca

SEQ ID NO: 583534 - DNA, 25 bp, Rattus norvegicus
tccagtttgtgcgagaggcgctaca

SEQ ID NO: 583535 - DNA, 25 bp, Rattus norvegicus
tccagtttgtgtccagtccagcggg

SEQ ID NO: 583536 - DNA, 25 bp, Rattus norvegicus
tccagtttgtgtgcagtccagcggg

SEQ ID NO: 583537 - DNA, 25 bp, Rattus norvegicus
tccagttttcatattgttcctattg

SEQ ID NO: 583538 - DNA, 25 bp, Rattus norvegicus
tccagttttcattttgttcctattg

SEQ ID NO: 583539 - DNA, 25 bp, Rattus norvegicus
tccagttttccaaggcagaggtgtc

SEQ ID NO: 583540 - DNA, 25 bp, Rattus norvegicus
tccagttttccatggcagaggtgtc

SEQ ID NO: 583541 - DNA, 25 bp, Rattus norvegicus
tccagtttttggactacagttgaat

SEQ ID NO: 583542 - DNA, 25 bp, Rattus norvegicus
tccagtttttggtctacagttgaat

SEQ ID NO: 583543 - DNA, 25 bp, Rattus norvegicus
tccataaacatgcagtgtctttcca

SEQ ID NO: 583544 - DNA, 25 bp, Rattus norvegicus
tccataaacatggagtgtctttcca

SEQ ID NO: 583545 - DNA, 25 bp, Rattus norvegicus
tccataaatggccttaacgtacttt

SEQ ID NO: 583546 - DNA, 25 bp, Rattus norvegicus
tccataaatggcgttaacgtacttt

SEQ ID NO: 583547 - DNA, 25 bp, Rattus norvegicus
tccataattttgactcaacactgag

SEQ ID NO: 583548 - DNA, 25 bp, Rattus norvegicus
tccataattttgtctcaacactgag

SEQ ID NO: 583549 - DNA, 25 bp, Rattus norvegicus
tccatacacggcaaaaagtttcaaa

SEQ ID NO: 583550 - DNA, 25 bp, Rattus norvegicus
tccatacacggctaaaagtttcaaa

SEQ ID NO: 583551 - DNA, 25 bp, Rattus norvegicus
tccatacatgcaagatcactcacct

SEQ ID NO: 583552 - DNA, 25 bp, Rattus norvegicus
tccatacatgcatgatcactcacct

SEQ ID NO: 583553 - DNA, 25 bp, Rattus norvegicus
tccataccaggacgcctgcaggtta

SEQ ID NO: 583554 - DNA, 25 bp, Rattus norvegicus
tccataccaggaggcctgcaggtta

SEQ ID NO: 583555 - DNA, 25 bp, Rattus norvegicus
tccataccctagagtgagcacgttc

SEQ ID NO: 583556 - DNA, 25 bp, Rattus norvegicus
tccataccctagtgtgagcacgttc

SEQ ID NO: 583557 - DNA, 25 bp, Rattus norvegicus
tccatacctcctcggttatctatga

SEQ ID NO: 583558 - DNA, 25 bp, Rattus norvegicus
tccatacctcctgggttatctatga

SEQ ID NO: 583559 - DNA, 25 bp, Rattus norvegicus
tccatactccttagccagtgtaggg

SEQ ID NO: 583560 - DNA, 25 bp, Rattus norvegicus
tccatactcctttgccagtgtaggg

SEQ ID NO: 583561 - DNA, 25 bp, Rattus norvegicus
tccatactctgtccatttatttaaa

SEQ ID NO: 583562 - DNA, 25 bp, Rattus norvegicus
tccatactctgtgcatttatttaaa

SEQ ID NO: 583563 - DNA, 25 bp, Rattus norvegicus
tccatagaaatgactgtaccccagg

SEQ ID NO: 583564 - DNA, 25 bp, Rattus norvegicus
tccatagaaatgtctgtaccccagg

SEQ ID NO: 583565 - DNA, 25 bp, Rattus norvegicus
tccatagaacgtatgctgtcagctc

SEQ ID NO: 583566 - DNA, 25 bp, Rattus norvegicus
tccatagaacgtttgctgtcagctc

SEQ ID NO: 583567 - DNA, 25 bp, Rattus norvegicus
tccatagaagttcactgctgacctg

SEQ ID NO: 583568 - DNA, 25 bp, Rattus norvegicus
tccatagaagttgactgctgacctg

SEQ ID NO: 583569 - DNA, 25 bp, Rattus norvegicus
tccatagattttccctttttcttag

SEQ ID NO: 583570 - DNA, 25 bp, Rattus norvegicus
tccatagattttgcctttttcttag

SEQ ID NO: 583571 - DNA, 25 bp, Rattus norvegicus
tccatagcagcaagtcctacggaaa

SEQ ID NO: 583572 - DNA, 25 bp, Rattus norvegicus
tccatagcagcatgtcctacggaaa

SEQ ID NO: 583573 - DNA, 25 bp, Rattus norvegicus
tccataggacccatgagcccgctga

SEQ ID NO: 583574 - DNA, 25 bp, Rattus norvegicus
tccataggacccttgagcccgctga

SEQ ID NO: 583575 - DNA, 25 bp, Rattus norvegicus
tccataggtctcagaatcactgtcc

SEQ ID NO: 583576 - DNA, 25 bp, Rattus norvegicus
tccataggtctctgaatcactgtcc

SEQ ID NO: 583577 - DNA, 25 bp, Rattus norvegicus
tccatagtgtcgaatgccttgcagt

SEQ ID NO: 583578 - DNA, 25 bp, Rattus norvegicus
tccatagtgtcgtatgccttgcagt

SEQ ID NO: 583579 - DNA, 25 bp, Rattus norvegicus
tccatatacacaaccccattgttct

SEQ ID NO: 583580 - DNA, 25 bp, Rattus norvegicus
tccatatacacatccccattgttct

SEQ ID NO: 583581 - DNA, 25 bp, Rattus norvegicus
tccatatgctggctgctgtttacat

SEQ ID NO: 583582 - DNA, 25 bp, Rattus norvegicus
tccatatgctgggtgctgtttacat

SEQ ID NO: 583583 - DNA, 25 bp, Rattus norvegicus
tccatatggcataccagggctgttc

SEQ ID NO: 583584 - DNA, 25 bp, Rattus norvegicus
tccatatggcattccagggctgttc

SEQ ID NO: 583585 - DNA, 25 bp, Rattus norvegicus
tccatatgtaatctacccacttttg

SEQ ID NO: 583586 - DNA, 25 bp, Rattus norvegicus
tccatatgtaatgtacccacttttg

SEQ ID NO: 583587 - DNA, 25 bp, Rattus norvegicus
tccatatgtggaattaatgtttagg

SEQ ID NO: 583588 - DNA, 25 bp, Rattus norvegicus
tccatatgtggatttaatgtttagg

SEQ ID NO: 583589 - DNA, 25 bp, Rattus norvegicus
tccatattgaaccagtcagcaggct

SEQ ID NO: 583590 - DNA, 25 bp, Rattus norvegicus
tccatattgaacgagtcagcaggct

SEQ ID NO: 583591 - DNA, 25 bp, Rattus norvegicus
tccatattttcccattatccctgtt

SEQ ID NO: 583592 - DNA, 25 bp, Rattus norvegicus
tccatattttccgattatccctgtt

SEQ ID NO: 583593 - DNA, 25 bp, Rattus norvegicus
tccatcaaccgcataaacttttcac

SEQ ID NO: 583594 - DNA, 25 bp, Rattus norvegicus
tccatcaaccgcttaaacttttcac

SEQ ID NO: 583595 - DNA, 25 bp, Rattus norvegicus
tccatcaacgtcatttacccttgaa

SEQ ID NO: 583596 - DNA, 25 bp, Rattus norvegicus
tccatcaacgtcttttacccttgaa

SEQ ID NO: 583597 - DNA, 25 bp, Rattus norvegicus
tccatcaactggagccaagtgttca

SEQ ID NO: 583598 - DNA, 25 bp, Rattus norvegicus
tccatcaactggtgccaagtgttca

SEQ ID NO: 583599 - DNA, 25 bp, Rattus norvegicus
tccatcaagctgatttctcaacggg

SEQ ID NO: 583600 - DNA, 25 bp, Rattus norvegicus
tccatcaagctgttttctcaacggg

SEQ ID NO: 583601 - DNA, 25 bp, Rattus norvegicus
tccatcacaacacctataagctgtc

SEQ ID NO: 583602 - DNA, 25 bp, Rattus norvegicus
tccatcacaacagctataagctgtc

SEQ ID NO: 583603 - DNA, 25 bp, Rattus norvegicus
tccatcacactgcacttagctgaca

SEQ ID NO: 583604 - DNA, 25 bp, Rattus norvegicus
tccatcacactggacttagctgaca

SEQ ID NO: 583605 - DNA, 25 bp, Rattus norvegicus
tccatcactgctcaacttgggagcc

SEQ ID NO: 583606 - DNA, 25 bp, Rattus norvegicus
tccatcactgctgaacttgggagcc

SEQ ID NO: 583607 - DNA, 25 bp, Rattus norvegicus
tccatcagggttaatctaggttgct

SEQ ID NO: 583608 - DNA, 25 bp, Rattus norvegicus
tccatcagggtttatctaggttgct

SEQ ID NO: 583609 - DNA, 25 bp, Rattus norvegicus
tccatcaggtctcaggttgtcttga

SEQ ID NO: 583610 - DNA, 25 bp, Rattus norvegicus
tccatcaggtctgaggttgtcttga

SEQ ID NO: 583611 - DNA, 25 bp, Rattus norvegicus
tccatcagtccaatcagctcgtgtt

SEQ ID NO: 583612 - DNA, 25 bp, Rattus norvegicus
tccatcagtccattcagctcgtgtt

SEQ ID NO: 583613 - DNA, 25 bp, Rattus norvegicus
tccatcataaggcttctagctgtca

SEQ ID NO: 583614 - DNA, 25 bp, Rattus norvegicus
tccatcataagggttctagctgtca

SEQ ID NO: 583615 - DNA, 25 bp, Rattus norvegicus
tccatccaactgacactattccatg

SEQ ID NO: 583616 - DNA, 25 bp, Rattus norvegicus
tccatccaactgtcactattccatg

SEQ ID NO: 583617 - DNA, 25 bp, Rattus norvegicus
tccatccacctcattggagcaagag

SEQ ID NO: 583618 - DNA, 25 bp, Rattus norvegicus
tccatccacctctttggagcaagag

SEQ ID NO: 583619 - DNA, 25 bp, Rattus norvegicus
tccatccactgactccaacgtggaa

SEQ ID NO: 583620 - DNA, 25 bp, Rattus norvegicus
tccatccactgagtccaacgtggaa

SEQ ID NO: 583621 - DNA, 25 bp, Rattus norvegicus
tccatccagatactgcagactctgc

SEQ ID NO: 583622 - DNA, 25 bp, Rattus norvegicus
tccatccagatagtgcagactctgc

SEQ ID NO: 583623 - DNA, 25 bp, Rattus norvegicus
tccatccagtgccttgaagtcttca

SEQ ID NO: 583624 - DNA, 25 bp, Rattus norvegicus
tccatccagtgcgttgaagtcttca

SEQ ID NO: 583625 - DNA, 25 bp, Rattus norvegicus
tccatccatcacagcatcttttatt

SEQ ID NO: 583626 - DNA, 25 bp, Rattus norvegicus
tccatccatcactgcatcttttatt

SEQ ID NO: 583627 - DNA, 25 bp, Rattus norvegicus
tccatccatggacactgccgtagtc

SEQ ID NO: 583628 - DNA, 25 bp, Rattus norvegicus
tccatccatggagactgccgtagtc

SEQ ID NO: 583629 - DNA, 25 bp, Rattus norvegicus
tccatcccagcaagcaaggcatgta

SEQ ID NO: 583630 - DNA, 25 bp, Rattus norvegicus
tccatcccagcatgcaaggcatgta

SEQ ID NO: 583631 - DNA, 25 bp, Rattus norvegicus
tccatcccatcactctgtgactaga

SEQ ID NO: 583632 - DNA, 25 bp, Rattus norvegicus
tccatcccatcagtctgtgactaga

SEQ ID NO: 583633 - DNA, 25 bp, Rattus norvegicus
tccatccccaagacattctattgtt

SEQ ID NO: 583634 - DNA, 25 bp, Rattus norvegicus
tccatccccaagtcattctattgtt

SEQ ID NO: 583635 - DNA, 25 bp, Rattus norvegicus
tccatccccagtacagttggcatgg

SEQ ID NO: 583636 - DNA, 25 bp, Rattus norvegicus
tccatccccagtcaaagaacacagt

SEQ ID NO: 583637 - DNA, 25 bp, Rattus norvegicus
tccatccccagtgaaagaacacagt

SEQ ID NO: 583638 - DNA, 25 bp, Rattus norvegicus
tccatccccagttcagttggcatgg

SEQ ID NO: 583639 - DNA, 25 bp, Rattus norvegicus
tccatccccgtgagggcactgtgca

SEQ ID NO: 583640 - DNA, 25 bp, Rattus norvegicus
tccatccccgtgtgggcactgtgca

SEQ ID NO: 583641 - DNA, 25 bp, Rattus norvegicus
tccatcccctatcactggataggag

SEQ ID NO: 583642 - DNA, 25 bp, Rattus norvegicus
tccatcccctatgactggataggag

SEQ ID NO: 583643 - DNA, 25 bp, Rattus norvegicus
tccatcccgagccagttcaattaga

SEQ ID NO: 583644 - DNA, 25 bp, Rattus norvegicus
tccatcccgagcgagttcaattaga

SEQ ID NO: 583645 - DNA, 25 bp, Rattus norvegicus
tccatcccgtctcccgaaaggtgtt

SEQ ID NO: 583646 - DNA, 25 bp, Rattus norvegicus
tccatcccgtctgccgaaaggtgtt

SEQ ID NO: 583647 - DNA, 25 bp, Rattus norvegicus
tccatccctcaaacgtctgaagtga

SEQ ID NO: 583648 - DNA, 25 bp, Rattus norvegicus
tccatccctcaatcgtctgaagtga

SEQ ID NO: 583649 - DNA, 25 bp, Rattus norvegicus
tccatccctggactcatgcgttaaa

SEQ ID NO: 583650 - DNA, 25 bp, Rattus norvegicus
tccatccctggagtcatgcgttaaa

SEQ ID NO: 583651 - DNA, 25 bp, Rattus norvegicus
tccatccctgtcatatgcactagaa

SEQ ID NO: 583652 - DNA, 25 bp, Rattus norvegicus
tccatccctgtcttatgcactagaa

SEQ ID NO: 583653 - DNA, 25 bp, Rattus norvegicus
tccatccctgtgaaaagctgtaaag

SEQ ID NO: 583654 - DNA, 25 bp, Rattus norvegicus
tccatccctgtgtaaagctgtaaag

SEQ ID NO: 583655 - DNA, 25 bp, Rattus norvegicus
tccatccgtgggacttgcgtgatga

SEQ ID NO: 583656 - DNA, 25 bp, Rattus norvegicus
tccatccgtgggtcttgcgtgatga

SEQ ID NO: 583657 - DNA, 25 bp, Rattus norvegicus
tccatcctcatgacatacagcatca

SEQ ID NO: 583658 - DNA, 25 bp, Rattus norvegicus
tccatcctcatgtcatacagcatca

SEQ ID NO: 583659 - DNA, 25 bp, Rattus norvegicus
tccatcctcccaaatcaggagaagt

SEQ ID NO: 583660 - DNA, 25 bp, Rattus norvegicus
tccatcctcccatatcaggagaagt

SEQ ID NO: 583661 - DNA, 25 bp, Rattus norvegicus
tccatcctgagcatctttgcgtatt

SEQ ID NO: 583662 - DNA, 25 bp, Rattus norvegicus
tccatcctgagcttctttgcgtatt

SEQ ID NO: 583663 - DNA, 25 bp, Rattus norvegicus
tccatcctggttacaattactgtgc

SEQ ID NO: 583664 - DNA, 25 bp, Rattus norvegicus
tccatcctggtttcaattactgtgc

SEQ ID NO: 583665 - DNA, 25 bp, Rattus norvegicus
tccatccttttgatttcaacctaag

SEQ ID NO: 583666 - DNA, 25 bp, Rattus norvegicus
tccatccttttgttttcaacctaag

SEQ ID NO: 583667 - DNA, 25 bp, Rattus norvegicus
tccatcgaaagactccctgtgtata

SEQ ID NO: 583668 - DNA, 25 bp, Rattus norvegicus
tccatcgaaagagtccctgtgtata

SEQ ID NO: 583669 - DNA, 25 bp, Rattus norvegicus
tccatcgaccaactccaacatggaa

SEQ ID NO: 583670 - DNA, 25 bp, Rattus norvegicus
tccatcgaccaagtccaacatggaa

SEQ ID NO: 583671 - DNA, 25 bp, Rattus norvegicus
tccatcgcccgtaacgagtgttgaa

SEQ ID NO: 583672 - DNA, 25 bp, Rattus norvegicus
tccatcgcccgttacgagtgttgaa

SEQ ID NO: 583673 - DNA, 25 bp, Rattus norvegicus
tccatcggaggcctggatgccagct

SEQ ID NO: 583674 - DNA, 25 bp, Rattus norvegicus
tccatcggaggcgtggatgccagct

SEQ ID NO: 583675 - DNA, 25 bp, Rattus norvegicus
tccatcgtgagcaggcatttggtct

SEQ ID NO: 583676 - DNA, 25 bp, Rattus norvegicus
tccatcgtgagctggcatttggtct

SEQ ID NO: 583677 - DNA, 25 bp, Rattus norvegicus
tccatctaccaactccaacatgagt

SEQ ID NO: 583678 - DNA, 25 bp, Rattus norvegicus
tccatctaccaagtccaacatgagt

SEQ ID NO: 583679 - DNA, 25 bp, Rattus norvegicus
tccatctacccaatactttgctgag

SEQ ID NO: 583680 - DNA, 25 bp, Rattus norvegicus
tccatctacccacttcagggaggga

SEQ ID NO: 583681 - DNA, 25 bp, Rattus norvegicus
tccatctacccagttcagggaggga

SEQ ID NO: 583682 - DNA, 25 bp, Rattus norvegicus
tccatctacccattactttgctgag

SEQ ID NO: 583683 - DNA, 25 bp, Rattus norvegicus
tccatctcccaaccacagggattaa

SEQ ID NO: 583684 - DNA, 25 bp, Rattus norvegicus
tccatctcccaaccgagagaggctg

SEQ ID NO: 583685 - DNA, 25 bp, Rattus norvegicus
tccatctcccaagcacagggattaa

SEQ ID NO: 583686 - DNA, 25 bp, Rattus norvegicus
tccatctcccaagcgagagaggctg

SEQ ID NO: 583687 - DNA, 25 bp, Rattus norvegicus
tccatctctgtgaggcactttgtga

SEQ ID NO: 583688 - DNA, 25 bp, Rattus norvegicus
tccatctctgtgtggcactttgtga

SEQ ID NO: 583689 - DNA, 25 bp, Rattus norvegicus
tccatctgagacaagggctcggagc

SEQ ID NO: 583690 - DNA, 25 bp, Rattus norvegicus
tccatctgagactagggctcggagc

SEQ ID NO: 583691 - DNA, 25 bp, Rattus norvegicus
tccatctgaggaagttgagggttca

SEQ ID NO: 583692 - DNA, 25 bp, Rattus norvegicus
tccatctgaggatgttgagggttca

SEQ ID NO: 583693 - DNA, 25 bp, Rattus norvegicus
tccatctgatacagcacttcatcaa

SEQ ID NO: 583694 - DNA, 25 bp, Rattus norvegicus
tccatctgatactgcacttcatcaa

SEQ ID NO: 583695 - DNA, 25 bp, Rattus norvegicus
tccatctgccttaccaaatgtttgc

SEQ ID NO: 583696 - DNA, 25 bp, Rattus norvegicus
tccatctgcctttccaaatgtttgc

SEQ ID NO: 583697 - DNA, 25 bp, Rattus norvegicus
tccatctggttcatcaaagccaaag

SEQ ID NO: 583698 - DNA, 25 bp, Rattus norvegicus
tccatctggttcttcaaagccaaag

SEQ ID NO: 583699 - DNA, 25 bp, Rattus norvegicus
tccatctgtgatcctctagaagttt

SEQ ID NO: 583700 - DNA, 25 bp, Rattus norvegicus
tccatctgtgatgctctagaagttt

SEQ ID NO: 583701 - DNA, 25 bp, Rattus norvegicus
tccatctgtgttcttcaatttgtga

SEQ ID NO: 583702 - DNA, 25 bp, Rattus norvegicus
tccatctgtgttgttcaatttgtga

SEQ ID NO: 583703 - DNA, 25 bp, Rattus norvegicus
tccatcttgcgcaggccgaagctgc

SEQ ID NO: 583704 - DNA, 25 bp, Rattus norvegicus
tccatcttgcgctggccgaagctgc

SEQ ID NO: 583705 - DNA, 25 bp, Rattus norvegicus
tccatcttggccacggcagtggctg

SEQ ID NO: 583706 - DNA, 25 bp, Rattus norvegicus
tccatcttggcctcggcagtggctg

SEQ ID NO: 583707 - DNA, 25 bp, Rattus norvegicus
tccatctttcctcttgccagagaat

SEQ ID NO: 583708 - DNA, 25 bp, Rattus norvegicus
tccatctttcctgttgccagagaat

SEQ ID NO: 583709 - DNA, 25 bp, Rattus norvegicus
tccatctttcgacgattttgcccag

SEQ ID NO: 583710 - DNA, 25 bp, Rattus norvegicus
tccatctttcgaggattttgcccag

SEQ ID NO: 583711 - DNA, 25 bp, Rattus norvegicus
tccatctttgaccaaggacagactc

SEQ ID NO: 583712 - DNA, 25 bp, Rattus norvegicus
tccatctttgacgaaggacagactc

SEQ ID NO: 583713 - DNA, 25 bp, Rattus norvegicus
tccatctttgagctgcctgaagact

SEQ ID NO: 583714 - DNA, 25 bp, Rattus norvegicus
tccatctttgaggtgcctgaagact

SEQ ID NO: 583715 - DNA, 25 bp, Rattus norvegicus
tccatctttggactttctgagacaa

SEQ ID NO: 583716 - DNA, 25 bp, Rattus norvegicus
tccatctttggagtttctgagacaa

SEQ ID NO: 583717 - DNA, 25 bp, Rattus norvegicus
tccatgaagattcagactgggtctt

SEQ ID NO: 583718 - DNA, 25 bp, Rattus norvegicus
tccatgaagattgagactgggtctt

SEQ ID NO: 583719 - DNA, 25 bp, Rattus norvegicus
tccatgacacatacccaagggatct

SEQ ID NO: 583720 - DNA, 25 bp, Rattus norvegicus
tccatgacacattcccaagggatct

SEQ ID NO: 583721 - DNA, 25 bp, Rattus norvegicus
tccatgactaccaagtgggcacttt

SEQ ID NO: 583722 - DNA, 25 bp, Rattus norvegicus
tccatgactacctagtgggcacttt

SEQ ID NO: 583723 - DNA, 25 bp, Rattus norvegicus
tccatgagccctcggcaacgtagag

SEQ ID NO: 583724 - DNA, 25 bp, Rattus norvegicus
tccatgagccctgggcaacgtagag

SEQ ID NO: 583725 - DNA, 25 bp, Rattus norvegicus
tccatgaggttgactccctgtgcgt

SEQ ID NO: 583726 - DNA, 25 bp, Rattus norvegicus
tccatgaggttgtctccctgtgcgt

SEQ ID NO: 583727 - DNA, 25 bp, Rattus norvegicus
tccatgagtatcagctcacagccag

SEQ ID NO: 583728 - DNA, 25 bp, Rattus norvegicus
tccatgagtatctgctcacagccag

SEQ ID NO: 583729 - DNA, 25 bp, Rattus norvegicus
tccatgatatttctacttgctagca

SEQ ID NO: 583730 - DNA, 25 bp, Rattus norvegicus
tccatgatatttgtacttgctagca

SEQ ID NO: 583731 - DNA, 25 bp, Rattus norvegicus
tccatgatccaacactgggccaaga

SEQ ID NO: 583732 - DNA, 25 bp, Rattus norvegicus
tccatgatccaagactgggccaaga

SEQ ID NO: 583733 - DNA, 25 bp, Rattus norvegicus
tccatgatctgtaggctctctcggc

SEQ ID NO: 583734 - DNA, 25 bp, Rattus norvegicus
tccatgatctgttggctctctcggc

SEQ ID NO: 583735 - DNA, 25 bp, Rattus norvegicus
tccatgatgatgcacggtcgtaaca

SEQ ID NO: 583736 - DNA, 25 bp, Rattus norvegicus
tccatgatgatggacggtcgtaaca

SEQ ID NO: 583737 - DNA, 25 bp, Rattus norvegicus
tccatgattgatatgctgtcgacat

SEQ ID NO: 583738 - DNA, 25 bp, Rattus norvegicus
tccatgattgatttgctgtcgacat

SEQ ID NO: 583739 - DNA, 25 bp, Rattus norvegicus
tccatgcacagacaaggcaggtcct

SEQ ID NO: 583740 - DNA, 25 bp, Rattus norvegicus
tccatgcacagagaaggcaggtcct

SEQ ID NO: 583741 - DNA, 25 bp, Rattus norvegicus
tccatgcagtatccctagcctagag

SEQ ID NO: 583742 - DNA, 25 bp, Rattus norvegicus
tccatgcagtatgcctagcctagag

SEQ ID NO: 583743 - DNA, 25 bp, Rattus norvegicus
tccatgcatggcattcttcatagtg

SEQ ID NO: 583744 - DNA, 25 bp, Rattus norvegicus
tccatgcatggctttcttcatagtg

SEQ ID NO: 583745 - DNA, 25 bp, Rattus norvegicus
tccatgccaaggctcccaggaaatc

SEQ ID NO: 583746 - DNA, 25 bp, Rattus norvegicus
tccatgccaagggtcccaggaaatc

SEQ ID NO: 583747 - DNA, 25 bp, Rattus norvegicus
tccatgcccaatcctggtggcaggg

SEQ ID NO: 583748 - DNA, 25 bp, Rattus norvegicus
tccatgcccaatgctggtggcaggg

SEQ ID NO: 583749 - DNA, 25 bp, Rattus norvegicus
tccatgcctctgatcttgttctgct

SEQ ID NO: 583750 - DNA, 25 bp, Rattus norvegicus
tccatgcctctgttcttgttctgct

SEQ ID NO: 583751 - DNA, 25 bp, Rattus norvegicus
tccatgcctcttactcggctaaagg

SEQ ID NO: 583752 - DNA, 25 bp, Rattus norvegicus
tccatgcctctttctcggctaaagg

SEQ ID NO: 583753 - DNA, 25 bp, Rattus norvegicus
tccatgcgatggagagtgatccctt

SEQ ID NO: 583754 - DNA, 25 bp, Rattus norvegicus
tccatgcgatggtgagtgatccctt

SEQ ID NO: 583755 - DNA, 25 bp, Rattus norvegicus
tccatgcgccttctatgagagtcac

SEQ ID NO: 583756 - DNA, 25 bp, Rattus norvegicus
tccatgcgccttgtatgagagtcac

SEQ ID NO: 583757 - DNA, 25 bp, Rattus norvegicus
tccatgcgcgtgactgtgagtgtgt

SEQ ID NO: 583758 - DNA, 25 bp, Rattus norvegicus
tccatgcgcgtgtctgtgagtgtgt

SEQ ID NO: 583759 - DNA, 25 bp, Rattus norvegicus
tccatgcgtagcatgtcactctcca

SEQ ID NO: 583760 - DNA, 25 bp, Rattus norvegicus
tccatgcgtagcttgtcactctcca

SEQ ID NO: 583761 - DNA, 25 bp, Rattus norvegicus
tccatgctacttagtgaaaccccgt

SEQ ID NO: 583762 - DNA, 25 bp, Rattus norvegicus
tccatgctactttgtgaaaccccgt

SEQ ID NO: 583763 - DNA, 25 bp, Rattus norvegicus
tccatgctataaatcagaccctcaa

SEQ ID NO: 583764 - DNA, 25 bp, Rattus norvegicus
tccatgctataattcagaccctcaa

SEQ ID NO: 583765 - DNA, 25 bp, Rattus norvegicus
tccatgctctccacaaggaaactgg

SEQ ID NO: 583766 - DNA, 25 bp, Rattus norvegicus
tccatgctctcctcaaggaaactgg

SEQ ID NO: 583767 - DNA, 25 bp, Rattus norvegicus
tccatgctgctgctgagagttcgcc

SEQ ID NO: 583768 - DNA, 25 bp, Rattus norvegicus
tccatgctgctggtgagagttcgcc

SEQ ID NO: 583769 - DNA, 25 bp, Rattus norvegicus
tccatgctggctcggatcttagcaa

SEQ ID NO: 583770 - DNA, 25 bp, Rattus norvegicus
tccatgctggctgggatcttagcaa

SEQ ID NO: 583771 - DNA, 25 bp, Rattus norvegicus
tccatgctgggcataatgtggcttt

SEQ ID NO: 583772 - DNA, 25 bp, Rattus norvegicus
tccatgctgggcttaatgtggcttt

SEQ ID NO: 583773 - DNA, 25 bp, Rattus norvegicus
tccatgctggtaccaacagccaggt

SEQ ID NO: 583774 - DNA, 25 bp, Rattus norvegicus
tccatgctggtagcaacagccaggt

SEQ ID NO: 583775 - DNA, 25 bp, Rattus norvegicus
tccatgcttcttaccagaactcagg

SEQ ID NO: 583776 - DNA, 25 bp, Rattus norvegicus
tccatgcttctttccagaactcagg

SEQ ID NO: 583777 - DNA, 25 bp, Rattus norvegicus
tccatgcttgtcattgtgccagtac

SEQ ID NO: 583778 - DNA, 25 bp, Rattus norvegicus
tccatgcttgtctttgtgccagtac

SEQ ID NO: 583779 - DNA, 25 bp, Rattus norvegicus
tccatgcttttcagaggtatccttt

SEQ ID NO: 583780 - DNA, 25 bp, Rattus norvegicus
tccatgcttttctgaggtatccttt

SEQ ID NO: 583781 - DNA, 25 bp, Rattus norvegicus
tccatggacatgattcacagctgtt

SEQ ID NO: 583782 - DNA, 25 bp, Rattus norvegicus
tccatggacatgtttcacagctgtt

SEQ ID NO: 583783 - DNA, 25 bp, Rattus norvegicus
tccatggaccgtaaagaatctttca

SEQ ID NO: 583784 - DNA, 25 bp, Rattus norvegicus
tccatggaccgttaagaatctttca

SEQ ID NO: 583785 - DNA, 25 bp, Rattus norvegicus
tccatggagcatccccagaagctgg

SEQ ID NO: 583786 - DNA, 25 bp, Rattus norvegicus
tccatggagcatgcccagaagctgg

SEQ ID NO: 583787 - DNA, 25 bp, Rattus norvegicus
tccatggatgggaactaggcgtgca

SEQ ID NO: 583788 - DNA, 25 bp, Rattus norvegicus
tccatggatgggtactaggcgtgca

SEQ ID NO: 583789 - DNA, 25 bp, Rattus norvegicus
tccatggcaaagcatgtcatcagta

SEQ ID NO: 583790 - DNA, 25 bp, Rattus norvegicus
tccatggcaaaggatgtcatcagta

SEQ ID NO: 583791 - DNA, 25 bp, Rattus norvegicus
tccatggcaacacaggctcagtctt

SEQ ID NO: 583792 - DNA, 25 bp, Rattus norvegicus
tccatggcaacagaggctcagtctt

SEQ ID NO: 583793 - DNA, 25 bp, Rattus norvegicus
tccatggcaaccaatgtaccaacaa

SEQ ID NO: 583794 - DNA, 25 bp, Rattus norvegicus
tccatggcaacctatgtaccaacaa

SEQ ID NO: 583795 - DNA, 25 bp, Rattus norvegicus
tccatggcacatattttctgagtaa

SEQ ID NO: 583796 - DNA, 25 bp, Rattus norvegicus
tccatggcacattttttctgagtaa

SEQ ID NO: 583797 - DNA, 25 bp, Rattus norvegicus
tccatggccctgagttggattctca

SEQ ID NO: 583798 - DNA, 25 bp, Rattus norvegicus
tccatggccctgtgttggattctca

SEQ ID NO: 583799 - DNA, 25 bp, Rattus norvegicus
tccatggccttgacctgtgcaataa

SEQ ID NO: 583800 - DNA, 25 bp, Rattus norvegicus
tccatggccttgtcctgtgcaataa

SEQ ID NO: 583801 - DNA, 25 bp, Rattus norvegicus
tccatggctctgatgtcaggccgca

SEQ ID NO: 583802 - DNA, 25 bp, Rattus norvegicus
tccatggctctgttgtcaggccgca

SEQ ID NO: 583803 - DNA, 25 bp, Rattus norvegicus
tccatggctggtcacggcaaggcta

SEQ ID NO: 583804 - DNA, 25 bp, Rattus norvegicus
tccatggctggtgacggcaaggcta

SEQ ID NO: 583805 - DNA, 25 bp, Rattus norvegicus
tccatggcttagagctttttccttt

SEQ ID NO: 583806 - DNA, 25 bp, Rattus norvegicus
tccatggcttagtgctttttccttt

SEQ ID NO: 583807 - DNA, 25 bp, Rattus norvegicus
tccatggcttatctgtaaccctgta

SEQ ID NO: 583808 - DNA, 25 bp, Rattus norvegicus
tccatggcttatgtgtaaccctgta

SEQ ID NO: 583809 - DNA, 25 bp, Rattus norvegicus
tccatggcttccacgaacttgtagt

SEQ ID NO: 583810 - DNA, 25 bp, Rattus norvegicus
tccatggcttcctcgaacttgtagt

SEQ ID NO: 583811 - DNA, 25 bp, Rattus norvegicus
tccatgggacatatgagtaaatatt

SEQ ID NO: 583812 - DNA, 25 bp, Rattus norvegicus
tccatgggacatttgagtaaatatt

SEQ ID NO: 583813 - DNA, 25 bp, Rattus norvegicus
tccatgggatccacttttctcagca

SEQ ID NO: 583814 - DNA, 25 bp, Rattus norvegicus
tccatgggatcctcttttctcagca

SEQ ID NO: 583815 - DNA, 25 bp, Rattus norvegicus
tccatgggcaggactttggttcaaa

SEQ ID NO: 583816 - DNA, 25 bp, Rattus norvegicus
tccatgggcaggtctttggttcaaa

SEQ ID NO: 583817 - DNA, 25 bp, Rattus norvegicus
tccatgggttgtaacttgccttgag

SEQ ID NO: 583818 - DNA, 25 bp, Rattus norvegicus
tccatgggttgttacttgccttgag

SEQ ID NO: 583819 - DNA, 25 bp, Rattus norvegicus
tccatggtgcatcgtgccttcctgc

SEQ ID NO: 583820 - DNA, 25 bp, Rattus norvegicus
tccatggtgcatggtgccttcctgc

SEQ ID NO: 583821 - DNA, 25 bp, Rattus norvegicus
tccatgtagggaccatccagcgaat

SEQ ID NO: 583822 - DNA, 25 bp, Rattus norvegicus
tccatgtagggagcatccagcgaat

SEQ ID NO: 583823 - DNA, 25 bp, Rattus norvegicus
tccatgtcagcacaactccaggtga

SEQ ID NO: 583824 - DNA, 25 bp, Rattus norvegicus
tccatgtcagcagaactccaggtga

SEQ ID NO: 583825 - DNA, 25 bp, Rattus norvegicus
tccatgtcatgtcctttgatcccaa

SEQ ID NO: 583826 - DNA, 25 bp, Rattus norvegicus
tccatgtcatgtgctttgatcccaa

SEQ ID NO: 583827 - DNA, 25 bp, Rattus norvegicus
tccatgtctgtgcttatcctgtgaa

SEQ ID NO: 583828 - DNA, 25 bp, Rattus norvegicus
tccatgtctgtggttatcctgtgaa

SEQ ID NO: 583829 - DNA, 25 bp, Rattus norvegicus
tccatgtctttgaaccgtgtcacag

SEQ ID NO: 583830 - DNA, 25 bp, Rattus norvegicus
tccatgtctttgtaccgtgtcacag

SEQ ID NO: 583831 - DNA, 25 bp, Rattus norvegicus
tccatgtgaacacccctttaactta

SEQ ID NO: 583832 - DNA, 25 bp, Rattus norvegicus
tccatgtgaacagccctttaactta

SEQ ID NO: 583833 - DNA, 25 bp, Rattus norvegicus
tccatgtgaatactgactgttgcaa

SEQ ID NO: 583834 - DNA, 25 bp, Rattus norvegicus
tccatgtgaatagtgactgttgcaa

SEQ ID NO: 583835 - DNA, 25 bp, Rattus norvegicus
tccatgtgatgaactgagcaaacta

SEQ ID NO: 583836 - DNA, 25 bp, Rattus norvegicus
tccatgtgatgatctgagcaaacta

SEQ ID NO: 583837 - DNA, 25 bp, Rattus norvegicus
tccatgtgtctgatcctcaagtcaa

SEQ ID NO: 583838 - DNA, 25 bp, Rattus norvegicus
tccatgtgtctgttcctcaagtcaa

SEQ ID NO: 583839 - DNA, 25 bp, Rattus norvegicus
tccatgttatttcatttgacctgaa

SEQ ID NO: 583840 - DNA, 25 bp, Rattus norvegicus
tccatgttatttgatttgacctgaa

SEQ ID NO: 583841 - DNA, 25 bp, Rattus norvegicus
tccatgttcatgatccagacacggg

SEQ ID NO: 583842 - DNA, 25 bp, Rattus norvegicus
tccatgttcatgttccagacacggg

SEQ ID NO: 583843 - DNA, 25 bp, Rattus norvegicus
tccatgttcctgaggccacatctaa

SEQ ID NO: 583844 - DNA, 25 bp, Rattus norvegicus
tccatgttcctgtggccacatctaa

SEQ ID NO: 583845 - DNA, 25 bp, Rattus norvegicus
tccatgttcttgcaagtgccttcaa

SEQ ID NO: 583846 - DNA, 25 bp, Rattus norvegicus
tccatgttcttggaagtgccttcaa

SEQ ID NO: 583847 - DNA, 25 bp, Rattus norvegicus
tccatgtttccaagtgccagagcac

SEQ ID NO: 583848 - DNA, 25 bp, Rattus norvegicus
tccatgtttccatgtgccagagcac

SEQ ID NO: 583849 - DNA, 25 bp, Rattus norvegicus
tccatgtttcttccctactgtaaaa

SEQ ID NO: 583850 - DNA, 25 bp, Rattus norvegicus
tccatgtttcttgcctactgtaaaa

SEQ ID NO: 583851 - DNA, 25 bp, Rattus norvegicus
tccatgtttgtccaccagaaggccg

SEQ ID NO: 583852 - DNA, 25 bp, Rattus norvegicus
tccatgtttgtcgaccagaaggccg

SEQ ID NO: 583853 - DNA, 25 bp, Rattus norvegicus
tccattaatggactagtgaggcctg

SEQ ID NO: 583854 - DNA, 25 bp, Rattus norvegicus
tccattaatggagtagtgaggcctg

SEQ ID NO: 583855 - DNA, 25 bp, Rattus norvegicus
tccattactgcaactagacctagcc

SEQ ID NO: 583856 - DNA, 25 bp, Rattus norvegicus
tccattactgcatctagacctagcc

SEQ ID NO: 583857 - DNA, 25 bp, Rattus norvegicus
tccattagaataacctcctcccatt

SEQ ID NO: 583858 - DNA, 25 bp, Rattus norvegicus
tccattagaatatcctcctcccatt

SEQ ID NO: 583859 - DNA, 25 bp, Rattus norvegicus
tccattcaaccaccactctatagag

SEQ ID NO: 583860 - DNA, 25 bp, Rattus norvegicus
tccattcaaccagcactctatagag

SEQ ID NO: 583861 - DNA, 25 bp, Rattus norvegicus
tccattcaccgactccagcatgcca

SEQ ID NO: 583862 - DNA, 25 bp, Rattus norvegicus
tccattcaccgagtccagcatgcca

SEQ ID NO: 583863 - DNA, 25 bp, Rattus norvegicus
tccattccaggtatctgcacagtga

SEQ ID NO: 583864 - DNA, 25 bp, Rattus norvegicus
tccattccaggtttctgcacagtga

SEQ ID NO: 583865 - DNA, 25 bp, Rattus norvegicus
tccattcccaagcatgcttcctaat

SEQ ID NO: 583866 - DNA, 25 bp, Rattus norvegicus
tccattcccaaggatgcttcctaat

SEQ ID NO: 583867 - DNA, 25 bp, Rattus norvegicus
tccattccccttacttggtgcaaaa

SEQ ID NO: 583868 - DNA, 25 bp, Rattus norvegicus
tccattcccctttcttggtgcaaaa

SEQ ID NO: 583869 - DNA, 25 bp, Rattus norvegicus
tccattccctcccaatttgaatttg

SEQ ID NO: 583870 - DNA, 25 bp, Rattus norvegicus
tccattccctccgaatttgaatttg

SEQ ID NO: 583871 - DNA, 25 bp, Rattus norvegicus
tccattccgtttcggtggtgttatt

SEQ ID NO: 583872 - DNA, 25 bp, Rattus norvegicus
tccattccgtttgggtggtgttatt

SEQ ID NO: 583873 - DNA, 25 bp, Rattus norvegicus
tccattcctccacgaattttatata

SEQ ID NO: 583874 - DNA, 25 bp, Rattus norvegicus
tccattcctccacttcagggatgaa

SEQ ID NO: 583875 - DNA, 25 bp, Rattus norvegicus
tccattcctccaggaattttatata

SEQ ID NO: 583876 - DNA, 25 bp, Rattus norvegicus
tccattcctccagttcagggatgaa

SEQ ID NO: 583877 - DNA, 25 bp, Rattus norvegicus
tccattctacggcttcagggttcaa

SEQ ID NO: 583878 - DNA, 25 bp, Rattus norvegicus
tccattctacgggttcagggttcaa

SEQ ID NO: 583879 - DNA, 25 bp, Rattus norvegicus
tccattctatgcatctgtgtacctg

SEQ ID NO: 583880 - DNA, 25 bp, Rattus norvegicus
tccattctatgcttctgtgtacctg

SEQ ID NO: 583881 - DNA, 25 bp, Rattus norvegicus
tccattctgatgacacgccattaag

SEQ ID NO: 583882 - DNA, 25 bp, Rattus norvegicus
tccattctgatgtcacgccattaag

SEQ ID NO: 583883 - DNA, 25 bp, Rattus norvegicus
tccattctgcctctggctttctaag

SEQ ID NO: 583884 - DNA, 25 bp, Rattus norvegicus
tccattctgcctgtggctttctaag

SEQ ID NO: 583885 - DNA, 25 bp, Rattus norvegicus
tccattctgcttatctgctgtaggt

SEQ ID NO: 583886 - DNA, 25 bp, Rattus norvegicus
tccattctgcttttctgctgtaggt

SEQ ID NO: 583887 - DNA, 25 bp, Rattus norvegicus
tccattctggaaactgagttcaaac

SEQ ID NO: 583888 - DNA, 25 bp, Rattus norvegicus
tccattctggaatctgagttcaaac

SEQ ID NO: 583889 - DNA, 25 bp, Rattus norvegicus
tccattctgggtagtggatggccac

SEQ ID NO: 583890 - DNA, 25 bp, Rattus norvegicus
tccattctgggttgtggatggccac

SEQ ID NO: 583891 - DNA, 25 bp, Rattus norvegicus
tccattcttctgcatagaggcctcc

SEQ ID NO: 583892 - DNA, 25 bp, Rattus norvegicus
tccattcttctggatagaggcctcc

SEQ ID NO: 583893 - DNA, 25 bp, Rattus norvegicus
tccattctttggctccttagagcaa

SEQ ID NO: 583894 - DNA, 25 bp, Rattus norvegicus
tccattctttgggtccttagagcaa

SEQ ID NO: 583895 - DNA, 25 bp, Rattus norvegicus
tccattgaagaaaattacgctcggg

SEQ ID NO: 583896 - DNA, 25 bp, Rattus norvegicus
tccattgaagaatattacgctcggg

SEQ ID NO: 583897 - DNA, 25 bp, Rattus norvegicus
tccattgaagacatggccctgggaa

SEQ ID NO: 583898 - DNA, 25 bp, Rattus norvegicus
tccattgaagacttggccctgggaa

SEQ ID NO: 583899 - DNA, 25 bp, Rattus norvegicus
tccattgacgtgattattgcctttt

SEQ ID NO: 583900 - DNA, 25 bp, Rattus norvegicus
tccattgacgtgtttattgcctttt

SEQ ID NO: 583901 - DNA, 25 bp, Rattus norvegicus
tccattgatgttactataaattgaa

SEQ ID NO: 583902 - DNA, 25 bp, Rattus norvegicus
tccattgatgtttctataaattgaa

SEQ ID NO: 583903 - DNA, 25 bp, Rattus norvegicus
tccattgcacaacttaatgcagaga

SEQ ID NO: 583904 - DNA, 25 bp, Rattus norvegicus
tccattgcacaagttaatgcagaga

SEQ ID NO: 583905 - DNA, 25 bp, Rattus norvegicus
tccattgccataacggctcgcaaat

SEQ ID NO: 583906 - DNA, 25 bp, Rattus norvegicus
tccattgccatatcggctcgcaaat

SEQ ID NO: 583907 - DNA, 25 bp, Rattus norvegicus
tccattgcttggagaacggccagta

SEQ ID NO: 583908 - DNA, 25 bp, Rattus norvegicus
tccattgcttggtgaacggccagta

SEQ ID NO: 583909 - DNA, 25 bp, Rattus norvegicus
tccattggctggcattctggcaaat

SEQ ID NO: 583910 - DNA, 25 bp, Rattus norvegicus
tccattggctgggattctggcaaat

SEQ ID NO: 583911 - DNA, 25 bp, Rattus norvegicus
tccattggcttgaggtcttgtgatg

SEQ ID NO: 583912 - DNA, 25 bp, Rattus norvegicus
tccattggcttgtggtcttgtgatg

SEQ ID NO: 583913 - DNA, 25 bp, Rattus norvegicus
tccattggtggcatcagttgtggct

SEQ ID NO: 583914 - DNA, 25 bp, Rattus norvegicus
tccattggtggcttcagttgtggct

SEQ ID NO: 583915 - DNA, 25 bp, Rattus norvegicus
tccattggttccctttgtagttcaa

SEQ ID NO: 583916 - DNA, 25 bp, Rattus norvegicus
tccattggttccgtttgtagttcaa

SEQ ID NO: 583917 - DNA, 25 bp, Rattus norvegicus
tccattgtaaacctgcttacccatg

SEQ ID NO: 583918 - DNA, 25 bp, Rattus norvegicus
tccattgtaaacgtgcttacccatg

SEQ ID NO: 583919 - DNA, 25 bp, Rattus norvegicus
tccattgtcgtgaggcacactcctg

SEQ ID NO: 583920 - DNA, 25 bp, Rattus norvegicus
tccattgtcgtgtggcacactcctg

SEQ ID NO: 583921 - DNA, 25 bp, Rattus norvegicus
tccatttaacatcagagttttcgtt

SEQ ID NO: 583922 - DNA, 25 bp, Rattus norvegicus
tccatttaacatgagagttttcgtt

SEQ ID NO: 583923 - DNA, 25 bp, Rattus norvegicus
tccatttacagcaacctgggtgggt

SEQ ID NO: 583924 - DNA, 25 bp, Rattus norvegicus
tccatttacagctacctgggtgggt

SEQ ID NO: 583925 - DNA, 25 bp, Rattus norvegicus
tccatttactttcaccatggtggcg

SEQ ID NO: 583926 - DNA, 25 bp, Rattus norvegicus
tccatttactttgaccatggtggcg

SEQ ID NO: 583927 - DNA, 25 bp, Rattus norvegicus
tccatttagcttctctctcgtttta

SEQ ID NO: 583928 - DNA, 25 bp, Rattus norvegicus
tccatttagcttgtctctcgtttta

SEQ ID NO: 583929 - DNA, 25 bp, Rattus norvegicus
tccatttatgtgctttgtaaacagt

SEQ ID NO: 583930 - DNA, 25 bp, Rattus norvegicus
tccatttatgtggtttgtaaacagt

SEQ ID NO: 583931 - DNA, 25 bp, Rattus norvegicus
tccatttcccgaacactacatgtgg

SEQ ID NO: 583932 - DNA, 25 bp, Rattus norvegicus
tccatttcccgatcactacatgtgg

SEQ ID NO: 583933 - DNA, 25 bp, Rattus norvegicus
tccatttcccttatctaactgcctg

SEQ ID NO: 583934 - DNA, 25 bp, Rattus norvegicus
tccatttcccttttctaactgcctg

SEQ ID NO: 583935 - DNA, 25 bp, Rattus norvegicus
tccatttccttgctgtctgggcagg

SEQ ID NO: 583936 - DNA, 25 bp, Rattus norvegicus
tccatttccttggtgtctgggcagg

SEQ ID NO: 583937 - DNA, 25 bp, Rattus norvegicus
tccatttcggtaagacattgatatt

SEQ ID NO: 583938 - DNA, 25 bp, Rattus norvegicus
tccatttcggtatgacattgatatt

SEQ ID NO: 583939 - DNA, 25 bp, Rattus norvegicus
tccatttctatcatactggcagcca

SEQ ID NO: 583940 - DNA, 25 bp, Rattus norvegicus
tccatttctatcttactggcagcca

SEQ ID NO: 583941 - DNA, 25 bp, Rattus norvegicus
tccatttgaggcatctgtgtgagac

SEQ ID NO: 583942 - DNA, 25 bp, Rattus norvegicus
tccatttgaggcttctgtgtgagac

SEQ ID NO: 583943 - DNA, 25 bp, Rattus norvegicus
tccatttgcctgctcagaagtccca

SEQ ID NO: 583944 - DNA, 25 bp, Rattus norvegicus
tccatttgcctggtcagaagtccca

SEQ ID NO: 583945 - DNA, 25 bp, Rattus norvegicus
tccatttggccgacactgggaaaca

SEQ ID NO: 583946 - DNA, 25 bp, Rattus norvegicus
tccatttggccgtcactgggaaaca

SEQ ID NO: 583947 - DNA, 25 bp, Rattus norvegicus
tccatttgtattcccagcgctcgtt

SEQ ID NO: 583948 - DNA, 25 bp, Rattus norvegicus
tccatttgtattgccagcgctcgtt

SEQ ID NO: 583949 - DNA, 25 bp, Rattus norvegicus
tccatttgtttaatgccttcagcct

SEQ ID NO: 583950 - DNA, 25 bp, Rattus norvegicus
tccatttgtttattgccttcagcct

SEQ ID NO: 583951 - DNA, 25 bp, Rattus norvegicus
tccattttcacgagggcgggtcagg

SEQ ID NO: 583952 - DNA, 25 bp, Rattus norvegicus
tccattttcacgtgggcgggtcagg

SEQ ID NO: 583953 - DNA, 25 bp, Rattus norvegicus
tccattttcccacataagccatgtt

SEQ ID NO: 583954 - DNA, 25 bp, Rattus norvegicus
tccattttcccagataagccatgtt

SEQ ID NO: 583955 - DNA, 25 bp, Rattus norvegicus
tccattttctccagcagccataaaa

SEQ ID NO: 583956 - DNA, 25 bp, Rattus norvegicus
tccattttctcctgcagccataaaa

SEQ ID NO: 583957 - DNA, 25 bp, Rattus norvegicus
tccattttctttctggccttaacct

SEQ ID NO: 583958 - DNA, 25 bp, Rattus norvegicus
tccattttctttgtggccttaacct

SEQ ID NO: 583959 - DNA, 25 bp, Rattus norvegicus
tccattttgggcattagactgatta

SEQ ID NO: 583960 - DNA, 25 bp, Rattus norvegicus
tccattttgggctttagactgatta

SEQ ID NO: 583961 - DNA, 25 bp, Rattus norvegicus
tccatttttggaagcatcgcgctgt

SEQ ID NO: 583962 - DNA, 25 bp, Rattus norvegicus
tccatttttggatgcatcgcgctgt

SEQ ID NO: 583963 - DNA, 25 bp, Rattus norvegicus
tccattttttcaccaggattcaaag

SEQ ID NO: 583964 - DNA, 25 bp, Rattus norvegicus
tccattttttcagcaggattcaaag

SEQ ID NO: 583965 - DNA, 25 bp, Rattus norvegicus
tcccaaacaggaagcactctactaa

SEQ ID NO: 583966 - DNA, 25 bp, Rattus norvegicus
tcccaaacaggatgcactctactaa

SEQ ID NO: 583967 - DNA, 25 bp, Rattus norvegicus
tcccaaactaacatctgcgatcgag

SEQ ID NO: 583968 - DNA, 25 bp, Rattus norvegicus
tcccaaactaacttctgcgatcgag

SEQ ID NO: 583969 - DNA, 25 bp, Rattus norvegicus
tcccaaacttgaccctgaaactgtg

SEQ ID NO: 583970 - DNA, 25 bp, Rattus norvegicus
tcccaaacttgagcctgaaactgtg

SEQ ID NO: 583971 - DNA, 25 bp, Rattus norvegicus
tcccaaagattcatccttgtcttca

SEQ ID NO: 583972 - DNA, 25 bp, Rattus norvegicus
tcccaaagattcttccttgtcttca

SEQ ID NO: 583973 - DNA, 25 bp, Rattus norvegicus
tcccaaagttgtagtaacctgccgt

SEQ ID NO: 583974 - DNA, 25 bp, Rattus norvegicus
tcccaaagttgttgtaacctgccgt

SEQ ID NO: 583975 - DNA, 25 bp, Rattus norvegicus
tcccaaataattcaggctggactat

SEQ ID NO: 583976 - DNA, 25 bp, Rattus norvegicus
tcccaaataattgaggctggactat

SEQ ID NO: 583977 - DNA, 25 bp, Rattus norvegicus
tcccaaatgaagagatagtgcagaa

SEQ ID NO: 583978 - DNA, 25 bp, Rattus norvegicus
tcccaaatgaagtgatagtgcagaa

SEQ ID NO: 583979 - DNA, 25 bp, Rattus norvegicus
tcccaacaaaatacacatgcagcta

SEQ ID NO: 583980 - DNA, 25 bp, Rattus norvegicus
tcccaacaaaattcacatgcagcta

SEQ ID NO: 583981 - DNA, 25 bp, Rattus norvegicus
tcccaacacaccagcaacagtttta

SEQ ID NO: 583982 - DNA, 25 bp, Rattus norvegicus
tcccaacacacctgcaacagtttta

SEQ ID NO: 583983 - DNA, 25 bp, Rattus norvegicus
tcccaacaccacacgtgatttaggt

SEQ ID NO: 583984 - DNA, 25 bp, Rattus norvegicus
tcccaacaccactcgtgatttaggt

SEQ ID NO: 583985 - DNA, 25 bp, Rattus norvegicus
tcccaacacttcatcagctgtttga

SEQ ID NO: 583986 - DNA, 25 bp, Rattus norvegicus
tcccaacacttcttcagctgtttga

SEQ ID NO: 583987 - DNA, 25 bp, Rattus norvegicus
tcccaacccagaaatgtccatactt

SEQ ID NO: 583988 - DNA, 25 bp, Rattus norvegicus
tcccaacccagatatgtccatactt

SEQ ID NO: 583989 - DNA, 25 bp, Rattus norvegicus
tcccaacccgatagctttcaagaaa

SEQ ID NO: 583990 - DNA, 25 bp, Rattus norvegicus
tcccaacccgattgctttcaagaaa

SEQ ID NO: 583991 - DNA, 25 bp, Rattus norvegicus
tcccaaccctcacagtattaagtac

SEQ ID NO: 583992 - DNA, 25 bp, Rattus norvegicus
tcccaaccctcagagtattaagtac

SEQ ID NO: 583993 - DNA, 25 bp, Rattus norvegicus
tcccaacccttgatagtcttgcgtt

SEQ ID NO: 583994 - DNA, 25 bp, Rattus norvegicus
tcccaacccttgttagtcttgcgtt

SEQ ID NO: 583995 - DNA, 25 bp, Rattus norvegicus
tcccaaccgcccctaaatatatata

SEQ ID NO: 583996 - DNA, 25 bp, Rattus norvegicus
tcccaaccgcccgtaaatatatata

SEQ ID NO: 583997 - DNA, 25 bp, Rattus norvegicus
tcccaaccgttaaccgtgtgctggg

SEQ ID NO: 583998 - DNA, 25 bp, Rattus norvegicus
tcccaaccgttatccgtgtgctggg

SEQ ID NO: 583999 - DNA, 25 bp, Rattus norvegicus
tcccaacgttgactgcagaagagat

SEQ ID NO: 584000 - DNA, 25 bp, Rattus norvegicus
tcccaacgttgagtgcagaagagat

SEQ ID NO: 584001 - DNA, 25 bp, Rattus norvegicus
tcccaactacagagtccagggtatt

SEQ ID NO: 584002 - DNA, 25 bp, Rattus norvegicus
tcccaactacagtgtccagggtatt

SEQ ID NO: 584003 - DNA, 25 bp, Rattus norvegicus
tcccaactacctcgagttttacaat

SEQ ID NO: 584004 - DNA, 25 bp, Rattus norvegicus
tcccaactacctggagttttacaat

SEQ ID NO: 584005 - DNA, 25 bp, Rattus norvegicus
tcccaactgggtatgtgcgacacac

SEQ ID NO: 584006 - DNA, 25 bp, Rattus norvegicus
tcccaactgggtttgtgcgacacac

SEQ ID NO: 584007 - DNA, 25 bp, Rattus norvegicus
tcccaagaacggactttaatttctg

SEQ ID NO: 584008 - DNA, 25 bp, Rattus norvegicus
tcccaagaacggtctttaatttctg

SEQ ID NO: 584009 - DNA, 25 bp, Rattus norvegicus
tcccaagaccctcccaatagttaat

SEQ ID NO: 584010 - DNA, 25 bp, Rattus norvegicus
tcccaagaccctgccaatagttaat

SEQ ID NO: 584011 - DNA, 25 bp, Rattus norvegicus
tcccaagaccttatcgcttaactct

SEQ ID NO: 584012 - DNA, 25 bp, Rattus norvegicus
tcccaagaccttttcgcttaactct

SEQ ID NO: 584013 - DNA, 25 bp, Rattus norvegicus
tcccaagcagagaaaggcctcccgt

SEQ ID NO: 584014 - DNA, 25 bp, Rattus norvegicus
tcccaagcagagtaaggcctcccgt

SEQ ID NO: 584015 - DNA, 25 bp, Rattus norvegicus
tcccaagcccacacagtttcaagat

SEQ ID NO: 584016 - DNA, 25 bp, Rattus norvegicus
tcccaagcccactcagtttcaagat

SEQ ID NO: 584017 - DNA, 25 bp, Rattus norvegicus
tcccaagccttccttaggttacgtg

SEQ ID NO: 584018 - DNA, 25 bp, Rattus norvegicus
tcccaagccttcgttaggttacgtg

SEQ ID NO: 584019 - DNA, 25 bp, Rattus norvegicus
tcccaagctctaaggttttctaaaa

SEQ ID NO: 584020 - DNA, 25 bp, Rattus norvegicus
tcccaagctctatggttttctaaaa

SEQ ID NO: 584021 - DNA, 25 bp, Rattus norvegicus
tcccaagctctgaccaagtgttgat

SEQ ID NO: 584022 - DNA, 25 bp, Rattus norvegicus
tcccaagctctgtccaagtgttgat

SEQ ID NO: 584023 - DNA, 25 bp, Rattus norvegicus
tcccaaggaaggcaaccctgcagag

SEQ ID NO: 584024 - DNA, 25 bp, Rattus norvegicus
tcccaaggaagggaaccctgcagag

SEQ ID NO: 584025 - DNA, 25 bp, Rattus norvegicus
tcccaaggacttaagaactctctga

SEQ ID NO: 584026 - DNA, 25 bp, Rattus norvegicus
tcccaaggactttagaactctctga

SEQ ID NO: 584027 - DNA, 25 bp, Rattus norvegicus
tcccaaggaggacactgagctgctt

SEQ ID NO: 584028 - DNA, 25 bp, Rattus norvegicus
tcccaaggaggagactgagctgctt

SEQ ID NO: 584029 - DNA, 25 bp, Rattus norvegicus
tcccaaggatgcatcctaatggaaa

SEQ ID NO: 584030 - DNA, 25 bp, Rattus norvegicus
tcccaaggatgcttcctaatggaaa

SEQ ID NO: 584031 - DNA, 25 bp, Rattus norvegicus
tcccaagggctgaggtcttcttgaa

SEQ ID NO: 584032 - DNA, 25 bp, Rattus norvegicus
tcccaagggctgtggtcttcttgaa

SEQ ID NO: 584033 - DNA, 25 bp, Rattus norvegicus
tcccaaggtaatccatgttctgtgt

SEQ ID NO: 584034 - DNA, 25 bp, Rattus norvegicus
tcccaaggtaatgcatgttctgtgt

SEQ ID NO: 584035 - DNA, 25 bp, Rattus norvegicus
tcccaaggtctgatttctgcaggct

SEQ ID NO: 584036 - DNA, 25 bp, Rattus norvegicus
tcccaaggtctgttttctgcaggct

SEQ ID NO: 584037 - DNA, 25 bp, Rattus norvegicus
tcccaagtgcccatcctaaaagttg

SEQ ID NO: 584038 - DNA, 25 bp, Rattus norvegicus
tcccaagtgcccttcctaaaagttg

SEQ ID NO: 584039 - DNA, 25 bp, Rattus norvegicus
tcccaagttcccagtccgaggtcat

SEQ ID NO: 584040 - DNA, 25 bp, Rattus norvegicus
tcccaagttccctgtccgaggtcat

SEQ ID NO: 584041 - DNA, 25 bp, Rattus norvegicus
tcccaagttgctagcacagcagcat

SEQ ID NO: 584042 - DNA, 25 bp, Rattus norvegicus
tcccaagttgcttgcacagcagcat

SEQ ID NO: 584043 - DNA, 25 bp, Rattus norvegicus
tcccaatatgaaatgagttctctct

SEQ ID NO: 584044 - DNA, 25 bp, Rattus norvegicus
tcccaatatgaattgagttctctct

SEQ ID NO: 584045 - DNA, 25 bp, Rattus norvegicus
tcccaatattttaaacctatgttat

SEQ ID NO: 584046 - DNA, 25 bp, Rattus norvegicus
tcccaatatttttaacctatgttat

SEQ ID NO: 584047 - DNA, 25 bp, Rattus norvegicus
tcccaatctctgacatctcacttgt

SEQ ID NO: 584048 - DNA, 25 bp, Rattus norvegicus
tcccaatctctgtcatctcacttgt

SEQ ID NO: 584049 - DNA, 25 bp, Rattus norvegicus
tcccaatctgggaccaagaagcata

SEQ ID NO: 584050 - DNA, 25 bp, Rattus norvegicus
tcccaatctgggtccaagaagcata

SEQ ID NO: 584051 - DNA, 25 bp, Rattus norvegicus
tcccaatcttatcccacataactta

SEQ ID NO: 584052 - DNA, 25 bp, Rattus norvegicus
tcccaatcttatgccacataactta

SEQ ID NO: 584053 - DNA, 25 bp, Rattus norvegicus
tcccaatgccaaccccattttgagg

SEQ ID NO: 584054 - DNA, 25 bp, Rattus norvegicus
tcccaatgccaagcccattttgagg

SEQ ID NO: 584055 - DNA, 25 bp, Rattus norvegicus
tcccaatgtcatatatatcctcctc

SEQ ID NO: 584056 - DNA, 25 bp, Rattus norvegicus
tcccaatgtcatttatatcctcctc

SEQ ID NO: 584057 - DNA, 25 bp, Rattus norvegicus
tcccaattctacaaatgtccaccta

SEQ ID NO: 584058 - DNA, 25 bp, Rattus norvegicus
tcccaattctactaatgtccaccta

SEQ ID NO: 584059 - DNA, 25 bp, Rattus norvegicus
tcccacaacaggagcgggcaggagc

SEQ ID NO: 584060 - DNA, 25 bp, Rattus norvegicus
tcccacaacaggtgcgggcaggagc

SEQ ID NO: 584061 - DNA, 25 bp, Rattus norvegicus
tcccacaattgtacgtgtcttctga

SEQ ID NO: 584062 - DNA, 25 bp, Rattus norvegicus
tcccacaattgttcgtgtcttctga

SEQ ID NO: 584063 - DNA, 25 bp, Rattus norvegicus
tcccacacacataccagaagtcagg

SEQ ID NO: 584064 - DNA, 25 bp, Rattus norvegicus
tcccacacacattccagaagtcagg

SEQ ID NO: 584065 - DNA, 25 bp, Rattus norvegicus
tcccacaccgggatgtaccatgaca

SEQ ID NO: 584066 - DNA, 25 bp, Rattus norvegicus
tcccacaccgggttgtaccatgaca

SEQ ID NO: 584067 - DNA, 25 bp, Rattus norvegicus
tcccacactctgacttggttgtaaa

SEQ ID NO: 584068 - DNA, 25 bp, Rattus norvegicus
tcccacactctgtcttggttgtaaa

SEQ ID NO: 584069 - DNA, 25 bp, Rattus norvegicus
tcccacactcttatacctgaggtta

SEQ ID NO: 584070 - DNA, 25 bp, Rattus norvegicus
tcccacactcttttacctgaggtta

SEQ ID NO: 584071 - DNA, 25 bp, Rattus norvegicus
tcccacagaagcctcacagagtttt

SEQ ID NO: 584072 - DNA, 25 bp, Rattus norvegicus
tcccacagaagcgtcacagagtttt

SEQ ID NO: 584073 - DNA, 25 bp, Rattus norvegicus
tcccacagcctgaaacttaatgttt

SEQ ID NO: 584074 - DNA, 25 bp, Rattus norvegicus
tcccacagcctgtaacttaatgttt

SEQ ID NO: 584075 - DNA, 25 bp, Rattus norvegicus
tcccacagctgaccgtctaatatga

SEQ ID NO: 584076 - DNA, 25 bp, Rattus norvegicus
tcccacagctgagcgtctaatatga

SEQ ID NO: 584077 - DNA, 25 bp, Rattus norvegicus
tcccacaggaagaggtttaagccaa

SEQ ID NO: 584078 - DNA, 25 bp, Rattus norvegicus
tcccacaggaagtggtttaagccaa

SEQ ID NO: 584079 - DNA, 25 bp, Rattus norvegicus
tcccacaggacaccacacaagaagt

SEQ ID NO: 584080 - DNA, 25 bp, Rattus norvegicus
tcccacaggacagcacacaagaagt

SEQ ID NO: 584081 - DNA, 25 bp, Rattus norvegicus
tcccacaggcccctgaacaggaaaa

SEQ ID NO: 584082 - DNA, 25 bp, Rattus norvegicus
tcccacaggcccgtgaacaggaaaa

SEQ ID NO: 584083 - DNA, 25 bp, Rattus norvegicus
tcccacatcaaacaaaagctgcaag

SEQ ID NO: 584084 - DNA, 25 bp, Rattus norvegicus
tcccacatcaaagaaaagctgcaag

SEQ ID NO: 584085 - DNA, 25 bp, Rattus norvegicus
tcccacatcgggataggccatgact

SEQ ID NO: 584086 - DNA, 25 bp, Rattus norvegicus
tcccacatcgggttaggccatgact

SEQ ID NO: 584087 - DNA, 25 bp, Rattus norvegicus
tcccacatgcgaatgcggcgatcag

SEQ ID NO: 584088 - DNA, 25 bp, Rattus norvegicus
tcccacatgcgattgcggcgatcag

SEQ ID NO: 584089 - DNA, 25 bp, Rattus norvegicus
tcccacatgctcagcacttaagagg

SEQ ID NO: 584090 - DNA, 25 bp, Rattus norvegicus
tcccacatgctctgcacttaagagg

SEQ ID NO: 584091 - DNA, 25 bp, Rattus norvegicus
tcccacatgggtcctggcaactgaa

SEQ ID NO: 584092 - DNA, 25 bp, Rattus norvegicus
tcccacatgggtgctggcaactgaa

SEQ ID NO: 584093 - DNA, 25 bp, Rattus norvegicus
tcccaccaaagtaaccgttcagttg

SEQ ID NO: 584094 - DNA, 25 bp, Rattus norvegicus
tcccaccaaagttaccgttcagttg

SEQ ID NO: 584095 - DNA, 25 bp, Rattus norvegicus
tcccaccaagctctagaactgtctg

SEQ ID NO: 584096 - DNA, 25 bp, Rattus norvegicus
tcccaccaagctgtagaactgtctg

SEQ ID NO: 584097 - DNA, 25 bp, Rattus norvegicus
tcccaccaataaagcccctgttggt

SEQ ID NO: 584098 - DNA, 25 bp, Rattus norvegicus
tcccaccaataatgcccctgttggt

SEQ ID NO: 584099 - DNA, 25 bp, Rattus norvegicus
tcccaccacaggaaaagaccataca

SEQ ID NO: 584100 - DNA, 25 bp, Rattus norvegicus
tcccaccacaggtaaagaccataca

SEQ ID NO: 584101 - DNA, 25 bp, Rattus norvegicus
tcccaccacatgctactcttgtttt

SEQ ID NO: 584102 - DNA, 25 bp, Rattus norvegicus
tcccaccacatggtactcttgtttt

SEQ ID NO: 584103 - DNA, 25 bp, Rattus norvegicus
tcccaccactgtaataggccgtaag

SEQ ID NO: 584104 - DNA, 25 bp, Rattus norvegicus
tcccaccactgttataggccgtaag

SEQ ID NO: 584105 - DNA, 25 bp, Rattus norvegicus
tcccaccaggcaacattacttagaa

SEQ ID NO: 584106 - DNA, 25 bp, Rattus norvegicus
tcccaccaggcatcattacttagaa

SEQ ID NO: 584107 - DNA, 25 bp, Rattus norvegicus
tcccaccagtggcttagattaatgg

SEQ ID NO: 584108 - DNA, 25 bp, Rattus norvegicus
tcccaccagtgggttagattaatgg

SEQ ID NO: 584109 - DNA, 25 bp, Rattus norvegicus
tcccaccagttcctttgtaggcaaa

SEQ ID NO: 584110 - DNA, 25 bp, Rattus norvegicus
tcccaccagttcgtttgtaggcaaa

SEQ ID NO: 584111 - DNA, 25 bp, Rattus norvegicus
tcccaccatcctcttatatgtatag

SEQ ID NO: 584112 - DNA, 25 bp, Rattus norvegicus
tcccaccatcctgttatatgtatag

SEQ ID NO: 584113 - DNA, 25 bp, Rattus norvegicus
tcccaccatgagatgccagcaggaa

SEQ ID NO: 584114 - DNA, 25 bp, Rattus norvegicus
tcccaccatgagttgccagcaggaa

SEQ ID NO: 584115 - DNA, 25 bp, Rattus norvegicus
tcccaccatggcctcttgtatttgg

SEQ ID NO: 584116 - DNA, 25 bp, Rattus norvegicus
tcccaccatggcgtcttgtatttgg

SEQ ID NO: 584117 - DNA, 25 bp, Rattus norvegicus
tcccacccaccgagtaagcaaagga

SEQ ID NO: 584118 - DNA, 25 bp, Rattus norvegicus
tcccacccaccgtgtaagcaaagga

SEQ ID NO: 584119 - DNA, 25 bp, Rattus norvegicus
tcccaccccagccaaaaatatattt

SEQ ID NO: 584120 - DNA, 25 bp, Rattus norvegicus
tcccaccccagcgaaaaatatattt

SEQ ID NO: 584121 - DNA, 25 bp, Rattus norvegicus
tcccaccccgtgatgttaatattat

SEQ ID NO: 584122 - DNA, 25 bp, Rattus norvegicus
tcccaccccgtgttgttaatattat

SEQ ID NO: 584123 - DNA, 25 bp, Rattus norvegicus
tcccacccggatcgcggtatataga

SEQ ID NO: 584124 - DNA, 25 bp, Rattus norvegicus
tcccacccggatggcggtatataga

SEQ ID NO: 584125 - DNA, 25 bp, Rattus norvegicus
tcccaccctatgagtcctatgagaa

SEQ ID NO: 584126 - DNA, 25 bp, Rattus norvegicus
tcccaccctatgtgtcctatgagaa

SEQ ID NO: 584127 - DNA, 25 bp, Rattus norvegicus
tcccacccttgtatgaagttgtgct

SEQ ID NO: 584128 - DNA, 25 bp, Rattus norvegicus
tcccacccttgtttgaagttgtgct

SEQ ID NO: 584129 - DNA, 25 bp, Rattus norvegicus
tcccacccttttctttcaggaatat

SEQ ID NO: 584130 - DNA, 25 bp, Rattus norvegicus
tcccacccttttgtttcaggaatat

SEQ ID NO: 584131 - DNA, 25 bp, Rattus norvegicus
tcccaccgaatgagctttacctatg

SEQ ID NO: 584132 - DNA, 25 bp, Rattus norvegicus
tcccaccgaatgtgctttacctatg

SEQ ID NO: 584133 - DNA, 25 bp, Rattus norvegicus
tcccaccgagttactcgactctttt

SEQ ID NO: 584134 - DNA, 25 bp, Rattus norvegicus
tcccaccgagtttctcgactctttt

SEQ ID NO: 584135 - DNA, 25 bp, Rattus norvegicus
tcccacctatatctggcctcaagag

SEQ ID NO: 584136 - DNA, 25 bp, Rattus norvegicus
tcccacctatatgtggcctcaagag

SEQ ID NO: 584137 - DNA, 25 bp, Rattus norvegicus
tcccacctatgacctttcttttaga

SEQ ID NO: 584138 - DNA, 25 bp, Rattus norvegicus
tcccacctatgagctttcttttaga

SEQ ID NO: 584139 - DNA, 25 bp, Rattus norvegicus
tcccacctcctcctggaggcaaagt

SEQ ID NO: 584140 - DNA, 25 bp, Rattus norvegicus
tcccacctcctcgtggaggcaaagt

SEQ ID NO: 584141 - DNA, 25 bp, Rattus norvegicus
tcccacctctcccagtagaaagaag

SEQ ID NO: 584142 - DNA, 25 bp, Rattus norvegicus
tcccacctctccgagtagaaagaag

SEQ ID NO: 584143 - DNA, 25 bp, Rattus norvegicus
tcccacctgcaaatgtgcgtcacag

SEQ ID NO: 584144 - DNA, 25 bp, Rattus norvegicus
tcccacctgcaattgtgcgtcacag

SEQ ID NO: 584145 - DNA, 25 bp, Rattus norvegicus
tcccacctgtagagccatatactta

SEQ ID NO: 584146 - DNA, 25 bp, Rattus norvegicus
tcccacctgtagtgccatatactta

SEQ ID NO: 584147 - DNA, 25 bp, Rattus norvegicus
tcccacctgtttccttatctatatg

SEQ ID NO: 584148 - DNA, 25 bp, Rattus norvegicus
tcccacctgtttgcttatctatatg

SEQ ID NO: 584149 - DNA, 25 bp, Rattus norvegicus
tcccaccttgatcatactgtactga

SEQ ID NO: 584150 - DNA, 25 bp, Rattus norvegicus
tcccaccttgatgatactgtactga

SEQ ID NO: 584151 - DNA, 25 bp, Rattus norvegicus
tcccaccttttacctttagttagct

SEQ ID NO: 584152 - DNA, 25 bp, Rattus norvegicus
tcccaccttttagctttagttagct

SEQ ID NO: 584153 - DNA, 25 bp, Rattus norvegicus
tcccacgactccactgatttgaaag

SEQ ID NO: 584154 - DNA, 25 bp, Rattus norvegicus
tcccacgactcctctgatttgaaag

SEQ ID NO: 584155 - DNA, 25 bp, Rattus norvegicus
tcccacggactgctcgggctaggaa

SEQ ID NO: 584156 - DNA, 25 bp, Rattus norvegicus
tcccacggactggtcgggctaggaa

SEQ ID NO: 584157 - DNA, 25 bp, Rattus norvegicus
tcccacggccctaggactagagaag

SEQ ID NO: 584158 - DNA, 25 bp, Rattus norvegicus
tcccacggcccttggactagagaag

SEQ ID NO: 584159 - DNA, 25 bp, Rattus norvegicus
tcccacggctgcaaggtgtgtctga

SEQ ID NO: 584160 - DNA, 25 bp, Rattus norvegicus
tcccacggctgctaggtgtgtctga

SEQ ID NO: 584161 - DNA, 25 bp, Rattus norvegicus
tcccacggctttcttcaaattaaat

SEQ ID NO: 584162 - DNA, 25 bp, Rattus norvegicus
tcccacggctttgttcaaattaaat

SEQ ID NO: 584163 - DNA, 25 bp, Rattus norvegicus
tcccacggtcccaattatgatacgg

SEQ ID NO: 584164 - DNA, 25 bp, Rattus norvegicus
tcccacggtccctattatgatacgg

SEQ ID NO: 584165 - DNA, 25 bp, Rattus norvegicus
tcccacggttcccacgaagctgatg

SEQ ID NO: 584166 - DNA, 25 bp, Rattus norvegicus
tcccacggttccgacgaagctgatg

SEQ ID NO: 584167 - DNA, 25 bp, Rattus norvegicus
tcccacgtctataatgggcctttgg

SEQ ID NO: 584168 - DNA, 25 bp, Rattus norvegicus
tcccacgtctattatgggcctttgg

SEQ ID NO: 584169 - DNA, 25 bp, Rattus norvegicus
tcccacgtgcctagaaattgatata

SEQ ID NO: 584170 - DNA, 25 bp, Rattus norvegicus
tcccacgtgccttgaaattgatata

SEQ ID NO: 584171 - DNA, 25 bp, Rattus norvegicus
tcccactaaccaccattaaactgag

SEQ ID NO: 584172 - DNA, 25 bp, Rattus norvegicus
tcccactaaccagcattaaactgag

SEQ ID NO: 584173 - DNA, 25 bp, Rattus norvegicus
tcccactattttcggcctgagacaa

SEQ ID NO: 584174 - DNA, 25 bp, Rattus norvegicus
tcccactattttgggcctgagacaa

SEQ ID NO: 584175 - DNA, 25 bp, Rattus norvegicus
tcccactcacccaggtcaggaaggg

SEQ ID NO: 584176 - DNA, 25 bp, Rattus norvegicus
tcccactcaccctggtcaggaaggg

SEQ ID NO: 584177 - DNA, 25 bp, Rattus norvegicus
tcccactcatggctccaaagtgagt

SEQ ID NO: 584178 - DNA, 25 bp, Rattus norvegicus
tcccactcatgggtccaaagtgagt

SEQ ID NO: 584179 - DNA, 25 bp, Rattus norvegicus
tcccactccaaaaggctttgctgag

SEQ ID NO: 584180 - DNA, 25 bp, Rattus norvegicus
tcccactccaaatggctttgctgag

SEQ ID NO: 584181 - DNA, 25 bp, Rattus norvegicus
tcccactccgagaccgaagatgatg

SEQ ID NO: 584182 - DNA, 25 bp, Rattus norvegicus
tcccactccgagtccgaagatgatg

SEQ ID NO: 584183 - DNA, 25 bp, Rattus norvegicus
tcccactcctgaagggccaaggtgt

SEQ ID NO: 584184 - DNA, 25 bp, Rattus norvegicus
tcccactcctgatgggccaaggtgt

SEQ ID NO: 584185 - DNA, 25 bp, Rattus norvegicus
tcccactgctggctatctgaataaa

SEQ ID NO: 584186 - DNA, 25 bp, Rattus norvegicus
tcccactgctgggtatctgaataaa

SEQ ID NO: 584187 - DNA, 25 bp, Rattus norvegicus
tcccactggcccctgaaagtaataa

SEQ ID NO: 584188 - DNA, 25 bp, Rattus norvegicus
tcccactggcccgtgaaagtaataa

SEQ ID NO: 584189 - DNA, 25 bp, Rattus norvegicus
tcccactggtgaaattctacatttc

SEQ ID NO: 584190 - DNA, 25 bp, Rattus norvegicus
tcccactggtgatattctacatttc

SEQ ID NO: 584191 - DNA, 25 bp, Rattus norvegicus
tcccactgtcgtatttaccactttg

SEQ ID NO: 584192 - DNA, 25 bp, Rattus norvegicus
tcccactgtcgtttttaccactttg

SEQ ID NO: 584193 - DNA, 25 bp, Rattus norvegicus
tcccactgtgataggcatgttgaca

SEQ ID NO: 584194 - DNA, 25 bp, Rattus norvegicus
tcccactgtgattggcatgttgaca

SEQ ID NO: 584195 - DNA, 25 bp, Rattus norvegicus
tcccactgttttcctggtgagagga

SEQ ID NO: 584196 - DNA, 25 bp, Rattus norvegicus
tcccactgttttgctggtgagagga

SEQ ID NO: 584197 - DNA, 25 bp, Rattus norvegicus
tcccacttacccaaaaggctttctg

SEQ ID NO: 584198 - DNA, 25 bp, Rattus norvegicus
tcccacttaccctaaaggctttctg

SEQ ID NO: 584199 - DNA, 25 bp, Rattus norvegicus
tcccacttacttaagctgctgcata

SEQ ID NO: 584200 - DNA, 25 bp, Rattus norvegicus
tcccacttactttagctgctgcata

SEQ ID NO: 584201 - DNA, 25 bp, Rattus norvegicus
tcccacttgaccatcagcgtaatgt

SEQ ID NO: 584202 - DNA, 25 bp, Rattus norvegicus
tcccacttgaccttcagcgtaatgt

SEQ ID NO: 584203 - DNA, 25 bp, Rattus norvegicus
tcccacttgcacagttgccgtaaga

SEQ ID NO: 584204 - DNA, 25 bp, Rattus norvegicus
tcccacttgcactgttgccgtaaga

SEQ ID NO: 584205 - DNA, 25 bp, Rattus norvegicus
tcccacttgggtcttaagttttctg

SEQ ID NO: 584206 - DNA, 25 bp, Rattus norvegicus
tcccacttgggtgttaagttttctg

SEQ ID NO: 584207 - DNA, 25 bp, Rattus norvegicus
tcccacttgtctctaaaatcacaat

SEQ ID NO: 584208 - DNA, 25 bp, Rattus norvegicus
tcccacttgtctgtaaaatcacaat

SEQ ID NO: 584209 - DNA, 25 bp, Rattus norvegicus
tcccactttcatcttggcttttaag

SEQ ID NO: 584210 - DNA, 25 bp, Rattus norvegicus
tcccactttcatgttggcttttaag

SEQ ID NO: 584211 - DNA, 25 bp, Rattus norvegicus
tcccagaacctcatgtattcactat

SEQ ID NO: 584212 - DNA, 25 bp, Rattus norvegicus
tcccagaacctcttgtattcactat

SEQ ID NO: 584213 - DNA, 25 bp, Rattus norvegicus
tcccagaactggagaggctgtcact

SEQ ID NO: 584214 - DNA, 25 bp, Rattus norvegicus
tcccagaactggtgaggctgtcact

SEQ ID NO: 584215 - DNA, 25 bp, Rattus norvegicus
tcccagaagacaatcccagtcatta

SEQ ID NO: 584216 - DNA, 25 bp, Rattus norvegicus
tcccagaagacattcccagtcatta

SEQ ID NO: 584217 - DNA, 25 bp, Rattus norvegicus
tcccagaatacactttaccacgtta

SEQ ID NO: 584218 - DNA, 25 bp, Rattus norvegicus
tcccagaatacagtttaccacgtta

SEQ ID NO: 584219 - DNA, 25 bp, Rattus norvegicus
tcccagaatgccatgcgattggaat

SEQ ID NO: 584220 - DNA, 25 bp, Rattus norvegicus
tcccagaatgccttgcgattggaat

SEQ ID NO: 584221 - DNA, 25 bp, Rattus norvegicus
tcccagaattttccagttcagttgt

SEQ ID NO: 584222 - DNA, 25 bp, Rattus norvegicus
tcccagaattttgcagttcagttgt

SEQ ID NO: 584223 - DNA, 25 bp, Rattus norvegicus
tcccagacagagcagcggctggtct

SEQ ID NO: 584224 - DNA, 25 bp, Rattus norvegicus
tcccagacagaggagcggctggtct

SEQ ID NO: 584225 - DNA, 25 bp, Rattus norvegicus
tcccagacccagaaagcttgcatgg

SEQ ID NO: 584226 - DNA, 25 bp, Rattus norvegicus
tcccagacccagtaagcttgcatgg

SEQ ID NO: 584227 - DNA, 25 bp, Rattus norvegicus
tcccagagcataaccaagccatcaa

SEQ ID NO: 584228 - DNA, 25 bp, Rattus norvegicus
tcccagagcatatccaagccatcaa

SEQ ID NO: 584229 - DNA, 25 bp, Rattus norvegicus
tcccagagccacatgaggaaggctt

SEQ ID NO: 584230 - DNA, 25 bp, Rattus norvegicus
tcccagagccacttgaggaaggctt

SEQ ID NO: 584231 - DNA, 25 bp, Rattus norvegicus
tcccagagccgtcatctcaaggtga

SEQ ID NO: 584232 - DNA, 25 bp, Rattus norvegicus
tcccagagccgtgatctcaaggtga

SEQ ID NO: 584233 - DNA, 25 bp, Rattus norvegicus
tcccagagcctcacctaaataatgt

SEQ ID NO: 584234 - DNA, 25 bp, Rattus norvegicus
tcccagagcctctcctaaataatgt

SEQ ID NO: 584235 - DNA, 25 bp, Rattus norvegicus
tcccagagctgtcaccttagagtat

SEQ ID NO: 584236 - DNA, 25 bp, Rattus norvegicus
tcccagagctgtgaccttagagtat

SEQ ID NO: 584237 - DNA, 25 bp, Rattus norvegicus
tcccagaggcacacggcacacgtgt

SEQ ID NO: 584238 - DNA, 25 bp, Rattus norvegicus
tcccagaggcactcggcacacgtgt

SEQ ID NO: 584239 - DNA, 25 bp, Rattus norvegicus
tcccagagtgctccgcgccgtgaag

SEQ ID NO: 584240 - DNA, 25 bp, Rattus norvegicus
tcccagagtgctgcgcgccgtgaag

SEQ ID NO: 584241 - DNA, 25 bp, Rattus norvegicus
tcccagatccctcctaacggaagaa

SEQ ID NO: 584242 - DNA, 25 bp, Rattus norvegicus
tcccagatccctgctaacggaagaa

SEQ ID NO: 584243 - DNA, 25 bp, Rattus norvegicus
tcccagatgccacagagaccactga

SEQ ID NO: 584244 - DNA, 25 bp, Rattus norvegicus
tcccagatgccagagagaccactga

SEQ ID NO: 584245 - DNA, 25 bp, Rattus norvegicus
tcccagatggtaccacaggtttttc

SEQ ID NO: 584246 - DNA, 25 bp, Rattus norvegicus
tcccagatggtagcacaggtttttc

SEQ ID NO: 584247 - DNA, 25 bp, Rattus norvegicus
tcccagcaaggaaagtctcaggttt

SEQ ID NO: 584248 - DNA, 25 bp, Rattus norvegicus
tcccagcaaggatagtctcaggttt

SEQ ID NO: 584249 - DNA, 25 bp, Rattus norvegicus
tcccagcacagaccatcttgacagt

SEQ ID NO: 584250 - DNA, 25 bp, Rattus norvegicus
tcccagcacagagcatcttgacagt

SEQ ID NO: 584251 - DNA, 25 bp, Rattus norvegicus
tcccagcactcaaagactagaacag

SEQ ID NO: 584252 - DNA, 25 bp, Rattus norvegicus
tcccagcactcactgtagtttacag

SEQ ID NO: 584253 - DNA, 25 bp, Rattus norvegicus
tcccagcactcagtgtagtttacag

SEQ ID NO: 584254 - DNA, 25 bp, Rattus norvegicus
tcccagcactcatagactagaacag

SEQ ID NO: 584255 - DNA, 25 bp, Rattus norvegicus
tcccagcagcaaactaccattaatc

SEQ ID NO: 584256 - DNA, 25 bp, Rattus norvegicus
tcccagcagcaactctgtatatcca

SEQ ID NO: 584257 - DNA, 25 bp, Rattus norvegicus
tcccagcagcaagtctgtatatcca

SEQ ID NO: 584258 - DNA, 25 bp, Rattus norvegicus
tcccagcagcaatctaccattaatc

SEQ ID NO: 584259 - DNA, 25 bp, Rattus norvegicus
tcccagcagccacctagaactgata

SEQ ID NO: 584260 - DNA, 25 bp, Rattus norvegicus
tcccagcagccagctagaactgata

SEQ ID NO: 584261 - DNA, 25 bp, Rattus norvegicus
tcccagcattgccttgttgagatga

SEQ ID NO: 584262 - DNA, 25 bp, Rattus norvegicus
tcccagcattgcgttgttgagatga

SEQ ID NO: 584263 - DNA, 25 bp, Rattus norvegicus
tcccagccacagcagagtctgattc

SEQ ID NO: 584264 - DNA, 25 bp, Rattus norvegicus
tcccagccacaggagagtctgattc

SEQ ID NO: 584265 - DNA, 25 bp, Rattus norvegicus
tcccagccagcacttggaagtatga

SEQ ID NO: 584266 - DNA, 25 bp, Rattus norvegicus
tcccagccagcagttggaagtatga

SEQ ID NO: 584267 - DNA, 25 bp, Rattus norvegicus
tcccagcccggaagacatgagtttt

SEQ ID NO: 584268 - DNA, 25 bp, Rattus norvegicus
tcccagcccggatgacatgagtttt

SEQ ID NO: 584269 - DNA, 25 bp, Rattus norvegicus
tcccagcctgctctaggattagatt

SEQ ID NO: 584270 - DNA, 25 bp, Rattus norvegicus
tcccagcctgctgtaggattagatt

SEQ ID NO: 584271 - DNA, 25 bp, Rattus norvegicus
tcccagcctttaccatgtcctgagt

SEQ ID NO: 584272 - DNA, 25 bp, Rattus norvegicus
tcccagcctttagcatgtcctgagt

SEQ ID NO: 584273 - DNA, 25 bp, Rattus norvegicus
tcccagcgatgtctagcagcgttct

SEQ ID NO: 584274 - DNA, 25 bp, Rattus norvegicus
tcccagcgatgtgtagcagcgttct

SEQ ID NO: 584275 - DNA, 25 bp, Rattus norvegicus
tcccagcgcatcagcaagcttgaga

SEQ ID NO: 584276 - DNA, 25 bp, Rattus norvegicus
tcccagcgcatctgcaagcttgaga

SEQ ID NO: 584277 - DNA, 25 bp, Rattus norvegicus
tcccagcgctcacgatacgaggaag

SEQ ID NO: 584278 - DNA, 25 bp, Rattus norvegicus
tcccagcgctcaggatacgaggaag

SEQ ID NO: 584279 - DNA, 25 bp, Rattus norvegicus
tcccagcgtgtgaaccccgaataga

SEQ ID NO: 584280 - DNA, 25 bp, Rattus norvegicus
tcccagcgtgtgtaccccgaataga

SEQ ID NO: 584281 - DNA, 25 bp, Rattus norvegicus
tcccagctactgagttaacctctgt

SEQ ID NO: 584282 - DNA, 25 bp, Rattus norvegicus
tcccagctactgtgttaacctctgt

SEQ ID NO: 584283 - DNA, 25 bp, Rattus norvegicus
tcccagctcatgacctgagagatga

SEQ ID NO: 584284 - DNA, 25 bp, Rattus norvegicus
tcccagctcatgtcctgagagatga

SEQ ID NO: 584285 - DNA, 25 bp, Rattus norvegicus
tcccagctccaactgaggtctcatt

SEQ ID NO: 584286 - DNA, 25 bp, Rattus norvegicus
tcccagctccaagtgaggtctcatt

SEQ ID NO: 584287 - DNA, 25 bp, Rattus norvegicus
tcccagctcgggagaggtcctaatg

SEQ ID NO: 584288 - DNA, 25 bp, Rattus norvegicus
tcccagctcgggtgaggtcctaatg

SEQ ID NO: 584289 - DNA, 25 bp, Rattus norvegicus
tcccagctgatcagagaccacagaa

SEQ ID NO: 584290 - DNA, 25 bp, Rattus norvegicus
tcccagctgatctgagaccacagaa

SEQ ID NO: 584291 - DNA, 25 bp, Rattus norvegicus
tcccagctgggaaatgtctctacat

SEQ ID NO: 584292 - DNA, 25 bp, Rattus norvegicus
tcccagctgggatatgtctctacat

SEQ ID NO: 584293 - DNA, 25 bp, Rattus norvegicus
tcccagctgggtaccatggtgatca

SEQ ID NO: 584294 - DNA, 25 bp, Rattus norvegicus
tcccagctgggttccatggtgatca

SEQ ID NO: 584295 - DNA, 25 bp, Rattus norvegicus
tcccagcttcgaacagcaggcagca

SEQ ID NO: 584296 - DNA, 25 bp, Rattus norvegicus
tcccagcttcgatcagcaggcagca

SEQ ID NO: 584297 - DNA, 25 bp, Rattus norvegicus
tcccagcttctcctaactcagttat

SEQ ID NO: 584298 - DNA, 25 bp, Rattus norvegicus
tcccagcttctcgtaactcagttat

SEQ ID NO: 584299 - DNA, 25 bp, Rattus norvegicus
tcccaggaagcgaggaagcccttat

SEQ ID NO: 584300 - DNA, 25 bp, Rattus norvegicus
tcccaggaagcgtggaagcccttat

SEQ ID NO: 584301 - DNA, 25 bp, Rattus norvegicus
tcccaggaccatattgacgagataa

SEQ ID NO: 584302 - DNA, 25 bp, Rattus norvegicus
tcccaggaccattttgacgagataa

SEQ ID NO: 584303 - DNA, 25 bp, Rattus norvegicus
tcccaggactgcaatcatccaggaa

SEQ ID NO: 584304 - DNA, 25 bp, Rattus norvegicus
tcccaggactgcatcaaaggtagac

SEQ ID NO: 584305 - DNA, 25 bp, Rattus norvegicus
tcccaggactgctatcatccaggaa

SEQ ID NO: 584306 - DNA, 25 bp, Rattus norvegicus
tcccaggactgcttcaaaggtagac

SEQ ID NO: 584307 - DNA, 25 bp, Rattus norvegicus
tcccaggagagccatcaaaccaact

SEQ ID NO: 584308 - DNA, 25 bp, Rattus norvegicus
tcccaggagagcgatcaaaccaact

SEQ ID NO: 584309 - DNA, 25 bp, Rattus norvegicus
tcccaggaggtgagtttcttcaggt

SEQ ID NO: 584310 - DNA, 25 bp, Rattus norvegicus
tcccaggaggtgtgtttcttcaggt

SEQ ID NO: 584311 - DNA, 25 bp, Rattus norvegicus
tcccaggatgtcaactgtgtggctt

SEQ ID NO: 584312 - DNA, 25 bp, Rattus norvegicus
tcccaggatgtctactgtgtggctt

SEQ ID NO: 584313 - DNA, 25 bp, Rattus norvegicus
tcccaggccaggataatccttgcaa

SEQ ID NO: 584314 - DNA, 25 bp, Rattus norvegicus
tcccaggccaggttaatccttgcaa

SEQ ID NO: 584315 - DNA, 25 bp, Rattus norvegicus
tcccaggccatgcacacttttaatt

SEQ ID NO: 584316 - DNA, 25 bp, Rattus norvegicus
tcccaggccatggacacttttaatt

SEQ ID NO: 584317 - DNA, 25 bp, Rattus norvegicus
tcccaggccctgagatatttattgt

SEQ ID NO: 584318 - DNA, 25 bp, Rattus norvegicus
tcccaggccctgtgatatttattgt

SEQ ID NO: 584319 - DNA, 25 bp, Rattus norvegicus
tcccaggctcctactttagatatga

SEQ ID NO: 584320 - DNA, 25 bp, Rattus norvegicus
tcccaggctccttctttagatatga

SEQ ID NO: 584321 - DNA, 25 bp, Rattus norvegicus
tcccaggctctgatccggtctttta

SEQ ID NO: 584322 - DNA, 25 bp, Rattus norvegicus
tcccaggctctgttccggtctttta

SEQ ID NO: 584323 - DNA, 25 bp, Rattus norvegicus
tcccaggcttcacaaaatcatccag

SEQ ID NO: 584324 - DNA, 25 bp, Rattus norvegicus
tcccaggcttcagaaaatcatccag

SEQ ID NO: 584325 - DNA, 25 bp, Rattus norvegicus
tcccaggcttcgattcacaggcgaa

SEQ ID NO: 584326 - DNA, 25 bp, Rattus norvegicus
tcccaggcttcgctacttatgatta

SEQ ID NO: 584327 - DNA, 25 bp, Rattus norvegicus
tcccaggcttcggtacttatgatta

SEQ ID NO: 584328 - DNA, 25 bp, Rattus norvegicus
tcccaggcttcgtttcacaggcgaa

SEQ ID NO: 584329 - DNA, 25 bp, Rattus norvegicus
tcccaggcttgaagtgactattttt

SEQ ID NO: 584330 - DNA, 25 bp, Rattus norvegicus
tcccaggcttgatgtgactattttt

SEQ ID NO: 584331 - DNA, 25 bp, Rattus norvegicus
tcccagggactgaactatgacttac

SEQ ID NO: 584332 - DNA, 25 bp, Rattus norvegicus
tcccagggactgtactatgacttac

SEQ ID NO: 584333 - DNA, 25 bp, Rattus norvegicus
tcccagggatatcagctgaacacag

SEQ ID NO: 584334 - DNA, 25 bp, Rattus norvegicus
tcccagggatatgagctgaacacag

SEQ ID NO: 584335 - DNA, 25 bp, Rattus norvegicus
tcccagggccctacagttaggtgta

SEQ ID NO: 584336 - DNA, 25 bp, Rattus norvegicus
tcccagggcccttcagttaggtgta

SEQ ID NO: 584337 - DNA, 25 bp, Rattus norvegicus
tcccagggcgttatcaggagctgta

SEQ ID NO: 584338 - DNA, 25 bp, Rattus norvegicus
tcccagggcgttttcaggagctgta

SEQ ID NO: 584339 - DNA, 25 bp, Rattus norvegicus
tcccagggtcataaggcggtagctt

SEQ ID NO: 584340 - DNA, 25 bp, Rattus norvegicus
tcccagggtcattaggcggtagctt

SEQ ID NO: 584341 - DNA, 25 bp, Rattus norvegicus
tcccagggtctccaagattctttat

SEQ ID NO: 584342 - DNA, 25 bp, Rattus norvegicus
tcccagggtctcgaagattctttat

SEQ ID NO: 584343 - DNA, 25 bp, Rattus norvegicus
tcccaggtagccaccaaacagattg

SEQ ID NO: 584344 - DNA, 25 bp, Rattus norvegicus
tcccaggtagcctccaaacagattg

SEQ ID NO: 584345 - DNA, 25 bp, Rattus norvegicus
tcccaggtcatgacctcaaggagtt

SEQ ID NO: 584346 - DNA, 25 bp, Rattus norvegicus
tcccaggtcatgtcctcaaggagtt

SEQ ID NO: 584347 - DNA, 25 bp, Rattus norvegicus
tcccaggtccagaattggtctttct

SEQ ID NO: 584348 - DNA, 25 bp, Rattus norvegicus
tcccaggtccagtattggtctttct

SEQ ID NO: 584349 - DNA, 25 bp, Rattus norvegicus
tcccaggtcgctctagttcagaata

SEQ ID NO: 584350 - DNA, 25 bp, Rattus norvegicus
tcccaggtcgctgtagttcagaata

SEQ ID NO: 584351 - DNA, 25 bp, Rattus norvegicus
tcccaggtctgtcactcataattta

SEQ ID NO: 584352 - DNA, 25 bp, Rattus norvegicus
tcccaggtctgtgactcataattta

SEQ ID NO: 584353 - DNA, 25 bp, Rattus norvegicus
tcccaggtgcctatgctgcagaaat

SEQ ID NO: 584354 - DNA, 25 bp, Rattus norvegicus
tcccaggtgcctttgctgcagaaat

SEQ ID NO: 584355 - DNA, 25 bp, Rattus norvegicus
tcccaggtgctacaattgtaaaagt

SEQ ID NO: 584356 - DNA, 25 bp, Rattus norvegicus
tcccaggtgctagaattgtaaaagt

SEQ ID NO: 584357 - DNA, 25 bp, Rattus norvegicus
tcccaggtggcactcttggaacaag

SEQ ID NO: 584358 - DNA, 25 bp, Rattus norvegicus
tcccaggtggcagtcttggaacaag

SEQ ID NO: 584359 - DNA, 25 bp, Rattus norvegicus
tcccaggttgcaacaaggacaatgt

SEQ ID NO: 584360 - DNA, 25 bp, Rattus norvegicus
tcccaggttgcatcaaggacaatgt

SEQ ID NO: 584361 - DNA, 25 bp, Rattus norvegicus
tcccaggttggtatcattgactaca

SEQ ID NO: 584362 - DNA, 25 bp, Rattus norvegicus
tcccaggttggtttcattgactaca

SEQ ID NO: 584363 - DNA, 25 bp, Rattus norvegicus
tcccaggtttcgatgtactttgcat

SEQ ID NO: 584364 - DNA, 25 bp, Rattus norvegicus
tcccaggtttcgttgtactttgcat

SEQ ID NO: 584365 - DNA, 25 bp, Rattus norvegicus
tcccagtaatacagtacctgtgttt

SEQ ID NO: 584366 - DNA, 25 bp, Rattus norvegicus
tcccagtaatactgtacctgtgttt

SEQ ID NO: 584367 - DNA, 25 bp, Rattus norvegicus
tcccagtacagcatgggctccggga

SEQ ID NO: 584368 - DNA, 25 bp, Rattus norvegicus
tcccagtacagcttgggctccggga

SEQ ID NO: 584369 - DNA, 25 bp, Rattus norvegicus
tcccagtaggccagcacacatgtgc

SEQ ID NO: 584370 - DNA, 25 bp, Rattus norvegicus
tcccagtaggcctgcacacatgtgc

SEQ ID NO: 584371 - DNA, 25 bp, Rattus norvegicus
tcccagtccacgctgtgaactgatt

SEQ ID NO: 584372 - DNA, 25 bp, Rattus norvegicus
tcccagtccacggtgtgaactgatt

SEQ ID NO: 584373 - DNA, 25 bp, Rattus norvegicus
tcccagtcctccagaatcaaggtaa

SEQ ID NO: 584374 - DNA, 25 bp, Rattus norvegicus
tcccagtcctccataaagcattgtt

SEQ ID NO: 584375 - DNA, 25 bp, Rattus norvegicus
tcccagtcctcctgaatcaaggtaa

SEQ ID NO: 584376 - DNA, 25 bp, Rattus norvegicus
tcccagtcctccttaaagcattgtt

SEQ ID NO: 584377 - DNA, 25 bp, Rattus norvegicus
tcccagtccttacagttcctgaggg

SEQ ID NO: 584378 - DNA, 25 bp, Rattus norvegicus
tcccagtccttagagttcctgaggg

SEQ ID NO: 584379 - DNA, 25 bp, Rattus norvegicus
tcccagtctgacatagatccgcatt

SEQ ID NO: 584380 - DNA, 25 bp, Rattus norvegicus
tcccagtctgacttagatccgcatt

SEQ ID NO: 584381 - DNA, 25 bp, Rattus norvegicus
tcccagtctgggatgcctacaaaac

SEQ ID NO: 584382 - DNA, 25 bp, Rattus norvegicus
tcccagtctgggttgcctacaaaac

SEQ ID NO: 584383 - DNA, 25 bp, Rattus norvegicus
tcccagtcttacaggacagataatt

SEQ ID NO: 584384 - DNA, 25 bp, Rattus norvegicus
tcccagtcttactggacagataatt

SEQ ID NO: 584385 - DNA, 25 bp, Rattus norvegicus
tcccagtcttccagtggttgtagag

SEQ ID NO: 584386 - DNA, 25 bp, Rattus norvegicus
tcccagtcttcctgtggttgtagag

SEQ ID NO: 584387 - DNA, 25 bp, Rattus norvegicus
tcccagtgaacaaatggtggctgac

SEQ ID NO: 584388 - DNA, 25 bp, Rattus norvegicus
tcccagtgaacatatggtggctgac

SEQ ID NO: 584389 - DNA, 25 bp, Rattus norvegicus
tcccagtgcgggaagctaacgctgt

SEQ ID NO: 584390 - DNA, 25 bp, Rattus norvegicus
tcccagtgcgggtagctaacgctgt

SEQ ID NO: 584391 - DNA, 25 bp, Rattus norvegicus
tcccagtggcctatcagaggtgttc

SEQ ID NO: 584392 - DNA, 25 bp, Rattus norvegicus
tcccagtggcctttcagaggtgttc

SEQ ID NO: 584393 - DNA, 25 bp, Rattus norvegicus
tcccagtggcttccccaaatgtgaa

SEQ ID NO: 584394 - DNA, 25 bp, Rattus norvegicus
tcccagtggcttgcccaaatgtgaa

SEQ ID NO: 584395 - DNA, 25 bp, Rattus norvegicus
tcccagtgggggacatgtagctgat

SEQ ID NO: 584396 - DNA, 25 bp, Rattus norvegicus
tcccagtgggggtcatgtagctgat

SEQ ID NO: 584397 - DNA, 25 bp, Rattus norvegicus
tcccagtggtctaggctgctataaa

SEQ ID NO: 584398 - DNA, 25 bp, Rattus norvegicus
tcccagtggtcttggctgctataaa

SEQ ID NO: 584399 - DNA, 25 bp, Rattus norvegicus
tcccagtgtatcctctatcaatcga

SEQ ID NO: 584400 - DNA, 25 bp, Rattus norvegicus
tcccagtgtatcgtctatcaatcga

SEQ ID NO: 584401 - DNA, 25 bp, Rattus norvegicus
tcccagtgtggtcccttttgaggaa

SEQ ID NO: 584402 - DNA, 25 bp, Rattus norvegicus
tcccagtgtggtgccttttgaggaa

SEQ ID NO: 584403 - DNA, 25 bp, Rattus norvegicus
tcccagtgtgtgaagaagtctgaca

SEQ ID NO: 584404 - DNA, 25 bp, Rattus norvegicus
tcccagtgtgtgcttaggttcttga

SEQ ID NO: 584405 - DNA, 25 bp, Rattus norvegicus
tcccagtgtgtggttaggttcttga

SEQ ID NO: 584406 - DNA, 25 bp, Rattus norvegicus
tcccagtgtgtgtagaagtctgaca

SEQ ID NO: 584407 - DNA, 25 bp, Rattus norvegicus
tcccagttatttactacctggagac

SEQ ID NO: 584408 - DNA, 25 bp, Rattus norvegicus
tcccagttattttctacctggagac

SEQ ID NO: 584409 - DNA, 25 bp, Rattus norvegicus
tcccagttcaaccaatcaagctttt

SEQ ID NO: 584410 - DNA, 25 bp, Rattus norvegicus
tcccagttcaacgaatcaagctttt

SEQ ID NO: 584411 - DNA, 25 bp, Rattus norvegicus
tcccagttcattaccacggatcaag

SEQ ID NO: 584412 - DNA, 25 bp, Rattus norvegicus
tcccagttcatttccacggatcaag

SEQ ID NO: 584413 - DNA, 25 bp, Rattus norvegicus
tcccagttctggctgctttctgaag

SEQ ID NO: 584414 - DNA, 25 bp, Rattus norvegicus
tcccagttctgggtgctttctgaag

SEQ ID NO: 584415 - DNA, 25 bp, Rattus norvegicus
tcccagttgaacaacaggcccttta

SEQ ID NO: 584416 - DNA, 25 bp, Rattus norvegicus
tcccagttgaactacaggcccttta

SEQ ID NO: 584417 - DNA, 25 bp, Rattus norvegicus
tcccagttggttatggactgcatag

SEQ ID NO: 584418 - DNA, 25 bp, Rattus norvegicus
tcccagttggttttggactgcatag

SEQ ID NO: 584419 - DNA, 25 bp, Rattus norvegicus
tcccagttgtgacgacccaagaatg

SEQ ID NO: 584420 - DNA, 25 bp, Rattus norvegicus
tcccagttgtgaggacccaagaatg

SEQ ID NO: 584421 - DNA, 25 bp, Rattus norvegicus
tcccagtttccaacgtgacatgtga

SEQ ID NO: 584422 - DNA, 25 bp, Rattus norvegicus
tcccagtttccatcgtgacatgtga

SEQ ID NO: 584423 - DNA, 25 bp, Rattus norvegicus
tcccataagcaacaccccgttcata

SEQ ID NO: 584424 - DNA, 25 bp, Rattus norvegicus
tcccataagcaagaccccgttcata

SEQ ID NO: 584425 - DNA, 25 bp, Rattus norvegicus
tcccatacctatctggatgcttcag

SEQ ID NO: 584426 - DNA, 25 bp, Rattus norvegicus
tcccatacctatgtggatgcttcag

SEQ ID NO: 584427 - DNA, 25 bp, Rattus norvegicus
tcccatacctgaacttagttaccaa

SEQ ID NO: 584428 - DNA, 25 bp, Rattus norvegicus
tcccatacctgatcttagttaccaa

SEQ ID NO: 584429 - DNA, 25 bp, Rattus norvegicus
tcccatacctgtattaatcttctag

SEQ ID NO: 584430 - DNA, 25 bp, Rattus norvegicus
tcccatacctgttttaatcttctag

SEQ ID NO: 584431 - DNA, 25 bp, Rattus norvegicus
tcccataccttcagtggcttgcaga

SEQ ID NO: 584432 - DNA, 25 bp, Rattus norvegicus
tcccataccttctgtggcttgcaga

SEQ ID NO: 584433 - DNA, 25 bp, Rattus norvegicus
tcccatactgcgctgagcttgatta

SEQ ID NO: 584434 - DNA, 25 bp, Rattus norvegicus
tcccatactgcggtgagcttgatta

SEQ ID NO: 584435 - DNA, 25 bp, Rattus norvegicus
tcccatagaaacctactttcacgtc

SEQ ID NO: 584436 - DNA, 25 bp, Rattus norvegicus
tcccatagaaacgtactttcacgtc

SEQ ID NO: 584437 - DNA, 25 bp, Rattus norvegicus
tcccatagccttcgacataagtcta

SEQ ID NO: 584438 - DNA, 25 bp, Rattus norvegicus
tcccatagccttggacataagtcta

SEQ ID NO: 584439 - DNA, 25 bp, Rattus norvegicus
tcccatatcctcagctctgaaaaaa

SEQ ID NO: 584440 - DNA, 25 bp, Rattus norvegicus
tcccatatcctctgctctgaaaaaa

SEQ ID NO: 584441 - DNA, 25 bp, Rattus norvegicus
tcccatatggtcactggcaatactc

SEQ ID NO: 584442 - DNA, 25 bp, Rattus norvegicus
tcccatatggtctctggcaatactc

SEQ ID NO: 584443 - DNA, 25 bp, Rattus norvegicus
tcccatcacctgacgggaaggcaaa

SEQ ID NO: 584444 - DNA, 25 bp, Rattus norvegicus
tcccatcacctgtcgggaaggcaaa

SEQ ID NO: 584445 - DNA, 25 bp, Rattus norvegicus
tcccatcatcagatattccggctta

SEQ ID NO: 584446 - DNA, 25 bp, Rattus norvegicus
tcccatcatcagttattccggctta

SEQ ID NO: 584447 - DNA, 25 bp, Rattus norvegicus
tcccatccatgtatctgcagaaggc

SEQ ID NO: 584448 - DNA, 25 bp, Rattus norvegicus
tcccatccatgtttctgcagaaggc

SEQ ID NO: 584449 - DNA, 25 bp, Rattus norvegicus
tcccatccctgcaaggagttgatga

SEQ ID NO: 584450 - DNA, 25 bp, Rattus norvegicus
tcccatccctgctaggagttgatga

SEQ ID NO: 584451 - DNA, 25 bp, Rattus norvegicus
tcccatccctggaggaagctggaag

SEQ ID NO: 584452 - DNA, 25 bp, Rattus norvegicus
tcccatccctggtggaagctggaag

SEQ ID NO: 584453 - DNA, 25 bp, Rattus norvegicus
tcccatcccttcattattgtttctg

SEQ ID NO: 584454 - DNA, 25 bp, Rattus norvegicus
tcccatcccttctttattgtttctg

SEQ ID NO: 584455 - DNA, 25 bp, Rattus norvegicus
tcccatcctaacagtccatcaaaaa

SEQ ID NO: 584456 - DNA, 25 bp, Rattus norvegicus
tcccatcctaactgtccatcaaaaa

SEQ ID NO: 584457 - DNA, 25 bp, Rattus norvegicus
tcccatcggctgcagctatttcatt

SEQ ID NO: 584458 - DNA, 25 bp, Rattus norvegicus
tcccatcggctgcagtctgatgatg

SEQ ID NO: 584459 - DNA, 25 bp, Rattus norvegicus
tcccatcggctggagctatttcatt

SEQ ID NO: 584460 - DNA, 25 bp, Rattus norvegicus
tcccatcggctggagtctgatgatg

SEQ ID NO: 584461 - DNA, 25 bp, Rattus norvegicus
tcccatcggtacatttgaagcactt

SEQ ID NO: 584462 - DNA, 25 bp, Rattus norvegicus
tcccatcggtacttttgaagcactt

SEQ ID NO: 584463 - DNA, 25 bp, Rattus norvegicus
tcccatcgtttcatggatgaagacg

SEQ ID NO: 584464 - DNA, 25 bp, Rattus norvegicus
tcccatcgtttcttggatgaagacg

SEQ ID NO: 584465 - DNA, 25 bp, Rattus norvegicus
tcccatctcctcacagaagtgtgta

SEQ ID NO: 584466 - DNA, 25 bp, Rattus norvegicus
tcccatctcctctcagaagtgtgta

SEQ ID NO: 584467 - DNA, 25 bp, Rattus norvegicus
tcccatctctctagttcacttttta

SEQ ID NO: 584468 - DNA, 25 bp, Rattus norvegicus
tcccatctctcttgttcacttttta

SEQ ID NO: 584469 - DNA, 25 bp, Rattus norvegicus
tcccatctgaccatctcgaatttag

SEQ ID NO: 584470 - DNA, 25 bp, Rattus norvegicus
tcccatctgaccttctcgaatttag

SEQ ID NO: 584471 - DNA, 25 bp, Rattus norvegicus
tcccatctggttacggctagtatct

SEQ ID NO: 584472 - DNA, 25 bp, Rattus norvegicus
tcccatctggtttcggctagtatct

SEQ ID NO: 584473 - DNA, 25 bp, Rattus norvegicus
tcccatctgtcaaagctctgtctaa

SEQ ID NO: 584474 - DNA, 25 bp, Rattus norvegicus
tcccatctgtcatagctctgtctaa

SEQ ID NO: 584475 - DNA, 25 bp, Rattus norvegicus
tcccatctgtgtaaggagtcggaga

SEQ ID NO: 584476 - DNA, 25 bp, Rattus norvegicus
tcccatctgtgttaggagtcggaga

SEQ ID NO: 584477 - DNA, 25 bp, Rattus norvegicus
tcccatctgtttctgtccaaggtga

SEQ ID NO: 584478 - DNA, 25 bp, Rattus norvegicus
tcccatctgtttgtgtccaaggtga

SEQ ID NO: 584479 - DNA, 25 bp, Rattus norvegicus
tcccatcttcagcagtattacttgt

SEQ ID NO: 584480 - DNA, 25 bp, Rattus norvegicus
tcccatcttcaggagtattacttgt

SEQ ID NO: 584481 - DNA, 25 bp, Rattus norvegicus
tcccatcttccacaagggtgcaagg

SEQ ID NO: 584482 - DNA, 25 bp, Rattus norvegicus
tcccatcttccagaagggtgcaagg

SEQ ID NO: 584483 - DNA, 25 bp, Rattus norvegicus
tcccatgaagaccaccatcagttat

SEQ ID NO: 584484 - DNA, 25 bp, Rattus norvegicus
tcccatgaagacgaccatcagttat

SEQ ID NO: 584485 - DNA, 25 bp, Rattus norvegicus
tcccatgacgagacagtgcggctgt

SEQ ID NO: 584486 - DNA, 25 bp, Rattus norvegicus
tcccatgacgagtcagtgcggctgt

SEQ ID NO: 584487 - DNA, 25 bp, Rattus norvegicus
tcccatgactggagactgtttaaca

SEQ ID NO: 584488 - DNA, 25 bp, Rattus norvegicus
tcccatgactggtgactgtttaaca

SEQ ID NO: 584489 - DNA, 25 bp, Rattus norvegicus
tcccatgagagcactttgtcctacg

SEQ ID NO: 584490 - DNA, 25 bp, Rattus norvegicus
tcccatgagagctctttgtcctacg

SEQ ID NO: 584491 - DNA, 25 bp, Rattus norvegicus
tcccatgagctgacctgttggaatt

SEQ ID NO: 584492 - DNA, 25 bp, Rattus norvegicus
tcccatgagctgtcctgttggaatt

SEQ ID NO: 584493 - DNA, 25 bp, Rattus norvegicus
tcccatgaggcacttcaggtctgga

SEQ ID NO: 584494 - DNA, 25 bp, Rattus norvegicus
tcccatgaggcagttcaggtctgga

SEQ ID NO: 584495 - DNA, 25 bp, Rattus norvegicus
tcccatgatcatcgttctgctcata

SEQ ID NO: 584496 - DNA, 25 bp, Rattus norvegicus
tcccatgatcatggttctgctcata

SEQ ID NO: 584497 - DNA, 25 bp, Rattus norvegicus
tcccatgcaggaagacaggcccgtt

SEQ ID NO: 584498 - DNA, 25 bp, Rattus norvegicus
tcccatgcaggatgacaggcccgtt

SEQ ID NO: 584499 - DNA, 25 bp, Rattus norvegicus
tcccatgccccgagtgtgccgatga

SEQ ID NO: 584500 - DNA, 25 bp, Rattus norvegicus
tcccatgccccgtgtgtgccgatga

SEQ ID NO: 584501 - DNA, 25 bp, Rattus norvegicus
tcccatgccctcagtgacatggaaa

SEQ ID NO: 584502 - DNA, 25 bp, Rattus norvegicus
tcccatgccctctgtgacatggaaa

SEQ ID NO: 584503 - DNA, 25 bp, Rattus norvegicus
tcccatgctaacaacactgctgtaa

SEQ ID NO: 584504 - DNA, 25 bp, Rattus norvegicus
tcccatgctaactacactgctgtaa

SEQ ID NO: 584505 - DNA, 25 bp, Rattus norvegicus
tcccatgctgaacgagccatgccag

SEQ ID NO: 584506 - DNA, 25 bp, Rattus norvegicus
tcccatgctgaaggagccatgccag

SEQ ID NO: 584507 - DNA, 25 bp, Rattus norvegicus
tcccatggcttaaagcttctaccta

SEQ ID NO: 584508 - DNA, 25 bp, Rattus norvegicus
tcccatggcttatagcttctaccta

SEQ ID NO: 584509 - DNA, 25 bp, Rattus norvegicus
tcccatgggctcagcagtcacacag

SEQ ID NO: 584510 - DNA, 25 bp, Rattus norvegicus
tcccatgggctctgcagtcacacag

SEQ ID NO: 584511 - DNA, 25 bp, Rattus norvegicus
tcccatgggttgacctctctgaagg

SEQ ID NO: 584512 - DNA, 25 bp, Rattus norvegicus
tcccatgggttgtcctctctgaagg

SEQ ID NO: 584513 - DNA, 25 bp, Rattus norvegicus
tcccatggtgctagagactgaactc

SEQ ID NO: 584514 - DNA, 25 bp, Rattus norvegicus
tcccatggtgcttgagactgaactc

SEQ ID NO: 584515 - DNA, 25 bp, Rattus norvegicus
tcccatgtatccaaggccttgaact

SEQ ID NO: 584516 - DNA, 25 bp, Rattus norvegicus
tcccatgtatcctaggccttgaact

SEQ ID NO: 584517 - DNA, 25 bp, Rattus norvegicus
tcccatgtcaggagctgtgtactgg

SEQ ID NO: 584518 - DNA, 25 bp, Rattus norvegicus
tcccatgtcaggtgctgtgtactgg

SEQ ID NO: 584519 - DNA, 25 bp, Rattus norvegicus
tcccatgtctctcatgtctcacaaa

SEQ ID NO: 584520 - DNA, 25 bp, Rattus norvegicus
tcccatgtctctgatgtctcacaaa

SEQ ID NO: 584521 - DNA, 25 bp, Rattus norvegicus
tcccatgtgcaacggcctgggttca

SEQ ID NO: 584522 - DNA, 25 bp, Rattus norvegicus
tcccatgtgcaagggcctgggttca

SEQ ID NO: 584523 - DNA, 25 bp, Rattus norvegicus
tcccatgttcttccctgtaattcaa

SEQ ID NO: 584524 - DNA, 25 bp, Rattus norvegicus
tcccatgttcttgcctgtaattcaa

SEQ ID NO: 584525 - DNA, 25 bp, Rattus norvegicus
tcccatgttgggagatttagaataa

SEQ ID NO: 584526 - DNA, 25 bp, Rattus norvegicus
tcccatgttgggtgatttagaataa

SEQ ID NO: 584527 - DNA, 25 bp, Rattus norvegicus
tcccatgttgtgatactacagaagc

SEQ ID NO: 584528 - DNA, 25 bp, Rattus norvegicus
tcccatgttgtgttactacagaagc

SEQ ID NO: 584529 - DNA, 25 bp, Rattus norvegicus
tcccattaatgccttatcagtgttt

SEQ ID NO: 584530 - DNA, 25 bp, Rattus norvegicus
tcccattaatgcgttatcagtgttt

SEQ ID NO: 584531 - DNA, 25 bp, Rattus norvegicus
tcccattcaacaaagcagagccggt

SEQ ID NO: 584532 - DNA, 25 bp, Rattus norvegicus
tcccattcaacatagcagagccggt

SEQ ID NO: 584533 - DNA, 25 bp, Rattus norvegicus
tcccattccaagcatgctggcattt

SEQ ID NO: 584534 - DNA, 25 bp, Rattus norvegicus
tcccattccaaggatgctggcattt

SEQ ID NO: 584535 - DNA, 25 bp, Rattus norvegicus
tcccattccacacgcttcttagtag

SEQ ID NO: 584536 - DNA, 25 bp, Rattus norvegicus
tcccattccacaggcttcttagtag

SEQ ID NO: 584537 - DNA, 25 bp, Rattus norvegicus
tcccattcgagcaccacagaaacat

SEQ ID NO: 584538 - DNA, 25 bp, Rattus norvegicus
tcccattcgagctccacagaaacat

SEQ ID NO: 584539 - DNA, 25 bp, Rattus norvegicus
tcccattctgataatttgtttccta

SEQ ID NO: 584540 - DNA, 25 bp, Rattus norvegicus
tcccattctgattatttgtttccta

SEQ ID NO: 584541 - DNA, 25 bp, Rattus norvegicus
tcccattgacttattatacttcctc

SEQ ID NO: 584542 - DNA, 25 bp, Rattus norvegicus
tcccattgactttttatacttcctc

SEQ ID NO: 584543 - DNA, 25 bp, Rattus norvegicus
tcccattgctctatggaattgttat

SEQ ID NO: 584544 - DNA, 25 bp, Rattus norvegicus
tcccattgctctttggaattgttat

SEQ ID NO: 584545 - DNA, 25 bp, Rattus norvegicus
tcccattgtgttaccattgagctca

SEQ ID NO: 584546 - DNA, 25 bp, Rattus norvegicus
tcccattgtgtttccattgagctca

SEQ ID NO: 584547 - DNA, 25 bp, Rattus norvegicus
tcccatttaactactgcgtgctaaa

SEQ ID NO: 584548 - DNA, 25 bp, Rattus norvegicus
tcccatttaacttctgcgtgctaaa

SEQ ID NO: 584549 - DNA, 25 bp, Rattus norvegicus
tcccatttcctaccagtgagttttg

SEQ ID NO: 584550 - DNA, 25 bp, Rattus norvegicus
tcccatttcctagcagtgagttttg

SEQ ID NO: 584551 - DNA, 25 bp, Rattus norvegicus
tcccatttcttcagcttgggcaaat

SEQ ID NO: 584552 - DNA, 25 bp, Rattus norvegicus
tcccatttcttctgcttgggcaaat

SEQ ID NO: 584553 - DNA, 25 bp, Rattus norvegicus
tcccatttggagcttgtttctcttt

SEQ ID NO: 584554 - DNA, 25 bp, Rattus norvegicus
tcccatttggaggttgtttctcttt

SEQ ID NO: 584555 - DNA, 25 bp, Rattus norvegicus
tcccatttggttacactcagcagtt

SEQ ID NO: 584556 - DNA, 25 bp, Rattus norvegicus
tcccatttggtttcactcagcagtt

SEQ ID NO: 584557 - DNA, 25 bp, Rattus norvegicus
tcccatttgtctcgtgacttcttag

SEQ ID NO: 584558 - DNA, 25 bp, Rattus norvegicus
tcccatttgtctggtgacttcttag

SEQ ID NO: 584559 - DNA, 25 bp, Rattus norvegicus
tcccatttgtttacaatgaccctga

SEQ ID NO: 584560 - DNA, 25 bp, Rattus norvegicus
tcccatttgttttcaatgaccctga

SEQ ID NO: 584561 - DNA, 25 bp, Rattus norvegicus
tcccattttcgcacatttgctgtta

SEQ ID NO: 584562 - DNA, 25 bp, Rattus norvegicus
tcccattttcgctcatttgctgtta

SEQ ID NO: 584563 - DNA, 25 bp, Rattus norvegicus
tcccattttgcccaatttgactgtg

SEQ ID NO: 584564 - DNA, 25 bp, Rattus norvegicus
tcccattttgccgaatttgactgtg

SEQ ID NO: 584565 - DNA, 25 bp, Rattus norvegicus
tcccattttggaacccttttcagat

SEQ ID NO: 584566 - DNA, 25 bp, Rattus norvegicus
tcccattttggatcccttttcagat

SEQ ID NO: 584567 - DNA, 25 bp, Rattus norvegicus
tccccaaaatggcatcagttctgtg

SEQ ID NO: 584568 - DNA, 25 bp, Rattus norvegicus
tccccaaaatgggatcagttctgtg

SEQ ID NO: 584569 - DNA, 25 bp, Rattus norvegicus
tccccaaacttcaggaccttgtcaa

SEQ ID NO: 584570 - DNA, 25 bp, Rattus norvegicus
tccccaaacttctggaccttgtcaa

SEQ ID NO: 584571 - DNA, 25 bp, Rattus norvegicus
tccccaaagctcactctgaagatgt

SEQ ID NO: 584572 - DNA, 25 bp, Rattus norvegicus
tccccaaagctccatggctgttcaa

SEQ ID NO: 584573 - DNA, 25 bp, Rattus norvegicus
tccccaaagctcgatggctgttcaa

SEQ ID NO: 584574 - DNA, 25 bp, Rattus norvegicus
tccccaaagctctctctgaagatgt

SEQ ID NO: 584575 - DNA, 25 bp, Rattus norvegicus
tccccaaagggaaactgcagttata

SEQ ID NO: 584576 - DNA, 25 bp, Rattus norvegicus
tccccaaagggatactgcagttata

SEQ ID NO: 584577 - DNA, 25 bp, Rattus norvegicus
tccccaaatgtccttgtgttccttt

SEQ ID NO: 584578 - DNA, 25 bp, Rattus norvegicus
tccccaaatgtcgttgtgttccttt

SEQ ID NO: 584579 - DNA, 25 bp, Rattus norvegicus
tccccaaccacaagccattatataa

SEQ ID NO: 584580 - DNA, 25 bp, Rattus norvegicus
tccccaaccacatgccattatataa

SEQ ID NO: 584581 - DNA, 25 bp, Rattus norvegicus
tccccaaccccaagaacattgtatt

SEQ ID NO: 584582 - DNA, 25 bp, Rattus norvegicus
tccccaaccccatgaacattgtatt

SEQ ID NO: 584583 - DNA, 25 bp, Rattus norvegicus
tccccaacctccagaagttgtttga

SEQ ID NO: 584584 - DNA, 25 bp, Rattus norvegicus
tccccaacctcctgaagttgtttga

SEQ ID NO: 584585 - DNA, 25 bp, Rattus norvegicus
tccccaacctctagtgtatttcaca

SEQ ID NO: 584586 - DNA, 25 bp, Rattus norvegicus
tccccaacctcttgtgtatttcaca

SEQ ID NO: 584587 - DNA, 25 bp, Rattus norvegicus
tccccaacctgcattttgactgtaa

SEQ ID NO: 584588 - DNA, 25 bp, Rattus norvegicus
tccccaacctgctttttgactgtaa

SEQ ID NO: 584589 - DNA, 25 bp, Rattus norvegicus
tccccaactgctcgtcatgtgtgga

SEQ ID NO: 584590 - DNA, 25 bp, Rattus norvegicus
tccccaactgctggtcatgtgtgga

SEQ ID NO: 584591 - DNA, 25 bp, Rattus norvegicus
tccccaagccagatcttaacgttgt

SEQ ID NO: 584592 - DNA, 25 bp, Rattus norvegicus
tccccaagccagttcttaacgttgt

SEQ ID NO: 584593 - DNA, 25 bp, Rattus norvegicus
tccccaagcctgagtatatcctgaa

SEQ ID NO: 584594 - DNA, 25 bp, Rattus norvegicus
tccccaagcctgtgtatatcctgaa

SEQ ID NO: 584595 - DNA, 25 bp, Rattus norvegicus
tccccaaggaagaaagtatgcaagt

SEQ ID NO: 584596 - DNA, 25 bp, Rattus norvegicus
tccccaaggaagtaagtatgcaagt

SEQ ID NO: 584597 - DNA, 25 bp, Rattus norvegicus
tccccaaggctgccagacatggact

SEQ ID NO: 584598 - DNA, 25 bp, Rattus norvegicus
tccccaaggctggcagacatggact

SEQ ID NO: 584599 - DNA, 25 bp, Rattus norvegicus
tccccaagggcacacttcgtgtata

SEQ ID NO: 584600 - DNA, 25 bp, Rattus norvegicus
tccccaagggcagacttcgtgtata

SEQ ID NO: 584601 - DNA, 25 bp, Rattus norvegicus
tccccaagggctctgagttgtgttt

SEQ ID NO: 584602 - DNA, 25 bp, Rattus norvegicus
tccccaagggctgtgagttgtgttt

SEQ ID NO: 584603 - DNA, 25 bp, Rattus norvegicus
tccccaaggtttatgtagcccttat

SEQ ID NO: 584604 - DNA, 25 bp, Rattus norvegicus
tccccaaggtttttgtagcccttat

SEQ ID NO: 584605 - DNA, 25 bp, Rattus norvegicus
tccccaagtctccaaagagccattg

SEQ ID NO: 584606 - DNA, 25 bp, Rattus norvegicus
tccccaagtctcgaaagagccattg

SEQ ID NO: 584607 - DNA, 25 bp, Rattus norvegicus
tccccaagtgcccaaaggtatttct

SEQ ID NO: 584608 - DNA, 25 bp, Rattus norvegicus
tccccaagtgccgaaaggtatttct

SEQ ID NO: 584609 - DNA, 25 bp, Rattus norvegicus
tccccaagtggcatgttttccaaag

SEQ ID NO: 584610 - DNA, 25 bp, Rattus norvegicus
tccccaagtggcttgttttccaaag

SEQ ID NO: 584611 - DNA, 25 bp, Rattus norvegicus
tccccaatcaagatctcctggtgag

SEQ ID NO: 584612 - DNA, 25 bp, Rattus norvegicus
tccccaatcaagttctcctggtgag

SEQ ID NO: 584613 - DNA, 25 bp, Rattus norvegicus
tccccaatgggcaccagtgaagggc

SEQ ID NO: 584614 - DNA, 25 bp, Rattus norvegicus
tccccaatgggctccagtgaagggc

SEQ ID NO: 584615 - DNA, 25 bp, Rattus norvegicus
tccccaattggcaacaaggctggtt

SEQ ID NO: 584616 - DNA, 25 bp, Rattus norvegicus
tccccaattggctacaaggctggtt

SEQ ID NO: 584617 - DNA, 25 bp, Rattus norvegicus
tccccacaaactccgattacagaaa

SEQ ID NO: 584618 - DNA, 25 bp, Rattus norvegicus
tccccacaaactgcgattacagaaa

SEQ ID NO: 584619 - DNA, 25 bp, Rattus norvegicus
tccccacaagaactggcctttaatg

SEQ ID NO: 584620 - DNA, 25 bp, Rattus norvegicus
tccccacaagaagtggcctttaatg

SEQ ID NO: 584621 - DNA, 25 bp, Rattus norvegicus
tccccacatcagaagctacttacag

SEQ ID NO: 584622 - DNA, 25 bp, Rattus norvegicus
tccccacatcagtagctacttacag

SEQ ID NO: 584623 - DNA, 25 bp, Rattus norvegicus
tccccaccacctagatacttgaaga

SEQ ID NO: 584624 - DNA, 25 bp, Rattus norvegicus
tccccaccaccttgatacttgaaga

SEQ ID NO: 584625 - DNA, 25 bp, Rattus norvegicus
tccccacccataaggatgccatgtg

SEQ ID NO: 584626 - DNA, 25 bp, Rattus norvegicus
tccccacccatatggatgccatgtg

SEQ ID NO: 584627 - DNA, 25 bp, Rattus norvegicus
tccccaccccatcataagagagaga

SEQ ID NO: 584628 - DNA, 25 bp, Rattus norvegicus
tccccaccccatgataagagagaga

SEQ ID NO: 584629 - DNA, 25 bp, Rattus norvegicus
tccccaccctctatgaatagtgaac

SEQ ID NO: 584630 - DNA, 25 bp, Rattus norvegicus
tccccaccctctttgaatagtgaac

SEQ ID NO: 584631 - DNA, 25 bp, Rattus norvegicus
tccccaccgtgcagttagatagact

SEQ ID NO: 584632 - DNA, 25 bp, Rattus norvegicus
tccccaccgtgctgttagatagact

SEQ ID NO: 584633 - DNA, 25 bp, Rattus norvegicus
tccccacctgtcaaatgtcatatat

SEQ ID NO: 584634 - DNA, 25 bp, Rattus norvegicus
tccccacctgtctaatgtcatatat

SEQ ID NO: 584635 - DNA, 25 bp, Rattus norvegicus
tccccaccttctatttataagacct

SEQ ID NO: 584636 - DNA, 25 bp, Rattus norvegicus
tccccaccttctttttataagacct

SEQ ID NO: 584637 - DNA, 25 bp, Rattus norvegicus
tccccacgatgaacatacacactgt

SEQ ID NO: 584638 - DNA, 25 bp, Rattus norvegicus
tccccacgatgatcatacacactgt

SEQ ID NO: 584639 - DNA, 25 bp, Rattus norvegicus
tccccacgcagtcatcttttttagt

SEQ ID NO: 584640 - DNA, 25 bp, Rattus norvegicus
tccccacgcagtgatcttttttagt

SEQ ID NO: 584641 - DNA, 25 bp, Rattus norvegicus
tccccacgctacagtcgagagtaca

SEQ ID NO: 584642 - DNA, 25 bp, Rattus norvegicus
tccccacgctactgtcgagagtaca

SEQ ID NO: 584643 - DNA, 25 bp, Rattus norvegicus
tccccacggctaacaagtaccaaga

SEQ ID NO: 584644 - DNA, 25 bp, Rattus norvegicus
tccccacggctatcaagtaccaaga

SEQ ID NO: 584645 - DNA, 25 bp, Rattus norvegicus
tccccacgggtaagtagactgtctt

SEQ ID NO: 584646 - DNA, 25 bp, Rattus norvegicus
tccccacgggtatgtagactgtctt

SEQ ID NO: 584647 - DNA, 25 bp, Rattus norvegicus
tccccactcaagatcaaggccgaag

SEQ ID NO: 584648 - DNA, 25 bp, Rattus norvegicus
tccccactcaagttcaaggccgaag

SEQ ID NO: 584649 - DNA, 25 bp, Rattus norvegicus
tccccactcagcagtgtacctgagg

SEQ ID NO: 584650 - DNA, 25 bp, Rattus norvegicus
tccccactcagctgtgtacctgagg

SEQ ID NO: 584651 - DNA, 25 bp, Rattus norvegicus
tccccactcaggatgttattctgaa

SEQ ID NO: 584652 - DNA, 25 bp, Rattus norvegicus
tccccactcaggttgttattctgaa

SEQ ID NO: 584653 - DNA, 25 bp, Rattus norvegicus
tccccactcctaataagtctttact

SEQ ID NO: 584654 - DNA, 25 bp, Rattus norvegicus
tccccactcctattaagtctttact

SEQ ID NO: 584655 - DNA, 25 bp, Rattus norvegicus
tccccactctgaacagggccaataa

SEQ ID NO: 584656 - DNA, 25 bp, Rattus norvegicus
tccccactctgatcagggccaataa

SEQ ID NO: 584657 - DNA, 25 bp, Rattus norvegicus
tccccactgggacatgagctatcag

SEQ ID NO: 584658 - DNA, 25 bp, Rattus norvegicus
tccccactgggagatgagctatcag

SEQ ID NO: 584659 - DNA, 25 bp, Rattus norvegicus
tccccactgggtcggccagagtaca

SEQ ID NO: 584660 - DNA, 25 bp, Rattus norvegicus
tccccactgggtgggccagagtaca

SEQ ID NO: 584661 - DNA, 25 bp, Rattus norvegicus
tccccacttcatagtctgttcataa

SEQ ID NO: 584662 - DNA, 25 bp, Rattus norvegicus
tccccacttcattgtctgttcataa

SEQ ID NO: 584663 - DNA, 25 bp, Rattus norvegicus
tccccacttcccaagcaaggtaaat

SEQ ID NO: 584664 - DNA, 25 bp, Rattus norvegicus
tccccacttccctagcaaggtaaat

SEQ ID NO: 584665 - DNA, 25 bp, Rattus norvegicus
tccccacttctaaagagattgtttt

SEQ ID NO: 584666 - DNA, 25 bp, Rattus norvegicus
tccccacttctatagagattgtttt

SEQ ID NO: 584667 - DNA, 25 bp, Rattus norvegicus
tccccacttctgaagaaacattgtt

SEQ ID NO: 584668 - DNA, 25 bp, Rattus norvegicus
tccccacttctgtagaaacattgtt

SEQ ID NO: 584669 - DNA, 25 bp, Rattus norvegicus
tccccactttccagtaaactacagg

SEQ ID NO: 584670 - DNA, 25 bp, Rattus norvegicus
tccccactttcctgtaaactacagg

SEQ ID NO: 584671 - DNA, 25 bp, Rattus norvegicus
tccccagaagccatttccattaaag

SEQ ID NO: 584672 - DNA, 25 bp, Rattus norvegicus
tccccagaagccttttccattaaag

SEQ ID NO: 584673 - DNA, 25 bp, Rattus norvegicus
tccccagacagcctgtcactttaaa

SEQ ID NO: 584674 - DNA, 25 bp, Rattus norvegicus
tccccagacagcgtgtcactttaaa

SEQ ID NO: 584675 - DNA, 25 bp, Rattus norvegicus
tccccagagagccagtgccttctag

SEQ ID NO: 584676 - DNA, 25 bp, Rattus norvegicus
tccccagagagcgagtgccttctag

SEQ ID NO: 584677 - DNA, 25 bp, Rattus norvegicus
tccccagagcaacgatgccggcaga

SEQ ID NO: 584678 - DNA, 25 bp, Rattus norvegicus
tccccagagcaaggatgccggcaga

SEQ ID NO: 584679 - DNA, 25 bp, Rattus norvegicus
tccccagaggatatgtttacagcta

SEQ ID NO: 584680 - DNA, 25 bp, Rattus norvegicus
tccccagaggatttgtttacagcta

SEQ ID NO: 584681 - DNA, 25 bp, Rattus norvegicus
tccccagatctactgtgttctgaaa

SEQ ID NO: 584682 - DNA, 25 bp, Rattus norvegicus
tccccagatctagtgtgttctgaaa

SEQ ID NO: 584683 - DNA, 25 bp, Rattus norvegicus
tccccagatgcaaggaaggcgttag

SEQ ID NO: 584684 - DNA, 25 bp, Rattus norvegicus
tccccagatgcatggaaggcgttag

SEQ ID NO: 584685 - DNA, 25 bp, Rattus norvegicus
tccccagatgttctagatgccttaa

SEQ ID NO: 584686 - DNA, 25 bp, Rattus norvegicus
tccccagatgttgtagatgccttaa

SEQ ID NO: 584687 - DNA, 25 bp, Rattus norvegicus
tccccagcacagaagagattcatcc

SEQ ID NO: 584688 - DNA, 25 bp, Rattus norvegicus
tccccagcacagtagagattcatcc

SEQ ID NO: 584689 - DNA, 25 bp, Rattus norvegicus
tccccagcacgtctggatacgaaaa

SEQ ID NO: 584690 - DNA, 25 bp, Rattus norvegicus
tccccagcacgtgtggatacgaaaa

SEQ ID NO: 584691 - DNA, 25 bp, Rattus norvegicus
tccccagcagcacctatatgagaac

SEQ ID NO: 584692 - DNA, 25 bp, Rattus norvegicus
tccccagcagcagctatatgagaac

SEQ ID NO: 584693 - DNA, 25 bp, Rattus norvegicus
tccccagcagggaccaggaatgtgc

SEQ ID NO: 584694 - DNA, 25 bp, Rattus norvegicus
tccccagcagggtccaggaatgtgc

SEQ ID NO: 584695 - DNA, 25 bp, Rattus norvegicus
tccccagcagtacgactatcaaaag

SEQ ID NO: 584696 - DNA, 25 bp, Rattus norvegicus
tccccagcagtaggactatcaaaag

SEQ ID NO: 584697 - DNA, 25 bp, Rattus norvegicus
tccccagcatatatatcctacatat

SEQ ID NO: 584698 - DNA, 25 bp, Rattus norvegicus
tccccagcatatttatcctacatat

SEQ ID NO: 584699 - DNA, 25 bp, Rattus norvegicus
tccccagccccaagaggagcaaaag

SEQ ID NO: 584700 - DNA, 25 bp, Rattus norvegicus
tccccagccccaagattaattctta

SEQ ID NO: 584701 - DNA, 25 bp, Rattus norvegicus
tccccagccccatgaggagcaaaag

SEQ ID NO: 584702 - DNA, 25 bp, Rattus norvegicus
tccccagccccatgattaattctta

SEQ ID NO: 584703 - DNA, 25 bp, Rattus norvegicus
tccccagccggaaaccaaatttgat

SEQ ID NO: 584704 - DNA, 25 bp, Rattus norvegicus
tccccagccggataccaaatttgat

SEQ ID NO: 584705 - DNA, 25 bp, Rattus norvegicus
tccccagcctcacgtggagctaata

SEQ ID NO: 584706 - DNA, 25 bp, Rattus norvegicus
tccccagcctcaggtggagctaata

SEQ ID NO: 584707 - DNA, 25 bp, Rattus norvegicus
tccccagccttcagagggatgtgga

SEQ ID NO: 584708 - DNA, 25 bp, Rattus norvegicus
tccccagccttctgagggatgtgga

SEQ ID NO: 584709 - DNA, 25 bp, Rattus norvegicus
tccccagcggaacggctagagtaga

SEQ ID NO: 584710 - DNA, 25 bp, Rattus norvegicus
tccccagcggaagggctagagtaga

SEQ ID NO: 584711 - DNA, 25 bp, Rattus norvegicus
tccccagcgggaaaaaagcctcgag

SEQ ID NO: 584712 - DNA, 25 bp, Rattus norvegicus
tccccagcgggataaaagcctcgag

SEQ ID NO: 584713 - DNA, 25 bp, Rattus norvegicus
tccccagctcctagtcataacataa

SEQ ID NO: 584714 - DNA, 25 bp, Rattus norvegicus
tccccagctccttgtcataacataa

SEQ ID NO: 584715 - DNA, 25 bp, Rattus norvegicus
tccccaggacgaccagcagacttat

SEQ ID NO: 584716 - DNA, 25 bp, Rattus norvegicus
tccccaggacgagcagcagacttat

SEQ ID NO: 584717 - DNA, 25 bp, Rattus norvegicus
tccccaggatcgagcaatagtcaga

SEQ ID NO: 584718 - DNA, 25 bp, Rattus norvegicus
tccccaggatcgtgcaatagtcaga

SEQ ID NO: 584719 - DNA, 25 bp, Rattus norvegicus
tccccaggcctaaatgtctgtgagt

SEQ ID NO: 584720 - DNA, 25 bp, Rattus norvegicus
tccccaggcctatatgtctgtgagt

SEQ ID NO: 584721 - DNA, 25 bp, Rattus norvegicus
tccccaggcgtaacttgaccaagca

SEQ ID NO: 584722 - DNA, 25 bp, Rattus norvegicus
tccccaggcgtatcttgaccaagca

SEQ ID NO: 584723 - DNA, 25 bp, Rattus norvegicus
tccccaggcttaatctgcatggata

SEQ ID NO: 584724 - DNA, 25 bp, Rattus norvegicus
tccccaggcttattctgcatggata

SEQ ID NO: 584725 - DNA, 25 bp, Rattus norvegicus
tccccaggcttcagccagggatgtt

SEQ ID NO: 584726 - DNA, 25 bp, Rattus norvegicus
tccccaggcttctgccagggatgtt

SEQ ID NO: 584727 - DNA, 25 bp, Rattus norvegicus
tccccagggagcatgcagtgcagta

SEQ ID NO: 584728 - DNA, 25 bp, Rattus norvegicus
tccccagggagcttgcagtgcagta

SEQ ID NO: 584729 - DNA, 25 bp, Rattus norvegicus
tccccagggcagaaaagagaaatac

SEQ ID NO: 584730 - DNA, 25 bp, Rattus norvegicus
tccccagggcagtaaagagaaatac

SEQ ID NO: 584731 - DNA, 25 bp, Rattus norvegicus
tccccaggggttactgagtcagtca

SEQ ID NO: 584732 - DNA, 25 bp, Rattus norvegicus
tccccaggggtttctgagtcagtca

SEQ ID NO: 584733 - DNA, 25 bp, Rattus norvegicus
tccccaggtctgaaatgagcgtaat

SEQ ID NO: 584734 - DNA, 25 bp, Rattus norvegicus
tccccaggtctgtaatgagcgtaat

SEQ ID NO: 584735 - DNA, 25 bp, Rattus norvegicus
tccccagtaatgattcccctgaact

SEQ ID NO: 584736 - DNA, 25 bp, Rattus norvegicus
tccccagtaatgtttcccctgaact

SEQ ID NO: 584737 - DNA, 25 bp, Rattus norvegicus
tccccagtactgactacttttcaat

SEQ ID NO: 584738 - DNA, 25 bp, Rattus norvegicus
tccccagtactgtctacttttcaat

SEQ ID NO: 584739 - DNA, 25 bp, Rattus norvegicus
tccccagtcagtattaccctgagaa

SEQ ID NO: 584740 - DNA, 25 bp, Rattus norvegicus
tccccagtcagttttaccctgagaa

SEQ ID NO: 584741 - DNA, 25 bp, Rattus norvegicus
tccccagtccatatgtgttctgctg

SEQ ID NO: 584742 - DNA, 25 bp, Rattus norvegicus
tccccagtccatttgtgttctgctg

SEQ ID NO: 584743 - DNA, 25 bp, Rattus norvegicus
tccccagtcctgaacagacactaaa

SEQ ID NO: 584744 - DNA, 25 bp, Rattus norvegicus
tccccagtcctgcttggcttttgga

SEQ ID NO: 584745 - DNA, 25 bp, Rattus norvegicus
tccccagtcctggttggcttttgga

SEQ ID NO: 584746 - DNA, 25 bp, Rattus norvegicus
tccccagtcctgtacagacactaaa

SEQ ID NO: 584747 - DNA, 25 bp, Rattus norvegicus
tccccagtctggagttagtatcact

SEQ ID NO: 584748 - DNA, 25 bp, Rattus norvegicus
tccccagtctggtgttagtatcact

SEQ ID NO: 584749 - DNA, 25 bp, Rattus norvegicus
tccccagtgaagctatcaggaagca

SEQ ID NO: 584750 - DNA, 25 bp, Rattus norvegicus
tccccagtgaaggtatcaggaagca

SEQ ID NO: 584751 - DNA, 25 bp, Rattus norvegicus
tccccagtgactatctttttagata

SEQ ID NO: 584752 - DNA, 25 bp, Rattus norvegicus
tccccagtgactttctttttagata

SEQ ID NO: 584753 - DNA, 25 bp, Rattus norvegicus
tccccagtgcagatgttagagctca

SEQ ID NO: 584754 - DNA, 25 bp, Rattus norvegicus
tccccagtgcagttgttagagctca

SEQ ID NO: 584755 - DNA, 25 bp, Rattus norvegicus
tccccagtgggacgtttctagagag

SEQ ID NO: 584756 - DNA, 25 bp, Rattus norvegicus
tccccagtgggaggtttctagagag

SEQ ID NO: 584757 - DNA, 25 bp, Rattus norvegicus
tccccagtgtgacaggcaccagcaa

SEQ ID NO: 584758 - DNA, 25 bp, Rattus norvegicus
tccccagtgtgagaggcaccagcaa

SEQ ID NO: 584759 - DNA, 25 bp, Rattus norvegicus
tccccagttaacaccccaattagag

SEQ ID NO: 584760 - DNA, 25 bp, Rattus norvegicus
tccccagttaactccccaattagag

SEQ ID NO: 584761 - DNA, 25 bp, Rattus norvegicus
tccccagttcaccaggcatcaagaa

SEQ ID NO: 584762 - DNA, 25 bp, Rattus norvegicus
tccccagttcacgaggcatcaagaa

SEQ ID NO: 584763 - DNA, 25 bp, Rattus norvegicus
tccccagttcttcactgtgagtggg

SEQ ID NO: 584764 - DNA, 25 bp, Rattus norvegicus
tccccagttcttgactgtgagtggg

SEQ ID NO: 584765 - DNA, 25 bp, Rattus norvegicus
tccccataaggacatctgaagctgt

SEQ ID NO: 584766 - DNA, 25 bp, Rattus norvegicus
tccccataaggagatctgaagctgt

SEQ ID NO: 584767 - DNA, 25 bp, Rattus norvegicus
tccccatagtcgcagatcacgatgt

SEQ ID NO: 584768 - DNA, 25 bp, Rattus norvegicus
tccccatagtcggagatcacgatgt

SEQ ID NO: 584769 - DNA, 25 bp, Rattus norvegicus
tccccatatgtactcttcggttgat

SEQ ID NO: 584770 - DNA, 25 bp, Rattus norvegicus
tccccatatgtagtcttcggttgat

SEQ ID NO: 584771 - DNA, 25 bp, Rattus norvegicus
tccccatcatggactaagtacaagg

SEQ ID NO: 584772 - DNA, 25 bp, Rattus norvegicus
tccccatcatggtctaagtacaagg

SEQ ID NO: 584773 - DNA, 25 bp, Rattus norvegicus
tccccatcattaaacacagcctgat

SEQ ID NO: 584774 - DNA, 25 bp, Rattus norvegicus
tccccatcattatacacagcctgat

SEQ ID NO: 584775 - DNA, 25 bp, Rattus norvegicus
tccccatccactatccagaaagtag

SEQ ID NO: 584776 - DNA, 25 bp, Rattus norvegicus
tccccatccactttccagaaagtag

SEQ ID NO: 584777 - DNA, 25 bp, Rattus norvegicus
tccccatccgtgcagtattgtgggt

SEQ ID NO: 584778 - DNA, 25 bp, Rattus norvegicus
tccccatccgtggagtattgtgggt

SEQ ID NO: 584779 - DNA, 25 bp, Rattus norvegicus
tccccatctctacgaaatctacatg

SEQ ID NO: 584780 - DNA, 25 bp, Rattus norvegicus
tccccatctctaggaaatctacatg

SEQ ID NO: 584781 - DNA, 25 bp, Rattus norvegicus
tccccatctgaacacccagaaaaat

SEQ ID NO: 584782 - DNA, 25 bp, Rattus norvegicus
tccccatctgaagacccagaaaaat

SEQ ID NO: 584783 - DNA, 25 bp, Rattus norvegicus
tccccatcttgacctgttttgttga

SEQ ID NO: 584784 - DNA, 25 bp, Rattus norvegicus
tccccatcttgagctgttttgttga

SEQ ID NO: 584785 - DNA, 25 bp, Rattus norvegicus
tccccatggtgaaagcgtgaagagc

SEQ ID NO: 584786 - DNA, 25 bp, Rattus norvegicus
tccccatggtgatagcgtgaagagc

SEQ ID NO: 584787 - DNA, 25 bp, Rattus norvegicus
tccccatgtacaaccaggcatacaa

SEQ ID NO: 584788 - DNA, 25 bp, Rattus norvegicus
tccccatgtacatccaggcatacaa

SEQ ID NO: 584789 - DNA, 25 bp, Rattus norvegicus
tccccatgtatgaattcttaaagaa

SEQ ID NO: 584790 - DNA, 25 bp, Rattus norvegicus
tccccatgtatgtattcttaaagaa

SEQ ID NO: 584791 - DNA, 25 bp, Rattus norvegicus
tccccatgtcatagtgcgcatcaaa

SEQ ID NO: 584792 - DNA, 25 bp, Rattus norvegicus
tccccatgtcattgtgcgcatcaaa

SEQ ID NO: 584793 - DNA, 25 bp, Rattus norvegicus
tccccatgtctcattggaaattaca

SEQ ID NO: 584794 - DNA, 25 bp, Rattus norvegicus
tccccatgtctctttggaaattaca

SEQ ID NO: 584795 - DNA, 25 bp, Rattus norvegicus
tccccatgtctgacagtgtatgtct

SEQ ID NO: 584796 - DNA, 25 bp, Rattus norvegicus
tccccatgtctgctgagctgcagtg

SEQ ID NO: 584797 - DNA, 25 bp, Rattus norvegicus
tccccatgtctggtgagctgcagtg

SEQ ID NO: 584798 - DNA, 25 bp, Rattus norvegicus
tccccatgtctgtcagtgtatgtct

SEQ ID NO: 584799 - DNA, 25 bp, Rattus norvegicus
tccccatgttgaagcctgtgagttg

SEQ ID NO: 584800 - DNA, 25 bp, Rattus norvegicus
tccccatgttgatgcctgtgagttg

SEQ ID NO: 584801 - DNA, 25 bp, Rattus norvegicus
tccccattacctcacttgcaagttt

SEQ ID NO: 584802 - DNA, 25 bp, Rattus norvegicus
tccccattacctgacttgcaagttt

SEQ ID NO: 584803 - DNA, 25 bp, Rattus norvegicus
tccccattagaaaaacctccattag

SEQ ID NO: 584804 - DNA, 25 bp, Rattus norvegicus
tccccattagaataacctccattag

SEQ ID NO: 584805 - DNA, 25 bp, Rattus norvegicus
tccccattagctactagtttctaca

SEQ ID NO: 584806 - DNA, 25 bp, Rattus norvegicus
tccccattagcttctagtttctaca

SEQ ID NO: 584807 - DNA, 25 bp, Rattus norvegicus
tccccattcataaattctccgtcgg

SEQ ID NO: 584808 - DNA, 25 bp, Rattus norvegicus
tccccattcatatattctccgtcgg

SEQ ID NO: 584809 - DNA, 25 bp, Rattus norvegicus
tccccattccttacgtatttgtgtg

SEQ ID NO: 584810 - DNA, 25 bp, Rattus norvegicus
tccccattcctttcgtatttgtgtg

SEQ ID NO: 584811 - DNA, 25 bp, Rattus norvegicus
tccccattgtccagtccaggaaaga

SEQ ID NO: 584812 - DNA, 25 bp, Rattus norvegicus
tccccattgtcctgtccaggaaaga

SEQ ID NO: 584813 - DNA, 25 bp, Rattus norvegicus
tccccatttagcctggacattccag

SEQ ID NO: 584814 - DNA, 25 bp, Rattus norvegicus
tccccatttagcgtggacattccag

SEQ ID NO: 584815 - DNA, 25 bp, Rattus norvegicus
tcccccggcgcaagtatgtacaggg

SEQ ID NO: 584816 - DNA, 25 bp, Rattus norvegicus
tcccccggcgcatgtatgtacaggg

SEQ ID NO: 584817 - DNA, 25 bp, Rattus norvegicus
tccccgaaggacagagcatcttgtt

SEQ ID NO: 584818 - DNA, 25 bp, Rattus norvegicus
tccccgaaggactgagcatcttgtt

SEQ ID NO: 584819 - DNA, 25 bp, Rattus norvegicus
tccccgaaggtgacgtcagtggcaa

SEQ ID NO: 584820 - DNA, 25 bp, Rattus norvegicus
tccccgaaggtgtcgtcagtggcaa

SEQ ID NO: 584821 - DNA, 25 bp, Rattus norvegicus
tccccgaatttcaaggtttaggcag

SEQ ID NO: 584822 - DNA, 25 bp, Rattus norvegicus
tccccgaatttctaggtttaggcag

SEQ ID NO: 584823 - DNA, 25 bp, Rattus norvegicus
tccccgacagcgatgaacagagaac

SEQ ID NO: 584824 - DNA, 25 bp, Rattus norvegicus
tccccgacagcgttgaacagagaac

SEQ ID NO: 584825 - DNA, 25 bp, Rattus norvegicus
tccccgacattgattgacctgctaa

SEQ ID NO: 584826 - DNA, 25 bp, Rattus norvegicus
tccccgacattgtttgacctgctaa

SEQ ID NO: 584827 - DNA, 25 bp, Rattus norvegicus
tccccgaccaatcggcaactgtaaa

SEQ ID NO: 584828 - DNA, 25 bp, Rattus norvegicus
tccccgaccaatgggcaactgtaaa

SEQ ID NO: 584829 - DNA, 25 bp, Rattus norvegicus
tccccgacggacaatttttgaagct

SEQ ID NO: 584830 - DNA, 25 bp, Rattus norvegicus
tccccgacggactatttttgaagct

SEQ ID NO: 584831 - DNA, 25 bp, Rattus norvegicus
tccccgactcggaaagcaaaaggtg

SEQ ID NO: 584832 - DNA, 25 bp, Rattus norvegicus
tccccgactcggtaagcaaaaggtg

SEQ ID NO: 584833 - DNA, 25 bp, Rattus norvegicus
tccccgagctccacaagtggattga

SEQ ID NO: 584834 - DNA, 25 bp, Rattus norvegicus
tccccgagctcctcaagtggattga

SEQ ID NO: 584835 - DNA, 25 bp, Rattus norvegicus
tccccgaggacgatacttcacatga

SEQ ID NO: 584836 - DNA, 25 bp, Rattus norvegicus
tccccgaggacgttacttcacatga

SEQ ID NO: 584837 - DNA, 25 bp, Rattus norvegicus
tccccgaggcctctagtggtggaaa

SEQ ID NO: 584838 - DNA, 25 bp, Rattus norvegicus
tccccgaggcctgtagtggtggaaa

SEQ ID NO: 584839 - DNA, 25 bp, Rattus norvegicus
tccccgagttggaggttctatttgg

SEQ ID NO: 584840 - DNA, 25 bp, Rattus norvegicus
tccccgagttggtggttctatttgg

SEQ ID NO: 584841 - DNA, 25 bp, Rattus norvegicus
tccccgatttacactctcgtttaat

SEQ ID NO: 584842 - DNA, 25 bp, Rattus norvegicus
tccccgatttactctctcgtttaat

SEQ ID NO: 584843 - DNA, 25 bp, Rattus norvegicus
tccccgcatcgtatagttctgtaaa

SEQ ID NO: 584844 - DNA, 25 bp, Rattus norvegicus
tccccgcatcgtttagttctgtaaa

SEQ ID NO: 584845 - DNA, 25 bp, Rattus norvegicus
tccccgcatctgcaattttctctgg

SEQ ID NO: 584846 - DNA, 25 bp, Rattus norvegicus
tccccgcatctggaattttctctgg

SEQ ID NO: 584847 - DNA, 25 bp, Rattus norvegicus
tccccgcggcgcaagatgtgcgtca

SEQ ID NO: 584848 - DNA, 25 bp, Rattus norvegicus
tccccgcggcgctagatgtgcgtca

SEQ ID NO: 584849 - DNA, 25 bp, Rattus norvegicus
tccccgcgggaacgctgcgaggcga

SEQ ID NO: 584850 - DNA, 25 bp, Rattus norvegicus
tccccgcgggaaggctgcgaggcga

SEQ ID NO: 584851 - DNA, 25 bp, Rattus norvegicus
tccccgctcattcaattgatctagg

SEQ ID NO: 584852 - DNA, 25 bp, Rattus norvegicus
tccccgctcattgaattgatctagg

SEQ ID NO: 584853 - DNA, 25 bp, Rattus norvegicus
tccccgctcctgacataggaggtaa

SEQ ID NO: 584854 - DNA, 25 bp, Rattus norvegicus
tccccgctcctgtcataggaggtaa

SEQ ID NO: 584855 - DNA, 25 bp, Rattus norvegicus
tccccgctggcaaactcaggaataa

SEQ ID NO: 584856 - DNA, 25 bp, Rattus norvegicus
tccccgctggcatactcaggaataa

SEQ ID NO: 584857 - DNA, 25 bp, Rattus norvegicus
tccccgctgtctaccaagtattatt

SEQ ID NO: 584858 - DNA, 25 bp, Rattus norvegicus
tccccgctgtcttccaagtattatt

SEQ ID NO: 584859 - DNA, 25 bp, Rattus norvegicus
tccccgcttgggatgctgcctagat

SEQ ID NO: 584860 - DNA, 25 bp, Rattus norvegicus
tccccgcttgggttgctgcctagat

SEQ ID NO: 584861 - DNA, 25 bp, Rattus norvegicus
tccccgcttgttatttgggcagaag

SEQ ID NO: 584862 - DNA, 25 bp, Rattus norvegicus
tccccgcttgttttttgggcagaag

SEQ ID NO: 584863 - DNA, 25 bp, Rattus norvegicus
tccccgctttcacctgtgtttcggg

SEQ ID NO: 584864 - DNA, 25 bp, Rattus norvegicus
tccccgctttcagctgtgtttcggg

SEQ ID NO: 584865 - DNA, 25 bp, Rattus norvegicus
tccccggacagaccccagtgggaga

SEQ ID NO: 584866 - DNA, 25 bp, Rattus norvegicus
tccccggacagagcccagtgggaga

SEQ ID NO: 584867 - DNA, 25 bp, Rattus norvegicus
tccccggaggagagcacgccgagtc

SEQ ID NO: 584868 - DNA, 25 bp, Rattus norvegicus
tccccggaggagtgcacgccgagtc

SEQ ID NO: 584869 - DNA, 25 bp, Rattus norvegicus
tccccggcccggattgtgactgcgg

SEQ ID NO: 584870 - DNA, 25 bp, Rattus norvegicus
tccccggcccggtttgtgactgcgg

SEQ ID NO: 584871 - DNA, 25 bp, Rattus norvegicus
tccccggcttttcaaacaccataga

SEQ ID NO: 584872 - DNA, 25 bp, Rattus norvegicus
tccccggcttttgaaacaccataga

SEQ ID NO: 584873 - DNA, 25 bp, Rattus norvegicus
tccccgggaacaatcttgcctcatg

SEQ ID NO: 584874 - DNA, 25 bp, Rattus norvegicus
tccccgggaacattcttgcctcatg

SEQ ID NO: 584875 - DNA, 25 bp, Rattus norvegicus
tccccgggctctctcttagtggcgt

SEQ ID NO: 584876 - DNA, 25 bp, Rattus norvegicus
tccccgggctctgtcttagtggcgt

SEQ ID NO: 584877 - DNA, 25 bp, Rattus norvegicus
tccccgggtattccattgaacttgt

SEQ ID NO: 584878 - DNA, 25 bp, Rattus norvegicus
tccccgggtattgcattgaacttgt

SEQ ID NO: 584879 - DNA, 25 bp, Rattus norvegicus
tccccggtgaagctaatggccctgg

SEQ ID NO: 584880 - DNA, 25 bp, Rattus norvegicus
tccccggtgaaggtaatggccctgg

SEQ ID NO: 584881 - DNA, 25 bp, Rattus norvegicus
tccccgtagtgcacggcaacagata

SEQ ID NO: 584882 - DNA, 25 bp, Rattus norvegicus
tccccgtagtgctcggcaacagata

SEQ ID NO: 584883 - DNA, 25 bp, Rattus norvegicus
tccccgtcctcaaggtgaatgcagt

SEQ ID NO: 584884 - DNA, 25 bp, Rattus norvegicus
tccccgtcctcatggtgaatgcagt

SEQ ID NO: 584885 - DNA, 25 bp, Rattus norvegicus
tccccgtcgggaattgtagtttgcg

SEQ ID NO: 584886 - DNA, 25 bp, Rattus norvegicus
tccccgtcgggatttgtagtttgcg

SEQ ID NO: 584887 - DNA, 25 bp, Rattus norvegicus
tccccgtcgtaaccgctgaggaatg

SEQ ID NO: 584888 - DNA, 25 bp, Rattus norvegicus
tccccgtcgtaagcgctgaggaatg

SEQ ID NO: 584889 - DNA, 25 bp, Rattus norvegicus
tccccgtgaagtcccgtgtaggaga

SEQ ID NO: 584890 - DNA, 25 bp, Rattus norvegicus
tccccgtgaagtgccgtgtaggaga

SEQ ID NO: 584891 - DNA, 25 bp, Rattus norvegicus
tccccgtgaccgatgtcagttaagc

SEQ ID NO: 584892 - DNA, 25 bp, Rattus norvegicus
tccccgtgaccgttgtcagttaagc

SEQ ID NO: 584893 - DNA, 25 bp, Rattus norvegicus
tccccgtgcggcatcttagagaaca

SEQ ID NO: 584894 - DNA, 25 bp, Rattus norvegicus
tccccgtgcggcttcttagagaaca

SEQ ID NO: 584895 - DNA, 25 bp, Rattus norvegicus
tccccgtgctaaagtcctaagatga

SEQ ID NO: 584896 - DNA, 25 bp, Rattus norvegicus
tccccgtgctaatgtcctaagatga

SEQ ID NO: 584897 - DNA, 25 bp, Rattus norvegicus
tccccgtgtaggaaggttgcttgca

SEQ ID NO: 584898 - DNA, 25 bp, Rattus norvegicus
tccccgtgtaggtaggttgcttgca

SEQ ID NO: 584899 - DNA, 25 bp, Rattus norvegicus
tccccgttcggtagatgctttagtt

SEQ ID NO: 584900 - DNA, 25 bp, Rattus norvegicus
tccccgttcggttgatgctttagtt

SEQ ID NO: 584901 - DNA, 25 bp, Rattus norvegicus
tccccgttctgactcaaacttcatt

SEQ ID NO: 584902 - DNA, 25 bp, Rattus norvegicus
tccccgttctgagtcaaacttcatt

SEQ ID NO: 584903 - DNA, 25 bp, Rattus norvegicus
tccccgttcttaattctttgagcag

SEQ ID NO: 584904 - DNA, 25 bp, Rattus norvegicus
tccccgttcttatttctttgagcag

SEQ ID NO: 584905 - DNA, 25 bp, Rattus norvegicus
tccccgtttaggatgcatgacgtgt

SEQ ID NO: 584906 - DNA, 25 bp, Rattus norvegicus
tccccgtttaggttgcatgacgtgt

SEQ ID NO: 584907 - DNA, 25 bp, Rattus norvegicus
tccccgtttctaatactgcgtgtaa

SEQ ID NO: 584908 - DNA, 25 bp, Rattus norvegicus
tccccgtttctattactgcgtgtaa

SEQ ID NO: 584909 - DNA, 25 bp, Rattus norvegicus
tccccgtttttcattgaatgtccat

SEQ ID NO: 584910 - DNA, 25 bp, Rattus norvegicus
tccccgtttttctttgaatgtccat

SEQ ID NO: 584911 - DNA, 25 bp, Rattus norvegicus
tcccctaaaggaacacgtaactcgg

SEQ ID NO: 584912 - DNA, 25 bp, Rattus norvegicus
tcccctaaaggatcacgtaactcgg

SEQ ID NO: 584913 - DNA, 25 bp, Rattus norvegicus
tcccctacataaatgtgttaccctg

SEQ ID NO: 584914 - DNA, 25 bp, Rattus norvegicus
tcccctacataattgtgttaccctg

SEQ ID NO: 584915 - DNA, 25 bp, Rattus norvegicus
tcccctaccaggagatcgcaggtaa

SEQ ID NO: 584916 - DNA, 25 bp, Rattus norvegicus
tcccctaccaggtgatcgcaggtaa

SEQ ID NO: 584917 - DNA, 25 bp, Rattus norvegicus
tcccctacgacgcaaactgttaact

SEQ ID NO: 584918 - DNA, 25 bp, Rattus norvegicus
tcccctacgacggaaactgttaact

SEQ ID NO: 584919 - DNA, 25 bp, Rattus norvegicus
tcccctagacctccaatgttcatta

SEQ ID NO: 584920 - DNA, 25 bp, Rattus norvegicus
tcccctagacctgcaatgttcatta

SEQ ID NO: 584921 - DNA, 25 bp, Rattus norvegicus
tcccctagccatatgtatgtcctta

SEQ ID NO: 584922 - DNA, 25 bp, Rattus norvegicus
tcccctagccatttgtatgtcctta

SEQ ID NO: 584923 - DNA, 25 bp, Rattus norvegicus
tcccctagcttcactcaatgttagt

SEQ ID NO: 584924 - DNA, 25 bp, Rattus norvegicus
tcccctagcttctctcaatgttagt

SEQ ID NO: 584925 - DNA, 25 bp, Rattus norvegicus
tcccctaggcggctgtcaacagagg

SEQ ID NO: 584926 - DNA, 25 bp, Rattus norvegicus
tcccctaggcgggtgtcaacagagg

SEQ ID NO: 584927 - DNA, 25 bp, Rattus norvegicus
tcccctaggtggactaacaaacact

SEQ ID NO: 584928 - DNA, 25 bp, Rattus norvegicus
tcccctaggtggtctaacaaacact

SEQ ID NO: 584929 - DNA, 25 bp, Rattus norvegicus
tcccctagttacctcactctaaata

SEQ ID NO: 584930 - DNA, 25 bp, Rattus norvegicus
tcccctagttacgtcactctaaata

SEQ ID NO: 584931 - DNA, 25 bp, Rattus norvegicus
tcccctagtttcctgtctgttgaat

SEQ ID NO: 584932 - DNA, 25 bp, Rattus norvegicus
tcccctagtttcgtgtctgttgaat

SEQ ID NO: 584933 - DNA, 25 bp, Rattus norvegicus
tcccctagttttccaagggtgtatg

SEQ ID NO: 584934 - DNA, 25 bp, Rattus norvegicus
tcccctagttttgcaagggtgtatg

SEQ ID NO: 584935 - DNA, 25 bp, Rattus norvegicus
tcccctatctctcacgcataataaa

SEQ ID NO: 584936 - DNA, 25 bp, Rattus norvegicus
tcccctatctctgacgcataataaa

SEQ ID NO: 584937 - DNA, 25 bp, Rattus norvegicus
tcccctatgaccatctgtacggatt

SEQ ID NO: 584938 - DNA, 25 bp, Rattus norvegicus
tcccctatgaccttctgtacggatt

SEQ ID NO: 584939 - DNA, 25 bp, Rattus norvegicus
tcccctatgtgcatgttccaatgaa

SEQ ID NO: 584940 - DNA, 25 bp, Rattus norvegicus
tcccctatgtgcttgttccaatgaa

SEQ ID NO: 584941 - DNA, 25 bp, Rattus norvegicus
tcccctattggacctaagtgtggtg

SEQ ID NO: 584942 - DNA, 25 bp, Rattus norvegicus
tcccctattggagctaagtgtggtg

SEQ ID NO: 584943 - DNA, 25 bp, Rattus norvegicus
tcccctatttccattcagctgataa

SEQ ID NO: 584944 - DNA, 25 bp, Rattus norvegicus
tcccctatttcctttcagctgataa

SEQ ID NO: 584945 - DNA, 25 bp, Rattus norvegicus
tcccctatttttctcactgtgtagc

SEQ ID NO: 584946 - DNA, 25 bp, Rattus norvegicus
tcccctatttttgtcactgtgtagc

SEQ ID NO: 584947 - DNA, 25 bp, Rattus norvegicus
tcccctcacgacatattttttagca

SEQ ID NO: 584948 - DNA, 25 bp, Rattus norvegicus
tcccctcacgacttattttttagca

SEQ ID NO: 584949 - DNA, 25 bp, Rattus norvegicus
tcccctcagaatcccatttccgagg

SEQ ID NO: 584950 - DNA, 25 bp, Rattus norvegicus
tcccctcagaatgccatttccgagg

SEQ ID NO: 584951 - DNA, 25 bp, Rattus norvegicus
tcccctcagggcactggctgggtgc

SEQ ID NO: 584952 - DNA, 25 bp, Rattus norvegicus
tcccctcagggctctggctgggtgc

SEQ ID NO: 584953 - DNA, 25 bp, Rattus norvegicus
tcccctcatccacgctgatgaagag

SEQ ID NO: 584954 - DNA, 25 bp, Rattus norvegicus
tcccctcatccaggctgatgaagag

SEQ ID NO: 584955 - DNA, 25 bp, Rattus norvegicus
tcccctcatgagacaagtctgctaa

SEQ ID NO: 584956 - DNA, 25 bp, Rattus norvegicus
tcccctcatgagtcaagtctgctaa

SEQ ID NO: 584957 - DNA, 25 bp, Rattus norvegicus
tcccctcattataccctgttttaat

SEQ ID NO: 584958 - DNA, 25 bp, Rattus norvegicus
tcccctcattattccctgttttaat

SEQ ID NO: 584959 - DNA, 25 bp, Rattus norvegicus
tcccctcattggagtctactttgta

SEQ ID NO: 584960 - DNA, 25 bp, Rattus norvegicus
tcccctcattggtgtctactttgta

SEQ ID NO: 584961 - DNA, 25 bp, Rattus norvegicus
tcccctccactgaagaagtatgtat

SEQ ID NO: 584962 - DNA, 25 bp, Rattus norvegicus
tcccctccactgtagaagtatgtat

SEQ ID NO: 584963 - DNA, 25 bp, Rattus norvegicus
tcccctccagagattaacagtcaaa

SEQ ID NO: 584964 - DNA, 25 bp, Rattus norvegicus
tcccctccagagtttaacagtcaaa

SEQ ID NO: 584965 - DNA, 25 bp, Rattus norvegicus
tcccctccatgcagtacgattgtat

SEQ ID NO: 584966 - DNA, 25 bp, Rattus norvegicus
tcccctccatgctgtacgattgtat

SEQ ID NO: 584967 - DNA, 25 bp, Rattus norvegicus
tcccctcccctaactaaatgatttt

SEQ ID NO: 584968 - DNA, 25 bp, Rattus norvegicus
tcccctcccctatctaaatgatttt

SEQ ID NO: 584969 - DNA, 25 bp, Rattus norvegicus
tcccctcccgtaacaatggtgtgac

SEQ ID NO: 584970 - DNA, 25 bp, Rattus norvegicus
tcccctcccgtatcaatggtgtgac

SEQ ID NO: 584971 - DNA, 25 bp, Rattus norvegicus
tcccctccctgcactggtgtaagga

SEQ ID NO: 584972 - DNA, 25 bp, Rattus norvegicus
tcccctccctgctctggtgtaagga

SEQ ID NO: 584973 - DNA, 25 bp, Rattus norvegicus
tcccctcgtggcagaatacattgta

SEQ ID NO: 584974 - DNA, 25 bp, Rattus norvegicus
tcccctcgtggctgaatacattgta

SEQ ID NO: 584975 - DNA, 25 bp, Rattus norvegicus
tcccctctagatagcagctagctct

SEQ ID NO: 584976 - DNA, 25 bp, Rattus norvegicus
tcccctctagattgcagctagctct

SEQ ID NO: 584977 - DNA, 25 bp, Rattus norvegicus
tcccctctcagtagtgtcagaacga

SEQ ID NO: 584978 - DNA, 25 bp, Rattus norvegicus
tcccctctcagttgtgtcagaacga

SEQ ID NO: 584979 - DNA, 25 bp, Rattus norvegicus
tcccctctcatgatgtttgcagatg

SEQ ID NO: 584980 - DNA, 25 bp, Rattus norvegicus
tcccctctcatgttgtttgcagatg

SEQ ID NO: 584981 - DNA, 25 bp, Rattus norvegicus
tcccctctccatatataccaaagaa

SEQ ID NO: 584982 - DNA, 25 bp, Rattus norvegicus
tcccctctccatttataccaaagaa

SEQ ID NO: 584983 - DNA, 25 bp, Rattus norvegicus
tcccctctcgccacggtttatttat

SEQ ID NO: 584984 - DNA, 25 bp, Rattus norvegicus
tcccctctcgcctcggtttatttat

SEQ ID NO: 584985 - DNA, 25 bp, Rattus norvegicus
tcccctctctgcattgtttaattgg

SEQ ID NO: 584986 - DNA, 25 bp, Rattus norvegicus
tcccctctctgctttgtttaattgg

SEQ ID NO: 584987 - DNA, 25 bp, Rattus norvegicus
tcccctctgacaagcttagcaagat

SEQ ID NO: 584988 - DNA, 25 bp, Rattus norvegicus
tcccctctgacatgcttagcaagat

SEQ ID NO: 584989 - DNA, 25 bp, Rattus norvegicus
tcccctctgctgacagcattgctgt

SEQ ID NO: 584990 - DNA, 25 bp, Rattus norvegicus
tcccctctgctgtcagcattgctgt

SEQ ID NO: 584991 - DNA, 25 bp, Rattus norvegicus
tcccctctgcttacaatgtgcattt

SEQ ID NO: 584992 - DNA, 25 bp, Rattus norvegicus
tcccctctgctttcaatgtgcattt

SEQ ID NO: 584993 - DNA, 25 bp, Rattus norvegicus
tcccctctgtcgatttgcatgaatg

SEQ ID NO: 584994 - DNA, 25 bp, Rattus norvegicus
tcccctctgtcgttttgcatgaatg

SEQ ID NO: 584995 - DNA, 25 bp, Rattus norvegicus
tcccctctgtggagtcacttttgta

SEQ ID NO: 584996 - DNA, 25 bp, Rattus norvegicus
tcccctctgtggtgtcacttttgta

SEQ ID NO: 584997 - DNA, 25 bp, Rattus norvegicus
tcccctcttgggagagagatcctag

SEQ ID NO: 584998 - DNA, 25 bp, Rattus norvegicus
tcccctcttgggtgagagatcctag

SEQ ID NO: 584999 - DNA, 25 bp, Rattus norvegicus
tcccctgaaatgctggcgctccgag

SEQ ID NO: 585000 - DNA, 25 bp, Rattus norvegicus
tcccctgaaatggtggcgctccgag

SEQ ID NO: 585001 - DNA, 25 bp, Rattus norvegicus
tcccctgacaggaggacactgagct

SEQ ID NO: 585002 - DNA, 25 bp, Rattus norvegicus
tcccctgacaggtggacactgagct

SEQ ID NO: 585003 - DNA, 25 bp, Rattus norvegicus
tcccctgaccctatgagacaaggac

SEQ ID NO: 585004 - DNA, 25 bp, Rattus norvegicus
tcccctgaccctttgagacaaggac

SEQ ID NO: 585005 - DNA, 25 bp, Rattus norvegicus
tcccctgagggcactttaagtagat

SEQ ID NO: 585006 - DNA, 25 bp, Rattus norvegicus
tcccctgagggctctttaagtagat

SEQ ID NO: 585007 - DNA, 25 bp, Rattus norvegicus
tcccctgatctgagttttgtttttg

SEQ ID NO: 585008 - DNA, 25 bp, Rattus norvegicus
tcccctgatctgtgttttgtttttg

SEQ ID NO: 585009 - DNA, 25 bp, Rattus norvegicus
tcccctgatggtcacttgtgtctgt

SEQ ID NO: 585010 - DNA, 25 bp, Rattus norvegicus
tcccctgatggtgacttgtgtctgt

SEQ ID NO: 585011 - DNA, 25 bp, Rattus norvegicus
tcccctgcagggatcctgtcattga

SEQ ID NO: 585012 - DNA, 25 bp, Rattus norvegicus
tcccctgcagggttcctgtcattga

SEQ ID NO: 585013 - DNA, 25 bp, Rattus norvegicus
tcccctgcagttctttctacattgt

SEQ ID NO: 585014 - DNA, 25 bp, Rattus norvegicus
tcccctgcagttgtttctacattgt

SEQ ID NO: 585015 - DNA, 25 bp, Rattus norvegicus
tcccctgccatcattctttaagaaa

SEQ ID NO: 585016 - DNA, 25 bp, Rattus norvegicus
tcccctgccatctttctttaagaaa

SEQ ID NO: 585017 - DNA, 25 bp, Rattus norvegicus
tcccctgccctcaagttttgtttgc

SEQ ID NO: 585018 - DNA, 25 bp, Rattus norvegicus
tcccctgccctctagttttgtttgc

SEQ ID NO: 585019 - DNA, 25 bp, Rattus norvegicus
tcccctgcctgtcgctaacaaagag

SEQ ID NO: 585020 - DNA, 25 bp, Rattus norvegicus
tcccctgcctgtggctaacaaagag

SEQ ID NO: 585021 - DNA, 25 bp, Rattus norvegicus
tcccctgcgaccagaaaggcattgg

SEQ ID NO: 585022 - DNA, 25 bp, Rattus norvegicus
tcccctgcgacctgaaaggcattgg

SEQ ID NO: 585023 - DNA, 25 bp, Rattus norvegicus
tcccctgctctgacttcaataaaga

SEQ ID NO: 585024 - DNA, 25 bp, Rattus norvegicus
tcccctgctctgtcttcaataaaga

SEQ ID NO: 585025 - DNA, 25 bp, Rattus norvegicus
tcccctgctgccagtgtaagggtta

SEQ ID NO: 585026 - DNA, 25 bp, Rattus norvegicus
tcccctgctgcctgtgtaagggtta

SEQ ID NO: 585027 - DNA, 25 bp, Rattus norvegicus
tcccctggaagaacatgaaatgctg

SEQ ID NO: 585028 - DNA, 25 bp, Rattus norvegicus
tcccctggaagatcatgaaatgctg

SEQ ID NO: 585029 - DNA, 25 bp, Rattus norvegicus
tcccctggaagtctctggttactgt

SEQ ID NO: 585030 - DNA, 25 bp, Rattus norvegicus
tcccctggaagtgtctggttactgt

SEQ ID NO: 585031 - DNA, 25 bp, Rattus norvegicus
tcccctggagttcgctcggcagaga

SEQ ID NO: 585032 - DNA, 25 bp, Rattus norvegicus
tcccctggagttggctcggcagaga

SEQ ID NO: 585033 - DNA, 25 bp, Rattus norvegicus
tcccctggatgcacaaggtgtttgt

SEQ ID NO: 585034 - DNA, 25 bp, Rattus norvegicus
tcccctggatgctcaaggtgtttgt

SEQ ID NO: 585035 - DNA, 25 bp, Rattus norvegicus
tcccctggcttaaagcagcagtata

SEQ ID NO: 585036 - DNA, 25 bp, Rattus norvegicus
tcccctggcttatagcagcagtata

SEQ ID NO: 585037 - DNA, 25 bp, Rattus norvegicus
tcccctggctttccatcaagtgatg

SEQ ID NO: 585038 - DNA, 25 bp, Rattus norvegicus
tcccctggctttgcatcaagtgatg

SEQ ID NO: 585039 - DNA, 25 bp, Rattus norvegicus
tcccctgggatcaggacatggctag

SEQ ID NO: 585040 - DNA, 25 bp, Rattus norvegicus
tcccctgggatctggacatggctag

SEQ ID NO: 585041 - DNA, 25 bp, Rattus norvegicus
tcccctgggcaaacttgtactacgt

SEQ ID NO: 585042 - DNA, 25 bp, Rattus norvegicus
tcccctgggcaatcttgtactacgt

SEQ ID NO: 585043 - DNA, 25 bp, Rattus norvegicus
tcccctgggtatacctaggtaccag

SEQ ID NO: 585044 - DNA, 25 bp, Rattus norvegicus
tcccctgggtattcctaggtaccag

SEQ ID NO: 585045 - DNA, 25 bp, Rattus norvegicus
tcccctggtgctctatctgcaatga

SEQ ID NO: 585046 - DNA, 25 bp, Rattus norvegicus
tcccctggtgctgtatctgcaatga

SEQ ID NO: 585047 - DNA, 25 bp, Rattus norvegicus
tcccctgtaacgcacatgcaatgag

SEQ ID NO: 585048 - DNA, 25 bp, Rattus norvegicus
tcccctgtaacggacatgcaatgag

SEQ ID NO: 585049 - DNA, 25 bp, Rattus norvegicus
tcccctgtacagaatctctcagaga

SEQ ID NO: 585050 - DNA, 25 bp, Rattus norvegicus
tcccctgtacagtatctctcagaga

SEQ ID NO: 585051 - DNA, 25 bp, Rattus norvegicus
tcccctgtctctaatcatggtacta

SEQ ID NO: 585052 - DNA, 25 bp, Rattus norvegicus
tcccctgtctcttatcatggtacta

SEQ ID NO: 585053 - DNA, 25 bp, Rattus norvegicus
tcccctgttctccagtgacgtgaat

SEQ ID NO: 585054 - DNA, 25 bp, Rattus norvegicus
tcccctgttctcgagtgacgtgaat

SEQ ID NO: 585055 - DNA, 25 bp, Rattus norvegicus
tcccctgttggccattaactgtgtg

SEQ ID NO: 585056 - DNA, 25 bp, Rattus norvegicus
tcccctgttggcgattaactgtgtg

SEQ ID NO: 585057 - DNA, 25 bp, Rattus norvegicus
tcccctgtttttcctagtcatagta

SEQ ID NO: 585058 - DNA, 25 bp, Rattus norvegicus
tcccctgtttttgctagtcatagta

SEQ ID NO: 585059 - DNA, 25 bp, Rattus norvegicus
tccccttacgttctctgtgtgaatt

SEQ ID NO: 585060 - DNA, 25 bp, Rattus norvegicus
tccccttacgttgtctgtgtgaatt

SEQ ID NO: 585061 - DNA, 25 bp, Rattus norvegicus
tccccttagcccacttatttatact

SEQ ID NO: 585062 - DNA, 25 bp, Rattus norvegicus
tccccttagccctcttatttatact

SEQ ID NO: 585063 - DNA, 25 bp, Rattus norvegicus
tccccttaggcccttatcagagact

SEQ ID NO: 585064 - DNA, 25 bp, Rattus norvegicus
tccccttaggccgttatcagagact

SEQ ID NO: 585065 - DNA, 25 bp, Rattus norvegicus
tccccttcaaagaccttagatccaa

SEQ ID NO: 585066 - DNA, 25 bp, Rattus norvegicus
tccccttcaaagtccttagatccaa

SEQ ID NO: 585067 - DNA, 25 bp, Rattus norvegicus
tccccttcacgtatgcagttgatgt

SEQ ID NO: 585068 - DNA, 25 bp, Rattus norvegicus
tccccttcacgtttgcagttgatgt

SEQ ID NO: 585069 - DNA, 25 bp, Rattus norvegicus
tccccttcatccattttgaacactt

SEQ ID NO: 585070 - DNA, 25 bp, Rattus norvegicus
tccccttcatcctttttgaacactt

SEQ ID NO: 585071 - DNA, 25 bp, Rattus norvegicus
tccccttccctaacagactggatgt

SEQ ID NO: 585072 - DNA, 25 bp, Rattus norvegicus
tccccttccctatcagactggatgt

SEQ ID NO: 585073 - DNA, 25 bp, Rattus norvegicus
tccccttcctacctctagaataaag

SEQ ID NO: 585074 - DNA, 25 bp, Rattus norvegicus
tccccttcctacgtctagaataaag

SEQ ID NO: 585075 - DNA, 25 bp, Rattus norvegicus
tccccttcctgtacttgacattcag

SEQ ID NO: 585076 - DNA, 25 bp, Rattus norvegicus
tccccttcctgttcttgacattcag

SEQ ID NO: 585077 - DNA, 25 bp, Rattus norvegicus
tccccttccttcagaaaaagccgat

SEQ ID NO: 585078 - DNA, 25 bp, Rattus norvegicus
tccccttccttctgaaaaagccgat

SEQ ID NO: 585079 - DNA, 25 bp, Rattus norvegicus
tccccttcgatcctctagattttga

SEQ ID NO: 585080 - DNA, 25 bp, Rattus norvegicus
tccccttcgatcgtctagattttga

SEQ ID NO: 585081 - DNA, 25 bp, Rattus norvegicus
tccccttcggctctgtacaataaag

SEQ ID NO: 585082 - DNA, 25 bp, Rattus norvegicus
tccccttcggctgtgtacaataaag

SEQ ID NO: 585083 - DNA, 25 bp, Rattus norvegicus
tccccttctagaccgtttggagatg

SEQ ID NO: 585084 - DNA, 25 bp, Rattus norvegicus
tccccttctagactgtgaatcctta

SEQ ID NO: 585085 - DNA, 25 bp, Rattus norvegicus
tccccttctagagcgtttggagatg

SEQ ID NO: 585086 - DNA, 25 bp, Rattus norvegicus
tccccttctagagtgtgaatcctta

SEQ ID NO: 585087 - DNA, 25 bp, Rattus norvegicus
tccccttctagtaccattgtttgtt

SEQ ID NO: 585088 - DNA, 25 bp, Rattus norvegicus
tccccttctagttccattgtttgtt

SEQ ID NO: 585089 - DNA, 25 bp, Rattus norvegicus
tccccttctctaatttggtcacaat

SEQ ID NO: 585090 - DNA, 25 bp, Rattus norvegicus
tccccttctctattttggtcacaat

SEQ ID NO: 585091 - DNA, 25 bp, Rattus norvegicus
tccccttctctgagtttattcaaaa

SEQ ID NO: 585092 - DNA, 25 bp, Rattus norvegicus
tccccttctctgtgtttattcaaaa

SEQ ID NO: 585093 - DNA, 25 bp, Rattus norvegicus
tccccttctgggatgatatcatctt

SEQ ID NO: 585094 - DNA, 25 bp, Rattus norvegicus
tccccttctgggttgatatcatctt

SEQ ID NO: 585095 - DNA, 25 bp, Rattus norvegicus
tccccttcttgacactcaggtagag

SEQ ID NO: 585096 - DNA, 25 bp, Rattus norvegicus
tccccttcttgagactcaggtagag

SEQ ID NO: 585097 - DNA, 25 bp, Rattus norvegicus
tccccttgaaataatgtttatgctg

SEQ ID NO: 585098 - DNA, 25 bp, Rattus norvegicus
tccccttgaaattatgtttatgctg

SEQ ID NO: 585099 - DNA, 25 bp, Rattus norvegicus
tccccttgcagcatgttcataaagt

SEQ ID NO: 585100 - DNA, 25 bp, Rattus norvegicus
tccccttgcagcttgttcataaagt

SEQ ID NO: 585101 - DNA, 25 bp, Rattus norvegicus
tccccttgcctactctggaagcagt

SEQ ID NO: 585102 - DNA, 25 bp, Rattus norvegicus
tccccttgcctagtctggaagcagt

SEQ ID NO: 585103 - DNA, 25 bp, Rattus norvegicus
tccccttggagtcgaatgctgccat

SEQ ID NO: 585104 - DNA, 25 bp, Rattus norvegicus
tccccttggagtggaatgctgccat

SEQ ID NO: 585105 - DNA, 25 bp, Rattus norvegicus
tccccttggcacaaattactgttat

SEQ ID NO: 585106 - DNA, 25 bp, Rattus norvegicus
tccccttggcactaattactgttat

SEQ ID NO: 585107 - DNA, 25 bp, Rattus norvegicus
tccccttggcatatatttttgggct

SEQ ID NO: 585108 - DNA, 25 bp, Rattus norvegicus
tccccttggcatttatttttgggct

SEQ ID NO: 585109 - DNA, 25 bp, Rattus norvegicus
tccccttggctgattcttttgaaag

SEQ ID NO: 585110 - DNA, 25 bp, Rattus norvegicus
tccccttggctgtttcttttgaaag

SEQ ID NO: 585111 - DNA, 25 bp, Rattus norvegicus
tccccttgggccctagagtatagag

SEQ ID NO: 585112 - DNA, 25 bp, Rattus norvegicus
tccccttgggccgtagagtatagag

SEQ ID NO: 585113 - DNA, 25 bp, Rattus norvegicus
tccccttgggctcagtctggagaga

SEQ ID NO: 585114 - DNA, 25 bp, Rattus norvegicus
tccccttgggctgagtctggagaga

SEQ ID NO: 585115 - DNA, 25 bp, Rattus norvegicus
tccccttgtacacaacttttccatt

SEQ ID NO: 585116 - DNA, 25 bp, Rattus norvegicus
tccccttgtacagaacttttccatt

SEQ ID NO: 585117 - DNA, 25 bp, Rattus norvegicus
tccccttgtttgctgtatggcttgt

SEQ ID NO: 585118 - DNA, 25 bp, Rattus norvegicus
tccccttgtttggtgtatggcttgt

SEQ ID NO: 585119 - DNA, 25 bp, Rattus norvegicus
tcccctttacggagcactgcagaga

SEQ ID NO: 585120 - DNA, 25 bp, Rattus norvegicus
tcccctttacggtgcactgcagaga

SEQ ID NO: 585121 - DNA, 25 bp, Rattus norvegicus
tcccctttcagccaggaggaagcag

SEQ ID NO: 585122 - DNA, 25 bp, Rattus norvegicus
tcccctttcagcgaggaggaagcag

SEQ ID NO: 585123 - DNA, 25 bp, Rattus norvegicus
tcccctttcccaattgtgttagaag

SEQ ID NO: 585124 - DNA, 25 bp, Rattus norvegicus
tcccctttcccatttgtgttagaag

SEQ ID NO: 585125 - DNA, 25 bp, Rattus norvegicus
tcccctttctcaagcaggatgcagt

SEQ ID NO: 585126 - DNA, 25 bp, Rattus norvegicus
tcccctttctcatgcaggatgcagt

SEQ ID NO: 585127 - DNA, 25 bp, Rattus norvegicus
tcccctttctgacctatgttggaag

SEQ ID NO: 585128 - DNA, 25 bp, Rattus norvegicus
tcccctttctgagctatgttggaag

SEQ ID NO: 585129 - DNA, 25 bp, Rattus norvegicus
tcccctttctggatccaatttgaga

SEQ ID NO: 585130 - DNA, 25 bp, Rattus norvegicus
tcccctttctggttccaatttgaga

SEQ ID NO: 585131 - DNA, 25 bp, Rattus norvegicus
tcccctttcttgaaggttagtaatg

SEQ ID NO: 585132 - DNA, 25 bp, Rattus norvegicus
tcccctttcttgtaggttagtaatg

SEQ ID NO: 585133 - DNA, 25 bp, Rattus norvegicus
tcccctttctttcgcttcattgttt

SEQ ID NO: 585134 - DNA, 25 bp, Rattus norvegicus
tcccctttctttggcttcattgttt

SEQ ID NO: 585135 - DNA, 25 bp, Rattus norvegicus
tcccctttgactaccaagcagaata

SEQ ID NO: 585136 - DNA, 25 bp, Rattus norvegicus
tcccctttgacttccaagcagaata

SEQ ID NO: 585137 - DNA, 25 bp, Rattus norvegicus
tcccctttgattccagctgaacttt

SEQ ID NO: 585138 - DNA, 25 bp, Rattus norvegicus
tcccctttgattgcagctgaacttt

SEQ ID NO: 585139 - DNA, 25 bp, Rattus norvegicus
tcccctttgctcagtagtactgatt

SEQ ID NO: 585140 - DNA, 25 bp, Rattus norvegicus
tcccctttgctctgtagtactgatt

SEQ ID NO: 585141 - DNA, 25 bp, Rattus norvegicus
tcccctttgcttagggatgggactc

SEQ ID NO: 585142 - DNA, 25 bp, Rattus norvegicus
tcccctttgctttgggatgggactc

SEQ ID NO: 585143 - DNA, 25 bp, Rattus norvegicus
tcccctttgggtctatgattttctt

SEQ ID NO: 585144 - DNA, 25 bp, Rattus norvegicus
tcccctttgggtgtatgattttctt

SEQ ID NO: 585145 - DNA, 25 bp, Rattus norvegicus
tcccctttgtagagccagagactta

SEQ ID NO: 585146 - DNA, 25 bp, Rattus norvegicus
tcccctttgtagtgccagagactta

SEQ ID NO: 585147 - DNA, 25 bp, Rattus norvegicus
tccccttttcctcaggtgaacacag

SEQ ID NO: 585148 - DNA, 25 bp, Rattus norvegicus
tccccttttcctcagtttcattttg

SEQ ID NO: 585149 - DNA, 25 bp, Rattus norvegicus
tccccttttcctgaggtgaacacag

SEQ ID NO: 585150 - DNA, 25 bp, Rattus norvegicus
tccccttttcctgagtttcattttg

SEQ ID NO: 585151 - DNA, 25 bp, Rattus norvegicus
tcccctttttggcataagctcattc

SEQ ID NO: 585152 - DNA, 25 bp, Rattus norvegicus
tcccctttttgggataagctcattc

SEQ ID NO: 585153 - DNA, 25 bp, Rattus norvegicus
tcccgaacttacctttgtgacactt

SEQ ID NO: 585154 - DNA, 25 bp, Rattus norvegicus
tcccgaacttacgtttgtgacactt

SEQ ID NO: 585155 - DNA, 25 bp, Rattus norvegicus
tcccgaagcacacggtcactttcat

SEQ ID NO: 585156 - DNA, 25 bp, Rattus norvegicus
tcccgaagcacagggtcactttcat

SEQ ID NO: 585157 - DNA, 25 bp, Rattus norvegicus
tcccgaatcctcattctggaatagt

SEQ ID NO: 585158 - DNA, 25 bp, Rattus norvegicus
tcccgaatcctctttctggaatagt

SEQ ID NO: 585159 - DNA, 25 bp, Rattus norvegicus
tcccgaattccaagtttgtggcaat

SEQ ID NO: 585160 - DNA, 25 bp, Rattus norvegicus
tcccgaattccatgtttgtggcaat

SEQ ID NO: 585161 - DNA, 25 bp, Rattus norvegicus
tcccgacaagggacttctgtgacat

SEQ ID NO: 585162 - DNA, 25 bp, Rattus norvegicus
tcccgacaagggtcttctgtgacat

SEQ ID NO: 585163 - DNA, 25 bp, Rattus norvegicus
tcccgacacacacatgagatacatg

SEQ ID NO: 585164 - DNA, 25 bp, Rattus norvegicus
tcccgacacacagatgagatacatg

SEQ ID NO: 585165 - DNA, 25 bp, Rattus norvegicus
tcccgacgtgtgctgtttgcagaat

SEQ ID NO: 585166 - DNA, 25 bp, Rattus norvegicus
tcccgacgtgtggtgtttgcagaat

SEQ ID NO: 585167 - DNA, 25 bp, Rattus norvegicus
tcccgactatatccactgtcaaagt

SEQ ID NO: 585168 - DNA, 25 bp, Rattus norvegicus
tcccgactatatgcactgtcaaagt

SEQ ID NO: 585169 - DNA, 25 bp, Rattus norvegicus
tcccgactgatgatccctgctattc

SEQ ID NO: 585170 - DNA, 25 bp, Rattus norvegicus
tcccgactgatgttccctgctattc

SEQ ID NO: 585171 - DNA, 25 bp, Rattus norvegicus
tcccgactgtctcgactataaggac

SEQ ID NO: 585172 - DNA, 25 bp, Rattus norvegicus
tcccgactgtctggactataaggac

SEQ ID NO: 585173 - DNA, 25 bp, Rattus norvegicus
tcccgactttgaaatgctatggagt

SEQ ID NO: 585174 - DNA, 25 bp, Rattus norvegicus
tcccgactttgatatgctatggagt

SEQ ID NO: 585175 - DNA, 25 bp, Rattus norvegicus
tcccgagcagcgcatccaagttcaa

SEQ ID NO: 585176 - DNA, 25 bp, Rattus norvegicus
tcccgagcagcggatccaagttcaa

SEQ ID NO: 585177 - DNA, 25 bp, Rattus norvegicus
tcccgagcatttctctaccttaccg

SEQ ID NO: 585178 - DNA, 25 bp, Rattus norvegicus
tcccgagcatttgtctaccttaccg

SEQ ID NO: 585179 - DNA, 25 bp, Rattus norvegicus
tcccgagccagcatttgtgtgcagc

SEQ ID NO: 585180 - DNA, 25 bp, Rattus norvegicus
tcccgagccagcttttgtgtgcagc

SEQ ID NO: 585181 - DNA, 25 bp, Rattus norvegicus
tcccgagctagcatgggactttgtt

SEQ ID NO: 585182 - DNA, 25 bp, Rattus norvegicus
tcccgagctagcttgggactttgtt

SEQ ID NO: 585183 - DNA, 25 bp, Rattus norvegicus
tcccgaggagttagctactgggctc

SEQ ID NO: 585184 - DNA, 25 bp, Rattus norvegicus
tcccgaggagtttgctactgggctc

SEQ ID NO: 585185 - DNA, 25 bp, Rattus norvegicus
tcccgaggcacacgtttggacttgt

SEQ ID NO: 585186 - DNA, 25 bp, Rattus norvegicus
tcccgaggcacaggtttggacttgt

SEQ ID NO: 585187 - DNA, 25 bp, Rattus norvegicus
tcccgaggctcacaccatcaggtaa

SEQ ID NO: 585188 - DNA, 25 bp, Rattus norvegicus
tcccgaggctcagaccatcaggtaa

SEQ ID NO: 585189 - DNA, 25 bp, Rattus norvegicus
tcccgaggtcagaggctcacctgga

SEQ ID NO: 585190 - DNA, 25 bp, Rattus norvegicus
tcccgaggtcagtggctcacctgga

SEQ ID NO: 585191 - DNA, 25 bp, Rattus norvegicus
tcccgaggtttaaccagtctctgga

SEQ ID NO: 585192 - DNA, 25 bp, Rattus norvegicus
tcccgaggtttatccagtctctgga

SEQ ID NO: 585193 - DNA, 25 bp, Rattus norvegicus
tcccgagtatgcactggaggttagt

SEQ ID NO: 585194 - DNA, 25 bp, Rattus norvegicus
tcccgagtatgctctggaggttagt

SEQ ID NO: 585195 - DNA, 25 bp, Rattus norvegicus
tcccgagtcctcaacaagctgggag

SEQ ID NO: 585196 - DNA, 25 bp, Rattus norvegicus
tcccgagtcctctacaagctgggag

SEQ ID NO: 585197 - DNA, 25 bp, Rattus norvegicus
tcccgagtctacctgctgatgaaga

SEQ ID NO: 585198 - DNA, 25 bp, Rattus norvegicus
tcccgagtctacgtgctgatgaaga

SEQ ID NO: 585199 - DNA, 25 bp, Rattus norvegicus
tcccgagtgcaacttcacccaagtg

SEQ ID NO: 585200 - DNA, 25 bp, Rattus norvegicus
tcccgagtgcaagttcacccaagtg

SEQ ID NO: 585201 - DNA, 25 bp, Rattus norvegicus
tcccgagtgccacgtctagaagttt

SEQ ID NO: 585202 - DNA, 25 bp, Rattus norvegicus
tcccgagtgccaggtctagaagttt

SEQ ID NO: 585203 - DNA, 25 bp, Rattus norvegicus
tcccgataaatccatagccagcttg

SEQ ID NO: 585204 - DNA, 25 bp, Rattus norvegicus
tcccgataaatcgatagccagcttg

SEQ ID NO: 585205 - DNA, 25 bp, Rattus norvegicus
tcccgatacctgatactagatttct

SEQ ID NO: 585206 - DNA, 25 bp, Rattus norvegicus
tcccgatacctgttactagatttct

SEQ ID NO: 585207 - DNA, 25 bp, Rattus norvegicus
tcccgatccgggaagagctgctgcg

SEQ ID NO: 585208 - DNA, 25 bp, Rattus norvegicus
tcccgatccgggtagagctgctgcg

SEQ ID NO: 585209 - DNA, 25 bp, Rattus norvegicus
tcccgatgccttaacgcctaaagaa

SEQ ID NO: 585210 - DNA, 25 bp, Rattus norvegicus
tcccgatgcctttacgcctaaagaa

SEQ ID NO: 585211 - DNA, 25 bp, Rattus norvegicus
tcccgatttcgcctcatgatgaact

SEQ ID NO: 585212 - DNA, 25 bp, Rattus norvegicus
tcccgatttcgcgtcatgatgaact

SEQ ID NO: 585213 - DNA, 25 bp, Rattus norvegicus
tcccgcaaagatcctgttttcaggt

SEQ ID NO: 585214 - DNA, 25 bp, Rattus norvegicus
tcccgcaaagatgctgttttcaggt

SEQ ID NO: 585215 - DNA, 25 bp, Rattus norvegicus
tcccgcaaccctatggtgtgaagga

SEQ ID NO: 585216 - DNA, 25 bp, Rattus norvegicus
tcccgcaaccctttggtgtgaagga

SEQ ID NO: 585217 - DNA, 25 bp, Rattus norvegicus
tcccgcaagtggatggtgacggctt

SEQ ID NO: 585218 - DNA, 25 bp, Rattus norvegicus
tcccgcaagtggttggtgacggctt

SEQ ID NO: 585219 - DNA, 25 bp, Rattus norvegicus
tcccgcactcccagggtttagaagt

SEQ ID NO: 585220 - DNA, 25 bp, Rattus norvegicus
tcccgcactccctgggtttagaagt

SEQ ID NO: 585221 - DNA, 25 bp, Rattus norvegicus
tcccgcagcagtctcatgaagtcct

SEQ ID NO: 585222 - DNA, 25 bp, Rattus norvegicus
tcccgcagcagtgtcatgaagtcct

SEQ ID NO: 585223 - DNA, 25 bp, Rattus norvegicus
tcccgcagcgttactgcctgtgtat

SEQ ID NO: 585224 - DNA, 25 bp, Rattus norvegicus
tcccgcagcgtttctgcctgtgtat

SEQ ID NO: 585225 - DNA, 25 bp, Rattus norvegicus
tcccgcagtgacctcatgtttgaga

SEQ ID NO: 585226 - DNA, 25 bp, Rattus norvegicus
tcccgcagtgacgtcatgtttgaga

SEQ ID NO: 585227 - DNA, 25 bp, Rattus norvegicus
tcccgccaaactccatgagaatttc

SEQ ID NO: 585228 - DNA, 25 bp, Rattus norvegicus
tcccgccaaactgcatgagaatttc

SEQ ID NO: 585229 - DNA, 25 bp, Rattus norvegicus
tcccgccaacttcagaccaaagagt

SEQ ID NO: 585230 - DNA, 25 bp, Rattus norvegicus
tcccgccaacttgagaccaaagagt

SEQ ID NO: 585231 - DNA, 25 bp, Rattus norvegicus
tcccgcctcagaacttctataatgg

SEQ ID NO: 585232 - DNA, 25 bp, Rattus norvegicus
tcccgcctcagatcttctataatgg

SEQ ID NO: 585233 - DNA, 25 bp, Rattus norvegicus
tcccgcctggagacgaaaaacttct

SEQ ID NO: 585234 - DNA, 25 bp, Rattus norvegicus
tcccgcctggagtcgaaaaacttct

SEQ ID NO: 585235 - DNA, 25 bp, Rattus norvegicus
tcccgccttctaagtgaacacgagt

SEQ ID NO: 585236 - DNA, 25 bp, Rattus norvegicus
tcccgccttctatgtgaacacgagt

SEQ ID NO: 585237 - DNA, 25 bp, Rattus norvegicus
tcccgcgcgcgtccttaaagcaaga

SEQ ID NO: 585238 - DNA, 25 bp, Rattus norvegicus
tcccgcgcgcgtgcttaaagcaaga

SEQ ID NO: 585239 - DNA, 25 bp, Rattus norvegicus
tcccgcgggaatctgtgtgtgaaca

SEQ ID NO: 585240 - DNA, 25 bp, Rattus norvegicus
tcccgcgggaatgtgtgtgtgaaca

SEQ ID NO: 585241 - DNA, 25 bp, Rattus norvegicus
tcccgctgcttgaaagagtcattca

SEQ ID NO: 585242 - DNA, 25 bp, Rattus norvegicus
tcccgctgcttgtaagagtcattca

SEQ ID NO: 585243 - DNA, 25 bp, Rattus norvegicus
tcccgctggaacacgatggttgaca

SEQ ID NO: 585244 - DNA, 25 bp, Rattus norvegicus
tcccgctggaactcgatggttgaca

SEQ ID NO: 585245 - DNA, 25 bp, Rattus norvegicus
tcccgcttcataattccttttcttt

SEQ ID NO: 585246 - DNA, 25 bp, Rattus norvegicus
tcccgcttcatatttccttttcttt

SEQ ID NO: 585247 - DNA, 25 bp, Rattus norvegicus
tcccgcttcatcaggttggaggagc

SEQ ID NO: 585248 - DNA, 25 bp, Rattus norvegicus
tcccgcttcatctggttggaggagc

SEQ ID NO: 585249 - DNA, 25 bp, Rattus norvegicus
tcccgcttcgctctttgtgcggtag

SEQ ID NO: 585250 - DNA, 25 bp, Rattus norvegicus
tcccgcttcgctgtttgtgcggtag

SEQ ID NO: 585251 - DNA, 25 bp, Rattus norvegicus
tcccgctttctgatttgactgtatt

SEQ ID NO: 585252 - DNA, 25 bp, Rattus norvegicus
tcccgctttctgttttgactgtatt

SEQ ID NO: 585253 - DNA, 25 bp, Rattus norvegicus
tcccggaaagggagagccagccaaa

SEQ ID NO: 585254 - DNA, 25 bp, Rattus norvegicus
tcccggaaagggtgagccagccaaa

SEQ ID NO: 585255 - DNA, 25 bp, Rattus norvegicus
tcccggaagtccagttagcaaccag

SEQ ID NO: 585256 - DNA, 25 bp, Rattus norvegicus
tcccggaagtcctgttagcaaccag

SEQ ID NO: 585257 - DNA, 25 bp, Rattus norvegicus
tcccggagcaataccgaaggcttcg

SEQ ID NO: 585258 - DNA, 25 bp, Rattus norvegicus
tcccggagcaattccgaaggcttcg

SEQ ID NO: 585259 - DNA, 25 bp, Rattus norvegicus
tcccggagtagccagctggctcact

SEQ ID NO: 585260 - DNA, 25 bp, Rattus norvegicus
tcccggagtagcgagctggctcact

SEQ ID NO: 585261 - DNA, 25 bp, Rattus norvegicus
tcccggagtttgaccttagcagata

SEQ ID NO: 585262 - DNA, 25 bp, Rattus norvegicus
tcccggagtttgtccttagcagata

SEQ ID NO: 585263 - DNA, 25 bp, Rattus norvegicus
tcccggatccagcacttggtagcaa

SEQ ID NO: 585264 - DNA, 25 bp, Rattus norvegicus
tcccggatccaggacttggtagcaa

SEQ ID NO: 585265 - DNA, 25 bp, Rattus norvegicus
tcccggattgtgctgtgcagttttc

SEQ ID NO: 585266 - DNA, 25 bp, Rattus norvegicus
tcccggattgtggtgtgcagttttc

SEQ ID NO: 585267 - DNA, 25 bp, Rattus norvegicus
tcccggcaagtccagtacaccttat

SEQ ID NO: 585268 - DNA, 25 bp, Rattus norvegicus
tcccggcaagtcgagtacaccttat

SEQ ID NO: 585269 - DNA, 25 bp, Rattus norvegicus
tcccggcagagaaggctgaggcaca

SEQ ID NO: 585270 - DNA, 25 bp, Rattus norvegicus
tcccggcagagatggctgaggcaca

SEQ ID NO: 585271 - DNA, 25 bp, Rattus norvegicus
tcccggcagagtacgagtccaagtg

SEQ ID NO: 585272 - DNA, 25 bp, Rattus norvegicus
tcccggcagagttcgagtccaagtg

SEQ ID NO: 585273 - DNA, 25 bp, Rattus norvegicus
tcccggcagggtaagagttcacagt

SEQ ID NO: 585274 - DNA, 25 bp, Rattus norvegicus
tcccggcagggttagagttcacagt

SEQ ID NO: 585275 - DNA, 25 bp, Rattus norvegicus
tcccggcatagcatctcagagtgga

SEQ ID NO: 585276 - DNA, 25 bp, Rattus norvegicus
tcccggcatagcttctcagagtgga

SEQ ID NO: 585277 - DNA, 25 bp, Rattus norvegicus
tcccggcctccacgatacggagtgg

SEQ ID NO: 585278 - DNA, 25 bp, Rattus norvegicus
tcccggcctccaggatacggagtgg

SEQ ID NO: 585279 - DNA, 25 bp, Rattus norvegicus
tcccggcctgacatgagacacaggt

SEQ ID NO: 585280 - DNA, 25 bp, Rattus norvegicus
tcccggcctgacttgagacacaggt

SEQ ID NO: 585281 - DNA, 25 bp, Rattus norvegicus
tcccggcctttgctatagcagctaa

SEQ ID NO: 585282 - DNA, 25 bp, Rattus norvegicus
tcccggcctttggtatagcagctaa

SEQ ID NO: 585283 - DNA, 25 bp, Rattus norvegicus
tcccggcggcccagagagagagcaa

SEQ ID NO: 585284 - DNA, 25 bp, Rattus norvegicus
tcccggcggccctgagagagagcaa

SEQ ID NO: 585285 - DNA, 25 bp, Rattus norvegicus
tcccggctccgtagtaatcatggcg

SEQ ID NO: 585286 - DNA, 25 bp, Rattus norvegicus
tcccggctccgttgtaatcatggcg

SEQ ID NO: 585287 - DNA, 25 bp, Rattus norvegicus
tcccggctcctcatgtgtttgaaga

SEQ ID NO: 585288 - DNA, 25 bp, Rattus norvegicus
tcccggctcctcttgtgtttgaaga

SEQ ID NO: 585289 - DNA, 25 bp, Rattus norvegicus
tcccgggaacctccacaggcagaga

SEQ ID NO: 585290 - DNA, 25 bp, Rattus norvegicus
tcccgggaacctgcacaggcagaga

SEQ ID NO: 585291 - DNA, 25 bp, Rattus norvegicus
tcccgggagtcacacgagtggattt

SEQ ID NO: 585292 - DNA, 25 bp, Rattus norvegicus
tcccgggagtcagacgagtggattt

SEQ ID NO: 585293 - DNA, 25 bp, Rattus norvegicus
tcccgggatggccacattggttaaa

SEQ ID NO: 585294 - DNA, 25 bp, Rattus norvegicus
tcccgggatggcgacattggttaaa

SEQ ID NO: 585295 - DNA, 25 bp, Rattus norvegicus
tcccgggcaggcaaatcagatacct

SEQ ID NO: 585296 - DNA, 25 bp, Rattus norvegicus
tcccgggcaggctaatcagatacct

SEQ ID NO: 585297 - DNA, 25 bp, Rattus norvegicus
tcccgggcgtcaaagctgagtggta

SEQ ID NO: 585298 - DNA, 25 bp, Rattus norvegicus
tcccgggcgtcatagctgagtggta

SEQ ID NO: 585299 - DNA, 25 bp, Rattus norvegicus
tcccgggtagaccaccatctgatgg

SEQ ID NO: 585300 - DNA, 25 bp, Rattus norvegicus
tcccgggtagacgaccatctgatgg

SEQ ID NO: 585301 - DNA, 25 bp, Rattus norvegicus
tcccgggtttagaccacagtaccag

SEQ ID NO: 585302 - DNA, 25 bp, Rattus norvegicus
tcccgggtttagtccacagtaccag

SEQ ID NO: 585303 - DNA, 25 bp, Rattus norvegicus
tcccggtaacatcctgagacttgca

SEQ ID NO: 585304 - DNA, 25 bp, Rattus norvegicus
tcccggtaacatgctgagacttgca

SEQ ID NO: 585305 - DNA, 25 bp, Rattus norvegicus
tcccggtactgtatttgttatgttg

SEQ ID NO: 585306 - DNA, 25 bp, Rattus norvegicus
tcccggtactgtttttgttatgttg

SEQ ID NO: 585307 - DNA, 25 bp, Rattus norvegicus
tcccggtcgtccagcgcatcgagga

SEQ ID NO: 585308 - DNA, 25 bp, Rattus norvegicus
tcccggtcgtcctgcgcatcgagga

SEQ ID NO: 585309 - DNA, 25 bp, Rattus norvegicus
tcccggtctgtacacatttgcttaa

SEQ ID NO: 585310 - DNA, 25 bp, Rattus norvegicus
tcccggtctgtagacatttgcttaa

SEQ ID NO: 585311 - DNA, 25 bp, Rattus norvegicus
tcccggttccttaattctacttatg

SEQ ID NO: 585312 - DNA, 25 bp, Rattus norvegicus
tcccggttcctttattctacttatg

SEQ ID NO: 585313 - DNA, 25 bp, Rattus norvegicus
tcccggttcttgagtgatttggctt

SEQ ID NO: 585314 - DNA, 25 bp, Rattus norvegicus
tcccggttcttgtgtgatttggctt

SEQ ID NO: 585315 - DNA, 25 bp, Rattus norvegicus
tcccgtaaacggagatagcgcagat

SEQ ID NO: 585316 - DNA, 25 bp, Rattus norvegicus
tcccgtaaacggtgatagcgcagat

SEQ ID NO: 585317 - DNA, 25 bp, Rattus norvegicus
tcccgtagagtgacaggttatgttc

SEQ ID NO: 585318 - DNA, 25 bp, Rattus norvegicus
tcccgtagagtgtcaggttatgttc

SEQ ID NO: 585319 - DNA, 25 bp, Rattus norvegicus
tcccgtatgtgaccatggacataaa

SEQ ID NO: 585320 - DNA, 25 bp, Rattus norvegicus
tcccgtatgtgagcatggacataaa

SEQ ID NO: 585321 - DNA, 25 bp, Rattus norvegicus
tcccgtatttaaaccactcttgctc

SEQ ID NO: 585322 - DNA, 25 bp, Rattus norvegicus
tcccgtatttaatccactcttgctc

SEQ ID NO: 585323 - DNA, 25 bp, Rattus norvegicus
tcccgtcaatgaaccaaagagcctt

SEQ ID NO: 585324 - DNA, 25 bp, Rattus norvegicus
tcccgtcaatgatccaaagagcctt

SEQ ID NO: 585325 - DNA, 25 bp, Rattus norvegicus
tcccgtcaggaccttgaggactttt

SEQ ID NO: 585326 - DNA, 25 bp, Rattus norvegicus
tcccgtcaggacgttgaggactttt

SEQ ID NO: 585327 - DNA, 25 bp, Rattus norvegicus
tcccgtcatctaatagttgaaacac

SEQ ID NO: 585328 - DNA, 25 bp, Rattus norvegicus
tcccgtcatctattagttgaaacac

SEQ ID NO: 585329 - DNA, 25 bp, Rattus norvegicus
tcccgtccttagcatcctgatggtg

SEQ ID NO: 585330 - DNA, 25 bp, Rattus norvegicus
tcccgtccttaggatcctgatggtg

SEQ ID NO: 585331 - DNA, 25 bp, Rattus norvegicus
tcccgtctgggacatttttgacagt

SEQ ID NO: 585332 - DNA, 25 bp, Rattus norvegicus
tcccgtctgggagatttttgacagt

SEQ ID NO: 585333 - DNA, 25 bp, Rattus norvegicus
tcccgtcttctgctcagagttcaaa

SEQ ID NO: 585334 - DNA, 25 bp, Rattus norvegicus
tcccgtcttctggtcagagttcaaa

SEQ ID NO: 585335 - DNA, 25 bp, Rattus norvegicus
tcccgtgacctcagcaaatggacag

SEQ ID NO: 585336 - DNA, 25 bp, Rattus norvegicus
tcccgtgacctctgcaaatggacag

SEQ ID NO: 585337 - DNA, 25 bp, Rattus norvegicus
tcccgtgactggacccattgagcag

SEQ ID NO: 585338 - DNA, 25 bp, Rattus norvegicus
tcccgtgactggtcccattgagcag

SEQ ID NO: 585339 - DNA, 25 bp, Rattus norvegicus
tcccgtgctttgacgaatcgttcta

SEQ ID NO: 585340 - DNA, 25 bp, Rattus norvegicus
tcccgtgctttgtcgaatcgttcta

SEQ ID NO: 585341 - DNA, 25 bp, Rattus norvegicus
tcccgtggaaccagtagctacaaat

SEQ ID NO: 585342 - DNA, 25 bp, Rattus norvegicus
tcccgtggaacctgtagctacaaat

SEQ ID NO: 585343 - DNA, 25 bp, Rattus norvegicus
tcccgtgtatttaatgattcctctg

SEQ ID NO: 585344 - DNA, 25 bp, Rattus norvegicus
tcccgtgtattttatgattcctctg

SEQ ID NO: 585345 - DNA, 25 bp, Rattus norvegicus
tcccgtgtttctagcctttgcaaaa

SEQ ID NO: 585346 - DNA, 25 bp, Rattus norvegicus
tcccgtgtttcttgcctttgcaaaa

SEQ ID NO: 585347 - DNA, 25 bp, Rattus norvegicus
tcccgttaggtgctttcctgtagaa

SEQ ID NO: 585348 - DNA, 25 bp, Rattus norvegicus
tcccgttaggtggtttcctgtagaa

SEQ ID NO: 585349 - DNA, 25 bp, Rattus norvegicus
tcccgttgtcatatcctttgttata

SEQ ID NO: 585350 - DNA, 25 bp, Rattus norvegicus
tcccgttgtcatttcctttgttata

SEQ ID NO: 585351 - DNA, 25 bp, Rattus norvegicus
tcccgtttgcccaaggtcttgcttg

SEQ ID NO: 585352 - DNA, 25 bp, Rattus norvegicus
tcccgtttgccctaggtcttgcttg

SEQ ID NO: 585353 - DNA, 25 bp, Rattus norvegicus
tccctaaaagttcgccgtgaggatt

SEQ ID NO: 585354 - DNA, 25 bp, Rattus norvegicus
tccctaaaagttggccgtgaggatt

SEQ ID NO: 585355 - DNA, 25 bp, Rattus norvegicus
tccctaaaccccacaatatttgtgt

SEQ ID NO: 585356 - DNA, 25 bp, Rattus norvegicus
tccctaaacccctcaatatttgtgt

SEQ ID NO: 585357 - DNA, 25 bp, Rattus norvegicus
tccctaaactggatctctgagcaac

SEQ ID NO: 585358 - DNA, 25 bp, Rattus norvegicus
tccctaaactggttctctgagcaac

SEQ ID NO: 585359 - DNA, 25 bp, Rattus norvegicus
tccctaacccagaattggccggagg

SEQ ID NO: 585360 - DNA, 25 bp, Rattus norvegicus
tccctaacccagatgatctccaatt

SEQ ID NO: 585361 - DNA, 25 bp, Rattus norvegicus
tccctaacccagtattggccggagg

SEQ ID NO: 585362 - DNA, 25 bp, Rattus norvegicus
tccctaacccagttgatctccaatt

SEQ ID NO: 585363 - DNA, 25 bp, Rattus norvegicus
tccctaaccctcagatttgcagtgg

SEQ ID NO: 585364 - DNA, 25 bp, Rattus norvegicus
tccctaaccctctgatttgcagtgg

SEQ ID NO: 585365 - DNA, 25 bp, Rattus norvegicus
tccctaacctgacccactgggaagg

SEQ ID NO: 585366 - DNA, 25 bp, Rattus norvegicus
tccctaacctgagccactgggaagg

SEQ ID NO: 585367 - DNA, 25 bp, Rattus norvegicus
tccctaactctcacatggcaaggag

SEQ ID NO: 585368 - DNA, 25 bp, Rattus norvegicus
tccctaactctccttgacacaaatg

SEQ ID NO: 585369 - DNA, 25 bp, Rattus norvegicus
tccctaactctcgttgacacaaatg

SEQ ID NO: 585370 - DNA, 25 bp, Rattus norvegicus
tccctaactctctcatggcaaggag

SEQ ID NO: 585371 - DNA, 25 bp, Rattus norvegicus
tccctaagctgtagagaccggtttt

SEQ ID NO: 585372 - DNA, 25 bp, Rattus norvegicus
tccctaagctgttgagaccggtttt

SEQ ID NO: 585373 - DNA, 25 bp, Rattus norvegicus
tccctaagggagaggcccccaggct

SEQ ID NO: 585374 - DNA, 25 bp, Rattus norvegicus
tccctaagggagtggcccccaggct

SEQ ID NO: 585375 - DNA, 25 bp, Rattus norvegicus
tccctaagttcccagagcaggagct

SEQ ID NO: 585376 - DNA, 25 bp, Rattus norvegicus
tccctaagttccgagagcaggagct

SEQ ID NO: 585377 - DNA, 25 bp, Rattus norvegicus
tccctaatcactaccaggctgcaaa

SEQ ID NO: 585378 - DNA, 25 bp, Rattus norvegicus
tccctaatcacttccaggctgcaaa

SEQ ID NO: 585379 - DNA, 25 bp, Rattus norvegicus
tccctaatttcccagtgtattgctc

SEQ ID NO: 585380 - DNA, 25 bp, Rattus norvegicus
tccctaatttccgagtgtattgctc

SEQ ID NO: 585381 - DNA, 25 bp, Rattus norvegicus
tccctacagcttaagagactccttt

SEQ ID NO: 585382 - DNA, 25 bp, Rattus norvegicus
tccctacagctttagagactccttt

SEQ ID NO: 585383 - DNA, 25 bp, Rattus norvegicus
tccctaccaatcataagttcaccat

SEQ ID NO: 585384 - DNA, 25 bp, Rattus norvegicus
tccctaccaatcttaagttcaccat

SEQ ID NO: 585385 - DNA, 25 bp, Rattus norvegicus
tccctaccagatacctggcttggaa

SEQ ID NO: 585386 - DNA, 25 bp, Rattus norvegicus
tccctaccagattcctggcttggaa

SEQ ID NO: 585387 - DNA, 25 bp, Rattus norvegicus
tccctacccctaatacttaatatat

SEQ ID NO: 585388 - DNA, 25 bp, Rattus norvegicus
tccctacccctattacttaatatat

SEQ ID NO: 585389 - DNA, 25 bp, Rattus norvegicus
tccctacctaatactcctattcaag

SEQ ID NO: 585390 - DNA, 25 bp, Rattus norvegicus
tccctacctaattctcctattcaag

SEQ ID NO: 585391 - DNA, 25 bp, Rattus norvegicus
tccctacctgctcttagatgctaag

SEQ ID NO: 585392 - DNA, 25 bp, Rattus norvegicus
tccctacctgctgttagatgctaag

SEQ ID NO: 585393 - DNA, 25 bp, Rattus norvegicus
tccctacgggtgcaaggagcaagaa

SEQ ID NO: 585394 - DNA, 25 bp, Rattus norvegicus
tccctacgggtggaaggagcaagaa

SEQ ID NO: 585395 - DNA, 25 bp, Rattus norvegicus
tccctactagcactttttcttttct

SEQ ID NO: 585396 - DNA, 25 bp, Rattus norvegicus
tccctactagcagtttttcttttct

SEQ ID NO: 585397 - DNA, 25 bp, Rattus norvegicus
tccctactcattaggtaccagtgtc

SEQ ID NO: 585398 - DNA, 25 bp, Rattus norvegicus
tccctactcatttggtaccagtgtc

SEQ ID NO: 585399 - DNA, 25 bp, Rattus norvegicus
tccctactcttcctgatatgcaagt

SEQ ID NO: 585400 - DNA, 25 bp, Rattus norvegicus
tccctactcttcgtgatatgcaagt

SEQ ID NO: 585401 - DNA, 25 bp, Rattus norvegicus
tccctagatttgaatttgcatgctt

SEQ ID NO: 585402 - DNA, 25 bp, Rattus norvegicus
tccctagatttgtatttgcatgctt

SEQ ID NO: 585403 - DNA, 25 bp, Rattus norvegicus
tccctagcccagattgactctttta

SEQ ID NO: 585404 - DNA, 25 bp, Rattus norvegicus
tccctagcccagtttgactctttta

SEQ ID NO: 585405 - DNA, 25 bp, Rattus norvegicus
tccctagccctactgcacatgataa

SEQ ID NO: 585406 - DNA, 25 bp, Rattus norvegicus
tccctagccctagtgcacatgataa

SEQ ID NO: 585407 - DNA, 25 bp, Rattus norvegicus
tccctagctgccatttaagtgacat

SEQ ID NO: 585408 - DNA, 25 bp, Rattus norvegicus
tccctagctgccttttaagtgacat

SEQ ID NO: 585409 - DNA, 25 bp, Rattus norvegicus
tccctaggccggagatcttggagat

SEQ ID NO: 585410 - DNA, 25 bp, Rattus norvegicus
tccctaggccggtgatcttggagat

SEQ ID NO: 585411 - DNA, 25 bp, Rattus norvegicus
tccctaggctgtctgctttatgcaa

SEQ ID NO: 585412 - DNA, 25 bp, Rattus norvegicus
tccctaggctgtgtgctttatgcaa

SEQ ID NO: 585413 - DNA, 25 bp, Rattus norvegicus
tccctagggtggcaagctgtgtaca

SEQ ID NO: 585414 - DNA, 25 bp, Rattus norvegicus
tccctagggtgggaagctgtgtaca

SEQ ID NO: 585415 - DNA, 25 bp, Rattus norvegicus
tccctagtaaccagagaatgcccaa

SEQ ID NO: 585416 - DNA, 25 bp, Rattus norvegicus
tccctagtaacctgagaatgcccaa

SEQ ID NO: 585417 - DNA, 25 bp, Rattus norvegicus
tccctagtaccaagctccttaaaaa

SEQ ID NO: 585418 - DNA, 25 bp, Rattus norvegicus
tccctagtaccatgctccttaaaaa

SEQ ID NO: 585419 - DNA, 25 bp, Rattus norvegicus
tccctagtctctatgctgtgatgca

SEQ ID NO: 585420 - DNA, 25 bp, Rattus norvegicus
tccctagtctctttgctgtgatgca

SEQ ID NO: 585421 - DNA, 25 bp, Rattus norvegicus
tccctagtgtgactcgtctgtccct

SEQ ID NO: 585422 - DNA, 25 bp, Rattus norvegicus
tccctagtgtgagtcgtctgtccct

SEQ ID NO: 585423 - DNA, 25 bp, Rattus norvegicus
tccctataaaacatccaaaatggca

SEQ ID NO: 585424 - DNA, 25 bp, Rattus norvegicus
tccctataaaacttccaaaatggca

SEQ ID NO: 585425 - DNA, 25 bp, Rattus norvegicus
tccctatacctacttcctaattctt

SEQ ID NO: 585426 - DNA, 25 bp, Rattus norvegicus
tccctatacctagttcctaattctt

SEQ ID NO: 585427 - DNA, 25 bp, Rattus norvegicus
tccctatactccctgaccagaagaa

SEQ ID NO: 585428 - DNA, 25 bp, Rattus norvegicus
tccctatactccgtgaccagaagaa

SEQ ID NO: 585429 - DNA, 25 bp, Rattus norvegicus
tccctatcagatccatgcctgtaag

SEQ ID NO: 585430 - DNA, 25 bp, Rattus norvegicus
tccctatcagatgcatgcctgtaag

SEQ ID NO: 585431 - DNA, 25 bp, Rattus norvegicus
tccctatcctgaacctactgtaaag

SEQ ID NO: 585432 - DNA, 25 bp, Rattus norvegicus
tccctatcctgatcctactgtaaag

SEQ ID NO: 585433 - DNA, 25 bp, Rattus norvegicus
tccctatgggatacgcctttggata

SEQ ID NO: 585434 - DNA, 25 bp, Rattus norvegicus
tccctatgggattcgcctttggata

SEQ ID NO: 585435 - DNA, 25 bp, Rattus norvegicus
tccctatttaccactttacacctat

SEQ ID NO: 585436 - DNA, 25 bp, Rattus norvegicus
tccctatttacctctttacacctat

SEQ ID NO: 585437 - DNA, 25 bp, Rattus norvegicus
tccctcaaaagcaacagaactgtgt

SEQ ID NO: 585438 - DNA, 25 bp, Rattus norvegicus
tccctcaaaagctacagaactgtgt

SEQ ID NO: 585439 - DNA, 25 bp, Rattus norvegicus
tccctcacactgaagtttcctaata

SEQ ID NO: 585440 - DNA, 25 bp, Rattus norvegicus
tccctcacactgtagtttcctaata

SEQ ID NO: 585441 - DNA, 25 bp, Rattus norvegicus
tccctcaccactctgacataggaat

SEQ ID NO: 585442 - DNA, 25 bp, Rattus norvegicus
tccctcaccactgtgacataggaat

SEQ ID NO: 585443 - DNA, 25 bp, Rattus norvegicus
tccctcaccgccctgaatttattta

SEQ ID NO: 585444 - DNA, 25 bp, Rattus norvegicus
tccctcaccgccgtgaatttattta

SEQ ID NO: 585445 - DNA, 25 bp, Rattus norvegicus
tccctcactgtacgagagctagtat

SEQ ID NO: 585446 - DNA, 25 bp, Rattus norvegicus
tccctcactgtaggagagctagtat

SEQ ID NO: 585447 - DNA, 25 bp, Rattus norvegicus
tccctcagattcctaccttgagttc

SEQ ID NO: 585448 - DNA, 25 bp, Rattus norvegicus
tccctcagattcgtaccttgagttc

SEQ ID NO: 585449 - DNA, 25 bp, Rattus norvegicus
tccctcagcctgaaaacttttatct

SEQ ID NO: 585450 - DNA, 25 bp, Rattus norvegicus
tccctcagcctgtaaacttttatct

SEQ ID NO: 585451 - DNA, 25 bp, Rattus norvegicus
tccctcagctaacttctacttggta

SEQ ID NO: 585452 - DNA, 25 bp, Rattus norvegicus
tccctcagctaagttctacttggta

SEQ ID NO: 585453 - DNA, 25 bp, Rattus norvegicus
tccctcagggtcacgtgtcctcctg

SEQ ID NO: 585454 - DNA, 25 bp, Rattus norvegicus
tccctcagggtctcgtgtcctcctg

SEQ ID NO: 585455 - DNA, 25 bp, Rattus norvegicus
tccctcagtctgaattaagtcctca

SEQ ID NO: 585456 - DNA, 25 bp, Rattus norvegicus
tccctcagtctgtattaagtcctca

SEQ ID NO: 585457 - DNA, 25 bp, Rattus norvegicus
tccctcagttttccagcttgaagtg

SEQ ID NO: 585458 - DNA, 25 bp, Rattus norvegicus
tccctcagttttctccagacaaaag

SEQ ID NO: 585459 - DNA, 25 bp, Rattus norvegicus
tccctcagttttgcagcttgaagtg

SEQ ID NO: 585460 - DNA, 25 bp, Rattus norvegicus
tccctcagttttgtccagacaaaag

SEQ ID NO: 585461 - DNA, 25 bp, Rattus norvegicus
tccctcataccaacagaaatgccct

SEQ ID NO: 585462 - DNA, 25 bp, Rattus norvegicus
tccctcataccatcagaaatgccct

SEQ ID NO: 585463 - DNA, 25 bp, Rattus norvegicus
tccctcataccgactagatatctgg

SEQ ID NO: 585464 - DNA, 25 bp, Rattus norvegicus
tccctcataccgtctagatatctgg

SEQ ID NO: 585465 - DNA, 25 bp, Rattus norvegicus
tccctcatctgccttcatattgaag

SEQ ID NO: 585466 - DNA, 25 bp, Rattus norvegicus
tccctcatctgcgttcatattgaag

SEQ ID NO: 585467 - DNA, 25 bp, Rattus norvegicus
tccctcatgctccagacactaaaga

SEQ ID NO: 585468 - DNA, 25 bp, Rattus norvegicus
tccctcatgctcgagacactaaaga

SEQ ID NO: 585469 - DNA, 25 bp, Rattus norvegicus
tccctcatgtagatcccagtggtca

SEQ ID NO: 585470 - DNA, 25 bp, Rattus norvegicus
tccctcatgtagttcccagtggtca

SEQ ID NO: 585471 - DNA, 25 bp, Rattus norvegicus
tccctcattgaaagttctcatcata

SEQ ID NO: 585472 - DNA, 25 bp, Rattus norvegicus
tccctcattgaatgttctcatcata

SEQ ID NO: 585473 - DNA, 25 bp, Rattus norvegicus
tccctcattgcactgctttgagaca

SEQ ID NO: 585474 - DNA, 25 bp, Rattus norvegicus
tccctcattgcagtgctttgagaca

SEQ ID NO: 585475 - DNA, 25 bp, Rattus norvegicus
tccctcatttgacactggtatagat

SEQ ID NO: 585476 - DNA, 25 bp, Rattus norvegicus
tccctcatttgagactggtatagat

SEQ ID NO: 585477 - DNA, 25 bp, Rattus norvegicus
tccctccacctcaggtaactattta

SEQ ID NO: 585478 - DNA, 25 bp, Rattus norvegicus
tccctccacctctggtaactattta

SEQ ID NO: 585479 - DNA, 25 bp, Rattus norvegicus
tccctccagatacttggtgggtgtt

SEQ ID NO: 585480 - DNA, 25 bp, Rattus norvegicus
tccctccagatagttggtgggtgtt

SEQ ID NO: 585481 - DNA, 25 bp, Rattus norvegicus
tccctccagggacggcggcagtatt

SEQ ID NO: 585482 - DNA, 25 bp, Rattus norvegicus
tccctccagggagggcggcagtatt

SEQ ID NO: 585483 - DNA, 25 bp, Rattus norvegicus
tccctccatgtaaactccttagttg

SEQ ID NO: 585484 - DNA, 25 bp, Rattus norvegicus
tccctccatgtatactccttagttg

SEQ ID NO: 585485 - DNA, 25 bp, Rattus norvegicus
tccctccattaaatttgtcaccgtt

SEQ ID NO: 585486 - DNA, 25 bp, Rattus norvegicus
tccctccattaattttgtcaccgtt

SEQ ID NO: 585487 - DNA, 25 bp, Rattus norvegicus
tccctccatttcatcattttagcag

SEQ ID NO: 585488 - DNA, 25 bp, Rattus norvegicus
tccctccatttcttcattttagcag

SEQ ID NO: 585489 - DNA, 25 bp, Rattus norvegicus
tccctccatttgaaacacaggatta

SEQ ID NO: 585490 - DNA, 25 bp, Rattus norvegicus
tccctccatttgtaacacaggatta

SEQ ID NO: 585491 - DNA, 25 bp, Rattus norvegicus
tccctcccaaggaatcatcttttaa

SEQ ID NO: 585492 - DNA, 25 bp, Rattus norvegicus
tccctcccaaggtatcatcttttaa

SEQ ID NO: 585493 - DNA, 25 bp, Rattus norvegicus
tccctcccacctagattgcaaaagt

SEQ ID NO: 585494 - DNA, 25 bp, Rattus norvegicus
tccctcccaccttgattgcaaaagt

SEQ ID NO: 585495 - DNA, 25 bp, Rattus norvegicus
tccctcccactcagtaaagacaaat

SEQ ID NO: 585496 - DNA, 25 bp, Rattus norvegicus
tccctcccactctgtaaagacaaat

SEQ ID NO: 585497 - DNA, 25 bp, Rattus norvegicus
tccctcccagttctggcatgcagga

SEQ ID NO: 585498 - DNA, 25 bp, Rattus norvegicus
tccctcccagttgtggcatgcagga

SEQ ID NO: 585499 - DNA, 25 bp, Rattus norvegicus
tccctcccattcagcggaaggactg

SEQ ID NO: 585500 - DNA, 25 bp, Rattus norvegicus
tccctcccattctgcggaaggactg

SEQ ID NO: 585501 - DNA, 25 bp, Rattus norvegicus
tccctccccataagtcgtttacaag

SEQ ID NO: 585502 - DNA, 25 bp, Rattus norvegicus
tccctccccatatgtcgtttacaag

SEQ ID NO: 585503 - DNA, 25 bp, Rattus norvegicus
tccctccccgtgaagaatgtattgt

SEQ ID NO: 585504 - DNA, 25 bp, Rattus norvegicus
tccctccccgtgtagaatgtattgt

SEQ ID NO: 585505 - DNA, 25 bp, Rattus norvegicus
tccctcccgtctcgttgtaggaata

SEQ ID NO: 585506 - DNA, 25 bp, Rattus norvegicus
tccctcccgtctggttgtaggaata

SEQ ID NO: 585507 - DNA, 25 bp, Rattus norvegicus
tccctccctcatatgacactggtat

SEQ ID NO: 585508 - DNA, 25 bp, Rattus norvegicus
tccctccctcatttgacactggtat

SEQ ID NO: 585509 - DNA, 25 bp, Rattus norvegicus
tccctccctcctcagaagtaaagga

SEQ ID NO: 585510 - DNA, 25 bp, Rattus norvegicus
tccctccctcctgagaagtaaagga

SEQ ID NO: 585511 - DNA, 25 bp, Rattus norvegicus
tccctccctgagattgtgtatcatg

SEQ ID NO: 585512 - DNA, 25 bp, Rattus norvegicus
tccctccctgagtttgtgtatcatg

SEQ ID NO: 585513 - DNA, 25 bp, Rattus norvegicus
tccctcccttccacatggattgaaa

SEQ ID NO: 585514 - DNA, 25 bp, Rattus norvegicus
tccctcccttcctcatggattgaaa

SEQ ID NO: 585515 - DNA, 25 bp, Rattus norvegicus
tccctccgaattcttggcagtgcaa

SEQ ID NO: 585516 - DNA, 25 bp, Rattus norvegicus
tccctccgaattgttggcagtgcaa

SEQ ID NO: 585517 - DNA, 25 bp, Rattus norvegicus
tccctccggccgcatagtggtaggt

SEQ ID NO: 585518 - DNA, 25 bp, Rattus norvegicus
tccctccggccggatagtggtaggt

SEQ ID NO: 585519 - DNA, 25 bp, Rattus norvegicus
tccctccgtcttattgttacattgg

SEQ ID NO: 585520 - DNA, 25 bp, Rattus norvegicus
tccctccgtctttttgttacattgg

SEQ ID NO: 585521 - DNA, 25 bp, Rattus norvegicus
tccctcctaaggagtgctcctaaat

SEQ ID NO: 585522 - DNA, 25 bp, Rattus norvegicus
tccctcctaaggtgtgctcctaaat

SEQ ID NO: 585523 - DNA, 25 bp, Rattus norvegicus
tccctcctacctactgaagtggtga

SEQ ID NO: 585524 - DNA, 25 bp, Rattus norvegicus
tccctcctaccttctgaagtggtga

SEQ ID NO: 585525 - DNA, 25 bp, Rattus norvegicus
tccctcctacttccaatgatgactg

SEQ ID NO: 585526 - DNA, 25 bp, Rattus norvegicus
tccctcctacttgcaatgatgactg

SEQ ID NO: 585527 - DNA, 25 bp, Rattus norvegicus
tccctcctccatatttcatgttgaa

SEQ ID NO: 585528 - DNA, 25 bp, Rattus norvegicus
tccctcctccatttttcatgttgaa

SEQ ID NO: 585529 - DNA, 25 bp, Rattus norvegicus
tccctcctccttattattatgcatt

SEQ ID NO: 585530 - DNA, 25 bp, Rattus norvegicus
tccctcctcctttttattatgcatt

SEQ ID NO: 585531 - DNA, 25 bp, Rattus norvegicus
tccctcctgacgacgaggactgaaa

SEQ ID NO: 585532 - DNA, 25 bp, Rattus norvegicus
tccctcctgacgtcgaggactgaaa

SEQ ID NO: 585533 - DNA, 25 bp, Rattus norvegicus
tccctcctgtgcaaccaagatatat

SEQ ID NO: 585534 - DNA, 25 bp, Rattus norvegicus
tccctcctgtgcagtcaagtttgtc

SEQ ID NO: 585535 - DNA, 25 bp, Rattus norvegicus
tccctcctgtgctaccaagatatat

SEQ ID NO: 585536 - DNA, 25 bp, Rattus norvegicus
tccctcctgtgctgtcaagtttgtc

SEQ ID NO: 585537 - DNA, 25 bp, Rattus norvegicus
tccctcctgtgtatgcagtagcaga

SEQ ID NO: 585538 - DNA, 25 bp, Rattus norvegicus
tccctcctgtgtcgcttagaatggc

SEQ ID NO: 585539 - DNA, 25 bp, Rattus norvegicus
tccctcctgtgtggcttagaatggc

SEQ ID NO: 585540 - DNA, 25 bp, Rattus norvegicus
tccctcctgtgtttgcagtagcaga

SEQ ID NO: 585541 - DNA, 25 bp, Rattus norvegicus
tccctccttcataccagtaaagtgt

SEQ ID NO: 585542 - DNA, 25 bp, Rattus norvegicus
tccctccttcattccagtaaagtgt

SEQ ID NO: 585543 - DNA, 25 bp, Rattus norvegicus
tccctccttggaaaatttgctgcaa

SEQ ID NO: 585544 - DNA, 25 bp, Rattus norvegicus
tccctccttggataatttgctgcaa

SEQ ID NO: 585545 - DNA, 25 bp, Rattus norvegicus
tccctcctttagacccaaaacattg

SEQ ID NO: 585546 - DNA, 25 bp, Rattus norvegicus
tccctcctttagtcccaaaacattg

SEQ ID NO: 585547 - DNA, 25 bp, Rattus norvegicus
tccctcgccattacctggagaaagg

SEQ ID NO: 585548 - DNA, 25 bp, Rattus norvegicus
tccctcgccatttcctggagaaagg

SEQ ID NO: 585549 - DNA, 25 bp, Rattus norvegicus
tccctcgcctttatattttcagaag

SEQ ID NO: 585550 - DNA, 25 bp, Rattus norvegicus
tccctcgcctttttattttcagaag

SEQ ID NO: 585551 - DNA, 25 bp, Rattus norvegicus
tccctcgctgctctgtagaaatgtg

SEQ ID NO: 585552 - DNA, 25 bp, Rattus norvegicus
tccctcgctgctgtgtagaaatgtg

SEQ ID NO: 585553 - DNA, 25 bp, Rattus norvegicus
tccctcggtaaaaagcctgacttgt

SEQ ID NO: 585554 - DNA, 25 bp, Rattus norvegicus
tccctcggtaaatagcctgacttgt

SEQ ID NO: 585555 - DNA, 25 bp, Rattus norvegicus
tccctcgtacccaggatcagtgaaa

SEQ ID NO: 585556 - DNA, 25 bp, Rattus norvegicus
tccctcgtaccctggatcagtgaaa

SEQ ID NO: 585557 - DNA, 25 bp, Rattus norvegicus
tccctcgtaccgcattatttactga

SEQ ID NO: 585558 - DNA, 25 bp, Rattus norvegicus
tccctcgtaccggattatttactga

SEQ ID NO: 585559 - DNA, 25 bp, Rattus norvegicus
tccctcgtagagatgaagctgtttt

SEQ ID NO: 585560 - DNA, 25 bp, Rattus norvegicus
tccctcgtagagttgaagctgtttt

SEQ ID NO: 585561 - DNA, 25 bp, Rattus norvegicus
tccctcgtctttccattttagacag

SEQ ID NO: 585562 - DNA, 25 bp, Rattus norvegicus
tccctcgtctttgcattttagacag

SEQ ID NO: 585563 - DNA, 25 bp, Rattus norvegicus
tccctcgtggttctcaggtctcaga

SEQ ID NO: 585564 - DNA, 25 bp, Rattus norvegicus
tccctcgtggttgtcaggtctcaga

SEQ ID NO: 585565 - DNA, 25 bp, Rattus norvegicus
tccctcgtgtctattactcgtgtta

SEQ ID NO: 585566 - DNA, 25 bp, Rattus norvegicus
tccctcgtgtcttttactcgtgtta

SEQ ID NO: 585567 - DNA, 25 bp, Rattus norvegicus
tccctctacgtcatgagttccgggt

SEQ ID NO: 585568 - DNA, 25 bp, Rattus norvegicus
tccctctacgtcttgagttccgggt

SEQ ID NO: 585569 - DNA, 25 bp, Rattus norvegicus
tccctctactccaggttgattgttg

SEQ ID NO: 585570 - DNA, 25 bp, Rattus norvegicus
tccctctactcctggttgattgttg

SEQ ID NO: 585571 - DNA, 25 bp, Rattus norvegicus
tccctctcaaagactctggtatgtg

SEQ ID NO: 585572 - DNA, 25 bp, Rattus norvegicus
tccctctcaaagtctctggtatgtg

SEQ ID NO: 585573 - DNA, 25 bp, Rattus norvegicus
tccctctcctgaatgctgtgattac

SEQ ID NO: 585574 - DNA, 25 bp, Rattus norvegicus
tccctctcctgattgctgtgattac

SEQ ID NO: 585575 - DNA, 25 bp, Rattus norvegicus
tccctctcgggaaccagaatgtttt

SEQ ID NO: 585576 - DNA, 25 bp, Rattus norvegicus
tccctctcgggatccagaatgtttt

SEQ ID NO: 585577 - DNA, 25 bp, Rattus norvegicus
tccctctcgtccaagatgtgatggg

SEQ ID NO: 585578 - DNA, 25 bp, Rattus norvegicus
tccctctcgtcctagatgtgatggg

SEQ ID NO: 585579 - DNA, 25 bp, Rattus norvegicus
tccctctctggcatcgtaataagtg

SEQ ID NO: 585580 - DNA, 25 bp, Rattus norvegicus
tccctctctggcttcgtaataagtg

SEQ ID NO: 585581 - DNA, 25 bp, Rattus norvegicus
tccctctctgtcaatctgatatgct

SEQ ID NO: 585582 - DNA, 25 bp, Rattus norvegicus
tccctctctgtctatctgatatgct

SEQ ID NO: 585583 - DNA, 25 bp, Rattus norvegicus
tccctctgacgcaggttagcattga

SEQ ID NO: 585584 - DNA, 25 bp, Rattus norvegicus
tccctctgacgctggttagcattga

SEQ ID NO: 585585 - DNA, 25 bp, Rattus norvegicus
tccctctgagctacctgtaaatctt

SEQ ID NO: 585586 - DNA, 25 bp, Rattus norvegicus
tccctctgagcttcctgtaaatctt

SEQ ID NO: 585587 - DNA, 25 bp, Rattus norvegicus
tccctctgccatatcttgcaaatgt

SEQ ID NO: 585588 - DNA, 25 bp, Rattus norvegicus
tccctctgccatttcttgcaaatgt

SEQ ID NO: 585589 - DNA, 25 bp, Rattus norvegicus
tccctctgcgtacattgttcaactg

SEQ ID NO: 585590 - DNA, 25 bp, Rattus norvegicus
tccctctgcgtagattgttcaactg

SEQ ID NO: 585591 - DNA, 25 bp, Rattus norvegicus
tccctctgctggaatttggatggct

SEQ ID NO: 585592 - DNA, 25 bp, Rattus norvegicus
tccctctgctggtatttggatggct

SEQ ID NO: 585593 - DNA, 25 bp, Rattus norvegicus
tccctctgctgtctctaaggatgga

SEQ ID NO: 585594 - DNA, 25 bp, Rattus norvegicus
tccctctgctgtgtctaaggatgga

SEQ ID NO: 585595 - DNA, 25 bp, Rattus norvegicus
tccctctgctttagcggcttaaaaa

SEQ ID NO: 585596 - DNA, 25 bp, Rattus norvegicus
tccctctgcttttgcggcttaaaaa

SEQ ID NO: 585597 - DNA, 25 bp, Rattus norvegicus
tccctctggaagaggagctgttctc

SEQ ID NO: 585598 - DNA, 25 bp, Rattus norvegicus
tccctctggaagtggagctgttctc

SEQ ID NO: 585599 - DNA, 25 bp, Rattus norvegicus
tccctctggccaagtcgattggaag

SEQ ID NO: 585600 - DNA, 25 bp, Rattus norvegicus
tccctctggccatgtcgattggaag

SEQ ID NO: 585601 - DNA, 25 bp, Rattus norvegicus
tccctctggcctagggcactttcta

SEQ ID NO: 585602 - DNA, 25 bp, Rattus norvegicus
tccctctggccttgggcactttcta

SEQ ID NO: 585603 - DNA, 25 bp, Rattus norvegicus
tccctctggctgcaatatagacatg

SEQ ID NO: 585604 - DNA, 25 bp, Rattus norvegicus
tccctctggctggaatatagacatg

SEQ ID NO: 585605 - DNA, 25 bp, Rattus norvegicus
tccctctggtatctgcttgaatgtc

SEQ ID NO: 585606 - DNA, 25 bp, Rattus norvegicus
tccctctggtatgtgcttgaatgtc

SEQ ID NO: 585607 - DNA, 25 bp, Rattus norvegicus
tccctctgtactaacacaatctgtg

SEQ ID NO: 585608 - DNA, 25 bp, Rattus norvegicus
tccctctgtacttacacaatctgtg

SEQ ID NO: 585609 - DNA, 25 bp, Rattus norvegicus
tccctctgtcaaacactaaccaagg

SEQ ID NO: 585610 - DNA, 25 bp, Rattus norvegicus
tccctctgtcaatcactaaccaagg

SEQ ID NO: 585611 - DNA, 25 bp, Rattus norvegicus
tccctctgtcccaagatgacttgcg

SEQ ID NO: 585612 - DNA, 25 bp, Rattus norvegicus
tccctctgtccccatgggtcatggg

SEQ ID NO: 585613 - DNA, 25 bp, Rattus norvegicus
tccctctgtcccgatgggtcatggg

SEQ ID NO: 585614 - DNA, 25 bp, Rattus norvegicus
tccctctgtccctagatgacttgcg

SEQ ID NO: 585615 - DNA, 25 bp, Rattus norvegicus
tccctctgtcctattcaggagtgaa

SEQ ID NO: 585616 - DNA, 25 bp, Rattus norvegicus
tccctctgtccttttcaggagtgaa

SEQ ID NO: 585617 - DNA, 25 bp, Rattus norvegicus
tccctctgttatcgctcgaagaaca

SEQ ID NO: 585618 - DNA, 25 bp, Rattus norvegicus
tccctctgttatggctcgaagaaca

SEQ ID NO: 585619 - DNA, 25 bp, Rattus norvegicus
tccctctgttttctcaaagttctgt

SEQ ID NO: 585620 - DNA, 25 bp, Rattus norvegicus
tccctctgttttgtcaaagttctgt

SEQ ID NO: 585621 - DNA, 25 bp, Rattus norvegicus
tccctcttaatcacgttctgtaatg

SEQ ID NO: 585622 - DNA, 25 bp, Rattus norvegicus
tccctcttaatctcgttctgtaatg

SEQ ID NO: 585623 - DNA, 25 bp, Rattus norvegicus
tccctcttagggaccaagcaattgc

SEQ ID NO: 585624 - DNA, 25 bp, Rattus norvegicus
tccctcttagggtccaagcaattgc

SEQ ID NO: 585625 - DNA, 25 bp, Rattus norvegicus
tccctcttattcattgtgttatgaa

SEQ ID NO: 585626 - DNA, 25 bp, Rattus norvegicus
tccctcttattctttgtgttatgaa

SEQ ID NO: 585627 - DNA, 25 bp, Rattus norvegicus
tccctcttctcgatagctagctcta

SEQ ID NO: 585628 - DNA, 25 bp, Rattus norvegicus
tccctcttctcgttagctagctcta

SEQ ID NO: 585629 - DNA, 25 bp, Rattus norvegicus
tccctcttctctagacttgtatttt

SEQ ID NO: 585630 - DNA, 25 bp, Rattus norvegicus
tccctcttctcttgacttgtatttt

SEQ ID NO: 585631 - DNA, 25 bp, Rattus norvegicus
tccctcttcttcaaccaaaaagcaa

SEQ ID NO: 585632 - DNA, 25 bp, Rattus norvegicus
tccctcttcttctaccaaaaagcaa

SEQ ID NO: 585633 - DNA, 25 bp, Rattus norvegicus
tccctcttgacactccttgacagga

SEQ ID NO: 585634 - DNA, 25 bp, Rattus norvegicus
tccctcttgacagtccttgacagga

SEQ ID NO: 585635 - DNA, 25 bp, Rattus norvegicus
tccctcttgattataactttccaaa

SEQ ID NO: 585636 - DNA, 25 bp, Rattus norvegicus
tccctcttgattttaactttccaaa

SEQ ID NO: 585637 - DNA, 25 bp, Rattus norvegicus
tccctcttggatcctgagaacgttt

SEQ ID NO: 585638 - DNA, 25 bp, Rattus norvegicus
tccctcttggatgctgagaacgttt

SEQ ID NO: 585639 - DNA, 25 bp, Rattus norvegicus
tccctcttgtctcctattgtgtaaa

SEQ ID NO: 585640 - DNA, 25 bp, Rattus norvegicus
tccctcttgtctgctattgtgtaaa

SEQ ID NO: 585641 - DNA, 25 bp, Rattus norvegicus
tccctctttctactacttactactt

SEQ ID NO: 585642 - DNA, 25 bp, Rattus norvegicus
tccctctttctagtacttactactt

SEQ ID NO: 585643 - DNA, 25 bp, Rattus norvegicus
tccctcttttctctggctcattaaa

SEQ ID NO: 585644 - DNA, 25 bp, Rattus norvegicus
tccctcttttctgtggctcattaaa

SEQ ID NO: 585645 - DNA, 25 bp, Rattus norvegicus
tccctgaacgctaagtttccttgaa

SEQ ID NO: 585646 - DNA, 25 bp, Rattus norvegicus
tccctgaacgcttagtttccttgaa

SEQ ID NO: 585647 - DNA, 25 bp, Rattus norvegicus
tccctgaagcttcctatctgttaat

SEQ ID NO: 585648 - DNA, 25 bp, Rattus norvegicus
tccctgaagcttgctatctgttaat

SEQ ID NO: 585649 - DNA, 25 bp, Rattus norvegicus
tccctgaattttcgctctcagagag

SEQ ID NO: 585650 - DNA, 25 bp, Rattus norvegicus
tccctgaattttggctctcagagag

SEQ ID NO: 585651 - DNA, 25 bp, Rattus norvegicus
tccctgacaggcatgtgcagtcaat

SEQ ID NO: 585652 - DNA, 25 bp, Rattus norvegicus
tccctgacaggcttgtgcagtcaat

SEQ ID NO: 585653 - DNA, 25 bp, Rattus norvegicus
tccctgacgctcctagttgatgaag

SEQ ID NO: 585654 - DNA, 25 bp, Rattus norvegicus
tccctgacgctcgtagttgatgaag

SEQ ID NO: 585655 - DNA, 25 bp, Rattus norvegicus
tccctgactcctaacacttattaat

SEQ ID NO: 585656 - DNA, 25 bp, Rattus norvegicus
tccctgactccttacacttattaat

SEQ ID NO: 585657 - DNA, 25 bp, Rattus norvegicus
tccctgactcggcagaggcgctgca

SEQ ID NO: 585658 - DNA, 25 bp, Rattus norvegicus
tccctgactcgggagaggcgctgca

SEQ ID NO: 585659 - DNA, 25 bp, Rattus norvegicus
tccctgactgagctgtgccatgtgg

SEQ ID NO: 585660 - DNA, 25 bp, Rattus norvegicus
tccctgactgaggtgtgccatgtgg

SEQ ID NO: 585661 - DNA, 25 bp, Rattus norvegicus
tccctgactttacctgccttaatat

SEQ ID NO: 585662 - DNA, 25 bp, Rattus norvegicus
tccctgactttagctgccttaatat

SEQ ID NO: 585663 - DNA, 25 bp, Rattus norvegicus
tccctgagactcctgagccagaatc

SEQ ID NO: 585664 - DNA, 25 bp, Rattus norvegicus
tccctgagactcgtgagccagaatc

SEQ ID NO: 585665 - DNA, 25 bp, Rattus norvegicus
tccctgagagtgcaaggtgtgtccc

SEQ ID NO: 585666 - DNA, 25 bp, Rattus norvegicus
tccctgagagtggaaggtgtgtccc

SEQ ID NO: 585667 - DNA, 25 bp, Rattus norvegicus
tccctgagatcacacagtggaagta

SEQ ID NO: 585668 - DNA, 25 bp, Rattus norvegicus
tccctgagatcagacagtggaagta

SEQ ID NO: 585669 - DNA, 25 bp, Rattus norvegicus
tccctgagatccacatgattaaagg

SEQ ID NO: 585670 - DNA, 25 bp, Rattus norvegicus
tccctgagatcctcatgattaaagg

SEQ ID NO: 585671 - DNA, 25 bp, Rattus norvegicus
tccctgagccttatacatctgtata

SEQ ID NO: 585672 - DNA, 25 bp, Rattus norvegicus
tccctgagccttttacatctgtata

SEQ ID NO: 585673 - DNA, 25 bp, Rattus norvegicus
tccctgagggtaacaacttcgtgca

SEQ ID NO: 585674 - DNA, 25 bp, Rattus norvegicus
tccctgagggtatcaacttcgtgca

SEQ ID NO: 585675 - DNA, 25 bp, Rattus norvegicus
tccctgagtagcagaagatgatgac

SEQ ID NO: 585676 - DNA, 25 bp, Rattus norvegicus
tccctgagtagctgaagatgatgac

SEQ ID NO: 585677 - DNA, 25 bp, Rattus norvegicus
tccctgagtgagaaccgtggtgtcc

SEQ ID NO: 585678 - DNA, 25 bp, Rattus norvegicus
tccctgagtgagtaccgtggtgtcc

SEQ ID NO: 585679 - DNA, 25 bp, Rattus norvegicus
tccctgatatttacggcacaagtag

SEQ ID NO: 585680 - DNA, 25 bp, Rattus norvegicus
tccctgatattttcggcacaagtag

SEQ ID NO: 585681 - DNA, 25 bp, Rattus norvegicus
tccctgatggacctgataaatccag

SEQ ID NO: 585682 - DNA, 25 bp, Rattus norvegicus
tccctgatggacgtgataaatccag

SEQ ID NO: 585683 - DNA, 25 bp, Rattus norvegicus
tccctgatggctatggcattgcata

SEQ ID NO: 585684 - DNA, 25 bp, Rattus norvegicus
tccctgatggctttggcattgcata

SEQ ID NO: 585685 - DNA, 25 bp, Rattus norvegicus
tccctgattcccagaatgatctcat

SEQ ID NO: 585686 - DNA, 25 bp, Rattus norvegicus
tccctgattccctgaatgatctcat

SEQ ID NO: 585687 - DNA, 25 bp, Rattus norvegicus
tccctgcaactgcagagtctggtag

SEQ ID NO: 585688 - DNA, 25 bp, Rattus norvegicus
tccctgcaactggagagtctggtag

SEQ ID NO: 585689 - DNA, 25 bp, Rattus norvegicus
tccctgcaacttatatctctcaaga

SEQ ID NO: 585690 - DNA, 25 bp, Rattus norvegicus
tccctgcaacttttatctctcaaga

SEQ ID NO: 585691 - DNA, 25 bp, Rattus norvegicus
tccctgcaggttcagttcacattgt

SEQ ID NO: 585692 - DNA, 25 bp, Rattus norvegicus
tccctgcaggttgagttcacattgt

SEQ ID NO: 585693 - DNA, 25 bp, Rattus norvegicus
tccctgcatccgctcatagtaaact

SEQ ID NO: 585694 - DNA, 25 bp, Rattus norvegicus
tccctgcatccggtcatagtaaact

SEQ ID NO: 585695 - DNA, 25 bp, Rattus norvegicus
tccctgcatgctactttaaatgtca

SEQ ID NO: 585696 - DNA, 25 bp, Rattus norvegicus
tccctgcatgctcagattgtctaca

SEQ ID NO: 585697 - DNA, 25 bp, Rattus norvegicus
tccctgcatgctgagattgtctaca

SEQ ID NO: 585698 - DNA, 25 bp, Rattus norvegicus
tccctgcatgcttctttaaatgtca

SEQ ID NO: 585699 - DNA, 25 bp, Rattus norvegicus
tccctgcattatccaaccatagtga

SEQ ID NO: 585700 - DNA, 25 bp, Rattus norvegicus
tccctgcattatgcaaccatagtga

SEQ ID NO: 585701 - DNA, 25 bp, Rattus norvegicus
tccctgccagctacagctattgtga

SEQ ID NO: 585702 - DNA, 25 bp, Rattus norvegicus
tccctgccagcttcagctattgtga

SEQ ID NO: 585703 - DNA, 25 bp, Rattus norvegicus
tccctgccatgtagcttttatattc

SEQ ID NO: 585704 - DNA, 25 bp, Rattus norvegicus
tccctgccatgttgcttttatattc

SEQ ID NO: 585705 - DNA, 25 bp, Rattus norvegicus
tccctgccctacatgaagatggtct

SEQ ID NO: 585706 - DNA, 25 bp, Rattus norvegicus
tccctgccctacttgaagatggtct

SEQ ID NO: 585707 - DNA, 25 bp, Rattus norvegicus
tccctgcccttaatgatgccatcat

SEQ ID NO: 585708 - DNA, 25 bp, Rattus norvegicus
tccctgcccttattgatgccatcat

SEQ ID NO: 585709 - DNA, 25 bp, Rattus norvegicus
tccctgccgcatctgtaactggaag

SEQ ID NO: 585710 - DNA, 25 bp, Rattus norvegicus
tccctgccgcatgtgtaactggaag

SEQ ID NO: 585711 - DNA, 25 bp, Rattus norvegicus
tccctgcctgatataagctttgtca

SEQ ID NO: 585712 - DNA, 25 bp, Rattus norvegicus
tccctgcctgatttaagctttgtca

SEQ ID NO: 585713 - DNA, 25 bp, Rattus norvegicus
tccctgcctggtccctattaaatgt

SEQ ID NO: 585714 - DNA, 25 bp, Rattus norvegicus
tccctgcctggtgcctattaaatgt

SEQ ID NO: 585715 - DNA, 25 bp, Rattus norvegicus
tccctgcctttgaaactccatttta

SEQ ID NO: 585716 - DNA, 25 bp, Rattus norvegicus
tccctgcctttgtaactccatttta

SEQ ID NO: 585717 - DNA, 25 bp, Rattus norvegicus
tccctgccttttcctgtttttaatg

SEQ ID NO: 585718 - DNA, 25 bp, Rattus norvegicus
tccctgccttttgctgtttttaatg

SEQ ID NO: 585719 - DNA, 25 bp, Rattus norvegicus
tccctgcgacttaactggtacccaa

SEQ ID NO: 585720 - DNA, 25 bp, Rattus norvegicus
tccctgcgactttactggtacccaa

SEQ ID NO: 585721 - DNA, 25 bp, Rattus norvegicus
tccctgcggttccatgacaaacctg

SEQ ID NO: 585722 - DNA, 25 bp, Rattus norvegicus
tccctgcggttcgatgacaaacctg

SEQ ID NO: 585723 - DNA, 25 bp, Rattus norvegicus
tccctgctactgaccagatgtgtgt

SEQ ID NO: 585724 - DNA, 25 bp, Rattus norvegicus
tccctgctactgtccagatgtgtgt

SEQ ID NO: 585725 - DNA, 25 bp, Rattus norvegicus
tccctgctcaatccggttatttatg

SEQ ID NO: 585726 - DNA, 25 bp, Rattus norvegicus
tccctgctcaatgcggttatttatg

SEQ ID NO: 585727 - DNA, 25 bp, Rattus norvegicus
tccctgctcatcagcttgattaaga

SEQ ID NO: 585728 - DNA, 25 bp, Rattus norvegicus
tccctgctcatctgcttgattaaga

SEQ ID NO: 585729 - DNA, 25 bp, Rattus norvegicus
tccctgctcatgagtagctgacgta

SEQ ID NO: 585730 - DNA, 25 bp, Rattus norvegicus
tccctgctcatgtgtagctgacgta

SEQ ID NO: 585731 - DNA, 25 bp, Rattus norvegicus
tccctgctctctcatcgcaaaatta

SEQ ID NO: 585732 - DNA, 25 bp, Rattus norvegicus
tccctgctctctgatcgcaaaatta

SEQ ID NO: 585733 - DNA, 25 bp, Rattus norvegicus
tccctgctgacgattgtgcatatgt

SEQ ID NO: 585734 - DNA, 25 bp, Rattus norvegicus
tccctgctgacgtttgtgcatatgt

SEQ ID NO: 585735 - DNA, 25 bp, Rattus norvegicus
tccctgctgcaaatcttcaaggcat

SEQ ID NO: 585736 - DNA, 25 bp, Rattus norvegicus
tccctgctgcaattcttcaaggcat

SEQ ID NO: 585737 - DNA, 25 bp, Rattus norvegicus
tccctgctgcacagaatatgttcga

SEQ ID NO: 585738 - DNA, 25 bp, Rattus norvegicus
tccctgctgcactgaatatgttcga

SEQ ID NO: 585739 - DNA, 25 bp, Rattus norvegicus
tccctgctggagactgtttccgaaa

SEQ ID NO: 585740 - DNA, 25 bp, Rattus norvegicus
tccctgctggagtctgtttccgaaa

SEQ ID NO: 585741 - DNA, 25 bp, Rattus norvegicus
tccctgctggatcactgtttaataa

SEQ ID NO: 585742 - DNA, 25 bp, Rattus norvegicus
tccctgctggatgactgtttaataa

SEQ ID NO: 585743 - DNA, 25 bp, Rattus norvegicus
tccctgcttattcagtgtccaagag

SEQ ID NO: 585744 - DNA, 25 bp, Rattus norvegicus
tccctgcttattgagtgtccaagag

SEQ ID NO: 585745 - DNA, 25 bp, Rattus norvegicus
tccctgctttccatagtgactgaca

SEQ ID NO: 585746 - DNA, 25 bp, Rattus norvegicus
tccctgctttccttagtgactgaca

SEQ ID NO: 585747 - DNA, 25 bp, Rattus norvegicus
tccctggaacccacacagtgaagga

SEQ ID NO: 585748 - DNA, 25 bp, Rattus norvegicus
tccctggaaccctcacagtgaagga

SEQ ID NO: 585749 - DNA, 25 bp, Rattus norvegicus
tccctggaaggcaaagacgctactt

SEQ ID NO: 585750 - DNA, 25 bp, Rattus norvegicus
tccctggaaggctaagacgctactt

SEQ ID NO: 585751 - DNA, 25 bp, Rattus norvegicus
tccctggagccactgcagctgatgg

SEQ ID NO: 585752 - DNA, 25 bp, Rattus norvegicus
tccctggagccagtgcagctgatgg

SEQ ID NO: 585753 - DNA, 25 bp, Rattus norvegicus
tccctggaggtaaaagcacccgctt

SEQ ID NO: 585754 - DNA, 25 bp, Rattus norvegicus
tccctggaggtataagcacccgctt

SEQ ID NO: 585755 - DNA, 25 bp, Rattus norvegicus
tccctggagtatcaggccttctcct

SEQ ID NO: 585756 - DNA, 25 bp, Rattus norvegicus
tccctggagtatgaggccttctcct

SEQ ID NO: 585757 - DNA, 25 bp, Rattus norvegicus
tccctggatatgactggcaccgtag

SEQ ID NO: 585758 - DNA, 25 bp, Rattus norvegicus
tccctggatatgtctggcaccgtag

SEQ ID NO: 585759 - DNA, 25 bp, Rattus norvegicus
tccctggatctcctgattacatcaa

SEQ ID NO: 585760 - DNA, 25 bp, Rattus norvegicus
tccctggatctcgtgattacatcaa

SEQ ID NO: 585761 - DNA, 25 bp, Rattus norvegicus
tccctggctagacactgtttgatgc

SEQ ID NO: 585762 - DNA, 25 bp, Rattus norvegicus
tccctggctagagactgtttgatgc

SEQ ID NO: 585763 - DNA, 25 bp, Rattus norvegicus
tccctggctgcactttttgcacaag

SEQ ID NO: 585764 - DNA, 25 bp, Rattus norvegicus
tccctggctgcagtttttgcacaag

SEQ ID NO: 585765 - DNA, 25 bp, Rattus norvegicus
tccctgggaattagtgctgctctaa

SEQ ID NO: 585766 - DNA, 25 bp, Rattus norvegicus
tccctgggaatttgtgctgctctaa

SEQ ID NO: 585767 - DNA, 25 bp, Rattus norvegicus
tccctgggactcattccagtgtaaa

SEQ ID NO: 585768 - DNA, 25 bp, Rattus norvegicus
tccctgggactctttccagtgtaaa

SEQ ID NO: 585769 - DNA, 25 bp, Rattus norvegicus
tccctgggagccaggaggcatacag

SEQ ID NO: 585770 - DNA, 25 bp, Rattus norvegicus
tccctgggagcctggaggcatacag

SEQ ID NO: 585771 - DNA, 25 bp, Rattus norvegicus
tccctgggagggagctatcagttct

SEQ ID NO: 585772 - DNA, 25 bp, Rattus norvegicus
tccctgggagggtgctatcagttct

SEQ ID NO: 585773 - DNA, 25 bp, Rattus norvegicus
tccctgggatgcaatggtggttctg

SEQ ID NO: 585774 - DNA, 25 bp, Rattus norvegicus
tccctgggatgctatggtggttctg

SEQ ID NO: 585775 - DNA, 25 bp, Rattus norvegicus
tccctgggcacgagttaaaaacctg

SEQ ID NO: 585776 - DNA, 25 bp, Rattus norvegicus
tccctgggcacgtgttaaaaacctg

SEQ ID NO: 585777 - DNA, 25 bp, Rattus norvegicus
tccctgggcactctcagctaagagt

SEQ ID NO: 585778 - DNA, 25 bp, Rattus norvegicus
tccctgggcactgtcagctaagagt

SEQ ID NO: 585779 - DNA, 25 bp, Rattus norvegicus
tccctgggcaggatggcaagatgtc

SEQ ID NO: 585780 - DNA, 25 bp, Rattus norvegicus
tccctgggcaggttggcaagatgtc

SEQ ID NO: 585781 - DNA, 25 bp, Rattus norvegicus
tccctgggtacccaacacaggtagt

SEQ ID NO: 585782 - DNA, 25 bp, Rattus norvegicus
tccctgggtaccgaacacaggtagt

SEQ ID NO: 585783 - DNA, 25 bp, Rattus norvegicus
tccctgggtcataagcaacgtgttt

SEQ ID NO: 585784 - DNA, 25 bp, Rattus norvegicus
tccctgggtcattagcaacgtgttt

SEQ ID NO: 585785 - DNA, 25 bp, Rattus norvegicus
tccctgggtctcctgtttgcttcct

SEQ ID NO: 585786 - DNA, 25 bp, Rattus norvegicus
tccctgggtctcgtgtttgcttcct

SEQ ID NO: 585787 - DNA, 25 bp, Rattus norvegicus
tccctgggtgctctttaatttgtca

SEQ ID NO: 585788 - DNA, 25 bp, Rattus norvegicus
tccctgggtgctgtttaatttgtca

SEQ ID NO: 585789 - DNA, 25 bp, Rattus norvegicus
tccctgggtttaatgtgatcttgca

SEQ ID NO: 585790 - DNA, 25 bp, Rattus norvegicus
tccctgggtttattgtgatcttgca

SEQ ID NO: 585791 - DNA, 25 bp, Rattus norvegicus
tccctggtaaggagaccgacacaat

SEQ ID NO: 585792 - DNA, 25 bp, Rattus norvegicus
tccctggtaaggtgaccgacacaat

SEQ ID NO: 585793 - DNA, 25 bp, Rattus norvegicus
tccctggtacacaggcttctgctgg

SEQ ID NO: 585794 - DNA, 25 bp, Rattus norvegicus
tccctggtacactggcttctgctgg

SEQ ID NO: 585795 - DNA, 25 bp, Rattus norvegicus
tccctggtcccaaacagtgggtgtg

SEQ ID NO: 585796 - DNA, 25 bp, Rattus norvegicus
tccctggtcccatacagtgggtgtg

SEQ ID NO: 585797 - DNA, 25 bp, Rattus norvegicus
tccctggtcctgattcttaaagacg

SEQ ID NO: 585798 - DNA, 25 bp, Rattus norvegicus
tccctggtcctgtttcttaaagacg

SEQ ID NO: 585799 - DNA, 25 bp, Rattus norvegicus
tccctggtctgacaagagcaactgt

SEQ ID NO: 585800 - DNA, 25 bp, Rattus norvegicus
tccctggtctgagaagagcaactgt

SEQ ID NO: 585801 - DNA, 25 bp, Rattus norvegicus
tccctggtgcatcttcttcaatgaa

SEQ ID NO: 585802 - DNA, 25 bp, Rattus norvegicus
tccctggtgcatgttcttcaatgaa

SEQ ID NO: 585803 - DNA, 25 bp, Rattus norvegicus
tccctggtgcttacagcaagagctc

SEQ ID NO: 585804 - DNA, 25 bp, Rattus norvegicus
tccctggtgctttcagcaagagctc

SEQ ID NO: 585805 - DNA, 25 bp, Rattus norvegicus
tccctggtggatcttgacgttgtct

SEQ ID NO: 585806 - DNA, 25 bp, Rattus norvegicus
tccctggtggatgttgacgttgtct

SEQ ID NO: 585807 - DNA, 25 bp, Rattus norvegicus
tccctgtactacagtgcgaacaatc

SEQ ID NO: 585808 - DNA, 25 bp, Rattus norvegicus
tccctgtactactgtgcgaacaatc

SEQ ID NO: 585809 - DNA, 25 bp, Rattus norvegicus
tccctgtccctactctttgaagaga

SEQ ID NO: 585810 - DNA, 25 bp, Rattus norvegicus
tccctgtccctagtctttgaagaga

SEQ ID NO: 585811 - DNA, 25 bp, Rattus norvegicus
tccctgtcctctagtatatctgaaa

SEQ ID NO: 585812 - DNA, 25 bp, Rattus norvegicus
tccctgtcctcttgtatatctgaaa

SEQ ID NO: 585813 - DNA, 25 bp, Rattus norvegicus
tccctgtcctgaacttagaacagtg

SEQ ID NO: 585814 - DNA, 25 bp, Rattus norvegicus
tccctgtcctgatcttagaacagtg

SEQ ID NO: 585815 - DNA, 25 bp, Rattus norvegicus
tccctgtcctggcagaacagtggtg

SEQ ID NO: 585816 - DNA, 25 bp, Rattus norvegicus
tccctgtcctggctggtcagtgtgc

SEQ ID NO: 585817 - DNA, 25 bp, Rattus norvegicus
tccctgtcctgggagaacagtggtg

SEQ ID NO: 585818 - DNA, 25 bp, Rattus norvegicus
tccctgtcctgggtggtcagtgtgc

SEQ ID NO: 585819 - DNA, 25 bp, Rattus norvegicus
tccctgtctcacagctgatgggaga

SEQ ID NO: 585820 - DNA, 25 bp, Rattus norvegicus
tccctgtctcactgctgatgggaga

SEQ ID NO: 585821 - DNA, 25 bp, Rattus norvegicus
tccctgtctctccatgaaatcaaga

SEQ ID NO: 585822 - DNA, 25 bp, Rattus norvegicus
tccctgtctctcgatgaaatcaaga

SEQ ID NO: 585823 - DNA, 25 bp, Rattus norvegicus
tccctgtctcttagtcagagctgta

SEQ ID NO: 585824 - DNA, 25 bp, Rattus norvegicus
tccctgtctctttgtcagagctgta

SEQ ID NO: 585825 - DNA, 25 bp, Rattus norvegicus
tccctgtcttctcgtttaccaaaga

SEQ ID NO: 585826 - DNA, 25 bp, Rattus norvegicus
tccctgtcttctggtttaccaaaga

SEQ ID NO: 585827 - DNA, 25 bp, Rattus norvegicus
tccctgtgcctaagatgatattggt

SEQ ID NO: 585828 - DNA, 25 bp, Rattus norvegicus
tccctgtgcctatgatgatattggt

SEQ ID NO: 585829 - DNA, 25 bp, Rattus norvegicus
tccctgtgctaaacgttcaactgta

SEQ ID NO: 585830 - DNA, 25 bp, Rattus norvegicus
tccctgtgctaatcgttcaactgta

SEQ ID NO: 585831 - DNA, 25 bp, Rattus norvegicus
tccctgtggcagcaagtgtcttctt

SEQ ID NO: 585832 - DNA, 25 bp, Rattus norvegicus
tccctgtggcaggaagtgtcttctt

SEQ ID NO: 585833 - DNA, 25 bp, Rattus norvegicus
tccctgtgggacatgcttctcaaaa

SEQ ID NO: 585834 - DNA, 25 bp, Rattus norvegicus
tccctgtgggacttgcttctcaaaa

SEQ ID NO: 585835 - DNA, 25 bp, Rattus norvegicus
tccctgtgggctattcttggagatt

SEQ ID NO: 585836 - DNA, 25 bp, Rattus norvegicus
tccctgtgggcttttcttggagatt

SEQ ID NO: 585837 - DNA, 25 bp, Rattus norvegicus
tccctgtggtccatgtctcataaaa

SEQ ID NO: 585838 - DNA, 25 bp, Rattus norvegicus
tccctgtggtccttgtctcataaaa

SEQ ID NO: 585839 - DNA, 25 bp, Rattus norvegicus
tccctgtgtcagactgttcttcctg

SEQ ID NO: 585840 - DNA, 25 bp, Rattus norvegicus
tccctgtgtcagtctgttcttcctg

SEQ ID NO: 585841 - DNA, 25 bp, Rattus norvegicus
tccctgtgtggcagtgagctctgag

SEQ ID NO: 585842 - DNA, 25 bp, Rattus norvegicus
tccctgtgtggctgtgagctctgag

SEQ ID NO: 585843 - DNA, 25 bp, Rattus norvegicus
tccctgtgtgttaaacccttgaccg

SEQ ID NO: 585844 - DNA, 25 bp, Rattus norvegicus
tccctgtgtgtttaacccttgaccg

SEQ ID NO: 585845 - DNA, 25 bp, Rattus norvegicus
tccctgtgttgtcgcctcacgttga

SEQ ID NO: 585846 - DNA, 25 bp, Rattus norvegicus
tccctgtgttgtggcctcacgttga

SEQ ID NO: 585847 - DNA, 25 bp, Rattus norvegicus
tccctgtgtttgctgcctttgctgt

SEQ ID NO: 585848 - DNA, 25 bp, Rattus norvegicus
tccctgtgtttggtgcctttgctgt

SEQ ID NO: 585849 - DNA, 25 bp, Rattus norvegicus
tccctgttatatagaattccatact

SEQ ID NO: 585850 - DNA, 25 bp, Rattus norvegicus
tccctgttatattgaattccatact

SEQ ID NO: 585851 - DNA, 25 bp, Rattus norvegicus
tccctgttcattactttctatccaa

SEQ ID NO: 585852 - DNA, 25 bp, Rattus norvegicus
tccctgttcatttctttctatccaa

SEQ ID NO: 585853 - DNA, 25 bp, Rattus norvegicus
tccctgttccttagatgatctcatc

SEQ ID NO: 585854 - DNA, 25 bp, Rattus norvegicus
tccctgttcctttgatgatctcatc

SEQ ID NO: 585855 - DNA, 25 bp, Rattus norvegicus
tccctgttctgtactgttgttattt

SEQ ID NO: 585856 - DNA, 25 bp, Rattus norvegicus
tccctgttctgttctgttgttattt

SEQ ID NO: 585857 - DNA, 25 bp, Rattus norvegicus
tccctgttgctgaaccatactactt

SEQ ID NO: 585858 - DNA, 25 bp, Rattus norvegicus
tccctgttgctgagtgcaagtttac

SEQ ID NO: 585859 - DNA, 25 bp, Rattus norvegicus
tccctgttgctgtaccatactactt

SEQ ID NO: 585860 - DNA, 25 bp, Rattus norvegicus
tccctgttgctgtgtgcaagtttac

SEQ ID NO: 585861 - DNA, 25 bp, Rattus norvegicus
tccctgttggtactggtgttggtaa

SEQ ID NO: 585862 - DNA, 25 bp, Rattus norvegicus
tccctgttggtagtggtgttggtaa

SEQ ID NO: 585863 - DNA, 25 bp, Rattus norvegicus
tccctgttgtcactgaagccataca

SEQ ID NO: 585864 - DNA, 25 bp, Rattus norvegicus
tccctgttgtcagtgaagccataca

SEQ ID NO: 585865 - DNA, 25 bp, Rattus norvegicus
tccctgtttcaccttaggcttttga

SEQ ID NO: 585866 - DNA, 25 bp, Rattus norvegicus
tccctgtttcacgttaggcttttga

SEQ ID NO: 585867 - DNA, 25 bp, Rattus norvegicus
tccctgtttggaatgagcctttggc

SEQ ID NO: 585868 - DNA, 25 bp, Rattus norvegicus
tccctgtttggattgagcctttggc

SEQ ID NO: 585869 - DNA, 25 bp, Rattus norvegicus
tccctgttttgtacccaagtatgca

SEQ ID NO: 585870 - DNA, 25 bp, Rattus norvegicus
tccctgttttgttcccaagtatgca

SEQ ID NO: 585871 - DNA, 25 bp, Rattus norvegicus
tccctgtttttcctagagatcctat

SEQ ID NO: 585872 - DNA, 25 bp, Rattus norvegicus
tccctgtttttcgtagagatcctat

SEQ ID NO: 585873 - DNA, 25 bp, Rattus norvegicus
tcccttaacattagctcccaagtgt

SEQ ID NO: 585874 - DNA, 25 bp, Rattus norvegicus
tcccttaacatttgctcccaagtgt

SEQ ID NO: 585875 - DNA, 25 bp, Rattus norvegicus
tcccttaaggcccaagtctggtttg

SEQ ID NO: 585876 - DNA, 25 bp, Rattus norvegicus
tcccttaaggccgaagtctggtttg

SEQ ID NO: 585877 - DNA, 25 bp, Rattus norvegicus
tcccttaatgttatgtgtccgctca

SEQ ID NO: 585878 - DNA, 25 bp, Rattus norvegicus
tcccttaatgttttgtgtccgctca

SEQ ID NO: 585879 - DNA, 25 bp, Rattus norvegicus
tcccttacctgtctgttttgtataa

SEQ ID NO: 585880 - DNA, 25 bp, Rattus norvegicus
tcccttacctgtgtgttttgtataa

SEQ ID NO: 585881 - DNA, 25 bp, Rattus norvegicus
tcccttacttggacagctggcatta

SEQ ID NO: 585882 - DNA, 25 bp, Rattus norvegicus
tcccttacttggtcagctggcatta

SEQ ID NO: 585883 - DNA, 25 bp, Rattus norvegicus
tcccttagcgggagcacggacaaag

SEQ ID NO: 585884 - DNA, 25 bp, Rattus norvegicus
tcccttagcgggtgcacggacaaag

SEQ ID NO: 585885 - DNA, 25 bp, Rattus norvegicus
tcccttaggccccatggtaaaagtg

SEQ ID NO: 585886 - DNA, 25 bp, Rattus norvegicus
tcccttaggcccgatggtaaaagtg

SEQ ID NO: 585887 - DNA, 25 bp, Rattus norvegicus
tcccttagtcacagcagatgctggc

SEQ ID NO: 585888 - DNA, 25 bp, Rattus norvegicus
tcccttagtcactgcagatgctggc

SEQ ID NO: 585889 - DNA, 25 bp, Rattus norvegicus
tcccttatccccaattgacaactaa

SEQ ID NO: 585890 - DNA, 25 bp, Rattus norvegicus
tcccttatcccctattgacaactaa

SEQ ID NO: 585891 - DNA, 25 bp, Rattus norvegicus
tcccttatctctctggacttgtata

SEQ ID NO: 585892 - DNA, 25 bp, Rattus norvegicus
tcccttatctctgtggacttgtata

SEQ ID NO: 585893 - DNA, 25 bp, Rattus norvegicus
tcccttattagcactcttgatactc

SEQ ID NO: 585894 - DNA, 25 bp, Rattus norvegicus
tcccttattagctctcttgatactc

SEQ ID NO: 585895 - DNA, 25 bp, Rattus norvegicus
tcccttattcaacgagacagcataa

SEQ ID NO: 585896 - DNA, 25 bp, Rattus norvegicus
tcccttattcaaggagacagcataa

SEQ ID NO: 585897 - DNA, 25 bp, Rattus norvegicus
tcccttcaccaccacaggattattg

SEQ ID NO: 585898 - DNA, 25 bp, Rattus norvegicus
tcccttcaccacgacaggattattg

SEQ ID NO: 585899 - DNA, 25 bp, Rattus norvegicus
tcccttcagcagattttcggtcgag

SEQ ID NO: 585900 - DNA, 25 bp, Rattus norvegicus
tcccttcagcagtttttcggtcgag

SEQ ID NO: 585901 - DNA, 25 bp, Rattus norvegicus
tcccttcagcttaattctgcttgta

SEQ ID NO: 585902 - DNA, 25 bp, Rattus norvegicus
tcccttcagctttattctgcttgta

SEQ ID NO: 585903 - DNA, 25 bp, Rattus norvegicus
tcccttcaggccctccagaagagaa

SEQ ID NO: 585904 - DNA, 25 bp, Rattus norvegicus
tcccttcaggccgtccagaagagaa

SEQ ID NO: 585905 - DNA, 25 bp, Rattus norvegicus
tcccttcagggtccggcggcatgca

SEQ ID NO: 585906 - DNA, 25 bp, Rattus norvegicus
tcccttcagggtgcggcggcatgca

SEQ ID NO: 585907 - DNA, 25 bp, Rattus norvegicus
tcccttcagtctccattcaagcata

SEQ ID NO: 585908 - DNA, 25 bp, Rattus norvegicus
tcccttcagtctgcattcaagcata

SEQ ID NO: 585909 - DNA, 25 bp, Rattus norvegicus
tcccttcatctcattctttaatgcg

SEQ ID NO: 585910 - DNA, 25 bp, Rattus norvegicus
tcccttcatctctttctttaatgcg

SEQ ID NO: 585911 - DNA, 25 bp, Rattus norvegicus
tcccttccacatacgcaatgtttga

SEQ ID NO: 585912 - DNA, 25 bp, Rattus norvegicus
tcccttccacattcgcaatgtttga

SEQ ID NO: 585913 - DNA, 25 bp, Rattus norvegicus
tcccttccatctccttggagttaaa

SEQ ID NO: 585914 - DNA, 25 bp, Rattus norvegicus
tcccttccatctgcttggagttaaa

SEQ ID NO: 585915 - DNA, 25 bp, Rattus norvegicus
tcccttccatttagctgagagccag

SEQ ID NO: 585916 - DNA, 25 bp, Rattus norvegicus
tcccttccattttgctgagagccag

SEQ ID NO: 585917 - DNA, 25 bp, Rattus norvegicus
tcccttccctgtagatgcattagac

SEQ ID NO: 585918 - DNA, 25 bp, Rattus norvegicus
tcccttccctgttgatgcattagac

SEQ ID NO: 585919 - DNA, 25 bp, Rattus norvegicus
tcccttcccttgcagattgtgagat

SEQ ID NO: 585920 - DNA, 25 bp, Rattus norvegicus
tcccttcccttggagattgtgagat

SEQ ID NO: 585921 - DNA, 25 bp, Rattus norvegicus
tcccttcctcaacattgcactatta

SEQ ID NO: 585922 - DNA, 25 bp, Rattus norvegicus
tcccttcctcaagattgcactatta

SEQ ID NO: 585923 - DNA, 25 bp, Rattus norvegicus
tcccttcctgttcaccaaagaaacg

SEQ ID NO: 585924 - DNA, 25 bp, Rattus norvegicus
tcccttcctgttgaccaaagaaacg

SEQ ID NO: 585925 - DNA, 25 bp, Rattus norvegicus
tcccttcctttgacggcagtggaaa

SEQ ID NO: 585926 - DNA, 25 bp, Rattus norvegicus
tcccttcctttgtcggcagtggaaa

SEQ ID NO: 585927 - DNA, 25 bp, Rattus norvegicus
tcccttcgaggactctactgaggaa

SEQ ID NO: 585928 - DNA, 25 bp, Rattus norvegicus
tcccttcgaggagtctactgaggaa

SEQ ID NO: 585929 - DNA, 25 bp, Rattus norvegicus
tcccttcggcagcttgtaaaactgt

SEQ ID NO: 585930 - DNA, 25 bp, Rattus norvegicus
tcccttcggcaggttgtaaaactgt

SEQ ID NO: 585931 - DNA, 25 bp, Rattus norvegicus
tcccttcgggatagattgtatactt

SEQ ID NO: 585932 - DNA, 25 bp, Rattus norvegicus
tcccttcgggattgattgtatactt

SEQ ID NO: 585933 - DNA, 25 bp, Rattus norvegicus
tcccttcggtcacaccgtgggagga

SEQ ID NO: 585934 - DNA, 25 bp, Rattus norvegicus
tcccttcggtcagaccgtgggagga

SEQ ID NO: 585935 - DNA, 25 bp, Rattus norvegicus
tcccttcgtgtgatccaaagttgtg

SEQ ID NO: 585936 - DNA, 25 bp, Rattus norvegicus
tcccttcgtgtgttccaaagttgtg

SEQ ID NO: 585937 - DNA, 25 bp, Rattus norvegicus
tcccttctagcccatgagaggaagt

SEQ ID NO: 585938 - DNA, 25 bp, Rattus norvegicus
tcccttctagccgatgagaggaagt

SEQ ID NO: 585939 - DNA, 25 bp, Rattus norvegicus
tcccttctcaggcagcaacttgata

SEQ ID NO: 585940 - DNA, 25 bp, Rattus norvegicus
tcccttctcagggagcaacttgata

SEQ ID NO: 585941 - DNA, 25 bp, Rattus norvegicus
tcccttctccaaattgctgtgaact

SEQ ID NO: 585942 - DNA, 25 bp, Rattus norvegicus
tcccttctccaatttgctgtgaact

SEQ ID NO: 585943 - DNA, 25 bp, Rattus norvegicus
tcccttctccttatatctattacag

SEQ ID NO: 585944 - DNA, 25 bp, Rattus norvegicus
tcccttctccttttatctattacag

SEQ ID NO: 585945 - DNA, 25 bp, Rattus norvegicus
tcccttctctgcagagtagcaggca

SEQ ID NO: 585946 - DNA, 25 bp, Rattus norvegicus
tcccttctctgctgagtagcaggca

SEQ ID NO: 585947 - DNA, 25 bp, Rattus norvegicus
tcccttctcttacagtagcacagac

SEQ ID NO: 585948 - DNA, 25 bp, Rattus norvegicus
tcccttctcttagagtagcacagac

SEQ ID NO: 585949 - DNA, 25 bp, Rattus norvegicus
tcccttctgccgctgtgagatcaaa

SEQ ID NO: 585950 - DNA, 25 bp, Rattus norvegicus
tcccttctgccggtgtgagatcaaa

SEQ ID NO: 585951 - DNA, 25 bp, Rattus norvegicus
tcccttctggctactcaagagtctg

SEQ ID NO: 585952 - DNA, 25 bp, Rattus norvegicus
tcccttctggcttctcaagagtctg

SEQ ID NO: 585953 - DNA, 25 bp, Rattus norvegicus
tcccttctggttatgatctgctcta

SEQ ID NO: 585954 - DNA, 25 bp, Rattus norvegicus
tcccttctggttttgatctgctcta

SEQ ID NO: 585955 - DNA, 25 bp, Rattus norvegicus
tcccttcttcctaactgaaactgaa

SEQ ID NO: 585956 - DNA, 25 bp, Rattus norvegicus
tcccttcttcctctggatcttagga

SEQ ID NO: 585957 - DNA, 25 bp, Rattus norvegicus
tcccttcttcctgtggatcttagga

SEQ ID NO: 585958 - DNA, 25 bp, Rattus norvegicus
tcccttcttccttactgaaactgaa

SEQ ID NO: 585959 - DNA, 25 bp, Rattus norvegicus
tcccttcttctccaaagcaaactgt

SEQ ID NO: 585960 - DNA, 25 bp, Rattus norvegicus
tcccttcttctcgaaagcaaactgt

SEQ ID NO: 585961 - DNA, 25 bp, Rattus norvegicus
tcccttcttctgctgtcatttctaa

SEQ ID NO: 585962 - DNA, 25 bp, Rattus norvegicus
tcccttcttctggtgtcatttctaa

SEQ ID NO: 585963 - DNA, 25 bp, Rattus norvegicus
tcccttgaaagtctcagccagctaa

SEQ ID NO: 585964 - DNA, 25 bp, Rattus norvegicus
tcccttgaaagtgtcagccagctaa

SEQ ID NO: 585965 - DNA, 25 bp, Rattus norvegicus
tcccttgaactgataactgccaatg

SEQ ID NO: 585966 - DNA, 25 bp, Rattus norvegicus
tcccttgaactgttaactgccaatg

SEQ ID NO: 585967 - DNA, 25 bp, Rattus norvegicus
tcccttgacattcttttgttgttaa

SEQ ID NO: 585968 - DNA, 25 bp, Rattus norvegicus
tcccttgacattgttttgttgttaa

SEQ ID NO: 585969 - DNA, 25 bp, Rattus norvegicus
tcccttgaggacacttcttgggaca

SEQ ID NO: 585970 - DNA, 25 bp, Rattus norvegicus
tcccttgaggactcttcttgggaca

SEQ ID NO: 585971 - DNA, 25 bp, Rattus norvegicus
tcccttgatcttcagctgcaactga

SEQ ID NO: 585972 - DNA, 25 bp, Rattus norvegicus
tcccttgatcttgagctgcaactga

SEQ ID NO: 585973 - DNA, 25 bp, Rattus norvegicus
tcccttgcacgtctacatgaatggc

SEQ ID NO: 585974 - DNA, 25 bp, Rattus norvegicus
tcccttgcacgtgtacatgaatggc

SEQ ID NO: 585975 - DNA, 25 bp, Rattus norvegicus
tcccttgccgtgatatgtaccatat

SEQ ID NO: 585976 - DNA, 25 bp, Rattus norvegicus
tcccttgccgtgttatgtaccatat

SEQ ID NO: 585977 - DNA, 25 bp, Rattus norvegicus
tcccttgctgcaagatggtcactag

SEQ ID NO: 585978 - DNA, 25 bp, Rattus norvegicus
tcccttgctgcatgatggtcactag

SEQ ID NO: 585979 - DNA, 25 bp, Rattus norvegicus
tcccttgctgtactgactggttgtg

SEQ ID NO: 585980 - DNA, 25 bp, Rattus norvegicus
tcccttgctgtagtgactggttgtg

SEQ ID NO: 585981 - DNA, 25 bp, Rattus norvegicus
tcccttgctgttcacttctatagga

SEQ ID NO: 585982 - DNA, 25 bp, Rattus norvegicus
tcccttgctgttgacttctatagga

SEQ ID NO: 585983 - DNA, 25 bp, Rattus norvegicus
tcccttgcttgtaggtgtcttactg

SEQ ID NO: 585984 - DNA, 25 bp, Rattus norvegicus
tcccttgcttgttggtgtcttactg

SEQ ID NO: 585985 - DNA, 25 bp, Rattus norvegicus
tcccttgctttcaatctcgtttgta

SEQ ID NO: 585986 - DNA, 25 bp, Rattus norvegicus
tcccttgctttctatctcgtttgta

SEQ ID NO: 585987 - DNA, 25 bp, Rattus norvegicus
tcccttgctttgaatgcgtggtgta

SEQ ID NO: 585988 - DNA, 25 bp, Rattus norvegicus
tcccttgctttgctgtatagtctga

SEQ ID NO: 585989 - DNA, 25 bp, Rattus norvegicus
tcccttgctttggtgtatagtctga

SEQ ID NO: 585990 - DNA, 25 bp, Rattus norvegicus
tcccttgctttgtatgcgtggtgta

SEQ ID NO: 585991 - DNA, 25 bp, Rattus norvegicus
tcccttggcaagaccggtggatgaa

SEQ ID NO: 585992 - DNA, 25 bp, Rattus norvegicus
tcccttggcaagtccggtggatgaa

SEQ ID NO: 585993 - DNA, 25 bp, Rattus norvegicus
tcccttggccaacagctcaattgaa

SEQ ID NO: 585994 - DNA, 25 bp, Rattus norvegicus
tcccttggccaagagctcaattgaa

SEQ ID NO: 585995 - DNA, 25 bp, Rattus norvegicus
tcccttggtttcatcagacattgca

SEQ ID NO: 585996 - DNA, 25 bp, Rattus norvegicus
tcccttggtttcttcagacattgca

SEQ ID NO: 585997 - DNA, 25 bp, Rattus norvegicus
tcccttgtacacatcctggtttgaa

SEQ ID NO: 585998 - DNA, 25 bp, Rattus norvegicus
tcccttgtacacttcctggtttgaa

SEQ ID NO: 585999 - DNA, 25 bp, Rattus norvegicus
tcccttgtcccaaattattccaaag

SEQ ID NO: 586000 - DNA, 25 bp, Rattus norvegicus
tcccttgtcccatattattccaaag

SEQ ID NO: 586001 - DNA, 25 bp, Rattus norvegicus
tcccttgtccctcaacagcaatagt

SEQ ID NO: 586002 - DNA, 25 bp, Rattus norvegicus
tcccttgtccctgaacagcaatagt

SEQ ID NO: 586003 - DNA, 25 bp, Rattus norvegicus
tcccttgtcctacaattgcatcctt

SEQ ID NO: 586004 - DNA, 25 bp, Rattus norvegicus
tcccttgtcctagaattgcatcctt

SEQ ID NO: 586005 - DNA, 25 bp, Rattus norvegicus
tcccttgtctggctaggagttactt

SEQ ID NO: 586006 - DNA, 25 bp, Rattus norvegicus
tcccttgtctgggtaggagttactt

SEQ ID NO: 586007 - DNA, 25 bp, Rattus norvegicus
tcccttgtgtttcaaccaactacta

SEQ ID NO: 586008 - DNA, 25 bp, Rattus norvegicus
tcccttgtgtttgaaccaactacta

SEQ ID NO: 586009 - DNA, 25 bp, Rattus norvegicus
tccctttaacagcactggaaaaaag

SEQ ID NO: 586010 - DNA, 25 bp, Rattus norvegicus
tccctttaacaggactggaaaaaag

SEQ ID NO: 586011 - DNA, 25 bp, Rattus norvegicus
tccctttacagtattaccgccaatg

SEQ ID NO: 586012 - DNA, 25 bp, Rattus norvegicus
tccctttacagttttaccgccaatg

SEQ ID NO: 586013 - DNA, 25 bp, Rattus norvegicus
tccctttagcttctgggcatggagg

SEQ ID NO: 586014 - DNA, 25 bp, Rattus norvegicus
tccctttagcttgtgggcatggagg

SEQ ID NO: 586015 - DNA, 25 bp, Rattus norvegicus
tccctttatctcacatgctttggtt

SEQ ID NO: 586016 - DNA, 25 bp, Rattus norvegicus
tccctttatctctcatgctttggtt

SEQ ID NO: 586017 - DNA, 25 bp, Rattus norvegicus
tccctttcaagtcaggtccttattg

SEQ ID NO: 586018 - DNA, 25 bp, Rattus norvegicus
tccctttcaagtgaggtccttattg

SEQ ID NO: 586019 - DNA, 25 bp, Rattus norvegicus
tccctttcagcaacagcaggcagaa

SEQ ID NO: 586020 - DNA, 25 bp, Rattus norvegicus
tccctttcagcatcagcaggcagaa

SEQ ID NO: 586021 - DNA, 25 bp, Rattus norvegicus
tccctttccatacaccaatcaaaaa

SEQ ID NO: 586022 - DNA, 25 bp, Rattus norvegicus
tccctttccatagaccaatcaaaaa

SEQ ID NO: 586023 - DNA, 25 bp, Rattus norvegicus
tccctttccccaacttattaattat

SEQ ID NO: 586024 - DNA, 25 bp, Rattus norvegicus
tccctttccccatcttattaattat

SEQ ID NO: 586025 - DNA, 25 bp, Rattus norvegicus
tccctttcccctactgtaagtgtgg

SEQ ID NO: 586026 - DNA, 25 bp, Rattus norvegicus
tccctttccccttctgtaagtgtgg

SEQ ID NO: 586027 - DNA, 25 bp, Rattus norvegicus
tccctttcccgtcgagcatgaaagt

SEQ ID NO: 586028 - DNA, 25 bp, Rattus norvegicus
tccctttcccgtggagcatgaaagt

SEQ ID NO: 586029 - DNA, 25 bp, Rattus norvegicus
tccctttcctgaactgctttgtgga

SEQ ID NO: 586030 - DNA, 25 bp, Rattus norvegicus
tccctttcctgatctgctttgtgga

SEQ ID NO: 586031 - DNA, 25 bp, Rattus norvegicus
tccctttccttgagattcctagaga

SEQ ID NO: 586032 - DNA, 25 bp, Rattus norvegicus
tccctttccttgtgattcctagaga

SEQ ID NO: 586033 - DNA, 25 bp, Rattus norvegicus
tccctttctactaactcaggaggtt

SEQ ID NO: 586034 - DNA, 25 bp, Rattus norvegicus
tccctttctacttactcaggaggtt

SEQ ID NO: 586035 - DNA, 25 bp, Rattus norvegicus
tccctttctccactgggaagcgatt

SEQ ID NO: 586036 - DNA, 25 bp, Rattus norvegicus
tccctttctccagtgggaagcgatt

SEQ ID NO: 586037 - DNA, 25 bp, Rattus norvegicus
tccctttctcctagctgtgtaaaaa

SEQ ID NO: 586038 - DNA, 25 bp, Rattus norvegicus
tccctttctccttgctgtgtaaaaa

SEQ ID NO: 586039 - DNA, 25 bp, Rattus norvegicus
tccctttctgccatggctgaggttg

SEQ ID NO: 586040 - DNA, 25 bp, Rattus norvegicus
tccctttctgccttggctgaggttg

SEQ ID NO: 586041 - DNA, 25 bp, Rattus norvegicus
tccctttctgctctgaaaagccagg

SEQ ID NO: 586042 - DNA, 25 bp, Rattus norvegicus
tccctttctgctgtgaaaagccagg

SEQ ID NO: 586043 - DNA, 25 bp, Rattus norvegicus
tccctttctgttcagcttatttttt

SEQ ID NO: 586044 - DNA, 25 bp, Rattus norvegicus
tccctttctgttgagcttatttttt

SEQ ID NO: 586045 - DNA, 25 bp, Rattus norvegicus
tccctttcttgcaccttaaagcagt

SEQ ID NO: 586046 - DNA, 25 bp, Rattus norvegicus
tccctttcttgctccttaaagcagt

SEQ ID NO: 586047 - DNA, 25 bp, Rattus norvegicus
tccctttcttttctccaacatgata

SEQ ID NO: 586048 - DNA, 25 bp, Rattus norvegicus
tccctttcttttgtccaacatgata

SEQ ID NO: 586049 - DNA, 25 bp, Rattus norvegicus
tccctttgacaacatcaacccttta

SEQ ID NO: 586050 - DNA, 25 bp, Rattus norvegicus
tccctttgacaagatcaacccttta

SEQ ID NO: 586051 - DNA, 25 bp, Rattus norvegicus
tccctttgcactatgaatcttcatt

SEQ ID NO: 586052 - DNA, 25 bp, Rattus norvegicus
tccctttgcactttgaatcttcatt

SEQ ID NO: 586053 - DNA, 25 bp, Rattus norvegicus
tccctttgcagtcctttctaaacta

SEQ ID NO: 586054 - DNA, 25 bp, Rattus norvegicus
tccctttgcagtgctttctaaacta

SEQ ID NO: 586055 - DNA, 25 bp, Rattus norvegicus
tccctttgcctccaacggaatagca

SEQ ID NO: 586056 - DNA, 25 bp, Rattus norvegicus
tccctttgcctcgaacggaatagca

SEQ ID NO: 586057 - DNA, 25 bp, Rattus norvegicus
tccctttggcaacggcaggaccacg

SEQ ID NO: 586058 - DNA, 25 bp, Rattus norvegicus
tccctttggcaagggcaggaccacg

SEQ ID NO: 586059 - DNA, 25 bp, Rattus norvegicus
tccctttggctaacagaccatcgaa

SEQ ID NO: 586060 - DNA, 25 bp, Rattus norvegicus
tccctttggctatcagaccatcgaa

SEQ ID NO: 586061 - DNA, 25 bp, Rattus norvegicus
tccctttgtaacataggttgacttg

SEQ ID NO: 586062 - DNA, 25 bp, Rattus norvegicus
tccctttgtaacttaggttgacttg

SEQ ID NO: 586063 - DNA, 25 bp, Rattus norvegicus
tccctttgtgagctggtgcttttta

SEQ ID NO: 586064 - DNA, 25 bp, Rattus norvegicus
tccctttgtgaggtggtgcttttta

SEQ ID NO: 586065 - DNA, 25 bp, Rattus norvegicus
tccctttgttgtaagccgtggtaca

SEQ ID NO: 586066 - DNA, 25 bp, Rattus norvegicus
tccctttgttgttagccgtggtaca

SEQ ID NO: 586067 - DNA, 25 bp, Rattus norvegicus
tcccttttaagcacctggtgctaaa

SEQ ID NO: 586068 - DNA, 25 bp, Rattus norvegicus
tcccttttaagctcctggtgctaaa

SEQ ID NO: 586069 - DNA, 25 bp, Rattus norvegicus
tcccttttatagagatggccttcaa

SEQ ID NO: 586070 - DNA, 25 bp, Rattus norvegicus
tcccttttatagtgatggccttcaa

SEQ ID NO: 586071 - DNA, 25 bp, Rattus norvegicus
tcccttttcagcattgccttctaaa

SEQ ID NO: 586072 - DNA, 25 bp, Rattus norvegicus
tcccttttcagctttgccttctaaa

SEQ ID NO: 586073 - DNA, 25 bp, Rattus norvegicus
tcccttttcctgacatagaaccttc

SEQ ID NO: 586074 - DNA, 25 bp, Rattus norvegicus
tcccttttcctgtcatagaaccttc

SEQ ID NO: 586075 - DNA, 25 bp, Rattus norvegicus
tcccttttctctatacctcagaagt

SEQ ID NO: 586076 - DNA, 25 bp, Rattus norvegicus
tcccttttctctttacctcagaagt

SEQ ID NO: 586077 - DNA, 25 bp, Rattus norvegicus
tcccttttcttcctccaatactatt

SEQ ID NO: 586078 - DNA, 25 bp, Rattus norvegicus
tcccttttcttcgtccaatactatt

SEQ ID NO: 586079 - DNA, 25 bp, Rattus norvegicus
tcccttttgggaatagtcacacgtt

SEQ ID NO: 586080 - DNA, 25 bp, Rattus norvegicus
tcccttttgggattagtcacacgtt

SEQ ID NO: 586081 - DNA, 25 bp, Rattus norvegicus
tcccttttgtccattgcattgattt

SEQ ID NO: 586082 - DNA, 25 bp, Rattus norvegicus
tcccttttgtcctttgcattgattt

SEQ ID NO: 586083 - DNA, 25 bp, Rattus norvegicus
tccctttttagtctttatcagtaat

SEQ ID NO: 586084 - DNA, 25 bp, Rattus norvegicus
tccctttttagtgtttatcagtaat

SEQ ID NO: 586085 - DNA, 25 bp, Rattus norvegicus
tccctttttattaccagttctagct

SEQ ID NO: 586086 - DNA, 25 bp, Rattus norvegicus
tccctttttatttccagttctagct

SEQ ID NO: 586087 - DNA, 25 bp, Rattus norvegicus
tccctttttgccatgtactgaatga

SEQ ID NO: 586088 - DNA, 25 bp, Rattus norvegicus
tccctttttgccttgtactgaatga

SEQ ID NO: 586089 - DNA, 25 bp, Rattus norvegicus
tcccttttttaaatgcaacagctgt

SEQ ID NO: 586090 - DNA, 25 bp, Rattus norvegicus
tcccttttttaattgcaacagctgt

SEQ ID NO: 586091 - DNA, 25 bp, Rattus norvegicus
tccgaaacgggactaacttgatgct

SEQ ID NO: 586092 - DNA, 25 bp, Rattus norvegicus
tccgaaacgggagtaacttgatgct

SEQ ID NO: 586093 - DNA, 25 bp, Rattus norvegicus
tccgaaagctttataatctctccaa

SEQ ID NO: 586094 - DNA, 25 bp, Rattus norvegicus
tccgaaagctttttaatctctccaa

SEQ ID NO: 586095 - DNA, 25 bp, Rattus norvegicus
tccgaaccctggatgtctgggttat

SEQ ID NO: 586096 - DNA, 25 bp, Rattus norvegicus
tccgaaccctggttgtctgggttat

SEQ ID NO: 586097 - DNA, 25 bp, Rattus norvegicus
tccgaagaaccaactctcagacgat

SEQ ID NO: 586098 - DNA, 25 bp, Rattus norvegicus
tccgaagaaccatctctcagacgat

SEQ ID NO: 586099 - DNA, 25 bp, Rattus norvegicus
tccgaagcttgaatgacacaggtga

SEQ ID NO: 586100 - DNA, 25 bp, Rattus norvegicus
tccgaagcttgattgacacaggtga

SEQ ID NO: 586101 - DNA, 25 bp, Rattus norvegicus
tccgaaggaaatcccgtgaccagag

SEQ ID NO: 586102 - DNA, 25 bp, Rattus norvegicus
tccgaaggaaatgccgtgaccagag

SEQ ID NO: 586103 - DNA, 25 bp, Rattus norvegicus
tccgaaggcatcactttggagcaga

SEQ ID NO: 586104 - DNA, 25 bp, Rattus norvegicus
tccgaaggcatctctttggagcaga

SEQ ID NO: 586105 - DNA, 25 bp, Rattus norvegicus
tccgaagtcactcgcatttaagtca

SEQ ID NO: 586106 - DNA, 25 bp, Rattus norvegicus
tccgaagtcactggcatttaagtca

SEQ ID NO: 586107 - DNA, 25 bp, Rattus norvegicus
tccgaagtgtcaaatggcctaccca

SEQ ID NO: 586108 - DNA, 25 bp, Rattus norvegicus
tccgaagtgtcatatggcctaccca

SEQ ID NO: 586109 - DNA, 25 bp, Rattus norvegicus
tccgaagtgtccagaaccttgtcct

SEQ ID NO: 586110 - DNA, 25 bp, Rattus norvegicus
tccgaagtgtcctgaaccttgtcct

SEQ ID NO: 586111 - DNA, 25 bp, Rattus norvegicus
tccgaatcagtgcagggcctcaaac

SEQ ID NO: 586112 - DNA, 25 bp, Rattus norvegicus
tccgaatcagtggagggcctcaaac

SEQ ID NO: 586113 - DNA, 25 bp, Rattus norvegicus
tccgaattcttgctgtggagcccag

SEQ ID NO: 586114 - DNA, 25 bp, Rattus norvegicus
tccgaattcttggtgtggagcccag

SEQ ID NO: 586115 - DNA, 25 bp, Rattus norvegicus
tccgaatttcctcttttcaaagcac

SEQ ID NO: 586116 - DNA, 25 bp, Rattus norvegicus
tccgaatttcctgttttcaaagcac

SEQ ID NO: 586117 - DNA, 25 bp, Rattus norvegicus
tccgaatttctcaccgtagccagta

SEQ ID NO: 586118 - DNA, 25 bp, Rattus norvegicus
tccgaatttctctccgtagccagta

SEQ ID NO: 586119 - DNA, 25 bp, Rattus norvegicus
tccgacctctgtagttctggtgaaa

SEQ ID NO: 586120 - DNA, 25 bp, Rattus norvegicus
tccgacctctgttgttctggtgaaa

SEQ ID NO: 586121 - DNA, 25 bp, Rattus norvegicus
tccgacctgaggaccagggcacata

SEQ ID NO: 586122 - DNA, 25 bp, Rattus norvegicus
tccgacctgaggtccagggcacata

SEQ ID NO: 586123 - DNA, 25 bp, Rattus norvegicus
tccgacctggtgatcacgtattgag

SEQ ID NO: 586124 - DNA, 25 bp, Rattus norvegicus
tccgacctggtgttcacgtattgag

SEQ ID NO: 586125 - DNA, 25 bp, Rattus norvegicus
tccgactccttaccaagcttatgaa

SEQ ID NO: 586126 - DNA, 25 bp, Rattus norvegicus
tccgactccttagcaagcttatgaa

SEQ ID NO: 586127 - DNA, 25 bp, Rattus norvegicus
tccgactgacacctactctgagaac

SEQ ID NO: 586128 - DNA, 25 bp, Rattus norvegicus
tccgactgacacgtactctgagaac

SEQ ID NO: 586129 - DNA, 25 bp, Rattus norvegicus
tccgagaaactgagtgagcctttac

SEQ ID NO: 586130 - DNA, 25 bp, Rattus norvegicus
tccgagaaactgtgtgagcctttac

SEQ ID NO: 586131 - DNA, 25 bp, Rattus norvegicus
tccgagactatcctacttactatac

SEQ ID NO: 586132 - DNA, 25 bp, Rattus norvegicus
tccgagactatcgtacttactatac

SEQ ID NO: 586133 - DNA, 25 bp, Rattus norvegicus
tccgagaggacaacccttcaaggtt

SEQ ID NO: 586134 - DNA, 25 bp, Rattus norvegicus
tccgagaggacatcccttcaaggtt

SEQ ID NO: 586135 - DNA, 25 bp, Rattus norvegicus
tccgagatgcttatcacctgaactt

SEQ ID NO: 586136 - DNA, 25 bp, Rattus norvegicus
tccgagatgcttttcacctgaactt

SEQ ID NO: 586137 - DNA, 25 bp, Rattus norvegicus
tccgagcaaagcctggccgtcaaag

SEQ ID NO: 586138 - DNA, 25 bp, Rattus norvegicus
tccgagcaaagcgtggccgtcaaag

SEQ ID NO: 586139 - DNA, 25 bp, Rattus norvegicus
tccgagccagagagcgcctgagccg

SEQ ID NO: 586140 - DNA, 25 bp, Rattus norvegicus
tccgagccagagtgcgcctgagccg

SEQ ID NO: 586141 - DNA, 25 bp, Rattus norvegicus
tccgagccatgccaaatctgtatgt

SEQ ID NO: 586142 - DNA, 25 bp, Rattus norvegicus
tccgagccatgcgaaatctgtatgt

SEQ ID NO: 586143 - DNA, 25 bp, Rattus norvegicus
tccgagcccaagatagagcaccaag

SEQ ID NO: 586144 - DNA, 25 bp, Rattus norvegicus
tccgagcccaagttagagcaccaag

SEQ ID NO: 586145 - DNA, 25 bp, Rattus norvegicus
tccgagcctcatcctgtgaatggag

SEQ ID NO: 586146 - DNA, 25 bp, Rattus norvegicus
tccgagcctcatgctgtgaatggag

SEQ ID NO: 586147 - DNA, 25 bp, Rattus norvegicus
tccgagcgacttcactggctgagaa

SEQ ID NO: 586148 - DNA, 25 bp, Rattus norvegicus
tccgagcgacttgactggctgagaa

SEQ ID NO: 586149 - DNA, 25 bp, Rattus norvegicus
tccgagcgatggagactcgggtccc

SEQ ID NO: 586150 - DNA, 25 bp, Rattus norvegicus
tccgagcgatggtgactcgggtccc

SEQ ID NO: 586151 - DNA, 25 bp, Rattus norvegicus
tccgagctacttagcgctcattgac

SEQ ID NO: 586152 - DNA, 25 bp, Rattus norvegicus
tccgagctactttgcgctcattgac

SEQ ID NO: 586153 - DNA, 25 bp, Rattus norvegicus
tccgaggacacgaagacgatctcca

SEQ ID NO: 586154 - DNA, 25 bp, Rattus norvegicus
tccgaggacacgtagacgatctcca

SEQ ID NO: 586155 - DNA, 25 bp, Rattus norvegicus
tccgaggccctgacattttcctttt

SEQ ID NO: 586156 - DNA, 25 bp, Rattus norvegicus
tccgaggccctgtcattttcctttt

SEQ ID NO: 586157 - DNA, 25 bp, Rattus norvegicus
tccgagggcagaccttccatcggcg

SEQ ID NO: 586158 - DNA, 25 bp, Rattus norvegicus
tccgagggcagagcttccatcggcg

SEQ ID NO: 586159 - DNA, 25 bp, Rattus norvegicus
tccgagggcgctacctcagcggagt

SEQ ID NO: 586160 - DNA, 25 bp, Rattus norvegicus
tccgagggcgcttcctcagcggagt

SEQ ID NO: 586161 - DNA, 25 bp, Rattus norvegicus
tccgagggctacagacagtggaccc

SEQ ID NO: 586162 - DNA, 25 bp, Rattus norvegicus
tccgagggctactgacagtggaccc

SEQ ID NO: 586163 - DNA, 25 bp, Rattus norvegicus
tccgagggctgacaacctggtgttc

SEQ ID NO: 586164 - DNA, 25 bp, Rattus norvegicus
tccgagggctgagaacctggtgttc

SEQ ID NO: 586165 - DNA, 25 bp, Rattus norvegicus
tccgagggtctcaattctgttcctg

SEQ ID NO: 586166 - DNA, 25 bp, Rattus norvegicus
tccgagggtctctattctgttcctg

SEQ ID NO: 586167 - DNA, 25 bp, Rattus norvegicus
tccgaggtcttaatctgctgtttaa

SEQ ID NO: 586168 - DNA, 25 bp, Rattus norvegicus
tccgaggtcttattctgctgtttaa

SEQ ID NO: 586169 - DNA, 25 bp, Rattus norvegicus
tccgaggttcagagtacttgttgct

SEQ ID NO: 586170 - DNA, 25 bp, Rattus norvegicus
tccgaggttcagtgtacttgttgct

SEQ ID NO: 586171 - DNA, 25 bp, Rattus norvegicus
tccgagtcactcagcttggtaggta

SEQ ID NO: 586172 - DNA, 25 bp, Rattus norvegicus
tccgagtcactctgcttggtaggta

SEQ ID NO: 586173 - DNA, 25 bp, Rattus norvegicus
tccgagtccttgaggttgcgcagca

SEQ ID NO: 586174 - DNA, 25 bp, Rattus norvegicus
tccgagtccttgtggttgcgcagca

SEQ ID NO: 586175 - DNA, 25 bp, Rattus norvegicus
tccgagtgcaaccagaggcgtgatt

SEQ ID NO: 586176 - DNA, 25 bp, Rattus norvegicus
tccgagtgcaacgagaggcgtgatt

SEQ ID NO: 586177 - DNA, 25 bp, Rattus norvegicus
tccgagtgggacatcgaccagcctc

SEQ ID NO: 586178 - DNA, 25 bp, Rattus norvegicus
tccgagtgggacttcgaccagcctc

SEQ ID NO: 586179 - DNA, 25 bp, Rattus norvegicus
tccgagtgtagacgaaccaaccaag

SEQ ID NO: 586180 - DNA, 25 bp, Rattus norvegicus
tccgagtgtagaggaaccaaccaag

SEQ ID NO: 586181 - DNA, 25 bp, Rattus norvegicus
tccgagttacagatccgggacttga

SEQ ID NO: 586182 - DNA, 25 bp, Rattus norvegicus
tccgagttacagttccgggacttga

SEQ ID NO: 586183 - DNA, 25 bp, Rattus norvegicus
tccgagttgcttactgtggagggct

SEQ ID NO: 586184 - DNA, 25 bp, Rattus norvegicus
tccgagttgctttctgtggagggct

SEQ ID NO: 586185 - DNA, 25 bp, Rattus norvegicus
tccgagttttcacagagcagcagca

SEQ ID NO: 586186 - DNA, 25 bp, Rattus norvegicus
tccgagttttcagagagcagcagca

SEQ ID NO: 586187 - DNA, 25 bp, Rattus norvegicus
tccgagttttctcctacgaccacaa

SEQ ID NO: 586188 - DNA, 25 bp, Rattus norvegicus
tccgagttttctgctacgaccacaa

SEQ ID NO: 586189 - DNA, 25 bp, Rattus norvegicus
tccgatagatctcccctcttgaaaa

SEQ ID NO: 586190 - DNA, 25 bp, Rattus norvegicus
tccgatagatctgccctcttgaaaa

SEQ ID NO: 586191 - DNA, 25 bp, Rattus norvegicus
tccgatcaggagattctcgctgtta

SEQ ID NO: 586192 - DNA, 25 bp, Rattus norvegicus
tccgatcaggagtttctcgctgtta

SEQ ID NO: 586193 - DNA, 25 bp, Rattus norvegicus
tccgatcattcacaagttcctttac

SEQ ID NO: 586194 - DNA, 25 bp, Rattus norvegicus
tccgatcattcagaagttcctttac

SEQ ID NO: 586195 - DNA, 25 bp, Rattus norvegicus
tccgatgccctccttgacaaaaagg

SEQ ID NO: 586196 - DNA, 25 bp, Rattus norvegicus
tccgatgccctcgttgacaaaaagg

SEQ ID NO: 586197 - DNA, 25 bp, Rattus norvegicus
tccgatggctcgattgtctataatt

SEQ ID NO: 586198 - DNA, 25 bp, Rattus norvegicus
tccgatggctcgtttgtctataatt

SEQ ID NO: 586199 - DNA, 25 bp, Rattus norvegicus
tccgatggtcaacaacagtggtgtc

SEQ ID NO: 586200 - DNA, 25 bp, Rattus norvegicus
tccgatggtcaagaacagtggtgtc

SEQ ID NO: 586201 - DNA, 25 bp, Rattus norvegicus
tccgatgtgtaccaggagatgcctg

SEQ ID NO: 586202 - DNA, 25 bp, Rattus norvegicus
tccgatgtgtacgaggagatgcctg

SEQ ID NO: 586203 - DNA, 25 bp, Rattus norvegicus
tccgattcttccctgggcgagaaac

SEQ ID NO: 586204 - DNA, 25 bp, Rattus norvegicus
tccgattcttccgtgggcgagaaac

SEQ ID NO: 586205 - DNA, 25 bp, Rattus norvegicus
tccgattgttttcgctttccggtgg

SEQ ID NO: 586206 - DNA, 25 bp, Rattus norvegicus
tccgattgttttggctttccggtgg

SEQ ID NO: 586207 - DNA, 25 bp, Rattus norvegicus
tccgattttgtgatgattcagctaa

SEQ ID NO: 586208 - DNA, 25 bp, Rattus norvegicus
tccgattttgtgttgattcagctaa

SEQ ID NO: 586209 - DNA, 25 bp, Rattus norvegicus
tccgcaaagtgcaggacgccaatac

SEQ ID NO: 586210 - DNA, 25 bp, Rattus norvegicus
tccgcaaagtgctggacgccaatac

SEQ ID NO: 586211 - DNA, 25 bp, Rattus norvegicus
tccgcaagcctcatgtgggctgagg

SEQ ID NO: 586212 - DNA, 25 bp, Rattus norvegicus
tccgcaagcctcttgtgggctgagg

SEQ ID NO: 586213 - DNA, 25 bp, Rattus norvegicus
tccgcaaggtatagcaggctcgtga

SEQ ID NO: 586214 - DNA, 25 bp, Rattus norvegicus
tccgcaaggtattgcaggctcgtga

SEQ ID NO: 586215 - DNA, 25 bp, Rattus norvegicus
tccgcacaatttaccacttaagcag

SEQ ID NO: 586216 - DNA, 25 bp, Rattus norvegicus
tccgcacaattttccacttaagcag

SEQ ID NO: 586217 - DNA, 25 bp, Rattus norvegicus
tccgcacacagtacacggtgagcag

SEQ ID NO: 586218 - DNA, 25 bp, Rattus norvegicus
tccgcacacagttcacggtgagcag

SEQ ID NO: 586219 - DNA, 25 bp, Rattus norvegicus
tccgcaccaacgacagtaagtcaat

SEQ ID NO: 586220 - DNA, 25 bp, Rattus norvegicus
tccgcaccaacgtcagtaagtcaat

SEQ ID NO: 586221 - DNA, 25 bp, Rattus norvegicus
tccgcacccggtatgtgttttagat

SEQ ID NO: 586222 - DNA, 25 bp, Rattus norvegicus
tccgcacccggtttgtgttttagat

SEQ ID NO: 586223 - DNA, 25 bp, Rattus norvegicus
tccgcaccgcacctatacatgaatt

SEQ ID NO: 586224 - DNA, 25 bp, Rattus norvegicus
tccgcaccgcacgtatacatgaatt

SEQ ID NO: 586225 - DNA, 25 bp, Rattus norvegicus
tccgcacctagcatctttgggaaga

SEQ ID NO: 586226 - DNA, 25 bp, Rattus norvegicus
tccgcacctagcttctttgggaaga

SEQ ID NO: 586227 - DNA, 25 bp, Rattus norvegicus
tccgcacgggtgaggatgacgtcaa

SEQ ID NO: 586228 - DNA, 25 bp, Rattus norvegicus
tccgcacgggtgtggatgacgtcaa

SEQ ID NO: 586229 - DNA, 25 bp, Rattus norvegicus
tccgcagcttagactactgatcatc

SEQ ID NO: 586230 - DNA, 25 bp, Rattus norvegicus
tccgcagcttagtctactgatcatc

SEQ ID NO: 586231 - DNA, 25 bp, Rattus norvegicus
tccgcaggcatcacatggtctggaa

SEQ ID NO: 586232 - DNA, 25 bp, Rattus norvegicus
tccgcaggcatctcatggtctggaa

SEQ ID NO: 586233 - DNA, 25 bp, Rattus norvegicus
tccgcaggcggcagctcaaattcat

SEQ ID NO: 586234 - DNA, 25 bp, Rattus norvegicus
tccgcaggcggctgctcaaattcat

SEQ ID NO: 586235 - DNA, 25 bp, Rattus norvegicus
tccgcagggatgactatatccgggt

SEQ ID NO: 586236 - DNA, 25 bp, Rattus norvegicus
tccgcagggatgtctatatccgggt

SEQ ID NO: 586237 - DNA, 25 bp, Rattus norvegicus
tccgcagggcttaacatttaccttt

SEQ ID NO: 586238 - DNA, 25 bp, Rattus norvegicus
tccgcagggctttacatttaccttt

SEQ ID NO: 586239 - DNA, 25 bp, Rattus norvegicus
tccgcagggttcatatggtccatat

SEQ ID NO: 586240 - DNA, 25 bp, Rattus norvegicus
tccgcagggttcttatggtccatat

SEQ ID NO: 586241 - DNA, 25 bp, Rattus norvegicus
tccgcagtatggcttgtttatggta

SEQ ID NO: 586242 - DNA, 25 bp, Rattus norvegicus
tccgcagtatgggttgtttatggta

SEQ ID NO: 586243 - DNA, 25 bp, Rattus norvegicus
tccgcatattgtactttcctcaaag

SEQ ID NO: 586244 - DNA, 25 bp, Rattus norvegicus
tccgcatattgttctttcctcaaag

SEQ ID NO: 586245 - DNA, 25 bp, Rattus norvegicus
tccgcatctttgacaggaacgcaga

SEQ ID NO: 586246 - DNA, 25 bp, Rattus norvegicus
tccgcatctttgtcaggaacgcaga

SEQ ID NO: 586247 - DNA, 25 bp, Rattus norvegicus
tccgcatgcacgacggtgatggcaa

SEQ ID NO: 586248 - DNA, 25 bp, Rattus norvegicus
tccgcatgcacgtcggtgatggcaa

SEQ ID NO: 586249 - DNA, 25 bp, Rattus norvegicus
tccgcatggcaaagggaaaccccag

SEQ ID NO: 586250 - DNA, 25 bp, Rattus norvegicus
tccgcatggcaatgggaaaccccag

SEQ ID NO: 586251 - DNA, 25 bp, Rattus norvegicus
tccgcattctctacaagtcgatgtt

SEQ ID NO: 586252 - DNA, 25 bp, Rattus norvegicus
tccgcattctcttcaagtcgatgtt

SEQ ID NO: 586253 - DNA, 25 bp, Rattus norvegicus
tccgcattctgtagaccacaagcaa

SEQ ID NO: 586254 - DNA, 25 bp, Rattus norvegicus
tccgcattctgttgaccacaagcaa

SEQ ID NO: 586255 - DNA, 25 bp, Rattus norvegicus
tccgcattgcagctagtcacttatt

SEQ ID NO: 586256 - DNA, 25 bp, Rattus norvegicus
tccgcattgcaggtagtcacttatt

SEQ ID NO: 586257 - DNA, 25 bp, Rattus norvegicus
tccgcattgtacctgctgacatgga

SEQ ID NO: 586258 - DNA, 25 bp, Rattus norvegicus
tccgcattgtacgtgctgacatgga

SEQ ID NO: 586259 - DNA, 25 bp, Rattus norvegicus
tccgccaaaaaacacagggccccag

SEQ ID NO: 586260 - DNA, 25 bp, Rattus norvegicus
tccgccaaaaaagacagggccccag

SEQ ID NO: 586261 - DNA, 25 bp, Rattus norvegicus
tccgccaaggccctttagaggatct

SEQ ID NO: 586262 - DNA, 25 bp, Rattus norvegicus
tccgccaaggccgtttagaggatct

SEQ ID NO: 586263 - DNA, 25 bp, Rattus norvegicus
tccgccagccaacatgagtctgttt

SEQ ID NO: 586264 - DNA, 25 bp, Rattus norvegicus
tccgccagccaagatgagtctgttt

SEQ ID NO: 586265 - DNA, 25 bp, Rattus norvegicus
tccgccatattcacggctgttttat

SEQ ID NO: 586266 - DNA, 25 bp, Rattus norvegicus
tccgccatattctcggctgttttat

SEQ ID NO: 586267 - DNA, 25 bp, Rattus norvegicus
tccgccatcattaccagcagtgaaa

SEQ ID NO: 586268 - DNA, 25 bp, Rattus norvegicus
tccgccatcatttccagcagtgaaa

SEQ ID NO: 586269 - DNA, 25 bp, Rattus norvegicus
tccgcccaggttattttgctgggtg

SEQ ID NO: 586270 - DNA, 25 bp, Rattus norvegicus
tccgcccaggtttttttgctgggtg

SEQ ID NO: 586271 - DNA, 25 bp, Rattus norvegicus
tccgccccatttatattcacagaaa

SEQ ID NO: 586272 - DNA, 25 bp, Rattus norvegicus
tccgccccatttttattcacagaaa

SEQ ID NO: 586273 - DNA, 25 bp, Rattus norvegicus
tccgccctagacagctgtacttaga

SEQ ID NO: 586274 - DNA, 25 bp, Rattus norvegicus
tccgccctagactgctgtacttaga

SEQ ID NO: 586275 - DNA, 25 bp, Rattus norvegicus
tccgccgagctgaggaccaggattt

SEQ ID NO: 586276 - DNA, 25 bp, Rattus norvegicus
tccgccgagctgtggaccaggattt

SEQ ID NO: 586277 - DNA, 25 bp, Rattus norvegicus
tccgccgcctgtcgatgagcacttg

SEQ ID NO: 586278 - DNA, 25 bp, Rattus norvegicus
tccgccgcctgtggatgagcacttg

SEQ ID NO: 586279 - DNA, 25 bp, Rattus norvegicus
tccgccgggagccacccatgataag

SEQ ID NO: 586280 - DNA, 25 bp, Rattus norvegicus
tccgccgggagcgacccatgataag

SEQ ID NO: 586281 - DNA, 25 bp, Rattus norvegicus
tccgccgtgcacctcaagaacgaaa

SEQ ID NO: 586282 - DNA, 25 bp, Rattus norvegicus
tccgccgtgcacgtcaagaacgaaa

SEQ ID NO: 586283 - DNA, 25 bp, Rattus norvegicus
tccgcctagtgacttcattacagag

SEQ ID NO: 586284 - DNA, 25 bp, Rattus norvegicus
tccgcctagtgagttcattacagag

SEQ ID NO: 586285 - DNA, 25 bp, Rattus norvegicus
tccgcctcaccaattgggcaaggag

SEQ ID NO: 586286 - DNA, 25 bp, Rattus norvegicus
tccgcctcaccatttgggcaaggag

SEQ ID NO: 586287 - DNA, 25 bp, Rattus norvegicus
tccgcctccagaaaacttcagttga

SEQ ID NO: 586288 - DNA, 25 bp, Rattus norvegicus
tccgcctccagataacttcagttga

SEQ ID NO: 586289 - DNA, 25 bp, Rattus norvegicus
tccgcctccagcagagagtgttaag

SEQ ID NO: 586290 - DNA, 25 bp, Rattus norvegicus
tccgcctccagctgagagtgttaag

SEQ ID NO: 586291 - DNA, 25 bp, Rattus norvegicus
tccgcctcgtggcaattagtgcaga

SEQ ID NO: 586292 - DNA, 25 bp, Rattus norvegicus
tccgcctcgtgggaattagtgcaga

SEQ ID NO: 586293 - DNA, 25 bp, Rattus norvegicus
tccgcctgacccataatcggtaata

SEQ ID NO: 586294 - DNA, 25 bp, Rattus norvegicus
tccgcctgacccttaatcggtaata

SEQ ID NO: 586295 - DNA, 25 bp, Rattus norvegicus
tccgcctgtgtccaagagagagtcc

SEQ ID NO: 586296 - DNA, 25 bp, Rattus norvegicus
tccgcctgtgtcgaagagagagtcc

SEQ ID NO: 586297 - DNA, 25 bp, Rattus norvegicus
tccgcctgttccaagcattgaagag

SEQ ID NO: 586298 - DNA, 25 bp, Rattus norvegicus
tccgcctgttcctagcattgaagag

SEQ ID NO: 586299 - DNA, 25 bp, Rattus norvegicus
tccgccttatcccttggagattttc

SEQ ID NO: 586300 - DNA, 25 bp, Rattus norvegicus
tccgccttatccgttggagattttc

SEQ ID NO: 586301 - DNA, 25 bp, Rattus norvegicus
tccgccttccttaagaatgcctggg

SEQ ID NO: 586302 - DNA, 25 bp, Rattus norvegicus
tccgccttcctttagaatgcctggg

SEQ ID NO: 586303 - DNA, 25 bp, Rattus norvegicus
tccgccttggtacgtttggtgttct

SEQ ID NO: 586304 - DNA, 25 bp, Rattus norvegicus
tccgccttggtaggtttggtgttct

SEQ ID NO: 586305 - DNA, 25 bp, Rattus norvegicus
tccgcctttagacggtagaactctg

SEQ ID NO: 586306 - DNA, 25 bp, Rattus norvegicus
tccgcctttagagggtagaactctg

SEQ ID NO: 586307 - DNA, 25 bp, Rattus norvegicus
tccgccttttcccatttaacagtgg

SEQ ID NO: 586308 - DNA, 25 bp, Rattus norvegicus
tccgccttttccgatttaacagtgg

SEQ ID NO: 586309 - DNA, 25 bp, Rattus norvegicus
tccgccttttgacatgcattgccaa

SEQ ID NO: 586310 - DNA, 25 bp, Rattus norvegicus
tccgccttttgagatgcattgccaa

SEQ ID NO: 586311 - DNA, 25 bp, Rattus norvegicus
tccgcgagcgccagcggccgtggag

SEQ ID NO: 586312 - DNA, 25 bp, Rattus norvegicus
tccgcgagcgcctgcggccgtggag

SEQ ID NO: 586313 - DNA, 25 bp, Rattus norvegicus
tccgcgccgagcagcagtgtgcctg

SEQ ID NO: 586314 - DNA, 25 bp, Rattus norvegicus
tccgcgccgagctgcagtgtgcctg

SEQ ID NO: 586315 - DNA, 25 bp, Rattus norvegicus
tccgcgcttcgcagaggggtattag

SEQ ID NO: 586316 - DNA, 25 bp, Rattus norvegicus
tccgcgcttcgctgaggggtattag

SEQ ID NO: 586317 - DNA, 25 bp, Rattus norvegicus
tccgcggacgcgacattgttcttga

SEQ ID NO: 586318 - DNA, 25 bp, Rattus norvegicus
tccgcggacgcgtcattgttcttga

SEQ ID NO: 586319 - DNA, 25 bp, Rattus norvegicus
tccgcggcatctcctatcgagagaa

SEQ ID NO: 586320 - DNA, 25 bp, Rattus norvegicus
tccgcggcatctgctatcgagagaa

SEQ ID NO: 586321 - DNA, 25 bp, Rattus norvegicus
tccgcggcccgacagggaagaaact

SEQ ID NO: 586322 - DNA, 25 bp, Rattus norvegicus
tccgcggcccgagagggaagaaact

SEQ ID NO: 586323 - DNA, 25 bp, Rattus norvegicus
tccgcgtccatgaatgagggcaaga

SEQ ID NO: 586324 - DNA, 25 bp, Rattus norvegicus
tccgcgtccatgtatgagggcaaga

SEQ ID NO: 586325 - DNA, 25 bp, Rattus norvegicus
tccgcgtcctggagttcaagagaga

SEQ ID NO: 586326 - DNA, 25 bp, Rattus norvegicus
tccgcgtcctggtgttcaagagaga

SEQ ID NO: 586327 - DNA, 25 bp, Rattus norvegicus
tccgcgtctggtagggcttgaactt

SEQ ID NO: 586328 - DNA, 25 bp, Rattus norvegicus
tccgcgtctggttgggcttgaactt

SEQ ID NO: 586329 - DNA, 25 bp, Rattus norvegicus
tccgctaaagcgctgtatgagcatt

SEQ ID NO: 586330 - DNA, 25 bp, Rattus norvegicus
tccgctaaagcggtgtatgagcatt

SEQ ID NO: 586331 - DNA, 25 bp, Rattus norvegicus
tccgctaagcccagcagaattaatg

SEQ ID NO: 586332 - DNA, 25 bp, Rattus norvegicus
tccgctaagccctgcagaattaatg

SEQ ID NO: 586333 - DNA, 25 bp, Rattus norvegicus
tccgctacttacatgagattcatta

SEQ ID NO: 586334 - DNA, 25 bp, Rattus norvegicus
tccgctacttacttgagattcatta

SEQ ID NO: 586335 - DNA, 25 bp, Rattus norvegicus
tccgctatagcgcactacgtataag

SEQ ID NO: 586336 - DNA, 25 bp, Rattus norvegicus
tccgctatagcggactacgtataag

SEQ ID NO: 586337 - DNA, 25 bp, Rattus norvegicus
tccgctatctctacggtggattaat

SEQ ID NO: 586338 - DNA, 25 bp, Rattus norvegicus
tccgctatctcttcggtggattaat

SEQ ID NO: 586339 - DNA, 25 bp, Rattus norvegicus
tccgctcactggcatgtcggccgag

SEQ ID NO: 586340 - DNA, 25 bp, Rattus norvegicus
tccgctcactgggatgtcggccgag

SEQ ID NO: 586341 - DNA, 25 bp, Rattus norvegicus
tccgctcaggtcctgtctctcttta

SEQ ID NO: 586342 - DNA, 25 bp, Rattus norvegicus
tccgctcaggtcgtgtctctcttta

SEQ ID NO: 586343 - DNA, 25 bp, Rattus norvegicus
tccgctccatcgaggcacaattaag

SEQ ID NO: 586344 - DNA, 25 bp, Rattus norvegicus
tccgctccatcgtggcacaattaag

SEQ ID NO: 586345 - DNA, 25 bp, Rattus norvegicus
tccgctctgcccagatagatgagaa

SEQ ID NO: 586346 - DNA, 25 bp, Rattus norvegicus
tccgctctgccctgatagatgagaa

SEQ ID NO: 586347 - DNA, 25 bp, Rattus norvegicus
tccgctctgtgcactgtaggtcatt

SEQ ID NO: 586348 - DNA, 25 bp, Rattus norvegicus
tccgctctgtgctctgtaggtcatt

SEQ ID NO: 586349 - DNA, 25 bp, Rattus norvegicus
tccgctcttagtcaactggtgtaat

SEQ ID NO: 586350 - DNA, 25 bp, Rattus norvegicus
tccgctcttagtgaactggtgtaat

SEQ ID NO: 586351 - DNA, 25 bp, Rattus norvegicus
tccgctgaacctactatgaggccag

SEQ ID NO: 586352 - DNA, 25 bp, Rattus norvegicus
tccgctgaaccttctatgaggccag

SEQ ID NO: 586353 - DNA, 25 bp, Rattus norvegicus
tccgctgaggttatcttgaccaaaa

SEQ ID NO: 586354 - DNA, 25 bp, Rattus norvegicus
tccgctgaggttttcttgaccaaaa

SEQ ID NO: 586355 - DNA, 25 bp, Rattus norvegicus
tccgctgccacaagggtgtcgtttt

SEQ ID NO: 586356 - DNA, 25 bp, Rattus norvegicus
tccgctgccacatgggtgtcgtttt

SEQ ID NO: 586357 - DNA, 25 bp, Rattus norvegicus
tccgctgccagtatgccaatggaat

SEQ ID NO: 586358 - DNA, 25 bp, Rattus norvegicus
tccgctgccagtttgccaatggaat

SEQ ID NO: 586359 - DNA, 25 bp, Rattus norvegicus
tccgctgcgtttacaggactgactc

SEQ ID NO: 586360 - DNA, 25 bp, Rattus norvegicus
tccgctgcgttttcaggactgactc

SEQ ID NO: 586361 - DNA, 25 bp, Rattus norvegicus
tccgctgctgtgaggtagattgtct

SEQ ID NO: 586362 - DNA, 25 bp, Rattus norvegicus
tccgctgctgtgtggtagattgtct

SEQ ID NO: 586363 - DNA, 25 bp, Rattus norvegicus
tccgctggagctctctgccaaaaga

SEQ ID NO: 586364 - DNA, 25 bp, Rattus norvegicus
tccgctggagctgtctgccaaaaga

SEQ ID NO: 586365 - DNA, 25 bp, Rattus norvegicus
tccgctggctttcccagtatattga

SEQ ID NO: 586366 - DNA, 25 bp, Rattus norvegicus
tccgctggctttgccagtatattga

SEQ ID NO: 586367 - DNA, 25 bp, Rattus norvegicus
tccgctggtagcaagtgattctctt

SEQ ID NO: 586368 - DNA, 25 bp, Rattus norvegicus
tccgctggtagctagtgattctctt

SEQ ID NO: 586369 - DNA, 25 bp, Rattus norvegicus
tccgctgtagatctgctcctcttgg

SEQ ID NO: 586370 - DNA, 25 bp, Rattus norvegicus
tccgctgtagatgtgctcctcttgg

SEQ ID NO: 586371 - DNA, 25 bp, Rattus norvegicus
tccgctgtatccagcgcctggctga

SEQ ID NO: 586372 - DNA, 25 bp, Rattus norvegicus
tccgctgtatcctgcgcctggctga

SEQ ID NO: 586373 - DNA, 25 bp, Rattus norvegicus
tccgctgtcttgagtacttttgtac

SEQ ID NO: 586374 - DNA, 25 bp, Rattus norvegicus
tccgctgtcttgtgtacttttgtac

SEQ ID NO: 586375 - DNA, 25 bp, Rattus norvegicus
tccgctgttgctcgtgtctgttaca

SEQ ID NO: 586376 - DNA, 25 bp, Rattus norvegicus
tccgctgttgctggtgtctgttaca

SEQ ID NO: 586377 - DNA, 25 bp, Rattus norvegicus
tccgcttacactctcaacgatgtga

SEQ ID NO: 586378 - DNA, 25 bp, Rattus norvegicus
tccgcttacactgtcaacgatgtga

SEQ ID NO: 586379 - DNA, 25 bp, Rattus norvegicus
tccgcttcaatgaggccaagtcact

SEQ ID NO: 586380 - DNA, 25 bp, Rattus norvegicus
tccgcttcaatgtggccaagtcact

SEQ ID NO: 586381 - DNA, 25 bp, Rattus norvegicus
tccgcttcatttatcttctttgaga

SEQ ID NO: 586382 - DNA, 25 bp, Rattus norvegicus
tccgcttcatttttcttctttgaga

SEQ ID NO: 586383 - DNA, 25 bp, Rattus norvegicus
tccgcttccagaacatggctgcaag

SEQ ID NO: 586384 - DNA, 25 bp, Rattus norvegicus
tccgcttccagatcatggctgcaag

SEQ ID NO: 586385 - DNA, 25 bp, Rattus norvegicus
tccgcttccgttaccgtatactggg

SEQ ID NO: 586386 - DNA, 25 bp, Rattus norvegicus
tccgcttccgtttccgtatactggg

SEQ ID NO: 586387 - DNA, 25 bp, Rattus norvegicus
tccgcttgcgacatcaaggacagga

SEQ ID NO: 586388 - DNA, 25 bp, Rattus norvegicus
tccgcttgcgacttcaaggacagga

SEQ ID NO: 586389 - DNA, 25 bp, Rattus norvegicus
tccgcttgtgttcatgtcgatttac

SEQ ID NO: 586390 - DNA, 25 bp, Rattus norvegicus
tccgcttgtgttgatgtcgatttac

SEQ ID NO: 586391 - DNA, 25 bp, Rattus norvegicus
tccgctttatgcagtgcgttttcag

SEQ ID NO: 586392 - DNA, 25 bp, Rattus norvegicus
tccgctttatgctgtgcgttttcag

SEQ ID NO: 586393 - DNA, 25 bp, Rattus norvegicus
tccgctttgatgcagccctcaacgt

SEQ ID NO: 586394 - DNA, 25 bp, Rattus norvegicus
tccgctttgatggagccctcaacgt

SEQ ID NO: 586395 - DNA, 25 bp, Rattus norvegicus
tccgctttggctcgtggtagagaac

SEQ ID NO: 586396 - DNA, 25 bp, Rattus norvegicus
tccgctttggctggtggtagagaac

SEQ ID NO: 586397 - DNA, 25 bp, Rattus norvegicus
tccggaaatctcaagttaaccttgg

SEQ ID NO: 586398 - DNA, 25 bp, Rattus norvegicus
tccggaaatctctagttaaccttgg

SEQ ID NO: 586399 - DNA, 25 bp, Rattus norvegicus
tccggaacccatcattgagtctaca

SEQ ID NO: 586400 - DNA, 25 bp, Rattus norvegicus
tccggaacccatgattgagtctaca

SEQ ID NO: 586401 - DNA, 25 bp, Rattus norvegicus
tccggaacccggcttctagaacgag

SEQ ID NO: 586402 - DNA, 25 bp, Rattus norvegicus
tccggaacccgggttctagaacgag

SEQ ID NO: 586403 - DNA, 25 bp, Rattus norvegicus
tccggaaccgagatgaggtttcctt

SEQ ID NO: 586404 - DNA, 25 bp, Rattus norvegicus
tccggaaccgagttgaggtttcctt

SEQ ID NO: 586405 - DNA, 25 bp, Rattus norvegicus
tccggaacctcaacatcgacgatga

SEQ ID NO: 586406 - DNA, 25 bp, Rattus norvegicus
tccggaacctcatcatcgacgatga

SEQ ID NO: 586407 - DNA, 25 bp, Rattus norvegicus
tccggaacctctaagtgtcttatac

SEQ ID NO: 586408 - DNA, 25 bp, Rattus norvegicus
tccggaacctcttagtgtcttatac

SEQ ID NO: 586409 - DNA, 25 bp, Rattus norvegicus
tccggaactggccttttcaaatgtg

SEQ ID NO: 586410 - DNA, 25 bp, Rattus norvegicus
tccggaactggcgttttcaaatgtg

SEQ ID NO: 586411 - DNA, 25 bp, Rattus norvegicus
tccggaagtgcccatgacagagctg

SEQ ID NO: 586412 - DNA, 25 bp, Rattus norvegicus
tccggaagtgccgatgacagagctg

SEQ ID NO: 586413 - DNA, 25 bp, Rattus norvegicus
tccggaatccgtaacatcagcttta

SEQ ID NO: 586414 - DNA, 25 bp, Rattus norvegicus
tccggaatccgttacatcagcttta

SEQ ID NO: 586415 - DNA, 25 bp, Rattus norvegicus
tccggaatgacaatgctgccaagta

SEQ ID NO: 586416 - DNA, 25 bp, Rattus norvegicus
tccggaatgacattgctgccaagta

SEQ ID NO: 586417 - DNA, 25 bp, Rattus norvegicus
tccggacaaccgaagtgactttgga

SEQ ID NO: 586418 - DNA, 25 bp, Rattus norvegicus
tccggacaaccgtagtgactttgga

SEQ ID NO: 586419 - DNA, 25 bp, Rattus norvegicus
tccggaccaagaccatctgggtacg

SEQ ID NO: 586420 - DNA, 25 bp, Rattus norvegicus
tccggaccaagagcatctgggtacg

SEQ ID NO: 586421 - DNA, 25 bp, Rattus norvegicus
tccggaccaggcatggtttcaagtt

SEQ ID NO: 586422 - DNA, 25 bp, Rattus norvegicus
tccggaccaggcttggtttcaagtt

SEQ ID NO: 586423 - DNA, 25 bp, Rattus norvegicus
tccggacctctgagattcctgtctg

SEQ ID NO: 586424 - DNA, 25 bp, Rattus norvegicus
tccggacctctgtgattcctgtctg

SEQ ID NO: 586425 - DNA, 25 bp, Rattus norvegicus
tccggacgtctgatttgcactgaat

SEQ ID NO: 586426 - DNA, 25 bp, Rattus norvegicus
tccggacgtctgttttgcactgaat

SEQ ID NO: 586427 - DNA, 25 bp, Rattus norvegicus
tccggactgcacacgggctgcggct

SEQ ID NO: 586428 - DNA, 25 bp, Rattus norvegicus
tccggactgcactcgggctgcggct

SEQ ID NO: 586429 - DNA, 25 bp, Rattus norvegicus
tccggactgcgtcgaagctgagcca

SEQ ID NO: 586430 - DNA, 25 bp, Rattus norvegicus
tccggactgcgtggaagctgagcca

SEQ ID NO: 586431 - DNA, 25 bp, Rattus norvegicus
tccggacttaacaaaacaggcacta

SEQ ID NO: 586432 - DNA, 25 bp, Rattus norvegicus
tccggacttaactaaacaggcacta

SEQ ID NO: 586433 - DNA, 25 bp, Rattus norvegicus
tccggactttctagcacacagtgca

SEQ ID NO: 586434 - DNA, 25 bp, Rattus norvegicus
tccggactttcttgcacacagtgca

SEQ ID NO: 586435 - DNA, 25 bp, Rattus norvegicus
tccggagacgcacgacattcccatg

SEQ ID NO: 586436 - DNA, 25 bp, Rattus norvegicus
tccggagacgcaggacattcccatg

SEQ ID NO: 586437 - DNA, 25 bp, Rattus norvegicus
tccggagactccaaaagtgtgctaa

SEQ ID NO: 586438 - DNA, 25 bp, Rattus norvegicus
tccggagactcctaaagtgtgctaa

SEQ ID NO: 586439 - DNA, 25 bp, Rattus norvegicus
tccggagagaccaacacctgtgttg

SEQ ID NO: 586440 - DNA, 25 bp, Rattus norvegicus
tccggagagacctacacctgtgttg

SEQ ID NO: 586441 - DNA, 25 bp, Rattus norvegicus
tccggagagcgaccagatgattact

SEQ ID NO: 586442 - DNA, 25 bp, Rattus norvegicus
tccggagagcgagcagatgattact

SEQ ID NO: 586443 - DNA, 25 bp, Rattus norvegicus
tccggagatattaaacacattgatg

SEQ ID NO: 586444 - DNA, 25 bp, Rattus norvegicus
tccggagatatttaacacattgatg

SEQ ID NO: 586445 - DNA, 25 bp, Rattus norvegicus
tccggagccgccattggaggagcta

SEQ ID NO: 586446 - DNA, 25 bp, Rattus norvegicus
tccggagccgcctttggaggagcta

SEQ ID NO: 586447 - DNA, 25 bp, Rattus norvegicus
tccggagccggtcctgctgcaaagt

SEQ ID NO: 586448 - DNA, 25 bp, Rattus norvegicus
tccggagccggtgctgctgcaaagt

SEQ ID NO: 586449 - DNA, 25 bp, Rattus norvegicus
tccggagcgggcaaacagcctagat

SEQ ID NO: 586450 - DNA, 25 bp, Rattus norvegicus
tccggagcgggctaacagcctagat

SEQ ID NO: 586451 - DNA, 25 bp, Rattus norvegicus
tccggaggcgagcacaaacgcactt

SEQ ID NO: 586452 - DNA, 25 bp, Rattus norvegicus
tccggaggcgaggacaaacgcactt

SEQ ID NO: 586453 - DNA, 25 bp, Rattus norvegicus
tccggaggcggcacacccgaagctg

SEQ ID NO: 586454 - DNA, 25 bp, Rattus norvegicus
tccggaggcggctcacccgaagctg

SEQ ID NO: 586455 - DNA, 25 bp, Rattus norvegicus
tccggagtgtagacgcgccggctct

SEQ ID NO: 586456 - DNA, 25 bp, Rattus norvegicus
tccggagtgtagtcgcgccggctct

SEQ ID NO: 586457 - DNA, 25 bp, Rattus norvegicus
tccggatatcagaatcgctatacag

SEQ ID NO: 586458 - DNA, 25 bp, Rattus norvegicus
tccggatatcagtatcgctatacag

SEQ ID NO: 586459 - DNA, 25 bp, Rattus norvegicus
tccggatattcaccctgtaggctgg

SEQ ID NO: 586460 - DNA, 25 bp, Rattus norvegicus
tccggatattcagcctgtaggctgg

SEQ ID NO: 586461 - DNA, 25 bp, Rattus norvegicus
tccggatcacggcaatgcggctgca

SEQ ID NO: 586462 - DNA, 25 bp, Rattus norvegicus
tccggatcacgggaatgcggctgca

SEQ ID NO: 586463 - DNA, 25 bp, Rattus norvegicus
tccggatccggaaatcacttggttt

SEQ ID NO: 586464 - DNA, 25 bp, Rattus norvegicus
tccggatccggatatcacttggttt

SEQ ID NO: 586465 - DNA, 25 bp, Rattus norvegicus
tccggatgttccagaaactacactt

SEQ ID NO: 586466 - DNA, 25 bp, Rattus norvegicus
tccggatgttcctgaaactacactt

SEQ ID NO: 586467 - DNA, 25 bp, Rattus norvegicus
tccggcaccagactgttcactgtag

SEQ ID NO: 586468 - DNA, 25 bp, Rattus norvegicus
tccggcaccagagtgttcactgtag

SEQ ID NO: 586469 - DNA, 25 bp, Rattus norvegicus
tccggcactggaacaaccctaagaa

SEQ ID NO: 586470 - DNA, 25 bp, Rattus norvegicus
tccggcactggatcaaccctaagaa

SEQ ID NO: 586471 - DNA, 25 bp, Rattus norvegicus
tccggccactgaccttgcacagata

SEQ ID NO: 586472 - DNA, 25 bp, Rattus norvegicus
tccggccactgagcttgcacagata

SEQ ID NO: 586473 - DNA, 25 bp, Rattus norvegicus
tccggccagtgcatcacggtggaga

SEQ ID NO: 586474 - DNA, 25 bp, Rattus norvegicus
tccggccagtgcttcacggtggaga

SEQ ID NO: 586475 - DNA, 25 bp, Rattus norvegicus
tccggccctggcaactgtttaaagg

SEQ ID NO: 586476 - DNA, 25 bp, Rattus norvegicus
tccggccctggctactgtttaaagg

SEQ ID NO: 586477 - DNA, 25 bp, Rattus norvegicus
tccggcccttgcctagcaatagaga

SEQ ID NO: 586478 - DNA, 25 bp, Rattus norvegicus
tccggcccttgcgtagcaatagaga

SEQ ID NO: 586479 - DNA, 25 bp, Rattus norvegicus
tccggccgacagatacagacttgaa

SEQ ID NO: 586480 - DNA, 25 bp, Rattus norvegicus
tccggccgacagttacagacttgaa

SEQ ID NO: 586481 - DNA, 25 bp, Rattus norvegicus
tccggccggtggaagccctagcttg

SEQ ID NO: 586482 - DNA, 25 bp, Rattus norvegicus
tccggccggtggtagccctagcttg

SEQ ID NO: 586483 - DNA, 25 bp, Rattus norvegicus
tccggcctccatctctctgagggaa

SEQ ID NO: 586484 - DNA, 25 bp, Rattus norvegicus
tccggcctccatgtctctgagggaa

SEQ ID NO: 586485 - DNA, 25 bp, Rattus norvegicus
tccggcctcttactagtgtttgttt

SEQ ID NO: 586486 - DNA, 25 bp, Rattus norvegicus
tccggcctcttagtagtgtttgttt

SEQ ID NO: 586487 - DNA, 25 bp, Rattus norvegicus
tccggccttcaacatcacagacagg

SEQ ID NO: 586488 - DNA, 25 bp, Rattus norvegicus
tccggccttcaagatcacagacagg

SEQ ID NO: 586489 - DNA, 25 bp, Rattus norvegicus
tccggcgaaaagactggtgtgatac

SEQ ID NO: 586490 - DNA, 25 bp, Rattus norvegicus
tccggcgaaaagtctggtgtgatac

SEQ ID NO: 586491 - DNA, 25 bp, Rattus norvegicus
tccggcggtcaacgtttcctgaaat

SEQ ID NO: 586492 - DNA, 25 bp, Rattus norvegicus
tccggcggtcaaggtttcctgaaat

SEQ ID NO: 586493 - DNA, 25 bp, Rattus norvegicus
tccggctactggcaccaaatcgaaa

SEQ ID NO: 586494 - DNA, 25 bp, Rattus norvegicus
tccggctactgggaccaaatcgaaa

SEQ ID NO: 586495 - DNA, 25 bp, Rattus norvegicus
tccggctagcacacccaagcgagtg

SEQ ID NO: 586496 - DNA, 25 bp, Rattus norvegicus
tccggctagcactcccaagcgagtg

SEQ ID NO: 586497 - DNA, 25 bp, Rattus norvegicus
tccggctcaggcacggagtcggtct

SEQ ID NO: 586498 - DNA, 25 bp, Rattus norvegicus
tccggctcaggctcggagtcggtct

SEQ ID NO: 586499 - DNA, 25 bp, Rattus norvegicus
tccggctccaaactagcaagtgcgt

SEQ ID NO: 586500 - DNA, 25 bp, Rattus norvegicus
tccggctccaaagtagcaagtgcgt

SEQ ID NO: 586501 - DNA, 25 bp, Rattus norvegicus
tccggctcctacaaaggaagcgact

SEQ ID NO: 586502 - DNA, 25 bp, Rattus norvegicus
tccggctcctactaaggaagcgact

SEQ ID NO: 586503 - DNA, 25 bp, Rattus norvegicus
tccggctccttcaaactcaacaaga

SEQ ID NO: 586504 - DNA, 25 bp, Rattus norvegicus
tccggctccttctaactcaacaaga

SEQ ID NO: 586505 - DNA, 25 bp, Rattus norvegicus
tccggctcgaagcttctgggttaca

SEQ ID NO: 586506 - DNA, 25 bp, Rattus norvegicus
tccggctcgaaggttctgggttaca

SEQ ID NO: 586507 - DNA, 25 bp, Rattus norvegicus
tccggctctagcaagttgcctggca

SEQ ID NO: 586508 - DNA, 25 bp, Rattus norvegicus
tccggctctagctagttgcctggca

SEQ ID NO: 586509 - DNA, 25 bp, Rattus norvegicus
tccggctcttccaggtgcaacaaaa

SEQ ID NO: 586510 - DNA, 25 bp, Rattus norvegicus
tccggctcttcctggtgcaacaaaa

SEQ ID NO: 586511 - DNA, 25 bp, Rattus norvegicus
tccggctgcaagatccattttttaa

SEQ ID NO: 586512 - DNA, 25 bp, Rattus norvegicus
tccggctgcaagttccattttttaa

SEQ ID NO: 586513 - DNA, 25 bp, Rattus norvegicus
tccggctgcattagagacgtctcaa

SEQ ID NO: 586514 - DNA, 25 bp, Rattus norvegicus
tccggctgcatttgagacgtctcaa

SEQ ID NO: 586515 - DNA, 25 bp, Rattus norvegicus
tccggctgcgcaaggttcgtgcaag

SEQ ID NO: 586516 - DNA, 25 bp, Rattus norvegicus
tccggctgcgcatggttcgtgcaag

SEQ ID NO: 586517 - DNA, 25 bp, Rattus norvegicus
tccggctgtggaagttgtagaccct

SEQ ID NO: 586518 - DNA, 25 bp, Rattus norvegicus
tccggctgtggatgttgtagaccct

SEQ ID NO: 586519 - DNA, 25 bp, Rattus norvegicus
tccggctgtgtgctgtcaggtctct

SEQ ID NO: 586520 - DNA, 25 bp, Rattus norvegicus
tccggctgtgtggtgtcaggtctct

SEQ ID NO: 586521 - DNA, 25 bp, Rattus norvegicus
tccggctgtttcctacagggcaggt

SEQ ID NO: 586522 - DNA, 25 bp, Rattus norvegicus
tccggctgtttcgtacagggcaggt

SEQ ID NO: 586523 - DNA, 25 bp, Rattus norvegicus
tccggcttcaggatgctcatggtga

SEQ ID NO: 586524 - DNA, 25 bp, Rattus norvegicus
tccggcttcaggttgctcatggtga

SEQ ID NO: 586525 - DNA, 25 bp, Rattus norvegicus
tccggcttcggcagcatagttctga

SEQ ID NO: 586526 - DNA, 25 bp, Rattus norvegicus
tccggcttcggctgcatagttctga

SEQ ID NO: 586527 - DNA, 25 bp, Rattus norvegicus
tccggcttttgcactgtgaattcag

SEQ ID NO: 586528 - DNA, 25 bp, Rattus norvegicus
tccggcttttgctctgtgaattcag

SEQ ID NO: 586529 - DNA, 25 bp, Rattus norvegicus
tccgggaactagaagctgagcgctt

SEQ ID NO: 586530 - DNA, 25 bp, Rattus norvegicus
tccgggaactagtagctgagcgctt

SEQ ID NO: 586531 - DNA, 25 bp, Rattus norvegicus
tccgggaagcctatctggatacctt

SEQ ID NO: 586532 - DNA, 25 bp, Rattus norvegicus
tccgggaagcctttctggatacctt

SEQ ID NO: 586533 - DNA, 25 bp, Rattus norvegicus
tccgggaaggtccaaccaaggctgt

SEQ ID NO: 586534 - DNA, 25 bp, Rattus norvegicus
tccgggaaggtcgaaccaaggctgt

SEQ ID NO: 586535 - DNA, 25 bp, Rattus norvegicus
tccgggaatcggacacacaaatcat

SEQ ID NO: 586536 - DNA, 25 bp, Rattus norvegicus
tccgggaatcggtcacacaaatcat

SEQ ID NO: 586537 - DNA, 25 bp, Rattus norvegicus
tccgggaccgccaggtattgggcaa

SEQ ID NO: 586538 - DNA, 25 bp, Rattus norvegicus
tccgggaccgcctggtattgggcaa

SEQ ID NO: 586539 - DNA, 25 bp, Rattus norvegicus
tccgggacctacagctgcagaatac

SEQ ID NO: 586540 - DNA, 25 bp, Rattus norvegicus
tccgggacctactgctgcagaatac

SEQ ID NO: 586541 - DNA, 25 bp, Rattus norvegicus
tccgggacttggactgaggcatctt

SEQ ID NO: 586542 - DNA, 25 bp, Rattus norvegicus
tccgggacttggtctgaggcatctt

SEQ ID NO: 586543 - DNA, 25 bp, Rattus norvegicus
tccgggactttcaccgggtccagag

SEQ ID NO: 586544 - DNA, 25 bp, Rattus norvegicus
tccgggactttctccgggtccagag

SEQ ID NO: 586545 - DNA, 25 bp, Rattus norvegicus
tccgggactttgactttgtgtctaa

SEQ ID NO: 586546 - DNA, 25 bp, Rattus norvegicus
tccgggactttgtctttgtgtctaa

SEQ ID NO: 586547 - DNA, 25 bp, Rattus norvegicus
tccgggagctacacgatatgttcat

SEQ ID NO: 586548 - DNA, 25 bp, Rattus norvegicus
tccgggagctactcgatatgttcat

SEQ ID NO: 586549 - DNA, 25 bp, Rattus norvegicus
tccgggatagttatcaggtttgact

SEQ ID NO: 586550 - DNA, 25 bp, Rattus norvegicus
tccgggatagttttcaggtttgact

SEQ ID NO: 586551 - DNA, 25 bp, Rattus norvegicus
tccgggatatacacctcgagatagg

SEQ ID NO: 586552 - DNA, 25 bp, Rattus norvegicus
tccgggatatactcctcgagatagg

SEQ ID NO: 586553 - DNA, 25 bp, Rattus norvegicus
tccgggatccaaaaaccagagtgtg

SEQ ID NO: 586554 - DNA, 25 bp, Rattus norvegicus
tccgggatccaataaccagagtgtg

SEQ ID NO: 586555 - DNA, 25 bp, Rattus norvegicus
tccgggatgctcctttgtttatagc

SEQ ID NO: 586556 - DNA, 25 bp, Rattus norvegicus
tccgggatgctcgtttgtttatagc

SEQ ID NO: 586557 - DNA, 25 bp, Rattus norvegicus
tccgggcagcggattcaccagagga

SEQ ID NO: 586558 - DNA, 25 bp, Rattus norvegicus
tccgggcagcggtttcaccagagga

SEQ ID NO: 586559 - DNA, 25 bp, Rattus norvegicus
tccgggcccaaacgccgtctttatg

SEQ ID NO: 586560 - DNA, 25 bp, Rattus norvegicus
tccgggcccaaaggccgtctttatg

SEQ ID NO: 586561 - DNA, 25 bp, Rattus norvegicus
tccgggcgcctaagcacgttgtgta

SEQ ID NO: 586562 - DNA, 25 bp, Rattus norvegicus
tccgggcgcctatgcacgttgtgta

SEQ ID NO: 586563 - DNA, 25 bp, Rattus norvegicus
tccgggcgggagattgcaaacctca

SEQ ID NO: 586564 - DNA, 25 bp, Rattus norvegicus
tccgggcgggagtttgcaaacctca

SEQ ID NO: 586565 - DNA, 25 bp, Rattus norvegicus
tccgggcgtcaaactcagatcgtta

SEQ ID NO: 586566 - DNA, 25 bp, Rattus norvegicus
tccgggcgtcaatctcagatcgtta

SEQ ID NO: 586567 - DNA, 25 bp, Rattus norvegicus
tccgggctcatcaactccagactga

SEQ ID NO: 586568 - DNA, 25 bp, Rattus norvegicus
tccgggctcatctactccagactga

SEQ ID NO: 586569 - DNA, 25 bp, Rattus norvegicus
tccgggctgcagatgtcgtagacca

SEQ ID NO: 586570 - DNA, 25 bp, Rattus norvegicus
tccgggctgcagttgtcgtagacca

SEQ ID NO: 586571 - DNA, 25 bp, Rattus norvegicus
tccggggcacagagatcagcatttg

SEQ ID NO: 586572 - DNA, 25 bp, Rattus norvegicus
tccggggcacagtgatcagcatttg

SEQ ID NO: 586573 - DNA, 25 bp, Rattus norvegicus
tccggggcgctgcatagagtgctgt

SEQ ID NO: 586574 - DNA, 25 bp, Rattus norvegicus
tccggggcgctggatagagtgctgt

SEQ ID NO: 586575 - DNA, 25 bp, Rattus norvegicus
tccgggtatggaaagctaggctgat

SEQ ID NO: 586576 - DNA, 25 bp, Rattus norvegicus
tccgggtatggatagctaggctgat

SEQ ID NO: 586577 - DNA, 25 bp, Rattus norvegicus
tccgggtcacctatctgaagatttg

SEQ ID NO: 586578 - DNA, 25 bp, Rattus norvegicus
tccgggtcacctttctgaagatttg

SEQ ID NO: 586579 - DNA, 25 bp, Rattus norvegicus
tccgggtcaggtaggccagagccaa

SEQ ID NO: 586580 - DNA, 25 bp, Rattus norvegicus
tccgggtcaggttggccagagccaa

SEQ ID NO: 586581 - DNA, 25 bp, Rattus norvegicus
tccgggtccagaaagggcgggctct

SEQ ID NO: 586582 - DNA, 25 bp, Rattus norvegicus
tccgggtccagatagggcgggctct

SEQ ID NO: 586583 - DNA, 25 bp, Rattus norvegicus
tccgggtcctcactcagataacagc

SEQ ID NO: 586584 - DNA, 25 bp, Rattus norvegicus
tccgggtcctcagtcagataacagc

SEQ ID NO: 586585 - DNA, 25 bp, Rattus norvegicus
tccgggtgcgctatatttcctttat

SEQ ID NO: 586586 - DNA, 25 bp, Rattus norvegicus
tccgggtgcgctttatttcctttat

SEQ ID NO: 586587 - DNA, 25 bp, Rattus norvegicus
tccgggtgctacaggacccgaagca

SEQ ID NO: 586588 - DNA, 25 bp, Rattus norvegicus
tccgggtgctactggacccgaagca

SEQ ID NO: 586589 - DNA, 25 bp, Rattus norvegicus
tccgggttcgtcagagtttttccag

SEQ ID NO: 586590 - DNA, 25 bp, Rattus norvegicus
tccgggttcgtctgagtttttccag

SEQ ID NO: 586591 - DNA, 25 bp, Rattus norvegicus
tccgggttgctcagaccttaattaa

SEQ ID NO: 586592 - DNA, 25 bp, Rattus norvegicus
tccgggttgctctgaccttaattaa

SEQ ID NO: 586593 - DNA, 25 bp, Rattus norvegicus
tccgggttgggacgctgcaggcttc

SEQ ID NO: 586594 - DNA, 25 bp, Rattus norvegicus
tccgggttgggaggctgcaggcttc

SEQ ID NO: 586595 - DNA, 25 bp, Rattus norvegicus
tccggtactattctcggttcttgga

SEQ ID NO: 586596 - DNA, 25 bp, Rattus norvegicus
tccggtactattgtcggttcttgga

SEQ ID NO: 586597 - DNA, 25 bp, Rattus norvegicus
tccggtcagccacttgtacctggga

SEQ ID NO: 586598 - DNA, 25 bp, Rattus norvegicus
tccggtcagccagttgtacctggga

SEQ ID NO: 586599 - DNA, 25 bp, Rattus norvegicus
tccggtcaggtgcttcggtacgaca

SEQ ID NO: 586600 - DNA, 25 bp, Rattus norvegicus
tccggtcaggtggttcggtacgaca

SEQ ID NO: 586601 - DNA, 25 bp, Rattus norvegicus
tccggtccagttattctgtcaaact

SEQ ID NO: 586602 - DNA, 25 bp, Rattus norvegicus
tccggtccagtttttctgtcaaact

SEQ ID NO: 586603 - DNA, 25 bp, Rattus norvegicus
tccggtcccaagaggaaggtggcct

SEQ ID NO: 586604 - DNA, 25 bp, Rattus norvegicus
tccggtcccaagtggaaggtggcct

SEQ ID NO: 586605 - DNA, 25 bp, Rattus norvegicus
tccggtccggcgaggcggcggcggc

SEQ ID NO: 586606 - DNA, 25 bp, Rattus norvegicus
tccggtccggcgtggcggcggcggc

SEQ ID NO: 586607 - DNA, 25 bp, Rattus norvegicus
tccggtcctgtcactttaagtggtg

SEQ ID NO: 586608 - DNA, 25 bp, Rattus norvegicus
tccggtcctgtctctttaagtggtg

SEQ ID NO: 586609 - DNA, 25 bp, Rattus norvegicus
tccggtctgaagattctccgagtaa

SEQ ID NO: 586610 - DNA, 25 bp, Rattus norvegicus
tccggtctgaagtttctccgagtaa

SEQ ID NO: 586611 - DNA, 25 bp, Rattus norvegicus
tccggtcttatccctgaatgtctag

SEQ ID NO: 586612 - DNA, 25 bp, Rattus norvegicus
tccggtcttatcgctgaatgtctag

SEQ ID NO: 586613 - DNA, 25 bp, Rattus norvegicus
tccggtgacttcacagcacttgctg

SEQ ID NO: 586614 - DNA, 25 bp, Rattus norvegicus
tccggtgacttctcagcacttgctg

SEQ ID NO: 586615 - DNA, 25 bp, Rattus norvegicus
tccggtgagcgaccataccaatgtc

SEQ ID NO: 586616 - DNA, 25 bp, Rattus norvegicus
tccggtgagcgagcataccaatgtc

SEQ ID NO: 586617 - DNA, 25 bp, Rattus norvegicus
tccggtgatgtcagctggaccaaaa

SEQ ID NO: 586618 - DNA, 25 bp, Rattus norvegicus
tccggtgatgtctgctggaccaaaa

SEQ ID NO: 586619 - DNA, 25 bp, Rattus norvegicus
tccggtgcgtgaagtcttcaggagt

SEQ ID NO: 586620 - DNA, 25 bp, Rattus norvegicus
tccggtgcgtgatgtcttcaggagt

SEQ ID NO: 586621 - DNA, 25 bp, Rattus norvegicus
tccggtgctaacatctttttgtgag

SEQ ID NO: 586622 - DNA, 25 bp, Rattus norvegicus
tccggtgctaacttctttttgtgag

SEQ ID NO: 586623 - DNA, 25 bp, Rattus norvegicus
tccggtggaataattcctagtcaag

SEQ ID NO: 586624 - DNA, 25 bp, Rattus norvegicus
tccggtggaatatttcctagtcaag

SEQ ID NO: 586625 - DNA, 25 bp, Rattus norvegicus
tccggtggccagactttaaccagga

SEQ ID NO: 586626 - DNA, 25 bp, Rattus norvegicus
tccggtggccagtctttaaccagga

SEQ ID NO: 586627 - DNA, 25 bp, Rattus norvegicus
tccggtggtaccagctaacctgaaa

SEQ ID NO: 586628 - DNA, 25 bp, Rattus norvegicus
tccggtggtacctgctaacctgaaa

SEQ ID NO: 586629 - DNA, 25 bp, Rattus norvegicus
tccggtgtcccgatgtatctctgtg

SEQ ID NO: 586630 - DNA, 25 bp, Rattus norvegicus
tccggtgtcccgttgtatctctgtg

SEQ ID NO: 586631 - DNA, 25 bp, Rattus norvegicus
tccggtgttgtgagtatttcttgct

SEQ ID NO: 586632 - DNA, 25 bp, Rattus norvegicus
tccggtgttgtgtgtatttcttgct

SEQ ID NO: 586633 - DNA, 25 bp, Rattus norvegicus
tccggttcaacgagggtgtctccaa

SEQ ID NO: 586634 - DNA, 25 bp, Rattus norvegicus
tccggttcaacgtgggtgtctccaa

SEQ ID NO: 586635 - DNA, 25 bp, Rattus norvegicus
tccggttcatagagacatcctgtct

SEQ ID NO: 586636 - DNA, 25 bp, Rattus norvegicus
tccggttcatagtgacatcctgtct

SEQ ID NO: 586637 - DNA, 25 bp, Rattus norvegicus
tccggttctcaacaaaggagccata

SEQ ID NO: 586638 - DNA, 25 bp, Rattus norvegicus
tccggttctcaagaaaggagccata

SEQ ID NO: 586639 - DNA, 25 bp, Rattus norvegicus
tccggttctgaactggatcttgctg

SEQ ID NO: 586640 - DNA, 25 bp, Rattus norvegicus
tccggttctgaagtggatcttgctg

SEQ ID NO: 586641 - DNA, 25 bp, Rattus norvegicus
tccggtttccgactggagcgcacac

SEQ ID NO: 586642 - DNA, 25 bp, Rattus norvegicus
tccggtttccgagtggagcgcacac

SEQ ID NO: 586643 - DNA, 25 bp, Rattus norvegicus
tccggtttgggaaccgagctgcaga

SEQ ID NO: 586644 - DNA, 25 bp, Rattus norvegicus
tccggtttgggatccgagctgcaga

SEQ ID NO: 586645 - DNA, 25 bp, Rattus norvegicus
tccggtttgtctacgtgcgcgcacg

SEQ ID NO: 586646 - DNA, 25 bp, Rattus norvegicus
tccggtttgtcttcgtgcgcgcacg

SEQ ID NO: 586647 - DNA, 25 bp, Rattus norvegicus
tccggttttgctacactcgatagag

SEQ ID NO: 586648 - DNA, 25 bp, Rattus norvegicus
tccggttttgcttcactcgatagag

SEQ ID NO: 586649 - DNA, 25 bp, Rattus norvegicus
tccgtaaactacactcttctcagaa

SEQ ID NO: 586650 - DNA, 25 bp, Rattus norvegicus
tccgtaaactactctcttctcagaa

SEQ ID NO: 586651 - DNA, 25 bp, Rattus norvegicus
tccgtaattctgatcctgagaggca

SEQ ID NO: 586652 - DNA, 25 bp, Rattus norvegicus
tccgtaattctgttcctgagaggca

SEQ ID NO: 586653 - DNA, 25 bp, Rattus norvegicus
tccgtagataatattaatgggcacc

SEQ ID NO: 586654 - DNA, 25 bp, Rattus norvegicus
tccgtagataattttaatgggcacc

SEQ ID NO: 586655 - DNA, 25 bp, Rattus norvegicus
tccgtagatggacaagctgcttagc

SEQ ID NO: 586656 - DNA, 25 bp, Rattus norvegicus
tccgtagatggagaagctgcttagc

SEQ ID NO: 586657 - DNA, 25 bp, Rattus norvegicus
tccgtagccagcatcttgattggtg

SEQ ID NO: 586658 - DNA, 25 bp, Rattus norvegicus
tccgtagccagcttcttgattggtg

SEQ ID NO: 586659 - DNA, 25 bp, Rattus norvegicus
tccgtagttccaccctaggaaagca

SEQ ID NO: 586660 - DNA, 25 bp, Rattus norvegicus
tccgtagttccagcctaggaaagca

SEQ ID NO: 586661 - DNA, 25 bp, Rattus norvegicus
tccgtatcatgccagagtccagtgc

SEQ ID NO: 586662 - DNA, 25 bp, Rattus norvegicus
tccgtatcatgcgagagtccagtgc

SEQ ID NO: 586663 - DNA, 25 bp, Rattus norvegicus
tccgtatcatggcagggtccagtga

SEQ ID NO: 586664 - DNA, 25 bp, Rattus norvegicus
tccgtatcatgggagggtccagtga

SEQ ID NO: 586665 - DNA, 25 bp, Rattus norvegicus
tccgtatcccctcagtagctggaga

SEQ ID NO: 586666 - DNA, 25 bp, Rattus norvegicus
tccgtatcccctgagtagctggaga

SEQ ID NO: 586667 - DNA, 25 bp, Rattus norvegicus
tccgtatgatatcctgaacctggta

SEQ ID NO: 586668 - DNA, 25 bp, Rattus norvegicus
tccgtatgatatgctgaacctggta

SEQ ID NO: 586669 - DNA, 25 bp, Rattus norvegicus
tccgtattaagccacattcctacga

SEQ ID NO: 586670 - DNA, 25 bp, Rattus norvegicus
tccgtattaagcgacattcctacga

SEQ ID NO: 586671 - DNA, 25 bp, Rattus norvegicus
tccgtcaccgggacttggagccaag

SEQ ID NO: 586672 - DNA, 25 bp, Rattus norvegicus
tccgtcaccgggtcttggagccaag

SEQ ID NO: 586673 - DNA, 25 bp, Rattus norvegicus
tccgtcactgtactcaccagatttt

SEQ ID NO: 586674 - DNA, 25 bp, Rattus norvegicus
tccgtcactgtagtcaccagatttt

SEQ ID NO: 586675 - DNA, 25 bp, Rattus norvegicus
tccgtcatccccataaatgtgcaat

SEQ ID NO: 586676 - DNA, 25 bp, Rattus norvegicus
tccgtcatccccttaaatgtgcaat

SEQ ID NO: 586677 - DNA, 25 bp, Rattus norvegicus
tccgtcatgcgcagggccttggcca

SEQ ID NO: 586678 - DNA, 25 bp, Rattus norvegicus
tccgtcatgcgctgggccttggcca

SEQ ID NO: 586679 - DNA, 25 bp, Rattus norvegicus
tccgtccagcgtcatcatttggtaa

SEQ ID NO: 586680 - DNA, 25 bp, Rattus norvegicus
tccgtccagcgtgatcatttggtaa

SEQ ID NO: 586681 - DNA, 25 bp, Rattus norvegicus
tccgtccatggtctgatttttatat

SEQ ID NO: 586682 - DNA, 25 bp, Rattus norvegicus
tccgtccatggtgtgatttttatat

SEQ ID NO: 586683 - DNA, 25 bp, Rattus norvegicus
tccgtccctctgcttgtaacaaata

SEQ ID NO: 586684 - DNA, 25 bp, Rattus norvegicus
tccgtccctctggttgtaacaaata

SEQ ID NO: 586685 - DNA, 25 bp, Rattus norvegicus
tccgtccctgctagaatcagaatga

SEQ ID NO: 586686 - DNA, 25 bp, Rattus norvegicus
tccgtccctgcttgaatcagaatga

SEQ ID NO: 586687 - DNA, 25 bp, Rattus norvegicus
tccgtccgagtcagtgttcttctgt

SEQ ID NO: 586688 - DNA, 25 bp, Rattus norvegicus
tccgtccgagtctgtgttcttctgt

SEQ ID NO: 586689 - DNA, 25 bp, Rattus norvegicus
tccgtcctcatactcttcaataaaa

SEQ ID NO: 586690 - DNA, 25 bp, Rattus norvegicus
tccgtcctcatagtcttcaataaaa

SEQ ID NO: 586691 - DNA, 25 bp, Rattus norvegicus
tccgtcctggcaacagtcatagagg

SEQ ID NO: 586692 - DNA, 25 bp, Rattus norvegicus
tccgtcctggcatcagtcatagagg

SEQ ID NO: 586693 - DNA, 25 bp, Rattus norvegicus
tccgtccttccgctaaatgtagttg

SEQ ID NO: 586694 - DNA, 25 bp, Rattus norvegicus
tccgtccttccggtaaatgtagttg

SEQ ID NO: 586695 - DNA, 25 bp, Rattus norvegicus
tccgtcctttaacccatggagtgta

SEQ ID NO: 586696 - DNA, 25 bp, Rattus norvegicus
tccgtcctttaagccatggagtgta

SEQ ID NO: 586697 - DNA, 25 bp, Rattus norvegicus
tccgtcgccaggaacagctagaaag

SEQ ID NO: 586698 - DNA, 25 bp, Rattus norvegicus
tccgtcgccaggtacagctagaaag

SEQ ID NO: 586699 - DNA, 25 bp, Rattus norvegicus
tccgtcggagccagggcaagaacta

SEQ ID NO: 586700 - DNA, 25 bp, Rattus norvegicus
tccgtcggagcctgggcaagaacta

SEQ ID NO: 586701 - DNA, 25 bp, Rattus norvegicus
tccgtcgtcgtcatggtgaagctga

SEQ ID NO: 586702 - DNA, 25 bp, Rattus norvegicus
tccgtcgtcgtcttggtgaagctga

SEQ ID NO: 586703 - DNA, 25 bp, Rattus norvegicus
tccgtcgttgtgagaggcctgcagc

SEQ ID NO: 586704 - DNA, 25 bp, Rattus norvegicus
tccgtcgttgtgtgaggcctgcagc

SEQ ID NO: 586705 - DNA, 25 bp, Rattus norvegicus
tccgtctcagggattgcttaaccag

SEQ ID NO: 586706 - DNA, 25 bp, Rattus norvegicus
tccgtctcagggtttgcttaaccag

SEQ ID NO: 586707 - DNA, 25 bp, Rattus norvegicus
tccgtctggtccactgtggcttgga

SEQ ID NO: 586708 - DNA, 25 bp, Rattus norvegicus
tccgtctggtcctctgtggcttgga

SEQ ID NO: 586709 - DNA, 25 bp, Rattus norvegicus
tccgtcttgggaactctgcatgagt

SEQ ID NO: 586710 - DNA, 25 bp, Rattus norvegicus
tccgtcttgggatctctgcatgagt

SEQ ID NO: 586711 - DNA, 25 bp, Rattus norvegicus
tccgtctttgttaccagcttaaaag

SEQ ID NO: 586712 - DNA, 25 bp, Rattus norvegicus
tccgtctttgtttccagcttaaaag

SEQ ID NO: 586713 - DNA, 25 bp, Rattus norvegicus
tccgtgaagagtagcttgccaaagc

SEQ ID NO: 586714 - DNA, 25 bp, Rattus norvegicus
tccgtgaagagttgcttgccaaagc

SEQ ID NO: 586715 - DNA, 25 bp, Rattus norvegicus
tccgtgaaggctcatcctgtcgaga

SEQ ID NO: 586716 - DNA, 25 bp, Rattus norvegicus
tccgtgaaggctgatcctgtcgaga

SEQ ID NO: 586717 - DNA, 25 bp, Rattus norvegicus
tccgtgactcaccaggctggaaata

SEQ ID NO: 586718 - DNA, 25 bp, Rattus norvegicus
tccgtgactcacgaggctggaaata

SEQ ID NO: 586719 - DNA, 25 bp, Rattus norvegicus
tccgtgaggtcaaagccagccagtt

SEQ ID NO: 586720 - DNA, 25 bp, Rattus norvegicus
tccgtgaggtcatagccagccagtt

SEQ ID NO: 586721 - DNA, 25 bp, Rattus norvegicus
tccgtgagtggtagtggcatgctct

SEQ ID NO: 586722 - DNA, 25 bp, Rattus norvegicus
tccgtgagtggttgtggcatgctct

SEQ ID NO: 586723 - DNA, 25 bp, Rattus norvegicus
tccgtgcaaagcatgcgttcttttt

SEQ ID NO: 586724 - DNA, 25 bp, Rattus norvegicus
tccgtgcaaagcttgcgttcttttt

SEQ ID NO: 586725 - DNA, 25 bp, Rattus norvegicus
tccgtgcctgagaatgtgattacat

SEQ ID NO: 586726 - DNA, 25 bp, Rattus norvegicus
tccgtgcctgagtatgtgattacat

SEQ ID NO: 586727 - DNA, 25 bp, Rattus norvegicus
tccgtgcctgcactagtctaaggaa

SEQ ID NO: 586728 - DNA, 25 bp, Rattus norvegicus
tccgtgcctgcagtagtctaaggaa

SEQ ID NO: 586729 - DNA, 25 bp, Rattus norvegicus
tccgtgcgagcaatcctaactacgc

SEQ ID NO: 586730 - DNA, 25 bp, Rattus norvegicus
tccgtgcgagcattcctaactacgc

SEQ ID NO: 586731 - DNA, 25 bp, Rattus norvegicus
tccgtgcggattcttgctcaaatgt

SEQ ID NO: 586732 - DNA, 25 bp, Rattus norvegicus
tccgtgcggattgttgctcaaatgt

SEQ ID NO: 586733 - DNA, 25 bp, Rattus norvegicus
tccgtgcgtgtgcgacacgttccga

SEQ ID NO: 586734 - DNA, 25 bp, Rattus norvegicus
tccgtgcgtgtgggacacgttccga

SEQ ID NO: 586735 - DNA, 25 bp, Rattus norvegicus
tccgtgctcacgctggacagggaca

SEQ ID NO: 586736 - DNA, 25 bp, Rattus norvegicus
tccgtgctcacggtggacagggaca

SEQ ID NO: 586737 - DNA, 25 bp, Rattus norvegicus
tccgtgctggctattcacagtagga

SEQ ID NO: 586738 - DNA, 25 bp, Rattus norvegicus
tccgtgctggcttttcacagtagga

SEQ ID NO: 586739 - DNA, 25 bp, Rattus norvegicus
tccgtgctttcacatctcttgacaa

SEQ ID NO: 586740 - DNA, 25 bp, Rattus norvegicus
tccgtgctttcagatctcttgacaa

SEQ ID NO: 586741 - DNA, 25 bp, Rattus norvegicus
tccgtggaggccagagtaccgcagc

SEQ ID NO: 586742 - DNA, 25 bp, Rattus norvegicus
tccgtggaggcctgagtaccgcagc

SEQ ID NO: 586743 - DNA, 25 bp, Rattus norvegicus
tccgtggatcttcactatctacgta

SEQ ID NO: 586744 - DNA, 25 bp, Rattus norvegicus
tccgtggatcttgactatctacgta

SEQ ID NO: 586745 - DNA, 25 bp, Rattus norvegicus
tccgtggctcttatgaactagtgtc

SEQ ID NO: 586746 - DNA, 25 bp, Rattus norvegicus
tccgtggctcttttgaactagtgtc

SEQ ID NO: 586747 - DNA, 25 bp, Rattus norvegicus
tccgtgggctctcagttttcgaata

SEQ ID NO: 586748 - DNA, 25 bp, Rattus norvegicus
tccgtgggctctgagttttcgaata

SEQ ID NO: 586749 - DNA, 25 bp, Rattus norvegicus
tccgtggtagctacaagtgcctttc

SEQ ID NO: 586750 - DNA, 25 bp, Rattus norvegicus
tccgtggtagcttcaagtgcctttc

SEQ ID NO: 586751 - DNA, 25 bp, Rattus norvegicus
tccgtggtgagtcaggagcttctct

SEQ ID NO: 586752 - DNA, 25 bp, Rattus norvegicus
tccgtggtgagtgaggagcttctct

SEQ ID NO: 586753 - DNA, 25 bp, Rattus norvegicus
tccgtgtacctcaagacctatgtta

SEQ ID NO: 586754 - DNA, 25 bp, Rattus norvegicus
tccgtgtacctctagacctatgtta

SEQ ID NO: 586755 - DNA, 25 bp, Rattus norvegicus
tccgtgtggattctttttagcaaaa

SEQ ID NO: 586756 - DNA, 25 bp, Rattus norvegicus
tccgtgtggattgtttttagcaaaa

SEQ ID NO: 586757 - DNA, 25 bp, Rattus norvegicus
tccgtgtggtccaggctgaagactg

SEQ ID NO: 586758 - DNA, 25 bp, Rattus norvegicus
tccgtgtggtcctggctgaagactg

SEQ ID NO: 586759 - DNA, 25 bp, Rattus norvegicus
tccgtgtgtccaccagtctgcaagg

SEQ ID NO: 586760 - DNA, 25 bp, Rattus norvegicus
tccgtgtgtccagcagtctgcaagg

SEQ ID NO: 586761 - DNA, 25 bp, Rattus norvegicus
tccgtgtgtgctccttgaggtgtta

SEQ ID NO: 586762 - DNA, 25 bp, Rattus norvegicus
tccgtgtgtgctgcttgaggtgtta

SEQ ID NO: 586763 - DNA, 25 bp, Rattus norvegicus
tccgtgttaacaaccccatccaaga

SEQ ID NO: 586764 - DNA, 25 bp, Rattus norvegicus
tccgtgttaacatccccatccaaga

SEQ ID NO: 586765 - DNA, 25 bp, Rattus norvegicus
tccgtgttatccaagctcgaggtaa

SEQ ID NO: 586766 - DNA, 25 bp, Rattus norvegicus
tccgtgttatcctagctcgaggtaa

SEQ ID NO: 586767 - DNA, 25 bp, Rattus norvegicus
tccgtgttgggcacctaggataacc

SEQ ID NO: 586768 - DNA, 25 bp, Rattus norvegicus
tccgtgttgggctcctaggataacc

SEQ ID NO: 586769 - DNA, 25 bp, Rattus norvegicus
tccgtgttggtgatggcattctcta

SEQ ID NO: 586770 - DNA, 25 bp, Rattus norvegicus
tccgtgttggtgttggcattctcta

SEQ ID NO: 586771 - DNA, 25 bp, Rattus norvegicus
tccgtgttgttcataaccgtctgtg

SEQ ID NO: 586772 - DNA, 25 bp, Rattus norvegicus
tccgtgttgttcttaaccgtctgtg

SEQ ID NO: 586773 - DNA, 25 bp, Rattus norvegicus
tccgtgtttcggattgttgctaaag

SEQ ID NO: 586774 - DNA, 25 bp, Rattus norvegicus
tccgtgtttcggtttgttgctaaag

SEQ ID NO: 586775 - DNA, 25 bp, Rattus norvegicus
tccgtgtttgtgacttctttgtttc

SEQ ID NO: 586776 - DNA, 25 bp, Rattus norvegicus
tccgtgtttgtgtcttctttgtttc

SEQ ID NO: 586777 - DNA, 25 bp, Rattus norvegicus
tccgtgttttaacctgtaccccctg

SEQ ID NO: 586778 - DNA, 25 bp, Rattus norvegicus
tccgtgttttaagctgtaccccctg

SEQ ID NO: 586779 - DNA, 25 bp, Rattus norvegicus
tccgttactcagaaggagcggttaa

SEQ ID NO: 586780 - DNA, 25 bp, Rattus norvegicus
tccgttactcagtaggagcggttaa

SEQ ID NO: 586781 - DNA, 25 bp, Rattus norvegicus
tccgttatccccatttgttctgtga

SEQ ID NO: 586782 - DNA, 25 bp, Rattus norvegicus
tccgttatccccttttgttctgtga

SEQ ID NO: 586783 - DNA, 25 bp, Rattus norvegicus
tccgttatgactaaacgcccagctt

SEQ ID NO: 586784 - DNA, 25 bp, Rattus norvegicus
tccgttatgacttaacgcccagctt

SEQ ID NO: 586785 - DNA, 25 bp, Rattus norvegicus
tccgttcaccagatgctgtggacaa

SEQ ID NO: 586786 - DNA, 25 bp, Rattus norvegicus
tccgttcaccagttgctgtggacaa

SEQ ID NO: 586787 - DNA, 25 bp, Rattus norvegicus
tccgttcagtggactcggtgcagat

SEQ ID NO: 586788 - DNA, 25 bp, Rattus norvegicus
tccgttcagtggtctcggtgcagat

SEQ ID NO: 586789 - DNA, 25 bp, Rattus norvegicus
tccgttcatctgattattctaccac

SEQ ID NO: 586790 - DNA, 25 bp, Rattus norvegicus
tccgttcatctgtttattctaccac

SEQ ID NO: 586791 - DNA, 25 bp, Rattus norvegicus
tccgttcattcccatgagcagtagg

SEQ ID NO: 586792 - DNA, 25 bp, Rattus norvegicus
tccgttcattccgatgagcagtagg

SEQ ID NO: 586793 - DNA, 25 bp, Rattus norvegicus
tccgttcccttcagtacatttggaa

SEQ ID NO: 586794 - DNA, 25 bp, Rattus norvegicus
tccgttcccttctgtacatttggaa

SEQ ID NO: 586795 - DNA, 25 bp, Rattus norvegicus
tccgttccggctcttcgtaggcgat

SEQ ID NO: 586796 - DNA, 25 bp, Rattus norvegicus
tccgttccggctgttcgtaggcgat

SEQ ID NO: 586797 - DNA, 25 bp, Rattus norvegicus
tccgttccgtcgagtgtggctgtaa

SEQ ID NO: 586798 - DNA, 25 bp, Rattus norvegicus
tccgttccgtcgtgtgtggctgtaa

SEQ ID NO: 586799 - DNA, 25 bp, Rattus norvegicus
tccgttcctagtaaagtggcttcca

SEQ ID NO: 586800 - DNA, 25 bp, Rattus norvegicus
tccgttcctagttaagtggcttcca

SEQ ID NO: 586801 - DNA, 25 bp, Rattus norvegicus
tccgttcgtgttagtctcctaagaa

SEQ ID NO: 586802 - DNA, 25 bp, Rattus norvegicus
tccgttcgtgtttgtctcctaagaa

SEQ ID NO: 586803 - DNA, 25 bp, Rattus norvegicus
tccgttctggttactttgatgggaa

SEQ ID NO: 586804 - DNA, 25 bp, Rattus norvegicus
tccgttctggtttctttgatgggaa

SEQ ID NO: 586805 - DNA, 25 bp, Rattus norvegicus
tccgttctgtatatctgcttgcttg

SEQ ID NO: 586806 - DNA, 25 bp, Rattus norvegicus
tccgttctgtatttctgcttgcttg

SEQ ID NO: 586807 - DNA, 25 bp, Rattus norvegicus
tccgttgagaagcagtttcacccaa

SEQ ID NO: 586808 - DNA, 25 bp, Rattus norvegicus
tccgttgagaaggagtttcacccaa

SEQ ID NO: 586809 - DNA, 25 bp, Rattus norvegicus
tccgttgatggcacctttagggtga

SEQ ID NO: 586810 - DNA, 25 bp, Rattus norvegicus
tccgttgatggctcctttagggtga

SEQ ID NO: 586811 - DNA, 25 bp, Rattus norvegicus
tccgttgcaactctcttggtaggaa

SEQ ID NO: 586812 - DNA, 25 bp, Rattus norvegicus
tccgttgcaactgtcttggtaggaa

SEQ ID NO: 586813 - DNA, 25 bp, Rattus norvegicus
tccgttgcctccaccgtgtaacaaa

SEQ ID NO: 586814 - DNA, 25 bp, Rattus norvegicus
tccgttgcctcctccgtgtaacaaa

SEQ ID NO: 586815 - DNA, 25 bp, Rattus norvegicus
tccgttggagatccctacacaactt

SEQ ID NO: 586816 - DNA, 25 bp, Rattus norvegicus
tccgttggagatgcctacacaactt

SEQ ID NO: 586817 - DNA, 25 bp, Rattus norvegicus
tccgttggtctgatggtgtcatgaa

SEQ ID NO: 586818 - DNA, 25 bp, Rattus norvegicus
tccgttggtctgttggtgtcatgaa

SEQ ID NO: 586819 - DNA, 25 bp, Rattus norvegicus
tccgttgtgattacctttccttata

SEQ ID NO: 586820 - DNA, 25 bp, Rattus norvegicus
tccgttgtgatttcctttccttata

SEQ ID NO: 586821 - DNA, 25 bp, Rattus norvegicus
tccgttgtggatctgacatgccgcc

SEQ ID NO: 586822 - DNA, 25 bp, Rattus norvegicus
tccgttgtggatgtgacatgccgcc

SEQ ID NO: 586823 - DNA, 25 bp, Rattus norvegicus
tccgttgtgtgtattaagcttttct

SEQ ID NO: 586824 - DNA, 25 bp, Rattus norvegicus
tccgttgtgtgttttaagcttttct

SEQ ID NO: 586825 - DNA, 25 bp, Rattus norvegicus
tccgtttactgtcatgtgctactgt

SEQ ID NO: 586826 - DNA, 25 bp, Rattus norvegicus
tccgtttactgtgatgtgctactgt

SEQ ID NO: 586827 - DNA, 25 bp, Rattus norvegicus
tccgtttcaatccttttccctaatg

SEQ ID NO: 586828 - DNA, 25 bp, Rattus norvegicus
tccgtttcaatcgttttccctaatg

SEQ ID NO: 586829 - DNA, 25 bp, Rattus norvegicus
tccgtttgtccaactgctgaaatat

SEQ ID NO: 586830 - DNA, 25 bp, Rattus norvegicus
tccgtttgtccatctgctgaaatat

SEQ ID NO: 586831 - DNA, 25 bp, Rattus norvegicus
tccgttttccccatctgtatgtaaa

SEQ ID NO: 586832 - DNA, 25 bp, Rattus norvegicus
tccgttttccccttctgtatgtaaa

SEQ ID NO: 586833 - DNA, 25 bp, Rattus norvegicus
tcctaaaaagtcaccagtgcactcc

SEQ ID NO: 586834 - DNA, 25 bp, Rattus norvegicus
tcctaaaaagtctccagtgcactcc

SEQ ID NO: 586835 - DNA, 25 bp, Rattus norvegicus
tcctaaaagtcaccgtgtggccact

SEQ ID NO: 586836 - DNA, 25 bp, Rattus norvegicus
tcctaaaagtcagcgtgtggccact

SEQ ID NO: 586837 - DNA, 25 bp, Rattus norvegicus
tcctaaacccacatcaatcttctag

SEQ ID NO: 586838 - DNA, 25 bp, Rattus norvegicus
tcctaaacccacttcaatcttctag

SEQ ID NO: 586839 - DNA, 25 bp, Rattus norvegicus
tcctaaactctaactgactgcactg

SEQ ID NO: 586840 - DNA, 25 bp, Rattus norvegicus
tcctaaactctatctgactgcactg

SEQ ID NO: 586841 - DNA, 25 bp, Rattus norvegicus
tcctaaatcctgagcctgagaacca

SEQ ID NO: 586842 - DNA, 25 bp, Rattus norvegicus
tcctaaatcctgtgcctgagaacca

SEQ ID NO: 586843 - DNA, 25 bp, Rattus norvegicus
tcctaacaattccttacattccagc

SEQ ID NO: 586844 - DNA, 25 bp, Rattus norvegicus
tcctaacaattcgttacattccagc

SEQ ID NO: 586845 - DNA, 25 bp, Rattus norvegicus
tcctaacactttcgcttatatctca

SEQ ID NO: 586846 - DNA, 25 bp, Rattus norvegicus
tcctaacactttggcttatatctca

SEQ ID NO: 586847 - DNA, 25 bp, Rattus norvegicus
tcctaacagctgctttgcctttttt

SEQ ID NO: 586848 - DNA, 25 bp, Rattus norvegicus
tcctaacagctggtttgcctttttt

SEQ ID NO: 586849 - DNA, 25 bp, Rattus norvegicus
tcctaacagcttagaattccttaaa

SEQ ID NO: 586850 - DNA, 25 bp, Rattus norvegicus
tcctaacagctttgaattccttaaa

SEQ ID NO: 586851 - DNA, 25 bp, Rattus norvegicus
tcctaaccctacagtgagcacatga

SEQ ID NO: 586852 - DNA, 25 bp, Rattus norvegicus
tcctaaccctactgtgagcacatga

SEQ ID NO: 586853 - DNA, 25 bp, Rattus norvegicus
tcctaaccctcgacaaagaaactat

SEQ ID NO: 586854 - DNA, 25 bp, Rattus norvegicus
tcctaaccctcgtcaaagaaactat

SEQ ID NO: 586855 - DNA, 25 bp, Rattus norvegicus
tcctaaccctggcttttattggctt

SEQ ID NO: 586856 - DNA, 25 bp, Rattus norvegicus
tcctaaccctgggttttattggctt

SEQ ID NO: 586857 - DNA, 25 bp, Rattus norvegicus
tcctaaccgcgtagcataatgccac

SEQ ID NO: 586858 - DNA, 25 bp, Rattus norvegicus
tcctaaccgcgttgcataatgccac

SEQ ID NO: 586859 - DNA, 25 bp, Rattus norvegicus
tcctaaccgttcagcatgtatctgc

SEQ ID NO: 586860 - DNA, 25 bp, Rattus norvegicus
tcctaaccgttctgcatgtatctgc

SEQ ID NO: 586861 - DNA, 25 bp, Rattus norvegicus
tcctaacctcccatttgacagagat

SEQ ID NO: 586862 - DNA, 25 bp, Rattus norvegicus
tcctaacctcccttttgacagagat

SEQ ID NO: 586863 - DNA, 25 bp, Rattus norvegicus
tcctaactcctcagtgaacagcatg

SEQ ID NO: 586864 - DNA, 25 bp, Rattus norvegicus
tcctaactcctctgtgaacagcatg

SEQ ID NO: 586865 - DNA, 25 bp, Rattus norvegicus
tcctaactgagaaatcaagataagc

SEQ ID NO: 586866 - DNA, 25 bp, Rattus norvegicus
tcctaactgagatatcaagataagc

SEQ ID NO: 586867 - DNA, 25 bp, Rattus norvegicus
tcctaagaagttcgagcagtcaggg

SEQ ID NO: 586868 - DNA, 25 bp, Rattus norvegicus
tcctaagaagttggagcagtcaggg

SEQ ID NO: 586869 - DNA, 25 bp, Rattus norvegicus
tcctaagaccttcgcactgggcaaa

SEQ ID NO: 586870 - DNA, 25 bp, Rattus norvegicus
tcctaagaccttggcactgggcaaa

SEQ ID NO: 586871 - DNA, 25 bp, Rattus norvegicus
tcctaagccgttatcctctgaggat

SEQ ID NO: 586872 - DNA, 25 bp, Rattus norvegicus
tcctaagccgttttcctctgaggat

SEQ ID NO: 586873 - DNA, 25 bp, Rattus norvegicus
tcctaaggacaaccatttgtatctt

SEQ ID NO: 586874 - DNA, 25 bp, Rattus norvegicus
tcctaaggacaagcatttgtatctt

SEQ ID NO: 586875 - DNA, 25 bp, Rattus norvegicus
tcctaaggacacagcagaaatggtt

SEQ ID NO: 586876 - DNA, 25 bp, Rattus norvegicus
tcctaaggacactgcagaaatggtt

SEQ ID NO: 586877 - DNA, 25 bp, Rattus norvegicus
tcctaaggttctccaggcacgaagt

SEQ ID NO: 586878 - DNA, 25 bp, Rattus norvegicus
tcctaaggttctgcaggcacgaagt

SEQ ID NO: 586879 - DNA, 25 bp, Rattus norvegicus
tcctaaggttttaagcctaaatatg

SEQ ID NO: 586880 - DNA, 25 bp, Rattus norvegicus
tcctaaggtttttagcctaaatatg

SEQ ID NO: 586881 - DNA, 25 bp, Rattus norvegicus
tcctaagtcctaattactacctctc

SEQ ID NO: 586882 - DNA, 25 bp, Rattus norvegicus
tcctaagtcctatttactacctctc

SEQ ID NO: 586883 - DNA, 25 bp, Rattus norvegicus
tcctaagttgggacactccactggg

SEQ ID NO: 586884 - DNA, 25 bp, Rattus norvegicus
tcctaagttgggtcactccactggg

SEQ ID NO: 586885 - DNA, 25 bp, Rattus norvegicus
tcctaatccatcatctgcacattat

SEQ ID NO: 586886 - DNA, 25 bp, Rattus norvegicus
tcctaatccatcttctgcacattat

SEQ ID NO: 586887 - DNA, 25 bp, Rattus norvegicus
tcctaatcctgaaccccatgaaaat

SEQ ID NO: 586888 - DNA, 25 bp, Rattus norvegicus
tcctaatcctgatccccatgaaaat

SEQ ID NO: 586889 - DNA, 25 bp, Rattus norvegicus
tcctaatgtggcattccctgaaaac

SEQ ID NO: 586890 - DNA, 25 bp, Rattus norvegicus
tcctaatgtggctttccctgaaaac

SEQ ID NO: 586891 - DNA, 25 bp, Rattus norvegicus
tcctaatttgccctgccttttatta

SEQ ID NO: 586892 - DNA, 25 bp, Rattus norvegicus
tcctaatttgccgtgccttttatta

SEQ ID NO: 586893 - DNA, 25 bp, Rattus norvegicus
tcctacaacgagacggtggatctgt

SEQ ID NO: 586894 - DNA, 25 bp, Rattus norvegicus
tcctacaacgagtcggtggatctgt

SEQ ID NO: 586895 - DNA, 25 bp, Rattus norvegicus
tcctacaagctcacccagaaaggat

SEQ ID NO: 586896 - DNA, 25 bp, Rattus norvegicus
tcctacaagctctcccagaaaggat

SEQ ID NO: 586897 - DNA, 25 bp, Rattus norvegicus
tcctacacgccgcaggtgatagaga

SEQ ID NO: 586898 - DNA, 25 bp, Rattus norvegicus
tcctacacgccggaggtgatagaga

SEQ ID NO: 586899 - DNA, 25 bp, Rattus norvegicus
tcctacactgttagctcttgatgag

SEQ ID NO: 586900 - DNA, 25 bp, Rattus norvegicus
tcctacactgtttgctcttgatgag

SEQ ID NO: 586901 - DNA, 25 bp, Rattus norvegicus
tcctacagaaagcatgccgcgtggc

SEQ ID NO: 586902 - DNA, 25 bp, Rattus norvegicus
tcctacagaaaggatgccgcgtggc

SEQ ID NO: 586903 - DNA, 25 bp, Rattus norvegicus
tcctacagccccattaaagtttatg

SEQ ID NO: 586904 - DNA, 25 bp, Rattus norvegicus
tcctacagcccctttaaagtttatg

SEQ ID NO: 586905 - DNA, 25 bp, Rattus norvegicus
tcctacagcgaaagggcgagctctt

SEQ ID NO: 586906 - DNA, 25 bp, Rattus norvegicus
tcctacagcgaatgggcgagctctt

SEQ ID NO: 586907 - DNA, 25 bp, Rattus norvegicus
tcctacagtgtcacctttttatctt

SEQ ID NO: 586908 - DNA, 25 bp, Rattus norvegicus
tcctacagtgtctcctttttatctt

SEQ ID NO: 586909 - DNA, 25 bp, Rattus norvegicus
tcctacatccaactctgaggtgtcc

SEQ ID NO: 586910 - DNA, 25 bp, Rattus norvegicus
tcctacatccaagtctgaggtgtcc

SEQ ID NO: 586911 - DNA, 25 bp, Rattus norvegicus
tcctacatgcctatggatttcagct

SEQ ID NO: 586912 - DNA, 25 bp, Rattus norvegicus
tcctacatgcctttggatttcagct

SEQ ID NO: 586913 - DNA, 25 bp, Rattus norvegicus
tcctaccaaatcacttcacaatgtc

SEQ ID NO: 586914 - DNA, 25 bp, Rattus norvegicus
tcctaccaaatctcttcacaatgtc

SEQ ID NO: 586915 - DNA, 25 bp, Rattus norvegicus
tcctaccaacttaaacttctgctat

SEQ ID NO: 586916 - DNA, 25 bp, Rattus norvegicus
tcctaccaactttaacttctgctat

SEQ ID NO: 586917 - DNA, 25 bp, Rattus norvegicus
tcctaccacaatatccagcttacgt

SEQ ID NO: 586918 - DNA, 25 bp, Rattus norvegicus
tcctaccacaatttccagcttacgt

SEQ ID NO: 586919 - DNA, 25 bp, Rattus norvegicus
tcctaccacttgattttgcttgatg

SEQ ID NO: 586920 - DNA, 25 bp, Rattus norvegicus
tcctaccacttgtttttgcttgatg

SEQ ID NO: 586921 - DNA, 25 bp, Rattus norvegicus
tcctaccagtttacagacgtgggct

SEQ ID NO: 586922 - DNA, 25 bp, Rattus norvegicus
tcctaccagttttcagacgtgggct

SEQ ID NO: 586923 - DNA, 25 bp, Rattus norvegicus
tcctaccatagcaatgaaagtgtcc

SEQ ID NO: 586924 - DNA, 25 bp, Rattus norvegicus
tcctaccatagctatgaaagtgtcc

SEQ ID NO: 586925 - DNA, 25 bp, Rattus norvegicus
tcctaccatgtccttctggagagta

SEQ ID NO: 586926 - DNA, 25 bp, Rattus norvegicus
tcctaccatgtcgttctggagagta

SEQ ID NO: 586927 - DNA, 25 bp, Rattus norvegicus
tcctacccagccatattcgtacaag

SEQ ID NO: 586928 - DNA, 25 bp, Rattus norvegicus
tcctacccagccttattcgtacaag

SEQ ID NO: 586929 - DNA, 25 bp, Rattus norvegicus
tcctacccaggaagcgcatacagat

SEQ ID NO: 586930 - DNA, 25 bp, Rattus norvegicus
tcctacccaggatgcgcatacagat

SEQ ID NO: 586931 - DNA, 25 bp, Rattus norvegicus
tcctacccagttcttaaccagacag

SEQ ID NO: 586932 - DNA, 25 bp, Rattus norvegicus
tcctacccagttgttaaccagacag

SEQ ID NO: 586933 - DNA, 25 bp, Rattus norvegicus
tcctaccccagaaaagctctgtgtt

SEQ ID NO: 586934 - DNA, 25 bp, Rattus norvegicus
tcctaccccagataagctctgtgtt

SEQ ID NO: 586935 - DNA, 25 bp, Rattus norvegicus
tcctacccctcactattcatgaggt

SEQ ID NO: 586936 - DNA, 25 bp, Rattus norvegicus
tcctacccctcagtattcatgaggt

SEQ ID NO: 586937 - DNA, 25 bp, Rattus norvegicus
tcctaccctgacattctttgacaaa

SEQ ID NO: 586938 - DNA, 25 bp, Rattus norvegicus
tcctaccctgactttctttgacaaa

SEQ ID NO: 586939 - DNA, 25 bp, Rattus norvegicus
tcctaccctggaccggaagcagaag

SEQ ID NO: 586940 - DNA, 25 bp, Rattus norvegicus
tcctaccctggagcggaagcagaag

SEQ ID NO: 586941 - DNA, 25 bp, Rattus norvegicus
tcctaccgggagcacattgagcagc

SEQ ID NO: 586942 - DNA, 25 bp, Rattus norvegicus
tcctaccgggaggacattgagcagc

SEQ ID NO: 586943 - DNA, 25 bp, Rattus norvegicus
tcctacctaagaagaggcacagaca

SEQ ID NO: 586944 - DNA, 25 bp, Rattus norvegicus
tcctacctaagatgaggcacagaca

SEQ ID NO: 586945 - DNA, 25 bp, Rattus norvegicus
tcctacctccacatcagttgtagaa

SEQ ID NO: 586946 - DNA, 25 bp, Rattus norvegicus
tcctacctccacttcagttgtagaa

SEQ ID NO: 586947 - DNA, 25 bp, Rattus norvegicus
tcctacctgtgcactatcgatatca

SEQ ID NO: 586948 - DNA, 25 bp, Rattus norvegicus
tcctacctgtgctctatcgatatca

SEQ ID NO: 586949 - DNA, 25 bp, Rattus norvegicus
tcctacctgtggagccttcagagta

SEQ ID NO: 586950 - DNA, 25 bp, Rattus norvegicus
tcctacctgtggtgccttcagagta

SEQ ID NO: 586951 - DNA, 25 bp, Rattus norvegicus
tcctaccttaccactggtcatggtg

SEQ ID NO: 586952 - DNA, 25 bp, Rattus norvegicus
tcctaccttacctctggtcatggtg

SEQ ID NO: 586953 - DNA, 25 bp, Rattus norvegicus
tcctaccttagaccacatcagaaaa

SEQ ID NO: 586954 - DNA, 25 bp, Rattus norvegicus
tcctaccttagagcacatcagaaaa

SEQ ID NO: 586955 - DNA, 25 bp, Rattus norvegicus
tcctaccttgtcaatcctttgttaa

SEQ ID NO: 586956 - DNA, 25 bp, Rattus norvegicus
tcctaccttgtctatcctttgttaa

SEQ ID NO: 586957 - DNA, 25 bp, Rattus norvegicus
tcctaccttttcattcagtctattt

SEQ ID NO: 586958 - DNA, 25 bp, Rattus norvegicus
tcctaccttttctttcagtctattt

SEQ ID NO: 586959 - DNA, 25 bp, Rattus norvegicus
tcctacgactttacagctagctggg

SEQ ID NO: 586960 - DNA, 25 bp, Rattus norvegicus
tcctacgacttttcagctagctggg

SEQ ID NO: 586961 - DNA, 25 bp, Rattus norvegicus
tcctacgcttcacatggtttctttg

SEQ ID NO: 586962 - DNA, 25 bp, Rattus norvegicus
tcctacgcttcagatggtttctttg

SEQ ID NO: 586963 - DNA, 25 bp, Rattus norvegicus
tcctacgggagcaagtggcgcagct

SEQ ID NO: 586964 - DNA, 25 bp, Rattus norvegicus
tcctacgggagctagtggcgcagct

SEQ ID NO: 586965 - DNA, 25 bp, Rattus norvegicus
tcctacgtcagcacttttctaatgt

SEQ ID NO: 586966 - DNA, 25 bp, Rattus norvegicus
tcctacgtcagctcttttctaatgt

SEQ ID NO: 586967 - DNA, 25 bp, Rattus norvegicus
tcctactatcccaactgtcagagaa

SEQ ID NO: 586968 - DNA, 25 bp, Rattus norvegicus
tcctactatccctactgtcagagaa

SEQ ID NO: 586969 - DNA, 25 bp, Rattus norvegicus
tcctactcacagcagaggcggcaga

SEQ ID NO: 586970 - DNA, 25 bp, Rattus norvegicus
tcctactcacaggagaggcggcaga

SEQ ID NO: 586971 - DNA, 25 bp, Rattus norvegicus
tcctactcctcaactaacctagaat

SEQ ID NO: 586972 - DNA, 25 bp, Rattus norvegicus
tcctactcctcatctaacctagaat

SEQ ID NO: 586973 - DNA, 25 bp, Rattus norvegicus
tcctactgagccatggattctgagt

SEQ ID NO: 586974 - DNA, 25 bp, Rattus norvegicus
tcctactgagccttggattctgagt

SEQ ID NO: 586975 - DNA, 25 bp, Rattus norvegicus
tcctacttagggagcattcatttaa

SEQ ID NO: 586976 - DNA, 25 bp, Rattus norvegicus
tcctacttagggtgcattcatttaa

SEQ ID NO: 586977 - DNA, 25 bp, Rattus norvegicus
tcctacttccgtacctctgaagaag

SEQ ID NO: 586978 - DNA, 25 bp, Rattus norvegicus
tcctacttccgttcctctgaagaag

SEQ ID NO: 586979 - DNA, 25 bp, Rattus norvegicus
tcctacttccttactttgagcattt

SEQ ID NO: 586980 - DNA, 25 bp, Rattus norvegicus
tcctacttcctttctttgagcattt

SEQ ID NO: 586981 - DNA, 25 bp, Rattus norvegicus
tcctacttcgctctaatgtctcatt

SEQ ID NO: 586982 - DNA, 25 bp, Rattus norvegicus
tcctacttcgctgtaatgtctcatt

SEQ ID NO: 586983 - DNA, 25 bp, Rattus norvegicus
tcctacttggccattggtcaaattc

SEQ ID NO: 586984 - DNA, 25 bp, Rattus norvegicus
tcctacttggcctttggtcaaattc

SEQ ID NO: 586985 - DNA, 25 bp, Rattus norvegicus
tcctacttgtgaccccttggagtaa

SEQ ID NO: 586986 - DNA, 25 bp, Rattus norvegicus
tcctacttgtgagcccttggagtaa

SEQ ID NO: 586987 - DNA, 25 bp, Rattus norvegicus
tcctacttgtggcactgctagcagt

SEQ ID NO: 586988 - DNA, 25 bp, Rattus norvegicus
tcctacttgtgggactgctagcagt

SEQ ID NO: 586989 - DNA, 25 bp, Rattus norvegicus
tcctactttattactgctgactcta

SEQ ID NO: 586990 - DNA, 25 bp, Rattus norvegicus
tcctactttatttctgctgactcta

SEQ ID NO: 586991 - DNA, 25 bp, Rattus norvegicus
tcctactttctgatccttgatagat

SEQ ID NO: 586992 - DNA, 25 bp, Rattus norvegicus
tcctactttctgttccttgatagat

SEQ ID NO: 586993 - DNA, 25 bp, Rattus norvegicus
tcctacttttgtcttcctggcatca

SEQ ID NO: 586994 - DNA, 25 bp, Rattus norvegicus
tcctacttttgtgttcctggcatca

SEQ ID NO: 586995 - DNA, 25 bp, Rattus norvegicus
tcctagaacagaacccgggcatggt

SEQ ID NO: 586996 - DNA, 25 bp, Rattus norvegicus
tcctagaacagatcccgggcatggt

SEQ ID NO: 586997 - DNA, 25 bp, Rattus norvegicus
tcctagaacctacgtaaagcttttg

SEQ ID NO: 586998 - DNA, 25 bp, Rattus norvegicus
tcctagaacctaggtaaagcttttg

SEQ ID NO: 586999 - DNA, 25 bp, Rattus norvegicus
tcctagacctatcttgaagcttcag

SEQ ID NO: 587000 - DNA, 25 bp, Rattus norvegicus
tcctagacctatgttgaagcttcag

SEQ ID NO: 587001 - DNA, 25 bp, Rattus norvegicus
tcctagatcatgatagatgcctttc

SEQ ID NO: 587002 - DNA, 25 bp, Rattus norvegicus
tcctagatcatgttagatgcctttc

SEQ ID NO: 587003 - DNA, 25 bp, Rattus norvegicus
tcctagcactcaaagttagaggtcg

SEQ ID NO: 587004 - DNA, 25 bp, Rattus norvegicus
tcctagcactcatagttagaggtcg

SEQ ID NO: 587005 - DNA, 25 bp, Rattus norvegicus
tcctagcactggcttgtgagtccaa

SEQ ID NO: 587006 - DNA, 25 bp, Rattus norvegicus
tcctagcactgggttgtgagtccaa

SEQ ID NO: 587007 - DNA, 25 bp, Rattus norvegicus
tcctagccagcccaaaactgtgaaa

SEQ ID NO: 587008 - DNA, 25 bp, Rattus norvegicus
tcctagccagccgaaaactgtgaaa

SEQ ID NO: 587009 - DNA, 25 bp, Rattus norvegicus
tcctagccctgaagaacagcaagtg

SEQ ID NO: 587010 - DNA, 25 bp, Rattus norvegicus
tcctagccctgatgaacagcaagtg

SEQ ID NO: 587011 - DNA, 25 bp, Rattus norvegicus
tcctagccctgtagggtgtgatgtc

SEQ ID NO: 587012 - DNA, 25 bp, Rattus norvegicus
tcctagccctgttgggtgtgatgtc

SEQ ID NO: 587013 - DNA, 25 bp, Rattus norvegicus
tcctagccctttctgtccaagatta

SEQ ID NO: 587014 - DNA, 25 bp, Rattus norvegicus
tcctagccctttgtgtccaagatta

SEQ ID NO: 587015 - DNA, 25 bp, Rattus norvegicus
tcctagcctctcacccaaaaagtaa

SEQ ID NO: 587016 - DNA, 25 bp, Rattus norvegicus
tcctagcctctctcccaaaaagtaa

SEQ ID NO: 587017 - DNA, 25 bp, Rattus norvegicus
tcctagctaggacctcagtcaggtt

SEQ ID NO: 587018 - DNA, 25 bp, Rattus norvegicus
tcctagctaggagctcagtcaggtt

SEQ ID NO: 587019 - DNA, 25 bp, Rattus norvegicus
tcctagctctccaatttctgggtgt

SEQ ID NO: 587020 - DNA, 25 bp, Rattus norvegicus
tcctagctctcctatttctgggtgt

SEQ ID NO: 587021 - DNA, 25 bp, Rattus norvegicus
tcctagctctgtccctcagaggtaa

SEQ ID NO: 587022 - DNA, 25 bp, Rattus norvegicus
tcctagctctgtgcctcagaggtaa

SEQ ID NO: 587023 - DNA, 25 bp, Rattus norvegicus
tcctagctgagccaaaccacatgaa

SEQ ID NO: 587024 - DNA, 25 bp, Rattus norvegicus
tcctagctgagcgaaaccacatgaa

SEQ ID NO: 587025 - DNA, 25 bp, Rattus norvegicus
tcctagctgctactgtgctgataca

SEQ ID NO: 587026 - DNA, 25 bp, Rattus norvegicus
tcctagctgctagtgtgctgataca

SEQ ID NO: 587027 - DNA, 25 bp, Rattus norvegicus
tcctagcttcctcacatttgtgcaa

SEQ ID NO: 587028 - DNA, 25 bp, Rattus norvegicus
tcctagcttcctgacatttgtgcaa

SEQ ID NO: 587029 - DNA, 25 bp, Rattus norvegicus
tcctagcttcgaattgggtttcaaa

SEQ ID NO: 587030 - DNA, 25 bp, Rattus norvegicus
tcctagcttcgatttgggtttcaaa

SEQ ID NO: 587031 - DNA, 25 bp, Rattus norvegicus
tcctaggaaggcatcctccacaaac

SEQ ID NO: 587032 - DNA, 25 bp, Rattus norvegicus
tcctaggaaggcttcctccacaaac

SEQ ID NO: 587033 - DNA, 25 bp, Rattus norvegicus
tcctagggccagacagtgatgaact

SEQ ID NO: 587034 - DNA, 25 bp, Rattus norvegicus
tcctagggccagtcagtgatgaact

SEQ ID NO: 587035 - DNA, 25 bp, Rattus norvegicus
tcctaggtaggaacagctctcaatg

SEQ ID NO: 587036 - DNA, 25 bp, Rattus norvegicus
tcctaggtaggatcagctctcaatg

SEQ ID NO: 587037 - DNA, 25 bp, Rattus norvegicus
tcctaggtccacacggttgatgtaa

SEQ ID NO: 587038 - DNA, 25 bp, Rattus norvegicus
tcctaggtccactcggttgatgtaa

SEQ ID NO: 587039 - DNA, 25 bp, Rattus norvegicus
tcctagtaaacactcagacctctgc

SEQ ID NO: 587040 - DNA, 25 bp, Rattus norvegicus
tcctagtaaacagtcagacctctgc

SEQ ID NO: 587041 - DNA, 25 bp, Rattus norvegicus
tcctagtaattaccaaaaccaccat

SEQ ID NO: 587042 - DNA, 25 bp, Rattus norvegicus
tcctagtaattagcaaaaccaccat

SEQ ID NO: 587043 - DNA, 25 bp, Rattus norvegicus
tcctagtactttcgaggtggctata

SEQ ID NO: 587044 - DNA, 25 bp, Rattus norvegicus
tcctagtactttggaggtggctata

SEQ ID NO: 587045 - DNA, 25 bp, Rattus norvegicus
tcctagtagtaactgtaacccggcg

SEQ ID NO: 587046 - DNA, 25 bp, Rattus norvegicus
tcctagtagtaagtgtaacccggcg

SEQ ID NO: 587047 - DNA, 25 bp, Rattus norvegicus
tcctagtcgttgctccagataattt

SEQ ID NO: 587048 - DNA, 25 bp, Rattus norvegicus
tcctagtcgttggtccagataattt

SEQ ID NO: 587049 - DNA, 25 bp, Rattus norvegicus
tcctagtcttatatatgctcccctt

SEQ ID NO: 587050 - DNA, 25 bp, Rattus norvegicus
tcctagtcttatttatgctcccctt

SEQ ID NO: 587051 - DNA, 25 bp, Rattus norvegicus
tcctagtgaagccttgtgaccctct

SEQ ID NO: 587052 - DNA, 25 bp, Rattus norvegicus
tcctagtgaagcgttgtgaccctct

SEQ ID NO: 587053 - DNA, 25 bp, Rattus norvegicus
tcctagtgacttcttttgtttaatt

SEQ ID NO: 587054 - DNA, 25 bp, Rattus norvegicus
tcctagtgacttgttttgtttaatt

SEQ ID NO: 587055 - DNA, 25 bp, Rattus norvegicus
tcctagtggagcaggtgcctcggta

SEQ ID NO: 587056 - DNA, 25 bp, Rattus norvegicus
tcctagtggagctggtgcctcggta

SEQ ID NO: 587057 - DNA, 25 bp, Rattus norvegicus
tcctagtgtcccattcttttaaatg

SEQ ID NO: 587058 - DNA, 25 bp, Rattus norvegicus
tcctagtgtccctttcttttaaatg

SEQ ID NO: 587059 - DNA, 25 bp, Rattus norvegicus
tcctagtttgttacatgtagcccag

SEQ ID NO: 587060 - DNA, 25 bp, Rattus norvegicus
tcctagtttgtttcatgtagcccag

SEQ ID NO: 587061 - DNA, 25 bp, Rattus norvegicus
tcctagttttgacaaatcctgtttt

SEQ ID NO: 587062 - DNA, 25 bp, Rattus norvegicus
tcctagttttgagaaatcctgtttt

SEQ ID NO: 587063 - DNA, 25 bp, Rattus norvegicus
tcctagttttgtatttcgttgctga

SEQ ID NO: 587064 - DNA, 25 bp, Rattus norvegicus
tcctagttttgtttttcgttgctga

SEQ ID NO: 587065 - DNA, 25 bp, Rattus norvegicus
tcctatacaagacaggtcccaggcg

SEQ ID NO: 587066 - DNA, 25 bp, Rattus norvegicus
tcctatacaagagaggtcccaggcg

SEQ ID NO: 587067 - DNA, 25 bp, Rattus norvegicus
tcctataccggtctccaggtggaac

SEQ ID NO: 587068 - DNA, 25 bp, Rattus norvegicus
tcctataccggtgtccaggtggaac

SEQ ID NO: 587069 - DNA, 25 bp, Rattus norvegicus
tcctatacctttctttcagcagtgg

SEQ ID NO: 587070 - DNA, 25 bp, Rattus norvegicus
tcctatacctttgtttcagcagtgg

SEQ ID NO: 587071 - DNA, 25 bp, Rattus norvegicus
tcctatagtatactcctgtccccat

SEQ ID NO: 587072 - DNA, 25 bp, Rattus norvegicus
tcctatagtatagtcctgtccccat

SEQ ID NO: 587073 - DNA, 25 bp, Rattus norvegicus
tcctatcccataaggctgggcagtg

SEQ ID NO: 587074 - DNA, 25 bp, Rattus norvegicus
tcctatcccatatggctgggcagtg

SEQ ID NO: 587075 - DNA, 25 bp, Rattus norvegicus
tcctatcctccaagaacttagcaag

SEQ ID NO: 587076 - DNA, 25 bp, Rattus norvegicus
tcctatcctccatgaacttagcaag

SEQ ID NO: 587077 - DNA, 25 bp, Rattus norvegicus
tcctatctatcaacttcccctggtt

SEQ ID NO: 587078 - DNA, 25 bp, Rattus norvegicus
tcctatctatcatcttcccctggtt

SEQ ID NO: 587079 - DNA, 25 bp, Rattus norvegicus
tcctatctcacaacgggaagcacta

SEQ ID NO: 587080 - DNA, 25 bp, Rattus norvegicus
tcctatctcacatcgggaagcacta

SEQ ID NO: 587081 - DNA, 25 bp, Rattus norvegicus
tcctatctcctgcttgggttttaat

SEQ ID NO: 587082 - DNA, 25 bp, Rattus norvegicus
tcctatctcctggttgggttttaat

SEQ ID NO: 587083 - DNA, 25 bp, Rattus norvegicus
tcctatcttgttcctatgggaccat

SEQ ID NO: 587084 - DNA, 25 bp, Rattus norvegicus
tcctatcttgttgctatgggaccat

SEQ ID NO: 587085 - DNA, 25 bp, Rattus norvegicus
tcctatgacccgagcctggaagacg

SEQ ID NO: 587086 - DNA, 25 bp, Rattus norvegicus
tcctatgacccgtgcctggaagacg

SEQ ID NO: 587087 - DNA, 25 bp, Rattus norvegicus
tcctatgcccaacactcacatgtta

SEQ ID NO: 587088 - DNA, 25 bp, Rattus norvegicus
tcctatgcccaagactcacatgtta

SEQ ID NO: 587089 - DNA, 25 bp, Rattus norvegicus
tcctatgcttgcagtgttcatctca

SEQ ID NO: 587090 - DNA, 25 bp, Rattus norvegicus
tcctatgcttgctgtgttcatctca

SEQ ID NO: 587091 - DNA, 25 bp, Rattus norvegicus
tcctatggaagtcggaaacatggtc

SEQ ID NO: 587092 - DNA, 25 bp, Rattus norvegicus
tcctatggaagtgggaaacatggtc

SEQ ID NO: 587093 - DNA, 25 bp, Rattus norvegicus
tcctatggcctacctcagtggtaca

SEQ ID NO: 587094 - DNA, 25 bp, Rattus norvegicus
tcctatggcctagctcagtggtaca

SEQ ID NO: 587095 - DNA, 25 bp, Rattus norvegicus
tcctatgtacttcattaaagcagtg

SEQ ID NO: 587096 - DNA, 25 bp, Rattus norvegicus
tcctatgtacttgattaaagcagtg

SEQ ID NO: 587097 - DNA, 25 bp, Rattus norvegicus
tcctatgtggccctctttgaccgag

SEQ ID NO: 587098 - DNA, 25 bp, Rattus norvegicus
tcctatgtggccgtctttgaccgag

SEQ ID NO: 587099 - DNA, 25 bp, Rattus norvegicus
tcctattaaaaacaagactcacttt

SEQ ID NO: 587100 - DNA, 25 bp, Rattus norvegicus
tcctattaaaaagaagactcacttt

SEQ ID NO: 587101 - DNA, 25 bp, Rattus norvegicus
tcctattaggaccttctctttaaag

SEQ ID NO: 587102 - DNA, 25 bp, Rattus norvegicus
tcctattaggacgttctctttaaag

SEQ ID NO: 587103 - DNA, 25 bp, Rattus norvegicus
tcctattagtcaccttgcctctgag

SEQ ID NO: 587104 - DNA, 25 bp, Rattus norvegicus
tcctattagtcagcttgcctctgag

SEQ ID NO: 587105 - DNA, 25 bp, Rattus norvegicus
tcctattcgcatatattctgacccc

SEQ ID NO: 587106 - DNA, 25 bp, Rattus norvegicus
tcctattcgcatttattctgacccc

SEQ ID NO: 587107 - DNA, 25 bp, Rattus norvegicus
tcctattcgtgaccgagcttctcaa

SEQ ID NO: 587108 - DNA, 25 bp, Rattus norvegicus
tcctattcgtgagcgagcttctcaa

SEQ ID NO: 587109 - DNA, 25 bp, Rattus norvegicus
tcctattgcctaattgttgacacag

SEQ ID NO: 587110 - DNA, 25 bp, Rattus norvegicus
tcctattgcctatttgttgacacag

SEQ ID NO: 587111 - DNA, 25 bp, Rattus norvegicus
tcctattgcttacgtgatgatatac

SEQ ID NO: 587112 - DNA, 25 bp, Rattus norvegicus
tcctattgcttaggtgatgatatac

SEQ ID NO: 587113 - DNA, 25 bp, Rattus norvegicus
tcctattggtttagttccctggcct

SEQ ID NO: 587114 - DNA, 25 bp, Rattus norvegicus
tcctattggttttgttccctggcct

SEQ ID NO: 587115 - DNA, 25 bp, Rattus norvegicus
tcctattttggactggtcagacatt

SEQ ID NO: 587116 - DNA, 25 bp, Rattus norvegicus
tcctattttggagtggtcagacatt

SEQ ID NO: 587117 - DNA, 25 bp, Rattus norvegicus
tcctcaaagagcattatttttcttc

SEQ ID NO: 587118 - DNA, 25 bp, Rattus norvegicus
tcctcaaagagctttatttttcttc

SEQ ID NO: 587119 - DNA, 25 bp, Rattus norvegicus
tcctcaaaggcaaaattgttcttgt

SEQ ID NO: 587120 - DNA, 25 bp, Rattus norvegicus
tcctcaaaggcataattgttcttgt

SEQ ID NO: 587121 - DNA, 25 bp, Rattus norvegicus
tcctcaaaggtcaccagagaggtgc

SEQ ID NO: 587122 - DNA, 25 bp, Rattus norvegicus
tcctcaaaggtctccagagaggtgc

SEQ ID NO: 587123 - DNA, 25 bp, Rattus norvegicus
tcctcaaaggttctggcgcacacac

SEQ ID NO: 587124 - DNA, 25 bp, Rattus norvegicus
tcctcaaaggttgtggcgcacacac

SEQ ID NO: 587125 - DNA, 25 bp, Rattus norvegicus
tcctcaacaagaaagacctctttgg

SEQ ID NO: 587126 - DNA, 25 bp, Rattus norvegicus
tcctcaacaagatagacctctttgg

SEQ ID NO: 587127 - DNA, 25 bp, Rattus norvegicus
tcctcaacacctacgaaacctatgt

SEQ ID NO: 587128 - DNA, 25 bp, Rattus norvegicus
tcctcaacaccttcgaaacctatgt

SEQ ID NO: 587129 - DNA, 25 bp, Rattus norvegicus
tcctcaacctccaaaatactgtcta

SEQ ID NO: 587130 - DNA, 25 bp, Rattus norvegicus
tcctcaacctcctaaatactgtcta

SEQ ID NO: 587131 - DNA, 25 bp, Rattus norvegicus
tcctcaactcttcgcttatatcttt

SEQ ID NO: 587132 - DNA, 25 bp, Rattus norvegicus
tcctcaactcttggcttatatcttt

SEQ ID NO: 587133 - DNA, 25 bp, Rattus norvegicus
tcctcaagccggattagaatcttgg

SEQ ID NO: 587134 - DNA, 25 bp, Rattus norvegicus
tcctcaagccggtttagaatcttgg

SEQ ID NO: 587135 - DNA, 25 bp, Rattus norvegicus
tcctcaagtaccagcggagacggtt

SEQ ID NO: 587136 - DNA, 25 bp, Rattus norvegicus
tcctcaagtacctgcggagacggtt

SEQ ID NO: 587137 - DNA, 25 bp, Rattus norvegicus
tcctcaatgtctagtctcatctcta

SEQ ID NO: 587138 - DNA, 25 bp, Rattus norvegicus
tcctcaatgtcttgtctcatctcta

SEQ ID NO: 587139 - DNA, 25 bp, Rattus norvegicus
tcctcaattcaaaagggacagcact

SEQ ID NO: 587140 - DNA, 25 bp, Rattus norvegicus
tcctcaattcaatagggacagcact

SEQ ID NO: 587141 - DNA, 25 bp, Rattus norvegicus
tcctcacacaccattgtatctgtaa

SEQ ID NO: 587142 - DNA, 25 bp, Rattus norvegicus
tcctcacacacctttgtatctgtaa

SEQ ID NO: 587143 - DNA, 25 bp, Rattus norvegicus
tcctcacacggaaagtactctctgt

SEQ ID NO: 587144 - DNA, 25 bp, Rattus norvegicus
tcctcacacggatagtactctctgt

SEQ ID NO: 587145 - DNA, 25 bp, Rattus norvegicus
tcctcacagagtctgctctcttttc

SEQ ID NO: 587146 - DNA, 25 bp, Rattus norvegicus
tcctcacagagtgtgctctcttttc

SEQ ID NO: 587147 - DNA, 25 bp, Rattus norvegicus
tcctcacagatcacagttacttttg

SEQ ID NO: 587148 - DNA, 25 bp, Rattus norvegicus
tcctcacagatctcagttacttttg

SEQ ID NO: 587149 - DNA, 25 bp, Rattus norvegicus
tcctcacagtttcccacggagagaa

SEQ ID NO: 587150 - DNA, 25 bp, Rattus norvegicus
tcctcacagtttgccacggagagaa

SEQ ID NO: 587151 - DNA, 25 bp, Rattus norvegicus
tcctcaccaagaagccttccattaa

SEQ ID NO: 587152 - DNA, 25 bp, Rattus norvegicus
tcctcaccaagatgccttccattaa

SEQ ID NO: 587153 - DNA, 25 bp, Rattus norvegicus
tcctcaccacaacctgaatattttc

SEQ ID NO: 587154 - DNA, 25 bp, Rattus norvegicus
tcctcaccacaagctgaatattttc

SEQ ID NO: 587155 - DNA, 25 bp, Rattus norvegicus
tcctcaccatcgctatgcaaagtgg

SEQ ID NO: 587156 - DNA, 25 bp, Rattus norvegicus
tcctcaccatcggtatgcaaagtgg

SEQ ID NO: 587157 - DNA, 25 bp, Rattus norvegicus
tcctcaccatggatgcagcacaaag

SEQ ID NO: 587158 - DNA, 25 bp, Rattus norvegicus
tcctcaccatggttgcagcacaaag

SEQ ID NO: 587159 - DNA, 25 bp, Rattus norvegicus
tcctcaccccttaacagtggaagaa

SEQ ID NO: 587160 - DNA, 25 bp, Rattus norvegicus
tcctcaccccttagatgagcaggaa

SEQ ID NO: 587161 - DNA, 25 bp, Rattus norvegicus
tcctcacccctttacagtggaagaa

SEQ ID NO: 587162 - DNA, 25 bp, Rattus norvegicus
tcctcacccctttgatgagcaggaa

SEQ ID NO: 587163 - DNA, 25 bp, Rattus norvegicus
tcctcacccgttatcagactgatct

SEQ ID NO: 587164 - DNA, 25 bp, Rattus norvegicus
tcctcacccgttttcagactgatct

SEQ ID NO: 587165 - DNA, 25 bp, Rattus norvegicus
tcctcacctgaaagcacgttgtatc

SEQ ID NO: 587166 - DNA, 25 bp, Rattus norvegicus
tcctcacctgaatgcacgttgtatc

SEQ ID NO: 587167 - DNA, 25 bp, Rattus norvegicus
tcctcacctggtaaaccttgggtat

SEQ ID NO: 587168 - DNA, 25 bp, Rattus norvegicus
tcctcacctggttaaccttgggtat

SEQ ID NO: 587169 - DNA, 25 bp, Rattus norvegicus
tcctcaccttgactagcacaatttt

SEQ ID NO: 587170 - DNA, 25 bp, Rattus norvegicus
tcctcaccttgagtagcacaatttt

SEQ ID NO: 587171 - DNA, 25 bp, Rattus norvegicus
tcctcacgaagcagttgccaagtta

SEQ ID NO: 587172 - DNA, 25 bp, Rattus norvegicus
tcctcacgaagctgttgccaagtta

SEQ ID NO: 587173 - DNA, 25 bp, Rattus norvegicus
tcctcacggacgacctccggtgggt

SEQ ID NO: 587174 - DNA, 25 bp, Rattus norvegicus
tcctcacggacgtcctccggtgggt

SEQ ID NO: 587175 - DNA, 25 bp, Rattus norvegicus
tcctcacgtagcagtccttccaagt

SEQ ID NO: 587176 - DNA, 25 bp, Rattus norvegicus
tcctcacgtagctgtccttccaagt

SEQ ID NO: 587177 - DNA, 25 bp, Rattus norvegicus
tcctcactagcaccctaggtgtgat

SEQ ID NO: 587178 - DNA, 25 bp, Rattus norvegicus
tcctcactagcagcctaggtgtgat

SEQ ID NO: 587179 - DNA, 25 bp, Rattus norvegicus
tcctcactagtcagacatcgctgga

SEQ ID NO: 587180 - DNA, 25 bp, Rattus norvegicus
tcctcactagtctgacatcgctgga

SEQ ID NO: 587181 - DNA, 25 bp, Rattus norvegicus
tcctcactgacgctggtgggtccat

SEQ ID NO: 587182 - DNA, 25 bp, Rattus norvegicus
tcctcactgacggtggtgggtccat

SEQ ID NO: 587183 - DNA, 25 bp, Rattus norvegicus
tcctcactgcctctttagttttatt

SEQ ID NO: 587184 - DNA, 25 bp, Rattus norvegicus
tcctcactgcctgtttagttttatt

SEQ ID NO: 587185 - DNA, 25 bp, Rattus norvegicus
tcctcactgctaagccagttagtaa

SEQ ID NO: 587186 - DNA, 25 bp, Rattus norvegicus
tcctcactgctatgccagttagtaa

SEQ ID NO: 587187 - DNA, 25 bp, Rattus norvegicus
tcctcactgctcaaacatgctgaag

SEQ ID NO: 587188 - DNA, 25 bp, Rattus norvegicus
tcctcactgctctaacatgctgaag

SEQ ID NO: 587189 - DNA, 25 bp, Rattus norvegicus
tcctcactgtgaatgtcgacagacc

SEQ ID NO: 587190 - DNA, 25 bp, Rattus norvegicus
tcctcactgtgattgtcgacagacc

SEQ ID NO: 587191 - DNA, 25 bp, Rattus norvegicus
tcctcactgtgtcctatagaactca

SEQ ID NO: 587192 - DNA, 25 bp, Rattus norvegicus
tcctcactgtgtgctatagaactca

SEQ ID NO: 587193 - DNA, 25 bp, Rattus norvegicus
tcctcacttcggagttgggcttgga

SEQ ID NO: 587194 - DNA, 25 bp, Rattus norvegicus
tcctcacttcggtgttgggcttgga

SEQ ID NO: 587195 - DNA, 25 bp, Rattus norvegicus
tcctcactttctactctaggcagtt

SEQ ID NO: 587196 - DNA, 25 bp, Rattus norvegicus
tcctcactttcttctctaggcagtt

SEQ ID NO: 587197 - DNA, 25 bp, Rattus norvegicus
tcctcagaacccatggataacccag

SEQ ID NO: 587198 - DNA, 25 bp, Rattus norvegicus
tcctcagaacccttggataacccag

SEQ ID NO: 587199 - DNA, 25 bp, Rattus norvegicus
tcctcagacaccagctaagcatatg

SEQ ID NO: 587200 - DNA, 25 bp, Rattus norvegicus
tcctcagacacctgctaagcatatg

SEQ ID NO: 587201 - DNA, 25 bp, Rattus norvegicus
tcctcagacagccacgagggctcgg

SEQ ID NO: 587202 - DNA, 25 bp, Rattus norvegicus
tcctcagacagcgacgagggctcgg

SEQ ID NO: 587203 - DNA, 25 bp, Rattus norvegicus
tcctcagaccggcttcctgaagatt

SEQ ID NO: 587204 - DNA, 25 bp, Rattus norvegicus
tcctcagaccgggttcctgaagatt

SEQ ID NO: 587205 - DNA, 25 bp, Rattus norvegicus
tcctcagactctctgctctttggag

SEQ ID NO: 587206 - DNA, 25 bp, Rattus norvegicus
tcctcagactctgtgctctttggag

SEQ ID NO: 587207 - DNA, 25 bp, Rattus norvegicus
tcctcagactgaacaatgtgtgggt

SEQ ID NO: 587208 - DNA, 25 bp, Rattus norvegicus
tcctcagactgatcaatgtgtgggt

SEQ ID NO: 587209 - DNA, 25 bp, Rattus norvegicus
tcctcagactgcctgtggtttattt

SEQ ID NO: 587210 - DNA, 25 bp, Rattus norvegicus
tcctcagactgcgtgtggtttattt

SEQ ID NO: 587211 - DNA, 25 bp, Rattus norvegicus
tcctcagagcaccattcggatgcta

SEQ ID NO: 587212 - DNA, 25 bp, Rattus norvegicus
tcctcagagcacgattcggatgcta

SEQ ID NO: 587213 - DNA, 25 bp, Rattus norvegicus
tcctcagagcccatagcatactgta

SEQ ID NO: 587214 - DNA, 25 bp, Rattus norvegicus
tcctcagagcccttagcatactgta

SEQ ID NO: 587215 - DNA, 25 bp, Rattus norvegicus
tcctcagagtctcctaaggtcttgt

SEQ ID NO: 587216 - DNA, 25 bp, Rattus norvegicus
tcctcagagtctgctaaggtcttgt

SEQ ID NO: 587217 - DNA, 25 bp, Rattus norvegicus
tcctcagagtttctcatccgtcctt

SEQ ID NO: 587218 - DNA, 25 bp, Rattus norvegicus
tcctcagagtttgtcatccgtcctt

SEQ ID NO: 587219 - DNA, 25 bp, Rattus norvegicus
tcctcagatctgaccagtggagcaa

SEQ ID NO: 587220 - DNA, 25 bp, Rattus norvegicus
tcctcagatctgtccagtggagcaa

SEQ ID NO: 587221 - DNA, 25 bp, Rattus norvegicus
tcctcagatgccattcgggtagcaa

SEQ ID NO: 587222 - DNA, 25 bp, Rattus norvegicus
tcctcagatgcctttcgggtagcaa

SEQ ID NO: 587223 - DNA, 25 bp, Rattus norvegicus
tcctcagattcccaagcagctaagc

SEQ ID NO: 587224 - DNA, 25 bp, Rattus norvegicus
tcctcagattccgaagcagctaagc

SEQ ID NO: 587225 - DNA, 25 bp, Rattus norvegicus
tcctcagcagcccactggtgatgat

SEQ ID NO: 587226 - DNA, 25 bp, Rattus norvegicus
tcctcagcagccgactggtgatgat

SEQ ID NO: 587227 - DNA, 25 bp, Rattus norvegicus
tcctcagccaaccagtcttgtaaac

SEQ ID NO: 587228 - DNA, 25 bp, Rattus norvegicus
tcctcagccaacgagtcttgtaaac

SEQ ID NO: 587229 - DNA, 25 bp, Rattus norvegicus
tcctcagccaagacttcaacagcaa

SEQ ID NO: 587230 - DNA, 25 bp, Rattus norvegicus
tcctcagccaagtcttcaacagcaa

SEQ ID NO: 587231 - DNA, 25 bp, Rattus norvegicus
tcctcagcccttagcattttgtcct

SEQ ID NO: 587232 - DNA, 25 bp, Rattus norvegicus
tcctcagccctttgcattttgtcct

SEQ ID NO: 587233 - DNA, 25 bp, Rattus norvegicus
tcctcagccgtgctagatggacagc

SEQ ID NO: 587234 - DNA, 25 bp, Rattus norvegicus
tcctcagccgtggtagatggacagc

SEQ ID NO: 587235 - DNA, 25 bp, Rattus norvegicus
tcctcagcggctctggtgtttctga

SEQ ID NO: 587236 - DNA, 25 bp, Rattus norvegicus
tcctcagcggctgtggtgtttctga

SEQ ID NO: 587237 - DNA, 25 bp, Rattus norvegicus
tcctcagcgtccagtaggtgagagt

SEQ ID NO: 587238 - DNA, 25 bp, Rattus norvegicus
tcctcagcgtcctgtaggtgagagt

SEQ ID NO: 587239 - DNA, 25 bp, Rattus norvegicus
tcctcagctctaagtgcatgaatgg

SEQ ID NO: 587240 - DNA, 25 bp, Rattus norvegicus
tcctcagctctatgtgcatgaatgg

SEQ ID NO: 587241 - DNA, 25 bp, Rattus norvegicus
tcctcagctgtcatttatcttttat

SEQ ID NO: 587242 - DNA, 25 bp, Rattus norvegicus
tcctcagctgtcttttatcttttat

SEQ ID NO: 587243 - DNA, 25 bp, Rattus norvegicus
tcctcagcttcgagtgaaataaaag

SEQ ID NO: 587244 - DNA, 25 bp, Rattus norvegicus
tcctcagcttcgtgtgaaataaaag

SEQ ID NO: 587245 - DNA, 25 bp, Rattus norvegicus
tcctcagctttgatttggtcactgt

SEQ ID NO: 587246 - DNA, 25 bp, Rattus norvegicus
tcctcagctttgttttggtcactgt

SEQ ID NO: 587247 - DNA, 25 bp, Rattus norvegicus
tcctcaggatgcacgggagctgagc

SEQ ID NO: 587248 - DNA, 25 bp, Rattus norvegicus
tcctcaggatgctcgggagctgagc

SEQ ID NO: 587249 - DNA, 25 bp, Rattus norvegicus
tcctcaggcgccaacaaagactgat

SEQ ID NO: 587250 - DNA, 25 bp, Rattus norvegicus
tcctcaggcgcctacaaagactgat

SEQ ID NO: 587251 - DNA, 25 bp, Rattus norvegicus
tcctcaggcttgaccaccacagtgg

SEQ ID NO: 587252 - DNA, 25 bp, Rattus norvegicus
tcctcaggcttgtccaccacagtgg

SEQ ID NO: 587253 - DNA, 25 bp, Rattus norvegicus
tcctcagggacaaagcaagcttctc

SEQ ID NO: 587254 - DNA, 25 bp, Rattus norvegicus
tcctcagggacatagcaagcttctc

SEQ ID NO: 587255 - DNA, 25 bp, Rattus norvegicus
tcctcagggagccaaatgtctctga

SEQ ID NO: 587256 - DNA, 25 bp, Rattus norvegicus
tcctcagggagcgaaatgtctctga

SEQ ID NO: 587257 - DNA, 25 bp, Rattus norvegicus
tcctcagggcacacagtgttggttt

SEQ ID NO: 587258 - DNA, 25 bp, Rattus norvegicus
tcctcagggcactcagtgttggttt

SEQ ID NO: 587259 - DNA, 25 bp, Rattus norvegicus
tcctcagggccaccgaaaggtctgg

SEQ ID NO: 587260 - DNA, 25 bp, Rattus norvegicus
tcctcagggccagcgaaaggtctgg

SEQ ID NO: 587261 - DNA, 25 bp, Rattus norvegicus
tcctcagggcctctgttagtgtctg

SEQ ID NO: 587262 - DNA, 25 bp, Rattus norvegicus
tcctcagggcctgtgttagtgtctg

SEQ ID NO: 587263 - DNA, 25 bp, Rattus norvegicus
tcctcaggtccgattgtggcttatg

SEQ ID NO: 587264 - DNA, 25 bp, Rattus norvegicus
tcctcaggtccgtttgtggcttatg

SEQ ID NO: 587265 - DNA, 25 bp, Rattus norvegicus
tcctcaggttcacatgccacatgtg

SEQ ID NO: 587266 - DNA, 25 bp, Rattus norvegicus
tcctcaggttcagatgccacatgtg

SEQ ID NO: 587267 - DNA, 25 bp, Rattus norvegicus
tcctcagtaccacctgtaagggtca

SEQ ID NO: 587268 - DNA, 25 bp, Rattus norvegicus
tcctcagtaccagctgtaagggtca

SEQ ID NO: 587269 - DNA, 25 bp, Rattus norvegicus
tcctcagtagccagctgcatggact

SEQ ID NO: 587270 - DNA, 25 bp, Rattus norvegicus
tcctcagtagcctgctgcatggact

SEQ ID NO: 587271 - DNA, 25 bp, Rattus norvegicus
tcctcagtattacttcccttagtgg

SEQ ID NO: 587272 - DNA, 25 bp, Rattus norvegicus
tcctcagtattagttcccttagtgg

SEQ ID NO: 587273 - DNA, 25 bp, Rattus norvegicus
tcctcagtcaccaggcatgaatgtg

SEQ ID NO: 587274 - DNA, 25 bp, Rattus norvegicus
tcctcagtcacctggcatgaatgtg

SEQ ID NO: 587275 - DNA, 25 bp, Rattus norvegicus
tcctcagtctcaccagtgtactggg

SEQ ID NO: 587276 - DNA, 25 bp, Rattus norvegicus
tcctcagtctcagcagtgtactggg

SEQ ID NO: 587277 - DNA, 25 bp, Rattus norvegicus
tcctcagtgctgagcccaagggtgg

SEQ ID NO: 587278 - DNA, 25 bp, Rattus norvegicus
tcctcagtgctgtgcccaagggtgg

SEQ ID NO: 587279 - DNA, 25 bp, Rattus norvegicus
tcctcagtggctcaatgtttccaga

SEQ ID NO: 587280 - DNA, 25 bp, Rattus norvegicus
tcctcagtggctgaatgtttccaga

SEQ ID NO: 587281 - DNA, 25 bp, Rattus norvegicus
tcctcagttcagaatgttgtctcag

SEQ ID NO: 587282 - DNA, 25 bp, Rattus norvegicus
tcctcagttcagtatgttgtctcag

SEQ ID NO: 587283 - DNA, 25 bp, Rattus norvegicus
tcctcagttccgctgcagtatagta

SEQ ID NO: 587284 - DNA, 25 bp, Rattus norvegicus
tcctcagttccggtgcagtatagta

SEQ ID NO: 587285 - DNA, 25 bp, Rattus norvegicus
tcctcagttcttcgctgttcagaag

SEQ ID NO: 587286 - DNA, 25 bp, Rattus norvegicus
tcctcagttcttggctgttcagaag

SEQ ID NO: 587287 - DNA, 25 bp, Rattus norvegicus
tcctcagtttttccaagtctaaaag

SEQ ID NO: 587288 - DNA, 25 bp, Rattus norvegicus
tcctcagtttttgcaagtctaaaag

SEQ ID NO: 587289 - DNA, 25 bp, Rattus norvegicus
tcctcatactggaacactacctggc

SEQ ID NO: 587290 - DNA, 25 bp, Rattus norvegicus
tcctcatactggtacactacctggc

SEQ ID NO: 587291 - DNA, 25 bp, Rattus norvegicus
tcctcatagcacattgcgctgttgt

SEQ ID NO: 587292 - DNA, 25 bp, Rattus norvegicus
tcctcatagcactttgcgctgttgt

SEQ ID NO: 587293 - DNA, 25 bp, Rattus norvegicus
tcctcatcatcaaagtggcggtgaa

SEQ ID NO: 587294 - DNA, 25 bp, Rattus norvegicus
tcctcatcatcatagtggcggtgaa

SEQ ID NO: 587295 - DNA, 25 bp, Rattus norvegicus
tcctcatccgctacagacaggaatg

SEQ ID NO: 587296 - DNA, 25 bp, Rattus norvegicus
tcctcatccgcttcagacaggaatg

SEQ ID NO: 587297 - DNA, 25 bp, Rattus norvegicus
tcctcatccggtcacaggctttggg

SEQ ID NO: 587298 - DNA, 25 bp, Rattus norvegicus
tcctcatccggtgacaggctttggg

SEQ ID NO: 587299 - DNA, 25 bp, Rattus norvegicus
tcctcatcctacacgtacattatga

SEQ ID NO: 587300 - DNA, 25 bp, Rattus norvegicus
tcctcatcctactcgtacattatga

SEQ ID NO: 587301 - DNA, 25 bp, Rattus norvegicus
tcctcatcctttacatgtacttagc

SEQ ID NO: 587302 - DNA, 25 bp, Rattus norvegicus
tcctcatccttttcatgtacttagc

SEQ ID NO: 587303 - DNA, 25 bp, Rattus norvegicus
tcctcatcgacaccatggctctgaa

SEQ ID NO: 587304 - DNA, 25 bp, Rattus norvegicus
tcctcatcgacagcatggctctgaa

SEQ ID NO: 587305 - DNA, 25 bp, Rattus norvegicus
tcctcatcgtgtcgccataagtgtg

SEQ ID NO: 587306 - DNA, 25 bp, Rattus norvegicus
tcctcatcgtgtggccataagtgtg

SEQ ID NO: 587307 - DNA, 25 bp, Rattus norvegicus
tcctcatctttactcatcacttgaa

SEQ ID NO: 587308 - DNA, 25 bp, Rattus norvegicus
tcctcatctttagtcatcacttgaa

SEQ ID NO: 587309 - DNA, 25 bp, Rattus norvegicus
tcctcatcttttcggtagccatggt

SEQ ID NO: 587310 - DNA, 25 bp, Rattus norvegicus
tcctcatcttttgggtagccatggt

SEQ ID NO: 587311 - DNA, 25 bp, Rattus norvegicus
tcctcatgaactctttcccgaaatt

SEQ ID NO: 587312 - DNA, 25 bp, Rattus norvegicus
tcctcatgaactgtttcccgaaatt

SEQ ID NO: 587313 - DNA, 25 bp, Rattus norvegicus
tcctcatgaggaaccagtagtgaca

SEQ ID NO: 587314 - DNA, 25 bp, Rattus norvegicus
tcctcatgaggatccagtagtgaca

SEQ ID NO: 587315 - DNA, 25 bp, Rattus norvegicus
tcctcatgcgagagctggactcata

SEQ ID NO: 587316 - DNA, 25 bp, Rattus norvegicus
tcctcatgcgagtgctggactcata

SEQ ID NO: 587317 - DNA, 25 bp, Rattus norvegicus
tcctcatgcgctcacataatgccaa

SEQ ID NO: 587318 - DNA, 25 bp, Rattus norvegicus
tcctcatgcgctgacataatgccaa

SEQ ID NO: 587319 - DNA, 25 bp, Rattus norvegicus
tcctcatgtttaagttggtgttgct

SEQ ID NO: 587320 - DNA, 25 bp, Rattus norvegicus
tcctcatgtttatgttggtgttgct

SEQ ID NO: 587321 - DNA, 25 bp, Rattus norvegicus
tcctcattctcacaccagtgattca

SEQ ID NO: 587322 - DNA, 25 bp, Rattus norvegicus
tcctcattctcagaccagtgattca

SEQ ID NO: 587323 - DNA, 25 bp, Rattus norvegicus
tcctcattctgcctctttatgtgct

SEQ ID NO: 587324 - DNA, 25 bp, Rattus norvegicus
tcctcattctgcgtctttatgtgct

SEQ ID NO: 587325 - DNA, 25 bp, Rattus norvegicus
tcctcattgctgcgatcatgtccaa

SEQ ID NO: 587326 - DNA, 25 bp, Rattus norvegicus
tcctcattgctgggatcatgtccaa

SEQ ID NO: 587327 - DNA, 25 bp, Rattus norvegicus
tcctcattggccagctggtaaggtt

SEQ ID NO: 587328 - DNA, 25 bp, Rattus norvegicus
tcctcattggcctgctggtaaggtt

SEQ ID NO: 587329 - DNA, 25 bp, Rattus norvegicus
tcctcattgggccaccctttaaaat

SEQ ID NO: 587330 - DNA, 25 bp, Rattus norvegicus
tcctcattgggcgaccctttaaaat

SEQ ID NO: 587331 - DNA, 25 bp, Rattus norvegicus
tcctcatttcccaagatggtcaaat

SEQ ID NO: 587332 - DNA, 25 bp, Rattus norvegicus
tcctcatttccctagatggtcaaat

SEQ ID NO: 587333 - DNA, 25 bp, Rattus norvegicus
tcctcatttcctatatccgagtaat

SEQ ID NO: 587334 - DNA, 25 bp, Rattus norvegicus
tcctcatttcctatcctcaaaagat

SEQ ID NO: 587335 - DNA, 25 bp, Rattus norvegicus
tcctcatttcctttatccgagtaat

SEQ ID NO: 587336 - DNA, 25 bp, Rattus norvegicus
tcctcatttcctttcctcaaaagat

SEQ ID NO: 587337 - DNA, 25 bp, Rattus norvegicus
tcctcatttgttatgccgatttgca

SEQ ID NO: 587338 - DNA, 25 bp, Rattus norvegicus
tcctcatttgttttgccgatttgca

SEQ ID NO: 587339 - DNA, 25 bp, Rattus norvegicus
tcctccacaggaccaaagtttggtt

SEQ ID NO: 587340 - DNA, 25 bp, Rattus norvegicus
tcctccacaggagcaaagtttggtt

SEQ ID NO: 587341 - DNA, 25 bp, Rattus norvegicus
tcctccacattcagtaaacgtgcgt

SEQ ID NO: 587342 - DNA, 25 bp, Rattus norvegicus
tcctccacattctgtaaacgtgcgt

SEQ ID NO: 587343 - DNA, 25 bp, Rattus norvegicus
tcctccacatttacctcatttattg

SEQ ID NO: 587344 - DNA, 25 bp, Rattus norvegicus
tcctccacattttcctcatttattg

SEQ ID NO: 587345 - DNA, 25 bp, Rattus norvegicus
tcctccacggtcattgtgtgagcgt

SEQ ID NO: 587346 - DNA, 25 bp, Rattus norvegicus
tcctccacggtctttgtgtgagcgt

SEQ ID NO: 587347 - DNA, 25 bp, Rattus norvegicus
tcctccactgaaaccgttgtgcaat

SEQ ID NO: 587348 - DNA, 25 bp, Rattus norvegicus
tcctccactgaatccgttgtgcaat

SEQ ID NO: 587349 - DNA, 25 bp, Rattus norvegicus
tcctccagccaacgagccaatggtt

SEQ ID NO: 587350 - DNA, 25 bp, Rattus norvegicus
tcctccagccaaggagccaatggtt

SEQ ID NO: 587351 - DNA, 25 bp, Rattus norvegicus
tcctccagcgttcatgcataactaa

SEQ ID NO: 587352 - DNA, 25 bp, Rattus norvegicus
tcctccagcgttgatgcataactaa

SEQ ID NO: 587353 - DNA, 25 bp, Rattus norvegicus
tcctccagctcaaccagtgttaaaa

SEQ ID NO: 587354 - DNA, 25 bp, Rattus norvegicus
tcctccagctcacaacatttacttt

SEQ ID NO: 587355 - DNA, 25 bp, Rattus norvegicus
tcctccagctcagaacatttacttt

SEQ ID NO: 587356 - DNA, 25 bp, Rattus norvegicus
tcctccagctcatccagtgttaaaa

SEQ ID NO: 587357 - DNA, 25 bp, Rattus norvegicus
tcctccaggctgatgggcattagac

SEQ ID NO: 587358 - DNA, 25 bp, Rattus norvegicus
tcctccaggctgttgggcattagac

SEQ ID NO: 587359 - DNA, 25 bp, Rattus norvegicus
tcctccaggtctattttggccttct

SEQ ID NO: 587360 - DNA, 25 bp, Rattus norvegicus
tcctccaggtcttttttggccttct

SEQ ID NO: 587361 - DNA, 25 bp, Rattus norvegicus
tcctccagtgttcggatggatggcc

SEQ ID NO: 587362 - DNA, 25 bp, Rattus norvegicus
tcctccagtgttgggatggatggcc

SEQ ID NO: 587363 - DNA, 25 bp, Rattus norvegicus
tcctccagttccatctagaagtatt

SEQ ID NO: 587364 - DNA, 25 bp, Rattus norvegicus
tcctccagttccatgggtaagtgtg

SEQ ID NO: 587365 - DNA, 25 bp, Rattus norvegicus
tcctccagttccttctagaagtatt

SEQ ID NO: 587366 - DNA, 25 bp, Rattus norvegicus
tcctccagttccttgggtaagtgtg

SEQ ID NO: 587367 - DNA, 25 bp, Rattus norvegicus
tcctccataggtcactttgtcaaga

SEQ ID NO: 587368 - DNA, 25 bp, Rattus norvegicus
tcctccataggtgactttgtcaaga

SEQ ID NO: 587369 - DNA, 25 bp, Rattus norvegicus
tcctccatcgtgatggacatagctt

SEQ ID NO: 587370 - DNA, 25 bp, Rattus norvegicus
tcctccatcgtgttggacatagctt

SEQ ID NO: 587371 - DNA, 25 bp, Rattus norvegicus
tcctccatcgttatgtccttaatga

SEQ ID NO: 587372 - DNA, 25 bp, Rattus norvegicus
tcctccatcgttttgtccttaatga

SEQ ID NO: 587373 - DNA, 25 bp, Rattus norvegicus
tcctccatgaaaaccactcctagtg

SEQ ID NO: 587374 - DNA, 25 bp, Rattus norvegicus
tcctccatgaaatccactcctagtg

SEQ ID NO: 587375 - DNA, 25 bp, Rattus norvegicus
tcctccatgggcaactcagtttaca

SEQ ID NO: 587376 - DNA, 25 bp, Rattus norvegicus
tcctccatgggctactcagtttaca

SEQ ID NO: 587377 - DNA, 25 bp, Rattus norvegicus
tcctccattgaaagcggctgggact

SEQ ID NO: 587378 - DNA, 25 bp, Rattus norvegicus
tcctccattgaatgcggctgggact

SEQ ID NO: 587379 - DNA, 25 bp, Rattus norvegicus
tcctccatttggaattcagaaaggg

SEQ ID NO: 587380 - DNA, 25 bp, Rattus norvegicus
tcctccatttggtattcagaaaggg

SEQ ID NO: 587381 - DNA, 25 bp, Rattus norvegicus
tcctccattttccatcggatctcaa

SEQ ID NO: 587382 - DNA, 25 bp, Rattus norvegicus
tcctccattttcgatcggatctcaa

SEQ ID NO: 587383 - DNA, 25 bp, Rattus norvegicus
tcctcccaaaagatttctggccaag

SEQ ID NO: 587384 - DNA, 25 bp, Rattus norvegicus
tcctcccaaaagttttctggccaag

SEQ ID NO: 587385 - DNA, 25 bp, Rattus norvegicus
tcctcccacaggaccaagatgttta

SEQ ID NO: 587386 - DNA, 25 bp, Rattus norvegicus
tcctcccacaggtccaagatgttta

SEQ ID NO: 587387 - DNA, 25 bp, Rattus norvegicus
tcctcccacattaatagccagatct

SEQ ID NO: 587388 - DNA, 25 bp, Rattus norvegicus
tcctcccacatttatagccagatct

SEQ ID NO: 587389 - DNA, 25 bp, Rattus norvegicus
tcctcccactgtattaaagctgcaa

SEQ ID NO: 587390 - DNA, 25 bp, Rattus norvegicus
tcctcccactgttttaaagctgcaa

SEQ ID NO: 587391 - DNA, 25 bp, Rattus norvegicus
tcctcccagaggacgcctagtgtgt

SEQ ID NO: 587392 - DNA, 25 bp, Rattus norvegicus
tcctcccagaggtcgcctagtgtgt

SEQ ID NO: 587393 - DNA, 25 bp, Rattus norvegicus
tcctcccagatgaacagcactaatt

SEQ ID NO: 587394 - DNA, 25 bp, Rattus norvegicus
tcctcccagatgtacagcactaatt

SEQ ID NO: 587395 - DNA, 25 bp, Rattus norvegicus
tcctcccaggtgaaccattttaaca

SEQ ID NO: 587396 - DNA, 25 bp, Rattus norvegicus
tcctcccaggtgtaccattttaaca

SEQ ID NO: 587397 - DNA, 25 bp, Rattus norvegicus
tcctcccatctcattgcatgtttaa

SEQ ID NO: 587398 - DNA, 25 bp, Rattus norvegicus
tcctcccatctctttgcatgtttaa

SEQ ID NO: 587399 - DNA, 25 bp, Rattus norvegicus
tcctcccatctgcaagaacatcaag

SEQ ID NO: 587400 - DNA, 25 bp, Rattus norvegicus
tcctcccatctggaagaacatcaag

SEQ ID NO: 587401 - DNA, 25 bp, Rattus norvegicus
tcctcccatgctctccgataagaga

SEQ ID NO: 587402 - DNA, 25 bp, Rattus norvegicus
tcctcccatgctgtccgataagaga

SEQ ID NO: 587403 - DNA, 25 bp, Rattus norvegicus
tcctcccatttcattataccgagtt

SEQ ID NO: 587404 - DNA, 25 bp, Rattus norvegicus
tcctcccatttctttataccgagtt

SEQ ID NO: 587405 - DNA, 25 bp, Rattus norvegicus
tcctcccatttgagttttagttgat

SEQ ID NO: 587406 - DNA, 25 bp, Rattus norvegicus
tcctcccatttgtgttttagttgat

SEQ ID NO: 587407 - DNA, 25 bp, Rattus norvegicus
tcctccccaattatggtgaaaatag

SEQ ID NO: 587408 - DNA, 25 bp, Rattus norvegicus
tcctccccaattttggtgaaaatag

SEQ ID NO: 587409 - DNA, 25 bp, Rattus norvegicus
tcctccccaggtaacttttgatcat

SEQ ID NO: 587410 - DNA, 25 bp, Rattus norvegicus
tcctccccaggtcatgtagatattt

SEQ ID NO: 587411 - DNA, 25 bp, Rattus norvegicus
tcctccccaggtgatgtagatattt

SEQ ID NO: 587412 - DNA, 25 bp, Rattus norvegicus
tcctccccaggttacttttgatcat

SEQ ID NO: 587413 - DNA, 25 bp, Rattus norvegicus
tcctccccatggcatgtgcaagtag

SEQ ID NO: 587414 - DNA, 25 bp, Rattus norvegicus
tcctccccatgggatgtgcaagtag

SEQ ID NO: 587415 - DNA, 25 bp, Rattus norvegicus
tcctccccggatcccgagaagtgga

SEQ ID NO: 587416 - DNA, 25 bp, Rattus norvegicus
tcctccccggatgccgagaagtgga

SEQ ID NO: 587417 - DNA, 25 bp, Rattus norvegicus
tcctccccgtgtatcgcaaataatt

SEQ ID NO: 587418 - DNA, 25 bp, Rattus norvegicus
tcctccccgtgtttcgcaaataatt

SEQ ID NO: 587419 - DNA, 25 bp, Rattus norvegicus
tcctcccctgtgctagtagtactta

SEQ ID NO: 587420 - DNA, 25 bp, Rattus norvegicus
tcctcccctgtggtagtagtactta

SEQ ID NO: 587421 - DNA, 25 bp, Rattus norvegicus
tcctccccttcaaatgctgtaatta

SEQ ID NO: 587422 - DNA, 25 bp, Rattus norvegicus
tcctccccttcatatgctgtaatta

SEQ ID NO: 587423 - DNA, 25 bp, Rattus norvegicus
tcctcccgaaggatctcaagactga

SEQ ID NO: 587424 - DNA, 25 bp, Rattus norvegicus
tcctcccgaaggttctcaagactga

SEQ ID NO: 587425 - DNA, 25 bp, Rattus norvegicus
tcctcccgaggcagttagatatatt

SEQ ID NO: 587426 - DNA, 25 bp, Rattus norvegicus
tcctcccgaggctgttagatatatt

SEQ ID NO: 587427 - DNA, 25 bp, Rattus norvegicus
tcctcccgctggagtagaatagcca

SEQ ID NO: 587428 - DNA, 25 bp, Rattus norvegicus
tcctcccgctggtgtagaatagcca

SEQ ID NO: 587429 - DNA, 25 bp, Rattus norvegicus
tcctcccgggaactcagccggctca

SEQ ID NO: 587430 - DNA, 25 bp, Rattus norvegicus
tcctcccgggaagtcagccggctca

SEQ ID NO: 587431 - DNA, 25 bp, Rattus norvegicus
tcctcccgtgatcaactacaattta

SEQ ID NO: 587432 - DNA, 25 bp, Rattus norvegicus
tcctcccgtgatgaactacaattta

SEQ ID NO: 587433 - DNA, 25 bp, Rattus norvegicus
tcctcccgttggaagttgaaacaat

SEQ ID NO: 587434 - DNA, 25 bp, Rattus norvegicus
tcctcccgttggtagttgaaacaat

SEQ ID NO: 587435 - DNA, 25 bp, Rattus norvegicus
tcctccctaacgacatcggtgtgga

SEQ ID NO: 587436 - DNA, 25 bp, Rattus norvegicus
tcctccctaacgtcatcggtgtgga

SEQ ID NO: 587437 - DNA, 25 bp, Rattus norvegicus
tcctccctacagagtggccggggct

SEQ ID NO: 587438 - DNA, 25 bp, Rattus norvegicus
tcctccctacagtgtggccggggct

SEQ ID NO: 587439 - DNA, 25 bp, Rattus norvegicus
tcctccctcctcaagcttatataag

SEQ ID NO: 587440 - DNA, 25 bp, Rattus norvegicus
tcctccctcctctagcttatataag

SEQ ID NO: 587441 - DNA, 25 bp, Rattus norvegicus
tcctccctctcaccttagttaagga

SEQ ID NO: 587442 - DNA, 25 bp, Rattus norvegicus
tcctccctctcagcttagttaagga

SEQ ID NO: 587443 - DNA, 25 bp, Rattus norvegicus
tcctccctgaaccattatttgcata

SEQ ID NO: 587444 - DNA, 25 bp, Rattus norvegicus
tcctccctgaacgattatttgcata

SEQ ID NO: 587445 - DNA, 25 bp, Rattus norvegicus
tcctccctgctgcttttttagctat

SEQ ID NO: 587446 - DNA, 25 bp, Rattus norvegicus
tcctccctgctggttttttagctat

SEQ ID NO: 587447 - DNA, 25 bp, Rattus norvegicus
tcctccctggacctgtgattgatgc

SEQ ID NO: 587448 - DNA, 25 bp, Rattus norvegicus
tcctccctggacgtgtgattgatgc

SEQ ID NO: 587449 - DNA, 25 bp, Rattus norvegicus
tcctccctgtgtcatatggtttcgg

SEQ ID NO: 587450 - DNA, 25 bp, Rattus norvegicus
tcctccctgtgtgatatggtttcgg

SEQ ID NO: 587451 - DNA, 25 bp, Rattus norvegicus
tcctcccttcatcattccatgatga

SEQ ID NO: 587452 - DNA, 25 bp, Rattus norvegicus
tcctcccttcatgattccatgatga

SEQ ID NO: 587453 - DNA, 25 bp, Rattus norvegicus
tcctccgaagtgaccagaaccttgt

SEQ ID NO: 587454 - DNA, 25 bp, Rattus norvegicus
tcctccgaagtgtccagaaccttgt

SEQ ID NO: 587455 - DNA, 25 bp, Rattus norvegicus
tcctccgacaggcagcacacagaaa

SEQ ID NO: 587456 - DNA, 25 bp, Rattus norvegicus
tcctccgacagggagcacacagaaa

SEQ ID NO: 587457 - DNA, 25 bp, Rattus norvegicus
tcctccgactccagcagtagtagca

SEQ ID NO: 587458 - DNA, 25 bp, Rattus norvegicus
tcctccgactcctgcagtagtagca

SEQ ID NO: 587459 - DNA, 25 bp, Rattus norvegicus
tcctccgaggcccatagtaatttca

SEQ ID NO: 587460 - DNA, 25 bp, Rattus norvegicus
tcctccgaggccgatagtaatttca

SEQ ID NO: 587461 - DNA, 25 bp, Rattus norvegicus
tcctccgcaacgagttttcagatga

SEQ ID NO: 587462 - DNA, 25 bp, Rattus norvegicus
tcctccgcaacgtgttttcagatga

SEQ ID NO: 587463 - DNA, 25 bp, Rattus norvegicus
tcctccgccatgaggcaggtgtttg

SEQ ID NO: 587464 - DNA, 25 bp, Rattus norvegicus
tcctccgccatgtggcaggtgtttg

SEQ ID NO: 587465 - DNA, 25 bp, Rattus norvegicus
tcctccgcctgcagataaagcttag

SEQ ID NO: 587466 - DNA, 25 bp, Rattus norvegicus
tcctccgcctgctgataaagcttag

SEQ ID NO: 587467 - DNA, 25 bp, Rattus norvegicus
tcctccgcggatctcaaacaagtca

SEQ ID NO: 587468 - DNA, 25 bp, Rattus norvegicus
tcctccgcggatgtcaaacaagtca

SEQ ID NO: 587469 - DNA, 25 bp, Rattus norvegicus
tcctccggaaggaggcctgggacta

SEQ ID NO: 587470 - DNA, 25 bp, Rattus norvegicus
tcctccggaaggtggcctgggacta

SEQ ID NO: 587471 - DNA, 25 bp, Rattus norvegicus
tcctccggcattctgtatcttgaag

SEQ ID NO: 587472 - DNA, 25 bp, Rattus norvegicus
tcctccggcattgtgtatcttgaag

SEQ ID NO: 587473 - DNA, 25 bp, Rattus norvegicus
tcctccgggaatccttatcatctga

SEQ ID NO: 587474 - DNA, 25 bp, Rattus norvegicus
tcctccgggaatgcttatcatctga

SEQ ID NO: 587475 - DNA, 25 bp, Rattus norvegicus
tcctccggtaggcatgcgcgcgcta

SEQ ID NO: 587476 - DNA, 25 bp, Rattus norvegicus
tcctccggtagggatgcgcgcgcta

SEQ ID NO: 587477 - DNA, 25 bp, Rattus norvegicus
tcctccggtgagctgttgtgataat

SEQ ID NO: 587478 - DNA, 25 bp, Rattus norvegicus
tcctccggtgaggtgttgtgataat

SEQ ID NO: 587479 - DNA, 25 bp, Rattus norvegicus
tcctccgtcggtactcaatgaaaaa

SEQ ID NO: 587480 - DNA, 25 bp, Rattus norvegicus
tcctccgtcggttctcaatgaaaaa

SEQ ID NO: 587481 - DNA, 25 bp, Rattus norvegicus
tcctccgtgactaactagacttaac

SEQ ID NO: 587482 - DNA, 25 bp, Rattus norvegicus
tcctccgtgacttactagacttaac

SEQ ID NO: 587483 - DNA, 25 bp, Rattus norvegicus
tcctccgtgtccctacaatgaattg

SEQ ID NO: 587484 - DNA, 25 bp, Rattus norvegicus
tcctccgtgtccgtacaatgaattg

SEQ ID NO: 587485 - DNA, 25 bp, Rattus norvegicus
tcctcctacattcaacagacacggt

SEQ ID NO: 587486 - DNA, 25 bp, Rattus norvegicus
tcctcctacattgaacagacacggt

SEQ ID NO: 587487 - DNA, 25 bp, Rattus norvegicus
tcctcctaccaaaaatttttctcca

SEQ ID NO: 587488 - DNA, 25 bp, Rattus norvegicus
tcctcctaccaataatttttctcca

SEQ ID NO: 587489 - DNA, 25 bp, Rattus norvegicus
tcctcctaccgactacagacagaag

SEQ ID NO: 587490 - DNA, 25 bp, Rattus norvegicus
tcctcctaccgagtacagacagaag

SEQ ID NO: 587491 - DNA, 25 bp, Rattus norvegicus
tcctcctactgcctggaatattttt

SEQ ID NO: 587492 - DNA, 25 bp, Rattus norvegicus
tcctcctactgcgtggaatattttt

SEQ ID NO: 587493 - DNA, 25 bp, Rattus norvegicus
tcctcctagcctcttttttctcaaa

SEQ ID NO: 587494 - DNA, 25 bp, Rattus norvegicus
tcctcctagcctgttttttctcaaa

SEQ ID NO: 587495 - DNA, 25 bp, Rattus norvegicus
tcctcctagcgtattgccagtaatg

SEQ ID NO: 587496 - DNA, 25 bp, Rattus norvegicus
tcctcctagcgttttgccagtaatg

SEQ ID NO: 587497 - DNA, 25 bp, Rattus norvegicus
tcctcctagtttagtgtaccagtca

SEQ ID NO: 587498 - DNA, 25 bp, Rattus norvegicus
tcctcctagttttgtgtaccagtca

SEQ ID NO: 587499 - DNA, 25 bp, Rattus norvegicus
tcctcctatcccctaaaaggctgaa

SEQ ID NO: 587500 - DNA, 25 bp, Rattus norvegicus
tcctcctatcccgtaaaaggctgaa

SEQ ID NO: 587501 - DNA, 25 bp, Rattus norvegicus
tcctcctcacatcacggatagggat

SEQ ID NO: 587502 - DNA, 25 bp, Rattus norvegicus
tcctcctcacatgacggatagggat

SEQ ID NO: 587503 - DNA, 25 bp, Rattus norvegicus
tcctcctcagaaaagaccagatcct

SEQ ID NO: 587504 - DNA, 25 bp, Rattus norvegicus
tcctcctcagaatagaccagatcct

SEQ ID NO: 587505 - DNA, 25 bp, Rattus norvegicus
tcctcctcatgcattttgtcagtaa

SEQ ID NO: 587506 - DNA, 25 bp, Rattus norvegicus
tcctcctcatgctttttgtcagtaa

SEQ ID NO: 587507 - DNA, 25 bp, Rattus norvegicus
tcctcctcctggaattttacacaga

SEQ ID NO: 587508 - DNA, 25 bp, Rattus norvegicus
tcctcctcctggtattttacacaga

SEQ ID NO: 587509 - DNA, 25 bp, Rattus norvegicus
tcctcctccttaattatatcacctg

SEQ ID NO: 587510 - DNA, 25 bp, Rattus norvegicus
tcctcctccttatttatatcacctg

SEQ ID NO: 587511 - DNA, 25 bp, Rattus norvegicus
tcctcctccttcaaattaagagact

SEQ ID NO: 587512 - DNA, 25 bp, Rattus norvegicus
tcctcctccttctaattaagagact

SEQ ID NO: 587513 - DNA, 25 bp, Rattus norvegicus
tcctcctcgaagaaagtatccctca

SEQ ID NO: 587514 - DNA, 25 bp, Rattus norvegicus
tcctcctcgaagtaagtatccctca

SEQ ID NO: 587515 - DNA, 25 bp, Rattus norvegicus
tcctcctcggtgattatctaagcga

SEQ ID NO: 587516 - DNA, 25 bp, Rattus norvegicus
tcctcctcggtgtttatctaagcga

SEQ ID NO: 587517 - DNA, 25 bp, Rattus norvegicus
tcctcctctgtgcaaaattgccagt

SEQ ID NO: 587518 - DNA, 25 bp, Rattus norvegicus
tcctcctctgtgcagcattgctgtt

SEQ ID NO: 587519 - DNA, 25 bp, Rattus norvegicus
tcctcctctgtggaaaattgccagt

SEQ ID NO: 587520 - DNA, 25 bp, Rattus norvegicus
tcctcctctgtggagcattgctgtt

SEQ ID NO: 587521 - DNA, 25 bp, Rattus norvegicus
tcctcctctgttcttaggttcggga

SEQ ID NO: 587522 - DNA, 25 bp, Rattus norvegicus
tcctcctctgttgttaggttcggga

SEQ ID NO: 587523 - DNA, 25 bp, Rattus norvegicus
tcctcctgaaacattcgtctcattc

SEQ ID NO: 587524 - DNA, 25 bp, Rattus norvegicus
tcctcctgaaactttcgtctcattc

SEQ ID NO: 587525 - DNA, 25 bp, Rattus norvegicus
tcctcctgaagtacctgagaatgga

SEQ ID NO: 587526 - DNA, 25 bp, Rattus norvegicus
tcctcctgaagtctctaaaccgtgc

SEQ ID NO: 587527 - DNA, 25 bp, Rattus norvegicus
tcctcctgaagtgtctaaaccgtgc

SEQ ID NO: 587528 - DNA, 25 bp, Rattus norvegicus
tcctcctgaagttcctgagaatgga

SEQ ID NO: 587529 - DNA, 25 bp, Rattus norvegicus
tcctcctgagacactacatcacaga

SEQ ID NO: 587530 - DNA, 25 bp, Rattus norvegicus
tcctcctgagactctacatcacaga

SEQ ID NO: 587531 - DNA, 25 bp, Rattus norvegicus
tcctcctgagagcatgaacctatga

SEQ ID NO: 587532 - DNA, 25 bp, Rattus norvegicus
tcctcctgagaggatgaacctatga

SEQ ID NO: 587533 - DNA, 25 bp, Rattus norvegicus
tcctcctgatgcattctgtaaagat

SEQ ID NO: 587534 - DNA, 25 bp, Rattus norvegicus
tcctcctgatgctttctgtaaagat

SEQ ID NO: 587535 - DNA, 25 bp, Rattus norvegicus
tcctcctgcacgaccttgaagaagg

SEQ ID NO: 587536 - DNA, 25 bp, Rattus norvegicus
tcctcctgcacgtccttgaagaagg

SEQ ID NO: 587537 - DNA, 25 bp, Rattus norvegicus
tcctcctggagaatctcgacagcta

SEQ ID NO: 587538 - DNA, 25 bp, Rattus norvegicus
tcctcctggagattctcgacagcta

SEQ ID NO: 587539 - DNA, 25 bp, Rattus norvegicus
tcctcctggatcaggtggacttcaa

SEQ ID NO: 587540 - DNA, 25 bp, Rattus norvegicus
tcctcctggatctggtggacttcaa

SEQ ID NO: 587541 - DNA, 25 bp, Rattus norvegicus
tcctcctggcagaacttaagacttg

SEQ ID NO: 587542 - DNA, 25 bp, Rattus norvegicus
tcctcctggcagctctttaaggaaa

SEQ ID NO: 587543 - DNA, 25 bp, Rattus norvegicus
tcctcctggcaggtctttaaggaaa

SEQ ID NO: 587544 - DNA, 25 bp, Rattus norvegicus
tcctcctggcagtacttaagacttg

SEQ ID NO: 587545 - DNA, 25 bp, Rattus norvegicus
tcctcctggtgaagtctgactgtga

SEQ ID NO: 587546 - DNA, 25 bp, Rattus norvegicus
tcctcctggtgatgtctgactgtga

SEQ ID NO: 587547 - DNA, 25 bp, Rattus norvegicus
tcctcctggttcaaagtgactgcta

SEQ ID NO: 587548 - DNA, 25 bp, Rattus norvegicus
tcctcctggttctaagtgactgcta

SEQ ID NO: 587549 - DNA, 25 bp, Rattus norvegicus
tcctcctgtagtcgctcagtggcta

SEQ ID NO: 587550 - DNA, 25 bp, Rattus norvegicus
tcctcctgtagtggctcagtggcta

SEQ ID NO: 587551 - DNA, 25 bp, Rattus norvegicus
tcctcctgtcttatgtagttttgtt

SEQ ID NO: 587552 - DNA, 25 bp, Rattus norvegicus
tcctcctgtcttttgtagttttgtt

SEQ ID NO: 587553 - DNA, 25 bp, Rattus norvegicus
tcctcctgtggcagataccagtgta

SEQ ID NO: 587554 - DNA, 25 bp, Rattus norvegicus
tcctcctgtggctgataccagtgta

SEQ ID NO: 587555 - DNA, 25 bp, Rattus norvegicus
tcctcctgtgttagctttcatcttg

SEQ ID NO: 587556 - DNA, 25 bp, Rattus norvegicus
tcctcctgtgttcccagtttattaa

SEQ ID NO: 587557 - DNA, 25 bp, Rattus norvegicus
tcctcctgtgttgccagtttattaa

SEQ ID NO: 587558 - DNA, 25 bp, Rattus norvegicus
tcctcctgtgtttgctttcatcttg

SEQ ID NO: 587559 - DNA, 25 bp, Rattus norvegicus
tcctccttacacctgggcaataaat

SEQ ID NO: 587560 - DNA, 25 bp, Rattus norvegicus
tcctccttacacgtgggcaataaat

SEQ ID NO: 587561 - DNA, 25 bp, Rattus norvegicus
tcctccttatttatatcacctggcc

SEQ ID NO: 587562 - DNA, 25 bp, Rattus norvegicus
tcctccttatttttatcacctggcc

SEQ ID NO: 587563 - DNA, 25 bp, Rattus norvegicus
tcctccttctggcttgtttatcaca

SEQ ID NO: 587564 - DNA, 25 bp, Rattus norvegicus
tcctccttctgggttgtttatcaca

SEQ ID NO: 587565 - DNA, 25 bp, Rattus norvegicus
tcctccttcttgaattggctgggaa

SEQ ID NO: 587566 - DNA, 25 bp, Rattus norvegicus
tcctccttcttgtattggctgggaa

SEQ ID NO: 587567 - DNA, 25 bp, Rattus norvegicus
tcctccttgaaacaaattgcaacaa

SEQ ID NO: 587568 - DNA, 25 bp, Rattus norvegicus
tcctccttgaaagaaattgcaacaa

SEQ ID NO: 587569 - DNA, 25 bp, Rattus norvegicus
tcctcctttctcatgattccttcaa

SEQ ID NO: 587570 - DNA, 25 bp, Rattus norvegicus
tcctcctttctcttgattccttcaa

SEQ ID NO: 587571 - DNA, 25 bp, Rattus norvegicus
tcctcctttctgagttgtgatgtat

SEQ ID NO: 587572 - DNA, 25 bp, Rattus norvegicus
tcctcctttctgtgttgtgatgtat

SEQ ID NO: 587573 - DNA, 25 bp, Rattus norvegicus
tcctccttttccactaaactgactt

SEQ ID NO: 587574 - DNA, 25 bp, Rattus norvegicus
tcctccttttcctctaaactgactt

SEQ ID NO: 587575 - DNA, 25 bp, Rattus norvegicus
tcctccttttgtcccctgattgtaa

SEQ ID NO: 587576 - DNA, 25 bp, Rattus norvegicus
tcctccttttgtgccctgattgtaa

SEQ ID NO: 587577 - DNA, 25 bp, Rattus norvegicus
tcctcgaaacatatctcagtccttt

SEQ ID NO: 587578 - DNA, 25 bp, Rattus norvegicus
tcctcgaaacatttctcagtccttt

SEQ ID NO: 587579 - DNA, 25 bp, Rattus norvegicus
tcctcgaaacttatacttacttgat

SEQ ID NO: 587580 - DNA, 25 bp, Rattus norvegicus
tcctcgaaacttttacttacttgat

SEQ ID NO: 587581 - DNA, 25 bp, Rattus norvegicus
tcctcgacagctcccaagtgcttgg

SEQ ID NO: 587582 - DNA, 25 bp, Rattus norvegicus
tcctcgacagctgccaagtgcttgg

SEQ ID NO: 587583 - DNA, 25 bp, Rattus norvegicus
tcctcgagagggatgtggctccagt

SEQ ID NO: 587584 - DNA, 25 bp, Rattus norvegicus
tcctcgagagggttgtggctccagt

SEQ ID NO: 587585 - DNA, 25 bp, Rattus norvegicus
tcctcgatcctgcatgtgggcagtt

SEQ ID NO: 587586 - DNA, 25 bp, Rattus norvegicus
tcctcgatcctggatgtgggcagtt

SEQ ID NO: 587587 - DNA, 25 bp, Rattus norvegicus
tcctcgatgccaaggaacctggaaa

SEQ ID NO: 587588 - DNA, 25 bp, Rattus norvegicus
tcctcgatgccatggaacctggaaa

SEQ ID NO: 587589 - DNA, 25 bp, Rattus norvegicus
tcctcgattcttaggcactgtattt

SEQ ID NO: 587590 - DNA, 25 bp, Rattus norvegicus
tcctcgattctttggcactgtattt

SEQ ID NO: 587591 - DNA, 25 bp, Rattus norvegicus
tcctcgcaccaacattccagaaaat

SEQ ID NO: 587592 - DNA, 25 bp, Rattus norvegicus
tcctcgcaccaagattccagaaaat

SEQ ID NO: 587593 - DNA, 25 bp, Rattus norvegicus
tcctcgccaaagacagcctagagag

SEQ ID NO: 587594 - DNA, 25 bp, Rattus norvegicus
tcctcgccaaagtcagcctagagag

SEQ ID NO: 587595 - DNA, 25 bp, Rattus norvegicus
tcctcgccagataaaccgtattcac

SEQ ID NO: 587596 - DNA, 25 bp, Rattus norvegicus
tcctcgccagattaaccgtattcac

SEQ ID NO: 587597 - DNA, 25 bp, Rattus norvegicus
tcctcgctcagtagtgatccagcag

SEQ ID NO: 587598 - DNA, 25 bp, Rattus norvegicus
tcctcgctcagttgtgatccagcag

SEQ ID NO: 587599 - DNA, 25 bp, Rattus norvegicus
tcctcgctccagaagaaccatgttg

SEQ ID NO: 587600 - DNA, 25 bp, Rattus norvegicus
tcctcgctccagtagaaccatgttg

SEQ ID NO: 587601 - DNA, 25 bp, Rattus norvegicus
tcctcgctctcgaggtcatcgtaca

SEQ ID NO: 587602 - DNA, 25 bp, Rattus norvegicus
tcctcgctctcgtggtcatcgtaca

SEQ ID NO: 587603 - DNA, 25 bp, Rattus norvegicus
tcctcgcttcttcccaagaactgag

SEQ ID NO: 587604 - DNA, 25 bp, Rattus norvegicus
tcctcgcttcttgccaagaactgag

SEQ ID NO: 587605 - DNA, 25 bp, Rattus norvegicus
tcctcggaagagcactatgactctg

SEQ ID NO: 587606 - DNA, 25 bp, Rattus norvegicus
tcctcggaagaggactatgactctg

SEQ ID NO: 587607 - DNA, 25 bp, Rattus norvegicus
tcctcggaaggaacagactcacaga

SEQ ID NO: 587608 - DNA, 25 bp, Rattus norvegicus
tcctcggaaggatcagactcacaga

SEQ ID NO: 587609 - DNA, 25 bp, Rattus norvegicus
tcctcggacatcactgaactttcag

SEQ ID NO: 587610 - DNA, 25 bp, Rattus norvegicus
tcctcggacatctctgaactttcag

SEQ ID NO: 587611 - DNA, 25 bp, Rattus norvegicus
tcctcggagaccctgcagcccagag

SEQ ID NO: 587612 - DNA, 25 bp, Rattus norvegicus
tcctcggagaccgtgcagcccagag

SEQ ID NO: 587613 - DNA, 25 bp, Rattus norvegicus
tcctcggatacccttgttgggataa

SEQ ID NO: 587614 - DNA, 25 bp, Rattus norvegicus
tcctcggataccgttgttgggataa

SEQ ID NO: 587615 - DNA, 25 bp, Rattus norvegicus
tcctcggatgagctccagacttaag

SEQ ID NO: 587616 - DNA, 25 bp, Rattus norvegicus
tcctcggatgaggtccagacttaag

SEQ ID NO: 587617 - DNA, 25 bp, Rattus norvegicus
tcctcggcatcaccggaatccatgg

SEQ ID NO: 587618 - DNA, 25 bp, Rattus norvegicus
tcctcggcatcagcggaatccatgg

SEQ ID NO: 587619 - DNA, 25 bp, Rattus norvegicus
tcctcggcattgagctccagattga

SEQ ID NO: 587620 - DNA, 25 bp, Rattus norvegicus
tcctcggcattgtgctccagattga

SEQ ID NO: 587621 - DNA, 25 bp, Rattus norvegicus
tcctcggccttgcacatcgtggagg

SEQ ID NO: 587622 - DNA, 25 bp, Rattus norvegicus
tcctcggccttggacatcgtggagg

SEQ ID NO: 587623 - DNA, 25 bp, Rattus norvegicus
tcctcggcgtctactgcagtaatta

SEQ ID NO: 587624 - DNA, 25 bp, Rattus norvegicus
tcctcggcgtcttctgcagtaatta

SEQ ID NO: 587625 - DNA, 25 bp, Rattus norvegicus
tcctcgggagtcatagacgctgtta

SEQ ID NO: 587626 - DNA, 25 bp, Rattus norvegicus
tcctcgggagtcttagacgctgtta

SEQ ID NO: 587627 - DNA, 25 bp, Rattus norvegicus
tcctcgggcagcacagacagagaca

SEQ ID NO: 587628 - DNA, 25 bp, Rattus norvegicus
tcctcgggcagctcagacagagaca

SEQ ID NO: 587629 - DNA, 25 bp, Rattus norvegicus
tcctcggtggtaacctctgaaagaa

SEQ ID NO: 587630 - DNA, 25 bp, Rattus norvegicus
tcctcggtggtatcctctgaaagaa

SEQ ID NO: 587631 - DNA, 25 bp, Rattus norvegicus
tcctcggtgtctcagccttagaagg

SEQ ID NO: 587632 - DNA, 25 bp, Rattus norvegicus
tcctcggtgtctgagccttagaagg

SEQ ID NO: 587633 - DNA, 25 bp, Rattus norvegicus
tcctcggttttcacagtatcctgag

SEQ ID NO: 587634 - DNA, 25 bp, Rattus norvegicus
tcctcggttttctcagtatcctgag

SEQ ID NO: 587635 - DNA, 25 bp, Rattus norvegicus
tcctcgtgaccacttctttgtgaat

SEQ ID NO: 587636 - DNA, 25 bp, Rattus norvegicus
tcctcgtgaccagttctttgtgaat

SEQ ID NO: 587637 - DNA, 25 bp, Rattus norvegicus
tcctcgtgcctgacatgttatatta

SEQ ID NO: 587638 - DNA, 25 bp, Rattus norvegicus
tcctcgtgcctgtcatgttatatta

SEQ ID NO: 587639 - DNA, 25 bp, Rattus norvegicus
tcctcgtgccttatggagcagtgtg

SEQ ID NO: 587640 - DNA, 25 bp, Rattus norvegicus
tcctcgtgccttttggagcagtgtg

SEQ ID NO: 587641 - DNA, 25 bp, Rattus norvegicus
tcctcgtggcatattgggctaggca

SEQ ID NO: 587642 - DNA, 25 bp, Rattus norvegicus
tcctcgtggcattttgggctaggca

SEQ ID NO: 587643 - DNA, 25 bp, Rattus norvegicus
tcctcgtggtacagctacaccagag

SEQ ID NO: 587644 - DNA, 25 bp, Rattus norvegicus
tcctcgtggtactgctacaccagag

SEQ ID NO: 587645 - DNA, 25 bp, Rattus norvegicus
tcctcgttacgcatgtggtgtggag

SEQ ID NO: 587646 - DNA, 25 bp, Rattus norvegicus
tcctcgttacgcttgtggtgtggag

SEQ ID NO: 587647 - DNA, 25 bp, Rattus norvegicus
tcctcgttgagcctgtagaccttca

SEQ ID NO: 587648 - DNA, 25 bp, Rattus norvegicus
tcctcgttgagcgtgtagaccttca

SEQ ID NO: 587649 - DNA, 25 bp, Rattus norvegicus
tcctcgttgaggaaggacttggcct

SEQ ID NO: 587650 - DNA, 25 bp, Rattus norvegicus
tcctcgttgaggtaggacttggcct

SEQ ID NO: 587651 - DNA, 25 bp, Rattus norvegicus
tcctcgtttccaacatctgacattg

SEQ ID NO: 587652 - DNA, 25 bp, Rattus norvegicus
tcctcgtttccatcatctgacattg

SEQ ID NO: 587653 - DNA, 25 bp, Rattus norvegicus
tcctctaatgccctccacaaagaaa

SEQ ID NO: 587654 - DNA, 25 bp, Rattus norvegicus
tcctctaatgccgtccacaaagaaa

SEQ ID NO: 587655 - DNA, 25 bp, Rattus norvegicus
tcctctactgtccttttcagatgaa

SEQ ID NO: 587656 - DNA, 25 bp, Rattus norvegicus
tcctctactgtcgttttcagatgaa

SEQ ID NO: 587657 - DNA, 25 bp, Rattus norvegicus
tcctctagcagtcctgattcatacc

SEQ ID NO: 587658 - DNA, 25 bp, Rattus norvegicus
tcctctagcagtgctgattcatacc

SEQ ID NO: 587659 - DNA, 25 bp, Rattus norvegicus
tcctctagcctacgtagttggtttt

SEQ ID NO: 587660 - DNA, 25 bp, Rattus norvegicus
tcctctagcctaggtagttggtttt

SEQ ID NO: 587661 - DNA, 25 bp, Rattus norvegicus
tcctctagcttaattggtgtctcca

SEQ ID NO: 587662 - DNA, 25 bp, Rattus norvegicus
tcctctagcttatttggtgtctcca

SEQ ID NO: 587663 - DNA, 25 bp, Rattus norvegicus
tcctctatgatcatggcctggctga

SEQ ID NO: 587664 - DNA, 25 bp, Rattus norvegicus
tcctctatgatcttggcctggctga

SEQ ID NO: 587665 - DNA, 25 bp, Rattus norvegicus
tcctctatgtcacaattactgctca

SEQ ID NO: 587666 - DNA, 25 bp, Rattus norvegicus
tcctctatgtcagaattactgctca

SEQ ID NO: 587667 - DNA, 25 bp, Rattus norvegicus
tcctctattaccagggatctgggtt

SEQ ID NO: 587668 - DNA, 25 bp, Rattus norvegicus
tcctctattacctgggatctgggtt

SEQ ID NO: 587669 - DNA, 25 bp, Rattus norvegicus
tcctctcacactccatggttgatgt

SEQ ID NO: 587670 - DNA, 25 bp, Rattus norvegicus
tcctctcacactgcatggttgatgt

SEQ ID NO: 587671 - DNA, 25 bp, Rattus norvegicus
tcctctcaccggaatgcaactatta

SEQ ID NO: 587672 - DNA, 25 bp, Rattus norvegicus
tcctctcaccggtatgcaactatta

SEQ ID NO: 587673 - DNA, 25 bp, Rattus norvegicus
tcctctcagaatacaccggttcgaa

SEQ ID NO: 587674 - DNA, 25 bp, Rattus norvegicus
tcctctcagaattcaccggttcgaa

SEQ ID NO: 587675 - DNA, 25 bp, Rattus norvegicus
tcctctcagagaagtgttcactttg

SEQ ID NO: 587676 - DNA, 25 bp, Rattus norvegicus
tcctctcagagactggcacgggcaa

SEQ ID NO: 587677 - DNA, 25 bp, Rattus norvegicus
tcctctcagagagtggcacgggcaa

SEQ ID NO: 587678 - DNA, 25 bp, Rattus norvegicus
tcctctcagagatgtgttcactttg

SEQ ID NO: 587679 - DNA, 25 bp, Rattus norvegicus
tcctctcagaggctgtttgtcagca

SEQ ID NO: 587680 - DNA, 25 bp, Rattus norvegicus
tcctctcagagggtgtttgtcagca

SEQ ID NO: 587681 - DNA, 25 bp, Rattus norvegicus
tcctctcagattacatctcttagca

SEQ ID NO: 587682 - DNA, 25 bp, Rattus norvegicus
tcctctcagatttcatctcttagca

SEQ ID NO: 587683 - DNA, 25 bp, Rattus norvegicus
tcctctcaggaaattatgtcagtgc

SEQ ID NO: 587684 - DNA, 25 bp, Rattus norvegicus
tcctctcaggaatttatgtcagtgc

SEQ ID NO: 587685 - DNA, 25 bp, Rattus norvegicus
tcctctcatcacaagctagtaagtt

SEQ ID NO: 587686 - DNA, 25 bp, Rattus norvegicus
tcctctcatcactagctagtaagtt

SEQ ID NO: 587687 - DNA, 25 bp, Rattus norvegicus
tcctctcattgtaatagcccctata

SEQ ID NO: 587688 - DNA, 25 bp, Rattus norvegicus
tcctctcattgttatagcccctata

SEQ ID NO: 587689 - DNA, 25 bp, Rattus norvegicus
tcctctccaaggcattactttttgt

SEQ ID NO: 587690 - DNA, 25 bp, Rattus norvegicus
tcctctccaagggattactttttgt

SEQ ID NO: 587691 - DNA, 25 bp, Rattus norvegicus
tcctctccacaaagaagtccttggt

SEQ ID NO: 587692 - DNA, 25 bp, Rattus norvegicus
tcctctccacaatgaagtccttggt

SEQ ID NO: 587693 - DNA, 25 bp, Rattus norvegicus
tcctctccacgtaatgggtgtggca

SEQ ID NO: 587694 - DNA, 25 bp, Rattus norvegicus
tcctctccacgttatgggtgtggca

SEQ ID NO: 587695 - DNA, 25 bp, Rattus norvegicus
tcctctccactcagtcttagtagaa

SEQ ID NO: 587696 - DNA, 25 bp, Rattus norvegicus
tcctctccactctgtcttagtagaa

SEQ ID NO: 587697 - DNA, 25 bp, Rattus norvegicus
tcctctccagtaatcagctcttaaa

SEQ ID NO: 587698 - DNA, 25 bp, Rattus norvegicus
tcctctccagtattcagctcttaaa

SEQ ID NO: 587699 - DNA, 25 bp, Rattus norvegicus
tcctctccatgcaagtgctgtttta

SEQ ID NO: 587700 - DNA, 25 bp, Rattus norvegicus
tcctctccatgctagtgctgtttta

SEQ ID NO: 587701 - DNA, 25 bp, Rattus norvegicus
tcctctcccagtcaaagccgtaata

SEQ ID NO: 587702 - DNA, 25 bp, Rattus norvegicus
tcctctcccagtgaaagccgtaata

SEQ ID NO: 587703 - DNA, 25 bp, Rattus norvegicus
tcctctccctctagctgtggaatgg

SEQ ID NO: 587704 - DNA, 25 bp, Rattus norvegicus
tcctctccctcttgctgtggaatgg

SEQ ID NO: 587705 - DNA, 25 bp, Rattus norvegicus
tcctctccggagacagaagtatttg

SEQ ID NO: 587706 - DNA, 25 bp, Rattus norvegicus
tcctctccggagtcagaagtatttg

SEQ ID NO: 587707 - DNA, 25 bp, Rattus norvegicus
tcctctcctctcagatggaactctg

SEQ ID NO: 587708 - DNA, 25 bp, Rattus norvegicus
tcctctcctctctgatggaactctg

SEQ ID NO: 587709 - DNA, 25 bp, Rattus norvegicus
tcctctctacttatggttatgaatg

SEQ ID NO: 587710 - DNA, 25 bp, Rattus norvegicus
tcctctctacttttggttatgaatg

SEQ ID NO: 587711 - DNA, 25 bp, Rattus norvegicus
tcctctctatgcactcgcattagct

SEQ ID NO: 587712 - DNA, 25 bp, Rattus norvegicus
tcctctctatgctctcgcattagct

SEQ ID NO: 587713 - DNA, 25 bp, Rattus norvegicus
tcctctctcattctcaatttcttag

SEQ ID NO: 587714 - DNA, 25 bp, Rattus norvegicus
tcctctctcattgtcaatttcttag

SEQ ID NO: 587715 - DNA, 25 bp, Rattus norvegicus
tcctctctccagcagtatcaacatt

SEQ ID NO: 587716 - DNA, 25 bp, Rattus norvegicus
tcctctctccaggagtatcaacatt

SEQ ID NO: 587717 - DNA, 25 bp, Rattus norvegicus
tcctctctctctatcagaagtttgt

SEQ ID NO: 587718 - DNA, 25 bp, Rattus norvegicus
tcctctctctctttcagaagtttgt

SEQ ID NO: 587719 - DNA, 25 bp, Rattus norvegicus
tcctctctctgaacctagagcatag

SEQ ID NO: 587720 - DNA, 25 bp, Rattus norvegicus
tcctctctctgatcctagagcatag

SEQ ID NO: 587721 - DNA, 25 bp, Rattus norvegicus
tcctctctcttaagaccaaatctca

SEQ ID NO: 587722 - DNA, 25 bp, Rattus norvegicus
tcctctctcttatgaccaaatctca

SEQ ID NO: 587723 - DNA, 25 bp, Rattus norvegicus
tcctctctcttgatttagctgttac

SEQ ID NO: 587724 - DNA, 25 bp, Rattus norvegicus
tcctctctcttgttttagctgttac

SEQ ID NO: 587725 - DNA, 25 bp, Rattus norvegicus
tcctctctgattctgggttctgaca

SEQ ID NO: 587726 - DNA, 25 bp, Rattus norvegicus
tcctctctgattgtgggttctgaca

SEQ ID NO: 587727 - DNA, 25 bp, Rattus norvegicus
tcctctctgcacagcatagctaaaa

SEQ ID NO: 587728 - DNA, 25 bp, Rattus norvegicus
tcctctctgcactgcatagctaaaa

SEQ ID NO: 587729 - DNA, 25 bp, Rattus norvegicus
tcctctctggctcggtatgggactc

SEQ ID NO: 587730 - DNA, 25 bp, Rattus norvegicus
tcctctctggctgggtatgggactc

SEQ ID NO: 587731 - DNA, 25 bp, Rattus norvegicus
tcctctctgggaatcttaagcatca

SEQ ID NO: 587732 - DNA, 25 bp, Rattus norvegicus
tcctctctgggattcttaagcatca

SEQ ID NO: 587733 - DNA, 25 bp, Rattus norvegicus
tcctctctgtgtctgcatttaatcc

SEQ ID NO: 587734 - DNA, 25 bp, Rattus norvegicus
tcctctctgtgtgtgcatttaatcc

SEQ ID NO: 587735 - DNA, 25 bp, Rattus norvegicus
tcctctcttcatcctggagtcagca

SEQ ID NO: 587736 - DNA, 25 bp, Rattus norvegicus
tcctctcttcatgctggagtcagca

SEQ ID NO: 587737 - DNA, 25 bp, Rattus norvegicus
tcctctcttctcactagacaaaaca

SEQ ID NO: 587738 - DNA, 25 bp, Rattus norvegicus
tcctctcttctctctagacaaaaca

SEQ ID NO: 587739 - DNA, 25 bp, Rattus norvegicus
tcctctcttgctcaattgtgtctga

SEQ ID NO: 587740 - DNA, 25 bp, Rattus norvegicus
tcctctcttgctgaattgtgtctga

SEQ ID NO: 587741 - DNA, 25 bp, Rattus norvegicus
tcctctcttttcaccaatcattgaa

SEQ ID NO: 587742 - DNA, 25 bp, Rattus norvegicus
tcctctcttttctccaatcattgaa

SEQ ID NO: 587743 - DNA, 25 bp, Rattus norvegicus
tcctctgacctcaatgcattggtct

SEQ ID NO: 587744 - DNA, 25 bp, Rattus norvegicus
tcctctgacctcaattgcagtgatg

SEQ ID NO: 587745 - DNA, 25 bp, Rattus norvegicus
tcctctgacctctatgcattggtct

SEQ ID NO: 587746 - DNA, 25 bp, Rattus norvegicus
tcctctgacctctattgcagtgatg

SEQ ID NO: 587747 - DNA, 25 bp, Rattus norvegicus
tcctctgacgagcacacggaggtct

SEQ ID NO: 587748 - DNA, 25 bp, Rattus norvegicus
tcctctgacgaggacacggaggtct

SEQ ID NO: 587749 - DNA, 25 bp, Rattus norvegicus
tcctctgactataacctccttaata

SEQ ID NO: 587750 - DNA, 25 bp, Rattus norvegicus
tcctctgactattacctccttaata

SEQ ID NO: 587751 - DNA, 25 bp, Rattus norvegicus
tcctctgagctcctgagagaactaa

SEQ ID NO: 587752 - DNA, 25 bp, Rattus norvegicus
tcctctgagctcgtgagagaactaa

SEQ ID NO: 587753 - DNA, 25 bp, Rattus norvegicus
tcctctgaggtcatagccagcctga

SEQ ID NO: 587754 - DNA, 25 bp, Rattus norvegicus
tcctctgaggtcttagccagcctga

SEQ ID NO: 587755 - DNA, 25 bp, Rattus norvegicus
tcctctgatgataatccctgatgga

SEQ ID NO: 587756 - DNA, 25 bp, Rattus norvegicus
tcctctgatgattatccctgatgga

SEQ ID NO: 587757 - DNA, 25 bp, Rattus norvegicus
tcctctgatttcaacatgcatgctg

SEQ ID NO: 587758 - DNA, 25 bp, Rattus norvegicus
tcctctgatttctacatgcatgctg

SEQ ID NO: 587759 - DNA, 25 bp, Rattus norvegicus
tcctctgcagaacgccaggaacatt

SEQ ID NO: 587760 - DNA, 25 bp, Rattus norvegicus
tcctctgcagaaggccaggaacatt

SEQ ID NO: 587761 - DNA, 25 bp, Rattus norvegicus
tcctctgcagacagcctttcatcat

SEQ ID NO: 587762 - DNA, 25 bp, Rattus norvegicus
tcctctgcagactgcctttcatcat

SEQ ID NO: 587763 - DNA, 25 bp, Rattus norvegicus
tcctctgcccatagtaatcatttga

SEQ ID NO: 587764 - DNA, 25 bp, Rattus norvegicus
tcctctgcccattgtaatcatttga

SEQ ID NO: 587765 - DNA, 25 bp, Rattus norvegicus
tcctctgcccttacgtttgaattaa

SEQ ID NO: 587766 - DNA, 25 bp, Rattus norvegicus
tcctctgccctttcgtttgaattaa

SEQ ID NO: 587767 - DNA, 25 bp, Rattus norvegicus
tcctctgcctctagaatgggatcag

SEQ ID NO: 587768 - DNA, 25 bp, Rattus norvegicus
tcctctgcctcttgaatgggatcag

SEQ ID NO: 587769 - DNA, 25 bp, Rattus norvegicus
tcctctgctaccataacttgtgaac

SEQ ID NO: 587770 - DNA, 25 bp, Rattus norvegicus
tcctctgctaccttaacttgtgaac

SEQ ID NO: 587771 - DNA, 25 bp, Rattus norvegicus
tcctctgctgctacgcgctgaggaa

SEQ ID NO: 587772 - DNA, 25 bp, Rattus norvegicus
tcctctgctgcttcgcgctgaggaa

SEQ ID NO: 587773 - DNA, 25 bp, Rattus norvegicus
tcctctgcttcgaggccagccattg

SEQ ID NO: 587774 - DNA, 25 bp, Rattus norvegicus
tcctctgcttcgtggccagccattg

SEQ ID NO: 587775 - DNA, 25 bp, Rattus norvegicus
tcctctggacagatccttctgttag

SEQ ID NO: 587776 - DNA, 25 bp, Rattus norvegicus
tcctctggacagttccttctgttag

SEQ ID NO: 587777 - DNA, 25 bp, Rattus norvegicus
tcctctggagctagtacgttcaaga

SEQ ID NO: 587778 - DNA, 25 bp, Rattus norvegicus
tcctctggagcttgtacgttcaaga

SEQ ID NO: 587779 - DNA, 25 bp, Rattus norvegicus
tcctctggagtgctggcatgcacca

SEQ ID NO: 587780 - DNA, 25 bp, Rattus norvegicus
tcctctggagtggtggcatgcacca

SEQ ID NO: 587781 - DNA, 25 bp, Rattus norvegicus
tcctctggctagagtctccaaagtg

SEQ ID NO: 587782 - DNA, 25 bp, Rattus norvegicus
tcctctggctagtgtctccaaagtg

SEQ ID NO: 587783 - DNA, 25 bp, Rattus norvegicus
tcctctgggcagcactatctaggta

SEQ ID NO: 587784 - DNA, 25 bp, Rattus norvegicus
tcctctgggcaggactatctaggta

SEQ ID NO: 587785 - DNA, 25 bp, Rattus norvegicus
tcctctggttcgagtttacagggca

SEQ ID NO: 587786 - DNA, 25 bp, Rattus norvegicus
tcctctggttcgtgtttacagggca

SEQ ID NO: 587787 - DNA, 25 bp, Rattus norvegicus
tcctctggttgcctggataccctct

SEQ ID NO: 587788 - DNA, 25 bp, Rattus norvegicus
tcctctggttgcgtggataccctct

SEQ ID NO: 587789 - DNA, 25 bp, Rattus norvegicus
tcctctgtaaacatcaccagggtgt

SEQ ID NO: 587790 - DNA, 25 bp, Rattus norvegicus
tcctctgtaaacttcaccagggtgt

SEQ ID NO: 587791 - DNA, 25 bp, Rattus norvegicus
tcctctgtactgctgatccgaatga

SEQ ID NO: 587792 - DNA, 25 bp, Rattus norvegicus
tcctctgtactggtgatccgaatga

SEQ ID NO: 587793 - DNA, 25 bp, Rattus norvegicus
tcctctgtagtcaccaacagtgtgt

SEQ ID NO: 587794 - DNA, 25 bp, Rattus norvegicus
tcctctgtagtctccaacagtgtgt

SEQ ID NO: 587795 - DNA, 25 bp, Rattus norvegicus
tcctctgtatgcctgactgaactat

SEQ ID NO: 587796 - DNA, 25 bp, Rattus norvegicus
tcctctgtatgcgtgactgaactat

SEQ ID NO: 587797 - DNA, 25 bp, Rattus norvegicus
tcctctgtcctactgcagactgaag

SEQ ID NO: 587798 - DNA, 25 bp, Rattus norvegicus
tcctctgtcctagtgcagactgaag

SEQ ID NO: 587799 - DNA, 25 bp, Rattus norvegicus
tcctctgtcttcctttgtcagaaaa

SEQ ID NO: 587800 - DNA, 25 bp, Rattus norvegicus
tcctctgtcttcgtttgtcagaaaa

SEQ ID NO: 587801 - DNA, 25 bp, Rattus norvegicus
tcctctgtggcgcaagatgcttatt

SEQ ID NO: 587802 - DNA, 25 bp, Rattus norvegicus
tcctctgtggcggaagatgcttatt

SEQ ID NO: 587803 - DNA, 25 bp, Rattus norvegicus
tcctctgtgtatcaagctgtggctg

SEQ ID NO: 587804 - DNA, 25 bp, Rattus norvegicus
tcctctgtgtatgaagctgtggctg

SEQ ID NO: 587805 - DNA, 25 bp, Rattus norvegicus
tcctctgtgtcccatggagcagcac

SEQ ID NO: 587806 - DNA, 25 bp, Rattus norvegicus
tcctctgtgtccgatggagcagcac

SEQ ID NO: 587807 - DNA, 25 bp, Rattus norvegicus
tcctctgttaggactgttttcccag

SEQ ID NO: 587808 - DNA, 25 bp, Rattus norvegicus
tcctctgttaggtctgttttcccag

SEQ ID NO: 587809 - DNA, 25 bp, Rattus norvegicus
tcctctgttctcagcattttgacaa

SEQ ID NO: 587810 - DNA, 25 bp, Rattus norvegicus
tcctctgttctctgcattttgacaa

SEQ ID NO: 587811 - DNA, 25 bp, Rattus norvegicus
tcctctgttctgaacctttatgaga

SEQ ID NO: 587812 - DNA, 25 bp, Rattus norvegicus
tcctctgttctgtacctttatgaga

SEQ ID NO: 587813 - DNA, 25 bp, Rattus norvegicus
tcctcttaaatgagttttctctgct

SEQ ID NO: 587814 - DNA, 25 bp, Rattus norvegicus
tcctcttaaatgtgttttctctgct

SEQ ID NO: 587815 - DNA, 25 bp, Rattus norvegicus
tcctcttagaggatcaccttacttt

SEQ ID NO: 587816 - DNA, 25 bp, Rattus norvegicus
tcctcttagaggttcaccttacttt

SEQ ID NO: 587817 - DNA, 25 bp, Rattus norvegicus
tcctcttagcctccatttcgttctg

SEQ ID NO: 587818 - DNA, 25 bp, Rattus norvegicus
tcctcttagcctgcatttcgttctg

SEQ ID NO: 587819 - DNA, 25 bp, Rattus norvegicus
tcctcttatggcattgctcagcaac

SEQ ID NO: 587820 - DNA, 25 bp, Rattus norvegicus
tcctcttatggctttgctcagcaac

SEQ ID NO: 587821 - DNA, 25 bp, Rattus norvegicus
tcctcttcacaccagactcagttaa

SEQ ID NO: 587822 - DNA, 25 bp, Rattus norvegicus
tcctcttcacacgagactcagttaa

SEQ ID NO: 587823 - DNA, 25 bp, Rattus norvegicus
tcctcttcacatcccttattcggaa

SEQ ID NO: 587824 - DNA, 25 bp, Rattus norvegicus
tcctcttcacatgccttattcggaa

SEQ ID NO: 587825 - DNA, 25 bp, Rattus norvegicus
tcctcttcaccgactgttgcagtca

SEQ ID NO: 587826 - DNA, 25 bp, Rattus norvegicus
tcctcttcaccgtctgttgcagtca

SEQ ID NO: 587827 - DNA, 25 bp, Rattus norvegicus
tcctcttcagcaagcaggactgtaa

SEQ ID NO: 587828 - DNA, 25 bp, Rattus norvegicus
tcctcttcagcatgcaggactgtaa

SEQ ID NO: 587829 - DNA, 25 bp, Rattus norvegicus
tcctcttcagccatcggtattgtga

SEQ ID NO: 587830 - DNA, 25 bp, Rattus norvegicus
tcctcttcagccttcggtattgtga

SEQ ID NO: 587831 - DNA, 25 bp, Rattus norvegicus
tcctcttcaggaaccgtgatgagca

SEQ ID NO: 587832 - DNA, 25 bp, Rattus norvegicus
tcctcttcaggatccgtgatgagca

SEQ ID NO: 587833 - DNA, 25 bp, Rattus norvegicus
tcctcttcaggcagctatgagtatt

SEQ ID NO: 587834 - DNA, 25 bp, Rattus norvegicus
tcctcttcaggctgctatgagtatt

SEQ ID NO: 587835 - DNA, 25 bp, Rattus norvegicus
tcctcttcatacactcagcttaaaa

SEQ ID NO: 587836 - DNA, 25 bp, Rattus norvegicus
tcctcttcatactctcagcttaaaa

SEQ ID NO: 587837 - DNA, 25 bp, Rattus norvegicus
tcctcttcatctagggcatccttat

SEQ ID NO: 587838 - DNA, 25 bp, Rattus norvegicus
tcctcttcatcttgggcatccttat

SEQ ID NO: 587839 - DNA, 25 bp, Rattus norvegicus
tcctcttccagcacagattcagact

SEQ ID NO: 587840 - DNA, 25 bp, Rattus norvegicus
tcctcttccagctcagattcagact

SEQ ID NO: 587841 - DNA, 25 bp, Rattus norvegicus
tcctcttccatgctagcgctcaaag

SEQ ID NO: 587842 - DNA, 25 bp, Rattus norvegicus
tcctcttccatggtagcgctcaaag

SEQ ID NO: 587843 - DNA, 25 bp, Rattus norvegicus
tcctcttcccacatttttaatcatg

SEQ ID NO: 587844 - DNA, 25 bp, Rattus norvegicus
tcctcttcccacttttttaatcatg

SEQ ID NO: 587845 - DNA, 25 bp, Rattus norvegicus
tcctcttcccctatgggttcatttg

SEQ ID NO: 587846 - DNA, 25 bp, Rattus norvegicus
tcctcttcccctttgggttcatttg

SEQ ID NO: 587847 - DNA, 25 bp, Rattus norvegicus
tcctcttccttcatatgaaccgaga

SEQ ID NO: 587848 - DNA, 25 bp, Rattus norvegicus
tcctcttccttcttatgaaccgaga

SEQ ID NO: 587849 - DNA, 25 bp, Rattus norvegicus
tcctcttcgtcaatgttattacata

SEQ ID NO: 587850 - DNA, 25 bp, Rattus norvegicus
tcctcttcgtcattgttattacata

SEQ ID NO: 587851 - DNA, 25 bp, Rattus norvegicus
tcctcttctgggaggccgatgaaaa

SEQ ID NO: 587852 - DNA, 25 bp, Rattus norvegicus
tcctcttctgggtggccgatgaaaa

SEQ ID NO: 587853 - DNA, 25 bp, Rattus norvegicus
tcctcttcttttaatcaacccaatg

SEQ ID NO: 587854 - DNA, 25 bp, Rattus norvegicus
tcctcttctttttatcaacccaatg

SEQ ID NO: 587855 - DNA, 25 bp, Rattus norvegicus
tcctcttgacatcagcccttaggga

SEQ ID NO: 587856 - DNA, 25 bp, Rattus norvegicus
tcctcttgacatgagcccttaggga

SEQ ID NO: 587857 - DNA, 25 bp, Rattus norvegicus
tcctcttgagaacacgcacagcttt

SEQ ID NO: 587858 - DNA, 25 bp, Rattus norvegicus
tcctcttgagaagacgcacagcttt

SEQ ID NO: 587859 - DNA, 25 bp, Rattus norvegicus
tcctcttgagttactgtttagcatt

SEQ ID NO: 587860 - DNA, 25 bp, Rattus norvegicus
tcctcttgagtttctgtttagcatt

SEQ ID NO: 587861 - DNA, 25 bp, Rattus norvegicus
tcctcttgcaccaagcaagaagaaa

SEQ ID NO: 587862 - DNA, 25 bp, Rattus norvegicus
tcctcttgcacctagcaagaagaaa

SEQ ID NO: 587863 - DNA, 25 bp, Rattus norvegicus
tcctcttgctaaaatctaagctcga

SEQ ID NO: 587864 - DNA, 25 bp, Rattus norvegicus
tcctcttgctaatatctaagctcga

SEQ ID NO: 587865 - DNA, 25 bp, Rattus norvegicus
tcctcttgctcgcaagcagcttgag

SEQ ID NO: 587866 - DNA, 25 bp, Rattus norvegicus
tcctcttgctcggaagcagcttgag

SEQ ID NO: 587867 - DNA, 25 bp, Rattus norvegicus
tcctcttgctgtaagcggagcgctt

SEQ ID NO: 587868 - DNA, 25 bp, Rattus norvegicus
tcctcttgctgttagcggagcgctt

SEQ ID NO: 587869 - DNA, 25 bp, Rattus norvegicus
tcctcttgctttattcatgtagcat

SEQ ID NO: 587870 - DNA, 25 bp, Rattus norvegicus
tcctcttgcttttttcatgtagcat

SEQ ID NO: 587871 - DNA, 25 bp, Rattus norvegicus
tcctcttggccaacatagctgggaa

SEQ ID NO: 587872 - DNA, 25 bp, Rattus norvegicus
tcctcttggccatcatagctgggaa

SEQ ID NO: 587873 - DNA, 25 bp, Rattus norvegicus
tcctcttgtcctcgaccagatttta

SEQ ID NO: 587874 - DNA, 25 bp, Rattus norvegicus
tcctcttgtcctggaccagatttta

SEQ ID NO: 587875 - DNA, 25 bp, Rattus norvegicus
tcctcttgtttgaggtatttctgca

SEQ ID NO: 587876 - DNA, 25 bp, Rattus norvegicus
tcctcttgtttgtggtatttctgca

SEQ ID NO: 587877 - DNA, 25 bp, Rattus norvegicus
tcctctttatccattttcagctaag

SEQ ID NO: 587878 - DNA, 25 bp, Rattus norvegicus
tcctctttatcctttttcagctaag

SEQ ID NO: 587879 - DNA, 25 bp, Rattus norvegicus
tcctctttccggaagaatctcatcg

SEQ ID NO: 587880 - DNA, 25 bp, Rattus norvegicus
tcctctttccggtagaatctcatcg

SEQ ID NO: 587881 - DNA, 25 bp, Rattus norvegicus
tcctctttgggcatgctgtggctag

SEQ ID NO: 587882 - DNA, 25 bp, Rattus norvegicus
tcctctttgggcctgctcaagggta

SEQ ID NO: 587883 - DNA, 25 bp, Rattus norvegicus
tcctctttgggcgtgctcaagggta

SEQ ID NO: 587884 - DNA, 25 bp, Rattus norvegicus
tcctctttgggcttgctgtggctag

SEQ ID NO: 587885 - DNA, 25 bp, Rattus norvegicus
tcctctttgttgaaaccttttcctg

SEQ ID NO: 587886 - DNA, 25 bp, Rattus norvegicus
tcctctttgttgtaaccttttcctg

SEQ ID NO: 587887 - DNA, 25 bp, Rattus norvegicus
tcctctttttctctcagtcttgctt

SEQ ID NO: 587888 - DNA, 25 bp, Rattus norvegicus
tcctctttttctgtcagtcttgctt

SEQ ID NO: 587889 - DNA, 25 bp, Rattus norvegicus
tcctgaaaatggctttctctctcct

SEQ ID NO: 587890 - DNA, 25 bp, Rattus norvegicus
tcctgaaaatgggtttctctctcct

SEQ ID NO: 587891 - DNA, 25 bp, Rattus norvegicus
tcctgaaacacaactccattgactg

SEQ ID NO: 587892 - DNA, 25 bp, Rattus norvegicus
tcctgaaacacatctccattgactg

SEQ ID NO: 587893 - DNA, 25 bp, Rattus norvegicus
tcctgaaaccaacccagaagttgtt

SEQ ID NO: 587894 - DNA, 25 bp, Rattus norvegicus
tcctgaaaccaagccagaagttgtt

SEQ ID NO: 587895 - DNA, 25 bp, Rattus norvegicus
tcctgaaagatgcactgaaggcctt

SEQ ID NO: 587896 - DNA, 25 bp, Rattus norvegicus
tcctgaaagatggactgaaggcctt

SEQ ID NO: 587897 - DNA, 25 bp, Rattus norvegicus
tcctgaaagcccctgaagtaaataa

SEQ ID NO: 587898 - DNA, 25 bp, Rattus norvegicus
tcctgaaagcccgtgaagtaaataa

SEQ ID NO: 587899 - DNA, 25 bp, Rattus norvegicus
tcctgaaagtgactccctgatgtga

SEQ ID NO: 587900 - DNA, 25 bp, Rattus norvegicus
tcctgaaagtgagtccctgatgtga

SEQ ID NO: 587901 - DNA, 25 bp, Rattus norvegicus
tcctgaacatttcagcctactaata

SEQ ID NO: 587902 - DNA, 25 bp, Rattus norvegicus
tcctgaacatttgagcctactaata

SEQ ID NO: 587903 - DNA, 25 bp, Rattus norvegicus
tcctgaaccagtacatgacactgag

SEQ ID NO: 587904 - DNA, 25 bp, Rattus norvegicus
tcctgaaccagttcatgacactgag

SEQ ID NO: 587905 - DNA, 25 bp, Rattus norvegicus
tcctgaaccataaagtcgatctttt

SEQ ID NO: 587906 - DNA, 25 bp, Rattus norvegicus
tcctgaaccatatagtcgatctttt

SEQ ID NO: 587907 - DNA, 25 bp, Rattus norvegicus
tcctgaaccatgctctccaaggaga

SEQ ID NO: 587908 - DNA, 25 bp, Rattus norvegicus
tcctgaaccatggtctccaaggaga

SEQ ID NO: 587909 - DNA, 25 bp, Rattus norvegicus
tcctgaacggtagcatcttgacgac

SEQ ID NO: 587910 - DNA, 25 bp, Rattus norvegicus
tcctgaaggagcagcaccggctcgc

SEQ ID NO: 587911 - DNA, 25 bp, Rattus norvegicus
tcctgaaggagctgcaccggctcgc

SEQ ID NO: 587912 - DNA, 25 bp, Rattus norvegicus
tcctgaatagttctccacctctgac

SEQ ID NO: 587913 - DNA, 25 bp, Rattus norvegicus
tcctgaatagttgtccacctctgac

SEQ ID NO: 587914 - DNA, 25 bp, Rattus norvegicus
tcctgaatttgcctgtattctctcc

SEQ ID NO: 587915 - DNA, 25 bp, Rattus norvegicus
tcctgaatttgcgtgtattctctcc

SEQ ID NO: 587916 - DNA, 25 bp, Rattus norvegicus
tcctgaattttgatttaagatcccg

SEQ ID NO: 587917 - DNA, 25 bp, Rattus norvegicus
tcctgaattttgttttaagatcccg

SEQ ID NO: 587918 - DNA, 25 bp, Rattus norvegicus
tcctgacaacccaccatatgataag

SEQ ID NO: 587919 - DNA, 25 bp, Rattus norvegicus
tcctgacaaccctccatatgataag

SEQ ID NO: 587920 - DNA, 25 bp, Rattus norvegicus
tcctgacagcttattctcttgttta

SEQ ID NO: 587921 - DNA, 25 bp, Rattus norvegicus
tcctgacagctttttctcttgttta

SEQ ID NO: 587922 - DNA, 25 bp, Rattus norvegicus
tcctgacagggaaccaagttagcct

SEQ ID NO: 587923 - DNA, 25 bp, Rattus norvegicus
tcctgacagggatccaagttagcct

SEQ ID NO: 587924 - DNA, 25 bp, Rattus norvegicus
tcctgacagtggcagctgggcccaa

SEQ ID NO: 587925 - DNA, 25 bp, Rattus norvegicus
tcctgacagtggctcatggtgcaga

SEQ ID NO: 587926 - DNA, 25 bp, Rattus norvegicus
tcctgacagtgggagctgggcccaa

SEQ ID NO: 587927 - DNA, 25 bp, Rattus norvegicus
tcctgacagtgggtcatggtgcaga

SEQ ID NO: 587928 - DNA, 25 bp, Rattus norvegicus
tcctgacattctcggatgctagaat

SEQ ID NO: 587929 - DNA, 25 bp, Rattus norvegicus
tcctgacattctgggatgctagaat

SEQ ID NO: 587930 - DNA, 25 bp, Rattus norvegicus
tcctgaccaaaacatcccaacaaaa

SEQ ID NO: 587931 - DNA, 25 bp, Rattus norvegicus
tcctgaccaaaagatcccaacaaaa

SEQ ID NO: 587932 - DNA, 25 bp, Rattus norvegicus
tcctgaccaactctttggcctgaaa

SEQ ID NO: 587933 - DNA, 25 bp, Rattus norvegicus
tcctgaccaactgtttggcctgaaa

SEQ ID NO: 587934 - DNA, 25 bp, Rattus norvegicus
tcctgaccaccaacggttgttagtt

SEQ ID NO: 587935 - DNA, 25 bp, Rattus norvegicus
tcctgaccaccatcggttgttagtt

SEQ ID NO: 587936 - DNA, 25 bp, Rattus norvegicus
tcctgaccacgaatttacaaaactt

SEQ ID NO: 587937 - DNA, 25 bp, Rattus norvegicus
tcctgaccacgattttacaaaactt

SEQ ID NO: 587938 - DNA, 25 bp, Rattus norvegicus
tcctgaccatcactcttgtgtgaac

SEQ ID NO: 587939 - DNA, 25 bp, Rattus norvegicus
tcctgaccatcagtcttgtgtgaac

SEQ ID NO: 587940 - DNA, 25 bp, Rattus norvegicus
tcctgaccctgacgttgtgatacac

SEQ ID NO: 587941 - DNA, 25 bp, Rattus norvegicus
tcctgaccctgaggttgtgatacac

SEQ ID NO: 587942 - DNA, 25 bp, Rattus norvegicus
tcctgacctccaaacaagtgcaaga

SEQ ID NO: 587943 - DNA, 25 bp, Rattus norvegicus
tcctgacctccacaaggactaggca

SEQ ID NO: 587944 - DNA, 25 bp, Rattus norvegicus
tcctgacctccagaaggactaggca

SEQ ID NO: 587945 - DNA, 25 bp, Rattus norvegicus
tcctgacctccatacaagtgcaaga

SEQ ID NO: 587946 - DNA, 25 bp, Rattus norvegicus
tcctgacctccgctgatagggaaac

SEQ ID NO: 587947 - DNA, 25 bp, Rattus norvegicus
tcctgacctccggtgatagggaaac

SEQ ID NO: 587948 - DNA, 25 bp, Rattus norvegicus
tcctgacctgagctcttcagaggaa

SEQ ID NO: 587949 - DNA, 25 bp, Rattus norvegicus
tcctgacctgaggtcttcagaggaa

SEQ ID NO: 587950 - DNA, 25 bp, Rattus norvegicus
tcctgaccttctccttagacagaga

SEQ ID NO: 587951 - DNA, 25 bp, Rattus norvegicus
tcctgaccttctgcttagacagaga

SEQ ID NO: 587952 - DNA, 25 bp, Rattus norvegicus
tcctgaccttggaaccttagggcag

SEQ ID NO: 587953 - DNA, 25 bp, Rattus norvegicus
tcctgaccttggtaccttagggcag

SEQ ID NO: 587954 - DNA, 25 bp, Rattus norvegicus
tcctgacgagtcagttgtgttctga

SEQ ID NO: 587955 - DNA, 25 bp, Rattus norvegicus
tcctgacgagtctgttgtgttctga

SEQ ID NO: 587956 - DNA, 25 bp, Rattus norvegicus
tcctgacgcaggatgggtacctttg

SEQ ID NO: 587957 - DNA, 25 bp, Rattus norvegicus
tcctgacgcaggttgggtacctttg

SEQ ID NO: 587958 - DNA, 25 bp, Rattus norvegicus
tcctgacgctccattgcagataata

SEQ ID NO: 587959 - DNA, 25 bp, Rattus norvegicus
tcctgacgctcctttgcagataata

SEQ ID NO: 587960 - DNA, 25 bp, Rattus norvegicus
tcctgacgggtcacaaggcttcaaa

SEQ ID NO: 587961 - DNA, 25 bp, Rattus norvegicus
tcctgacgggtctcaaggcttcaaa

SEQ ID NO: 587962 - DNA, 25 bp, Rattus norvegicus
tcctgactatgtactggaggttagt

SEQ ID NO: 587963 - DNA, 25 bp, Rattus norvegicus
tcctgactatgttctggaggttagt

SEQ ID NO: 587964 - DNA, 25 bp, Rattus norvegicus
tcctgactccgaattgctgctaaag

SEQ ID NO: 587965 - DNA, 25 bp, Rattus norvegicus
tcctgactccgatttgctgctaaag

SEQ ID NO: 587966 - DNA, 25 bp, Rattus norvegicus
tcctgactcctgatgctttgcttag

SEQ ID NO: 587967 - DNA, 25 bp, Rattus norvegicus
tcctgactcctgttgctttgcttag

SEQ ID NO: 587968 - DNA, 25 bp, Rattus norvegicus
tcctgactctataagccttcactgg

SEQ ID NO: 587969 - DNA, 25 bp, Rattus norvegicus
tcctgactctattagccttcactgg

SEQ ID NO: 587970 - DNA, 25 bp, Rattus norvegicus
tcctgactctctccactacagtgaa

SEQ ID NO: 587971 - DNA, 25 bp, Rattus norvegicus
tcctgactctctgcactacagtgaa

SEQ ID NO: 587972 - DNA, 25 bp, Rattus norvegicus
tcctgactgactctagagcatgtaa

SEQ ID NO: 587973 - DNA, 25 bp, Rattus norvegicus
tcctgactgactgtagagcatgtaa

SEQ ID NO: 587974 - DNA, 25 bp, Rattus norvegicus
tcctgactgcgaatcacacctggat

SEQ ID NO: 587975 - DNA, 25 bp, Rattus norvegicus
tcctgactgcgattcacacctggat

SEQ ID NO: 587976 - DNA, 25 bp, Rattus norvegicus
tcctgactggaactcttgggtccat

SEQ ID NO: 587977 - DNA, 25 bp, Rattus norvegicus
tcctgactggaagtcttgggtccat

SEQ ID NO: 587978 - DNA, 25 bp, Rattus norvegicus
tcctgacttcaaccagtgcctaaag

SEQ ID NO: 587979 - DNA, 25 bp, Rattus norvegicus
tcctgacttcaagcagtgcctaaag

SEQ ID NO: 587980 - DNA, 25 bp, Rattus norvegicus
tcctgacttctgacaccaagctgat

SEQ ID NO: 587981 - DNA, 25 bp, Rattus norvegicus
tcctgacttctgtcaccaagctgat

SEQ ID NO: 587982 - DNA, 25 bp, Rattus norvegicus
tcctgacttgctagagtttctgttc

SEQ ID NO: 587983 - DNA, 25 bp, Rattus norvegicus
tcctgacttgctctgaggaggatgt

SEQ ID NO: 587984 - DNA, 25 bp, Rattus norvegicus
tcctgacttgctgtgaggaggatgt

SEQ ID NO: 587985 - DNA, 25 bp, Rattus norvegicus
tcctgacttgcttgagtttctgttc

SEQ ID NO: 587986 - DNA, 25 bp, Rattus norvegicus
tcctgactttggctttgtttctgta

SEQ ID NO: 587987 - DNA, 25 bp, Rattus norvegicus
tcctgactttgggtttgtttctgta

SEQ ID NO: 587988 - DNA, 25 bp, Rattus norvegicus
tcctgactttttcccatgtgagact

SEQ ID NO: 587989 - DNA, 25 bp, Rattus norvegicus
tcctgactttttgccatgtgagact

SEQ ID NO: 587990 - DNA, 25 bp, Rattus norvegicus
tcctgagaacagatgcccctgatat

SEQ ID NO: 587991 - DNA, 25 bp, Rattus norvegicus
tcctgagaacagttgcccctgatat

SEQ ID NO: 587992 - DNA, 25 bp, Rattus norvegicus
tcctgagaagttcgatcggttccct

SEQ ID NO: 587993 - DNA, 25 bp, Rattus norvegicus
tcctgagaagttggatcggttccct

SEQ ID NO: 587994 - DNA, 25 bp, Rattus norvegicus
tcctgagagaagagattgagccaac

SEQ ID NO: 587995 - DNA, 25 bp, Rattus norvegicus
tcctgagagaagtgattgagccaac

SEQ ID NO: 587996 - DNA, 25 bp, Rattus norvegicus
tcctgagagctcaggttttccattc

SEQ ID NO: 587997 - DNA, 25 bp, Rattus norvegicus
tcctgagagctctggttttccattc

SEQ ID NO: 587998 - DNA, 25 bp, Rattus norvegicus
tcctgagagctgacgccgcgggcct

SEQ ID NO: 587999 - DNA, 25 bp, Rattus norvegicus
tcctgagagctgtcgccgcgggcct

SEQ ID NO: 588000 - DNA, 25 bp, Rattus norvegicus
tcctgagagggcagccacggagcca

SEQ ID NO: 588001 - DNA, 25 bp, Rattus norvegicus
tcctgagagggctgccacggagcca

SEQ ID NO: 588002 - DNA, 25 bp, Rattus norvegicus
tcctgagagtttctgagggctttct

SEQ ID NO: 588003 - DNA, 25 bp, Rattus norvegicus
tcctgagagtttgtgagggctttct

SEQ ID NO: 588004 - DNA, 25 bp, Rattus norvegicus
tcctgagcacccattgatttctgag

SEQ ID NO: 588005 - DNA, 25 bp, Rattus norvegicus
tcctgagcaccctttgatttctgag

SEQ ID NO: 588006 - DNA, 25 bp, Rattus norvegicus
tcctgagcatggacactggtctgaa

SEQ ID NO: 588007 - DNA, 25 bp, Rattus norvegicus
tcctgagcatggtcactggtctgaa

SEQ ID NO: 588008 - DNA, 25 bp, Rattus norvegicus
tcctgagccaggattgtccagtgat

SEQ ID NO: 588009 - DNA, 25 bp, Rattus norvegicus
tcctgagccaggtttgtccagtgat

SEQ ID NO: 588010 - DNA, 25 bp, Rattus norvegicus
tcctgagcccagaaagagctttcgt

SEQ ID NO: 588011 - DNA, 25 bp, Rattus norvegicus
tcctgagcccagtaagagctttcgt

SEQ ID NO: 588012 - DNA, 25 bp, Rattus norvegicus
tcctgagccctgctttcttttaagt

SEQ ID NO: 588013 - DNA, 25 bp, Rattus norvegicus
tcctgagccctggtttcttttaagt

SEQ ID NO: 588014 - DNA, 25 bp, Rattus norvegicus
tcctgagcctccagtgtaatcaaca

SEQ ID NO: 588015 - DNA, 25 bp, Rattus norvegicus
tcctgagcctcctgtgtaatcaaca

SEQ ID NO: 588016 - DNA, 25 bp, Rattus norvegicus
tcctgagcgctgaggaggaccgcat

SEQ ID NO: 588017 - DNA, 25 bp, Rattus norvegicus
tcctgagcgctgtggaggaccgcat

SEQ ID NO: 588018 - DNA, 25 bp, Rattus norvegicus
tcctgagctcgactcatctcaaggt

SEQ ID NO: 588019 - DNA, 25 bp, Rattus norvegicus
tcctgagctcgagtcatctcaaggt

SEQ ID NO: 588020 - DNA, 25 bp, Rattus norvegicus
tcctgaggacagatttctaatcact

SEQ ID NO: 588021 - DNA, 25 bp, Rattus norvegicus
tcctgaggacagttttctaatcact

SEQ ID NO: 588022 - DNA, 25 bp, Rattus norvegicus
tcctgaggactccagactatgcagt

SEQ ID NO: 588023 - DNA, 25 bp, Rattus norvegicus
tcctgaggactccagggtaatcctg

SEQ ID NO: 588024 - DNA, 25 bp, Rattus norvegicus
tcctgaggactcgagactatgcagt

SEQ ID NO: 588025 - DNA, 25 bp, Rattus norvegicus
tcctgaggactcgagggtaatcctg

SEQ ID NO: 588026 - DNA, 25 bp, Rattus norvegicus
tcctgaggagggacggacattcttt

SEQ ID NO: 588027 - DNA, 25 bp, Rattus norvegicus
tcctgaggagggtcggacattcttt

SEQ ID NO: 588028 - DNA, 25 bp, Rattus norvegicus
tcctgaggccaccatctgctgaagg

SEQ ID NO: 588029 - DNA, 25 bp, Rattus norvegicus
tcctgaggccacgatctgctgaagg

SEQ ID NO: 588030 - DNA, 25 bp, Rattus norvegicus
tcctgaggctagaccccaaggtcta

SEQ ID NO: 588031 - DNA, 25 bp, Rattus norvegicus
tcctgaggctagtccccaaggtcta

SEQ ID NO: 588032 - DNA, 25 bp, Rattus norvegicus
tcctgaggctcaacgggccattgaa

SEQ ID NO: 588033 - DNA, 25 bp, Rattus norvegicus
tcctgaggctcatcgggccattgaa

SEQ ID NO: 588034 - DNA, 25 bp, Rattus norvegicus
tcctgaggctgtaggcccttcctga

SEQ ID NO: 588035 - DNA, 25 bp, Rattus norvegicus
tcctgaggctgttggcccttcctga

SEQ ID NO: 588036 - DNA, 25 bp, Rattus norvegicus
tcctgaggcttgagtatcgttttgt

SEQ ID NO: 588037 - DNA, 25 bp, Rattus norvegicus
tcctgaggcttgtgtatcgttttgt

SEQ ID NO: 588038 - DNA, 25 bp, Rattus norvegicus
tcctgagggctcagtcatccccaga

SEQ ID NO: 588039 - DNA, 25 bp, Rattus norvegicus
tcctgagggctctgtcatccccaga

SEQ ID NO: 588040 - DNA, 25 bp, Rattus norvegicus
tcctgagggtgaaataacttggcat

SEQ ID NO: 588041 - DNA, 25 bp, Rattus norvegicus
tcctgagggtgatataacttggcat

SEQ ID NO: 588042 - DNA, 25 bp, Rattus norvegicus
tcctgaggtgtcctgacagtcattt

SEQ ID NO: 588043 - DNA, 25 bp, Rattus norvegicus
tcctgaggtgtcgtgacagtcattt

SEQ ID NO: 588044 - DNA, 25 bp, Rattus norvegicus
tcctgagtagttagttgggtgtcct

SEQ ID NO: 588045 - DNA, 25 bp, Rattus norvegicus
tcctgagtagtttgttgggtgtcct

SEQ ID NO: 588046 - DNA, 25 bp, Rattus norvegicus
tcctgagtcaagagccaagccaaaa

SEQ ID NO: 588047 - DNA, 25 bp, Rattus norvegicus
tcctgagtcaagtgccaagccaaaa

SEQ ID NO: 588048 - DNA, 25 bp, Rattus norvegicus
tcctgagtcaccaacactgagtaaa

SEQ ID NO: 588049 - DNA, 25 bp, Rattus norvegicus
tcctgagtcacctacactgagtaaa

SEQ ID NO: 588050 - DNA, 25 bp, Rattus norvegicus
tcctgagtcatgctgccaaatcttt

SEQ ID NO: 588051 - DNA, 25 bp, Rattus norvegicus
tcctgagtcatggtgccaaatcttt

SEQ ID NO: 588052 - DNA, 25 bp, Rattus norvegicus
tcctgagtcctgcaattctgggtgt

SEQ ID NO: 588053 - DNA, 25 bp, Rattus norvegicus
tcctgagtcctggaattctgggtgt

SEQ ID NO: 588054 - DNA, 25 bp, Rattus norvegicus
tcctgagtctatactgccctaatgt

SEQ ID NO: 588055 - DNA, 25 bp, Rattus norvegicus
tcctgagtctattctgccctaatgt

SEQ ID NO: 588056 - DNA, 25 bp, Rattus norvegicus
tcctgagtctgaccttctgtggaca

SEQ ID NO: 588057 - DNA, 25 bp, Rattus norvegicus
tcctgagtctgagcttctgtggaca

SEQ ID NO: 588058 - DNA, 25 bp, Rattus norvegicus
tcctgagtggctcagtcaaacccgt

SEQ ID NO: 588059 - DNA, 25 bp, Rattus norvegicus
tcctgagtggctgagtcaaacccgt

SEQ ID NO: 588060 - DNA, 25 bp, Rattus norvegicus
tcctgagtgtgaactccctgctgaa

SEQ ID NO: 588061 - DNA, 25 bp, Rattus norvegicus
tcctgagtgtgatctccctgctgaa

SEQ ID NO: 588062 - DNA, 25 bp, Rattus norvegicus
tcctgagttaccagggtgggcctaa

SEQ ID NO: 588063 - DNA, 25 bp, Rattus norvegicus
tcctgagttacctgggtgggcctaa

SEQ ID NO: 588064 - DNA, 25 bp, Rattus norvegicus
tcctgagttcttatactgacacgag

SEQ ID NO: 588065 - DNA, 25 bp, Rattus norvegicus
tcctgagttcttttactgacacgag

SEQ ID NO: 588066 - DNA, 25 bp, Rattus norvegicus
tcctgatacttccttgtgctgagat

SEQ ID NO: 588067 - DNA, 25 bp, Rattus norvegicus
tcctgatacttcgttgtgctgagat

SEQ ID NO: 588068 - DNA, 25 bp, Rattus norvegicus
tcctgatattccagccaagcctttg

SEQ ID NO: 588069 - DNA, 25 bp, Rattus norvegicus
tcctgatattcctgccaagcctttg

SEQ ID NO: 588070 - DNA, 25 bp, Rattus norvegicus
tcctgatcaacgcattattacccaa

SEQ ID NO: 588071 - DNA, 25 bp, Rattus norvegicus
tcctgatcaacggattattacccaa

SEQ ID NO: 588072 - DNA, 25 bp, Rattus norvegicus
tcctgatcctgcagagcctgggagt

SEQ ID NO: 588073 - DNA, 25 bp, Rattus norvegicus
tcctgatcctgctgagcctgggagt

SEQ ID NO: 588074 - DNA, 25 bp, Rattus norvegicus
tcctgatcgcagctcatttcaaatg

SEQ ID NO: 588075 - DNA, 25 bp, Rattus norvegicus
tcctgatcgcaggtcatttcaaatg

SEQ ID NO: 588076 - DNA, 25 bp, Rattus norvegicus
tcctgatgagatatgtgcctgggtt

SEQ ID NO: 588077 - DNA, 25 bp, Rattus norvegicus
tcctgatgagatcccccctctggaa

SEQ ID NO: 588078 - DNA, 25 bp, Rattus norvegicus
tcctgatgagatgccccctctggaa

SEQ ID NO: 588079 - DNA, 25 bp, Rattus norvegicus
tcctgatgagatttgtgcctgggtt

SEQ ID NO: 588080 - DNA, 25 bp, Rattus norvegicus
tcctgatgatagattgaacagccaa

SEQ ID NO: 588081 - DNA, 25 bp, Rattus norvegicus
tcctgatgatagtttgaacagccaa

SEQ ID NO: 588082 - DNA, 25 bp, Rattus norvegicus
tcctgatgcccaaggaggacccgaa

SEQ ID NO: 588083 - DNA, 25 bp, Rattus norvegicus
tcctgatgcccatggaggacccgaa

SEQ ID NO: 588084 - DNA, 25 bp, Rattus norvegicus
tcctgatgggaacagtacactagtt

SEQ ID NO: 588085 - DNA, 25 bp, Rattus norvegicus
tcctgatgggaagagtacactagtt

SEQ ID NO: 588086 - DNA, 25 bp, Rattus norvegicus
tcctgattccctaagtggcttggtg

SEQ ID NO: 588087 - DNA, 25 bp, Rattus norvegicus
tcctgattcccttagtggcttggtg

SEQ ID NO: 588088 - DNA, 25 bp, Rattus norvegicus
tcctgattcgcactggttctgtttt

SEQ ID NO: 588089 - DNA, 25 bp, Rattus norvegicus
tcctgattcgcagtggttctgtttt

SEQ ID NO: 588090 - DNA, 25 bp, Rattus norvegicus
tcctgattgcagcacgatgcaagga

SEQ ID NO: 588091 - DNA, 25 bp, Rattus norvegicus
tcctgattgcaggacgatgcaagga

SEQ ID NO: 588092 - DNA, 25 bp, Rattus norvegicus
tcctgattgtttcacccttttgtga

SEQ ID NO: 588093 - DNA, 25 bp, Rattus norvegicus
tcctgattgtttgacccttttgtga

SEQ ID NO: 588094 - DNA, 25 bp, Rattus norvegicus
tcctgatttacaccttcggaaaaaa

SEQ ID NO: 588095 - DNA, 25 bp, Rattus norvegicus
tcctgatttacagcttcggaaaaaa

SEQ ID NO: 588096 - DNA, 25 bp, Rattus norvegicus
tcctgatttcagcacggtgccagga

SEQ ID NO: 588097 - DNA, 25 bp, Rattus norvegicus
tcctgatttcaggacggtgccagga

SEQ ID NO: 588098 - DNA, 25 bp, Rattus norvegicus
tcctgatttgaacaccagactgtgg

SEQ ID NO: 588099 - DNA, 25 bp, Rattus norvegicus
tcctgatttgaagaccagactgtgg

SEQ ID NO: 588100 - DNA, 25 bp, Rattus norvegicus
tcctgattttcgacatgtgagccat

SEQ ID NO: 588101 - DNA, 25 bp, Rattus norvegicus
tcctgattttcgtcatgtgagccat

SEQ ID NO: 588102 - DNA, 25 bp, Rattus norvegicus
tcctgcaaccgtcgaatcagtcttg

SEQ ID NO: 588103 - DNA, 25 bp, Rattus norvegicus
tcctgcaaccgtggaatcagtcttg

SEQ ID NO: 588104 - DNA, 25 bp, Rattus norvegicus
tcctgcaatagtcacagtgctgggc

SEQ ID NO: 588105 - DNA, 25 bp, Rattus norvegicus
tcctgcaatagtgacagtgctgggc

SEQ ID NO: 588106 - DNA, 25 bp, Rattus norvegicus
tcctgcacctcaacaagctagggat

SEQ ID NO: 588107 - DNA, 25 bp, Rattus norvegicus
tcctgcacctcatcaagctagggat

SEQ ID NO: 588108 - DNA, 25 bp, Rattus norvegicus
tcctgcacgggacagtaccctgata

SEQ ID NO: 588109 - DNA, 25 bp, Rattus norvegicus
tcctgcacgggagagtaccctgata

SEQ ID NO: 588110 - DNA, 25 bp, Rattus norvegicus
tcctgcactcacaccagtaaagatg

SEQ ID NO: 588111 - DNA, 25 bp, Rattus norvegicus
tcctgcactcactccagtaaagatg

SEQ ID NO: 588112 - DNA, 25 bp, Rattus norvegicus
tcctgcactgaacggtgcgcttaat

SEQ ID NO: 588113 - DNA, 25 bp, Rattus norvegicus
tcctgcactgaagggtgcgcttaat

SEQ ID NO: 588114 - DNA, 25 bp, Rattus norvegicus
tcctgcacttgacgcctggacagat

SEQ ID NO: 588115 - DNA, 25 bp, Rattus norvegicus
tcctgcacttgaggcctggacagat

SEQ ID NO: 588116 - DNA, 25 bp, Rattus norvegicus
tcctgcagaaccctcagtcatgaaa

SEQ ID NO: 588117 - DNA, 25 bp, Rattus norvegicus
tcctgcagaaccgtcagtcatgaaa

SEQ ID NO: 588118 - DNA, 25 bp, Rattus norvegicus
tcctgcagacacagcaggctgtaga

SEQ ID NO: 588119 - DNA, 25 bp, Rattus norvegicus
tcctgcagacactgcaggctgtaga

SEQ ID NO: 588120 - DNA, 25 bp, Rattus norvegicus
tcctgcagcattcggagctggagcc

SEQ ID NO: 588121 - DNA, 25 bp, Rattus norvegicus
tcctgcagcattgggagctggagcc

SEQ ID NO: 588122 - DNA, 25 bp, Rattus norvegicus
tcctgcagcccaaccaagaaatgta

SEQ ID NO: 588123 - DNA, 25 bp, Rattus norvegicus
tcctgcagcccatccaagaaatgta

SEQ ID NO: 588124 - DNA, 25 bp, Rattus norvegicus
tcctgcagctccagatggattttta

SEQ ID NO: 588125 - DNA, 25 bp, Rattus norvegicus
tcctgcagctcctgatggattttta

SEQ ID NO: 588126 - DNA, 25 bp, Rattus norvegicus
tcctgcaggctcaagaattccatct

SEQ ID NO: 588127 - DNA, 25 bp, Rattus norvegicus
tcctgcaggctctagaattccatct

SEQ ID NO: 588128 - DNA, 25 bp, Rattus norvegicus
tcctgcagtcggagctagtgaacta

SEQ ID NO: 588129 - DNA, 25 bp, Rattus norvegicus
tcctgcagtcggtgctagtgaacta

SEQ ID NO: 588130 - DNA, 25 bp, Rattus norvegicus
tcctgcagtctaactacagctatgt

SEQ ID NO: 588131 - DNA, 25 bp, Rattus norvegicus
tcctgcagtctatctacagctatgt

SEQ ID NO: 588132 - DNA, 25 bp, Rattus norvegicus
tcctgcagtgccctgtgttgggaaa

SEQ ID NO: 588133 - DNA, 25 bp, Rattus norvegicus
tcctgcagtgccgtgtgttgggaaa

SEQ ID NO: 588134 - DNA, 25 bp, Rattus norvegicus
tcctgcagtggaccggaacttgttc

SEQ ID NO: 588135 - DNA, 25 bp, Rattus norvegicus
tcctgcagtggagcggaacttgttc

SEQ ID NO: 588136 - DNA, 25 bp, Rattus norvegicus
tcctgcatcgctactgcattaatga

SEQ ID NO: 588137 - DNA, 25 bp, Rattus norvegicus
tcctgcatcgcttctgcattaatga

SEQ ID NO: 588138 - DNA, 25 bp, Rattus norvegicus
tcctgcatgaggctgtctccgtggt

SEQ ID NO: 588139 - DNA, 25 bp, Rattus norvegicus
tcctgcatgagggtgtctccgtggt

SEQ ID NO: 588140 - DNA, 25 bp, Rattus norvegicus
tcctgcatgtttcaggagctggcct

SEQ ID NO: 588141 - DNA, 25 bp, Rattus norvegicus
tcctgcatgtttgaggagctggcct

SEQ ID NO: 588142 - DNA, 25 bp, Rattus norvegicus
tcctgcattaaacacgtggccatca

SEQ ID NO: 588143 - DNA, 25 bp, Rattus norvegicus
tcctgcattaaagacgtggccatca

SEQ ID NO: 588144 - DNA, 25 bp, Rattus norvegicus
tcctgcattcctatgtgggttccat

SEQ ID NO: 588145 - DNA, 25 bp, Rattus norvegicus
tcctgcattcctttgtgggttccat

SEQ ID NO: 588146 - DNA, 25 bp, Rattus norvegicus
tcctgcattcgtcgtacacctgata

SEQ ID NO: 588147 - DNA, 25 bp, Rattus norvegicus
tcctgcattcgtggtacacctgata

SEQ ID NO: 588148 - DNA, 25 bp, Rattus norvegicus
tcctgccaatggacttcagtttttg

SEQ ID NO: 588149 - DNA, 25 bp, Rattus norvegicus
tcctgccaatggtcttcagtttttg

SEQ ID NO: 588150 - DNA, 25 bp, Rattus norvegicus
tcctgccacataacagatctaccat

SEQ ID NO: 588151 - DNA, 25 bp, Rattus norvegicus
tcctgccacatatcagatctaccat

SEQ ID NO: 588152 - DNA, 25 bp, Rattus norvegicus
tcctgccacctcagggagtgaagag

SEQ ID NO: 588153 - DNA, 25 bp, Rattus norvegicus
tcctgccacctctgggagtgaagag

SEQ ID NO: 588154 - DNA, 25 bp, Rattus norvegicus
tcctgccacgcgacgagcgcagggt

SEQ ID NO: 588155 - DNA, 25 bp, Rattus norvegicus
tcctgccacgcgtcgagcgcagggt

SEQ ID NO: 588156 - DNA, 25 bp, Rattus norvegicus
tcctgccagatactggtggtccaca

SEQ ID NO: 588157 - DNA, 25 bp, Rattus norvegicus
tcctgccagatagtggtggtccaca

SEQ ID NO: 588158 - DNA, 25 bp, Rattus norvegicus
tcctgccataccacaaagtgttaaa

SEQ ID NO: 588159 - DNA, 25 bp, Rattus norvegicus
tcctgccatacctcaaagtgttaaa

SEQ ID NO: 588160 - DNA, 25 bp, Rattus norvegicus
tcctgcccaaggagttctcttttta

SEQ ID NO: 588161 - DNA, 25 bp, Rattus norvegicus
tcctgcccaaggtgttctcttttta

SEQ ID NO: 588162 - DNA, 25 bp, Rattus norvegicus
tcctgcccagagaccttaggttgat

SEQ ID NO: 588163 - DNA, 25 bp, Rattus norvegicus
tcctgcccagagtccttaggttgat

SEQ ID NO: 588164 - DNA, 25 bp, Rattus norvegicus
tcctgcccatgaaaaaccccaataa

SEQ ID NO: 588165 - DNA, 25 bp, Rattus norvegicus
tcctgcccatgataaaccccaataa

SEQ ID NO: 588166 - DNA, 25 bp, Rattus norvegicus
tcctgccccaagacaaagatccaat

SEQ ID NO: 588167 - DNA, 25 bp, Rattus norvegicus
tcctgccccaagtcaaagatccaat

SEQ ID NO: 588168 - DNA, 25 bp, Rattus norvegicus
tcctgccccgtgaaaggtctgtaaa

SEQ ID NO: 588169 - DNA, 25 bp, Rattus norvegicus
tcctgccccgtgtaaggtctgtaaa

SEQ ID NO: 588170 - DNA, 25 bp, Rattus norvegicus
tcctgccctaccagtgtgtattata

SEQ ID NO: 588171 - DNA, 25 bp, Rattus norvegicus
tcctgccctacctgtgtgtattata

SEQ ID NO: 588172 - DNA, 25 bp, Rattus norvegicus
tcctgccctaggactgagttttgaa

SEQ ID NO: 588173 - DNA, 25 bp, Rattus norvegicus
tcctgccctaggtctgagttttgaa

SEQ ID NO: 588174 - DNA, 25 bp, Rattus norvegicus
tcctgccctcagagtttgattacaa

SEQ ID NO: 588175 - DNA, 25 bp, Rattus norvegicus
tcctgccctcagtgtttgattacaa

SEQ ID NO: 588176 - DNA, 25 bp, Rattus norvegicus
tcctgccctccaatgtggatggtaa

SEQ ID NO: 588177 - DNA, 25 bp, Rattus norvegicus
tcctgccctccattgtggatggtaa

SEQ ID NO: 588178 - DNA, 25 bp, Rattus norvegicus
tcctgcccttttatgagagactggt

SEQ ID NO: 588179 - DNA, 25 bp, Rattus norvegicus
tcctgcccttttttgagagactggt

SEQ ID NO: 588180 - DNA, 25 bp, Rattus norvegicus
tcctgccgaactctggacaagcata

SEQ ID NO: 588181 - DNA, 25 bp, Rattus norvegicus
tcctgccgaactgtggacaagcata

SEQ ID NO: 588182 - DNA, 25 bp, Rattus norvegicus
tcctgccgctgcataaactacaact

SEQ ID NO: 588183 - DNA, 25 bp, Rattus norvegicus
tcctgccgctgcttaaactacaact

SEQ ID NO: 588184 - DNA, 25 bp, Rattus norvegicus
tcctgccggtatatttccagaaact

SEQ ID NO: 588185 - DNA, 25 bp, Rattus norvegicus
tcctgccggtatttttccagaaact

SEQ ID NO: 588186 - DNA, 25 bp, Rattus norvegicus
tcctgcctaaggatctcctacggag

SEQ ID NO: 588187 - DNA, 25 bp, Rattus norvegicus
tcctgcctaaggttctcctacggag

SEQ ID NO: 588188 - DNA, 25 bp, Rattus norvegicus
tcctgcctacagagtcgaaactaca

SEQ ID NO: 588189 - DNA, 25 bp, Rattus norvegicus
tcctgcctacagtgtcgaaactaca

SEQ ID NO: 588190 - DNA, 25 bp, Rattus norvegicus
tcctgcctactgacacaggcacaag

SEQ ID NO: 588191 - DNA, 25 bp, Rattus norvegicus
tcctgcctactgtcacaggcacaag

SEQ ID NO: 588192 - DNA, 25 bp, Rattus norvegicus
tcctgcctagctataggccatcaga

SEQ ID NO: 588193 - DNA, 25 bp, Rattus norvegicus
tcctgcctagctttaggccatcaga

SEQ ID NO: 588194 - DNA, 25 bp, Rattus norvegicus
tcctgcctcagtattacaagtgcca

SEQ ID NO: 588195 - DNA, 25 bp, Rattus norvegicus
tcctgcctcagttttacaagtgcca

SEQ ID NO: 588196 - DNA, 25 bp, Rattus norvegicus
tcctgcctcctaaactaagctattt

SEQ ID NO: 588197 - DNA, 25 bp, Rattus norvegicus
tcctgcctcctatactaagctattt

SEQ ID NO: 588198 - DNA, 25 bp, Rattus norvegicus
tcctgcctcttcagagggagaagtg

SEQ ID NO: 588199 - DNA, 25 bp, Rattus norvegicus
tcctgcctcttctgagggagaagtg

SEQ ID NO: 588200 - DNA, 25 bp, Rattus norvegicus
tcctgcctgacaaattcctttgaac

SEQ ID NO: 588201 - DNA, 25 bp, Rattus norvegicus
tcctgcctgacatattcctttgaac

SEQ ID NO: 588202 - DNA, 25 bp, Rattus norvegicus
tcctgcctgaccaaatgaattaagt

SEQ ID NO: 588203 - DNA, 25 bp, Rattus norvegicus
tcctgcctgacctaatgaattaagt

SEQ ID NO: 588204 - DNA, 25 bp, Rattus norvegicus
tcctgcctgagcagagcctaaatca

SEQ ID NO: 588205 - DNA, 25 bp, Rattus norvegicus
tcctgcctgagctgagcctaaatca

SEQ ID NO: 588206 - DNA, 25 bp, Rattus norvegicus
tcctgcctgcatagtaccttgttaa

SEQ ID NO: 588207 - DNA, 25 bp, Rattus norvegicus
tcctgcctgcattgtaccttgttaa

SEQ ID NO: 588208 - DNA, 25 bp, Rattus norvegicus
tcctgcctggcaagtcttcagtgtc

SEQ ID NO: 588209 - DNA, 25 bp, Rattus norvegicus
tcctgcctggcatgtcttcagtgtc

SEQ ID NO: 588210 - DNA, 25 bp, Rattus norvegicus
tcctgcctgggtactgttaggctga

SEQ ID NO: 588211 - DNA, 25 bp, Rattus norvegicus
tcctgcctgggttctgttaggctga

SEQ ID NO: 588212 - DNA, 25 bp, Rattus norvegicus
tcctgcctgtaactagtaaatgtgg

SEQ ID NO: 588213 - DNA, 25 bp, Rattus norvegicus
tcctgcctgtaagtagtaaatgtgg

SEQ ID NO: 588214 - DNA, 25 bp, Rattus norvegicus
tcctgcctgtatagcccttgtagac

SEQ ID NO: 588215 - DNA, 25 bp, Rattus norvegicus
tcctgcctgtatcactagtaaactt

SEQ ID NO: 588216 - DNA, 25 bp, Rattus norvegicus
tcctgcctgtatgactagtaaactt

SEQ ID NO: 588217 - DNA, 25 bp, Rattus norvegicus
tcctgcctgtattgcccttgtagac

SEQ ID NO: 588218 - DNA, 25 bp, Rattus norvegicus
tcctgccttctgagagcctcgggat

SEQ ID NO: 588219 - DNA, 25 bp, Rattus norvegicus
tcctgccttctgtgagcctcgggat

SEQ ID NO: 588220 - DNA, 25 bp, Rattus norvegicus
tcctgcctttccaagctattctaat

SEQ ID NO: 588221 - DNA, 25 bp, Rattus norvegicus
tcctgcctttccagatgtagctgtg

SEQ ID NO: 588222 - DNA, 25 bp, Rattus norvegicus
tcctgcctttcctagctattctaat

SEQ ID NO: 588223 - DNA, 25 bp, Rattus norvegicus
tcctgcctttcctgatgtagctgtg

SEQ ID NO: 588224 - DNA, 25 bp, Rattus norvegicus
tcctgcctttgcactgggtgctaaa

SEQ ID NO: 588225 - DNA, 25 bp, Rattus norvegicus
tcctgcctttgctctgggtgctaaa

SEQ ID NO: 588226 - DNA, 25 bp, Rattus norvegicus
tcctgcgaccagagtgttgtaaaaa

SEQ ID NO: 588227 - DNA, 25 bp, Rattus norvegicus
tcctgcgaccagtgtgttgtaaaaa

SEQ ID NO: 588228 - DNA, 25 bp, Rattus norvegicus
tcctgcgactgcaagtttttgtcta

SEQ ID NO: 588229 - DNA, 25 bp, Rattus norvegicus
tcctgcgactgctagtttttgtcta

SEQ ID NO: 588230 - DNA, 25 bp, Rattus norvegicus
tcctgcgagaggaacgttttggtcc

SEQ ID NO: 588231 - DNA, 25 bp, Rattus norvegicus
tcctgcgagaggtacgttttggtcc

SEQ ID NO: 588232 - DNA, 25 bp, Rattus norvegicus
tcctgcgccgtgaactcatggagct

SEQ ID NO: 588233 - DNA, 25 bp, Rattus norvegicus
tcctgcgccgtgtactcatggagct

SEQ ID NO: 588234 - DNA, 25 bp, Rattus norvegicus
tcctgcgcttcaagaggccgcggaa

SEQ ID NO: 588235 - DNA, 25 bp, Rattus norvegicus
tcctgcgcttcatgaggccgcggaa

SEQ ID NO: 588236 - DNA, 25 bp, Rattus norvegicus
tcctgcggcgtgaatattaacaatt

SEQ ID NO: 588237 - DNA, 25 bp, Rattus norvegicus
tcctgcggcgtgtatattaacaatt

SEQ ID NO: 588238 - DNA, 25 bp, Rattus norvegicus
tcctgcgggctgcttctctataaag

SEQ ID NO: 588239 - DNA, 25 bp, Rattus norvegicus
tcctgcgggctggttctctataaag

SEQ ID NO: 588240 - DNA, 25 bp, Rattus norvegicus
tcctgcggtctcagcgacagatgaa

SEQ ID NO: 588241 - DNA, 25 bp, Rattus norvegicus
tcctgcggtctctgcgacagatgaa

SEQ ID NO: 588242 - DNA, 25 bp, Rattus norvegicus
tcctgctaagatctataccactgaa

SEQ ID NO: 588243 - DNA, 25 bp, Rattus norvegicus
tcctgctaagatgtataccactgaa

SEQ ID NO: 588244 - DNA, 25 bp, Rattus norvegicus
tcctgctaaggtcggattctgccaa

SEQ ID NO: 588245 - DNA, 25 bp, Rattus norvegicus
tcctgctaaggtgggattctgccaa

SEQ ID NO: 588246 - DNA, 25 bp, Rattus norvegicus
tcctgctaatttccgatcacttctt

SEQ ID NO: 588247 - DNA, 25 bp, Rattus norvegicus
tcctgctaatttgcgatcacttctt

SEQ ID NO: 588248 - DNA, 25 bp, Rattus norvegicus
tcctgctaccctctgtatcttgatt

SEQ ID NO: 588249 - DNA, 25 bp, Rattus norvegicus
tcctgctaccctgtgtatcttgatt

SEQ ID NO: 588250 - DNA, 25 bp, Rattus norvegicus
tcctgctatgatcacactcacttaa

SEQ ID NO: 588251 - DNA, 25 bp, Rattus norvegicus
tcctgctatgatgacactcacttaa

SEQ ID NO: 588252 - DNA, 25 bp, Rattus norvegicus
tcctgctcagacattactgctttta

SEQ ID NO: 588253 - DNA, 25 bp, Rattus norvegicus
tcctgctcagactttactgctttta

SEQ ID NO: 588254 - DNA, 25 bp, Rattus norvegicus
tcctgctcagagcagttctgggaaa

SEQ ID NO: 588255 - DNA, 25 bp, Rattus norvegicus
tcctgctcagagctgccaattgttc

SEQ ID NO: 588256 - DNA, 25 bp, Rattus norvegicus
tcctgctcagaggagttctgggaaa

SEQ ID NO: 588257 - DNA, 25 bp, Rattus norvegicus
tcctgctcagaggtgccaattgttc

SEQ ID NO: 588258 - DNA, 25 bp, Rattus norvegicus
tcctgctcctctcttgactggatga

SEQ ID NO: 588259 - DNA, 25 bp, Rattus norvegicus
tcctgctcctctgttgactggatga

SEQ ID NO: 588260 - DNA, 25 bp, Rattus norvegicus
tcctgctcctttacatttctgtgta

SEQ ID NO: 588261 - DNA, 25 bp, Rattus norvegicus
tcctgctcctttccaatgtgatcat

SEQ ID NO: 588262 - DNA, 25 bp, Rattus norvegicus
tcctgctcctttgcaatgtgatcat

SEQ ID NO: 588263 - DNA, 25 bp, Rattus norvegicus
tcctgctccttttcatttctgtgta

SEQ ID NO: 588264 - DNA, 25 bp, Rattus norvegicus
tcctgctcgagaagaaccctaaact

SEQ ID NO: 588265 - DNA, 25 bp, Rattus norvegicus
tcctgctcgagatgaaccctaaact

SEQ ID NO: 588266 - DNA, 25 bp, Rattus norvegicus
tcctgctctagtctctgtaatctta

SEQ ID NO: 588267 - DNA, 25 bp, Rattus norvegicus
tcctgctctagtgtctgtaatctta

SEQ ID NO: 588268 - DNA, 25 bp, Rattus norvegicus
tcctgctctggacattgttctagaa

SEQ ID NO: 588269 - DNA, 25 bp, Rattus norvegicus
tcctgctctggagattgttctagaa

SEQ ID NO: 588270 - DNA, 25 bp, Rattus norvegicus
tcctgctcttggagctgctgcgagt

SEQ ID NO: 588271 - DNA, 25 bp, Rattus norvegicus
tcctgctcttggtgctgctgcgagt

SEQ ID NO: 588272 - DNA, 25 bp, Rattus norvegicus
tcctgctgaaagagagcgggcctca

SEQ ID NO: 588273 - DNA, 25 bp, Rattus norvegicus
tcctgctgaaagtgagcgggcctca

SEQ ID NO: 588274 - DNA, 25 bp, Rattus norvegicus
tcctgctgaactaaacatcttgtgc

SEQ ID NO: 588275 - DNA, 25 bp, Rattus norvegicus
tcctgctgaacttaacatcttgtgc

SEQ ID NO: 588276 - DNA, 25 bp, Rattus norvegicus
tcctgctgaaggagtttccccaata

SEQ ID NO: 588277 - DNA, 25 bp, Rattus norvegicus
tcctgctgaaggtgtttccccaata

SEQ ID NO: 588278 - DNA, 25 bp, Rattus norvegicus
tcctgctgacttatgccgaggctga

SEQ ID NO: 588279 - DNA, 25 bp, Rattus norvegicus
tcctgctgacttttgccgaggctga

SEQ ID NO: 588280 - DNA, 25 bp, Rattus norvegicus
tcctgctgagccagggagtcggctt

SEQ ID NO: 588281 - DNA, 25 bp, Rattus norvegicus
tcctgctgagcctgggagtcggctt

SEQ ID NO: 588282 - DNA, 25 bp, Rattus norvegicus
tcctgctgcagcactttacataaga

SEQ ID NO: 588283 - DNA, 25 bp, Rattus norvegicus
tcctgctgcagctctttacataaga

SEQ ID NO: 588284 - DNA, 25 bp, Rattus norvegicus
tcctgctgcaggagaacgacaagtc

SEQ ID NO: 588285 - DNA, 25 bp, Rattus norvegicus
tcctgctgcaggtgaacgacaagtc

SEQ ID NO: 588286 - DNA, 25 bp, Rattus norvegicus
tcctgctgcccactgtaaactgtca

SEQ ID NO: 588287 - DNA, 25 bp, Rattus norvegicus
tcctgctgcccagtgtaaactgtca

SEQ ID NO: 588288 - DNA, 25 bp, Rattus norvegicus
tcctgctgccccatgttctcagaga

SEQ ID NO: 588289 - DNA, 25 bp, Rattus norvegicus
tcctgctgccccttgttctcagaga

SEQ ID NO: 588290 - DNA, 25 bp, Rattus norvegicus
tcctgctgctagatggtatctatca

SEQ ID NO: 588291 - DNA, 25 bp, Rattus norvegicus
tcctgctgctagttggtatctatca

SEQ ID NO: 588292 - DNA, 25 bp, Rattus norvegicus
tcctgctgggatacagatcagttct

SEQ ID NO: 588293 - DNA, 25 bp, Rattus norvegicus
tcctgctgggattcagatcagttct

SEQ ID NO: 588294 - DNA, 25 bp, Rattus norvegicus
tcctgctgtgcgaggacaaactgat

SEQ ID NO: 588295 - DNA, 25 bp, Rattus norvegicus
tcctgctgtgcgtggacaaactgat

SEQ ID NO: 588296 - DNA, 25 bp, Rattus norvegicus
tcctgctgttccaagtgggactaat

SEQ ID NO: 588297 - DNA, 25 bp, Rattus norvegicus
tcctgctgttcctagtgggactaat

SEQ ID NO: 588298 - DNA, 25 bp, Rattus norvegicus
tcctgcttatcccattcactaaaac

SEQ ID NO: 588299 - DNA, 25 bp, Rattus norvegicus
tcctgcttatccgattcactaaaac

SEQ ID NO: 588300 - DNA, 25 bp, Rattus norvegicus
tcctgcttcagtatgggttctgagt

SEQ ID NO: 588301 - DNA, 25 bp, Rattus norvegicus
tcctgcttcagtttgggttctgagt

SEQ ID NO: 588302 - DNA, 25 bp, Rattus norvegicus
tcctgcttccctatgtgagatgaga

SEQ ID NO: 588303 - DNA, 25 bp, Rattus norvegicus
tcctgcttccctttgtgagatgaga

SEQ ID NO: 588304 - DNA, 25 bp, Rattus norvegicus
tcctgcttcctgagtaagctctcgg

SEQ ID NO: 588305 - DNA, 25 bp, Rattus norvegicus
tcctgcttcctgtgtaagctctcgg

SEQ ID NO: 588306 - DNA, 25 bp, Rattus norvegicus
tcctgcttcggcactaatggcagca

SEQ ID NO: 588307 - DNA, 25 bp, Rattus norvegicus
tcctgcttcggctctaatggcagca

SEQ ID NO: 588308 - DNA, 25 bp, Rattus norvegicus
tcctgcttcgttcatttgtgccagc

SEQ ID NO: 588309 - DNA, 25 bp, Rattus norvegicus
tcctgcttcgttgatttgtgccagc

SEQ ID NO: 588310 - DNA, 25 bp, Rattus norvegicus
tcctgcttctacagtgaatactgag

SEQ ID NO: 588311 - DNA, 25 bp, Rattus norvegicus
tcctgcttctactgtgaatactgag

SEQ ID NO: 588312 - DNA, 25 bp, Rattus norvegicus
tcctgcttctgcctctaggaatgct

SEQ ID NO: 588313 - DNA, 25 bp, Rattus norvegicus
tcctgcttctgcgtctaggaatgct

SEQ ID NO: 588314 - DNA, 25 bp, Rattus norvegicus
tcctgcttgaatacttccctacgag

SEQ ID NO: 588315 - DNA, 25 bp, Rattus norvegicus
tcctgcttgaattcttccctacgag

SEQ ID NO: 588316 - DNA, 25 bp, Rattus norvegicus
tcctgcttgaccaaggtagtcacta

SEQ ID NO: 588317 - DNA, 25 bp, Rattus norvegicus
tcctgcttgacctaggtagtcacta

SEQ ID NO: 588318 - DNA, 25 bp, Rattus norvegicus
tcctgcttggacatcaaagcctttt

SEQ ID NO: 588319 - DNA, 25 bp, Rattus norvegicus
tcctgcttggacttcaaagcctttt

SEQ ID NO: 588320 - DNA, 25 bp, Rattus norvegicus
tcctgcttgtcaatggtcccatctc

SEQ ID NO: 588321 - DNA, 25 bp, Rattus norvegicus
tcctgcttgtcattggtcccatctc

SEQ ID NO: 588322 - DNA, 25 bp, Rattus norvegicus
tcctgctttcctcgttgtatcttga

SEQ ID NO: 588323 - DNA, 25 bp, Rattus norvegicus
tcctgctttcctggttgtatcttga

SEQ ID NO: 588324 - DNA, 25 bp, Rattus norvegicus
tcctgctttgaacgcacgcagtgtg

SEQ ID NO: 588325 - DNA, 25 bp, Rattus norvegicus
tcctgctttgaaggcacgcagtgtg

SEQ ID NO: 588326 - DNA, 25 bp, Rattus norvegicus
tcctggaaacccaaccggcagaaat

SEQ ID NO: 588327 - DNA, 25 bp, Rattus norvegicus
tcctggaaaccctaccggcagaaat

SEQ ID NO: 588328 - DNA, 25 bp, Rattus norvegicus
tcctggaagaggatgcccacttgaa

SEQ ID NO: 588329 - DNA, 25 bp, Rattus norvegicus
tcctggaagaggttgcccacttgaa

SEQ ID NO: 588330 - DNA, 25 bp, Rattus norvegicus
tcctggaagccgcttggaatgtctt

SEQ ID NO: 588331 - DNA, 25 bp, Rattus norvegicus
tcctggaagccggttggaatgtctt

SEQ ID NO: 588332 - DNA, 25 bp, Rattus norvegicus
tcctggaattcaacagtgtggcggt

SEQ ID NO: 588333 - DNA, 25 bp, Rattus norvegicus
tcctggaattcactcaggcttggca

SEQ ID NO: 588334 - DNA, 25 bp, Rattus norvegicus
tcctggaattcagtcaggcttggca

SEQ ID NO: 588335 - DNA, 25 bp, Rattus norvegicus
tcctggaattcatcagtgtggcggt

SEQ ID NO: 588336 - DNA, 25 bp, Rattus norvegicus
tcctggaattccactaactgacaat

SEQ ID NO: 588337 - DNA, 25 bp, Rattus norvegicus
tcctggaattcctctaactgacaat

SEQ ID NO: 588338 - DNA, 25 bp, Rattus norvegicus
tcctggacaaggatgacctggccct

SEQ ID NO: 588339 - DNA, 25 bp, Rattus norvegicus
tcctggacaaggttgacctggccct

SEQ ID NO: 588340 - DNA, 25 bp, Rattus norvegicus
tcctggacactgatggctgtctggt

SEQ ID NO: 588341 - DNA, 25 bp, Rattus norvegicus
tcctggacactgttggctgtctggt

SEQ ID NO: 588342 - DNA, 25 bp, Rattus norvegicus
tcctggacagctccgaactcgggta

SEQ ID NO: 588343 - DNA, 25 bp, Rattus norvegicus
tcctggacagctgcgaactcgggta

SEQ ID NO: 588344 - DNA, 25 bp, Rattus norvegicus
tcctggacccgcaaggaggaaatca

SEQ ID NO: 588345 - DNA, 25 bp, Rattus norvegicus
tcctggacccgctaggaggaaatca

SEQ ID NO: 588346 - DNA, 25 bp, Rattus norvegicus
tcctggaccgatccagttctatcct

SEQ ID NO: 588347 - DNA, 25 bp, Rattus norvegicus
tcctggaccgatgcagttctatcct

SEQ ID NO: 588348 - DNA, 25 bp, Rattus norvegicus
tcctggacctagaacctgcattttt

SEQ ID NO: 588349 - DNA, 25 bp, Rattus norvegicus
tcctggacctagtacctgcattttt

SEQ ID NO: 588350 - DNA, 25 bp, Rattus norvegicus
tcctggacctcacatgtctttttaa

SEQ ID NO: 588351 - DNA, 25 bp, Rattus norvegicus
tcctggacctcagatgtctttttaa

SEQ ID NO: 588352 - DNA, 25 bp, Rattus norvegicus
tcctggacctgcagctggcgctgga

SEQ ID NO: 588353 - DNA, 25 bp, Rattus norvegicus
tcctggacctgctgctggcgctgga

SEQ ID NO: 588354 - DNA, 25 bp, Rattus norvegicus
tcctggacggaaccttggctggcac

SEQ ID NO: 588355 - DNA, 25 bp, Rattus norvegicus
tcctggacggaagcttggctggcac

SEQ ID NO: 588356 - DNA, 25 bp, Rattus norvegicus
tcctggactctaatcatcaatgctc

SEQ ID NO: 588357 - DNA, 25 bp, Rattus norvegicus
tcctggactctattcatcaatgctc

SEQ ID NO: 588358 - DNA, 25 bp, Rattus norvegicus
tcctggactgtgagcagaacacttt

SEQ ID NO: 588359 - DNA, 25 bp, Rattus norvegicus
tcctggactgtgtgcagaacacttt

SEQ ID NO: 588360 - DNA, 25 bp, Rattus norvegicus
tcctggagaagtctgcatttgtaca

SEQ ID NO: 588361 - DNA, 25 bp, Rattus norvegicus
tcctggagaagtgtgcatttgtaca

SEQ ID NO: 588362 - DNA, 25 bp, Rattus norvegicus
tcctggagacagctcgctgacaaag

SEQ ID NO: 588363 - DNA, 25 bp, Rattus norvegicus
tcctggagacaggtcgctgacaaag

SEQ ID NO: 588364 - DNA, 25 bp, Rattus norvegicus
tcctggagacctacctgttgacagt

SEQ ID NO: 588365 - DNA, 25 bp, Rattus norvegicus
tcctggagaccttcctgttgacagt

SEQ ID NO: 588366 - DNA, 25 bp, Rattus norvegicus
tcctggagaggcactaagtccctag

SEQ ID NO: 588367 - DNA, 25 bp, Rattus norvegicus
tcctggagaggctctaagtccctag

SEQ ID NO: 588368 - DNA, 25 bp, Rattus norvegicus
tcctggagcctcattggtaaatgtg

SEQ ID NO: 588369 - DNA, 25 bp, Rattus norvegicus
tcctggagcctctttggtaaatgtg

SEQ ID NO: 588370 - DNA, 25 bp, Rattus norvegicus
tcctggagctgtcggtttctgagaa

SEQ ID NO: 588371 - DNA, 25 bp, Rattus norvegicus
tcctggagctgtgggtttctgagaa

SEQ ID NO: 588372 - DNA, 25 bp, Rattus norvegicus
tcctggaggaagcagcataggctct

SEQ ID NO: 588373 - DNA, 25 bp, Rattus norvegicus
tcctggaggaaggagcataggctct

SEQ ID NO: 588374 - DNA, 25 bp, Rattus norvegicus
tcctggaggacaccctgatgcggat

SEQ ID NO: 588375 - DNA, 25 bp, Rattus norvegicus
tcctggaggacagcctgatgcggat

SEQ ID NO: 588376 - DNA, 25 bp, Rattus norvegicus
tcctggaggctcatgggacagccat

SEQ ID NO: 588377 - DNA, 25 bp, Rattus norvegicus
tcctggaggctcttgggacagccat

SEQ ID NO: 588378 - DNA, 25 bp, Rattus norvegicus
tcctggaggctgaaggctttcctgc

SEQ ID NO: 588379 - DNA, 25 bp, Rattus norvegicus
tcctggaggctgtaggctttcctgc

SEQ ID NO: 588380 - DNA, 25 bp, Rattus norvegicus
tcctggaggcttagggaccttcctg

SEQ ID NO: 588381 - DNA, 25 bp, Rattus norvegicus
tcctggaggctttgggaccttcctg

SEQ ID NO: 588382 - DNA, 25 bp, Rattus norvegicus
tcctggagtccccaaaatcctcggg

SEQ ID NO: 588383 - DNA, 25 bp, Rattus norvegicus
tcctggagtcccgaaaatcctcggg

SEQ ID NO: 588384 - DNA, 25 bp, Rattus norvegicus
tcctggagtctcataagtggtcact

SEQ ID NO: 588385 - DNA, 25 bp, Rattus norvegicus
tcctggagtctcttaagtggtcact

SEQ ID NO: 588386 - DNA, 25 bp, Rattus norvegicus
tcctggagtggaagcacgtgctgca

SEQ ID NO: 588387 - DNA, 25 bp, Rattus norvegicus
tcctggagtggatgcacgtgctgca

SEQ ID NO: 588388 - DNA, 25 bp, Rattus norvegicus
tcctggagttagacgtgtggtcacc

SEQ ID NO: 588389 - DNA, 25 bp, Rattus norvegicus
tcctggagttagtcgtgtggtcacc

SEQ ID NO: 588390 - DNA, 25 bp, Rattus norvegicus
tcctggatccgactgctgtatgact

SEQ ID NO: 588391 - DNA, 25 bp, Rattus norvegicus
tcctggatccgagtgctgtatgact

SEQ ID NO: 588392 - DNA, 25 bp, Rattus norvegicus
tcctggatccttccatcacactggg

SEQ ID NO: 588393 - DNA, 25 bp, Rattus norvegicus
tcctggatccttgcatcacactggg

SEQ ID NO: 588394 - DNA, 25 bp, Rattus norvegicus
tcctggatgacgagtccctgacaca

SEQ ID NO: 588395 - DNA, 25 bp, Rattus norvegicus
tcctggatgacgtgtccctgacaca

SEQ ID NO: 588396 - DNA, 25 bp, Rattus norvegicus
tcctggatgcagattgattggttaa

SEQ ID NO: 588397 - DNA, 25 bp, Rattus norvegicus
tcctggatgcagtttgattggttaa

SEQ ID NO: 588398 - DNA, 25 bp, Rattus norvegicus
tcctggatgcccatgcttttaaata

SEQ ID NO: 588399 - DNA, 25 bp, Rattus norvegicus
tcctggatgcccttgcttttaaata

SEQ ID NO: 588400 - DNA, 25 bp, Rattus norvegicus
tcctggatggacattggttgctgca

SEQ ID NO: 588401 - DNA, 25 bp, Rattus norvegicus
tcctggatggactttggttgctgca

SEQ ID NO: 588402 - DNA, 25 bp, Rattus norvegicus
tcctggatgttcaggaccttgttat

SEQ ID NO: 588403 - DNA, 25 bp, Rattus norvegicus
tcctggatgttctggaccttgttat

SEQ ID NO: 588404 - DNA, 25 bp, Rattus norvegicus
tcctggattccaattactgtttgat

SEQ ID NO: 588405 - DNA, 25 bp, Rattus norvegicus
tcctggattccatttactgtttgat

SEQ ID NO: 588406 - DNA, 25 bp, Rattus norvegicus
tcctggattgcacacctttctcttt

SEQ ID NO: 588407 - DNA, 25 bp, Rattus norvegicus
tcctggattgcagacctttctcttt

SEQ ID NO: 588408 - DNA, 25 bp, Rattus norvegicus
tcctggattttgaaagcagcccctc

SEQ ID NO: 588409 - DNA, 25 bp, Rattus norvegicus
tcctggattttgtaagcagcccctc

SEQ ID NO: 588410 - DNA, 25 bp, Rattus norvegicus
tcctggatttttacctgccctgtgg

SEQ ID NO: 588411 - DNA, 25 bp, Rattus norvegicus
tcctggattttttcctgccctgtgg

SEQ ID NO: 588412 - DNA, 25 bp, Rattus norvegicus
tcctggcacataactgtctccttaa

SEQ ID NO: 588413 - DNA, 25 bp, Rattus norvegicus
tcctggcacatatctgtctccttaa

SEQ ID NO: 588414 - DNA, 25 bp, Rattus norvegicus
tcctggcaccagaaataaacgaatt

SEQ ID NO: 588415 - DNA, 25 bp, Rattus norvegicus
tcctggcaccagtaataaacgaatt

SEQ ID NO: 588416 - DNA, 25 bp, Rattus norvegicus
tcctggcaccatccatgtggttcaa

SEQ ID NO: 588417 - DNA, 25 bp, Rattus norvegicus
tcctggcaccatgcatgtggttcaa

SEQ ID NO: 588418 - DNA, 25 bp, Rattus norvegicus
tcctggcagagtcccttggacaaga

SEQ ID NO: 588419 - DNA, 25 bp, Rattus norvegicus
tcctggcagagtgccttggacaaga

SEQ ID NO: 588420 - DNA, 25 bp, Rattus norvegicus
tcctggcagcgtacgattgtattga

SEQ ID NO: 588421 - DNA, 25 bp, Rattus norvegicus
tcctggcagcgttcgattgtattga

SEQ ID NO: 588422 - DNA, 25 bp, Rattus norvegicus
tcctggcaggccagcagaagggcta

SEQ ID NO: 588423 - DNA, 25 bp, Rattus norvegicus
tcctggcaggcctgcagaagggcta

SEQ ID NO: 588424 - DNA, 25 bp, Rattus norvegicus
tcctggcagtcgaagagtcgcgtga

SEQ ID NO: 588425 - DNA, 25 bp, Rattus norvegicus
tcctggcagtcgtagagtcgcgtga

SEQ ID NO: 588426 - DNA, 25 bp, Rattus norvegicus
tcctggcatcacatttatacatcct

SEQ ID NO: 588427 - DNA, 25 bp, Rattus norvegicus
tcctggcatcacttttatacatcct

SEQ ID NO: 588428 - DNA, 25 bp, Rattus norvegicus
tcctggcatcagcaatctcaagttt

SEQ ID NO: 588429 - DNA, 25 bp, Rattus norvegicus
tcctggcatcaggaatctcaagttt

SEQ ID NO: 588430 - DNA, 25 bp, Rattus norvegicus
tcctggcatcttctccatggcaaat

SEQ ID NO: 588431 - DNA, 25 bp, Rattus norvegicus
tcctggcatcttgtccatggcaaat

SEQ ID NO: 588432 - DNA, 25 bp, Rattus norvegicus
tcctggcatgctctccggtgtaaat

SEQ ID NO: 588433 - DNA, 25 bp, Rattus norvegicus
tcctggcatgctgtccggtgtaaat

SEQ ID NO: 588434 - DNA, 25 bp, Rattus norvegicus
tcctggcattgcagagatcctgtta

SEQ ID NO: 588435 - DNA, 25 bp, Rattus norvegicus
tcctggcattgctgagatcctgtta

SEQ ID NO: 588436 - DNA, 25 bp, Rattus norvegicus
tcctggccactaccaagcagaggat

SEQ ID NO: 588437 - DNA, 25 bp, Rattus norvegicus
tcctggccactagcaagcagaggat

SEQ ID NO: 588438 - DNA, 25 bp, Rattus norvegicus
tcctggccagccagagcagcggtgc

SEQ ID NO: 588439 - DNA, 25 bp, Rattus norvegicus
tcctggccagcctgagcagcggtgc

SEQ ID NO: 588440 - DNA, 25 bp, Rattus norvegicus
tcctggccaggtattctgcttggga

SEQ ID NO: 588441 - DNA, 25 bp, Rattus norvegicus
tcctggccaggttttctgcttggga

SEQ ID NO: 588442 - DNA, 25 bp, Rattus norvegicus
tcctggccatggaggctgctgttca

SEQ ID NO: 588443 - DNA, 25 bp, Rattus norvegicus
tcctggccatggtggctgctgttca

SEQ ID NO: 588444 - DNA, 25 bp, Rattus norvegicus
tcctggcccaccatagctgggaaga

SEQ ID NO: 588445 - DNA, 25 bp, Rattus norvegicus
tcctggcccaccttagctgggaaga

SEQ ID NO: 588446 - DNA, 25 bp, Rattus norvegicus
tcctggcccggcatttagacaataa

SEQ ID NO: 588447 - DNA, 25 bp, Rattus norvegicus
tcctggcccggcttttagacaataa

SEQ ID NO: 588448 - DNA, 25 bp, Rattus norvegicus
tcctggccgatgacttcgacgtgaa

SEQ ID NO: 588449 - DNA, 25 bp, Rattus norvegicus
tcctggccgatgtcttcgacgtgaa

SEQ ID NO: 588450 - DNA, 25 bp, Rattus norvegicus
tcctggccgccgattacagacatct

SEQ ID NO: 588451 - DNA, 25 bp, Rattus norvegicus
tcctggccgccgtttacagacatct

SEQ ID NO: 588452 - DNA, 25 bp, Rattus norvegicus
tcctggcctgctatgtagcatccat

SEQ ID NO: 588453 - DNA, 25 bp, Rattus norvegicus
tcctggcctgctttgtagcatccat

SEQ ID NO: 588454 - DNA, 25 bp, Rattus norvegicus
tcctggccttaacgaacgaaacttg

SEQ ID NO: 588455 - DNA, 25 bp, Rattus norvegicus
tcctggccttaaggaacgaaacttg

SEQ ID NO: 588456 - DNA, 25 bp, Rattus norvegicus
tcctggccttggattacaatgttgt

SEQ ID NO: 588457 - DNA, 25 bp, Rattus norvegicus
tcctggccttggtttacaatgttgt

SEQ ID NO: 588458 - DNA, 25 bp, Rattus norvegicus
tcctggcgggcgcactgcattgaca

SEQ ID NO: 588459 - DNA, 25 bp, Rattus norvegicus
tcctggcgggcggactgcattgaca

SEQ ID NO: 588460 - DNA, 25 bp, Rattus norvegicus
tcctggcggtagaggtcagcagact

SEQ ID NO: 588461 - DNA, 25 bp, Rattus norvegicus
tcctggcggtagtggtcagcagact

SEQ ID NO: 588462 - DNA, 25 bp, Rattus norvegicus
tcctggcggttaaccacgtgtttga

SEQ ID NO: 588463 - DNA, 25 bp, Rattus norvegicus
tcctggcggttatccacgtgtttga

SEQ ID NO: 588464 - DNA, 25 bp, Rattus norvegicus
tcctggcgtagaccgtttgctagct

SEQ ID NO: 588465 - DNA, 25 bp, Rattus norvegicus
tcctggcgtagagcgtttgctagct

SEQ ID NO: 588466 - DNA, 25 bp, Rattus norvegicus
tcctggcgtttcagcgcagagtcaa

SEQ ID NO: 588467 - DNA, 25 bp, Rattus norvegicus
tcctggcgtttctgcgcagagtcaa

SEQ ID NO: 588468 - DNA, 25 bp, Rattus norvegicus
tcctggctaacacagctgcgggtgc

SEQ ID NO: 588469 - DNA, 25 bp, Rattus norvegicus
tcctggctaacagagctgcgggtgc

SEQ ID NO: 588470 - DNA, 25 bp, Rattus norvegicus
tcctggctaggactggctggaccat

SEQ ID NO: 588471 - DNA, 25 bp, Rattus norvegicus
tcctggctaggagtggctggaccat

SEQ ID NO: 588472 - DNA, 25 bp, Rattus norvegicus
tcctggctcccacgtcacaggttgg

SEQ ID NO: 588473 - DNA, 25 bp, Rattus norvegicus
tcctggctcccaggtcacaggttgg

SEQ ID NO: 588474 - DNA, 25 bp, Rattus norvegicus
tcctggctcggcataaaggctcaaa

SEQ ID NO: 588475 - DNA, 25 bp, Rattus norvegicus
tcctggctcggcttaaaggctcaaa

SEQ ID NO: 588476 - DNA, 25 bp, Rattus norvegicus
tcctggctcttaatggctcatatga

SEQ ID NO: 588477 - DNA, 25 bp, Rattus norvegicus
tcctggctcttattggctcatatga

SEQ ID NO: 588478 - DNA, 25 bp, Rattus norvegicus
tcctggctgaggatctccttgtata

SEQ ID NO: 588479 - DNA, 25 bp, Rattus norvegicus
tcctggctgaggttctccttgtata

SEQ ID NO: 588480 - DNA, 25 bp, Rattus norvegicus
tcctggctgctcagtcattgaggga

SEQ ID NO: 588481 - DNA, 25 bp, Rattus norvegicus
tcctggctgctctgtcattgaggga

SEQ ID NO: 588482 - DNA, 25 bp, Rattus norvegicus
tcctggctgcttagatacaacatgg

SEQ ID NO: 588483 - DNA, 25 bp, Rattus norvegicus
tcctggctgcttagtctcacctgag

SEQ ID NO: 588484 - DNA, 25 bp, Rattus norvegicus
tcctggctgctttgatacaacatgg

SEQ ID NO: 588485 - DNA, 25 bp, Rattus norvegicus
tcctggctgctttgtctcacctgag

SEQ ID NO: 588486 - DNA, 25 bp, Rattus norvegicus
tcctggctggcaatttaagcactaa

SEQ ID NO: 588487 - DNA, 25 bp, Rattus norvegicus
tcctggctggcattttaagcactaa

SEQ ID NO: 588488 - DNA, 25 bp, Rattus norvegicus
tcctggctggcccactttggtatgg

SEQ ID NO: 588489 - DNA, 25 bp, Rattus norvegicus
tcctggctggccgactttggtatgg

SEQ ID NO: 588490 - DNA, 25 bp, Rattus norvegicus
tcctggctggctatgacgagcatga

SEQ ID NO: 588491 - DNA, 25 bp, Rattus norvegicus
tcctggctggctttgacgagcatga

SEQ ID NO: 588492 - DNA, 25 bp, Rattus norvegicus
tcctggctgggactttggcttgata

SEQ ID NO: 588493 - DNA, 25 bp, Rattus norvegicus
tcctggctgggagtttggcttgata

SEQ ID NO: 588494 - DNA, 25 bp, Rattus norvegicus
tcctggctgtttctatcatttccta

SEQ ID NO: 588495 - DNA, 25 bp, Rattus norvegicus
tcctggctgtttgtatcatttccta

SEQ ID NO: 588496 - DNA, 25 bp, Rattus norvegicus
tcctggcttaaaaacatgctctctt

SEQ ID NO: 588497 - DNA, 25 bp, Rattus norvegicus
tcctggcttaaatacatgctctctt

SEQ ID NO: 588498 - DNA, 25 bp, Rattus norvegicus
tcctggcttgagctcttagctgtat

SEQ ID NO: 588499 - DNA, 25 bp, Rattus norvegicus
tcctggcttgaggtcttagctgtat

SEQ ID NO: 588500 - DNA, 25 bp, Rattus norvegicus
tcctggcttggaactattttgcaca

SEQ ID NO: 588501 - DNA, 25 bp, Rattus norvegicus
tcctggcttggatctattttgcaca

SEQ ID NO: 588502 - DNA, 25 bp, Rattus norvegicus
tcctggctttcaacacttgtatcta

SEQ ID NO: 588503 - DNA, 25 bp, Rattus norvegicus
tcctggctttcatcacttgtatcta

SEQ ID NO: 588504 - DNA, 25 bp, Rattus norvegicus
tcctggctttctctacaaggtggaa

SEQ ID NO: 588505 - DNA, 25 bp, Rattus norvegicus
tcctggctttctgtacaaggtggaa

SEQ ID NO: 588506 - DNA, 25 bp, Rattus norvegicus
tcctggctttgtctgggcactttac

SEQ ID NO: 588507 - DNA, 25 bp, Rattus norvegicus
tcctggctttgtgtgggcactttac

SEQ ID NO: 588508 - DNA, 25 bp, Rattus norvegicus
tcctgggaagcacacatttacattt

SEQ ID NO: 588509 - DNA, 25 bp, Rattus norvegicus
tcctgggaagcagacatttacattt

SEQ ID NO: 588510 - DNA, 25 bp, Rattus norvegicus
tcctgggacacacagtcttcaagca

SEQ ID NO: 588511 - DNA, 25 bp, Rattus norvegicus
tcctgggacacagagtcttcaagca

SEQ ID NO: 588512 - DNA, 25 bp, Rattus norvegicus
tcctgggaccacacctggagatgaa

SEQ ID NO: 588513 - DNA, 25 bp, Rattus norvegicus
tcctgggaccactcctggagatgaa

SEQ ID NO: 588514 - DNA, 25 bp, Rattus norvegicus
tcctgggacccaaaagtcatctggt

SEQ ID NO: 588515 - DNA, 25 bp, Rattus norvegicus
tcctgggacccataagtcatctggt

SEQ ID NO: 588516 - DNA, 25 bp, Rattus norvegicus
tcctgggaccttatgcagatgtgct

SEQ ID NO: 588517 - DNA, 25 bp, Rattus norvegicus
tcctgggaccttttgcagatgtgct

SEQ ID NO: 588518 - DNA, 25 bp, Rattus norvegicus
tcctgggactatagctcacttcgaa

SEQ ID NO: 588519 - DNA, 25 bp, Rattus norvegicus
tcctgggactattgctcacttcgaa

SEQ ID NO: 588520 - DNA, 25 bp, Rattus norvegicus
tcctgggactcccattctgactggg

SEQ ID NO: 588521 - DNA, 25 bp, Rattus norvegicus
tcctgggactccgattctgactggg

SEQ ID NO: 588522 - DNA, 25 bp, Rattus norvegicus
tcctgggagatgaaaggcagccttt

SEQ ID NO: 588523 - DNA, 25 bp, Rattus norvegicus
tcctgggagatgtaaggcagccttt

SEQ ID NO: 588524 - DNA, 25 bp, Rattus norvegicus
tcctgggagcacacagcacagctgg

SEQ ID NO: 588525 - DNA, 25 bp, Rattus norvegicus
tcctgggagcactcagcacagctgg

SEQ ID NO: 588526 - DNA, 25 bp, Rattus norvegicus
tcctgggagccgctgtatcaataaa

SEQ ID NO: 588527 - DNA, 25 bp, Rattus norvegicus
tcctgggagccggtgtatcaataaa

SEQ ID NO: 588528 - DNA, 25 bp, Rattus norvegicus
tcctgggaggtcatatctacattct

SEQ ID NO: 588529 - DNA, 25 bp, Rattus norvegicus
tcctgggaggtcttatctacattct

SEQ ID NO: 588530 - DNA, 25 bp, Rattus norvegicus
tcctgggatgaacctctttggagaa

SEQ ID NO: 588531 - DNA, 25 bp, Rattus norvegicus
tcctgggatgaagctctttggagaa

SEQ ID NO: 588532 - DNA, 25 bp, Rattus norvegicus
tcctgggatggactaaacggtttat

SEQ ID NO: 588533 - DNA, 25 bp, Rattus norvegicus
tcctgggatggagtaaacggtttat

SEQ ID NO: 588534 - DNA, 25 bp, Rattus norvegicus
tcctgggcagatctttggcaatgtt

SEQ ID NO: 588535 - DNA, 25 bp, Rattus norvegicus
tcctgggcagatgtttggcaatgtt

SEQ ID NO: 588536 - DNA, 25 bp, Rattus norvegicus
tcctgggcagcaccagtgatttctg

SEQ ID NO: 588537 - DNA, 25 bp, Rattus norvegicus
tcctgggcagcagcagtgatttctg

SEQ ID NO: 588538 - DNA, 25 bp, Rattus norvegicus
tcctgggcagtgctgacccgatctt

SEQ ID NO: 588539 - DNA, 25 bp, Rattus norvegicus
tcctgggcagtggtgacccgatctt

SEQ ID NO: 588540 - DNA, 25 bp, Rattus norvegicus
tcctgggcatcgctgaggtcaccga

SEQ ID NO: 588541 - DNA, 25 bp, Rattus norvegicus
tcctgggcatcggtgaggtcaccga

SEQ ID NO: 588542 - DNA, 25 bp, Rattus norvegicus
tcctgggccacacagcatgggaagt

SEQ ID NO: 588543 - DNA, 25 bp, Rattus norvegicus
tcctgggccacagagcatgggaagt

SEQ ID NO: 588544 - DNA, 25 bp, Rattus norvegicus
tcctgggccagacgtcacataatat

SEQ ID NO: 588545 - DNA, 25 bp, Rattus norvegicus
tcctgggccagaggtcacataatat

SEQ ID NO: 588546 - DNA, 25 bp, Rattus norvegicus
tcctgggccttgaggaccaagtgct

SEQ ID NO: 588547 - DNA, 25 bp, Rattus norvegicus
tcctgggccttgtggaccaagtgct

SEQ ID NO: 588548 - DNA, 25 bp, Rattus norvegicus
tcctgggcgagaatgtcctctttaa

SEQ ID NO: 588549 - DNA, 25 bp, Rattus norvegicus
tcctgggcgagattgtcctctttaa

SEQ ID NO: 588550 - DNA, 25 bp, Rattus norvegicus
tcctgggctcagagtctagccagag

SEQ ID NO: 588551 - DNA, 25 bp, Rattus norvegicus
tcctgggctcagtgtctagccagag

SEQ ID NO: 588552 - DNA, 25 bp, Rattus norvegicus
tcctgggctcccattaggcgcacgg

SEQ ID NO: 588553 - DNA, 25 bp, Rattus norvegicus
tcctgggctccctttaggcgcacgg

SEQ ID NO: 588554 - DNA, 25 bp, Rattus norvegicus
tcctgggctgacattccaggctgag

SEQ ID NO: 588555 - DNA, 25 bp, Rattus norvegicus
tcctgggctgactttccaggctgag

SEQ ID NO: 588556 - DNA, 25 bp, Rattus norvegicus
tcctgggcttcgagacacatggaga

SEQ ID NO: 588557 - DNA, 25 bp, Rattus norvegicus
tcctgggcttcgtgacacatggaga

SEQ ID NO: 588558 - DNA, 25 bp, Rattus norvegicus
tcctgggtagagctgcttcagccaa

SEQ ID NO: 588559 - DNA, 25 bp, Rattus norvegicus
tcctgggtagaggtgcttcagccaa

SEQ ID NO: 588560 - DNA, 25 bp, Rattus norvegicus
tcctgggtagccatggctccagaga

SEQ ID NO: 588561 - DNA, 25 bp, Rattus norvegicus
tcctgggtagccttggctccagaga

SEQ ID NO: 588562 - DNA, 25 bp, Rattus norvegicus
tcctgggtccacacagtgtctgaga

SEQ ID NO: 588563 - DNA, 25 bp, Rattus norvegicus
tcctgggtccactcagtgtctgaga

SEQ ID NO: 588564 - DNA, 25 bp, Rattus norvegicus
tcctgggtccctagtgaggacattt

SEQ ID NO: 588565 - DNA, 25 bp, Rattus norvegicus
tcctgggtcccttgtgaggacattt

SEQ ID NO: 588566 - DNA, 25 bp, Rattus norvegicus
tcctgggtcctgctgactgaaatca

SEQ ID NO: 588567 - DNA, 25 bp, Rattus norvegicus
tcctgggtcctggtgactgaaatca

SEQ ID NO: 588568 - DNA, 25 bp, Rattus norvegicus
tcctgggtgaccattgtgtagtaaa

SEQ ID NO: 588569 - DNA, 25 bp, Rattus norvegicus
tcctgggtgacctttgtgtagtaaa

SEQ ID NO: 588570 - DNA, 25 bp, Rattus norvegicus
tcctgggtgaggcaccttgagtgca

SEQ ID NO: 588571 - DNA, 25 bp, Rattus norvegicus
tcctgggtgagggaccttgagtgca

SEQ ID NO: 588572 - DNA, 25 bp, Rattus norvegicus
tcctgggtgagtacttccacaactt

SEQ ID NO: 588573 - DNA, 25 bp, Rattus norvegicus
tcctgggtgagttcttccacaactt

SEQ ID NO: 588574 - DNA, 25 bp, Rattus norvegicus
tcctgggtgcttccaatgcagaaca

SEQ ID NO: 588575 - DNA, 25 bp, Rattus norvegicus
tcctgggtgcttgcaatgcagaaca

SEQ ID NO: 588576 - DNA, 25 bp, Rattus norvegicus
tcctgggtggaacacagctggccat

SEQ ID NO: 588577 - DNA, 25 bp, Rattus norvegicus
tcctgggtggaagacagctggccat

SEQ ID NO: 588578 - DNA, 25 bp, Rattus norvegicus
tcctgggttccacacttacagatgg

SEQ ID NO: 588579 - DNA, 25 bp, Rattus norvegicus
tcctgggttccagacttacagatgg

SEQ ID NO: 588580 - DNA, 25 bp, Rattus norvegicus
tcctgggttgagcagcttcttcgag

SEQ ID NO: 588581 - DNA, 25 bp, Rattus norvegicus
tcctgggttgaggagcttcttcgag

SEQ ID NO: 588582 - DNA, 25 bp, Rattus norvegicus
tcctgggttgtaacagtgatggctg

SEQ ID NO: 588583 - DNA, 25 bp, Rattus norvegicus
tcctgggttgtatcagtgatggctg

SEQ ID NO: 588584 - DNA, 25 bp, Rattus norvegicus
tcctgggttgttatgcacatgcaca

SEQ ID NO: 588585 - DNA, 25 bp, Rattus norvegicus
tcctgggttgttttgcacatgcaca

SEQ ID NO: 588586 - DNA, 25 bp, Rattus norvegicus
tcctgggtttcgactatggctgcta

SEQ ID NO: 588587 - DNA, 25 bp, Rattus norvegicus
tcctgggtttcgtctatggctgcta

SEQ ID NO: 588588 - DNA, 25 bp, Rattus norvegicus
tcctggtactcacccggtagcctaa

SEQ ID NO: 588589 - DNA, 25 bp, Rattus norvegicus
tcctggtactcagccggtagcctaa

SEQ ID NO: 588590 - DNA, 25 bp, Rattus norvegicus
tcctggtagaggatcgtctcttctg

SEQ ID NO: 588591 - DNA, 25 bp, Rattus norvegicus
tcctggtagaggttcgtctcttctg

SEQ ID NO: 588592 - DNA, 25 bp, Rattus norvegicus
tcctggtatcagatctcttgacatc

SEQ ID NO: 588593 - DNA, 25 bp, Rattus norvegicus
tcctggtatcagttctcttgacatc

SEQ ID NO: 588594 - DNA, 25 bp, Rattus norvegicus
tcctggtatgccaggagtttgtcca

SEQ ID NO: 588595 - DNA, 25 bp, Rattus norvegicus
tcctggtatgcctggagtttgtcca

SEQ ID NO: 588596 - DNA, 25 bp, Rattus norvegicus
tcctggtcaaccaccttagttagat

SEQ ID NO: 588597 - DNA, 25 bp, Rattus norvegicus
tcctggtcaacctccttagttagat

SEQ ID NO: 588598 - DNA, 25 bp, Rattus norvegicus
tcctggtcacttatggccacgatgg

SEQ ID NO: 588599 - DNA, 25 bp, Rattus norvegicus
tcctggtcacttcatgctgattaga

SEQ ID NO: 588600 - DNA, 25 bp, Rattus norvegicus
tcctggtcacttgatgctgattaga

SEQ ID NO: 588601 - DNA, 25 bp, Rattus norvegicus
tcctggtcacttttggccacgatgg

SEQ ID NO: 588602 - DNA, 25 bp, Rattus norvegicus
tcctggtccacacctgtcatggaat

SEQ ID NO: 588603 - DNA, 25 bp, Rattus norvegicus
tcctggtccacagctgtcatggaat

SEQ ID NO: 588604 - DNA, 25 bp, Rattus norvegicus
tcctggtccagccttgatcagaaaa

SEQ ID NO: 588605 - DNA, 25 bp, Rattus norvegicus
tcctggtccagcgttgatcagaaaa

SEQ ID NO: 588606 - DNA, 25 bp, Rattus norvegicus
tcctggtccagtacaaagctgcctt

SEQ ID NO: 588607 - DNA, 25 bp, Rattus norvegicus
tcctggtccagtcccgaatagacaa

SEQ ID NO: 588608 - DNA, 25 bp, Rattus norvegicus
tcctggtccagtgccgaatagacaa

SEQ ID NO: 588609 - DNA, 25 bp, Rattus norvegicus
tcctggtccagttcaaagctgcctt

SEQ ID NO: 588610 - DNA, 25 bp, Rattus norvegicus
tcctggtcccaacttgttctcaaca

SEQ ID NO: 588611 - DNA, 25 bp, Rattus norvegicus
tcctggtcccaagttgttctcaaca

SEQ ID NO: 588612 - DNA, 25 bp, Rattus norvegicus
tcctggtcccagatacgtttacaca

SEQ ID NO: 588613 - DNA, 25 bp, Rattus norvegicus
tcctggtcccagttacgtttacaca

SEQ ID NO: 588614 - DNA, 25 bp, Rattus norvegicus
tcctggtccgtaaaagatcctcttg

SEQ ID NO: 588615 - DNA, 25 bp, Rattus norvegicus
tcctggtccgtataagatcctcttg

SEQ ID NO: 588616 - DNA, 25 bp, Rattus norvegicus
tcctggtcctggacgtgattatagc

SEQ ID NO: 588617 - DNA, 25 bp, Rattus norvegicus
tcctggtcctggtcgtgattatagc

SEQ ID NO: 588618 - DNA, 25 bp, Rattus norvegicus
tcctggtctgccaggaacttcagga

SEQ ID NO: 588619 - DNA, 25 bp, Rattus norvegicus
tcctggtctgcctggaacttcagga

SEQ ID NO: 588620 - DNA, 25 bp, Rattus norvegicus
tcctggtgacccaggaagcctgggt

SEQ ID NO: 588621 - DNA, 25 bp, Rattus norvegicus
tcctggtgaccctggaagcctgggt

SEQ ID NO: 588622 - DNA, 25 bp, Rattus norvegicus
tcctggtgactcagattatatctag

SEQ ID NO: 588623 - DNA, 25 bp, Rattus norvegicus
tcctggtgactctgattatatctag

SEQ ID NO: 588624 - DNA, 25 bp, Rattus norvegicus
tcctggtgcctgctctgtaaactga

SEQ ID NO: 588625 - DNA, 25 bp, Rattus norvegicus
tcctggtgcctggtctgtaaactga

SEQ ID NO: 588626 - DNA, 25 bp, Rattus norvegicus
tcctggtggaggaaatctgagaact

SEQ ID NO: 588627 - DNA, 25 bp, Rattus norvegicus
tcctggtggaggtaatctgagaact

SEQ ID NO: 588628 - DNA, 25 bp, Rattus norvegicus
tcctggtggtgtaatcctgggtctc

SEQ ID NO: 588629 - DNA, 25 bp, Rattus norvegicus
tcctggtggtgttatcctgggtctc

SEQ ID NO: 588630 - DNA, 25 bp, Rattus norvegicus
tcctggtgtctcaatagcgtgatgt

SEQ ID NO: 588631 - DNA, 25 bp, Rattus norvegicus
tcctggtgtctctatagcgtgatgt

SEQ ID NO: 588632 - DNA, 25 bp, Rattus norvegicus
tcctggtgtgtgactagtgtggaca

SEQ ID NO: 588633 - DNA, 25 bp, Rattus norvegicus
tcctggtgtgtgtctagtgtggaca

SEQ ID NO: 588634 - DNA, 25 bp, Rattus norvegicus
tcctggttaaagactggccaccgga

SEQ ID NO: 588635 - DNA, 25 bp, Rattus norvegicus
tcctggttaaagtctggccaccgga

SEQ ID NO: 588636 - DNA, 25 bp, Rattus norvegicus
tcctggttccctcgcataatctgag

SEQ ID NO: 588637 - DNA, 25 bp, Rattus norvegicus
tcctggttccctggcataatctgag

SEQ ID NO: 588638 - DNA, 25 bp, Rattus norvegicus
tcctggttctggaccaaggtcaaag

SEQ ID NO: 588639 - DNA, 25 bp, Rattus norvegicus
tcctggttctggtccaaggtcaaag

SEQ ID NO: 588640 - DNA, 25 bp, Rattus norvegicus
tcctggttgagacacctcgagtgca

SEQ ID NO: 588641 - DNA, 25 bp, Rattus norvegicus
tcctggttgagagacctcgagtgca

SEQ ID NO: 588642 - DNA, 25 bp, Rattus norvegicus
tcctggttgcagaccgcagtgtaaa

SEQ ID NO: 588643 - DNA, 25 bp, Rattus norvegicus
tcctggttgcagtccgcagtgtaaa

SEQ ID NO: 588644 - DNA, 25 bp, Rattus norvegicus
tcctggttggaaccttaactctgaa

SEQ ID NO: 588645 - DNA, 25 bp, Rattus norvegicus
tcctggttggaagcttaactctgaa

SEQ ID NO: 588646 - DNA, 25 bp, Rattus norvegicus
tcctggttgtgcatctggtcatctt

SEQ ID NO: 588647 - DNA, 25 bp, Rattus norvegicus
tcctggttgtgcttctggtcatctt

SEQ ID NO: 588648 - DNA, 25 bp, Rattus norvegicus
tcctggtttgtgaaagcagaattgt

SEQ ID NO: 588649 - DNA, 25 bp, Rattus norvegicus
tcctggtttgtgtaagcagaattgt

SEQ ID NO: 588650 - DNA, 25 bp, Rattus norvegicus
tcctggttttacaacagttccctgt

SEQ ID NO: 588651 - DNA, 25 bp, Rattus norvegicus
tcctggttttactacagttccctgt

SEQ ID NO: 588652 - DNA, 25 bp, Rattus norvegicus
tcctggttttatattcctcatgata

SEQ ID NO: 588653 - DNA, 25 bp, Rattus norvegicus
tcctggttttattttcctcatgata

SEQ ID NO: 588654 - DNA, 25 bp, Rattus norvegicus
tcctggttttctctgagatgcggcc

SEQ ID NO: 588655 - DNA, 25 bp, Rattus norvegicus
tcctggttttctgtgagatgcggcc

SEQ ID NO: 588656 - DNA, 25 bp, Rattus norvegicus
tcctgtaaaatgcagctggccacat

SEQ ID NO: 588657 - DNA, 25 bp, Rattus norvegicus
tcctgtaaaatggagctggccacat

SEQ ID NO: 588658 - DNA, 25 bp, Rattus norvegicus
tcctgtaatttgcagtcgggattta

SEQ ID NO: 588659 - DNA, 25 bp, Rattus norvegicus
tcctgtaatttggagtcgggattta

SEQ ID NO: 588660 - DNA, 25 bp, Rattus norvegicus
tcctgtacaaataatttaccctgaa

SEQ ID NO: 588661 - DNA, 25 bp, Rattus norvegicus
tcctgtacaaattatttaccctgaa

SEQ ID NO: 588662 - DNA, 25 bp, Rattus norvegicus
tcctgtacactccacagcagctaag

SEQ ID NO: 588663 - DNA, 25 bp, Rattus norvegicus
tcctgtacactcgacagcagctaag

SEQ ID NO: 588664 - DNA, 25 bp, Rattus norvegicus
tcctgtaccttgctttgggacaatg

SEQ ID NO: 588665 - DNA, 25 bp, Rattus norvegicus
tcctgtaccttggtttgggacaatg

SEQ ID NO: 588666 - DNA, 25 bp, Rattus norvegicus
tcctgtactctgctgctgacttcgt

SEQ ID NO: 588667 - DNA, 25 bp, Rattus norvegicus
tcctgtactctggtgctgacttcgt

SEQ ID NO: 588668 - DNA, 25 bp, Rattus norvegicus
tcctgtagagtcctgttcaccattt

SEQ ID NO: 588669 - DNA, 25 bp, Rattus norvegicus
tcctgtagagtcgtgttcaccattt

SEQ ID NO: 588670 - DNA, 25 bp, Rattus norvegicus
tcctgtagcagtctcggtatgttga

SEQ ID NO: 588671 - DNA, 25 bp, Rattus norvegicus
tcctgtagcagtgtcggtatgttga

SEQ ID NO: 588672 - DNA, 25 bp, Rattus norvegicus
tcctgtagctaccttaacttctcac

SEQ ID NO: 588673 - DNA, 25 bp, Rattus norvegicus
tcctgtagctacgttaacttctcac

SEQ ID NO: 588674 - DNA, 25 bp, Rattus norvegicus
tcctgtaggtaaacccgatccgtgc

SEQ ID NO: 588675 - DNA, 25 bp, Rattus norvegicus
tcctgtaggtaatcccgatccgtgc

SEQ ID NO: 588676 - DNA, 25 bp, Rattus norvegicus
tcctgtaggtatcaaatgtctggtg

SEQ ID NO: 588677 - DNA, 25 bp, Rattus norvegicus
tcctgtaggtatgaaatgtctggtg

SEQ ID NO: 588678 - DNA, 25 bp, Rattus norvegicus
tcctgtagtgttctaactgctgtaa

SEQ ID NO: 588679 - DNA, 25 bp, Rattus norvegicus
tcctgtagtgttgtaactgctgtaa

SEQ ID NO: 588680 - DNA, 25 bp, Rattus norvegicus
tcctgtatcaggctatttcagttta

SEQ ID NO: 588681 - DNA, 25 bp, Rattus norvegicus
tcctgtatcagggtatttcagttta

SEQ ID NO: 588682 - DNA, 25 bp, Rattus norvegicus
tcctgtatctgcagtggtggcttca

SEQ ID NO: 588683 - DNA, 25 bp, Rattus norvegicus
tcctgtatctgctgtggtggcttca

SEQ ID NO: 588684 - DNA, 25 bp, Rattus norvegicus
tcctgtatgagaccaacaagccact

SEQ ID NO: 588685 - DNA, 25 bp, Rattus norvegicus
tcctgtatgagagcaacaagccact

SEQ ID NO: 588686 - DNA, 25 bp, Rattus norvegicus
tcctgtattcttctttgagtccttc

SEQ ID NO: 588687 - DNA, 25 bp, Rattus norvegicus
tcctgtattcttgtttgagtccttc

SEQ ID NO: 588688 - DNA, 25 bp, Rattus norvegicus
tcctgtcaaagactgcagaatctgg

SEQ ID NO: 588689 - DNA, 25 bp, Rattus norvegicus
tcctgtcaaagagtgcagaatctgg

SEQ ID NO: 588690 - DNA, 25 bp, Rattus norvegicus
tcctgtcacctgacagcataggtag

SEQ ID NO: 588691 - DNA, 25 bp, Rattus norvegicus
tcctgtcacctgtcagcataggtag

SEQ ID NO: 588692 - DNA, 25 bp, Rattus norvegicus
tcctgtcactcaagtggacctcaga

SEQ ID NO: 588693 - DNA, 25 bp, Rattus norvegicus
tcctgtcactcatgtggacctcaga

SEQ ID NO: 588694 - DNA, 25 bp, Rattus norvegicus
tcctgtcatcaaagagagcctcatt

SEQ ID NO: 588695 - DNA, 25 bp, Rattus norvegicus
tcctgtcatcaatgagagcctcatt

SEQ ID NO: 588696 - DNA, 25 bp, Rattus norvegicus
tcctgtcctcttaacagtgtctaga

SEQ ID NO: 588697 - DNA, 25 bp, Rattus norvegicus
tcctgtcctctttacagtgtctaga

SEQ ID NO: 588698 - DNA, 25 bp, Rattus norvegicus
tcctgtcctggcaggcttcggaagg

SEQ ID NO: 588699 - DNA, 25 bp, Rattus norvegicus
tcctgtcctggctggcttcggaagg

SEQ ID NO: 588700 - DNA, 25 bp, Rattus norvegicus
tcctgtcctgtaccatacttttggt

SEQ ID NO: 588701 - DNA, 25 bp, Rattus norvegicus
tcctgtcctgtagcatacttttggt

SEQ ID NO: 588702 - DNA, 25 bp, Rattus norvegicus
tcctgtccttaaagctgtctgggtc

SEQ ID NO: 588703 - DNA, 25 bp, Rattus norvegicus
tcctgtccttaatgctgtctgggtc

SEQ ID NO: 588704 - DNA, 25 bp, Rattus norvegicus
tcctgtccttgtccattttagagca

SEQ ID NO: 588705 - DNA, 25 bp, Rattus norvegicus
tcctgtccttgtgcattttagagca

SEQ ID NO: 588706 - DNA, 25 bp, Rattus norvegicus
tcctgtccttttcggtgtcttagag

SEQ ID NO: 588707 - DNA, 25 bp, Rattus norvegicus
tcctgtccttttgggtgtcttagag

SEQ ID NO: 588708 - DNA, 25 bp, Rattus norvegicus
tcctgtcgagcgagtgccatctgtt

SEQ ID NO: 588709 - DNA, 25 bp, Rattus norvegicus
tcctgtcgagcgtgtgccatctgtt

SEQ ID NO: 588710 - DNA, 25 bp, Rattus norvegicus
tcctgtcgcttgctaaggtgtctca

SEQ ID NO: 588711 - DNA, 25 bp, Rattus norvegicus
tcctgtcgcttggtaaggtgtctca

SEQ ID NO: 588712 - DNA, 25 bp, Rattus norvegicus
tcctgtcggtggagggcagtattaa

SEQ ID NO: 588713 - DNA, 25 bp, Rattus norvegicus
tcctgtcggtggtgggcagtattaa

SEQ ID NO: 588714 - DNA, 25 bp, Rattus norvegicus
tcctgtctcaatcaaatcctggttt

SEQ ID NO: 588715 - DNA, 25 bp, Rattus norvegicus
tcctgtctcaatgaaatcctggttt

SEQ ID NO: 588716 - DNA, 25 bp, Rattus norvegicus
tcctgtctcagcattctatatgtta

SEQ ID NO: 588717 - DNA, 25 bp, Rattus norvegicus
tcctgtctcagctttctatatgtta

SEQ ID NO: 588718 - DNA, 25 bp, Rattus norvegicus
tcctgtctcaggatcggaatgcggg

SEQ ID NO: 588719 - DNA, 25 bp, Rattus norvegicus
tcctgtctcaggttcggaatgcggg

SEQ ID NO: 588720 - DNA, 25 bp, Rattus norvegicus
tcctgtctctcaccctatgtttaaa

SEQ ID NO: 588721 - DNA, 25 bp, Rattus norvegicus
tcctgtctctcagcctatgtttaaa

SEQ ID NO: 588722 - DNA, 25 bp, Rattus norvegicus
tcctgtctctctattagccagtagg

SEQ ID NO: 588723 - DNA, 25 bp, Rattus norvegicus
tcctgtctctcttttagccagtagg

SEQ ID NO: 588724 - DNA, 25 bp, Rattus norvegicus
tcctgtctgactatcgcacagctgt

SEQ ID NO: 588725 - DNA, 25 bp, Rattus norvegicus
tcctgtctgactttcgcacagctgt

SEQ ID NO: 588726 - DNA, 25 bp, Rattus norvegicus
tcctgtctgcctagctgggagagct

SEQ ID NO: 588727 - DNA, 25 bp, Rattus norvegicus
tcctgtctgccttgctgggagagct

SEQ ID NO: 588728 - DNA, 25 bp, Rattus norvegicus
tcctgtctggaacgatgttgccctt

SEQ ID NO: 588729 - DNA, 25 bp, Rattus norvegicus
tcctgtctggaaggatgttgccctt

SEQ ID NO: 588730 - DNA, 25 bp, Rattus norvegicus
tcctgtctggcccacatacaataca

SEQ ID NO: 588731 - DNA, 25 bp, Rattus norvegicus
tcctgtctggccgacatacaataca

SEQ ID NO: 588732 - DNA, 25 bp, Rattus norvegicus
tcctgtctgggacttgtgttattta

SEQ ID NO: 588733 - DNA, 25 bp, Rattus norvegicus
tcctgtctgggagttgtgttattta

SEQ ID NO: 588734 - DNA, 25 bp, Rattus norvegicus
tcctgtctgtcaccgcagtttcaga

SEQ ID NO: 588735 - DNA, 25 bp, Rattus norvegicus
tcctgtctgtcagcgcagtttcaga

SEQ ID NO: 588736 - DNA, 25 bp, Rattus norvegicus
tcctgtcttcacctttattagcgtg

SEQ ID NO: 588737 - DNA, 25 bp, Rattus norvegicus
tcctgtcttcacgtttattagcgtg

SEQ ID NO: 588738 - DNA, 25 bp, Rattus norvegicus
tcctgtcttcttagacctctgtaag

SEQ ID NO: 588739 - DNA, 25 bp, Rattus norvegicus
tcctgtcttcttattctgattcttc

SEQ ID NO: 588740 - DNA, 25 bp, Rattus norvegicus
tcctgtcttctttgacctctgtaag

SEQ ID NO: 588741 - DNA, 25 bp, Rattus norvegicus
tcctgtcttctttttctgattcttc

SEQ ID NO: 588742 - DNA, 25 bp, Rattus norvegicus
tcctgtcttggtatattttgtgcta

SEQ ID NO: 588743 - DNA, 25 bp, Rattus norvegicus
tcctgtcttggtttattttgtgcta

SEQ ID NO: 588744 - DNA, 25 bp, Rattus norvegicus
tcctgtctttctatcaattttccac

SEQ ID NO: 588745 - DNA, 25 bp, Rattus norvegicus
tcctgtctttctttcaattttccac

SEQ ID NO: 588746 - DNA, 25 bp, Rattus norvegicus
tcctgtctttgaaatctactcttgg

SEQ ID NO: 588747 - DNA, 25 bp, Rattus norvegicus
tcctgtctttgatatctactcttgg

SEQ ID NO: 588748 - DNA, 25 bp, Rattus norvegicus
tcctgtgaagttatgtggaccctca

SEQ ID NO: 588749 - DNA, 25 bp, Rattus norvegicus
tcctgtgaagttttgtggaccctca

SEQ ID NO: 588750 - DNA, 25 bp, Rattus norvegicus
tcctgtgaatctcctgctgtcatcc

SEQ ID NO: 588751 - DNA, 25 bp, Rattus norvegicus
tcctgtgaatctgctgctgtcatcc

SEQ ID NO: 588752 - DNA, 25 bp, Rattus norvegicus
tcctgtgacacaaatcatggctgcc

SEQ ID NO: 588753 - DNA, 25 bp, Rattus norvegicus
tcctgtgacacatatcatggctgcc

SEQ ID NO: 588754 - DNA, 25 bp, Rattus norvegicus
tcctgtgacctcagggtttggccca

SEQ ID NO: 588755 - DNA, 25 bp, Rattus norvegicus
tcctgtgacctctgggtttggccca

SEQ ID NO: 588756 - DNA, 25 bp, Rattus norvegicus
tcctgtgacttcaacagcaactccc

SEQ ID NO: 588757 - DNA, 25 bp, Rattus norvegicus
tcctgtgacttctacagcaactccc

SEQ ID NO: 588758 - DNA, 25 bp, Rattus norvegicus
tcctgtgatatcacggttcagacta

SEQ ID NO: 588759 - DNA, 25 bp, Rattus norvegicus
tcctgtgatatctcggttcagacta

SEQ ID NO: 588760 - DNA, 25 bp, Rattus norvegicus
tcctgtgatcggaccctggaagtta

SEQ ID NO: 588761 - DNA, 25 bp, Rattus norvegicus
tcctgtgatcggtccctggaagtta

SEQ ID NO: 588762 - DNA, 25 bp, Rattus norvegicus
tcctgtgatgtgaattgtgctgctt

SEQ ID NO: 588763 - DNA, 25 bp, Rattus norvegicus
tcctgtgatgtgtattgtgctgctt

SEQ ID NO: 588764 - DNA, 25 bp, Rattus norvegicus
tcctgtgattctatataaagccaga

SEQ ID NO: 588765 - DNA, 25 bp, Rattus norvegicus
tcctgtgattctttataaagccaga

SEQ ID NO: 588766 - DNA, 25 bp, Rattus norvegicus
tcctgtgattgaattctcggtgtgt

SEQ ID NO: 588767 - DNA, 25 bp, Rattus norvegicus
tcctgtgattgatttctcggtgtgt

SEQ ID NO: 588768 - DNA, 25 bp, Rattus norvegicus
tcctgtgcacacaccttagaaggga

SEQ ID NO: 588769 - DNA, 25 bp, Rattus norvegicus
tcctgtgcacactccttagaaggga

SEQ ID NO: 588770 - DNA, 25 bp, Rattus norvegicus
tcctgtgcaccgatcgtgactgtaa

SEQ ID NO: 588771 - DNA, 25 bp, Rattus norvegicus
tcctgtgcaccgttcgtgactgtaa

SEQ ID NO: 588772 - DNA, 25 bp, Rattus norvegicus
tcctgtgcagacagggcacatccaa

SEQ ID NO: 588773 - DNA, 25 bp, Rattus norvegicus
tcctgtgcagactgggcacatccaa

SEQ ID NO: 588774 - DNA, 25 bp, Rattus norvegicus
tcctgtgcagctcatgccagcagta

SEQ ID NO: 588775 - DNA, 25 bp, Rattus norvegicus
tcctgtgcagctcgcaatctctgag

SEQ ID NO: 588776 - DNA, 25 bp, Rattus norvegicus
tcctgtgcagctgatgccagcagta

SEQ ID NO: 588777 - DNA, 25 bp, Rattus norvegicus
tcctgtgcagctggcaatctctgag

SEQ ID NO: 588778 - DNA, 25 bp, Rattus norvegicus
tcctgtgcataacctctgcatgtga

SEQ ID NO: 588779 - DNA, 25 bp, Rattus norvegicus
tcctgtgcataaccttgctgaggaa

SEQ ID NO: 588780 - DNA, 25 bp, Rattus norvegicus
tcctgtgcataagctctgcatgtga

SEQ ID NO: 588781 - DNA, 25 bp, Rattus norvegicus
tcctgtgcataagcttgctgaggaa

SEQ ID NO: 588782 - DNA, 25 bp, Rattus norvegicus
tcctgtgcatcaattgatgaggcag

SEQ ID NO: 588783 - DNA, 25 bp, Rattus norvegicus
tcctgtgcatcatttgatgaggcag

SEQ ID NO: 588784 - DNA, 25 bp, Rattus norvegicus
tcctgtgcccctcaaactttctggg

SEQ ID NO: 588785 - DNA, 25 bp, Rattus norvegicus
tcctgtgcccctgaaactttctggg

SEQ ID NO: 588786 - DNA, 25 bp, Rattus norvegicus
tcctgtgcccgtcgaggacacataa

SEQ ID NO: 588787 - DNA, 25 bp, Rattus norvegicus
tcctgtgcccgtggaggacacataa

SEQ ID NO: 588788 - DNA, 25 bp, Rattus norvegicus
tcctgtgcctatcatggctgccggc

SEQ ID NO: 588789 - DNA, 25 bp, Rattus norvegicus
tcctgtgcctatgatggctgccggc

SEQ ID NO: 588790 - DNA, 25 bp, Rattus norvegicus
tcctgtgccttcaagatctttgtat

SEQ ID NO: 588791 - DNA, 25 bp, Rattus norvegicus
tcctgtgccttctagatctttgtat

SEQ ID NO: 588792 - DNA, 25 bp, Rattus norvegicus
tcctgtgccttgcagccatggggta

SEQ ID NO: 588793 - DNA, 25 bp, Rattus norvegicus
tcctgtgccttggagccatggggta

SEQ ID NO: 588794 - DNA, 25 bp, Rattus norvegicus
tcctgtgcgcacaaactttgatgct

SEQ ID NO: 588795 - DNA, 25 bp, Rattus norvegicus
tcctgtgcgcactaactttgatgct

SEQ ID NO: 588796 - DNA, 25 bp, Rattus norvegicus
tcctgtgctaggctctgcagaggat

SEQ ID NO: 588797 - DNA, 25 bp, Rattus norvegicus
tcctgtgctagggtctgcagaggat

SEQ ID NO: 588798 - DNA, 25 bp, Rattus norvegicus
tcctgtgctctcctgtaagaagaca

SEQ ID NO: 588799 - DNA, 25 bp, Rattus norvegicus
tcctgtgctctcgtgtaagaagaca

SEQ ID NO: 588800 - DNA, 25 bp, Rattus norvegicus
tcctgtgctctgagagaactcgtgg

SEQ ID NO: 588801 - DNA, 25 bp, Rattus norvegicus
tcctgtgctctgtgagaactcgtgg

SEQ ID NO: 588802 - DNA, 25 bp, Rattus norvegicus
tcctgtgctgtacctggagcttcaa

SEQ ID NO: 588803 - DNA, 25 bp, Rattus norvegicus
tcctgtgctgtagctggagcttcaa

SEQ ID NO: 588804 - DNA, 25 bp, Rattus norvegicus
tcctgtgcttggactgccgggttga

SEQ ID NO: 588805 - DNA, 25 bp, Rattus norvegicus
tcctgtgcttggtctgccgggttga

SEQ ID NO: 588806 - DNA, 25 bp, Rattus norvegicus
tcctgtgctttacaaatggctctgt

SEQ ID NO: 588807 - DNA, 25 bp, Rattus norvegicus
tcctgtgctttagaaatggctctgt

SEQ ID NO: 588808 - DNA, 25 bp, Rattus norvegicus
tcctgtggaaatctgcattggcttt

SEQ ID NO: 588809 - DNA, 25 bp, Rattus norvegicus
tcctgtggaaatgtgcattggcttt

SEQ ID NO: 588810 - DNA, 25 bp, Rattus norvegicus
tcctgtggaagtaggatgccgcagt

SEQ ID NO: 588811 - DNA, 25 bp, Rattus norvegicus
tcctgtggaagttggatgccgcagt

SEQ ID NO: 588812 - DNA, 25 bp, Rattus norvegicus
tcctgtggacatacttcatgctcga

SEQ ID NO: 588813 - DNA, 25 bp, Rattus norvegicus
tcctgtggacattcttcatgctcga

SEQ ID NO: 588814 - DNA, 25 bp, Rattus norvegicus
tcctgtggaccaatgctgttagctg

SEQ ID NO: 588815 - DNA, 25 bp, Rattus norvegicus
tcctgtggaccattgctgttagctg

SEQ ID NO: 588816 - DNA, 25 bp, Rattus norvegicus
tcctgtggacgaactttgcggtgca

SEQ ID NO: 588817 - DNA, 25 bp, Rattus norvegicus
tcctgtggacgatctttgcggtgca

SEQ ID NO: 588818 - DNA, 25 bp, Rattus norvegicus
tcctgtggagacataatgttcttaa

SEQ ID NO: 588819 - DNA, 25 bp, Rattus norvegicus
tcctgtggagacttaatgttcttaa

SEQ ID NO: 588820 - DNA, 25 bp, Rattus norvegicus
tcctgtggagggagggcgtggacca

SEQ ID NO: 588821 - DNA, 25 bp, Rattus norvegicus
tcctgtggagggtgggcgtggacca

SEQ ID NO: 588822 - DNA, 25 bp, Rattus norvegicus
tcctgtggcgttaggttttatttct

SEQ ID NO: 588823 - DNA, 25 bp, Rattus norvegicus
tcctgtggcgtttggttttatttct

SEQ ID NO: 588824 - DNA, 25 bp, Rattus norvegicus
tcctgtggctgtaaggtcgacctgt

SEQ ID NO: 588825 - DNA, 25 bp, Rattus norvegicus
tcctgtggctgttaggtcgacctgt

SEQ ID NO: 588826 - DNA, 25 bp, Rattus norvegicus
tcctgtgggacgatgaagctggtat

SEQ ID NO: 588827 - DNA, 25 bp, Rattus norvegicus
tcctgtgggacgttgaagctggtat

SEQ ID NO: 588828 - DNA, 25 bp, Rattus norvegicus
tcctgtgggactcgctgggtttaaa

SEQ ID NO: 588829 - DNA, 25 bp, Rattus norvegicus
tcctgtgggactggctgggtttaaa

SEQ ID NO: 588830 - DNA, 25 bp, Rattus norvegicus
tcctgtgggctgagtgctttgtaca

SEQ ID NO: 588831 - DNA, 25 bp, Rattus norvegicus
tcctgtgggctgtgtgctttgtaca

SEQ ID NO: 588832 - DNA, 25 bp, Rattus norvegicus
tcctgtgggttgctgtatcctgaaa

SEQ ID NO: 588833 - DNA, 25 bp, Rattus norvegicus
tcctgtgggttggtgtatcctgaaa

SEQ ID NO: 588834 - DNA, 25 bp, Rattus norvegicus
tcctgtggtctcagagtcgggaagt

SEQ ID NO: 588835 - DNA, 25 bp, Rattus norvegicus
tcctgtggtctcagttgcataacat

SEQ ID NO: 588836 - DNA, 25 bp, Rattus norvegicus
tcctgtggtctctgagtcgggaagt

SEQ ID NO: 588837 - DNA, 25 bp, Rattus norvegicus
tcctgtggtctctgttgcataacat

SEQ ID NO: 588838 - DNA, 25 bp, Rattus norvegicus
tcctgtggttctcttgtatatgtgt

SEQ ID NO: 588839 - DNA, 25 bp, Rattus norvegicus
tcctgtggttctgttgtatatgtgt

SEQ ID NO: 588840 - DNA, 25 bp, Rattus norvegicus
tcctgtgtcattacctgtttctagt

SEQ ID NO: 588841 - DNA, 25 bp, Rattus norvegicus
tcctgtgtcatttcctgtttctagt

SEQ ID NO: 588842 - DNA, 25 bp, Rattus norvegicus
tcctgtgtcgtgcaggtggctctac

SEQ ID NO: 588843 - DNA, 25 bp, Rattus norvegicus
tcctgtgtcgtggaggtggctctac

SEQ ID NO: 588844 - DNA, 25 bp, Rattus norvegicus
tcctgtgtgaatagatggctgccca

SEQ ID NO: 588845 - DNA, 25 bp, Rattus norvegicus
tcctgtgtgaattgatggctgccca

SEQ ID NO: 588846 - DNA, 25 bp, Rattus norvegicus
tcctgtgtgatactttttcctgtat

SEQ ID NO: 588847 - DNA, 25 bp, Rattus norvegicus
tcctgtgtgatagtttttcctgtat

SEQ ID NO: 588848 - DNA, 25 bp, Rattus norvegicus
tcctgtgtgctgatctgatgacgta

SEQ ID NO: 588849 - DNA, 25 bp, Rattus norvegicus
tcctgtgtgctgttctgatgacgta

SEQ ID NO: 588850 - DNA, 25 bp, Rattus norvegicus
tcctgtgtgcttctgcagctgcttg

SEQ ID NO: 588851 - DNA, 25 bp, Rattus norvegicus
tcctgtgtgcttgtgcagctgcttg

SEQ ID NO: 588852 - DNA, 25 bp, Rattus norvegicus
tcctgtgtggaacctgggtcgactc

SEQ ID NO: 588853 - DNA, 25 bp, Rattus norvegicus
tcctgtgtggaagctgggtcgactc

SEQ ID NO: 588854 - DNA, 25 bp, Rattus norvegicus
tcctgtgtgtatccttggagccatc

SEQ ID NO: 588855 - DNA, 25 bp, Rattus norvegicus
tcctgtgtgtatgcttggagccatc

SEQ ID NO: 588856 - DNA, 25 bp, Rattus norvegicus
tcctgtgtgtgtcccttgtcaagaa

SEQ ID NO: 588857 - DNA, 25 bp, Rattus norvegicus
tcctgtgtgtgtgccttgtcaagaa

SEQ ID NO: 588858 - DNA, 25 bp, Rattus norvegicus
tcctgtgttattacaaaccctgggt

SEQ ID NO: 588859 - DNA, 25 bp, Rattus norvegicus
tcctgtgttatttcaaaccctgggt

SEQ ID NO: 588860 - DNA, 25 bp, Rattus norvegicus
tcctgtgttctgataaccaccgaga

SEQ ID NO: 588861 - DNA, 25 bp, Rattus norvegicus
tcctgtgttctgttaaccaccgaga

SEQ ID NO: 588862 - DNA, 25 bp, Rattus norvegicus
tcctgtgttggtcagcatctggtga

SEQ ID NO: 588863 - DNA, 25 bp, Rattus norvegicus
tcctgtgttggtgagcatctggtga

SEQ ID NO: 588864 - DNA, 25 bp, Rattus norvegicus
tcctgtgtttccacactgtggaaga

SEQ ID NO: 588865 - DNA, 25 bp, Rattus norvegicus
tcctgtgtttcctcactgtggaaga

SEQ ID NO: 588866 - DNA, 25 bp, Rattus norvegicus
tcctgtgtttctcccagttacttat

SEQ ID NO: 588867 - DNA, 25 bp, Rattus norvegicus
tcctgtgtttctgccagttacttat

SEQ ID NO: 588868 - DNA, 25 bp, Rattus norvegicus
tcctgtgttttcattgccttaacca

SEQ ID NO: 588869 - DNA, 25 bp, Rattus norvegicus
tcctgtgttttctttgccttaacca

SEQ ID NO: 588870 - DNA, 25 bp, Rattus norvegicus
tcctgtgtttttctgtaagttctat

SEQ ID NO: 588871 - DNA, 25 bp, Rattus norvegicus
tcctgtgtttttgtgtaagttctat

SEQ ID NO: 588872 - DNA, 25 bp, Rattus norvegicus
tcctgttaccacatcacttttgaaa

SEQ ID NO: 588873 - DNA, 25 bp, Rattus norvegicus
tcctgttaccacttcacttttgaaa

SEQ ID NO: 588874 - DNA, 25 bp, Rattus norvegicus
tcctgttacctcatcttctttttta

SEQ ID NO: 588875 - DNA, 25 bp, Rattus norvegicus
tcctgttacctcttcttctttttta

SEQ ID NO: 588876 - DNA, 25 bp, Rattus norvegicus
tcctgttactctctgctgccctgag

SEQ ID NO: 588877 - DNA, 25 bp, Rattus norvegicus
tcctgttactctgtgctgccctgag

SEQ ID NO: 588878 - DNA, 25 bp, Rattus norvegicus
tcctgttatcctaactcaccgagtg

SEQ ID NO: 588879 - DNA, 25 bp, Rattus norvegicus
tcctgttatccttactcaccgagtg

SEQ ID NO: 588880 - DNA, 25 bp, Rattus norvegicus
tcctgttatctgagacaatccatag

SEQ ID NO: 588881 - DNA, 25 bp, Rattus norvegicus
tcctgttatctgtgacaatccatag

SEQ ID NO: 588882 - DNA, 25 bp, Rattus norvegicus
tcctgttccaaaaaggaatcctgct

SEQ ID NO: 588883 - DNA, 25 bp, Rattus norvegicus
tcctgttccaaataggaatcctgct

SEQ ID NO: 588884 - DNA, 25 bp, Rattus norvegicus
tcctgttccattagcttatccaagt

SEQ ID NO: 588885 - DNA, 25 bp, Rattus norvegicus
tcctgttccatttgcttatccaagt

SEQ ID NO: 588886 - DNA, 25 bp, Rattus norvegicus
tcctgttccctgcttacttgaaaga

SEQ ID NO: 588887 - DNA, 25 bp, Rattus norvegicus
tcctgttccctggttacttgaaaga

SEQ ID NO: 588888 - DNA, 25 bp, Rattus norvegicus
tcctgttcggtcaccttcgaggcag

SEQ ID NO: 588889 - DNA, 25 bp, Rattus norvegicus
tcctgttcggtctccttcgaggcag

SEQ ID NO: 588890 - DNA, 25 bp, Rattus norvegicus
tcctgttctcatctgtatcttctaa

SEQ ID NO: 588891 - DNA, 25 bp, Rattus norvegicus
tcctgttctcatgtgtatcttctaa

SEQ ID NO: 588892 - DNA, 25 bp, Rattus norvegicus
tcctgttgactaacttctgcatgtt

SEQ ID NO: 588893 - DNA, 25 bp, Rattus norvegicus
tcctgttgactatcttctgcatgtt

SEQ ID NO: 588894 - DNA, 25 bp, Rattus norvegicus
tcctgttgcaggagtccaatattac

SEQ ID NO: 588895 - DNA, 25 bp, Rattus norvegicus
tcctgttgcaggtgtccaatattac

SEQ ID NO: 588896 - DNA, 25 bp, Rattus norvegicus
tcctgttgcttcaaggagagttcta

SEQ ID NO: 588897 - DNA, 25 bp, Rattus norvegicus
tcctgttgcttctaggagagttcta

SEQ ID NO: 588898 - DNA, 25 bp, Rattus norvegicus
tcctgttgttctcctggtgatcgga

SEQ ID NO: 588899 - DNA, 25 bp, Rattus norvegicus
tcctgttgttctgctggtgatcgga

SEQ ID NO: 588900 - DNA, 25 bp, Rattus norvegicus
tcctgtttagccactatcattgtga

SEQ ID NO: 588901 - DNA, 25 bp, Rattus norvegicus
tcctgtttagcctctatcattgtga

SEQ ID NO: 588902 - DNA, 25 bp, Rattus norvegicus
tcctgtttcatcatctgtttcttga

SEQ ID NO: 588903 - DNA, 25 bp, Rattus norvegicus
tcctgtttcatcttctgtttcttga

SEQ ID NO: 588904 - DNA, 25 bp, Rattus norvegicus
tcctgtttcctgagcccagcaagtg

SEQ ID NO: 588905 - DNA, 25 bp, Rattus norvegicus
tcctgtttcctgtgcccagcaagtg

SEQ ID NO: 588906 - DNA, 25 bp, Rattus norvegicus
tcctgtttccttacgggttcctctg

SEQ ID NO: 588907 - DNA, 25 bp, Rattus norvegicus
tcctgtttcctttcgggttcctctg

SEQ ID NO: 588908 - DNA, 25 bp, Rattus norvegicus
tcctgtttggagctcaatgctgcct

SEQ ID NO: 588909 - DNA, 25 bp, Rattus norvegicus
tcctgtttggaggtcaatgctgcct

SEQ ID NO: 588910 - DNA, 25 bp, Rattus norvegicus
tcctgtttgtgacccggaatcgtca

SEQ ID NO: 588911 - DNA, 25 bp, Rattus norvegicus
tcctgtttgtgagccggaatcgtca

SEQ ID NO: 588912 - DNA, 25 bp, Rattus norvegicus
tcctgtttgtgcagacagaccctgt

SEQ ID NO: 588913 - DNA, 25 bp, Rattus norvegicus
tcctgtttgtgctgacagaccctgt

SEQ ID NO: 588914 - DNA, 25 bp, Rattus norvegicus
tcctgtttgtggattgacgagctca

SEQ ID NO: 588915 - DNA, 25 bp, Rattus norvegicus
tcctgtttgtggtttgacgagctca

SEQ ID NO: 588916 - DNA, 25 bp, Rattus norvegicus
tcctgttttaaaccgaatggcacga

SEQ ID NO: 588917 - DNA, 25 bp, Rattus norvegicus
tcctgttttaaagcgaatggcacga

SEQ ID NO: 588918 - DNA, 25 bp, Rattus norvegicus
tcctgttttgggagatcgtgtataa

SEQ ID NO: 588919 - DNA, 25 bp, Rattus norvegicus
tcctgttttgggtgatcgtgtataa

SEQ ID NO: 588920 - DNA, 25 bp, Rattus norvegicus
tcctgttttgtaacctctttgtact

SEQ ID NO: 588921 - DNA, 25 bp, Rattus norvegicus
tcctgttttgtatcctctttgtact

SEQ ID NO: 588922 - DNA, 25 bp, Rattus norvegicus
tcctgttttgtgactgttctgagct

SEQ ID NO: 588923 - DNA, 25 bp, Rattus norvegicus
tcctgttttgtgtctgttctgagct

SEQ ID NO: 588924 - DNA, 25 bp, Rattus norvegicus
tcctgttttgttctgactgctttct

SEQ ID NO: 588925 - DNA, 25 bp, Rattus norvegicus
tcctgttttgttgtgactgctttct

SEQ ID NO: 588926 - DNA, 25 bp, Rattus norvegicus
tcctgtttttagaagctactccctt

SEQ ID NO: 588927 - DNA, 25 bp, Rattus norvegicus
tcctgtttttagtagctactccctt

SEQ ID NO: 588928 - DNA, 25 bp, Rattus norvegicus
tcctgtttttataccttggagcaaa

SEQ ID NO: 588929 - DNA, 25 bp, Rattus norvegicus
tcctgtttttattccttggagcaaa

SEQ ID NO: 588930 - DNA, 25 bp, Rattus norvegicus
tccttaaaaactctcttcccatgct

SEQ ID NO: 588931 - DNA, 25 bp, Rattus norvegicus
tccttaaaaactgtcttcccatgct

SEQ ID NO: 588932 - DNA, 25 bp, Rattus norvegicus
tccttaaaaccccagaaagctgtgg

SEQ ID NO: 588933 - DNA, 25 bp, Rattus norvegicus
tccttaaaacccgagaaagctgtgg

SEQ ID NO: 588934 - DNA, 25 bp, Rattus norvegicus
tccttaaactgcattcttttccact

SEQ ID NO: 588935 - DNA, 25 bp, Rattus norvegicus
tccttaaactgctttcttttccact

SEQ ID NO: 588936 - DNA, 25 bp, Rattus norvegicus
tccttaaagccaatttgaactgagt

SEQ ID NO: 588937 - DNA, 25 bp, Rattus norvegicus
tccttaaagccattttgaactgagt

SEQ ID NO: 588938 - DNA, 25 bp, Rattus norvegicus
tccttaagacagcagagacgcctct

SEQ ID NO: 588939 - DNA, 25 bp, Rattus norvegicus
tccttaagacaggagagacgcctct

SEQ ID NO: 588940 - DNA, 25 bp, Rattus norvegicus
tccttaaggcagaggtatcgtccgt

SEQ ID NO: 588941 - DNA, 25 bp, Rattus norvegicus
tccttaaggcagtggtatcgtccgt

SEQ ID NO: 588942 - DNA, 25 bp, Rattus norvegicus
tccttacaagaaaccctgcccaggg

SEQ ID NO: 588943 - DNA, 25 bp, Rattus norvegicus
tccttacaagaatccctgcccaggg

SEQ ID NO: 588944 - DNA, 25 bp, Rattus norvegicus
tccttacacaacacccatgatttta

SEQ ID NO: 588945 - DNA, 25 bp, Rattus norvegicus
tccttacacaactcccatgatttta

SEQ ID NO: 588946 - DNA, 25 bp, Rattus norvegicus
tccttacaccagcacttcagtttag

SEQ ID NO: 588947 - DNA, 25 bp, Rattus norvegicus
tccttacaccaggacttcagtttag

SEQ ID NO: 588948 - DNA, 25 bp, Rattus norvegicus
tccttaccaccacattttatatgct

SEQ ID NO: 588949 - DNA, 25 bp, Rattus norvegicus
tccttaccaccagattttatatgct

SEQ ID NO: 588950 - DNA, 25 bp, Rattus norvegicus
tccttacccaagatattaccgtcat

SEQ ID NO: 588951 - DNA, 25 bp, Rattus norvegicus
tccttacccaagttattaccgtcat

SEQ ID NO: 588952 - DNA, 25 bp, Rattus norvegicus
tccttacccagtagtttgtcccgtg

SEQ ID NO: 588953 - DNA, 25 bp, Rattus norvegicus
tccttacccagttgtttgtcccgtg

SEQ ID NO: 588954 - DNA, 25 bp, Rattus norvegicus
tccttacccctcagtgaggagttag

SEQ ID NO: 588955 - DNA, 25 bp, Rattus norvegicus
tccttacccctctgtgaggagttag

SEQ ID NO: 588956 - DNA, 25 bp, Rattus norvegicus
tccttaccgactaatggaggccaag

SEQ ID NO: 588957 - DNA, 25 bp, Rattus norvegicus
tccttaccgacttatggaggccaag

SEQ ID NO: 588958 - DNA, 25 bp, Rattus norvegicus
tccttaccgaggctgtaacgtaggt

SEQ ID NO: 588959 - DNA, 25 bp, Rattus norvegicus
tccttaccgagggtgtaacgtaggt

SEQ ID NO: 588960 - DNA, 25 bp, Rattus norvegicus
tccttaccgatgaattttcctactc

SEQ ID NO: 588961 - DNA, 25 bp, Rattus norvegicus
tccttaccgatgtattttcctactc

SEQ ID NO: 588962 - DNA, 25 bp, Rattus norvegicus
tccttacctttgatagcatcctggg

SEQ ID NO: 588963 - DNA, 25 bp, Rattus norvegicus
tccttacctttgttagcatcctggg

SEQ ID NO: 588964 - DNA, 25 bp, Rattus norvegicus
tccttacgctctcgagtgtgtgttc

SEQ ID NO: 588965 - DNA, 25 bp, Rattus norvegicus
tccttacgctctggagtgtgtgttc

SEQ ID NO: 588966 - DNA, 25 bp, Rattus norvegicus
tccttacgttgcatttaccagggtg

SEQ ID NO: 588967 - DNA, 25 bp, Rattus norvegicus
tccttacgttgcttttaccagggtg

SEQ ID NO: 588968 - DNA, 25 bp, Rattus norvegicus
tccttactccccaatatatacttct

SEQ ID NO: 588969 - DNA, 25 bp, Rattus norvegicus
tccttactcccctatatatacttct

SEQ ID NO: 588970 - DNA, 25 bp, Rattus norvegicus
tccttactggctcagggtagcttat

SEQ ID NO: 588971 - DNA, 25 bp, Rattus norvegicus
tccttactggctgagggtagcttat

SEQ ID NO: 588972 - DNA, 25 bp, Rattus norvegicus
tccttactgtcacccattctaaaga

SEQ ID NO: 588973 - DNA, 25 bp, Rattus norvegicus
tccttactgtcagccattctaaaga

SEQ ID NO: 588974 - DNA, 25 bp, Rattus norvegicus
tccttactgtctcccttgagaatca

SEQ ID NO: 588975 - DNA, 25 bp, Rattus norvegicus
tccttactgtctgccttgagaatca

SEQ ID NO: 588976 - DNA, 25 bp, Rattus norvegicus
tccttacttttaattgtgtgccggg

SEQ ID NO: 588977 - DNA, 25 bp, Rattus norvegicus
tccttacttttatttgtgtgccggg

SEQ ID NO: 588978 - DNA, 25 bp, Rattus norvegicus
tccttagaagacatgccttgctcat

SEQ ID NO: 588979 - DNA, 25 bp, Rattus norvegicus
tccttagaagacttgccttgctcat

SEQ ID NO: 588980 - DNA, 25 bp, Rattus norvegicus
tccttagaccagcatagatacttgc

SEQ ID NO: 588981 - DNA, 25 bp, Rattus norvegicus
tccttagaccaggatagatacttgc

SEQ ID NO: 588982 - DNA, 25 bp, Rattus norvegicus
tccttagagcttctgtgtgcctgca

SEQ ID NO: 588983 - DNA, 25 bp, Rattus norvegicus
tccttagagcttgtgtgtgcctgca

SEQ ID NO: 588984 - DNA, 25 bp, Rattus norvegicus
tccttagcagtcaggtaggtaatga

SEQ ID NO: 588985 - DNA, 25 bp, Rattus norvegicus
tccttagcagtctggtaggtaatga

SEQ ID NO: 588986 - DNA, 25 bp, Rattus norvegicus
tccttagctgggaactgacagtggc

SEQ ID NO: 588987 - DNA, 25 bp, Rattus norvegicus
tccttagctgggtactgacagtggc

SEQ ID NO: 588988 - DNA, 25 bp, Rattus norvegicus
tccttaggactaccctggattcctt

SEQ ID NO: 588989 - DNA, 25 bp, Rattus norvegicus
tccttaggactagcctggattcctt

SEQ ID NO: 588990 - DNA, 25 bp, Rattus norvegicus
tccttagggagtcttcgtgtctgac

SEQ ID NO: 588991 - DNA, 25 bp, Rattus norvegicus
tccttagggagtgttcgtgtctgac

SEQ ID NO: 588992 - DNA, 25 bp, Rattus norvegicus
tccttagggctgctggagttaaact

SEQ ID NO: 588993 - DNA, 25 bp, Rattus norvegicus
tccttagggctggtggagttaaact

SEQ ID NO: 588994 - DNA, 25 bp, Rattus norvegicus
tccttagggtgccaactctgatggg

SEQ ID NO: 588995 - DNA, 25 bp, Rattus norvegicus
tccttagggtgcgaactctgatggg

SEQ ID NO: 588996 - DNA, 25 bp, Rattus norvegicus
tccttaggtccacatgagccactta

SEQ ID NO: 588997 - DNA, 25 bp, Rattus norvegicus
tccttaggtccagatgagccactta

SEQ ID NO: 588998 - DNA, 25 bp, Rattus norvegicus
tccttagtgctgctcttggtggttt

SEQ ID NO: 588999 - DNA, 25 bp, Rattus norvegicus
tccttagtgctggtcttggtggttt

SEQ ID NO: 589000 - DNA, 25 bp, Rattus norvegicus
tccttatacaccactgtcttgggat

SEQ ID NO: 589001 - DNA, 25 bp, Rattus norvegicus
tccttatacacctctgtcttgggat

SEQ ID NO: 589002 - DNA, 25 bp, Rattus norvegicus
tccttatcccgcagtttggaattca

SEQ ID NO: 589003 - DNA, 25 bp, Rattus norvegicus
tccttatcccgctgtttggaattca

SEQ ID NO: 589004 - DNA, 25 bp, Rattus norvegicus
tccttatccctaagtttgtatcacc

SEQ ID NO: 589005 - DNA, 25 bp, Rattus norvegicus
tccttatccctatgtttgtatcacc

SEQ ID NO: 589006 - DNA, 25 bp, Rattus norvegicus
tccttatcctggaggcgtgaggcta

SEQ ID NO: 589007 - DNA, 25 bp, Rattus norvegicus
tccttatcctggtggcgtgaggcta

SEQ ID NO: 589008 - DNA, 25 bp, Rattus norvegicus
tccttatccttaccgttctgaatgg

SEQ ID NO: 589009 - DNA, 25 bp, Rattus norvegicus
tccttatccttagcgttctgaatgg

SEQ ID NO: 589010 - DNA, 25 bp, Rattus norvegicus
tccttatccttcctgtgttcattaa

SEQ ID NO: 589011 - DNA, 25 bp, Rattus norvegicus
tccttatccttcgtgtgttcattaa

SEQ ID NO: 589012 - DNA, 25 bp, Rattus norvegicus
tccttatgctcgaacctccttcatg

SEQ ID NO: 589013 - DNA, 25 bp, Rattus norvegicus
tccttatgctcgtacctccttcatg

SEQ ID NO: 589014 - DNA, 25 bp, Rattus norvegicus
tccttatgtgtgaatttcctggcaa

SEQ ID NO: 589015 - DNA, 25 bp, Rattus norvegicus
tccttatgtgtgtatttcctggcaa

SEQ ID NO: 589016 - DNA, 25 bp, Rattus norvegicus
tccttatgtttaacctattccctag

SEQ ID NO: 589017 - DNA, 25 bp, Rattus norvegicus
tccttatgtttatcctattccctag

SEQ ID NO: 589018 - DNA, 25 bp, Rattus norvegicus
tccttatgttttagttggtgctgct

SEQ ID NO: 589019 - DNA, 25 bp, Rattus norvegicus
tccttatgtttttgttggtgctgct

SEQ ID NO: 589020 - DNA, 25 bp, Rattus norvegicus
tccttatttataacacctggccgct

SEQ ID NO: 589021 - DNA, 25 bp, Rattus norvegicus
tccttatttatatcacctggccgct

SEQ ID NO: 589022 - DNA, 25 bp, Rattus norvegicus
tccttatttattagagccgtgagag

SEQ ID NO: 589023 - DNA, 25 bp, Rattus norvegicus
tccttatttatttgagccgtgagag

SEQ ID NO: 589024 - DNA, 25 bp, Rattus norvegicus
tccttcaaaattcctgcttcacaaa

SEQ ID NO: 589025 - DNA, 25 bp, Rattus norvegicus
tccttcaaaattgctgcttcacaaa

SEQ ID NO: 589026 - DNA, 25 bp, Rattus norvegicus
tccttcaaagttagccgtcgggttg

SEQ ID NO: 589027 - DNA, 25 bp, Rattus norvegicus
tccttcaaagtttgccgtcgggttg

SEQ ID NO: 589028 - DNA, 25 bp, Rattus norvegicus
tccttcaagcctatcttcctatctt

SEQ ID NO: 589029 - DNA, 25 bp, Rattus norvegicus
tccttcaagcctttcttcctatctt

SEQ ID NO: 589030 - DNA, 25 bp, Rattus norvegicus
tccttcacagaactcattacactgg

SEQ ID NO: 589031 - DNA, 25 bp, Rattus norvegicus
tccttcacagaagtcattacactgg

SEQ ID NO: 589032 - DNA, 25 bp, Rattus norvegicus
tccttcacgcaacctagactagtaa

SEQ ID NO: 589033 - DNA, 25 bp, Rattus norvegicus
tccttcacgcaagctagactagtaa

SEQ ID NO: 589034 - DNA, 25 bp, Rattus norvegicus
tccttcacgggacagcatctaacag

SEQ ID NO: 589035 - DNA, 25 bp, Rattus norvegicus
tccttcacgggagagcatctaacag

SEQ ID NO: 589036 - DNA, 25 bp, Rattus norvegicus
tccttcactctgcttggacaagaac

SEQ ID NO: 589037 - DNA, 25 bp, Rattus norvegicus
tccttcactctggttggacaagaac

SEQ ID NO: 589038 - DNA, 25 bp, Rattus norvegicus
tccttcactttcattacctttatct

SEQ ID NO: 589039 - DNA, 25 bp, Rattus norvegicus
tccttcactttctttacctttatct

SEQ ID NO: 589040 - DNA, 25 bp, Rattus norvegicus
tccttcactttgatctggaatttaa

SEQ ID NO: 589041 - DNA, 25 bp, Rattus norvegicus
tccttcactttgttctggaatttaa

SEQ ID NO: 589042 - DNA, 25 bp, Rattus norvegicus
tccttcagacgaatcctccagaata

SEQ ID NO: 589043 - DNA, 25 bp, Rattus norvegicus
tccttcagacgattcctccagaata

SEQ ID NO: 589044 - DNA, 25 bp, Rattus norvegicus
tccttcagagatagtgtccccaaca

SEQ ID NO: 589045 - DNA, 25 bp, Rattus norvegicus
tccttcagagattgtgtccccaaca

SEQ ID NO: 589046 - DNA, 25 bp, Rattus norvegicus
tccttcagattcagcgtcacgatga

SEQ ID NO: 589047 - DNA, 25 bp, Rattus norvegicus
tccttcagattctgcgtcacgatga

SEQ ID NO: 589048 - DNA, 25 bp, Rattus norvegicus
tccttcagggaacccagtttcagtt

SEQ ID NO: 589049 - DNA, 25 bp, Rattus norvegicus
tccttcagggaagccagtttcagtt

SEQ ID NO: 589050 - DNA, 25 bp, Rattus norvegicus
tccttcagtgacatctaaccatcca

SEQ ID NO: 589051 - DNA, 25 bp, Rattus norvegicus
tccttcagtgacttctaaccatcca

SEQ ID NO: 589052 - DNA, 25 bp, Rattus norvegicus
tccttcagttccactgcctttatgt

SEQ ID NO: 589053 - DNA, 25 bp, Rattus norvegicus
tccttcagttcctctgcctttatgt

SEQ ID NO: 589054 - DNA, 25 bp, Rattus norvegicus
tccttcatcaggatttcccctgcag

SEQ ID NO: 589055 - DNA, 25 bp, Rattus norvegicus
tccttcatcaggttttcccctgcag

SEQ ID NO: 589056 - DNA, 25 bp, Rattus norvegicus
tccttcatccatagagcttggtgct

SEQ ID NO: 589057 - DNA, 25 bp, Rattus norvegicus
tccttcatccatctgtttctagatg

SEQ ID NO: 589058 - DNA, 25 bp, Rattus norvegicus
tccttcatccatgtgtttctagatg

SEQ ID NO: 589059 - DNA, 25 bp, Rattus norvegicus
tccttcatccattgagcttggtgct

SEQ ID NO: 589060 - DNA, 25 bp, Rattus norvegicus
tccttcatcctgataatcttctctt

SEQ ID NO: 589061 - DNA, 25 bp, Rattus norvegicus
tccttcatcctgttaatcttctctt

SEQ ID NO: 589062 - DNA, 25 bp, Rattus norvegicus
tccttcatgctcctcagtttctaag

SEQ ID NO: 589063 - DNA, 25 bp, Rattus norvegicus
tccttcatgctcgtcagtttctaag

SEQ ID NO: 589064 - DNA, 25 bp, Rattus norvegicus
tccttcatgtctctggcgatgttca

SEQ ID NO: 589065 - DNA, 25 bp, Rattus norvegicus
tccttcatgtctgtggcgatgttca

SEQ ID NO: 589066 - DNA, 25 bp, Rattus norvegicus
tccttcatgtgtcggagggagccta

SEQ ID NO: 589067 - DNA, 25 bp, Rattus norvegicus
tccttcatgtgtgggagggagccta

SEQ ID NO: 589068 - DNA, 25 bp, Rattus norvegicus
tccttcatgttcacagtcattctgt

SEQ ID NO: 589069 - DNA, 25 bp, Rattus norvegicus
tccttcatgttctcagtcattctgt

SEQ ID NO: 589070 - DNA, 25 bp, Rattus norvegicus
tccttcattactctgtgtgagtcct

SEQ ID NO: 589071 - DNA, 25 bp, Rattus norvegicus
tccttcattactgtgtgtgagtcct

SEQ ID NO: 589072 - DNA, 25 bp, Rattus norvegicus
tccttccaaataccctccagatgaa

SEQ ID NO: 589073 - DNA, 25 bp, Rattus norvegicus
tccttccaaatagcctccagatgaa

SEQ ID NO: 589074 - DNA, 25 bp, Rattus norvegicus
tccttccaagcccacagaaagagtc

SEQ ID NO: 589075 - DNA, 25 bp, Rattus norvegicus
tccttccaagccgacagaaagagtc

SEQ ID NO: 589076 - DNA, 25 bp, Rattus norvegicus
tccttccagcaaccatgtctgacaa

SEQ ID NO: 589077 - DNA, 25 bp, Rattus norvegicus
tccttccagcaagcatgtctgacaa

SEQ ID NO: 589078 - DNA, 25 bp, Rattus norvegicus
tccttccagctgcagtctgatttca

SEQ ID NO: 589079 - DNA, 25 bp, Rattus norvegicus
tccttccagctggagtctgatttca

SEQ ID NO: 589080 - DNA, 25 bp, Rattus norvegicus
tccttccagcttcggtttgttagaa

SEQ ID NO: 589081 - DNA, 25 bp, Rattus norvegicus
tccttccagcttgggtttgttagaa

SEQ ID NO: 589082 - DNA, 25 bp, Rattus norvegicus
tccttccaggcgagtgttgttagtt

SEQ ID NO: 589083 - DNA, 25 bp, Rattus norvegicus
tccttccaggcgtgtgttgttagtt

SEQ ID NO: 589084 - DNA, 25 bp, Rattus norvegicus
tccttccatacacgcatgccttggg

SEQ ID NO: 589085 - DNA, 25 bp, Rattus norvegicus
tccttccatacaggcatgccttggg

SEQ ID NO: 589086 - DNA, 25 bp, Rattus norvegicus
tccttccatcgcagtggtcgggtag

SEQ ID NO: 589087 - DNA, 25 bp, Rattus norvegicus
tccttccatcgctgtggtcgggtag

SEQ ID NO: 589088 - DNA, 25 bp, Rattus norvegicus
tccttcccaagcagttctgatcttt

SEQ ID NO: 589089 - DNA, 25 bp, Rattus norvegicus
tccttcccaagctgttctgatcttt

SEQ ID NO: 589090 - DNA, 25 bp, Rattus norvegicus
tccttcccagagctgacatcgaaca

SEQ ID NO: 589091 - DNA, 25 bp, Rattus norvegicus
tccttcccagaggtgacatcgaaca

SEQ ID NO: 589092 - DNA, 25 bp, Rattus norvegicus
tccttcccagctatcaagactgcaa

SEQ ID NO: 589093 - DNA, 25 bp, Rattus norvegicus
tccttcccagctttcaagactgcaa

SEQ ID NO: 589094 - DNA, 25 bp, Rattus norvegicus
tccttccccagtctgtttttctaat

SEQ ID NO: 589095 - DNA, 25 bp, Rattus norvegicus
tccttccccagtgtgtttttctaat

SEQ ID NO: 589096 - DNA, 25 bp, Rattus norvegicus
tccttcccctgaacagcatgagtag

SEQ ID NO: 589097 - DNA, 25 bp, Rattus norvegicus
tccttcccctgatcagcatgagtag

SEQ ID NO: 589098 - DNA, 25 bp, Rattus norvegicus
tccttccccttactcctatatgtaa

SEQ ID NO: 589099 - DNA, 25 bp, Rattus norvegicus
tccttccccttagtcctatatgtaa

SEQ ID NO: 589100 - DNA, 25 bp, Rattus norvegicus
tccttccccttcatggtgatttgaa

SEQ ID NO: 589101 - DNA, 25 bp, Rattus norvegicus
tccttccccttcttggtgatttgaa

SEQ ID NO: 589102 - DNA, 25 bp, Rattus norvegicus
tccttcccgcgcaggttaaagtaga

SEQ ID NO: 589103 - DNA, 25 bp, Rattus norvegicus
tccttcccgcgctggttaaagtaga

SEQ ID NO: 589104 - DNA, 25 bp, Rattus norvegicus
tccttccctaataatccccaagtag

SEQ ID NO: 589105 - DNA, 25 bp, Rattus norvegicus
tccttccctaattatccccaagtag

SEQ ID NO: 589106 - DNA, 25 bp, Rattus norvegicus
tccttccctaccagtgaaattgcta

SEQ ID NO: 589107 - DNA, 25 bp, Rattus norvegicus
tccttccctacctgtgaaattgcta

SEQ ID NO: 589108 - DNA, 25 bp, Rattus norvegicus
tccttccctattcccttacaaaggt

SEQ ID NO: 589109 - DNA, 25 bp, Rattus norvegicus
tccttccctattgccttacaaaggt

SEQ ID NO: 589110 - DNA, 25 bp, Rattus norvegicus
tccttccctcagactgtgtacagat

SEQ ID NO: 589111 - DNA, 25 bp, Rattus norvegicus
tccttccctcagtctgtgtacagat

SEQ ID NO: 589112 - DNA, 25 bp, Rattus norvegicus
tccttccctcataattatactctta

SEQ ID NO: 589113 - DNA, 25 bp, Rattus norvegicus
tccttccctcattattatactctta

SEQ ID NO: 589114 - DNA, 25 bp, Rattus norvegicus
tccttccctcgtaatgaattccaga

SEQ ID NO: 589115 - DNA, 25 bp, Rattus norvegicus
tccttccctcgttatgaattccaga

SEQ ID NO: 589116 - DNA, 25 bp, Rattus norvegicus
tccttccctgaacactaggcatgaa

SEQ ID NO: 589117 - DNA, 25 bp, Rattus norvegicus
tccttccctgaagactaggcatgaa

SEQ ID NO: 589118 - DNA, 25 bp, Rattus norvegicus
tccttccctgacctacatctttgta

SEQ ID NO: 589119 - DNA, 25 bp, Rattus norvegicus
tccttccctgacgtacatctttgta

SEQ ID NO: 589120 - DNA, 25 bp, Rattus norvegicus
tccttccctggaatggcattctaga

SEQ ID NO: 589121 - DNA, 25 bp, Rattus norvegicus
tccttccctggattggcattctaga

SEQ ID NO: 589122 - DNA, 25 bp, Rattus norvegicus
tccttcccttacatttgcagagaga

SEQ ID NO: 589123 - DNA, 25 bp, Rattus norvegicus
tccttcccttacttttgcagagaga

SEQ ID NO: 589124 - DNA, 25 bp, Rattus norvegicus
tccttcccttagctaactacagatt

SEQ ID NO: 589125 - DNA, 25 bp, Rattus norvegicus
tccttcccttaggtaactacagatt

SEQ ID NO: 589126 - DNA, 25 bp, Rattus norvegicus
tccttccctttcaaatgtgccagtg

SEQ ID NO: 589127 - DNA, 25 bp, Rattus norvegicus
tccttccctttcagtctgtcgactg

SEQ ID NO: 589128 - DNA, 25 bp, Rattus norvegicus
tccttccctttctaatgtgccagtg

SEQ ID NO: 589129 - DNA, 25 bp, Rattus norvegicus
tccttccctttctgtctgtcgactg

SEQ ID NO: 589130 - DNA, 25 bp, Rattus norvegicus
tccttccggattctgagacccagac

SEQ ID NO: 589131 - DNA, 25 bp, Rattus norvegicus
tccttccggattgtgagacccagac

SEQ ID NO: 589132 - DNA, 25 bp, Rattus norvegicus
tccttccgggccatcagtgaagagt

SEQ ID NO: 589133 - DNA, 25 bp, Rattus norvegicus
tccttccgggccttcagtgaagagt

SEQ ID NO: 589134 - DNA, 25 bp, Rattus norvegicus
tccttccgtgctctgccacagggat

SEQ ID NO: 589135 - DNA, 25 bp, Rattus norvegicus
tccttccgtgctgtgccacagggat

SEQ ID NO: 589136 - DNA, 25 bp, Rattus norvegicus
tccttccgtggtacttcctacaaag

SEQ ID NO: 589137 - DNA, 25 bp, Rattus norvegicus
tccttccgtggttcttcctacaaag

SEQ ID NO: 589138 - DNA, 25 bp, Rattus norvegicus
tccttccgtgtgatctgagtgtcag

SEQ ID NO: 589139 - DNA, 25 bp, Rattus norvegicus
tccttccgtgtgttctgagtgtcag

SEQ ID NO: 589140 - DNA, 25 bp, Rattus norvegicus
tccttcctaagacacttcccaagag

SEQ ID NO: 589141 - DNA, 25 bp, Rattus norvegicus
tccttcctaagagacttcccaagag

SEQ ID NO: 589142 - DNA, 25 bp, Rattus norvegicus
tccttcctaagcacaatagcaccag

SEQ ID NO: 589143 - DNA, 25 bp, Rattus norvegicus
tccttcctaagctcaatagcaccag

SEQ ID NO: 589144 - DNA, 25 bp, Rattus norvegicus
tccttcctaattctgggtgcaatgt

SEQ ID NO: 589145 - DNA, 25 bp, Rattus norvegicus
tccttcctaattcttcctaggctaa

SEQ ID NO: 589146 - DNA, 25 bp, Rattus norvegicus
tccttcctaattgtgggtgcaatgt

SEQ ID NO: 589147 - DNA, 25 bp, Rattus norvegicus
tccttcctaattgttcctaggctaa

SEQ ID NO: 589148 - DNA, 25 bp, Rattus norvegicus
tccttcctatcacagcatgactagt

SEQ ID NO: 589149 - DNA, 25 bp, Rattus norvegicus
tccttcctatcagagcatgactagt

SEQ ID NO: 589150 - DNA, 25 bp, Rattus norvegicus
tccttcctattactcatgtgtgcat

SEQ ID NO: 589151 - DNA, 25 bp, Rattus norvegicus
tccttcctattagtcatgtgtgcat

SEQ ID NO: 589152 - DNA, 25 bp, Rattus norvegicus
tccttcctcagcaactgcaaggtga

SEQ ID NO: 589153 - DNA, 25 bp, Rattus norvegicus
tccttcctcagctactgcaaggtga

SEQ ID NO: 589154 - DNA, 25 bp, Rattus norvegicus
tccttcctcatgaagccaatcaaca

SEQ ID NO: 589155 - DNA, 25 bp, Rattus norvegicus
tccttcctcatgtagccaatcaaca

SEQ ID NO: 589156 - DNA, 25 bp, Rattus norvegicus
tccttcctccctagattcataatga

SEQ ID NO: 589157 - DNA, 25 bp, Rattus norvegicus
tccttcctcccttgattcataatga

SEQ ID NO: 589158 - DNA, 25 bp, Rattus norvegicus
tccttcctcggaatcctaaatggtg

SEQ ID NO: 589159 - DNA, 25 bp, Rattus norvegicus
tccttcctcggattcctaaatggtg

SEQ ID NO: 589160 - DNA, 25 bp, Rattus norvegicus
tccttcctgaagacagtcagcctgg

SEQ ID NO: 589161 - DNA, 25 bp, Rattus norvegicus
tccttcctgaagtcagtcagcctgg

SEQ ID NO: 589162 - DNA, 25 bp, Rattus norvegicus
tccttcctgatcactgaacatgata

SEQ ID NO: 589163 - DNA, 25 bp, Rattus norvegicus
tccttcctgatctctgaacatgata

SEQ ID NO: 589164 - DNA, 25 bp, Rattus norvegicus
tccttcctgggcattctggatattg

SEQ ID NO: 589165 - DNA, 25 bp, Rattus norvegicus
tccttcctgggctttctggatattg

SEQ ID NO: 589166 - DNA, 25 bp, Rattus norvegicus
tccttcctgtgtacttctggagaat

SEQ ID NO: 589167 - DNA, 25 bp, Rattus norvegicus
tccttcctgtgttcttctggagaat

SEQ ID NO: 589168 - DNA, 25 bp, Rattus norvegicus
tccttccttaagaagttttacattg

SEQ ID NO: 589169 - DNA, 25 bp, Rattus norvegicus
tccttccttaagtagttttacattg

SEQ ID NO: 589170 - DNA, 25 bp, Rattus norvegicus
tccttccttaggattcttagctgaa

SEQ ID NO: 589171 - DNA, 25 bp, Rattus norvegicus
tccttccttaggtttcttagctgaa

SEQ ID NO: 589172 - DNA, 25 bp, Rattus norvegicus
tccttccttcccattagcatttttg

SEQ ID NO: 589173 - DNA, 25 bp, Rattus norvegicus
tccttccttccctttagcatttttg

SEQ ID NO: 589174 - DNA, 25 bp, Rattus norvegicus
tccttccttgaccttctgagagtgt

SEQ ID NO: 589175 - DNA, 25 bp, Rattus norvegicus
tccttccttgacgttctgagagtgt

SEQ ID NO: 589176 - DNA, 25 bp, Rattus norvegicus
tccttccttggacgcatgttaaatg

SEQ ID NO: 589177 - DNA, 25 bp, Rattus norvegicus
tccttccttggaggcatgttaaatg

SEQ ID NO: 589178 - DNA, 25 bp, Rattus norvegicus
tccttcctttccatgttgagaatgc

SEQ ID NO: 589179 - DNA, 25 bp, Rattus norvegicus
tccttcctttccttgttgagaatgc

SEQ ID NO: 589180 - DNA, 25 bp, Rattus norvegicus
tccttccttttaacgctaatttaat

SEQ ID NO: 589181 - DNA, 25 bp, Rattus norvegicus
tccttccttttatcgctaatttaat

SEQ ID NO: 589182 - DNA, 25 bp, Rattus norvegicus
tccttcgaaggaaactatccagcag

SEQ ID NO: 589183 - DNA, 25 bp, Rattus norvegicus
tccttcgaaggatactatccagcag

SEQ ID NO: 589184 - DNA, 25 bp, Rattus norvegicus
tccttcgatccaagtgagtctgtaa

SEQ ID NO: 589185 - DNA, 25 bp, Rattus norvegicus
tccttcgatccatgtgagtctgtaa

SEQ ID NO: 589186 - DNA, 25 bp, Rattus norvegicus
tccttcgcctctcagtagcagtaga

SEQ ID NO: 589187 - DNA, 25 bp, Rattus norvegicus
tccttcgcctctgagtagcagtaga

SEQ ID NO: 589188 - DNA, 25 bp, Rattus norvegicus
tccttcggagccagctttagtgaaa

SEQ ID NO: 589189 - DNA, 25 bp, Rattus norvegicus
tccttcggagcctgctttagtgaaa

SEQ ID NO: 589190 - DNA, 25 bp, Rattus norvegicus
tccttcgggtttcgtggtactaatg

SEQ ID NO: 589191 - DNA, 25 bp, Rattus norvegicus
tccttcgggtttggtggtactaatg

SEQ ID NO: 589192 - DNA, 25 bp, Rattus norvegicus
tccttcgtcaaccattacatcagtg

SEQ ID NO: 589193 - DNA, 25 bp, Rattus norvegicus
tccttcgtcaacgattacatcagtg

SEQ ID NO: 589194 - DNA, 25 bp, Rattus norvegicus
tccttcgtggtccagcagacatgat

SEQ ID NO: 589195 - DNA, 25 bp, Rattus norvegicus
tccttcgtggtcgagcagacatgat

SEQ ID NO: 589196 - DNA, 25 bp, Rattus norvegicus
tccttcgttaccatcatgagttctt

SEQ ID NO: 589197 - DNA, 25 bp, Rattus norvegicus
tccttcgttaccttcatgagttctt

SEQ ID NO: 589198 - DNA, 25 bp, Rattus norvegicus
tccttctacatacctatctttctta

SEQ ID NO: 589199 - DNA, 25 bp, Rattus norvegicus
tccttctacatagctatctttctta

SEQ ID NO: 589200 - DNA, 25 bp, Rattus norvegicus
tccttctagcaactgtctctgactg

SEQ ID NO: 589201 - DNA, 25 bp, Rattus norvegicus
tccttctagcaagtgtctctgactg

SEQ ID NO: 589202 - DNA, 25 bp, Rattus norvegicus
tccttctagggtagtctgctgctaa

SEQ ID NO: 589203 - DNA, 25 bp, Rattus norvegicus
tccttctagggttgtctgctgctaa

SEQ ID NO: 589204 - DNA, 25 bp, Rattus norvegicus
tccttctattcacatcttgctgtag

SEQ ID NO: 589205 - DNA, 25 bp, Rattus norvegicus
tccttctattcagatcttgctgtag

SEQ ID NO: 589206 - DNA, 25 bp, Rattus norvegicus
tccttctcagcaagggagtgatatt

SEQ ID NO: 589207 - DNA, 25 bp, Rattus norvegicus
tccttctcagcatgggagtgatatt

SEQ ID NO: 589208 - DNA, 25 bp, Rattus norvegicus
tccttctcagctacagcggagtaaa

SEQ ID NO: 589209 - DNA, 25 bp, Rattus norvegicus
tccttctcagcttcagcggagtaaa

SEQ ID NO: 589210 - DNA, 25 bp, Rattus norvegicus
tccttctcatatcccatgtgctaga

SEQ ID NO: 589211 - DNA, 25 bp, Rattus norvegicus
tccttctcatatgccatgtgctaga

SEQ ID NO: 589212 - DNA, 25 bp, Rattus norvegicus
tccttctcatggaggcactcctgtg

SEQ ID NO: 589213 - DNA, 25 bp, Rattus norvegicus
tccttctcatggtggcactcctgtg

SEQ ID NO: 589214 - DNA, 25 bp, Rattus norvegicus
tccttctccaccactagtaaatttg

SEQ ID NO: 589215 - DNA, 25 bp, Rattus norvegicus
tccttctccacctctagtaaatttg

SEQ ID NO: 589216 - DNA, 25 bp, Rattus norvegicus
tccttctcccggacaaatcttaagg

SEQ ID NO: 589217 - DNA, 25 bp, Rattus norvegicus
tccttctcccggtcaaatcttaagg

SEQ ID NO: 589218 - DNA, 25 bp, Rattus norvegicus
tccttctccgtcaaaacacagttga

SEQ ID NO: 589219 - DNA, 25 bp, Rattus norvegicus
tccttctccgtctaaacacagttga

SEQ ID NO: 589220 - DNA, 25 bp, Rattus norvegicus
tccttctctaggatcagcatcttaa

SEQ ID NO: 589221 - DNA, 25 bp, Rattus norvegicus
tccttctctaggttcagcatcttaa

SEQ ID NO: 589222 - DNA, 25 bp, Rattus norvegicus
tccttctgatccagtggtaccttta

SEQ ID NO: 589223 - DNA, 25 bp, Rattus norvegicus
tccttctgatcctgtggtaccttta

SEQ ID NO: 589224 - DNA, 25 bp, Rattus norvegicus
tccttctgcctcaacactgaaattt

SEQ ID NO: 589225 - DNA, 25 bp, Rattus norvegicus
tccttctgcctctacactgaaattt

SEQ ID NO: 589226 - DNA, 25 bp, Rattus norvegicus
tccttctgcctgaatgtctacttaa

SEQ ID NO: 589227 - DNA, 25 bp, Rattus norvegicus
tccttctgcctgtatgtctacttaa

SEQ ID NO: 589228 - DNA, 25 bp, Rattus norvegicus
tccttctggtctcaagggtcttgga

SEQ ID NO: 589229 - DNA, 25 bp, Rattus norvegicus
tccttctggtctgaagggtcttgga

SEQ ID NO: 589230 - DNA, 25 bp, Rattus norvegicus
tccttctgtcggctcagacattgaa

SEQ ID NO: 589231 - DNA, 25 bp, Rattus norvegicus
tccttctgtcgggtcagacattgaa

SEQ ID NO: 589232 - DNA, 25 bp, Rattus norvegicus
tccttcttcaagagcctgggttgtt

SEQ ID NO: 589233 - DNA, 25 bp, Rattus norvegicus
tccttcttcaagtgcctgggttgtt

SEQ ID NO: 589234 - DNA, 25 bp, Rattus norvegicus
tccttcttcctgcttgatggtattt

SEQ ID NO: 589235 - DNA, 25 bp, Rattus norvegicus
tccttcttcctggttgatggtattt

SEQ ID NO: 589236 - DNA, 25 bp, Rattus norvegicus
tccttcttcttgcagggaaccaaac

SEQ ID NO: 589237 - DNA, 25 bp, Rattus norvegicus
tccttcttcttggagggaaccaaac

SEQ ID NO: 589238 - DNA, 25 bp, Rattus norvegicus
tccttcttgagcagcgtcttggtct

SEQ ID NO: 589239 - DNA, 25 bp, Rattus norvegicus
tccttcttgagctgcgtcttggtct

SEQ ID NO: 589240 - DNA, 25 bp, Rattus norvegicus
tccttcttggcgactgcaaacaaag

SEQ ID NO: 589241 - DNA, 25 bp, Rattus norvegicus
tccttcttggcgtctgcaaacaaag

SEQ ID NO: 589242 - DNA, 25 bp, Rattus norvegicus
tccttcttttatactgaaatctgac

SEQ ID NO: 589243 - DNA, 25 bp, Rattus norvegicus
tccttcttttattctgaaatctgac

SEQ ID NO: 589244 - DNA, 25 bp, Rattus norvegicus
tccttctttttgagctgggactgaa

SEQ ID NO: 589245 - DNA, 25 bp, Rattus norvegicus
tccttctttttgtgctgggactgaa

SEQ ID NO: 589246 - DNA, 25 bp, Rattus norvegicus
tccttgaatacgaggcttccaggct

SEQ ID NO: 589247 - DNA, 25 bp, Rattus norvegicus
tccttgaatacgtggcttccaggct

SEQ ID NO: 589248 - DNA, 25 bp, Rattus norvegicus
tccttgaatgtgagactctgggcag

SEQ ID NO: 589249 - DNA, 25 bp, Rattus norvegicus
tccttgaatgtgtgactctgggcag

SEQ ID NO: 589250 - DNA, 25 bp, Rattus norvegicus
tccttgacacagagtggatagcttt

SEQ ID NO: 589251 - DNA, 25 bp, Rattus norvegicus
tccttgacacagtgtggatagcttt

SEQ ID NO: 589252 - DNA, 25 bp, Rattus norvegicus
tccttgagaccactaccttgcaaca

SEQ ID NO: 589253 - DNA, 25 bp, Rattus norvegicus
tccttgagaccactatcatacagca

SEQ ID NO: 589254 - DNA, 25 bp, Rattus norvegicus
tccttgagaccagtaccttgcaaca

SEQ ID NO: 589255 - DNA, 25 bp, Rattus norvegicus
tccttgagaccagtatcatacagca

SEQ ID NO: 589256 - DNA, 25 bp, Rattus norvegicus
tccttgagcttgagcaccagctgcg

SEQ ID NO: 589257 - DNA, 25 bp, Rattus norvegicus
tccttgagcttgtgcaccagctgcg

SEQ ID NO: 589258 - DNA, 25 bp, Rattus norvegicus
tccttgaggaggcagctacacctgg

SEQ ID NO: 589259 - DNA, 25 bp, Rattus norvegicus
tccttgaggagggagctacacctgg

SEQ ID NO: 589260 - DNA, 25 bp, Rattus norvegicus
tccttgaggtcactggtgtgtgcca

SEQ ID NO: 589261 - DNA, 25 bp, Rattus norvegicus
tccttgaggtcagtggtgtgtgcca

SEQ ID NO: 589262 - DNA, 25 bp, Rattus norvegicus
tccttgagtttcctcttcctttaca

SEQ ID NO: 589263 - DNA, 25 bp, Rattus norvegicus
tccttgagtttcgtcttcctttaca

SEQ ID NO: 589264 - DNA, 25 bp, Rattus norvegicus
tccttgatacacacataccttctaa

SEQ ID NO: 589265 - DNA, 25 bp, Rattus norvegicus
tccttgatacactcataccttctaa

SEQ ID NO: 589266 - DNA, 25 bp, Rattus norvegicus
tccttgatgctgacaccgtacagag

SEQ ID NO: 589267 - DNA, 25 bp, Rattus norvegicus
tccttgatgctgtcaccgtacagag

SEQ ID NO: 589268 - DNA, 25 bp, Rattus norvegicus
tccttgatgttgctggaggcgccac

SEQ ID NO: 589269 - DNA, 25 bp, Rattus norvegicus
tccttgatgttggtggaggcgccac

SEQ ID NO: 589270 - DNA, 25 bp, Rattus norvegicus
tccttgattggtcggtgggtcttaa

SEQ ID NO: 589271 - DNA, 25 bp, Rattus norvegicus
tccttgattggtgggtgggtcttaa

SEQ ID NO: 589272 - DNA, 25 bp, Rattus norvegicus
tccttgcaagcacagattacccaga

SEQ ID NO: 589273 - DNA, 25 bp, Rattus norvegicus
tccttgcaagcagagattacccaga

SEQ ID NO: 589274 - DNA, 25 bp, Rattus norvegicus
tccttgcacaggaagaagctctcta

SEQ ID NO: 589275 - DNA, 25 bp, Rattus norvegicus
tccttgcacaggtagaagctctcta

SEQ ID NO: 589276 - DNA, 25 bp, Rattus norvegicus
tccttgcacttgatatgtagacgag

SEQ ID NO: 589277 - DNA, 25 bp, Rattus norvegicus
tccttgcacttgttatgtagacgag

SEQ ID NO: 589278 - DNA, 25 bp, Rattus norvegicus
tccttgcatctgaatgtcttctctg

SEQ ID NO: 589279 - DNA, 25 bp, Rattus norvegicus
tccttgcatctgtatgtcttctctg

SEQ ID NO: 589280 - DNA, 25 bp, Rattus norvegicus
tccttgccaatgatcggaaagcttt

SEQ ID NO: 589281 - DNA, 25 bp, Rattus norvegicus
tccttgccaatgttcggaaagcttt

SEQ ID NO: 589282 - DNA, 25 bp, Rattus norvegicus
tccttgcctctgagggttacctgta

SEQ ID NO: 589283 - DNA, 25 bp, Rattus norvegicus
tccttgcctctgtgggttacctgta

SEQ ID NO: 589284 - DNA, 25 bp, Rattus norvegicus
tccttgcctgccactatttctgtga

SEQ ID NO: 589285 - DNA, 25 bp, Rattus norvegicus
tccttgcctgcctctatttctgtga

SEQ ID NO: 589286 - DNA, 25 bp, Rattus norvegicus
tccttgcctggcaggagtttacaga

SEQ ID NO: 589287 - DNA, 25 bp, Rattus norvegicus
tccttgcctggctggagtttacaga

SEQ ID NO: 589288 - DNA, 25 bp, Rattus norvegicus
tccttgcgaactcgagcaacccaag

SEQ ID NO: 589289 - DNA, 25 bp, Rattus norvegicus
tccttgcgaactggagcaacccaag

SEQ ID NO: 589290 - DNA, 25 bp, Rattus norvegicus
tccttgcgcctaatgctctgtaaag

SEQ ID NO: 589291 - DNA, 25 bp, Rattus norvegicus
tccttgcgcctattgctctgtaaag

SEQ ID NO: 589292 - DNA, 25 bp, Rattus norvegicus
tccttgctatgcctcagaagactaa

SEQ ID NO: 589293 - DNA, 25 bp, Rattus norvegicus
tccttgctatgcgtcagaagactaa

SEQ ID NO: 589294 - DNA, 25 bp, Rattus norvegicus
tccttgctgtatccattttgctatg

SEQ ID NO: 589295 - DNA, 25 bp, Rattus norvegicus
tccttgctgtatgcattttgctatg

SEQ ID NO: 589296 - DNA, 25 bp, Rattus norvegicus
tccttgcttcacacctgaagattca

SEQ ID NO: 589297 - DNA, 25 bp, Rattus norvegicus
tccttgcttcactcctgaagattca

SEQ ID NO: 589298 - DNA, 25 bp, Rattus norvegicus
tccttgcttctaataacctgttctg

SEQ ID NO: 589299 - DNA, 25 bp, Rattus norvegicus
tccttgcttctattaacctgttctg

SEQ ID NO: 589300 - DNA, 25 bp, Rattus norvegicus
tccttgcttgctacttttcaatgtt

SEQ ID NO: 589301 - DNA, 25 bp, Rattus norvegicus
tccttgcttgcttcttttcaatgtt

SEQ ID NO: 589302 - DNA, 25 bp, Rattus norvegicus
tccttgcttggaacgctaatgtatt

SEQ ID NO: 589303 - DNA, 25 bp, Rattus norvegicus
tccttgcttggatcgctaatgtatt

SEQ ID NO: 589304 - DNA, 25 bp, Rattus norvegicus
tccttgctttccctctagattagag

SEQ ID NO: 589305 - DNA, 25 bp, Rattus norvegicus
tccttgctttccgtctagattagag

SEQ ID NO: 589306 - DNA, 25 bp, Rattus norvegicus
tccttgctttgactgggacccaaaa

SEQ ID NO: 589307 - DNA, 25 bp, Rattus norvegicus
tccttgctttgagtgggacccaaaa

SEQ ID NO: 589308 - DNA, 25 bp, Rattus norvegicus
tccttgctttggagtcctgactgag

SEQ ID NO: 589309 - DNA, 25 bp, Rattus norvegicus
tccttgctttggtgtcctgactgag

SEQ ID NO: 589310 - DNA, 25 bp, Rattus norvegicus
tccttgctttgtattggtttataat

SEQ ID NO: 589311 - DNA, 25 bp, Rattus norvegicus
tccttgctttgttttggtttataat

SEQ ID NO: 589312 - DNA, 25 bp, Rattus norvegicus
tccttgctttttacagatttctcat

SEQ ID NO: 589313 - DNA, 25 bp, Rattus norvegicus
tccttgcttttttcagatttctcat

SEQ ID NO: 589314 - DNA, 25 bp, Rattus norvegicus
tccttggaaaaacctgtggccctgt

SEQ ID NO: 589315 - DNA, 25 bp, Rattus norvegicus
tccttggaaaaagctgtggccctgt

SEQ ID NO: 589316 - DNA, 25 bp, Rattus norvegicus
tccttggaagctacctgcattgatg

SEQ ID NO: 589317 - DNA, 25 bp, Rattus norvegicus
tccttggaagcttcctgcattgatg

SEQ ID NO: 589318 - DNA, 25 bp, Rattus norvegicus
tccttggacggtattggctctgaga

SEQ ID NO: 589319 - DNA, 25 bp, Rattus norvegicus
tccttggacggttttggctctgaga

SEQ ID NO: 589320 - DNA, 25 bp, Rattus norvegicus
tccttggagactctttcttctttta

SEQ ID NO: 589321 - DNA, 25 bp, Rattus norvegicus
tccttggagactgtttcttctttta

SEQ ID NO: 589322 - DNA, 25 bp, Rattus norvegicus
tccttggagaggcttggccagccac

SEQ ID NO: 589323 - DNA, 25 bp, Rattus norvegicus
tccttggagagggttggccagccac

SEQ ID NO: 589324 - DNA, 25 bp, Rattus norvegicus
tccttggagccgctcttgaagagca

SEQ ID NO: 589325 - DNA, 25 bp, Rattus norvegicus
tccttggagccggtcttgaagagca

SEQ ID NO: 589326 - DNA, 25 bp, Rattus norvegicus
tccttggcaggaccagtgtgtgatc

SEQ ID NO: 589327 - DNA, 25 bp, Rattus norvegicus
tccttggcaggagcagtgtgtgatc

SEQ ID NO: 589328 - DNA, 25 bp, Rattus norvegicus
tccttggcatctcacgtatgctgaa

SEQ ID NO: 589329 - DNA, 25 bp, Rattus norvegicus
tccttggcatctgacgtatgctgaa

SEQ ID NO: 589330 - DNA, 25 bp, Rattus norvegicus
tccttggccaaacagtttccgcaaa

SEQ ID NO: 589331 - DNA, 25 bp, Rattus norvegicus
tccttggccaaagagtttccgcaaa

SEQ ID NO: 589332 - DNA, 25 bp, Rattus norvegicus
tccttggccataaacctagcttgag

SEQ ID NO: 589333 - DNA, 25 bp, Rattus norvegicus
tccttggccatatacctagcttgag

SEQ ID NO: 589334 - DNA, 25 bp, Rattus norvegicus
tccttggccccgaattgtgttaatt

SEQ ID NO: 589335 - DNA, 25 bp, Rattus norvegicus
tccttggccccgtattgtgttaatt

SEQ ID NO: 589336 - DNA, 25 bp, Rattus norvegicus
tccttggcggcaaacagggatcgta

SEQ ID NO: 589337 - DNA, 25 bp, Rattus norvegicus
tccttggcggcatacagggatcgta

SEQ ID NO: 589338 - DNA, 25 bp, Rattus norvegicus
tccttggcgtggctcctggtcatag

SEQ ID NO: 589339 - DNA, 25 bp, Rattus norvegicus
tccttggcgtgggtcctggtcatag

SEQ ID NO: 589340 - DNA, 25 bp, Rattus norvegicus
tccttggctgttagctgctgctaaa

SEQ ID NO: 589341 - DNA, 25 bp, Rattus norvegicus
tccttggctgtttgctgctgctaaa

SEQ ID NO: 589342 - DNA, 25 bp, Rattus norvegicus
tccttggcttgcatagatgtttccc

SEQ ID NO: 589343 - DNA, 25 bp, Rattus norvegicus
tccttggcttgcttagatgtttccc

SEQ ID NO: 589344 - DNA, 25 bp, Rattus norvegicus
tccttgggacccatgtgttggaagc

SEQ ID NO: 589345 - DNA, 25 bp, Rattus norvegicus
tccttgggacccttgtgttggaagc

SEQ ID NO: 589346 - DNA, 25 bp, Rattus norvegicus
tccttgggcagcatgcgtgcagcat

SEQ ID NO: 589347 - DNA, 25 bp, Rattus norvegicus
tccttgggcagcttgcgtgcagcat

SEQ ID NO: 589348 - DNA, 25 bp, Rattus norvegicus
tccttgggctgcaggtgaacttctg

SEQ ID NO: 589349 - DNA, 25 bp, Rattus norvegicus
tccttgggctgctggtgaacttctg

SEQ ID NO: 589350 - DNA, 25 bp, Rattus norvegicus
tccttgggtgacatcgggtagtcag

SEQ ID NO: 589351 - DNA, 25 bp, Rattus norvegicus
tccttgggtgacttcgggtagtcag

SEQ ID NO: 589352 - DNA, 25 bp, Rattus norvegicus
tccttgggtggcatccattttgaca

SEQ ID NO: 589353 - DNA, 25 bp, Rattus norvegicus
tccttgggtggcttccattttgaca

SEQ ID NO: 589354 - DNA, 25 bp, Rattus norvegicus
tccttggtcacgcacagtactgtga

SEQ ID NO: 589355 - DNA, 25 bp, Rattus norvegicus
tccttggtcacggacagtactgtga

SEQ ID NO: 589356 - DNA, 25 bp, Rattus norvegicus
tccttggtcagcagcatcttgagaa

SEQ ID NO: 589357 - DNA, 25 bp, Rattus norvegicus
tccttggtcagctgcatcttgagaa

SEQ ID NO: 589358 - DNA, 25 bp, Rattus norvegicus
tccttggtgcaaccctcaggcaaat

SEQ ID NO: 589359 - DNA, 25 bp, Rattus norvegicus
tccttggtgcaagcctcaggcaaat

SEQ ID NO: 589360 - DNA, 25 bp, Rattus norvegicus
tccttggtgctaatcgattttgagt

SEQ ID NO: 589361 - DNA, 25 bp, Rattus norvegicus
tccttggtgctattcgattttgagt

SEQ ID NO: 589362 - DNA, 25 bp, Rattus norvegicus
tccttggtggacactggacacacga

SEQ ID NO: 589363 - DNA, 25 bp, Rattus norvegicus
tccttggtggactctggacacacga

SEQ ID NO: 589364 - DNA, 25 bp, Rattus norvegicus
tccttggtgtttacttgcttctact

SEQ ID NO: 589365 - DNA, 25 bp, Rattus norvegicus
tccttggtgtttcttaccgtcatct

SEQ ID NO: 589366 - DNA, 25 bp, Rattus norvegicus
tccttggtgtttgttaccgtcatct

SEQ ID NO: 589367 - DNA, 25 bp, Rattus norvegicus
tccttggtgttttcttgcttctact

SEQ ID NO: 589368 - DNA, 25 bp, Rattus norvegicus
tccttggttaccagagtcgctgcag

SEQ ID NO: 589369 - DNA, 25 bp, Rattus norvegicus
tccttggttacctgagtcgctgcag

SEQ ID NO: 589370 - DNA, 25 bp, Rattus norvegicus
tccttggttggaagctattcttttg

SEQ ID NO: 589371 - DNA, 25 bp, Rattus norvegicus
tccttggttggatgctattcttttg

SEQ ID NO: 589372 - DNA, 25 bp, Rattus norvegicus
tccttggttttgacgtcttgactgt

SEQ ID NO: 589373 - DNA, 25 bp, Rattus norvegicus
tccttggttttgtcgtcttgactgt

SEQ ID NO: 589374 - DNA, 25 bp, Rattus norvegicus
tccttgtaatgaactggagcccaca

SEQ ID NO: 589375 - DNA, 25 bp, Rattus norvegicus
tccttgtaatgatctggagcccaca

SEQ ID NO: 589376 - DNA, 25 bp, Rattus norvegicus
tccttgtaattaagcctctcggaca

SEQ ID NO: 589377 - DNA, 25 bp, Rattus norvegicus
tccttgtaattatgcctctcggaca

SEQ ID NO: 589378 - DNA, 25 bp, Rattus norvegicus
tccttgtaccctaggccacaaagtc

SEQ ID NO: 589379 - DNA, 25 bp, Rattus norvegicus
tccttgtacccttggccacaaagtc

SEQ ID NO: 589380 - DNA, 25 bp, Rattus norvegicus
tccttgtagctgcaaccagtctata

SEQ ID NO: 589381 - DNA, 25 bp, Rattus norvegicus
tccttgtagctggaaccagtctata

SEQ ID NO: 589382 - DNA, 25 bp, Rattus norvegicus
tccttgtcatgaaggttcggtgcat

SEQ ID NO: 589383 - DNA, 25 bp, Rattus norvegicus
tccttgtcatgatggttcggtgcat

SEQ ID NO: 589384 - DNA, 25 bp, Rattus norvegicus
tccttgtccactattcattttcctc

SEQ ID NO: 589385 - DNA, 25 bp, Rattus norvegicus
tccttgtccacttttcattttcctc

SEQ ID NO: 589386 - DNA, 25 bp, Rattus norvegicus
tccttgtcccaacgctgaagtcatg

SEQ ID NO: 589387 - DNA, 25 bp, Rattus norvegicus
tccttgtcccaaggctgaagtcatg

SEQ ID NO: 589388 - DNA, 25 bp, Rattus norvegicus
tccttgtcctagatggatataaccc

SEQ ID NO: 589389 - DNA, 25 bp, Rattus norvegicus
tccttgtcctagttggatataaccc

SEQ ID NO: 589390 - DNA, 25 bp, Rattus norvegicus
tccttgtcgcccagggctcagtgtt

SEQ ID NO: 589391 - DNA, 25 bp, Rattus norvegicus
tccttgtcgccctgggctcagtgtt

SEQ ID NO: 589392 - DNA, 25 bp, Rattus norvegicus
tccttgtcgggcaccacgaggaagg

SEQ ID NO: 589393 - DNA, 25 bp, Rattus norvegicus
tccttgtcgggctccacgaggaagg

SEQ ID NO: 589394 - DNA, 25 bp, Rattus norvegicus
tccttgtgatgcagaatgactgtgt

SEQ ID NO: 589395 - DNA, 25 bp, Rattus norvegicus
tccttgtgatgctgaatgactgtgt

SEQ ID NO: 589396 - DNA, 25 bp, Rattus norvegicus
tccttgtgggttcaactctggtgct

SEQ ID NO: 589397 - DNA, 25 bp, Rattus norvegicus
tccttgtgggttgaactctggtgct

SEQ ID NO: 589398 - DNA, 25 bp, Rattus norvegicus
tccttgttgctgattgatgaatact

SEQ ID NO: 589399 - DNA, 25 bp, Rattus norvegicus
tccttgttgctgtttgatgaatact

SEQ ID NO: 589400 - DNA, 25 bp, Rattus norvegicus
tccttgtttctcacaccttttatag

SEQ ID NO: 589401 - DNA, 25 bp, Rattus norvegicus
tccttgtttctctcaccttttatag

SEQ ID NO: 589402 - DNA, 25 bp, Rattus norvegicus
tccttgtttggaccactggattcaa

SEQ ID NO: 589403 - DNA, 25 bp, Rattus norvegicus
tccttgtttggagcactggattcaa

SEQ ID NO: 589404 - DNA, 25 bp, Rattus norvegicus
tcctttaaccacactgtagcttttt

SEQ ID NO: 589405 - DNA, 25 bp, Rattus norvegicus
tcctttaaccactctgtagcttttt

SEQ ID NO: 589406 - DNA, 25 bp, Rattus norvegicus
tcctttaattccactgggccggtga

SEQ ID NO: 589407 - DNA, 25 bp, Rattus norvegicus
tcctttaattcctctgggccggtga

SEQ ID NO: 589408 - DNA, 25 bp, Rattus norvegicus
tcctttacaccgaggctgctattcc

SEQ ID NO: 589409 - DNA, 25 bp, Rattus norvegicus
tcctttacaccgtggctgctattcc

SEQ ID NO: 589410 - DNA, 25 bp, Rattus norvegicus
tcctttactcacagattctcttcat

SEQ ID NO: 589411 - DNA, 25 bp, Rattus norvegicus
tcctttactcactgattctcttcat

SEQ ID NO: 589412 - DNA, 25 bp, Rattus norvegicus
tcctttactccgagtactctgtaaa

SEQ ID NO: 589413 - DNA, 25 bp, Rattus norvegicus
tcctttactccgtgtactctgtaaa

SEQ ID NO: 589414 - DNA, 25 bp, Rattus norvegicus
tcctttagcggaatgttctgcctta

SEQ ID NO: 589415 - DNA, 25 bp, Rattus norvegicus
tcctttagcggattgttctgcctta

SEQ ID NO: 589416 - DNA, 25 bp, Rattus norvegicus
tcctttagcttaaccagggtaagtc

SEQ ID NO: 589417 - DNA, 25 bp, Rattus norvegicus
tcctttagcttatccagggtaagtc

SEQ ID NO: 589418 - DNA, 25 bp, Rattus norvegicus
tcctttagtcagagttccaacctta

SEQ ID NO: 589419 - DNA, 25 bp, Rattus norvegicus
tcctttagtcagtgttccaacctta

SEQ ID NO: 589420 - DNA, 25 bp, Rattus norvegicus
tcctttagtctcctattcgcatgaa

SEQ ID NO: 589421 - DNA, 25 bp, Rattus norvegicus
tcctttagtctcgtattcgcatgaa

SEQ ID NO: 589422 - DNA, 25 bp, Rattus norvegicus
tcctttagtctgatggtacttttga

SEQ ID NO: 589423 - DNA, 25 bp, Rattus norvegicus
tcctttagtctgttggtacttttga

SEQ ID NO: 589424 - DNA, 25 bp, Rattus norvegicus
tcctttatatgcactgtgacgtaca

SEQ ID NO: 589425 - DNA, 25 bp, Rattus norvegicus
tcctttatatgctctgtgacgtaca

SEQ ID NO: 589426 - DNA, 25 bp, Rattus norvegicus
tcctttatcaccactaatctctaat

SEQ ID NO: 589427 - DNA, 25 bp, Rattus norvegicus
tcctttatcacctctaatctctaat

SEQ ID NO: 589428 - DNA, 25 bp, Rattus norvegicus
tcctttcaagttcttgctttgagtt

SEQ ID NO: 589429 - DNA, 25 bp, Rattus norvegicus
tcctttcaagttgttgctttgagtt

SEQ ID NO: 589430 - DNA, 25 bp, Rattus norvegicus
tcctttcaatgaagctgttctactg

SEQ ID NO: 589431 - DNA, 25 bp, Rattus norvegicus
tcctttcaatgatgctgttctactg

SEQ ID NO: 589432 - DNA, 25 bp, Rattus norvegicus
tcctttcaatttctaaccccttgag

SEQ ID NO: 589433 - DNA, 25 bp, Rattus norvegicus
tcctttcaatttgtaaccccttgag

SEQ ID NO: 589434 - DNA, 25 bp, Rattus norvegicus
tcctttcactcactctcatttgaga

SEQ ID NO: 589435 - DNA, 25 bp, Rattus norvegicus
tcctttcactcagtctcatttgaga

SEQ ID NO: 589436 - DNA, 25 bp, Rattus norvegicus
tcctttcactgtatgatgctgttga

SEQ ID NO: 589437 - DNA, 25 bp, Rattus norvegicus
tcctttcactgtttgatgctgttga

SEQ ID NO: 589438 - DNA, 25 bp, Rattus norvegicus
tcctttcataacatcggcttcgaga

SEQ ID NO: 589439 - DNA, 25 bp, Rattus norvegicus
tcctttcataacttcggcttcgaga

SEQ ID NO: 589440 - DNA, 25 bp, Rattus norvegicus
tcctttcatggcactgtagctcaaa

SEQ ID NO: 589441 - DNA, 25 bp, Rattus norvegicus
tcctttcatggctctgtagctcaaa

SEQ ID NO: 589442 - DNA, 25 bp, Rattus norvegicus
tcctttccaaaaacgggatccttca

SEQ ID NO: 589443 - DNA, 25 bp, Rattus norvegicus
tcctttccaaaatcgggatccttca

SEQ ID NO: 589444 - DNA, 25 bp, Rattus norvegicus
tcctttccagtgctccaggatgctg

SEQ ID NO: 589445 - DNA, 25 bp, Rattus norvegicus
tcctttccagtggtccaggatgctg

SEQ ID NO: 589446 - DNA, 25 bp, Rattus norvegicus
tcctttccatttagcacttgcacta

SEQ ID NO: 589447 - DNA, 25 bp, Rattus norvegicus
tcctttccattttgcacttgcacta

SEQ ID NO: 589448 - DNA, 25 bp, Rattus norvegicus
tcctttcccagcctctagagttcgg

SEQ ID NO: 589449 - DNA, 25 bp, Rattus norvegicus
tcctttcccagcgtctagagttcgg

SEQ ID NO: 589450 - DNA, 25 bp, Rattus norvegicus
tcctttccctatattctgttgttat

SEQ ID NO: 589451 - DNA, 25 bp, Rattus norvegicus
tcctttccctatcaagtactcttaa

SEQ ID NO: 589452 - DNA, 25 bp, Rattus norvegicus
tcctttccctatgaagtactcttaa

SEQ ID NO: 589453 - DNA, 25 bp, Rattus norvegicus
tcctttccctattttctgttgttat

SEQ ID NO: 589454 - DNA, 25 bp, Rattus norvegicus
tcctttccctgaaggttctttcttt

SEQ ID NO: 589455 - DNA, 25 bp, Rattus norvegicus
tcctttccctgatggttctttcttt

SEQ ID NO: 589456 - DNA, 25 bp, Rattus norvegicus
tcctttcccttccttaatagaagca

SEQ ID NO: 589457 - DNA, 25 bp, Rattus norvegicus
tcctttcccttcgttaatagaagca

SEQ ID NO: 589458 - DNA, 25 bp, Rattus norvegicus
tcctttcccttgccccgattgtggg

SEQ ID NO: 589459 - DNA, 25 bp, Rattus norvegicus
tcctttcccttggcccgattgtggg

SEQ ID NO: 589460 - DNA, 25 bp, Rattus norvegicus
tcctttcctatcattttctctttag

SEQ ID NO: 589461 - DNA, 25 bp, Rattus norvegicus
tcctttcctatctttttctctttag

SEQ ID NO: 589462 - DNA, 25 bp, Rattus norvegicus
tcctttcctctgcaagggacttggc

SEQ ID NO: 589463 - DNA, 25 bp, Rattus norvegicus
tcctttcctctggaagggacttggc

SEQ ID NO: 589464 - DNA, 25 bp, Rattus norvegicus
tcctttcctcttcacactctaaaat

SEQ ID NO: 589465 - DNA, 25 bp, Rattus norvegicus
tcctttcctcttgacactctaaaat

SEQ ID NO: 589466 - DNA, 25 bp, Rattus norvegicus
tcctttcctgagagccctaaaaact

SEQ ID NO: 589467 - DNA, 25 bp, Rattus norvegicus
tcctttcctgagataagcacccgga

SEQ ID NO: 589468 - DNA, 25 bp, Rattus norvegicus
tcctttcctgagtgccctaaaaact

SEQ ID NO: 589469 - DNA, 25 bp, Rattus norvegicus
tcctttcctgagttaagcacccgga

SEQ ID NO: 589470 - DNA, 25 bp, Rattus norvegicus
tcctttcctggcagtgacatccatg

SEQ ID NO: 589471 - DNA, 25 bp, Rattus norvegicus
tcctttcctggctgtgacatccatg

SEQ ID NO: 589472 - DNA, 25 bp, Rattus norvegicus
tcctttccttgtcggtgacacagag

SEQ ID NO: 589473 - DNA, 25 bp, Rattus norvegicus
tcctttccttgtgggtgacacagag

SEQ ID NO: 589474 - DNA, 25 bp, Rattus norvegicus
tcctttctactaccattatctctaa

SEQ ID NO: 589475 - DNA, 25 bp, Rattus norvegicus
tcctttctactagcattatctctaa

SEQ ID NO: 589476 - DNA, 25 bp, Rattus norvegicus
tcctttctacttctaacgagtcatt

SEQ ID NO: 589477 - DNA, 25 bp, Rattus norvegicus
tcctttctacttgtaacgagtcatt

SEQ ID NO: 589478 - DNA, 25 bp, Rattus norvegicus
tcctttctagctccaactgttcagt

SEQ ID NO: 589479 - DNA, 25 bp, Rattus norvegicus
tcctttctagctgcaactgttcagt

SEQ ID NO: 589480 - DNA, 25 bp, Rattus norvegicus
tcctttctcaatctagtggccttgg

SEQ ID NO: 589481 - DNA, 25 bp, Rattus norvegicus
tcctttctcaatgtagtggccttgg

SEQ ID NO: 589482 - DNA, 25 bp, Rattus norvegicus
tcctttctcagccacaacaatgcaa

SEQ ID NO: 589483 - DNA, 25 bp, Rattus norvegicus
tcctttctcagcgacaacaatgcaa

SEQ ID NO: 589484 - DNA, 25 bp, Rattus norvegicus
tcctttctcctgaagactttccaac

SEQ ID NO: 589485 - DNA, 25 bp, Rattus norvegicus
tcctttctcctgtagactttccaac

SEQ ID NO: 589486 - DNA, 25 bp, Rattus norvegicus
tcctttctctacatctgtggtccag

SEQ ID NO: 589487 - DNA, 25 bp, Rattus norvegicus
tcctttctctacttctgtggtccag

SEQ ID NO: 589488 - DNA, 25 bp, Rattus norvegicus
tcctttctgaggagaccatcaattc

SEQ ID NO: 589489 - DNA, 25 bp, Rattus norvegicus
tcctttctgaggtgaccatcaattc

SEQ ID NO: 589490 - DNA, 25 bp, Rattus norvegicus
tcctttctgctcagattcttatgtc

SEQ ID NO: 589491 - DNA, 25 bp, Rattus norvegicus
tcctttctgctctgattcttatgtc

SEQ ID NO: 589492 - DNA, 25 bp, Rattus norvegicus
tcctttctgggtactgagatggcac

SEQ ID NO: 589493 - DNA, 25 bp, Rattus norvegicus
tcctttctgggttctgagatggcac

SEQ ID NO: 589494 - DNA, 25 bp, Rattus norvegicus
tcctttcttcgacctttactgattt

SEQ ID NO: 589495 - DNA, 25 bp, Rattus norvegicus
tcctttcttcgagctttactgattt

SEQ ID NO: 589496 - DNA, 25 bp, Rattus norvegicus
tcctttcttcttcaagttgcctttg

SEQ ID NO: 589497 - DNA, 25 bp, Rattus norvegicus
tcctttcttcttgaagttgcctttg

SEQ ID NO: 589498 - DNA, 25 bp, Rattus norvegicus
tcctttcttgttacaatcccaacta

SEQ ID NO: 589499 - DNA, 25 bp, Rattus norvegicus
tcctttcttgtttcaatcccaacta

SEQ ID NO: 589500 - DNA, 25 bp, Rattus norvegicus
tcctttctttttctcactgggttag

SEQ ID NO: 589501 - DNA, 25 bp, Rattus norvegicus
tcctttctttttgtcactgggttag

SEQ ID NO: 589502 - DNA, 25 bp, Rattus norvegicus
tcctttgaactccagggcatcagac

SEQ ID NO: 589503 - DNA, 25 bp, Rattus norvegicus
tcctttgaactcgagggcatcagac

SEQ ID NO: 589504 - DNA, 25 bp, Rattus norvegicus
tcctttgaatataagcagtgatggc

SEQ ID NO: 589505 - DNA, 25 bp, Rattus norvegicus
tcctttgaatattagcagtgatggc

SEQ ID NO: 589506 - DNA, 25 bp, Rattus norvegicus
tcctttgaccttaatctccttgtta

SEQ ID NO: 589507 - DNA, 25 bp, Rattus norvegicus
tcctttgaccttagggtgcctaaat

SEQ ID NO: 589508 - DNA, 25 bp, Rattus norvegicus
tcctttgacctttatctccttgtta

SEQ ID NO: 589509 - DNA, 25 bp, Rattus norvegicus
tcctttgacctttgggtgcctaaat

SEQ ID NO: 589510 - DNA, 25 bp, Rattus norvegicus
tcctttgactctatttcttgcttag

SEQ ID NO: 589511 - DNA, 25 bp, Rattus norvegicus
tcctttgactctttttcttgcttag

SEQ ID NO: 589512 - DNA, 25 bp, Rattus norvegicus
tcctttgaggttctagagtccgaga

SEQ ID NO: 589513 - DNA, 25 bp, Rattus norvegicus
tcctttgaggttgtagagtccgaga

SEQ ID NO: 589514 - DNA, 25 bp, Rattus norvegicus
tcctttgagtttacagttacattaa

SEQ ID NO: 589515 - DNA, 25 bp, Rattus norvegicus
tcctttgagttttcagttacattaa

SEQ ID NO: 589516 - DNA, 25 bp, Rattus norvegicus
tcctttgatgtaaacgatgctcccc

SEQ ID NO: 589517 - DNA, 25 bp, Rattus norvegicus
tcctttgatgtacggcaattgcgac

SEQ ID NO: 589518 - DNA, 25 bp, Rattus norvegicus
tcctttgatgtagggcaattgcgac

SEQ ID NO: 589519 - DNA, 25 bp, Rattus norvegicus
tcctttgatgtatacgatgctcccc

SEQ ID NO: 589520 - DNA, 25 bp, Rattus norvegicus
tcctttgcattaacctgtggcaaac

SEQ ID NO: 589521 - DNA, 25 bp, Rattus norvegicus
tcctttgcattatcctgtggcaaac

SEQ ID NO: 589522 - DNA, 25 bp, Rattus norvegicus
tcctttgccattcacaagtgtctgg

SEQ ID NO: 589523 - DNA, 25 bp, Rattus norvegicus
tcctttgccattgacaagtgtctgg

SEQ ID NO: 589524 - DNA, 25 bp, Rattus norvegicus
tcctttgcccagatgctgagggttg

SEQ ID NO: 589525 - DNA, 25 bp, Rattus norvegicus
tcctttgcccagttgctgagggttg

SEQ ID NO: 589526 - DNA, 25 bp, Rattus norvegicus
tcctttgcctctaaatgggtcccaa

SEQ ID NO: 589527 - DNA, 25 bp, Rattus norvegicus
tcctttgcctcttaatgggtcccaa

SEQ ID NO: 589528 - DNA, 25 bp, Rattus norvegicus
tcctttgcctgccttgtatctaaga

SEQ ID NO: 589529 - DNA, 25 bp, Rattus norvegicus
tcctttgcctgcgttgtatctaaga

SEQ ID NO: 589530 - DNA, 25 bp, Rattus norvegicus
tcctttgcggaacctgacatttttc

SEQ ID NO: 589531 - DNA, 25 bp, Rattus norvegicus
tcctttgcggaagctgacatttttc

SEQ ID NO: 589532 - DNA, 25 bp, Rattus norvegicus
tcctttgcgtagaatgtgggcttcc

SEQ ID NO: 589533 - DNA, 25 bp, Rattus norvegicus
tcctttgcgtagtatgtgggcttcc

SEQ ID NO: 589534 - DNA, 25 bp, Rattus norvegicus
tcctttgcgttcctcgtttaagcaa

SEQ ID NO: 589535 - DNA, 25 bp, Rattus norvegicus
tcctttgcgttcgtcgtttaagcaa

SEQ ID NO: 589536 - DNA, 25 bp, Rattus norvegicus
tcctttgctttcagctgtctcttag

SEQ ID NO: 589537 - DNA, 25 bp, Rattus norvegicus
tcctttgctttctgctgtctcttag

SEQ ID NO: 589538 - DNA, 25 bp, Rattus norvegicus
tcctttggcaggaaggtgtcttgct

SEQ ID NO: 589539 - DNA, 25 bp, Rattus norvegicus
tcctttggcaggtaggtgtcttgct

SEQ ID NO: 589540 - DNA, 25 bp, Rattus norvegicus
tcctttggctgcaaattgcaatcat

SEQ ID NO: 589541 - DNA, 25 bp, Rattus norvegicus
tcctttggctgctaattgcaatcat

SEQ ID NO: 589542 - DNA, 25 bp, Rattus norvegicus
tcctttgtaacaaatgagcatcaga

SEQ ID NO: 589543 - DNA, 25 bp, Rattus norvegicus
tcctttgtaacatatgagcatcaga

SEQ ID NO: 589544 - DNA, 25 bp, Rattus norvegicus
tcctttgtctgcagaatctcacagt

SEQ ID NO: 589545 - DNA, 25 bp, Rattus norvegicus
tcctttgtctgctgaatctcacagt

SEQ ID NO: 589546 - DNA, 25 bp, Rattus norvegicus
tcctttgtgggcaggttcctcggct

SEQ ID NO: 589547 - DNA, 25 bp, Rattus norvegicus
tcctttgtgggctggttcctcggct

SEQ ID NO: 589548 - DNA, 25 bp, Rattus norvegicus
tcctttgttcttactgcatcacaac

SEQ ID NO: 589549 - DNA, 25 bp, Rattus norvegicus
tcctttgttctttctgcatcacaac

SEQ ID NO: 589550 - DNA, 25 bp, Rattus norvegicus
tcctttgttttacgcctggaagcaa

SEQ ID NO: 589551 - DNA, 25 bp, Rattus norvegicus
tcctttgttttacggtgtctcttgg

SEQ ID NO: 589552 - DNA, 25 bp, Rattus norvegicus
tcctttgttttaggcctggaagcaa

SEQ ID NO: 589553 - DNA, 25 bp, Rattus norvegicus
tcctttgttttagggtgtctcttgg

SEQ ID NO: 589554 - DNA, 25 bp, Rattus norvegicus
tccttttaaattaccctcgatcaca

SEQ ID NO: 589555 - DNA, 25 bp, Rattus norvegicus
tccttttaaatttccctcgatcaca

SEQ ID NO: 589556 - DNA, 25 bp, Rattus norvegicus
tccttttaactaatctctttggcgg

SEQ ID NO: 589557 - DNA, 25 bp, Rattus norvegicus
tccttttaactattctctttggcgg

SEQ ID NO: 589558 - DNA, 25 bp, Rattus norvegicus
tccttttagcagagtgaaccccttt

SEQ ID NO: 589559 - DNA, 25 bp, Rattus norvegicus
tccttttagcagtgtgaaccccttt

SEQ ID NO: 589560 - DNA, 25 bp, Rattus norvegicus
tccttttagcttactgtcataccca

SEQ ID NO: 589561 - DNA, 25 bp, Rattus norvegicus
tccttttagctttctgtcataccca

SEQ ID NO: 589562 - DNA, 25 bp, Rattus norvegicus
tccttttaggatactctgactgcag

SEQ ID NO: 589563 - DNA, 25 bp, Rattus norvegicus
tccttttaggattctctgactgcag

SEQ ID NO: 589564 - DNA, 25 bp, Rattus norvegicus
tccttttatcctcttgtgtattcac

SEQ ID NO: 589565 - DNA, 25 bp, Rattus norvegicus
tccttttatcctgttgtgtattcac

SEQ ID NO: 589566 - DNA, 25 bp, Rattus norvegicus
tccttttatgtaagacactgtagat

SEQ ID NO: 589567 - DNA, 25 bp, Rattus norvegicus
tccttttatgtatgacactgtagat

SEQ ID NO: 589568 - DNA, 25 bp, Rattus norvegicus
tccttttcacacacactgtctagaa

SEQ ID NO: 589569 - DNA, 25 bp, Rattus norvegicus
tccttttcacactcactgtctagaa

SEQ ID NO: 589570 - DNA, 25 bp, Rattus norvegicus
tccttttcagttctgggttaccatt

SEQ ID NO: 589571 - DNA, 25 bp, Rattus norvegicus
tccttttcagttgtgggttaccatt

SEQ ID NO: 589572 - DNA, 25 bp, Rattus norvegicus
tccttttcataaatacttgctacca

SEQ ID NO: 589573 - DNA, 25 bp, Rattus norvegicus
tccttttcataattacttgctacca

SEQ ID NO: 589574 - DNA, 25 bp, Rattus norvegicus
tccttttccagaccttggtgctagt

SEQ ID NO: 589575 - DNA, 25 bp, Rattus norvegicus
tccttttccagagcttggtgctagt

SEQ ID NO: 589576 - DNA, 25 bp, Rattus norvegicus
tccttttccctgaagttctgtgttt

SEQ ID NO: 589577 - DNA, 25 bp, Rattus norvegicus
tccttttccctgagacgcgaaggag

SEQ ID NO: 589578 - DNA, 25 bp, Rattus norvegicus
tccttttccctgtagttctgtgttt

SEQ ID NO: 589579 - DNA, 25 bp, Rattus norvegicus
tccttttccctgtgacgcgaaggag

SEQ ID NO: 589580 - DNA, 25 bp, Rattus norvegicus
tccttttcctacagcctctgtgctg

SEQ ID NO: 589581 - DNA, 25 bp, Rattus norvegicus
tccttttcctactgcctctgtgctg

SEQ ID NO: 589582 - DNA, 25 bp, Rattus norvegicus
tccttttccttacatgttcctgggt

SEQ ID NO: 589583 - DNA, 25 bp, Rattus norvegicus
tccttttccttagatgttcctgggt

SEQ ID NO: 589584 - DNA, 25 bp, Rattus norvegicus
tccttttctaagctgtggaagccag

SEQ ID NO: 589585 - DNA, 25 bp, Rattus norvegicus
tccttttctaaggtgtggaagccag

SEQ ID NO: 589586 - DNA, 25 bp, Rattus norvegicus
tccttttctacaaacatcccactga

SEQ ID NO: 589587 - DNA, 25 bp, Rattus norvegicus
tccttttctacatacatcccactga

SEQ ID NO: 589588 - DNA, 25 bp, Rattus norvegicus
tccttttctgaaacttgtgtcctta

SEQ ID NO: 589589 - DNA, 25 bp, Rattus norvegicus
tccttttctgaatcttgtgtcctta

SEQ ID NO: 589590 - DNA, 25 bp, Rattus norvegicus
tccttttctggtcttgcagcacgga

SEQ ID NO: 589591 - DNA, 25 bp, Rattus norvegicus
tccttttctggtgttgcagcacgga

SEQ ID NO: 589592 - DNA, 25 bp, Rattus norvegicus
tccttttcttacctccttggatgtt

SEQ ID NO: 589593 - DNA, 25 bp, Rattus norvegicus
tccttttcttacgtccttggatgtt

SEQ ID NO: 589594 - DNA, 25 bp, Rattus norvegicus
tccttttcttctacagcagtgatgt

SEQ ID NO: 589595 - DNA, 25 bp, Rattus norvegicus
tccttttcttcttcagcagtgatgt

SEQ ID NO: 589596 - DNA, 25 bp, Rattus norvegicus
tccttttgatttcttccttttgtca

SEQ ID NO: 589597 - DNA, 25 bp, Rattus norvegicus
tccttttgatttgttccttttgtca

SEQ ID NO: 589598 - DNA, 25 bp, Rattus norvegicus
tccttttgccatcggagggaaactg

SEQ ID NO: 589599 - DNA, 25 bp, Rattus norvegicus
tccttttgccatgggagggaaactg

SEQ ID NO: 589600 - DNA, 25 bp, Rattus norvegicus
tccttttgcctgagctgggaagctt

SEQ ID NO: 589601 - DNA, 25 bp, Rattus norvegicus
tccttttgcctgtgctgggaagctt

SEQ ID NO: 589602 - DNA, 25 bp, Rattus norvegicus
tccttttgctctactagtgtgcatt

SEQ ID NO: 589603 - DNA, 25 bp, Rattus norvegicus
tccttttgctcttctagtgtgcatt

SEQ ID NO: 589604 - DNA, 25 bp, Rattus norvegicus
tccttttggattattcattaaccct

SEQ ID NO: 589605 - DNA, 25 bp, Rattus norvegicus
tccttttggatttttcattaaccct

SEQ ID NO: 589606 - DNA, 25 bp, Rattus norvegicus
tccttttggtttatctagccgagtg

SEQ ID NO: 589607 - DNA, 25 bp, Rattus norvegicus
tccttttggtttttctagccgagtg

SEQ ID NO: 589608 - DNA, 25 bp, Rattus norvegicus
tccttttgtaccatgggcaacacac

SEQ ID NO: 589609 - DNA, 25 bp, Rattus norvegicus
tccttttgtaccttgggcaacacac

SEQ ID NO: 589610 - DNA, 25 bp, Rattus norvegicus
tccttttgtagaactcccgacttag

SEQ ID NO: 589611 - DNA, 25 bp, Rattus norvegicus
tccttttgtagatctcccgacttag

SEQ ID NO: 589612 - DNA, 25 bp, Rattus norvegicus
tccttttgtgcccagtttacatgat

SEQ ID NO: 589613 - DNA, 25 bp, Rattus norvegicus
tccttttgtgccgagtttacatgat

SEQ ID NO: 589614 - DNA, 25 bp, Rattus norvegicus
tccttttgttttaaatgctacccag

SEQ ID NO: 589615 - DNA, 25 bp, Rattus norvegicus
tccttttgtttttaatgctacccag

SEQ ID NO: 589616 - DNA, 25 bp, Rattus norvegicus
tcctttttactcatttcgaacgtgt

SEQ ID NO: 589617 - DNA, 25 bp, Rattus norvegicus
tcctttttactcttttcgaacgtgt

SEQ ID NO: 589618 - DNA, 25 bp, Rattus norvegicus
tcctttttatagagtgctttcctga

SEQ ID NO: 589619 - DNA, 25 bp, Rattus norvegicus
tcctttttatagtgtgctttcctga

SEQ ID NO: 589620 - DNA, 25 bp, Rattus norvegicus
tcctttttatttcttccactggaat

SEQ ID NO: 589621 - DNA, 25 bp, Rattus norvegicus
tcctttttatttgttccactggaat

SEQ ID NO: 589622 - DNA, 25 bp, Rattus norvegicus
tcctttttcctcacaagcacttttt

SEQ ID NO: 589623 - DNA, 25 bp, Rattus norvegicus
tcctttttcctctcaagcacttttt

SEQ ID NO: 589624 - DNA, 25 bp, Rattus norvegicus
tcctttttcttacagtgcactccag

SEQ ID NO: 589625 - DNA, 25 bp, Rattus norvegicus
tcctttttcttagagtgcactccag

SEQ ID NO: 589626 - DNA, 25 bp, Rattus norvegicus
tcctttttcttgatggtgttgctga

SEQ ID NO: 589627 - DNA, 25 bp, Rattus norvegicus
tcctttttcttgttggtgttgctga

SEQ ID NO: 589628 - DNA, 25 bp, Rattus norvegicus
tcctttttgactaagacttacttag

SEQ ID NO: 589629 - DNA, 25 bp, Rattus norvegicus
tcctttttgacttagacttacttag

SEQ ID NO: 589630 - DNA, 25 bp, Rattus norvegicus
tcctttttgggtactctgagtgcag

SEQ ID NO: 589631 - DNA, 25 bp, Rattus norvegicus
tcctttttgggttctctgagtgcag

SEQ ID NO: 589632 - DNA, 25 bp, Rattus norvegicus
tcctttttgtcccaacttgtatgtg

SEQ ID NO: 589633 - DNA, 25 bp, Rattus norvegicus
tcctttttgtccgaacttgtatgtg

SEQ ID NO: 589634 - DNA, 25 bp, Rattus norvegicus
tccttttttatcactatgcctgcaa

SEQ ID NO: 589635 - DNA, 25 bp, Rattus norvegicus
tccttttttatctctatgcctgcaa

SEQ ID NO: 589636 - DNA, 25 bp, Rattus norvegicus
tccttttttcctattagtgatagca

SEQ ID NO: 589637 - DNA, 25 bp, Rattus norvegicus
tccttttttccttttagtgatagca

SEQ ID NO: 589638 - DNA, 25 bp, Rattus norvegicus
tccttttttcgtatatttcctcgag

SEQ ID NO: 589639 - DNA, 25 bp, Rattus norvegicus
tccttttttcgtttatttcctcgag

SEQ ID NO: 589640 - DNA, 25 bp, Rattus norvegicus
tccttttttgttattgctcatttgt

SEQ ID NO: 589641 - DNA, 25 bp, Rattus norvegicus
tccttttttgtttttgctcatttgt

SEQ ID NO: 589642 - DNA, 25 bp, Rattus norvegicus
tcgaaaattcctcctcatctgagag

SEQ ID NO: 589643 - DNA, 25 bp, Rattus norvegicus
tcgaaaattcctgctcatctgagag

SEQ ID NO: 589644 - DNA, 25 bp, Rattus norvegicus
tcgaaaattgtcagtctgtgtctcc

SEQ ID NO: 589645 - DNA, 25 bp, Rattus norvegicus
tcgaaaattgtctgtctgtgtctcc

SEQ ID NO: 589646 - DNA, 25 bp, Rattus norvegicus
tcgaaacctacaaagacaatgtgac

SEQ ID NO: 589647 - DNA, 25 bp, Rattus norvegicus
tcgaaacctacatagacaatgtgac

SEQ ID NO: 589648 - DNA, 25 bp, Rattus norvegicus
tcgaaagccagcagcccggagagtg

SEQ ID NO: 589649 - DNA, 25 bp, Rattus norvegicus
tcgaaagccagctgcccggagagtg

SEQ ID NO: 589650 - DNA, 25 bp, Rattus norvegicus
tcgaaagcccttcggcagcaaacac

SEQ ID NO: 589651 - DNA, 25 bp, Rattus norvegicus
tcgaaagcccttgggcagcaaacac

SEQ ID NO: 589652 - DNA, 25 bp, Rattus norvegicus
tcgaaaggtggtcgacccagagacc

SEQ ID NO: 589653 - DNA, 25 bp, Rattus norvegicus
tcgaaaggtggtggacccagagacc

SEQ ID NO: 589654 - DNA, 25 bp, Rattus norvegicus
tcgaaatctattcaacccgcatact

SEQ ID NO: 589655 - DNA, 25 bp, Rattus norvegicus
tcgaaatctattgaacccgcatact

SEQ ID NO: 589656 - DNA, 25 bp, Rattus norvegicus
tcgaaatgtctcaccatgcatctgt

SEQ ID NO: 589657 - DNA, 25 bp, Rattus norvegicus
tcgaaatgtctctccatgcatctgt

SEQ ID NO: 589658 - DNA, 25 bp, Rattus norvegicus
tcgaacatttgccatctcttgctgc

SEQ ID NO: 589659 - DNA, 25 bp, Rattus norvegicus
tcgaacatttgcgatctcttgctgc

SEQ ID NO: 589660 - DNA, 25 bp, Rattus norvegicus
tcgaacccgagtctggcagcctttt

SEQ ID NO: 589661 - DNA, 25 bp, Rattus norvegicus
tcgaacccgagtgtggcagcctttt

SEQ ID NO: 589662 - DNA, 25 bp, Rattus norvegicus
tcgaacctgggaccttagaacaatg

SEQ ID NO: 589663 - DNA, 25 bp, Rattus norvegicus
tcgaacctgggagcttagaacaatg

SEQ ID NO: 589664 - DNA, 25 bp, Rattus norvegicus
tcgaaccttcgtctctaatatttaa

SEQ ID NO: 589665 - DNA, 25 bp, Rattus norvegicus
tcgaaccttcgtgtctaatatttaa

SEQ ID NO: 589666 - DNA, 25 bp, Rattus norvegicus
tcgaacctttttcgctttcttctcg

SEQ ID NO: 589667 - DNA, 25 bp, Rattus norvegicus
tcgaacctttttggctttcttctcg

SEQ ID NO: 589668 - DNA, 25 bp, Rattus norvegicus
tcgaacgggatgacattgcctgtgg

SEQ ID NO: 589669 - DNA, 25 bp, Rattus norvegicus
tcgaacgggatgtcattgcctgtgg

SEQ ID NO: 589670 - DNA, 25 bp, Rattus norvegicus
tcgaacgtggatattcccttctgag

SEQ ID NO: 589671 - DNA, 25 bp, Rattus norvegicus
tcgaacgtggattttcccttctgag

SEQ ID NO: 589672 - DNA, 25 bp, Rattus norvegicus
tcgaacgtgtaacgctgcttgcagc

SEQ ID NO: 589673 - DNA, 25 bp, Rattus norvegicus
tcgaacgtgtaaggctgcttgcagc

SEQ ID NO: 589674 - DNA, 25 bp, Rattus norvegicus
tcgaactcctaaacggtgtagttat

SEQ ID NO: 589675 - DNA, 25 bp, Rattus norvegicus
tcgaactcctaatcggtgtagttat

SEQ ID NO: 589676 - DNA, 25 bp, Rattus norvegicus
tcgaactgccagagggccgcttgca

SEQ ID NO: 589677 - DNA, 25 bp, Rattus norvegicus
tcgaactgccagtgggccgcttgca

SEQ ID NO: 589678 - DNA, 25 bp, Rattus norvegicus
tcgaactggactagacgctgagggt

SEQ ID NO: 589679 - DNA, 25 bp, Rattus norvegicus
tcgaactggactcaagctgcctggc

SEQ ID NO: 589680 - DNA, 25 bp, Rattus norvegicus
tcgaactggactgaagctgcctggc

SEQ ID NO: 589681 - DNA, 25 bp, Rattus norvegicus
tcgaactggacttgacgctgagggt

SEQ ID NO: 589682 - DNA, 25 bp, Rattus norvegicus
tcgaactgttccaaagtcccaggag

SEQ ID NO: 589683 - DNA, 25 bp, Rattus norvegicus
tcgaactgttcctaagtcccaggag

SEQ ID NO: 589684 - DNA, 25 bp, Rattus norvegicus
tcgaacttgctcaggcccaggatat

SEQ ID NO: 589685 - DNA, 25 bp, Rattus norvegicus
tcgaacttgctctggcccaggatat

SEQ ID NO: 589686 - DNA, 25 bp, Rattus norvegicus
tcgaactttccaaaggagtcgtccg

SEQ ID NO: 589687 - DNA, 25 bp, Rattus norvegicus
tcgaactttccataggagtcgtccg

SEQ ID NO: 589688 - DNA, 25 bp, Rattus norvegicus
tcgaagaaggacagggccctgcaca

SEQ ID NO: 589689 - DNA, 25 bp, Rattus norvegicus
tcgaagaaggactgggccctgcaca

SEQ ID NO: 589690 - DNA, 25 bp, Rattus norvegicus
tcgaagacctagcaatccattcgcc

SEQ ID NO: 589691 - DNA, 25 bp, Rattus norvegicus
tcgaagacctaggaatccattcgcc

SEQ ID NO: 589692 - DNA, 25 bp, Rattus norvegicus
tcgaagacgagaccgggattatgat

SEQ ID NO: 589693 - DNA, 25 bp, Rattus norvegicus
tcgaagacgagagcgggattatgat

SEQ ID NO: 589694 - DNA, 25 bp, Rattus norvegicus
tcgaagacgttcctaatgggttcct

SEQ ID NO: 589695 - DNA, 25 bp, Rattus norvegicus
tcgaagacgttcgtaatgggttcct

SEQ ID NO: 589696 - DNA, 25 bp, Rattus norvegicus
tcgaagacttcaacgctgatctgga

SEQ ID NO: 589697 - DNA, 25 bp, Rattus norvegicus
tcgaagacttcatcgctgatctgga

SEQ ID NO: 589698 - DNA, 25 bp, Rattus norvegicus
tcgaagatggtcagcctgtgcagct

SEQ ID NO: 589699 - DNA, 25 bp, Rattus norvegicus
tcgaagatggtctgcctgtgcagct

SEQ ID NO: 589700 - DNA, 25 bp, Rattus norvegicus
tcgaagcatcgaaaaacagcacttg

SEQ ID NO: 589701 - DNA, 25 bp, Rattus norvegicus
tcgaagcatcgataaacagcacttg

SEQ ID NO: 589702 - DNA, 25 bp, Rattus norvegicus
tcgaagcctttgatgactctggaaa

SEQ ID NO: 589703 - DNA, 25 bp, Rattus norvegicus
tcgaagcctttgttgactctggaaa

SEQ ID NO: 589704 - DNA, 25 bp, Rattus norvegicus
tcgaagcgggcgcagacacccgaaa

SEQ ID NO: 589705 - DNA, 25 bp, Rattus norvegicus
tcgaagcgggcggagacacccgaaa

SEQ ID NO: 589706 - DNA, 25 bp, Rattus norvegicus
tcgaagcttcttatccttgagacat

SEQ ID NO: 589707 - DNA, 25 bp, Rattus norvegicus
tcgaagcttcttttccttgagacat

SEQ ID NO: 589708 - DNA, 25 bp, Rattus norvegicus
tcgaagctttcactagactgccata

SEQ ID NO: 589709 - DNA, 25 bp, Rattus norvegicus
tcgaagctttcagtagactgccata

SEQ ID NO: 589710 - DNA, 25 bp, Rattus norvegicus
tcgaagggagccagcaagcctgtga

SEQ ID NO: 589711 - DNA, 25 bp, Rattus norvegicus
tcgaagggagcctgcaagcctgtga

SEQ ID NO: 589712 - DNA, 25 bp, Rattus norvegicus
tcgaagggatcgcaggtcgctacct

SEQ ID NO: 589713 - DNA, 25 bp, Rattus norvegicus
tcgaagggatcggaggtcgctacct

SEQ ID NO: 589714 - DNA, 25 bp, Rattus norvegicus
tcgaagggccaacaaaggtgacttt

SEQ ID NO: 589715 - DNA, 25 bp, Rattus norvegicus
tcgaagggccaagaaaggtgacttt

SEQ ID NO: 589716 - DNA, 25 bp, Rattus norvegicus
tcgaatcaggtacgcactggccagg

SEQ ID NO: 589717 - DNA, 25 bp, Rattus norvegicus
tcgaatcaggtaggcactggccagg

SEQ ID NO: 589718 - DNA, 25 bp, Rattus norvegicus
tcgaatcgaacgaccgtgtgggagc

SEQ ID NO: 589719 - DNA, 25 bp, Rattus norvegicus
tcgaatcgaacgtccgtgtgggagc

SEQ ID NO: 589720 - DNA, 25 bp, Rattus norvegicus
tcgaatgggttgcagcggaggccct

SEQ ID NO: 589721 - DNA, 25 bp, Rattus norvegicus
tcgaatgggttggagcggaggccct

SEQ ID NO: 589722 - DNA, 25 bp, Rattus norvegicus
tcgaattaactaacagacaactgat

SEQ ID NO: 589723 - DNA, 25 bp, Rattus norvegicus
tcgaattaactatcagacaactgat

SEQ ID NO: 589724 - DNA, 25 bp, Rattus norvegicus
tcgaattgatctccactttctgcaa

SEQ ID NO: 589725 - DNA, 25 bp, Rattus norvegicus
tcgaattgatctgcactttctgcaa

SEQ ID NO: 589726 - DNA, 25 bp, Rattus norvegicus
tcgacaaatcccacgatcaagctgt

SEQ ID NO: 589727 - DNA, 25 bp, Rattus norvegicus
tcgacaaatccctcgatcaagctgt

SEQ ID NO: 589728 - DNA, 25 bp, Rattus norvegicus
tcgacacacctgcttcctttaagaa

SEQ ID NO: 589729 - DNA, 25 bp, Rattus norvegicus
tcgacacacctggttcctttaagaa

SEQ ID NO: 589730 - DNA, 25 bp, Rattus norvegicus
tcgacacggcgcagcttttgggtcc

SEQ ID NO: 589731 - DNA, 25 bp, Rattus norvegicus
tcgacacggcgctgcttttgggtcc

SEQ ID NO: 589732 - DNA, 25 bp, Rattus norvegicus
tcgacactacccctaaagcaagagg

SEQ ID NO: 589733 - DNA, 25 bp, Rattus norvegicus
tcgacactacccgtaaagcaagagg

SEQ ID NO: 589734 - DNA, 25 bp, Rattus norvegicus
tcgacactagtcagcttcacaaagt

SEQ ID NO: 589735 - DNA, 25 bp, Rattus norvegicus
tcgacactagtctgcttcacaaagt

SEQ ID NO: 589736 - DNA, 25 bp, Rattus norvegicus
tcgacactcccaagacatcctgtga

SEQ ID NO: 589737 - DNA, 25 bp, Rattus norvegicus
tcgacactcccatgacatcctgtga

SEQ ID NO: 589738 - DNA, 25 bp, Rattus norvegicus
tcgacacttttccagcagcaataat

SEQ ID NO: 589739 - DNA, 25 bp, Rattus norvegicus
tcgacacttttcgagcagcaataat

SEQ ID NO: 589740 - DNA, 25 bp, Rattus norvegicus
tcgacagaattgaaggcgattctag

SEQ ID NO: 589741 - DNA, 25 bp, Rattus norvegicus
tcgacagaattgtaggcgattctag

SEQ ID NO: 589742 - DNA, 25 bp, Rattus norvegicus
tcgacagccctgatagtttagaaaa

SEQ ID NO: 589743 - DNA, 25 bp, Rattus norvegicus
tcgacagccctgttagtttagaaaa

SEQ ID NO: 589744 - DNA, 25 bp, Rattus norvegicus
tcgacagctgggaggatatcgccat

SEQ ID NO: 589745 - DNA, 25 bp, Rattus norvegicus
tcgacagctgggtggatatcgccat

SEQ ID NO: 589746 - DNA, 25 bp, Rattus norvegicus
tcgacagggcttacctacgattaag

SEQ ID NO: 589747 - DNA, 25 bp, Rattus norvegicus
tcgacagggctttcctacgattaag

SEQ ID NO: 589748 - DNA, 25 bp, Rattus norvegicus
tcgacagtatttcaggccctgagcc

SEQ ID NO: 589749 - DNA, 25 bp, Rattus norvegicus
tcgacagtatttgaggccctgagcc

SEQ ID NO: 589750 - DNA, 25 bp, Rattus norvegicus
tcgacagtgagacctggactcctga

SEQ ID NO: 589751 - DNA, 25 bp, Rattus norvegicus
tcgacagtgagagctggactcctga

SEQ ID NO: 589752 - DNA, 25 bp, Rattus norvegicus
tcgacagtgtgcactcctcagtgga

SEQ ID NO: 589753 - DNA, 25 bp, Rattus norvegicus
tcgacagtgtgctctcctcagtgga

SEQ ID NO: 589754 - DNA, 25 bp, Rattus norvegicus
tcgacagttttgacagcttgacata

SEQ ID NO: 589755 - DNA, 25 bp, Rattus norvegicus
tcgacagttttgtcagcttgacata

SEQ ID NO: 589756 - DNA, 25 bp, Rattus norvegicus
tcgaccagttgtctccttgtgagga

SEQ ID NO: 589757 - DNA, 25 bp, Rattus norvegicus
tcgaccagttgtgtccttgtgagga

SEQ ID NO: 589758 - DNA, 25 bp, Rattus norvegicus
tcgacccaacacattctatgtgacc

SEQ ID NO: 589759 - DNA, 25 bp, Rattus norvegicus
tcgacccaacactttctatgtgacc

SEQ ID NO: 589760 - DNA, 25 bp, Rattus norvegicus
tcgacccaagatccggtaggaattg

SEQ ID NO: 589761 - DNA, 25 bp, Rattus norvegicus
tcgacccaagatgcggtaggaattg

SEQ ID NO: 589762 - DNA, 25 bp, Rattus norvegicus
tcgacccaattccttttcacaataa

SEQ ID NO: 589763 - DNA, 25 bp, Rattus norvegicus
tcgacccaattcgttttcacaataa

SEQ ID NO: 589764 - DNA, 25 bp, Rattus norvegicus
tcgaccccaacaacgttatcattga

SEQ ID NO: 589765 - DNA, 25 bp, Rattus norvegicus
tcgaccccaacatcgttatcattga

SEQ ID NO: 589766 - DNA, 25 bp, Rattus norvegicus
tcgacccggactcctacaatatgtt

SEQ ID NO: 589767 - DNA, 25 bp, Rattus norvegicus
tcgacccggactgctacaatatgtt

SEQ ID NO: 589768 - DNA, 25 bp, Rattus norvegicus
tcgaccctatttacagacgaacctg

SEQ ID NO: 589769 - DNA, 25 bp, Rattus norvegicus
tcgaccctattttcagacgaacctg

SEQ ID NO: 589770 - DNA, 25 bp, Rattus norvegicus
tcgaccgccttgattcttgttctct

SEQ ID NO: 589771 - DNA, 25 bp, Rattus norvegicus
tcgaccgccttgtttcttgttctct

SEQ ID NO: 589772 - DNA, 25 bp, Rattus norvegicus
tcgaccgctgccagggcactggctt

SEQ ID NO: 589773 - DNA, 25 bp, Rattus norvegicus
tcgaccgctgcctgggcactggctt

SEQ ID NO: 589774 - DNA, 25 bp, Rattus norvegicus
tcgaccggcctactgatgagtttaa

SEQ ID NO: 589775 - DNA, 25 bp, Rattus norvegicus
tcgaccggcctagtgatgagtttaa

SEQ ID NO: 589776 - DNA, 25 bp, Rattus norvegicus
tcgacctagaaaacgccttactact

SEQ ID NO: 589777 - DNA, 25 bp, Rattus norvegicus
tcgacctagaaatcgccttactact

SEQ ID NO: 589778 - DNA, 25 bp, Rattus norvegicus
tcgacctctctccttttcaggatat

SEQ ID NO: 589779 - DNA, 25 bp, Rattus norvegicus
tcgacctctctcgttttcaggatat

SEQ ID NO: 589780 - DNA, 25 bp, Rattus norvegicus
tcgacctgagtcacatttcctatga

SEQ ID NO: 589781 - DNA, 25 bp, Rattus norvegicus
tcgacctgagtctcatttcctatga

SEQ ID NO: 589782 - DNA, 25 bp, Rattus norvegicus
tcgacctgggcgaccatactgagga

SEQ ID NO: 589783 - DNA, 25 bp, Rattus norvegicus
tcgacctgggcgtccatactgagga

SEQ ID NO: 589784 - DNA, 25 bp, Rattus norvegicus
tcgaccttaaagcagccggcttact

SEQ ID NO: 589785 - DNA, 25 bp, Rattus norvegicus
tcgaccttaaaggagccggcttact

SEQ ID NO: 589786 - DNA, 25 bp, Rattus norvegicus
tcgaccttcaagaggttctggcaga

SEQ ID NO: 589787 - DNA, 25 bp, Rattus norvegicus
tcgaccttcaagtggttctggcaga

SEQ ID NO: 589788 - DNA, 25 bp, Rattus norvegicus
tcgaccttctgcatttcatcatggt

SEQ ID NO: 589789 - DNA, 25 bp, Rattus norvegicus
tcgaccttctgcttttcatcatggt

SEQ ID NO: 589790 - DNA, 25 bp, Rattus norvegicus
tcgacgaagggcacggcagcctttc

SEQ ID NO: 589791 - DNA, 25 bp, Rattus norvegicus
tcgacgaagggctcggcagcctttc

SEQ ID NO: 589792 - DNA, 25 bp, Rattus norvegicus
tcgacgcagcgacagattttcagat

SEQ ID NO: 589793 - DNA, 25 bp, Rattus norvegicus
tcgacgcagcgagagattttcagat

SEQ ID NO: 589794 - DNA, 25 bp, Rattus norvegicus
tcgacgcatccacacgggtgaacga

SEQ ID NO: 589795 - DNA, 25 bp, Rattus norvegicus
tcgacgcatccagacgggtgaacga

SEQ ID NO: 589796 - DNA, 25 bp, Rattus norvegicus
tcgacgcttttcattcagtccacat

SEQ ID NO: 589797 - DNA, 25 bp, Rattus norvegicus
tcgacgcttttctttcagtccacat

SEQ ID NO: 589798 - DNA, 25 bp, Rattus norvegicus
tcgacggaggacagtgagagccttt

SEQ ID NO: 589799 - DNA, 25 bp, Rattus norvegicus
tcgacggaggactgtgagagccttt

SEQ ID NO: 589800 - DNA, 25 bp, Rattus norvegicus
tcgacgtacgtcaagcaaacactgc

SEQ ID NO: 589801 - DNA, 25 bp, Rattus norvegicus
tcgacgtacgtctagcaaacactgc

SEQ ID NO: 589802 - DNA, 25 bp, Rattus norvegicus
tcgactatggtaatgaaatgctggt

SEQ ID NO: 589803 - DNA, 25 bp, Rattus norvegicus
tcgactatggtattgaaatgctggt

SEQ ID NO: 589804 - DNA, 25 bp, Rattus norvegicus
tcgactatgtccacagagtagagaa

SEQ ID NO: 589805 - DNA, 25 bp, Rattus norvegicus
tcgactatgtcctcagagtagagaa

SEQ ID NO: 589806 - DNA, 25 bp, Rattus norvegicus
tcgactcacgtcagttagcagccgc

SEQ ID NO: 589807 - DNA, 25 bp, Rattus norvegicus
tcgactcacgtctgttagcagccgc

SEQ ID NO: 589808 - DNA, 25 bp, Rattus norvegicus
tcgactcagctactgccatggtgca

SEQ ID NO: 589809 - DNA, 25 bp, Rattus norvegicus
tcgactcagctagtgccatggtgca

SEQ ID NO: 589810 - DNA, 25 bp, Rattus norvegicus
tcgactccagttctcaccagaatac

SEQ ID NO: 589811 - DNA, 25 bp, Rattus norvegicus
tcgactccagttgtcaccagaatac

SEQ ID NO: 589812 - DNA, 25 bp, Rattus norvegicus
tcgactctcttcctgatgccagtgg

SEQ ID NO: 589813 - DNA, 25 bp, Rattus norvegicus
tcgactctcttcgtgatgccagtgg

SEQ ID NO: 589814 - DNA, 25 bp, Rattus norvegicus
tcgactctggagaactggtgccgga

SEQ ID NO: 589815 - DNA, 25 bp, Rattus norvegicus
tcgactctggagtactggtgccgga

SEQ ID NO: 589816 - DNA, 25 bp, Rattus norvegicus
tcgactctggtcaaatacatggtta

SEQ ID NO: 589817 - DNA, 25 bp, Rattus norvegicus
tcgactctggtctaatacatggtta

SEQ ID NO: 589818 - DNA, 25 bp, Rattus norvegicus
tcgactgagctgactggtttcatgc

SEQ ID NO: 589819 - DNA, 25 bp, Rattus norvegicus
tcgactgagctgtctggtttcatgc

SEQ ID NO: 589820 - DNA, 25 bp, Rattus norvegicus
tcgactggtcagaggcttttgcaac

SEQ ID NO: 589821 - DNA, 25 bp, Rattus norvegicus
tcgactggtcagtggcttttgcaac

SEQ ID NO: 589822 - DNA, 25 bp, Rattus norvegicus
tcgactgtccggattcctgtaaaat

SEQ ID NO: 589823 - DNA, 25 bp, Rattus norvegicus
tcgactgtccggtttcctgtaaaat

SEQ ID NO: 589824 - DNA, 25 bp, Rattus norvegicus
tcgacttccagaaccacaagaactt

SEQ ID NO: 589825 - DNA, 25 bp, Rattus norvegicus
tcgacttccagatccacaagaactt

SEQ ID NO: 589826 - DNA, 25 bp, Rattus norvegicus
tcgacttcccctaacagatatgcat

SEQ ID NO: 589827 - DNA, 25 bp, Rattus norvegicus
tcgacttccccttacagatatgcat

SEQ ID NO: 589828 - DNA, 25 bp, Rattus norvegicus
tcgacttggaccctggaacatcatt

SEQ ID NO: 589829 - DNA, 25 bp, Rattus norvegicus
tcgacttggaccgtggaacatcatt

SEQ ID NO: 589830 - DNA, 25 bp, Rattus norvegicus
tcgacttggccgatcctgaaaagat

SEQ ID NO: 589831 - DNA, 25 bp, Rattus norvegicus
tcgacttggccgttcctgaaaagat

SEQ ID NO: 589832 - DNA, 25 bp, Rattus norvegicus
tcgacttgggacaggcagcctagtt

SEQ ID NO: 589833 - DNA, 25 bp, Rattus norvegicus
tcgacttgggactggcagcctagtt

SEQ ID NO: 589834 - DNA, 25 bp, Rattus norvegicus
tcgacttggtggaagagatgctcca

SEQ ID NO: 589835 - DNA, 25 bp, Rattus norvegicus
tcgacttggtggtagagatgctcca

SEQ ID NO: 589836 - DNA, 25 bp, Rattus norvegicus
tcgagaagcccaaggagtttccact

SEQ ID NO: 589837 - DNA, 25 bp, Rattus norvegicus
tcgagaagcccatggagtttccact

SEQ ID NO: 589838 - DNA, 25 bp, Rattus norvegicus
tcgagaagcttcagtctttggcgaa

SEQ ID NO: 589839 - DNA, 25 bp, Rattus norvegicus
tcgagaagcttctgtctttggcgaa

SEQ ID NO: 589840 - DNA, 25 bp, Rattus norvegicus
tcgagaatatctcgctctcctgatg

SEQ ID NO: 589841 - DNA, 25 bp, Rattus norvegicus
tcgagaatatctggctctcctgatg

SEQ ID NO: 589842 - DNA, 25 bp, Rattus norvegicus
tcgagacatttaaggaggagactat

SEQ ID NO: 589843 - DNA, 25 bp, Rattus norvegicus
tcgagacatttatggaggagactat

SEQ ID NO: 589844 - DNA, 25 bp, Rattus norvegicus
tcgagaccaagaagcacatccgctt

SEQ ID NO: 589845 - DNA, 25 bp, Rattus norvegicus
tcgagaccaagatgcacatccgctt

SEQ ID NO: 589846 - DNA, 25 bp, Rattus norvegicus
tcgagacgcgctccaaggccgaaag

SEQ ID NO: 589847 - DNA, 25 bp, Rattus norvegicus
tcgagacgcgctgcaaggccgaaag

SEQ ID NO: 589848 - DNA, 25 bp, Rattus norvegicus
tcgagactcgggagctcagctgctt

SEQ ID NO: 589849 - DNA, 25 bp, Rattus norvegicus
tcgagactcgggtgctcagctgctt

SEQ ID NO: 589850 - DNA, 25 bp, Rattus norvegicus
tcgagactgcagatgctagcccaaa

SEQ ID NO: 589851 - DNA, 25 bp, Rattus norvegicus
tcgagactgcagttgctagcccaaa

SEQ ID NO: 589852 - DNA, 25 bp, Rattus norvegicus
tcgagactgcttaaacaaaacccaa

SEQ ID NO: 589853 - DNA, 25 bp, Rattus norvegicus
tcgagactgctttaacaaaacccaa

SEQ ID NO: 589854 - DNA, 25 bp, Rattus norvegicus
tcgagactgtacactggcctcattt

SEQ ID NO: 589855 - DNA, 25 bp, Rattus norvegicus
tcgagactgtactctggcctcattt

SEQ ID NO: 589856 - DNA, 25 bp, Rattus norvegicus
tcgagagacagactaccctgcagga

SEQ ID NO: 589857 - DNA, 25 bp, Rattus norvegicus
tcgagagacagagtaccctgcagga

SEQ ID NO: 589858 - DNA, 25 bp, Rattus norvegicus
tcgagagagtgtacagcgtgacctg

SEQ ID NO: 589859 - DNA, 25 bp, Rattus norvegicus
tcgagagagtgttcagcgtgacctg

SEQ ID NO: 589860 - DNA, 25 bp, Rattus norvegicus
tcgagagccgccacctccgagacca

SEQ ID NO: 589861 - DNA, 25 bp, Rattus norvegicus
tcgagagccgcctcctccgagacca

SEQ ID NO: 589862 - DNA, 25 bp, Rattus norvegicus
tcgagagctcggagcttgatatcta

SEQ ID NO: 589863 - DNA, 25 bp, Rattus norvegicus
tcgagagctcggtgcttgatatcta

SEQ ID NO: 589864 - DNA, 25 bp, Rattus norvegicus
tcgagagctgttagccgccttggat

SEQ ID NO: 589865 - DNA, 25 bp, Rattus norvegicus
tcgagagctgtttgccgccttggat

SEQ ID NO: 589866 - DNA, 25 bp, Rattus norvegicus
tcgagagtcccgacagcagcagcag

SEQ ID NO: 589867 - DNA, 25 bp, Rattus norvegicus
tcgagagtcccgtcagcagcagcag

SEQ ID NO: 589868 - DNA, 25 bp, Rattus norvegicus
tcgagatggtgcaggctccgaacac

SEQ ID NO: 589869 - DNA, 25 bp, Rattus norvegicus
tcgagatggtgctggctccgaacac

SEQ ID NO: 589870 - DNA, 25 bp, Rattus norvegicus
tcgagattagagatgcctgcccacg

SEQ ID NO: 589871 - DNA, 25 bp, Rattus norvegicus
tcgagattagagttgcctgcccacg

SEQ ID NO: 589872 - DNA, 25 bp, Rattus norvegicus
tcgagattatctccgctgtttaaaa

SEQ ID NO: 589873 - DNA, 25 bp, Rattus norvegicus
tcgagattatctgcgctgtttaaaa

SEQ ID NO: 589874 - DNA, 25 bp, Rattus norvegicus
tcgagattttctcaaagttttgtga

SEQ ID NO: 589875 - DNA, 25 bp, Rattus norvegicus
tcgagattttctgaaagttttgtga

SEQ ID NO: 589876 - DNA, 25 bp, Rattus norvegicus
tcgagcaccacgcaagaagattcag

SEQ ID NO: 589877 - DNA, 25 bp, Rattus norvegicus
tcgagcaccacggaagaagattcag

SEQ ID NO: 589878 - DNA, 25 bp, Rattus norvegicus
tcgagcaccctccttgtagtgagaa

SEQ ID NO: 589879 - DNA, 25 bp, Rattus norvegicus
tcgagcaccctcgttgtagtgagaa

SEQ ID NO: 589880 - DNA, 25 bp, Rattus norvegicus
tcgagcacctggagcgacggtagcc

SEQ ID NO: 589881 - DNA, 25 bp, Rattus norvegicus
tcgagcacctggtgcgacggtagcc

SEQ ID NO: 589882 - DNA, 25 bp, Rattus norvegicus
tcgagcagacgcaggtcaccgtggc

SEQ ID NO: 589883 - DNA, 25 bp, Rattus norvegicus
tcgagcagacgctggtcaccgtggc

SEQ ID NO: 589884 - DNA, 25 bp, Rattus norvegicus
tcgagcagcgccaacacagatgtac

SEQ ID NO: 589885 - DNA, 25 bp, Rattus norvegicus
tcgagcagcgcctacacagatgtac

SEQ ID NO: 589886 - DNA, 25 bp, Rattus norvegicus
tcgagcagtgccagagagtgattct

SEQ ID NO: 589887 - DNA, 25 bp, Rattus norvegicus
tcgagcagtgcctgagagtgattct

SEQ ID NO: 589888 - DNA, 25 bp, Rattus norvegicus
tcgagcatccatcgcgtcttgagac

SEQ ID NO: 589889 - DNA, 25 bp, Rattus norvegicus
tcgagcatccatggcgtcttgagac

SEQ ID NO: 589890 - DNA, 25 bp, Rattus norvegicus
tcgagccaagatcttccagagggac

SEQ ID NO: 589891 - DNA, 25 bp, Rattus norvegicus
tcgagccaagatgttccagagggac

SEQ ID NO: 589892 - DNA, 25 bp, Rattus norvegicus
tcgagccatgtgagatttgccaggg

SEQ ID NO: 589893 - DNA, 25 bp, Rattus norvegicus
tcgagccatgtgtgatttgccaggg

SEQ ID NO: 589894 - DNA, 25 bp, Rattus norvegicus
tcgagccattgtcgccttctaggga

SEQ ID NO: 589895 - DNA, 25 bp, Rattus norvegicus
tcgagccattgtggccttctaggga

SEQ ID NO: 589896 - DNA, 25 bp, Rattus norvegicus
tcgagcccacgtcaagaaaaccatt

SEQ ID NO: 589897 - DNA, 25 bp, Rattus norvegicus
tcgagcccacgtgaagaaaaccatt

SEQ ID NO: 589898 - DNA, 25 bp, Rattus norvegicus
tcgagcccagccatagatgtcacag

SEQ ID NO: 589899 - DNA, 25 bp, Rattus norvegicus
tcgagcccagccttagatgtcacag

SEQ ID NO: 589900 - DNA, 25 bp, Rattus norvegicus
tcgagccccgtgatccttttgtctt

SEQ ID NO: 589901 - DNA, 25 bp, Rattus norvegicus
tcgagccccgtgttccttttgtctt

SEQ ID NO: 589902 - DNA, 25 bp, Rattus norvegicus
tcgagccgcaggactgcagtgagca

SEQ ID NO: 589903 - DNA, 25 bp, Rattus norvegicus
tcgagccgcaggtctgcagtgagca

SEQ ID NO: 589904 - DNA, 25 bp, Rattus norvegicus
tcgagccggagccaagcccaagctg

SEQ ID NO: 589905 - DNA, 25 bp, Rattus norvegicus
tcgagccggagcgaagcccaagctg

SEQ ID NO: 589906 - DNA, 25 bp, Rattus norvegicus
tcgagcctccaacttgagatctctt

SEQ ID NO: 589907 - DNA, 25 bp, Rattus norvegicus
tcgagcctccaagttgagatctctt

SEQ ID NO: 589908 - DNA, 25 bp, Rattus norvegicus
tcgagcctgcctcattcttttatca

SEQ ID NO: 589909 - DNA, 25 bp, Rattus norvegicus
tcgagcctgcctgattcttttatca

SEQ ID NO: 589910 - DNA, 25 bp, Rattus norvegicus
tcgagccttcttctcattctaaatc

SEQ ID NO: 589911 - DNA, 25 bp, Rattus norvegicus
tcgagccttcttgtcattctaaatc

SEQ ID NO: 589912 - DNA, 25 bp, Rattus norvegicus
tcgagcgcgcgacatgaatgccctt

SEQ ID NO: 589913 - DNA, 25 bp, Rattus norvegicus
tcgagcgcgcgagatgaatgccctt

SEQ ID NO: 589914 - DNA, 25 bp, Rattus norvegicus
tcgagcggagctatgggctgccact

SEQ ID NO: 589915 - DNA, 25 bp, Rattus norvegicus
tcgagcggagctttgggctgccact

SEQ ID NO: 589916 - DNA, 25 bp, Rattus norvegicus
tcgagcggcccaaacattaataagt

SEQ ID NO: 589917 - DNA, 25 bp, Rattus norvegicus
tcgagcggcccatacattaataagt

SEQ ID NO: 589918 - DNA, 25 bp, Rattus norvegicus
tcgagctcatctattacatcctgga

SEQ ID NO: 589919 - DNA, 25 bp, Rattus norvegicus
tcgagctcatcttttacatcctgga

SEQ ID NO: 589920 - DNA, 25 bp, Rattus norvegicus
tcgagctgacctccagacttggtgt

SEQ ID NO: 589921 - DNA, 25 bp, Rattus norvegicus
tcgagctgacctgcagacttggtgt

SEQ ID NO: 589922 - DNA, 25 bp, Rattus norvegicus
tcgagctgacggcacactgactggt

SEQ ID NO: 589923 - DNA, 25 bp, Rattus norvegicus
tcgagctgacgggacactgactggt

SEQ ID NO: 589924 - DNA, 25 bp, Rattus norvegicus
tcgagctgcccactgtcaagagtca

SEQ ID NO: 589925 - DNA, 25 bp, Rattus norvegicus
tcgagctgcccagtgtcaagagtca

SEQ ID NO: 589926 - DNA, 25 bp, Rattus norvegicus
tcgagctgcgggagagacctttcta

SEQ ID NO: 589927 - DNA, 25 bp, Rattus norvegicus
tcgagctgcgggtgagacctttcta

SEQ ID NO: 589928 - DNA, 25 bp, Rattus norvegicus
tcgaggaacctcaaagtctgggaag

SEQ ID NO: 589929 - DNA, 25 bp, Rattus norvegicus
tcgaggaacctctaagtctgggaag

SEQ ID NO: 589930 - DNA, 25 bp, Rattus norvegicus
tcgaggaccggcacgctcagcgact

SEQ ID NO: 589931 - DNA, 25 bp, Rattus norvegicus
tcgaggaccggctcgctcagcgact

SEQ ID NO: 589932 - DNA, 25 bp, Rattus norvegicus
tcgaggacgcggcatcttacagtgt

SEQ ID NO: 589933 - DNA, 25 bp, Rattus norvegicus
tcgaggacgcgggatcttacagtgt

SEQ ID NO: 589934 - DNA, 25 bp, Rattus norvegicus
tcgaggactatgatgtccagcgcaa

SEQ ID NO: 589935 - DNA, 25 bp, Rattus norvegicus
tcgaggactatgttgtccagcgcaa

SEQ ID NO: 589936 - DNA, 25 bp, Rattus norvegicus
tcgaggagagccaaggagctataac

SEQ ID NO: 589937 - DNA, 25 bp, Rattus norvegicus
tcgaggagagcctaggagctataac

SEQ ID NO: 589938 - DNA, 25 bp, Rattus norvegicus
tcgaggagccacaccagtattcaag

SEQ ID NO: 589939 - DNA, 25 bp, Rattus norvegicus
tcgaggagccactccagtattcaag

SEQ ID NO: 589940 - DNA, 25 bp, Rattus norvegicus
tcgaggatattacccgggccttcga

SEQ ID NO: 589941 - DNA, 25 bp, Rattus norvegicus
tcgaggatattagccgggccttcga

SEQ ID NO: 589942 - DNA, 25 bp, Rattus norvegicus
tcgaggatgatcaggagatgaccat

SEQ ID NO: 589943 - DNA, 25 bp, Rattus norvegicus
tcgaggatgatctggagatgaccat

SEQ ID NO: 589944 - DNA, 25 bp, Rattus norvegicus
tcgaggatgcgtctctccactgggt

SEQ ID NO: 589945 - DNA, 25 bp, Rattus norvegicus
tcgaggatgcgtgtctccactgggt

SEQ ID NO: 589946 - DNA, 25 bp, Rattus norvegicus
tcgaggatgtgtcagccctggcttc

SEQ ID NO: 589947 - DNA, 25 bp, Rattus norvegicus
tcgaggatgtgtgagccctggcttc

SEQ ID NO: 589948 - DNA, 25 bp, Rattus norvegicus
tcgaggcacgttagaggactttacc

SEQ ID NO: 589949 - DNA, 25 bp, Rattus norvegicus
tcgaggcacgtttgaggactttacc

SEQ ID NO: 589950 - DNA, 25 bp, Rattus norvegicus
tcgaggcagcatccaactcctgcag

SEQ ID NO: 589951 - DNA, 25 bp, Rattus norvegicus
tcgaggcagcatgcaactcctgcag

SEQ ID NO: 589952 - DNA, 25 bp, Rattus norvegicus
tcgaggccaaacagggattttcact

SEQ ID NO: 589953 - DNA, 25 bp, Rattus norvegicus
tcgaggccaaactgggattttcact

SEQ ID NO: 589954 - DNA, 25 bp, Rattus norvegicus
tcgaggccaccaacaacaactttga

SEQ ID NO: 589955 - DNA, 25 bp, Rattus norvegicus
tcgaggccaccatcaacaactttga

SEQ ID NO: 589956 - DNA, 25 bp, Rattus norvegicus
tcgaggccagttctttggtctacaa

SEQ ID NO: 589957 - DNA, 25 bp, Rattus norvegicus
tcgaggccagttgtttggtctacaa

SEQ ID NO: 589958 - DNA, 25 bp, Rattus norvegicus
tcgaggcccggcaatcggagcagat

SEQ ID NO: 589959 - DNA, 25 bp, Rattus norvegicus
tcgaggcccggctatcggagcagat

SEQ ID NO: 589960 - DNA, 25 bp, Rattus norvegicus
tcgaggcctagcacaattttgcaaa

SEQ ID NO: 589961 - DNA, 25 bp, Rattus norvegicus
tcgaggcctagctcaattttgcaaa

SEQ ID NO: 589962 - DNA, 25 bp, Rattus norvegicus
tcgaggcctattatgccgtacaacc

SEQ ID NO: 589963 - DNA, 25 bp, Rattus norvegicus
tcgaggcctattttgccgtacaacc

SEQ ID NO: 589964 - DNA, 25 bp, Rattus norvegicus
tcgaggcctcaaagtctccattggg

SEQ ID NO: 589965 - DNA, 25 bp, Rattus norvegicus
tcgaggcctcaatgtctccattggg

SEQ ID NO: 589966 - DNA, 25 bp, Rattus norvegicus
tcgaggcctgccagggctactggaa

SEQ ID NO: 589967 - DNA, 25 bp, Rattus norvegicus
tcgaggcctgcctgggctactggaa

SEQ ID NO: 589968 - DNA, 25 bp, Rattus norvegicus
tcgaggcgagcaaaggagacattct

SEQ ID NO: 589969 - DNA, 25 bp, Rattus norvegicus
tcgaggcgagcataggagacattct

SEQ ID NO: 589970 - DNA, 25 bp, Rattus norvegicus
tcgaggctatccagtgacagtccat

SEQ ID NO: 589971 - DNA, 25 bp, Rattus norvegicus
tcgaggctatcctgtgacagtccat

SEQ ID NO: 589972 - DNA, 25 bp, Rattus norvegicus
tcgaggctgccgatgagaccacctt

SEQ ID NO: 589973 - DNA, 25 bp, Rattus norvegicus
tcgaggctgccgttgagaccacctt

SEQ ID NO: 589974 - DNA, 25 bp, Rattus norvegicus
tcgaggctgggcagctctacaaaat

SEQ ID NO: 589975 - DNA, 25 bp, Rattus norvegicus
tcgaggctgggctgctctacaaaat

SEQ ID NO: 589976 - DNA, 25 bp, Rattus norvegicus
tcgagggaaccaacacttaaaaact

SEQ ID NO: 589977 - DNA, 25 bp, Rattus norvegicus
tcgagggaaccatcacttaaaaact

SEQ ID NO: 589978 - DNA, 25 bp, Rattus norvegicus
tcgagggagggcaaggctacacttc

SEQ ID NO: 589979 - DNA, 25 bp, Rattus norvegicus
tcgagggagggctaggctacacttc

SEQ ID NO: 589980 - DNA, 25 bp, Rattus norvegicus
tcgagggcagtgacatcatctacca

SEQ ID NO: 589981 - DNA, 25 bp, Rattus norvegicus
tcgagggcagtgtcatcatctacca

SEQ ID NO: 589982 - DNA, 25 bp, Rattus norvegicus
tcgagggcccagaactgtaactctg

SEQ ID NO: 589983 - DNA, 25 bp, Rattus norvegicus
tcgagggcccagtactgtaactctg

SEQ ID NO: 589984 - DNA, 25 bp, Rattus norvegicus
tcgagggttgtgacactgctgtaaa

SEQ ID NO: 589985 - DNA, 25 bp, Rattus norvegicus
tcgagggttgtgtcactgctgtaaa

SEQ ID NO: 589986 - DNA, 25 bp, Rattus norvegicus
tcgagggtttcgagctggattcaga

SEQ ID NO: 589987 - DNA, 25 bp, Rattus norvegicus
tcgagggtttcgtgctggattcaga

SEQ ID NO: 589988 - DNA, 25 bp, Rattus norvegicus
tcgaggtatggcacccccaacaaca

SEQ ID NO: 589989 - DNA, 25 bp, Rattus norvegicus
tcgaggtatggctcccccaacaaca

SEQ ID NO: 589990 - DNA, 25 bp, Rattus norvegicus
tcgaggtcaacaacagtgagctgcc

SEQ ID NO: 589991 - DNA, 25 bp, Rattus norvegicus
tcgaggtcaacatcagtgagctgcc

SEQ ID NO: 589992 - DNA, 25 bp, Rattus norvegicus
tcgaggtcaggcagctggaaatgct

SEQ ID NO: 589993 - DNA, 25 bp, Rattus norvegicus
tcgaggtcaggctgctggaaatgct

SEQ ID NO: 589994 - DNA, 25 bp, Rattus norvegicus
tcgaggtccacaaaaaacgtcccag

SEQ ID NO: 589995 - DNA, 25 bp, Rattus norvegicus
tcgaggtccacataaaacgtcccag

SEQ ID NO: 589996 - DNA, 25 bp, Rattus norvegicus
tcgaggtggcagcaacagagctact

SEQ ID NO: 589997 - DNA, 25 bp, Rattus norvegicus
tcgaggtggcaggaacagagctact

SEQ ID NO: 589998 - DNA, 25 bp, Rattus norvegicus
tcgaggttactaagtagactggaga

SEQ ID NO: 589999 - DNA, 25 bp, Rattus norvegicus
tcgaggttactatgtagactggaga

SEQ ID NO: 590000 - DNA, 25 bp, Rattus norvegicus
tcgaggttcctgatagatttaagac

SEQ ID NO: 590001 - DNA, 25 bp, Rattus norvegicus
tcgaggttcctgttagatttaagac

SEQ ID NO: 590002 - DNA, 25 bp, Rattus norvegicus
tcgagtaacatcagcatcaggccct

SEQ ID NO: 590003 - DNA, 25 bp, Rattus norvegicus
tcgagtaacatctgcatcaggccct

SEQ ID NO: 590004 - DNA, 25 bp, Rattus norvegicus
tcgagtaactttcaccttgggtgaa

SEQ ID NO: 590005 - DNA, 25 bp, Rattus norvegicus
tcgagtaactttgaccttgggtgaa

SEQ ID NO: 590006 - DNA, 25 bp, Rattus norvegicus
tcgagtactgcaagctcatcctgag

SEQ ID NO: 590007 - DNA, 25 bp, Rattus norvegicus
tcgagtactgcatgctcatcctgag

SEQ ID NO: 590008 - DNA, 25 bp, Rattus norvegicus
tcgagtattcttactttcctttgtt

SEQ ID NO: 590009 - DNA, 25 bp, Rattus norvegicus
tcgagtattctttctttcctttgtt

SEQ ID NO: 590010 - DNA, 25 bp, Rattus norvegicus
tcgagtcacggccatcagtattcac

SEQ ID NO: 590011 - DNA, 25 bp, Rattus norvegicus
tcgagtcacggcgatcagtattcac

SEQ ID NO: 590012 - DNA, 25 bp, Rattus norvegicus
tcgagtcaggaaatctggctacttt

SEQ ID NO: 590013 - DNA, 25 bp, Rattus norvegicus
tcgagtcaggaattctggctacttt

SEQ ID NO: 590014 - DNA, 25 bp, Rattus norvegicus
tcgagtcatctgacgtgtcatcatg

SEQ ID NO: 590015 - DNA, 25 bp, Rattus norvegicus
tcgagtcatctgtcgtgtcatcatg

SEQ ID NO: 590016 - DNA, 25 bp, Rattus norvegicus
tcgagtccatccagagaagttccca

SEQ ID NO: 590017 - DNA, 25 bp, Rattus norvegicus
tcgagtccatcctgagaagttccca

SEQ ID NO: 590018 - DNA, 25 bp, Rattus norvegicus
tcgagtccattccatctcaggaggg

SEQ ID NO: 590019 - DNA, 25 bp, Rattus norvegicus
tcgagtccattcgatctcaggaggg

SEQ ID NO: 590020 - DNA, 25 bp, Rattus norvegicus
tcgagtcgagccaaagccgagtctc

SEQ ID NO: 590021 - DNA, 25 bp, Rattus norvegicus
tcgagtcgagcctaagccgagtctc

SEQ ID NO: 590022 - DNA, 25 bp, Rattus norvegicus
tcgagtctaccactaagacattact

SEQ ID NO: 590023 - DNA, 25 bp, Rattus norvegicus
tcgagtctaccagtaagacattact

SEQ ID NO: 590024 - DNA, 25 bp, Rattus norvegicus
tcgagtctccgtcaagctgaaaatg

SEQ ID NO: 590025 - DNA, 25 bp, Rattus norvegicus
tcgagtctccgtgaagctgaaaatg

SEQ ID NO: 590026 - DNA, 25 bp, Rattus norvegicus
tcgagtctgggcaggaaccagctga

SEQ ID NO: 590027 - DNA, 25 bp, Rattus norvegicus
tcgagtctgggctggaaccagctga

SEQ ID NO: 590028 - DNA, 25 bp, Rattus norvegicus
tcgagtctgttgactctggcttaaa

SEQ ID NO: 590029 - DNA, 25 bp, Rattus norvegicus
tcgagtctgttgtctctggcttaaa

SEQ ID NO: 590030 - DNA, 25 bp, Rattus norvegicus
tcgagtcttagtactgccacagtaa

SEQ ID NO: 590031 - DNA, 25 bp, Rattus norvegicus
tcgagtcttagttctgccacagtaa

SEQ ID NO: 590032 - DNA, 25 bp, Rattus norvegicus
tcgagtgaggtcctgagcacttcca

SEQ ID NO: 590033 - DNA, 25 bp, Rattus norvegicus
tcgagtgaggtcgtgagcacttcca

SEQ ID NO: 590034 - DNA, 25 bp, Rattus norvegicus
tcgagtgcctccacagggccaggaa

SEQ ID NO: 590035 - DNA, 25 bp, Rattus norvegicus
tcgagtgcctcctcagggccaggaa

SEQ ID NO: 590036 - DNA, 25 bp, Rattus norvegicus
tcgagtgcgcatcagcaaggcccct

SEQ ID NO: 590037 - DNA, 25 bp, Rattus norvegicus
tcgagtgcgcatgagcaaggcccct

SEQ ID NO: 590038 - DNA, 25 bp, Rattus norvegicus
tcgagtggtgtcacctgagttttat

SEQ ID NO: 590039 - DNA, 25 bp, Rattus norvegicus
tcgagtggtgtctcctgagttttat

SEQ ID NO: 590040 - DNA, 25 bp, Rattus norvegicus
tcgagtgtgctgattgctcttgtct

SEQ ID NO: 590041 - DNA, 25 bp, Rattus norvegicus
tcgagtgtgctgtttgctcttgtct

SEQ ID NO: 590042 - DNA, 25 bp, Rattus norvegicus
tcgagttcaagcctgaatcacgaat

SEQ ID NO: 590043 - DNA, 25 bp, Rattus norvegicus
tcgagttcaagcgtgaatcacgaat

SEQ ID NO: 590044 - DNA, 25 bp, Rattus norvegicus
tcgagttccctacgaagtttgtctt

SEQ ID NO: 590045 - DNA, 25 bp, Rattus norvegicus
tcgagttccctaggaagtttgtctt

SEQ ID NO: 590046 - DNA, 25 bp, Rattus norvegicus
tcgagttccgagagcgtggccgttt

SEQ ID NO: 590047 - DNA, 25 bp, Rattus norvegicus
tcgagttccgagtgcgtggccgttt

SEQ ID NO: 590048 - DNA, 25 bp, Rattus norvegicus
tcgagttcgtgtcctgcccgttggc

SEQ ID NO: 590049 - DNA, 25 bp, Rattus norvegicus
tcgagttcgtgtgctgcccgttggc

SEQ ID NO: 590050 - DNA, 25 bp, Rattus norvegicus
tcgagtttgcgcaggccattgtgga

SEQ ID NO: 590051 - DNA, 25 bp, Rattus norvegicus
tcgagtttgcgctggccattgtgga

SEQ ID NO: 590052 - DNA, 25 bp, Rattus norvegicus
tcgagttttgttattctgcacctgt

SEQ ID NO: 590053 - DNA, 25 bp, Rattus norvegicus
tcgagttttgtttttctgcacctgt

SEQ ID NO: 590054 - DNA, 25 bp, Rattus norvegicus
tcgagtttttccaagattgcatctg

SEQ ID NO: 590055 - DNA, 25 bp, Rattus norvegicus
tcgagtttttcctagattgcatctg

SEQ ID NO: 590056 - DNA, 25 bp, Rattus norvegicus
tcgatacaagcgcactttgctctgg

SEQ ID NO: 590057 - DNA, 25 bp, Rattus norvegicus
tcgatacaagcggactttgctctgg

SEQ ID NO: 590058 - DNA, 25 bp, Rattus norvegicus
tcgatacccaggcttacagttaact

SEQ ID NO: 590059 - DNA, 25 bp, Rattus norvegicus
tcgatacccagggttacagttaact

SEQ ID NO: 590060 - DNA, 25 bp, Rattus norvegicus
tcgataccctagagctcactgtgga

SEQ ID NO: 590061 - DNA, 25 bp, Rattus norvegicus
tcgataccctagtgctcactgtgga

SEQ ID NO: 590062 - DNA, 25 bp, Rattus norvegicus
tcgatacctctgcacattactatgt

SEQ ID NO: 590063 - DNA, 25 bp, Rattus norvegicus
tcgatacctctggacattactatgt

SEQ ID NO: 590064 - DNA, 25 bp, Rattus norvegicus
tcgatatagccacccagagccgctg

SEQ ID NO: 590065 - DNA, 25 bp, Rattus norvegicus
tcgatatagccagccagagccgctg

SEQ ID NO: 590066 - DNA, 25 bp, Rattus norvegicus
tcgatatctccgcaactaagcagtt

SEQ ID NO: 590067 - DNA, 25 bp, Rattus norvegicus
tcgatatctccggaactaagcagtt

SEQ ID NO: 590068 - DNA, 25 bp, Rattus norvegicus
tcgatatgatcaactccagtgccat

SEQ ID NO: 590069 - DNA, 25 bp, Rattus norvegicus
tcgatatgatcatctccagtgccat

SEQ ID NO: 590070 - DNA, 25 bp, Rattus norvegicus
tcgatatgctggattcacttctgaa

SEQ ID NO: 590071 - DNA, 25 bp, Rattus norvegicus
tcgatatgctggtttcacttctgaa

SEQ ID NO: 590072 - DNA, 25 bp, Rattus norvegicus
tcgatattatgtccttgaagcgaat

SEQ ID NO: 590073 - DNA, 25 bp, Rattus norvegicus
tcgatattatgtgcttgaagcgaat

SEQ ID NO: 590074 - DNA, 25 bp, Rattus norvegicus
tcgatatttgcacatatgtgccact

SEQ ID NO: 590075 - DNA, 25 bp, Rattus norvegicus
tcgatatttgcagatatgtgccact

SEQ ID NO: 590076 - DNA, 25 bp, Rattus norvegicus
tcgatcaaatctacctcttttcgtt

SEQ ID NO: 590077 - DNA, 25 bp, Rattus norvegicus
tcgatcaaatcttcctcttttcgtt

SEQ ID NO: 590078 - DNA, 25 bp, Rattus norvegicus
tcgatcaatgatcctccttcactga

SEQ ID NO: 590079 - DNA, 25 bp, Rattus norvegicus
tcgatcaatgatgctccttcactga

SEQ ID NO: 590080 - DNA, 25 bp, Rattus norvegicus
tcgatcacctcgaccatactgagca

SEQ ID NO: 590081 - DNA, 25 bp, Rattus norvegicus
tcgatcacctcgtccatactgagca

SEQ ID NO: 590082 - DNA, 25 bp, Rattus norvegicus
tcgatcacgagtccacaagtgtctc

SEQ ID NO: 590083 - DNA, 25 bp, Rattus norvegicus
tcgatcacgagtgcacaagtgtctc

SEQ ID NO: 590084 - DNA, 25 bp, Rattus norvegicus
tcgatcactgtccaaagcagctgct

SEQ ID NO: 590085 - DNA, 25 bp, Rattus norvegicus
tcgatcactgtcgaaagcagctgct

SEQ ID NO: 590086 - DNA, 25 bp, Rattus norvegicus
tcgatcactgttagagggtcttgtc

SEQ ID NO: 590087 - DNA, 25 bp, Rattus norvegicus
tcgatcactgtttgagggtcttgtc

SEQ ID NO: 590088 - DNA, 25 bp, Rattus norvegicus
tcgatcagtcaaccatatgagccag

SEQ ID NO: 590089 - DNA, 25 bp, Rattus norvegicus
tcgatcagtcaagcatatgagccag

SEQ ID NO: 590090 - DNA, 25 bp, Rattus norvegicus
tcgatcatcatcctgctaagtgtct

SEQ ID NO: 590091 - DNA, 25 bp, Rattus norvegicus
tcgatcatcatcgtgctaagtgtct

SEQ ID NO: 590092 - DNA, 25 bp, Rattus norvegicus
tcgatcatctttaccatccagatgc

SEQ ID NO: 590093 - DNA, 25 bp, Rattus norvegicus
tcgatcatcttttccatccagatgc

SEQ ID NO: 590094 - DNA, 25 bp, Rattus norvegicus
tcgatccagtcgacaggcgagtcac

SEQ ID NO: 590095 - DNA, 25 bp, Rattus norvegicus
tcgatccagtcgtcaggcgagtcac

SEQ ID NO: 590096 - DNA, 25 bp, Rattus norvegicus
tcgatcccagaacttgctaggtgct

SEQ ID NO: 590097 - DNA, 25 bp, Rattus norvegicus
tcgatcccagaagttgctaggtgct

SEQ ID NO: 590098 - DNA, 25 bp, Rattus norvegicus
tcgatcccggtcaaggcgtggccaa

SEQ ID NO: 590099 - DNA, 25 bp, Rattus norvegicus
tcgatcccggtctaggcgtggccaa

SEQ ID NO: 590100 - DNA, 25 bp, Rattus norvegicus
tcgatccgaaagaaccgcgcgcgga

SEQ ID NO: 590101 - DNA, 25 bp, Rattus norvegicus
tcgatccgaaagtaccgcgcgcgga

SEQ ID NO: 590102 - DNA, 25 bp, Rattus norvegicus
tcgatccgcctacctgtgttgctgt

SEQ ID NO: 590103 - DNA, 25 bp, Rattus norvegicus
tcgatccgcctagctgtgttgctgt

SEQ ID NO: 590104 - DNA, 25 bp, Rattus norvegicus
tcgatccgttgccaactttgattga

SEQ ID NO: 590105 - DNA, 25 bp, Rattus norvegicus
tcgatccgttgcgaactttgattga

SEQ ID NO: 590106 - DNA, 25 bp, Rattus norvegicus
tcgatcctatgtactgtcctgaatg

SEQ ID NO: 590107 - DNA, 25 bp, Rattus norvegicus
tcgatcctatgttctgtcctgaatg

SEQ ID NO: 590108 - DNA, 25 bp, Rattus norvegicus
tcgatcctcgtcaggtgcaggtcag

SEQ ID NO: 590109 - DNA, 25 bp, Rattus norvegicus
tcgatcctcgtctggtgcaggtcag

SEQ ID NO: 590110 - DNA, 25 bp, Rattus norvegicus
tcgatctgccttacaacacatacat

SEQ ID NO: 590111 - DNA, 25 bp, Rattus norvegicus
tcgatctgcctttcaacacatacat

SEQ ID NO: 590112 - DNA, 25 bp, Rattus norvegicus
tcgatctgctagacgctcagcaggc

SEQ ID NO: 590113 - DNA, 25 bp, Rattus norvegicus
tcgatctgctagtcgctcagcaggc

SEQ ID NO: 590114 - DNA, 25 bp, Rattus norvegicus
tcgatcttcataacggacaaactga

SEQ ID NO: 590115 - DNA, 25 bp, Rattus norvegicus
tcgatcttcatatcggacaaactga

SEQ ID NO: 590116 - DNA, 25 bp, Rattus norvegicus
tcgatgaccttgacgtgctcaggac

SEQ ID NO: 590117 - DNA, 25 bp, Rattus norvegicus
tcgatgaccttgtcgtgctcaggac

SEQ ID NO: 590118 - DNA, 25 bp, Rattus norvegicus
tcgatgacggtgacggcctcctcat

SEQ ID NO: 590119 - DNA, 25 bp, Rattus norvegicus
tcgatgacggtgtcggcctcctcat

SEQ ID NO: 590120 - DNA, 25 bp, Rattus norvegicus
tcgatgagaactatccaaaggcctt

SEQ ID NO: 590121 - DNA, 25 bp, Rattus norvegicus
tcgatgagaactcaagcaaggatgc

SEQ ID NO: 590122 - DNA, 25 bp, Rattus norvegicus
tcgatgagaactgaagcaaggatgc

SEQ ID NO: 590123 - DNA, 25 bp, Rattus norvegicus
tcgatgagaactttccaaaggcctt

SEQ ID NO: 590124 - DNA, 25 bp, Rattus norvegicus
tcgatgcagcctatacaataatgta

SEQ ID NO: 590125 - DNA, 25 bp, Rattus norvegicus
tcgatgcagcctttacaataatgta

SEQ ID NO: 590126 - DNA, 25 bp, Rattus norvegicus
tcgatgccgtacctattggccacag

SEQ ID NO: 590127 - DNA, 25 bp, Rattus norvegicus
tcgatgccgtacgtattggccacag

SEQ ID NO: 590128 - DNA, 25 bp, Rattus norvegicus
tcgatgcgcttcagggagagccaca

SEQ ID NO: 590129 - DNA, 25 bp, Rattus norvegicus
tcgatgcgcttctgggagagccaca

SEQ ID NO: 590130 - DNA, 25 bp, Rattus norvegicus
tcgatgctctggatgaggcacacgt

SEQ ID NO: 590131 - DNA, 25 bp, Rattus norvegicus
tcgatgctctggttgaggcacacgt

SEQ ID NO: 590132 - DNA, 25 bp, Rattus norvegicus
tcgatgctctgtcgccagtatcaaa

SEQ ID NO: 590133 - DNA, 25 bp, Rattus norvegicus
tcgatgctctgtggccagtatcaaa

SEQ ID NO: 590134 - DNA, 25 bp, Rattus norvegicus
tcgatgctgactaaactgtttacct

SEQ ID NO: 590135 - DNA, 25 bp, Rattus norvegicus
tcgatgctgacttaactgtttacct

SEQ ID NO: 590136 - DNA, 25 bp, Rattus norvegicus
tcgatgctggaaaaccctttgccta

SEQ ID NO: 590137 - DNA, 25 bp, Rattus norvegicus
tcgatgctggaataccctttgccta

SEQ ID NO: 590138 - DNA, 25 bp, Rattus norvegicus
tcgatgctttgcatcctaattaact

SEQ ID NO: 590139 - DNA, 25 bp, Rattus norvegicus
tcgatgctttgcttcctaattaact

SEQ ID NO: 590140 - DNA, 25 bp, Rattus norvegicus
tcgatggaacagatactccgctgcc

SEQ ID NO: 590141 - DNA, 25 bp, Rattus norvegicus
tcgatggaacagttactccgctgcc

SEQ ID NO: 590142 - DNA, 25 bp, Rattus norvegicus
tcgatggatagtcgccgtgaacacc

SEQ ID NO: 590143 - DNA, 25 bp, Rattus norvegicus
tcgatggatagtggccgtgaacacc

SEQ ID NO: 590144 - DNA, 25 bp, Rattus norvegicus
tcgatggcgccaccataggtaggaa

SEQ ID NO: 590145 - DNA, 25 bp, Rattus norvegicus
tcgatggcgccagcataggtaggaa

SEQ ID NO: 590146 - DNA, 25 bp, Rattus norvegicus
tcgatggcttctctcctgatttgga

SEQ ID NO: 590147 - DNA, 25 bp, Rattus norvegicus
tcgatggcttctgtcctgatttgga

SEQ ID NO: 590148 - DNA, 25 bp, Rattus norvegicus
tcgatgggccacagagggacgcaca

SEQ ID NO: 590149 - DNA, 25 bp, Rattus norvegicus
tcgatgggccactgagggacgcaca

SEQ ID NO: 590150 - DNA, 25 bp, Rattus norvegicus
tcgatggtagcaagcgctgaggcct

SEQ ID NO: 590151 - DNA, 25 bp, Rattus norvegicus
tcgatggtagcatgcgctgaggcct

SEQ ID NO: 590152 - DNA, 25 bp, Rattus norvegicus
tcgatgtcatctatctgcctgggat

SEQ ID NO: 590153 - DNA, 25 bp, Rattus norvegicus
tcgatgtcatctttctgcctgggat

SEQ ID NO: 590154 - DNA, 25 bp, Rattus norvegicus
tcgatgtcctttcccatgctctgga

SEQ ID NO: 590155 - DNA, 25 bp, Rattus norvegicus
tcgatgtcctttgccatgctctgga

SEQ ID NO: 590156 - DNA, 25 bp, Rattus norvegicus
tcgatgtctccgaagacctcgaagt

SEQ ID NO: 590157 - DNA, 25 bp, Rattus norvegicus
tcgatgtctccgtagacctcgaagt

SEQ ID NO: 590158 - DNA, 25 bp, Rattus norvegicus
tcgatgtgtctcattttcccgtaaa

SEQ ID NO: 590159 - DNA, 25 bp, Rattus norvegicus
tcgatgtgtctctttttcccgtaaa

SEQ ID NO: 590160 - DNA, 25 bp, Rattus norvegicus
tcgatgtgtgacctaagtgctggca

SEQ ID NO: 590161 - DNA, 25 bp, Rattus norvegicus
tcgatgtgtgacgtaagtgctggca

SEQ ID NO: 590162 - DNA, 25 bp, Rattus norvegicus
tcgatgttacttctgttgttcttgg

SEQ ID NO: 590163 - DNA, 25 bp, Rattus norvegicus
tcgatgttacttgtgttgttcttgg

SEQ ID NO: 590164 - DNA, 25 bp, Rattus norvegicus
tcgatgttccgacaagtccttccaa

SEQ ID NO: 590165 - DNA, 25 bp, Rattus norvegicus
tcgatgttccgagaagtccttccaa

SEQ ID NO: 590166 - DNA, 25 bp, Rattus norvegicus
tcgattacccgaacgcactcagaaa

SEQ ID NO: 590167 - DNA, 25 bp, Rattus norvegicus
tcgattacccgatcgcactcagaaa

SEQ ID NO: 590168 - DNA, 25 bp, Rattus norvegicus
tcgattacgtgcaaaactggacaaa

SEQ ID NO: 590169 - DNA, 25 bp, Rattus norvegicus
tcgattacgtgctaaactggacaaa

SEQ ID NO: 590170 - DNA, 25 bp, Rattus norvegicus
tcgattagcaggaccctggctgatg

SEQ ID NO: 590171 - DNA, 25 bp, Rattus norvegicus
tcgattagcaggtccctggctgatg

SEQ ID NO: 590172 - DNA, 25 bp, Rattus norvegicus
tcgattccccttagtggtggatttt

SEQ ID NO: 590173 - DNA, 25 bp, Rattus norvegicus
tcgattcccctttgtggtggatttt

SEQ ID NO: 590174 - DNA, 25 bp, Rattus norvegicus
tcgattcctctgactttttactaat

SEQ ID NO: 590175 - DNA, 25 bp, Rattus norvegicus
tcgattcctctgtctttttactaat

SEQ ID NO: 590176 - DNA, 25 bp, Rattus norvegicus
tcgattgctttaaaaactgcacgtt

SEQ ID NO: 590177 - DNA, 25 bp, Rattus norvegicus
tcgattgctttataaactgcacgtt

SEQ ID NO: 590178 - DNA, 25 bp, Rattus norvegicus
tcgattgtctgaaacctaaccatgt

SEQ ID NO: 590179 - DNA, 25 bp, Rattus norvegicus
tcgattgtctgatacctaaccatgt

SEQ ID NO: 590180 - DNA, 25 bp, Rattus norvegicus
tcgatttcatcgaaggtagcaagct

SEQ ID NO: 590181 - DNA, 25 bp, Rattus norvegicus
tcgatttcatcgtaggtagcaagct

SEQ ID NO: 590182 - DNA, 25 bp, Rattus norvegicus
tcgcaaagaagaaggccaggcccct

SEQ ID NO: 590183 - DNA, 25 bp, Rattus norvegicus
tcgcaaagaagatggccaggcccct

SEQ ID NO: 590184 - DNA, 25 bp, Rattus norvegicus
tcgcaaatgagtaagtaagccacct

SEQ ID NO: 590185 - DNA, 25 bp, Rattus norvegicus
tcgcaaatgagttagtaagccacct

SEQ ID NO: 590186 - DNA, 25 bp, Rattus norvegicus
tcgcaacgtctaccgcaacaagctg

SEQ ID NO: 590187 - DNA, 25 bp, Rattus norvegicus
tcgcaacgtctagcgcaacaagctg

SEQ ID NO: 590188 - DNA, 25 bp, Rattus norvegicus
tcgcaagcagccatcgtccttgtct

SEQ ID NO: 590189 - DNA, 25 bp, Rattus norvegicus
tcgcaagcagccttcgtccttgtct

SEQ ID NO: 590190 - DNA, 25 bp, Rattus norvegicus
tcgcaagcccgtcgaggagaaataa

SEQ ID NO: 590191 - DNA, 25 bp, Rattus norvegicus
tcgcaagcccgtggaggagaaataa

SEQ ID NO: 590192 - DNA, 25 bp, Rattus norvegicus
tcgcaagctgccacctttgcaggca

SEQ ID NO: 590193 - DNA, 25 bp, Rattus norvegicus
tcgcaagctgcctcctttgcaggca

SEQ ID NO: 590194 - DNA, 25 bp, Rattus norvegicus
tcgcaatgattcagctcgctgagga

SEQ ID NO: 590195 - DNA, 25 bp, Rattus norvegicus
tcgcaatgattctgctcgctgagga

SEQ ID NO: 590196 - DNA, 25 bp, Rattus norvegicus
tcgcaatggtgaaggagtaggactc

SEQ ID NO: 590197 - DNA, 25 bp, Rattus norvegicus
tcgcaatggtgatggagtaggactc

SEQ ID NO: 590198 - DNA, 25 bp, Rattus norvegicus
tcgcacacacatatcaattctgtga

SEQ ID NO: 590199 - DNA, 25 bp, Rattus norvegicus
tcgcacacacatcacggcaaacgta

SEQ ID NO: 590200 - DNA, 25 bp, Rattus norvegicus
tcgcacacacatgacggcaaacgta

SEQ ID NO: 590201 - DNA, 25 bp, Rattus norvegicus
tcgcacacacatttcaattctgtga

SEQ ID NO: 590202 - DNA, 25 bp, Rattus norvegicus
tcgcacacgcgcatgaaaacagcag

SEQ ID NO: 590203 - DNA, 25 bp, Rattus norvegicus
tcgcacacgcgcttgaaaacagcag

SEQ ID NO: 590204 - DNA, 25 bp, Rattus norvegicus
tcgcacagcgtgacccggagtggct

SEQ ID NO: 590205 - DNA, 25 bp, Rattus norvegicus
tcgcacagcgtgtcccggagtggct

SEQ ID NO: 590206 - DNA, 25 bp, Rattus norvegicus
tcgcacaggctgacaactttattcc

SEQ ID NO: 590207 - DNA, 25 bp, Rattus norvegicus
tcgcacaggctgtcaactttattcc

SEQ ID NO: 590208 - DNA, 25 bp, Rattus norvegicus
tcgcacagttcacgtcatggtcccg

SEQ ID NO: 590209 - DNA, 25 bp, Rattus norvegicus
tcgcacagttcaggtcatggtcccg

SEQ ID NO: 590210 - DNA, 25 bp, Rattus norvegicus
tcgcacatatggagcgactcctgaa

SEQ ID NO: 590211 - DNA, 25 bp, Rattus norvegicus
tcgcacatatggtgcgactcctgaa

SEQ ID NO: 590212 - DNA, 25 bp, Rattus norvegicus
tcgcacccaattcagtgatttcggg

SEQ ID NO: 590213 - DNA, 25 bp, Rattus norvegicus
tcgcacccaattgagtgatttcggg

SEQ ID NO: 590214 - DNA, 25 bp, Rattus norvegicus
tcgcaccgtcagaccagttcaaagg

SEQ ID NO: 590215 - DNA, 25 bp, Rattus norvegicus
tcgcaccgtcagtccagttcaaagg

SEQ ID NO: 590216 - DNA, 25 bp, Rattus norvegicus
tcgcacctgcatattcctacaactt

SEQ ID NO: 590217 - DNA, 25 bp, Rattus norvegicus
tcgcacctgcattttcctacaactt

SEQ ID NO: 590218 - DNA, 25 bp, Rattus norvegicus
tcgcaccttacactaaacactatcg

SEQ ID NO: 590219 - DNA, 25 bp, Rattus norvegicus
tcgcaccttacagtaaacactatcg

SEQ ID NO: 590220 - DNA, 25 bp, Rattus norvegicus
tcgcacgacggcatagacggcggct

SEQ ID NO: 590221 - DNA, 25 bp, Rattus norvegicus
tcgcacgacggcttagacggcggct

SEQ ID NO: 590222 - DNA, 25 bp, Rattus norvegicus
tcgcacgcaactactttaagccaat

SEQ ID NO: 590223 - DNA, 25 bp, Rattus norvegicus
tcgcacgcaacttctttaagccaat

SEQ ID NO: 590224 - DNA, 25 bp, Rattus norvegicus
tcgcactagcagactggctgggttc

SEQ ID NO: 590225 - DNA, 25 bp, Rattus norvegicus
tcgcactagcagtctggctgggttc

SEQ ID NO: 590226 - DNA, 25 bp, Rattus norvegicus
tcgcactccggcaagagaccaggga

SEQ ID NO: 590227 - DNA, 25 bp, Rattus norvegicus
tcgcactccggctagagaccaggga

SEQ ID NO: 590228 - DNA, 25 bp, Rattus norvegicus
tcgcactgttgccacggtagttaag

SEQ ID NO: 590229 - DNA, 25 bp, Rattus norvegicus
tcgcactgttgcgacggtagttaag

SEQ ID NO: 590230 - DNA, 25 bp, Rattus norvegicus
tcgcagagactcaggctattcagat

SEQ ID NO: 590231 - DNA, 25 bp, Rattus norvegicus
tcgcagagactctggctattcagat

SEQ ID NO: 590232 - DNA, 25 bp, Rattus norvegicus
tcgcagagttttatctcaccactga

SEQ ID NO: 590233 - DNA, 25 bp, Rattus norvegicus
tcgcagagttttttctcaccactga

SEQ ID NO: 590234 - DNA, 25 bp, Rattus norvegicus
tcgcagatgacgcttcggcggaaaa

SEQ ID NO: 590235 - DNA, 25 bp, Rattus norvegicus
tcgcagatgacggttcggcggaaaa

SEQ ID NO: 590236 - DNA, 25 bp, Rattus norvegicus
tcgcagcacacacgtgagggcgcct

SEQ ID NO: 590237 - DNA, 25 bp, Rattus norvegicus
tcgcagcacacaggtgagggcgcct

SEQ ID NO: 590238 - DNA, 25 bp, Rattus norvegicus
tcgcagcagcaaagagggccacgtg

SEQ ID NO: 590239 - DNA, 25 bp, Rattus norvegicus
tcgcagcagcaatgagggccacgtg

SEQ ID NO: 590240 - DNA, 25 bp, Rattus norvegicus
tcgcagcagtggacagtcccaaatt

SEQ ID NO: 590241 - DNA, 25 bp, Rattus norvegicus
tcgcagcagtggtcagtcccaaatt

SEQ ID NO: 590242 - DNA, 25 bp, Rattus norvegicus
tcgcagccactaagaggagggtccg

SEQ ID NO: 590243 - DNA, 25 bp, Rattus norvegicus
tcgcagccactatgaggagggtccg

SEQ ID NO: 590244 - DNA, 25 bp, Rattus norvegicus
tcgcagcgccggattcgggcacgct

SEQ ID NO: 590245 - DNA, 25 bp, Rattus norvegicus
tcgcagcgccggtttcgggcacgct

SEQ ID NO: 590246 - DNA, 25 bp, Rattus norvegicus
tcgcagctgctgaaccacattggca

SEQ ID NO: 590247 - DNA, 25 bp, Rattus norvegicus
tcgcagctgctgtaccacattggca

SEQ ID NO: 590248 - DNA, 25 bp, Rattus norvegicus
tcgcagcttggacttgtatgaaaac

SEQ ID NO: 590249 - DNA, 25 bp, Rattus norvegicus
tcgcagcttggagttgtatgaaaac

SEQ ID NO: 590250 - DNA, 25 bp, Rattus norvegicus
tcgcaggaacccatccaagggacaa

SEQ ID NO: 590251 - DNA, 25 bp, Rattus norvegicus
tcgcaggaacccttccaagggacaa

SEQ ID NO: 590252 - DNA, 25 bp, Rattus norvegicus
tcgcaggactgtatgttaggtctgt

SEQ ID NO: 590253 - DNA, 25 bp, Rattus norvegicus
tcgcaggactgtttgttaggtctgt

SEQ ID NO: 590254 - DNA, 25 bp, Rattus norvegicus
tcgcagggcagcacctcccgggaag

SEQ ID NO: 590255 - DNA, 25 bp, Rattus norvegicus
tcgcagggcagctcctcccgggaag

SEQ ID NO: 590256 - DNA, 25 bp, Rattus norvegicus
tcgcagtaatagaagacgtcgtcat

SEQ ID NO: 590257 - DNA, 25 bp, Rattus norvegicus
tcgcagtaatagtagacgtcgtcat

SEQ ID NO: 590258 - DNA, 25 bp, Rattus norvegicus
tcgcatccagaaccgataccttgag

SEQ ID NO: 590259 - DNA, 25 bp, Rattus norvegicus
tcgcatccagaagcgataccttgag

SEQ ID NO: 590260 - DNA, 25 bp, Rattus norvegicus
tcgcatccgccgagaacgtaacaaa

SEQ ID NO: 590261 - DNA, 25 bp, Rattus norvegicus
tcgcatccgccgtgaacgtaacaaa

SEQ ID NO: 590262 - DNA, 25 bp, Rattus norvegicus
tcgcatgaagtacaagaaggaccag

SEQ ID NO: 590263 - DNA, 25 bp, Rattus norvegicus
tcgcatgaagtagaagaaggaccag

SEQ ID NO: 590264 - DNA, 25 bp, Rattus norvegicus
tcgcatgactgtcgaggcctgagca

SEQ ID NO: 590265 - DNA, 25 bp, Rattus norvegicus
tcgcatgactgtggaggcctgagca

SEQ ID NO: 590266 - DNA, 25 bp, Rattus norvegicus
tcgcatgcttagactttaacgggct

SEQ ID NO: 590267 - DNA, 25 bp, Rattus norvegicus
tcgcatgcttagtctttaacgggct

SEQ ID NO: 590268 - DNA, 25 bp, Rattus norvegicus
tcgcatggttcaccttggtgggtat

SEQ ID NO: 590269 - DNA, 25 bp, Rattus norvegicus
tcgcatggttcagcttggtgggtat

SEQ ID NO: 590270 - DNA, 25 bp, Rattus norvegicus
tcgcatgtcagaccctcagtgaggc

SEQ ID NO: 590271 - DNA, 25 bp, Rattus norvegicus
tcgcatgtcagagcctcagtgaggc

SEQ ID NO: 590272 - DNA, 25 bp, Rattus norvegicus
tcgcatgtggcgcaagactcgatca

SEQ ID NO: 590273 - DNA, 25 bp, Rattus norvegicus
tcgcatgtggcggaagactcgatca

SEQ ID NO: 590274 - DNA, 25 bp, Rattus norvegicus
tcgcattgccttacactcagtgaaa

SEQ ID NO: 590275 - DNA, 25 bp, Rattus norvegicus
tcgcattgcctttcactcagtgaaa

SEQ ID NO: 590276 - DNA, 25 bp, Rattus norvegicus
tcgccaactccacggtgagtgttga

SEQ ID NO: 590277 - DNA, 25 bp, Rattus norvegicus
tcgccaactccagggtgagtgttga

SEQ ID NO: 590278 - DNA, 25 bp, Rattus norvegicus
tcgccaacttctatgcctttgtcaa

SEQ ID NO: 590279 - DNA, 25 bp, Rattus norvegicus
tcgccaacttctttgcctttgtcaa

SEQ ID NO: 590280 - DNA, 25 bp, Rattus norvegicus
tcgccaagttcaaagctgtgcacat

SEQ ID NO: 590281 - DNA, 25 bp, Rattus norvegicus
tcgccaagttcatagctgtgcacat

SEQ ID NO: 590282 - DNA, 25 bp, Rattus norvegicus
tcgccaatcaaaagcgtcgctggac

SEQ ID NO: 590283 - DNA, 25 bp, Rattus norvegicus
tcgccaatcaaatgcgtcgctggac

SEQ ID NO: 590284 - DNA, 25 bp, Rattus norvegicus
tcgccaccgcacaagggacatgggt

SEQ ID NO: 590285 - DNA, 25 bp, Rattus norvegicus
tcgccaccgcactagggacatgggt

SEQ ID NO: 590286 - DNA, 25 bp, Rattus norvegicus
tcgccagaggacaactcgctaacgc

SEQ ID NO: 590287 - DNA, 25 bp, Rattus norvegicus
tcgccagaggactactcgctaacgc

SEQ ID NO: 590288 - DNA, 25 bp, Rattus norvegicus
tcgccagcatatacacctcagaatg

SEQ ID NO: 590289 - DNA, 25 bp, Rattus norvegicus
tcgccagcatattcacctcagaatg

SEQ ID NO: 590290 - DNA, 25 bp, Rattus norvegicus
tcgccagccacgaaatggccgtaga

SEQ ID NO: 590291 - DNA, 25 bp, Rattus norvegicus
tcgccagccacgtaatggccgtaga

SEQ ID NO: 590292 - DNA, 25 bp, Rattus norvegicus
tcgccagcctctcaggtggtagtga

SEQ ID NO: 590293 - DNA, 25 bp, Rattus norvegicus
tcgccagcctctgaggtggtagtga

SEQ ID NO: 590294 - DNA, 25 bp, Rattus norvegicus
tcgccagtaattcatctgacttcat

SEQ ID NO: 590295 - DNA, 25 bp, Rattus norvegicus
tcgccagtaattgatctgacttcat

SEQ ID NO: 590296 - DNA, 25 bp, Rattus norvegicus
tcgccagtatgtctcaggctgattt

SEQ ID NO: 590297 - DNA, 25 bp, Rattus norvegicus
tcgccagtatgtgtcaggctgattt

SEQ ID NO: 590298 - DNA, 25 bp, Rattus norvegicus
tcgccagtgcctatgtttacatgaa

SEQ ID NO: 590299 - DNA, 25 bp, Rattus norvegicus
tcgccagtgcctttgtttacatgaa

SEQ ID NO: 590300 - DNA, 25 bp, Rattus norvegicus
tcgccagtggcaattgcgtacttac

SEQ ID NO: 590301 - DNA, 25 bp, Rattus norvegicus
tcgccagtggcatttgcgtacttac

SEQ ID NO: 590302 - DNA, 25 bp, Rattus norvegicus
tcgccatacagaagggagtgcacac

SEQ ID NO: 590303 - DNA, 25 bp, Rattus norvegicus
tcgccatacagatgggagtgcacac

SEQ ID NO: 590304 - DNA, 25 bp, Rattus norvegicus
tcgccatcaccaaagagccacagtt

SEQ ID NO: 590305 - DNA, 25 bp, Rattus norvegicus
tcgccatcaccatagagccacagtt

SEQ ID NO: 590306 - DNA, 25 bp, Rattus norvegicus
tcgccatcatcacattgcatcgtgc

SEQ ID NO: 590307 - DNA, 25 bp, Rattus norvegicus
tcgccatcatcagattgcatcgtgc

SEQ ID NO: 590308 - DNA, 25 bp, Rattus norvegicus
tcgccatcgccaacagctgtatgaa

SEQ ID NO: 590309 - DNA, 25 bp, Rattus norvegicus
tcgccatcgccatcagctgtatgaa

SEQ ID NO: 590310 - DNA, 25 bp, Rattus norvegicus
tcgccatggccacagcgattggatt

SEQ ID NO: 590311 - DNA, 25 bp, Rattus norvegicus
tcgccatggccagagcgattggatt

SEQ ID NO: 590312 - DNA, 25 bp, Rattus norvegicus
tcgcccaagcttctcatcaaaaatg

SEQ ID NO: 590313 - DNA, 25 bp, Rattus norvegicus
tcgcccaagcttgtcatcaaaaatg

SEQ ID NO: 590314 - DNA, 25 bp, Rattus norvegicus
tcgcccaagtctccttttattgaaa

SEQ ID NO: 590315 - DNA, 25 bp, Rattus norvegicus
tcgcccaagtctgcttttattgaaa

SEQ ID NO: 590316 - DNA, 25 bp, Rattus norvegicus
tcgcccacctttctattgttactga

SEQ ID NO: 590317 - DNA, 25 bp, Rattus norvegicus
tcgcccacctttgtattgttactga

SEQ ID NO: 590318 - DNA, 25 bp, Rattus norvegicus
tcgcccagcaggactgaatgcagaa

SEQ ID NO: 590319 - DNA, 25 bp, Rattus norvegicus
tcgcccagcaggagctacaacatga

SEQ ID NO: 590320 - DNA, 25 bp, Rattus norvegicus
tcgcccagcaggtctgaatgcagaa

SEQ ID NO: 590321 - DNA, 25 bp, Rattus norvegicus
tcgcccagcaggtgctacaacatga

SEQ ID NO: 590322 - DNA, 25 bp, Rattus norvegicus
tcgcccaggtccattgcatgatcca

SEQ ID NO: 590323 - DNA, 25 bp, Rattus norvegicus
tcgcccaggtcctttgcatgatcca

SEQ ID NO: 590324 - DNA, 25 bp, Rattus norvegicus
tcgcccataaagcaagctccaatgt

SEQ ID NO: 590325 - DNA, 25 bp, Rattus norvegicus
tcgcccataaaggaagctccaatgt

SEQ ID NO: 590326 - DNA, 25 bp, Rattus norvegicus
tcgcccattatgattttcccattct

SEQ ID NO: 590327 - DNA, 25 bp, Rattus norvegicus
tcgcccattatgtttttcccattct

SEQ ID NO: 590328 - DNA, 25 bp, Rattus norvegicus
tcgccccagaacagcagagtagctg

SEQ ID NO: 590329 - DNA, 25 bp, Rattus norvegicus
tcgccccagaactgcagagtagctg

SEQ ID NO: 590330 - DNA, 25 bp, Rattus norvegicus
tcgccccagctgattttatggtggt

SEQ ID NO: 590331 - DNA, 25 bp, Rattus norvegicus
tcgccccagctgtttttatggtggt

SEQ ID NO: 590332 - DNA, 25 bp, Rattus norvegicus
tcgcccctcaataagactggcaatt

SEQ ID NO: 590333 - DNA, 25 bp, Rattus norvegicus
tcgcccctcaattagactggcaatt

SEQ ID NO: 590334 - DNA, 25 bp, Rattus norvegicus
tcgccccttagcatatttgccgaaa

SEQ ID NO: 590335 - DNA, 25 bp, Rattus norvegicus
tcgccccttagcttatttgccgaaa

SEQ ID NO: 590336 - DNA, 25 bp, Rattus norvegicus
tcgccccttgatcacgcggaagtaa

SEQ ID NO: 590337 - DNA, 25 bp, Rattus norvegicus
tcgccccttgatgacgcggaagtaa

SEQ ID NO: 590338 - DNA, 25 bp, Rattus norvegicus
tcgcccctttctcttggaagaagca

SEQ ID NO: 590339 - DNA, 25 bp, Rattus norvegicus
tcgcccctttctgttggaagaagca

SEQ ID NO: 590340 - DNA, 25 bp, Rattus norvegicus
tcgcccctttggaaataggaaagct

SEQ ID NO: 590341 - DNA, 25 bp, Rattus norvegicus
tcgcccctttggtaataggaaagct

SEQ ID NO: 590342 - DNA, 25 bp, Rattus norvegicus
tcgcccgacctcagaagctgaaaat

SEQ ID NO: 590343 - DNA, 25 bp, Rattus norvegicus
tcgcccgacctctgaagctgaaaat

SEQ ID NO: 590344 - DNA, 25 bp, Rattus norvegicus
tcgcccgaggagatgctaccgtgga

SEQ ID NO: 590345 - DNA, 25 bp, Rattus norvegicus
tcgcccgaggagttgctaccgtgga

SEQ ID NO: 590346 - DNA, 25 bp, Rattus norvegicus
tcgcccgggagcagttcctaagaaa

SEQ ID NO: 590347 - DNA, 25 bp, Rattus norvegicus
tcgcccgggagctgttcctaagaaa

SEQ ID NO: 590348 - DNA, 25 bp, Rattus norvegicus
tcgccctcggtgactggaaataaac

SEQ ID NO: 590349 - DNA, 25 bp, Rattus norvegicus
tcgccctcggtgtctggaaataaac

SEQ ID NO: 590350 - DNA, 25 bp, Rattus norvegicus
tcgccctcgtgtatgtacactgcaa

SEQ ID NO: 590351 - DNA, 25 bp, Rattus norvegicus
tcgccctcgtgtttgtacactgcaa

SEQ ID NO: 590352 - DNA, 25 bp, Rattus norvegicus
tcgccctggctaattaaactttaag

SEQ ID NO: 590353 - DNA, 25 bp, Rattus norvegicus
tcgccctggctatttaaactttaag

SEQ ID NO: 590354 - DNA, 25 bp, Rattus norvegicus
tcgccctgtcagaactgtgatgtct

SEQ ID NO: 590355 - DNA, 25 bp, Rattus norvegicus
tcgccctgtcagtactgtgatgtct

SEQ ID NO: 590356 - DNA, 25 bp, Rattus norvegicus
tcgcccttcccaagtacagggttgg

SEQ ID NO: 590357 - DNA, 25 bp, Rattus norvegicus
tcgcccttcccatgtacagggttgg

SEQ ID NO: 590358 - DNA, 25 bp, Rattus norvegicus
tcgccgacgccacattcacggaagt

SEQ ID NO: 590359 - DNA, 25 bp, Rattus norvegicus
tcgccgacgccagattcacggaagt

SEQ ID NO: 590360 - DNA, 25 bp, Rattus norvegicus
tcgccgagcttgatacactgaatga

SEQ ID NO: 590361 - DNA, 25 bp, Rattus norvegicus
tcgccgagcttgttacactgaatga

SEQ ID NO: 590362 - DNA, 25 bp, Rattus norvegicus
tcgccgagtctcaagaaaccttttt

SEQ ID NO: 590363 - DNA, 25 bp, Rattus norvegicus
tcgccgagtctctagaaaccttttt

SEQ ID NO: 590364 - DNA, 25 bp, Rattus norvegicus
tcgccgcagactacatttctagtgt

SEQ ID NO: 590365 - DNA, 25 bp, Rattus norvegicus
tcgccgcagacttcatttctagtgt

SEQ ID NO: 590366 - DNA, 25 bp, Rattus norvegicus
tcgccgcagcccagaggacagcgag

SEQ ID NO: 590367 - DNA, 25 bp, Rattus norvegicus
tcgccgcagccctgaggacagcgag

SEQ ID NO: 590368 - DNA, 25 bp, Rattus norvegicus
tcgccgccagaaatactcaagcaat

SEQ ID NO: 590369 - DNA, 25 bp, Rattus norvegicus
tcgccgccagaattactcaagcaat

SEQ ID NO: 590370 - DNA, 25 bp, Rattus norvegicus
tcgccgccggttatgcagagagcac

SEQ ID NO: 590371 - DNA, 25 bp, Rattus norvegicus
tcgccgccggttttgcagagagcac

SEQ ID NO: 590372 - DNA, 25 bp, Rattus norvegicus
tcgccgcgggtcaccgactgtgtac

SEQ ID NO: 590373 - DNA, 25 bp, Rattus norvegicus
tcgccgcgggtctccgactgtgtac

SEQ ID NO: 590374 - DNA, 25 bp, Rattus norvegicus
tcgccgcttttgaacaggttcagta

SEQ ID NO: 590375 - DNA, 25 bp, Rattus norvegicus
tcgccgcttttgtacaggttcagta

SEQ ID NO: 590376 - DNA, 25 bp, Rattus norvegicus
tcgccggaacaactcggctgtgcag

SEQ ID NO: 590377 - DNA, 25 bp, Rattus norvegicus
tcgccggaacaagtcggctgtgcag

SEQ ID NO: 590378 - DNA, 25 bp, Rattus norvegicus
tcgccggccggcaggtacatgctga

SEQ ID NO: 590379 - DNA, 25 bp, Rattus norvegicus
tcgccggccggctggtacatgctga

SEQ ID NO: 590380 - DNA, 25 bp, Rattus norvegicus
tcgccggctctaacaaggaaatctc

SEQ ID NO: 590381 - DNA, 25 bp, Rattus norvegicus
tcgccggctctatcaaggaaatctc

SEQ ID NO: 590382 - DNA, 25 bp, Rattus norvegicus
tcgccggctctcatgtatacaaaca

SEQ ID NO: 590383 - DNA, 25 bp, Rattus norvegicus
tcgccggctctcttgtatacaaaca

SEQ ID NO: 590384 - DNA, 25 bp, Rattus norvegicus
tcgccggtcttcatcgaaaacctat

SEQ ID NO: 590385 - DNA, 25 bp, Rattus norvegicus
tcgccggtcttcttcgaaaacctat

SEQ ID NO: 590386 - DNA, 25 bp, Rattus norvegicus
tcgccgtagcatccagaagaccagg

SEQ ID NO: 590387 - DNA, 25 bp, Rattus norvegicus
tcgccgtagcatgcagaagaccagg

SEQ ID NO: 590388 - DNA, 25 bp, Rattus norvegicus
tcgccgtcaaccagcagaacatgtg

SEQ ID NO: 590389 - DNA, 25 bp, Rattus norvegicus
tcgccgtcaacctgcagaacatgtg

SEQ ID NO: 590390 - DNA, 25 bp, Rattus norvegicus
tcgccgtgagcgatggctacagaaa

SEQ ID NO: 590391 - DNA, 25 bp, Rattus norvegicus
tcgccgtgagcgttggctacagaaa

SEQ ID NO: 590392 - DNA, 25 bp, Rattus norvegicus
tcgccgttgctcaagggcagatttg

SEQ ID NO: 590393 - DNA, 25 bp, Rattus norvegicus
tcgccgttgctctagggcagatttg

SEQ ID NO: 590394 - DNA, 25 bp, Rattus norvegicus
tcgccgtttcggcagatggtaactt

SEQ ID NO: 590395 - DNA, 25 bp, Rattus norvegicus
tcgccgtttcgggagatggtaactt

SEQ ID NO: 590396 - DNA, 25 bp, Rattus norvegicus
tcgcctaatgtcaacaagcactgtt

SEQ ID NO: 590397 - DNA, 25 bp, Rattus norvegicus
tcgcctaatgtctacaagcactgtt

SEQ ID NO: 590398 - DNA, 25 bp, Rattus norvegicus
tcgcctaccacacatattgcagaga

SEQ ID NO: 590399 - DNA, 25 bp, Rattus norvegicus
tcgcctaccacagatattgcagaga

SEQ ID NO: 590400 - DNA, 25 bp, Rattus norvegicus
tcgcctacccttaattattttcaca

SEQ ID NO: 590401 - DNA, 25 bp, Rattus norvegicus
tcgcctaccctttattattttcaca

SEQ ID NO: 590402 - DNA, 25 bp, Rattus norvegicus
tcgcctcagagcacagggccaaggg

SEQ ID NO: 590403 - DNA, 25 bp, Rattus norvegicus
tcgcctcagagctcagggccaaggg

SEQ ID NO: 590404 - DNA, 25 bp, Rattus norvegicus
tcgcctcatgcgattttggatagtt

SEQ ID NO: 590405 - DNA, 25 bp, Rattus norvegicus
tcgcctcatgcgtttttggatagtt

SEQ ID NO: 590406 - DNA, 25 bp, Rattus norvegicus
tcgcctcccggaactctcgtggcgg

SEQ ID NO: 590407 - DNA, 25 bp, Rattus norvegicus
tcgcctcccggatctctcgtggcgg

SEQ ID NO: 590408 - DNA, 25 bp, Rattus norvegicus
tcgcctcctccactaggtgggaaag

SEQ ID NO: 590409 - DNA, 25 bp, Rattus norvegicus
tcgcctcctccagtaggtgggaaag

SEQ ID NO: 590410 - DNA, 25 bp, Rattus norvegicus
tcgcctcctgcccactgagggagga

SEQ ID NO: 590411 - DNA, 25 bp, Rattus norvegicus
tcgcctcctgccgactgagggagga

SEQ ID NO: 590412 - DNA, 25 bp, Rattus norvegicus
tcgcctcctgtgatatgttctagac

SEQ ID NO: 590413 - DNA, 25 bp, Rattus norvegicus
tcgcctcctgtgttatgttctagac

SEQ ID NO: 590414 - DNA, 25 bp, Rattus norvegicus
tcgcctcgaatgctgcctcggaagc

SEQ ID NO: 590415 - DNA, 25 bp, Rattus norvegicus
tcgcctcgaatggtgcctcggaagc

SEQ ID NO: 590416 - DNA, 25 bp, Rattus norvegicus
tcgcctctcttgacagagctggaag

SEQ ID NO: 590417 - DNA, 25 bp, Rattus norvegicus
tcgcctctcttgtcagagctggaag

SEQ ID NO: 590418 - DNA, 25 bp, Rattus norvegicus
tcgcctctttcaacatcaataccaa

SEQ ID NO: 590419 - DNA, 25 bp, Rattus norvegicus
tcgcctctttcatcatcaataccaa

SEQ ID NO: 590420 - DNA, 25 bp, Rattus norvegicus
tcgcctgacactaccggaatgcaag

SEQ ID NO: 590421 - DNA, 25 bp, Rattus norvegicus
tcgcctgacacttccggaatgcaag

SEQ ID NO: 590422 - DNA, 25 bp, Rattus norvegicus
tcgcctgagtcaacctgtgtgagtg

SEQ ID NO: 590423 - DNA, 25 bp, Rattus norvegicus
tcgcctgagtcatcctgtgtgagtg

SEQ ID NO: 590424 - DNA, 25 bp, Rattus norvegicus
tcgcctgcatggaggtgacagtcat

SEQ ID NO: 590425 - DNA, 25 bp, Rattus norvegicus
tcgcctgcatggtggtgacagtcat

SEQ ID NO: 590426 - DNA, 25 bp, Rattus norvegicus
tcgcctgcggtcagttggagacgtt

SEQ ID NO: 590427 - DNA, 25 bp, Rattus norvegicus
tcgcctgcggtctgttggagacgtt

SEQ ID NO: 590428 - DNA, 25 bp, Rattus norvegicus
tcgcctgcttggcatccagttaaat

SEQ ID NO: 590429 - DNA, 25 bp, Rattus norvegicus
tcgcctgcttgggatccagttaaat

SEQ ID NO: 590430 - DNA, 25 bp, Rattus norvegicus
tcgcctggacagatttgtttctatt

SEQ ID NO: 590431 - DNA, 25 bp, Rattus norvegicus
tcgcctggacagttttgtttctatt

SEQ ID NO: 590432 - DNA, 25 bp, Rattus norvegicus
tcgcctggaggcatttagtctggat

SEQ ID NO: 590433 - DNA, 25 bp, Rattus norvegicus
tcgcctggaggcttttagtctggat

SEQ ID NO: 590434 - DNA, 25 bp, Rattus norvegicus
tcgcctggctagcatggagcttgca

SEQ ID NO: 590435 - DNA, 25 bp, Rattus norvegicus
tcgcctggctaggatggagcttgca

SEQ ID NO: 590436 - DNA, 25 bp, Rattus norvegicus
tcgcctggctgcagctgcaagacct

SEQ ID NO: 590437 - DNA, 25 bp, Rattus norvegicus
tcgcctggctgctgctgcaagacct

SEQ ID NO: 590438 - DNA, 25 bp, Rattus norvegicus
tcgcctgggagtcttcctgtaatac

SEQ ID NO: 590439 - DNA, 25 bp, Rattus norvegicus
tcgcctgggagtgttcctgtaatac

SEQ ID NO: 590440 - DNA, 25 bp, Rattus norvegicus
tcgcctggtcttcgagggatttcca

SEQ ID NO: 590441 - DNA, 25 bp, Rattus norvegicus
tcgcctggtcttggagggatttcca

SEQ ID NO: 590442 - DNA, 25 bp, Rattus norvegicus
tcgcctgtctcgcagtcgcgcggat

SEQ ID NO: 590443 - DNA, 25 bp, Rattus norvegicus
tcgcctgtctcggagtcgcgcggat

SEQ ID NO: 590444 - DNA, 25 bp, Rattus norvegicus
tcgcctgtgcttacttgaacattta

SEQ ID NO: 590445 - DNA, 25 bp, Rattus norvegicus
tcgcctgtgctttcttgaacattta

SEQ ID NO: 590446 - DNA, 25 bp, Rattus norvegicus
tcgcctgtgtgcagccgctggtgta

SEQ ID NO: 590447 - DNA, 25 bp, Rattus norvegicus
tcgcctgtgtgctgccgctggtgta

SEQ ID NO: 590448 - DNA, 25 bp, Rattus norvegicus
tcgccttaaacgagggcccaggacg

SEQ ID NO: 590449 - DNA, 25 bp, Rattus norvegicus
tcgccttaaacgtgggcccaggacg

SEQ ID NO: 590450 - DNA, 25 bp, Rattus norvegicus
tcgccttaccctcagtgtgaattgt

SEQ ID NO: 590451 - DNA, 25 bp, Rattus norvegicus
tcgccttaccctgagtgtgaattgt

SEQ ID NO: 590452 - DNA, 25 bp, Rattus norvegicus
tcgccttccagcattgagtacacca

SEQ ID NO: 590453 - DNA, 25 bp, Rattus norvegicus
tcgccttccagctttgagtacacca

SEQ ID NO: 590454 - DNA, 25 bp, Rattus norvegicus
tcgccttcccttagggctgcagaaa

SEQ ID NO: 590455 - DNA, 25 bp, Rattus norvegicus
tcgccttccctttgggctgcagaaa

SEQ ID NO: 590456 - DNA, 25 bp, Rattus norvegicus
tcgccttccgcaaaactgtgagcaa

SEQ ID NO: 590457 - DNA, 25 bp, Rattus norvegicus
tcgccttccgcataactgtgagcaa

SEQ ID NO: 590458 - DNA, 25 bp, Rattus norvegicus
tcgccttcctttatcacattattaa

SEQ ID NO: 590459 - DNA, 25 bp, Rattus norvegicus
tcgccttcctttttcacattattaa

SEQ ID NO: 590460 - DNA, 25 bp, Rattus norvegicus
tcgccttcgtgcagggcaaccggca

SEQ ID NO: 590461 - DNA, 25 bp, Rattus norvegicus
tcgccttcgtgctgggcaaccggca

SEQ ID NO: 590462 - DNA, 25 bp, Rattus norvegicus
tcgccttctagacatcactgttcat

SEQ ID NO: 590463 - DNA, 25 bp, Rattus norvegicus
tcgccttctagagatcactgttcat

SEQ ID NO: 590464 - DNA, 25 bp, Rattus norvegicus
tcgccttctcggcaacctttgtaat

SEQ ID NO: 590465 - DNA, 25 bp, Rattus norvegicus
tcgccttctcgggaacctttgtaat

SEQ ID NO: 590466 - DNA, 25 bp, Rattus norvegicus
tcgccttgggcacctgtaccaaagt

SEQ ID NO: 590467 - DNA, 25 bp, Rattus norvegicus
tcgccttgggcagctgtaccaaagt

SEQ ID NO: 590468 - DNA, 25 bp, Rattus norvegicus
tcgcctttcttgatggatacttcag

SEQ ID NO: 590469 - DNA, 25 bp, Rattus norvegicus
tcgcctttcttgttggatacttcag

SEQ ID NO: 590470 - DNA, 25 bp, Rattus norvegicus
tcgcctttgacaaacccacggagaa

SEQ ID NO: 590471 - DNA, 25 bp, Rattus norvegicus
tcgcctttgacatacccacggagaa

SEQ ID NO: 590472 - DNA, 25 bp, Rattus norvegicus
tcgccttttgggagcctgtttcctt

SEQ ID NO: 590473 - DNA, 25 bp, Rattus norvegicus
tcgccttttgggtgcctgtttcctt

SEQ ID NO: 590474 - DNA, 25 bp, Rattus norvegicus
tcgcgaaactggagccccggagaag

SEQ ID NO: 590475 - DNA, 25 bp, Rattus norvegicus
tcgcgaaactggtgccccggagaag

SEQ ID NO: 590476 - DNA, 25 bp, Rattus norvegicus
tcgcgacagttcagcacacctgtat

SEQ ID NO: 590477 - DNA, 25 bp, Rattus norvegicus
tcgcgacagttctgcacacctgtat

SEQ ID NO: 590478 - DNA, 25 bp, Rattus norvegicus
tcgcgaccaggtcaaggccatcaac

SEQ ID NO: 590479 - DNA, 25 bp, Rattus norvegicus
tcgcgaccaggtgaaggccatcaac

SEQ ID NO: 590480 - DNA, 25 bp, Rattus norvegicus
tcgcgactcctaatactatgcagta

SEQ ID NO: 590481 - DNA, 25 bp, Rattus norvegicus
tcgcgactcctattactatgcagta

SEQ ID NO: 590482 - DNA, 25 bp, Rattus norvegicus
tcgcgagcttgtcgctgtcctacaa

SEQ ID NO: 590483 - DNA, 25 bp, Rattus norvegicus
tcgcgagcttgtggctgtcctacaa

SEQ ID NO: 590484 - DNA, 25 bp, Rattus norvegicus
tcgcgcaggcgtctgaagtactcca

SEQ ID NO: 590485 - DNA, 25 bp, Rattus norvegicus
tcgcgcaggcgtgtgaagtactcca

SEQ ID NO: 590486 - DNA, 25 bp, Rattus norvegicus
tcgcgcatagctacgttctgaggaa

SEQ ID NO: 590487 - DNA, 25 bp, Rattus norvegicus
tcgcgcatagcttcgttctgaggaa

SEQ ID NO: 590488 - DNA, 25 bp, Rattus norvegicus
tcgcgccaaagccaagacccgttct

SEQ ID NO: 590489 - DNA, 25 bp, Rattus norvegicus
tcgcgccaaagcgaagacccgttct

SEQ ID NO: 590490 - DNA, 25 bp, Rattus norvegicus
tcgcgcgactctcactgagcaggaa

SEQ ID NO: 590491 - DNA, 25 bp, Rattus norvegicus
tcgcgcgactctgactgagcaggaa

SEQ ID NO: 590492 - DNA, 25 bp, Rattus norvegicus
tcgcgcgattgaacacgtgtcagtt

SEQ ID NO: 590493 - DNA, 25 bp, Rattus norvegicus
tcgcgcgattgatcacgtgtcagtt

SEQ ID NO: 590494 - DNA, 25 bp, Rattus norvegicus
tcgcgcgggtgtcaagttactttcc

SEQ ID NO: 590495 - DNA, 25 bp, Rattus norvegicus
tcgcgcgggtgtgaagttactttcc

SEQ ID NO: 590496 - DNA, 25 bp, Rattus norvegicus
tcgcgctacaaaaccgggctggaag

SEQ ID NO: 590497 - DNA, 25 bp, Rattus norvegicus
tcgcgctacaaatccgggctggaag

SEQ ID NO: 590498 - DNA, 25 bp, Rattus norvegicus
tcgcgctgcaggaacttgtaccaga

SEQ ID NO: 590499 - DNA, 25 bp, Rattus norvegicus
tcgcgctgcaggtacttgtaccaga

SEQ ID NO: 590500 - DNA, 25 bp, Rattus norvegicus
tcgcgctgtcctaagaagtgttcct

SEQ ID NO: 590501 - DNA, 25 bp, Rattus norvegicus
tcgcgctgtccttagaagtgttcct

SEQ ID NO: 590502 - DNA, 25 bp, Rattus norvegicus
tcgcggaactcgatgaggccctgcg

SEQ ID NO: 590503 - DNA, 25 bp, Rattus norvegicus
tcgcggaactcgttgaggccctgcg

SEQ ID NO: 590504 - DNA, 25 bp, Rattus norvegicus
tcgcggagcccgcttggttgcacat

SEQ ID NO: 590505 - DNA, 25 bp, Rattus norvegicus
tcgcggagcccggttggttgcacat

SEQ ID NO: 590506 - DNA, 25 bp, Rattus norvegicus
tcgcggagcgcgcagaaagttacaa

SEQ ID NO: 590507 - DNA, 25 bp, Rattus norvegicus
tcgcggagcgcggagaaagttacaa

SEQ ID NO: 590508 - DNA, 25 bp, Rattus norvegicus
tcgcggatacgcatgacctgtctga

SEQ ID NO: 590509 - DNA, 25 bp, Rattus norvegicus
tcgcggatacgcttgacctgtctga

SEQ ID NO: 590510 - DNA, 25 bp, Rattus norvegicus
tcgcggatgccgctgggcctctttt

SEQ ID NO: 590511 - DNA, 25 bp, Rattus norvegicus
tcgcggatgccggtgggcctctttt

SEQ ID NO: 590512 - DNA, 25 bp, Rattus norvegicus
tcgcggctaaccaactgtttgagat

SEQ ID NO: 590513 - DNA, 25 bp, Rattus norvegicus
tcgcggctaacctactgtttgagat

SEQ ID NO: 590514 - DNA, 25 bp, Rattus norvegicus
tcgcgggcgaaaccgtctccagcgt

SEQ ID NO: 590515 - DNA, 25 bp, Rattus norvegicus
tcgcgggcgaaagcgtctccagcgt

SEQ ID NO: 590516 - DNA, 25 bp, Rattus norvegicus
tcgcgggctgcgattggaacgttaa

SEQ ID NO: 590517 - DNA, 25 bp, Rattus norvegicus
tcgcgggctgcgtttggaacgttaa

SEQ ID NO: 590518 - DNA, 25 bp, Rattus norvegicus
tcgcgggtctacactgtggactgta

SEQ ID NO: 590519 - DNA, 25 bp, Rattus norvegicus
tcgcgggtctactctgtggactgta

SEQ ID NO: 590520 - DNA, 25 bp, Rattus norvegicus
tcgcgggttcccactgcagcagaga

SEQ ID NO: 590521 - DNA, 25 bp, Rattus norvegicus
tcgcgggttccctctgcagcagaga

SEQ ID NO: 590522 - DNA, 25 bp, Rattus norvegicus
tcgcgtacacgaaatcatacattac

SEQ ID NO: 590523 - DNA, 25 bp, Rattus norvegicus
tcgcgtacacgatatcatacattac

SEQ ID NO: 590524 - DNA, 25 bp, Rattus norvegicus
tcgcgtcgcagccaggaagacttta

SEQ ID NO: 590525 - DNA, 25 bp, Rattus norvegicus
tcgcgtcgcagcgaggaagacttta

SEQ ID NO: 590526 - DNA, 25 bp, Rattus norvegicus
tcgcgtctcgatctcaagaagctgt

SEQ ID NO: 590527 - DNA, 25 bp, Rattus norvegicus
tcgcgtctcgatgtcaagaagctgt

SEQ ID NO: 590528 - DNA, 25 bp, Rattus norvegicus
tcgcgtcttcagaaaacagcagtag

SEQ ID NO: 590529 - DNA, 25 bp, Rattus norvegicus
tcgcgtcttcagtaaacagcagtag

SEQ ID NO: 590530 - DNA, 25 bp, Rattus norvegicus
tcgcgtgtcttgcactaatcagtgc

SEQ ID NO: 590531 - DNA, 25 bp, Rattus norvegicus
tcgcgtgtcttggactaatcagtgc

SEQ ID NO: 590532 - DNA, 25 bp, Rattus norvegicus
tcgcgttagggacacgctctggtcc

SEQ ID NO: 590533 - DNA, 25 bp, Rattus norvegicus
tcgcgttagggagacgctctggtcc

SEQ ID NO: 590534 - DNA, 25 bp, Rattus norvegicus
tcgcgttcgctgcaggacctgagct

SEQ ID NO: 590535 - DNA, 25 bp, Rattus norvegicus
tcgcgttcgctggaggacctgagct

SEQ ID NO: 590536 - DNA, 25 bp, Rattus norvegicus
tcgctacatgcgattccacgttata

SEQ ID NO: 590537 - DNA, 25 bp, Rattus norvegicus
tcgctacatgcgtttccacgttata

SEQ ID NO: 590538 - DNA, 25 bp, Rattus norvegicus
tcgctactacggactgattttctat

SEQ ID NO: 590539 - DNA, 25 bp, Rattus norvegicus
tcgctactacggtctgattttctat

SEQ ID NO: 590540 - DNA, 25 bp, Rattus norvegicus
tcgctactccgaaaacttgcagttt

SEQ ID NO: 590541 - DNA, 25 bp, Rattus norvegicus
tcgctactccgataacttgcagttt

SEQ ID NO: 590542 - DNA, 25 bp, Rattus norvegicus
tcgctacttaccaggaccttactaa

SEQ ID NO: 590543 - DNA, 25 bp, Rattus norvegicus
tcgctacttacctggaccttactaa

SEQ ID NO: 590544 - DNA, 25 bp, Rattus norvegicus
tcgctacttactccttgtgagactt

SEQ ID NO: 590545 - DNA, 25 bp, Rattus norvegicus
tcgctacttactgcttgtgagactt

SEQ ID NO: 590546 - DNA, 25 bp, Rattus norvegicus
tcgctagcaccccaaacgattttta

SEQ ID NO: 590547 - DNA, 25 bp, Rattus norvegicus
tcgctagcacccgaaacgattttta

SEQ ID NO: 590548 - DNA, 25 bp, Rattus norvegicus
tcgctagggttaagaccccttgaag

SEQ ID NO: 590549 - DNA, 25 bp, Rattus norvegicus
tcgctagggttatgaccccttgaag

SEQ ID NO: 590550 - DNA, 25 bp, Rattus norvegicus
tcgctagtgcacacgccctggagga

SEQ ID NO: 590551 - DNA, 25 bp, Rattus norvegicus
tcgctagtgcactcgccctggagga

SEQ ID NO: 590552 - DNA, 25 bp, Rattus norvegicus
tcgctatggctgctctgtctgagaa

SEQ ID NO: 590553 - DNA, 25 bp, Rattus norvegicus
tcgctatggctggtctgtctgagaa

SEQ ID NO: 590554 - DNA, 25 bp, Rattus norvegicus
tcgctattaggcctgatgatcgtct

SEQ ID NO: 590555 - DNA, 25 bp, Rattus norvegicus
tcgctattaggcgtgatgatcgtct

SEQ ID NO: 590556 - DNA, 25 bp, Rattus norvegicus
tcgctattttccagctccgcactaa

SEQ ID NO: 590557 - DNA, 25 bp, Rattus norvegicus
tcgctattttcctgctccgcactaa

SEQ ID NO: 590558 - DNA, 25 bp, Rattus norvegicus
tcgctcaataacctcccattttgga

SEQ ID NO: 590559 - DNA, 25 bp, Rattus norvegicus
tcgctcaataacgtcccattttgga

SEQ ID NO: 590560 - DNA, 25 bp, Rattus norvegicus
tcgctcatccaacctagacttgtga

SEQ ID NO: 590561 - DNA, 25 bp, Rattus norvegicus
tcgctcatccaagctagacttgtga

SEQ ID NO: 590562 - DNA, 25 bp, Rattus norvegicus
tcgctcatgctaagggccggcaaga

SEQ ID NO: 590563 - DNA, 25 bp, Rattus norvegicus
tcgctcatgctatgggccggcaaga

SEQ ID NO: 590564 - DNA, 25 bp, Rattus norvegicus
tcgctcatgttgacatcctctgtgc

SEQ ID NO: 590565 - DNA, 25 bp, Rattus norvegicus
tcgctcatgttgtcatcctctgtgc

SEQ ID NO: 590566 - DNA, 25 bp, Rattus norvegicus
tcgctccagggcatagcagtggtaa

SEQ ID NO: 590567 - DNA, 25 bp, Rattus norvegicus
tcgctccagggcttagcagtggtaa

SEQ ID NO: 590568 - DNA, 25 bp, Rattus norvegicus
tcgctcccagccctatgagatattt

SEQ ID NO: 590569 - DNA, 25 bp, Rattus norvegicus
tcgctcccagccgtatgagatattt

SEQ ID NO: 590570 - DNA, 25 bp, Rattus norvegicus
tcgctccgatccatttcttatgagg

SEQ ID NO: 590571 - DNA, 25 bp, Rattus norvegicus
tcgctccgatccttttcttatgagg

SEQ ID NO: 590572 - DNA, 25 bp, Rattus norvegicus
tcgctcctggatatctttcatttca

SEQ ID NO: 590573 - DNA, 25 bp, Rattus norvegicus
tcgctcctggatttctttcatttca

SEQ ID NO: 590574 - DNA, 25 bp, Rattus norvegicus
tcgctcctttgacaggtcccataaa

SEQ ID NO: 590575 - DNA, 25 bp, Rattus norvegicus
tcgctcctttgagaggtcccataaa

SEQ ID NO: 590576 - DNA, 25 bp, Rattus norvegicus
tcgctcgcaaacactatgactttaa

SEQ ID NO: 590577 - DNA, 25 bp, Rattus norvegicus
tcgctcgcaaactctatgactttaa

SEQ ID NO: 590578 - DNA, 25 bp, Rattus norvegicus
tcgctcgcacaacctgtatgccata

SEQ ID NO: 590579 - DNA, 25 bp, Rattus norvegicus
tcgctcgcacaagctgtatgccata

SEQ ID NO: 590580 - DNA, 25 bp, Rattus norvegicus
tcgctcggaagtagctggttgacaa

SEQ ID NO: 590581 - DNA, 25 bp, Rattus norvegicus
tcgctcggaagttgctggttgacaa

SEQ ID NO: 590582 - DNA, 25 bp, Rattus norvegicus
tcgctcgtaaagcttatccctctgt

SEQ ID NO: 590583 - DNA, 25 bp, Rattus norvegicus
tcgctcgtaaaggttatccctctgt

SEQ ID NO: 590584 - DNA, 25 bp, Rattus norvegicus
tcgctctaaactatcttcttgtctc

SEQ ID NO: 590585 - DNA, 25 bp, Rattus norvegicus
tcgctctaaactttcttcttgtctc

SEQ ID NO: 590586 - DNA, 25 bp, Rattus norvegicus
tcgctctcagagaccgtacatgtga

SEQ ID NO: 590587 - DNA, 25 bp, Rattus norvegicus
tcgctctcagagtccgtacatgtga

SEQ ID NO: 590588 - DNA, 25 bp, Rattus norvegicus
tcgctctcatccctttatctctgta

SEQ ID NO: 590589 - DNA, 25 bp, Rattus norvegicus
tcgctctcatccgtttatctctgta

SEQ ID NO: 590590 - DNA, 25 bp, Rattus norvegicus
tcgctctctgccctgacgagcaggg

SEQ ID NO: 590591 - DNA, 25 bp, Rattus norvegicus
tcgctctctgccgtgacgagcaggg

SEQ ID NO: 590592 - DNA, 25 bp, Rattus norvegicus
tcgctctgagtgatctgaccttgca

SEQ ID NO: 590593 - DNA, 25 bp, Rattus norvegicus
tcgctctgagtgttctgaccttgca

SEQ ID NO: 590594 - DNA, 25 bp, Rattus norvegicus
tcgctctgcaaaccttgtgcacaat

SEQ ID NO: 590595 - DNA, 25 bp, Rattus norvegicus
tcgctctgcaaagcttgtgcacaat

SEQ ID NO: 590596 - DNA, 25 bp, Rattus norvegicus
tcgctctgctgaactaactcttggg

SEQ ID NO: 590597 - DNA, 25 bp, Rattus norvegicus
tcgctctgctgatctaactcttggg

SEQ ID NO: 590598 - DNA, 25 bp, Rattus norvegicus
tcgctctgtgccattataccatgag

SEQ ID NO: 590599 - DNA, 25 bp, Rattus norvegicus
tcgctctgtgcctttataccatgag

SEQ ID NO: 590600 - DNA, 25 bp, Rattus norvegicus
tcgctcttcaagcatctgcatgttt

SEQ ID NO: 590601 - DNA, 25 bp, Rattus norvegicus
tcgctcttcaaggatctgcatgttt

SEQ ID NO: 590602 - DNA, 25 bp, Rattus norvegicus
tcgctcttcccaaaatgagaacctc

SEQ ID NO: 590603 - DNA, 25 bp, Rattus norvegicus
tcgctcttcccataatgagaacctc

SEQ ID NO: 590604 - DNA, 25 bp, Rattus norvegicus
tcgctcttgtagctcttctcctcaa

SEQ ID NO: 590605 - DNA, 25 bp, Rattus norvegicus
tcgctcttgtaggtcttctcctcaa

SEQ ID NO: 590606 - DNA, 25 bp, Rattus norvegicus
tcgctcttttatccctgaatgctgt

SEQ ID NO: 590607 - DNA, 25 bp, Rattus norvegicus
tcgctcttttatgcctgaatgctgt

SEQ ID NO: 590608 - DNA, 25 bp, Rattus norvegicus
tcgctgaactcgatgaattccacct

SEQ ID NO: 590609 - DNA, 25 bp, Rattus norvegicus
tcgctgaactcgttgaattccacct

SEQ ID NO: 590610 - DNA, 25 bp, Rattus norvegicus
tcgctgacctacctaagagtgacaa

SEQ ID NO: 590611 - DNA, 25 bp, Rattus norvegicus
tcgctgacctacgtaagagtgacaa

SEQ ID NO: 590612 - DNA, 25 bp, Rattus norvegicus
tcgctgagccttatagcctgctata

SEQ ID NO: 590613 - DNA, 25 bp, Rattus norvegicus
tcgctgagccttttagcctgctata

SEQ ID NO: 590614 - DNA, 25 bp, Rattus norvegicus
tcgctgatgctcagtgatacacgct

SEQ ID NO: 590615 - DNA, 25 bp, Rattus norvegicus
tcgctgatgctctgtgatacacgct

SEQ ID NO: 590616 - DNA, 25 bp, Rattus norvegicus
tcgctgccaaagagggcgccgtctt

SEQ ID NO: 590617 - DNA, 25 bp, Rattus norvegicus
tcgctgccaaagtgggcgccgtctt

SEQ ID NO: 590618 - DNA, 25 bp, Rattus norvegicus
tcgctgccaggcatgatgacttacg

SEQ ID NO: 590619 - DNA, 25 bp, Rattus norvegicus
tcgctgccaggcttgatgacttacg

SEQ ID NO: 590620 - DNA, 25 bp, Rattus norvegicus
tcgctgcccatgactatcattattg

SEQ ID NO: 590621 - DNA, 25 bp, Rattus norvegicus
tcgctgcccatgtctatcattattg

SEQ ID NO: 590622 - DNA, 25 bp, Rattus norvegicus
tcgctgccctgtactataaatcaag

SEQ ID NO: 590623 - DNA, 25 bp, Rattus norvegicus
tcgctgccctgttctataaatcaag

SEQ ID NO: 590624 - DNA, 25 bp, Rattus norvegicus
tcgctgcccttgcttattctaagga

SEQ ID NO: 590625 - DNA, 25 bp, Rattus norvegicus
tcgctgcccttggttattctaagga

SEQ ID NO: 590626 - DNA, 25 bp, Rattus norvegicus
tcgctgccgaacaatttatccatga

SEQ ID NO: 590627 - DNA, 25 bp, Rattus norvegicus
tcgctgccgaactatttatccatga

SEQ ID NO: 590628 - DNA, 25 bp, Rattus norvegicus
tcgctgccgggcaacgtgcattgct

SEQ ID NO: 590629 - DNA, 25 bp, Rattus norvegicus
tcgctgccgggctacgtgcattgct

SEQ ID NO: 590630 - DNA, 25 bp, Rattus norvegicus
tcgctgcctgagatgccactggtaa

SEQ ID NO: 590631 - DNA, 25 bp, Rattus norvegicus
tcgctgcctgagttgccactggtaa

SEQ ID NO: 590632 - DNA, 25 bp, Rattus norvegicus
tcgctgcgatctcatcaggaccatg

SEQ ID NO: 590633 - DNA, 25 bp, Rattus norvegicus
tcgctgcgatctgatcaggaccatg

SEQ ID NO: 590634 - DNA, 25 bp, Rattus norvegicus
tcgctgcgcttgatttccacgtaaa

SEQ ID NO: 590635 - DNA, 25 bp, Rattus norvegicus
tcgctgcgcttgttttccacgtaaa

SEQ ID NO: 590636 - DNA, 25 bp, Rattus norvegicus
tcgctgcgggcgagtgtaattgcca

SEQ ID NO: 590637 - DNA, 25 bp, Rattus norvegicus
tcgctgcgggcgtgtgtaattgcca

SEQ ID NO: 590638 - DNA, 25 bp, Rattus norvegicus
tcgctgctacctctttaactgcaca

SEQ ID NO: 590639 - DNA, 25 bp, Rattus norvegicus
tcgctgctacctgtttaactgcaca

SEQ ID NO: 590640 - DNA, 25 bp, Rattus norvegicus
tcgctgcttcctcaggagtctgtga

SEQ ID NO: 590641 - DNA, 25 bp, Rattus norvegicus
tcgctgcttcctgaggagtctgtga

SEQ ID NO: 590642 - DNA, 25 bp, Rattus norvegicus
tcgctgcttgttctgtactgttata

SEQ ID NO: 590643 - DNA, 25 bp, Rattus norvegicus
tcgctgcttgttgtgtactgttata

SEQ ID NO: 590644 - DNA, 25 bp, Rattus norvegicus
tcgctggacgcacgcgcgttacgct

SEQ ID NO: 590645 - DNA, 25 bp, Rattus norvegicus
tcgctggacgcaggcgcgttacgct

SEQ ID NO: 590646 - DNA, 25 bp, Rattus norvegicus
tcgctggaggaactgtgatgctttt

SEQ ID NO: 590647 - DNA, 25 bp, Rattus norvegicus
tcgctggaggaagtgtgatgctttt

SEQ ID NO: 590648 - DNA, 25 bp, Rattus norvegicus
tcgctggccgccatgtacacataac

SEQ ID NO: 590649 - DNA, 25 bp, Rattus norvegicus
tcgctggccgccttgtacacataac

SEQ ID NO: 590650 - DNA, 25 bp, Rattus norvegicus
tcgctgggaacgctccaaaaaccgt

SEQ ID NO: 590651 - DNA, 25 bp, Rattus norvegicus
tcgctgggaacggtccaaaaaccgt

SEQ ID NO: 590652 - DNA, 25 bp, Rattus norvegicus
tcgctgggacaaatgcctccattaa

SEQ ID NO: 590653 - DNA, 25 bp, Rattus norvegicus
tcgctgggacaattgcctccattaa

SEQ ID NO: 590654 - DNA, 25 bp, Rattus norvegicus
tcgctgggactcatgttcactgaca

SEQ ID NO: 590655 - DNA, 25 bp, Rattus norvegicus
tcgctgggactcttgttcactgaca

SEQ ID NO: 590656 - DNA, 25 bp, Rattus norvegicus
tcgctggtcaggcttagggatttaa

SEQ ID NO: 590657 - DNA, 25 bp, Rattus norvegicus
tcgctggtcagggttagggatttaa

SEQ ID NO: 590658 - DNA, 25 bp, Rattus norvegicus
tcgctggtcttcattctgcttttca

SEQ ID NO: 590659 - DNA, 25 bp, Rattus norvegicus
tcgctggtcttctttctgcttttca

SEQ ID NO: 590660 - DNA, 25 bp, Rattus norvegicus
tcgctggtgccgaccacgacgatct

SEQ ID NO: 590661 - DNA, 25 bp, Rattus norvegicus
tcgctggtgccgtccacgacgatct

SEQ ID NO: 590662 - DNA, 25 bp, Rattus norvegicus
tcgctgtaacgaattggaaccactt

SEQ ID NO: 590663 - DNA, 25 bp, Rattus norvegicus
tcgctgtaacgatttggaaccactt

SEQ ID NO: 590664 - DNA, 25 bp, Rattus norvegicus
tcgctgtcccaacggctgtcttaat

SEQ ID NO: 590665 - DNA, 25 bp, Rattus norvegicus
tcgctgtcccaagggctgtcttaat

SEQ ID NO: 590666 - DNA, 25 bp, Rattus norvegicus
tcgctgtccctgaaagcttgttaac

SEQ ID NO: 590667 - DNA, 25 bp, Rattus norvegicus
tcgctgtccctgtaagcttgttaac

SEQ ID NO: 590668 - DNA, 25 bp, Rattus norvegicus
tcgctgtgcattatcatctttgtga

SEQ ID NO: 590669 - DNA, 25 bp, Rattus norvegicus
tcgctgtgcattttcatctttgtga

SEQ ID NO: 590670 - DNA, 25 bp, Rattus norvegicus
tcgctgtgtttcatgtcttggacta

SEQ ID NO: 590671 - DNA, 25 bp, Rattus norvegicus
tcgctgtgtttcttgtcttggacta

SEQ ID NO: 590672 - DNA, 25 bp, Rattus norvegicus
tcgctgttgctaacccacaataaat

SEQ ID NO: 590673 - DNA, 25 bp, Rattus norvegicus
tcgctgttgctaaggccctgaaaag

SEQ ID NO: 590674 - DNA, 25 bp, Rattus norvegicus
tcgctgttgctatcccacaataaat

SEQ ID NO: 590675 - DNA, 25 bp, Rattus norvegicus
tcgctgttgctatggccctgaaaag

SEQ ID NO: 590676 - DNA, 25 bp, Rattus norvegicus
tcgctgttggagaagacttatttgt

SEQ ID NO: 590677 - DNA, 25 bp, Rattus norvegicus
tcgctgttggagtagacttatttgt

SEQ ID NO: 590678 - DNA, 25 bp, Rattus norvegicus
tcgctgttgttcattctgtctaaat

SEQ ID NO: 590679 - DNA, 25 bp, Rattus norvegicus
tcgctgttgttctttctgtctaaat

SEQ ID NO: 590680 - DNA, 25 bp, Rattus norvegicus
tcgctgtttgagcaagtttggcttc

SEQ ID NO: 590681 - DNA, 25 bp, Rattus norvegicus
tcgctgtttgaggaagtttggcttc

SEQ ID NO: 590682 - DNA, 25 bp, Rattus norvegicus
tcgcttaaagatacgcgcccgcgcg

SEQ ID NO: 590683 - DNA, 25 bp, Rattus norvegicus
tcgcttaaagattcgcgcccgcgcg

SEQ ID NO: 590684 - DNA, 25 bp, Rattus norvegicus
tcgcttaccctgcagtggatgagtt

SEQ ID NO: 590685 - DNA, 25 bp, Rattus norvegicus
tcgcttaccctggagtggatgagtt

SEQ ID NO: 590686 - DNA, 25 bp, Rattus norvegicus
tcgcttcaactcacagcaggctgga

SEQ ID NO: 590687 - DNA, 25 bp, Rattus norvegicus
tcgcttcaactctcagcaggctgga

SEQ ID NO: 590688 - DNA, 25 bp, Rattus norvegicus
tcgcttcatctgatttccatgtaga

SEQ ID NO: 590689 - DNA, 25 bp, Rattus norvegicus
tcgcttcatctgttttccatgtaga

SEQ ID NO: 590690 - DNA, 25 bp, Rattus norvegicus
tcgcttccacgtccatcttaaaggt

SEQ ID NO: 590691 - DNA, 25 bp, Rattus norvegicus
tcgcttccacgtgcatcttaaaggt

SEQ ID NO: 590692 - DNA, 25 bp, Rattus norvegicus
tcgcttccccttaggcgttagagag

SEQ ID NO: 590693 - DNA, 25 bp, Rattus norvegicus
tcgcttcccctttggcgttagagag

SEQ ID NO: 590694 - DNA, 25 bp, Rattus norvegicus
tcgcttctcgcccagtgatgatgtg

SEQ ID NO: 590695 - DNA, 25 bp, Rattus norvegicus
tcgcttctcgccgagtgatgatgtg

SEQ ID NO: 590696 - DNA, 25 bp, Rattus norvegicus
tcgcttctcttacgttctcatagtt

SEQ ID NO: 590697 - DNA, 25 bp, Rattus norvegicus
tcgcttctcttaggttctcatagtt

SEQ ID NO: 590698 - DNA, 25 bp, Rattus norvegicus
tcgcttctgtgccttgtgaattagt

SEQ ID NO: 590699 - DNA, 25 bp, Rattus norvegicus
tcgcttctgtgcgttgtgaattagt

SEQ ID NO: 590700 - DNA, 25 bp, Rattus norvegicus
tcgcttgcagtcagtagatctagtg

SEQ ID NO: 590701 - DNA, 25 bp, Rattus norvegicus
tcgcttgcagtctgtagatctagtg

SEQ ID NO: 590702 - DNA, 25 bp, Rattus norvegicus
tcgcttgcttttaacttagaaaaga

SEQ ID NO: 590703 - DNA, 25 bp, Rattus norvegicus
tcgcttgctttttacttagaaaaga

SEQ ID NO: 590704 - DNA, 25 bp, Rattus norvegicus
tcgcttgtccaacttggttgtgttc

SEQ ID NO: 590705 - DNA, 25 bp, Rattus norvegicus
tcgcttgtccaagttggttgtgttc

SEQ ID NO: 590706 - DNA, 25 bp, Rattus norvegicus
tcgcttgtgcttatgatcggtcaga

SEQ ID NO: 590707 - DNA, 25 bp, Rattus norvegicus
tcgcttgtgcttttgatcggtcaga

SEQ ID NO: 590708 - DNA, 25 bp, Rattus norvegicus
tcgcttgtttttaaaccccacagat

SEQ ID NO: 590709 - DNA, 25 bp, Rattus norvegicus
tcgcttgttttttaaccccacagat

SEQ ID NO: 590710 - DNA, 25 bp, Rattus norvegicus
tcgctttcccgcagaacatgagact

SEQ ID NO: 590711 - DNA, 25 bp, Rattus norvegicus
tcgctttcccgctgaacatgagact

SEQ ID NO: 590712 - DNA, 25 bp, Rattus norvegicus
tcgctttgcctgcagcatttgtgaa

SEQ ID NO: 590713 - DNA, 25 bp, Rattus norvegicus
tcgctttgcctggagcatttgtgaa

SEQ ID NO: 590714 - DNA, 25 bp, Rattus norvegicus
tcgctttgctttccttgagcccaga

SEQ ID NO: 590715 - DNA, 25 bp, Rattus norvegicus
tcgctttgctttgcttgagcccaga

SEQ ID NO: 590716 - DNA, 25 bp, Rattus norvegicus
tcgcttttatttcactgctcactga

SEQ ID NO: 590717 - DNA, 25 bp, Rattus norvegicus
tcgcttttatttgactgctcactga

SEQ ID NO: 590718 - DNA, 25 bp, Rattus norvegicus
tcgcttttccttcgctggagcataa

SEQ ID NO: 590719 - DNA, 25 bp, Rattus norvegicus
tcgcttttccttggctggagcataa

SEQ ID NO: 590720 - DNA, 25 bp, Rattus norvegicus
tcggaaaatcaaagtcagccccacg

SEQ ID NO: 590721 - DNA, 25 bp, Rattus norvegicus
tcggaaaatcaatgtcagccccacg

SEQ ID NO: 590722 - DNA, 25 bp, Rattus norvegicus
tcggaaatcgcaaccaaagactatt

SEQ ID NO: 590723 - DNA, 25 bp, Rattus norvegicus
tcggaaatcgcatccaaagactatt

SEQ ID NO: 590724 - DNA, 25 bp, Rattus norvegicus
tcggaaatggacatggggacctcgt

SEQ ID NO: 590725 - DNA, 25 bp, Rattus norvegicus
tcggaaatggacttggggacctcgt

SEQ ID NO: 590726 - DNA, 25 bp, Rattus norvegicus
tcggaaatgtccctctctcttgtgt

SEQ ID NO: 590727 - DNA, 25 bp, Rattus norvegicus
tcggaaatgtccgtctctcttgtgt

SEQ ID NO: 590728 - DNA, 25 bp, Rattus norvegicus
tcggaaattcctctactgtagctaa

SEQ ID NO: 590729 - DNA, 25 bp, Rattus norvegicus
tcggaaattcctgtactgtagctaa

SEQ ID NO: 590730 - DNA, 25 bp, Rattus norvegicus
tcggaacaggaaacgggactcggct

SEQ ID NO: 590731 - DNA, 25 bp, Rattus norvegicus
tcggaacaggaatcgggactcggct

SEQ ID NO: 590732 - DNA, 25 bp, Rattus norvegicus
tcggaaccagctacgttactcagaa

SEQ ID NO: 590733 - DNA, 25 bp, Rattus norvegicus
tcggaaccagcttcgttactcagaa

SEQ ID NO: 590734 - DNA, 25 bp, Rattus norvegicus
tcggaaccccttcgaagagctcagg

SEQ ID NO: 590735 - DNA, 25 bp, Rattus norvegicus
tcggaaccccttggaagagctcagg

SEQ ID NO: 590736 - DNA, 25 bp, Rattus norvegicus
tcggaacccggcatggcccagagcg

SEQ ID NO: 590737 - DNA, 25 bp, Rattus norvegicus
tcggaacccggcttggcccagagcg

SEQ ID NO: 590738 - DNA, 25 bp, Rattus norvegicus
tcggaacgagaaaccacgagttgta

SEQ ID NO: 590739 - DNA, 25 bp, Rattus norvegicus
tcggaacgagaatccacgagttgta

SEQ ID NO: 590740 - DNA, 25 bp, Rattus norvegicus
tcggaactcggcagacaccagaggt

SEQ ID NO: 590741 - DNA, 25 bp, Rattus norvegicus
tcggaactcggctgacaccagaggt

SEQ ID NO: 590742 - DNA, 25 bp, Rattus norvegicus
tcggaactcgtcccttatttacgaa

SEQ ID NO: 590743 - DNA, 25 bp, Rattus norvegicus
tcggaactcgtcgcttatttacgaa

SEQ ID NO: 590744 - DNA, 25 bp, Rattus norvegicus
tcggaagacacgatcaagggcctga

SEQ ID NO: 590745 - DNA, 25 bp, Rattus norvegicus
tcggaagacacgttcaagggcctga

SEQ ID NO: 590746 - DNA, 25 bp, Rattus norvegicus
tcggaagcccatctcttggcatgat

SEQ ID NO: 590747 - DNA, 25 bp, Rattus norvegicus
tcggaagcccatgtcttggcatgat

SEQ ID NO: 590748 - DNA, 25 bp, Rattus norvegicus
tcggaagccgtgagctgcagagact

SEQ ID NO: 590749 - DNA, 25 bp, Rattus norvegicus
tcggaagccgtgtgctgcagagact

SEQ ID NO: 590750 - DNA, 25 bp, Rattus norvegicus
tcggaagcgacgctgtcaggacact

SEQ ID NO: 590751 - DNA, 25 bp, Rattus norvegicus
tcggaagcgacggtgtcaggacact

SEQ ID NO: 590752 - DNA, 25 bp, Rattus norvegicus
tcggaagcttctaggaaacctcgct

SEQ ID NO: 590753 - DNA, 25 bp, Rattus norvegicus
tcggaagcttcttggaaacctcgct

SEQ ID NO: 590754 - DNA, 25 bp, Rattus norvegicus
tcggaagggcccaccggtaatccat

SEQ ID NO: 590755 - DNA, 25 bp, Rattus norvegicus
tcggaagggccctccggtaatccat

SEQ ID NO: 590756 - DNA, 25 bp, Rattus norvegicus
tcggaaggtgagatggtagcactct

SEQ ID NO: 590757 - DNA, 25 bp, Rattus norvegicus
tcggaaggtgagttggtagcactct

SEQ ID NO: 590758 - DNA, 25 bp, Rattus norvegicus
tcggaaggtgtaaccccggccagaa

SEQ ID NO: 590759 - DNA, 25 bp, Rattus norvegicus
tcggaaggtgtatccccggccagaa

SEQ ID NO: 590760 - DNA, 25 bp, Rattus norvegicus
tcggaagttagtctgtggctgcctc

SEQ ID NO: 590761 - DNA, 25 bp, Rattus norvegicus
tcggaagttagtgtgtggctgcctc

SEQ ID NO: 590762 - DNA, 25 bp, Rattus norvegicus
tcggaatcctggctctcctcggagt

SEQ ID NO: 590763 - DNA, 25 bp, Rattus norvegicus
tcggaatcctgggtctcctcggagt

SEQ ID NO: 590764 - DNA, 25 bp, Rattus norvegicus
tcggaatgatccaactcttgaagta

SEQ ID NO: 590765 - DNA, 25 bp, Rattus norvegicus
tcggaatgatcctactcttgaagta

SEQ ID NO: 590766 - DNA, 25 bp, Rattus norvegicus
tcggaatgcgcgatggtgaccacac

SEQ ID NO: 590767 - DNA, 25 bp, Rattus norvegicus
tcggaatgcgcgttggtgaccacac

SEQ ID NO: 590768 - DNA, 25 bp, Rattus norvegicus
tcggaatggcgcacagcagatattt

SEQ ID NO: 590769 - DNA, 25 bp, Rattus norvegicus
tcggaatggcgctcagcagatattt

SEQ ID NO: 590770 - DNA, 25 bp, Rattus norvegicus
tcggaattacgtatggacttgacag

SEQ ID NO: 590771 - DNA, 25 bp, Rattus norvegicus
tcggaattacgtttggacttgacag

SEQ ID NO: 590772 - DNA, 25 bp, Rattus norvegicus
tcggaattctgtagtgctggccact

SEQ ID NO: 590773 - DNA, 25 bp, Rattus norvegicus
tcggaattctgttgtgctggccact

SEQ ID NO: 590774 - DNA, 25 bp, Rattus norvegicus
tcggacacccgaagtgcattgcgtg

SEQ ID NO: 590775 - DNA, 25 bp, Rattus norvegicus
tcggacacccgatgtgcattgcgtg

SEQ ID NO: 590776 - DNA, 25 bp, Rattus norvegicus
tcggacacttttcttgagcactgga

SEQ ID NO: 590777 - DNA, 25 bp, Rattus norvegicus
tcggacacttttgttgagcactgga

SEQ ID NO: 590778 - DNA, 25 bp, Rattus norvegicus
tcggacagaaaactgatcgatcccc

SEQ ID NO: 590779 - DNA, 25 bp, Rattus norvegicus
tcggacagaaaagtgatcgatcccc

SEQ ID NO: 590780 - DNA, 25 bp, Rattus norvegicus
tcggacattagacagcagcactgct

SEQ ID NO: 590781 - DNA, 25 bp, Rattus norvegicus
tcggacattagagagcagcactgct

SEQ ID NO: 590782 - DNA, 25 bp, Rattus norvegicus
tcggaccaaggtccggcccgtattt

SEQ ID NO: 590783 - DNA, 25 bp, Rattus norvegicus
tcggaccaaggtgcggcccgtattt

SEQ ID NO: 590784 - DNA, 25 bp, Rattus norvegicus
tcggacccggcactagcagtagcaa

SEQ ID NO: 590785 - DNA, 25 bp, Rattus norvegicus
tcggacccggcagtagcagtagcaa

SEQ ID NO: 590786 - DNA, 25 bp, Rattus norvegicus
tcggaccgaacgaagtcgcggtgct

SEQ ID NO: 590787 - DNA, 25 bp, Rattus norvegicus
tcggaccgaacgtagtcgcggtgct

SEQ ID NO: 590788 - DNA, 25 bp, Rattus norvegicus
tcggaccgcgtcaatgagaaactga

SEQ ID NO: 590789 - DNA, 25 bp, Rattus norvegicus
tcggaccgcgtctatgagaaactga

SEQ ID NO: 590790 - DNA, 25 bp, Rattus norvegicus
tcggacctactcaaggccggcggcg

SEQ ID NO: 590791 - DNA, 25 bp, Rattus norvegicus
tcggacctactctaggccggcggcg

SEQ ID NO: 590792 - DNA, 25 bp, Rattus norvegicus
tcggacgtctgcagtgctgttgaga

SEQ ID NO: 590793 - DNA, 25 bp, Rattus norvegicus
tcggacgtctgctgtgctgttgaga

SEQ ID NO: 590794 - DNA, 25 bp, Rattus norvegicus
tcggacgttgggacccgctgccacg

SEQ ID NO: 590795 - DNA, 25 bp, Rattus norvegicus
tcggacgttgggtcccgctgccacg

SEQ ID NO: 590796 - DNA, 25 bp, Rattus norvegicus
tcggactcagaaatggcggcgtcca

SEQ ID NO: 590797 - DNA, 25 bp, Rattus norvegicus
tcggactcagaattggcggcgtcca

SEQ ID NO: 590798 - DNA, 25 bp, Rattus norvegicus
tcggactcctctacttcaacttctt

SEQ ID NO: 590799 - DNA, 25 bp, Rattus norvegicus
tcggactcctcttcttcaacttctt

SEQ ID NO: 590800 - DNA, 25 bp, Rattus norvegicus
tcggactcctgcctttaaagcagat

SEQ ID NO: 590801 - DNA, 25 bp, Rattus norvegicus
tcggactcctgcgtttaaagcagat

SEQ ID NO: 590802 - DNA, 25 bp, Rattus norvegicus
tcggacttgtccctgttgcttctgc

SEQ ID NO: 590803 - DNA, 25 bp, Rattus norvegicus
tcggacttgtccgtgttgcttctgc

SEQ ID NO: 590804 - DNA, 25 bp, Rattus norvegicus
tcggagaaatttcacctgatggaga

SEQ ID NO: 590805 - DNA, 25 bp, Rattus norvegicus
tcggagaaatttgacctgatggaga

SEQ ID NO: 590806 - DNA, 25 bp, Rattus norvegicus
tcggagaaccaaagatgcccatgtg

SEQ ID NO: 590807 - DNA, 25 bp, Rattus norvegicus
tcggagaaccaatgatgcccatgtg

SEQ ID NO: 590808 - DNA, 25 bp, Rattus norvegicus
tcggagatgtgcagagaggctctca

SEQ ID NO: 590809 - DNA, 25 bp, Rattus norvegicus
tcggagatgtgctgagaggctctca

SEQ ID NO: 590810 - DNA, 25 bp, Rattus norvegicus
tcggagcaaacacgttccccatgag

SEQ ID NO: 590811 - DNA, 25 bp, Rattus norvegicus
tcggagcaaacaggttccccatgag

SEQ ID NO: 590812 - DNA, 25 bp, Rattus norvegicus
tcggagcagtttactttggattctt

SEQ ID NO: 590813 - DNA, 25 bp, Rattus norvegicus
tcggagcagttttctttggattctt

SEQ ID NO: 590814 - DNA, 25 bp, Rattus norvegicus
tcggagcccaacatggcatcggcct

SEQ ID NO: 590815 - DNA, 25 bp, Rattus norvegicus
tcggagcccaacttggcatcggcct

SEQ ID NO: 590816 - DNA, 25 bp, Rattus norvegicus
tcggagctataacgtggccaaatct

SEQ ID NO: 590817 - DNA, 25 bp, Rattus norvegicus
tcggagctataaggtggccaaatct

SEQ ID NO: 590818 - DNA, 25 bp, Rattus norvegicus
tcggagctcttacagcatctgcaag

SEQ ID NO: 590819 - DNA, 25 bp, Rattus norvegicus
tcggagctcttagagcatctgcaag

SEQ ID NO: 590820 - DNA, 25 bp, Rattus norvegicus
tcggagctggcaatgctagttctgt

SEQ ID NO: 590821 - DNA, 25 bp, Rattus norvegicus
tcggagctggcattgctagttctgt

SEQ ID NO: 590822 - DNA, 25 bp, Rattus norvegicus
tcggaggaaccgctgccccaggatt

SEQ ID NO: 590823 - DNA, 25 bp, Rattus norvegicus
tcggaggaaccggtgccccaggatt

SEQ ID NO: 590824 - DNA, 25 bp, Rattus norvegicus
tcggaggacataaagccccaagctt

SEQ ID NO: 590825 - DNA, 25 bp, Rattus norvegicus
tcggaggacatatagccccaagctt

SEQ ID NO: 590826 - DNA, 25 bp, Rattus norvegicus
tcggaggacgccatcaataactact

SEQ ID NO: 590827 - DNA, 25 bp, Rattus norvegicus
tcggaggacgccttcaataactact

SEQ ID NO: 590828 - DNA, 25 bp, Rattus norvegicus
tcggaggagggcagtcacccatctc

SEQ ID NO: 590829 - DNA, 25 bp, Rattus norvegicus
tcggaggagggctgtcacccatctc

SEQ ID NO: 590830 - DNA, 25 bp, Rattus norvegicus
tcggaggattatcgcccttcaaatg

SEQ ID NO: 590831 - DNA, 25 bp, Rattus norvegicus
tcggaggattatggcccttcaaatg

SEQ ID NO: 590832 - DNA, 25 bp, Rattus norvegicus
tcggaggcagagactcctctcgcag

SEQ ID NO: 590833 - DNA, 25 bp, Rattus norvegicus
tcggaggcagagtctcctctcgcag

SEQ ID NO: 590834 - DNA, 25 bp, Rattus norvegicus
tcggaggcgtctagcggcgcgcgca

SEQ ID NO: 590835 - DNA, 25 bp, Rattus norvegicus
tcggaggcgtcttgcggcgcgcgca

SEQ ID NO: 590836 - DNA, 25 bp, Rattus norvegicus
tcggaggctactcgacaccttggtc

SEQ ID NO: 590837 - DNA, 25 bp, Rattus norvegicus
tcggaggctactggacaccttggtc

SEQ ID NO: 590838 - DNA, 25 bp, Rattus norvegicus
tcggagggccccacgattagagatg

SEQ ID NO: 590839 - DNA, 25 bp, Rattus norvegicus
tcggagggcccctcgattagagatg

SEQ ID NO: 590840 - DNA, 25 bp, Rattus norvegicus
tcggaggtgacaccgccacctcggt

SEQ ID NO: 590841 - DNA, 25 bp, Rattus norvegicus
tcggaggtgacagcgccacctcggt

SEQ ID NO: 590842 - DNA, 25 bp, Rattus norvegicus
tcggaggtgaccatacgtgccagaa

SEQ ID NO: 590843 - DNA, 25 bp, Rattus norvegicus
tcggaggtgaccttacgtgccagaa

SEQ ID NO: 590844 - DNA, 25 bp, Rattus norvegicus
tcggagtacccgctttggcaccgag

SEQ ID NO: 590845 - DNA, 25 bp, Rattus norvegicus
tcggagtacccggtttggcaccgag

SEQ ID NO: 590846 - DNA, 25 bp, Rattus norvegicus
tcggagtgtctccttgtatcacatt

SEQ ID NO: 590847 - DNA, 25 bp, Rattus norvegicus
tcggagtgtctcgttgtatcacatt

SEQ ID NO: 590848 - DNA, 25 bp, Rattus norvegicus
tcggagttcctccaatgccaatgga

SEQ ID NO: 590849 - DNA, 25 bp, Rattus norvegicus
tcggagttcctcgaatgccaatgga

SEQ ID NO: 590850 - DNA, 25 bp, Rattus norvegicus
tcggagttgctcaaaaacgccacgt

SEQ ID NO: 590851 - DNA, 25 bp, Rattus norvegicus
tcggagttgctctaaaacgccacgt

SEQ ID NO: 590852 - DNA, 25 bp, Rattus norvegicus
tcggagttggccatccgaagggcat

SEQ ID NO: 590853 - DNA, 25 bp, Rattus norvegicus
tcggagttggccttccgaagggcat

SEQ ID NO: 590854 - DNA, 25 bp, Rattus norvegicus
tcggagttggctacctgattgtcac

SEQ ID NO: 590855 - DNA, 25 bp, Rattus norvegicus
tcggagttggcttcctgattgtcac

SEQ ID NO: 590856 - DNA, 25 bp, Rattus norvegicus
tcggatacctggagcgctgagcatc

SEQ ID NO: 590857 - DNA, 25 bp, Rattus norvegicus
tcggatacctggtgcgctgagcatc

SEQ ID NO: 590858 - DNA, 25 bp, Rattus norvegicus
tcggatcatccaagtgtttgagcat

SEQ ID NO: 590859 - DNA, 25 bp, Rattus norvegicus
tcggatcatccatgtgtttgagcat

SEQ ID NO: 590860 - DNA, 25 bp, Rattus norvegicus
tcggatcctaatcagaagagaccaa

SEQ ID NO: 590861 - DNA, 25 bp, Rattus norvegicus
tcggatcctaatgagaagagaccaa

SEQ ID NO: 590862 - DNA, 25 bp, Rattus norvegicus
tcggatctgacgctcacctctgaag

SEQ ID NO: 590863 - DNA, 25 bp, Rattus norvegicus
tcggatctgacggtcacctctgaag

SEQ ID NO: 590864 - DNA, 25 bp, Rattus norvegicus
tcggatctgtctataccactcattt

SEQ ID NO: 590865 - DNA, 25 bp, Rattus norvegicus
tcggatctgtctttaccactcattt

SEQ ID NO: 590866 - DNA, 25 bp, Rattus norvegicus
tcggatcttcttattgtcttctcaa

SEQ ID NO: 590867 - DNA, 25 bp, Rattus norvegicus
tcggatcttctttttgtcttctcaa

SEQ ID NO: 590868 - DNA, 25 bp, Rattus norvegicus
tcggatgacctacctgagaactcac

SEQ ID NO: 590869 - DNA, 25 bp, Rattus norvegicus
tcggatgacctagctgagaactcac

SEQ ID NO: 590870 - DNA, 25 bp, Rattus norvegicus
tcggatgactatccagaggccttgg

SEQ ID NO: 590871 - DNA, 25 bp, Rattus norvegicus
tcggatgactatgcagaggccttgg

SEQ ID NO: 590872 - DNA, 25 bp, Rattus norvegicus
tcggatgccggtacacacagatcat

SEQ ID NO: 590873 - DNA, 25 bp, Rattus norvegicus
tcggatgccggttcacacagatcat

SEQ ID NO: 590874 - DNA, 25 bp, Rattus norvegicus
tcggatgctgccacgcagccgctgg

SEQ ID NO: 590875 - DNA, 25 bp, Rattus norvegicus
tcggatgctgcctcgcagccgctgg

SEQ ID NO: 590876 - DNA, 25 bp, Rattus norvegicus
tcggatggccagaaagtttactcac

SEQ ID NO: 590877 - DNA, 25 bp, Rattus norvegicus
tcggatggccagtaagtttactcac

SEQ ID NO: 590878 - DNA, 25 bp, Rattus norvegicus
tcggatggtgttacctcaggcagga

SEQ ID NO: 590879 - DNA, 25 bp, Rattus norvegicus
tcggatggtgtttcctcaggcagga

SEQ ID NO: 590880 - DNA, 25 bp, Rattus norvegicus
tcggattcctaacatctgccttaaa

SEQ ID NO: 590881 - DNA, 25 bp, Rattus norvegicus
tcggattcctaagatctgccttaaa

SEQ ID NO: 590882 - DNA, 25 bp, Rattus norvegicus
tcggattctgctctgtgtattgtct

SEQ ID NO: 590883 - DNA, 25 bp, Rattus norvegicus
tcggattctgctgtgtgtattgtct

SEQ ID NO: 590884 - DNA, 25 bp, Rattus norvegicus
tcggattcttctcaacagcctttat

SEQ ID NO: 590885 - DNA, 25 bp, Rattus norvegicus
tcggattcttctgaacagcctttat

SEQ ID NO: 590886 - DNA, 25 bp, Rattus norvegicus
tcggattgacgacagccatgcattg

SEQ ID NO: 590887 - DNA, 25 bp, Rattus norvegicus
tcggattgacgagagccatgcattg

SEQ ID NO: 590888 - DNA, 25 bp, Rattus norvegicus
tcggatttgtagatcagcccttcca

SEQ ID NO: 590889 - DNA, 25 bp, Rattus norvegicus
tcggatttgtagttcagcccttcca

SEQ ID NO: 590890 - DNA, 25 bp, Rattus norvegicus
tcggcaaacactcaggaagccctgc

SEQ ID NO: 590891 - DNA, 25 bp, Rattus norvegicus
tcggcaaacactgaggaagccctgc

SEQ ID NO: 590892 - DNA, 25 bp, Rattus norvegicus
tcggcaaagtgcacctgttcagcta

SEQ ID NO: 590893 - DNA, 25 bp, Rattus norvegicus
tcggcaaagtgctcctgttcagcta

SEQ ID NO: 590894 - DNA, 25 bp, Rattus norvegicus
tcggcaacagccacaacgtgcatgt

SEQ ID NO: 590895 - DNA, 25 bp, Rattus norvegicus
tcggcaacagcctcaacgtgcatgt

SEQ ID NO: 590896 - DNA, 25 bp, Rattus norvegicus
tcggcaaccatgctggaacacctga

SEQ ID NO: 590897 - DNA, 25 bp, Rattus norvegicus
tcggcaaccatggtggaacacctga

SEQ ID NO: 590898 - DNA, 25 bp, Rattus norvegicus
tcggcaacctctctgtggacaatag

SEQ ID NO: 590899 - DNA, 25 bp, Rattus norvegicus
tcggcaacctctgtgtggacaatag

SEQ ID NO: 590900 - DNA, 25 bp, Rattus norvegicus
tcggcaagatcgctggcgcccagaa

SEQ ID NO: 590901 - DNA, 25 bp, Rattus norvegicus
tcggcaagatcggtggcgcccagaa

SEQ ID NO: 590902 - DNA, 25 bp, Rattus norvegicus
tcggcaataaggaaaggacggccat

SEQ ID NO: 590903 - DNA, 25 bp, Rattus norvegicus
tcggcaataaggtaaggacggccat

SEQ ID NO: 590904 - DNA, 25 bp, Rattus norvegicus
tcggcaattatgacttgatctgatt

SEQ ID NO: 590905 - DNA, 25 bp, Rattus norvegicus
tcggcaattatgtcttgatctgatt

SEQ ID NO: 590906 - DNA, 25 bp, Rattus norvegicus
tcggcacaatgacctctgagaccag

SEQ ID NO: 590907 - DNA, 25 bp, Rattus norvegicus
tcggcacaatgagctctgagaccag

SEQ ID NO: 590908 - DNA, 25 bp, Rattus norvegicus
tcggcacaggccaagagacccagag

SEQ ID NO: 590909 - DNA, 25 bp, Rattus norvegicus
tcggcacaggcctagagacccagag

SEQ ID NO: 590910 - DNA, 25 bp, Rattus norvegicus
tcggcacatgcgcagctttgaaaac

SEQ ID NO: 590911 - DNA, 25 bp, Rattus norvegicus
tcggcacatgcggagctttgaaaac

SEQ ID NO: 590912 - DNA, 25 bp, Rattus norvegicus
tcggcacgaggcaaacttactctcc

SEQ ID NO: 590913 - DNA, 25 bp, Rattus norvegicus
tcggcacgaggctaacttactctcc

SEQ ID NO: 590914 - DNA, 25 bp, Rattus norvegicus
tcggcacggcaccttttctaaagaa

SEQ ID NO: 590915 - DNA, 25 bp, Rattus norvegicus
tcggcacggcacgttttctaaagaa

SEQ ID NO: 590916 - DNA, 25 bp, Rattus norvegicus
tcggcagcaggaacatgcgcaactt

SEQ ID NO: 590917 - DNA, 25 bp, Rattus norvegicus
tcggcagcaggatcatgcgcaactt

SEQ ID NO: 590918 - DNA, 25 bp, Rattus norvegicus
tcggcagcatccattttacttcaaa

SEQ ID NO: 590919 - DNA, 25 bp, Rattus norvegicus
tcggcagcatcctttttacttcaaa

SEQ ID NO: 590920 - DNA, 25 bp, Rattus norvegicus
tcggcagcctgtaggtgctgatgct

SEQ ID NO: 590921 - DNA, 25 bp, Rattus norvegicus
tcggcagcctgttggtgctgatgct

SEQ ID NO: 590922 - DNA, 25 bp, Rattus norvegicus
tcggcagctaaacaactcgctttaa

SEQ ID NO: 590923 - DNA, 25 bp, Rattus norvegicus
tcggcagctaaagaactcgctttaa

SEQ ID NO: 590924 - DNA, 25 bp, Rattus norvegicus
tcggcagcttccatggacatgaact

SEQ ID NO: 590925 - DNA, 25 bp, Rattus norvegicus
tcggcagcttccttggacatgaact

SEQ ID NO: 590926 - DNA, 25 bp, Rattus norvegicus
tcggcagggcctatgtttacaggga

SEQ ID NO: 590927 - DNA, 25 bp, Rattus norvegicus
tcggcagggcctttgtttacaggga

SEQ ID NO: 590928 - DNA, 25 bp, Rattus norvegicus
tcggcagggtggatactggacacat

SEQ ID NO: 590929 - DNA, 25 bp, Rattus norvegicus
tcggcagggtggttactggacacat

SEQ ID NO: 590930 - DNA, 25 bp, Rattus norvegicus
tcggcaggtcgtatttattctctaa

SEQ ID NO: 590931 - DNA, 25 bp, Rattus norvegicus
tcggcaggtcgtttttattctctaa

SEQ ID NO: 590932 - DNA, 25 bp, Rattus norvegicus
tcggcagtcgttcaaatccctttga

SEQ ID NO: 590933 - DNA, 25 bp, Rattus norvegicus
tcggcagtcgttgaaatccctttga

SEQ ID NO: 590934 - DNA, 25 bp, Rattus norvegicus
tcggcagtgctcagttctggtgaca

SEQ ID NO: 590935 - DNA, 25 bp, Rattus norvegicus
tcggcagtgctctgttctggtgaca

SEQ ID NO: 590936 - DNA, 25 bp, Rattus norvegicus
tcggcatcagagcatccatactggt

SEQ ID NO: 590937 - DNA, 25 bp, Rattus norvegicus
tcggcatcagaggatccatactggt

SEQ ID NO: 590938 - DNA, 25 bp, Rattus norvegicus
tcggcatcatcaatcatctttgcac

SEQ ID NO: 590939 - DNA, 25 bp, Rattus norvegicus
tcggcatcatcattcatctttgcac

SEQ ID NO: 590940 - DNA, 25 bp, Rattus norvegicus
tcggcatcgaccaaatcctcaacag

SEQ ID NO: 590941 - DNA, 25 bp, Rattus norvegicus
tcggcatcgacctaatcctcaacag

SEQ ID NO: 590942 - DNA, 25 bp, Rattus norvegicus
tcggcatcggaccatctgtggatag

SEQ ID NO: 590943 - DNA, 25 bp, Rattus norvegicus
tcggcatcggacgatctgtggatag

SEQ ID NO: 590944 - DNA, 25 bp, Rattus norvegicus
tcggcatgcatgctatgacacatat

SEQ ID NO: 590945 - DNA, 25 bp, Rattus norvegicus
tcggcatgcatggtatgacacatat

SEQ ID NO: 590946 - DNA, 25 bp, Rattus norvegicus
tcggcatgcttccaccataaggtct

SEQ ID NO: 590947 - DNA, 25 bp, Rattus norvegicus
tcggcatgcttcgaccataaggtct

SEQ ID NO: 590948 - DNA, 25 bp, Rattus norvegicus
tcggcatggcatacggcgccaagcg

SEQ ID NO: 590949 - DNA, 25 bp, Rattus norvegicus
tcggcatggcattcggcgccaagcg

SEQ ID NO: 590950 - DNA, 25 bp, Rattus norvegicus
tcggcatgtactattcactggctat

SEQ ID NO: 590951 - DNA, 25 bp, Rattus norvegicus
tcggcatgtacttttcactggctat

SEQ ID NO: 590952 - DNA, 25 bp, Rattus norvegicus
tcggcatgtttacgaagcctcctgt

SEQ ID NO: 590953 - DNA, 25 bp, Rattus norvegicus
tcggcatgtttaggaagcctcctgt

SEQ ID NO: 590954 - DNA, 25 bp, Rattus norvegicus
tcggcattcctgaaccggcgagctg

SEQ ID NO: 590955 - DNA, 25 bp, Rattus norvegicus
tcggcattcctgtaccggcgagctg

SEQ ID NO: 590956 - DNA, 25 bp, Rattus norvegicus
tcggcatttacgcacaacagggatt

SEQ ID NO: 590957 - DNA, 25 bp, Rattus norvegicus
tcggcatttacggacaacagggatt

SEQ ID NO: 590958 - DNA, 25 bp, Rattus norvegicus
tcggcatttagaaagatccagtggt

SEQ ID NO: 590959 - DNA, 25 bp, Rattus norvegicus
tcggcatttagatagatccagtggt

SEQ ID NO: 590960 - DNA, 25 bp, Rattus norvegicus
tcggccaaaaaacacaaggacccag

SEQ ID NO: 590961 - DNA, 25 bp, Rattus norvegicus
tcggccaaaaaagacaaggacccag

SEQ ID NO: 590962 - DNA, 25 bp, Rattus norvegicus
tcggccaaagctacgggaacctagg

SEQ ID NO: 590963 - DNA, 25 bp, Rattus norvegicus
tcggccaaagcttcgggaacctagg

SEQ ID NO: 590964 - DNA, 25 bp, Rattus norvegicus
tcggccaacacaccagttttaccag

SEQ ID NO: 590965 - DNA, 25 bp, Rattus norvegicus
tcggccaacacagcagttttaccag

SEQ ID NO: 590966 - DNA, 25 bp, Rattus norvegicus
tcggccaccgagcagtcctgggttc

SEQ ID NO: 590967 - DNA, 25 bp, Rattus norvegicus
tcggccaccgaggagtcctgggttc

SEQ ID NO: 590968 - DNA, 25 bp, Rattus norvegicus
tcggccacctgaattgggtgtcaga

SEQ ID NO: 590969 - DNA, 25 bp, Rattus norvegicus
tcggccacctgatttgggtgtcaga

SEQ ID NO: 590970 - DNA, 25 bp, Rattus norvegicus
tcggccacctttctttggatttgta

SEQ ID NO: 590971 - DNA, 25 bp, Rattus norvegicus
tcggccacctttgtttggatttgta

SEQ ID NO: 590972 - DNA, 25 bp, Rattus norvegicus
tcggccagtgagcatcaggtcttgt

SEQ ID NO: 590973 - DNA, 25 bp, Rattus norvegicus
tcggccagtgaggatcaggtcttgt

SEQ ID NO: 590974 - DNA, 25 bp, Rattus norvegicus
tcggccatagcaaggtctccatatg

SEQ ID NO: 590975 - DNA, 25 bp, Rattus norvegicus
tcggccatagcatggtctccatatg

SEQ ID NO: 590976 - DNA, 25 bp, Rattus norvegicus
tcggccatggagctctggctttaga

SEQ ID NO: 590977 - DNA, 25 bp, Rattus norvegicus
tcggccatggaggtctggctttaga

SEQ ID NO: 590978 - DNA, 25 bp, Rattus norvegicus
tcggccatggttccaacggagctac

SEQ ID NO: 590979 - DNA, 25 bp, Rattus norvegicus
tcggccatggttgcaacggagctac

SEQ ID NO: 590980 - DNA, 25 bp, Rattus norvegicus
tcggcccaccggactgaagttcaga

SEQ ID NO: 590981 - DNA, 25 bp, Rattus norvegicus
tcggcccaccggtctgaagttcaga

SEQ ID NO: 590982 - DNA, 25 bp, Rattus norvegicus
tcggcccacgacagcaatctggaag

SEQ ID NO: 590983 - DNA, 25 bp, Rattus norvegicus
tcggcccacgactgcaatctggaag

SEQ ID NO: 590984 - DNA, 25 bp, Rattus norvegicus
tcggcccagggaacaagcaggtagt

SEQ ID NO: 590985 - DNA, 25 bp, Rattus norvegicus
tcggcccagggatcaagcaggtagt

SEQ ID NO: 590986 - DNA, 25 bp, Rattus norvegicus
tcggcccatcctcgagaagctgtgt

SEQ ID NO: 590987 - DNA, 25 bp, Rattus norvegicus
tcggcccatcctggagaagctgtgt

SEQ ID NO: 590988 - DNA, 25 bp, Rattus norvegicus
tcggccccggtgaacagactcatag

SEQ ID NO: 590989 - DNA, 25 bp, Rattus norvegicus
tcggccccggtgtacagactcatag

SEQ ID NO: 590990 - DNA, 25 bp, Rattus norvegicus
tcggccctcacgaccgggagaagga

SEQ ID NO: 590991 - DNA, 25 bp, Rattus norvegicus
tcggccctcacgtccgggagaagga

SEQ ID NO: 590992 - DNA, 25 bp, Rattus norvegicus
tcggccctgaagcatggcagctatc

SEQ ID NO: 590993 - DNA, 25 bp, Rattus norvegicus
tcggccctgaaggatggcagctatc

SEQ ID NO: 590994 - DNA, 25 bp, Rattus norvegicus
tcggccctgcttattatcaatctag

SEQ ID NO: 590995 - DNA, 25 bp, Rattus norvegicus
tcggccctgctttttatcaatctag

SEQ ID NO: 590996 - DNA, 25 bp, Rattus norvegicus
tcggccgaatgtctcagcttcattt

SEQ ID NO: 590997 - DNA, 25 bp, Rattus norvegicus
tcggccgaatgtgtcagcttcattt

SEQ ID NO: 590998 - DNA, 25 bp, Rattus norvegicus
tcggccgacaacattagtaacccag

SEQ ID NO: 590999 - DNA, 25 bp, Rattus norvegicus
tcggccgacaactttagtaacccag

SEQ ID NO: 591000 - DNA, 25 bp, Rattus norvegicus
tcggccgacggcactggcatctggc

SEQ ID NO: 591001 - DNA, 25 bp, Rattus norvegicus
tcggccgacggctctggcatctggc

SEQ ID NO: 591002 - DNA, 25 bp, Rattus norvegicus
tcggccgagtaccaggtcagactga

SEQ ID NO: 591003 - DNA, 25 bp, Rattus norvegicus
tcggccgagtacgaggtcagactga

SEQ ID NO: 591004 - DNA, 25 bp, Rattus norvegicus
tcggccgcagctctaaatctgttaa

SEQ ID NO: 591005 - DNA, 25 bp, Rattus norvegicus
tcggccgcagctgtaaatctgttaa

SEQ ID NO: 591006 - DNA, 25 bp, Rattus norvegicus
tcggccgccatgcaactctggagtt

SEQ ID NO: 591007 - DNA, 25 bp, Rattus norvegicus
tcggccgccatggaactctggagtt

SEQ ID NO: 591008 - DNA, 25 bp, Rattus norvegicus
tcggccggcttacacacctcgtttt

SEQ ID NO: 591009 - DNA, 25 bp, Rattus norvegicus
tcggccggcttagacacctcgtttt

SEQ ID NO: 591010 - DNA, 25 bp, Rattus norvegicus
tcggccgtaccacttctaaaagtcg

SEQ ID NO: 591011 - DNA, 25 bp, Rattus norvegicus
tcggccgtaccagttctaaaagtcg

SEQ ID NO: 591012 - DNA, 25 bp, Rattus norvegicus
tcggccgtttttaagattcccagag

SEQ ID NO: 591013 - DNA, 25 bp, Rattus norvegicus
tcggccgttttttagattcccagag

SEQ ID NO: 591014 - DNA, 25 bp, Rattus norvegicus
tcggcctattttaggatctctgcat

SEQ ID NO: 591015 - DNA, 25 bp, Rattus norvegicus
tcggcctatttttggatctctgcat

SEQ ID NO: 591016 - DNA, 25 bp, Rattus norvegicus
tcggcctcaaaactccatgtggaat

SEQ ID NO: 591017 - DNA, 25 bp, Rattus norvegicus
tcggcctcaaaagtccatgtggaat

SEQ ID NO: 591018 - DNA, 25 bp, Rattus norvegicus
tcggcctcagagagcacagatgtta

SEQ ID NO: 591019 - DNA, 25 bp, Rattus norvegicus
tcggcctcagagtgcacagatgtta

SEQ ID NO: 591020 - DNA, 25 bp, Rattus norvegicus
tcggcctcgcggatgcgcaagccat

SEQ ID NO: 591021 - DNA, 25 bp, Rattus norvegicus
tcggcctcgcggttgcgcaagccat

SEQ ID NO: 591022 - DNA, 25 bp, Rattus norvegicus
tcggcctctagtacagtctgtatta

SEQ ID NO: 591023 - DNA, 25 bp, Rattus norvegicus
tcggcctctagttcagtctgtatta

SEQ ID NO: 591024 - DNA, 25 bp, Rattus norvegicus
tcggcctctgaaacactctgaaaac

SEQ ID NO: 591025 - DNA, 25 bp, Rattus norvegicus
tcggcctctgaatcactctgaaaac

SEQ ID NO: 591026 - DNA, 25 bp, Rattus norvegicus
tcggcctctttcctgttggcggtaa

SEQ ID NO: 591027 - DNA, 25 bp, Rattus norvegicus
tcggcctctttcgtgttggcggtaa

SEQ ID NO: 591028 - DNA, 25 bp, Rattus norvegicus
tcggcctggcctactaaacatagga

SEQ ID NO: 591029 - DNA, 25 bp, Rattus norvegicus
tcggcctggccttctaaacatagga

SEQ ID NO: 591030 - DNA, 25 bp, Rattus norvegicus
tcggcctggtcacaaggcgtgttct

SEQ ID NO: 591031 - DNA, 25 bp, Rattus norvegicus
tcggcctggtcagaaggcgtgttct

SEQ ID NO: 591032 - DNA, 25 bp, Rattus norvegicus
tcggcctgttttacttcggacttct

SEQ ID NO: 591033 - DNA, 25 bp, Rattus norvegicus
tcggcctgtttttcttcggacttct

SEQ ID NO: 591034 - DNA, 25 bp, Rattus norvegicus
tcggccttaacaagcagcgtccggg

SEQ ID NO: 591035 - DNA, 25 bp, Rattus norvegicus
tcggccttaacatgcagcgtccggg

SEQ ID NO: 591036 - DNA, 25 bp, Rattus norvegicus
tcggccttcccgagaaatctataaa

SEQ ID NO: 591037 - DNA, 25 bp, Rattus norvegicus
tcggccttcccgtgaaatctataaa

SEQ ID NO: 591038 - DNA, 25 bp, Rattus norvegicus
tcggcctttctgctcaaaactgtcc

SEQ ID NO: 591039 - DNA, 25 bp, Rattus norvegicus
tcggcctttctggtcaaaactgtcc

SEQ ID NO: 591040 - DNA, 25 bp, Rattus norvegicus
tcggccttttctctaattgatgctg

SEQ ID NO: 591041 - DNA, 25 bp, Rattus norvegicus
tcggccttttctgtaattgatgctg

SEQ ID NO: 591042 - DNA, 25 bp, Rattus norvegicus
tcggcgaagcagcacgtgcttttaa

SEQ ID NO: 591043 - DNA, 25 bp, Rattus norvegicus
tcggcgaagcaggacgtgcttttaa

SEQ ID NO: 591044 - DNA, 25 bp, Rattus norvegicus
tcggcgaagtcgatcacgaggctgt

SEQ ID NO: 591045 - DNA, 25 bp, Rattus norvegicus
tcggcgaagtcgttcacgaggctgt

SEQ ID NO: 591046 - DNA, 25 bp, Rattus norvegicus
tcggcgacaatgacctcgtctacat

SEQ ID NO: 591047 - DNA, 25 bp, Rattus norvegicus
tcggcgacaatgtcctcgtctacat

SEQ ID NO: 591048 - DNA, 25 bp, Rattus norvegicus
tcggcgacggcaagaccagcatgat

SEQ ID NO: 591049 - DNA, 25 bp, Rattus norvegicus
tcggcgacggcatgaccagcatgat

SEQ ID NO: 591050 - DNA, 25 bp, Rattus norvegicus
tcggcgatactacacgggcgccagt

SEQ ID NO: 591051 - DNA, 25 bp, Rattus norvegicus
tcggcgatactagacgggcgccagt

SEQ ID NO: 591052 - DNA, 25 bp, Rattus norvegicus
tcggcgattgcacctctaaaacatg

SEQ ID NO: 591053 - DNA, 25 bp, Rattus norvegicus
tcggcgattgcagctctaaaacatg

SEQ ID NO: 591054 - DNA, 25 bp, Rattus norvegicus
tcggcgcctggactcgagccattgt

SEQ ID NO: 591055 - DNA, 25 bp, Rattus norvegicus
tcggcgcctggagtcgagccattgt

SEQ ID NO: 591056 - DNA, 25 bp, Rattus norvegicus
tcggcgcggctccagcctggtttca

SEQ ID NO: 591057 - DNA, 25 bp, Rattus norvegicus
tcggcgcggctcgagcctggtttca

SEQ ID NO: 591058 - DNA, 25 bp, Rattus norvegicus
tcggcgcggcttctgcagggtgcga

SEQ ID NO: 591059 - DNA, 25 bp, Rattus norvegicus
tcggcgcggcttgtgcagggtgcga

SEQ ID NO: 591060 - DNA, 25 bp, Rattus norvegicus
tcggcggacagcatgaccatcagtg

SEQ ID NO: 591061 - DNA, 25 bp, Rattus norvegicus
tcggcggacagcttgaccatcagtg

SEQ ID NO: 591062 - DNA, 25 bp, Rattus norvegicus
tcggcggaccaactgtcgcaagcga

SEQ ID NO: 591063 - DNA, 25 bp, Rattus norvegicus
tcggcggaccaagtgtcgcaagcga

SEQ ID NO: 591064 - DNA, 25 bp, Rattus norvegicus
tcggcggcaagcatccttttcaatc

SEQ ID NO: 591065 - DNA, 25 bp, Rattus norvegicus
tcggcggcaagcttccttttcaatc

SEQ ID NO: 591066 - DNA, 25 bp, Rattus norvegicus
tcggcggcgacgagtcagcctccag

SEQ ID NO: 591067 - DNA, 25 bp, Rattus norvegicus
tcggcggcgacgctggtgtccggcg

SEQ ID NO: 591068 - DNA, 25 bp, Rattus norvegicus
tcggcggcgacggtggtgtccggcg

SEQ ID NO: 591069 - DNA, 25 bp, Rattus norvegicus
tcggcggcgacgtgtcagcctccag

SEQ ID NO: 591070 - DNA, 25 bp, Rattus norvegicus
tcggcggcgcacatgttgagcaatt

SEQ ID NO: 591071 - DNA, 25 bp, Rattus norvegicus
tcggcggcgcacttgttgagcaatt

SEQ ID NO: 591072 - DNA, 25 bp, Rattus norvegicus
tcggcggcgccgaccgggatgagaa

SEQ ID NO: 591073 - DNA, 25 bp, Rattus norvegicus
tcggcggcgccgtccgggatgagaa

SEQ ID NO: 591074 - DNA, 25 bp, Rattus norvegicus
tcggcggcggtgagttcaatcgact

SEQ ID NO: 591075 - DNA, 25 bp, Rattus norvegicus
tcggcggcggtgtgttcaatcgact

SEQ ID NO: 591076 - DNA, 25 bp, Rattus norvegicus
tcggcggttttaatggcagttctgt

SEQ ID NO: 591077 - DNA, 25 bp, Rattus norvegicus
tcggcggttttattggcagttctgt

SEQ ID NO: 591078 - DNA, 25 bp, Rattus norvegicus
tcggcgtccaggacgaccttggtgc

SEQ ID NO: 591079 - DNA, 25 bp, Rattus norvegicus
tcggcgtccaggtcgaccttggtgc

SEQ ID NO: 591080 - DNA, 25 bp, Rattus norvegicus
tcggcgtctgagagaaccctaggag

SEQ ID NO: 591081 - DNA, 25 bp, Rattus norvegicus
tcggcgtctgagtgaaccctaggag

SEQ ID NO: 591082 - DNA, 25 bp, Rattus norvegicus
tcggctagatgacccagctctgggc

SEQ ID NO: 591083 - DNA, 25 bp, Rattus norvegicus
tcggctagatgagccagctctgggc

SEQ ID NO: 591084 - DNA, 25 bp, Rattus norvegicus
tcggctaggctaaggacaggtctgt

SEQ ID NO: 591085 - DNA, 25 bp, Rattus norvegicus
tcggctaggctatggacaggtctgt

SEQ ID NO: 591086 - DNA, 25 bp, Rattus norvegicus
tcggctagtcaccagcacttgtaag

SEQ ID NO: 591087 - DNA, 25 bp, Rattus norvegicus
tcggctagtcacgagcacttgtaag

SEQ ID NO: 591088 - DNA, 25 bp, Rattus norvegicus
tcggctatcttcatctgtttcatat

SEQ ID NO: 591089 - DNA, 25 bp, Rattus norvegicus
tcggctatcttcttctgtttcatat

SEQ ID NO: 591090 - DNA, 25 bp, Rattus norvegicus
tcggctcaaacccagtatcatcatt

SEQ ID NO: 591091 - DNA, 25 bp, Rattus norvegicus
tcggctcaaaccgagtatcatcatt

SEQ ID NO: 591092 - DNA, 25 bp, Rattus norvegicus
tcggctcaaataacaccccagagat

SEQ ID NO: 591093 - DNA, 25 bp, Rattus norvegicus
tcggctcaaatatcaccccagagat

SEQ ID NO: 591094 - DNA, 25 bp, Rattus norvegicus
tcggctcagaagctggcaagtccta

SEQ ID NO: 591095 - DNA, 25 bp, Rattus norvegicus
tcggctcagaaggtggcaagtccta

SEQ ID NO: 591096 - DNA, 25 bp, Rattus norvegicus
tcggctcaggtaaggcagggatttt

SEQ ID NO: 591097 - DNA, 25 bp, Rattus norvegicus
tcggctcaggtatggcagggatttt

SEQ ID NO: 591098 - DNA, 25 bp, Rattus norvegicus
tcggctccagcaccagaggacagca

SEQ ID NO: 591099 - DNA, 25 bp, Rattus norvegicus
tcggctccagcagcagaggacagca

SEQ ID NO: 591100 - DNA, 25 bp, Rattus norvegicus
tcggctccgaggcacttcctcaggg

SEQ ID NO: 591101 - DNA, 25 bp, Rattus norvegicus
tcggctccgagggacttcctcaggg

SEQ ID NO: 591102 - DNA, 25 bp, Rattus norvegicus
tcggctccggtccatgacagtgaga

SEQ ID NO: 591103 - DNA, 25 bp, Rattus norvegicus
tcggctccggtcgatgacagtgaga

SEQ ID NO: 591104 - DNA, 25 bp, Rattus norvegicus
tcggctccgttcactttccataggg

SEQ ID NO: 591105 - DNA, 25 bp, Rattus norvegicus
tcggctccgttctctttccataggg

SEQ ID NO: 591106 - DNA, 25 bp, Rattus norvegicus
tcggctcctgaactctgttttaagt

SEQ ID NO: 591107 - DNA, 25 bp, Rattus norvegicus
tcggctcctgaagtctgttttaagt

SEQ ID NO: 591108 - DNA, 25 bp, Rattus norvegicus
tcggctccttttctggcagtcactt

SEQ ID NO: 591109 - DNA, 25 bp, Rattus norvegicus
tcggctccttttgtggcagtcactt

SEQ ID NO: 591110 - DNA, 25 bp, Rattus norvegicus
tcggctcgggccatccagaagaaaa

SEQ ID NO: 591111 - DNA, 25 bp, Rattus norvegicus
tcggctcgggccttccagaagaaaa

SEQ ID NO: 591112 - DNA, 25 bp, Rattus norvegicus
tcggctcgtcagaacattcatggcg

SEQ ID NO: 591113 - DNA, 25 bp, Rattus norvegicus
tcggctcgtcagtacattcatggcg

SEQ ID NO: 591114 - DNA, 25 bp, Rattus norvegicus
tcggctctggcgatttgtggtctca

SEQ ID NO: 591115 - DNA, 25 bp, Rattus norvegicus
tcggctctggcgttttgtggtctca

SEQ ID NO: 591116 - DNA, 25 bp, Rattus norvegicus
tcggctgaattgctcacctctttga

SEQ ID NO: 591117 - DNA, 25 bp, Rattus norvegicus
tcggctgaattggtcacctctttga

SEQ ID NO: 591118 - DNA, 25 bp, Rattus norvegicus
tcggctgacattctcttcagagaca

SEQ ID NO: 591119 - DNA, 25 bp, Rattus norvegicus
tcggctgacattgtcttcagagaca

SEQ ID NO: 591120 - DNA, 25 bp, Rattus norvegicus
tcggctgcgggcatcctcctgcaga

SEQ ID NO: 591121 - DNA, 25 bp, Rattus norvegicus
tcggctgcgggcttcctcctgcaga

SEQ ID NO: 591122 - DNA, 25 bp, Rattus norvegicus
tcggctgctcagacatgtggacaag

SEQ ID NO: 591123 - DNA, 25 bp, Rattus norvegicus
tcggctgctcagtcatgtggacaag

SEQ ID NO: 591124 - DNA, 25 bp, Rattus norvegicus
tcggctgctgcacctcagggactgt

SEQ ID NO: 591125 - DNA, 25 bp, Rattus norvegicus
tcggctgctgcagctcagggactgt

SEQ ID NO: 591126 - DNA, 25 bp, Rattus norvegicus
tcggctgtatctaccctttatagat

SEQ ID NO: 591127 - DNA, 25 bp, Rattus norvegicus
tcggctgtatcttccctttatagat

SEQ ID NO: 591128 - DNA, 25 bp, Rattus norvegicus
tcggcttcgctgctagaacctgttg

SEQ ID NO: 591129 - DNA, 25 bp, Rattus norvegicus
tcggcttcgctggtagaacctgttg

SEQ ID NO: 591130 - DNA, 25 bp, Rattus norvegicus
tcggcttcggatcctctaagcggga

SEQ ID NO: 591131 - DNA, 25 bp, Rattus norvegicus
tcggcttcggatgctctaagcggga

SEQ ID NO: 591132 - DNA, 25 bp, Rattus norvegicus
tcggcttcgtgtaatcagctgctta

SEQ ID NO: 591133 - DNA, 25 bp, Rattus norvegicus
tcggcttcgtgttatcagctgctta

SEQ ID NO: 591134 - DNA, 25 bp, Rattus norvegicus
tcggcttctgttagggaccctgcga

SEQ ID NO: 591135 - DNA, 25 bp, Rattus norvegicus
tcggcttctgtttgggaccctgcga

SEQ ID NO: 591136 - DNA, 25 bp, Rattus norvegicus
tcggcttctttaaggtccctgccca

SEQ ID NO: 591137 - DNA, 25 bp, Rattus norvegicus
tcggcttctttatggtccctgccca

SEQ ID NO: 591138 - DNA, 25 bp, Rattus norvegicus
tcggcttgccaacagctgtgacagt

SEQ ID NO: 591139 - DNA, 25 bp, Rattus norvegicus
tcggcttgccaagagctgtgacagt

SEQ ID NO: 591140 - DNA, 25 bp, Rattus norvegicus
tcggcttgttccatcagtgttgact

SEQ ID NO: 591141 - DNA, 25 bp, Rattus norvegicus
tcggcttgttccttcagtgttgact

SEQ ID NO: 591142 - DNA, 25 bp, Rattus norvegicus
tcggctttaagactcaatgctgctg

SEQ ID NO: 591143 - DNA, 25 bp, Rattus norvegicus
tcggctttaagagtcaatgctgctg

SEQ ID NO: 591144 - DNA, 25 bp, Rattus norvegicus
tcggctttatccaaaccctgaatga

SEQ ID NO: 591145 - DNA, 25 bp, Rattus norvegicus
tcggctttatcctaaccctgaatga

SEQ ID NO: 591146 - DNA, 25 bp, Rattus norvegicus
tcggcttttctgacctcattaataa

SEQ ID NO: 591147 - DNA, 25 bp, Rattus norvegicus
tcggcttttctgtcctcattaataa

SEQ ID NO: 591148 - DNA, 25 bp, Rattus norvegicus
tcgggaacagccaggaccggcagaa

SEQ ID NO: 591149 - DNA, 25 bp, Rattus norvegicus
tcgggaacagcctggaccggcagaa

SEQ ID NO: 591150 - DNA, 25 bp, Rattus norvegicus
tcgggaacataacctgccgagcgcc

SEQ ID NO: 591151 - DNA, 25 bp, Rattus norvegicus
tcgggaacataagctgccgagcgcc

SEQ ID NO: 591152 - DNA, 25 bp, Rattus norvegicus
tcgggaaccctaccacagtgcgaag

SEQ ID NO: 591153 - DNA, 25 bp, Rattus norvegicus
tcgggaaccctagcacagtgcgaag

SEQ ID NO: 591154 - DNA, 25 bp, Rattus norvegicus
tcgggaagaattcgcctccacctgt

SEQ ID NO: 591155 - DNA, 25 bp, Rattus norvegicus
tcgggaagaattggcctccacctgt

SEQ ID NO: 591156 - DNA, 25 bp, Rattus norvegicus
tcgggaataaacataatcctcattg

SEQ ID NO: 591157 - DNA, 25 bp, Rattus norvegicus
tcgggaataaacttaatcctcattg

SEQ ID NO: 591158 - DNA, 25 bp, Rattus norvegicus
tcgggaatttacagaggaacggcca

SEQ ID NO: 591159 - DNA, 25 bp, Rattus norvegicus
tcgggaatttactgaggaacggcca

SEQ ID NO: 591160 - DNA, 25 bp, Rattus norvegicus
tcgggacaaattaccatgcacgtgt

SEQ ID NO: 591161 - DNA, 25 bp, Rattus norvegicus
tcgggacaaatttccatgcacgtgt

SEQ ID NO: 591162 - DNA, 25 bp, Rattus norvegicus
tcgggacatttgctcttcagttcgt

SEQ ID NO: 591163 - DNA, 25 bp, Rattus norvegicus
tcgggacatttggtcttcagttcgt

SEQ ID NO: 591164 - DNA, 25 bp, Rattus norvegicus
tcgggaccgtacagtggactctaga

SEQ ID NO: 591165 - DNA, 25 bp, Rattus norvegicus
tcgggaccgtactgtggactctaga

SEQ ID NO: 591166 - DNA, 25 bp, Rattus norvegicus
tcgggacttggtatgtcccactagg

SEQ ID NO: 591167 - DNA, 25 bp, Rattus norvegicus
tcgggacttggtttgtcccactagg

SEQ ID NO: 591168 - DNA, 25 bp, Rattus norvegicus
tcgggacttgttctggcattgccta

SEQ ID NO: 591169 - DNA, 25 bp, Rattus norvegicus
tcgggacttgttgtggcattgccta

SEQ ID NO: 591170 - DNA, 25 bp, Rattus norvegicus
tcgggagacccactctgcaggttga

SEQ ID NO: 591171 - DNA, 25 bp, Rattus norvegicus
tcgggagacccagtctgcaggttga

SEQ ID NO: 591172 - DNA, 25 bp, Rattus norvegicus
tcgggagacctgaatttgcactgct

SEQ ID NO: 591173 - DNA, 25 bp, Rattus norvegicus
tcgggagacctgtatttgcactgct

SEQ ID NO: 591174 - DNA, 25 bp, Rattus norvegicus
tcgggagccgacatgctcagggaaa

SEQ ID NO: 591175 - DNA, 25 bp, Rattus norvegicus
tcgggagccgacttgctcagggaaa

SEQ ID NO: 591176 - DNA, 25 bp, Rattus norvegicus
tcgggagcctcgaagagtctatgaa

SEQ ID NO: 591177 - DNA, 25 bp, Rattus norvegicus
tcgggagcctcgtagagtctatgaa

SEQ ID NO: 591178 - DNA, 25 bp, Rattus norvegicus
tcgggagcgcatcaagcagcagatt

SEQ ID NO: 591179 - DNA, 25 bp, Rattus norvegicus
tcgggagcgcatgaagcagcagatt

SEQ ID NO: 591180 - DNA, 25 bp, Rattus norvegicus
tcgggaggcccgaccaggtactccg

SEQ ID NO: 591181 - DNA, 25 bp, Rattus norvegicus
tcgggaggcccgtccaggtactccg

SEQ ID NO: 591182 - DNA, 25 bp, Rattus norvegicus
tcgggagggtgcactactctgagtt

SEQ ID NO: 591183 - DNA, 25 bp, Rattus norvegicus
tcgggagggtgctctactctgagtt

SEQ ID NO: 591184 - DNA, 25 bp, Rattus norvegicus
tcgggagtctcaccagccaactact

SEQ ID NO: 591185 - DNA, 25 bp, Rattus norvegicus
tcgggagtctcagcagccaactact

SEQ ID NO: 591186 - DNA, 25 bp, Rattus norvegicus
tcgggagtttaccagtacagcggat

SEQ ID NO: 591187 - DNA, 25 bp, Rattus norvegicus
tcgggagtttacgagtacagcggat

SEQ ID NO: 591188 - DNA, 25 bp, Rattus norvegicus
tcgggataagaaaccctgggagcct

SEQ ID NO: 591189 - DNA, 25 bp, Rattus norvegicus
tcgggataagaatccctgggagcct

SEQ ID NO: 591190 - DNA, 25 bp, Rattus norvegicus
tcgggatccgccagccaggcaaggc

SEQ ID NO: 591191 - DNA, 25 bp, Rattus norvegicus
tcgggatccgcctgccaggcaaggc

SEQ ID NO: 591192 - DNA, 25 bp, Rattus norvegicus
tcgggatctgaacactttctgcctt

SEQ ID NO: 591193 - DNA, 25 bp, Rattus norvegicus
tcgggatctgaagactttctgcctt

SEQ ID NO: 591194 - DNA, 25 bp, Rattus norvegicus
tcgggattcatcaactacgttcaag

SEQ ID NO: 591195 - DNA, 25 bp, Rattus norvegicus
tcgggattcatctactacgttcaag

SEQ ID NO: 591196 - DNA, 25 bp, Rattus norvegicus
tcgggatttctaaaactgcctactt

SEQ ID NO: 591197 - DNA, 25 bp, Rattus norvegicus
tcgggatttctataactgcctactt

SEQ ID NO: 591198 - DNA, 25 bp, Rattus norvegicus
tcgggcaacggcacggcacgcgcgg

SEQ ID NO: 591199 - DNA, 25 bp, Rattus norvegicus
tcgggcaacggctcggcacgcgcgg

SEQ ID NO: 591200 - DNA, 25 bp, Rattus norvegicus
tcgggcacacttcatgggttaatgg

SEQ ID NO: 591201 - DNA, 25 bp, Rattus norvegicus
tcgggcacacttgatgggttaatgg

SEQ ID NO: 591202 - DNA, 25 bp, Rattus norvegicus
tcgggcaccaagcacttctgattct

SEQ ID NO: 591203 - DNA, 25 bp, Rattus norvegicus
tcgggcaccaaggacttctgattct

SEQ ID NO: 591204 - DNA, 25 bp, Rattus norvegicus
tcgggcaccgtcaggcttaagtcca

SEQ ID NO: 591205 - DNA, 25 bp, Rattus norvegicus
tcgggcaccgtctggcttaagtcca

SEQ ID NO: 591206 - DNA, 25 bp, Rattus norvegicus
tcgggcagagaacaccaggattcat

SEQ ID NO: 591207 - DNA, 25 bp, Rattus norvegicus
tcgggcagagaagaccaggattcat

SEQ ID NO: 591208 - DNA, 25 bp, Rattus norvegicus
tcgggcagccaacacaaccagagca

SEQ ID NO: 591209 - DNA, 25 bp, Rattus norvegicus
tcgggcagccaagacaaccagagca

SEQ ID NO: 591210 - DNA, 25 bp, Rattus norvegicus
tcgggcagctcacagattaggaatt

SEQ ID NO: 591211 - DNA, 25 bp, Rattus norvegicus
tcgggcagctcagagattaggaatt

SEQ ID NO: 591212 - DNA, 25 bp, Rattus norvegicus
tcgggcccatttcgaccgcagtgga

SEQ ID NO: 591213 - DNA, 25 bp, Rattus norvegicus
tcgggcccatttggaccgcagtgga

SEQ ID NO: 591214 - DNA, 25 bp, Rattus norvegicus
tcgggcccctcaccagaaattacta

SEQ ID NO: 591215 - DNA, 25 bp, Rattus norvegicus
tcgggcccctcagcagaaattacta

SEQ ID NO: 591216 - DNA, 25 bp, Rattus norvegicus
tcgggccggtctatgtgctcgctga

SEQ ID NO: 591217 - DNA, 25 bp, Rattus norvegicus
tcgggccggtctttgtgctcgctga

SEQ ID NO: 591218 - DNA, 25 bp, Rattus norvegicus
tcgggcctcatgcatgtttcatgta

SEQ ID NO: 591219 - DNA, 25 bp, Rattus norvegicus
tcgggcctcatggatgtttcatgta

SEQ ID NO: 591220 - DNA, 25 bp, Rattus norvegicus
tcgggcctccatataagcgcatggg

SEQ ID NO: 591221 - DNA, 25 bp, Rattus norvegicus
tcgggcctccatttaagcgcatggg

SEQ ID NO: 591222 - DNA, 25 bp, Rattus norvegicus
tcgggcctcgacctaagagacgtta

SEQ ID NO: 591223 - DNA, 25 bp, Rattus norvegicus
tcgggcctcgacgtaagagacgtta

SEQ ID NO: 591224 - DNA, 25 bp, Rattus norvegicus
tcgggcctcgtcatagcaatattta

SEQ ID NO: 591225 - DNA, 25 bp, Rattus norvegicus
tcgggcctcgtcttagcaatattta

SEQ ID NO: 591226 - DNA, 25 bp, Rattus norvegicus
tcgggcctgggaacaattttgacat

SEQ ID NO: 591227 - DNA, 25 bp, Rattus norvegicus
tcgggcctgggatcaattttgacat

SEQ ID NO: 591228 - DNA, 25 bp, Rattus norvegicus
tcgggcctttggattgattttaaat

SEQ ID NO: 591229 - DNA, 25 bp, Rattus norvegicus
tcgggcctttggtttgattttaaat

SEQ ID NO: 591230 - DNA, 25 bp, Rattus norvegicus
tcgggccttttcacagcacagaaag

SEQ ID NO: 591231 - DNA, 25 bp, Rattus norvegicus
tcgggccttttctcagcacagaaag

SEQ ID NO: 591232 - DNA, 25 bp, Rattus norvegicus
tcgggcgagtacatgagcagctgtt

SEQ ID NO: 591233 - DNA, 25 bp, Rattus norvegicus
tcgggcgagtacttgagcagctgtt

SEQ ID NO: 591234 - DNA, 25 bp, Rattus norvegicus
tcgggcgccaaacttgctgatctta

SEQ ID NO: 591235 - DNA, 25 bp, Rattus norvegicus
tcgggcgccaaagttgctgatctta

SEQ ID NO: 591236 - DNA, 25 bp, Rattus norvegicus
tcgggcgccaacaacaagagcgtgc

SEQ ID NO: 591237 - DNA, 25 bp, Rattus norvegicus
tcgggcgccaactacaagagcgtgc

SEQ ID NO: 591238 - DNA, 25 bp, Rattus norvegicus
tcgggcgctctaagggccgagcctc

SEQ ID NO: 591239 - DNA, 25 bp, Rattus norvegicus
tcgggcgctctatgggccgagcctc

SEQ ID NO: 591240 - DNA, 25 bp, Rattus norvegicus
tcgggcggctgcagccgaagcacct

SEQ ID NO: 591241 - DNA, 25 bp, Rattus norvegicus
tcgggcggctgctgccgaagcacct

SEQ ID NO: 591242 - DNA, 25 bp, Rattus norvegicus
tcgggctatattatggatccacata

SEQ ID NO: 591243 - DNA, 25 bp, Rattus norvegicus
tcgggctatattttggatccacata

SEQ ID NO: 591244 - DNA, 25 bp, Rattus norvegicus
tcgggctcttgacactctgggcaat

SEQ ID NO: 591245 - DNA, 25 bp, Rattus norvegicus
tcgggctcttgagactctgggcaat

SEQ ID NO: 591246 - DNA, 25 bp, Rattus norvegicus
tcgggctctttgctctgtgctggtt

SEQ ID NO: 591247 - DNA, 25 bp, Rattus norvegicus
tcgggctctttggtctgtgctggtt

SEQ ID NO: 591248 - DNA, 25 bp, Rattus norvegicus
tcgggctgaccgaatcgcgagtgca

SEQ ID NO: 591249 - DNA, 25 bp, Rattus norvegicus
tcgggctgaccgtatcgcgagtgca

SEQ ID NO: 591250 - DNA, 25 bp, Rattus norvegicus
tcgggctgcctcacttctcggagag

SEQ ID NO: 591251 - DNA, 25 bp, Rattus norvegicus
tcgggctgcctctcttctcggagag

SEQ ID NO: 591252 - DNA, 25 bp, Rattus norvegicus
tcgggctgggtcacggcacagcctc

SEQ ID NO: 591253 - DNA, 25 bp, Rattus norvegicus
tcgggctgggtctcggcacagcctc

SEQ ID NO: 591254 - DNA, 25 bp, Rattus norvegicus
tcgggctgttctcccaatggctgtg

SEQ ID NO: 591255 - DNA, 25 bp, Rattus norvegicus
tcgggctgttctgccaatggctgtg

SEQ ID NO: 591256 - DNA, 25 bp, Rattus norvegicus
tcgggcttactcagtgacaccagtg

SEQ ID NO: 591257 - DNA, 25 bp, Rattus norvegicus
tcgggcttactctgtgacaccagtg

SEQ ID NO: 591258 - DNA, 25 bp, Rattus norvegicus
tcgggcttcagtcttgttcctcaga

SEQ ID NO: 591259 - DNA, 25 bp, Rattus norvegicus
tcgggcttcagtgttgttcctcaga

SEQ ID NO: 591260 - DNA, 25 bp, Rattus norvegicus
tcgggtaacccaacttacagatcaa

SEQ ID NO: 591261 - DNA, 25 bp, Rattus norvegicus
tcgggtaacccatcttacagatcaa

SEQ ID NO: 591262 - DNA, 25 bp, Rattus norvegicus
tcgggtacacatcagtggctcagct

SEQ ID NO: 591263 - DNA, 25 bp, Rattus norvegicus
tcgggtacacatgagtggctcagct

SEQ ID NO: 591264 - DNA, 25 bp, Rattus norvegicus
tcgggtattgtcagccaccagtcat

SEQ ID NO: 591265 - DNA, 25 bp, Rattus norvegicus
tcgggtattgtctgccaccagtcat

SEQ ID NO: 591266 - DNA, 25 bp, Rattus norvegicus
tcgggtcaccttcctggtggcagaa

SEQ ID NO: 591267 - DNA, 25 bp, Rattus norvegicus
tcgggtcaccttgctggtggcagaa

SEQ ID NO: 591268 - DNA, 25 bp, Rattus norvegicus
tcgggtcatggtcatgcgaagccac

SEQ ID NO: 591269 - DNA, 25 bp, Rattus norvegicus
tcgggtcatggtgatgcgaagccac

SEQ ID NO: 591270 - DNA, 25 bp, Rattus norvegicus
tcgggtcccaagaccagggcgcgta

SEQ ID NO: 591271 - DNA, 25 bp, Rattus norvegicus
tcgggtcccaagtccagggcgcgta

SEQ ID NO: 591272 - DNA, 25 bp, Rattus norvegicus
tcgggtccccgtagaaatagacttg

SEQ ID NO: 591273 - DNA, 25 bp, Rattus norvegicus
tcgggtccccgttgaaatagacttg

SEQ ID NO: 591274 - DNA, 25 bp, Rattus norvegicus
tcgggtcccggcctgggaggcggtg

SEQ ID NO: 591275 - DNA, 25 bp, Rattus norvegicus
tcgggtcccggcgtgggaggcggtg

SEQ ID NO: 591276 - DNA, 25 bp, Rattus norvegicus
tcgggtccgttcagtttccatggga

SEQ ID NO: 591277 - DNA, 25 bp, Rattus norvegicus
tcgggtccgttctgtttccatggga

SEQ ID NO: 591278 - DNA, 25 bp, Rattus norvegicus
tcgggtcgacgtcctccgtttgctc

SEQ ID NO: 591279 - DNA, 25 bp, Rattus norvegicus
tcgggtcgacgtgctccgtttgctc

SEQ ID NO: 591280 - DNA, 25 bp, Rattus norvegicus
tcgggtctccaaacacagctggttt

SEQ ID NO: 591281 - DNA, 25 bp, Rattus norvegicus
tcgggtctccaatcacagctggttt

SEQ ID NO: 591282 - DNA, 25 bp, Rattus norvegicus
tcgggtctgaaaagcgtggctgtaa

SEQ ID NO: 591283 - DNA, 25 bp, Rattus norvegicus
tcgggtctgaaatgcgtggctgtaa

SEQ ID NO: 591284 - DNA, 25 bp, Rattus norvegicus
tcgggtgactacaagcacttcaggg

SEQ ID NO: 591285 - DNA, 25 bp, Rattus norvegicus
tcgggtgactactagcacttcaggg

SEQ ID NO: 591286 - DNA, 25 bp, Rattus norvegicus
tcgggtgcagttagaggattctctc

SEQ ID NO: 591287 - DNA, 25 bp, Rattus norvegicus
tcgggtgcagtttgaggattctctc

SEQ ID NO: 591288 - DNA, 25 bp, Rattus norvegicus
tcgggtgccagaaggcgtgacgctg

SEQ ID NO: 591289 - DNA, 25 bp, Rattus norvegicus
tcgggtgccagatggcgtgacgctg

SEQ ID NO: 591290 - DNA, 25 bp, Rattus norvegicus
tcgggtgccctgagtttctgaatga

SEQ ID NO: 591291 - DNA, 25 bp, Rattus norvegicus
tcgggtgccctgtgtttctgaatga

SEQ ID NO: 591292 - DNA, 25 bp, Rattus norvegicus
tcgggtggatttaagtgacactgtg

SEQ ID NO: 591293 - DNA, 25 bp, Rattus norvegicus
tcgggtggattttagtgacactgtg

SEQ ID NO: 591294 - DNA, 25 bp, Rattus norvegicus
tcgggtggccccataacttggagaa

SEQ ID NO: 591295 - DNA, 25 bp, Rattus norvegicus
tcgggtggccccttaacttggagaa

SEQ ID NO: 591296 - DNA, 25 bp, Rattus norvegicus
tcgggtggttcccagctttggttat

SEQ ID NO: 591297 - DNA, 25 bp, Rattus norvegicus
tcgggtggttccgagctttggttat

SEQ ID NO: 591298 - DNA, 25 bp, Rattus norvegicus
tcgggttacagaagcccaccctatt

SEQ ID NO: 591299 - DNA, 25 bp, Rattus norvegicus
tcgggttacagatgcccaccctatt

SEQ ID NO: 591300 - DNA, 25 bp, Rattus norvegicus
tcgggttactaaaggcttgaagctc

SEQ ID NO: 591301 - DNA, 25 bp, Rattus norvegicus
tcgggttactaatggcttgaagctc

SEQ ID NO: 591302 - DNA, 25 bp, Rattus norvegicus
tcgggttcaccccaatgatagtgga

SEQ ID NO: 591303 - DNA, 25 bp, Rattus norvegicus
tcgggttcacccgaatgatagtgga

SEQ ID NO: 591304 - DNA, 25 bp, Rattus norvegicus
tcgggttcagatctactcctgagtg

SEQ ID NO: 591305 - DNA, 25 bp, Rattus norvegicus
tcgggttcagatgtactcctgagtg

SEQ ID NO: 591306 - DNA, 25 bp, Rattus norvegicus
tcgggttcccatatgaaaatggagt

SEQ ID NO: 591307 - DNA, 25 bp, Rattus norvegicus
tcgggttcccatttgaaaatggagt

SEQ ID NO: 591308 - DNA, 25 bp, Rattus norvegicus
tcgggttctattagggagtgactgt

SEQ ID NO: 591309 - DNA, 25 bp, Rattus norvegicus
tcgggttctatttgggagtgactgt

SEQ ID NO: 591310 - DNA, 25 bp, Rattus norvegicus
tcgggttgcccacttagttctgatt

SEQ ID NO: 591311 - DNA, 25 bp, Rattus norvegicus
tcgggttgcccagttagttctgatt

SEQ ID NO: 591312 - DNA, 25 bp, Rattus norvegicus
tcgggtttcctgctttctcatggca

SEQ ID NO: 591313 - DNA, 25 bp, Rattus norvegicus
tcgggtttcctggtttctcatggca

SEQ ID NO: 591314 - DNA, 25 bp, Rattus norvegicus
tcgggtttctcgcagttagatgtca

SEQ ID NO: 591315 - DNA, 25 bp, Rattus norvegicus
tcgggtttctcggagttagatgtca

SEQ ID NO: 591316 - DNA, 25 bp, Rattus norvegicus
tcgggtttgataattttctgcctaa

SEQ ID NO: 591317 - DNA, 25 bp, Rattus norvegicus
tcgggtttgatatttttctgcctaa

SEQ ID NO: 591318 - DNA, 25 bp, Rattus norvegicus
tcggtaaataggaagcccggtcgag

SEQ ID NO: 591319 - DNA, 25 bp, Rattus norvegicus
tcggtaaataggtagcccggtcgag

SEQ ID NO: 591320 - DNA, 25 bp, Rattus norvegicus
tcggtaaccattctcctcagatact

SEQ ID NO: 591321 - DNA, 25 bp, Rattus norvegicus
tcggtaaccattgtcctcagatact

SEQ ID NO: 591322 - DNA, 25 bp, Rattus norvegicus
tcggtaacttacatctctctgggaa

SEQ ID NO: 591323 - DNA, 25 bp, Rattus norvegicus
tcggtaacttacttctctctgggaa

SEQ ID NO: 591324 - DNA, 25 bp, Rattus norvegicus
tcggtaagctcacctcttctcctta

SEQ ID NO: 591325 - DNA, 25 bp, Rattus norvegicus
tcggtaagctcagctcttctcctta

SEQ ID NO: 591326 - DNA, 25 bp, Rattus norvegicus
tcggtaccactgacctgtataaacg

SEQ ID NO: 591327 - DNA, 25 bp, Rattus norvegicus
tcggtaccactgtcctgtataaacg

SEQ ID NO: 591328 - DNA, 25 bp, Rattus norvegicus
tcggtagccgtccccggaagcgctt

SEQ ID NO: 591329 - DNA, 25 bp, Rattus norvegicus
tcggtagccgtcgccggaagcgctt

SEQ ID NO: 591330 - DNA, 25 bp, Rattus norvegicus
tcggtagctaatctctttgagtttt

SEQ ID NO: 591331 - DNA, 25 bp, Rattus norvegicus
tcggtagctaatgtctttgagtttt

SEQ ID NO: 591332 - DNA, 25 bp, Rattus norvegicus
tcggtagtacctcagctctagagat

SEQ ID NO: 591333 - DNA, 25 bp, Rattus norvegicus
tcggtagtacctgagctctagagat

SEQ ID NO: 591334 - DNA, 25 bp, Rattus norvegicus
tcggtatactcaaggccccaaggaa

SEQ ID NO: 591335 - DNA, 25 bp, Rattus norvegicus
tcggtatactcatggccccaaggaa

SEQ ID NO: 591336 - DNA, 25 bp, Rattus norvegicus
tcggtattacacagagcctcattct

SEQ ID NO: 591337 - DNA, 25 bp, Rattus norvegicus
tcggtattacactgagcctcattct

SEQ ID NO: 591338 - DNA, 25 bp, Rattus norvegicus
tcggtcaaagccacaactgcaatgc

SEQ ID NO: 591339 - DNA, 25 bp, Rattus norvegicus
tcggtcaaagcctcaactgcaatgc

SEQ ID NO: 591340 - DNA, 25 bp, Rattus norvegicus
tcggtcaatgtactgggcgattctt

SEQ ID NO: 591341 - DNA, 25 bp, Rattus norvegicus
tcggtcaatgtagtgggcgattctt

SEQ ID NO: 591342 - DNA, 25 bp, Rattus norvegicus
tcggtcatctctaagtacaacattg

SEQ ID NO: 591343 - DNA, 25 bp, Rattus norvegicus
tcggtcatctcttagtacaacattg

SEQ ID NO: 591344 - DNA, 25 bp, Rattus norvegicus
tcggtccataaactgtgcctggctt

SEQ ID NO: 591345 - DNA, 25 bp, Rattus norvegicus
tcggtccataaagtgtgcctggctt

SEQ ID NO: 591346 - DNA, 25 bp, Rattus norvegicus
tcggtcccagagaacagagtgatat

SEQ ID NO: 591347 - DNA, 25 bp, Rattus norvegicus
tcggtcccagagtacagagtgatat

SEQ ID NO: 591348 - DNA, 25 bp, Rattus norvegicus
tcggtccctcagcaatttcttttta

SEQ ID NO: 591349 - DNA, 25 bp, Rattus norvegicus
tcggtccctcaggaatttcttttta

SEQ ID NO: 591350 - DNA, 25 bp, Rattus norvegicus
tcggtccggcctaaaagcagcggga

SEQ ID NO: 591351 - DNA, 25 bp, Rattus norvegicus
tcggtccggccttaaagcagcggga

SEQ ID NO: 591352 - DNA, 25 bp, Rattus norvegicus
tcggtcctcagcattggggggataa

SEQ ID NO: 591353 - DNA, 25 bp, Rattus norvegicus
tcggtcctcagctttggggggataa

SEQ ID NO: 591354 - DNA, 25 bp, Rattus norvegicus
tcggtcctccatcggtcagtgcgga

SEQ ID NO: 591355 - DNA, 25 bp, Rattus norvegicus
tcggtcctccatgggtcagtgcgga

SEQ ID NO: 591356 - DNA, 25 bp, Rattus norvegicus
tcggtcgcacagatgcactgcaggt

SEQ ID NO: 591357 - DNA, 25 bp, Rattus norvegicus
tcggtcgcacagttgcactgcaggt

SEQ ID NO: 591358 - DNA, 25 bp, Rattus norvegicus
tcggtcgggcccaggccacaaaggc

SEQ ID NO: 591359 - DNA, 25 bp, Rattus norvegicus
tcggtcgggccctggccacaaaggc

SEQ ID NO: 591360 - DNA, 25 bp, Rattus norvegicus
tcggtctaaggcctatgctttggaa

SEQ ID NO: 591361 - DNA, 25 bp, Rattus norvegicus
tcggtctaaggcgtatgctttggaa

SEQ ID NO: 591362 - DNA, 25 bp, Rattus norvegicus
tcggtctactgacctttggaaccca

SEQ ID NO: 591363 - DNA, 25 bp, Rattus norvegicus
tcggtctactgagctttggaaccca

SEQ ID NO: 591364 - DNA, 25 bp, Rattus norvegicus
tcggtctagaatatttaagccctat

SEQ ID NO: 591365 - DNA, 25 bp, Rattus norvegicus
tcggtctagaatttttaagccctat

SEQ ID NO: 591366 - DNA, 25 bp, Rattus norvegicus
tcggtctcactaattgtaacatcct

SEQ ID NO: 591367 - DNA, 25 bp, Rattus norvegicus
tcggtctcactatttgtaacatcct

SEQ ID NO: 591368 - DNA, 25 bp, Rattus norvegicus
tcggtctcatcgatgccccagaatg

SEQ ID NO: 591369 - DNA, 25 bp, Rattus norvegicus
tcggtctcatcgttgccccagaatg

SEQ ID NO: 591370 - DNA, 25 bp, Rattus norvegicus
tcggtctccgacaaaagtttccact

SEQ ID NO: 591371 - DNA, 25 bp, Rattus norvegicus
tcggtctccgactaaagtttccact

SEQ ID NO: 591372 - DNA, 25 bp, Rattus norvegicus
tcggtctcgtgcaacaggacgggca

SEQ ID NO: 591373 - DNA, 25 bp, Rattus norvegicus
tcggtctcgtgctacaggacgggca

SEQ ID NO: 591374 - DNA, 25 bp, Rattus norvegicus
tcggtctggcttcgctgcttggcac

SEQ ID NO: 591375 - DNA, 25 bp, Rattus norvegicus
tcggtctggcttggctgcttggcac

SEQ ID NO: 591376 - DNA, 25 bp, Rattus norvegicus
tcggtgaaacacatgccttttagca

SEQ ID NO: 591377 - DNA, 25 bp, Rattus norvegicus
tcggtgaaacacttgccttttagca

SEQ ID NO: 591378 - DNA, 25 bp, Rattus norvegicus
tcggtgaaagcactccgctcctcag

SEQ ID NO: 591379 - DNA, 25 bp, Rattus norvegicus
tcggtgaaagcagtccgctcctcag

SEQ ID NO: 591380 - DNA, 25 bp, Rattus norvegicus
tcggtgacaatcaggctttgggccc

SEQ ID NO: 591381 - DNA, 25 bp, Rattus norvegicus
tcggtgacaatctggctttgggccc

SEQ ID NO: 591382 - DNA, 25 bp, Rattus norvegicus
tcggtgacacccagctgccgttgtg

SEQ ID NO: 591383 - DNA, 25 bp, Rattus norvegicus
tcggtgacaccctgctgccgttgtg

SEQ ID NO: 591384 - DNA, 25 bp, Rattus norvegicus
tcggtgacaggaaagcaagcgtaac

SEQ ID NO: 591385 - DNA, 25 bp, Rattus norvegicus
tcggtgacaggatagcaagcgtaac

SEQ ID NO: 591386 - DNA, 25 bp, Rattus norvegicus
tcggtgaccggcagctcctcggagt

SEQ ID NO: 591387 - DNA, 25 bp, Rattus norvegicus
tcggtgaccggctgctcctcggagt

SEQ ID NO: 591388 - DNA, 25 bp, Rattus norvegicus
tcggtgacgtttctccaggttaggc

SEQ ID NO: 591389 - DNA, 25 bp, Rattus norvegicus
tcggtgacgtttgtccaggttaggc

SEQ ID NO: 591390 - DNA, 25 bp, Rattus norvegicus
tcggtgactcctctgtgtagtaata

SEQ ID NO: 591391 - DNA, 25 bp, Rattus norvegicus
tcggtgactcctgtgtgtagtaata

SEQ ID NO: 591392 - DNA, 25 bp, Rattus norvegicus
tcggtgatccatccgttcaggcaat

SEQ ID NO: 591393 - DNA, 25 bp, Rattus norvegicus
tcggtgatccatgcgttcaggcaat

SEQ ID NO: 591394 - DNA, 25 bp, Rattus norvegicus
tcggtgatcgccattgaaacgcaca

SEQ ID NO: 591395 - DNA, 25 bp, Rattus norvegicus
tcggtgatcgcctttgaaacgcaca

SEQ ID NO: 591396 - DNA, 25 bp, Rattus norvegicus
tcggtgccatcgctttcttttaata

SEQ ID NO: 591397 - DNA, 25 bp, Rattus norvegicus
tcggtgccatcggtttcttttaata

SEQ ID NO: 591398 - DNA, 25 bp, Rattus norvegicus
tcggtgcccgcacggagaacttcag

SEQ ID NO: 591399 - DNA, 25 bp, Rattus norvegicus
tcggtgcccgcagggagaacttcag

SEQ ID NO: 591400 - DNA, 25 bp, Rattus norvegicus
tcggtgcccttcaggaggctagcga

SEQ ID NO: 591401 - DNA, 25 bp, Rattus norvegicus
tcggtgcccttctggaggctagcga

SEQ ID NO: 591402 - DNA, 25 bp, Rattus norvegicus
tcggtgctaccacagaggttctgat

SEQ ID NO: 591403 - DNA, 25 bp, Rattus norvegicus
tcggtgctaccagagaggttctgat

SEQ ID NO: 591404 - DNA, 25 bp, Rattus norvegicus
tcggtgctcatgaccctgaagcaga

SEQ ID NO: 591405 - DNA, 25 bp, Rattus norvegicus
tcggtgctcatgtccctgaagcaga

SEQ ID NO: 591406 - DNA, 25 bp, Rattus norvegicus
tcggtggaagatccccaggccacat

SEQ ID NO: 591407 - DNA, 25 bp, Rattus norvegicus
tcggtggaagatgcccaggccacat

SEQ ID NO: 591408 - DNA, 25 bp, Rattus norvegicus
tcggtggcagaacctctccaaaatg

SEQ ID NO: 591409 - DNA, 25 bp, Rattus norvegicus
tcggtggcagaagctctccaaaatg

SEQ ID NO: 591410 - DNA, 25 bp, Rattus norvegicus
tcggtggcagtccaccacatctggg

SEQ ID NO: 591411 - DNA, 25 bp, Rattus norvegicus
tcggtggcagtcgaccacatctggg

SEQ ID NO: 591412 - DNA, 25 bp, Rattus norvegicus
tcggtgggaattcgctctcaatgat

SEQ ID NO: 591413 - DNA, 25 bp, Rattus norvegicus
tcggtgggaattggctctcaatgat

SEQ ID NO: 591414 - DNA, 25 bp, Rattus norvegicus
tcggtgggcacactcccgagctgct

SEQ ID NO: 591415 - DNA, 25 bp, Rattus norvegicus
tcggtgggcacagtcccgagctgct

SEQ ID NO: 591416 - DNA, 25 bp, Rattus norvegicus
tcggtgggccccaaaagcaatagca

SEQ ID NO: 591417 - DNA, 25 bp, Rattus norvegicus
tcggtgggcccctaaagcaatagca

SEQ ID NO: 591418 - DNA, 25 bp, Rattus norvegicus
tcggtggtggagacatctgcatcct

SEQ ID NO: 591419 - DNA, 25 bp, Rattus norvegicus
tcggtggtggagtcatctgcatcct

SEQ ID NO: 591420 - DNA, 25 bp, Rattus norvegicus
tcggtggtggtccaaaagccatcat

SEQ ID NO: 591421 - DNA, 25 bp, Rattus norvegicus
tcggtggtggtcgaaaagccatcat

SEQ ID NO: 591422 - DNA, 25 bp, Rattus norvegicus
tcggtggttaagcacaccagctgct

SEQ ID NO: 591423 - DNA, 25 bp, Rattus norvegicus
tcggtggttaaggacaccagctgct

SEQ ID NO: 591424 - DNA, 25 bp, Rattus norvegicus
tcggtgtccactagtgacattaaag

SEQ ID NO: 591425 - DNA, 25 bp, Rattus norvegicus
tcggtgtccacttgtgacattaaag

SEQ ID NO: 591426 - DNA, 25 bp, Rattus norvegicus
tcggtgtctctcagggccattgcat

SEQ ID NO: 591427 - DNA, 25 bp, Rattus norvegicus
tcggtgtctctctgggccattgcat

SEQ ID NO: 591428 - DNA, 25 bp, Rattus norvegicus
tcggtgtgacagattccccttagag

SEQ ID NO: 591429 - DNA, 25 bp, Rattus norvegicus
tcggtgtgacagtttccccttagag

SEQ ID NO: 591430 - DNA, 25 bp, Rattus norvegicus
tcggtgtgccacacgccgggagcgg

SEQ ID NO: 591431 - DNA, 25 bp, Rattus norvegicus
tcggtgtgccactcgccgggagcgg

SEQ ID NO: 591432 - DNA, 25 bp, Rattus norvegicus
tcggtgttcacacgcctaagcacaa

SEQ ID NO: 591433 - DNA, 25 bp, Rattus norvegicus
tcggtgttcacaggcctaagcacaa

SEQ ID NO: 591434 - DNA, 25 bp, Rattus norvegicus
tcggtgttcttccaggccaagagac

SEQ ID NO: 591435 - DNA, 25 bp, Rattus norvegicus
tcggtgttcttcgaggccaagagac

SEQ ID NO: 591436 - DNA, 25 bp, Rattus norvegicus
tcggttatttagctccagcagctac

SEQ ID NO: 591437 - DNA, 25 bp, Rattus norvegicus
tcggttatttaggtccagcagctac

SEQ ID NO: 591438 - DNA, 25 bp, Rattus norvegicus
tcggttcagctcaacttgtcaaaaa

SEQ ID NO: 591439 - DNA, 25 bp, Rattus norvegicus
tcggttcagctctacttgtcaaaaa

SEQ ID NO: 591440 - DNA, 25 bp, Rattus norvegicus
tcggttccagctcgccagaattagc

SEQ ID NO: 591441 - DNA, 25 bp, Rattus norvegicus
tcggttccagctggccagaattagc

SEQ ID NO: 591442 - DNA, 25 bp, Rattus norvegicus
tcggttccatctaccgctgcgcgaa

SEQ ID NO: 591443 - DNA, 25 bp, Rattus norvegicus
tcggttccatcttccgctgcgcgaa

SEQ ID NO: 591444 - DNA, 25 bp, Rattus norvegicus
tcggttccccaaactgaaggcatgt

SEQ ID NO: 591445 - DNA, 25 bp, Rattus norvegicus
tcggttccccaatctgaaggcatgt

SEQ ID NO: 591446 - DNA, 25 bp, Rattus norvegicus
tcggttctgcacaattcggtttcaa

SEQ ID NO: 591447 - DNA, 25 bp, Rattus norvegicus
tcggttctgcactattcggtttcaa

SEQ ID NO: 591448 - DNA, 25 bp, Rattus norvegicus
tcggttctttccatgagctttaagt

SEQ ID NO: 591449 - DNA, 25 bp, Rattus norvegicus
tcggttctttccttgagctttaagt

SEQ ID NO: 591450 - DNA, 25 bp, Rattus norvegicus
tcggttgctgagcttccctccatga

SEQ ID NO: 591451 - DNA, 25 bp, Rattus norvegicus
tcggttgctgaggttccctccatga

SEQ ID NO: 591452 - DNA, 25 bp, Rattus norvegicus
tcggttgtgtatctaatatgcccca

SEQ ID NO: 591453 - DNA, 25 bp, Rattus norvegicus
tcggttgtgtatgtaatatgcccca

SEQ ID NO: 591454 - DNA, 25 bp, Rattus norvegicus
tcggttgttaacaatggtactccat

SEQ ID NO: 591455 - DNA, 25 bp, Rattus norvegicus
tcggttgttaactatggtactccat

SEQ ID NO: 591456 - DNA, 25 bp, Rattus norvegicus
tcggtttacctgatattgttctgtt

SEQ ID NO: 591457 - DNA, 25 bp, Rattus norvegicus
tcggtttacctgttattgttctgtt

SEQ ID NO: 591458 - DNA, 25 bp, Rattus norvegicus
tcggtttcctcacctagttgaatta

SEQ ID NO: 591459 - DNA, 25 bp, Rattus norvegicus
tcggtttcctcagctagttgaatta

SEQ ID NO: 591460 - DNA, 25 bp, Rattus norvegicus
tcggtttgactacttccgtttgcaa

SEQ ID NO: 591461 - DNA, 25 bp, Rattus norvegicus
tcggtttgactagttccgtttgcaa

SEQ ID NO: 591462 - DNA, 25 bp, Rattus norvegicus
tcggttttaactcgaaatcgtcaca

SEQ ID NO: 591463 - DNA, 25 bp, Rattus norvegicus
tcggttttaactggaaatcgtcaca

SEQ ID NO: 591464 - DNA, 25 bp, Rattus norvegicus
tcggttttaattctgcactggcctt

SEQ ID NO: 591465 - DNA, 25 bp, Rattus norvegicus
tcggttttaattgtgcactggcctt

SEQ ID NO: 591466 - DNA, 25 bp, Rattus norvegicus
tcggttttcctgatcacctctgatt

SEQ ID NO: 591467 - DNA, 25 bp, Rattus norvegicus
tcggttttcctgttcacctctgatt

SEQ ID NO: 591468 - DNA, 25 bp, Rattus norvegicus
tcggttttgttgattgccattcatt

SEQ ID NO: 591469 - DNA, 25 bp, Rattus norvegicus
tcggttttgttgtttgccattcatt

SEQ ID NO: 591470 - DNA, 25 bp, Rattus norvegicus
tcggtttttggtagtgcctgtcgta

SEQ ID NO: 591471 - DNA, 25 bp, Rattus norvegicus
tcggtttttggttgtgcctgtcgta

SEQ ID NO: 591472 - DNA, 25 bp, Rattus norvegicus
tcgtaaaagctcagggtggcccgca

SEQ ID NO: 591473 - DNA, 25 bp, Rattus norvegicus
tcgtaaaagctctgggtggcccgca

SEQ ID NO: 591474 - DNA, 25 bp, Rattus norvegicus
tcgtaaacagtccagagtccatgcc

SEQ ID NO: 591475 - DNA, 25 bp, Rattus norvegicus
tcgtaaacagtcgagagtccatgcc

SEQ ID NO: 591476 - DNA, 25 bp, Rattus norvegicus
tcgtaacaagccatccttggagtgg

SEQ ID NO: 591477 - DNA, 25 bp, Rattus norvegicus
tcgtaacaagccttccttggagtgg

SEQ ID NO: 591478 - DNA, 25 bp, Rattus norvegicus
tcgtaagacatccgcgagcgactgt

SEQ ID NO: 591479 - DNA, 25 bp, Rattus norvegicus
tcgtaagacatcggcgagcgactgt

SEQ ID NO: 591480 - DNA, 25 bp, Rattus norvegicus
tcgtaagggcttcaacccaagtcct

SEQ ID NO: 591481 - DNA, 25 bp, Rattus norvegicus
tcgtaagggcttgaacccaagtcct

SEQ ID NO: 591482 - DNA, 25 bp, Rattus norvegicus
tcgtaagtggtgctgacagttcatg

SEQ ID NO: 591483 - DNA, 25 bp, Rattus norvegicus
tcgtaagtggtggtgacagttcatg

SEQ ID NO: 591484 - DNA, 25 bp, Rattus norvegicus
tcgtaatcccagcattctcaggcca

SEQ ID NO: 591485 - DNA, 25 bp, Rattus norvegicus
tcgtaatcccaggattctcaggcca

SEQ ID NO: 591486 - DNA, 25 bp, Rattus norvegicus
tcgtaattctcaatagctgcagccc

SEQ ID NO: 591487 - DNA, 25 bp, Rattus norvegicus
tcgtaattctcattagctgcagccc

SEQ ID NO: 591488 - DNA, 25 bp, Rattus norvegicus
tcgtacacttctccagagacgtggt

SEQ ID NO: 591489 - DNA, 25 bp, Rattus norvegicus
tcgtacacttctgcagagacgtggt

SEQ ID NO: 591490 - DNA, 25 bp, Rattus norvegicus
tcgtacccctggcttattgaaggtc

SEQ ID NO: 591491 - DNA, 25 bp, Rattus norvegicus
tcgtacccctgggttattgaaggtc

SEQ ID NO: 591492 - DNA, 25 bp, Rattus norvegicus
tcgtacctgctgattgctacatgtc

SEQ ID NO: 591493 - DNA, 25 bp, Rattus norvegicus
tcgtacctgctgtttgctacatgtc

SEQ ID NO: 591494 - DNA, 25 bp, Rattus norvegicus
tcgtactattttatgctatctgaag

SEQ ID NO: 591495 - DNA, 25 bp, Rattus norvegicus
tcgtactattttttgctatctgaag

SEQ ID NO: 591496 - DNA, 25 bp, Rattus norvegicus
tcgtactcacgcagccgatcgcggt

SEQ ID NO: 591497 - DNA, 25 bp, Rattus norvegicus
tcgtactcacgctgccgatcgcggt

SEQ ID NO: 591498 - DNA, 25 bp, Rattus norvegicus
tcgtacttaaagctcttcccacagt

SEQ ID NO: 591499 - DNA, 25 bp, Rattus norvegicus
tcgtacttaaaggtcttcccacagt

SEQ ID NO: 591500 - DNA, 25 bp, Rattus norvegicus
tcgtagcacgaaccctttctgttat

SEQ ID NO: 591501 - DNA, 25 bp, Rattus norvegicus
tcgtagcacgaagcctttctgttat

SEQ ID NO: 591502 - DNA, 25 bp, Rattus norvegicus
tcgtagccctaaacttatcaatcct

SEQ ID NO: 591503 - DNA, 25 bp, Rattus norvegicus
tcgtagccctaatcttatcaatcct

SEQ ID NO: 591504 - DNA, 25 bp, Rattus norvegicus
tcgtagccgtggaggtgtttgccat

SEQ ID NO: 591505 - DNA, 25 bp, Rattus norvegicus
tcgtagccgtggtggtgtttgccat

SEQ ID NO: 591506 - DNA, 25 bp, Rattus norvegicus
tcgtaggaccctcccacataataaa

SEQ ID NO: 591507 - DNA, 25 bp, Rattus norvegicus
tcgtaggaccctgccacataataaa

SEQ ID NO: 591508 - DNA, 25 bp, Rattus norvegicus
tcgtaggaggctctcctgtctgcag

SEQ ID NO: 591509 - DNA, 25 bp, Rattus norvegicus
tcgtaggaggctgtcctgtctgcag

SEQ ID NO: 591510 - DNA, 25 bp, Rattus norvegicus
tcgtaggcgcacacggagcgcgagt

SEQ ID NO: 591511 - DNA, 25 bp, Rattus norvegicus
tcgtaggcgcactcggagcgcgagt

SEQ ID NO: 591512 - DNA, 25 bp, Rattus norvegicus
tcgtagtgtgttaccaagcccggct

SEQ ID NO: 591513 - DNA, 25 bp, Rattus norvegicus
tcgtagtgtgtttccaagcccggct

SEQ ID NO: 591514 - DNA, 25 bp, Rattus norvegicus
tcgtataaatgacctgcctggctcc

SEQ ID NO: 591515 - DNA, 25 bp, Rattus norvegicus
tcgtataaatgagctgcctggctcc

SEQ ID NO: 591516 - DNA, 25 bp, Rattus norvegicus
tcgtatagtacgagcctggatctac

SEQ ID NO: 591517 - DNA, 25 bp, Rattus norvegicus
tcgtatagtacgtgcctggatctac

SEQ ID NO: 591518 - DNA, 25 bp, Rattus norvegicus
tcgtatctaaggcaacgccacctga

SEQ ID NO: 591519 - DNA, 25 bp, Rattus norvegicus
tcgtatctaagggaacgccacctga

SEQ ID NO: 591520 - DNA, 25 bp, Rattus norvegicus
tcgtatgaagatcccatgatgcctt

SEQ ID NO: 591521 - DNA, 25 bp, Rattus norvegicus
tcgtatgaagatgccatgatgcctt

SEQ ID NO: 591522 - DNA, 25 bp, Rattus norvegicus
tcgtatggacctcatcatccctggg

SEQ ID NO: 591523 - DNA, 25 bp, Rattus norvegicus
tcgtatggacctgatcatccctggg

SEQ ID NO: 591524 - DNA, 25 bp, Rattus norvegicus
tcgtatgggaacaccatttcactct

SEQ ID NO: 591525 - DNA, 25 bp, Rattus norvegicus
tcgtatgggaactccatttcactct

SEQ ID NO: 591526 - DNA, 25 bp, Rattus norvegicus
tcgtatgtccgcctctggttgggct

SEQ ID NO: 591527 - DNA, 25 bp, Rattus norvegicus
tcgtatgtccgcgtctggttgggct

SEQ ID NO: 591528 - DNA, 25 bp, Rattus norvegicus
tcgtatttacacagtgtgtggatac

SEQ ID NO: 591529 - DNA, 25 bp, Rattus norvegicus
tcgtatttacactgtgtgtggatac

SEQ ID NO: 591530 - DNA, 25 bp, Rattus norvegicus
tcgtattttgttccatcgtacactg

SEQ ID NO: 591531 - DNA, 25 bp, Rattus norvegicus
tcgtattttgttgcatcgtacactg

SEQ ID NO: 591532 - DNA, 25 bp, Rattus norvegicus
tcgtcaacgcagcaaaacggcaaaa

SEQ ID NO: 591533 - DNA, 25 bp, Rattus norvegicus
tcgtcaacgcaggaaaacggcaaaa

SEQ ID NO: 591534 - DNA, 25 bp, Rattus norvegicus
tcgtcaagagtcccataatctcaga

SEQ ID NO: 591535 - DNA, 25 bp, Rattus norvegicus
tcgtcaagagtcgcataatctcaga

SEQ ID NO: 591536 - DNA, 25 bp, Rattus norvegicus
tcgtcaaggcccatgtttcctttga

SEQ ID NO: 591537 - DNA, 25 bp, Rattus norvegicus
tcgtcaaggcccttgtttcctttga

SEQ ID NO: 591538 - DNA, 25 bp, Rattus norvegicus
tcgtcacatctgagcttgtggaaaa

SEQ ID NO: 591539 - DNA, 25 bp, Rattus norvegicus
tcgtcacatctgtgcttgtggaaaa

SEQ ID NO: 591540 - DNA, 25 bp, Rattus norvegicus
tcgtcacggcttcagatgatggcta

SEQ ID NO: 591541 - DNA, 25 bp, Rattus norvegicus
tcgtcacggcttgagatgatggcta

SEQ ID NO: 591542 - DNA, 25 bp, Rattus norvegicus
tcgtcagaaacgctttgctggtccc

SEQ ID NO: 591543 - DNA, 25 bp, Rattus norvegicus
tcgtcagaaacggtttgctggtccc

SEQ ID NO: 591544 - DNA, 25 bp, Rattus norvegicus
tcgtcagacagcctcacatcttact

SEQ ID NO: 591545 - DNA, 25 bp, Rattus norvegicus
tcgtcagacagcgtcacatcttact

SEQ ID NO: 591546 - DNA, 25 bp, Rattus norvegicus
tcgtcagacttcacgctatcaggaa

SEQ ID NO: 591547 - DNA, 25 bp, Rattus norvegicus
tcgtcagacttctcgctatcaggaa

SEQ ID NO: 591548 - DNA, 25 bp, Rattus norvegicus
tcgtcaggactaagttttgtttctc

SEQ ID NO: 591549 - DNA, 25 bp, Rattus norvegicus
tcgtcaggactatgttttgtttctc

SEQ ID NO: 591550 - DNA, 25 bp, Rattus norvegicus
tcgtcagggctaatgtgctgacccc

SEQ ID NO: 591551 - DNA, 25 bp, Rattus norvegicus
tcgtcagggctattgtgctgacccc

SEQ ID NO: 591552 - DNA, 25 bp, Rattus norvegicus
tcgtcaggtgcacgtcagcacgttg

SEQ ID NO: 591553 - DNA, 25 bp, Rattus norvegicus
tcgtcaggtgcaggtcagcacgttg

SEQ ID NO: 591554 - DNA, 25 bp, Rattus norvegicus
tcgtcagtctccatcagtattcaga

SEQ ID NO: 591555 - DNA, 25 bp, Rattus norvegicus
tcgtcagtctccttcagtattcaga

SEQ ID NO: 591556 - DNA, 25 bp, Rattus norvegicus
tcgtcagtggaaacattggcccctt

SEQ ID NO: 591557 - DNA, 25 bp, Rattus norvegicus
tcgtcagtggaatcattggcccctt

SEQ ID NO: 591558 - DNA, 25 bp, Rattus norvegicus
tcgtcagtttaaccgacaaagaggt

SEQ ID NO: 591559 - DNA, 25 bp, Rattus norvegicus
tcgtcagtttaagcgacaaagaggt

SEQ ID NO: 591560 - DNA, 25 bp, Rattus norvegicus
tcgtcatcatgtctgggatcccata

SEQ ID NO: 591561 - DNA, 25 bp, Rattus norvegicus
tcgtcatcatgtgtgggatcccata

SEQ ID NO: 591562 - DNA, 25 bp, Rattus norvegicus
tcgtcatcctggacagcagtcagct

SEQ ID NO: 591563 - DNA, 25 bp, Rattus norvegicus
tcgtcatcctggtcagcagtcagct

SEQ ID NO: 591564 - DNA, 25 bp, Rattus norvegicus
tcgtcatctatgcatcaactgtagc

SEQ ID NO: 591565 - DNA, 25 bp, Rattus norvegicus
tcgtcatctatggatcaactgtagc

SEQ ID NO: 591566 - DNA, 25 bp, Rattus norvegicus
tcgtcatcttggcagtgcatccatt

SEQ ID NO: 591567 - DNA, 25 bp, Rattus norvegicus
tcgtcatcttgggagtgcatccatt

SEQ ID NO: 591568 - DNA, 25 bp, Rattus norvegicus
tcgtccacgcttagatgtttgctga

SEQ ID NO: 591569 - DNA, 25 bp, Rattus norvegicus
tcgtccacgctttgatgtttgctga

SEQ ID NO: 591570 - DNA, 25 bp, Rattus norvegicus
tcgtccagaattcccaggttcagtt

SEQ ID NO: 591571 - DNA, 25 bp, Rattus norvegicus
tcgtccagaattgccaggttcagtt

SEQ ID NO: 591572 - DNA, 25 bp, Rattus norvegicus
tcgtccaggacgatcccaggcttgt

SEQ ID NO: 591573 - DNA, 25 bp, Rattus norvegicus
tcgtccaggacgttcccaggcttgt

SEQ ID NO: 591574 - DNA, 25 bp, Rattus norvegicus
tcgtccaggaggacatattctttat

SEQ ID NO: 591575 - DNA, 25 bp, Rattus norvegicus
tcgtccaggaggtcatattctttat

SEQ ID NO: 591576 - DNA, 25 bp, Rattus norvegicus
tcgtcccagcacatcttaacaaatg

SEQ ID NO: 591577 - DNA, 25 bp, Rattus norvegicus
tcgtcccagcacttcttaacaaatg

SEQ ID NO: 591578 - DNA, 25 bp, Rattus norvegicus
tcgtcccagtcaaggcggctgtaat

SEQ ID NO: 591579 - DNA, 25 bp, Rattus norvegicus
tcgtcccagtcatggcggctgtaat

SEQ ID NO: 591580 - DNA, 25 bp, Rattus norvegicus
tcgtccccaggacgtcagcagaaga

SEQ ID NO: 591581 - DNA, 25 bp, Rattus norvegicus
tcgtccccaggaggtcagcagaaga

SEQ ID NO: 591582 - DNA, 25 bp, Rattus norvegicus
tcgtccccgagtaaggactcttcaa

SEQ ID NO: 591583 - DNA, 25 bp, Rattus norvegicus
tcgtccccgagttaggactcttcaa

SEQ ID NO: 591584 - DNA, 25 bp, Rattus norvegicus
tcgtcccctcgtaaggcaggaacaa

SEQ ID NO: 591585 - DNA, 25 bp, Rattus norvegicus
tcgtcccctcgttaggcaggaacaa

SEQ ID NO: 591586 - DNA, 25 bp, Rattus norvegicus
tcgtcccgactgacaaatgcaaagt

SEQ ID NO: 591587 - DNA, 25 bp, Rattus norvegicus
tcgtcccgactgtcaaatgcaaagt

SEQ ID NO: 591588 - DNA, 25 bp, Rattus norvegicus
tcgtccctgagacatggcctctgtt

SEQ ID NO: 591589 - DNA, 25 bp, Rattus norvegicus
tcgtccctgagagatggcctctgtt

SEQ ID NO: 591590 - DNA, 25 bp, Rattus norvegicus
tcgtccctggtacagccattggaaa

SEQ ID NO: 591591 - DNA, 25 bp, Rattus norvegicus
tcgtccctggtagagccattggaaa

SEQ ID NO: 591592 - DNA, 25 bp, Rattus norvegicus
tcgtcccttgctaccagataaaatg

SEQ ID NO: 591593 - DNA, 25 bp, Rattus norvegicus
tcgtcccttgcttccagataaaatg

SEQ ID NO: 591594 - DNA, 25 bp, Rattus norvegicus
tcgtccgtagctctggattcttaga

SEQ ID NO: 591595 - DNA, 25 bp, Rattus norvegicus
tcgtccgtagctgtggattcttaga

SEQ ID NO: 591596 - DNA, 25 bp, Rattus norvegicus
tcgtccgtgctcactgtggtggaga

SEQ ID NO: 591597 - DNA, 25 bp, Rattus norvegicus
tcgtccgtgctctctgtggtggaga

SEQ ID NO: 591598 - DNA, 25 bp, Rattus norvegicus
tcgtccgtgcttcagagaattgctc

SEQ ID NO: 591599 - DNA, 25 bp, Rattus norvegicus
tcgtccgtgcttgagagaattgctc

SEQ ID NO: 591600 - DNA, 25 bp, Rattus norvegicus
tcgtccgttccaactggtgacagga

SEQ ID NO: 591601 - DNA, 25 bp, Rattus norvegicus
tcgtccgttccatctggtgacagga

SEQ ID NO: 591602 - DNA, 25 bp, Rattus norvegicus
tcgtccgttcttccgaagcttatca

SEQ ID NO: 591603 - DNA, 25 bp, Rattus norvegicus
tcgtccgttcttgcgaagcttatca

SEQ ID NO: 591604 - DNA, 25 bp, Rattus norvegicus
tcgtcctaggctataccagtgtata

SEQ ID NO: 591605 - DNA, 25 bp, Rattus norvegicus
tcgtcctaggctttaccagtgtata

SEQ ID NO: 591606 - DNA, 25 bp, Rattus norvegicus
tcgtcctcactaaccggcctgtgag

SEQ ID NO: 591607 - DNA, 25 bp, Rattus norvegicus
tcgtcctcactatccggcctgtgag

SEQ ID NO: 591608 - DNA, 25 bp, Rattus norvegicus
tcgtcctccaaacaagatttttcct

SEQ ID NO: 591609 - DNA, 25 bp, Rattus norvegicus
tcgtcctccaaagaagatttttcct

SEQ ID NO: 591610 - DNA, 25 bp, Rattus norvegicus
tcgtcctcgaggcacagggtgaaat

SEQ ID NO: 591611 - DNA, 25 bp, Rattus norvegicus
tcgtcctcgagggacagggtgaaat

SEQ ID NO: 591612 - DNA, 25 bp, Rattus norvegicus
tcgtcctcgtacagctgcatgctct

SEQ ID NO: 591613 - DNA, 25 bp, Rattus norvegicus
tcgtcctcgtactgctgcatgctct

SEQ ID NO: 591614 - DNA, 25 bp, Rattus norvegicus
tcgtcctctctaacatgcttcaaag

SEQ ID NO: 591615 - DNA, 25 bp, Rattus norvegicus
tcgtcctctctatcatgcttcaaag

SEQ ID NO: 591616 - DNA, 25 bp, Rattus norvegicus
tcgtcctgtggacatcagctctaga

SEQ ID NO: 591617 - DNA, 25 bp, Rattus norvegicus
tcgtcctgtggagatcagctctaga

SEQ ID NO: 591618 - DNA, 25 bp, Rattus norvegicus
tcgtcctgtgtcctcattcactaaa

SEQ ID NO: 591619 - DNA, 25 bp, Rattus norvegicus
tcgtcctgtgtcgtcattcactaaa

SEQ ID NO: 591620 - DNA, 25 bp, Rattus norvegicus
tcgtccttcaggctgctcttagcag

SEQ ID NO: 591621 - DNA, 25 bp, Rattus norvegicus
tcgtccttcagggtgctcttagcag

SEQ ID NO: 591622 - DNA, 25 bp, Rattus norvegicus
tcgtccttgagcctagccgcaagtt

SEQ ID NO: 591623 - DNA, 25 bp, Rattus norvegicus
tcgtccttgagcgtagccgcaagtt

SEQ ID NO: 591624 - DNA, 25 bp, Rattus norvegicus
tcgtccttgtgcatgacctgcaaaa

SEQ ID NO: 591625 - DNA, 25 bp, Rattus norvegicus
tcgtccttgtgcttgacctgcaaaa

SEQ ID NO: 591626 - DNA, 25 bp, Rattus norvegicus
tcgtcgaccgccagggacagctgcg

SEQ ID NO: 591627 - DNA, 25 bp, Rattus norvegicus
tcgtcgaccgcctgggacagctgcg

SEQ ID NO: 591628 - DNA, 25 bp, Rattus norvegicus
tcgtcgatgccccagtaggccagct

SEQ ID NO: 591629 - DNA, 25 bp, Rattus norvegicus
tcgtcgatgcccgagtaggccagct

SEQ ID NO: 591630 - DNA, 25 bp, Rattus norvegicus
tcgtcggccttgctctctggccggt

SEQ ID NO: 591631 - DNA, 25 bp, Rattus norvegicus
tcgtcggccttggtctctggccggt

SEQ ID NO: 591632 - DNA, 25 bp, Rattus norvegicus
tcgtcggtgtccacctcgtcggtga

SEQ ID NO: 591633 - DNA, 25 bp, Rattus norvegicus
tcgtcggtgtcctcctcgtcggtga

SEQ ID NO: 591634 - DNA, 25 bp, Rattus norvegicus
tcgtcggttcccagtgcagagtagc

SEQ ID NO: 591635 - DNA, 25 bp, Rattus norvegicus
tcgtcggttccctgtgcagagtagc

SEQ ID NO: 591636 - DNA, 25 bp, Rattus norvegicus
tcgtcgtcataaatttcagccgtcc

SEQ ID NO: 591637 - DNA, 25 bp, Rattus norvegicus
tcgtcgtcataattttcagccgtcc

SEQ ID NO: 591638 - DNA, 25 bp, Rattus norvegicus
tcgtcgtcctcgcaatcctgggtct

SEQ ID NO: 591639 - DNA, 25 bp, Rattus norvegicus
tcgtcgtcctcggaatcctgggtct

SEQ ID NO: 591640 - DNA, 25 bp, Rattus norvegicus
tcgtcgtcctctcctgaagataaaa

SEQ ID NO: 591641 - DNA, 25 bp, Rattus norvegicus
tcgtcgtcctctgctgaagataaaa

SEQ ID NO: 591642 - DNA, 25 bp, Rattus norvegicus
tcgtcgtcgtttatcatggttttca

SEQ ID NO: 591643 - DNA, 25 bp, Rattus norvegicus
tcgtcgtcgtttttcatggttttca

SEQ ID NO: 591644 - DNA, 25 bp, Rattus norvegicus
tcgtcgtgggcaatgtcttcttcat

SEQ ID NO: 591645 - DNA, 25 bp, Rattus norvegicus
tcgtcgtgggcattgtcttcttcat

SEQ ID NO: 591646 - DNA, 25 bp, Rattus norvegicus
tcgtcgttgtttacaatggcctttt

SEQ ID NO: 591647 - DNA, 25 bp, Rattus norvegicus
tcgtcgttgttttcaatggcctttt

SEQ ID NO: 591648 - DNA, 25 bp, Rattus norvegicus
tcgtcgtttcctcttgttagatgct

SEQ ID NO: 591649 - DNA, 25 bp, Rattus norvegicus
tcgtcgtttcctgttgttagatgct

SEQ ID NO: 591650 - DNA, 25 bp, Rattus norvegicus
tcgtcgtttttaccacgggcattct

SEQ ID NO: 591651 - DNA, 25 bp, Rattus norvegicus
tcgtcgtttttagcacgggcattct

SEQ ID NO: 591652 - DNA, 25 bp, Rattus norvegicus
tcgtctcactacaccaggaactggg

SEQ ID NO: 591653 - DNA, 25 bp, Rattus norvegicus
tcgtctcactactccaggaactggg

SEQ ID NO: 591654 - DNA, 25 bp, Rattus norvegicus
tcgtctcagagcaacaggatgacct

SEQ ID NO: 591655 - DNA, 25 bp, Rattus norvegicus
tcgtctcagagctacaggatgacct

SEQ ID NO: 591656 - DNA, 25 bp, Rattus norvegicus
tcgtctcagtctactctgacagaga

SEQ ID NO: 591657 - DNA, 25 bp, Rattus norvegicus
tcgtctcagtcttctctgacagaga

SEQ ID NO: 591658 - DNA, 25 bp, Rattus norvegicus
tcgtctccactgattgttttgcttc

SEQ ID NO: 591659 - DNA, 25 bp, Rattus norvegicus
tcgtctccactgtttgttttgcttc

SEQ ID NO: 591660 - DNA, 25 bp, Rattus norvegicus
tcgtctccatttagcagacacagga

SEQ ID NO: 591661 - DNA, 25 bp, Rattus norvegicus
tcgtctccattttgcagacacagga

SEQ ID NO: 591662 - DNA, 25 bp, Rattus norvegicus
tcgtctccctggaaacagatgcgca

SEQ ID NO: 591663 - DNA, 25 bp, Rattus norvegicus
tcgtctccctggtaacagatgcgca

SEQ ID NO: 591664 - DNA, 25 bp, Rattus norvegicus
tcgtctccgcagacggccgtgtgtg

SEQ ID NO: 591665 - DNA, 25 bp, Rattus norvegicus
tcgtctccgcagtcggccgtgtgtg

SEQ ID NO: 591666 - DNA, 25 bp, Rattus norvegicus
tcgtctcctgcaactctgacttcct

SEQ ID NO: 591667 - DNA, 25 bp, Rattus norvegicus
tcgtctcctgcatctctgacttcct

SEQ ID NO: 591668 - DNA, 25 bp, Rattus norvegicus
tcgtctctacagctggacagtgcat

SEQ ID NO: 591669 - DNA, 25 bp, Rattus norvegicus
tcgtctctacaggtggacagtgcat

SEQ ID NO: 591670 - DNA, 25 bp, Rattus norvegicus
tcgtctctccatcacagctgtgaag

SEQ ID NO: 591671 - DNA, 25 bp, Rattus norvegicus
tcgtctctccatctaatcacgggat

SEQ ID NO: 591672 - DNA, 25 bp, Rattus norvegicus
tcgtctctccatgacagctgtgaag

SEQ ID NO: 591673 - DNA, 25 bp, Rattus norvegicus
tcgtctctccatgtaatcacgggat

SEQ ID NO: 591674 - DNA, 25 bp, Rattus norvegicus
tcgtctctctcgattgtctttgtac

SEQ ID NO: 591675 - DNA, 25 bp, Rattus norvegicus
tcgtctctctcgtttgtctttgtac

SEQ ID NO: 591676 - DNA, 25 bp, Rattus norvegicus
tcgtctctggctatcactggataaa

SEQ ID NO: 591677 - DNA, 25 bp, Rattus norvegicus
tcgtctctggctttcactggataaa

SEQ ID NO: 591678 - DNA, 25 bp, Rattus norvegicus
tcgtctctgtggacagattctgaag

SEQ ID NO: 591679 - DNA, 25 bp, Rattus norvegicus
tcgtctctgtggtcagattctgaag

SEQ ID NO: 591680 - DNA, 25 bp, Rattus norvegicus
tcgtctcttctgagacagtgccaaa

SEQ ID NO: 591681 - DNA, 25 bp, Rattus norvegicus
tcgtctcttctgtgacagtgccaaa

SEQ ID NO: 591682 - DNA, 25 bp, Rattus norvegicus
tcgtctcttcttcttatggttgcaa

SEQ ID NO: 591683 - DNA, 25 bp, Rattus norvegicus
tcgtctcttcttgttatggttgcaa

SEQ ID NO: 591684 - DNA, 25 bp, Rattus norvegicus
tcgtctctttctaatctttttgcat

SEQ ID NO: 591685 - DNA, 25 bp, Rattus norvegicus
tcgtctctttcttatctttttgcat

SEQ ID NO: 591686 - DNA, 25 bp, Rattus norvegicus
tcgtctgacccacaagtatccttct

SEQ ID NO: 591687 - DNA, 25 bp, Rattus norvegicus
tcgtctgacccagaagtatccttct

SEQ ID NO: 591688 - DNA, 25 bp, Rattus norvegicus
tcgtctgatctccgaagctaagcag

SEQ ID NO: 591689 - DNA, 25 bp, Rattus norvegicus
tcgtctgatctcggaagctaagcag

SEQ ID NO: 591690 - DNA, 25 bp, Rattus norvegicus
tcgtctgcaactctgtccatcagaa

SEQ ID NO: 591691 - DNA, 25 bp, Rattus norvegicus
tcgtctgcaactgtgtccatcagaa

SEQ ID NO: 591692 - DNA, 25 bp, Rattus norvegicus
tcgtctgccagacccggcaaagtga

SEQ ID NO: 591693 - DNA, 25 bp, Rattus norvegicus
tcgtctgccagagccggcaaagtga

SEQ ID NO: 591694 - DNA, 25 bp, Rattus norvegicus
tcgtctgccatcattgctcaaaaca

SEQ ID NO: 591695 - DNA, 25 bp, Rattus norvegicus
tcgtctgccatctttgctcaaaaca

SEQ ID NO: 591696 - DNA, 25 bp, Rattus norvegicus
tcgtctgcgttcacattccagaatg

SEQ ID NO: 591697 - DNA, 25 bp, Rattus norvegicus
tcgtctgcgttctcattccagaatg

SEQ ID NO: 591698 - DNA, 25 bp, Rattus norvegicus
tcgtctgctgcgctttgggaagtac

SEQ ID NO: 591699 - DNA, 25 bp, Rattus norvegicus
tcgtctgctgcggtttgggaagtac

SEQ ID NO: 591700 - DNA, 25 bp, Rattus norvegicus
tcgtctgtactgcagctcttggtgc

SEQ ID NO: 591701 - DNA, 25 bp, Rattus norvegicus
tcgtctgtactggagctcttggtgc

SEQ ID NO: 591702 - DNA, 25 bp, Rattus norvegicus
tcgtctgtagaaaatgtgaacctcc

SEQ ID NO: 591703 - DNA, 25 bp, Rattus norvegicus
tcgtctgtagaatatgtgaacctcc

SEQ ID NO: 591704 - DNA, 25 bp, Rattus norvegicus
tcgtctgtcgtcagatctcacaaaa

SEQ ID NO: 591705 - DNA, 25 bp, Rattus norvegicus
tcgtctgtcgtctgatctcacaaaa

SEQ ID NO: 591706 - DNA, 25 bp, Rattus norvegicus
tcgtctgtgccaacaatagttcttg

SEQ ID NO: 591707 - DNA, 25 bp, Rattus norvegicus
tcgtctgtgccatcaatagttcttg

SEQ ID NO: 591708 - DNA, 25 bp, Rattus norvegicus
tcgtctgtggacattgctctttcaa

SEQ ID NO: 591709 - DNA, 25 bp, Rattus norvegicus
tcgtctgtggactttgctctttcaa

SEQ ID NO: 591710 - DNA, 25 bp, Rattus norvegicus
tcgtctgtgggtctaaggcttgctt

SEQ ID NO: 591711 - DNA, 25 bp, Rattus norvegicus
tcgtctgtgggtgtaaggcttgctt

SEQ ID NO: 591712 - DNA, 25 bp, Rattus norvegicus
tcgtctgtgtgtccactcccagcaa

SEQ ID NO: 591713 - DNA, 25 bp, Rattus norvegicus
tcgtctgtgtgtgcactcccagcaa

SEQ ID NO: 591714 - DNA, 25 bp, Rattus norvegicus
tcgtcttaagtgcttcagtcttttg

SEQ ID NO: 591715 - DNA, 25 bp, Rattus norvegicus
tcgtcttaagtggttcagtcttttg

SEQ ID NO: 591716 - DNA, 25 bp, Rattus norvegicus
tcgtcttccgtgagctttgaatttt

SEQ ID NO: 591717 - DNA, 25 bp, Rattus norvegicus
tcgtcttccgtgtgctttgaatttt

SEQ ID NO: 591718 - DNA, 25 bp, Rattus norvegicus
tcgtcttcgatgataaccagtttct

SEQ ID NO: 591719 - DNA, 25 bp, Rattus norvegicus
tcgtcttcgatgttaaccagtttct

SEQ ID NO: 591720 - DNA, 25 bp, Rattus norvegicus
tcgtctttcattctgtgccgagaaa

SEQ ID NO: 591721 - DNA, 25 bp, Rattus norvegicus
tcgtctttcattgtgtgccgagaaa

SEQ ID NO: 591722 - DNA, 25 bp, Rattus norvegicus
tcgtctttctccctggtaaaactgg

SEQ ID NO: 591723 - DNA, 25 bp, Rattus norvegicus
tcgtctttctccgtggtaaaactgg

SEQ ID NO: 591724 - DNA, 25 bp, Rattus norvegicus
tcgtgaagctgaccctctgctattc

SEQ ID NO: 591725 - DNA, 25 bp, Rattus norvegicus
tcgtgaagctgagcctctgctattc

SEQ ID NO: 591726 - DNA, 25 bp, Rattus norvegicus
tcgtgaaggcacagcggacgttcct

SEQ ID NO: 591727 - DNA, 25 bp, Rattus norvegicus
tcgtgaaggcactgcggacgttcct

SEQ ID NO: 591728 - DNA, 25 bp, Rattus norvegicus
tcgtgaccttaacaatgctgatgct

SEQ ID NO: 591729 - DNA, 25 bp, Rattus norvegicus
tcgtgaccttaagaatgctgatgct

SEQ ID NO: 591730 - DNA, 25 bp, Rattus norvegicus
tcgtgacgtgcaccgctagccaatg

SEQ ID NO: 591731 - DNA, 25 bp, Rattus norvegicus
tcgtgacgtgcagcgctagccaatg

SEQ ID NO: 591732 - DNA, 25 bp, Rattus norvegicus
tcgtgactaaaaataacttcccaga

SEQ ID NO: 591733 - DNA, 25 bp, Rattus norvegicus
tcgtgactaaaattaacttcccaga

SEQ ID NO: 591734 - DNA, 25 bp, Rattus norvegicus
tcgtgactaaccatgcgagtgtgta

SEQ ID NO: 591735 - DNA, 25 bp, Rattus norvegicus
tcgtgactaaccttgcgagtgtgta

SEQ ID NO: 591736 - DNA, 25 bp, Rattus norvegicus
tcgtgactcagaccataggcctgga

SEQ ID NO: 591737 - DNA, 25 bp, Rattus norvegicus
tcgtgactcagagcataggcctgga

SEQ ID NO: 591738 - DNA, 25 bp, Rattus norvegicus
tcgtgactgtgtccgtgtttttgta

SEQ ID NO: 591739 - DNA, 25 bp, Rattus norvegicus
tcgtgactgtgtgcgtgtttttgta

SEQ ID NO: 591740 - DNA, 25 bp, Rattus norvegicus
tcgtgacttccaaccctgctgaatg

SEQ ID NO: 591741 - DNA, 25 bp, Rattus norvegicus
tcgtgacttccatccctgctgaatg

SEQ ID NO: 591742 - DNA, 25 bp, Rattus norvegicus
tcgtgacttgccctggttgccagaa

SEQ ID NO: 591743 - DNA, 25 bp, Rattus norvegicus
tcgtgacttgccgtggttgccagaa

SEQ ID NO: 591744 - DNA, 25 bp, Rattus norvegicus
tcgtgacttgtaatgttccttaatc

SEQ ID NO: 591745 - DNA, 25 bp, Rattus norvegicus
tcgtgacttgtattgttccttaatc

SEQ ID NO: 591746 - DNA, 25 bp, Rattus norvegicus
tcgtgagatcttctgaactgacctt

SEQ ID NO: 591747 - DNA, 25 bp, Rattus norvegicus
tcgtgagatcttgtgaactgacctt

SEQ ID NO: 591748 - DNA, 25 bp, Rattus norvegicus
tcgtgagcagagaccgtcctggagt

SEQ ID NO: 591749 - DNA, 25 bp, Rattus norvegicus
tcgtgagcagagtccgtcctggagt

SEQ ID NO: 591750 - DNA, 25 bp, Rattus norvegicus
tcgtgagcctctattctgtgaatat

SEQ ID NO: 591751 - DNA, 25 bp, Rattus norvegicus
tcgtgagcctcttttctgtgaatat

SEQ ID NO: 591752 - DNA, 25 bp, Rattus norvegicus
tcgtgagctggaccgctatgacgtt

SEQ ID NO: 591753 - DNA, 25 bp, Rattus norvegicus
tcgtgagctggagcgctatgacgtt

SEQ ID NO: 591754 - DNA, 25 bp, Rattus norvegicus
tcgtgagtacacctggagtctccac

SEQ ID NO: 591755 - DNA, 25 bp, Rattus norvegicus
tcgtgagtacacgtggagtctccac

SEQ ID NO: 591756 - DNA, 25 bp, Rattus norvegicus
tcgtgatccgggacaggatggtctc

SEQ ID NO: 591757 - DNA, 25 bp, Rattus norvegicus
tcgtgatccgggtcaggatggtctc

SEQ ID NO: 591758 - DNA, 25 bp, Rattus norvegicus
tcgtgatggctcaagtatggctttt

SEQ ID NO: 591759 - DNA, 25 bp, Rattus norvegicus
tcgtgatggctctagtatggctttt

SEQ ID NO: 591760 - DNA, 25 bp, Rattus norvegicus
tcgtgatgtgtacaagctgcctcca

SEQ ID NO: 591761 - DNA, 25 bp, Rattus norvegicus
tcgtgatgtgtagaagctgcctcca

SEQ ID NO: 591762 - DNA, 25 bp, Rattus norvegicus
tcgtgatgtgttccttttccttgct

SEQ ID NO: 591763 - DNA, 25 bp, Rattus norvegicus
tcgtgatgtgttgcttttccttgct

SEQ ID NO: 591764 - DNA, 25 bp, Rattus norvegicus
tcgtgattcctgatttgtaacaaaa

SEQ ID NO: 591765 - DNA, 25 bp, Rattus norvegicus
tcgtgattcctgttttgtaacaaaa

SEQ ID NO: 591766 - DNA, 25 bp, Rattus norvegicus
tcgtgattcgagatgctgagatgct

SEQ ID NO: 591767 - DNA, 25 bp, Rattus norvegicus
tcgtgattcgagttgctgagatgct

SEQ ID NO: 591768 - DNA, 25 bp, Rattus norvegicus
tcgtgattgacacttccaggtgctt

SEQ ID NO: 591769 - DNA, 25 bp, Rattus norvegicus
tcgtgattgacagttccaggtgctt

SEQ ID NO: 591770 - DNA, 25 bp, Rattus norvegicus
tcgtgcaggtggatctcgtaagaat

SEQ ID NO: 591771 - DNA, 25 bp, Rattus norvegicus
tcgtgcaggtggttctcgtaagaat

SEQ ID NO: 591772 - DNA, 25 bp, Rattus norvegicus
tcgtgcatcggcagctggaactgag

SEQ ID NO: 591773 - DNA, 25 bp, Rattus norvegicus
tcgtgcatcggctgctggaactgag

SEQ ID NO: 591774 - DNA, 25 bp, Rattus norvegicus
tcgtgcatgaggatctccatttgat

SEQ ID NO: 591775 - DNA, 25 bp, Rattus norvegicus
tcgtgcatgaggttctccatttgat

SEQ ID NO: 591776 - DNA, 25 bp, Rattus norvegicus
tcgtgccctggaaggtgcatacatt

SEQ ID NO: 591777 - DNA, 25 bp, Rattus norvegicus
tcgtgccctggatggtgcatacatt

SEQ ID NO: 591778 - DNA, 25 bp, Rattus norvegicus
tcgtgcctcctaagaaaagccatgc

SEQ ID NO: 591779 - DNA, 25 bp, Rattus norvegicus
tcgtgcctcctatgaaaagccatgc

SEQ ID NO: 591780 - DNA, 25 bp, Rattus norvegicus
tcgtgcctgcagagttgtgacaagc

SEQ ID NO: 591781 - DNA, 25 bp, Rattus norvegicus
tcgtgcctgcagtgttgtgacaagc

SEQ ID NO: 591782 - DNA, 25 bp, Rattus norvegicus
tcgtgcgagctgcatgtcattttca

SEQ ID NO: 591783 - DNA, 25 bp, Rattus norvegicus
tcgtgcgagctggatgtcattttca

SEQ ID NO: 591784 - DNA, 25 bp, Rattus norvegicus
tcgtgcgcaccaaactggtctacag

SEQ ID NO: 591785 - DNA, 25 bp, Rattus norvegicus
tcgtgcgcaccatactggtctacag

SEQ ID NO: 591786 - DNA, 25 bp, Rattus norvegicus
tcgtgcggctcactgatgagttcta

SEQ ID NO: 591787 - DNA, 25 bp, Rattus norvegicus
tcgtgcggctcagtgatgagttcta

SEQ ID NO: 591788 - DNA, 25 bp, Rattus norvegicus
tcgtgctaaacgatgtcgggctgaa

SEQ ID NO: 591789 - DNA, 25 bp, Rattus norvegicus
tcgtgctaaacgttgtcgggctgaa

SEQ ID NO: 591790 - DNA, 25 bp, Rattus norvegicus
tcgtgctacgcactcatcgaggagc

SEQ ID NO: 591791 - DNA, 25 bp, Rattus norvegicus
tcgtgctacgcagtcatcgaggagc

SEQ ID NO: 591792 - DNA, 25 bp, Rattus norvegicus
tcgtgctcaactcgaggtgtccgcg

SEQ ID NO: 591793 - DNA, 25 bp, Rattus norvegicus
tcgtgctcaactggaggtgtccgcg

SEQ ID NO: 591794 - DNA, 25 bp, Rattus norvegicus
tcgtgctcctaacgacctcgatgaa

SEQ ID NO: 591795 - DNA, 25 bp, Rattus norvegicus
tcgtgctcctaaggacctcgatgaa

SEQ ID NO: 591796 - DNA, 25 bp, Rattus norvegicus
tcgtgctctcttagctggaggtatt

SEQ ID NO: 591797 - DNA, 25 bp, Rattus norvegicus
tcgtgctctctttgctggaggtatt

SEQ ID NO: 591798 - DNA, 25 bp, Rattus norvegicus
tcgtgctggcgcactacgacaggca

SEQ ID NO: 591799 - DNA, 25 bp, Rattus norvegicus
tcgtgctggcgctctacgacaggca

SEQ ID NO: 591800 - DNA, 25 bp, Rattus norvegicus
tcgtgctgggcaacatcatcatcat

SEQ ID NO: 591801 - DNA, 25 bp, Rattus norvegicus
tcgtgctgggcatcatcatcatcat

SEQ ID NO: 591802 - DNA, 25 bp, Rattus norvegicus
tcgtgctgtagcctttgcagaacca

SEQ ID NO: 591803 - DNA, 25 bp, Rattus norvegicus
tcgtgctgtagcgtttgcagaacca

SEQ ID NO: 591804 - DNA, 25 bp, Rattus norvegicus
tcgtgcttactaaggagcctttaaa

SEQ ID NO: 591805 - DNA, 25 bp, Rattus norvegicus
tcgtgcttactatggagcctttaaa

SEQ ID NO: 591806 - DNA, 25 bp, Rattus norvegicus
tcgtgcttgcggcttgagatgtaaa

SEQ ID NO: 591807 - DNA, 25 bp, Rattus norvegicus
tcgtgcttgcgggttgagatgtaaa

SEQ ID NO: 591808 - DNA, 25 bp, Rattus norvegicus
tcgtggacatccctgtagagttcaa

SEQ ID NO: 591809 - DNA, 25 bp, Rattus norvegicus
tcgtggacatccgtgtagagttcaa

SEQ ID NO: 591810 - DNA, 25 bp, Rattus norvegicus
tcgtggacattacagctgcagtttt

SEQ ID NO: 591811 - DNA, 25 bp, Rattus norvegicus
tcgtggacattagagctgcagtttt

SEQ ID NO: 591812 - DNA, 25 bp, Rattus norvegicus
tcgtggacctgaaccccgacagtga

SEQ ID NO: 591813 - DNA, 25 bp, Rattus norvegicus
tcgtggacctgatccccgacagtga

SEQ ID NO: 591814 - DNA, 25 bp, Rattus norvegicus
tcgtggaggatgaggacgccttcat

SEQ ID NO: 591815 - DNA, 25 bp, Rattus norvegicus
tcgtggaggatgtggacgccttcat

SEQ ID NO: 591816 - DNA, 25 bp, Rattus norvegicus
tcgtggagtgcgacagagacctctc

SEQ ID NO: 591817 - DNA, 25 bp, Rattus norvegicus
tcgtggagtgcgtcagagacctctc

SEQ ID NO: 591818 - DNA, 25 bp, Rattus norvegicus
tcgtggattcgcatgagcccttggg

SEQ ID NO: 591819 - DNA, 25 bp, Rattus norvegicus
tcgtggattcgcttgagcccttggg

SEQ ID NO: 591820 - DNA, 25 bp, Rattus norvegicus
tcgtggattcggaactttagcattc

SEQ ID NO: 591821 - DNA, 25 bp, Rattus norvegicus
tcgtggattcggtactttagcattc

SEQ ID NO: 591822 - DNA, 25 bp, Rattus norvegicus
tcgtggcccgggacaacgagacagt

SEQ ID NO: 591823 - DNA, 25 bp, Rattus norvegicus
tcgtggcccgggtcaacgagacagt

SEQ ID NO: 591824 - DNA, 25 bp, Rattus norvegicus
tcgtggcgagtgcatctactgtgtt

SEQ ID NO: 591825 - DNA, 25 bp, Rattus norvegicus
tcgtggcgagtggatctactgtgtt

SEQ ID NO: 591826 - DNA, 25 bp, Rattus norvegicus
tcgtggcgctttcaggaaccggaaa

SEQ ID NO: 591827 - DNA, 25 bp, Rattus norvegicus
tcgtggcgctttgaggaaccggaaa

SEQ ID NO: 591828 - DNA, 25 bp, Rattus norvegicus
tcgtgggactcaatggaagcttaca

SEQ ID NO: 591829 - DNA, 25 bp, Rattus norvegicus
tcgtgggactcattggaagcttaca

SEQ ID NO: 591830 - DNA, 25 bp, Rattus norvegicus
tcgtgggatgtcatgcatttgagca

SEQ ID NO: 591831 - DNA, 25 bp, Rattus norvegicus
tcgtgggatgtcttgcatttgagca

SEQ ID NO: 591832 - DNA, 25 bp, Rattus norvegicus
tcgtgggcagatacaagtctcgcaa

SEQ ID NO: 591833 - DNA, 25 bp, Rattus norvegicus
tcgtgggcagattcaagtctcgcaa

SEQ ID NO: 591834 - DNA, 25 bp, Rattus norvegicus
tcgtgggcatcgcagtgctcttgta

SEQ ID NO: 591835 - DNA, 25 bp, Rattus norvegicus
tcgtgggcatcggagtgctcttgta

SEQ ID NO: 591836 - DNA, 25 bp, Rattus norvegicus
tcgtgggccagcatgaagccgtcaa

SEQ ID NO: 591837 - DNA, 25 bp, Rattus norvegicus
tcgtgggccagcttgaagccgtcaa

SEQ ID NO: 591838 - DNA, 25 bp, Rattus norvegicus
tcgtgggctcggaagctaatgtctt

SEQ ID NO: 591839 - DNA, 25 bp, Rattus norvegicus
tcgtgggctcggtagctaatgtctt

SEQ ID NO: 591840 - DNA, 25 bp, Rattus norvegicus
tcgtgggctgcactgtgtttgcctc

SEQ ID NO: 591841 - DNA, 25 bp, Rattus norvegicus
tcgtgggctgcagtgtgtttgcctc

SEQ ID NO: 591842 - DNA, 25 bp, Rattus norvegicus
tcgtgggtcttgagccgccgataga

SEQ ID NO: 591843 - DNA, 25 bp, Rattus norvegicus
tcgtgggtcttgtgccgccgataga

SEQ ID NO: 591844 - DNA, 25 bp, Rattus norvegicus
tcgtggtacctcaggttgaccagca

SEQ ID NO: 591845 - DNA, 25 bp, Rattus norvegicus
tcgtggtacctcattcttgtttata

SEQ ID NO: 591846 - DNA, 25 bp, Rattus norvegicus
tcgtggtacctctggttgaccagca

SEQ ID NO: 591847 - DNA, 25 bp, Rattus norvegicus
tcgtggtacctctttcttgtttata

SEQ ID NO: 591848 - DNA, 25 bp, Rattus norvegicus
tcgtggtgcactaaaccgggcgctt

SEQ ID NO: 591849 - DNA, 25 bp, Rattus norvegicus
tcgtggtgcacttaaccgggcgctt

SEQ ID NO: 591850 - DNA, 25 bp, Rattus norvegicus
tcgtggtgctgccattcatgaccat

SEQ ID NO: 591851 - DNA, 25 bp, Rattus norvegicus
tcgtggtgctgcgattcatgaccat

SEQ ID NO: 591852 - DNA, 25 bp, Rattus norvegicus
tcgtggtggcaaacatgactcccaa

SEQ ID NO: 591853 - DNA, 25 bp, Rattus norvegicus
tcgtggtggcaatcatgactcccaa

SEQ ID NO: 591854 - DNA, 25 bp, Rattus norvegicus
tcgtggtgttggactagcttagttc

SEQ ID NO: 591855 - DNA, 25 bp, Rattus norvegicus
tcgtggtgttggtctagcttagttc

SEQ ID NO: 591856 - DNA, 25 bp, Rattus norvegicus
tcgtggttcacccagaattgagcta

SEQ ID NO: 591857 - DNA, 25 bp, Rattus norvegicus
tcgtggttcaccgagaattgagcta

SEQ ID NO: 591858 - DNA, 25 bp, Rattus norvegicus
tcgtgtaaatttcctctgcttctta

SEQ ID NO: 591859 - DNA, 25 bp, Rattus norvegicus
tcgtgtaaatttgctctgcttctta

SEQ ID NO: 591860 - DNA, 25 bp, Rattus norvegicus
tcgtgtacaagtcacctgtggtgtc

SEQ ID NO: 591861 - DNA, 25 bp, Rattus norvegicus
tcgtgtacaagtgacctgtggtgtc

SEQ ID NO: 591862 - DNA, 25 bp, Rattus norvegicus
tcgtgtacatatccccacgcagggc

SEQ ID NO: 591863 - DNA, 25 bp, Rattus norvegicus
tcgtgtacatatgcccacgcagggc

SEQ ID NO: 591864 - DNA, 25 bp, Rattus norvegicus
tcgtgtaccacacaggacaccggct

SEQ ID NO: 591865 - DNA, 25 bp, Rattus norvegicus
tcgtgtaccacagaggacaccggct

SEQ ID NO: 591866 - DNA, 25 bp, Rattus norvegicus
tcgtgtacgctcctatgaagttcca

SEQ ID NO: 591867 - DNA, 25 bp, Rattus norvegicus
tcgtgtacgctcgtatgaagttcca

SEQ ID NO: 591868 - DNA, 25 bp, Rattus norvegicus
tcgtgtagctgacggcgtccttgaa

SEQ ID NO: 591869 - DNA, 25 bp, Rattus norvegicus
tcgtgtagctgagggcgtccttgaa

SEQ ID NO: 591870 - DNA, 25 bp, Rattus norvegicus
tcgtgtcaccgcactgtaggagtca

SEQ ID NO: 591871 - DNA, 25 bp, Rattus norvegicus
tcgtgtcaccgctctgtaggagtca

SEQ ID NO: 591872 - DNA, 25 bp, Rattus norvegicus
tcgtgtcccacaagagtgagaccat

SEQ ID NO: 591873 - DNA, 25 bp, Rattus norvegicus
tcgtgtcccacatgagtgagaccat

SEQ ID NO: 591874 - DNA, 25 bp, Rattus norvegicus
tcgtgtccgaggctgactgcaagaa

SEQ ID NO: 591875 - DNA, 25 bp, Rattus norvegicus
tcgtgtccgagggtgactgcaagaa

SEQ ID NO: 591876 - DNA, 25 bp, Rattus norvegicus
tcgtgtccgtgtaccatactgtaaa

SEQ ID NO: 591877 - DNA, 25 bp, Rattus norvegicus
tcgtgtccgtgttccatactgtaaa

SEQ ID NO: 591878 - DNA, 25 bp, Rattus norvegicus
tcgtgtctagctacacatgctgaga

SEQ ID NO: 591879 - DNA, 25 bp, Rattus norvegicus
tcgtgtctagcttcacatgctgaga

SEQ ID NO: 591880 - DNA, 25 bp, Rattus norvegicus
tcgtgtctctgtctggtctgctgtg

SEQ ID NO: 591881 - DNA, 25 bp, Rattus norvegicus
tcgtgtctctgtgtggtctgctgtg

SEQ ID NO: 591882 - DNA, 25 bp, Rattus norvegicus
tcgtgtcttttgactgggtgttaat

SEQ ID NO: 591883 - DNA, 25 bp, Rattus norvegicus
tcgtgtcttttgtctgggtgttaat

SEQ ID NO: 591884 - DNA, 25 bp, Rattus norvegicus
tcgtgtgaaatgagattactgggtt

SEQ ID NO: 591885 - DNA, 25 bp, Rattus norvegicus
tcgtgtgaaatgtgattactgggtt

SEQ ID NO: 591886 - DNA, 25 bp, Rattus norvegicus
tcgtgtgatttgacctcagctgctt

SEQ ID NO: 591887 - DNA, 25 bp, Rattus norvegicus
tcgtgtgatttgtcctcagctgctt

SEQ ID NO: 591888 - DNA, 25 bp, Rattus norvegicus
tcgtgtgcacaacccttaggattcg

SEQ ID NO: 591889 - DNA, 25 bp, Rattus norvegicus
tcgtgtgcacaagccttaggattcg

SEQ ID NO: 591890 - DNA, 25 bp, Rattus norvegicus
tcgtgtgcacacatctgggagggaa

SEQ ID NO: 591891 - DNA, 25 bp, Rattus norvegicus
tcgtgtgcacacttctgggagggaa

SEQ ID NO: 591892 - DNA, 25 bp, Rattus norvegicus
tcgtgtgcttctcaggcaacatcag

SEQ ID NO: 591893 - DNA, 25 bp, Rattus norvegicus
tcgtgtgcttctgaggcaacatcag

SEQ ID NO: 591894 - DNA, 25 bp, Rattus norvegicus
tcgtgtgcttgcaacttgagtgaat

SEQ ID NO: 591895 - DNA, 25 bp, Rattus norvegicus
tcgtgtgcttgctacttgagtgaat

SEQ ID NO: 591896 - DNA, 25 bp, Rattus norvegicus
tcgtgtggcacactcggacagagaa

SEQ ID NO: 591897 - DNA, 25 bp, Rattus norvegicus
tcgtgtggcacagtcggacagagaa

SEQ ID NO: 591898 - DNA, 25 bp, Rattus norvegicus
tcgtgtggcaccctgatgaatgttt

SEQ ID NO: 591899 - DNA, 25 bp, Rattus norvegicus
tcgtgtggcaccgtgatgaatgttt

SEQ ID NO: 591900 - DNA, 25 bp, Rattus norvegicus
tcgtgtggcggaacagggcctcaaa

SEQ ID NO: 591901 - DNA, 25 bp, Rattus norvegicus
tcgtgtggcggatcagggcctcaaa

SEQ ID NO: 591902 - DNA, 25 bp, Rattus norvegicus
tcgtgtggcgtgagccccatcagct

SEQ ID NO: 591903 - DNA, 25 bp, Rattus norvegicus
tcgtgtggcgtgtgccccatcagct

SEQ ID NO: 591904 - DNA, 25 bp, Rattus norvegicus
tcgtgtggctatacttgtggatgac

SEQ ID NO: 591905 - DNA, 25 bp, Rattus norvegicus
tcgtgtggctattcttgtggatgac

SEQ ID NO: 591906 - DNA, 25 bp, Rattus norvegicus
tcgtgtgtgagccattttgaagttt

SEQ ID NO: 591907 - DNA, 25 bp, Rattus norvegicus
tcgtgtgtgagcgattttgaagttt

SEQ ID NO: 591908 - DNA, 25 bp, Rattus norvegicus
tcgtgttaatctcctgagttttctt

SEQ ID NO: 591909 - DNA, 25 bp, Rattus norvegicus
tcgtgttaatctgctgagttttctt

SEQ ID NO: 591910 - DNA, 25 bp, Rattus norvegicus
tcgtgttattctcagcttcgatatg

SEQ ID NO: 591911 - DNA, 25 bp, Rattus norvegicus
tcgtgttattctgagcttcgatatg

SEQ ID NO: 591912 - DNA, 25 bp, Rattus norvegicus
tcgtgttcactcagcagatcaacca

SEQ ID NO: 591913 - DNA, 25 bp, Rattus norvegicus
tcgtgttcactctgcagatcaacca

SEQ ID NO: 591914 - DNA, 25 bp, Rattus norvegicus
tcgtgttcccaccataggagtgaca

SEQ ID NO: 591915 - DNA, 25 bp, Rattus norvegicus
tcgtgttcccacgataggagtgaca

SEQ ID NO: 591916 - DNA, 25 bp, Rattus norvegicus
tcgtgttcggctacgtagcatgtaa

SEQ ID NO: 591917 - DNA, 25 bp, Rattus norvegicus
tcgtgttcggcttcgtagcatgtaa

SEQ ID NO: 591918 - DNA, 25 bp, Rattus norvegicus
tcgtgttcgtatcttgtttgcttcc

SEQ ID NO: 591919 - DNA, 25 bp, Rattus norvegicus
tcgtgttcgtatgttgtttgcttcc

SEQ ID NO: 591920 - DNA, 25 bp, Rattus norvegicus
tcgtgttctcctatatcaatgcttg

SEQ ID NO: 591921 - DNA, 25 bp, Rattus norvegicus
tcgtgttctcctttatcaatgcttg

SEQ ID NO: 591922 - DNA, 25 bp, Rattus norvegicus
tcgtgttctgccagacttgttagaa

SEQ ID NO: 591923 - DNA, 25 bp, Rattus norvegicus
tcgtgttctgcctgacttgttagaa

SEQ ID NO: 591924 - DNA, 25 bp, Rattus norvegicus
tcgtgttctggaaacgtgtcttgaa

SEQ ID NO: 591925 - DNA, 25 bp, Rattus norvegicus
tcgtgttctggatacgtgtcttgaa

SEQ ID NO: 591926 - DNA, 25 bp, Rattus norvegicus
tcgtgttcttccagtttgttgtaat

SEQ ID NO: 591927 - DNA, 25 bp, Rattus norvegicus
tcgtgttcttcctgtttgttgtaat

SEQ ID NO: 591928 - DNA, 25 bp, Rattus norvegicus
tcgtgttgaactctggactggtatt

SEQ ID NO: 591929 - DNA, 25 bp, Rattus norvegicus
tcgtgttgaactgtggactggtatt

SEQ ID NO: 591930 - DNA, 25 bp, Rattus norvegicus
tcgtgttgccacagttagtagtcat

SEQ ID NO: 591931 - DNA, 25 bp, Rattus norvegicus
tcgtgttgccactgttagtagtcat

SEQ ID NO: 591932 - DNA, 25 bp, Rattus norvegicus
tcgtgtttttacctgcatgtgggca

SEQ ID NO: 591933 - DNA, 25 bp, Rattus norvegicus
tcgtgtttttacgtgcatgtgggca

SEQ ID NO: 591934 - DNA, 25 bp, Rattus norvegicus
tcgttaacatttcacttctcctgaa

SEQ ID NO: 591935 - DNA, 25 bp, Rattus norvegicus
tcgttaacatttgacttctcctgaa

SEQ ID NO: 591936 - DNA, 25 bp, Rattus norvegicus
tcgttacctaacaccatttatggcc

SEQ ID NO: 591937 - DNA, 25 bp, Rattus norvegicus
tcgttacctaactccatttatggcc

SEQ ID NO: 591938 - DNA, 25 bp, Rattus norvegicus
tcgttacctggcatagtcatctaca

SEQ ID NO: 591939 - DNA, 25 bp, Rattus norvegicus
tcgttacctggcttagtcatctaca

SEQ ID NO: 591940 - DNA, 25 bp, Rattus norvegicus
tcgttagctcgaaaatcagttgact

SEQ ID NO: 591941 - DNA, 25 bp, Rattus norvegicus
tcgttagctcgataatcagttgact

SEQ ID NO: 591942 - DNA, 25 bp, Rattus norvegicus
tcgttaggactgatgcccctgcaaa

SEQ ID NO: 591943 - DNA, 25 bp, Rattus norvegicus
tcgttaggactgttgcccctgcaaa

SEQ ID NO: 591944 - DNA, 25 bp, Rattus norvegicus
tcgttagggatgatgcagtctgcaa

SEQ ID NO: 591945 - DNA, 25 bp, Rattus norvegicus
tcgttagggatgttgcagtctgcaa

SEQ ID NO: 591946 - DNA, 25 bp, Rattus norvegicus
tcgttatctctcaccaggctgtcat

SEQ ID NO: 591947 - DNA, 25 bp, Rattus norvegicus
tcgttatctctctccaggctgtcat

SEQ ID NO: 591948 - DNA, 25 bp, Rattus norvegicus
tcgttattcgatcgtcactgcttgt

SEQ ID NO: 591949 - DNA, 25 bp, Rattus norvegicus
tcgttattcgatggtcactgcttgt

SEQ ID NO: 591950 - DNA, 25 bp, Rattus norvegicus
tcgttattttgtactgcaggaaaga

SEQ ID NO: 591951 - DNA, 25 bp, Rattus norvegicus
tcgttattttgttctgcaggaaaga

SEQ ID NO: 591952 - DNA, 25 bp, Rattus norvegicus
tcgttcaaaatgcattgatggtcac

SEQ ID NO: 591953 - DNA, 25 bp, Rattus norvegicus
tcgttcaaaatggattgatggtcac

SEQ ID NO: 591954 - DNA, 25 bp, Rattus norvegicus
tcgttcacagatacatacatgcagg

SEQ ID NO: 591955 - DNA, 25 bp, Rattus norvegicus
tcgttcacagattcatacatgcagg

SEQ ID NO: 591956 - DNA, 25 bp, Rattus norvegicus
tcgttcacagcaaccagtgagtcag

SEQ ID NO: 591957 - DNA, 25 bp, Rattus norvegicus
tcgttcacagcatccagtgagtcag

SEQ ID NO: 591958 - DNA, 25 bp, Rattus norvegicus
tcgttcaccactctatgtccaggaa

SEQ ID NO: 591959 - DNA, 25 bp, Rattus norvegicus
tcgttcaccactgtatgtccaggaa

SEQ ID NO: 591960 - DNA, 25 bp, Rattus norvegicus
tcgttcactcatcgaaaatagcgat

SEQ ID NO: 591961 - DNA, 25 bp, Rattus norvegicus
tcgttcactcatggaaaatagcgat

SEQ ID NO: 591962 - DNA, 25 bp, Rattus norvegicus
tcgttcactgccaacggtcctcgga

SEQ ID NO: 591963 - DNA, 25 bp, Rattus norvegicus
tcgttcactgcctacggtcctcgga

SEQ ID NO: 591964 - DNA, 25 bp, Rattus norvegicus
tcgttcagattcatggtgcccgcca

SEQ ID NO: 591965 - DNA, 25 bp, Rattus norvegicus
tcgttcagattcttggtgcccgcca

SEQ ID NO: 591966 - DNA, 25 bp, Rattus norvegicus
tcgttcatccctcagtgttgtcata

SEQ ID NO: 591967 - DNA, 25 bp, Rattus norvegicus
tcgttcatccctgagtgttgtcata

SEQ ID NO: 591968 - DNA, 25 bp, Rattus norvegicus
tcgttcatgaagacacatctgctct

SEQ ID NO: 591969 - DNA, 25 bp, Rattus norvegicus
tcgttcatgaagtcacatctgctct

SEQ ID NO: 591970 - DNA, 25 bp, Rattus norvegicus
tcgttcatgtctatcctagtcagag

SEQ ID NO: 591971 - DNA, 25 bp, Rattus norvegicus
tcgttcatgtctttcctagtcagag

SEQ ID NO: 591972 - DNA, 25 bp, Rattus norvegicus
tcgttccaaccccagtgattgaaga

SEQ ID NO: 591973 - DNA, 25 bp, Rattus norvegicus
tcgttccaacccgagtgattgaaga

SEQ ID NO: 591974 - DNA, 25 bp, Rattus norvegicus
tcgttccattttccttgcttatgag

SEQ ID NO: 591975 - DNA, 25 bp, Rattus norvegicus
tcgttccattttgcttgcttatgag

SEQ ID NO: 591976 - DNA, 25 bp, Rattus norvegicus
tcgttcccaagaccgactcgttaat

SEQ ID NO: 591977 - DNA, 25 bp, Rattus norvegicus
tcgttcccaagagcgactcgttaat

SEQ ID NO: 591978 - DNA, 25 bp, Rattus norvegicus
tcgttccccttgaattatatatcag

SEQ ID NO: 591979 - DNA, 25 bp, Rattus norvegicus
tcgttccccttgtattatatatcag

SEQ ID NO: 591980 - DNA, 25 bp, Rattus norvegicus
tcgttccctctcagctgaggtggaa

SEQ ID NO: 591981 - DNA, 25 bp, Rattus norvegicus
tcgttccctctctgctgaggtggaa

SEQ ID NO: 591982 - DNA, 25 bp, Rattus norvegicus
tcgttccctgtgcttagtcatgaga

SEQ ID NO: 591983 - DNA, 25 bp, Rattus norvegicus
tcgttccctgtggttagtcatgaga

SEQ ID NO: 591984 - DNA, 25 bp, Rattus norvegicus
tcgttcccttggcacccctggtgaa

SEQ ID NO: 591985 - DNA, 25 bp, Rattus norvegicus
tcgttcccttgggacccctggtgaa

SEQ ID NO: 591986 - DNA, 25 bp, Rattus norvegicus
tcgttcggagtcactaaggcccaca

SEQ ID NO: 591987 - DNA, 25 bp, Rattus norvegicus
tcgttcggagtctctaaggcccaca

SEQ ID NO: 591988 - DNA, 25 bp, Rattus norvegicus
tcgttcggttccaaactgtgatgat

SEQ ID NO: 591989 - DNA, 25 bp, Rattus norvegicus
tcgttcggttcctaactgtgatgat

SEQ ID NO: 591990 - DNA, 25 bp, Rattus norvegicus
tcgttctatatgactaccagcggct

SEQ ID NO: 591991 - DNA, 25 bp, Rattus norvegicus
tcgttctatatgtctaccagcggct

SEQ ID NO: 591992 - DNA, 25 bp, Rattus norvegicus
tcgttctcaccaagctggcagatat

SEQ ID NO: 591993 - DNA, 25 bp, Rattus norvegicus
tcgttctcaccatgctggcagatat

SEQ ID NO: 591994 - DNA, 25 bp, Rattus norvegicus
tcgttctcagtcacggttgagcatg

SEQ ID NO: 591995 - DNA, 25 bp, Rattus norvegicus
tcgttctcagtctcggttgagcatg

SEQ ID NO: 591996 - DNA, 25 bp, Rattus norvegicus
tcgttctggctcataaggtcaccac

SEQ ID NO: 591997 - DNA, 25 bp, Rattus norvegicus
tcgttctggctcttaaggtcaccac

SEQ ID NO: 591998 - DNA, 25 bp, Rattus norvegicus
tcgttcttggagatacacctaattg

SEQ ID NO: 591999 - DNA, 25 bp, Rattus norvegicus
tcgttcttggagttacacctaattg

SEQ ID NO: 592000 - DNA, 25 bp, Rattus norvegicus
tcgttgaagtagctgacctccgtac

SEQ ID NO: 592001 - DNA, 25 bp, Rattus norvegicus
tcgttgaagtaggtgacctccgtac

SEQ ID NO: 592002 - DNA, 25 bp, Rattus norvegicus
tcgttgacatcaacagacacaccca

SEQ ID NO: 592003 - DNA, 25 bp, Rattus norvegicus
tcgttgacatcatcagacacaccca

SEQ ID NO: 592004 - DNA, 25 bp, Rattus norvegicus
tcgttgacgccgaagtggcccagca

SEQ ID NO: 592005 - DNA, 25 bp, Rattus norvegicus
tcgttgacgccgtagtggcccagca

SEQ ID NO: 592006 - DNA, 25 bp, Rattus norvegicus
tcgttgacgttgcatctctagacct

SEQ ID NO: 592007 - DNA, 25 bp, Rattus norvegicus
tcgttgacgttggatctctagacct

SEQ ID NO: 592008 - DNA, 25 bp, Rattus norvegicus
tcgttgatctatcagttgacccgct

SEQ ID NO: 592009 - DNA, 25 bp, Rattus norvegicus
tcgttgatctatgagttgacccgct

SEQ ID NO: 592010 - DNA, 25 bp, Rattus norvegicus
tcgttgcagtggcacatctttcagt

SEQ ID NO: 592011 - DNA, 25 bp, Rattus norvegicus
tcgttgcagtgggacatctttcagt

SEQ ID NO: 592012 - DNA, 25 bp, Rattus norvegicus
tcgttgccttggcacctatctgatt

SEQ ID NO: 592013 - DNA, 25 bp, Rattus norvegicus
tcgttgccttgggacctatctgatt

SEQ ID NO: 592014 - DNA, 25 bp, Rattus norvegicus
tcgttgctcgctaccgtgttctggg

SEQ ID NO: 592015 - DNA, 25 bp, Rattus norvegicus
tcgttgctcgcttccgtgttctggg

SEQ ID NO: 592016 - DNA, 25 bp, Rattus norvegicus
tcgttgctgacaacctgaggacagt

SEQ ID NO: 592017 - DNA, 25 bp, Rattus norvegicus
tcgttgctgacatcctgaggacagt

SEQ ID NO: 592018 - DNA, 25 bp, Rattus norvegicus
tcgttgctgctgatttctctttaaa

SEQ ID NO: 592019 - DNA, 25 bp, Rattus norvegicus
tcgttgctgctgttttctctttaaa

SEQ ID NO: 592020 - DNA, 25 bp, Rattus norvegicus
tcgttgcttggaattctgacataat

SEQ ID NO: 592021 - DNA, 25 bp, Rattus norvegicus
tcgttgcttggatttctgacataat

SEQ ID NO: 592022 - DNA, 25 bp, Rattus norvegicus
tcgttggaaataacatctgccctaa

SEQ ID NO: 592023 - DNA, 25 bp, Rattus norvegicus
tcgttggaaatatcatctgccctaa

SEQ ID NO: 592024 - DNA, 25 bp, Rattus norvegicus
tcgttgggcgtgatcagtgtacttc

SEQ ID NO: 592025 - DNA, 25 bp, Rattus norvegicus
tcgttgggcgtgttcagtgtacttc

SEQ ID NO: 592026 - DNA, 25 bp, Rattus norvegicus
tcgttgggtggtcgtcagtaccctc

SEQ ID NO: 592027 - DNA, 25 bp, Rattus norvegicus
tcgttgggtggtggtcagtaccctc

SEQ ID NO: 592028 - DNA, 25 bp, Rattus norvegicus
tcgttgtgggatctaacccctttct

SEQ ID NO: 592029 - DNA, 25 bp, Rattus norvegicus
tcgttgtgggatgtaacccctttct

SEQ ID NO: 592030 - DNA, 25 bp, Rattus norvegicus
tcgttgttctgtaccaatggtgaca

SEQ ID NO: 592031 - DNA, 25 bp, Rattus norvegicus
tcgttgttctgttccaatggtgaca

SEQ ID NO: 592032 - DNA, 25 bp, Rattus norvegicus
tcgtttaaaccaactgacgccagat

SEQ ID NO: 592033 - DNA, 25 bp, Rattus norvegicus
tcgtttaaaccatctgacgccagat

SEQ ID NO: 592034 - DNA, 25 bp, Rattus norvegicus
tcgtttactctacgcaaaccctcta

SEQ ID NO: 592035 - DNA, 25 bp, Rattus norvegicus
tcgtttactctaggcaaaccctcta

SEQ ID NO: 592036 - DNA, 25 bp, Rattus norvegicus
tcgtttcactcaccgtttacttgga

SEQ ID NO: 592037 - DNA, 25 bp, Rattus norvegicus
tcgtttcactcagcgtttacttgga

SEQ ID NO: 592038 - DNA, 25 bp, Rattus norvegicus
tcgtttcaggatcgaaaacagccaa

SEQ ID NO: 592039 - DNA, 25 bp, Rattus norvegicus
tcgtttcaggatggaaaacagccaa

SEQ ID NO: 592040 - DNA, 25 bp, Rattus norvegicus
tcgtttccactcaactgtttgcaga

SEQ ID NO: 592041 - DNA, 25 bp, Rattus norvegicus
tcgtttccactctactgtttgcaga

SEQ ID NO: 592042 - DNA, 25 bp, Rattus norvegicus
tcgtttctgattcctttcacgggaa

SEQ ID NO: 592043 - DNA, 25 bp, Rattus norvegicus
tcgtttctgattgctttcacgggaa

SEQ ID NO: 592044 - DNA, 25 bp, Rattus norvegicus
tcgtttcttcccacaggactgtaag

SEQ ID NO: 592045 - DNA, 25 bp, Rattus norvegicus
tcgtttcttccctcaggactgtaag

SEQ ID NO: 592046 - DNA, 25 bp, Rattus norvegicus
tcgtttgaagctcaccaatctgaga

SEQ ID NO: 592047 - DNA, 25 bp, Rattus norvegicus
tcgtttgaagctgaccaatctgaga

SEQ ID NO: 592048 - DNA, 25 bp, Rattus norvegicus
tcgtttgccatcattgatcccttgg

SEQ ID NO: 592049 - DNA, 25 bp, Rattus norvegicus
tcgtttgccatctttgatcccttgg

SEQ ID NO: 592050 - DNA, 25 bp, Rattus norvegicus
tcgtttgcggtcaggcctctttctg

SEQ ID NO: 592051 - DNA, 25 bp, Rattus norvegicus
tcgtttgcggtctggcctctttctg

SEQ ID NO: 592052 - DNA, 25 bp, Rattus norvegicus
tcgtttgctgtgaccgcagagcgga

SEQ ID NO: 592053 - DNA, 25 bp, Rattus norvegicus
tcgtttgctgtgtccgcagagcgga

SEQ ID NO: 592054 - DNA, 25 bp, Rattus norvegicus
tcgtttgcttctctcagtccatgaa

SEQ ID NO: 592055 - DNA, 25 bp, Rattus norvegicus
tcgtttgcttctgtcagtccatgaa

SEQ ID NO: 592056 - DNA, 25 bp, Rattus norvegicus
tcgtttgggaggcaagaaagaatct

SEQ ID NO: 592057 - DNA, 25 bp, Rattus norvegicus
tcgtttgggagggaagaaagaatct

SEQ ID NO: 592058 - DNA, 25 bp, Rattus norvegicus
tcgtttgtaagacttttccccagca

SEQ ID NO: 592059 - DNA, 25 bp, Rattus norvegicus
tcgtttgtaagagttttccccagca

SEQ ID NO: 592060 - DNA, 25 bp, Rattus norvegicus
tcgtttgtacctctctccaaaatat

SEQ ID NO: 592061 - DNA, 25 bp, Rattus norvegicus
tcgtttgtacctgtctccaaaatat

SEQ ID NO: 592062 - DNA, 25 bp, Rattus norvegicus
tcgtttgtccctaattgctcggaaa

SEQ ID NO: 592063 - DNA, 25 bp, Rattus norvegicus
tcgtttgtcccttattgctcggaaa

SEQ ID NO: 592064 - DNA, 25 bp, Rattus norvegicus
tcgtttgtgcctactcctttagttt

SEQ ID NO: 592065 - DNA, 25 bp, Rattus norvegicus
tcgtttgtgccttctcctttagttt

SEQ ID NO: 592066 - DNA, 25 bp, Rattus norvegicus
tcgtttgtgtttctctctcaaggga

SEQ ID NO: 592067 - DNA, 25 bp, Rattus norvegicus
tcgtttgtgtttgtctctcaaggga

SEQ ID NO: 592068 - DNA, 25 bp, Rattus norvegicus
tcgtttgttcctccagagttgcttt

SEQ ID NO: 592069 - DNA, 25 bp, Rattus norvegicus
tcgtttgttcctcgtctggatgcaa

SEQ ID NO: 592070 - DNA, 25 bp, Rattus norvegicus
tcgtttgttcctgcagagttgcttt

SEQ ID NO: 592071 - DNA, 25 bp, Rattus norvegicus
tcgtttgttcctggtctggatgcaa

SEQ ID NO: 592072 - DNA, 25 bp, Rattus norvegicus
tcgttttccaaacgctgcgaggatc

SEQ ID NO: 592073 - DNA, 25 bp, Rattus norvegicus
tcgttttccaaaggctgcgaggatc

SEQ ID NO: 592074 - DNA, 25 bp, Rattus norvegicus
tcgttttcctagctcatgagtgcaa

SEQ ID NO: 592075 - DNA, 25 bp, Rattus norvegicus
tcgttttcctaggtcatgagtgcaa

SEQ ID NO: 592076 - DNA, 25 bp, Rattus norvegicus
tcgttttctctacatgtgtgtagac

SEQ ID NO: 592077 - DNA, 25 bp, Rattus norvegicus
tcgttttctctagatgtgtgtagac

SEQ ID NO: 592078 - DNA, 25 bp, Rattus norvegicus
tcgtttttcacaaggcatctggtag

SEQ ID NO: 592079 - DNA, 25 bp, Rattus norvegicus
tcgtttttcacatggcatctggtag

SEQ ID NO: 592080 - DNA, 25 bp, Rattus norvegicus
tcgtttttcactatggctgacccaa

SEQ ID NO: 592081 - DNA, 25 bp, Rattus norvegicus
tcgtttttcactttggctgacccaa

SEQ ID NO: 592082 - DNA, 25 bp, Rattus norvegicus
tcgtttttgccaaactacctctggg

SEQ ID NO: 592083 - DNA, 25 bp, Rattus norvegicus
tcgtttttgccatactacctctggg

SEQ ID NO: 592084 - DNA, 25 bp, Rattus norvegicus
tctaaaaatcccaacgtggcctgta

SEQ ID NO: 592085 - DNA, 25 bp, Rattus norvegicus
tctaaaaatccctacgtggcctgta

SEQ ID NO: 592086 - DNA, 25 bp, Rattus norvegicus
tctaaaaatgatacgctcggccacc

SEQ ID NO: 592087 - DNA, 25 bp, Rattus norvegicus
tctaaaaatgattcgctcggccacc

SEQ ID NO: 592088 - DNA, 25 bp, Rattus norvegicus
tctaaaaccagccatcaagacaggg

SEQ ID NO: 592089 - DNA, 25 bp, Rattus norvegicus
tctaaaaccagcgatcaagacaggg

SEQ ID NO: 592090 - DNA, 25 bp, Rattus norvegicus
tctaaaaccgctacactatcagcag

SEQ ID NO: 592091 - DNA, 25 bp, Rattus norvegicus
tctaaaaccgcttcactatcagcag

SEQ ID NO: 592092 - DNA, 25 bp, Rattus norvegicus
tctaaaagtagtctgttgggctgga

SEQ ID NO: 592093 - DNA, 25 bp, Rattus norvegicus
tctaaaagtagtgtgttgggctgga

SEQ ID NO: 592094 - DNA, 25 bp, Rattus norvegicus
tctaaaatagttcactgttgagcat

SEQ ID NO: 592095 - DNA, 25 bp, Rattus norvegicus
tctaaaatagttgactgttgagcat

SEQ ID NO: 592096 - DNA, 25 bp, Rattus norvegicus
tctaaaattagcctttccaccggtg

SEQ ID NO: 592097 - DNA, 25 bp, Rattus norvegicus
tctaaaattagcgtttccaccggtg

SEQ ID NO: 592098 - DNA, 25 bp, Rattus norvegicus
tctaaacaattccttacagccactg

SEQ ID NO: 592099 - DNA, 25 bp, Rattus norvegicus
tctaaacaattcgttacagccactg

SEQ ID NO: 592100 - DNA, 25 bp, Rattus norvegicus
tctaaacctggactatcatgtcata

SEQ ID NO: 592101 - DNA, 25 bp, Rattus norvegicus
tctaaacctggagtatcatgtcata

SEQ ID NO: 592102 - DNA, 25 bp, Rattus norvegicus
tctaaaccttcacggcaactctgtc

SEQ ID NO: 592103 - DNA, 25 bp, Rattus norvegicus
tctaaaccttcagggcaactctgtc

SEQ ID NO: 592104 - DNA, 25 bp, Rattus norvegicus
tctaaactcacacagctcacctttg

SEQ ID NO: 592105 - DNA, 25 bp, Rattus norvegicus
tctaaactcacagagctcacctttg

SEQ ID NO: 592106 - DNA, 25 bp, Rattus norvegicus
tctaaactttgcacaccgagtgtcc

SEQ ID NO: 592107 - DNA, 25 bp, Rattus norvegicus
tctaaactttgctcaccgagtgtcc

SEQ ID NO: 592108 - DNA, 25 bp, Rattus norvegicus
tctaaagagctcaggcaagccgcgt

SEQ ID NO: 592109 - DNA, 25 bp, Rattus norvegicus
tctaaagagctctggcaagccgcgt

SEQ ID NO: 592110 - DNA, 25 bp, Rattus norvegicus
tctaaaggaggcactgacgctctgg

SEQ ID NO: 592111 - DNA, 25 bp, Rattus norvegicus
tctaaaggaggctctgacgctctgg

SEQ ID NO: 592112 - DNA, 25 bp, Rattus norvegicus
tctaaaggatcacttgctctctcat

SEQ ID NO: 592113 - DNA, 25 bp, Rattus norvegicus
tctaaaggatcagttgctctctcat

SEQ ID NO: 592114 - DNA, 25 bp, Rattus norvegicus
tctaaaggctttcttcattcccaag

SEQ ID NO: 592115 - DNA, 25 bp, Rattus norvegicus
tctaaaggctttgttcattcccaag

SEQ ID NO: 592116 - DNA, 25 bp, Rattus norvegicus
tctaaagtgcttctgcacctgtcct

SEQ ID NO: 592117 - DNA, 25 bp, Rattus norvegicus
tctaaagtgcttgtgcacctgtcct

SEQ ID NO: 592118 - DNA, 25 bp, Rattus norvegicus
tctaaagtggtaataaaatctgtca

SEQ ID NO: 592119 - DNA, 25 bp, Rattus norvegicus
tctaaagtggtattaaaatctgtca

SEQ ID NO: 592120 - DNA, 25 bp, Rattus norvegicus
tctaaatagctgacccatctgtggg

SEQ ID NO: 592121 - DNA, 25 bp, Rattus norvegicus
tctaaatagctgtcccatctgtggg

SEQ ID NO: 592122 - DNA, 25 bp, Rattus norvegicus
tctaaatcccttcttttctatgcac

SEQ ID NO: 592123 - DNA, 25 bp, Rattus norvegicus
tctaaatcccttgttttctatgcac

SEQ ID NO: 592124 - DNA, 25 bp, Rattus norvegicus
tctaaatcctgaagtgagccagctg

SEQ ID NO: 592125 - DNA, 25 bp, Rattus norvegicus
tctaaatcctgatgtgagccagctg

SEQ ID NO: 592126 - DNA, 25 bp, Rattus norvegicus
tctaaatgcattcctatgcccacat

SEQ ID NO: 592127 - DNA, 25 bp, Rattus norvegicus
tctaaatgcattgctatgcccacat

SEQ ID NO: 592128 - DNA, 25 bp, Rattus norvegicus
tctaaatggtcgatgtaccctctcc

SEQ ID NO: 592129 - DNA, 25 bp, Rattus norvegicus
tctaaatggtcgttgtaccctctcc

SEQ ID NO: 592130 - DNA, 25 bp, Rattus norvegicus
tctaaattccggagtgctagcctct

SEQ ID NO: 592131 - DNA, 25 bp, Rattus norvegicus
tctaaattccggtgtgctagcctct

SEQ ID NO: 592132 - DNA, 25 bp, Rattus norvegicus
tctaacacttagcaggatcactttg

SEQ ID NO: 592133 - DNA, 25 bp, Rattus norvegicus
tctaacacttaggaggatcactttg

SEQ ID NO: 592134 - DNA, 25 bp, Rattus norvegicus
tctaacagctcacccaagatgcaga

SEQ ID NO: 592135 - DNA, 25 bp, Rattus norvegicus
tctaacagctcagccaagatgcaga

SEQ ID NO: 592136 - DNA, 25 bp, Rattus norvegicus
tctaacatcgttaacaattgggtca

SEQ ID NO: 592137 - DNA, 25 bp, Rattus norvegicus
tctaacatcgtttacaattgggtca

SEQ ID NO: 592138 - DNA, 25 bp, Rattus norvegicus
tctaaccacccgcacagggaggttg

SEQ ID NO: 592139 - DNA, 25 bp, Rattus norvegicus
tctaaccacccggacagggaggttg

SEQ ID NO: 592140 - DNA, 25 bp, Rattus norvegicus
tctaacccatggagatttctcctgc

SEQ ID NO: 592141 - DNA, 25 bp, Rattus norvegicus
tctaacccatggtgatttctcctgc

SEQ ID NO: 592142 - DNA, 25 bp, Rattus norvegicus
tctaaccccgtgcaagtgaggctct

SEQ ID NO: 592143 - DNA, 25 bp, Rattus norvegicus
tctaaccccgtggaagtgaggctct

SEQ ID NO: 592144 - DNA, 25 bp, Rattus norvegicus
tctaacccctcacgttctggtatta

SEQ ID NO: 592145 - DNA, 25 bp, Rattus norvegicus
tctaacccctcaggttctggtatta

SEQ ID NO: 592146 - DNA, 25 bp, Rattus norvegicus
tctaacccctggattctggagtgtg

SEQ ID NO: 592147 - DNA, 25 bp, Rattus norvegicus
tctaacccctggtttctggagtgtg

SEQ ID NO: 592148 - DNA, 25 bp, Rattus norvegicus
tctaacccgatcattccaattcata

SEQ ID NO: 592149 - DNA, 25 bp, Rattus norvegicus
tctaacccgatctttccaattcata

SEQ ID NO: 592150 - DNA, 25 bp, Rattus norvegicus
tctaacccgctaagcttttgctgaa

SEQ ID NO: 592151 - DNA, 25 bp, Rattus norvegicus
tctaacccgctatgcttttgctgaa

SEQ ID NO: 592152 - DNA, 25 bp, Rattus norvegicus
tctaaccctgtgcaagctgtctgca

SEQ ID NO: 592153 - DNA, 25 bp, Rattus norvegicus
tctaaccctgtggaagctgtctgca

SEQ ID NO: 592154 - DNA, 25 bp, Rattus norvegicus
tctaaccggagacgattatgatgtc

SEQ ID NO: 592155 - DNA, 25 bp, Rattus norvegicus
tctaaccggagaggattatgatgtc

SEQ ID NO: 592156 - DNA, 25 bp, Rattus norvegicus
tctaacctcaatagctacaactacc

SEQ ID NO: 592157 - DNA, 25 bp, Rattus norvegicus
tctaacctcaattgctacaactacc

SEQ ID NO: 592158 - DNA, 25 bp, Rattus norvegicus
tctaacctccatacgcacatgattc

SEQ ID NO: 592159 - DNA, 25 bp, Rattus norvegicus
tctaacctccattcgcacatgattc

SEQ ID NO: 592160 - DNA, 25 bp, Rattus norvegicus
tctaacctgggacagtagttttcct

SEQ ID NO: 592161 - DNA, 25 bp, Rattus norvegicus
tctaacctgggagagtagttttcct

SEQ ID NO: 592162 - DNA, 25 bp, Rattus norvegicus
tctaacgcattgaattggccaccag

SEQ ID NO: 592163 - DNA, 25 bp, Rattus norvegicus
tctaacgcattgtattggccaccag

SEQ ID NO: 592164 - DNA, 25 bp, Rattus norvegicus
tctaacgtctgcattgtatctcatt

SEQ ID NO: 592165 - DNA, 25 bp, Rattus norvegicus
tctaacgtctgctttgtatctcatt

SEQ ID NO: 592166 - DNA, 25 bp, Rattus norvegicus
tctaacgtctttccagatggacctg

SEQ ID NO: 592167 - DNA, 25 bp, Rattus norvegicus
tctaacgtctttgcagatggacctg

SEQ ID NO: 592168 - DNA, 25 bp, Rattus norvegicus
tctaactatcaaagcctttggcccc

SEQ ID NO: 592169 - DNA, 25 bp, Rattus norvegicus
tctaactatcaatgcctttggcccc

SEQ ID NO: 592170 - DNA, 25 bp, Rattus norvegicus
tctaactcagcccagactaacgaat

SEQ ID NO: 592171 - DNA, 25 bp, Rattus norvegicus
tctaactcagccgagactaacgaat

SEQ ID NO: 592172 - DNA, 25 bp, Rattus norvegicus
tctaactcagtgacagggcccagga

SEQ ID NO: 592173 - DNA, 25 bp, Rattus norvegicus
tctaactcagtgtcagggcccagga

SEQ ID NO: 592174 - DNA, 25 bp, Rattus norvegicus
tctaactcctccctatttgtagggt

SEQ ID NO: 592175 - DNA, 25 bp, Rattus norvegicus
tctaactcctccgtatttgtagggt

SEQ ID NO: 592176 - DNA, 25 bp, Rattus norvegicus
tctaactcctgaccactggacttac

SEQ ID NO: 592177 - DNA, 25 bp, Rattus norvegicus
tctaactcctgagcactggacttac

SEQ ID NO: 592178 - DNA, 25 bp, Rattus norvegicus
tctaactccttacatttcacttctg

SEQ ID NO: 592179 - DNA, 25 bp, Rattus norvegicus
tctaactccttagatttcacttctg

SEQ ID NO: 592180 - DNA, 25 bp, Rattus norvegicus
tctaactcttccacagtttggttcc

SEQ ID NO: 592181 - DNA, 25 bp, Rattus norvegicus
tctaactcttcctcagtttggttcc

SEQ ID NO: 592182 - DNA, 25 bp, Rattus norvegicus
tctaactgagctcaccttcctgatt

SEQ ID NO: 592183 - DNA, 25 bp, Rattus norvegicus
tctaactgagctgaccttcctgatt

SEQ ID NO: 592184 - DNA, 25 bp, Rattus norvegicus
tctaacttgcaacctgtgacagcca

SEQ ID NO: 592185 - DNA, 25 bp, Rattus norvegicus
tctaacttgcaagctgtgacagcca

SEQ ID NO: 592186 - DNA, 25 bp, Rattus norvegicus
tctaacttgcggcttttgttgtctg

SEQ ID NO: 592187 - DNA, 25 bp, Rattus norvegicus
tctaacttgcgggttttgttgtctg

SEQ ID NO: 592188 - DNA, 25 bp, Rattus norvegicus
tctaacttgggcaagagccttacta

SEQ ID NO: 592189 - DNA, 25 bp, Rattus norvegicus
tctaacttgggctagagccttacta

SEQ ID NO: 592190 - DNA, 25 bp, Rattus norvegicus
tctaacttgtgtatctttgtggaca

SEQ ID NO: 592191 - DNA, 25 bp, Rattus norvegicus
tctaacttgtgtttctttgtggaca

SEQ ID NO: 592192 - DNA, 25 bp, Rattus norvegicus
tctaactttcaaagccttctgtgtg

SEQ ID NO: 592193 - DNA, 25 bp, Rattus norvegicus
tctaactttcaatgccttctgtgtg

SEQ ID NO: 592194 - DNA, 25 bp, Rattus norvegicus
tctaagaaagcccttaccttgcgtt

SEQ ID NO: 592195 - DNA, 25 bp, Rattus norvegicus
tctaagaaagccgttaccttgcgtt

SEQ ID NO: 592196 - DNA, 25 bp, Rattus norvegicus
tctaagaacgtcatccaaactgtcc

SEQ ID NO: 592197 - DNA, 25 bp, Rattus norvegicus
tctaagaacgtcttccaaactgtcc

SEQ ID NO: 592198 - DNA, 25 bp, Rattus norvegicus
tctaagaaggtcaccctgggcgtgg

SEQ ID NO: 592199 - DNA, 25 bp, Rattus norvegicus
tctaagaaggtctccctgggcgtgg

SEQ ID NO: 592200 - DNA, 25 bp, Rattus norvegicus
tctaagacccctcggagggtagagc

SEQ ID NO: 592201 - DNA, 25 bp, Rattus norvegicus
tctaagacccctgggagggtagagc

SEQ ID NO: 592202 - DNA, 25 bp, Rattus norvegicus
tctaagactgctatgtacgtcaccc

SEQ ID NO: 592203 - DNA, 25 bp, Rattus norvegicus
tctaagactgctttgtacgtcaccc

SEQ ID NO: 592204 - DNA, 25 bp, Rattus norvegicus
tctaagactggtattcagcccgtat

SEQ ID NO: 592205 - DNA, 25 bp, Rattus norvegicus
tctaagactggttttcagcccgtat

SEQ ID NO: 592206 - DNA, 25 bp, Rattus norvegicus
tctaagactgttactccttttctgg

SEQ ID NO: 592207 - DNA, 25 bp, Rattus norvegicus
tctaagactgtttctccttttctgg

SEQ ID NO: 592208 - DNA, 25 bp, Rattus norvegicus
tctaagaggaaccatctgtctgtct

SEQ ID NO: 592209 - DNA, 25 bp, Rattus norvegicus
tctaagaggaacgatctgtctgtct

SEQ ID NO: 592210 - DNA, 25 bp, Rattus norvegicus
tctaagagtcgtcagggtgcctatc

SEQ ID NO: 592211 - DNA, 25 bp, Rattus norvegicus
tctaagagtcgtgagggtgcctatc

SEQ ID NO: 592212 - DNA, 25 bp, Rattus norvegicus
tctaagatacaccaggcaagcgcct

SEQ ID NO: 592213 - DNA, 25 bp, Rattus norvegicus
tctaagatacacgaggcaagcgcct

SEQ ID NO: 592214 - DNA, 25 bp, Rattus norvegicus
tctaagcagttaaagggaccctcgg

SEQ ID NO: 592215 - DNA, 25 bp, Rattus norvegicus
tctaagcagttatagggaccctcgg

SEQ ID NO: 592216 - DNA, 25 bp, Rattus norvegicus
tctaagccaagtaaaatcactacag

SEQ ID NO: 592217 - DNA, 25 bp, Rattus norvegicus
tctaagccaagttaaatcactacag

SEQ ID NO: 592218 - DNA, 25 bp, Rattus norvegicus
tctaagccacctcggttatcctgga

SEQ ID NO: 592219 - DNA, 25 bp, Rattus norvegicus
tctaagccacctgggttatcctgga

SEQ ID NO: 592220 - DNA, 25 bp, Rattus norvegicus
tctaagctccgacccagaagaggtg

SEQ ID NO: 592221 - DNA, 25 bp, Rattus norvegicus
tctaagctccgagccagaagaggtg

SEQ ID NO: 592222 - DNA, 25 bp, Rattus norvegicus
tctaagctgtcactgatgctttcta

SEQ ID NO: 592223 - DNA, 25 bp, Rattus norvegicus
tctaagctgtcagtgatgctttcta

SEQ ID NO: 592224 - DNA, 25 bp, Rattus norvegicus
tctaagcttcataagatttcttaat

SEQ ID NO: 592225 - DNA, 25 bp, Rattus norvegicus
tctaagcttcattagatttcttaat

SEQ ID NO: 592226 - DNA, 25 bp, Rattus norvegicus
tctaagcttgtcaccctaaaagagg

SEQ ID NO: 592227 - DNA, 25 bp, Rattus norvegicus
tctaagcttgtctccctaaaagagg

SEQ ID NO: 592228 - DNA, 25 bp, Rattus norvegicus
tctaaggaaatcatcctgcaacagt

SEQ ID NO: 592229 - DNA, 25 bp, Rattus norvegicus
tctaaggaaatcttcctgcaacagt

SEQ ID NO: 592230 - DNA, 25 bp, Rattus norvegicus
tctaaggactctagtgacctggcca

SEQ ID NO: 592231 - DNA, 25 bp, Rattus norvegicus
tctaaggactcttgtgacctggcca

SEQ ID NO: 592232 - DNA, 25 bp, Rattus norvegicus
tctaaggagtccaacggctgtgtgc

SEQ ID NO: 592233 - DNA, 25 bp, Rattus norvegicus
tctaaggagtcctacggctgtgtgc

SEQ ID NO: 592234 - DNA, 25 bp, Rattus norvegicus
tctaaggcgtcacccagcagctgtg

SEQ ID NO: 592235 - DNA, 25 bp, Rattus norvegicus
tctaaggcgtcagccagcagctgtg

SEQ ID NO: 592236 - DNA, 25 bp, Rattus norvegicus
tctaaggctatgctggttcaccatg

SEQ ID NO: 592237 - DNA, 25 bp, Rattus norvegicus
tctaaggctatggtggttcaccatg

SEQ ID NO: 592238 - DNA, 25 bp, Rattus norvegicus
tctaaggctattaatgttcctgaaa

SEQ ID NO: 592239 - DNA, 25 bp, Rattus norvegicus
tctaaggctatttatgttcctgaaa

SEQ ID NO: 592240 - DNA, 25 bp, Rattus norvegicus
tctaaggcttacaccacaagttttt

SEQ ID NO: 592241 - DNA, 25 bp, Rattus norvegicus
tctaaggcttactccacaagttttt

SEQ ID NO: 592242 - DNA, 25 bp, Rattus norvegicus
tctaagggacctcaatcgctgcacc

SEQ ID NO: 592243 - DNA, 25 bp, Rattus norvegicus
tctaagggacctgaatcgctgcacc

SEQ ID NO: 592244 - DNA, 25 bp, Rattus norvegicus
tctaagggacttatgcaccggttca

SEQ ID NO: 592245 - DNA, 25 bp, Rattus norvegicus
tctaagggacttttgcaccggttca

SEQ ID NO: 592246 - DNA, 25 bp, Rattus norvegicus
tctaagggtcttcttgctgctcagc

SEQ ID NO: 592247 - DNA, 25 bp, Rattus norvegicus
tctaagggtcttgttgctgctcagc

SEQ ID NO: 592248 - DNA, 25 bp, Rattus norvegicus
tctaaggtaggtctttataatccca

SEQ ID NO: 592249 - DNA, 25 bp, Rattus norvegicus
tctaaggtaggtgtttataatccca

SEQ ID NO: 592250 - DNA, 25 bp, Rattus norvegicus
tctaaggtgaatacccagcagcagc

SEQ ID NO: 592251 - DNA, 25 bp, Rattus norvegicus
tctaaggtgaattcccagcagcagc

SEQ ID NO: 592252 - DNA, 25 bp, Rattus norvegicus
tctaaggttttcactgggctcataa

SEQ ID NO: 592253 - DNA, 25 bp, Rattus norvegicus
tctaaggttttctctgggctcataa

SEQ ID NO: 592254 - DNA, 25 bp, Rattus norvegicus
tctaagtaagtaacggccgccaccg

SEQ ID NO: 592255 - DNA, 25 bp, Rattus norvegicus
tctaagtaagtatcggccgccaccg

SEQ ID NO: 592256 - DNA, 25 bp, Rattus norvegicus
tctaagtagcttattctgtcctgaa

SEQ ID NO: 592257 - DNA, 25 bp, Rattus norvegicus
tctaagtagctttttctgtcctgaa

SEQ ID NO: 592258 - DNA, 25 bp, Rattus norvegicus
tctaagtagggcagaaatccagact

SEQ ID NO: 592259 - DNA, 25 bp, Rattus norvegicus
tctaagtagggctgaaatccagact

SEQ ID NO: 592260 - DNA, 25 bp, Rattus norvegicus
tctaagtcccgaattttgggcccag

SEQ ID NO: 592261 - DNA, 25 bp, Rattus norvegicus
tctaagtcccgatttttgggcccag

SEQ ID NO: 592262 - DNA, 25 bp, Rattus norvegicus
tctaagttacttcaccgaggacagg

SEQ ID NO: 592263 - DNA, 25 bp, Rattus norvegicus
tctaagttacttgaccgaggacagg

SEQ ID NO: 592264 - DNA, 25 bp, Rattus norvegicus
tctaagttctccaaagtaccgcgtt

SEQ ID NO: 592265 - DNA, 25 bp, Rattus norvegicus
tctaagttctcctaagtaccgcgtt

SEQ ID NO: 592266 - DNA, 25 bp, Rattus norvegicus
tctaagtttgagagttttacctgaa

SEQ ID NO: 592267 - DNA, 25 bp, Rattus norvegicus
tctaagtttgagtgttttacctgaa

SEQ ID NO: 592268 - DNA, 25 bp, Rattus norvegicus
tctaataaagtacagctcatggagc

SEQ ID NO: 592269 - DNA, 25 bp, Rattus norvegicus
tctaataaagtagagctcatggagc

SEQ ID NO: 592270 - DNA, 25 bp, Rattus norvegicus
tctaataattatactgagtctcagt

SEQ ID NO: 592271 - DNA, 25 bp, Rattus norvegicus
tctaataattattctgagtctcagt

SEQ ID NO: 592272 - DNA, 25 bp, Rattus norvegicus
tctaatacctcaagcagtgtcctac

SEQ ID NO: 592273 - DNA, 25 bp, Rattus norvegicus
tctaatacctcatgcagtgtcctac

SEQ ID NO: 592274 - DNA, 25 bp, Rattus norvegicus
tctaatcaacctctgggagtccagc

SEQ ID NO: 592275 - DNA, 25 bp, Rattus norvegicus
tctaatcaacctgtgggagtccagc

SEQ ID NO: 592276 - DNA, 25 bp, Rattus norvegicus
tctaatcaatgccagctgctaatat

SEQ ID NO: 592277 - DNA, 25 bp, Rattus norvegicus
tctaatcaatgcgagctgctaatat

SEQ ID NO: 592278 - DNA, 25 bp, Rattus norvegicus
tctaatcactgaaaccaccttggaa

SEQ ID NO: 592279 - DNA, 25 bp, Rattus norvegicus
tctaatcactgataccaccttggaa

SEQ ID NO: 592280 - DNA, 25 bp, Rattus norvegicus
tctaatccaaccacactacattgta

SEQ ID NO: 592281 - DNA, 25 bp, Rattus norvegicus
tctaatccaacctcactacattgta

SEQ ID NO: 592282 - DNA, 25 bp, Rattus norvegicus
tctaatcccactcactgagcagagg

SEQ ID NO: 592283 - DNA, 25 bp, Rattus norvegicus
tctaatcccactgactgagcagagg

SEQ ID NO: 592284 - DNA, 25 bp, Rattus norvegicus
tctaatccccagagtgtgttcatct

SEQ ID NO: 592285 - DNA, 25 bp, Rattus norvegicus
tctaatccccagtgtgtgttcatct

SEQ ID NO: 592286 - DNA, 25 bp, Rattus norvegicus
tctaatccctgtatttctcaacaca

SEQ ID NO: 592287 - DNA, 25 bp, Rattus norvegicus
tctaatccctgtttttctcaacaca

SEQ ID NO: 592288 - DNA, 25 bp, Rattus norvegicus
tctaatctctggagccaactagcca

SEQ ID NO: 592289 - DNA, 25 bp, Rattus norvegicus
tctaatctctggtgccaactagcca

SEQ ID NO: 592290 - DNA, 25 bp, Rattus norvegicus
tctaatctcttcaaccgtactaggg

SEQ ID NO: 592291 - DNA, 25 bp, Rattus norvegicus
tctaatctcttctaccgtactaggg

SEQ ID NO: 592292 - DNA, 25 bp, Rattus norvegicus
tctaatctgtatcgtcactgtgctt

SEQ ID NO: 592293 - DNA, 25 bp, Rattus norvegicus
tctaatctgtatggtcactgtgctt

SEQ ID NO: 592294 - DNA, 25 bp, Rattus norvegicus
tctaatgattagcaaacacgatgtg

SEQ ID NO: 592295 - DNA, 25 bp, Rattus norvegicus
tctaatgattaggaaacacgatgtg

SEQ ID NO: 592296 - DNA, 25 bp, Rattus norvegicus
tctaatgcagctctggctttccaga

SEQ ID NO: 592297 - DNA, 25 bp, Rattus norvegicus
tctaatgcagctgtggctttccaga

SEQ ID NO: 592298 - DNA, 25 bp, Rattus norvegicus
tctaatgctagacaacccctgggaa

SEQ ID NO: 592299 - DNA, 25 bp, Rattus norvegicus
tctaatgctagagaacccctgggaa

SEQ ID NO: 592300 - DNA, 25 bp, Rattus norvegicus
tctaatgctgatatctgattccaag

SEQ ID NO: 592301 - DNA, 25 bp, Rattus norvegicus
tctaatgctgatttctgattccaag

SEQ ID NO: 592302 - DNA, 25 bp, Rattus norvegicus
tctaatgctggcatcttgtgatcct

SEQ ID NO: 592303 - DNA, 25 bp, Rattus norvegicus
tctaatgctggcttcttgtgatcct

SEQ ID NO: 592304 - DNA, 25 bp, Rattus norvegicus
tctaatgctgtaacagtcttctgag

SEQ ID NO: 592305 - DNA, 25 bp, Rattus norvegicus
tctaatgctgtatcagtcttctgag

SEQ ID NO: 592306 - DNA, 25 bp, Rattus norvegicus
tctaatgtgcaaacggactgtccca

SEQ ID NO: 592307 - DNA, 25 bp, Rattus norvegicus
tctaatgtgcaatcggactgtccca

SEQ ID NO: 592308 - DNA, 25 bp, Rattus norvegicus
tctaattaccatatccacctgggtg

SEQ ID NO: 592309 - DNA, 25 bp, Rattus norvegicus
tctaattaccatttccacctgggtg

SEQ ID NO: 592310 - DNA, 25 bp, Rattus norvegicus
tctaattcaattatcgccaactcca

SEQ ID NO: 592311 - DNA, 25 bp, Rattus norvegicus
tctaattcaattttcgccaactcca

SEQ ID NO: 592312 - DNA, 25 bp, Rattus norvegicus
tctaattcatagaggccggcctttg

SEQ ID NO: 592313 - DNA, 25 bp, Rattus norvegicus
tctaattcatagtggccggcctttg

SEQ ID NO: 592314 - DNA, 25 bp, Rattus norvegicus
tctaattcatgtccagtgatatagt

SEQ ID NO: 592315 - DNA, 25 bp, Rattus norvegicus
tctaattcatgtgcagtgatatagt

SEQ ID NO: 592316 - DNA, 25 bp, Rattus norvegicus
tctaattcccctagccctgtgggaa

SEQ ID NO: 592317 - DNA, 25 bp, Rattus norvegicus
tctaattccccttgccctgtgggaa

SEQ ID NO: 592318 - DNA, 25 bp, Rattus norvegicus
tctaattctcccagtaagtctgcaa

SEQ ID NO: 592319 - DNA, 25 bp, Rattus norvegicus
tctaattctccctgtaagtctgcaa

SEQ ID NO: 592320 - DNA, 25 bp, Rattus norvegicus
tctaattgactccatttctggaaat

SEQ ID NO: 592321 - DNA, 25 bp, Rattus norvegicus
tctaattgactcgatttctggaaat

SEQ ID NO: 592322 - DNA, 25 bp, Rattus norvegicus
tctaattgtattcccttccaagacc

SEQ ID NO: 592323 - DNA, 25 bp, Rattus norvegicus
tctaattgtattgccttccaagacc

SEQ ID NO: 592324 - DNA, 25 bp, Rattus norvegicus
tctaattttctaatgtgccttggat

SEQ ID NO: 592325 - DNA, 25 bp, Rattus norvegicus
tctaattttctattgtgccttggat

SEQ ID NO: 592326 - DNA, 25 bp, Rattus norvegicus
tctacaaaatctctcagcgactcag

SEQ ID NO: 592327 - DNA, 25 bp, Rattus norvegicus
tctacaaaatctgtcagcgactcag

SEQ ID NO: 592328 - DNA, 25 bp, Rattus norvegicus
tctacaaataatactcagtgctgca

SEQ ID NO: 592329 - DNA, 25 bp, Rattus norvegicus
tctacaaataattctcagtgctgca

SEQ ID NO: 592330 - DNA, 25 bp, Rattus norvegicus
tctacaaatgccataaagtttctcc

SEQ ID NO: 592331 - DNA, 25 bp, Rattus norvegicus
tctacaaatgccttaaagtttctcc

SEQ ID NO: 592332 - DNA, 25 bp, Rattus norvegicus
tctacaacccgtaccagttcgagat

SEQ ID NO: 592333 - DNA, 25 bp, Rattus norvegicus
tctacaacccgttccagttcgagat

SEQ ID NO: 592334 - DNA, 25 bp, Rattus norvegicus
tctacaacggccattttgtcccaag

SEQ ID NO: 592335 - DNA, 25 bp, Rattus norvegicus
tctacaacggcctttttgtcccaag

SEQ ID NO: 592336 - DNA, 25 bp, Rattus norvegicus
tctacaacttcccaaggcagtgctg

SEQ ID NO: 592337 - DNA, 25 bp, Rattus norvegicus
tctacaacttccgaaggcagtgctg

SEQ ID NO: 592338 - DNA, 25 bp, Rattus norvegicus
tctacaactttgatggtggaaactg

SEQ ID NO: 592339 - DNA, 25 bp, Rattus norvegicus
tctacaactttgttggtggaaactg

SEQ ID NO: 592340 - DNA, 25 bp, Rattus norvegicus
tctacaagctagctgtgttcccgtt

SEQ ID NO: 592341 - DNA, 25 bp, Rattus norvegicus
tctacaagctaggtgtgttcccgtt

SEQ ID NO: 592342 - DNA, 25 bp, Rattus norvegicus
tctacaatctgcagttgagttcccc

SEQ ID NO: 592343 - DNA, 25 bp, Rattus norvegicus
tctacaatctgctgttgagttcccc

SEQ ID NO: 592344 - DNA, 25 bp, Rattus norvegicus
tctacaatgatgacagctacctctg

SEQ ID NO: 592345 - DNA, 25 bp, Rattus norvegicus
tctacaatgatgtcagctacctctg

SEQ ID NO: 592346 - DNA, 25 bp, Rattus norvegicus
tctacaattgttcgcagcgtcggct

SEQ ID NO: 592347 - DNA, 25 bp, Rattus norvegicus
tctacaattgttggcagcgtcggct

SEQ ID NO: 592348 - DNA, 25 bp, Rattus norvegicus
tctacacacacaccttgtgaggttc

SEQ ID NO: 592349 - DNA, 25 bp, Rattus norvegicus
tctacacacacagcttgtgaggttc

SEQ ID NO: 592350 - DNA, 25 bp, Rattus norvegicus
tctacacatcctaatgcacgctggt

SEQ ID NO: 592351 - DNA, 25 bp, Rattus norvegicus
tctacacatccttatgcacgctggt

SEQ ID NO: 592352 - DNA, 25 bp, Rattus norvegicus
tctacaccaggaccggatggacgtt

SEQ ID NO: 592353 - DNA, 25 bp, Rattus norvegicus
tctacaccaggagcggatggacgtt

SEQ ID NO: 592354 - DNA, 25 bp, Rattus norvegicus
tctacaccatagcttcttggacacg

SEQ ID NO: 592355 - DNA, 25 bp, Rattus norvegicus
tctacaccataggttcttggacacg

SEQ ID NO: 592356 - DNA, 25 bp, Rattus norvegicus
tctacaccctttaggtcggacgata

SEQ ID NO: 592357 - DNA, 25 bp, Rattus norvegicus
tctacacccttttggtcggacgata

SEQ ID NO: 592358 - DNA, 25 bp, Rattus norvegicus
tctacaccggcgagttggaggtcgc

SEQ ID NO: 592359 - DNA, 25 bp, Rattus norvegicus
tctacaccggcgtgttggaggtcgc

SEQ ID NO: 592360 - DNA, 25 bp, Rattus norvegicus
tctacaccgggacggcttcagtttc

SEQ ID NO: 592361 - DNA, 25 bp, Rattus norvegicus
tctacaccgggagggcttcagtttc

SEQ ID NO: 592362 - DNA, 25 bp, Rattus norvegicus
tctacactcgggaggcggcagcata

SEQ ID NO: 592363 - DNA, 25 bp, Rattus norvegicus
tctacactcgggtggcggcagcata

SEQ ID NO: 592364 - DNA, 25 bp, Rattus norvegicus
tctacactgactaacttctcctaat

SEQ ID NO: 592365 - DNA, 25 bp, Rattus norvegicus
tctacactgacttacttctcctaat

SEQ ID NO: 592366 - DNA, 25 bp, Rattus norvegicus
tctacactgagtacgatgaggactt

SEQ ID NO: 592367 - DNA, 25 bp, Rattus norvegicus
tctacactgagttcgatgaggactt

SEQ ID NO: 592368 - DNA, 25 bp, Rattus norvegicus
tctacactgtgtagcatgaatgatg

SEQ ID NO: 592369 - DNA, 25 bp, Rattus norvegicus
tctacactgtgttgcatgaatgatg

SEQ ID NO: 592370 - DNA, 25 bp, Rattus norvegicus
tctacacttagaacgttgcaattgg

SEQ ID NO: 592371 - DNA, 25 bp, Rattus norvegicus
tctacacttagatcgttgcaattgg

SEQ ID NO: 592372 - DNA, 25 bp, Rattus norvegicus
tctacacttgacacggtgcgcgcct

SEQ ID NO: 592373 - DNA, 25 bp, Rattus norvegicus
tctacacttgactcggtgcgcgcct

SEQ ID NO: 592374 - DNA, 25 bp, Rattus norvegicus
tctacagacaaaagctccatccgat

SEQ ID NO: 592375 - DNA, 25 bp, Rattus norvegicus
tctacagacaaatgctccatccgat

SEQ ID NO: 592376 - DNA, 25 bp, Rattus norvegicus
tctacagaggctatgaagatggcat

SEQ ID NO: 592377 - DNA, 25 bp, Rattus norvegicus
tctacagaggctttgaagatggcat

SEQ ID NO: 592378 - DNA, 25 bp, Rattus norvegicus
tctacagcagcaattttcaccattt

SEQ ID NO: 592379 - DNA, 25 bp, Rattus norvegicus
tctacagcagcatttttcaccattt

SEQ ID NO: 592380 - DNA, 25 bp, Rattus norvegicus
tctacagcaggacctctggagcctc

SEQ ID NO: 592381 - DNA, 25 bp, Rattus norvegicus
tctacagcaggagctctggagcctc

SEQ ID NO: 592382 - DNA, 25 bp, Rattus norvegicus
tctacagcatctatccgcatggatc

SEQ ID NO: 592383 - DNA, 25 bp, Rattus norvegicus
tctacagcatctttccgcatggatc

SEQ ID NO: 592384 - DNA, 25 bp, Rattus norvegicus
tctacagccctgaattgtggagagt

SEQ ID NO: 592385 - DNA, 25 bp, Rattus norvegicus
tctacagccctgtattgtggagagt

SEQ ID NO: 592386 - DNA, 25 bp, Rattus norvegicus
tctacagcgataactcccgtttttt

SEQ ID NO: 592387 - DNA, 25 bp, Rattus norvegicus
tctacagcgatatctcccgtttttt

SEQ ID NO: 592388 - DNA, 25 bp, Rattus norvegicus
tctacagcgcgaccaagacaggcaa

SEQ ID NO: 592389 - DNA, 25 bp, Rattus norvegicus
tctacagcgcgagcaagacaggcaa

SEQ ID NO: 592390 - DNA, 25 bp, Rattus norvegicus
tctacagcgctgaagaccagttcca

SEQ ID NO: 592391 - DNA, 25 bp, Rattus norvegicus
tctacagcgctgtagaccagttcca

SEQ ID NO: 592392 - DNA, 25 bp, Rattus norvegicus
tctacagctctcctttggtttctga

SEQ ID NO: 592393 - DNA, 25 bp, Rattus norvegicus
tctacagctctcgtttggtttctga

SEQ ID NO: 592394 - DNA, 25 bp, Rattus norvegicus
tctacagctgggagcctggcagtgc

SEQ ID NO: 592395 - DNA, 25 bp, Rattus norvegicus
tctacagctgggtgcctggcagtgc

SEQ ID NO: 592396 - DNA, 25 bp, Rattus norvegicus
tctacagctttacagctgcttgctg

SEQ ID NO: 592397 - DNA, 25 bp, Rattus norvegicus
tctacagctttagagctgcttgctg

SEQ ID NO: 592398 - DNA, 25 bp, Rattus norvegicus
tctacaggaccacctgctcagttca

SEQ ID NO: 592399 - DNA, 25 bp, Rattus norvegicus
tctacaggaccagctgctcagttca

SEQ ID NO: 592400 - DNA, 25 bp, Rattus norvegicus
tctacaggcaacagacacagctctt

SEQ ID NO: 592401 - DNA, 25 bp, Rattus norvegicus
tctacaggcaactgacacagctctt

SEQ ID NO: 592402 - DNA, 25 bp, Rattus norvegicus
tctacaggcgctcatactgtgtttt

SEQ ID NO: 592403 - DNA, 25 bp, Rattus norvegicus
tctacaggcgctgatactgtgtttt

SEQ ID NO: 592404 - DNA, 25 bp, Rattus norvegicus
tctacagggcaacctgagccacgtt

SEQ ID NO: 592405 - DNA, 25 bp, Rattus norvegicus
tctacagggcaagctgagccacgtt

SEQ ID NO: 592406 - DNA, 25 bp, Rattus norvegicus
tctacaggtcttactttccagttag

SEQ ID NO: 592407 - DNA, 25 bp, Rattus norvegicus
tctacaggtctttctttccagttag

SEQ ID NO: 592408 - DNA, 25 bp, Rattus norvegicus
tctacaggtgaacaattcctacatt

SEQ ID NO: 592409 - DNA, 25 bp, Rattus norvegicus
tctacaggtgaagaattcctacatt

SEQ ID NO: 592410 - DNA, 25 bp, Rattus norvegicus
tctacagtgaagaagccccggtcat

SEQ ID NO: 592411 - DNA, 25 bp, Rattus norvegicus
tctacagtgaagtagccccggtcat

SEQ ID NO: 592412 - DNA, 25 bp, Rattus norvegicus
tctacagtgcccagatgatcacatc

SEQ ID NO: 592413 - DNA, 25 bp, Rattus norvegicus
tctacagtgccctgatgatcacatc

SEQ ID NO: 592414 - DNA, 25 bp, Rattus norvegicus
tctacagtgtatctggcctccatta

SEQ ID NO: 592415 - DNA, 25 bp, Rattus norvegicus
tctacagtgtatgtggcctccatta

SEQ ID NO: 592416 - DNA, 25 bp, Rattus norvegicus
tctacagttccaaaattgtccgggt

SEQ ID NO: 592417 - DNA, 25 bp, Rattus norvegicus
tctacagttccataattgtccgggt

SEQ ID NO: 592418 - DNA, 25 bp, Rattus norvegicus
tctacagttggacgctgctggagtt

SEQ ID NO: 592419 - DNA, 25 bp, Rattus norvegicus
tctacagttggaggctgctggagtt

SEQ ID NO: 592420 - DNA, 25 bp, Rattus norvegicus
tctacagtttccagaagaccaccag

SEQ ID NO: 592421 - DNA, 25 bp, Rattus norvegicus
tctacagtttcctgaagaccaccag

SEQ ID NO: 592422 - DNA, 25 bp, Rattus norvegicus
tctacatagagcagactggccccaa

SEQ ID NO: 592423 - DNA, 25 bp, Rattus norvegicus
tctacatagagctgactggccccaa

SEQ ID NO: 592424 - DNA, 25 bp, Rattus norvegicus
tctacatagctcacattcgtcctaa

SEQ ID NO: 592425 - DNA, 25 bp, Rattus norvegicus
tctacatagctctcattcgtcctaa

SEQ ID NO: 592426 - DNA, 25 bp, Rattus norvegicus
tctacatagtggaatcgagggctac

SEQ ID NO: 592427 - DNA, 25 bp, Rattus norvegicus
tctacatagtggtatcgagggctac

SEQ ID NO: 592428 - DNA, 25 bp, Rattus norvegicus
tctacatatcctccacttgaacaaa

SEQ ID NO: 592429 - DNA, 25 bp, Rattus norvegicus
tctacatatcctgcacttgaacaaa

SEQ ID NO: 592430 - DNA, 25 bp, Rattus norvegicus
tctacatcaaataagacggtggcaa

SEQ ID NO: 592431 - DNA, 25 bp, Rattus norvegicus
tctacatcaaattagacggtggcaa

SEQ ID NO: 592432 - DNA, 25 bp, Rattus norvegicus
tctacatcaagtaccatggcttcca

SEQ ID NO: 592433 - DNA, 25 bp, Rattus norvegicus
tctacatcaagttccatggcttcca

SEQ ID NO: 592434 - DNA, 25 bp, Rattus norvegicus
tctacatcatcgatatgcgtctcag

SEQ ID NO: 592435 - DNA, 25 bp, Rattus norvegicus
tctacatcatcgttatgcgtctcag

SEQ ID NO: 592436 - DNA, 25 bp, Rattus norvegicus
tctacatctatcagtcgggctcaaa

SEQ ID NO: 592437 - DNA, 25 bp, Rattus norvegicus
tctacatctatctgtcgggctcaaa

SEQ ID NO: 592438 - DNA, 25 bp, Rattus norvegicus
tctacatctgtcctctttgatggcc

SEQ ID NO: 592439 - DNA, 25 bp, Rattus norvegicus
tctacatctgtcgtctttgatggcc

SEQ ID NO: 592440 - DNA, 25 bp, Rattus norvegicus
tctacatgacccacatggcttgcta

SEQ ID NO: 592441 - DNA, 25 bp, Rattus norvegicus
tctacatgaccctcatggcttgcta

SEQ ID NO: 592442 - DNA, 25 bp, Rattus norvegicus
tctacattgcacagaaggactcctg

SEQ ID NO: 592443 - DNA, 25 bp, Rattus norvegicus
tctacattgcactgaaggactcctg

SEQ ID NO: 592444 - DNA, 25 bp, Rattus norvegicus
tctacattggaacctccaggacagc

SEQ ID NO: 592445 - DNA, 25 bp, Rattus norvegicus
tctacattggaagctccaggacagc

SEQ ID NO: 592446 - DNA, 25 bp, Rattus norvegicus
tctaccaaagttcactctcacaatg

SEQ ID NO: 592447 - DNA, 25 bp, Rattus norvegicus
tctaccaaagttgactctcacaatg

SEQ ID NO: 592448 - DNA, 25 bp, Rattus norvegicus
tctaccaactggcaagcaagcattt

SEQ ID NO: 592449 - DNA, 25 bp, Rattus norvegicus
tctaccaactgggaagcaagcattt

SEQ ID NO: 592450 - DNA, 25 bp, Rattus norvegicus
tctaccaaggctagaactcccagtg

SEQ ID NO: 592451 - DNA, 25 bp, Rattus norvegicus
tctaccaaggcttgaactcccagtg

SEQ ID NO: 592452 - DNA, 25 bp, Rattus norvegicus
tctaccaagtacacgcgcgatgttt

SEQ ID NO: 592453 - DNA, 25 bp, Rattus norvegicus
tctaccaagtactcgcgcgatgttt

SEQ ID NO: 592454 - DNA, 25 bp, Rattus norvegicus
tctaccacatagattcctttcactg

SEQ ID NO: 592455 - DNA, 25 bp, Rattus norvegicus
tctaccacatagtttcctttcactg

SEQ ID NO: 592456 - DNA, 25 bp, Rattus norvegicus
tctaccacatctaacttcgctatga

SEQ ID NO: 592457 - DNA, 25 bp, Rattus norvegicus
tctaccacatcttacttcgctatga

SEQ ID NO: 592458 - DNA, 25 bp, Rattus norvegicus
tctaccacccttatgattggagctt

SEQ ID NO: 592459 - DNA, 25 bp, Rattus norvegicus
tctaccacccttttgattggagctt

SEQ ID NO: 592460 - DNA, 25 bp, Rattus norvegicus
tctaccaccttacccaaagattcag

SEQ ID NO: 592461 - DNA, 25 bp, Rattus norvegicus
tctaccaccttagccaaagattcag

SEQ ID NO: 592462 - DNA, 25 bp, Rattus norvegicus
tctaccacggagctatttgaaaatt

SEQ ID NO: 592463 - DNA, 25 bp, Rattus norvegicus
tctaccacggaggtatttgaaaatt

SEQ ID NO: 592464 - DNA, 25 bp, Rattus norvegicus
tctaccacggtcacacaaaatgtca

SEQ ID NO: 592465 - DNA, 25 bp, Rattus norvegicus
tctaccacggtctcacaaaatgtca

SEQ ID NO: 592466 - DNA, 25 bp, Rattus norvegicus
tctaccactacaacgactactacaa

SEQ ID NO: 592467 - DNA, 25 bp, Rattus norvegicus
tctaccactacatcgactactacaa

SEQ ID NO: 592468 - DNA, 25 bp, Rattus norvegicus
tctaccactcagcaagcacaggcaa

SEQ ID NO: 592469 - DNA, 25 bp, Rattus norvegicus
tctaccactcaggaagcacaggcaa

SEQ ID NO: 592470 - DNA, 25 bp, Rattus norvegicus
tctaccactctaccaaatcattttt

SEQ ID NO: 592471 - DNA, 25 bp, Rattus norvegicus
tctaccactctagcaaatcattttt

SEQ ID NO: 592472 - DNA, 25 bp, Rattus norvegicus
tctaccactgaactttctgtcctgc

SEQ ID NO: 592473 - DNA, 25 bp, Rattus norvegicus
tctaccactgaagtttctgtcctgc

SEQ ID NO: 592474 - DNA, 25 bp, Rattus norvegicus
tctaccactggcaaagccctgatat

SEQ ID NO: 592475 - DNA, 25 bp, Rattus norvegicus
tctaccactggctaagccctgatat

SEQ ID NO: 592476 - DNA, 25 bp, Rattus norvegicus
tctaccactgtcagaaaatgctata

SEQ ID NO: 592477 - DNA, 25 bp, Rattus norvegicus
tctaccactgtctgaaaatgctata

SEQ ID NO: 592478 - DNA, 25 bp, Rattus norvegicus
tctaccagaaccacaaaattctttt

SEQ ID NO: 592479 - DNA, 25 bp, Rattus norvegicus
tctaccagaacctcaaaattctttt

SEQ ID NO: 592480 - DNA, 25 bp, Rattus norvegicus
tctaccagaagaccacggaggacga

SEQ ID NO: 592481 - DNA, 25 bp, Rattus norvegicus
tctaccagaagagcacggaggacga

SEQ ID NO: 592482 - DNA, 25 bp, Rattus norvegicus
tctaccagactccttataggcatcg

SEQ ID NO: 592483 - DNA, 25 bp, Rattus norvegicus
tctaccagactcgttataggcatcg

SEQ ID NO: 592484 - DNA, 25 bp, Rattus norvegicus
tctaccagctctagcaggtcttaat

SEQ ID NO: 592485 - DNA, 25 bp, Rattus norvegicus
tctaccagctctataactacctaaa

SEQ ID NO: 592486 - DNA, 25 bp, Rattus norvegicus
tctaccagctcttgcaggtcttaat

SEQ ID NO: 592487 - DNA, 25 bp, Rattus norvegicus
tctaccagctctttaactacctaaa

SEQ ID NO: 592488 - DNA, 25 bp, Rattus norvegicus
tctaccaggactacgacttttcatt

SEQ ID NO: 592489 - DNA, 25 bp, Rattus norvegicus
tctaccaggacttcgacttttcatt

SEQ ID NO: 592490 - DNA, 25 bp, Rattus norvegicus
tctaccaggtgtcatctgggcctaa

SEQ ID NO: 592491 - DNA, 25 bp, Rattus norvegicus
tctaccaggtgtgatctgggcctaa

SEQ ID NO: 592492 - DNA, 25 bp, Rattus norvegicus
tctaccagtgacctcttgattatga

SEQ ID NO: 592493 - DNA, 25 bp, Rattus norvegicus
tctaccagtgacgtcttgattatga

SEQ ID NO: 592494 - DNA, 25 bp, Rattus norvegicus
tctaccagtgatccgcatcccagga

SEQ ID NO: 592495 - DNA, 25 bp, Rattus norvegicus
tctaccagtgatgcgcatcccagga

SEQ ID NO: 592496 - DNA, 25 bp, Rattus norvegicus
tctaccagtgtcagagcctccgagg

SEQ ID NO: 592497 - DNA, 25 bp, Rattus norvegicus
tctaccagtgtctgagcctccgagg

SEQ ID NO: 592498 - DNA, 25 bp, Rattus norvegicus
tctaccagttccatcaggcgcgctt

SEQ ID NO: 592499 - DNA, 25 bp, Rattus norvegicus
tctaccagttccttcaggcgcgctt

SEQ ID NO: 592500 - DNA, 25 bp, Rattus norvegicus
tctaccatcgctatcttttctcttt

SEQ ID NO: 592501 - DNA, 25 bp, Rattus norvegicus
tctaccatcgctttcttttctcttt

SEQ ID NO: 592502 - DNA, 25 bp, Rattus norvegicus
tctaccatgagcatgtcttgaccac

SEQ ID NO: 592503 - DNA, 25 bp, Rattus norvegicus
tctaccatgagcttgtcttgaccac

SEQ ID NO: 592504 - DNA, 25 bp, Rattus norvegicus
tctaccattatcatgggtttccatg

SEQ ID NO: 592505 - DNA, 25 bp, Rattus norvegicus
tctaccattatcttgggtttccatg

SEQ ID NO: 592506 - DNA, 25 bp, Rattus norvegicus
tctaccattttgaaggatccagtga

SEQ ID NO: 592507 - DNA, 25 bp, Rattus norvegicus
tctaccattttgtaggatccagtga

SEQ ID NO: 592508 - DNA, 25 bp, Rattus norvegicus
tctacccaccttattgctgggactt

SEQ ID NO: 592509 - DNA, 25 bp, Rattus norvegicus
tctacccacctttttgctgggactt

SEQ ID NO: 592510 - DNA, 25 bp, Rattus norvegicus
tctacccagcatcacaaggacggag

SEQ ID NO: 592511 - DNA, 25 bp, Rattus norvegicus
tctacccagcatgacaaggacggag

SEQ ID NO: 592512 - DNA, 25 bp, Rattus norvegicus
tctaccccaagaatccctaggtttg

SEQ ID NO: 592513 - DNA, 25 bp, Rattus norvegicus
tctaccccaagattccctaggtttg

SEQ ID NO: 592514 - DNA, 25 bp, Rattus norvegicus
tctaccccatcgatgacgtttatac

SEQ ID NO: 592515 - DNA, 25 bp, Rattus norvegicus
tctaccccatcgttgacgtttatac

SEQ ID NO: 592516 - DNA, 25 bp, Rattus norvegicus
tctacccctaacattaactcaatag

SEQ ID NO: 592517 - DNA, 25 bp, Rattus norvegicus
tctacccctaactttaactcaatag

SEQ ID NO: 592518 - DNA, 25 bp, Rattus norvegicus
tctacccctgcgacatgagtggaca

SEQ ID NO: 592519 - DNA, 25 bp, Rattus norvegicus
tctacccctgcgtcatgagtggaca

SEQ ID NO: 592520 - DNA, 25 bp, Rattus norvegicus
tctacccctgtaccaataccaagtg

SEQ ID NO: 592521 - DNA, 25 bp, Rattus norvegicus
tctacccctgtagcaataccaagtg

SEQ ID NO: 592522 - DNA, 25 bp, Rattus norvegicus
tctacccctgtccacgaagaacggt

SEQ ID NO: 592523 - DNA, 25 bp, Rattus norvegicus
tctacccctgtcgacgaagaacggt

SEQ ID NO: 592524 - DNA, 25 bp, Rattus norvegicus
tctacccgaaaacctgctcataatg

SEQ ID NO: 592525 - DNA, 25 bp, Rattus norvegicus
tctacccgaaaagctgctcataatg

SEQ ID NO: 592526 - DNA, 25 bp, Rattus norvegicus
tctaccctgatgacaacgatgagct

SEQ ID NO: 592527 - DNA, 25 bp, Rattus norvegicus
tctaccctgatgtcaacgatgagct

SEQ ID NO: 592528 - DNA, 25 bp, Rattus norvegicus
tctaccctgtaaagcctatttctgt

SEQ ID NO: 592529 - DNA, 25 bp, Rattus norvegicus
tctaccctgtaaagcgttttctgtt

SEQ ID NO: 592530 - DNA, 25 bp, Rattus norvegicus
tctaccctgtaatgcctatttctgt

SEQ ID NO: 592531 - DNA, 25 bp, Rattus norvegicus
tctaccctgtaatgcgttttctgtt

SEQ ID NO: 592532 - DNA, 25 bp, Rattus norvegicus
tctaccctgtgacccaaacacttta

SEQ ID NO: 592533 - DNA, 25 bp, Rattus norvegicus
tctaccctgtgagccaaacacttta

SEQ ID NO: 592534 - DNA, 25 bp, Rattus norvegicus
tctaccctgtgcagttggtcaagca

SEQ ID NO: 592535 - DNA, 25 bp, Rattus norvegicus
tctaccctgtgctgttggtcaagca

SEQ ID NO: 592536 - DNA, 25 bp, Rattus norvegicus
tctaccctgtgtatcgcagtggaga

SEQ ID NO: 592537 - DNA, 25 bp, Rattus norvegicus
tctaccctgtgtttcgcagtggaga

SEQ ID NO: 592538 - DNA, 25 bp, Rattus norvegicus
tctaccctttaaaatcagtctgtgt

SEQ ID NO: 592539 - DNA, 25 bp, Rattus norvegicus
tctaccctttaatatcagtctgtgt

SEQ ID NO: 592540 - DNA, 25 bp, Rattus norvegicus
tctaccgaactgagttgatgcccag

SEQ ID NO: 592541 - DNA, 25 bp, Rattus norvegicus
tctaccgaactgtgttgatgcccag

SEQ ID NO: 592542 - DNA, 25 bp, Rattus norvegicus
tctaccgaaggaactcagaggactc

SEQ ID NO: 592543 - DNA, 25 bp, Rattus norvegicus
tctaccgaaggatctcagaggactc

SEQ ID NO: 592544 - DNA, 25 bp, Rattus norvegicus
tctaccgattgcaatttttccgaac

SEQ ID NO: 592545 - DNA, 25 bp, Rattus norvegicus
tctaccgattgctatttttccgaac

SEQ ID NO: 592546 - DNA, 25 bp, Rattus norvegicus
tctaccgccaggagttcagagccct

SEQ ID NO: 592547 - DNA, 25 bp, Rattus norvegicus
tctaccgccaggtgttcagagccct

SEQ ID NO: 592548 - DNA, 25 bp, Rattus norvegicus
tctaccggcgctattgaagagccta

SEQ ID NO: 592549 - DNA, 25 bp, Rattus norvegicus
tctaccggcgcttttgaagagccta

SEQ ID NO: 592550 - DNA, 25 bp, Rattus norvegicus
tctaccgggatgacacagtgactct

SEQ ID NO: 592551 - DNA, 25 bp, Rattus norvegicus
tctaccgggatgtcacagtgactct

SEQ ID NO: 592552 - DNA, 25 bp, Rattus norvegicus
tctaccgggcggagtccgataccat

SEQ ID NO: 592553 - DNA, 25 bp, Rattus norvegicus
tctaccgggcggtgtccgataccat

SEQ ID NO: 592554 - DNA, 25 bp, Rattus norvegicus
tctaccggtgagcatgggccttgca

SEQ ID NO: 592555 - DNA, 25 bp, Rattus norvegicus
tctaccggtgaggatgggccttgca

SEQ ID NO: 592556 - DNA, 25 bp, Rattus norvegicus
tctaccgtgcaaagtcatccgtgga

SEQ ID NO: 592557 - DNA, 25 bp, Rattus norvegicus
tctaccgtgcaatgtcatccgtgga

SEQ ID NO: 592558 - DNA, 25 bp, Rattus norvegicus
tctacctaacttacttggaagcagt

SEQ ID NO: 592559 - DNA, 25 bp, Rattus norvegicus
tctacctaactttcttggaagcagt

SEQ ID NO: 592560 - DNA, 25 bp, Rattus norvegicus
tctacctatgtcatggtggccaggg

SEQ ID NO: 592561 - DNA, 25 bp, Rattus norvegicus
tctacctatgtcttggtggccaggg

SEQ ID NO: 592562 - DNA, 25 bp, Rattus norvegicus
tctacctcactcagtgcatattgca

SEQ ID NO: 592563 - DNA, 25 bp, Rattus norvegicus
tctacctcactcataggacttcaag

SEQ ID NO: 592564 - DNA, 25 bp, Rattus norvegicus
tctacctcactctgtgcatattgca

SEQ ID NO: 592565 - DNA, 25 bp, Rattus norvegicus
tctacctcactcttaggacttcaag

SEQ ID NO: 592566 - DNA, 25 bp, Rattus norvegicus
tctacctcacttaccccgtggtaat

SEQ ID NO: 592567 - DNA, 25 bp, Rattus norvegicus
tctacctcactttccccgtggtaat

SEQ ID NO: 592568 - DNA, 25 bp, Rattus norvegicus
tctacctcccatcacgagtaactaa

SEQ ID NO: 592569 - DNA, 25 bp, Rattus norvegicus
tctacctcccatgacgagtaactaa

SEQ ID NO: 592570 - DNA, 25 bp, Rattus norvegicus
tctacctcctgtattttctactgta

SEQ ID NO: 592571 - DNA, 25 bp, Rattus norvegicus
tctacctcctgttttttctactgta

SEQ ID NO: 592572 - DNA, 25 bp, Rattus norvegicus
tctacctccttgatgtgctaactta

SEQ ID NO: 592573 - DNA, 25 bp, Rattus norvegicus
tctacctccttgttgtgctaactta

SEQ ID NO: 592574 - DNA, 25 bp, Rattus norvegicus
tctacctctaagcttgagcccagaa

SEQ ID NO: 592575 - DNA, 25 bp, Rattus norvegicus
tctacctctaaggttgagcccagaa

SEQ ID NO: 592576 - DNA, 25 bp, Rattus norvegicus
tctacctctgagagatgcattattt

SEQ ID NO: 592577 - DNA, 25 bp, Rattus norvegicus
tctacctctgagtgatgcattattt

SEQ ID NO: 592578 - DNA, 25 bp, Rattus norvegicus
tctacctctggacctgggacctagt

SEQ ID NO: 592579 - DNA, 25 bp, Rattus norvegicus
tctacctctggagctgggacctagt

SEQ ID NO: 592580 - DNA, 25 bp, Rattus norvegicus
tctacctgaaaaaacccttctcact

SEQ ID NO: 592581 - DNA, 25 bp, Rattus norvegicus
tctacctgaaaatacccttctcact

SEQ ID NO: 592582 - DNA, 25 bp, Rattus norvegicus
tctacctgacatcgcctgaagatgc

SEQ ID NO: 592583 - DNA, 25 bp, Rattus norvegicus
tctacctgacatggcctgaagatgc

SEQ ID NO: 592584 - DNA, 25 bp, Rattus norvegicus
tctacctgatccctaagcagctcaa

SEQ ID NO: 592585 - DNA, 25 bp, Rattus norvegicus
tctacctgatccgtaagcagctcaa

SEQ ID NO: 592586 - DNA, 25 bp, Rattus norvegicus
tctacctgccatattgtcagtgatg

SEQ ID NO: 592587 - DNA, 25 bp, Rattus norvegicus
tctacctgccattttgtcagtgatg

SEQ ID NO: 592588 - DNA, 25 bp, Rattus norvegicus
tctacctgccctactttgagaagtg

SEQ ID NO: 592589 - DNA, 25 bp, Rattus norvegicus
tctacctgcccttctttgagaagtg

SEQ ID NO: 592590 - DNA, 25 bp, Rattus norvegicus
tctacctggaggaggccccgtggcc

SEQ ID NO: 592591 - DNA, 25 bp, Rattus norvegicus
tctacctggaggtggccccgtggcc

SEQ ID NO: 592592 - DNA, 25 bp, Rattus norvegicus
tctacctggcctcgactaggattta

SEQ ID NO: 592593 - DNA, 25 bp, Rattus norvegicus
tctacctggcctggactaggattta

SEQ ID NO: 592594 - DNA, 25 bp, Rattus norvegicus
tctaccttcttgatgacagcagcta

SEQ ID NO: 592595 - DNA, 25 bp, Rattus norvegicus
tctaccttcttgttgacagcagcta

SEQ ID NO: 592596 - DNA, 25 bp, Rattus norvegicus
tctaccttgacccactggaaacttc

SEQ ID NO: 592597 - DNA, 25 bp, Rattus norvegicus
tctaccttgaccgactggaaacttc

SEQ ID NO: 592598 - DNA, 25 bp, Rattus norvegicus
tctaccttgctcattccggaaaaca

SEQ ID NO: 592599 - DNA, 25 bp, Rattus norvegicus
tctaccttgctctttccggaaaaca

SEQ ID NO: 592600 - DNA, 25 bp, Rattus norvegicus
tctaccttttgtcagatgatgccag

SEQ ID NO: 592601 - DNA, 25 bp, Rattus norvegicus
tctaccttttgtgagatgatgccag

SEQ ID NO: 592602 - DNA, 25 bp, Rattus norvegicus
tctacctttttaacgggaaacattg

SEQ ID NO: 592603 - DNA, 25 bp, Rattus norvegicus
tctacctttttatcgggaaacattg

SEQ ID NO: 592604 - DNA, 25 bp, Rattus norvegicus
tctacgaaagacagaatgtaaaagt

SEQ ID NO: 592605 - DNA, 25 bp, Rattus norvegicus
tctacgaaagactgaatgtaaaagt

SEQ ID NO: 592606 - DNA, 25 bp, Rattus norvegicus
tctacgaagggtaggactggctgtc

SEQ ID NO: 592607 - DNA, 25 bp, Rattus norvegicus
tctacgaagggttggactggctgtc

SEQ ID NO: 592608 - DNA, 25 bp, Rattus norvegicus
tctacgacccttattggaccgacag

SEQ ID NO: 592609 - DNA, 25 bp, Rattus norvegicus
tctacgaccctttttggaccgacag

SEQ ID NO: 592610 - DNA, 25 bp, Rattus norvegicus
tctacgactatgaccctcgggaaag

SEQ ID NO: 592611 - DNA, 25 bp, Rattus norvegicus
tctacgactatgtccctcgggaaag

SEQ ID NO: 592612 - DNA, 25 bp, Rattus norvegicus
tctacgaggcagaagcagcagcacc

SEQ ID NO: 592613 - DNA, 25 bp, Rattus norvegicus
tctacgaggcagtagcagcagcacc

SEQ ID NO: 592614 - DNA, 25 bp, Rattus norvegicus
tctacgatcccaattcaacctcgag

SEQ ID NO: 592615 - DNA, 25 bp, Rattus norvegicus
tctacgatcccatttcaacctcgag

SEQ ID NO: 592616 - DNA, 25 bp, Rattus norvegicus
tctacgcagcgaaggtttcagtgtt

SEQ ID NO: 592617 - DNA, 25 bp, Rattus norvegicus
tctacgcagcgatggtttcagtgtt

SEQ ID NO: 592618 - DNA, 25 bp, Rattus norvegicus
tctacgcatgctccctagggctgga

SEQ ID NO: 592619 - DNA, 25 bp, Rattus norvegicus
tctacgcatgctgcctagggctgga

SEQ ID NO: 592620 - DNA, 25 bp, Rattus norvegicus
tctacgcattaaaaaccccttcaca

SEQ ID NO: 592621 - DNA, 25 bp, Rattus norvegicus
tctacgcattaataaccccttcaca

SEQ ID NO: 592622 - DNA, 25 bp, Rattus norvegicus
tctacgccattaatgtctgtgcgtt

SEQ ID NO: 592623 - DNA, 25 bp, Rattus norvegicus
tctacgccattattgtctgtgcgtt

SEQ ID NO: 592624 - DNA, 25 bp, Rattus norvegicus
tctacgcccaagaccaacatgataa

SEQ ID NO: 592625 - DNA, 25 bp, Rattus norvegicus
tctacgcccaagtccaacatgataa

SEQ ID NO: 592626 - DNA, 25 bp, Rattus norvegicus
tctacgccgcctcgaagttctcggg

SEQ ID NO: 592627 - DNA, 25 bp, Rattus norvegicus
tctacgccgcctggaagttctcggg

SEQ ID NO: 592628 - DNA, 25 bp, Rattus norvegicus
tctacgctgatgacattgccctgct

SEQ ID NO: 592629 - DNA, 25 bp, Rattus norvegicus
tctacgctgatgatcccctaaataa

SEQ ID NO: 592630 - DNA, 25 bp, Rattus norvegicus
tctacgctgatgtcattgccctgct

SEQ ID NO: 592631 - DNA, 25 bp, Rattus norvegicus
tctacgctgatgttcccctaaataa

SEQ ID NO: 592632 - DNA, 25 bp, Rattus norvegicus
tctacgcttagcatacaggtccaac

SEQ ID NO: 592633 - DNA, 25 bp, Rattus norvegicus
tctacgcttagcttacaggtccaac

SEQ ID NO: 592634 - DNA, 25 bp, Rattus norvegicus
tctacggaactgctttcgttttgct

SEQ ID NO: 592635 - DNA, 25 bp, Rattus norvegicus
tctacggaactggtttcgttttgct

SEQ ID NO: 592636 - DNA, 25 bp, Rattus norvegicus
tctacggacgctagtggagcattct

SEQ ID NO: 592637 - DNA, 25 bp, Rattus norvegicus
tctacggacgcttgtggagcattct

SEQ ID NO: 592638 - DNA, 25 bp, Rattus norvegicus
tctacggccgccagtattccgagag

SEQ ID NO: 592639 - DNA, 25 bp, Rattus norvegicus
tctacggccgcctgtattccgagag

SEQ ID NO: 592640 - DNA, 25 bp, Rattus norvegicus
tctacggctaccaacagaagactgg

SEQ ID NO: 592641 - DNA, 25 bp, Rattus norvegicus
tctacggctacccttcaggagagaa

SEQ ID NO: 592642 - DNA, 25 bp, Rattus norvegicus
tctacggctaccgttcaggagagaa

SEQ ID NO: 592643 - DNA, 25 bp, Rattus norvegicus
tctacggctacctacagaagactgg

SEQ ID NO: 592644 - DNA, 25 bp, Rattus norvegicus
tctacggtagacagcaggctctctc

SEQ ID NO: 592645 - DNA, 25 bp, Rattus norvegicus
tctacggtagactgcaggctctctc

SEQ ID NO: 592646 - DNA, 25 bp, Rattus norvegicus
tctacggtctcaacgtggccctaat

SEQ ID NO: 592647 - DNA, 25 bp, Rattus norvegicus
tctacggtctcatcgtggccctaat

SEQ ID NO: 592648 - DNA, 25 bp, Rattus norvegicus
tctacggtctgtcaagttgctgtcc

SEQ ID NO: 592649 - DNA, 25 bp, Rattus norvegicus
tctacggtctgtgaagttgctgtcc

SEQ ID NO: 592650 - DNA, 25 bp, Rattus norvegicus
tctacggtgattaccacgaagcctt

SEQ ID NO: 592651 - DNA, 25 bp, Rattus norvegicus
tctacggtgatttccacgaagcctt

SEQ ID NO: 592652 - DNA, 25 bp, Rattus norvegicus
tctacgtcctgtatggtggttggga

SEQ ID NO: 592653 - DNA, 25 bp, Rattus norvegicus
tctacgtcctgtttggtggttggga

SEQ ID NO: 592654 - DNA, 25 bp, Rattus norvegicus
tctacgtctttactgcgggtgattt

SEQ ID NO: 592655 - DNA, 25 bp, Rattus norvegicus
tctacgtctttagtgcgggtgattt

SEQ ID NO: 592656 - DNA, 25 bp, Rattus norvegicus
tctacgtgtttgagtggagggtaca

SEQ ID NO: 592657 - DNA, 25 bp, Rattus norvegicus
tctacgtgtttgtgtggagggtaca

SEQ ID NO: 592658 - DNA, 25 bp, Rattus norvegicus
tctacgttagccagtctcatcattt

SEQ ID NO: 592659 - DNA, 25 bp, Rattus norvegicus
tctacgttagcctgtctcatcattt

SEQ ID NO: 592660 - DNA, 25 bp, Rattus norvegicus
tctacgttcgatagagcgggcctgg

SEQ ID NO: 592661 - DNA, 25 bp, Rattus norvegicus
tctacgttcgattgagcgggcctgg

SEQ ID NO: 592662 - DNA, 25 bp, Rattus norvegicus
tctacgttttaccaagtgggacctg

SEQ ID NO: 592663 - DNA, 25 bp, Rattus norvegicus
tctacgttttacgaagtgggacctg

SEQ ID NO: 592664 - DNA, 25 bp, Rattus norvegicus
tctactaaagttcctatccttggca

SEQ ID NO: 592665 - DNA, 25 bp, Rattus norvegicus
tctactaaagttgctatccttggca

SEQ ID NO: 592666 - DNA, 25 bp, Rattus norvegicus
tctactaaatgtctctgtcctgcga

SEQ ID NO: 592667 - DNA, 25 bp, Rattus norvegicus
tctactaaatgtgtctgtcctgcga

SEQ ID NO: 592668 - DNA, 25 bp, Rattus norvegicus
tctactaacagcagggttcattccc

SEQ ID NO: 592669 - DNA, 25 bp, Rattus norvegicus
tctactaacagctgggttcattccc

SEQ ID NO: 592670 - DNA, 25 bp, Rattus norvegicus
tctactaaggttactgcacagccaa

SEQ ID NO: 592671 - DNA, 25 bp, Rattus norvegicus
tctactaaggtttctgcacagccaa

SEQ ID NO: 592672 - DNA, 25 bp, Rattus norvegicus
tctactactgcactatccgttgtga

SEQ ID NO: 592673 - DNA, 25 bp, Rattus norvegicus
tctactactgcagtatccgttgtga

SEQ ID NO: 592674 - DNA, 25 bp, Rattus norvegicus
tctactactgtgaactgcccagctc

SEQ ID NO: 592675 - DNA, 25 bp, Rattus norvegicus
tctactactgtgtactgcccagctc

SEQ ID NO: 592676 - DNA, 25 bp, Rattus norvegicus
tctactcacctcacttgattatcat

SEQ ID NO: 592677 - DNA, 25 bp, Rattus norvegicus
tctactcacctcagcttcgatacaa

SEQ ID NO: 592678 - DNA, 25 bp, Rattus norvegicus
tctactcacctctcttgattatcat

SEQ ID NO: 592679 - DNA, 25 bp, Rattus norvegicus
tctactcacctctgcttcgatacaa

SEQ ID NO: 592680 - DNA, 25 bp, Rattus norvegicus
tctactcacggacaccatgaccaag

SEQ ID NO: 592681 - DNA, 25 bp, Rattus norvegicus
tctactcacggagaccatgaccaag

SEQ ID NO: 592682 - DNA, 25 bp, Rattus norvegicus
tctactcattcaatacacgcctctt

SEQ ID NO: 592683 - DNA, 25 bp, Rattus norvegicus
tctactcattcattacacgcctctt

SEQ ID NO: 592684 - DNA, 25 bp, Rattus norvegicus
tctactccatggaggctgttgcttt

SEQ ID NO: 592685 - DNA, 25 bp, Rattus norvegicus
tctactccatggtggctgttgcttt

SEQ ID NO: 592686 - DNA, 25 bp, Rattus norvegicus
tctactcccatgaattcacctttga

SEQ ID NO: 592687 - DNA, 25 bp, Rattus norvegicus
tctactcccatgtattcacctttga

SEQ ID NO: 592688 - DNA, 25 bp, Rattus norvegicus
tctactccgcctctgtggaagaaaa

SEQ ID NO: 592689 - DNA, 25 bp, Rattus norvegicus
tctactccgcctgtgtggaagaaaa

SEQ ID NO: 592690 - DNA, 25 bp, Rattus norvegicus
tctactcctaatctggttccatgtg

SEQ ID NO: 592691 - DNA, 25 bp, Rattus norvegicus
tctactcctaatgtggttccatgtg

SEQ ID NO: 592692 - DNA, 25 bp, Rattus norvegicus
tctactcctgctacgctggcggtga

SEQ ID NO: 592693 - DNA, 25 bp, Rattus norvegicus
tctactcctgctatgtctttcagaa

SEQ ID NO: 592694 - DNA, 25 bp, Rattus norvegicus
tctactcctgcttcgctggcggtga

SEQ ID NO: 592695 - DNA, 25 bp, Rattus norvegicus
tctactcctgctttgtctttcagaa

SEQ ID NO: 592696 - DNA, 25 bp, Rattus norvegicus
tctactcctgttatgctacattctc

SEQ ID NO: 592697 - DNA, 25 bp, Rattus norvegicus
tctactcctgttttgctacattctc

SEQ ID NO: 592698 - DNA, 25 bp, Rattus norvegicus
tctactcgagctagtgtgtccctaa

SEQ ID NO: 592699 - DNA, 25 bp, Rattus norvegicus
tctactcgagcttgtgtgtccctaa

SEQ ID NO: 592700 - DNA, 25 bp, Rattus norvegicus
tctactcggccgctgcgctacagga

SEQ ID NO: 592701 - DNA, 25 bp, Rattus norvegicus
tctactcggccggtgcgctacagga

SEQ ID NO: 592702 - DNA, 25 bp, Rattus norvegicus
tctactctagatcgcaacattggac

SEQ ID NO: 592703 - DNA, 25 bp, Rattus norvegicus
tctactctagatggcaacattggac

SEQ ID NO: 592704 - DNA, 25 bp, Rattus norvegicus
tctactctatctctcaggattaatt

SEQ ID NO: 592705 - DNA, 25 bp, Rattus norvegicus
tctactctatctgtcaggattaatt

SEQ ID NO: 592706 - DNA, 25 bp, Rattus norvegicus
tctactctctgcaatatttcacctt

SEQ ID NO: 592707 - DNA, 25 bp, Rattus norvegicus
tctactctctgctatatttcacctt

SEQ ID NO: 592708 - DNA, 25 bp, Rattus norvegicus
tctactctctgtacctggatagttt

SEQ ID NO: 592709 - DNA, 25 bp, Rattus norvegicus
tctactctctgttcctggatagttt

SEQ ID NO: 592710 - DNA, 25 bp, Rattus norvegicus
tctactctgaccctagacaatctgg

SEQ ID NO: 592711 - DNA, 25 bp, Rattus norvegicus
tctactctgaccgtagacaatctgg

SEQ ID NO: 592712 - DNA, 25 bp, Rattus norvegicus
tctactctggtactaagcatcggtt

SEQ ID NO: 592713 - DNA, 25 bp, Rattus norvegicus
tctactctggtagtaagcatcggtt

SEQ ID NO: 592714 - DNA, 25 bp, Rattus norvegicus
tctactgacccacggtggctgtgac

SEQ ID NO: 592715 - DNA, 25 bp, Rattus norvegicus
tctactgacccagggtggctgtgac

SEQ ID NO: 592716 - DNA, 25 bp, Rattus norvegicus
tctactgactcaactgtgggcaaca

SEQ ID NO: 592717 - DNA, 25 bp, Rattus norvegicus
tctactgactcatctgtgggcaaca

SEQ ID NO: 592718 - DNA, 25 bp, Rattus norvegicus
tctactgagaataccatggcttcat

SEQ ID NO: 592719 - DNA, 25 bp, Rattus norvegicus
tctactgagaattccatggcttcat

SEQ ID NO: 592720 - DNA, 25 bp, Rattus norvegicus
tctactgcactgataggcgacagca

SEQ ID NO: 592721 - DNA, 25 bp, Rattus norvegicus
tctactgcactgttaggcgacagca

SEQ ID NO: 592722 - DNA, 25 bp, Rattus norvegicus
tctactgcagacatggttttcgaaa

SEQ ID NO: 592723 - DNA, 25 bp, Rattus norvegicus
tctactgcagacttggttttcgaaa

SEQ ID NO: 592724 - DNA, 25 bp, Rattus norvegicus
tctactgcagagaaactagccgact

SEQ ID NO: 592725 - DNA, 25 bp, Rattus norvegicus
tctactgcagagtaactagccgact

SEQ ID NO: 592726 - DNA, 25 bp, Rattus norvegicus
tctactgcagtcctggtaatgccag

SEQ ID NO: 592727 - DNA, 25 bp, Rattus norvegicus
tctactgcagtcgtggtaatgccag

SEQ ID NO: 592728 - DNA, 25 bp, Rattus norvegicus
tctactgccagaaaaatgttacctt

SEQ ID NO: 592729 - DNA, 25 bp, Rattus norvegicus
tctactgccagaattaacattaaac

SEQ ID NO: 592730 - DNA, 25 bp, Rattus norvegicus
tctactgccagataaatgttacctt

SEQ ID NO: 592731 - DNA, 25 bp, Rattus norvegicus
tctactgccagatttaacattaaac

SEQ ID NO: 592732 - DNA, 25 bp, Rattus norvegicus
tctactgcctacacacaagctttag

SEQ ID NO: 592733 - DNA, 25 bp, Rattus norvegicus
tctactgcctactcacaagctttag

SEQ ID NO: 592734 - DNA, 25 bp, Rattus norvegicus
tctactgcgagaataaacaccattc

SEQ ID NO: 592735 - DNA, 25 bp, Rattus norvegicus
tctactgcgagattaaacaccattc

SEQ ID NO: 592736 - DNA, 25 bp, Rattus norvegicus
tctactggagtcacccgcggaagtt

SEQ ID NO: 592737 - DNA, 25 bp, Rattus norvegicus
tctactggagtctcccgcggaagtt

SEQ ID NO: 592738 - DNA, 25 bp, Rattus norvegicus
tctactggcgtgagcacctggtgcg

SEQ ID NO: 592739 - DNA, 25 bp, Rattus norvegicus
tctactggcgtgtgcacctggtgcg

SEQ ID NO: 592740 - DNA, 25 bp, Rattus norvegicus
tctactgggaggcaaagcctttcct

SEQ ID NO: 592741 - DNA, 25 bp, Rattus norvegicus
tctactgggagggaaagcctttcct

SEQ ID NO: 592742 - DNA, 25 bp, Rattus norvegicus
tctactgggcaaagacttgctcctt

SEQ ID NO: 592743 - DNA, 25 bp, Rattus norvegicus
tctactgggcaatgacttgctcctt

SEQ ID NO: 592744 - DNA, 25 bp, Rattus norvegicus
tctactgggcacatccatactacag

SEQ ID NO: 592745 - DNA, 25 bp, Rattus norvegicus
tctactgggcacttccatactacag

SEQ ID NO: 592746 - DNA, 25 bp, Rattus norvegicus
tctactggtactaacagaagtctgt

SEQ ID NO: 592747 - DNA, 25 bp, Rattus norvegicus
tctactggtacttacagaagtctgt

SEQ ID NO: 592748 - DNA, 25 bp, Rattus norvegicus
tctactgtagcaatcttaggcgttt

SEQ ID NO: 592749 - DNA, 25 bp, Rattus norvegicus
tctactgtagcattcttaggcgttt

SEQ ID NO: 592750 - DNA, 25 bp, Rattus norvegicus
tctactgtcactaagctgctcatgt

SEQ ID NO: 592751 - DNA, 25 bp, Rattus norvegicus
tctactgtcacttagctgctcatgt

SEQ ID NO: 592752 - DNA, 25 bp, Rattus norvegicus
tctactgtgcctctgtgcattaata

SEQ ID NO: 592753 - DNA, 25 bp, Rattus norvegicus
tctactgtgcctgtgtgcattaata

SEQ ID NO: 592754 - DNA, 25 bp, Rattus norvegicus
tctactgtggaaacattttgactca

SEQ ID NO: 592755 - DNA, 25 bp, Rattus norvegicus
tctactgtggaatcattttgactca

SEQ ID NO: 592756 - DNA, 25 bp, Rattus norvegicus
tctactgtgtatccttatgtgccca

SEQ ID NO: 592757 - DNA, 25 bp, Rattus norvegicus
tctactgtgtatgcttatgtgccca

SEQ ID NO: 592758 - DNA, 25 bp, Rattus norvegicus
tctactgtgtgacctgctggagtcc

SEQ ID NO: 592759 - DNA, 25 bp, Rattus norvegicus
tctactgtgtgagctgctggagtcc

SEQ ID NO: 592760 - DNA, 25 bp, Rattus norvegicus
tctactgttaacctttgatccccaa

SEQ ID NO: 592761 - DNA, 25 bp, Rattus norvegicus
tctactgttaacgtttgatccccaa

SEQ ID NO: 592762 - DNA, 25 bp, Rattus norvegicus
tctactgttctgcttgacttgtttg

SEQ ID NO: 592763 - DNA, 25 bp, Rattus norvegicus
tctactgttctggttgacttgtttg

SEQ ID NO: 592764 - DNA, 25 bp, Rattus norvegicus
tctactgttgaaccgcaagagccct

SEQ ID NO: 592765 - DNA, 25 bp, Rattus norvegicus
tctactgttgaagcgcaagagccct

SEQ ID NO: 592766 - DNA, 25 bp, Rattus norvegicus
tctacttaccaaaccttggacgcca

SEQ ID NO: 592767 - DNA, 25 bp, Rattus norvegicus
tctacttaccaatccttggacgcca

SEQ ID NO: 592768 - DNA, 25 bp, Rattus norvegicus
tctacttataagcaaacccacctca

SEQ ID NO: 592769 - DNA, 25 bp, Rattus norvegicus
tctacttataaggaaacccacctca

SEQ ID NO: 592770 - DNA, 25 bp, Rattus norvegicus
tctacttcaaccagaccaagggctt

SEQ ID NO: 592771 - DNA, 25 bp, Rattus norvegicus
tctacttcaacctgaccaagggctt

SEQ ID NO: 592772 - DNA, 25 bp, Rattus norvegicus
tctacttcaagcctctgactcaaaa

SEQ ID NO: 592773 - DNA, 25 bp, Rattus norvegicus
tctacttcaagcgtctgactcaaaa

SEQ ID NO: 592774 - DNA, 25 bp, Rattus norvegicus
tctacttcaatgctaccaagggctt

SEQ ID NO: 592775 - DNA, 25 bp, Rattus norvegicus
tctacttcaatggtaccaagggctt

SEQ ID NO: 592776 - DNA, 25 bp, Rattus norvegicus
tctacttcaggccttctcaaaaagc

SEQ ID NO: 592777 - DNA, 25 bp, Rattus norvegicus
tctacttcaggcgttctcaaaaagc

SEQ ID NO: 592778 - DNA, 25 bp, Rattus norvegicus
tctacttccctcatagacacaggag

SEQ ID NO: 592779 - DNA, 25 bp, Rattus norvegicus
tctacttccctcttagacacaggag

SEQ ID NO: 592780 - DNA, 25 bp, Rattus norvegicus
tctacttccgctatttctgtgggag

SEQ ID NO: 592781 - DNA, 25 bp, Rattus norvegicus
tctacttccgctttttctgtgggag

SEQ ID NO: 592782 - DNA, 25 bp, Rattus norvegicus
tctacttcctgtacaatcctatggg

SEQ ID NO: 592783 - DNA, 25 bp, Rattus norvegicus
tctacttcctgttcaatcctatggg

SEQ ID NO: 592784 - DNA, 25 bp, Rattus norvegicus
tctacttcctttaggcaagcttctt

SEQ ID NO: 592785 - DNA, 25 bp, Rattus norvegicus
tctacttccttttggcaagcttctt

SEQ ID NO: 592786 - DNA, 25 bp, Rattus norvegicus
tctacttctataagctgctgcctca

SEQ ID NO: 592787 - DNA, 25 bp, Rattus norvegicus
tctacttctatatgctgctgcctca

SEQ ID NO: 592788 - DNA, 25 bp, Rattus norvegicus
tctacttcttcaccttcatattctg

SEQ ID NO: 592789 - DNA, 25 bp, Rattus norvegicus
tctacttcttcagcttcatattctg

SEQ ID NO: 592790 - DNA, 25 bp, Rattus norvegicus
tctacttgaaaaagctctcctccag

SEQ ID NO: 592791 - DNA, 25 bp, Rattus norvegicus
tctacttgaaaatgctctcctccag

SEQ ID NO: 592792 - DNA, 25 bp, Rattus norvegicus
tctacttggtctcgcctgggtggaa

SEQ ID NO: 592793 - DNA, 25 bp, Rattus norvegicus
tctacttggtctggcctgggtggaa

SEQ ID NO: 592794 - DNA, 25 bp, Rattus norvegicus
tctacttggtgtatagaccctcgct

SEQ ID NO: 592795 - DNA, 25 bp, Rattus norvegicus
tctacttggtgtttagaccctcgct

SEQ ID NO: 592796 - DNA, 25 bp, Rattus norvegicus
tctacttgtgtgagggtctccagga

SEQ ID NO: 592797 - DNA, 25 bp, Rattus norvegicus
tctacttgtgtgtgggtctccagga

SEQ ID NO: 592798 - DNA, 25 bp, Rattus norvegicus
tctactttacctcactagctaatgt

SEQ ID NO: 592799 - DNA, 25 bp, Rattus norvegicus
tctactttacctgactagctaatgt

SEQ ID NO: 592800 - DNA, 25 bp, Rattus norvegicus
tctactttatatacctttccattcc

SEQ ID NO: 592801 - DNA, 25 bp, Rattus norvegicus
tctactttatattcctttccattcc

SEQ ID NO: 592802 - DNA, 25 bp, Rattus norvegicus
tctactttcttaaatcttctttctt

SEQ ID NO: 592803 - DNA, 25 bp, Rattus norvegicus
tctactttcttatatcttctttctt

SEQ ID NO: 592804 - DNA, 25 bp, Rattus norvegicus
tctactttgacgactacgcccagca

SEQ ID NO: 592805 - DNA, 25 bp, Rattus norvegicus
tctactttgacgtctacgcccagca

SEQ ID NO: 592806 - DNA, 25 bp, Rattus norvegicus
tctactttgagaacctgctggccaa

SEQ ID NO: 592807 - DNA, 25 bp, Rattus norvegicus
tctactttgagatcctgctggccaa

SEQ ID NO: 592808 - DNA, 25 bp, Rattus norvegicus
tctactttgtgtatggtgaccggta

SEQ ID NO: 592809 - DNA, 25 bp, Rattus norvegicus
tctactttgtgtttggtgaccggta

SEQ ID NO: 592810 - DNA, 25 bp, Rattus norvegicus
tctacttttccgagtccgcgtttct

SEQ ID NO: 592811 - DNA, 25 bp, Rattus norvegicus
tctacttttccgtgtccgcgtttct

SEQ ID NO: 592812 - DNA, 25 bp, Rattus norvegicus
tctacttttctaacaataacctcga

SEQ ID NO: 592813 - DNA, 25 bp, Rattus norvegicus
tctacttttctatcaataacctcga

SEQ ID NO: 592814 - DNA, 25 bp, Rattus norvegicus
tctacttttcttcactctgcgggat

SEQ ID NO: 592815 - DNA, 25 bp, Rattus norvegicus
tctacttttcttgactctgcgggat

SEQ ID NO: 592816 - DNA, 25 bp, Rattus norvegicus
tctagaaaagctatcttcttcctct

SEQ ID NO: 592817 - DNA, 25 bp, Rattus norvegicus
tctagaaaagctttcttcttcctct

SEQ ID NO: 592818 - DNA, 25 bp, Rattus norvegicus
tctagaaactctatgagccaaactt

SEQ ID NO: 592819 - DNA, 25 bp, Rattus norvegicus
tctagaaactctttgagccaaactt

SEQ ID NO: 592820 - DNA, 25 bp, Rattus norvegicus
tctagaacactgactgccagaggat

SEQ ID NO: 592821 - DNA, 25 bp, Rattus norvegicus
tctagaacactgtctgccagaggat

SEQ ID NO: 592822 - DNA, 25 bp, Rattus norvegicus
tctagaagacaactccatacctcag

SEQ ID NO: 592823 - DNA, 25 bp, Rattus norvegicus
tctagaagacaagtccatacctcag

SEQ ID NO: 592824 - DNA, 25 bp, Rattus norvegicus
tctagaagcccgattcacttttgtt

SEQ ID NO: 592825 - DNA, 25 bp, Rattus norvegicus
tctagaagcccgtttcacttttgtt

SEQ ID NO: 592826 - DNA, 25 bp, Rattus norvegicus
tctagaaggacgcaggctgaccact

SEQ ID NO: 592827 - DNA, 25 bp, Rattus norvegicus
tctagaaggacggaggctgaccact

SEQ ID NO: 592828 - DNA, 25 bp, Rattus norvegicus
tctagaagtctgaaaacgctccaag

SEQ ID NO: 592829 - DNA, 25 bp, Rattus norvegicus
tctagaagtctgtaaacgctccaag

SEQ ID NO: 592830 - DNA, 25 bp, Rattus norvegicus
tctagaatagaaagtccaagggtta

SEQ ID NO: 592831 - DNA, 25 bp, Rattus norvegicus
tctagaatagaatgtccaagggtta

SEQ ID NO: 592832 - DNA, 25 bp, Rattus norvegicus
tctagaattcaaaggcagctgctgg

SEQ ID NO: 592833 - DNA, 25 bp, Rattus norvegicus
tctagaattcaatggcagctgctgg

SEQ ID NO: 592834 - DNA, 25 bp, Rattus norvegicus
tctagaattgaaatcaggccctcag

SEQ ID NO: 592835 - DNA, 25 bp, Rattus norvegicus
tctagaattgaattcaggccctcag

SEQ ID NO: 592836 - DNA, 25 bp, Rattus norvegicus
tctagaattttcctatttccacctc

SEQ ID NO: 592837 - DNA, 25 bp, Rattus norvegicus
tctagaattttcgtatttccacctc

SEQ ID NO: 592838 - DNA, 25 bp, Rattus norvegicus
tctagacaatagcaaccccgttctc

SEQ ID NO: 592839 - DNA, 25 bp, Rattus norvegicus
tctagacaataggaaccccgttctc

SEQ ID NO: 592840 - DNA, 25 bp, Rattus norvegicus
tctagacaccctctgaagttcttca

SEQ ID NO: 592841 - DNA, 25 bp, Rattus norvegicus
tctagacaccctgtgaagttcttca

SEQ ID NO: 592842 - DNA, 25 bp, Rattus norvegicus
tctagacactttaccccttgtgggt

SEQ ID NO: 592843 - DNA, 25 bp, Rattus norvegicus
tctagacacttttccccttgtgggt

SEQ ID NO: 592844 - DNA, 25 bp, Rattus norvegicus
tctagaccaatgcagccaagctcag

SEQ ID NO: 592845 - DNA, 25 bp, Rattus norvegicus
tctagaccaatggagccaagctcag

SEQ ID NO: 592846 - DNA, 25 bp, Rattus norvegicus
tctagaccgtgcctgttctgaatac

SEQ ID NO: 592847 - DNA, 25 bp, Rattus norvegicus
tctagaccgtgcgtgttctgaatac

SEQ ID NO: 592848 - DNA, 25 bp, Rattus norvegicus
tctagacctaccaccctgggagatg

SEQ ID NO: 592849 - DNA, 25 bp, Rattus norvegicus
tctagacctacctccctgggagatg

SEQ ID NO: 592850 - DNA, 25 bp, Rattus norvegicus
tctagaccttgaagggccactgtct

SEQ ID NO: 592851 - DNA, 25 bp, Rattus norvegicus
tctagaccttgatgggccactgtct

SEQ ID NO: 592852 - DNA, 25 bp, Rattus norvegicus
tctagacgctgaccacttacgtgta

SEQ ID NO: 592853 - DNA, 25 bp, Rattus norvegicus
tctagacgctgagcacttacgtgta

SEQ ID NO: 592854 - DNA, 25 bp, Rattus norvegicus
tctagacgtctacaacttgcctaag

SEQ ID NO: 592855 - DNA, 25 bp, Rattus norvegicus
tctagacgtctagaacttgcctaag

SEQ ID NO: 592856 - DNA, 25 bp, Rattus norvegicus
tctagactagaactccgacggatcg

SEQ ID NO: 592857 - DNA, 25 bp, Rattus norvegicus
tctagactagaagtccgacggatcg

SEQ ID NO: 592858 - DNA, 25 bp, Rattus norvegicus
tctagactcaagctggacctgtgtg

SEQ ID NO: 592859 - DNA, 25 bp, Rattus norvegicus
tctagactcaaggtggacctgtgtg

SEQ ID NO: 592860 - DNA, 25 bp, Rattus norvegicus
tctagactctctcaacctggttgtg

SEQ ID NO: 592861 - DNA, 25 bp, Rattus norvegicus
tctagactctctgaacctggttgtg

SEQ ID NO: 592862 - DNA, 25 bp, Rattus norvegicus
tctagacttgtcagccttccttcaa

SEQ ID NO: 592863 - DNA, 25 bp, Rattus norvegicus
tctagacttgtctgccttccttcaa

SEQ ID NO: 592864 - DNA, 25 bp, Rattus norvegicus
tctagactttagaagggctcctctg

SEQ ID NO: 592865 - DNA, 25 bp, Rattus norvegicus
tctagactttagtagggctcctctg

SEQ ID NO: 592866 - DNA, 25 bp, Rattus norvegicus
tctagagacgggaagcagcctcatt

SEQ ID NO: 592867 - DNA, 25 bp, Rattus norvegicus
tctagagacgggtagcagcctcatt

SEQ ID NO: 592868 - DNA, 25 bp, Rattus norvegicus
tctagagactagaagttcccctgcc

SEQ ID NO: 592869 - DNA, 25 bp, Rattus norvegicus
tctagagactagtagttcccctgcc

SEQ ID NO: 592870 - DNA, 25 bp, Rattus norvegicus
tctagagatttgagctgcgtagcaa

SEQ ID NO: 592871 - DNA, 25 bp, Rattus norvegicus
tctagagatttgtgctgcgtagcaa

SEQ ID NO: 592872 - DNA, 25 bp, Rattus norvegicus
tctagagcagctacttacgagcccg

SEQ ID NO: 592873 - DNA, 25 bp, Rattus norvegicus
tctagagcagcttcttacgagcccg

SEQ ID NO: 592874 - DNA, 25 bp, Rattus norvegicus
tctagagctcccaggacacggtgct

SEQ ID NO: 592875 - DNA, 25 bp, Rattus norvegicus
tctagagctccctggacacggtgct

SEQ ID NO: 592876 - DNA, 25 bp, Rattus norvegicus
tctagaggaactccccacctaagag

SEQ ID NO: 592877 - DNA, 25 bp, Rattus norvegicus
tctagaggaactgcccacctaagag

SEQ ID NO: 592878 - DNA, 25 bp, Rattus norvegicus
tctagaggcagcaggccatggtctc

SEQ ID NO: 592879 - DNA, 25 bp, Rattus norvegicus
tctagaggcagctggccatggtctc

SEQ ID NO: 592880 - DNA, 25 bp, Rattus norvegicus
tctagaggtgaacccctgatttcct

SEQ ID NO: 592881 - DNA, 25 bp, Rattus norvegicus
tctagaggtgaagccctgatttcct

SEQ ID NO: 592882 - DNA, 25 bp, Rattus norvegicus
tctagagtcacactggctgctccta

SEQ ID NO: 592883 - DNA, 25 bp, Rattus norvegicus
tctagagtcacagtggctgctccta

SEQ ID NO: 592884 - DNA, 25 bp, Rattus norvegicus
tctagagtcctacttctgtttcttc

SEQ ID NO: 592885 - DNA, 25 bp, Rattus norvegicus
tctagagtcctagttctgtttcttc

SEQ ID NO: 592886 - DNA, 25 bp, Rattus norvegicus
tctagagtctcacggtcatggtcac

SEQ ID NO: 592887 - DNA, 25 bp, Rattus norvegicus
tctagagtctcagggtcatggtcac

SEQ ID NO: 592888 - DNA, 25 bp, Rattus norvegicus
tctagagtcttacttttcatcacac

SEQ ID NO: 592889 - DNA, 25 bp, Rattus norvegicus
tctagagtcttagttttcatcacac

SEQ ID NO: 592890 - DNA, 25 bp, Rattus norvegicus
tctagagtgctgagtccctgagtca

SEQ ID NO: 592891 - DNA, 25 bp, Rattus norvegicus
tctagagtgctgtgtccctgagtca

SEQ ID NO: 592892 - DNA, 25 bp, Rattus norvegicus
tctagagttcagagcaggccctggt

SEQ ID NO: 592893 - DNA, 25 bp, Rattus norvegicus
tctagagttcagtgcaggccctggt

SEQ ID NO: 592894 - DNA, 25 bp, Rattus norvegicus
tctagagttgatagacaggtgccat

SEQ ID NO: 592895 - DNA, 25 bp, Rattus norvegicus
tctagagttgattgacaggtgccat

SEQ ID NO: 592896 - DNA, 25 bp, Rattus norvegicus
tctagagtttaacgagcatcatgct

SEQ ID NO: 592897 - DNA, 25 bp, Rattus norvegicus
tctagagtttaaggagcatcatgct

SEQ ID NO: 592898 - DNA, 25 bp, Rattus norvegicus
tctagatacgttcctggctggacca

SEQ ID NO: 592899 - DNA, 25 bp, Rattus norvegicus
tctagatacgttgctggctggacca

SEQ ID NO: 592900 - DNA, 25 bp, Rattus norvegicus
tctagatcggctcaggacgctaaag

SEQ ID NO: 592901 - DNA, 25 bp, Rattus norvegicus
tctagatcggctgaggacgctaaag

SEQ ID NO: 592902 - DNA, 25 bp, Rattus norvegicus
tctagatgtggtctcgttgcagcta

SEQ ID NO: 592903 - DNA, 25 bp, Rattus norvegicus
tctagatgtggtgtcgttgcagcta

SEQ ID NO: 592904 - DNA, 25 bp, Rattus norvegicus
tctagattacttctcagactgccgg

SEQ ID NO: 592905 - DNA, 25 bp, Rattus norvegicus
tctagattacttgtcagactgccgg

SEQ ID NO: 592906 - DNA, 25 bp, Rattus norvegicus
tctagattcctaagtacttggtttc

SEQ ID NO: 592907 - DNA, 25 bp, Rattus norvegicus
tctagattcctatgtacttggtttc

SEQ ID NO: 592908 - DNA, 25 bp, Rattus norvegicus
tctagattctctcccagcatcggaa

SEQ ID NO: 592909 - DNA, 25 bp, Rattus norvegicus
tctagattctctgccagcatcggaa

SEQ ID NO: 592910 - DNA, 25 bp, Rattus norvegicus
tctagcaataggcacatggtctgta

SEQ ID NO: 592911 - DNA, 25 bp, Rattus norvegicus
tctagcaatagggacatggtctgta

SEQ ID NO: 592912 - DNA, 25 bp, Rattus norvegicus
tctagcacccagctggatggcagag

SEQ ID NO: 592913 - DNA, 25 bp, Rattus norvegicus
tctagcacccaggtggatggcagag

SEQ ID NO: 592914 - DNA, 25 bp, Rattus norvegicus
tctagcacctctaacaagaaccact

SEQ ID NO: 592915 - DNA, 25 bp, Rattus norvegicus
tctagcacctcttacaagaaccact

SEQ ID NO: 592916 - DNA, 25 bp, Rattus norvegicus
tctagcacctgcagaggcctggctc

SEQ ID NO: 592917 - DNA, 25 bp, Rattus norvegicus
tctagcacctgctgaggcctggctc

SEQ ID NO: 592918 - DNA, 25 bp, Rattus norvegicus
tctagcactttccacattcatgttt

SEQ ID NO: 592919 - DNA, 25 bp, Rattus norvegicus
tctagcactttcgacattcatgttt

SEQ ID NO: 592920 - DNA, 25 bp, Rattus norvegicus
tctagcagaatgaccaagttatttg

SEQ ID NO: 592921 - DNA, 25 bp, Rattus norvegicus
tctagcagaatgtccaagttatttg

SEQ ID NO: 592922 - DNA, 25 bp, Rattus norvegicus
tctagcagagacattccaaacaggc

SEQ ID NO: 592923 - DNA, 25 bp, Rattus norvegicus
tctagcagagactttccaaacaggc

SEQ ID NO: 592924 - DNA, 25 bp, Rattus norvegicus
tctagcagagagacaccaactttcc

SEQ ID NO: 592925 - DNA, 25 bp, Rattus norvegicus
tctagcagagagtcaccaactttcc

SEQ ID NO: 592926 - DNA, 25 bp, Rattus norvegicus
tctagcagatcaccatctgaaggct

SEQ ID NO: 592927 - DNA, 25 bp, Rattus norvegicus
tctagcagatcagcatctgaaggct

SEQ ID NO: 592928 - DNA, 25 bp, Rattus norvegicus
tctagcagccttagtagctataggt

SEQ ID NO: 592929 - DNA, 25 bp, Rattus norvegicus
tctagcagcctttgtagctataggt

SEQ ID NO: 592930 - DNA, 25 bp, Rattus norvegicus
tctagcagggttcttgactgccctt

SEQ ID NO: 592931 - DNA, 25 bp, Rattus norvegicus
tctagcagggttgttgactgccctt

SEQ ID NO: 592932 - DNA, 25 bp, Rattus norvegicus
tctagcatgaacatggtctccaggc

SEQ ID NO: 592933 - DNA, 25 bp, Rattus norvegicus
tctagcatgaacttggtctccaggc

SEQ ID NO: 592934 - DNA, 25 bp, Rattus norvegicus
tctagcatgacacagggttccgatt

SEQ ID NO: 592935 - DNA, 25 bp, Rattus norvegicus
tctagcatgacagagggttccgatt

SEQ ID NO: 592936 - DNA, 25 bp, Rattus norvegicus
tctagcatgtagagcaagcctgttt

SEQ ID NO: 592937 - DNA, 25 bp, Rattus norvegicus
tctagcatgtagtgcaagcctgttt

SEQ ID NO: 592938 - DNA, 25 bp, Rattus norvegicus
tctagcatttagcaggcggaggcaa

SEQ ID NO: 592939 - DNA, 25 bp, Rattus norvegicus
tctagcatttaggaggcggaggcaa

SEQ ID NO: 592940 - DNA, 25 bp, Rattus norvegicus
tctagccaggtacccacattgtttc

SEQ ID NO: 592941 - DNA, 25 bp, Rattus norvegicus
tctagccaggtagccacattgtttc

SEQ ID NO: 592942 - DNA, 25 bp, Rattus norvegicus
tctagccatgtgctgacaatgcctc

SEQ ID NO: 592943 - DNA, 25 bp, Rattus norvegicus
tctagccatgtggtgacaatgcctc

SEQ ID NO: 592944 - DNA, 25 bp, Rattus norvegicus
tctagcccaaagcaaatgttcagtg

SEQ ID NO: 592945 - DNA, 25 bp, Rattus norvegicus
tctagcccaaaggaaatgttcagtg

SEQ ID NO: 592946 - DNA, 25 bp, Rattus norvegicus
tctagcccatcaacagaatctctga

SEQ ID NO: 592947 - DNA, 25 bp, Rattus norvegicus
tctagcccatcatcagaatctctga

SEQ ID NO: 592948 - DNA, 25 bp, Rattus norvegicus
tctagcccatctagtgttgcattat

SEQ ID NO: 592949 - DNA, 25 bp, Rattus norvegicus
tctagcccatcttgtgttgcattat

SEQ ID NO: 592950 - DNA, 25 bp, Rattus norvegicus
tctagccccacgcaagagtctacat

SEQ ID NO: 592951 - DNA, 25 bp, Rattus norvegicus
tctagccccacggaagagtctacat

SEQ ID NO: 592952 - DNA, 25 bp, Rattus norvegicus
tctagcccctacattgagtgagcag

SEQ ID NO: 592953 - DNA, 25 bp, Rattus norvegicus
tctagcccctactttgagtgagcag

SEQ ID NO: 592954 - DNA, 25 bp, Rattus norvegicus
tctagccggatgctggtccatgaaa

SEQ ID NO: 592955 - DNA, 25 bp, Rattus norvegicus
tctagccggatggtggtccatgaaa

SEQ ID NO: 592956 - DNA, 25 bp, Rattus norvegicus
tctagccgttcaattcagttctttg

SEQ ID NO: 592957 - DNA, 25 bp, Rattus norvegicus
tctagccgttcatttcagttctttg

SEQ ID NO: 592958 - DNA, 25 bp, Rattus norvegicus
tctagcgttgataaatgactgaagc

SEQ ID NO: 592959 - DNA, 25 bp, Rattus norvegicus
tctagcgttgattaatgactgaagc

SEQ ID NO: 592960 - DNA, 25 bp, Rattus norvegicus
tctagcgtttagacctgcaaggaag

SEQ ID NO: 592961 - DNA, 25 bp, Rattus norvegicus
tctagcgtttagtcctgcaaggaag

SEQ ID NO: 592962 - DNA, 25 bp, Rattus norvegicus
tctagctaaagacccttcagcgctc

SEQ ID NO: 592963 - DNA, 25 bp, Rattus norvegicus
tctagctaaagagccttcagcgctc

SEQ ID NO: 592964 - DNA, 25 bp, Rattus norvegicus
tctagctcaacgacctgtgggcatg

SEQ ID NO: 592965 - DNA, 25 bp, Rattus norvegicus
tctagctcaacgtcctgtgggcatg

SEQ ID NO: 592966 - DNA, 25 bp, Rattus norvegicus
tctagctcagacaaaatcccatctc

SEQ ID NO: 592967 - DNA, 25 bp, Rattus norvegicus
tctagctcagactaaatcccatctc

SEQ ID NO: 592968 - DNA, 25 bp, Rattus norvegicus
tctagctcagagaacccaggacata

SEQ ID NO: 592969 - DNA, 25 bp, Rattus norvegicus
tctagctcagagtacccaggacata

SEQ ID NO: 592970 - DNA, 25 bp, Rattus norvegicus
tctagctctatcatctgacgcatgt

SEQ ID NO: 592971 - DNA, 25 bp, Rattus norvegicus
tctagctctatcttctgacgcatgt

SEQ ID NO: 592972 - DNA, 25 bp, Rattus norvegicus
tctagctgcaatcccaacggttcag

SEQ ID NO: 592973 - DNA, 25 bp, Rattus norvegicus
tctagctgcaatgccaacggttcag

SEQ ID NO: 592974 - DNA, 25 bp, Rattus norvegicus
tctagctggcagcaactggctttct

SEQ ID NO: 592975 - DNA, 25 bp, Rattus norvegicus
tctagctggcaggaactggctttct

SEQ ID NO: 592976 - DNA, 25 bp, Rattus norvegicus
tctagctgttgtagatcatctgtcc

SEQ ID NO: 592977 - DNA, 25 bp, Rattus norvegicus
tctagctgttgttgatcatctgtcc

SEQ ID NO: 592978 - DNA, 25 bp, Rattus norvegicus
tctagcttcacaacctgtattctca

SEQ ID NO: 592979 - DNA, 25 bp, Rattus norvegicus
tctagcttcacatcctgtattctca

SEQ ID NO: 592980 - DNA, 25 bp, Rattus norvegicus
tctagcttcagacaccctgttccag

SEQ ID NO: 592981 - DNA, 25 bp, Rattus norvegicus
tctagcttcagagaccctgttccag

SEQ ID NO: 592982 - DNA, 25 bp, Rattus norvegicus
tctagcttcatgactgggtccaggg

SEQ ID NO: 592983 - DNA, 25 bp, Rattus norvegicus
tctagcttcatgtctgggtccaggg

SEQ ID NO: 592984 - DNA, 25 bp, Rattus norvegicus
tctagcttccctacatttcttttta

SEQ ID NO: 592985 - DNA, 25 bp, Rattus norvegicus
tctagcttcccttcatttcttttta

SEQ ID NO: 592986 - DNA, 25 bp, Rattus norvegicus
tctagcttctctaacatccatgttg

SEQ ID NO: 592987 - DNA, 25 bp, Rattus norvegicus
tctagcttctcttacatccatgttg

SEQ ID NO: 592988 - DNA, 25 bp, Rattus norvegicus
tctagctttctaaacctaactggga

SEQ ID NO: 592989 - DNA, 25 bp, Rattus norvegicus
tctagctttctatacctaactggga

SEQ ID NO: 592990 - DNA, 25 bp, Rattus norvegicus
tctagctttgccacatatgtttcag

SEQ ID NO: 592991 - DNA, 25 bp, Rattus norvegicus
tctagctttgcctcatatgtttcag

SEQ ID NO: 592992 - DNA, 25 bp, Rattus norvegicus
tctagcttttcaagggtctctcttc

SEQ ID NO: 592993 - DNA, 25 bp, Rattus norvegicus
tctagcttttcatgggtctctcttc

SEQ ID NO: 592994 - DNA, 25 bp, Rattus norvegicus
tctaggataggtcctgtgctcggcc

SEQ ID NO: 592995 - DNA, 25 bp, Rattus norvegicus
tctaggataggtgctgtgctcggcc

SEQ ID NO: 592996 - DNA, 25 bp, Rattus norvegicus
tctaggatcactcgtaagagccacc

SEQ ID NO: 592997 - DNA, 25 bp, Rattus norvegicus
tctaggatcactggtaagagccacc

SEQ ID NO: 592998 - DNA, 25 bp, Rattus norvegicus
tctaggatgctgagtgtgttggtct

SEQ ID NO: 592999 - DNA, 25 bp, Rattus norvegicus
tctaggatgctgtgtgtgttggtct

SEQ ID NO: 593000 - DNA, 25 bp, Rattus norvegicus
tctaggcacactaccgtagcatatg

SEQ ID NO: 593001 - DNA, 25 bp, Rattus norvegicus
tctaggcacacttccgtagcatatg

SEQ ID NO: 593002 - DNA, 25 bp, Rattus norvegicus
tctaggcatcagactttggtcctgc

SEQ ID NO: 593003 - DNA, 25 bp, Rattus norvegicus
tctaggcatcagtctttggtcctgc

SEQ ID NO: 593004 - DNA, 25 bp, Rattus norvegicus
tctaggcatgttccttgtttcttcc

SEQ ID NO: 593005 - DNA, 25 bp, Rattus norvegicus
tctaggcatgttgcttgtttcttcc

SEQ ID NO: 593006 - DNA, 25 bp, Rattus norvegicus
tctaggccaagaagagtcacagcaa

SEQ ID NO: 593007 - DNA, 25 bp, Rattus norvegicus
tctaggccaagatgagtcacagcaa

SEQ ID NO: 593008 - DNA, 25 bp, Rattus norvegicus
tctaggccagaccaattcccaggat

SEQ ID NO: 593009 - DNA, 25 bp, Rattus norvegicus
tctaggccagacgaattcccaggat

SEQ ID NO: 593010 - DNA, 25 bp, Rattus norvegicus
tctaggcccctccattgaatttaaa

SEQ ID NO: 593011 - DNA, 25 bp, Rattus norvegicus
tctaggcccctcgattgaatttaaa

SEQ ID NO: 593012 - DNA, 25 bp, Rattus norvegicus
tctaggccctaacgcaagtgcttaa

SEQ ID NO: 593013 - DNA, 25 bp, Rattus norvegicus
tctaggccctaaggcaagtgcttaa

SEQ ID NO: 593014 - DNA, 25 bp, Rattus norvegicus
tctaggccctccaaaggctgaggta

SEQ ID NO: 593015 - DNA, 25 bp, Rattus norvegicus
tctaggccctcctaaggctgaggta

SEQ ID NO: 593016 - DNA, 25 bp, Rattus norvegicus
tctaggccgcacacatttattggat

SEQ ID NO: 593017 - DNA, 25 bp, Rattus norvegicus
tctaggccgcactcatttattggat

SEQ ID NO: 593018 - DNA, 25 bp, Rattus norvegicus
tctaggccttaaagtccttcctgga

SEQ ID NO: 593019 - DNA, 25 bp, Rattus norvegicus
tctaggccttaatgtccttcctgga

SEQ ID NO: 593020 - DNA, 25 bp, Rattus norvegicus
tctaggcggactcttactgagctgc

SEQ ID NO: 593021 - DNA, 25 bp, Rattus norvegicus
tctaggcggactgttactgagctgc

SEQ ID NO: 593022 - DNA, 25 bp, Rattus norvegicus
tctaggcggtttcaaaggtccattt

SEQ ID NO: 593023 - DNA, 25 bp, Rattus norvegicus
tctaggcggtttgaaaggtccattt

SEQ ID NO: 593024 - DNA, 25 bp, Rattus norvegicus
tctaggctccctaaagcttcgaaaa

SEQ ID NO: 593025 - DNA, 25 bp, Rattus norvegicus
tctaggctcccttaagcttcgaaaa

SEQ ID NO: 593026 - DNA, 25 bp, Rattus norvegicus
tctaggcttcaacacgcccaaggag

SEQ ID NO: 593027 - DNA, 25 bp, Rattus norvegicus
tctaggcttcaagacgcccaaggag

SEQ ID NO: 593028 - DNA, 25 bp, Rattus norvegicus
tctaggcttgtaaatcacgtgcttt

SEQ ID NO: 593029 - DNA, 25 bp, Rattus norvegicus
tctaggcttgtatatcacgtgcttt

SEQ ID NO: 593030 - DNA, 25 bp, Rattus norvegicus
tctagggactgtacaagcacttgct

SEQ ID NO: 593031 - DNA, 25 bp, Rattus norvegicus
tctagggactgttcaagcacttgct

SEQ ID NO: 593032 - DNA, 25 bp, Rattus norvegicus
tctagggcagatagaacttcacaga

SEQ ID NO: 593033 - DNA, 25 bp, Rattus norvegicus
tctagggcagattgaacttcacaga

SEQ ID NO: 593034 - DNA, 25 bp, Rattus norvegicus
tctagggcagccaggatcacacaga

SEQ ID NO: 593035 - DNA, 25 bp, Rattus norvegicus
tctagggcagcctggatcacacaga

SEQ ID NO: 593036 - DNA, 25 bp, Rattus norvegicus
tctagggccatccttattttgtttc

SEQ ID NO: 593037 - DNA, 25 bp, Rattus norvegicus
tctagggccatcgttattttgtttc

SEQ ID NO: 593038 - DNA, 25 bp, Rattus norvegicus
tctagggcctataggaggaccacca

SEQ ID NO: 593039 - DNA, 25 bp, Rattus norvegicus
tctagggcctattggaggaccacca

SEQ ID NO: 593040 - DNA, 25 bp, Rattus norvegicus
tctagggctgaaagcacttgctgct

SEQ ID NO: 593041 - DNA, 25 bp, Rattus norvegicus
tctagggctgaatgcacttgctgct

SEQ ID NO: 593042 - DNA, 25 bp, Rattus norvegicus
tctagggctgagcagtcatggagaa

SEQ ID NO: 593043 - DNA, 25 bp, Rattus norvegicus
tctagggctgaggagtcatggagaa

SEQ ID NO: 593044 - DNA, 25 bp, Rattus norvegicus
tctagggcttttaggtggacaccac

SEQ ID NO: 593045 - DNA, 25 bp, Rattus norvegicus
tctagggctttttggtggacaccac

SEQ ID NO: 593046 - DNA, 25 bp, Rattus norvegicus
tctagggtatcaaggcacatgggct

SEQ ID NO: 593047 - DNA, 25 bp, Rattus norvegicus
tctagggtatcatggcacatgggct

SEQ ID NO: 593048 - DNA, 25 bp, Rattus norvegicus
tctagggtgtcgctctctcgggttc

SEQ ID NO: 593049 - DNA, 25 bp, Rattus norvegicus
tctagggtgtcggtctctcgggttc

SEQ ID NO: 593050 - DNA, 25 bp, Rattus norvegicus
tctagggtgttcactgacgctctac

SEQ ID NO: 593051 - DNA, 25 bp, Rattus norvegicus
tctagggtgttctctgacgctctac

SEQ ID NO: 593052 - DNA, 25 bp, Rattus norvegicus
tctaggtagagcagccaaggtggcc

SEQ ID NO: 593053 - DNA, 25 bp, Rattus norvegicus
tctaggtagagctgccaaggtggcc

SEQ ID NO: 593054 - DNA, 25 bp, Rattus norvegicus
tctaggtcacccacagaagccagct

SEQ ID NO: 593055 - DNA, 25 bp, Rattus norvegicus
tctaggtcaccctcagaagccagct

SEQ ID NO: 593056 - DNA, 25 bp, Rattus norvegicus
tctaggtcacttactgggtggcata

SEQ ID NO: 593057 - DNA, 25 bp, Rattus norvegicus
tctaggtcactttctgggtggcata

SEQ ID NO: 593058 - DNA, 25 bp, Rattus norvegicus
tctaggtcctgaagccagtgtgact

SEQ ID NO: 593059 - DNA, 25 bp, Rattus norvegicus
tctaggtcctgatgccagtgtgact

SEQ ID NO: 593060 - DNA, 25 bp, Rattus norvegicus
tctaggtctctaccctggattgctg

SEQ ID NO: 593061 - DNA, 25 bp, Rattus norvegicus
tctaggtctctagcctggattgctg

SEQ ID NO: 593062 - DNA, 25 bp, Rattus norvegicus
tctaggtctgcaaactcccttttaa

SEQ ID NO: 593063 - DNA, 25 bp, Rattus norvegicus
tctaggtctgcatactcccttttaa

SEQ ID NO: 593064 - DNA, 25 bp, Rattus norvegicus
tctaggtggacgcagatacccatca

SEQ ID NO: 593065 - DNA, 25 bp, Rattus norvegicus
tctaggtggacggagatacccatca

SEQ ID NO: 593066 - DNA, 25 bp, Rattus norvegicus
tctaggttgaccacaccttaggaca

SEQ ID NO: 593067 - DNA, 25 bp, Rattus norvegicus
tctaggttgacctcaccttaggaca

SEQ ID NO: 593068 - DNA, 25 bp, Rattus norvegicus
tctaggtttcttcatccatgtttcc

SEQ ID NO: 593069 - DNA, 25 bp, Rattus norvegicus
tctaggtttcttgatccatgtttcc

SEQ ID NO: 593070 - DNA, 25 bp, Rattus norvegicus
tctaggtttgacaagctctgggcaa

SEQ ID NO: 593071 - DNA, 25 bp, Rattus norvegicus
tctaggtttgactagctctgggcaa

SEQ ID NO: 593072 - DNA, 25 bp, Rattus norvegicus
tctaggttttccagcttttttggat

SEQ ID NO: 593073 - DNA, 25 bp, Rattus norvegicus
tctaggttttcctgcttttttggat

SEQ ID NO: 593074 - DNA, 25 bp, Rattus norvegicus
tctagtacggtaaggcacttggctt

SEQ ID NO: 593075 - DNA, 25 bp, Rattus norvegicus
tctagtacggtatggcacttggctt

SEQ ID NO: 593076 - DNA, 25 bp, Rattus norvegicus
tctagtagagttatacccctgtcca

SEQ ID NO: 593077 - DNA, 25 bp, Rattus norvegicus
tctagtagagttttacccctgtcca

SEQ ID NO: 593078 - DNA, 25 bp, Rattus norvegicus
tctagtatgttcagtggttcttgga

SEQ ID NO: 593079 - DNA, 25 bp, Rattus norvegicus
tctagtatgttctgtggttcttgga

SEQ ID NO: 593080 - DNA, 25 bp, Rattus norvegicus
tctagtattcccaaatgccagcatg

SEQ ID NO: 593081 - DNA, 25 bp, Rattus norvegicus
tctagtattccctaatgccagcatg

SEQ ID NO: 593082 - DNA, 25 bp, Rattus norvegicus
tctagtcatcaccatctgtaaaggg

SEQ ID NO: 593083 - DNA, 25 bp, Rattus norvegicus
tctagtcatcacgatctgtaaaggg

SEQ ID NO: 593084 - DNA, 25 bp, Rattus norvegicus
tctagtccagccaccggaccccagg

SEQ ID NO: 593085 - DNA, 25 bp, Rattus norvegicus
tctagtccagcctccggaccccagg

SEQ ID NO: 593086 - DNA, 25 bp, Rattus norvegicus
tctagtccatagaacgccagtgcca

SEQ ID NO: 593087 - DNA, 25 bp, Rattus norvegicus
tctagtccatagtacgccagtgcca

SEQ ID NO: 593088 - DNA, 25 bp, Rattus norvegicus
tctagtccattcacgctgttttgta

SEQ ID NO: 593089 - DNA, 25 bp, Rattus norvegicus
tctagtccattctcgctgttttgta

SEQ ID NO: 593090 - DNA, 25 bp, Rattus norvegicus
tctagtcccatacgcagaggcagga

SEQ ID NO: 593091 - DNA, 25 bp, Rattus norvegicus
tctagtcccataggcagaggcagga

SEQ ID NO: 593092 - DNA, 25 bp, Rattus norvegicus
tctagtccggacatgctgtgtatat

SEQ ID NO: 593093 - DNA, 25 bp, Rattus norvegicus
tctagtccggacttgctgtgtatat

SEQ ID NO: 593094 - DNA, 25 bp, Rattus norvegicus
tctagtcctcatacctgttgtccta

SEQ ID NO: 593095 - DNA, 25 bp, Rattus norvegicus
tctagtcctcattcctgttgtccta

SEQ ID NO: 593096 - DNA, 25 bp, Rattus norvegicus
tctagtcgggcacctcaaggtgagc

SEQ ID NO: 593097 - DNA, 25 bp, Rattus norvegicus
tctagtcgggcagctcaaggtgagc

SEQ ID NO: 593098 - DNA, 25 bp, Rattus norvegicus
tctagtctctccacaatcgatgttc

SEQ ID NO: 593099 - DNA, 25 bp, Rattus norvegicus
tctagtctctcctcaatcgatgttc

SEQ ID NO: 593100 - DNA, 25 bp, Rattus norvegicus
tctagtctggctaccaagttggcat

SEQ ID NO: 593101 - DNA, 25 bp, Rattus norvegicus
tctagtctggcttccaagttggcat

SEQ ID NO: 593102 - DNA, 25 bp, Rattus norvegicus
tctagtctgggcaagttcacttttg

SEQ ID NO: 593103 - DNA, 25 bp, Rattus norvegicus
tctagtctgggctagttcacttttg

SEQ ID NO: 593104 - DNA, 25 bp, Rattus norvegicus
tctagtcttctaaaattgttgccaa

SEQ ID NO: 593105 - DNA, 25 bp, Rattus norvegicus
tctagtcttctataattgttgccaa

SEQ ID NO: 593106 - DNA, 25 bp, Rattus norvegicus
tctagtgacagcacccatcatctct

SEQ ID NO: 593107 - DNA, 25 bp, Rattus norvegicus
tctagtgacagctcccatcatctct

SEQ ID NO: 593108 - DNA, 25 bp, Rattus norvegicus
tctagtgacttgagtgacaggagct

SEQ ID NO: 593109 - DNA, 25 bp, Rattus norvegicus
tctagtgacttgtgtgacaggagct

SEQ ID NO: 593110 - DNA, 25 bp, Rattus norvegicus
tctagtgccatcaagctgcaactca

SEQ ID NO: 593111 - DNA, 25 bp, Rattus norvegicus
tctagtgccatctagctgcaactca

SEQ ID NO: 593112 - DNA, 25 bp, Rattus norvegicus
tctagtggagaacagggcttacgta

SEQ ID NO: 593113 - DNA, 25 bp, Rattus norvegicus
tctagtggagaagagggcttacgta

SEQ ID NO: 593114 - DNA, 25 bp, Rattus norvegicus
tctagtgtaaggctggcctggtacc

SEQ ID NO: 593115 - DNA, 25 bp, Rattus norvegicus
tctagtgtaagggtggcctggtacc

SEQ ID NO: 593116 - DNA, 25 bp, Rattus norvegicus
tctagtgtccttatccatatgagca

SEQ ID NO: 593117 - DNA, 25 bp, Rattus norvegicus
tctagtgtccttttccatatgagca

SEQ ID NO: 593118 - DNA, 25 bp, Rattus norvegicus
tctagtgtgttcatagtggttatac

SEQ ID NO: 593119 - DNA, 25 bp, Rattus norvegicus
tctagtgtgttcttagtggttatac

SEQ ID NO: 593120 - DNA, 25 bp, Rattus norvegicus
tctagtgttcagctacatcccttgg

SEQ ID NO: 593121 - DNA, 25 bp, Rattus norvegicus
tctagtgttcaggtacatcccttgg

SEQ ID NO: 593122 - DNA, 25 bp, Rattus norvegicus
tctagtgttttacatggtctgttca

SEQ ID NO: 593123 - DNA, 25 bp, Rattus norvegicus
tctagtgttttagatggtctgttca

SEQ ID NO: 593124 - DNA, 25 bp, Rattus norvegicus
tctagttagaacatcgtgctcccca

SEQ ID NO: 593125 - DNA, 25 bp, Rattus norvegicus
tctagttagaacttcgtgctcccca

SEQ ID NO: 593126 - DNA, 25 bp, Rattus norvegicus
tctagttattaacacccagtcaggt

SEQ ID NO: 593127 - DNA, 25 bp, Rattus norvegicus
tctagttattaagacccagtcaggt

SEQ ID NO: 593128 - DNA, 25 bp, Rattus norvegicus
tctagttccaagagacctgtcacct

SEQ ID NO: 593129 - DNA, 25 bp, Rattus norvegicus
tctagttccaagtgacctgtcacct

SEQ ID NO: 593130 - DNA, 25 bp, Rattus norvegicus
tctagttcccacatcttttcaaatt

SEQ ID NO: 593131 - DNA, 25 bp, Rattus norvegicus
tctagttcccacttcttttcaaatt

SEQ ID NO: 593132 - DNA, 25 bp, Rattus norvegicus
tctagttcgtgtatttttccttgat

SEQ ID NO: 593133 - DNA, 25 bp, Rattus norvegicus
tctagttcgtgtttttttccttgat

SEQ ID NO: 593134 - DNA, 25 bp, Rattus norvegicus
tctagtttctagatgcacttctgaa

SEQ ID NO: 593135 - DNA, 25 bp, Rattus norvegicus
tctagtttctagttgcacttctgaa

SEQ ID NO: 593136 - DNA, 25 bp, Rattus norvegicus
tctagtttcttcatctgggtctcca

SEQ ID NO: 593137 - DNA, 25 bp, Rattus norvegicus
tctagtttcttcttctgggtctcca

SEQ ID NO: 593138 - DNA, 25 bp, Rattus norvegicus
tctagtttgcagatcttaatgtttt

SEQ ID NO: 593139 - DNA, 25 bp, Rattus norvegicus
tctagtttgcagttcttaatgtttt

SEQ ID NO: 593140 - DNA, 25 bp, Rattus norvegicus
tctagttttcttacactgggtagca

SEQ ID NO: 593141 - DNA, 25 bp, Rattus norvegicus
tctagttttctttcactgggtagca

SEQ ID NO: 593142 - DNA, 25 bp, Rattus norvegicus
tctataagttggcaggttattcttt

SEQ ID NO: 593143 - DNA, 25 bp, Rattus norvegicus
tctataagttgggaggttattcttt

SEQ ID NO: 593144 - DNA, 25 bp, Rattus norvegicus
tctatacccaacaagttttgctggt

SEQ ID NO: 593145 - DNA, 25 bp, Rattus norvegicus
tctatacccaactagttttgctggt

SEQ ID NO: 593146 - DNA, 25 bp, Rattus norvegicus
tctataccccagatgcagtgaggag

SEQ ID NO: 593147 - DNA, 25 bp, Rattus norvegicus
tctataccccagttgcagtgaggag

SEQ ID NO: 593148 - DNA, 25 bp, Rattus norvegicus
tctatacttctaagtaccctctgtt

SEQ ID NO: 593149 - DNA, 25 bp, Rattus norvegicus
tctatacttctatgtaccctctgtt

SEQ ID NO: 593150 - DNA, 25 bp, Rattus norvegicus
tctatactttgacatgtttgctttg

SEQ ID NO: 593151 - DNA, 25 bp, Rattus norvegicus
tctatactttgagatgtttgctttg

SEQ ID NO: 593152 - DNA, 25 bp, Rattus norvegicus
tctatagatcgaaggctgtggctca

SEQ ID NO: 593153 - DNA, 25 bp, Rattus norvegicus
tctatagatcgatggctgtggctca

SEQ ID NO: 593154 - DNA, 25 bp, Rattus norvegicus
tctatagccttgctagccctgggac

SEQ ID NO: 593155 - DNA, 25 bp, Rattus norvegicus
tctatagccttggtagccctgggac

SEQ ID NO: 593156 - DNA, 25 bp, Rattus norvegicus
tctatagcctttcttctctgggttt

SEQ ID NO: 593157 - DNA, 25 bp, Rattus norvegicus
tctatagcctttgttctctgggttt

SEQ ID NO: 593158 - DNA, 25 bp, Rattus norvegicus
tctatagctaggcatagtggtgcat

SEQ ID NO: 593159 - DNA, 25 bp, Rattus norvegicus
tctatagctagggatagtggtgcat

SEQ ID NO: 593160 - DNA, 25 bp, Rattus norvegicus
tctatagctctaagttcaggtgatt

SEQ ID NO: 593161 - DNA, 25 bp, Rattus norvegicus
tctatagctctatgttcaggtgatt

SEQ ID NO: 593162 - DNA, 25 bp, Rattus norvegicus
tctatagtggcaatctttctcagct

SEQ ID NO: 593163 - DNA, 25 bp, Rattus norvegicus
tctatagtggcattctttctcagct

SEQ ID NO: 593164 - DNA, 25 bp, Rattus norvegicus
tctatagtgtacctgtgtctgaaac

SEQ ID NO: 593165 - DNA, 25 bp, Rattus norvegicus
tctatagtgtacgtgtgtctgaaac

SEQ ID NO: 593166 - DNA, 25 bp, Rattus norvegicus
tctatataagatctgctgccgccca

SEQ ID NO: 593167 - DNA, 25 bp, Rattus norvegicus
tctatataagatgtgctgccgccca

SEQ ID NO: 593168 - DNA, 25 bp, Rattus norvegicus
tctatatagacccagctagcctgga

SEQ ID NO: 593169 - DNA, 25 bp, Rattus norvegicus
tctatatagaccgagctagcctgga

SEQ ID NO: 593170 - DNA, 25 bp, Rattus norvegicus
tctatatcctccagtgtctgctttc

SEQ ID NO: 593171 - DNA, 25 bp, Rattus norvegicus
tctatatcctcctgtgtctgctttc

SEQ ID NO: 593172 - DNA, 25 bp, Rattus norvegicus
tctatatcttcacgcgcgcggtctg

SEQ ID NO: 593173 - DNA, 25 bp, Rattus norvegicus
tctatatcttcaggcgcgcggtctg

SEQ ID NO: 593174 - DNA, 25 bp, Rattus norvegicus
tctatattgagtcagggctttccca

SEQ ID NO: 593175 - DNA, 25 bp, Rattus norvegicus
tctatattgagtgagggctttccca

SEQ ID NO: 593176 - DNA, 25 bp, Rattus norvegicus
tctatattgtacagcacgggacccg

SEQ ID NO: 593177 - DNA, 25 bp, Rattus norvegicus
tctatattgtactgcacgggacccg

SEQ ID NO: 593178 - DNA, 25 bp, Rattus norvegicus
tctatcaatcccatggctctacaaa

SEQ ID NO: 593179 - DNA, 25 bp, Rattus norvegicus
tctatcaatcccttggctctacaaa

SEQ ID NO: 593180 - DNA, 25 bp, Rattus norvegicus
tctatcacgaggcagaagactcttc

SEQ ID NO: 593181 - DNA, 25 bp, Rattus norvegicus
tctatcacgagggagaagactcttc

SEQ ID NO: 593182 - DNA, 25 bp, Rattus norvegicus
tctatcacttgccattatatttctt

SEQ ID NO: 593183 - DNA, 25 bp, Rattus norvegicus
tctatcacttgcgattatatttctt

SEQ ID NO: 593184 - DNA, 25 bp, Rattus norvegicus
tctatcagccctatccatttgagaa

SEQ ID NO: 593185 - DNA, 25 bp, Rattus norvegicus
tctatcagccctttccatttgagaa

SEQ ID NO: 593186 - DNA, 25 bp, Rattus norvegicus
tctatcatggatctgcaccttcttg

SEQ ID NO: 593187 - DNA, 25 bp, Rattus norvegicus
tctatcatggatgtgcaccttcttg

SEQ ID NO: 593188 - DNA, 25 bp, Rattus norvegicus
tctatccaaatacaagggttctgtt

SEQ ID NO: 593189 - DNA, 25 bp, Rattus norvegicus
tctatccaaatagaagggttctgtt

SEQ ID NO: 593190 - DNA, 25 bp, Rattus norvegicus
tctatccaccatcagttcagacgaa

SEQ ID NO: 593191 - DNA, 25 bp, Rattus norvegicus
tctatccaccatgagttcagacgaa

SEQ ID NO: 593192 - DNA, 25 bp, Rattus norvegicus
tctatccaccgactccaacatggaa

SEQ ID NO: 593193 - DNA, 25 bp, Rattus norvegicus
tctatccaccgagtccaacatggaa

SEQ ID NO: 593194 - DNA, 25 bp, Rattus norvegicus
tctatccagaatcagtttttcgtcc

SEQ ID NO: 593195 - DNA, 25 bp, Rattus norvegicus
tctatccagaatgagtttttcgtcc

SEQ ID NO: 593196 - DNA, 25 bp, Rattus norvegicus
tctatccagggacctattctgtcac

SEQ ID NO: 593197 - DNA, 25 bp, Rattus norvegicus
tctatccagggagctattctgtcac

SEQ ID NO: 593198 - DNA, 25 bp, Rattus norvegicus
tctatccatcccaggtaatcacatg

SEQ ID NO: 593199 - DNA, 25 bp, Rattus norvegicus
tctatccatccctggtaatcacatg

SEQ ID NO: 593200 - DNA, 25 bp, Rattus norvegicus
tctatccccggcaatttgatactat

SEQ ID NO: 593201 - DNA, 25 bp, Rattus norvegicus
tctatccccggctatttgatactat

SEQ ID NO: 593202 - DNA, 25 bp, Rattus norvegicus
tctatccctgaaagccacacggtag

SEQ ID NO: 593203 - DNA, 25 bp, Rattus norvegicus
tctatccctgaatgccacacggtag

SEQ ID NO: 593204 - DNA, 25 bp, Rattus norvegicus
tctatccctgtgatactgaactgta

SEQ ID NO: 593205 - DNA, 25 bp, Rattus norvegicus
tctatccctgtgttactgaactgta

SEQ ID NO: 593206 - DNA, 25 bp, Rattus norvegicus
tctatccctttgacactacacagtt

SEQ ID NO: 593207 - DNA, 25 bp, Rattus norvegicus
tctatccctttgtcactacacagtt

SEQ ID NO: 593208 - DNA, 25 bp, Rattus norvegicus
tctatccgacttataccattcctta

SEQ ID NO: 593209 - DNA, 25 bp, Rattus norvegicus
tctatccgacttttaccattcctta

SEQ ID NO: 593210 - DNA, 25 bp, Rattus norvegicus
tctatccgggaaatcaccctttaga

SEQ ID NO: 593211 - DNA, 25 bp, Rattus norvegicus
tctatccgggaattcaccctttaga

SEQ ID NO: 593212 - DNA, 25 bp, Rattus norvegicus
tctatcctagcaaccctgagatgaa

SEQ ID NO: 593213 - DNA, 25 bp, Rattus norvegicus
tctatcctagcatccctgagatgaa

SEQ ID NO: 593214 - DNA, 25 bp, Rattus norvegicus
tctatccttagaagaggcgggcctt

SEQ ID NO: 593215 - DNA, 25 bp, Rattus norvegicus
tctatccttagatgaggcgggcctt

SEQ ID NO: 593216 - DNA, 25 bp, Rattus norvegicus
tctatccttggactgtgagctttca

SEQ ID NO: 593217 - DNA, 25 bp, Rattus norvegicus
tctatccttggagtgtgagctttca

SEQ ID NO: 593218 - DNA, 25 bp, Rattus norvegicus
tctatcggagctaaccagtggtcat

SEQ ID NO: 593219 - DNA, 25 bp, Rattus norvegicus
tctatcggagcttaccagtggtcat

SEQ ID NO: 593220 - DNA, 25 bp, Rattus norvegicus
tctatctaccacattcccaaatctt

SEQ ID NO: 593221 - DNA, 25 bp, Rattus norvegicus
tctatctaccactttcccaaatctt

SEQ ID NO: 593222 - DNA, 25 bp, Rattus norvegicus
tctatctcaagaaccgaatctcctc

SEQ ID NO: 593223 - DNA, 25 bp, Rattus norvegicus
tctatctcaagatccgaatctcctc

SEQ ID NO: 593224 - DNA, 25 bp, Rattus norvegicus
tctatctcatcaccaaggccaagta

SEQ ID NO: 593225 - DNA, 25 bp, Rattus norvegicus
tctatctcatcagcaaggccaagta

SEQ ID NO: 593226 - DNA, 25 bp, Rattus norvegicus
tctatctccgtcctagtttgggtga

SEQ ID NO: 593227 - DNA, 25 bp, Rattus norvegicus
tctatctccgtcgtagtttgggtga

SEQ ID NO: 593228 - DNA, 25 bp, Rattus norvegicus
tctatctcctgcactagttagttta

SEQ ID NO: 593229 - DNA, 25 bp, Rattus norvegicus
tctatctcctgctctagttagttta

SEQ ID NO: 593230 - DNA, 25 bp, Rattus norvegicus
tctatctctgtgctacttaatgagg

SEQ ID NO: 593231 - DNA, 25 bp, Rattus norvegicus
tctatctctgtggtacttaatgagg

SEQ ID NO: 593232 - DNA, 25 bp, Rattus norvegicus
tctatctggattctggcggtcgcct

SEQ ID NO: 593233 - DNA, 25 bp, Rattus norvegicus
tctatctggattgtggcggtcgcct

SEQ ID NO: 593234 - DNA, 25 bp, Rattus norvegicus
tctatcttacgtacactgctttcag

SEQ ID NO: 593235 - DNA, 25 bp, Rattus norvegicus
tctatcttacgttcactgctttcag

SEQ ID NO: 593236 - DNA, 25 bp, Rattus norvegicus
tctatcttgaccatcagctaccaga

SEQ ID NO: 593237 - DNA, 25 bp, Rattus norvegicus
tctatcttgaccttcagctaccaga

SEQ ID NO: 593238 - DNA, 25 bp, Rattus norvegicus
tctatctttgttcttcaggactggg

SEQ ID NO: 593239 - DNA, 25 bp, Rattus norvegicus
tctatctttgttgttcaggactggg

SEQ ID NO: 593240 - DNA, 25 bp, Rattus norvegicus
tctatctttttactacagtgatctg

SEQ ID NO: 593241 - DNA, 25 bp, Rattus norvegicus
tctatctttttagtacagtgatctg

SEQ ID NO: 593242 - DNA, 25 bp, Rattus norvegicus
tctatgaaagaaacagctggagcta

SEQ ID NO: 593243 - DNA, 25 bp, Rattus norvegicus
tctatgaaagaatcagctggagcta

SEQ ID NO: 593244 - DNA, 25 bp, Rattus norvegicus
tctatgacatagatctaccctgcct

SEQ ID NO: 593245 - DNA, 25 bp, Rattus norvegicus
tctatgacatagttctaccctgcct

SEQ ID NO: 593246 - DNA, 25 bp, Rattus norvegicus
tctatgacatccatccatctgttgt

SEQ ID NO: 593247 - DNA, 25 bp, Rattus norvegicus
tctatgacatccttccatctgttgt

SEQ ID NO: 593248 - DNA, 25 bp, Rattus norvegicus
tctatgacttctcggagtactacct

SEQ ID NO: 593249 - DNA, 25 bp, Rattus norvegicus
tctatgacttctgggagtactacct

SEQ ID NO: 593250 - DNA, 25 bp, Rattus norvegicus
tctatgagttccaacatgcacccag

SEQ ID NO: 593251 - DNA, 25 bp, Rattus norvegicus
tctatgagttccaaggctcgcctaa

SEQ ID NO: 593252 - DNA, 25 bp, Rattus norvegicus
tctatgagttcctacatgcacccag

SEQ ID NO: 593253 - DNA, 25 bp, Rattus norvegicus
tctatgagttcctaggctcgcctaa

SEQ ID NO: 593254 - DNA, 25 bp, Rattus norvegicus
tctatgatgtcaatccgggagctat

SEQ ID NO: 593255 - DNA, 25 bp, Rattus norvegicus
tctatgatgtcattccgggagctat

SEQ ID NO: 593256 - DNA, 25 bp, Rattus norvegicus
tctatgcaatgtatgccatctccgc

SEQ ID NO: 593257 - DNA, 25 bp, Rattus norvegicus
tctatgcaatgtttgccatctccgc

SEQ ID NO: 593258 - DNA, 25 bp, Rattus norvegicus
tctatgcagtttactttgagtgact

SEQ ID NO: 593259 - DNA, 25 bp, Rattus norvegicus
tctatgcagttttctttgagtgact

SEQ ID NO: 593260 - DNA, 25 bp, Rattus norvegicus
tctatgcatcaactgtagctgcacg

SEQ ID NO: 593261 - DNA, 25 bp, Rattus norvegicus
tctatgcatcaagtgtagctgcacg

SEQ ID NO: 593262 - DNA, 25 bp, Rattus norvegicus
tctatgcatgatacaaggaagccaa

SEQ ID NO: 593263 - DNA, 25 bp, Rattus norvegicus
tctatgcatgattcaaggaagccaa

SEQ ID NO: 593264 - DNA, 25 bp, Rattus norvegicus
tctatgcatgctacacttcactttt

SEQ ID NO: 593265 - DNA, 25 bp, Rattus norvegicus
tctatgcatgcttcacttcactttt

SEQ ID NO: 593266 - DNA, 25 bp, Rattus norvegicus
tctatgcctattcctttcctgttgg

SEQ ID NO: 593267 - DNA, 25 bp, Rattus norvegicus
tctatgcctattgctttcctgttgg

SEQ ID NO: 593268 - DNA, 25 bp, Rattus norvegicus
tctatgcctcaactcagctcaacag

SEQ ID NO: 593269 - DNA, 25 bp, Rattus norvegicus
tctatgcctcaagtcagctcaacag

SEQ ID NO: 593270 - DNA, 25 bp, Rattus norvegicus
tctatgcctttgatgtcagtgagta

SEQ ID NO: 593271 - DNA, 25 bp, Rattus norvegicus
tctatgcctttgttgtcagtgagta

SEQ ID NO: 593272 - DNA, 25 bp, Rattus norvegicus
tctatgctaacaacgtcctctcggg

SEQ ID NO: 593273 - DNA, 25 bp, Rattus norvegicus
tctatgctaacatcgtcctctcggg

SEQ ID NO: 593274 - DNA, 25 bp, Rattus norvegicus
tctatgctctgtcgccggtcaagga

SEQ ID NO: 593275 - DNA, 25 bp, Rattus norvegicus
tctatgctctgtggccggtcaagga

SEQ ID NO: 593276 - DNA, 25 bp, Rattus norvegicus
tctatgctgctcagtgctaggatta

SEQ ID NO: 593277 - DNA, 25 bp, Rattus norvegicus
tctatgctgctctgtgctaggatta

SEQ ID NO: 593278 - DNA, 25 bp, Rattus norvegicus
tctatgctggtcatcctgcacgtag

SEQ ID NO: 593279 - DNA, 25 bp, Rattus norvegicus
tctatgctggtcttcctgcacgtag

SEQ ID NO: 593280 - DNA, 25 bp, Rattus norvegicus
tctatgcttcatcaaatcgggtctt

SEQ ID NO: 593281 - DNA, 25 bp, Rattus norvegicus
tctatgcttcatgaaatcgggtctt

SEQ ID NO: 593282 - DNA, 25 bp, Rattus norvegicus
tctatggaatgtattttccccttag

SEQ ID NO: 593283 - DNA, 25 bp, Rattus norvegicus
tctatggaatgttttttccccttag

SEQ ID NO: 593284 - DNA, 25 bp, Rattus norvegicus
tctatggctgaactctttgactctc

SEQ ID NO: 593285 - DNA, 25 bp, Rattus norvegicus
tctatggctgaagtctttgactctc

SEQ ID NO: 593286 - DNA, 25 bp, Rattus norvegicus
tctatggctggtctacactttcctc

SEQ ID NO: 593287 - DNA, 25 bp, Rattus norvegicus
tctatggctggtgtacactttcctc

SEQ ID NO: 593288 - DNA, 25 bp, Rattus norvegicus
tctatgggcaccagccacatgatgt

SEQ ID NO: 593289 - DNA, 25 bp, Rattus norvegicus
tctatgggcacctgccacatgatgt

SEQ ID NO: 593290 - DNA, 25 bp, Rattus norvegicus
tctatgggccatacctaataggcat

SEQ ID NO: 593291 - DNA, 25 bp, Rattus norvegicus
tctatgggccattcctaataggcat

SEQ ID NO: 593292 - DNA, 25 bp, Rattus norvegicus
tctatgggcccaaggtacacaactt

SEQ ID NO: 593293 - DNA, 25 bp, Rattus norvegicus
tctatgggcccatggtacacaactt

SEQ ID NO: 593294 - DNA, 25 bp, Rattus norvegicus
tctatgggttctcgtagtcctggga

SEQ ID NO: 593295 - DNA, 25 bp, Rattus norvegicus
tctatgggttctggtagtcctggga

SEQ ID NO: 593296 - DNA, 25 bp, Rattus norvegicus
tctatgggttttcttttcgtgtcct

SEQ ID NO: 593297 - DNA, 25 bp, Rattus norvegicus
tctatgggttttgttttcgtgtcct

SEQ ID NO: 593298 - DNA, 25 bp, Rattus norvegicus
tctatggtacataagaatctgccca

SEQ ID NO: 593299 - DNA, 25 bp, Rattus norvegicus
tctatggtacattagaatctgccca

SEQ ID NO: 593300 - DNA, 25 bp, Rattus norvegicus
tctatggttcctctggatccagaca

SEQ ID NO: 593301 - DNA, 25 bp, Rattus norvegicus
tctatggttcctgtggatccagaca

SEQ ID NO: 593302 - DNA, 25 bp, Rattus norvegicus
tctatgtacgttatcagcttggccc

SEQ ID NO: 593303 - DNA, 25 bp, Rattus norvegicus
tctatgtacgttttcagcttggccc

SEQ ID NO: 593304 - DNA, 25 bp, Rattus norvegicus
tctatgtatgtacacacagacaggc

SEQ ID NO: 593305 - DNA, 25 bp, Rattus norvegicus
tctatgtatgtagacacagacaggc

SEQ ID NO: 593306 - DNA, 25 bp, Rattus norvegicus
tctatgtcccgcaacccgaggagga

SEQ ID NO: 593307 - DNA, 25 bp, Rattus norvegicus
tctatgtcccgctacccgaggagga

SEQ ID NO: 593308 - DNA, 25 bp, Rattus norvegicus
tctatgtccgacatctcagaagatg

SEQ ID NO: 593309 - DNA, 25 bp, Rattus norvegicus
tctatgtccgacttctcagaagatg

SEQ ID NO: 593310 - DNA, 25 bp, Rattus norvegicus
tctatgtcctggacccgatgttggg

SEQ ID NO: 593311 - DNA, 25 bp, Rattus norvegicus
tctatgtcctggtcccgatgttggg

SEQ ID NO: 593312 - DNA, 25 bp, Rattus norvegicus
tctatgtcgtgcactatctgtctgt

SEQ ID NO: 593313 - DNA, 25 bp, Rattus norvegicus
tctatgtcgtgctctatctgtctgt

SEQ ID NO: 593314 - DNA, 25 bp, Rattus norvegicus
tctatgtgccaaactgtgacctcag

SEQ ID NO: 593315 - DNA, 25 bp, Rattus norvegicus
tctatgtgccaatctgtgacctcag

SEQ ID NO: 593316 - DNA, 25 bp, Rattus norvegicus
tctatgtgccccacggcaaacgagt

SEQ ID NO: 593317 - DNA, 25 bp, Rattus norvegicus
tctatgtgcccctcggcaaacgagt

SEQ ID NO: 593318 - DNA, 25 bp, Rattus norvegicus
tctatgttctttctcttttgttctc

SEQ ID NO: 593319 - DNA, 25 bp, Rattus norvegicus
tctatgttctttgtcttttgttctc

SEQ ID NO: 593320 - DNA, 25 bp, Rattus norvegicus
tctattaagatgctgcacaccttcg

SEQ ID NO: 593321 - DNA, 25 bp, Rattus norvegicus
tctattaagatggtgcacaccttcg

SEQ ID NO: 593322 - DNA, 25 bp, Rattus norvegicus
tctattacagctccgtgcaccacag

SEQ ID NO: 593323 - DNA, 25 bp, Rattus norvegicus
tctattacagctgcgtgcaccacag

SEQ ID NO: 593324 - DNA, 25 bp, Rattus norvegicus
tctattaccggaaaccccaggagta

SEQ ID NO: 593325 - DNA, 25 bp, Rattus norvegicus
tctattaccggataccccaggagta

SEQ ID NO: 593326 - DNA, 25 bp, Rattus norvegicus
tctattagacaaccctcccaactgg

SEQ ID NO: 593327 - DNA, 25 bp, Rattus norvegicus
tctattagacaagcctcccaactgg

SEQ ID NO: 593328 - DNA, 25 bp, Rattus norvegicus
tctattagagagctggcccatccat

SEQ ID NO: 593329 - DNA, 25 bp, Rattus norvegicus
tctattagagaggtggcccatccat

SEQ ID NO: 593330 - DNA, 25 bp, Rattus norvegicus
tctattaggaagagctcccgctctt

SEQ ID NO: 593331 - DNA, 25 bp, Rattus norvegicus
tctattaggaagtgctcccgctctt

SEQ ID NO: 593332 - DNA, 25 bp, Rattus norvegicus
tctattcaatcgcatgagggcccat

SEQ ID NO: 593333 - DNA, 25 bp, Rattus norvegicus
tctattcaatcggatgagggcccat

SEQ ID NO: 593334 - DNA, 25 bp, Rattus norvegicus
tctattcacggcacctgaagcacgt

SEQ ID NO: 593335 - DNA, 25 bp, Rattus norvegicus
tctattcacggctcctgaagcacgt

SEQ ID NO: 593336 - DNA, 25 bp, Rattus norvegicus
tctattcagcccagcagcagtgagg

SEQ ID NO: 593337 - DNA, 25 bp, Rattus norvegicus
tctattcagccctgcagcagtgagg

SEQ ID NO: 593338 - DNA, 25 bp, Rattus norvegicus
tctattccctttatgacacggagga

SEQ ID NO: 593339 - DNA, 25 bp, Rattus norvegicus
tctattccctttttgacacggagga

SEQ ID NO: 593340 - DNA, 25 bp, Rattus norvegicus
tctattctcatgcagtgtactctcc

SEQ ID NO: 593341 - DNA, 25 bp, Rattus norvegicus
tctattctcatggagtgtactctcc

SEQ ID NO: 593342 - DNA, 25 bp, Rattus norvegicus
tctattcttgggattcgcaaggtct

SEQ ID NO: 593343 - DNA, 25 bp, Rattus norvegicus
tctattcttgggtttcgcaaggtct

SEQ ID NO: 593344 - DNA, 25 bp, Rattus norvegicus
tctattgacatgcttccaccagatg

SEQ ID NO: 593345 - DNA, 25 bp, Rattus norvegicus
tctattgacatggttccaccagatg

SEQ ID NO: 593346 - DNA, 25 bp, Rattus norvegicus
tctattggccaaccattttacttag

SEQ ID NO: 593347 - DNA, 25 bp, Rattus norvegicus
tctattggccaagcattttacttag

SEQ ID NO: 593348 - DNA, 25 bp, Rattus norvegicus
tctattggtctaaagccagggctac

SEQ ID NO: 593349 - DNA, 25 bp, Rattus norvegicus
tctattggtctatagccagggctac

SEQ ID NO: 593350 - DNA, 25 bp, Rattus norvegicus
tctattggtctccagaggacgggaa

SEQ ID NO: 593351 - DNA, 25 bp, Rattus norvegicus
tctattggtctcgagaggacgggaa

SEQ ID NO: 593352 - DNA, 25 bp, Rattus norvegicus
tctattgtagagaaacccttgtgac

SEQ ID NO: 593353 - DNA, 25 bp, Rattus norvegicus
tctattgtagagtaacccttgtgac

SEQ ID NO: 593354 - DNA, 25 bp, Rattus norvegicus
tctattgttaggatttgttacttct

SEQ ID NO: 593355 - DNA, 25 bp, Rattus norvegicus
tctattgttaggttttgttacttct

SEQ ID NO: 593356 - DNA, 25 bp, Rattus norvegicus
tctattgttgctactctcatctgag

SEQ ID NO: 593357 - DNA, 25 bp, Rattus norvegicus
tctattgttgcttctctcatctgag

SEQ ID NO: 593358 - DNA, 25 bp, Rattus norvegicus
tctatttatattactctcctcttct

SEQ ID NO: 593359 - DNA, 25 bp, Rattus norvegicus
tctatttatatttctctcctcttct

SEQ ID NO: 593360 - DNA, 25 bp, Rattus norvegicus
tctatttatcccaccttttcagtca

SEQ ID NO: 593361 - DNA, 25 bp, Rattus norvegicus
tctatttatccctccttttcagtca

SEQ ID NO: 593362 - DNA, 25 bp, Rattus norvegicus
tctatttccatgacgggcacaggct

SEQ ID NO: 593363 - DNA, 25 bp, Rattus norvegicus
tctatttccatgtcgggcacaggct

SEQ ID NO: 593364 - DNA, 25 bp, Rattus norvegicus
tctatttcctttcggctttgcgtta

SEQ ID NO: 593365 - DNA, 25 bp, Rattus norvegicus
tctatttcctttgggctttgcgtta

SEQ ID NO: 593366 - DNA, 25 bp, Rattus norvegicus
tctatttctctgctgtgttacgaca

SEQ ID NO: 593367 - DNA, 25 bp, Rattus norvegicus
tctatttctctggtgtgttacgaca

SEQ ID NO: 593368 - DNA, 25 bp, Rattus norvegicus
tctatttctgttactgtctctctgt

SEQ ID NO: 593369 - DNA, 25 bp, Rattus norvegicus
tctatttctgtttctgtctctctgt

SEQ ID NO: 593370 - DNA, 25 bp, Rattus norvegicus
tctatttctttcatgttggcttcaa

SEQ ID NO: 593371 - DNA, 25 bp, Rattus norvegicus
tctatttctttcttgttggcttcaa

SEQ ID NO: 593372 - DNA, 25 bp, Rattus norvegicus
tctatttgtcttaatttcaggtata

SEQ ID NO: 593373 - DNA, 25 bp, Rattus norvegicus
tctatttgtctttatttcaggtata

SEQ ID NO: 593374 - DNA, 25 bp, Rattus norvegicus
tctattttacaaagccactcacctg

SEQ ID NO: 593375 - DNA, 25 bp, Rattus norvegicus
tctattttacaatgccactcacctg

SEQ ID NO: 593376 - DNA, 25 bp, Rattus norvegicus
tctattttcttccactggtcgtttt

SEQ ID NO: 593377 - DNA, 25 bp, Rattus norvegicus
tctattttcttcgactggtcgtttt

SEQ ID NO: 593378 - DNA, 25 bp, Rattus norvegicus
tctatttttaacctcagttcatgtt

SEQ ID NO: 593379 - DNA, 25 bp, Rattus norvegicus
tctatttttaacgtcagttcatgtt

SEQ ID NO: 593380 - DNA, 25 bp, Rattus norvegicus
tctatttttatgaggcccttgagaa

SEQ ID NO: 593381 - DNA, 25 bp, Rattus norvegicus
tctatttttatgtggcccttgagaa

SEQ ID NO: 593382 - DNA, 25 bp, Rattus norvegicus
tctatttttgttcttgccattctta

SEQ ID NO: 593383 - DNA, 25 bp, Rattus norvegicus
tctatttttgttgttgccattctta

SEQ ID NO: 593384 - DNA, 25 bp, Rattus norvegicus
tctattttttaaagcctctctctgc

SEQ ID NO: 593385 - DNA, 25 bp, Rattus norvegicus
tctattttttaatgcctctctctgc

SEQ ID NO: 593386 - DNA, 25 bp, Rattus norvegicus
tctattttttgtcccacccatcaaa

SEQ ID NO: 593387 - DNA, 25 bp, Rattus norvegicus
tctattttttgtgccacccatcaaa

SEQ ID NO: 593388 - DNA, 25 bp, Rattus norvegicus
tctcaaaaagacaagccaggcccag

SEQ ID NO: 593389 - DNA, 25 bp, Rattus norvegicus
tctcaaaaagactagccaggcccag

SEQ ID NO: 593390 - DNA, 25 bp, Rattus norvegicus
tctcaaaaaggacccatgtgctgcc

SEQ ID NO: 593391 - DNA, 25 bp, Rattus norvegicus
tctcaaaaaggagccatgtgctgcc

SEQ ID NO: 593392 - DNA, 25 bp, Rattus norvegicus
tctcaaaaccccatcctgaagaaca

SEQ ID NO: 593393 - DNA, 25 bp, Rattus norvegicus
tctcaaaaccccttcctgaagaaca

SEQ ID NO: 593394 - DNA, 25 bp, Rattus norvegicus
tctcaaaacgttacaccgagcgtcg

SEQ ID NO: 593395 - DNA, 25 bp, Rattus norvegicus
tctcaaaacgtttcaccgagcgtcg

SEQ ID NO: 593396 - DNA, 25 bp, Rattus norvegicus
tctcaaaatatccatgcatttgcta

SEQ ID NO: 593397 - DNA, 25 bp, Rattus norvegicus
tctcaaaatatcgatgcatttgcta

SEQ ID NO: 593398 - DNA, 25 bp, Rattus norvegicus
tctcaaagatggcactggatttaca

SEQ ID NO: 593399 - DNA, 25 bp, Rattus norvegicus
tctcaaagatgggactggatttaca

SEQ ID NO: 593400 - DNA, 25 bp, Rattus norvegicus
tctcaaaggagcactcgccctgtga

SEQ ID NO: 593401 - DNA, 25 bp, Rattus norvegicus
tctcaaaggagctctcgccctgtga

SEQ ID NO: 593402 - DNA, 25 bp, Rattus norvegicus
tctcaaaggcttaaaacacggaggt

SEQ ID NO: 593403 - DNA, 25 bp, Rattus norvegicus
tctcaaaggctttaaacacggaggt

SEQ ID NO: 593404 - DNA, 25 bp, Rattus norvegicus
tctcaaaggtgtctttgtctcccac

SEQ ID NO: 593405 - DNA, 25 bp, Rattus norvegicus
tctcaaaggtgtgtttgtctcccac

SEQ ID NO: 593406 - DNA, 25 bp, Rattus norvegicus
tctcaaagttgacgcacacagtgac

SEQ ID NO: 593407 - DNA, 25 bp, Rattus norvegicus
tctcaaagttgaggcacacagtgac

SEQ ID NO: 593408 - DNA, 25 bp, Rattus norvegicus
tctcaaataccgacgtgctttttcc

SEQ ID NO: 593409 - DNA, 25 bp, Rattus norvegicus
tctcaaataccgtcgtgctttttcc

SEQ ID NO: 593410 - DNA, 25 bp, Rattus norvegicus
tctcaacactgacagcaactgtgct

SEQ ID NO: 593411 - DNA, 25 bp, Rattus norvegicus
tctcaacactgagagcaactgtgct

SEQ ID NO: 593412 - DNA, 25 bp, Rattus norvegicus
tctcaacattgaaccagagctcttg

SEQ ID NO: 593413 - DNA, 25 bp, Rattus norvegicus
tctcaacattgatccagagctcttg

SEQ ID NO: 593414 - DNA, 25 bp, Rattus norvegicus
tctcaaccaattcctgctccaggaa

SEQ ID NO: 593415 - DNA, 25 bp, Rattus norvegicus
tctcaaccaattgctgctccaggaa

SEQ ID NO: 593416 - DNA, 25 bp, Rattus norvegicus
tctcaaccagctctcacttcaggag

SEQ ID NO: 593417 - DNA, 25 bp, Rattus norvegicus
tctcaaccagctgtcacttcaggag

SEQ ID NO: 593418 - DNA, 25 bp, Rattus norvegicus
tctcaacctcccaagatgtgagtga

SEQ ID NO: 593419 - DNA, 25 bp, Rattus norvegicus
tctcaacctccctagatgtgagtga

SEQ ID NO: 593420 - DNA, 25 bp, Rattus norvegicus
tctcaacgatatcacttccatagaa

SEQ ID NO: 593421 - DNA, 25 bp, Rattus norvegicus
tctcaacgatatgacttccatagaa

SEQ ID NO: 593422 - DNA, 25 bp, Rattus norvegicus
tctcaactgcggagccagctatctc

SEQ ID NO: 593423 - DNA, 25 bp, Rattus norvegicus
tctcaactgcggtgccagctatctc

SEQ ID NO: 593424 - DNA, 25 bp, Rattus norvegicus
tctcaagaatgtccgagatcttcgc

SEQ ID NO: 593425 - DNA, 25 bp, Rattus norvegicus
tctcaagaatgtgcgagatcttcgc

SEQ ID NO: 593426 - DNA, 25 bp, Rattus norvegicus
tctcaagaccaaccagtgacggctg

SEQ ID NO: 593427 - DNA, 25 bp, Rattus norvegicus
tctcaagaccaagcagtgacggctg

SEQ ID NO: 593428 - DNA, 25 bp, Rattus norvegicus
tctcaagacctccaagatccaagtg

SEQ ID NO: 593429 - DNA, 25 bp, Rattus norvegicus
tctcaagacctcgaagatccaagtg

SEQ ID NO: 593430 - DNA, 25 bp, Rattus norvegicus
tctcaaggaactcagctagctcgct

SEQ ID NO: 593431 - DNA, 25 bp, Rattus norvegicus
tctcaaggaactgagctagctcgct

SEQ ID NO: 593432 - DNA, 25 bp, Rattus norvegicus
tctcaaggcttgatggctcagtgta

SEQ ID NO: 593433 - DNA, 25 bp, Rattus norvegicus
tctcaaggcttgttggctcagtgta

SEQ ID NO: 593434 - DNA, 25 bp, Rattus norvegicus
tctcaagggtatccgtacctcagtg

SEQ ID NO: 593435 - DNA, 25 bp, Rattus norvegicus
tctcaagggtatgcgtacctcagtg

SEQ ID NO: 593436 - DNA, 25 bp, Rattus norvegicus
tctcaaggttgcaaaggatgtatct

SEQ ID NO: 593437 - DNA, 25 bp, Rattus norvegicus
tctcaaggttgctaaggatgtatct

SEQ ID NO: 593438 - DNA, 25 bp, Rattus norvegicus
tctcaaggttttagctcaggtcgtt

SEQ ID NO: 593439 - DNA, 25 bp, Rattus norvegicus
tctcaaggtttttgctcaggtcgtt

SEQ ID NO: 593440 - DNA, 25 bp, Rattus norvegicus
tctcaagtagccactgtccctgtga

SEQ ID NO: 593441 - DNA, 25 bp, Rattus norvegicus
tctcaagtagcctctgtccctgtga

SEQ ID NO: 593442 - DNA, 25 bp, Rattus norvegicus
tctcaagtatccctacgtggcagtg

SEQ ID NO: 593443 - DNA, 25 bp, Rattus norvegicus
tctcaagtatccgtacgtggcagtg

SEQ ID NO: 593444 - DNA, 25 bp, Rattus norvegicus
tctcaagtgtctcggatccatgtac

SEQ ID NO: 593445 - DNA, 25 bp, Rattus norvegicus
tctcaagtgtctgggatccatgtac

SEQ ID NO: 593446 - DNA, 25 bp, Rattus norvegicus
tctcaatccgtcaaattccactgta

SEQ ID NO: 593447 - DNA, 25 bp, Rattus norvegicus
tctcaatccgtctaattccactgta

SEQ ID NO: 593448 - DNA, 25 bp, Rattus norvegicus
tctcaatcttttactgacactctct

SEQ ID NO: 593449 - DNA, 25 bp, Rattus norvegicus
tctcaatctttttctgacactctct

SEQ ID NO: 593450 - DNA, 25 bp, Rattus norvegicus
tctcaatggcatatactaccctggg

SEQ ID NO: 593451 - DNA, 25 bp, Rattus norvegicus
tctcaatggcatttactaccctggg

SEQ ID NO: 593452 - DNA, 25 bp, Rattus norvegicus
tctcaattacttcagttttttcccg

SEQ ID NO: 593453 - DNA, 25 bp, Rattus norvegicus
tctcaattacttgagttttttcccg

SEQ ID NO: 593454 - DNA, 25 bp, Rattus norvegicus
tctcacaagtgtagagtccccttct

SEQ ID NO: 593455 - DNA, 25 bp, Rattus norvegicus
tctcacaagtgttgagtccccttct

SEQ ID NO: 593456 - DNA, 25 bp, Rattus norvegicus
tctcacaccttcatttgtactatac

SEQ ID NO: 593457 - DNA, 25 bp, Rattus norvegicus
tctcacaccttcttttgtactatac

SEQ ID NO: 593458 - DNA, 25 bp, Rattus norvegicus
tctcacactcctcacttcagagtta

SEQ ID NO: 593459 - DNA, 25 bp, Rattus norvegicus
tctcacactcctgacttcagagtta

SEQ ID NO: 593460 - DNA, 25 bp, Rattus norvegicus
tctcacactgctacgaagaacctta

SEQ ID NO: 593461 - DNA, 25 bp, Rattus norvegicus
tctcacactgcttcgaagaacctta

SEQ ID NO: 593462 - DNA, 25 bp, Rattus norvegicus
tctcacagccatattgcccaaatag

SEQ ID NO: 593463 - DNA, 25 bp, Rattus norvegicus
tctcacagccattttgcccaaatag

SEQ ID NO: 593464 - DNA, 25 bp, Rattus norvegicus
tctcacaggagaatccatatgtcat

SEQ ID NO: 593465 - DNA, 25 bp, Rattus norvegicus
tctcacaggagattccatatgtcat

SEQ ID NO: 593466 - DNA, 25 bp, Rattus norvegicus
tctcacaggctgcaccagtggtagt

SEQ ID NO: 593467 - DNA, 25 bp, Rattus norvegicus
tctcacaggctggaccagtggtagt

SEQ ID NO: 593468 - DNA, 25 bp, Rattus norvegicus
tctcacagggttactccaagctgcc

SEQ ID NO: 593469 - DNA, 25 bp, Rattus norvegicus
tctcacagggtttctccaagctgcc

SEQ ID NO: 593470 - DNA, 25 bp, Rattus norvegicus
tctcacatacaacctcccaaatttt

SEQ ID NO: 593471 - DNA, 25 bp, Rattus norvegicus
tctcacatacaagctcccaaatttt

SEQ ID NO: 593472 - DNA, 25 bp, Rattus norvegicus
tctcacatagatccaaagtggtctt

SEQ ID NO: 593473 - DNA, 25 bp, Rattus norvegicus
tctcacatagatgcaaagtggtctt

SEQ ID NO: 593474 - DNA, 25 bp, Rattus norvegicus
tctcacatcctgatggtttccaggg

SEQ ID NO: 593475 - DNA, 25 bp, Rattus norvegicus
tctcacatcctgttggtttccaggg

SEQ ID NO: 593476 - DNA, 25 bp, Rattus norvegicus
tctcacatctcacccaaactgttgg

SEQ ID NO: 593477 - DNA, 25 bp, Rattus norvegicus
tctcacatctcagccaaactgttgg

SEQ ID NO: 593478 - DNA, 25 bp, Rattus norvegicus
tctcacatctgtcgtcaggcctgtg

SEQ ID NO: 593479 - DNA, 25 bp, Rattus norvegicus
tctcacatctgtggtcaggcctgtg

SEQ ID NO: 593480 - DNA, 25 bp, Rattus norvegicus
tctcacatgcttctgcaggaggaca

SEQ ID NO: 593481 - DNA, 25 bp, Rattus norvegicus
tctcacatgcttgtgcaggaggaca

SEQ ID NO: 593482 - DNA, 25 bp, Rattus norvegicus
tctcacattgttagaatgccacctt

SEQ ID NO: 593483 - DNA, 25 bp, Rattus norvegicus
tctcacattgtttgaatgccacctt

SEQ ID NO: 593484 - DNA, 25 bp, Rattus norvegicus
tctcacatttggacatagggcattc

SEQ ID NO: 593485 - DNA, 25 bp, Rattus norvegicus
tctcacatttggtcatagggcattc

SEQ ID NO: 593486 - DNA, 25 bp, Rattus norvegicus
tctcaccaccaacctataaatatca

SEQ ID NO: 593487 - DNA, 25 bp, Rattus norvegicus
tctcaccaccaagctataaatatca

SEQ ID NO: 593488 - DNA, 25 bp, Rattus norvegicus
tctcaccagactaacgggcattatg

SEQ ID NO: 593489 - DNA, 25 bp, Rattus norvegicus
tctcaccagacttacgggcattatg

SEQ ID NO: 593490 - DNA, 25 bp, Rattus norvegicus
tctcaccaggtgatcattcattcat

SEQ ID NO: 593491 - DNA, 25 bp, Rattus norvegicus
tctcaccaggtgttcattcattcat

SEQ ID NO: 593492 - DNA, 25 bp, Rattus norvegicus
tctcaccagtctctccagttatatc

SEQ ID NO: 593493 - DNA, 25 bp, Rattus norvegicus
tctcaccagtctgtccagttatatc

SEQ ID NO: 593494 - DNA, 25 bp, Rattus norvegicus
tctcaccatgttatcaacctcttaa

SEQ ID NO: 593495 - DNA, 25 bp, Rattus norvegicus
tctcaccatgttttcaacctcttaa

SEQ ID NO: 593496 - DNA, 25 bp, Rattus norvegicus
tctcacccaccgagacagcgatggg

SEQ ID NO: 593497 - DNA, 25 bp, Rattus norvegicus
tctcacccaccgtgacagcgatggg

SEQ ID NO: 593498 - DNA, 25 bp, Rattus norvegicus
tctcaccccgtgctcaatatcaaga

SEQ ID NO: 593499 - DNA, 25 bp, Rattus norvegicus
tctcaccccgtggtcaatatcaaga

SEQ ID NO: 593500 - DNA, 25 bp, Rattus norvegicus
tctcaccccttcaacaacttagaaa

SEQ ID NO: 593501 - DNA, 25 bp, Rattus norvegicus
tctcaccccttctacaacttagaaa

SEQ ID NO: 593502 - DNA, 25 bp, Rattus norvegicus
tctcacccggctatcacaaataaag

SEQ ID NO: 593503 - DNA, 25 bp, Rattus norvegicus
tctcacccggctttcacaaataaag

SEQ ID NO: 593504 - DNA, 25 bp, Rattus norvegicus
tctcaccctagcctttttaaatgca

SEQ ID NO: 593505 - DNA, 25 bp, Rattus norvegicus
tctcaccctagcgtttttaaatgca

SEQ ID NO: 593506 - DNA, 25 bp, Rattus norvegicus
tctcaccctctcactatttattgtt

SEQ ID NO: 593507 - DNA, 25 bp, Rattus norvegicus
tctcaccctctctctatttattgtt

SEQ ID NO: 593508 - DNA, 25 bp, Rattus norvegicus
tctcaccgcttgagtggtgtctcaa

SEQ ID NO: 593509 - DNA, 25 bp, Rattus norvegicus
tctcaccgcttgtgtggtgtctcaa

SEQ ID NO: 593510 - DNA, 25 bp, Rattus norvegicus
tctcacctcagcaatggacagatgt

SEQ ID NO: 593511 - DNA, 25 bp, Rattus norvegicus
tctcacctcagctatggacagatgt

SEQ ID NO: 593512 - DNA, 25 bp, Rattus norvegicus
tctcacctggctaaggctcatgtcc

SEQ ID NO: 593513 - DNA, 25 bp, Rattus norvegicus
tctcacctggcttaggctcatgtcc

SEQ ID NO: 593514 - DNA, 25 bp, Rattus norvegicus
tctcacctggtacgcttgtagcatc

SEQ ID NO: 593515 - DNA, 25 bp, Rattus norvegicus
tctcacctggtaggcttgtagcatc

SEQ ID NO: 593516 - DNA, 25 bp, Rattus norvegicus
tctcacctgtctagtaactgtgcaa

SEQ ID NO: 593517 - DNA, 25 bp, Rattus norvegicus
tctcacctgtcttgtaactgtgcaa

SEQ ID NO: 593518 - DNA, 25 bp, Rattus norvegicus
tctcacctgtggcaggctgtaaggc

SEQ ID NO: 593519 - DNA, 25 bp, Rattus norvegicus
tctcacctgtgggaggctgtaaggc

SEQ ID NO: 593520 - DNA, 25 bp, Rattus norvegicus
tctcaccttcacaggtgggtcaagg

SEQ ID NO: 593521 - DNA, 25 bp, Rattus norvegicus
tctcaccttcactggtgggtcaagg

SEQ ID NO: 593522 - DNA, 25 bp, Rattus norvegicus
tctcaccttcccctgaaatgaataa

SEQ ID NO: 593523 - DNA, 25 bp, Rattus norvegicus
tctcaccttcccgtgaaatgaataa

SEQ ID NO: 593524 - DNA, 25 bp, Rattus norvegicus
tctcacgacaagatccctgcttatg

SEQ ID NO: 593525 - DNA, 25 bp, Rattus norvegicus
tctcacgacaagttccctgcttatg

SEQ ID NO: 593526 - DNA, 25 bp, Rattus norvegicus
tctcacggagcaccatcagaatcac

SEQ ID NO: 593527 - DNA, 25 bp, Rattus norvegicus
tctcacggagcagcatcagaatcac

SEQ ID NO: 593528 - DNA, 25 bp, Rattus norvegicus
tctcacgggccgacaagatacctct

SEQ ID NO: 593529 - DNA, 25 bp, Rattus norvegicus
tctcacgggccgtcaagatacctct

SEQ ID NO: 593530 - DNA, 25 bp, Rattus norvegicus
tctcacgtcagacggaagtgtccga

SEQ ID NO: 593531 - DNA, 25 bp, Rattus norvegicus
tctcacgtcagagggaagtgtccga

SEQ ID NO: 593532 - DNA, 25 bp, Rattus norvegicus
tctcacgtgcttcgtaactagttac

SEQ ID NO: 593533 - DNA, 25 bp, Rattus norvegicus
tctcacgtgcttggtaactagttac

SEQ ID NO: 593534 - DNA, 25 bp, Rattus norvegicus
tctcacgtgggcaataatgtcaaat

SEQ ID NO: 593535 - DNA, 25 bp, Rattus norvegicus
tctcacgtgggctataatgtcaaat

SEQ ID NO: 593536 - DNA, 25 bp, Rattus norvegicus
tctcacgtgtctaccttatcatgac

SEQ ID NO: 593537 - DNA, 25 bp, Rattus norvegicus
tctcacgtgtcttccttatcatgac

SEQ ID NO: 593538 - DNA, 25 bp, Rattus norvegicus
tctcacgttagtatacggctctata

SEQ ID NO: 593539 - DNA, 25 bp, Rattus norvegicus
tctcacgttagtttacggctctata

SEQ ID NO: 593540 - DNA, 25 bp, Rattus norvegicus
tctcacgttgttcctcttgtaaata

SEQ ID NO: 593541 - DNA, 25 bp, Rattus norvegicus
tctcacgttgttgctcttgtaaata

SEQ ID NO: 593542 - DNA, 25 bp, Rattus norvegicus
tctcactatccaatcctttacaaag

SEQ ID NO: 593543 - DNA, 25 bp, Rattus norvegicus
tctcactatccattcctttacaaag

SEQ ID NO: 593544 - DNA, 25 bp, Rattus norvegicus
tctcactcaaatacctgttagcatt

SEQ ID NO: 593545 - DNA, 25 bp, Rattus norvegicus
tctcactcaaattcctgttagcatt

SEQ ID NO: 593546 - DNA, 25 bp, Rattus norvegicus
tctcactcaagccaagagccaaagg

SEQ ID NO: 593547 - DNA, 25 bp, Rattus norvegicus
tctcactcaagcgaagagccaaagg

SEQ ID NO: 593548 - DNA, 25 bp, Rattus norvegicus
tctcactcagacagtggcacactta

SEQ ID NO: 593549 - DNA, 25 bp, Rattus norvegicus
tctcactcagactgtggcacactta

SEQ ID NO: 593550 - DNA, 25 bp, Rattus norvegicus
tctcactccccaatttatgttgcag

SEQ ID NO: 593551 - DNA, 25 bp, Rattus norvegicus
tctcactccccattttatgttgcag

SEQ ID NO: 593552 - DNA, 25 bp, Rattus norvegicus
tctcactccgaactttactgctgga

SEQ ID NO: 593553 - DNA, 25 bp, Rattus norvegicus
tctcactccgaagtttactgctgga

SEQ ID NO: 593554 - DNA, 25 bp, Rattus norvegicus
tctcactctcgcattgtcattagct

SEQ ID NO: 593555 - DNA, 25 bp, Rattus norvegicus
tctcactctcgctttgtcattagct

SEQ ID NO: 593556 - DNA, 25 bp, Rattus norvegicus
tctcactctgttctctgactgtgaa

SEQ ID NO: 593557 - DNA, 25 bp, Rattus norvegicus
tctcactctgttgtctgactgtgaa

SEQ ID NO: 593558 - DNA, 25 bp, Rattus norvegicus
tctcactctttcactaaaggtctat

SEQ ID NO: 593559 - DNA, 25 bp, Rattus norvegicus
tctcactctttctctaaaggtctat

SEQ ID NO: 593560 - DNA, 25 bp, Rattus norvegicus
tctcactgcgttccaggtctgggca

SEQ ID NO: 593561 - DNA, 25 bp, Rattus norvegicus
tctcactgcgttgcaggtctgggca

SEQ ID NO: 593562 - DNA, 25 bp, Rattus norvegicus
tctcactgcttcaccatggcctttg

SEQ ID NO: 593563 - DNA, 25 bp, Rattus norvegicus
tctcactgcttctccatggcctttg

SEQ ID NO: 593564 - DNA, 25 bp, Rattus norvegicus
tctcactgtggaatttgggacgatt

SEQ ID NO: 593565 - DNA, 25 bp, Rattus norvegicus
tctcactgtggattttgggacgatt

SEQ ID NO: 593566 - DNA, 25 bp, Rattus norvegicus
tctcacttatgacgtcttggaccag

SEQ ID NO: 593567 - DNA, 25 bp, Rattus norvegicus
tctcacttatgaggtcttggaccag

SEQ ID NO: 593568 - DNA, 25 bp, Rattus norvegicus
tctcacttcaccagaacgaaattct

SEQ ID NO: 593569 - DNA, 25 bp, Rattus norvegicus
tctcacttcacctgaacgaaattct

SEQ ID NO: 593570 - DNA, 25 bp, Rattus norvegicus
tctcacttcactcgcattgtattgc

SEQ ID NO: 593571 - DNA, 25 bp, Rattus norvegicus
tctcacttcactggcattgtattgc

SEQ ID NO: 593572 - DNA, 25 bp, Rattus norvegicus
tctcacttcgttcgctacagcaaag

SEQ ID NO: 593573 - DNA, 25 bp, Rattus norvegicus
tctcacttcgttggctacagcaaag

SEQ ID NO: 593574 - DNA, 25 bp, Rattus norvegicus
tctcactttcccctaattatcttta

SEQ ID NO: 593575 - DNA, 25 bp, Rattus norvegicus
tctcactttcccgtaattatcttta

SEQ ID NO: 593576 - DNA, 25 bp, Rattus norvegicus
tctcactttgccatacctctgatct

SEQ ID NO: 593577 - DNA, 25 bp, Rattus norvegicus
tctcactttgccttacctctgatct

SEQ ID NO: 593578 - DNA, 25 bp, Rattus norvegicus
tctcagaacagtattattcccctcc

SEQ ID NO: 593579 - DNA, 25 bp, Rattus norvegicus
tctcagaacagttttattcccctcc

SEQ ID NO: 593580 - DNA, 25 bp, Rattus norvegicus
tctcagaagcccctgtgaagttctt

SEQ ID NO: 593581 - DNA, 25 bp, Rattus norvegicus
tctcagaagcccgtgtgaagttctt

SEQ ID NO: 593582 - DNA, 25 bp, Rattus norvegicus
tctcagaccattacctttcttttct

SEQ ID NO: 593583 - DNA, 25 bp, Rattus norvegicus
tctcagaccatttcctttcttttct

SEQ ID NO: 593584 - DNA, 25 bp, Rattus norvegicus
tctcagaccctcatcaaggttggga

SEQ ID NO: 593585 - DNA, 25 bp, Rattus norvegicus
tctcagaccctcttcaaggttggga

SEQ ID NO: 593586 - DNA, 25 bp, Rattus norvegicus
tctcagactctgcagacatgaccat

SEQ ID NO: 593587 - DNA, 25 bp, Rattus norvegicus
tctcagactctggagacatgaccat

SEQ ID NO: 593588 - DNA, 25 bp, Rattus norvegicus
tctcagactgcccttctgttttaga

SEQ ID NO: 593589 - DNA, 25 bp, Rattus norvegicus
tctcagactgccgttctgttttaga

SEQ ID NO: 593590 - DNA, 25 bp, Rattus norvegicus
tctcagaggccgcactgcgcctgct

SEQ ID NO: 593591 - DNA, 25 bp, Rattus norvegicus
tctcagaggccggactgcgcctgct

SEQ ID NO: 593592 - DNA, 25 bp, Rattus norvegicus
tctcagagggacactagcgcaggtt

SEQ ID NO: 593593 - DNA, 25 bp, Rattus norvegicus
tctcagagggactctagcgcaggtt

SEQ ID NO: 593594 - DNA, 25 bp, Rattus norvegicus
tctcagagtctgaacctccaacaaa

SEQ ID NO: 593595 - DNA, 25 bp, Rattus norvegicus
tctcagagtctgtacctccaacaaa

SEQ ID NO: 593596 - DNA, 25 bp, Rattus norvegicus
tctcagagtgacaggagctgggcct

SEQ ID NO: 593597 - DNA, 25 bp, Rattus norvegicus
tctcagagtgactggagctgggcct

SEQ ID NO: 593598 - DNA, 25 bp, Rattus norvegicus
tctcagagtgctatcttctttgtaa

SEQ ID NO: 593599 - DNA, 25 bp, Rattus norvegicus
tctcagagtgctttcttctttgtaa

SEQ ID NO: 593600 - DNA, 25 bp, Rattus norvegicus
tctcagagttggcaacggcggtctt

SEQ ID NO: 593601 - DNA, 25 bp, Rattus norvegicus
tctcagagttgggaacggcggtctt

SEQ ID NO: 593602 - DNA, 25 bp, Rattus norvegicus
tctcagataaaacttagagccccgt

SEQ ID NO: 593603 - DNA, 25 bp, Rattus norvegicus
tctcagataaaagttagagccccgt

SEQ ID NO: 593604 - DNA, 25 bp, Rattus norvegicus
tctcagatcctcaagttggacatca

SEQ ID NO: 593605 - DNA, 25 bp, Rattus norvegicus
tctcagatcctctagttggacatca

SEQ ID NO: 593606 - DNA, 25 bp, Rattus norvegicus
tctcagatctgaccaagggcaggac

SEQ ID NO: 593607 - DNA, 25 bp, Rattus norvegicus
tctcagatctgagcaagggcaggac

SEQ ID NO: 593608 - DNA, 25 bp, Rattus norvegicus
tctcagatgtgaaggcgaccgacct

SEQ ID NO: 593609 - DNA, 25 bp, Rattus norvegicus
tctcagatgtgatggcgaccgacct

SEQ ID NO: 593610 - DNA, 25 bp, Rattus norvegicus
tctcagcacccacgaagcgtaggca

SEQ ID NO: 593611 - DNA, 25 bp, Rattus norvegicus
tctcagcacccaggaagcgtaggca

SEQ ID NO: 593612 - DNA, 25 bp, Rattus norvegicus
tctcagcactcaaatggaccaacag

SEQ ID NO: 593613 - DNA, 25 bp, Rattus norvegicus
tctcagcactcatatggaccaacag

SEQ ID NO: 593614 - DNA, 25 bp, Rattus norvegicus
tctcagcagcagaccagctccaggg

SEQ ID NO: 593615 - DNA, 25 bp, Rattus norvegicus
tctcagcagcagtccagctccaggg

SEQ ID NO: 593616 - DNA, 25 bp, Rattus norvegicus
tctcagcatgggacctagactgcag

SEQ ID NO: 593617 - DNA, 25 bp, Rattus norvegicus
tctcagcatgggtcctagactgcag

SEQ ID NO: 593618 - DNA, 25 bp, Rattus norvegicus
tctcagccaaccagagctgcagcag

SEQ ID NO: 593619 - DNA, 25 bp, Rattus norvegicus
tctcagccaacctgagctgcagcag

SEQ ID NO: 593620 - DNA, 25 bp, Rattus norvegicus
tctcagccaggccatgttccaagag

SEQ ID NO: 593621 - DNA, 25 bp, Rattus norvegicus
tctcagccaggcgatgttccaagag

SEQ ID NO: 593622 - DNA, 25 bp, Rattus norvegicus
tctcagcccaacatcattggtctaa

SEQ ID NO: 593623 - DNA, 25 bp, Rattus norvegicus
tctcagcccaacttcattggtctaa

SEQ ID NO: 593624 - DNA, 25 bp, Rattus norvegicus
tctcagccctcacaatggttcataa

SEQ ID NO: 593625 - DNA, 25 bp, Rattus norvegicus
tctcagccctcagaatggttcataa

SEQ ID NO: 593626 - DNA, 25 bp, Rattus norvegicus
tctcagccctttctgtgcagggatt

SEQ ID NO: 593627 - DNA, 25 bp, Rattus norvegicus
tctcagccctttgtgtgcagggatt

SEQ ID NO: 593628 - DNA, 25 bp, Rattus norvegicus
tctcagcctagtcgtctctatggaa

SEQ ID NO: 593629 - DNA, 25 bp, Rattus norvegicus
tctcagcctagtggtctctatggaa

SEQ ID NO: 593630 - DNA, 25 bp, Rattus norvegicus
tctcagcctccaaatactcttgaat

SEQ ID NO: 593631 - DNA, 25 bp, Rattus norvegicus
tctcagcctccatatactcttgaat

SEQ ID NO: 593632 - DNA, 25 bp, Rattus norvegicus
tctcagcctttaacacatgatggag

SEQ ID NO: 593633 - DNA, 25 bp, Rattus norvegicus
tctcagcctttatcacatgatggag

SEQ ID NO: 593634 - DNA, 25 bp, Rattus norvegicus
tctcagcgtaaaccaatccatgctt

SEQ ID NO: 593635 - DNA, 25 bp, Rattus norvegicus
tctcagcgtaaagcaatccatgctt

SEQ ID NO: 593636 - DNA, 25 bp, Rattus norvegicus
tctcagcgtgtcaaacatatccatc

SEQ ID NO: 593637 - DNA, 25 bp, Rattus norvegicus
tctcagcgtgtctaacatatccatc

SEQ ID NO: 593638 - DNA, 25 bp, Rattus norvegicus
tctcagctcagcaccaaatggatcg

SEQ ID NO: 593639 - DNA, 25 bp, Rattus norvegicus
tctcagctcagctccaaatggatcg

SEQ ID NO: 593640 - DNA, 25 bp, Rattus norvegicus
tctcagctcaggctagcctcttcaa

SEQ ID NO: 593641 - DNA, 25 bp, Rattus norvegicus
tctcagctcagggtagcctcttcaa

SEQ ID NO: 593642 - DNA, 25 bp, Rattus norvegicus
tctcagctctagatcggacggcagt

SEQ ID NO: 593643 - DNA, 25 bp, Rattus norvegicus
tctcagctctagttcggacggcagt

SEQ ID NO: 593644 - DNA, 25 bp, Rattus norvegicus
tctcagctctggagtcacgagttca

SEQ ID NO: 593645 - DNA, 25 bp, Rattus norvegicus
tctcagctctggtgtcacgagttca

SEQ ID NO: 593646 - DNA, 25 bp, Rattus norvegicus
tctcagctgcttcctttaagtcttg

SEQ ID NO: 593647 - DNA, 25 bp, Rattus norvegicus
tctcagctgcttgctttaagtcttg

SEQ ID NO: 593648 - DNA, 25 bp, Rattus norvegicus
tctcagctggagacgttgtggccca

SEQ ID NO: 593649 - DNA, 25 bp, Rattus norvegicus
tctcagctggagtcgttgtggccca

SEQ ID NO: 593650 - DNA, 25 bp, Rattus norvegicus
tctcaggaacaaacggtcccagagt

SEQ ID NO: 593651 - DNA, 25 bp, Rattus norvegicus
tctcaggaacaatcggtcccagagt

SEQ ID NO: 593652 - DNA, 25 bp, Rattus norvegicus
tctcaggacatgacagcccaggtga

SEQ ID NO: 593653 - DNA, 25 bp, Rattus norvegicus
tctcaggacatgtcagcccaggtga

SEQ ID NO: 593654 - DNA, 25 bp, Rattus norvegicus
tctcaggaccaccaagccagagcat

SEQ ID NO: 593655 - DNA, 25 bp, Rattus norvegicus
tctcaggaccacgaagccagagcat

SEQ ID NO: 593656 - DNA, 25 bp, Rattus norvegicus
tctcaggcagtgaaagaatcccaag

SEQ ID NO: 593657 - DNA, 25 bp, Rattus norvegicus
tctcaggcagtgtaagaatcccaag

SEQ ID NO: 593658 - DNA, 25 bp, Rattus norvegicus
tctcaggcctggaggatgactacgg

SEQ ID NO: 593659 - DNA, 25 bp, Rattus norvegicus
tctcaggcctggtggatgactacgg

SEQ ID NO: 593660 - DNA, 25 bp, Rattus norvegicus
tctcaggccttacctcagtagctta

SEQ ID NO: 593661 - DNA, 25 bp, Rattus norvegicus
tctcaggccttagctcagtagctta

SEQ ID NO: 593662 - DNA, 25 bp, Rattus norvegicus
tctcaggctcatacattctctgtgg

SEQ ID NO: 593663 - DNA, 25 bp, Rattus norvegicus
tctcaggctcattcattctctgtgg

SEQ ID NO: 593664 - DNA, 25 bp, Rattus norvegicus
tctcaggctcctagggaccatggaa

SEQ ID NO: 593665 - DNA, 25 bp, Rattus norvegicus
tctcaggctccttgggaccatggaa

SEQ ID NO: 593666 - DNA, 25 bp, Rattus norvegicus
tctcaggctgagctatgaggatcat

SEQ ID NO: 593667 - DNA, 25 bp, Rattus norvegicus
tctcaggctgaggtatgaggatcat

SEQ ID NO: 593668 - DNA, 25 bp, Rattus norvegicus
tctcaggctgcgatttggattaaaa

SEQ ID NO: 593669 - DNA, 25 bp, Rattus norvegicus
tctcaggctgcgttttggattaaaa

SEQ ID NO: 593670 - DNA, 25 bp, Rattus norvegicus
tctcaggcttgacacctgtctgaat

SEQ ID NO: 593671 - DNA, 25 bp, Rattus norvegicus
tctcaggcttgagacctgtctgaat

SEQ ID NO: 593672 - DNA, 25 bp, Rattus norvegicus
tctcagggacttactgaggccaggt

SEQ ID NO: 593673 - DNA, 25 bp, Rattus norvegicus
tctcagggactttctgaggccaggt

SEQ ID NO: 593674 - DNA, 25 bp, Rattus norvegicus
tctcagggtccaatttttttctctc

SEQ ID NO: 593675 - DNA, 25 bp, Rattus norvegicus
tctcagggtccattttttttctctc

SEQ ID NO: 593676 - DNA, 25 bp, Rattus norvegicus
tctcagggtcttaagccacatgctt

SEQ ID NO: 593677 - DNA, 25 bp, Rattus norvegicus
tctcagggtctttagccacatgctt

SEQ ID NO: 593678 - DNA, 25 bp, Rattus norvegicus
tctcaggtccctcagagatgctgga

SEQ ID NO: 593679 - DNA, 25 bp, Rattus norvegicus
tctcaggtccctgagagatgctgga

SEQ ID NO: 593680 - DNA, 25 bp, Rattus norvegicus
tctcaggtctttcgctcagtgtcac

SEQ ID NO: 593681 - DNA, 25 bp, Rattus norvegicus
tctcaggtctttggctcagtgtcac

SEQ ID NO: 593682 - DNA, 25 bp, Rattus norvegicus
tctcaggtggagaggccataggcca

SEQ ID NO: 593683 - DNA, 25 bp, Rattus norvegicus
tctcaggtggagtggccataggcca

SEQ ID NO: 593684 - DNA, 25 bp, Rattus norvegicus
tctcaggttactccagcgcagatgg

SEQ ID NO: 593685 - DNA, 25 bp, Rattus norvegicus
tctcaggttactgcagcgcagatgg

SEQ ID NO: 593686 - DNA, 25 bp, Rattus norvegicus
tctcagtaagttattctgcagttta

SEQ ID NO: 593687 - DNA, 25 bp, Rattus norvegicus
tctcagtaagtttttctgcagttta

SEQ ID NO: 593688 - DNA, 25 bp, Rattus norvegicus
tctcagtcagatcctgcagatgcag

SEQ ID NO: 593689 - DNA, 25 bp, Rattus norvegicus
tctcagtcagatgctgcagatgcag

SEQ ID NO: 593690 - DNA, 25 bp, Rattus norvegicus
tctcagtccctcattgttgaagttt

SEQ ID NO: 593691 - DNA, 25 bp, Rattus norvegicus
tctcagtccctctttgttgaagttt

SEQ ID NO: 593692 - DNA, 25 bp, Rattus norvegicus
tctcagtctagaagcgccaggactt

SEQ ID NO: 593693 - DNA, 25 bp, Rattus norvegicus
tctcagtctagatgcgccaggactt

SEQ ID NO: 593694 - DNA, 25 bp, Rattus norvegicus
tctcagtctcagactggtaacatct

SEQ ID NO: 593695 - DNA, 25 bp, Rattus norvegicus
tctcagtctcagtctggtaacatct

SEQ ID NO: 593696 - DNA, 25 bp, Rattus norvegicus
tctcagtctcttactctcagacttt

SEQ ID NO: 593697 - DNA, 25 bp, Rattus norvegicus
tctcagtctctttctctcagacttt

SEQ ID NO: 593698 - DNA, 25 bp, Rattus norvegicus
tctcagtcttgcatccttcagggaa

SEQ ID NO: 593699 - DNA, 25 bp, Rattus norvegicus
tctcagtcttgcttccttcagggaa

SEQ ID NO: 593700 - DNA, 25 bp, Rattus norvegicus
tctcagtgcctaccagcgaaagtgc

SEQ ID NO: 593701 - DNA, 25 bp, Rattus norvegicus
tctcagtgcctagcagcgaaagtgc

SEQ ID NO: 593702 - DNA, 25 bp, Rattus norvegicus
tctcagtggctaacaccttatgtga

SEQ ID NO: 593703 - DNA, 25 bp, Rattus norvegicus
tctcagtggctatcaccttatgtga

SEQ ID NO: 593704 - DNA, 25 bp, Rattus norvegicus
tctcagtgggctccctggatgatga

SEQ ID NO: 593705 - DNA, 25 bp, Rattus norvegicus
tctcagtgggctgcctggatgatga

SEQ ID NO: 593706 - DNA, 25 bp, Rattus norvegicus
tctcagtgtaccctctttatttaaa

SEQ ID NO: 593707 - DNA, 25 bp, Rattus norvegicus
tctcagtgtaccgtctttatttaaa

SEQ ID NO: 593708 - DNA, 25 bp, Rattus norvegicus
tctcagtgtctaatagctgtccctg

SEQ ID NO: 593709 - DNA, 25 bp, Rattus norvegicus
tctcagtgtctattagctgtccctg

SEQ ID NO: 593710 - DNA, 25 bp, Rattus norvegicus
tctcagtgtgtgaatggtccatgcc

SEQ ID NO: 593711 - DNA, 25 bp, Rattus norvegicus
tctcagtgtgtgtatggtccatgcc

SEQ ID NO: 593712 - DNA, 25 bp, Rattus norvegicus
tctcagtgttgccttggttttcaag

SEQ ID NO: 593713 - DNA, 25 bp, Rattus norvegicus
tctcagtgttgcgttggttttcaag

SEQ ID NO: 593714 - DNA, 25 bp, Rattus norvegicus
tctcagtgtttcacaaggccgtgga

SEQ ID NO: 593715 - DNA, 25 bp, Rattus norvegicus
tctcagtgtttctcaaggccgtgga

SEQ ID NO: 593716 - DNA, 25 bp, Rattus norvegicus
tctcagttccatccccaggatgttg

SEQ ID NO: 593717 - DNA, 25 bp, Rattus norvegicus
tctcagttccatgcccaggatgttg

SEQ ID NO: 593718 - DNA, 25 bp, Rattus norvegicus
tctcagttccttctgctgcctctgt

SEQ ID NO: 593719 - DNA, 25 bp, Rattus norvegicus
tctcagttccttgtgctgcctctgt

SEQ ID NO: 593720 - DNA, 25 bp, Rattus norvegicus
tctcagttctgcactcagggtggca

SEQ ID NO: 593721 - DNA, 25 bp, Rattus norvegicus
tctcagttctgctctcagggtggca

SEQ ID NO: 593722 - DNA, 25 bp, Rattus norvegicus
tctcagttgctgactctgtggagac

SEQ ID NO: 593723 - DNA, 25 bp, Rattus norvegicus
tctcagttgctgtctctgtggagac

SEQ ID NO: 593724 - DNA, 25 bp, Rattus norvegicus
tctcatacagacctcctcaattaat

SEQ ID NO: 593725 - DNA, 25 bp, Rattus norvegicus
tctcatacagacgtcctcaattaat

SEQ ID NO: 593726 - DNA, 25 bp, Rattus norvegicus
tctcatacttacatggactccttag

SEQ ID NO: 593727 - DNA, 25 bp, Rattus norvegicus
tctcatacttacttggactccttag

SEQ ID NO: 593728 - DNA, 25 bp, Rattus norvegicus
tctcatagatctactctctgacagg

SEQ ID NO: 593729 - DNA, 25 bp, Rattus norvegicus
tctcatagatcttctctctgacagg

SEQ ID NO: 593730 - DNA, 25 bp, Rattus norvegicus
tctcatagcattaaggactccttcc

SEQ ID NO: 593731 - DNA, 25 bp, Rattus norvegicus
tctcatagcatttaggactccttcc

SEQ ID NO: 593732 - DNA, 25 bp, Rattus norvegicus
tctcatagcctcctgcaaacaaaac

SEQ ID NO: 593733 - DNA, 25 bp, Rattus norvegicus
tctcatagcctcgtgcaaacaaaac

SEQ ID NO: 593734 - DNA, 25 bp, Rattus norvegicus
tctcatatgtacaatgtttgccagc

SEQ ID NO: 593735 - DNA, 25 bp, Rattus norvegicus
tctcatatgtactatgtttgccagc

SEQ ID NO: 593736 - DNA, 25 bp, Rattus norvegicus
tctcatatgtgaaggagcccagcat

SEQ ID NO: 593737 - DNA, 25 bp, Rattus norvegicus
tctcatatgtgatggagcccagcat

SEQ ID NO: 593738 - DNA, 25 bp, Rattus norvegicus
tctcatcaccagcacagcaggtcga

SEQ ID NO: 593739 - DNA, 25 bp, Rattus norvegicus
tctcatcaccaggacagcaggtcga

SEQ ID NO: 593740 - DNA, 25 bp, Rattus norvegicus
tctcatcactccaaatcttttaagt

SEQ ID NO: 593741 - DNA, 25 bp, Rattus norvegicus
tctcatcactcctaatcttttaagt

SEQ ID NO: 593742 - DNA, 25 bp, Rattus norvegicus
tctcatccagacacctgcttaggat

SEQ ID NO: 593743 - DNA, 25 bp, Rattus norvegicus
tctcatccagactcctgcttaggat

SEQ ID NO: 593744 - DNA, 25 bp, Rattus norvegicus
tctcatcccacactagtgccttttt

SEQ ID NO: 593745 - DNA, 25 bp, Rattus norvegicus
tctcatcccacagtagtgccttttt

SEQ ID NO: 593746 - DNA, 25 bp, Rattus norvegicus
tctcatcctatcacctggtatggga

SEQ ID NO: 593747 - DNA, 25 bp, Rattus norvegicus
tctcatcctatctcctggtatggga

SEQ ID NO: 593748 - DNA, 25 bp, Rattus norvegicus
tctcatcgattcacacagacgtgat

SEQ ID NO: 593749 - DNA, 25 bp, Rattus norvegicus
tctcatcgattctcacagacgtgat

SEQ ID NO: 593750 - DNA, 25 bp, Rattus norvegicus
tctcatctagagacttcccttgtag

SEQ ID NO: 593751 - DNA, 25 bp, Rattus norvegicus
tctcatctagagtcttcccttgtag

SEQ ID NO: 593752 - DNA, 25 bp, Rattus norvegicus
tctcatctatccagttctgcttaaa

SEQ ID NO: 593753 - DNA, 25 bp, Rattus norvegicus
tctcatctatcctgttctgcttaaa

SEQ ID NO: 593754 - DNA, 25 bp, Rattus norvegicus
tctcatctccgtcgactctgaaaat

SEQ ID NO: 593755 - DNA, 25 bp, Rattus norvegicus
tctcatctccgtggactctgaaaat

SEQ ID NO: 593756 - DNA, 25 bp, Rattus norvegicus
tctcatctcttgctttgttttcccc

SEQ ID NO: 593757 - DNA, 25 bp, Rattus norvegicus
tctcatctcttggtttgttttcccc

SEQ ID NO: 593758 - DNA, 25 bp, Rattus norvegicus
tctcatctgagaaacctaaaaatgt

SEQ ID NO: 593759 - DNA, 25 bp, Rattus norvegicus
tctcatctgagatacctaaaaatgt

SEQ ID NO: 593760 - DNA, 25 bp, Rattus norvegicus
tctcatctggaaactttagagggtt

SEQ ID NO: 593761 - DNA, 25 bp, Rattus norvegicus
tctcatctggaatctttagagggtt

SEQ ID NO: 593762 - DNA, 25 bp, Rattus norvegicus
tctcatcttctgacgagcctatcag

SEQ ID NO: 593763 - DNA, 25 bp, Rattus norvegicus
tctcatcttctgtcgagcctatcag

SEQ ID NO: 593764 - DNA, 25 bp, Rattus norvegicus
tctcatcttgctcccagtaaagttt

SEQ ID NO: 593765 - DNA, 25 bp, Rattus norvegicus
tctcatcttgctgccagtaaagttt

SEQ ID NO: 593766 - DNA, 25 bp, Rattus norvegicus
tctcatctttagcaccaaactcggg

SEQ ID NO: 593767 - DNA, 25 bp, Rattus norvegicus
tctcatctttaggaccaaactcggg

SEQ ID NO: 593768 - DNA, 25 bp, Rattus norvegicus
tctcatgaaagcagtctcgggacac

SEQ ID NO: 593769 - DNA, 25 bp, Rattus norvegicus
tctcatgaaagctgtctcgggacac

SEQ ID NO: 593770 - DNA, 25 bp, Rattus norvegicus
tctcatgaagatcctccgccaggaa

SEQ ID NO: 593771 - DNA, 25 bp, Rattus norvegicus
tctcatgaagatgctccgccaggaa

SEQ ID NO: 593772 - DNA, 25 bp, Rattus norvegicus
tctcatgaagggactgttcgtagaa

SEQ ID NO: 593773 - DNA, 25 bp, Rattus norvegicus
tctcatgaagggtctgttcgtagaa

SEQ ID NO: 593774 - DNA, 25 bp, Rattus norvegicus
tctcatgacataatctgcttccttg

SEQ ID NO: 593775 - DNA, 25 bp, Rattus norvegicus
tctcatgacatattctgcttccttg

SEQ ID NO: 593776 - DNA, 25 bp, Rattus norvegicus
tctcatgactcacatgcccttggaa

SEQ ID NO: 593777 - DNA, 25 bp, Rattus norvegicus
tctcatgactcagatgcccttggaa

SEQ ID NO: 593778 - DNA, 25 bp, Rattus norvegicus
tctcatgagagtaaagtccccagca

SEQ ID NO: 593779 - DNA, 25 bp, Rattus norvegicus
tctcatgagagttaagtccccagca

SEQ ID NO: 593780 - DNA, 25 bp, Rattus norvegicus
tctcatgatttgactgtggatcagt

SEQ ID NO: 593781 - DNA, 25 bp, Rattus norvegicus
tctcatgatttgtctgtggatcagt

SEQ ID NO: 593782 - DNA, 25 bp, Rattus norvegicus
tctcatgcacaaaggacttccgctt

SEQ ID NO: 593783 - DNA, 25 bp, Rattus norvegicus
tctcatgcacaatggacttccgctt

SEQ ID NO: 593784 - DNA, 25 bp, Rattus norvegicus
tctcatgcctttaatgttaattttg

SEQ ID NO: 593785 - DNA, 25 bp, Rattus norvegicus
tctcatgccttttatgttaattttg

SEQ ID NO: 593786 - DNA, 25 bp, Rattus norvegicus
tctcatggatctatttaaacactgc

SEQ ID NO: 593787 - DNA, 25 bp, Rattus norvegicus
tctcatggatctttttaaacactgc

SEQ ID NO: 593788 - DNA, 25 bp, Rattus norvegicus
tctcatgtagccatctctctgcagg

SEQ ID NO: 593789 - DNA, 25 bp, Rattus norvegicus
tctcatgtagccttctctctgcagg

SEQ ID NO: 593790 - DNA, 25 bp, Rattus norvegicus
tctcatgtagttcggactggccttg

SEQ ID NO: 593791 - DNA, 25 bp, Rattus norvegicus
tctcatgtagttgggactggccttg

SEQ ID NO: 593792 - DNA, 25 bp, Rattus norvegicus
tctcatgtccccacatcatctgtgg

SEQ ID NO: 593793 - DNA, 25 bp, Rattus norvegicus
tctcatgtcccctcatcatctgtgg

SEQ ID NO: 593794 - DNA, 25 bp, Rattus norvegicus
tctcatgtcctcctattgattgttt

SEQ ID NO: 593795 - DNA, 25 bp, Rattus norvegicus
tctcatgtcctcgtattgattgttt

SEQ ID NO: 593796 - DNA, 25 bp, Rattus norvegicus
tctcatgttagcagtaccagtcagt

SEQ ID NO: 593797 - DNA, 25 bp, Rattus norvegicus
tctcatgttagctgtaccagtcagt

SEQ ID NO: 593798 - DNA, 25 bp, Rattus norvegicus
tctcatgttgagatattactgttct

SEQ ID NO: 593799 - DNA, 25 bp, Rattus norvegicus
tctcatgttgagttattactgttct

SEQ ID NO: 593800 - DNA, 25 bp, Rattus norvegicus
tctcattaaggaagatcgggttact

SEQ ID NO: 593801 - DNA, 25 bp, Rattus norvegicus
tctcattaaggatgatcgggttact

SEQ ID NO: 593802 - DNA, 25 bp, Rattus norvegicus
tctcattcaaaactctgcaaggctg

SEQ ID NO: 593803 - DNA, 25 bp, Rattus norvegicus
tctcattcaaaagtctgcaaggctg

SEQ ID NO: 593804 - DNA, 25 bp, Rattus norvegicus
tctcattcaaaccacggcattttca

SEQ ID NO: 593805 - DNA, 25 bp, Rattus norvegicus
tctcattcaaacgacggcattttca

SEQ ID NO: 593806 - DNA, 25 bp, Rattus norvegicus
tctcattcatcactttccctatagc

SEQ ID NO: 593807 - DNA, 25 bp, Rattus norvegicus
tctcattcatcagtttccctatagc

SEQ ID NO: 593808 - DNA, 25 bp, Rattus norvegicus
tctcattccctcatactgcgtatta

SEQ ID NO: 593809 - DNA, 25 bp, Rattus norvegicus
tctcattccctcttactgcgtatta

SEQ ID NO: 593810 - DNA, 25 bp, Rattus norvegicus
tctcattcctttcggcttatagcgc

SEQ ID NO: 593811 - DNA, 25 bp, Rattus norvegicus
tctcattcctttgggcttatagcgc

SEQ ID NO: 593812 - DNA, 25 bp, Rattus norvegicus
tctcattctaagacagcaggcagtg

SEQ ID NO: 593813 - DNA, 25 bp, Rattus norvegicus
tctcattctaagtcagcaggcagtg

SEQ ID NO: 593814 - DNA, 25 bp, Rattus norvegicus
tctcattcttaaacgggcattcagt

SEQ ID NO: 593815 - DNA, 25 bp, Rattus norvegicus
tctcattcttaatcgggcattcagt

SEQ ID NO: 593816 - DNA, 25 bp, Rattus norvegicus
tctcattgagtccatcagatgctat

SEQ ID NO: 593817 - DNA, 25 bp, Rattus norvegicus
tctcattgagtcgatcagatgctat

SEQ ID NO: 593818 - DNA, 25 bp, Rattus norvegicus
tctcattgcagacggaggtgccccg

SEQ ID NO: 593819 - DNA, 25 bp, Rattus norvegicus
tctcattgcagagggaggtgccccg

SEQ ID NO: 593820 - DNA, 25 bp, Rattus norvegicus
tctcattgtgtgaacctggaccatg

SEQ ID NO: 593821 - DNA, 25 bp, Rattus norvegicus
tctcattgtgtgtacctggaccatg

SEQ ID NO: 593822 - DNA, 25 bp, Rattus norvegicus
tctcatttaagaagtcacctccctg

SEQ ID NO: 593823 - DNA, 25 bp, Rattus norvegicus
tctcatttaagatgtcacctccctg

SEQ ID NO: 593824 - DNA, 25 bp, Rattus norvegicus
tctcatttattcatgttgtctggta

SEQ ID NO: 593825 - DNA, 25 bp, Rattus norvegicus
tctcatttattcttgttgtctggta

SEQ ID NO: 593826 - DNA, 25 bp, Rattus norvegicus
tctcatttccctcccatcagacgaa

SEQ ID NO: 593827 - DNA, 25 bp, Rattus norvegicus
tctcatttccctgccatcagacgaa

SEQ ID NO: 593828 - DNA, 25 bp, Rattus norvegicus
tctcatttgcttcctcatctccaaa

SEQ ID NO: 593829 - DNA, 25 bp, Rattus norvegicus
tctcatttgcttgctcatctccaaa

SEQ ID NO: 593830 - DNA, 25 bp, Rattus norvegicus
tctcattttgtcattctgtcttgaa

SEQ ID NO: 593831 - DNA, 25 bp, Rattus norvegicus
tctcattttgtctttctgtcttgaa

SEQ ID NO: 593832 - DNA, 25 bp, Rattus norvegicus
tctccaaaagccaggcggacatcct

SEQ ID NO: 593833 - DNA, 25 bp, Rattus norvegicus
tctccaaaagcctggcggacatcct

SEQ ID NO: 593834 - DNA, 25 bp, Rattus norvegicus
tctccaaaatcaactcctgacaact

SEQ ID NO: 593835 - DNA, 25 bp, Rattus norvegicus
tctccaaaatcatctcctgacaact

SEQ ID NO: 593836 - DNA, 25 bp, Rattus norvegicus
tctccaaacacaacagggtgcggcc

SEQ ID NO: 593837 - DNA, 25 bp, Rattus norvegicus
tctccaaacacatcagggtgcggcc

SEQ ID NO: 593838 - DNA, 25 bp, Rattus norvegicus
tctccaaacttaccttctgtacaag

SEQ ID NO: 593839 - DNA, 25 bp, Rattus norvegicus
tctccaaacttagcttctgtacaag

SEQ ID NO: 593840 - DNA, 25 bp, Rattus norvegicus
tctccaaagggcatacacctgtcat

SEQ ID NO: 593841 - DNA, 25 bp, Rattus norvegicus
tctccaaagggcttacacctgtcat

SEQ ID NO: 593842 - DNA, 25 bp, Rattus norvegicus
tctccaacatctacgtgatcgggaa

SEQ ID NO: 593843 - DNA, 25 bp, Rattus norvegicus
tctccaacatcttcgtgatcgggaa

SEQ ID NO: 593844 - DNA, 25 bp, Rattus norvegicus
tctccaactcttagccttgtgagag

SEQ ID NO: 593845 - DNA, 25 bp, Rattus norvegicus
tctccaactctttgccttgtgagag

SEQ ID NO: 593846 - DNA, 25 bp, Rattus norvegicus
tctccaacttgcctcttggtcatgg

SEQ ID NO: 593847 - DNA, 25 bp, Rattus norvegicus
tctccaacttgcgtcttggtcatgg

SEQ ID NO: 593848 - DNA, 25 bp, Rattus norvegicus
tctccaagagcacacccagatttgg

SEQ ID NO: 593849 - DNA, 25 bp, Rattus norvegicus
tctccaagagcagacccagatttgg

SEQ ID NO: 593850 - DNA, 25 bp, Rattus norvegicus
tctccaagccacagctcttctgtta

SEQ ID NO: 593851 - DNA, 25 bp, Rattus norvegicus
tctccaagccactgctcttctgtta

SEQ ID NO: 593852 - DNA, 25 bp, Rattus norvegicus
tctccaatggtaagtgggtcccctt

SEQ ID NO: 593853 - DNA, 25 bp, Rattus norvegicus
tctccaatggtatgtgggtcccctt

SEQ ID NO: 593854 - DNA, 25 bp, Rattus norvegicus
tctccaatgttgagctaagattttt

SEQ ID NO: 593855 - DNA, 25 bp, Rattus norvegicus
tctccaatgttgtgctaagattttt

SEQ ID NO: 593856 - DNA, 25 bp, Rattus norvegicus
tctccacaaataacgaccagctgca

SEQ ID NO: 593857 - DNA, 25 bp, Rattus norvegicus
tctccacaaatatcgaccagctgca

SEQ ID NO: 593858 - DNA, 25 bp, Rattus norvegicus
tctccacagccaatttattccttta

SEQ ID NO: 593859 - DNA, 25 bp, Rattus norvegicus
tctccacagccattttattccttta

SEQ ID NO: 593860 - DNA, 25 bp, Rattus norvegicus
tctccacaggtccttacttgggttt

SEQ ID NO: 593861 - DNA, 25 bp, Rattus norvegicus
tctccacaggtcgttacttgggttt

SEQ ID NO: 593862 - DNA, 25 bp, Rattus norvegicus
tctccaccaagtcactattatcatc

SEQ ID NO: 593863 - DNA, 25 bp, Rattus norvegicus
tctccaccaagtgactattatcatc

SEQ ID NO: 593864 - DNA, 25 bp, Rattus norvegicus
tctccaccaatcagattcctaacag

SEQ ID NO: 593865 - DNA, 25 bp, Rattus norvegicus
tctccaccaatctgattcctaacag

SEQ ID NO: 593866 - DNA, 25 bp, Rattus norvegicus
tctccaccagagcttgggtccagac

SEQ ID NO: 593867 - DNA, 25 bp, Rattus norvegicus
tctccaccagaggttgggtccagac

SEQ ID NO: 593868 - DNA, 25 bp, Rattus norvegicus
tctccacccaagcaaccataaataa

SEQ ID NO: 593869 - DNA, 25 bp, Rattus norvegicus
tctccacccaaggaaccataaataa

SEQ ID NO: 593870 - DNA, 25 bp, Rattus norvegicus
tctccaccctctagaagtagtctgt

SEQ ID NO: 593871 - DNA, 25 bp, Rattus norvegicus
tctccaccctcttgaagtagtctgt

SEQ ID NO: 593872 - DNA, 25 bp, Rattus norvegicus
tctccacctggtagaacttgttgcg

SEQ ID NO: 593873 - DNA, 25 bp, Rattus norvegicus
tctccacctggttgaacttgttgcg

SEQ ID NO: 593874 - DNA, 25 bp, Rattus norvegicus
tctccactcctactcacatttatgt

SEQ ID NO: 593875 - DNA, 25 bp, Rattus norvegicus
tctccactcctagtcacatttatgt

SEQ ID NO: 593876 - DNA, 25 bp, Rattus norvegicus
tctccactccttagcatctaattta

SEQ ID NO: 593877 - DNA, 25 bp, Rattus norvegicus
tctccactcctttgcatctaattta

SEQ ID NO: 593878 - DNA, 25 bp, Rattus norvegicus
tctccactgaggacctgattgcaga

SEQ ID NO: 593879 - DNA, 25 bp, Rattus norvegicus
tctccactgaggtcctgattgcaga

SEQ ID NO: 593880 - DNA, 25 bp, Rattus norvegicus
tctccacttgatccagcagttgtac

SEQ ID NO: 593881 - DNA, 25 bp, Rattus norvegicus
tctccacttgatgcagcagttgtac

SEQ ID NO: 593882 - DNA, 25 bp, Rattus norvegicus
tctccagacaaaccccgagatggcg

SEQ ID NO: 593883 - DNA, 25 bp, Rattus norvegicus
tctccagacaaagcccgagatggcg

SEQ ID NO: 593884 - DNA, 25 bp, Rattus norvegicus
tctccagacaccaggctagtggcaa

SEQ ID NO: 593885 - DNA, 25 bp, Rattus norvegicus
tctccagacacctggctagtggcaa

SEQ ID NO: 593886 - DNA, 25 bp, Rattus norvegicus
tctccagacccaagggcttcaggga

SEQ ID NO: 593887 - DNA, 25 bp, Rattus norvegicus
tctccagacccatgggcttcaggga

SEQ ID NO: 593888 - DNA, 25 bp, Rattus norvegicus
tctccagagagtcgcagtggcccta

SEQ ID NO: 593889 - DNA, 25 bp, Rattus norvegicus
tctccagagagtggcagtggcccta

SEQ ID NO: 593890 - DNA, 25 bp, Rattus norvegicus
tctccagagcatacactgagtgtct

SEQ ID NO: 593891 - DNA, 25 bp, Rattus norvegicus
tctccagagcattcactgagtgtct

SEQ ID NO: 593892 - DNA, 25 bp, Rattus norvegicus
tctccagagggcagcaacttgaaca

SEQ ID NO: 593893 - DNA, 25 bp, Rattus norvegicus
tctccagagggctgcaacttgaaca

SEQ ID NO: 593894 - DNA, 25 bp, Rattus norvegicus
tctccagatggaaccctctgtgctt

SEQ ID NO: 593895 - DNA, 25 bp, Rattus norvegicus
tctccagatggatccctctgtgctt

SEQ ID NO: 593896 - DNA, 25 bp, Rattus norvegicus
tctccagattggaggccaggctgct

SEQ ID NO: 593897 - DNA, 25 bp, Rattus norvegicus
tctccagattggtggccaggctgct

SEQ ID NO: 593898 - DNA, 25 bp, Rattus norvegicus
tctccagcagaccagagtcagacct

SEQ ID NO: 593899 - DNA, 25 bp, Rattus norvegicus
tctccagcagacgagagtcagacct

SEQ ID NO: 593900 - DNA, 25 bp, Rattus norvegicus
tctccagccacgagcgcaaggtgaa

SEQ ID NO: 593901 - DNA, 25 bp, Rattus norvegicus
tctccagccacgtgcgcaaggtgaa

SEQ ID NO: 593902 - DNA, 25 bp, Rattus norvegicus
tctccagcccatatctaagttttga

SEQ ID NO: 593903 - DNA, 25 bp, Rattus norvegicus
tctccagcccatttctaagttttga

SEQ ID NO: 593904 - DNA, 25 bp, Rattus norvegicus
tctccagccccgaactaaattgtta

SEQ ID NO: 593905 - DNA, 25 bp, Rattus norvegicus
tctccagccccgtactaaattgtta

SEQ ID NO: 593906 - DNA, 25 bp, Rattus norvegicus
tctccagcccttaaaatggtgattt

SEQ ID NO: 593907 - DNA, 25 bp, Rattus norvegicus
tctccagccctttaaatggtgattt

SEQ ID NO: 593908 - DNA, 25 bp, Rattus norvegicus
tctccagccgcgattggttctgcaa

SEQ ID NO: 593909 - DNA, 25 bp, Rattus norvegicus
tctccagccgcgtttggttctgcaa

SEQ ID NO: 593910 - DNA, 25 bp, Rattus norvegicus
tctccagcctagagaatccagccta

SEQ ID NO: 593911 - DNA, 25 bp, Rattus norvegicus
tctccagcctagtgaatccagccta

SEQ ID NO: 593912 - DNA, 25 bp, Rattus norvegicus
tctccagcctgtagattagttattc

SEQ ID NO: 593913 - DNA, 25 bp, Rattus norvegicus
tctccagcctgttgattagttattc

SEQ ID NO: 593914 - DNA, 25 bp, Rattus norvegicus
tctccagctgtgacttacgttctga

SEQ ID NO: 593915 - DNA, 25 bp, Rattus norvegicus
tctccagctgtgtcttacgttctga

SEQ ID NO: 593916 - DNA, 25 bp, Rattus norvegicus
tctccagctttcagccagctttaaa

SEQ ID NO: 593917 - DNA, 25 bp, Rattus norvegicus
tctccagctttctgccagctttaaa

SEQ ID NO: 593918 - DNA, 25 bp, Rattus norvegicus
tctccaggagccaaaacagcagcat

SEQ ID NO: 593919 - DNA, 25 bp, Rattus norvegicus
tctccaggagcctaaacagcagcat

SEQ ID NO: 593920 - DNA, 25 bp, Rattus norvegicus
tctccaggatcaatttccagcatcc

SEQ ID NO: 593921 - DNA, 25 bp, Rattus norvegicus
tctccaggatcattttccagcatcc

SEQ ID NO: 593922 - DNA, 25 bp, Rattus norvegicus
tctccaggccgtaagagctatgcta

SEQ ID NO: 593923 - DNA, 25 bp, Rattus norvegicus
tctccaggccgttagagctatgcta

SEQ ID NO: 593924 - DNA, 25 bp, Rattus norvegicus
tctccaggctgtatctttttttatg

SEQ ID NO: 593925 - DNA, 25 bp, Rattus norvegicus
tctccaggctgtttctttttttatg

SEQ ID NO: 593926 - DNA, 25 bp, Rattus norvegicus
tctccaggcttcaacttcagatttg

SEQ ID NO: 593927 - DNA, 25 bp, Rattus norvegicus
tctccaggcttctacttcagatttg

SEQ ID NO: 593928 - DNA, 25 bp, Rattus norvegicus
tctccagggctcaacaatccaaata

SEQ ID NO: 593929 - DNA, 25 bp, Rattus norvegicus
tctccagggctctacaatccaaata

SEQ ID NO: 593930 - DNA, 25 bp, Rattus norvegicus
tctccaggtcatagggttccaggta

SEQ ID NO: 593931 - DNA, 25 bp, Rattus norvegicus
tctccaggtcattgggttccaggta

SEQ ID NO: 593932 - DNA, 25 bp, Rattus norvegicus
tctccaggtggccagacgggaattc

SEQ ID NO: 593933 - DNA, 25 bp, Rattus norvegicus
tctccaggtggcgagacgggaattc

SEQ ID NO: 593934 - DNA, 25 bp, Rattus norvegicus
tctccagtatctcctttatcagagc

SEQ ID NO: 593935 - DNA, 25 bp, Rattus norvegicus
tctccagtatctgctttatcagagc

SEQ ID NO: 593936 - DNA, 25 bp, Rattus norvegicus
tctccagtccctatgtacgcagagc

SEQ ID NO: 593937 - DNA, 25 bp, Rattus norvegicus
tctccagtccctttgtacgcagagc

SEQ ID NO: 593938 - DNA, 25 bp, Rattus norvegicus
tctccagtcctcctaactgttacgg

SEQ ID NO: 593939 - DNA, 25 bp, Rattus norvegicus
tctccagtcctcgtaactgttacgg

SEQ ID NO: 593940 - DNA, 25 bp, Rattus norvegicus
tctccagtctacatagtaacctcga

SEQ ID NO: 593941 - DNA, 25 bp, Rattus norvegicus
tctccagtctacttagtaacctcga

SEQ ID NO: 593942 - DNA, 25 bp, Rattus norvegicus
tctccagtgagaccaagtgctgagt

SEQ ID NO: 593943 - DNA, 25 bp, Rattus norvegicus
tctccagtgagagcaagtgctgagt

SEQ ID NO: 593944 - DNA, 25 bp, Rattus norvegicus
tctccagtgctgattttcttcagat

SEQ ID NO: 593945 - DNA, 25 bp, Rattus norvegicus
tctccagtgctgtttttcttcagat

SEQ ID NO: 593946 - DNA, 25 bp, Rattus norvegicus
tctccagtgggacatcagtgcttat

SEQ ID NO: 593947 - DNA, 25 bp, Rattus norvegicus
tctccagtgggagatcagtgcttat

SEQ ID NO: 593948 - DNA, 25 bp, Rattus norvegicus
tctccagtgtgcatgcagcctgaaa

SEQ ID NO: 593949 - DNA, 25 bp, Rattus norvegicus
tctccagtgtgcttgcagcctgaaa

SEQ ID NO: 593950 - DNA, 25 bp, Rattus norvegicus
tctccagttctaaagttcaggtatc

SEQ ID NO: 593951 - DNA, 25 bp, Rattus norvegicus
tctccagttctatagttcaggtatc

SEQ ID NO: 593952 - DNA, 25 bp, Rattus norvegicus
tctccagttggtcattctgtctgtg

SEQ ID NO: 593953 - DNA, 25 bp, Rattus norvegicus
tctccagttggtgattctgtctgtg

SEQ ID NO: 593954 - DNA, 25 bp, Rattus norvegicus
tctccagtttccatggttacatctc

SEQ ID NO: 593955 - DNA, 25 bp, Rattus norvegicus
tctccagtttccttggttacatctc

SEQ ID NO: 593956 - DNA, 25 bp, Rattus norvegicus
tctccatagacgctccacagtagta

SEQ ID NO: 593957 - DNA, 25 bp, Rattus norvegicus
tctccatagacggtccacagtagta

SEQ ID NO: 593958 - DNA, 25 bp, Rattus norvegicus
tctccataggagagggccatgccag

SEQ ID NO: 593959 - DNA, 25 bp, Rattus norvegicus
tctccataggagtgggccatgccag

SEQ ID NO: 593960 - DNA, 25 bp, Rattus norvegicus
tctccatcaactagtgactgccagt

SEQ ID NO: 593961 - DNA, 25 bp, Rattus norvegicus
tctccatcaacttgtgactgccagt

SEQ ID NO: 593962 - DNA, 25 bp, Rattus norvegicus
tctccatcaagtataaaacagcctg

SEQ ID NO: 593963 - DNA, 25 bp, Rattus norvegicus
tctccatcaagtttaaaacagcctg

SEQ ID NO: 593964 - DNA, 25 bp, Rattus norvegicus
tctccatccaccctaggtgtgattt

SEQ ID NO: 593965 - DNA, 25 bp, Rattus norvegicus
tctccatccaccgtaggtgtgattt

SEQ ID NO: 593966 - DNA, 25 bp, Rattus norvegicus
tctccatcctagatcttttcctaat

SEQ ID NO: 593967 - DNA, 25 bp, Rattus norvegicus
tctccatcctagttcttttcctaat

SEQ ID NO: 593968 - DNA, 25 bp, Rattus norvegicus
tctccatcctccagtgaagacttca

SEQ ID NO: 593969 - DNA, 25 bp, Rattus norvegicus
tctccatcctccattacttagaaaa

SEQ ID NO: 593970 - DNA, 25 bp, Rattus norvegicus
tctccatcctcctgtgaagacttca

SEQ ID NO: 593971 - DNA, 25 bp, Rattus norvegicus
tctccatcctcctttacttagaaaa

SEQ ID NO: 593972 - DNA, 25 bp, Rattus norvegicus
tctccatctcctattgctgcaagaa

SEQ ID NO: 593973 - DNA, 25 bp, Rattus norvegicus
tctccatctccttttgctgcaagaa

SEQ ID NO: 593974 - DNA, 25 bp, Rattus norvegicus
tctccatcttctcaaggctcaaagt

SEQ ID NO: 593975 - DNA, 25 bp, Rattus norvegicus
tctccatcttctgaaggctcaaagt

SEQ ID NO: 593976 - DNA, 25 bp, Rattus norvegicus
tctccatcttggctaacagcgggca

SEQ ID NO: 593977 - DNA, 25 bp, Rattus norvegicus
tctccatcttgggtaacagcgggca

SEQ ID NO: 593978 - DNA, 25 bp, Rattus norvegicus
tctccatgagatctagacactgttt

SEQ ID NO: 593979 - DNA, 25 bp, Rattus norvegicus
tctccatgagatgtagacactgttt

SEQ ID NO: 593980 - DNA, 25 bp, Rattus norvegicus
tctccatgatttccaaggaatccaa

SEQ ID NO: 593981 - DNA, 25 bp, Rattus norvegicus
tctccatgatttgcaaggaatccaa

SEQ ID NO: 593982 - DNA, 25 bp, Rattus norvegicus
tctccatgctgccattaagccaaaa

SEQ ID NO: 593983 - DNA, 25 bp, Rattus norvegicus
tctccatgctgcgattaagccaaaa

SEQ ID NO: 593984 - DNA, 25 bp, Rattus norvegicus
tctccatgtggcatgcagaatctgc

SEQ ID NO: 593985 - DNA, 25 bp, Rattus norvegicus
tctccatgtggcttgcagaatctgc

SEQ ID NO: 593986 - DNA, 25 bp, Rattus norvegicus
tctccatgtttaatgttgcttactc

SEQ ID NO: 593987 - DNA, 25 bp, Rattus norvegicus
tctccatgtttattgttgcttactc

SEQ ID NO: 593988 - DNA, 25 bp, Rattus norvegicus
tctccattaatgaccccagcaatca

SEQ ID NO: 593989 - DNA, 25 bp, Rattus norvegicus
tctccattaatgtccccagcaatca

SEQ ID NO: 593990 - DNA, 25 bp, Rattus norvegicus
tctccattcgtccacaacagtgtgt

SEQ ID NO: 593991 - DNA, 25 bp, Rattus norvegicus
tctccattcgtcgacaacagtgtgt

SEQ ID NO: 593992 - DNA, 25 bp, Rattus norvegicus
tctccattcgttcgtttgtcagcaa

SEQ ID NO: 593993 - DNA, 25 bp, Rattus norvegicus
tctccattcgttggtttgtcagcaa

SEQ ID NO: 593994 - DNA, 25 bp, Rattus norvegicus
tctccattgcagacagcactgtttt

SEQ ID NO: 593995 - DNA, 25 bp, Rattus norvegicus
tctccattgcagtcagcactgtttt

SEQ ID NO: 593996 - DNA, 25 bp, Rattus norvegicus
tctccatttaaaccaacgacttgcc

SEQ ID NO: 593997 - DNA, 25 bp, Rattus norvegicus
tctccatttaaagcaacgacttgcc

SEQ ID NO: 593998 - DNA, 25 bp, Rattus norvegicus
tctccatttacacagcttctttaac

SEQ ID NO: 593999 - DNA, 25 bp, Rattus norvegicus
tctccatttacagagcttctttaac

SEQ ID NO: 594000 - DNA, 25 bp, Rattus norvegicus
tctccatttcccacggaaggaacgt

SEQ ID NO: 594001 - DNA, 25 bp, Rattus norvegicus
tctccatttccctcggaaggaacgt

SEQ ID NO: 594002 - DNA, 25 bp, Rattus norvegicus
tctccatttcctcagaattctgcag

SEQ ID NO: 594003 - DNA, 25 bp, Rattus norvegicus
tctccatttcctgagaattctgcag

SEQ ID NO: 594004 - DNA, 25 bp, Rattus norvegicus
tctcccaaccgtaaaccgtgtgctg

SEQ ID NO: 594005 - DNA, 25 bp, Rattus norvegicus
tctcccaaccgttaaccgtgtgctg

SEQ ID NO: 594006 - DNA, 25 bp, Rattus norvegicus
tctcccaagaaaccgggtgtcttct

SEQ ID NO: 594007 - DNA, 25 bp, Rattus norvegicus
tctcccaagaaagcgggtgtcttct

SEQ ID NO: 594008 - DNA, 25 bp, Rattus norvegicus
tctcccacatttagtcctagagtga

SEQ ID NO: 594009 - DNA, 25 bp, Rattus norvegicus
tctcccacattttgtcctagagtga

SEQ ID NO: 594010 - DNA, 25 bp, Rattus norvegicus
tctcccacgcgtctgactacaaaga

SEQ ID NO: 594011 - DNA, 25 bp, Rattus norvegicus
tctcccacgcgtgtgactacaaaga

SEQ ID NO: 594012 - DNA, 25 bp, Rattus norvegicus
tctcccactattcaacttacataat

SEQ ID NO: 594013 - DNA, 25 bp, Rattus norvegicus
tctcccactattgaacttacataat

SEQ ID NO: 594014 - DNA, 25 bp, Rattus norvegicus
tctcccactgtgagattcctgagga

SEQ ID NO: 594015 - DNA, 25 bp, Rattus norvegicus
tctcccactgtgtgattcctgagga

SEQ ID NO: 594016 - DNA, 25 bp, Rattus norvegicus
tctcccacttatatctagcacttta

SEQ ID NO: 594017 - DNA, 25 bp, Rattus norvegicus
tctcccacttatttctagcacttta

SEQ ID NO: 594018 - DNA, 25 bp, Rattus norvegicus
tctcccagaattcccctttggattg

SEQ ID NO: 594019 - DNA, 25 bp, Rattus norvegicus
tctcccagaattgccctttggattg

SEQ ID NO: 594020 - DNA, 25 bp, Rattus norvegicus
tctcccagagacatgacattttagc

SEQ ID NO: 594021 - DNA, 25 bp, Rattus norvegicus
tctcccagagacttgacattttagc

SEQ ID NO: 594022 - DNA, 25 bp, Rattus norvegicus
tctcccagatcgctgacagtcacta

SEQ ID NO: 594023 - DNA, 25 bp, Rattus norvegicus
tctcccagatcggtgacagtcacta

SEQ ID NO: 594024 - DNA, 25 bp, Rattus norvegicus
tctcccagcccaagcaacagaaggg

SEQ ID NO: 594025 - DNA, 25 bp, Rattus norvegicus
tctcccagcccatgcaacagaaggg

SEQ ID NO: 594026 - DNA, 25 bp, Rattus norvegicus
tctcccagctgcattacttaaaagt

SEQ ID NO: 594027 - DNA, 25 bp, Rattus norvegicus
tctcccagctgctttacttaaaagt

SEQ ID NO: 594028 - DNA, 25 bp, Rattus norvegicus
tctcccaggaaaacccctgtcattg

SEQ ID NO: 594029 - DNA, 25 bp, Rattus norvegicus
tctcccaggaaatcccctgtcattg

SEQ ID NO: 594030 - DNA, 25 bp, Rattus norvegicus
tctcccaggagacagggttcttggc

SEQ ID NO: 594031 - DNA, 25 bp, Rattus norvegicus
tctcccaggagagagggttcttggc

SEQ ID NO: 594032 - DNA, 25 bp, Rattus norvegicus
tctcccaggctaaccatgttgcata

SEQ ID NO: 594033 - DNA, 25 bp, Rattus norvegicus
tctcccaggctatccatgttgcata

SEQ ID NO: 594034 - DNA, 25 bp, Rattus norvegicus
tctcccaggtaccatgtcagtatca

SEQ ID NO: 594035 - DNA, 25 bp, Rattus norvegicus
tctcccaggtacgatgtcagtatca

SEQ ID NO: 594036 - DNA, 25 bp, Rattus norvegicus
tctcccaggtttagtcagttctcag

SEQ ID NO: 594037 - DNA, 25 bp, Rattus norvegicus
tctcccaggttttgtcagttctcag

SEQ ID NO: 594038 - DNA, 25 bp, Rattus norvegicus
tctcccagtagcagagctcaccgtg

SEQ ID NO: 594039 - DNA, 25 bp, Rattus norvegicus
tctcccagtagctgagctcaccgtg

SEQ ID NO: 594040 - DNA, 25 bp, Rattus norvegicus
tctcccagttccaacgcaggttatc

SEQ ID NO: 594041 - DNA, 25 bp, Rattus norvegicus
tctcccagttcctacgcaggttatc

SEQ ID NO: 594042 - DNA, 25 bp, Rattus norvegicus
tctcccatccagatccagtaaagga

SEQ ID NO: 594043 - DNA, 25 bp, Rattus norvegicus
tctcccatccagttccagtaaagga

SEQ ID NO: 594044 - DNA, 25 bp, Rattus norvegicus
tctcccatcttaagttgatcggcgt

SEQ ID NO: 594045 - DNA, 25 bp, Rattus norvegicus
tctcccatcttatgttgatcggcgt

SEQ ID NO: 594046 - DNA, 25 bp, Rattus norvegicus
tctcccattccacattgttcacaat

SEQ ID NO: 594047 - DNA, 25 bp, Rattus norvegicus
tctcccattccagattgttcacaat

SEQ ID NO: 594048 - DNA, 25 bp, Rattus norvegicus
tctcccattgggatccagacaaaga

SEQ ID NO: 594049 - DNA, 25 bp, Rattus norvegicus
tctcccattgggttccagacaaaga

SEQ ID NO: 594050 - DNA, 25 bp, Rattus norvegicus
tctcccatttgtctggaattggcta

SEQ ID NO: 594051 - DNA, 25 bp, Rattus norvegicus
tctcccatttgtgtggaattggcta

SEQ ID NO: 594052 - DNA, 25 bp, Rattus norvegicus
tctccccaaggtcacaactgtctga

SEQ ID NO: 594053 - DNA, 25 bp, Rattus norvegicus
tctccccaaggtgacaactgtctga

SEQ ID NO: 594054 - DNA, 25 bp, Rattus norvegicus
tctccccagctcactgaatgttgag

SEQ ID NO: 594055 - DNA, 25 bp, Rattus norvegicus
tctccccagctcctagtagataaaa

SEQ ID NO: 594056 - DNA, 25 bp, Rattus norvegicus
tctccccagctcgtagtagataaaa

SEQ ID NO: 594057 - DNA, 25 bp, Rattus norvegicus
tctccccagctctctgaatgttgag

SEQ ID NO: 594058 - DNA, 25 bp, Rattus norvegicus
tctccccatgctaccagtggtagta

SEQ ID NO: 594059 - DNA, 25 bp, Rattus norvegicus
tctccccatgcttccagtggtagta

SEQ ID NO: 594060 - DNA, 25 bp, Rattus norvegicus
tctccccgcaacacatttatgattt

SEQ ID NO: 594061 - DNA, 25 bp, Rattus norvegicus
tctccccgcaactcatttatgattt

SEQ ID NO: 594062 - DNA, 25 bp, Rattus norvegicus
tctccccggcctagtatttataaga

SEQ ID NO: 594063 - DNA, 25 bp, Rattus norvegicus
tctccccggccttgtatttataaga

SEQ ID NO: 594064 - DNA, 25 bp, Rattus norvegicus
tctccccgtgacactgtgacatgta

SEQ ID NO: 594065 - DNA, 25 bp, Rattus norvegicus
tctccccgtgactctgtgacatgta

SEQ ID NO: 594066 - DNA, 25 bp, Rattus norvegicus
tctccccgtgtgaaggaaaggtcta

SEQ ID NO: 594067 - DNA, 25 bp, Rattus norvegicus
tctccccgtgtgtaggaaaggtcta

SEQ ID NO: 594068 - DNA, 25 bp, Rattus norvegicus
tctcccctaataataaacacacacg

SEQ ID NO: 594069 - DNA, 25 bp, Rattus norvegicus
tctcccctaatattaaacacacacg

SEQ ID NO: 594070 - DNA, 25 bp, Rattus norvegicus
tctcccctaatcctgactggttttt

SEQ ID NO: 594071 - DNA, 25 bp, Rattus norvegicus
tctcccctaatcgtgactggttttt

SEQ ID NO: 594072 - DNA, 25 bp, Rattus norvegicus
tctcccctcagcaattcctgtaaag

SEQ ID NO: 594073 - DNA, 25 bp, Rattus norvegicus
tctcccctcagctattcctgtaaag

SEQ ID NO: 594074 - DNA, 25 bp, Rattus norvegicus
tctcccctcattactactatttttg

SEQ ID NO: 594075 - DNA, 25 bp, Rattus norvegicus
tctcccctcatttctactatttttg

SEQ ID NO: 594076 - DNA, 25 bp, Rattus norvegicus
tctcccctccagagtatgcatctga

SEQ ID NO: 594077 - DNA, 25 bp, Rattus norvegicus
tctcccctccagtgtatgcatctga

SEQ ID NO: 594078 - DNA, 25 bp, Rattus norvegicus
tctcccctgagcaagaatacattcc

SEQ ID NO: 594079 - DNA, 25 bp, Rattus norvegicus
tctcccctgagctagaatacattcc

SEQ ID NO: 594080 - DNA, 25 bp, Rattus norvegicus
tctcccctggagacatttggtgtta

SEQ ID NO: 594081 - DNA, 25 bp, Rattus norvegicus
tctcccctggagtcatttggtgtta

SEQ ID NO: 594082 - DNA, 25 bp, Rattus norvegicus
tctcccctgggtatttatgtaaatg

SEQ ID NO: 594083 - DNA, 25 bp, Rattus norvegicus
tctcccctgggtcttccaggagctg

SEQ ID NO: 594084 - DNA, 25 bp, Rattus norvegicus
tctcccctgggtgttccaggagctg

SEQ ID NO: 594085 - DNA, 25 bp, Rattus norvegicus
tctcccctgggtttttatgtaaatg

SEQ ID NO: 594086 - DNA, 25 bp, Rattus norvegicus
tctcccctgtcacccattaaagatg

SEQ ID NO: 594087 - DNA, 25 bp, Rattus norvegicus
tctcccctgtcagccattaaagatg

SEQ ID NO: 594088 - DNA, 25 bp, Rattus norvegicus
tctccccttaaaacaccaagtctag

SEQ ID NO: 594089 - DNA, 25 bp, Rattus norvegicus
tctccccttaaatcaccaagtctag

SEQ ID NO: 594090 - DNA, 25 bp, Rattus norvegicus
tctcccctttaacacgacggatttg

SEQ ID NO: 594091 - DNA, 25 bp, Rattus norvegicus
tctcccctttaagacgacggatttg

SEQ ID NO: 594092 - DNA, 25 bp, Rattus norvegicus
tctcccgacaggaccttaagcagag

SEQ ID NO: 594093 - DNA, 25 bp, Rattus norvegicus
tctcccgacaggtccttaagcagag

SEQ ID NO: 594094 - DNA, 25 bp, Rattus norvegicus
tctcccgagttcaaacgcaacatga

SEQ ID NO: 594095 - DNA, 25 bp, Rattus norvegicus
tctcccgagttctaacgcaacatga

SEQ ID NO: 594096 - DNA, 25 bp, Rattus norvegicus
tctcccgccagcattggaagtcata

SEQ ID NO: 594097 - DNA, 25 bp, Rattus norvegicus
tctcccgccagctttggaagtcata

SEQ ID NO: 594098 - DNA, 25 bp, Rattus norvegicus
tctcccgcggtgagagtacctaatt

SEQ ID NO: 594099 - DNA, 25 bp, Rattus norvegicus
tctcccgcggtgtgagtacctaatt

SEQ ID NO: 594100 - DNA, 25 bp, Rattus norvegicus
tctcccggggatattgtatatattt

SEQ ID NO: 594101 - DNA, 25 bp, Rattus norvegicus
tctcccggggattttgtatatattt

SEQ ID NO: 594102 - DNA, 25 bp, Rattus norvegicus
tctcccgtactgactcaatgatgtt

SEQ ID NO: 594103 - DNA, 25 bp, Rattus norvegicus
tctcccgtactgtctcaatgatgtt

SEQ ID NO: 594104 - DNA, 25 bp, Rattus norvegicus
tctcccgtagttatcttcaaacact

SEQ ID NO: 594105 - DNA, 25 bp, Rattus norvegicus
tctcccgtagttttcttcaaacact

SEQ ID NO: 594106 - DNA, 25 bp, Rattus norvegicus
tctcccgtatccattctttttcact

SEQ ID NO: 594107 - DNA, 25 bp, Rattus norvegicus
tctcccgtatcctttctttttcact

SEQ ID NO: 594108 - DNA, 25 bp, Rattus norvegicus
tctcccgtcagtcatttctaggtat

SEQ ID NO: 594109 - DNA, 25 bp, Rattus norvegicus
tctcccgtcagtgatttctaggtat

SEQ ID NO: 594110 - DNA, 25 bp, Rattus norvegicus
tctcccgtgacgaggtagcacaagg

SEQ ID NO: 594111 - DNA, 25 bp, Rattus norvegicus
tctcccgtgacgtggtagcacaagg

SEQ ID NO: 594112 - DNA, 25 bp, Rattus norvegicus
tctcccgtgagccatggcggagctc

SEQ ID NO: 594113 - DNA, 25 bp, Rattus norvegicus
tctcccgtgagcgatggcggagctc

SEQ ID NO: 594114 - DNA, 25 bp, Rattus norvegicus
tctcccgtgctcaactgttagatat

SEQ ID NO: 594115 - DNA, 25 bp, Rattus norvegicus
tctcccgtgctctactgttagatat

SEQ ID NO: 594116 - DNA, 25 bp, Rattus norvegicus
tctcccgtggtgcagcagttgtcag

SEQ ID NO: 594117 - DNA, 25 bp, Rattus norvegicus
tctcccgtggtggagcagttgtcag

SEQ ID NO: 594118 - DNA, 25 bp, Rattus norvegicus
tctcccgtgtggaccctctggtggg

SEQ ID NO: 594119 - DNA, 25 bp, Rattus norvegicus
tctcccgtgtggtccctctggtggg

SEQ ID NO: 594120 - DNA, 25 bp, Rattus norvegicus
tctcccgttcgtagtaggtgggcaa

SEQ ID NO: 594121 - DNA, 25 bp, Rattus norvegicus
tctcccgttcgttgtaggtgggcaa

SEQ ID NO: 594122 - DNA, 25 bp, Rattus norvegicus
tctccctaagagactgatcctttgt

SEQ ID NO: 594123 - DNA, 25 bp, Rattus norvegicus
tctccctaagagtctgatcctttgt

SEQ ID NO: 594124 - DNA, 25 bp, Rattus norvegicus
tctccctaatgtaccaactggtttg

SEQ ID NO: 594125 - DNA, 25 bp, Rattus norvegicus
tctccctaatgttccaactggtttg

SEQ ID NO: 594126 - DNA, 25 bp, Rattus norvegicus
tctccctaccgaaggccaggtatgg

SEQ ID NO: 594127 - DNA, 25 bp, Rattus norvegicus
tctccctaccgatggccaggtatgg

SEQ ID NO: 594128 - DNA, 25 bp, Rattus norvegicus
tctccctactgtcctggattgggaa

SEQ ID NO: 594129 - DNA, 25 bp, Rattus norvegicus
tctccctactgtgctggattgggaa

SEQ ID NO: 594130 - DNA, 25 bp, Rattus norvegicus
tctccctagcccagatatatatgcg

SEQ ID NO: 594131 - DNA, 25 bp, Rattus norvegicus
tctccctagccctgatatatatgcg

SEQ ID NO: 594132 - DNA, 25 bp, Rattus norvegicus
tctccctagcgccattgtgctgaaa

SEQ ID NO: 594133 - DNA, 25 bp, Rattus norvegicus
tctccctagcgcgattgtgctgaaa

SEQ ID NO: 594134 - DNA, 25 bp, Rattus norvegicus
tctccctatatgacactgttgtaca

SEQ ID NO: 594135 - DNA, 25 bp, Rattus norvegicus
tctccctatatgtcactgttgtaca

SEQ ID NO: 594136 - DNA, 25 bp, Rattus norvegicus
tctccctatcctcaatgcatttgtg

SEQ ID NO: 594137 - DNA, 25 bp, Rattus norvegicus
tctccctatcctgaatgcatttgtg

SEQ ID NO: 594138 - DNA, 25 bp, Rattus norvegicus
tctccctatgggagacagtgaactt

SEQ ID NO: 594139 - DNA, 25 bp, Rattus norvegicus
tctccctatgggtgacagtgaactt

SEQ ID NO: 594140 - DNA, 25 bp, Rattus norvegicus
tctccctattcaactcttatggaca

SEQ ID NO: 594141 - DNA, 25 bp, Rattus norvegicus
tctccctattcatctcttatggaca

SEQ ID NO: 594142 - DNA, 25 bp, Rattus norvegicus
tctccctattgcctgtgaacacaga

SEQ ID NO: 594143 - DNA, 25 bp, Rattus norvegicus
tctccctattgcgtgtgaacacaga

SEQ ID NO: 594144 - DNA, 25 bp, Rattus norvegicus
tctccctatttcagtctggatgtca

SEQ ID NO: 594145 - DNA, 25 bp, Rattus norvegicus
tctccctatttctgtctggatgtca

SEQ ID NO: 594146 - DNA, 25 bp, Rattus norvegicus
tctccctatttgatacctctcaaaa

SEQ ID NO: 594147 - DNA, 25 bp, Rattus norvegicus
tctccctatttgttacctctcaaaa

SEQ ID NO: 594148 - DNA, 25 bp, Rattus norvegicus
tctccctcagggatgcttaaagttg

SEQ ID NO: 594149 - DNA, 25 bp, Rattus norvegicus
tctccctcagggttgcttaaagttg

SEQ ID NO: 594150 - DNA, 25 bp, Rattus norvegicus
tctccctcagtaatggtgcttatct

SEQ ID NO: 594151 - DNA, 25 bp, Rattus norvegicus
tctccctcagtattggtgcttatct

SEQ ID NO: 594152 - DNA, 25 bp, Rattus norvegicus
tctccctcatcgacatgtgttttaa

SEQ ID NO: 594153 - DNA, 25 bp, Rattus norvegicus
tctccctcatcgtcatgtgttttaa

SEQ ID NO: 594154 - DNA, 25 bp, Rattus norvegicus
tctccctccaatagccataattagc

SEQ ID NO: 594155 - DNA, 25 bp, Rattus norvegicus
tctccctccaattgccataattagc

SEQ ID NO: 594156 - DNA, 25 bp, Rattus norvegicus
tctccctcccacagtgatatattgg

SEQ ID NO: 594157 - DNA, 25 bp, Rattus norvegicus
tctccctcccactgtgatatattgg

SEQ ID NO: 594158 - DNA, 25 bp, Rattus norvegicus
tctccctcctaaacgtgtacaatag

SEQ ID NO: 594159 - DNA, 25 bp, Rattus norvegicus
tctccctcctaatcgtgtacaatag

SEQ ID NO: 594160 - DNA, 25 bp, Rattus norvegicus
tctccctcctgcataaagagagcta

SEQ ID NO: 594161 - DNA, 25 bp, Rattus norvegicus
tctccctcctgcttaaagagagcta

SEQ ID NO: 594162 - DNA, 25 bp, Rattus norvegicus
tctccctctcacatgtggaaggcaa

SEQ ID NO: 594163 - DNA, 25 bp, Rattus norvegicus
tctccctctcacttgtggaaggcaa

SEQ ID NO: 594164 - DNA, 25 bp, Rattus norvegicus
tctccctctcttaatagccattggt

SEQ ID NO: 594165 - DNA, 25 bp, Rattus norvegicus
tctccctctctttatagccattggt

SEQ ID NO: 594166 - DNA, 25 bp, Rattus norvegicus
tctccctcttttaatctctttttat

SEQ ID NO: 594167 - DNA, 25 bp, Rattus norvegicus
tctccctctttttatctctttttat

SEQ ID NO: 594168 - DNA, 25 bp, Rattus norvegicus
tctccctgaaggacatgagacctgg

SEQ ID NO: 594169 - DNA, 25 bp, Rattus norvegicus
tctccctgaaggtcatgagacctgg

SEQ ID NO: 594170 - DNA, 25 bp, Rattus norvegicus
tctccctgacatactatccagttat

SEQ ID NO: 594171 - DNA, 25 bp, Rattus norvegicus
tctccctgacattctatccagttat

SEQ ID NO: 594172 - DNA, 25 bp, Rattus norvegicus
tctccctgacccagaggaaggacaa

SEQ ID NO: 594173 - DNA, 25 bp, Rattus norvegicus
tctccctgaccctgaggaaggacaa

SEQ ID NO: 594174 - DNA, 25 bp, Rattus norvegicus
tctccctgagaaatccatggtgttt

SEQ ID NO: 594175 - DNA, 25 bp, Rattus norvegicus
tctccctgagaacccttatttgtca

SEQ ID NO: 594176 - DNA, 25 bp, Rattus norvegicus
tctccctgagaagccttatttgtca

SEQ ID NO: 594177 - DNA, 25 bp, Rattus norvegicus
tctccctgagaattccatggtgttt

SEQ ID NO: 594178 - DNA, 25 bp, Rattus norvegicus
tctccctgcagcaattgccaaaaca

SEQ ID NO: 594179 - DNA, 25 bp, Rattus norvegicus
tctccctgcagctattgccaaaaca

SEQ ID NO: 594180 - DNA, 25 bp, Rattus norvegicus
tctccctgcgtgaagccaagaagtg

SEQ ID NO: 594181 - DNA, 25 bp, Rattus norvegicus
tctccctgcgtgtagccaagaagtg

SEQ ID NO: 594182 - DNA, 25 bp, Rattus norvegicus
tctccctgctgtatttctatgcaaa

SEQ ID NO: 594183 - DNA, 25 bp, Rattus norvegicus
tctccctgctgtttttctatgcaaa

SEQ ID NO: 594184 - DNA, 25 bp, Rattus norvegicus
tctccctggcgcaatctgtgatcaa

SEQ ID NO: 594185 - DNA, 25 bp, Rattus norvegicus
tctccctggcgctatctgtgatcaa

SEQ ID NO: 594186 - DNA, 25 bp, Rattus norvegicus
tctccctggctacattcgggaagga

SEQ ID NO: 594187 - DNA, 25 bp, Rattus norvegicus
tctccctggctagattcgggaagga

SEQ ID NO: 594188 - DNA, 25 bp, Rattus norvegicus
tctccctgggaaacatgaatcatgc

SEQ ID NO: 594189 - DNA, 25 bp, Rattus norvegicus
tctccctgggaatcatgaatcatgc

SEQ ID NO: 594190 - DNA, 25 bp, Rattus norvegicus
tctccctgggacagctcttaggaaa

SEQ ID NO: 594191 - DNA, 25 bp, Rattus norvegicus
tctccctgggactgctcttaggaaa

SEQ ID NO: 594192 - DNA, 25 bp, Rattus norvegicus
tctccctggtccaggtgcctttggg

SEQ ID NO: 594193 - DNA, 25 bp, Rattus norvegicus
tctccctggtcctggtgcctttggg

SEQ ID NO: 594194 - DNA, 25 bp, Rattus norvegicus
tctccctggtttaccatgagggcaa

SEQ ID NO: 594195 - DNA, 25 bp, Rattus norvegicus
tctccctggttttccatgagggcaa

SEQ ID NO: 594196 - DNA, 25 bp, Rattus norvegicus
tctccctgtagcaccagcaaataaa

SEQ ID NO: 594197 - DNA, 25 bp, Rattus norvegicus
tctccctgtagctccagcaaataaa

SEQ ID NO: 594198 - DNA, 25 bp, Rattus norvegicus
tctccctgtctaagttttatctcta

SEQ ID NO: 594199 - DNA, 25 bp, Rattus norvegicus
tctccctgtctatgttttatctcta

SEQ ID NO: 594200 - DNA, 25 bp, Rattus norvegicus
tctccctgtggacacatcttcatgg

SEQ ID NO: 594201 - DNA, 25 bp, Rattus norvegicus
tctccctgtggacctgattgatata

SEQ ID NO: 594202 - DNA, 25 bp, Rattus norvegicus
tctccctgtggagacatcttcatgg

SEQ ID NO: 594203 - DNA, 25 bp, Rattus norvegicus
tctccctgtggagctgattgatata

SEQ ID NO: 594204 - DNA, 25 bp, Rattus norvegicus
tctccctgttgtccaagatgagtgg

SEQ ID NO: 594205 - DNA, 25 bp, Rattus norvegicus
tctccctgttgtgcaagatgagtgg

SEQ ID NO: 594206 - DNA, 25 bp, Rattus norvegicus
tctccctgttttacaagtttccttg

SEQ ID NO: 594207 - DNA, 25 bp, Rattus norvegicus
tctccctgtttttcaagtttccttg

SEQ ID NO: 594208 - DNA, 25 bp, Rattus norvegicus
tctcccttacaaaacgtgtgtccaa

SEQ ID NO: 594209 - DNA, 25 bp, Rattus norvegicus
tctcccttacaatacgtgtgtccaa

SEQ ID NO: 594210 - DNA, 25 bp, Rattus norvegicus
tctcccttcccaagtatgcagacaa

SEQ ID NO: 594211 - DNA, 25 bp, Rattus norvegicus
tctcccttcccatgtatgcagacaa

SEQ ID NO: 594212 - DNA, 25 bp, Rattus norvegicus
tctcccttcctaccaacttttatgt

SEQ ID NO: 594213 - DNA, 25 bp, Rattus norvegicus
tctcccttcctagcaacttttatgt

SEQ ID NO: 594214 - DNA, 25 bp, Rattus norvegicus
tctcccttccttataatagcagcga

SEQ ID NO: 594215 - DNA, 25 bp, Rattus norvegicus
tctcccttccttttaatagcagcga

SEQ ID NO: 594216 - DNA, 25 bp, Rattus norvegicus
tctcccttctctctgatttctgtaa

SEQ ID NO: 594217 - DNA, 25 bp, Rattus norvegicus
tctcccttctctgtgatttctgtaa

SEQ ID NO: 594218 - DNA, 25 bp, Rattus norvegicus
tctcccttgaacacctttaggcaag

SEQ ID NO: 594219 - DNA, 25 bp, Rattus norvegicus
tctcccttgaactcctttaggcaag

SEQ ID NO: 594220 - DNA, 25 bp, Rattus norvegicus
tctcccttgggcagttttctataaa

SEQ ID NO: 594221 - DNA, 25 bp, Rattus norvegicus
tctcccttgggctgttttctataaa

SEQ ID NO: 594222 - DNA, 25 bp, Rattus norvegicus
tctccctttatgaccctagtgttgg

SEQ ID NO: 594223 - DNA, 25 bp, Rattus norvegicus
tctccctttatgtccctagtgttgg

SEQ ID NO: 594224 - DNA, 25 bp, Rattus norvegicus
tctccctttgtcatcaagttgctgc

SEQ ID NO: 594225 - DNA, 25 bp, Rattus norvegicus
tctccctttgtcttcaagttgctgc

SEQ ID NO: 594226 - DNA, 25 bp, Rattus norvegicus
tctccctttttcctcatatgatgga

SEQ ID NO: 594227 - DNA, 25 bp, Rattus norvegicus
tctccctttttcgtcatatgatgga

SEQ ID NO: 594228 - DNA, 25 bp, Rattus norvegicus
tctccgaacaccattgtcttcaata

SEQ ID NO: 594229 - DNA, 25 bp, Rattus norvegicus
tctccgaacacctttgtcttcaata

SEQ ID NO: 594230 - DNA, 25 bp, Rattus norvegicus
tctccgagacgccaaaggaaatctg

SEQ ID NO: 594231 - DNA, 25 bp, Rattus norvegicus
tctccgagacgcgaaaggaaatctg

SEQ ID NO: 594232 - DNA, 25 bp, Rattus norvegicus
tctccgatagttcaccttactgttt

SEQ ID NO: 594233 - DNA, 25 bp, Rattus norvegicus
tctccgatagttgaccttactgttt

SEQ ID NO: 594234 - DNA, 25 bp, Rattus norvegicus
tctccgatcttgacagccaaagagc

SEQ ID NO: 594235 - DNA, 25 bp, Rattus norvegicus
tctccgatcttgtcagccaaagagc

SEQ ID NO: 594236 - DNA, 25 bp, Rattus norvegicus
tctccgatgttgacagactctgact

SEQ ID NO: 594237 - DNA, 25 bp, Rattus norvegicus
tctccgatgttgtcagactctgact

SEQ ID NO: 594238 - DNA, 25 bp, Rattus norvegicus
tctccgcaggagaaagcctcgccgt

SEQ ID NO: 594239 - DNA, 25 bp, Rattus norvegicus
tctccgcaggagtaagcctcgccgt

SEQ ID NO: 594240 - DNA, 25 bp, Rattus norvegicus
tctccgccaggcaaggaatcacaaa

SEQ ID NO: 594241 - DNA, 25 bp, Rattus norvegicus
tctccgccaggctaggaatcacaaa

SEQ ID NO: 594242 - DNA, 25 bp, Rattus norvegicus
tctccgccagttacccagaaataag

SEQ ID NO: 594243 - DNA, 25 bp, Rattus norvegicus
tctccgccagtttcccagaaataag

SEQ ID NO: 594244 - DNA, 25 bp, Rattus norvegicus
tctccgccgtcactgtaactatgaa

SEQ ID NO: 594245 - DNA, 25 bp, Rattus norvegicus
tctccgccgtcagtgtaactatgaa

SEQ ID NO: 594246 - DNA, 25 bp, Rattus norvegicus
tctccgcgccttctaaacttttgga

SEQ ID NO: 594247 - DNA, 25 bp, Rattus norvegicus
tctccgcgccttgtaaacttttgga

SEQ ID NO: 594248 - DNA, 25 bp, Rattus norvegicus
tctccgcgcttcagtcaaaaacttg

SEQ ID NO: 594249 - DNA, 25 bp, Rattus norvegicus
tctccgcgcttctgtcaaaaacttg

SEQ ID NO: 594250 - DNA, 25 bp, Rattus norvegicus
tctccgctcaggaactaacgtgtag

SEQ ID NO: 594251 - DNA, 25 bp, Rattus norvegicus
tctccgctcaggtactaacgtgtag

SEQ ID NO: 594252 - DNA, 25 bp, Rattus norvegicus
tctccgctctccacggagacgtgag

SEQ ID NO: 594253 - DNA, 25 bp, Rattus norvegicus
tctccgctctcctcggagacgtgag

SEQ ID NO: 594254 - DNA, 25 bp, Rattus norvegicus
tctccgctgctgaaagaaccgctga

SEQ ID NO: 594255 - DNA, 25 bp, Rattus norvegicus
tctccgctgctgtaagaaccgctga

SEQ ID NO: 594256 - DNA, 25 bp, Rattus norvegicus
tctccgctggagctgacttcaaaag

SEQ ID NO: 594257 - DNA, 25 bp, Rattus norvegicus
tctccgctggaggtgacttcaaaag

SEQ ID NO: 594258 - DNA, 25 bp, Rattus norvegicus
tctccggactcaatcgttaaaactc

SEQ ID NO: 594259 - DNA, 25 bp, Rattus norvegicus
tctccggactcattcgttaaaactc

SEQ ID NO: 594260 - DNA, 25 bp, Rattus norvegicus
tctccggattgccacactcaaaatt

SEQ ID NO: 594261 - DNA, 25 bp, Rattus norvegicus
tctccggattgcgacactcaaaatt

SEQ ID NO: 594262 - DNA, 25 bp, Rattus norvegicus
tctccggccgccaaagtaacttgga

SEQ ID NO: 594263 - DNA, 25 bp, Rattus norvegicus
tctccggccgcctaagtaacttgga

SEQ ID NO: 594264 - DNA, 25 bp, Rattus norvegicus
tctccggccgctccaatgagtagga

SEQ ID NO: 594265 - DNA, 25 bp, Rattus norvegicus
tctccggccgctgcaatgagtagga

SEQ ID NO: 594266 - DNA, 25 bp, Rattus norvegicus
tctccggcgaaaagtctggtgtgat

SEQ ID NO: 594267 - DNA, 25 bp, Rattus norvegicus
tctccggcgaaatgtctggtgtgat

SEQ ID NO: 594268 - DNA, 25 bp, Rattus norvegicus
tctccggctctcacacaaatgaaca

SEQ ID NO: 594269 - DNA, 25 bp, Rattus norvegicus
tctccggctctctcacaaatgaaca

SEQ ID NO: 594270 - DNA, 25 bp, Rattus norvegicus
tctccgggaagcaacgcccgaggag

SEQ ID NO: 594271 - DNA, 25 bp, Rattus norvegicus
tctccgggaagctacgcccgaggag

SEQ ID NO: 594272 - DNA, 25 bp, Rattus norvegicus
tctccgggaggaagccattcagttt

SEQ ID NO: 594273 - DNA, 25 bp, Rattus norvegicus
tctccgggaggatgccattcagttt

SEQ ID NO: 594274 - DNA, 25 bp, Rattus norvegicus
tctccgggatgcatttgggtacgta

SEQ ID NO: 594275 - DNA, 25 bp, Rattus norvegicus
tctccgggatgcttttgggtacgta

SEQ ID NO: 594276 - DNA, 25 bp, Rattus norvegicus
tctccgggtaacactgcttaactaa

SEQ ID NO: 594277 - DNA, 25 bp, Rattus norvegicus
tctccgggtaactctgcttaactaa

SEQ ID NO: 594278 - DNA, 25 bp, Rattus norvegicus
tctccggtggccagaagcgttcaga

SEQ ID NO: 594279 - DNA, 25 bp, Rattus norvegicus
tctccggtggcctgaagcgttcaga

SEQ ID NO: 594280 - DNA, 25 bp, Rattus norvegicus
tctccggtgttcctggctggaagaa

SEQ ID NO: 594281 - DNA, 25 bp, Rattus norvegicus
tctccggtgttcgtggctggaagaa

SEQ ID NO: 594282 - DNA, 25 bp, Rattus norvegicus
tctccggttccaaaggcagaaggcc

SEQ ID NO: 594283 - DNA, 25 bp, Rattus norvegicus
tctccggttccataggcagaaggcc

SEQ ID NO: 594284 - DNA, 25 bp, Rattus norvegicus
tctccggtttctccattttgtatga

SEQ ID NO: 594285 - DNA, 25 bp, Rattus norvegicus
tctccggtttctgcattttgtatga

SEQ ID NO: 594286 - DNA, 25 bp, Rattus norvegicus
tctccgtaacttacagtcatcctga

SEQ ID NO: 594287 - DNA, 25 bp, Rattus norvegicus
tctccgtaactttcagtcatcctga

SEQ ID NO: 594288 - DNA, 25 bp, Rattus norvegicus
tctccgtagcttctctgtgatattc

SEQ ID NO: 594289 - DNA, 25 bp, Rattus norvegicus
tctccgtagcttgtctgtgatattc

SEQ ID NO: 594290 - DNA, 25 bp, Rattus norvegicus
tctccgtagtcgctttgcacatggc

SEQ ID NO: 594291 - DNA, 25 bp, Rattus norvegicus
tctccgtagtcggtttgcacatggc

SEQ ID NO: 594292 - DNA, 25 bp, Rattus norvegicus
tctccgtatgtcacctgaattcaaa

SEQ ID NO: 594293 - DNA, 25 bp, Rattus norvegicus
tctccgtatgtctcctgaattcaaa

SEQ ID NO: 594294 - DNA, 25 bp, Rattus norvegicus
tctccgtcttcaagtttctgtttgt

SEQ ID NO: 594295 - DNA, 25 bp, Rattus norvegicus
tctccgtcttcatgtttctgtttgt

SEQ ID NO: 594296 - DNA, 25 bp, Rattus norvegicus
tctccgtgttggctgcggtgcctca

SEQ ID NO: 594297 - DNA, 25 bp, Rattus norvegicus
tctccgtgttgggtgcggtgcctca

SEQ ID NO: 594298 - DNA, 25 bp, Rattus norvegicus
tctccgttcttgaatgtgtgtgttg

SEQ ID NO: 594299 - DNA, 25 bp, Rattus norvegicus
tctccgttcttgtatgtgtgtgttg

SEQ ID NO: 594300 - DNA, 25 bp, Rattus norvegicus
tctccgttgccaagagtgtcagcag

SEQ ID NO: 594301 - DNA, 25 bp, Rattus norvegicus
tctccgttgccatgagtgtcagcag

SEQ ID NO: 594302 - DNA, 25 bp, Rattus norvegicus
tctccgttgtgtataatttatttca

SEQ ID NO: 594303 - DNA, 25 bp, Rattus norvegicus
tctccgttgtgtttaatttatttca

SEQ ID NO: 594304 - DNA, 25 bp, Rattus norvegicus
tctcctaaatatccattcctctgaa

SEQ ID NO: 594305 - DNA, 25 bp, Rattus norvegicus
tctcctaaatatgcattcctctgaa

SEQ ID NO: 594306 - DNA, 25 bp, Rattus norvegicus
tctcctaagcacaggagcctccaat

SEQ ID NO: 594307 - DNA, 25 bp, Rattus norvegicus
tctcctaagcactggagcctccaat

SEQ ID NO: 594308 - DNA, 25 bp, Rattus norvegicus
tctcctacctgtaggtcctggaatt

SEQ ID NO: 594309 - DNA, 25 bp, Rattus norvegicus
tctcctacctgttggtcctggaatt

SEQ ID NO: 594310 - DNA, 25 bp, Rattus norvegicus
tctcctacttccatgcctaaaacag

SEQ ID NO: 594311 - DNA, 25 bp, Rattus norvegicus
tctcctacttccttgcctaaaacag

SEQ ID NO: 594312 - DNA, 25 bp, Rattus norvegicus
tctcctagacttctgggctttgcca

SEQ ID NO: 594313 - DNA, 25 bp, Rattus norvegicus
tctcctagacttgtgggctttgcca

SEQ ID NO: 594314 - DNA, 25 bp, Rattus norvegicus
tctcctagccacaatgcttgcagag

SEQ ID NO: 594315 - DNA, 25 bp, Rattus norvegicus
tctcctagccactatgcttgcagag

SEQ ID NO: 594316 - DNA, 25 bp, Rattus norvegicus
tctcctagccgacgccagctgtgtt

SEQ ID NO: 594317 - DNA, 25 bp, Rattus norvegicus
tctcctagccgaggccagctgtgtt

SEQ ID NO: 594318 - DNA, 25 bp, Rattus norvegicus
tctcctagctgtcttttggtttgga

SEQ ID NO: 594319 - DNA, 25 bp, Rattus norvegicus
tctcctagctgtgttttggtttgga

SEQ ID NO: 594320 - DNA, 25 bp, Rattus norvegicus
tctcctatacccagcagatggagga

SEQ ID NO: 594321 - DNA, 25 bp, Rattus norvegicus
tctcctataccctgcagatggagga

SEQ ID NO: 594322 - DNA, 25 bp, Rattus norvegicus
tctcctatcgtcaccagcaaagtgt

SEQ ID NO: 594323 - DNA, 25 bp, Rattus norvegicus
tctcctatcgtctccagcaaagtgt

SEQ ID NO: 594324 - DNA, 25 bp, Rattus norvegicus
tctcctatgggcacctctgagtgaa

SEQ ID NO: 594325 - DNA, 25 bp, Rattus norvegicus
tctcctatgggctcctctgagtgaa

SEQ ID NO: 594326 - DNA, 25 bp, Rattus norvegicus
tctcctattcaacagctcagaatgt

SEQ ID NO: 594327 - DNA, 25 bp, Rattus norvegicus
tctcctattcaagagctcagaatgt

SEQ ID NO: 594328 - DNA, 25 bp, Rattus norvegicus
tctcctattggcattgtctattgac

SEQ ID NO: 594329 - DNA, 25 bp, Rattus norvegicus
tctcctattggctttgtctattgac

SEQ ID NO: 594330 - DNA, 25 bp, Rattus norvegicus
tctcctcaagcccttcattaataaa

SEQ ID NO: 594331 - DNA, 25 bp, Rattus norvegicus
tctcctcaagccgttcattaataaa

SEQ ID NO: 594332 - DNA, 25 bp, Rattus norvegicus
tctcctcacattagaaccgacaaca

SEQ ID NO: 594333 - DNA, 25 bp, Rattus norvegicus
tctcctcacatttgaaccgacaaca

SEQ ID NO: 594334 - DNA, 25 bp, Rattus norvegicus
tctcctcacgttccagacagacgta

SEQ ID NO: 594335 - DNA, 25 bp, Rattus norvegicus
tctcctcacgttgcagacagacgta

SEQ ID NO: 594336 - DNA, 25 bp, Rattus norvegicus
tctcctcagaggatgtccctttaag

SEQ ID NO: 594337 - DNA, 25 bp, Rattus norvegicus
tctcctcagaggcaagacgtgagaa

SEQ ID NO: 594338 - DNA, 25 bp, Rattus norvegicus
tctcctcagagggaagacgtgagaa

SEQ ID NO: 594339 - DNA, 25 bp, Rattus norvegicus
tctcctcagaggttgtccctttaag

SEQ ID NO: 594340 - DNA, 25 bp, Rattus norvegicus
tctcctcagcttattgtcaggtctg

SEQ ID NO: 594341 - DNA, 25 bp, Rattus norvegicus
tctcctcagcttcactatctgggaa

SEQ ID NO: 594342 - DNA, 25 bp, Rattus norvegicus
tctcctcagcttgactatctgggaa

SEQ ID NO: 594343 - DNA, 25 bp, Rattus norvegicus
tctcctcagctttttgtcaggtctg

SEQ ID NO: 594344 - DNA, 25 bp, Rattus norvegicus
tctcctcatctcagacggctcagga

SEQ ID NO: 594345 - DNA, 25 bp, Rattus norvegicus
tctcctcatctctgacggctcagga

SEQ ID NO: 594346 - DNA, 25 bp, Rattus norvegicus
tctcctcatgctaagggcatggcaa

SEQ ID NO: 594347 - DNA, 25 bp, Rattus norvegicus
tctcctcatgcttagggcatggcaa

SEQ ID NO: 594348 - DNA, 25 bp, Rattus norvegicus
tctcctcattgactcagggatgcct

SEQ ID NO: 594349 - DNA, 25 bp, Rattus norvegicus
tctcctcattgagtcagggatgcct

SEQ ID NO: 594350 - DNA, 25 bp, Rattus norvegicus
tctcctccaagcacttttaaactct

SEQ ID NO: 594351 - DNA, 25 bp, Rattus norvegicus
tctcctccaagctcttttaaactct

SEQ ID NO: 594352 - DNA, 25 bp, Rattus norvegicus
tctcctccatctaaacttcaattca

SEQ ID NO: 594353 - DNA, 25 bp, Rattus norvegicus
tctcctccatcttaacttcaattca

SEQ ID NO: 594354 - DNA, 25 bp, Rattus norvegicus
tctcctccattactttctgcattgt

SEQ ID NO: 594355 - DNA, 25 bp, Rattus norvegicus
tctcctccattagtttctgcattgt

SEQ ID NO: 594356 - DNA, 25 bp, Rattus norvegicus
tctcctccctgaaaacacatgaatg

SEQ ID NO: 594357 - DNA, 25 bp, Rattus norvegicus
tctcctccctgactgagaaccgtgg

SEQ ID NO: 594358 - DNA, 25 bp, Rattus norvegicus
tctcctccctgagtgagaaccgtgg

SEQ ID NO: 594359 - DNA, 25 bp, Rattus norvegicus
tctcctccctgataacacatgaatg

SEQ ID NO: 594360 - DNA, 25 bp, Rattus norvegicus
tctcctcctcagagcaggtgatcag

SEQ ID NO: 594361 - DNA, 25 bp, Rattus norvegicus
tctcctcctcagtgcaggtgatcag

SEQ ID NO: 594362 - DNA, 25 bp, Rattus norvegicus
tctcctcctctcaggctgggtatgg

SEQ ID NO: 594363 - DNA, 25 bp, Rattus norvegicus
tctcctcctctctggctgggtatgg

SEQ ID NO: 594364 - DNA, 25 bp, Rattus norvegicus
tctcctcgcctcaagttatttgatt

SEQ ID NO: 594365 - DNA, 25 bp, Rattus norvegicus
tctcctcgcctctagttatttgatt

SEQ ID NO: 594366 - DNA, 25 bp, Rattus norvegicus
tctcctcgtgttacagaaaagcctc

SEQ ID NO: 594367 - DNA, 25 bp, Rattus norvegicus
tctcctcgtgttacatctctctgaa

SEQ ID NO: 594368 - DNA, 25 bp, Rattus norvegicus
tctcctcgtgtttcagaaaagcctc

SEQ ID NO: 594369 - DNA, 25 bp, Rattus norvegicus
tctcctcgtgtttcatctctctgaa

SEQ ID NO: 594370 - DNA, 25 bp, Rattus norvegicus
tctcctctactgacatcatagttaa

SEQ ID NO: 594371 - DNA, 25 bp, Rattus norvegicus
tctcctctactgtcatcatagttaa

SEQ ID NO: 594372 - DNA, 25 bp, Rattus norvegicus
tctcctctagatacccttcttgttt

SEQ ID NO: 594373 - DNA, 25 bp, Rattus norvegicus
tctcctctagattcccttcttgttt

SEQ ID NO: 594374 - DNA, 25 bp, Rattus norvegicus
tctcctctccggatagcagcatgct

SEQ ID NO: 594375 - DNA, 25 bp, Rattus norvegicus
tctcctctccggttagcagcatgct

SEQ ID NO: 594376 - DNA, 25 bp, Rattus norvegicus
tctcctctcctgctctataggaaga

SEQ ID NO: 594377 - DNA, 25 bp, Rattus norvegicus
tctcctctcctggtctataggaaga

SEQ ID NO: 594378 - DNA, 25 bp, Rattus norvegicus
tctcctctccttatgattagacaca

SEQ ID NO: 594379 - DNA, 25 bp, Rattus norvegicus
tctcctctccttttgattagacaca

SEQ ID NO: 594380 - DNA, 25 bp, Rattus norvegicus
tctcctctctttcttctacagatga

SEQ ID NO: 594381 - DNA, 25 bp, Rattus norvegicus
tctcctctctttgttctacagatga

SEQ ID NO: 594382 - DNA, 25 bp, Rattus norvegicus
tctcctctgactacgacagtcaagg

SEQ ID NO: 594383 - DNA, 25 bp, Rattus norvegicus
tctcctctgacttcgacagtcaagg

SEQ ID NO: 594384 - DNA, 25 bp, Rattus norvegicus
tctcctctgagtacgagctgcagca

SEQ ID NO: 594385 - DNA, 25 bp, Rattus norvegicus
tctcctctgagttcgagctgcagca

SEQ ID NO: 594386 - DNA, 25 bp, Rattus norvegicus
tctcctctggttcatgttgttgttt

SEQ ID NO: 594387 - DNA, 25 bp, Rattus norvegicus
tctcctctggttgatgttgttgttt

SEQ ID NO: 594388 - DNA, 25 bp, Rattus norvegicus
tctcctgaagctctcgtatctgttg

SEQ ID NO: 594389 - DNA, 25 bp, Rattus norvegicus
tctcctgaagctgtcgtatctgttg

SEQ ID NO: 594390 - DNA, 25 bp, Rattus norvegicus
tctcctgaatccagttatgaaccaa

SEQ ID NO: 594391 - DNA, 25 bp, Rattus norvegicus
tctcctgaatcctgttatgaaccaa

SEQ ID NO: 594392 - DNA, 25 bp, Rattus norvegicus
tctcctgacatccatgtctgaaatg

SEQ ID NO: 594393 - DNA, 25 bp, Rattus norvegicus
tctcctgacatcgatgtctgaaatg

SEQ ID NO: 594394 - DNA, 25 bp, Rattus norvegicus
tctcctgactgtactcgggtggaaa

SEQ ID NO: 594395 - DNA, 25 bp, Rattus norvegicus
tctcctgactgttctcgggtggaaa

SEQ ID NO: 594396 - DNA, 25 bp, Rattus norvegicus
tctcctgagatactggtcccaatga

SEQ ID NO: 594397 - DNA, 25 bp, Rattus norvegicus
tctcctgagatagtggtcccaatga

SEQ ID NO: 594398 - DNA, 25 bp, Rattus norvegicus
tctcctgataaactctctttgctgg

SEQ ID NO: 594399 - DNA, 25 bp, Rattus norvegicus
tctcctgataaagtctctttgctgg

SEQ ID NO: 594400 - DNA, 25 bp, Rattus norvegicus
tctcctgcaatgaaacagtttgttt

SEQ ID NO: 594401 - DNA, 25 bp, Rattus norvegicus
tctcctgcaatgtaacagtttgttt

SEQ ID NO: 594402 - DNA, 25 bp, Rattus norvegicus
tctcctgcacatctttattattcct

SEQ ID NO: 594403 - DNA, 25 bp, Rattus norvegicus
tctcctgcacatgtttattattcct

SEQ ID NO: 594404 - DNA, 25 bp, Rattus norvegicus
tctcctgccctaatggtctgcagat

SEQ ID NO: 594405 - DNA, 25 bp, Rattus norvegicus
tctcctgccctattggtctgcagat

SEQ ID NO: 594406 - DNA, 25 bp, Rattus norvegicus
tctcctgcctaccttcagtaagaag

SEQ ID NO: 594407 - DNA, 25 bp, Rattus norvegicus
tctcctgcctacgttcagtaagaag

SEQ ID NO: 594408 - DNA, 25 bp, Rattus norvegicus
tctcctgcctctcgatgagcagtaa

SEQ ID NO: 594409 - DNA, 25 bp, Rattus norvegicus
tctcctgcctctggatgagcagtaa

SEQ ID NO: 594410 - DNA, 25 bp, Rattus norvegicus
tctcctgcgaggagtttttttcgaa

SEQ ID NO: 594411 - DNA, 25 bp, Rattus norvegicus
tctcctgcgaggtgtttttttcgaa

SEQ ID NO: 594412 - DNA, 25 bp, Rattus norvegicus
tctcctgcgcgacatgccaagaaat

SEQ ID NO: 594413 - DNA, 25 bp, Rattus norvegicus
tctcctgcgcgagatgccaagaaat

SEQ ID NO: 594414 - DNA, 25 bp, Rattus norvegicus
tctcctgcgtgacacacgtgttggc

SEQ ID NO: 594415 - DNA, 25 bp, Rattus norvegicus
tctcctgcgtgagacacgtgttggc

SEQ ID NO: 594416 - DNA, 25 bp, Rattus norvegicus
tctcctgctgttctcatagacaaaa

SEQ ID NO: 594417 - DNA, 25 bp, Rattus norvegicus
tctcctgctgttgtcatagacaaaa

SEQ ID NO: 594418 - DNA, 25 bp, Rattus norvegicus
tctcctggaataacaatggctcggc

SEQ ID NO: 594419 - DNA, 25 bp, Rattus norvegicus
tctcctggaatatcaatggctcggc

SEQ ID NO: 594420 - DNA, 25 bp, Rattus norvegicus
tctcctggagagaagaaaccttttt

SEQ ID NO: 594421 - DNA, 25 bp, Rattus norvegicus
tctcctggagagtagaaaccttttt

SEQ ID NO: 594422 - DNA, 25 bp, Rattus norvegicus
tctcctggatctagaactgacgtct

SEQ ID NO: 594423 - DNA, 25 bp, Rattus norvegicus
tctcctggatcttgaactgacgtct

SEQ ID NO: 594424 - DNA, 25 bp, Rattus norvegicus
tctcctggatggactgcatgggcga

SEQ ID NO: 594425 - DNA, 25 bp, Rattus norvegicus
tctcctggatggtctgcatgggcga

SEQ ID NO: 594426 - DNA, 25 bp, Rattus norvegicus
tctcctggcactacagagacacatg

SEQ ID NO: 594427 - DNA, 25 bp, Rattus norvegicus
tctcctggcacttcagagacacatg

SEQ ID NO: 594428 - DNA, 25 bp, Rattus norvegicus
tctcctggcccgacgcctgtgaagg

SEQ ID NO: 594429 - DNA, 25 bp, Rattus norvegicus
tctcctggcccgtcgcctgtgaagg

SEQ ID NO: 594430 - DNA, 25 bp, Rattus norvegicus
tctcctggctgtatctgggttcagc

SEQ ID NO: 594431 - DNA, 25 bp, Rattus norvegicus
tctcctggctgtttctgggttcagc

SEQ ID NO: 594432 - DNA, 25 bp, Rattus norvegicus
tctcctgggaagatggttacattct

SEQ ID NO: 594433 - DNA, 25 bp, Rattus norvegicus
tctcctgggaagttggttacattct

SEQ ID NO: 594434 - DNA, 25 bp, Rattus norvegicus
tctcctgggtcacgcttgcagaatg

SEQ ID NO: 594435 - DNA, 25 bp, Rattus norvegicus
tctcctgggtcaggcttgcagaatg

SEQ ID NO: 594436 - DNA, 25 bp, Rattus norvegicus
tctcctgggtctaccgtgtttctta

SEQ ID NO: 594437 - DNA, 25 bp, Rattus norvegicus
tctcctgggtcttccgtgtttctta

SEQ ID NO: 594438 - DNA, 25 bp, Rattus norvegicus
tctcctggtactctctgctggtggg

SEQ ID NO: 594439 - DNA, 25 bp, Rattus norvegicus
tctcctggtactgtctgctggtggg

SEQ ID NO: 594440 - DNA, 25 bp, Rattus norvegicus
tctcctgtacctactgaattcacaa

SEQ ID NO: 594441 - DNA, 25 bp, Rattus norvegicus
tctcctgtaccttctgaattcacaa

SEQ ID NO: 594442 - DNA, 25 bp, Rattus norvegicus
tctcctgtagagaagctcattcccc

SEQ ID NO: 594443 - DNA, 25 bp, Rattus norvegicus
tctcctgtagagtagctcattcccc

SEQ ID NO: 594444 - DNA, 25 bp, Rattus norvegicus
tctcctgtaggcacatttgtataag

SEQ ID NO: 594445 - DNA, 25 bp, Rattus norvegicus
tctcctgtaggctcatttgtataag

SEQ ID NO: 594446 - DNA, 25 bp, Rattus norvegicus
tctcctgtaggtccatttcttcagt

SEQ ID NO: 594447 - DNA, 25 bp, Rattus norvegicus
tctcctgtaggtgcatttcttcagt

SEQ ID NO: 594448 - DNA, 25 bp, Rattus norvegicus
tctcctgtcactcagccaagtatgt

SEQ ID NO: 594449 - DNA, 25 bp, Rattus norvegicus
tctcctgtcactgagccaagtatgt

SEQ ID NO: 594450 - DNA, 25 bp, Rattus norvegicus
tctcctgtgcttcatattaaccttt

SEQ ID NO: 594451 - DNA, 25 bp, Rattus norvegicus
tctcctgtgcttgatattaaccttt

SEQ ID NO: 594452 - DNA, 25 bp, Rattus norvegicus
tctcctgtggagactgctgggcatg

SEQ ID NO: 594453 - DNA, 25 bp, Rattus norvegicus
tctcctgtggagtctgctgggcatg

SEQ ID NO: 594454 - DNA, 25 bp, Rattus norvegicus
tctcctgtgtcgagcaggtggctct

SEQ ID NO: 594455 - DNA, 25 bp, Rattus norvegicus
tctcctgtgtcgtgcaggtggctct

SEQ ID NO: 594456 - DNA, 25 bp, Rattus norvegicus
tctcctgtgttgaatgtatcatctg

SEQ ID NO: 594457 - DNA, 25 bp, Rattus norvegicus
tctcctgtgttgtatgtatcatctg

SEQ ID NO: 594458 - DNA, 25 bp, Rattus norvegicus
tctcctgtttggaaacctttgacct

SEQ ID NO: 594459 - DNA, 25 bp, Rattus norvegicus
tctcctgtttggtaacctttgacct

SEQ ID NO: 594460 - DNA, 25 bp, Rattus norvegicus
tctcctgtttgtatgctgtgtgcgt

SEQ ID NO: 594461 - DNA, 25 bp, Rattus norvegicus
tctcctgtttgtttgctgtgtgcgt

SEQ ID NO: 594462 - DNA, 25 bp, Rattus norvegicus
tctccttaagctatgacactacgtc

SEQ ID NO: 594463 - DNA, 25 bp, Rattus norvegicus
tctccttaagctttgacactacgtc

SEQ ID NO: 594464 - DNA, 25 bp, Rattus norvegicus
tctccttacccaaacagagtggcta

SEQ ID NO: 594465 - DNA, 25 bp, Rattus norvegicus
tctccttacccatacagagtggcta

SEQ ID NO: 594466 - DNA, 25 bp, Rattus norvegicus
tctccttaccctagatttctttctt

SEQ ID NO: 594467 - DNA, 25 bp, Rattus norvegicus
tctccttacccttgatttctttctt

SEQ ID NO: 594468 - DNA, 25 bp, Rattus norvegicus
tctccttacctcatagacactgttt

SEQ ID NO: 594469 - DNA, 25 bp, Rattus norvegicus
tctccttacctcttagacactgttt

SEQ ID NO: 594470 - DNA, 25 bp, Rattus norvegicus
tctccttagggcaccttgaggacaa

SEQ ID NO: 594471 - DNA, 25 bp, Rattus norvegicus
tctccttagggctccttgaggacaa

SEQ ID NO: 594472 - DNA, 25 bp, Rattus norvegicus
tctccttaggggctttctcaatcca

SEQ ID NO: 594473 - DNA, 25 bp, Rattus norvegicus
tctccttagggggtttctcaatcca

SEQ ID NO: 594474 - DNA, 25 bp, Rattus norvegicus
tctccttatctaactcctgtgttgg

SEQ ID NO: 594475 - DNA, 25 bp, Rattus norvegicus
tctccttatctatctcctgtgttgg

SEQ ID NO: 594476 - DNA, 25 bp, Rattus norvegicus
tctccttatcttccaggccaaagta

SEQ ID NO: 594477 - DNA, 25 bp, Rattus norvegicus
tctccttatcttgcaggccaaagta

SEQ ID NO: 594478 - DNA, 25 bp, Rattus norvegicus
tctccttatgaacttatggatatgg

SEQ ID NO: 594479 - DNA, 25 bp, Rattus norvegicus
tctccttatgaagttatggatatgg

SEQ ID NO: 594480 - DNA, 25 bp, Rattus norvegicus
tctccttcacatacttcaagactgt

SEQ ID NO: 594481 - DNA, 25 bp, Rattus norvegicus
tctccttcacattcttcaagactgt

SEQ ID NO: 594482 - DNA, 25 bp, Rattus norvegicus
tctccttcaggacgcagcatgacaa

SEQ ID NO: 594483 - DNA, 25 bp, Rattus norvegicus
tctccttcaggaggcagcatgacaa

SEQ ID NO: 594484 - DNA, 25 bp, Rattus norvegicus
tctccttccatcaacgcatgaattt

SEQ ID NO: 594485 - DNA, 25 bp, Rattus norvegicus
tctccttccatctacgcatgaattt

SEQ ID NO: 594486 - DNA, 25 bp, Rattus norvegicus
tctccttcccctcaagtatcttaaa

SEQ ID NO: 594487 - DNA, 25 bp, Rattus norvegicus
tctccttcccctgaagtatcttaaa

SEQ ID NO: 594488 - DNA, 25 bp, Rattus norvegicus
tctccttccctaagctcattgaaat

SEQ ID NO: 594489 - DNA, 25 bp, Rattus norvegicus
tctccttccctatgctcattgaaat

SEQ ID NO: 594490 - DNA, 25 bp, Rattus norvegicus
tctccttcctaaatgtgggtgcaat

SEQ ID NO: 594491 - DNA, 25 bp, Rattus norvegicus
tctccttcctaattgtgggtgcaat

SEQ ID NO: 594492 - DNA, 25 bp, Rattus norvegicus
tctccttcctctagataataaacag

SEQ ID NO: 594493 - DNA, 25 bp, Rattus norvegicus
tctccttcctcttgataataaacag

SEQ ID NO: 594494 - DNA, 25 bp, Rattus norvegicus
tctccttccttacaaagtacatcgc

SEQ ID NO: 594495 - DNA, 25 bp, Rattus norvegicus
tctccttccttagaaagtacatcgc

SEQ ID NO: 594496 - DNA, 25 bp, Rattus norvegicus
tctccttcggagacagtctgtctgt

SEQ ID NO: 594497 - DNA, 25 bp, Rattus norvegicus
tctccttcggagtcagtctgtctgt

SEQ ID NO: 594498 - DNA, 25 bp, Rattus norvegicus
tctccttctacacacttctatggtt

SEQ ID NO: 594499 - DNA, 25 bp, Rattus norvegicus
tctccttctacagacttctatggtt

SEQ ID NO: 594500 - DNA, 25 bp, Rattus norvegicus
tctccttctcccaaaagtgtactta

SEQ ID NO: 594501 - DNA, 25 bp, Rattus norvegicus
tctccttctccctaaagtgtactta

SEQ ID NO: 594502 - DNA, 25 bp, Rattus norvegicus
tctccttctgttaagctccttagta

SEQ ID NO: 594503 - DNA, 25 bp, Rattus norvegicus
tctccttctgtttagctccttagta

SEQ ID NO: 594504 - DNA, 25 bp, Rattus norvegicus
tctccttgactgcacgctgaactca

SEQ ID NO: 594505 - DNA, 25 bp, Rattus norvegicus
tctccttgactggacgctgaactca

SEQ ID NO: 594506 - DNA, 25 bp, Rattus norvegicus
tctccttgaggactaccagatcatt

SEQ ID NO: 594507 - DNA, 25 bp, Rattus norvegicus
tctccttgaggagtaccagatcatt

SEQ ID NO: 594508 - DNA, 25 bp, Rattus norvegicus
tctccttgcaccagtttcaaatcaa

SEQ ID NO: 594509 - DNA, 25 bp, Rattus norvegicus
tctccttgcacctgtttcaaatcaa

SEQ ID NO: 594510 - DNA, 25 bp, Rattus norvegicus
tctccttgcctcatgtaactatttt

SEQ ID NO: 594511 - DNA, 25 bp, Rattus norvegicus
tctccttgcctcttgtaactatttt

SEQ ID NO: 594512 - DNA, 25 bp, Rattus norvegicus
tctccttgcctgacaaacactctaa

SEQ ID NO: 594513 - DNA, 25 bp, Rattus norvegicus
tctccttgcctgtcaaacactctaa

SEQ ID NO: 594514 - DNA, 25 bp, Rattus norvegicus
tctccttgcggtactcgtcacggtt

SEQ ID NO: 594515 - DNA, 25 bp, Rattus norvegicus
tctccttgcggttctcgtcacggtt

SEQ ID NO: 594516 - DNA, 25 bp, Rattus norvegicus
tctccttgctgcctgcttagtagaa

SEQ ID NO: 594517 - DNA, 25 bp, Rattus norvegicus
tctccttgctgcgtgcttagtagaa

SEQ ID NO: 594518 - DNA, 25 bp, Rattus norvegicus
tctccttggagaaggcgctaactga

SEQ ID NO: 594519 - DNA, 25 bp, Rattus norvegicus
tctccttggagaccctggtttgaag

SEQ ID NO: 594520 - DNA, 25 bp, Rattus norvegicus
tctccttggagagcctggtttgaag

SEQ ID NO: 594521 - DNA, 25 bp, Rattus norvegicus
tctccttggagatggcgctaactga

SEQ ID NO: 594522 - DNA, 25 bp, Rattus norvegicus
tctccttggatgcaggttggacaat

SEQ ID NO: 594523 - DNA, 25 bp, Rattus norvegicus
tctccttggatggaggttggacaat

SEQ ID NO: 594524 - DNA, 25 bp, Rattus norvegicus
tctccttggctgagtctacggtaga

SEQ ID NO: 594525 - DNA, 25 bp, Rattus norvegicus
tctccttggctgtgtctacggtaga

SEQ ID NO: 594526 - DNA, 25 bp, Rattus norvegicus
tctccttggcttcagttcattctgg

SEQ ID NO: 594527 - DNA, 25 bp, Rattus norvegicus
tctccttggcttgagttcattctgg

SEQ ID NO: 594528 - DNA, 25 bp, Rattus norvegicus
tctccttgggttctgccttcatcaa

SEQ ID NO: 594529 - DNA, 25 bp, Rattus norvegicus
tctccttgggttgtgccttcatcaa

SEQ ID NO: 594530 - DNA, 25 bp, Rattus norvegicus
tctccttggtgtatccctagtacca

SEQ ID NO: 594531 - DNA, 25 bp, Rattus norvegicus
tctccttggtgtttccctagtacca

SEQ ID NO: 594532 - DNA, 25 bp, Rattus norvegicus
tctccttgtagtaaaagcaccccag

SEQ ID NO: 594533 - DNA, 25 bp, Rattus norvegicus
tctccttgtagttaaagcaccccag

SEQ ID NO: 594534 - DNA, 25 bp, Rattus norvegicus
tctccttgtgtaactgctgtttttt

SEQ ID NO: 594535 - DNA, 25 bp, Rattus norvegicus
tctccttgtgtaagtctcacttgtg

SEQ ID NO: 594536 - DNA, 25 bp, Rattus norvegicus
tctccttgtgtatctgctgtttttt

SEQ ID NO: 594537 - DNA, 25 bp, Rattus norvegicus
tctccttgtgtatgtctcacttgtg

SEQ ID NO: 594538 - DNA, 25 bp, Rattus norvegicus
tctcctttaatgagccaagattctg

SEQ ID NO: 594539 - DNA, 25 bp, Rattus norvegicus
tctcctttaatgtgccaagattctg

SEQ ID NO: 594540 - DNA, 25 bp, Rattus norvegicus
tctcctttaccaaaacttgtccgtg

SEQ ID NO: 594541 - DNA, 25 bp, Rattus norvegicus
tctcctttaccataacttgtccgtg

SEQ ID NO: 594542 - DNA, 25 bp, Rattus norvegicus
tctcctttagtaattgtctgctgca

SEQ ID NO: 594543 - DNA, 25 bp, Rattus norvegicus
tctcctttagtatttgtctgctgca

SEQ ID NO: 594544 - DNA, 25 bp, Rattus norvegicus
tctcctttagttaggcgggtgaaat

SEQ ID NO: 594545 - DNA, 25 bp, Rattus norvegicus
tctcctttagtttggcgggtgaaat

SEQ ID NO: 594546 - DNA, 25 bp, Rattus norvegicus
tctcctttcattcctaaacctgatc

SEQ ID NO: 594547 - DNA, 25 bp, Rattus norvegicus
tctcctttcattgctaaacctgatc

SEQ ID NO: 594548 - DNA, 25 bp, Rattus norvegicus
tctcctttccaccaaagccaggttt

SEQ ID NO: 594549 - DNA, 25 bp, Rattus norvegicus
tctcctttccacgaaagccaggttt

SEQ ID NO: 594550 - DNA, 25 bp, Rattus norvegicus
tctcctttcctcagtagttcattat

SEQ ID NO: 594551 - DNA, 25 bp, Rattus norvegicus
tctcctttcctctgtagttcattat

SEQ ID NO: 594552 - DNA, 25 bp, Rattus norvegicus
tctcctttcctgagttttccagatg

SEQ ID NO: 594553 - DNA, 25 bp, Rattus norvegicus
tctcctttcctgtgttttccagatg

SEQ ID NO: 594554 - DNA, 25 bp, Rattus norvegicus
tctcctttcgacatgcttttatggt

SEQ ID NO: 594555 - DNA, 25 bp, Rattus norvegicus
tctcctttcgacttgcttttatggt

SEQ ID NO: 594556 - DNA, 25 bp, Rattus norvegicus
tctcctttcgcgatgacgtcagcct

SEQ ID NO: 594557 - DNA, 25 bp, Rattus norvegicus
tctcctttcgcgttgacgtcagcct

SEQ ID NO: 594558 - DNA, 25 bp, Rattus norvegicus
tctcctttctcacatgtcaaacgtg

SEQ ID NO: 594559 - DNA, 25 bp, Rattus norvegicus
tctcctttctcagatgtcaaacgtg

SEQ ID NO: 594560 - DNA, 25 bp, Rattus norvegicus
tctcctttctctactctgggataag

SEQ ID NO: 594561 - DNA, 25 bp, Rattus norvegicus
tctcctttctcttctctgggataag

SEQ ID NO: 594562 - DNA, 25 bp, Rattus norvegicus
tctcctttgcctcacctctttttaa

SEQ ID NO: 594563 - DNA, 25 bp, Rattus norvegicus
tctcctttgcctgacctctttttaa

SEQ ID NO: 594564 - DNA, 25 bp, Rattus norvegicus
tctcctttgcgcatcctagattata

SEQ ID NO: 594565 - DNA, 25 bp, Rattus norvegicus
tctcctttgcgcttcctagattata

SEQ ID NO: 594566 - DNA, 25 bp, Rattus norvegicus
tctcctttgcttctactgtcaacta

SEQ ID NO: 594567 - DNA, 25 bp, Rattus norvegicus
tctcctttgcttgtactgtcaacta

SEQ ID NO: 594568 - DNA, 25 bp, Rattus norvegicus
tctcctttgtttacactccactgtg

SEQ ID NO: 594569 - DNA, 25 bp, Rattus norvegicus
tctcctttgttttcactccactgtg

SEQ ID NO: 594570 - DNA, 25 bp, Rattus norvegicus
tctccttttcctaggcacttacata

SEQ ID NO: 594571 - DNA, 25 bp, Rattus norvegicus
tctccttttccttggcacttacata

SEQ ID NO: 594572 - DNA, 25 bp, Rattus norvegicus
tctccttttcttctgtttgctagct

SEQ ID NO: 594573 - DNA, 25 bp, Rattus norvegicus
tctccttttcttgtgtttgctagct

SEQ ID NO: 594574 - DNA, 25 bp, Rattus norvegicus
tctcctttttcaatcccttgggaag

SEQ ID NO: 594575 - DNA, 25 bp, Rattus norvegicus
tctcctttttcattcccttgggaag

SEQ ID NO: 594576 - DNA, 25 bp, Rattus norvegicus
tctcctttttctcttgggttggcaa

SEQ ID NO: 594577 - DNA, 25 bp, Rattus norvegicus
tctcctttttctgttgggttggcaa

SEQ ID NO: 594578 - DNA, 25 bp, Rattus norvegicus
tctcgaacccatcggcactagagaa

SEQ ID NO: 594579 - DNA, 25 bp, Rattus norvegicus
tctcgaacccatgggcactagagaa

SEQ ID NO: 594580 - DNA, 25 bp, Rattus norvegicus
tctcgaactcttattctccctgtag

SEQ ID NO: 594581 - DNA, 25 bp, Rattus norvegicus
tctcgaactctttttctccctgtag

SEQ ID NO: 594582 - DNA, 25 bp, Rattus norvegicus
tctcgaactggaacgggttgtagaa

SEQ ID NO: 594583 - DNA, 25 bp, Rattus norvegicus
tctcgaactggatcgggttgtagaa

SEQ ID NO: 594584 - DNA, 25 bp, Rattus norvegicus
tctcgacagaacagcccttggtgat

SEQ ID NO: 594585 - DNA, 25 bp, Rattus norvegicus
tctcgacagaactgcccttggtgat

SEQ ID NO: 594586 - DNA, 25 bp, Rattus norvegicus
tctcgacagagaactcggcaccatt

SEQ ID NO: 594587 - DNA, 25 bp, Rattus norvegicus
tctcgacagagatctcggcaccatt

SEQ ID NO: 594588 - DNA, 25 bp, Rattus norvegicus
tctcgacattttactttcatcttgc

SEQ ID NO: 594589 - DNA, 25 bp, Rattus norvegicus
tctcgacatttttctttcatcttgc

SEQ ID NO: 594590 - DNA, 25 bp, Rattus norvegicus
tctcgaccctgtacaggtcatgtat

SEQ ID NO: 594591 - DNA, 25 bp, Rattus norvegicus
tctcgaccctgttcaggtcatgtat

SEQ ID NO: 594592 - DNA, 25 bp, Rattus norvegicus
tctcgacggccgacagggcgatgaa

SEQ ID NO: 594593 - DNA, 25 bp, Rattus norvegicus
tctcgacggccgtcagggcgatgaa

SEQ ID NO: 594594 - DNA, 25 bp, Rattus norvegicus
tctcgactggccacatgttctttta

SEQ ID NO: 594595 - DNA, 25 bp, Rattus norvegicus
tctcgactggcctcatgttctttta

SEQ ID NO: 594596 - DNA, 25 bp, Rattus norvegicus
tctcgagatgtgagctgtcagccac

SEQ ID NO: 594597 - DNA, 25 bp, Rattus norvegicus
tctcgagatgtgtgctgtcagccac

SEQ ID NO: 594598 - DNA, 25 bp, Rattus norvegicus
tctcgagcatcaagttccctagcat

SEQ ID NO: 594599 - DNA, 25 bp, Rattus norvegicus
tctcgagcatcatgttccctagcat

SEQ ID NO: 594600 - DNA, 25 bp, Rattus norvegicus
tctcgagccattctccttgagaaag

SEQ ID NO: 594601 - DNA, 25 bp, Rattus norvegicus
tctcgagccattgtccttgagaaag

SEQ ID NO: 594602 - DNA, 25 bp, Rattus norvegicus
tctcgagccttccttgggagaacat

SEQ ID NO: 594603 - DNA, 25 bp, Rattus norvegicus
tctcgagccttcgttgggagaacat

SEQ ID NO: 594604 - DNA, 25 bp, Rattus norvegicus
tctcgagctcttccctttattttat

SEQ ID NO: 594605 - DNA, 25 bp, Rattus norvegicus
tctcgagctcttgcctttattttat

SEQ ID NO: 594606 - DNA, 25 bp, Rattus norvegicus
tctcgaggctctcatgggcattcca

SEQ ID NO: 594607 - DNA, 25 bp, Rattus norvegicus
tctcgaggctctgatgggcattcca

SEQ ID NO: 594608 - DNA, 25 bp, Rattus norvegicus
tctcgaggttgcacttggtgttcaa

SEQ ID NO: 594609 - DNA, 25 bp, Rattus norvegicus
tctcgaggttgctcttggtgttcaa

SEQ ID NO: 594610 - DNA, 25 bp, Rattus norvegicus
tctcgagtttccaagaggccatggt

SEQ ID NO: 594611 - DNA, 25 bp, Rattus norvegicus
tctcgagtttcctagaggccatggt

SEQ ID NO: 594612 - DNA, 25 bp, Rattus norvegicus
tctcgataactgacgcgtagcttct

SEQ ID NO: 594613 - DNA, 25 bp, Rattus norvegicus
tctcgataactgtcgcgtagcttct

SEQ ID NO: 594614 - DNA, 25 bp, Rattus norvegicus
tctcgataccagagattgctttcct

SEQ ID NO: 594615 - DNA, 25 bp, Rattus norvegicus
tctcgataccagtgattgctttcct

SEQ ID NO: 594616 - DNA, 25 bp, Rattus norvegicus
tctcgatggcctaggtgatgaggtc

SEQ ID NO: 594617 - DNA, 25 bp, Rattus norvegicus
tctcgatggccttggtgatgaggtc

SEQ ID NO: 594618 - DNA, 25 bp, Rattus norvegicus
tctcgatgtctccatggtgacaact

SEQ ID NO: 594619 - DNA, 25 bp, Rattus norvegicus
tctcgatgtctcgatggtgacaact

SEQ ID NO: 594620 - DNA, 25 bp, Rattus norvegicus
tctcgattatttagcacctctacag

SEQ ID NO: 594621 - DNA, 25 bp, Rattus norvegicus
tctcgattattttgcacctctacag

SEQ ID NO: 594622 - DNA, 25 bp, Rattus norvegicus
tctcgcaagtccatcagcttaatgt

SEQ ID NO: 594623 - DNA, 25 bp, Rattus norvegicus
tctcgcaagtccttcagcttaatgt

SEQ ID NO: 594624 - DNA, 25 bp, Rattus norvegicus
tctcgcacagtgcaatgccatcaag

SEQ ID NO: 594625 - DNA, 25 bp, Rattus norvegicus
tctcgcacagtggaatgccatcaag

SEQ ID NO: 594626 - DNA, 25 bp, Rattus norvegicus
tctcgcactgtgatttcactgtgaa

SEQ ID NO: 594627 - DNA, 25 bp, Rattus norvegicus
tctcgcactgtgttttcactgtgaa

SEQ ID NO: 594628 - DNA, 25 bp, Rattus norvegicus
tctcgcagcagcactgggctaggga

SEQ ID NO: 594629 - DNA, 25 bp, Rattus norvegicus
tctcgcagcagctctgggctaggga

SEQ ID NO: 594630 - DNA, 25 bp, Rattus norvegicus
tctcgcagtattatcaatgcagttg

SEQ ID NO: 594631 - DNA, 25 bp, Rattus norvegicus
tctcgcagtattttcaatgcagttg

SEQ ID NO: 594632 - DNA, 25 bp, Rattus norvegicus
tctcgcattgcgactgaaaagaaat

SEQ ID NO: 594633 - DNA, 25 bp, Rattus norvegicus
tctcgcattgcgtctgaaaagaaat

SEQ ID NO: 594634 - DNA, 25 bp, Rattus norvegicus
tctcgccagaacagcagttgacttc

SEQ ID NO: 594635 - DNA, 25 bp, Rattus norvegicus
tctcgccagaactgcagttgacttc

SEQ ID NO: 594636 - DNA, 25 bp, Rattus norvegicus
tctcgccagggtcgatggccccttt

SEQ ID NO: 594637 - DNA, 25 bp, Rattus norvegicus
tctcgccagggtggatggccccttt

SEQ ID NO: 594638 - DNA, 25 bp, Rattus norvegicus
tctcgccagtatcctttcaaactaa

SEQ ID NO: 594639 - DNA, 25 bp, Rattus norvegicus
tctcgccagtatgctttcaaactaa

SEQ ID NO: 594640 - DNA, 25 bp, Rattus norvegicus
tctcgccccatcaacatttagtttg

SEQ ID NO: 594641 - DNA, 25 bp, Rattus norvegicus
tctcgccccatctacatttagtttg

SEQ ID NO: 594642 - DNA, 25 bp, Rattus norvegicus
tctcgcctgctcaaatcagtgaggt

SEQ ID NO: 594643 - DNA, 25 bp, Rattus norvegicus
tctcgcctgctctaatcagtgaggt

SEQ ID NO: 594644 - DNA, 25 bp, Rattus norvegicus
tctcgcctgtgtattggacggtaac

SEQ ID NO: 594645 - DNA, 25 bp, Rattus norvegicus
tctcgcctgtgttttggacggtaac

SEQ ID NO: 594646 - DNA, 25 bp, Rattus norvegicus
tctcgcctgtttcgttggctgtttc

SEQ ID NO: 594647 - DNA, 25 bp, Rattus norvegicus
tctcgcctgtttggttggctgtttc

SEQ ID NO: 594648 - DNA, 25 bp, Rattus norvegicus
tctcgcctttccatggcaggtaaaa

SEQ ID NO: 594649 - DNA, 25 bp, Rattus norvegicus
tctcgcctttccttggcaggtaaaa

SEQ ID NO: 594650 - DNA, 25 bp, Rattus norvegicus
tctcgcctttttccgaatggtggat

SEQ ID NO: 594651 - DNA, 25 bp, Rattus norvegicus
tctcgcctttttgcgaatggtggat

SEQ ID NO: 594652 - DNA, 25 bp, Rattus norvegicus
tctcgcgaggcccagccagagcaga

SEQ ID NO: 594653 - DNA, 25 bp, Rattus norvegicus
tctcgcgaggccgagccagagcaga

SEQ ID NO: 594654 - DNA, 25 bp, Rattus norvegicus
tctcgctctcttcaacacataactt

SEQ ID NO: 594655 - DNA, 25 bp, Rattus norvegicus
tctcgctctcttgaacacataactt

SEQ ID NO: 594656 - DNA, 25 bp, Rattus norvegicus
tctcgctgagccctgaataaggttt

SEQ ID NO: 594657 - DNA, 25 bp, Rattus norvegicus
tctcgctgagccgtgaataaggttt

SEQ ID NO: 594658 - DNA, 25 bp, Rattus norvegicus
tctcgctgatctccaggcgcaggta

SEQ ID NO: 594659 - DNA, 25 bp, Rattus norvegicus
tctcgctgatctgcaggcgcaggta

SEQ ID NO: 594660 - DNA, 25 bp, Rattus norvegicus
tctcgcttaagccatgatcatctga

SEQ ID NO: 594661 - DNA, 25 bp, Rattus norvegicus
tctcgcttaagcgatgatcatctga

SEQ ID NO: 594662 - DNA, 25 bp, Rattus norvegicus
tctcgctttcccattcaggtaaaat

SEQ ID NO: 594663 - DNA, 25 bp, Rattus norvegicus
tctcgctttccctttcaggtaaaat

SEQ ID NO: 594664 - DNA, 25 bp, Rattus norvegicus
tctcgctttttcacttacttgtagg

SEQ ID NO: 594665 - DNA, 25 bp, Rattus norvegicus
tctcgctttttctcttacttgtagg

SEQ ID NO: 594666 - DNA, 25 bp, Rattus norvegicus
tctcggaacgagactcctatgggaa

SEQ ID NO: 594667 - DNA, 25 bp, Rattus norvegicus
tctcggaacgagtctcctatgggaa

SEQ ID NO: 594668 - DNA, 25 bp, Rattus norvegicus
tctcggaaggccactgacgctggta

SEQ ID NO: 594669 - DNA, 25 bp, Rattus norvegicus
tctcggaaggcctctgacgctggta

SEQ ID NO: 594670 - DNA, 25 bp, Rattus norvegicus
tctcggacaaagatctcctcaactt

SEQ ID NO: 594671 - DNA, 25 bp, Rattus norvegicus
tctcggacaaagttctcctcaactt

SEQ ID NO: 594672 - DNA, 25 bp, Rattus norvegicus
tctcggagaaataccagctcttcac

SEQ ID NO: 594673 - DNA, 25 bp, Rattus norvegicus
tctcggagaaattccagctcttcac

SEQ ID NO: 594674 - DNA, 25 bp, Rattus norvegicus
tctcggagaactaccagcagcagca

SEQ ID NO: 594675 - DNA, 25 bp, Rattus norvegicus
tctcggagaacttccagcagcagca

SEQ ID NO: 594676 - DNA, 25 bp, Rattus norvegicus
tctcggagaagcacttcaccagcag

SEQ ID NO: 594677 - DNA, 25 bp, Rattus norvegicus
tctcggagaagctcttcaccagcag

SEQ ID NO: 594678 - DNA, 25 bp, Rattus norvegicus
tctcggagctgaccgtctgcagtgt

SEQ ID NO: 594679 - DNA, 25 bp, Rattus norvegicus
tctcggagctgagcgtctgcagtgt

SEQ ID NO: 594680 - DNA, 25 bp, Rattus norvegicus
tctcggaggccacactttgcaggga

SEQ ID NO: 594681 - DNA, 25 bp, Rattus norvegicus
tctcggaggccagactttgcaggga

SEQ ID NO: 594682 - DNA, 25 bp, Rattus norvegicus
tctcggagtccaccaatatgtgggt

SEQ ID NO: 594683 - DNA, 25 bp, Rattus norvegicus
tctcggagtccagcaatatgtgggt

SEQ ID NO: 594684 - DNA, 25 bp, Rattus norvegicus
tctcggatgtaaaaccgggcgccca

SEQ ID NO: 594685 - DNA, 25 bp, Rattus norvegicus
tctcggatgtaataccgggcgccca

SEQ ID NO: 594686 - DNA, 25 bp, Rattus norvegicus
tctcggcacactagaactttagcat

SEQ ID NO: 594687 - DNA, 25 bp, Rattus norvegicus
tctcggcacacttgaactttagcat

SEQ ID NO: 594688 - DNA, 25 bp, Rattus norvegicus
tctcggcagctgactgtacacttag

SEQ ID NO: 594689 - DNA, 25 bp, Rattus norvegicus
tctcggcagctgtctgtacacttag

SEQ ID NO: 594690 - DNA, 25 bp, Rattus norvegicus
tctcggccggcgcatggcgtggctg

SEQ ID NO: 594691 - DNA, 25 bp, Rattus norvegicus
tctcggccggcggatggcgtggctg

SEQ ID NO: 594692 - DNA, 25 bp, Rattus norvegicus
tctcggccgtggctcagacgttcac

SEQ ID NO: 594693 - DNA, 25 bp, Rattus norvegicus
tctcggccgtgggtcagacgttcac

SEQ ID NO: 594694 - DNA, 25 bp, Rattus norvegicus
tctcggcgggcactttacgtgtgac

SEQ ID NO: 594695 - DNA, 25 bp, Rattus norvegicus
tctcggcgggcagtttacgtgtgac

SEQ ID NO: 594696 - DNA, 25 bp, Rattus norvegicus
tctcggctgcctaatcaatgctaaa

SEQ ID NO: 594697 - DNA, 25 bp, Rattus norvegicus
tctcggctgccttatcaatgctaaa

SEQ ID NO: 594698 - DNA, 25 bp, Rattus norvegicus
tctcggcttagcattctgttgtttg

SEQ ID NO: 594699 - DNA, 25 bp, Rattus norvegicus
tctcggcttagctttctgttgtttg

SEQ ID NO: 594700 - DNA, 25 bp, Rattus norvegicus
tctcgggaacacatctgggtgctta

SEQ ID NO: 594701 - DNA, 25 bp, Rattus norvegicus
tctcgggaacacttctgggtgctta

SEQ ID NO: 594702 - DNA, 25 bp, Rattus norvegicus
tctcgggaaggtagaactgcagtgt

SEQ ID NO: 594703 - DNA, 25 bp, Rattus norvegicus
tctcgggaaggttgaactgcagtgt

SEQ ID NO: 594704 - DNA, 25 bp, Rattus norvegicus
tctcgggaattgaagggcctcactc

SEQ ID NO: 594705 - DNA, 25 bp, Rattus norvegicus
tctcgggaattgtagggcctcactc

SEQ ID NO: 594706 - DNA, 25 bp, Rattus norvegicus
tctcgggacagaaacaagcctttta

SEQ ID NO: 594707 - DNA, 25 bp, Rattus norvegicus
tctcgggacagatacaagcctttta

SEQ ID NO: 594708 - DNA, 25 bp, Rattus norvegicus
tctcgggacgcgctgaactgttgac

SEQ ID NO: 594709 - DNA, 25 bp, Rattus norvegicus
tctcgggacgcggtgaactgttgac

SEQ ID NO: 594710 - DNA, 25 bp, Rattus norvegicus
tctcgggactagcactgctgtgaac

SEQ ID NO: 594711 - DNA, 25 bp, Rattus norvegicus
tctcgggactaggactgctgtgaac

SEQ ID NO: 594712 - DNA, 25 bp, Rattus norvegicus
tctcgggagcaaacgcgccgggtcc

SEQ ID NO: 594713 - DNA, 25 bp, Rattus norvegicus
tctcgggagcaatcgcgccgggtcc

SEQ ID NO: 594714 - DNA, 25 bp, Rattus norvegicus
tctcgggaggctcctccgagtcaga

SEQ ID NO: 594715 - DNA, 25 bp, Rattus norvegicus
tctcgggaggctgctccgagtcaga

SEQ ID NO: 594716 - DNA, 25 bp, Rattus norvegicus
tctcgggctctacgaatgctgcaag

SEQ ID NO: 594717 - DNA, 25 bp, Rattus norvegicus
tctcgggctctaggaatgctgcaag

SEQ ID NO: 594718 - DNA, 25 bp, Rattus norvegicus
tctcgggctgggagcgtgtgcttcg

SEQ ID NO: 594719 - DNA, 25 bp, Rattus norvegicus
tctcgggctgggtgcgtgtgcttcg

SEQ ID NO: 594720 - DNA, 25 bp, Rattus norvegicus
tctcgggtgtttcaagcttgtccaa

SEQ ID NO: 594721 - DNA, 25 bp, Rattus norvegicus
tctcgggtgtttgaagcttgtccaa

SEQ ID NO: 594722 - DNA, 25 bp, Rattus norvegicus
tctcgggttcccactagaggatcga

SEQ ID NO: 594723 - DNA, 25 bp, Rattus norvegicus
tctcgggttccctctagaggatcga

SEQ ID NO: 594724 - DNA, 25 bp, Rattus norvegicus
tctcgggttcttctggacagagcca

SEQ ID NO: 594725 - DNA, 25 bp, Rattus norvegicus
tctcgggttcttgtggacagagcca

SEQ ID NO: 594726 - DNA, 25 bp, Rattus norvegicus
tctcgggttgacacttggtcacaaa

SEQ ID NO: 594727 - DNA, 25 bp, Rattus norvegicus
tctcgggttgactcttggtcacaaa

SEQ ID NO: 594728 - DNA, 25 bp, Rattus norvegicus
tctcggtcacttcgttaccttaaat

SEQ ID NO: 594729 - DNA, 25 bp, Rattus norvegicus
tctcggtcacttggttaccttaaat

SEQ ID NO: 594730 - DNA, 25 bp, Rattus norvegicus
tctcggtccaatcagtaatgcagct

SEQ ID NO: 594731 - DNA, 25 bp, Rattus norvegicus
tctcggtccaatgagtaatgcagct

SEQ ID NO: 594732 - DNA, 25 bp, Rattus norvegicus
tctcggtctcaccacactagcatgt

SEQ ID NO: 594733 - DNA, 25 bp, Rattus norvegicus
tctcggtctcacgacactagcatgt

SEQ ID NO: 594734 - DNA, 25 bp, Rattus norvegicus
tctcggtctgtaatcgtcactggaa

SEQ ID NO: 594735 - DNA, 25 bp, Rattus norvegicus
tctcggtctgtattcgtcactggaa

SEQ ID NO: 594736 - DNA, 25 bp, Rattus norvegicus
tctcggtcttcaatgcaaaacggcg

SEQ ID NO: 594737 - DNA, 25 bp, Rattus norvegicus
tctcggtcttcattgcaaaacggcg

SEQ ID NO: 594738 - DNA, 25 bp, Rattus norvegicus
tctcggtgcccgcagagttggcata

SEQ ID NO: 594739 - DNA, 25 bp, Rattus norvegicus
tctcggtgcccggagagttggcata

SEQ ID NO: 594740 - DNA, 25 bp, Rattus norvegicus
tctcggtgccctacacggaaatgaa

SEQ ID NO: 594741 - DNA, 25 bp, Rattus norvegicus
tctcggtgcccttcacggaaatgaa

SEQ ID NO: 594742 - DNA, 25 bp, Rattus norvegicus
tctcggtggctaacgctggtcttaa

SEQ ID NO: 594743 - DNA, 25 bp, Rattus norvegicus
tctcggtggctatcgctggtcttaa

SEQ ID NO: 594744 - DNA, 25 bp, Rattus norvegicus
tctcgtacctacagggcggctccaa

SEQ ID NO: 594745 - DNA, 25 bp, Rattus norvegicus
tctcgtacctactgggcggctccaa

SEQ ID NO: 594746 - DNA, 25 bp, Rattus norvegicus
tctcgtactcttcccaaagttcata

SEQ ID NO: 594747 - DNA, 25 bp, Rattus norvegicus
tctcgtactcttgccaaagttcata

SEQ ID NO: 594748 - DNA, 25 bp, Rattus norvegicus
tctcgtcccatcagctgaatgagtt

SEQ ID NO: 594749 - DNA, 25 bp, Rattus norvegicus
tctcgtcccatctgctgaatgagtt

SEQ ID NO: 594750 - DNA, 25 bp, Rattus norvegicus
tctcgtcggtggatatgccagattt

SEQ ID NO: 594751 - DNA, 25 bp, Rattus norvegicus
tctcgtcggtggttatgccagattt

SEQ ID NO: 594752 - DNA, 25 bp, Rattus norvegicus
tctcgtctcacaagcccggacaaga

SEQ ID NO: 594753 - DNA, 25 bp, Rattus norvegicus
tctcgtctcacatgcccggacaaga

SEQ ID NO: 594754 - DNA, 25 bp, Rattus norvegicus
tctcgtctccttctctggtcaggaa

SEQ ID NO: 594755 - DNA, 25 bp, Rattus norvegicus
tctcgtctccttgtctggtcaggaa

SEQ ID NO: 594756 - DNA, 25 bp, Rattus norvegicus
tctcgtctgatcacggaagctaagc

SEQ ID NO: 594757 - DNA, 25 bp, Rattus norvegicus
tctcgtctgatctcggaagctaagc

SEQ ID NO: 594758 - DNA, 25 bp, Rattus norvegicus
tctcgtgaatccatagtccgtaatt

SEQ ID NO: 594759 - DNA, 25 bp, Rattus norvegicus
tctcgtgaatccttagtccgtaatt

SEQ ID NO: 594760 - DNA, 25 bp, Rattus norvegicus
tctcgtgaccagctgacgtcaggag

SEQ ID NO: 594761 - DNA, 25 bp, Rattus norvegicus
tctcgtgaccaggtgacgtcaggag

SEQ ID NO: 594762 - DNA, 25 bp, Rattus norvegicus
tctcgtgccatgagaaccgccaggt

SEQ ID NO: 594763 - DNA, 25 bp, Rattus norvegicus
tctcgtgccatgtgaaccgccaggt

SEQ ID NO: 594764 - DNA, 25 bp, Rattus norvegicus
tctcgtgccccaaatcaggtggtga

SEQ ID NO: 594765 - DNA, 25 bp, Rattus norvegicus
tctcgtgccccatatcaggtggtga

SEQ ID NO: 594766 - DNA, 25 bp, Rattus norvegicus
tctcgtgcctcgagctcccgttgaa

SEQ ID NO: 594767 - DNA, 25 bp, Rattus norvegicus
tctcgtgcctcgtgctcccgttgaa

SEQ ID NO: 594768 - DNA, 25 bp, Rattus norvegicus
tctcgtggacttatcctcagggata

SEQ ID NO: 594769 - DNA, 25 bp, Rattus norvegicus
tctcgtggacttttcctcagggata

SEQ ID NO: 594770 - DNA, 25 bp, Rattus norvegicus
tctcgtgggagaaggcctgcaccaa

SEQ ID NO: 594771 - DNA, 25 bp, Rattus norvegicus
tctcgtgggagatggcctgcaccaa

SEQ ID NO: 594772 - DNA, 25 bp, Rattus norvegicus
tctcgtgtatatcgtcatcctcctg

SEQ ID NO: 594773 - DNA, 25 bp, Rattus norvegicus
tctcgtgtatatggtcatcctcctg

SEQ ID NO: 594774 - DNA, 25 bp, Rattus norvegicus
tctcgtgtctccacacatttatgta

SEQ ID NO: 594775 - DNA, 25 bp, Rattus norvegicus
tctcgtgtctcctcacatttatgta

SEQ ID NO: 594776 - DNA, 25 bp, Rattus norvegicus
tctcgtgttggtcttgtctgctgct

SEQ ID NO: 594777 - DNA, 25 bp, Rattus norvegicus
tctcgtgttggtgttgtctgctgct

SEQ ID NO: 594778 - DNA, 25 bp, Rattus norvegicus
tctcgttaacttaattcctgcactg

SEQ ID NO: 594779 - DNA, 25 bp, Rattus norvegicus
tctcgttaactttattcctgcactg

SEQ ID NO: 594780 - DNA, 25 bp, Rattus norvegicus
tctcgttacacacatgcctcatagg

SEQ ID NO: 594781 - DNA, 25 bp, Rattus norvegicus
tctcgttacacagatgcctcatagg

SEQ ID NO: 594782 - DNA, 25 bp, Rattus norvegicus
tctcgttctgacaccatgcataatt

SEQ ID NO: 594783 - DNA, 25 bp, Rattus norvegicus
tctcgttctgactccatgcataatt

SEQ ID NO: 594784 - DNA, 25 bp, Rattus norvegicus
tctcgttgccttcggacctatctga

SEQ ID NO: 594785 - DNA, 25 bp, Rattus norvegicus
tctcgttgccttgggacctatctga

SEQ ID NO: 594786 - DNA, 25 bp, Rattus norvegicus
tctcgttgcttgatacagatctgtt

SEQ ID NO: 594787 - DNA, 25 bp, Rattus norvegicus
tctcgttgcttgttacagatctgtt

SEQ ID NO: 594788 - DNA, 25 bp, Rattus norvegicus
tctcgttttcctctttcttattgta

SEQ ID NO: 594789 - DNA, 25 bp, Rattus norvegicus
tctcgttttcctgtttcttattgta

SEQ ID NO: 594790 - DNA, 25 bp, Rattus norvegicus
tctcgttttgacaagactgtggctc

SEQ ID NO: 594791 - DNA, 25 bp, Rattus norvegicus
tctcgttttgactagactgtggctc

SEQ ID NO: 594792 - DNA, 25 bp, Rattus norvegicus
tctctaacaacaccccttcagggtg

SEQ ID NO: 594793 - DNA, 25 bp, Rattus norvegicus
tctctaacaacagcccttcagggtg

SEQ ID NO: 594794 - DNA, 25 bp, Rattus norvegicus
tctctaacctctactcacaaagtgt

SEQ ID NO: 594795 - DNA, 25 bp, Rattus norvegicus
tctctaacctcttctcacaaagtgt

SEQ ID NO: 594796 - DNA, 25 bp, Rattus norvegicus
tctctaacttacagcctcatacata

SEQ ID NO: 594797 - DNA, 25 bp, Rattus norvegicus
tctctaacttactgcctcatacata

SEQ ID NO: 594798 - DNA, 25 bp, Rattus norvegicus
tctctaaggcgtcagccagcagctg

SEQ ID NO: 594799 - DNA, 25 bp, Rattus norvegicus
tctctaaggcgtgagccagcagctg

SEQ ID NO: 594800 - DNA, 25 bp, Rattus norvegicus
tctctaaggctaagggtggctctga

SEQ ID NO: 594801 - DNA, 25 bp, Rattus norvegicus
tctctaaggctatgggtggctctga

SEQ ID NO: 594802 - DNA, 25 bp, Rattus norvegicus
tctctacaacgtcctggccaaggtg

SEQ ID NO: 594803 - DNA, 25 bp, Rattus norvegicus
tctctacaacgtgctggccaaggtg

SEQ ID NO: 594804 - DNA, 25 bp, Rattus norvegicus
tctctacaacttcaaaaggctcttg

SEQ ID NO: 594805 - DNA, 25 bp, Rattus norvegicus
tctctacaacttgaaaaggctcttg

SEQ ID NO: 594806 - DNA, 25 bp, Rattus norvegicus
tctctacaagtcacttcatgccaga

SEQ ID NO: 594807 - DNA, 25 bp, Rattus norvegicus
tctctacaagtctcttcatgccaga

SEQ ID NO: 594808 - DNA, 25 bp, Rattus norvegicus
tctctacactctctttccagactaa

SEQ ID NO: 594809 - DNA, 25 bp, Rattus norvegicus
tctctacactctgtttccagactaa

SEQ ID NO: 594810 - DNA, 25 bp, Rattus norvegicus
tctctacccatgagtaatgtggagt

SEQ ID NO: 594811 - DNA, 25 bp, Rattus norvegicus
tctctacccatgtgtaatgtggagt

SEQ ID NO: 594812 - DNA, 25 bp, Rattus norvegicus
tctctaccccagacttggttgtgta

SEQ ID NO: 594813 - DNA, 25 bp, Rattus norvegicus
tctctaccccagtcttggttgtgta

SEQ ID NO: 594814 - DNA, 25 bp, Rattus norvegicus
tctctacctctgacctaaatgacag

SEQ ID NO: 594815 - DNA, 25 bp, Rattus norvegicus
tctctacctctgtcctaaatgacag

SEQ ID NO: 594816 - DNA, 25 bp, Rattus norvegicus
tctctacctgccagctcaaaagtta

SEQ ID NO: 594817 - DNA, 25 bp, Rattus norvegicus
tctctacctgcctgctcaaaagtta

SEQ ID NO: 594818 - DNA, 25 bp, Rattus norvegicus
tctctacctgttatcctatacatga

SEQ ID NO: 594819 - DNA, 25 bp, Rattus norvegicus
tctctacctgttttcctatacatga

SEQ ID NO: 594820 - DNA, 25 bp, Rattus norvegicus
tctctacctttgctcagatgtcatg

SEQ ID NO: 594821 - DNA, 25 bp, Rattus norvegicus
tctctacctttggtcagatgtcatg

SEQ ID NO: 594822 - DNA, 25 bp, Rattus norvegicus
tctctacggaggatggtttgcttca

SEQ ID NO: 594823 - DNA, 25 bp, Rattus norvegicus
tctctacggaggttggtttgcttca

SEQ ID NO: 594824 - DNA, 25 bp, Rattus norvegicus
tctctactacagctgccacgttaat

SEQ ID NO: 594825 - DNA, 25 bp, Rattus norvegicus
tctctactacaggtgccacgttaat

SEQ ID NO: 594826 - DNA, 25 bp, Rattus norvegicus
tctctactagagatccagcaggaag

SEQ ID NO: 594827 - DNA, 25 bp, Rattus norvegicus
tctctactagagttccagcaggaag

SEQ ID NO: 594828 - DNA, 25 bp, Rattus norvegicus
tctctactccagaggacaggtctga

SEQ ID NO: 594829 - DNA, 25 bp, Rattus norvegicus
tctctactccagtggacaggtctga

SEQ ID NO: 594830 - DNA, 25 bp, Rattus norvegicus
tctctactccgtagtactgtgggac

SEQ ID NO: 594831 - DNA, 25 bp, Rattus norvegicus
tctctactccgttgtactgtgggac

SEQ ID NO: 594832 - DNA, 25 bp, Rattus norvegicus
tctctactctggcacgtatcaggga

SEQ ID NO: 594833 - DNA, 25 bp, Rattus norvegicus
tctctactctgggacgtatcaggga

SEQ ID NO: 594834 - DNA, 25 bp, Rattus norvegicus
tctctactgccacgagtacttcaaa

SEQ ID NO: 594835 - DNA, 25 bp, Rattus norvegicus
tctctactgccaggagtacttcaaa

SEQ ID NO: 594836 - DNA, 25 bp, Rattus norvegicus
tctctagacccgaagctaacacttg

SEQ ID NO: 594837 - DNA, 25 bp, Rattus norvegicus
tctctagacccgtagctaacacttg

SEQ ID NO: 594838 - DNA, 25 bp, Rattus norvegicus
tctctagcaggccagtgtgtcatga

SEQ ID NO: 594839 - DNA, 25 bp, Rattus norvegicus
tctctagcaggcgagtgtgtcatga

SEQ ID NO: 594840 - DNA, 25 bp, Rattus norvegicus
tctctagccccgaaaaagctgaagt

SEQ ID NO: 594841 - DNA, 25 bp, Rattus norvegicus
tctctagccccgtaaaagctgaagt

SEQ ID NO: 594842 - DNA, 25 bp, Rattus norvegicus
tctctagctgtgaggatcgattcat

SEQ ID NO: 594843 - DNA, 25 bp, Rattus norvegicus
tctctagctgtgtggatcgattcat

SEQ ID NO: 594844 - DNA, 25 bp, Rattus norvegicus
tctctaggatacacagggcgcccaa

SEQ ID NO: 594845 - DNA, 25 bp, Rattus norvegicus
tctctaggatactcagggcgcccaa

SEQ ID NO: 594846 - DNA, 25 bp, Rattus norvegicus
tctctaggccaacaaattatttttc

SEQ ID NO: 594847 - DNA, 25 bp, Rattus norvegicus
tctctaggccaagaaattatttttc

SEQ ID NO: 594848 - DNA, 25 bp, Rattus norvegicus
tctctaggcttaatatccacaggga

SEQ ID NO: 594849 - DNA, 25 bp, Rattus norvegicus
tctctaggcttattatccacaggga

SEQ ID NO: 594850 - DNA, 25 bp, Rattus norvegicus
tctctagggctgctgagccctgaga

SEQ ID NO: 594851 - DNA, 25 bp, Rattus norvegicus
tctctagggctggtgagccctgaga

SEQ ID NO: 594852 - DNA, 25 bp, Rattus norvegicus
tctctaggtagacagtcccctctta

SEQ ID NO: 594853 - DNA, 25 bp, Rattus norvegicus
tctctaggtagagagtcccctctta

SEQ ID NO: 594854 - DNA, 25 bp, Rattus norvegicus
tctctaggtagtccccttttgcagg

SEQ ID NO: 594855 - DNA, 25 bp, Rattus norvegicus
tctctaggtagtgcccttttgcagg

SEQ ID NO: 594856 - DNA, 25 bp, Rattus norvegicus
tctctaggtcctactttagctgatt

SEQ ID NO: 594857 - DNA, 25 bp, Rattus norvegicus
tctctaggtccttctttagctgatt

SEQ ID NO: 594858 - DNA, 25 bp, Rattus norvegicus
tctctagtacttattcatctgcggt

SEQ ID NO: 594859 - DNA, 25 bp, Rattus norvegicus
tctctagtactttttcatctgcggt

SEQ ID NO: 594860 - DNA, 25 bp, Rattus norvegicus
tctctagtcccgatcatgttgatgc

SEQ ID NO: 594861 - DNA, 25 bp, Rattus norvegicus
tctctagtcccgttcatgttgatgc

SEQ ID NO: 594862 - DNA, 25 bp, Rattus norvegicus
tctctatactatattgtgcaccaca

SEQ ID NO: 594863 - DNA, 25 bp, Rattus norvegicus
tctctatactattttgtgcaccaca

SEQ ID NO: 594864 - DNA, 25 bp, Rattus norvegicus
tctctatcccggaggcaaagccagt

SEQ ID NO: 594865 - DNA, 25 bp, Rattus norvegicus
tctctatcccggtggcaaagccagt

SEQ ID NO: 594866 - DNA, 25 bp, Rattus norvegicus
tctctatcgcccagtctcttttaga

SEQ ID NO: 594867 - DNA, 25 bp, Rattus norvegicus
tctctatcgccctgtctcttttaga

SEQ ID NO: 594868 - DNA, 25 bp, Rattus norvegicus
tctctatctgcgcagggattcacct

SEQ ID NO: 594869 - DNA, 25 bp, Rattus norvegicus
tctctatctgcggagggattcacct

SEQ ID NO: 594870 - DNA, 25 bp, Rattus norvegicus
tctctatgggatcctcgtcaactta

SEQ ID NO: 594871 - DNA, 25 bp, Rattus norvegicus
tctctatgggatgctcgtcaactta

SEQ ID NO: 594872 - DNA, 25 bp, Rattus norvegicus
tctctatgtaaaccacgctggcctg

SEQ ID NO: 594873 - DNA, 25 bp, Rattus norvegicus
tctctatgtaaagcacgctggcctg

SEQ ID NO: 594874 - DNA, 25 bp, Rattus norvegicus
tctctatgtatgctttcctttataa

SEQ ID NO: 594875 - DNA, 25 bp, Rattus norvegicus
tctctatgtatggtttcctttataa

SEQ ID NO: 594876 - DNA, 25 bp, Rattus norvegicus
tctctatgtgttctgtctggcacaa

SEQ ID NO: 594877 - DNA, 25 bp, Rattus norvegicus
tctctatgtgttgtgtctggcacaa

SEQ ID NO: 594878 - DNA, 25 bp, Rattus norvegicus
tctctattacccaccttaagtgtgg

SEQ ID NO: 594879 - DNA, 25 bp, Rattus norvegicus
tctctattaccctccttaagtgtgg

SEQ ID NO: 594880 - DNA, 25 bp, Rattus norvegicus
tctctattactcaaacctgttgtcc

SEQ ID NO: 594881 - DNA, 25 bp, Rattus norvegicus
tctctattactctaacctgttgtcc

SEQ ID NO: 594882 - DNA, 25 bp, Rattus norvegicus
tctctattatttatattaccacatg

SEQ ID NO: 594883 - DNA, 25 bp, Rattus norvegicus
tctctattatttttattaccacatg

SEQ ID NO: 594884 - DNA, 25 bp, Rattus norvegicus
tctctattcgcccttcagtgtagaa

SEQ ID NO: 594885 - DNA, 25 bp, Rattus norvegicus
tctctattcgccgttcagtgtagaa

SEQ ID NO: 594886 - DNA, 25 bp, Rattus norvegicus
tctctattgtacagcctctgttact

SEQ ID NO: 594887 - DNA, 25 bp, Rattus norvegicus
tctctattgtactgcctctgttact

SEQ ID NO: 594888 - DNA, 25 bp, Rattus norvegicus
tctctattttctcccgtttactaca

SEQ ID NO: 594889 - DNA, 25 bp, Rattus norvegicus
tctctattttctgccgtttactaca

SEQ ID NO: 594890 - DNA, 25 bp, Rattus norvegicus
tctctcaaccatactgcttctggat

SEQ ID NO: 594891 - DNA, 25 bp, Rattus norvegicus
tctctcaaccattctgcttctggat

SEQ ID NO: 594892 - DNA, 25 bp, Rattus norvegicus
tctctcaagcagctcaacctgtggt

SEQ ID NO: 594893 - DNA, 25 bp, Rattus norvegicus
tctctcaagcaggtcaacctgtggt

SEQ ID NO: 594894 - DNA, 25 bp, Rattus norvegicus
tctctcaagttcctgggtgccacag

SEQ ID NO: 594895 - DNA, 25 bp, Rattus norvegicus
tctctcaagttcgtgggtgccacag

SEQ ID NO: 594896 - DNA, 25 bp, Rattus norvegicus
tctctcacactcaaattgcttctca

SEQ ID NO: 594897 - DNA, 25 bp, Rattus norvegicus
tctctcacactctaattgcttctca

SEQ ID NO: 594898 - DNA, 25 bp, Rattus norvegicus
tctctcacaggcacaagactgctta

SEQ ID NO: 594899 - DNA, 25 bp, Rattus norvegicus
tctctcacaggctcaagactgctta

SEQ ID NO: 594900 - DNA, 25 bp, Rattus norvegicus
tctctcaccagccttcaattgtggt

SEQ ID NO: 594901 - DNA, 25 bp, Rattus norvegicus
tctctcaccagcgttcaattgtggt

SEQ ID NO: 594902 - DNA, 25 bp, Rattus norvegicus
tctctcacgtgtcctgtggtagtgt

SEQ ID NO: 594903 - DNA, 25 bp, Rattus norvegicus
tctctcacgtgtgctgtggtagtgt

SEQ ID NO: 594904 - DNA, 25 bp, Rattus norvegicus
tctctcactcgcacagtttttatgt

SEQ ID NO: 594905 - DNA, 25 bp, Rattus norvegicus
tctctcactcgctcagtttttatgt

SEQ ID NO: 594906 - DNA, 25 bp, Rattus norvegicus
tctctcactgacacctgtatattag

SEQ ID NO: 594907 - DNA, 25 bp, Rattus norvegicus
tctctcactgactcctgtatattag

SEQ ID NO: 594908 - DNA, 25 bp, Rattus norvegicus
tctctcactgccattgtgactataa

SEQ ID NO: 594909 - DNA, 25 bp, Rattus norvegicus
tctctcactgcctttgtgactataa

SEQ ID NO: 594910 - DNA, 25 bp, Rattus norvegicus
tctctcagagcccatgaccaggaaa

SEQ ID NO: 594911 - DNA, 25 bp, Rattus norvegicus
tctctcagagccgatgaccaggaaa

SEQ ID NO: 594912 - DNA, 25 bp, Rattus norvegicus
tctctcagatttcccatgacttcaa

SEQ ID NO: 594913 - DNA, 25 bp, Rattus norvegicus
tctctcagatttgccatgacttcaa

SEQ ID NO: 594914 - DNA, 25 bp, Rattus norvegicus
tctctcagccatagtcttctttaag

SEQ ID NO: 594915 - DNA, 25 bp, Rattus norvegicus
tctctcagccattgtcttctttaag

SEQ ID NO: 594916 - DNA, 25 bp, Rattus norvegicus
tctctcagcccgagaatgcggaaag

SEQ ID NO: 594917 - DNA, 25 bp, Rattus norvegicus
tctctcagcccgtgaatgcggaaag

SEQ ID NO: 594918 - DNA, 25 bp, Rattus norvegicus
tctctcagcctgaacgtcacgaaag

SEQ ID NO: 594919 - DNA, 25 bp, Rattus norvegicus
tctctcagcctgtacgtcacgaaag

SEQ ID NO: 594920 - DNA, 25 bp, Rattus norvegicus
tctctcagctcacacaggactgtgg

SEQ ID NO: 594921 - DNA, 25 bp, Rattus norvegicus
tctctcagctcagacaggactgtgg

SEQ ID NO: 594922 - DNA, 25 bp, Rattus norvegicus
tctctcagctctacaggtgaatggt

SEQ ID NO: 594923 - DNA, 25 bp, Rattus norvegicus
tctctcagctcttcaggtgaatggt

SEQ ID NO: 594924 - DNA, 25 bp, Rattus norvegicus
tctctcagctttctacaactttggt

SEQ ID NO: 594925 - DNA, 25 bp, Rattus norvegicus
tctctcagctttgtacaactttggt

SEQ ID NO: 594926 - DNA, 25 bp, Rattus norvegicus
tctctcaggagtagccactggcagg

SEQ ID NO: 594927 - DNA, 25 bp, Rattus norvegicus
tctctcaggagttgccactggcagg

SEQ ID NO: 594928 - DNA, 25 bp, Rattus norvegicus
tctctcagtgagctgtgcttgcgca

SEQ ID NO: 594929 - DNA, 25 bp, Rattus norvegicus
tctctcagtgaggtgtgcttgcgca

SEQ ID NO: 594930 - DNA, 25 bp, Rattus norvegicus
tctctcataccgacaacaccatttg

SEQ ID NO: 594931 - DNA, 25 bp, Rattus norvegicus
tctctcataccgtcaacaccatttg

SEQ ID NO: 594932 - DNA, 25 bp, Rattus norvegicus
tctctcatatctctacttatacctc

SEQ ID NO: 594933 - DNA, 25 bp, Rattus norvegicus
tctctcatatctctgcccaatcaat

SEQ ID NO: 594934 - DNA, 25 bp, Rattus norvegicus
tctctcatatctgtacttatacctc

SEQ ID NO: 594935 - DNA, 25 bp, Rattus norvegicus
tctctcatatctgtgcccaatcaat

SEQ ID NO: 594936 - DNA, 25 bp, Rattus norvegicus
tctctcatcctacccagtggtggtg

SEQ ID NO: 594937 - DNA, 25 bp, Rattus norvegicus
tctctcatcctagccagtggtggtg

SEQ ID NO: 594938 - DNA, 25 bp, Rattus norvegicus
tctctcatcctcattctatgtgtat

SEQ ID NO: 594939 - DNA, 25 bp, Rattus norvegicus
tctctcatcctctttctatgtgtat

SEQ ID NO: 594940 - DNA, 25 bp, Rattus norvegicus
tctctcatctgacgctttctgcaat

SEQ ID NO: 594941 - DNA, 25 bp, Rattus norvegicus
tctctcatctgaggctttctgcaat

SEQ ID NO: 594942 - DNA, 25 bp, Rattus norvegicus
tctctcattagaccaccataccatg

SEQ ID NO: 594943 - DNA, 25 bp, Rattus norvegicus
tctctcattagagcaccataccatg

SEQ ID NO: 594944 - DNA, 25 bp, Rattus norvegicus
tctctcatttaaatttgtttagcag

SEQ ID NO: 594945 - DNA, 25 bp, Rattus norvegicus
tctctcatttaattttgtttagcag

SEQ ID NO: 594946 - DNA, 25 bp, Rattus norvegicus
tctctccaaccgaggcagtttccat

SEQ ID NO: 594947 - DNA, 25 bp, Rattus norvegicus
tctctccaaccgtggcagtttccat

SEQ ID NO: 594948 - DNA, 25 bp, Rattus norvegicus
tctctccaccttccagcaaatgtgg

SEQ ID NO: 594949 - DNA, 25 bp, Rattus norvegicus
tctctccaccttgcagcaaatgtgg

SEQ ID NO: 594950 - DNA, 25 bp, Rattus norvegicus
tctctccagacgcattgtgggtaca

SEQ ID NO: 594951 - DNA, 25 bp, Rattus norvegicus
tctctccagacggattgtgggtaca

SEQ ID NO: 594952 - DNA, 25 bp, Rattus norvegicus
tctctccagcagctttggcaacgga

SEQ ID NO: 594953 - DNA, 25 bp, Rattus norvegicus
tctctccagcaggtttggcaacgga

SEQ ID NO: 594954 - DNA, 25 bp, Rattus norvegicus
tctctccagcccattgatactggaa

SEQ ID NO: 594955 - DNA, 25 bp, Rattus norvegicus
tctctccagccctttgatactggaa

SEQ ID NO: 594956 - DNA, 25 bp, Rattus norvegicus
tctctccagccgcaaagtagtgata

SEQ ID NO: 594957 - DNA, 25 bp, Rattus norvegicus
tctctccagccggaaagtagtgata

SEQ ID NO: 594958 - DNA, 25 bp, Rattus norvegicus
tctctccagctcatatgttcagatg

SEQ ID NO: 594959 - DNA, 25 bp, Rattus norvegicus
tctctccagctcttatgttcagatg

SEQ ID NO: 594960 - DNA, 25 bp, Rattus norvegicus
tctctccaggttccagtgtgacgta

SEQ ID NO: 594961 - DNA, 25 bp, Rattus norvegicus
tctctccaggttgcagtgtgacgta

SEQ ID NO: 594962 - DNA, 25 bp, Rattus norvegicus
tctctccagttcattactctttgat

SEQ ID NO: 594963 - DNA, 25 bp, Rattus norvegicus
tctctccagttctttactctttgat

SEQ ID NO: 594964 - DNA, 25 bp, Rattus norvegicus
tctctccataacaatctgtgatgat

SEQ ID NO: 594965 - DNA, 25 bp, Rattus norvegicus
tctctccataactatctgtgatgat

SEQ ID NO: 594966 - DNA, 25 bp, Rattus norvegicus
tctctccataggcacttgccagatg

SEQ ID NO: 594967 - DNA, 25 bp, Rattus norvegicus
tctctccatagggacttgccagatg

SEQ ID NO: 594968 - DNA, 25 bp, Rattus norvegicus
tctctccatggtagacagtgagcca

SEQ ID NO: 594969 - DNA, 25 bp, Rattus norvegicus
tctctccatggttgacagtgagcca

SEQ ID NO: 594970 - DNA, 25 bp, Rattus norvegicus
tctctcccaactatgaccatgtggt

SEQ ID NO: 594971 - DNA, 25 bp, Rattus norvegicus
tctctcccaactttgaccatgtggt

SEQ ID NO: 594972 - DNA, 25 bp, Rattus norvegicus
tctctcccacagaaggtgccagctt

SEQ ID NO: 594973 - DNA, 25 bp, Rattus norvegicus
tctctcccacagtaggtgccagctt

SEQ ID NO: 594974 - DNA, 25 bp, Rattus norvegicus
tctctcccacgcacaagcaataaaa

SEQ ID NO: 594975 - DNA, 25 bp, Rattus norvegicus
tctctcccacgctcaagcaataaaa

SEQ ID NO: 594976 - DNA, 25 bp, Rattus norvegicus
tctctcccagacacatagcatcaat

SEQ ID NO: 594977 - DNA, 25 bp, Rattus norvegicus
tctctcccagactcatagcatcaat

SEQ ID NO: 594978 - DNA, 25 bp, Rattus norvegicus
tctctccccaacatccaaaaagtgg

SEQ ID NO: 594979 - DNA, 25 bp, Rattus norvegicus
tctctccccaacttccaaaaagtgg

SEQ ID NO: 594980 - DNA, 25 bp, Rattus norvegicus
tctctccccagacttatttaaaaga

SEQ ID NO: 594981 - DNA, 25 bp, Rattus norvegicus
tctctccccagagttatttaaaaga

SEQ ID NO: 594982 - DNA, 25 bp, Rattus norvegicus
tctctcccctcaaggatgttatagg

SEQ ID NO: 594983 - DNA, 25 bp, Rattus norvegicus
tctctcccctcatggatgttatagg

SEQ ID NO: 594984 - DNA, 25 bp, Rattus norvegicus
tctctcccctgtaacctgtttatta

SEQ ID NO: 594985 - DNA, 25 bp, Rattus norvegicus
tctctcccctgttacctgtttatta

SEQ ID NO: 594986 - DNA, 25 bp, Rattus norvegicus
tctctcccgtgtccacttctgtagg

SEQ ID NO: 594987 - DNA, 25 bp, Rattus norvegicus
tctctcccgtgtgcacttctgtagg

SEQ ID NO: 594988 - DNA, 25 bp, Rattus norvegicus
tctctccctaggcaaaccgggtgaa

SEQ ID NO: 594989 - DNA, 25 bp, Rattus norvegicus
tctctccctagggaaaccgggtgaa

SEQ ID NO: 594990 - DNA, 25 bp, Rattus norvegicus
tctctccctcttaccataaatatgt

SEQ ID NO: 594991 - DNA, 25 bp, Rattus norvegicus
tctctccctctttccataaatatgt

SEQ ID NO: 594992 - DNA, 25 bp, Rattus norvegicus
tctctccctgaaatgtgtttgctga

SEQ ID NO: 594993 - DNA, 25 bp, Rattus norvegicus
tctctccctgaattgtgtttgctga

SEQ ID NO: 594994 - DNA, 25 bp, Rattus norvegicus
tctctccctttgattatttcttact

SEQ ID NO: 594995 - DNA, 25 bp, Rattus norvegicus
tctctccctttgtttatttcttact

SEQ ID NO: 594996 - DNA, 25 bp, Rattus norvegicus
tctctccgctgtaaatatgtcttct

SEQ ID NO: 594997 - DNA, 25 bp, Rattus norvegicus
tctctccgctgttaatatgtcttct

SEQ ID NO: 594998 - DNA, 25 bp, Rattus norvegicus
tctctcctaacaaggttccatcaag

SEQ ID NO: 594999 - DNA, 25 bp, Rattus norvegicus
tctctcctaacatggttccatcaag

SEQ ID NO: 595000 - DNA, 25 bp, Rattus norvegicus
tctctcctagcaatgtgggcttcac

SEQ ID NO: 595001 - DNA, 25 bp, Rattus norvegicus
tctctcctagcattgtgggcttcac

SEQ ID NO: 595002 - DNA, 25 bp, Rattus norvegicus
tctctcctattcagttgttcccaag

SEQ ID NO: 595003 - DNA, 25 bp, Rattus norvegicus
tctctcctattctgttgttcccaag

SEQ ID NO: 595004 - DNA, 25 bp, Rattus norvegicus
tctctcctcctaaccttgaagaaag

SEQ ID NO: 595005 - DNA, 25 bp, Rattus norvegicus
tctctcctcctatccttgaagaaag

SEQ ID NO: 595006 - DNA, 25 bp, Rattus norvegicus
tctctcctcttgctttattttctta

SEQ ID NO: 595007 - DNA, 25 bp, Rattus norvegicus
tctctcctcttggtttattttctta

SEQ ID NO: 595008 - DNA, 25 bp, Rattus norvegicus
tctctcctgaacactctggaaggct

SEQ ID NO: 595009 - DNA, 25 bp, Rattus norvegicus
tctctcctgaactctctggaaggct

SEQ ID NO: 595010 - DNA, 25 bp, Rattus norvegicus
tctctcctgaggctgtctgttacac

SEQ ID NO: 595011 - DNA, 25 bp, Rattus norvegicus
tctctcctgagggtgtctgttacac

SEQ ID NO: 595012 - DNA, 25 bp, Rattus norvegicus
tctctcctggttccgaaatggactt

SEQ ID NO: 595013 - DNA, 25 bp, Rattus norvegicus
tctctcctggttgcgaaatggactt

SEQ ID NO: 595014 - DNA, 25 bp, Rattus norvegicus
tctctcctgtgtctatgttggccaa

SEQ ID NO: 595015 - DNA, 25 bp, Rattus norvegicus
tctctcctgtgtgtatgttggccaa

SEQ ID NO: 595016 - DNA, 25 bp, Rattus norvegicus
tctctccttcagaaagctttgtctt

SEQ ID NO: 595017 - DNA, 25 bp, Rattus norvegicus
tctctccttcagtaagctttgtctt

SEQ ID NO: 595018 - DNA, 25 bp, Rattus norvegicus
tctctccttttcctatttggatttt

SEQ ID NO: 595019 - DNA, 25 bp, Rattus norvegicus
tctctccttttcgtatttggatttt

SEQ ID NO: 595020 - DNA, 25 bp, Rattus norvegicus
tctctcgacagcagtagtgtcctaa

SEQ ID NO: 595021 - DNA, 25 bp, Rattus norvegicus
tctctcgacagctgtagtgtcctaa

SEQ ID NO: 595022 - DNA, 25 bp, Rattus norvegicus
tctctcgcagtcctcgggagtcagt

SEQ ID NO: 595023 - DNA, 25 bp, Rattus norvegicus
tctctcgcagtcgtcgggagtcagt

SEQ ID NO: 595024 - DNA, 25 bp, Rattus norvegicus
tctctcgcggctcctggcctggata

SEQ ID NO: 595025 - DNA, 25 bp, Rattus norvegicus
tctctcgcggctgctggcctggata

SEQ ID NO: 595026 - DNA, 25 bp, Rattus norvegicus
tctctcggtcatccttttagaagcc

SEQ ID NO: 595027 - DNA, 25 bp, Rattus norvegicus
tctctcggtcatgcttttagaagcc

SEQ ID NO: 595028 - DNA, 25 bp, Rattus norvegicus
tctctcgtcactctgttacacttac

SEQ ID NO: 595029 - DNA, 25 bp, Rattus norvegicus
tctctcgtcactgtgttacacttac

SEQ ID NO: 595030 - DNA, 25 bp, Rattus norvegicus
tctctcgtcagaatacctcacagga

SEQ ID NO: 595031 - DNA, 25 bp, Rattus norvegicus
tctctcgtcagattacctcacagga

SEQ ID NO: 595032 - DNA, 25 bp, Rattus norvegicus
tctctctagagtcttgggattccct

SEQ ID NO: 595033 - DNA, 25 bp, Rattus norvegicus
tctctctagagtgttgggattccct

SEQ ID NO: 595034 - DNA, 25 bp, Rattus norvegicus
tctctctaggagcggcttcgcacaa

SEQ ID NO: 595035 - DNA, 25 bp, Rattus norvegicus
tctctctaggaggggcttcgcacaa

SEQ ID NO: 595036 - DNA, 25 bp, Rattus norvegicus
tctctctagggaaacggacggcatt

SEQ ID NO: 595037 - DNA, 25 bp, Rattus norvegicus
tctctctagggatacggacggcatt

SEQ ID NO: 595038 - DNA, 25 bp, Rattus norvegicus
tctctctatagtaccctgccaaggc

SEQ ID NO: 595039 - DNA, 25 bp, Rattus norvegicus
tctctctatagttccctgccaaggc

SEQ ID NO: 595040 - DNA, 25 bp, Rattus norvegicus
tctctctatctcaagtttgtgcagg

SEQ ID NO: 595041 - DNA, 25 bp, Rattus norvegicus
tctctctatctctagtttgtgcagg

SEQ ID NO: 595042 - DNA, 25 bp, Rattus norvegicus
tctctctcacacatttgacattttg

SEQ ID NO: 595043 - DNA, 25 bp, Rattus norvegicus
tctctctcacacttttgacattttg

SEQ ID NO: 595044 - DNA, 25 bp, Rattus norvegicus
tctctctcccagctttggtctcagg

SEQ ID NO: 595045 - DNA, 25 bp, Rattus norvegicus
tctctctcccaggtttggtctcagg

SEQ ID NO: 595046 - DNA, 25 bp, Rattus norvegicus
tctctctcctgaattttcacatcaa

SEQ ID NO: 595047 - DNA, 25 bp, Rattus norvegicus
tctctctcctgatttttcacatcaa

SEQ ID NO: 595048 - DNA, 25 bp, Rattus norvegicus
tctctctcctgccttttgaatttta

SEQ ID NO: 595049 - DNA, 25 bp, Rattus norvegicus
tctctctcctgcgttttgaatttta

SEQ ID NO: 595050 - DNA, 25 bp, Rattus norvegicus
tctctctcctttatgttcccaaaat

SEQ ID NO: 595051 - DNA, 25 bp, Rattus norvegicus
tctctctcctttttgttcccaaaat

SEQ ID NO: 595052 - DNA, 25 bp, Rattus norvegicus
tctctctctaataccagccaaatag

SEQ ID NO: 595053 - DNA, 25 bp, Rattus norvegicus
tctctctctaattccagccaaatag

SEQ ID NO: 595054 - DNA, 25 bp, Rattus norvegicus
tctctctctactcctattttagcag

SEQ ID NO: 595055 - DNA, 25 bp, Rattus norvegicus
tctctctctactgctattttagcag

SEQ ID NO: 595056 - DNA, 25 bp, Rattus norvegicus
tctctctcttagcagaacatgttag

SEQ ID NO: 595057 - DNA, 25 bp, Rattus norvegicus
tctctctcttaggagaacatgttag

SEQ ID NO: 595058 - DNA, 25 bp, Rattus norvegicus
tctctctgagagatgcccttcaagg

SEQ ID NO: 595059 - DNA, 25 bp, Rattus norvegicus
tctctctgagagttgcccttcaagg

SEQ ID NO: 595060 - DNA, 25 bp, Rattus norvegicus
tctctctgaggacattatatccatg

SEQ ID NO: 595061 - DNA, 25 bp, Rattus norvegicus
tctctctgaggagattatatccatg

SEQ ID NO: 595062 - DNA, 25 bp, Rattus norvegicus
tctctctgcagtccaccgtaaaggg

SEQ ID NO: 595063 - DNA, 25 bp, Rattus norvegicus
tctctctgcagtgcaccgtaaaggg

SEQ ID NO: 595064 - DNA, 25 bp, Rattus norvegicus
tctctctgcattacctttttaaaca

SEQ ID NO: 595065 - DNA, 25 bp, Rattus norvegicus
tctctctgcatttcctttttaaaca

SEQ ID NO: 595066 - DNA, 25 bp, Rattus norvegicus
tctctctgcccaacttgaatatgat

SEQ ID NO: 595067 - DNA, 25 bp, Rattus norvegicus
tctctctgcccatcttgaatatgat

SEQ ID NO: 595068 - DNA, 25 bp, Rattus norvegicus
tctctctgccccaagatttaatgtt

SEQ ID NO: 595069 - DNA, 25 bp, Rattus norvegicus
tctctctgcccctagatttaatgtt

SEQ ID NO: 595070 - DNA, 25 bp, Rattus norvegicus
tctctctgccgtctgctagcatgga

SEQ ID NO: 595071 - DNA, 25 bp, Rattus norvegicus
tctctctgccgtgtgctagcatgga

SEQ ID NO: 595072 - DNA, 25 bp, Rattus norvegicus
tctctctgcgttccagatctgtcat

SEQ ID NO: 595073 - DNA, 25 bp, Rattus norvegicus
tctctctgcgttgcagatctgtcat

SEQ ID NO: 595074 - DNA, 25 bp, Rattus norvegicus
tctctctgctccattgaccaaagtt

SEQ ID NO: 595075 - DNA, 25 bp, Rattus norvegicus
tctctctgctcctttgaccaaagtt

SEQ ID NO: 595076 - DNA, 25 bp, Rattus norvegicus
tctctctgctgacgttggaacccag

SEQ ID NO: 595077 - DNA, 25 bp, Rattus norvegicus
tctctctgctgaggttggaacccag

SEQ ID NO: 595078 - DNA, 25 bp, Rattus norvegicus
tctctctggaacacaccttgcctgt

SEQ ID NO: 595079 - DNA, 25 bp, Rattus norvegicus
tctctctggaactcaccttgcctgt

SEQ ID NO: 595080 - DNA, 25 bp, Rattus norvegicus
tctctctggatcaattgagccttct

SEQ ID NO: 595081 - DNA, 25 bp, Rattus norvegicus
tctctctggatctattgagccttct

SEQ ID NO: 595082 - DNA, 25 bp, Rattus norvegicus
tctctctggtggcaggtgttctgaa

SEQ ID NO: 595083 - DNA, 25 bp, Rattus norvegicus
tctctctggtgggaggtgttctgaa

SEQ ID NO: 595084 - DNA, 25 bp, Rattus norvegicus
tctctctgtatcctgtaactcaaga

SEQ ID NO: 595085 - DNA, 25 bp, Rattus norvegicus
tctctctgtatcgtgtaactcaaga

SEQ ID NO: 595086 - DNA, 25 bp, Rattus norvegicus
tctctctgtgccctgagacaagaaa

SEQ ID NO: 595087 - DNA, 25 bp, Rattus norvegicus
tctctctgtgccgtgagacaagaaa

SEQ ID NO: 595088 - DNA, 25 bp, Rattus norvegicus
tctctctgtgttagttggtattatt

SEQ ID NO: 595089 - DNA, 25 bp, Rattus norvegicus
tctctctgtgtttgttggtattatt

SEQ ID NO: 595090 - DNA, 25 bp, Rattus norvegicus
tctctctgtttcagtctgtgcctct

SEQ ID NO: 595091 - DNA, 25 bp, Rattus norvegicus
tctctctgtttctgtctgtgcctct

SEQ ID NO: 595092 - DNA, 25 bp, Rattus norvegicus
tctctcttacctcagaattcattaa

SEQ ID NO: 595093 - DNA, 25 bp, Rattus norvegicus
tctctcttacctgagaattcattaa

SEQ ID NO: 595094 - DNA, 25 bp, Rattus norvegicus
tctctcttacttagaccttgattta

SEQ ID NO: 595095 - DNA, 25 bp, Rattus norvegicus
tctctcttactttgaccttgattta

SEQ ID NO: 595096 - DNA, 25 bp, Rattus norvegicus
tctctcttagtacattcctcacaaa

SEQ ID NO: 595097 - DNA, 25 bp, Rattus norvegicus
tctctcttagtagattcctcacaaa

SEQ ID NO: 595098 - DNA, 25 bp, Rattus norvegicus
tctctcttatgcattgcaggccggg

SEQ ID NO: 595099 - DNA, 25 bp, Rattus norvegicus
tctctcttatgctttgcaggccggg

SEQ ID NO: 595100 - DNA, 25 bp, Rattus norvegicus
tctctcttatttccctatctttgta

SEQ ID NO: 595101 - DNA, 25 bp, Rattus norvegicus
tctctcttatttgcctatctttgta

SEQ ID NO: 595102 - DNA, 25 bp, Rattus norvegicus
tctctcttcattaccaaactcattg

SEQ ID NO: 595103 - DNA, 25 bp, Rattus norvegicus
tctctcttcatttccaaactcattg

SEQ ID NO: 595104 - DNA, 25 bp, Rattus norvegicus
tctctcttccagaaatacacactgc

SEQ ID NO: 595105 - DNA, 25 bp, Rattus norvegicus
tctctcttccagtaatacacactgc

SEQ ID NO: 595106 - DNA, 25 bp, Rattus norvegicus
tctctcttcctaacatctcagaaat

SEQ ID NO: 595107 - DNA, 25 bp, Rattus norvegicus
tctctcttcctatcatctcagaaat

SEQ ID NO: 595108 - DNA, 25 bp, Rattus norvegicus
tctctcttcttcagggcacggtaca

SEQ ID NO: 595109 - DNA, 25 bp, Rattus norvegicus
tctctcttcttctgggcacggtaca

SEQ ID NO: 595110 - DNA, 25 bp, Rattus norvegicus
tctctcttgccaccctaacaaatgg

SEQ ID NO: 595111 - DNA, 25 bp, Rattus norvegicus
tctctcttgccagcctaacaaatgg

SEQ ID NO: 595112 - DNA, 25 bp, Rattus norvegicus
tctctcttgcctcatgctggaagaa

SEQ ID NO: 595113 - DNA, 25 bp, Rattus norvegicus
tctctcttgcctgatgctggaagaa

SEQ ID NO: 595114 - DNA, 25 bp, Rattus norvegicus
tctctcttggtactactatgccaca

SEQ ID NO: 595115 - DNA, 25 bp, Rattus norvegicus
tctctcttggtagtactatgccaca

SEQ ID NO: 595116 - DNA, 25 bp, Rattus norvegicus
tctctcttggtcactgtttaatgtt

SEQ ID NO: 595117 - DNA, 25 bp, Rattus norvegicus
tctctcttggtctctgtttaatgtt

SEQ ID NO: 595118 - DNA, 25 bp, Rattus norvegicus
tctctcttgtggaagctacattcag

SEQ ID NO: 595119 - DNA, 25 bp, Rattus norvegicus
tctctcttgtggtagctacattcag

SEQ ID NO: 595120 - DNA, 25 bp, Rattus norvegicus
tctctcttgtgtaccagtgagggta

SEQ ID NO: 595121 - DNA, 25 bp, Rattus norvegicus
tctctcttgtgttccagtgagggta

SEQ ID NO: 595122 - DNA, 25 bp, Rattus norvegicus
tctctctttctgaggagtccataga

SEQ ID NO: 595123 - DNA, 25 bp, Rattus norvegicus
tctctctttctgtggagtccataga

SEQ ID NO: 595124 - DNA, 25 bp, Rattus norvegicus
tctctctttgagatgcttctggtca

SEQ ID NO: 595125 - DNA, 25 bp, Rattus norvegicus
tctctctttgagttgcttctggtca

SEQ ID NO: 595126 - DNA, 25 bp, Rattus norvegicus
tctctctttgccataaacctcttta

SEQ ID NO: 595127 - DNA, 25 bp, Rattus norvegicus
tctctctttgccttaaacctcttta

SEQ ID NO: 595128 - DNA, 25 bp, Rattus norvegicus
tctctctttgctctggtatccagga

SEQ ID NO: 595129 - DNA, 25 bp, Rattus norvegicus
tctctctttgctgtggtatccagga

SEQ ID NO: 595130 - DNA, 25 bp, Rattus norvegicus
tctctctttgttctcagcacttata

SEQ ID NO: 595131 - DNA, 25 bp, Rattus norvegicus
tctctctttgttgtcagcacttata

SEQ ID NO: 595132 - DNA, 25 bp, Rattus norvegicus
tctctcttttgcctcttgtgaatta

SEQ ID NO: 595133 - DNA, 25 bp, Rattus norvegicus
tctctcttttgcgtcttgtgaatta

SEQ ID NO: 595134 - DNA, 25 bp, Rattus norvegicus
tctctctttttcatgctttctttgt

SEQ ID NO: 595135 - DNA, 25 bp, Rattus norvegicus
tctctctttttcttgctttctttgt

SEQ ID NO: 595136 - DNA, 25 bp, Rattus norvegicus
tctctgaaaatacacaagggcttaa

SEQ ID NO: 595137 - DNA, 25 bp, Rattus norvegicus
tctctgaaaatagacaagggcttaa

SEQ ID NO: 595138 - DNA, 25 bp, Rattus norvegicus
tctctgaagcttcctgcccttctag

SEQ ID NO: 595139 - DNA, 25 bp, Rattus norvegicus
tctctgaagcttgctgcccttctag

SEQ ID NO: 595140 - DNA, 25 bp, Rattus norvegicus
tctctgaccgagacctggaggatgt

SEQ ID NO: 595141 - DNA, 25 bp, Rattus norvegicus
tctctgaccgagtcctggaggatgt

SEQ ID NO: 595142 - DNA, 25 bp, Rattus norvegicus
tctctgacgtaaactcttggctagt

SEQ ID NO: 595143 - DNA, 25 bp, Rattus norvegicus
tctctgacgtaatctcttggctagt

SEQ ID NO: 595144 - DNA, 25 bp, Rattus norvegicus
tctctgactacaaagtatggaggat

SEQ ID NO: 595145 - DNA, 25 bp, Rattus norvegicus
tctctgactacatagtatggaggat

SEQ ID NO: 595146 - DNA, 25 bp, Rattus norvegicus
tctctgactgaaacgtgggaccaag

SEQ ID NO: 595147 - DNA, 25 bp, Rattus norvegicus
tctctgactgaatcgtgggaccaag

SEQ ID NO: 595148 - DNA, 25 bp, Rattus norvegicus
tctctgactggcctcagaaggcatg

SEQ ID NO: 595149 - DNA, 25 bp, Rattus norvegicus
tctctgactggcgtcagaaggcatg

SEQ ID NO: 595150 - DNA, 25 bp, Rattus norvegicus
tctctgacttagctaggacccgtta

SEQ ID NO: 595151 - DNA, 25 bp, Rattus norvegicus
tctctgacttaggtaggacccgtta

SEQ ID NO: 595152 - DNA, 25 bp, Rattus norvegicus
tctctgacttcaataatgcaccatt

SEQ ID NO: 595153 - DNA, 25 bp, Rattus norvegicus
tctctgacttcattaatgcaccatt

SEQ ID NO: 595154 - DNA, 25 bp, Rattus norvegicus
tctctgacttccaggactacatggg

SEQ ID NO: 595155 - DNA, 25 bp, Rattus norvegicus
tctctgacttcctggactacatggg

SEQ ID NO: 595156 - DNA, 25 bp, Rattus norvegicus
tctctgagacctagcgggcccaggg

SEQ ID NO: 595157 - DNA, 25 bp, Rattus norvegicus
tctctgagaccttgcgggcccaggg

SEQ ID NO: 595158 - DNA, 25 bp, Rattus norvegicus
tctctgagctagaaggcttttgcct

SEQ ID NO: 595159 - DNA, 25 bp, Rattus norvegicus
tctctgagctagtaggcttttgcct

SEQ ID NO: 595160 - DNA, 25 bp, Rattus norvegicus
tctctgagctcaaacgccagataga

SEQ ID NO: 595161 - DNA, 25 bp, Rattus norvegicus
tctctgagctcatacgccagataga

SEQ ID NO: 595162 - DNA, 25 bp, Rattus norvegicus
tctctgagctctctacttcaaccag

SEQ ID NO: 595163 - DNA, 25 bp, Rattus norvegicus
tctctgagctctgtacttcaaccag

SEQ ID NO: 595164 - DNA, 25 bp, Rattus norvegicus
tctctgagctgtacttgactttgca

SEQ ID NO: 595165 - DNA, 25 bp, Rattus norvegicus
tctctgagctgttcttgactttgca

SEQ ID NO: 595166 - DNA, 25 bp, Rattus norvegicus
tctctgaggaagagtcccatctgca

SEQ ID NO: 595167 - DNA, 25 bp, Rattus norvegicus
tctctgaggaagtgtcccatctgca

SEQ ID NO: 595168 - DNA, 25 bp, Rattus norvegicus
tctctgaggagcagactagaccctg

SEQ ID NO: 595169 - DNA, 25 bp, Rattus norvegicus
tctctgaggagctgactagaccctg

SEQ ID NO: 595170 - DNA, 25 bp, Rattus norvegicus
tctctgagggtgagcttttcttatg

SEQ ID NO: 595171 - DNA, 25 bp, Rattus norvegicus
tctctgagggtgtgcttttcttatg

SEQ ID NO: 595172 - DNA, 25 bp, Rattus norvegicus
tctctgaggtaactttctaaagaat

SEQ ID NO: 595173 - DNA, 25 bp, Rattus norvegicus
tctctgaggtaagtttctaaagaat

SEQ ID NO: 595174 - DNA, 25 bp, Rattus norvegicus
tctctgagttatatctgctcctgta

SEQ ID NO: 595175 - DNA, 25 bp, Rattus norvegicus
tctctgagttatttctgctcctgta

SEQ ID NO: 595176 - DNA, 25 bp, Rattus norvegicus
tctctgatatttcttcctcttgcaa

SEQ ID NO: 595177 - DNA, 25 bp, Rattus norvegicus
tctctgatatttgttcctcttgcaa

SEQ ID NO: 595178 - DNA, 25 bp, Rattus norvegicus
tctctgatcttcatgttcttccgaa

SEQ ID NO: 595179 - DNA, 25 bp, Rattus norvegicus
tctctgatcttcttgttcttccgaa

SEQ ID NO: 595180 - DNA, 25 bp, Rattus norvegicus
tctctgattggcatctggaccctga

SEQ ID NO: 595181 - DNA, 25 bp, Rattus norvegicus
tctctgattggcttctggaccctga

SEQ ID NO: 595182 - DNA, 25 bp, Rattus norvegicus
tctctgcaacaaaactttcctcaag

SEQ ID NO: 595183 - DNA, 25 bp, Rattus norvegicus
tctctgcaacaatactttcctcaag

SEQ ID NO: 595184 - DNA, 25 bp, Rattus norvegicus
tctctgcaatggaggctcaatgaac

SEQ ID NO: 595185 - DNA, 25 bp, Rattus norvegicus
tctctgcaatggtggctcaatgaac

SEQ ID NO: 595186 - DNA, 25 bp, Rattus norvegicus
tctctgcacagcaccttctgggtgg

SEQ ID NO: 595187 - DNA, 25 bp, Rattus norvegicus
tctctgcacagctccttctgggtgg

SEQ ID NO: 595188 - DNA, 25 bp, Rattus norvegicus
tctctgcacaggactagctgagact

SEQ ID NO: 595189 - DNA, 25 bp, Rattus norvegicus
tctctgcacaggtctagctgagact

SEQ ID NO: 595190 - DNA, 25 bp, Rattus norvegicus
tctctgcaccagaccctgagagcag

SEQ ID NO: 595191 - DNA, 25 bp, Rattus norvegicus
tctctgcaccagtccctgagagcag

SEQ ID NO: 595192 - DNA, 25 bp, Rattus norvegicus
tctctgcacgggagggcctaactga

SEQ ID NO: 595193 - DNA, 25 bp, Rattus norvegicus
tctctgcacgggtgggcctaactga

SEQ ID NO: 595194 - DNA, 25 bp, Rattus norvegicus
tctctgcactgcaggacatggtgga

SEQ ID NO: 595195 - DNA, 25 bp, Rattus norvegicus
tctctgcactgctggacatggtgga

SEQ ID NO: 595196 - DNA, 25 bp, Rattus norvegicus
tctctgcagcctccaagacattgag

SEQ ID NO: 595197 - DNA, 25 bp, Rattus norvegicus
tctctgcagcctgcaagacattgag

SEQ ID NO: 595198 - DNA, 25 bp, Rattus norvegicus
tctctgcatcataggcggtgtcata

SEQ ID NO: 595199 - DNA, 25 bp, Rattus norvegicus
tctctgcatcattggcggtgtcata

SEQ ID NO: 595200 - DNA, 25 bp, Rattus norvegicus
tctctgcatctgacagctggaggga

SEQ ID NO: 595201 - DNA, 25 bp, Rattus norvegicus
tctctgcatctgtcagctggaggga

SEQ ID NO: 595202 - DNA, 25 bp, Rattus norvegicus
tctctgccaatgatcctcgaaaact

SEQ ID NO: 595203 - DNA, 25 bp, Rattus norvegicus
tctctgccaatgttcctcgaaaact

SEQ ID NO: 595204 - DNA, 25 bp, Rattus norvegicus
tctctgccaggtcacacacatttat

SEQ ID NO: 595205 - DNA, 25 bp, Rattus norvegicus
tctctgccaggtgacacacatttat

SEQ ID NO: 595206 - DNA, 25 bp, Rattus norvegicus
tctctgcccaccaggtaagctttaa

SEQ ID NO: 595207 - DNA, 25 bp, Rattus norvegicus
tctctgcccacctggtaagctttaa

SEQ ID NO: 595208 - DNA, 25 bp, Rattus norvegicus
tctctgccctgcagtatcataaagc

SEQ ID NO: 595209 - DNA, 25 bp, Rattus norvegicus
tctctgccctgctgtatcataaagc

SEQ ID NO: 595210 - DNA, 25 bp, Rattus norvegicus
tctctgccgctaaaattcctttgca

SEQ ID NO: 595211 - DNA, 25 bp, Rattus norvegicus
tctctgccgctataattcctttgca

SEQ ID NO: 595212 - DNA, 25 bp, Rattus norvegicus
tctctgccgtgtcttaattgctctg

SEQ ID NO: 595213 - DNA, 25 bp, Rattus norvegicus
tctctgccgtgtgttaattgctctg

SEQ ID NO: 595214 - DNA, 25 bp, Rattus norvegicus
tctctgcctagcacagggctgaaac

SEQ ID NO: 595215 - DNA, 25 bp, Rattus norvegicus
tctctgcctagctcagggctgaaac

SEQ ID NO: 595216 - DNA, 25 bp, Rattus norvegicus
tctctgcctctcagttgtttatgca

SEQ ID NO: 595217 - DNA, 25 bp, Rattus norvegicus
tctctgcctctctgttgtttatgca

SEQ ID NO: 595218 - DNA, 25 bp, Rattus norvegicus
tctctgcctctgaccgagtgtgaag

SEQ ID NO: 595219 - DNA, 25 bp, Rattus norvegicus
tctctgcctctgagtatatgactgt

SEQ ID NO: 595220 - DNA, 25 bp, Rattus norvegicus
tctctgcctctgtccgagtgtgaag

SEQ ID NO: 595221 - DNA, 25 bp, Rattus norvegicus
tctctgcctctgtgtatatgactgt

SEQ ID NO: 595222 - DNA, 25 bp, Rattus norvegicus
tctctgcctgataggacttctggtt

SEQ ID NO: 595223 - DNA, 25 bp, Rattus norvegicus
tctctgcctgattggacttctggtt

SEQ ID NO: 595224 - DNA, 25 bp, Rattus norvegicus
tctctgcctgctcagggcgtaataa

SEQ ID NO: 595225 - DNA, 25 bp, Rattus norvegicus
tctctgcctgctgagggcgtaataa

SEQ ID NO: 595226 - DNA, 25 bp, Rattus norvegicus
tctctgcctggaatggtttctagct

SEQ ID NO: 595227 - DNA, 25 bp, Rattus norvegicus
tctctgcctggattggtttctagct

SEQ ID NO: 595228 - DNA, 25 bp, Rattus norvegicus
tctctgcctgtaacacctgtgagat

SEQ ID NO: 595229 - DNA, 25 bp, Rattus norvegicus
tctctgcctgtatcacctgtgagat

SEQ ID NO: 595230 - DNA, 25 bp, Rattus norvegicus
tctctgccttagctcttggagtaag

SEQ ID NO: 595231 - DNA, 25 bp, Rattus norvegicus
tctctgccttaggtcttggagtaag

SEQ ID NO: 595232 - DNA, 25 bp, Rattus norvegicus
tctctgccttgtcgatcatgggact

SEQ ID NO: 595233 - DNA, 25 bp, Rattus norvegicus
tctctgccttgtggatcatgggact

SEQ ID NO: 595234 - DNA, 25 bp, Rattus norvegicus
tctctgcgctctccaagaactgagg

SEQ ID NO: 595235 - DNA, 25 bp, Rattus norvegicus
tctctgcgctctgcaagaactgagg

SEQ ID NO: 595236 - DNA, 25 bp, Rattus norvegicus
tctctgcggtggcttcatgccggaa

SEQ ID NO: 595237 - DNA, 25 bp, Rattus norvegicus
tctctgcggtgggttcatgccggaa

SEQ ID NO: 595238 - DNA, 25 bp, Rattus norvegicus
tctctgcgtctgctcaagaaaggct

SEQ ID NO: 595239 - DNA, 25 bp, Rattus norvegicus
tctctgcgtctggtcaagaaaggct

SEQ ID NO: 595240 - DNA, 25 bp, Rattus norvegicus
tctctgctagtgcaatctgccgata

SEQ ID NO: 595241 - DNA, 25 bp, Rattus norvegicus
tctctgctagtggaatctgccgata

SEQ ID NO: 595242 - DNA, 25 bp, Rattus norvegicus
tctctgctcagtacaacccagatga

SEQ ID NO: 595243 - DNA, 25 bp, Rattus norvegicus
tctctgctcagttcaacccagatga

SEQ ID NO: 595244 - DNA, 25 bp, Rattus norvegicus
tctctgctctctagttttgcaactt

SEQ ID NO: 595245 - DNA, 25 bp, Rattus norvegicus
tctctgctctcttgttttgcaactt

SEQ ID NO: 595246 - DNA, 25 bp, Rattus norvegicus
tctctgctctgcaatctacttataa

SEQ ID NO: 595247 - DNA, 25 bp, Rattus norvegicus
tctctgctctgctatctacttataa

SEQ ID NO: 595248 - DNA, 25 bp, Rattus norvegicus
tctctgctcttcactttctaggtga

SEQ ID NO: 595249 - DNA, 25 bp, Rattus norvegicus
tctctgctcttctctttctaggtga

SEQ ID NO: 595250 - DNA, 25 bp, Rattus norvegicus
tctctgctctttataggacctccat

SEQ ID NO: 595251 - DNA, 25 bp, Rattus norvegicus
tctctgctctttttaggacctccat

SEQ ID NO: 595252 - DNA, 25 bp, Rattus norvegicus
tctctgctggctcctattggagaaa

SEQ ID NO: 595253 - DNA, 25 bp, Rattus norvegicus
tctctgctggctgctattggagaaa

SEQ ID NO: 595254 - DNA, 25 bp, Rattus norvegicus
tctctgctgggtatttgtggttcat

SEQ ID NO: 595255 - DNA, 25 bp, Rattus norvegicus
tctctgctgggtttttgtggttcat

SEQ ID NO: 595256 - DNA, 25 bp, Rattus norvegicus
tctctgcttcctatctatcatcttc

SEQ ID NO: 595257 - DNA, 25 bp, Rattus norvegicus
tctctgcttcctttctatcatcttc

SEQ ID NO: 595258 - DNA, 25 bp, Rattus norvegicus
tctctgcttctgctatgcttgaagt

SEQ ID NO: 595259 - DNA, 25 bp, Rattus norvegicus
tctctgcttctggtatgcttgaagt

SEQ ID NO: 595260 - DNA, 25 bp, Rattus norvegicus
tctctgctttgaagaactcctcact

SEQ ID NO: 595261 - DNA, 25 bp, Rattus norvegicus
tctctgctttgatgaactcctcact

SEQ ID NO: 595262 - DNA, 25 bp, Rattus norvegicus
tctctggaaagcctgcacttggtgc

SEQ ID NO: 595263 - DNA, 25 bp, Rattus norvegicus
tctctggaaagcgtgcacttggtgc

SEQ ID NO: 595264 - DNA, 25 bp, Rattus norvegicus
tctctggaacacagggtcccatagt

SEQ ID NO: 595265 - DNA, 25 bp, Rattus norvegicus
tctctggaacactgggtcccatagt

SEQ ID NO: 595266 - DNA, 25 bp, Rattus norvegicus
tctctggaagacacgggcacctatg

SEQ ID NO: 595267 - DNA, 25 bp, Rattus norvegicus
tctctggaagactcgggcacctatg

SEQ ID NO: 595268 - DNA, 25 bp, Rattus norvegicus
tctctggaagcaaggcaggttctct

SEQ ID NO: 595269 - DNA, 25 bp, Rattus norvegicus
tctctggaagcatggcaggttctct

SEQ ID NO: 595270 - DNA, 25 bp, Rattus norvegicus
tctctggagagtaggagcccacggt

SEQ ID NO: 595271 - DNA, 25 bp, Rattus norvegicus
tctctggagagttggagcccacggt

SEQ ID NO: 595272 - DNA, 25 bp, Rattus norvegicus
tctctggagcagatcctggttgact

SEQ ID NO: 595273 - DNA, 25 bp, Rattus norvegicus
tctctggagcagttcctggttgact

SEQ ID NO: 595274 - DNA, 25 bp, Rattus norvegicus
tctctggaggcgattggaacactct

SEQ ID NO: 595275 - DNA, 25 bp, Rattus norvegicus
tctctggaggcgtttggaacactct

SEQ ID NO: 595276 - DNA, 25 bp, Rattus norvegicus
tctctggatactacgctgtaagaaa

SEQ ID NO: 595277 - DNA, 25 bp, Rattus norvegicus
tctctggatacttcgctgtaagaaa

SEQ ID NO: 595278 - DNA, 25 bp, Rattus norvegicus
tctctggatcttatactctacaatt

SEQ ID NO: 595279 - DNA, 25 bp, Rattus norvegicus
tctctggatcttttactctacaatt

SEQ ID NO: 595280 - DNA, 25 bp, Rattus norvegicus
tctctggatggaacaggacccctga

SEQ ID NO: 595281 - DNA, 25 bp, Rattus norvegicus
tctctggatggatcaggacccctga

SEQ ID NO: 595282 - DNA, 25 bp, Rattus norvegicus
tctctggccatccttcagatagggc

SEQ ID NO: 595283 - DNA, 25 bp, Rattus norvegicus
tctctggccatcgttcagatagggc

SEQ ID NO: 595284 - DNA, 25 bp, Rattus norvegicus
tctctggccttacctggtacctgaa

SEQ ID NO: 595285 - DNA, 25 bp, Rattus norvegicus
tctctggccttagctggtacctgaa

SEQ ID NO: 595286 - DNA, 25 bp, Rattus norvegicus
tctctggcctttcctaatctgccta

SEQ ID NO: 595287 - DNA, 25 bp, Rattus norvegicus
tctctggcctttgctaatctgccta

SEQ ID NO: 595288 - DNA, 25 bp, Rattus norvegicus
tctctggctgggaatgggactcttt

SEQ ID NO: 595289 - DNA, 25 bp, Rattus norvegicus
tctctggctgggtatgggactcttt

SEQ ID NO: 595290 - DNA, 25 bp, Rattus norvegicus
tctctggcttccaggtgtaccctga

SEQ ID NO: 595291 - DNA, 25 bp, Rattus norvegicus
tctctggcttccatgatgttggtgc

SEQ ID NO: 595292 - DNA, 25 bp, Rattus norvegicus
tctctggcttcctggtgtaccctga

SEQ ID NO: 595293 - DNA, 25 bp, Rattus norvegicus
tctctggcttccttgatgttggtgc

SEQ ID NO: 595294 - DNA, 25 bp, Rattus norvegicus
tctctgggacctcatctgcaggtgc

SEQ ID NO: 595295 - DNA, 25 bp, Rattus norvegicus
tctctgggacctgatctgcaggtgc

SEQ ID NO: 595296 - DNA, 25 bp, Rattus norvegicus
tctctgggagctaccacagtttagt

SEQ ID NO: 595297 - DNA, 25 bp, Rattus norvegicus
tctctgggagcttccacagtttagt

SEQ ID NO: 595298 - DNA, 25 bp, Rattus norvegicus
tctctgggagtacggtacacatgac

SEQ ID NO: 595299 - DNA, 25 bp, Rattus norvegicus
tctctgggagtagggtacacatgac

SEQ ID NO: 595300 - DNA, 25 bp, Rattus norvegicus
tctctgggcactacactatctaaga

SEQ ID NO: 595301 - DNA, 25 bp, Rattus norvegicus
tctctgggcacttcactatctaaga

SEQ ID NO: 595302 - DNA, 25 bp, Rattus norvegicus
tctctgggccagagcttgagagctg

SEQ ID NO: 595303 - DNA, 25 bp, Rattus norvegicus
tctctgggccagtgcttgagagctg

SEQ ID NO: 595304 - DNA, 25 bp, Rattus norvegicus
tctctgggcttgactgttttatcaa

SEQ ID NO: 595305 - DNA, 25 bp, Rattus norvegicus
tctctgggcttgtctgttttatcaa

SEQ ID NO: 595306 - DNA, 25 bp, Rattus norvegicus
tctctgggtccacagcaagtgacat

SEQ ID NO: 595307 - DNA, 25 bp, Rattus norvegicus
tctctgggtccagagcaagtgacat

SEQ ID NO: 595308 - DNA, 25 bp, Rattus norvegicus
tctctgggtcccctggaacaaagaa

SEQ ID NO: 595309 - DNA, 25 bp, Rattus norvegicus
tctctgggtcccgtggaacaaagaa

SEQ ID NO: 595310 - DNA, 25 bp, Rattus norvegicus
tctctgggtgatctttagcctcaag

SEQ ID NO: 595311 - DNA, 25 bp, Rattus norvegicus
tctctgggtgatgtttagcctcaag

SEQ ID NO: 595312 - DNA, 25 bp, Rattus norvegicus
tctctggtatggacccttttccttt

SEQ ID NO: 595313 - DNA, 25 bp, Rattus norvegicus
tctctggtatggtcccttttccttt

SEQ ID NO: 595314 - DNA, 25 bp, Rattus norvegicus
tctctggtctttacacactgactac

SEQ ID NO: 595315 - DNA, 25 bp, Rattus norvegicus
tctctggtcttttcacactgactac

SEQ ID NO: 595316 - DNA, 25 bp, Rattus norvegicus
tctctggtgcctaaaaactaacttg

SEQ ID NO: 595317 - DNA, 25 bp, Rattus norvegicus
tctctggtgccttaaaactaacttg

SEQ ID NO: 595318 - DNA, 25 bp, Rattus norvegicus
tctctggtgcttactacgggaacat

SEQ ID NO: 595319 - DNA, 25 bp, Rattus norvegicus
tctctggtgctttctacgggaacat

SEQ ID NO: 595320 - DNA, 25 bp, Rattus norvegicus
tctctggtggccatctattttctca

SEQ ID NO: 595321 - DNA, 25 bp, Rattus norvegicus
tctctggtggccttctattttctca

SEQ ID NO: 595322 - DNA, 25 bp, Rattus norvegicus
tctctggtgtccatggcaacaacaa

SEQ ID NO: 595323 - DNA, 25 bp, Rattus norvegicus
tctctggtgtccttggcaacaacaa

SEQ ID NO: 595324 - DNA, 25 bp, Rattus norvegicus
tctctggttctactgcaattgtgtg

SEQ ID NO: 595325 - DNA, 25 bp, Rattus norvegicus
tctctggttctagtgcaattgtgtg

SEQ ID NO: 595326 - DNA, 25 bp, Rattus norvegicus
tctctgtaactactggtattgcccc

SEQ ID NO: 595327 - DNA, 25 bp, Rattus norvegicus
tctctgtaactagtggtattgcccc

SEQ ID NO: 595328 - DNA, 25 bp, Rattus norvegicus
tctctgtaagtgatgggccagccta

SEQ ID NO: 595329 - DNA, 25 bp, Rattus norvegicus
tctctgtaagtgttgggccagccta

SEQ ID NO: 595330 - DNA, 25 bp, Rattus norvegicus
tctctgtaataaatgtgcctctgag

SEQ ID NO: 595331 - DNA, 25 bp, Rattus norvegicus
tctctgtaataattgtgcctctgag

SEQ ID NO: 595332 - DNA, 25 bp, Rattus norvegicus
tctctgtacacaaaggatgctggac

SEQ ID NO: 595333 - DNA, 25 bp, Rattus norvegicus
tctctgtacacataggatgctggac

SEQ ID NO: 595334 - DNA, 25 bp, Rattus norvegicus
tctctgtacggcagcaatccttttt

SEQ ID NO: 595335 - DNA, 25 bp, Rattus norvegicus
tctctgtacggctgcaatccttttt

SEQ ID NO: 595336 - DNA, 25 bp, Rattus norvegicus
tctctgtacttgattctgactctga

SEQ ID NO: 595337 - DNA, 25 bp, Rattus norvegicus
tctctgtacttgtttctgactctga

SEQ ID NO: 595338 - DNA, 25 bp, Rattus norvegicus
tctctgtagcccaactcctggacag

SEQ ID NO: 595339 - DNA, 25 bp, Rattus norvegicus
tctctgtagccctactcctggacag

SEQ ID NO: 595340 - DNA, 25 bp, Rattus norvegicus
tctctgtagctgctgacagtacact

SEQ ID NO: 595341 - DNA, 25 bp, Rattus norvegicus
tctctgtagctggtgacagtacact

SEQ ID NO: 595342 - DNA, 25 bp, Rattus norvegicus
tctctgtaggtcaggctgggcttga

SEQ ID NO: 595343 - DNA, 25 bp, Rattus norvegicus
tctctgtaggtctggctgggcttga

SEQ ID NO: 595344 - DNA, 25 bp, Rattus norvegicus
tctctgtagtgtcgtcttttgacgt

SEQ ID NO: 595345 - DNA, 25 bp, Rattus norvegicus
tctctgtagtgtggtcttttgacgt

SEQ ID NO: 595346 - DNA, 25 bp, Rattus norvegicus
tctctgtagtttaatcatgtaatgt

SEQ ID NO: 595347 - DNA, 25 bp, Rattus norvegicus
tctctgtagttttatcatgtaatgt

SEQ ID NO: 595348 - DNA, 25 bp, Rattus norvegicus
tctctgtatctcacttctagaattg

SEQ ID NO: 595349 - DNA, 25 bp, Rattus norvegicus
tctctgtatctctcttctagaattg

SEQ ID NO: 595350 - DNA, 25 bp, Rattus norvegicus
tctctgtatgtcagtcttctctata

SEQ ID NO: 595351 - DNA, 25 bp, Rattus norvegicus
tctctgtatgtctgtcttctctata

SEQ ID NO: 595352 - DNA, 25 bp, Rattus norvegicus
tctctgtatgtgctggaagcctcct

SEQ ID NO: 595353 - DNA, 25 bp, Rattus norvegicus
tctctgtatgtggtggaagcctcct

SEQ ID NO: 595354 - DNA, 25 bp, Rattus norvegicus
tctctgtccagacgttcccaaagat

SEQ ID NO: 595355 - DNA, 25 bp, Rattus norvegicus
tctctgtccagaggttcccaaagat

SEQ ID NO: 595356 - DNA, 25 bp, Rattus norvegicus
tctctgtccccaaagactgtatgtg

SEQ ID NO: 595357 - DNA, 25 bp, Rattus norvegicus
tctctgtccccatagactgtatgtg

SEQ ID NO: 595358 - DNA, 25 bp, Rattus norvegicus
tctctgtcctctaccatttatagta

SEQ ID NO: 595359 - DNA, 25 bp, Rattus norvegicus
tctctgtcctcttccatttatagta

SEQ ID NO: 595360 - DNA, 25 bp, Rattus norvegicus
tctctgtctcttcggcgctgaggtt

SEQ ID NO: 595361 - DNA, 25 bp, Rattus norvegicus
tctctgtctcttgggcgctgaggtt

SEQ ID NO: 595362 - DNA, 25 bp, Rattus norvegicus
tctctgtgatttacaggtcatcctg

SEQ ID NO: 595363 - DNA, 25 bp, Rattus norvegicus
tctctgtgattttcaggtcatcctg

SEQ ID NO: 595364 - DNA, 25 bp, Rattus norvegicus
tctctgtgcccgaattgctttaaga

SEQ ID NO: 595365 - DNA, 25 bp, Rattus norvegicus
tctctgtgcccgtattgctttaaga

SEQ ID NO: 595366 - DNA, 25 bp, Rattus norvegicus
tctctgtgctgcagttggacagtca

SEQ ID NO: 595367 - DNA, 25 bp, Rattus norvegicus
tctctgtgctgcctggacatcctat

SEQ ID NO: 595368 - DNA, 25 bp, Rattus norvegicus
tctctgtgctgcgtggacatcctat

SEQ ID NO: 595369 - DNA, 25 bp, Rattus norvegicus
tctctgtgctgctgttggacagtca

SEQ ID NO: 595370 - DNA, 25 bp, Rattus norvegicus
tctctgtggatcagaggcttgacat

SEQ ID NO: 595371 - DNA, 25 bp, Rattus norvegicus
tctctgtggatctgaggcttgacat

SEQ ID NO: 595372 - DNA, 25 bp, Rattus norvegicus
tctctgtgtctcaggttagttggaa

SEQ ID NO: 595373 - DNA, 25 bp, Rattus norvegicus
tctctgtgtctcctgcttgtaaatc

SEQ ID NO: 595374 - DNA, 25 bp, Rattus norvegicus
tctctgtgtctcgtgcttgtaaatc

SEQ ID NO: 595375 - DNA, 25 bp, Rattus norvegicus
tctctgtgtctctggttagttggaa

SEQ ID NO: 595376 - DNA, 25 bp, Rattus norvegicus
tctctgtgttacctgttggccttgg

SEQ ID NO: 595377 - DNA, 25 bp, Rattus norvegicus
tctctgtgttacgtgttggccttgg

SEQ ID NO: 595378 - DNA, 25 bp, Rattus norvegicus
tctctgttcacaacctcacttggag

SEQ ID NO: 595379 - DNA, 25 bp, Rattus norvegicus
tctctgttcacatcctcacttggag

SEQ ID NO: 595380 - DNA, 25 bp, Rattus norvegicus
tctctgttctcaagaagatcacact

SEQ ID NO: 595381 - DNA, 25 bp, Rattus norvegicus
tctctgttctcatgaagatcacact

SEQ ID NO: 595382 - DNA, 25 bp, Rattus norvegicus
tctctgttgacccctgacctatttt

SEQ ID NO: 595383 - DNA, 25 bp, Rattus norvegicus
tctctgttgaccgctgacctatttt

SEQ ID NO: 595384 - DNA, 25 bp, Rattus norvegicus
tctctgttgactacctgtagattcc

SEQ ID NO: 595385 - DNA, 25 bp, Rattus norvegicus
tctctgttgacttcctgtagattcc

SEQ ID NO: 595386 - DNA, 25 bp, Rattus norvegicus
tctctgttggtgatgcccttgttca

SEQ ID NO: 595387 - DNA, 25 bp, Rattus norvegicus
tctctgttggtgttgcccttgttca

SEQ ID NO: 595388 - DNA, 25 bp, Rattus norvegicus
tctctgttgtctaggcctttggaaa

SEQ ID NO: 595389 - DNA, 25 bp, Rattus norvegicus
tctctgttgtcttggcctttggaaa

SEQ ID NO: 595390 - DNA, 25 bp, Rattus norvegicus
tctctgttttctcaaggactacctg

SEQ ID NO: 595391 - DNA, 25 bp, Rattus norvegicus
tctctgttttctgaaggactacctg

SEQ ID NO: 595392 - DNA, 25 bp, Rattus norvegicus
tctctgtttttgcagtatggtttca

SEQ ID NO: 595393 - DNA, 25 bp, Rattus norvegicus
tctctgtttttggagtatggtttca

SEQ ID NO: 595394 - DNA, 25 bp, Rattus norvegicus
tctcttaaagatcagacccctagcc

SEQ ID NO: 595395 - DNA, 25 bp, Rattus norvegicus
tctcttaaagatgagacccctagcc

SEQ ID NO: 595396 - DNA, 25 bp, Rattus norvegicus
tctcttaacccacaaggcatgtctt

SEQ ID NO: 595397 - DNA, 25 bp, Rattus norvegicus
tctcttaacccagaaggcatgtctt

SEQ ID NO: 595398 - DNA, 25 bp, Rattus norvegicus
tctcttactgtacgactggttctct

SEQ ID NO: 595399 - DNA, 25 bp, Rattus norvegicus
tctcttactgtaggactggttctct

SEQ ID NO: 595400 - DNA, 25 bp, Rattus norvegicus
tctcttacttcaaaactggcctggt

SEQ ID NO: 595401 - DNA, 25 bp, Rattus norvegicus
tctcttacttcataactggcctggt

SEQ ID NO: 595402 - DNA, 25 bp, Rattus norvegicus
tctcttagaagaagacggccaccct

SEQ ID NO: 595403 - DNA, 25 bp, Rattus norvegicus
tctcttagaagatgacggccaccct

SEQ ID NO: 595404 - DNA, 25 bp, Rattus norvegicus
tctcttagcataaaggtcaggttcc

SEQ ID NO: 595405 - DNA, 25 bp, Rattus norvegicus
tctcttagcatataggtcaggttcc

SEQ ID NO: 595406 - DNA, 25 bp, Rattus norvegicus
tctcttatgctaaccctgggatcaa

SEQ ID NO: 595407 - DNA, 25 bp, Rattus norvegicus
tctcttatgctatccctgggatcaa

SEQ ID NO: 595408 - DNA, 25 bp, Rattus norvegicus
tctcttattcagctttaatggaggc

SEQ ID NO: 595409 - DNA, 25 bp, Rattus norvegicus
tctcttattcaggtttaatggaggc

SEQ ID NO: 595410 - DNA, 25 bp, Rattus norvegicus
tctcttattcttcctgaggacattg

SEQ ID NO: 595411 - DNA, 25 bp, Rattus norvegicus
tctcttattcttgctgaggacattg

SEQ ID NO: 595412 - DNA, 25 bp, Rattus norvegicus
tctcttatttacaatctccccaatt

SEQ ID NO: 595413 - DNA, 25 bp, Rattus norvegicus
tctcttatttactatctccccaatt

SEQ ID NO: 595414 - DNA, 25 bp, Rattus norvegicus
tctcttatttatagcatcccctcat

SEQ ID NO: 595415 - DNA, 25 bp, Rattus norvegicus
tctcttatttattgcatcccctcat

SEQ ID NO: 595416 - DNA, 25 bp, Rattus norvegicus
tctcttcaaatgactgtccgatcga

SEQ ID NO: 595417 - DNA, 25 bp, Rattus norvegicus
tctcttcaaatgtctgtccgatcga

SEQ ID NO: 595418 - DNA, 25 bp, Rattus norvegicus
tctcttcaggctccctgtgtgtgtg

SEQ ID NO: 595419 - DNA, 25 bp, Rattus norvegicus
tctcttcaggctgcctgtgtgtgtg

SEQ ID NO: 595420 - DNA, 25 bp, Rattus norvegicus
tctcttcagtccacaaacctggaaa

SEQ ID NO: 595421 - DNA, 25 bp, Rattus norvegicus
tctcttcagtcctcaaacctggaaa

SEQ ID NO: 595422 - DNA, 25 bp, Rattus norvegicus
tctcttcattggctggtggttcact

SEQ ID NO: 595423 - DNA, 25 bp, Rattus norvegicus
tctcttcattgggtggtggttcact

SEQ ID NO: 595424 - DNA, 25 bp, Rattus norvegicus
tctcttccaactagtgacccttgcg

SEQ ID NO: 595425 - DNA, 25 bp, Rattus norvegicus
tctcttccaacttgtgacccttgcg

SEQ ID NO: 595426 - DNA, 25 bp, Rattus norvegicus
tctcttccacaactagatgcctaat

SEQ ID NO: 595427 - DNA, 25 bp, Rattus norvegicus
tctcttccacaagtagatgcctaat

SEQ ID NO: 595428 - DNA, 25 bp, Rattus norvegicus
tctcttccccggcaatgatgtggat

SEQ ID NO: 595429 - DNA, 25 bp, Rattus norvegicus
tctcttccccgggaatgatgtggat

SEQ ID NO: 595430 - DNA, 25 bp, Rattus norvegicus
tctcttcccgtgctgatttccctgg

SEQ ID NO: 595431 - DNA, 25 bp, Rattus norvegicus
tctcttcccgtggtgatttccctgg

SEQ ID NO: 595432 - DNA, 25 bp, Rattus norvegicus
tctcttcccttcagtggcacatagg

SEQ ID NO: 595433 - DNA, 25 bp, Rattus norvegicus
tctcttcccttctgtggcacatagg

SEQ ID NO: 595434 - DNA, 25 bp, Rattus norvegicus
tctcttcccttgactgtggacatga

SEQ ID NO: 595435 - DNA, 25 bp, Rattus norvegicus
tctcttcccttgtctgtggacatga

SEQ ID NO: 595436 - DNA, 25 bp, Rattus norvegicus
tctcttccgagaccatttgtagtga

SEQ ID NO: 595437 - DNA, 25 bp, Rattus norvegicus
tctcttccgagagcatttgtagtga

SEQ ID NO: 595438 - DNA, 25 bp, Rattus norvegicus
tctcttcctaggatgtcaggtctca

SEQ ID NO: 595439 - DNA, 25 bp, Rattus norvegicus
tctcttcctaggttgtcaggtctca

SEQ ID NO: 595440 - DNA, 25 bp, Rattus norvegicus
tctcttcctctcagcagtaacagaa

SEQ ID NO: 595441 - DNA, 25 bp, Rattus norvegicus
tctcttcctctctgcagtaacagaa

SEQ ID NO: 595442 - DNA, 25 bp, Rattus norvegicus
tctcttcctgccatctttatcataa

SEQ ID NO: 595443 - DNA, 25 bp, Rattus norvegicus
tctcttcctgccttctttatcataa

SEQ ID NO: 595444 - DNA, 25 bp, Rattus norvegicus
tctcttcctggcaggaatgctctga

SEQ ID NO: 595445 - DNA, 25 bp, Rattus norvegicus
tctcttcctggctggaatgctctga

SEQ ID NO: 595446 - DNA, 25 bp, Rattus norvegicus
tctcttccttctacagtcaatgtca

SEQ ID NO: 595447 - DNA, 25 bp, Rattus norvegicus
tctcttccttcttcagtcaatgtca

SEQ ID NO: 595448 - DNA, 25 bp, Rattus norvegicus
tctcttcgggagaccaacggcggag

SEQ ID NO: 595449 - DNA, 25 bp, Rattus norvegicus
tctcttcgggagtccaacggcggag

SEQ ID NO: 595450 - DNA, 25 bp, Rattus norvegicus
tctcttcgtaacacaggccagcagt

SEQ ID NO: 595451 - DNA, 25 bp, Rattus norvegicus
tctcttcgtaactcaggccagcagt

SEQ ID NO: 595452 - DNA, 25 bp, Rattus norvegicus
tctcttctagagacggtgagccaag

SEQ ID NO: 595453 - DNA, 25 bp, Rattus norvegicus
tctcttctagagtcggtgagccaag

SEQ ID NO: 595454 - DNA, 25 bp, Rattus norvegicus
tctcttctcataattatggcatcta

SEQ ID NO: 595455 - DNA, 25 bp, Rattus norvegicus
tctcttctcatatttatggcatcta

SEQ ID NO: 595456 - DNA, 25 bp, Rattus norvegicus
tctcttctcatgagggttgagcata

SEQ ID NO: 595457 - DNA, 25 bp, Rattus norvegicus
tctcttctcatgtgggttgagcata

SEQ ID NO: 595458 - DNA, 25 bp, Rattus norvegicus
tctcttctccatatgtcctaaattg

SEQ ID NO: 595459 - DNA, 25 bp, Rattus norvegicus
tctcttctccatttgtcctaaattg

SEQ ID NO: 595460 - DNA, 25 bp, Rattus norvegicus
tctcttctccggagcttgatggtgt

SEQ ID NO: 595461 - DNA, 25 bp, Rattus norvegicus
tctcttctccggtgcttgatggtgt

SEQ ID NO: 595462 - DNA, 25 bp, Rattus norvegicus
tctcttctctagaccttcgagtgta

SEQ ID NO: 595463 - DNA, 25 bp, Rattus norvegicus
tctcttctctagtccttcgagtgta

SEQ ID NO: 595464 - DNA, 25 bp, Rattus norvegicus
tctcttctctcaagctgacagttac

SEQ ID NO: 595465 - DNA, 25 bp, Rattus norvegicus
tctcttctctcatgctgacagttac

SEQ ID NO: 595466 - DNA, 25 bp, Rattus norvegicus
tctcttctctgccatcagttagtta

SEQ ID NO: 595467 - DNA, 25 bp, Rattus norvegicus
tctcttctctgcgatcagttagtta

SEQ ID NO: 595468 - DNA, 25 bp, Rattus norvegicus
tctcttctgagactgacttcttttt

SEQ ID NO: 595469 - DNA, 25 bp, Rattus norvegicus
tctcttctgagagtgacttcttttt

SEQ ID NO: 595470 - DNA, 25 bp, Rattus norvegicus
tctcttctgcctcttgattgtcatt

SEQ ID NO: 595471 - DNA, 25 bp, Rattus norvegicus
tctcttctgcctgttgattgtcatt

SEQ ID NO: 595472 - DNA, 25 bp, Rattus norvegicus
tctcttcttagcattgtcacaatgt

SEQ ID NO: 595473 - DNA, 25 bp, Rattus norvegicus
tctcttcttagctttgtcacaatgt

SEQ ID NO: 595474 - DNA, 25 bp, Rattus norvegicus
tctcttcttcttcggagccttggaa

SEQ ID NO: 595475 - DNA, 25 bp, Rattus norvegicus
tctcttcttcttgggagccttggaa

SEQ ID NO: 595476 - DNA, 25 bp, Rattus norvegicus
tctcttcttgaaccacaccgggctg

SEQ ID NO: 595477 - DNA, 25 bp, Rattus norvegicus
tctcttcttgaagcacaccgggctg

SEQ ID NO: 595478 - DNA, 25 bp, Rattus norvegicus
tctcttcttgctagggcatcaccgt

SEQ ID NO: 595479 - DNA, 25 bp, Rattus norvegicus
tctcttcttgcttgggcatcaccgt

SEQ ID NO: 595480 - DNA, 25 bp, Rattus norvegicus
tctcttcttggacaaagctgccatg

SEQ ID NO: 595481 - DNA, 25 bp, Rattus norvegicus
tctcttcttggagaaagctgccatg

SEQ ID NO: 595482 - DNA, 25 bp, Rattus norvegicus
tctcttcttgtgctagcgggttagt

SEQ ID NO: 595483 - DNA, 25 bp, Rattus norvegicus
tctcttcttgtggtagcgggttagt

SEQ ID NO: 595484 - DNA, 25 bp, Rattus norvegicus
tctcttctttccattctcaaactca

SEQ ID NO: 595485 - DNA, 25 bp, Rattus norvegicus
tctcttctttcctttctcaaactca

SEQ ID NO: 595486 - DNA, 25 bp, Rattus norvegicus
tctcttctttttctgacttacttta

SEQ ID NO: 595487 - DNA, 25 bp, Rattus norvegicus
tctcttctttttgtgacttacttta

SEQ ID NO: 595488 - DNA, 25 bp, Rattus norvegicus
tctcttgagaggcaaagccatggag

SEQ ID NO: 595489 - DNA, 25 bp, Rattus norvegicus
tctcttgagagggaaagccatggag

SEQ ID NO: 595490 - DNA, 25 bp, Rattus norvegicus
tctcttgatcagcttgtccagtgaa

SEQ ID NO: 595491 - DNA, 25 bp, Rattus norvegicus
tctcttgatcaggttgtccagtgaa

SEQ ID NO: 595492 - DNA, 25 bp, Rattus norvegicus
tctcttgatcttctgtcagcttttt

SEQ ID NO: 595493 - DNA, 25 bp, Rattus norvegicus
tctcttgatcttgtgtcagcttttt

SEQ ID NO: 595494 - DNA, 25 bp, Rattus norvegicus
tctcttgattctattccttgtgtag

SEQ ID NO: 595495 - DNA, 25 bp, Rattus norvegicus
tctcttgattcttttccttgtgtag

SEQ ID NO: 595496 - DNA, 25 bp, Rattus norvegicus
tctcttgcactccatactgtacttc

SEQ ID NO: 595497 - DNA, 25 bp, Rattus norvegicus
tctcttgcactcgatactgtacttc

SEQ ID NO: 595498 - DNA, 25 bp, Rattus norvegicus
tctcttgcacttacatatccggtaa

SEQ ID NO: 595499 - DNA, 25 bp, Rattus norvegicus
tctcttgcactttcatatccggtaa

SEQ ID NO: 595500 - DNA, 25 bp, Rattus norvegicus
tctcttgcagtgcatggacgcgttt

SEQ ID NO: 595501 - DNA, 25 bp, Rattus norvegicus
tctcttgcagtggatggacgcgttt

SEQ ID NO: 595502 - DNA, 25 bp, Rattus norvegicus
tctcttgcccacagtggtttctggc

SEQ ID NO: 595503 - DNA, 25 bp, Rattus norvegicus
tctcttgcccactgtggtttctggc

SEQ ID NO: 595504 - DNA, 25 bp, Rattus norvegicus
tctcttgcctgcctttgtgctgagc

SEQ ID NO: 595505 - DNA, 25 bp, Rattus norvegicus
tctcttgcctgcgtttgtgctgagc

SEQ ID NO: 595506 - DNA, 25 bp, Rattus norvegicus
tctcttgccttgagaaacctcagac

SEQ ID NO: 595507 - DNA, 25 bp, Rattus norvegicus
tctcttgccttgtgaaacctcagac

SEQ ID NO: 595508 - DNA, 25 bp, Rattus norvegicus
tctcttgcgttgagaattgacctga

SEQ ID NO: 595509 - DNA, 25 bp, Rattus norvegicus
tctcttgcgttgtgaattgacctga

SEQ ID NO: 595510 - DNA, 25 bp, Rattus norvegicus
tctcttgctactaaagaccaggccg

SEQ ID NO: 595511 - DNA, 25 bp, Rattus norvegicus
tctcttgctacttaagaccaggccg

SEQ ID NO: 595512 - DNA, 25 bp, Rattus norvegicus
tctcttgctatgcttctctgaaagg

SEQ ID NO: 595513 - DNA, 25 bp, Rattus norvegicus
tctcttgctatggttctctgaaagg

SEQ ID NO: 595514 - DNA, 25 bp, Rattus norvegicus
tctcttgctcagatttgggactaca

SEQ ID NO: 595515 - DNA, 25 bp, Rattus norvegicus
tctcttgctcagttttgggactaca

SEQ ID NO: 595516 - DNA, 25 bp, Rattus norvegicus
tctcttgctcataagatggactaca

SEQ ID NO: 595517 - DNA, 25 bp, Rattus norvegicus
tctcttgctcattagatggactaca

SEQ ID NO: 595518 - DNA, 25 bp, Rattus norvegicus
tctcttgctctcataggcttacaaa

SEQ ID NO: 595519 - DNA, 25 bp, Rattus norvegicus
tctcttgctctcttaggcttacaaa

SEQ ID NO: 595520 - DNA, 25 bp, Rattus norvegicus
tctcttgcttaaacccagagcctgg

SEQ ID NO: 595521 - DNA, 25 bp, Rattus norvegicus
tctcttgcttaatcccagagcctgg

SEQ ID NO: 595522 - DNA, 25 bp, Rattus norvegicus
tctcttgcttgtcgaaacccgtgta

SEQ ID NO: 595523 - DNA, 25 bp, Rattus norvegicus
tctcttgcttgtggaaacccgtgta

SEQ ID NO: 595524 - DNA, 25 bp, Rattus norvegicus
tctcttggaagacgctcggtgtttt

SEQ ID NO: 595525 - DNA, 25 bp, Rattus norvegicus
tctcttggaagactgcagtcagcct

SEQ ID NO: 595526 - DNA, 25 bp, Rattus norvegicus
tctcttggaagaggctcggtgtttt

SEQ ID NO: 595527 - DNA, 25 bp, Rattus norvegicus
tctcttggaagagtgcagtcagcct

SEQ ID NO: 595528 - DNA, 25 bp, Rattus norvegicus
tctcttggcgtgaactttgcacaga

SEQ ID NO: 595529 - DNA, 25 bp, Rattus norvegicus
tctcttggcgtgtactttgcacaga

SEQ ID NO: 595530 - DNA, 25 bp, Rattus norvegicus
tctcttgggctcagaagaccagcct

SEQ ID NO: 595531 - DNA, 25 bp, Rattus norvegicus
tctcttgggctctgaagaccagcct

SEQ ID NO: 595532 - DNA, 25 bp, Rattus norvegicus
tctcttggtctaactctggcttaaa

SEQ ID NO: 595533 - DNA, 25 bp, Rattus norvegicus
tctcttggtctatctctggcttaaa

SEQ ID NO: 595534 - DNA, 25 bp, Rattus norvegicus
tctcttggtggcatggacctgcaca

SEQ ID NO: 595535 - DNA, 25 bp, Rattus norvegicus
tctcttggtggcctttgccgcaggt

SEQ ID NO: 595536 - DNA, 25 bp, Rattus norvegicus
tctcttggtggcgtttgccgcaggt

SEQ ID NO: 595537 - DNA, 25 bp, Rattus norvegicus
tctcttggtggcttggacctgcaca

SEQ ID NO: 595538 - DNA, 25 bp, Rattus norvegicus
tctcttggtgttaccagggactgac

SEQ ID NO: 595539 - DNA, 25 bp, Rattus norvegicus
tctcttggtgtttccagggactgac

SEQ ID NO: 595540 - DNA, 25 bp, Rattus norvegicus
tctcttggttttatactgggcatga

SEQ ID NO: 595541 - DNA, 25 bp, Rattus norvegicus
tctcttggttttttactgggcatga

SEQ ID NO: 595542 - DNA, 25 bp, Rattus norvegicus
tctcttgtaacgagctctcttgaaa

SEQ ID NO: 595543 - DNA, 25 bp, Rattus norvegicus
tctcttgtaacgtgctctcttgaaa

SEQ ID NO: 595544 - DNA, 25 bp, Rattus norvegicus
tctcttgtacaaatcgaattaactg

SEQ ID NO: 595545 - DNA, 25 bp, Rattus norvegicus
tctcttgtacaattcgaattaactg

SEQ ID NO: 595546 - DNA, 25 bp, Rattus norvegicus
tctcttgtcctcagtgtgcttgcca

SEQ ID NO: 595547 - DNA, 25 bp, Rattus norvegicus
tctcttgtcctctgtgtgcttgcca

SEQ ID NO: 595548 - DNA, 25 bp, Rattus norvegicus
tctcttgtctctcatacctgttaat

SEQ ID NO: 595549 - DNA, 25 bp, Rattus norvegicus
tctcttgtctctgatacctgttaat

SEQ ID NO: 595550 - DNA, 25 bp, Rattus norvegicus
tctcttgtgcagcatccatgtggtg

SEQ ID NO: 595551 - DNA, 25 bp, Rattus norvegicus
tctcttgtgcaggatccatgtggtg

SEQ ID NO: 595552 - DNA, 25 bp, Rattus norvegicus
tctcttgtgctcagctgagggcaga

SEQ ID NO: 595553 - DNA, 25 bp, Rattus norvegicus
tctcttgtgctctgctgagggcaga

SEQ ID NO: 595554 - DNA, 25 bp, Rattus norvegicus
tctcttgttgttcgagcctggagcc

SEQ ID NO: 595555 - DNA, 25 bp, Rattus norvegicus
tctcttgttgttggagcctggagcc

SEQ ID NO: 595556 - DNA, 25 bp, Rattus norvegicus
tctcttgttttaacctgtactcagg

SEQ ID NO: 595557 - DNA, 25 bp, Rattus norvegicus
tctcttgttttatcctgtactcagg

SEQ ID NO: 595558 - DNA, 25 bp, Rattus norvegicus
tctctttaaactcattgatggcttg

SEQ ID NO: 595559 - DNA, 25 bp, Rattus norvegicus
tctctttaaactgattgatggcttg

SEQ ID NO: 595560 - DNA, 25 bp, Rattus norvegicus
tctctttattggaccttttttggct

SEQ ID NO: 595561 - DNA, 25 bp, Rattus norvegicus
tctctttattggtccttttttggct

SEQ ID NO: 595562 - DNA, 25 bp, Rattus norvegicus
tctctttcacatctttttactactt

SEQ ID NO: 595563 - DNA, 25 bp, Rattus norvegicus
tctctttcacatgtttttactactt

SEQ ID NO: 595564 - DNA, 25 bp, Rattus norvegicus
tctctttcagggacataatggctct

SEQ ID NO: 595565 - DNA, 25 bp, Rattus norvegicus
tctctttcagggtcataatggctct

SEQ ID NO: 595566 - DNA, 25 bp, Rattus norvegicus
tctctttccatgacttccgggacga

SEQ ID NO: 595567 - DNA, 25 bp, Rattus norvegicus
tctctttccatgtcttccgggacga

SEQ ID NO: 595568 - DNA, 25 bp, Rattus norvegicus
tctctttcctctacacagatgtaac

SEQ ID NO: 595569 - DNA, 25 bp, Rattus norvegicus
tctctttcctcttcacagatgtaac

SEQ ID NO: 595570 - DNA, 25 bp, Rattus norvegicus
tctctttccttgcttgttacctcta

SEQ ID NO: 595571 - DNA, 25 bp, Rattus norvegicus
tctctttccttggttgttacctcta

SEQ ID NO: 595572 - DNA, 25 bp, Rattus norvegicus
tctctttcgctaccagatcaggtta

SEQ ID NO: 595573 - DNA, 25 bp, Rattus norvegicus
tctctttcgctagcagatcaggtta

SEQ ID NO: 595574 - DNA, 25 bp, Rattus norvegicus
tctctttctcctacttgtttcattt

SEQ ID NO: 595575 - DNA, 25 bp, Rattus norvegicus
tctctttctccttcttgtttcattt

SEQ ID NO: 595576 - DNA, 25 bp, Rattus norvegicus
tctctttctcgccttatgatgaatt

SEQ ID NO: 595577 - DNA, 25 bp, Rattus norvegicus
tctctttctcgcgttatgatgaatt

SEQ ID NO: 595578 - DNA, 25 bp, Rattus norvegicus
tctctttctctgacttcattgtatt

SEQ ID NO: 595579 - DNA, 25 bp, Rattus norvegicus
tctctttctctgtcttcattgtatt

SEQ ID NO: 595580 - DNA, 25 bp, Rattus norvegicus
tctctttctgctcgtcgtctacaaa

SEQ ID NO: 595581 - DNA, 25 bp, Rattus norvegicus
tctctttctgctggtcgtctacaaa

SEQ ID NO: 595582 - DNA, 25 bp, Rattus norvegicus
tctctttcttccatacttagccagt

SEQ ID NO: 595583 - DNA, 25 bp, Rattus norvegicus
tctctttcttccttacttagccagt

SEQ ID NO: 595584 - DNA, 25 bp, Rattus norvegicus
tctctttcttttatcaggccagaag

SEQ ID NO: 595585 - DNA, 25 bp, Rattus norvegicus
tctctttcttttatccgcagctgta

SEQ ID NO: 595586 - DNA, 25 bp, Rattus norvegicus
tctctttcttttttcaggccagaag

SEQ ID NO: 595587 - DNA, 25 bp, Rattus norvegicus
tctctttcttttttccgcagctgta

SEQ ID NO: 595588 - DNA, 25 bp, Rattus norvegicus
tctctttgaacaacagccacgctgg

SEQ ID NO: 595589 - DNA, 25 bp, Rattus norvegicus
tctctttgaacatcagccacgctgg

SEQ ID NO: 595590 - DNA, 25 bp, Rattus norvegicus
tctctttgactccattttcgtgaca

SEQ ID NO: 595591 - DNA, 25 bp, Rattus norvegicus
tctctttgactcgattttcgtgaca

SEQ ID NO: 595592 - DNA, 25 bp, Rattus norvegicus
tctctttgagcacattaacttccct

SEQ ID NO: 595593 - DNA, 25 bp, Rattus norvegicus
tctctttgagcagattaacttccct

SEQ ID NO: 595594 - DNA, 25 bp, Rattus norvegicus
tctctttgcaaactgcctttttcag

SEQ ID NO: 595595 - DNA, 25 bp, Rattus norvegicus
tctctttgcaaagtgcctttttcag

SEQ ID NO: 595596 - DNA, 25 bp, Rattus norvegicus
tctctttgcctcattgtcttagtca

SEQ ID NO: 595597 - DNA, 25 bp, Rattus norvegicus
tctctttgcctctttgtcttagtca

SEQ ID NO: 595598 - DNA, 25 bp, Rattus norvegicus
tctctttgctttagactgcaggtgt

SEQ ID NO: 595599 - DNA, 25 bp, Rattus norvegicus
tctctttgcttttgactgcaggtgt

SEQ ID NO: 595600 - DNA, 25 bp, Rattus norvegicus
tctctttgtactatttctccttgat

SEQ ID NO: 595601 - DNA, 25 bp, Rattus norvegicus
tctctttgtactttttctccttgat

SEQ ID NO: 595602 - DNA, 25 bp, Rattus norvegicus
tctctttgttctactcactggctgg

SEQ ID NO: 595603 - DNA, 25 bp, Rattus norvegicus
tctctttgttcttctcactggctgg

SEQ ID NO: 595604 - DNA, 25 bp, Rattus norvegicus
tctcttttattcactctcagtctga

SEQ ID NO: 595605 - DNA, 25 bp, Rattus norvegicus
tctcttttattctctctcagtctga

SEQ ID NO: 595606 - DNA, 25 bp, Rattus norvegicus
tctcttttcagcaaggatggtcttg

SEQ ID NO: 595607 - DNA, 25 bp, Rattus norvegicus
tctcttttcagcactttaaccctaa

SEQ ID NO: 595608 - DNA, 25 bp, Rattus norvegicus
tctcttttcagctaggatggtcttg

SEQ ID NO: 595609 - DNA, 25 bp, Rattus norvegicus
tctcttttcagctctttaaccctaa

SEQ ID NO: 595610 - DNA, 25 bp, Rattus norvegicus
tctcttttcccaacagacatgatta

SEQ ID NO: 595611 - DNA, 25 bp, Rattus norvegicus
tctcttttcccatcagacatgatta

SEQ ID NO: 595612 - DNA, 25 bp, Rattus norvegicus
tctcttttctgcaccaagaagtgac

SEQ ID NO: 595613 - DNA, 25 bp, Rattus norvegicus
tctcttttctgctccaagaagtgac

SEQ ID NO: 595614 - DNA, 25 bp, Rattus norvegicus
tctcttttcttcatgtaccagtagg

SEQ ID NO: 595615 - DNA, 25 bp, Rattus norvegicus
tctcttttcttcttgtaccagtagg

SEQ ID NO: 595616 - DNA, 25 bp, Rattus norvegicus
tctcttttctttcgctgtcttgtaa

SEQ ID NO: 595617 - DNA, 25 bp, Rattus norvegicus
tctcttttctttggctgtcttgtaa

SEQ ID NO: 595618 - DNA, 25 bp, Rattus norvegicus
tctcttttgcatccttatcctgaaa

SEQ ID NO: 595619 - DNA, 25 bp, Rattus norvegicus
tctcttttgcatgcttatcctgaaa

SEQ ID NO: 595620 - DNA, 25 bp, Rattus norvegicus
tctctttttaaccttgcccaagtgt

SEQ ID NO: 595621 - DNA, 25 bp, Rattus norvegicus
tctctttttaacgttgcccaagtgt

SEQ ID NO: 595622 - DNA, 25 bp, Rattus norvegicus
tctctttttgctacccagatcacag

SEQ ID NO: 595623 - DNA, 25 bp, Rattus norvegicus
tctctttttgcttcccagatcacag

SEQ ID NO: 595624 - DNA, 25 bp, Rattus norvegicus
tctgaaaacagcagcaaccggtcct

SEQ ID NO: 595625 - DNA, 25 bp, Rattus norvegicus
tctgaaaacagctgcaaccggtcct

SEQ ID NO: 595626 - DNA, 25 bp, Rattus norvegicus
tctgaaaactcgcactcctcttctt

SEQ ID NO: 595627 - DNA, 25 bp, Rattus norvegicus
tctgaaaactcggactcctcttctt

SEQ ID NO: 595628 - DNA, 25 bp, Rattus norvegicus
tctgaaacagttacccaggtgcctg

SEQ ID NO: 595629 - DNA, 25 bp, Rattus norvegicus
tctgaaacagtttcccaggtgcctg

SEQ ID NO: 595630 - DNA, 25 bp, Rattus norvegicus
tctgaaacccaacagagccgagact

SEQ ID NO: 595631 - DNA, 25 bp, Rattus norvegicus
tctgaaacccaagagagccgagact

SEQ ID NO: 595632 - DNA, 25 bp, Rattus norvegicus
tctgaaacccctctttggtgctcat

SEQ ID NO: 595633 - DNA, 25 bp, Rattus norvegicus
tctgaaacccctgtttggtgctcat

SEQ ID NO: 595634 - DNA, 25 bp, Rattus norvegicus
tctgaaactggtccctgtcctaagc

SEQ ID NO: 595635 - DNA, 25 bp, Rattus norvegicus
tctgaaactggtgcctgtcctaagc

SEQ ID NO: 595636 - DNA, 25 bp, Rattus norvegicus
tctgaaagattgatcttccccaggg

SEQ ID NO: 595637 - DNA, 25 bp, Rattus norvegicus
tctgaaagattgttcttccccaggg

SEQ ID NO: 595638 - DNA, 25 bp, Rattus norvegicus
tctgaaagcttcagacaggccgcat

SEQ ID NO: 595639 - DNA, 25 bp, Rattus norvegicus
tctgaaagcttctgacaggccgcat

SEQ ID NO: 595640 - DNA, 25 bp, Rattus norvegicus
tctgaaaggtcacggacatttccta

SEQ ID NO: 595641 - DNA, 25 bp, Rattus norvegicus
tctgaaaggtcagggacatttccta

SEQ ID NO: 595642 - DNA, 25 bp, Rattus norvegicus
tctgaaatcagtaacgtcaccgcca

SEQ ID NO: 595643 - DNA, 25 bp, Rattus norvegicus
tctgaaatcagttacgtcaccgcca

SEQ ID NO: 595644 - DNA, 25 bp, Rattus norvegicus
tctgaaatctttcccatgctacatt

SEQ ID NO: 595645 - DNA, 25 bp, Rattus norvegicus
tctgaaatctttgccatgctacatt

SEQ ID NO: 595646 - DNA, 25 bp, Rattus norvegicus
tctgaaatgctgatgctgatgtaca

SEQ ID NO: 595647 - DNA, 25 bp, Rattus norvegicus
tctgaaatgctgttgctgatgtaca

SEQ ID NO: 595648 - DNA, 25 bp, Rattus norvegicus
tctgaacaagcgcaaagtgcccata

SEQ ID NO: 595649 - DNA, 25 bp, Rattus norvegicus
tctgaacaagcggaaagtgcccata

SEQ ID NO: 595650 - DNA, 25 bp, Rattus norvegicus
tctgaacacctccattgttatgcca

SEQ ID NO: 595651 - DNA, 25 bp, Rattus norvegicus
tctgaacacctcgattgttatgcca

SEQ ID NO: 595652 - DNA, 25 bp, Rattus norvegicus
tctgaacatggcctcagctggattt

SEQ ID NO: 595653 - DNA, 25 bp, Rattus norvegicus
tctgaacatggcgtcagctggattt

SEQ ID NO: 595654 - DNA, 25 bp, Rattus norvegicus
tctgaacccataacaaatcacctca

SEQ ID NO: 595655 - DNA, 25 bp, Rattus norvegicus
tctgaacccatatcaaatcacctca

SEQ ID NO: 595656 - DNA, 25 bp, Rattus norvegicus
tctgaacctactacggagccaatgt

SEQ ID NO: 595657 - DNA, 25 bp, Rattus norvegicus
tctgaacctacttcggagccaatgt

SEQ ID NO: 595658 - DNA, 25 bp, Rattus norvegicus
tctgaacctatgcacatcacctgaa

SEQ ID NO: 595659 - DNA, 25 bp, Rattus norvegicus
tctgaacctatggacatcacctgaa

SEQ ID NO: 595660 - DNA, 25 bp, Rattus norvegicus
tctgaacctcctatttatttcctag

SEQ ID NO: 595661 - DNA, 25 bp, Rattus norvegicus
tctgaacctcctttttatttcctag

SEQ ID NO: 595662 - DNA, 25 bp, Rattus norvegicus
tctgaacctggactgatacaataag

SEQ ID NO: 595663 - DNA, 25 bp, Rattus norvegicus
tctgaacctggagtgatacaataag

SEQ ID NO: 595664 - DNA, 25 bp, Rattus norvegicus
tctgaacgtagcacaggctggtctt

SEQ ID NO: 595665 - DNA, 25 bp, Rattus norvegicus
tctgaacgtagctcaggctggtctt

SEQ ID NO: 595666 - DNA, 25 bp, Rattus norvegicus
tctgaactcatgcactggtgggcct

SEQ ID NO: 595667 - DNA, 25 bp, Rattus norvegicus
tctgaactcatggactggtgggcct

SEQ ID NO: 595668 - DNA, 25 bp, Rattus norvegicus
tctgaactccacatgtgtgctatgg

SEQ ID NO: 595669 - DNA, 25 bp, Rattus norvegicus
tctgaactccacttgtgtgctatgg

SEQ ID NO: 595670 - DNA, 25 bp, Rattus norvegicus
tctgaactccgtagcacactgagag

SEQ ID NO: 595671 - DNA, 25 bp, Rattus norvegicus
tctgaactccgttgcacactgagag

SEQ ID NO: 595672 - DNA, 25 bp, Rattus norvegicus
tctgaactcctccattgctgaataa

SEQ ID NO: 595673 - DNA, 25 bp, Rattus norvegicus
tctgaactcctcgattgctgaataa

SEQ ID NO: 595674 - DNA, 25 bp, Rattus norvegicus
tctgaactctgcattctgttcatca

SEQ ID NO: 595675 - DNA, 25 bp, Rattus norvegicus
tctgaactctgctttctgttcatca

SEQ ID NO: 595676 - DNA, 25 bp, Rattus norvegicus
tctgaactcttcagtgtgcaacgaa

SEQ ID NO: 595677 - DNA, 25 bp, Rattus norvegicus
tctgaactcttctgtgtgcaacgaa

SEQ ID NO: 595678 - DNA, 25 bp, Rattus norvegicus
tctgaacttgttctccttgatggtt

SEQ ID NO: 595679 - DNA, 25 bp, Rattus norvegicus
tctgaacttgttgtccttgatggtt

SEQ ID NO: 595680 - DNA, 25 bp, Rattus norvegicus
tctgaagaagcactggtccacctcc

SEQ ID NO: 595681 - DNA, 25 bp, Rattus norvegicus
tctgaagaagcagtggtccacctcc

SEQ ID NO: 595682 - DNA, 25 bp, Rattus norvegicus
tctgaagacagtacgcacggctaca

SEQ ID NO: 595683 - DNA, 25 bp, Rattus norvegicus
tctgaagacagttcgcacggctaca

SEQ ID NO: 595684 - DNA, 25 bp, Rattus norvegicus
tctgaagacctcctgcatagtgact

SEQ ID NO: 595685 - DNA, 25 bp, Rattus norvegicus
tctgaagacctcgtgcatagtgact

SEQ ID NO: 595686 - DNA, 25 bp, Rattus norvegicus
tctgaagagaacatctgaccagtgt

SEQ ID NO: 595687 - DNA, 25 bp, Rattus norvegicus
tctgaagagaacttctgaccagtgt

SEQ ID NO: 595688 - DNA, 25 bp, Rattus norvegicus
tctgaagatactcggcttgcctgtc

SEQ ID NO: 595689 - DNA, 25 bp, Rattus norvegicus
tctgaagatactgggcttgcctgtc

SEQ ID NO: 595690 - DNA, 25 bp, Rattus norvegicus
tctgaagatcgaagcctgtgtgtaa

SEQ ID NO: 595691 - DNA, 25 bp, Rattus norvegicus
tctgaagatcgatgcctgtgtgtaa

SEQ ID NO: 595692 - DNA, 25 bp, Rattus norvegicus
tctgaagatgttcagcaccggcttg

SEQ ID NO: 595693 - DNA, 25 bp, Rattus norvegicus
tctgaagatgttgagcaccggcttg

SEQ ID NO: 595694 - DNA, 25 bp, Rattus norvegicus
tctgaagcaaacacagcctcggcag

SEQ ID NO: 595695 - DNA, 25 bp, Rattus norvegicus
tctgaagcaaactcagcctcggcag

SEQ ID NO: 595696 - DNA, 25 bp, Rattus norvegicus
tctgaagcaagtcaaggtccccatt

SEQ ID NO: 595697 - DNA, 25 bp, Rattus norvegicus
tctgaagcaagtgaaggtccccatt

SEQ ID NO: 595698 - DNA, 25 bp, Rattus norvegicus
tctgaagccctgacaccttggagag

SEQ ID NO: 595699 - DNA, 25 bp, Rattus norvegicus
tctgaagccctgtcaccttggagag

SEQ ID NO: 595700 - DNA, 25 bp, Rattus norvegicus
tctgaagctattatcactttctggg

SEQ ID NO: 595701 - DNA, 25 bp, Rattus norvegicus
tctgaagctattttcactttctggg

SEQ ID NO: 595702 - DNA, 25 bp, Rattus norvegicus
tctgaagctgctactgaccaaggat

SEQ ID NO: 595703 - DNA, 25 bp, Rattus norvegicus
tctgaagctgcttctgaccaaggat

SEQ ID NO: 595704 - DNA, 25 bp, Rattus norvegicus
tctgaagggccaacaagttgcactg

SEQ ID NO: 595705 - DNA, 25 bp, Rattus norvegicus
tctgaagggccatcaagttgcactg

SEQ ID NO: 595706 - DNA, 25 bp, Rattus norvegicus
tctgaaggtcatcttcaatggtgtc

SEQ ID NO: 595707 - DNA, 25 bp, Rattus norvegicus
tctgaaggtcatgttcaatggtgtc

SEQ ID NO: 595708 - DNA, 25 bp, Rattus norvegicus
tctgaaggtgctacccagagcaaag

SEQ ID NO: 595709 - DNA, 25 bp, Rattus norvegicus
tctgaaggtgcttcccagagcaaag

SEQ ID NO: 595710 - DNA, 25 bp, Rattus norvegicus
tctgaaggtggaactgtcccagctt

SEQ ID NO: 595711 - DNA, 25 bp, Rattus norvegicus
tctgaaggtggatctgtcccagctt

SEQ ID NO: 595712 - DNA, 25 bp, Rattus norvegicus
tctgaagtaccccatagagcacggc

SEQ ID NO: 595713 - DNA, 25 bp, Rattus norvegicus
tctgaagtacccgatagagcacggc

SEQ ID NO: 595714 - DNA, 25 bp, Rattus norvegicus
tctgaagtccctcaacggttttaat

SEQ ID NO: 595715 - DNA, 25 bp, Rattus norvegicus
tctgaagtccctgaacggttttaat

SEQ ID NO: 595716 - DNA, 25 bp, Rattus norvegicus
tctgaagtcctcagttcttgggcaa

SEQ ID NO: 595717 - DNA, 25 bp, Rattus norvegicus
tctgaagtcctctgttcttgggcaa

SEQ ID NO: 595718 - DNA, 25 bp, Rattus norvegicus
tctgaagtctccacgggctctaaga

SEQ ID NO: 595719 - DNA, 25 bp, Rattus norvegicus
tctgaagtctcctcgggctctaaga

SEQ ID NO: 595720 - DNA, 25 bp, Rattus norvegicus
tctgaagtgtccactcggcagtgaa

SEQ ID NO: 595721 - DNA, 25 bp, Rattus norvegicus
tctgaagtgtcctctcggcagtgaa

SEQ ID NO: 595722 - DNA, 25 bp, Rattus norvegicus
tctgaagttaggaggctccaggcaa

SEQ ID NO: 595723 - DNA, 25 bp, Rattus norvegicus
tctgaagttaggtggctccaggcaa

SEQ ID NO: 595724 - DNA, 25 bp, Rattus norvegicus
tctgaagttcatagccaggactgtg

SEQ ID NO: 595725 - DNA, 25 bp, Rattus norvegicus
tctgaagttcattgccaggactgtg

SEQ ID NO: 595726 - DNA, 25 bp, Rattus norvegicus
tctgaagttcctaggctaactgctt

SEQ ID NO: 595727 - DNA, 25 bp, Rattus norvegicus
tctgaagttccttggctaactgctt

SEQ ID NO: 595728 - DNA, 25 bp, Rattus norvegicus
tctgaagttctacgctatcctggtc

SEQ ID NO: 595729 - DNA, 25 bp, Rattus norvegicus
tctgaagttctaggctatcctggtc

SEQ ID NO: 595730 - DNA, 25 bp, Rattus norvegicus
tctgaatagacgatctgtgtggcac

SEQ ID NO: 595731 - DNA, 25 bp, Rattus norvegicus
tctgaatagacgttctgtgtggcac

SEQ ID NO: 595732 - DNA, 25 bp, Rattus norvegicus
tctgaatcactcatcacccttgggc

SEQ ID NO: 595733 - DNA, 25 bp, Rattus norvegicus
tctgaatcactcttcacccttgggc

SEQ ID NO: 595734 - DNA, 25 bp, Rattus norvegicus
tctgaatccagaccccagcagggag

SEQ ID NO: 595735 - DNA, 25 bp, Rattus norvegicus
tctgaatccagagcccagcagggag

SEQ ID NO: 595736 - DNA, 25 bp, Rattus norvegicus
tctgaatcccagacggaggcgtata

SEQ ID NO: 595737 - DNA, 25 bp, Rattus norvegicus
tctgaatcccagtcggaggcgtata

SEQ ID NO: 595738 - DNA, 25 bp, Rattus norvegicus
tctgaatgagcccatcttgtggatt

SEQ ID NO: 595739 - DNA, 25 bp, Rattus norvegicus
tctgaatgagccgatcttgtggatt

SEQ ID NO: 595740 - DNA, 25 bp, Rattus norvegicus
tctgaatgatggctctcaagtatcc

SEQ ID NO: 595741 - DNA, 25 bp, Rattus norvegicus
tctgaatgatgggtctcaagtatcc

SEQ ID NO: 595742 - DNA, 25 bp, Rattus norvegicus
tctgaatgcaagaccgcccagatca

SEQ ID NO: 595743 - DNA, 25 bp, Rattus norvegicus
tctgaatgcaagtccgcccagatca

SEQ ID NO: 595744 - DNA, 25 bp, Rattus norvegicus
tctgaatgcagaagccaggccaggc

SEQ ID NO: 595745 - DNA, 25 bp, Rattus norvegicus
tctgaatgcagatgccaggccaggc

SEQ ID NO: 595746 - DNA, 25 bp, Rattus norvegicus
tctgaatggactcccttcctgctgg

SEQ ID NO: 595747 - DNA, 25 bp, Rattus norvegicus
tctgaatggactgccttcctgctgg

SEQ ID NO: 595748 - DNA, 25 bp, Rattus norvegicus
tctgaatggcctatgtctttcttct

SEQ ID NO: 595749 - DNA, 25 bp, Rattus norvegicus
tctgaatggcctttgtctttcttct

SEQ ID NO: 595750 - DNA, 25 bp, Rattus norvegicus
tctgaatggtacctgtcccatcaac

SEQ ID NO: 595751 - DNA, 25 bp, Rattus norvegicus
tctgaatggtacgtgtcccatcaac

SEQ ID NO: 595752 - DNA, 25 bp, Rattus norvegicus
tctgaattcaggacccagttgctgt

SEQ ID NO: 595753 - DNA, 25 bp, Rattus norvegicus
tctgaattcaggtcccagttgctgt

SEQ ID NO: 595754 - DNA, 25 bp, Rattus norvegicus
tctgaatttcaacggctcctctgac

SEQ ID NO: 595755 - DNA, 25 bp, Rattus norvegicus
tctgaatttcaagggctcctctgac

SEQ ID NO: 595756 - DNA, 25 bp, Rattus norvegicus
tctgaatttttccatttatgaaacc

SEQ ID NO: 595757 - DNA, 25 bp, Rattus norvegicus
tctgaatttttcgatttatgaaacc

SEQ ID NO: 595758 - DNA, 25 bp, Rattus norvegicus
tctgacaaccctcatatcacatttt

SEQ ID NO: 595759 - DNA, 25 bp, Rattus norvegicus
tctgacaaccctgatatcacatttt

SEQ ID NO: 595760 - DNA, 25 bp, Rattus norvegicus
tctgacaagcttcacgaggaacatg

SEQ ID NO: 595761 - DNA, 25 bp, Rattus norvegicus
tctgacaagcttgacgaggaacatg

SEQ ID NO: 595762 - DNA, 25 bp, Rattus norvegicus
tctgacaaggaacgcctgtcccctg

SEQ ID NO: 595763 - DNA, 25 bp, Rattus norvegicus
tctgacaaggaaggcctgtcccctg

SEQ ID NO: 595764 - DNA, 25 bp, Rattus norvegicus
tctgacaagtcacccggcttctgaa

SEQ ID NO: 595765 - DNA, 25 bp, Rattus norvegicus
tctgacaagtcagccggcttctgaa

SEQ ID NO: 595766 - DNA, 25 bp, Rattus norvegicus
tctgacaagtgtcctggatgcgctc

SEQ ID NO: 595767 - DNA, 25 bp, Rattus norvegicus
tctgacaagtgtgctggatgcgctc

SEQ ID NO: 595768 - DNA, 25 bp, Rattus norvegicus
tctgacaccgacaactgactgatga

SEQ ID NO: 595769 - DNA, 25 bp, Rattus norvegicus
tctgacaccgactactgactgatga

SEQ ID NO: 595770 - DNA, 25 bp, Rattus norvegicus
tctgacacctgtcgagcatctcatg

SEQ ID NO: 595771 - DNA, 25 bp, Rattus norvegicus
tctgacacctgtggagcatctcatg

SEQ ID NO: 595772 - DNA, 25 bp, Rattus norvegicus
tctgacacggtgcaagggaccctca

SEQ ID NO: 595773 - DNA, 25 bp, Rattus norvegicus
tctgacacggtggaagggaccctca

SEQ ID NO: 595774 - DNA, 25 bp, Rattus norvegicus
tctgacactgtcaggtttgcacaaa

SEQ ID NO: 595775 - DNA, 25 bp, Rattus norvegicus
tctgacactgtctggtttgcacaaa

SEQ ID NO: 595776 - DNA, 25 bp, Rattus norvegicus
tctgacacttggagccattgcttct

SEQ ID NO: 595777 - DNA, 25 bp, Rattus norvegicus
tctgacacttggtgccattgcttct

SEQ ID NO: 595778 - DNA, 25 bp, Rattus norvegicus
tctgacagacgtattgcacagcctg

SEQ ID NO: 595779 - DNA, 25 bp, Rattus norvegicus
tctgacagacgttttgcacagcctg

SEQ ID NO: 595780 - DNA, 25 bp, Rattus norvegicus
tctgacagaggccttagttaccaag

SEQ ID NO: 595781 - DNA, 25 bp, Rattus norvegicus
tctgacagaggcgttagttaccaag

SEQ ID NO: 595782 - DNA, 25 bp, Rattus norvegicus
tctgacagccctatcgggatcagct

SEQ ID NO: 595783 - DNA, 25 bp, Rattus norvegicus
tctgacagccctttcgggatcagct

SEQ ID NO: 595784 - DNA, 25 bp, Rattus norvegicus
tctgacagtgacctggccctgggtc

SEQ ID NO: 595785 - DNA, 25 bp, Rattus norvegicus
tctgacagtgacgtggccctgggtc

SEQ ID NO: 595786 - DNA, 25 bp, Rattus norvegicus
tctgacatgggcattgggaaccaaa

SEQ ID NO: 595787 - DNA, 25 bp, Rattus norvegicus
tctgacatgggctttgggaaccaaa

SEQ ID NO: 595788 - DNA, 25 bp, Rattus norvegicus
tctgacatggtgataatctgtagtc

SEQ ID NO: 595789 - DNA, 25 bp, Rattus norvegicus
tctgacatggtgttaatctgtagtc

SEQ ID NO: 595790 - DNA, 25 bp, Rattus norvegicus
tctgacatgtcaacctgccaagaag

SEQ ID NO: 595791 - DNA, 25 bp, Rattus norvegicus
tctgacatgtcatcctgccaagaag

SEQ ID NO: 595792 - DNA, 25 bp, Rattus norvegicus
tctgaccactgccacgttctcaggt

SEQ ID NO: 595793 - DNA, 25 bp, Rattus norvegicus
tctgaccactgcgacgttctcaggt

SEQ ID NO: 595794 - DNA, 25 bp, Rattus norvegicus
tctgaccaggtacagatgtacatct

SEQ ID NO: 595795 - DNA, 25 bp, Rattus norvegicus
tctgaccaggtagagatgtacatct

SEQ ID NO: 595796 - DNA, 25 bp, Rattus norvegicus
tctgaccatttcatggcacgactta

SEQ ID NO: 595797 - DNA, 25 bp, Rattus norvegicus
tctgaccatttcttggcacgactta

SEQ ID NO: 595798 - DNA, 25 bp, Rattus norvegicus
tctgacccaaggacatttggctaac

SEQ ID NO: 595799 - DNA, 25 bp, Rattus norvegicus
tctgacccaaggtcatttggctaac

SEQ ID NO: 595800 - DNA, 25 bp, Rattus norvegicus
tctgacccagaaataagtttgctca

SEQ ID NO: 595801 - DNA, 25 bp, Rattus norvegicus
tctgacccagaattaagtttgctca

SEQ ID NO: 595802 - DNA, 25 bp, Rattus norvegicus
tctgacccagagatttcccttagga

SEQ ID NO: 595803 - DNA, 25 bp, Rattus norvegicus
tctgacccagagttttcccttagga

SEQ ID NO: 595804 - DNA, 25 bp, Rattus norvegicus
tctgaccccatgcaaactgcttatg

SEQ ID NO: 595805 - DNA, 25 bp, Rattus norvegicus
tctgaccccatggaaactgcttatg

SEQ ID NO: 595806 - DNA, 25 bp, Rattus norvegicus
tctgaccccattcttgacttaattg

SEQ ID NO: 595807 - DNA, 25 bp, Rattus norvegicus
tctgaccccattgttgacttaattg

SEQ ID NO: 595808 - DNA, 25 bp, Rattus norvegicus
tctgacccgggtctgggaataaagc

SEQ ID NO: 595809 - DNA, 25 bp, Rattus norvegicus
tctgacccgggtgtgggaataaagc

SEQ ID NO: 595810 - DNA, 25 bp, Rattus norvegicus
tctgaccctcccaagaaaggtggtt

SEQ ID NO: 595811 - DNA, 25 bp, Rattus norvegicus
tctgaccctccctagaaaggtggtt

SEQ ID NO: 595812 - DNA, 25 bp, Rattus norvegicus
tctgaccctgacctccacaaaaata

SEQ ID NO: 595813 - DNA, 25 bp, Rattus norvegicus
tctgaccctgacgtccacaaaaata

SEQ ID NO: 595814 - DNA, 25 bp, Rattus norvegicus
tctgaccctgctaaagccatgtcga

SEQ ID NO: 595815 - DNA, 25 bp, Rattus norvegicus
tctgaccctgcttaagccatgtcga

SEQ ID NO: 595816 - DNA, 25 bp, Rattus norvegicus
tctgaccgagtcatcaaagctgtgt

SEQ ID NO: 595817 - DNA, 25 bp, Rattus norvegicus
tctgaccgagtcttcaaagctgtgt

SEQ ID NO: 595818 - DNA, 25 bp, Rattus norvegicus
tctgaccgcatgcagttgctagctt

SEQ ID NO: 595819 - DNA, 25 bp, Rattus norvegicus
tctgaccgcatggagttgctagctt

SEQ ID NO: 595820 - DNA, 25 bp, Rattus norvegicus
tctgaccgttagatccttatctgcg

SEQ ID NO: 595821 - DNA, 25 bp, Rattus norvegicus
tctgaccgttagttccttatctgcg

SEQ ID NO: 595822 - DNA, 25 bp, Rattus norvegicus
tctgacctaggtatgcatcttcgaa

SEQ ID NO: 595823 - DNA, 25 bp, Rattus norvegicus
tctgacctaggtttgcatcttcgaa

SEQ ID NO: 595824 - DNA, 25 bp, Rattus norvegicus
tctgacctcagcaagtaccaggcag

SEQ ID NO: 595825 - DNA, 25 bp, Rattus norvegicus
tctgacctcagctagtaccaggcag

SEQ ID NO: 595826 - DNA, 25 bp, Rattus norvegicus
tctgacctccgaatcgtgttgaaat

SEQ ID NO: 595827 - DNA, 25 bp, Rattus norvegicus
tctgacctccgattcgtgttgaaat

SEQ ID NO: 595828 - DNA, 25 bp, Rattus norvegicus
tctgacctcctgatcctggccggaa

SEQ ID NO: 595829 - DNA, 25 bp, Rattus norvegicus
tctgacctcctgttcctggccggaa

SEQ ID NO: 595830 - DNA, 25 bp, Rattus norvegicus
tctgacctcgagcactgttgaaata

SEQ ID NO: 595831 - DNA, 25 bp, Rattus norvegicus
tctgacctcgaggactgttgaaata

SEQ ID NO: 595832 - DNA, 25 bp, Rattus norvegicus
tctgacctctacaggcaaaattggg

SEQ ID NO: 595833 - DNA, 25 bp, Rattus norvegicus
tctgacctctactggcaaaattggg

SEQ ID NO: 595834 - DNA, 25 bp, Rattus norvegicus
tctgacctctatcgctattcagtgg

SEQ ID NO: 595835 - DNA, 25 bp, Rattus norvegicus
tctgacctctatggctattcagtgg

SEQ ID NO: 595836 - DNA, 25 bp, Rattus norvegicus
tctgacctctcgctcaagatgagag

SEQ ID NO: 595837 - DNA, 25 bp, Rattus norvegicus
tctgacctctcggtcaagatgagag

SEQ ID NO: 595838 - DNA, 25 bp, Rattus norvegicus
tctgacctctgcagagaacagtcgt

SEQ ID NO: 595839 - DNA, 25 bp, Rattus norvegicus
tctgacctctgctgagaacagtcgt

SEQ ID NO: 595840 - DNA, 25 bp, Rattus norvegicus
tctgacctcttcaagcggtttgaga

SEQ ID NO: 595841 - DNA, 25 bp, Rattus norvegicus
tctgacctcttctagcggtttgaga

SEQ ID NO: 595842 - DNA, 25 bp, Rattus norvegicus
tctgacctgagcacctgtcaataaa

SEQ ID NO: 595843 - DNA, 25 bp, Rattus norvegicus
tctgacctgagctcctgtcaataaa

SEQ ID NO: 595844 - DNA, 25 bp, Rattus norvegicus
tctgacctgaggatgcacatttgca

SEQ ID NO: 595845 - DNA, 25 bp, Rattus norvegicus
tctgacctgaggttgcacatttgca

SEQ ID NO: 595846 - DNA, 25 bp, Rattus norvegicus
tctgacctgccgagcagaggcctgg

SEQ ID NO: 595847 - DNA, 25 bp, Rattus norvegicus
tctgacctgccgtgcagaggcctgg

SEQ ID NO: 595848 - DNA, 25 bp, Rattus norvegicus
tctgacctgcctcaaatactttgga

SEQ ID NO: 595849 - DNA, 25 bp, Rattus norvegicus
tctgacctgcctgaaatactttgga

SEQ ID NO: 595850 - DNA, 25 bp, Rattus norvegicus
tctgacctggaaatatcctttcaaa

SEQ ID NO: 595851 - DNA, 25 bp, Rattus norvegicus
tctgacctggaattatcctttcaaa

SEQ ID NO: 595852 - DNA, 25 bp, Rattus norvegicus
tctgacctggccagcacggtgagga

SEQ ID NO: 595853 - DNA, 25 bp, Rattus norvegicus
tctgacctggcctgcacggtgagga

SEQ ID NO: 595854 - DNA, 25 bp, Rattus norvegicus
tctgacctgtaacccctggtccaag

SEQ ID NO: 595855 - DNA, 25 bp, Rattus norvegicus
tctgacctgtaagccctggtccaag

SEQ ID NO: 595856 - DNA, 25 bp, Rattus norvegicus
tctgacctgtttctggacagacgct

SEQ ID NO: 595857 - DNA, 25 bp, Rattus norvegicus
tctgacctgtttgtggacagacgct

SEQ ID NO: 595858 - DNA, 25 bp, Rattus norvegicus
tctgaccttagaatgctttgctttg

SEQ ID NO: 595859 - DNA, 25 bp, Rattus norvegicus
tctgaccttagattgctttgctttg

SEQ ID NO: 595860 - DNA, 25 bp, Rattus norvegicus
tctgaccttcacatgagtgttgatg

SEQ ID NO: 595861 - DNA, 25 bp, Rattus norvegicus
tctgaccttcacttgagtgttgatg

SEQ ID NO: 595862 - DNA, 25 bp, Rattus norvegicus
tctgaccttcggaggcttctttaat

SEQ ID NO: 595863 - DNA, 25 bp, Rattus norvegicus
tctgaccttcggtggcttctttaat

SEQ ID NO: 595864 - DNA, 25 bp, Rattus norvegicus
tctgacctttccaacttagatgcta

SEQ ID NO: 595865 - DNA, 25 bp, Rattus norvegicus
tctgacctttcctacttagatgcta

SEQ ID NO: 595866 - DNA, 25 bp, Rattus norvegicus
tctgacgagcgaccagagccactgt

SEQ ID NO: 595867 - DNA, 25 bp, Rattus norvegicus
tctgacgagcgagcagagccactgt

SEQ ID NO: 595868 - DNA, 25 bp, Rattus norvegicus
tctgacgaggtacctgccatctttc

SEQ ID NO: 595869 - DNA, 25 bp, Rattus norvegicus
tctgacgaggtagctgccatctttc

SEQ ID NO: 595870 - DNA, 25 bp, Rattus norvegicus
tctgacgcataaacccttcttgaaa

SEQ ID NO: 595871 - DNA, 25 bp, Rattus norvegicus
tctgacgcataatcccttcttgaaa

SEQ ID NO: 595872 - DNA, 25 bp, Rattus norvegicus
tctgacgccctgatttcagtgagta

SEQ ID NO: 595873 - DNA, 25 bp, Rattus norvegicus
tctgacgccctgttttcagtgagta

SEQ ID NO: 595874 - DNA, 25 bp, Rattus norvegicus
tctgacgtcggcagcagagtggtct

SEQ ID NO: 595875 - DNA, 25 bp, Rattus norvegicus
tctgacgtcggctgcagagtggtct

SEQ ID NO: 595876 - DNA, 25 bp, Rattus norvegicus
tctgacgtgactctcctttaaagca

SEQ ID NO: 595877 - DNA, 25 bp, Rattus norvegicus
tctgacgtgactgtcctttaaagca

SEQ ID NO: 595878 - DNA, 25 bp, Rattus norvegicus
tctgacgtgccaagccatgttgata

SEQ ID NO: 595879 - DNA, 25 bp, Rattus norvegicus
tctgacgtgccatgccatgttgata

SEQ ID NO: 595880 - DNA, 25 bp, Rattus norvegicus
tctgactacagaagccccgtgcaag

SEQ ID NO: 595881 - DNA, 25 bp, Rattus norvegicus
tctgactacagatgccccgtgcaag

SEQ ID NO: 595882 - DNA, 25 bp, Rattus norvegicus
tctgactaccacagggattaaagag

SEQ ID NO: 595883 - DNA, 25 bp, Rattus norvegicus
tctgactaccactgggattaaagag

SEQ ID NO: 595884 - DNA, 25 bp, Rattus norvegicus
tctgactatcgtctatgctttccta

SEQ ID NO: 595885 - DNA, 25 bp, Rattus norvegicus
tctgactatcgtgtatgctttccta

SEQ ID NO: 595886 - DNA, 25 bp, Rattus norvegicus
tctgactatgaccaccagccttgca

SEQ ID NO: 595887 - DNA, 25 bp, Rattus norvegicus
tctgactatgacgaccagccttgca

SEQ ID NO: 595888 - DNA, 25 bp, Rattus norvegicus
tctgactccttaagtttgctgctga

SEQ ID NO: 595889 - DNA, 25 bp, Rattus norvegicus
tctgactccttatgtttgctgctga

SEQ ID NO: 595890 - DNA, 25 bp, Rattus norvegicus
tctgactctaggatcggttttcatc

SEQ ID NO: 595891 - DNA, 25 bp, Rattus norvegicus
tctgactctaggttcggttttcatc

SEQ ID NO: 595892 - DNA, 25 bp, Rattus norvegicus
tctgactctccactgctggtattac

SEQ ID NO: 595893 - DNA, 25 bp, Rattus norvegicus
tctgactctccagtgctggtattac

SEQ ID NO: 595894 - DNA, 25 bp, Rattus norvegicus
tctgactctcctcctgctgatgtgg

SEQ ID NO: 595895 - DNA, 25 bp, Rattus norvegicus
tctgactctcctgctgctgatgtgg

SEQ ID NO: 595896 - DNA, 25 bp, Rattus norvegicus
tctgactctcgcactagagttcaga

SEQ ID NO: 595897 - DNA, 25 bp, Rattus norvegicus
tctgactctcgctctagagttcaga

SEQ ID NO: 595898 - DNA, 25 bp, Rattus norvegicus
tctgactgagccactgtttcaacct

SEQ ID NO: 595899 - DNA, 25 bp, Rattus norvegicus
tctgactgagcctctgtttcaacct

SEQ ID NO: 595900 - DNA, 25 bp, Rattus norvegicus
tctgactgagtcaagaccctgcagt

SEQ ID NO: 595901 - DNA, 25 bp, Rattus norvegicus
tctgactgagtctagaccctgcagt

SEQ ID NO: 595902 - DNA, 25 bp, Rattus norvegicus
tctgactgattcatctgtttcctca

SEQ ID NO: 595903 - DNA, 25 bp, Rattus norvegicus
tctgactgattcttctgtttcctca

SEQ ID NO: 595904 - DNA, 25 bp, Rattus norvegicus
tctgactgccaactgaccatgcatg

SEQ ID NO: 595905 - DNA, 25 bp, Rattus norvegicus
tctgactgccaagtgaccatgcatg

SEQ ID NO: 595906 - DNA, 25 bp, Rattus norvegicus
tctgactgctgcaccccagagggaa

SEQ ID NO: 595907 - DNA, 25 bp, Rattus norvegicus
tctgactgctgctccccagagggaa

SEQ ID NO: 595908 - DNA, 25 bp, Rattus norvegicus
tctgactggccaagagcttagcttc

SEQ ID NO: 595909 - DNA, 25 bp, Rattus norvegicus
tctgactggccatgagcttagcttc

SEQ ID NO: 595910 - DNA, 25 bp, Rattus norvegicus
tctgactggcctcagaaggcatgaa

SEQ ID NO: 595911 - DNA, 25 bp, Rattus norvegicus
tctgactggcctgagaaggcatgaa

SEQ ID NO: 595912 - DNA, 25 bp, Rattus norvegicus
tctgactggtgccttgtgttcttcc

SEQ ID NO: 595913 - DNA, 25 bp, Rattus norvegicus
tctgactggtgcgttgtgttcttcc

SEQ ID NO: 595914 - DNA, 25 bp, Rattus norvegicus
tctgactgtactcatcttcacactc

SEQ ID NO: 595915 - DNA, 25 bp, Rattus norvegicus
tctgactgtactgatcttcacactc

SEQ ID NO: 595916 - DNA, 25 bp, Rattus norvegicus
tctgactgtatgcagttttgtcctt

SEQ ID NO: 595917 - DNA, 25 bp, Rattus norvegicus
tctgactgtatggagttttgtcctt

SEQ ID NO: 595918 - DNA, 25 bp, Rattus norvegicus
tctgactgtgttctgggcgatgaaa

SEQ ID NO: 595919 - DNA, 25 bp, Rattus norvegicus
tctgactgtgttgtgggcgatgaaa

SEQ ID NO: 595920 - DNA, 25 bp, Rattus norvegicus
tctgacttccatctgttgcttctaa

SEQ ID NO: 595921 - DNA, 25 bp, Rattus norvegicus
tctgacttccatgtgttgcttctaa

SEQ ID NO: 595922 - DNA, 25 bp, Rattus norvegicus
tctgacttctgtcgtgtgcgtgtgc

SEQ ID NO: 595923 - DNA, 25 bp, Rattus norvegicus
tctgacttctgtggtgtgcgtgtgc

SEQ ID NO: 595924 - DNA, 25 bp, Rattus norvegicus
tctgacttggctcttctgttttgta

SEQ ID NO: 595925 - DNA, 25 bp, Rattus norvegicus
tctgacttggctgttctgttttgta

SEQ ID NO: 595926 - DNA, 25 bp, Rattus norvegicus
tctgacttgtagctgggtgactgat

SEQ ID NO: 595927 - DNA, 25 bp, Rattus norvegicus
tctgacttgtaggtgggtgactgat

SEQ ID NO: 595928 - DNA, 25 bp, Rattus norvegicus
tctgagaaggcgctttatccggtaa

SEQ ID NO: 595929 - DNA, 25 bp, Rattus norvegicus
tctgagaaggcggtttatccggtaa

SEQ ID NO: 595930 - DNA, 25 bp, Rattus norvegicus
tctgagaagtcacctgtatgagcag

SEQ ID NO: 595931 - DNA, 25 bp, Rattus norvegicus
tctgagaagtcagctgtatgagcag

SEQ ID NO: 595932 - DNA, 25 bp, Rattus norvegicus
tctgagacacctacccagttatctg

SEQ ID NO: 595933 - DNA, 25 bp, Rattus norvegicus
tctgagacaccttcccagttatctg

SEQ ID NO: 595934 - DNA, 25 bp, Rattus norvegicus
tctgagacagttacctctagccgag

SEQ ID NO: 595935 - DNA, 25 bp, Rattus norvegicus
tctgagacagtttcctctagccgag

SEQ ID NO: 595936 - DNA, 25 bp, Rattus norvegicus
tctgagactgtcacctggatcctca

SEQ ID NO: 595937 - DNA, 25 bp, Rattus norvegicus
tctgagactgtctcctggatcctca

SEQ ID NO: 595938 - DNA, 25 bp, Rattus norvegicus
tctgagagatcaagacttttccgtc

SEQ ID NO: 595939 - DNA, 25 bp, Rattus norvegicus
tctgagagatcatgacttttccgtc

SEQ ID NO: 595940 - DNA, 25 bp, Rattus norvegicus
tctgagaggaggctcttaggtctct

SEQ ID NO: 595941 - DNA, 25 bp, Rattus norvegicus
tctgagaggagggtcttaggtctct

SEQ ID NO: 595942 - DNA, 25 bp, Rattus norvegicus
tctgagagtcttcctcgagaagtga

SEQ ID NO: 595943 - DNA, 25 bp, Rattus norvegicus
tctgagagtcttgctcgagaagtga

SEQ ID NO: 595944 - DNA, 25 bp, Rattus norvegicus
tctgagagtggaccagcggtccctt

SEQ ID NO: 595945 - DNA, 25 bp, Rattus norvegicus
tctgagagtggagcagcggtccctt

SEQ ID NO: 595946 - DNA, 25 bp, Rattus norvegicus
tctgagagttcacgctcccaggtcc

SEQ ID NO: 595947 - DNA, 25 bp, Rattus norvegicus
tctgagagttcaggctcccaggtcc

SEQ ID NO: 595948 - DNA, 25 bp, Rattus norvegicus
tctgagatgcagctgcttagagcct

SEQ ID NO: 595949 - DNA, 25 bp, Rattus norvegicus
tctgagatgcaggtgcttagagcct

SEQ ID NO: 595950 - DNA, 25 bp, Rattus norvegicus
tctgagatgctcacggatccagttg

SEQ ID NO: 595951 - DNA, 25 bp, Rattus norvegicus
tctgagatgctcagccagctctact

SEQ ID NO: 595952 - DNA, 25 bp, Rattus norvegicus
tctgagatgctctcggatccagttg

SEQ ID NO: 595953 - DNA, 25 bp, Rattus norvegicus
tctgagatgctctgccagctctact

SEQ ID NO: 595954 - DNA, 25 bp, Rattus norvegicus
tctgagatggagcaggatcctttgc

SEQ ID NO: 595955 - DNA, 25 bp, Rattus norvegicus
tctgagatggaggaggatcctttgc

SEQ ID NO: 595956 - DNA, 25 bp, Rattus norvegicus
tctgagcacttgaaagcgtacaaag

SEQ ID NO: 595957 - DNA, 25 bp, Rattus norvegicus
tctgagcacttgtaagcgtacaaag

SEQ ID NO: 595958 - DNA, 25 bp, Rattus norvegicus
tctgagcagcagcatcagcaaggct

SEQ ID NO: 595959 - DNA, 25 bp, Rattus norvegicus
tctgagcagcaggatcagcaaggct

SEQ ID NO: 595960 - DNA, 25 bp, Rattus norvegicus
tctgagcagccccagaggaaacaaa

SEQ ID NO: 595961 - DNA, 25 bp, Rattus norvegicus
tctgagcagcccgagaggaaacaaa

SEQ ID NO: 595962 - DNA, 25 bp, Rattus norvegicus
tctgagcagctgctcatcttggaga

SEQ ID NO: 595963 - DNA, 25 bp, Rattus norvegicus
tctgagcagctggtcatcttggaga

SEQ ID NO: 595964 - DNA, 25 bp, Rattus norvegicus
tctgagcattctcggcaagcaattc

SEQ ID NO: 595965 - DNA, 25 bp, Rattus norvegicus
tctgagcattctgggcaagcaattc

SEQ ID NO: 595966 - DNA, 25 bp, Rattus norvegicus
tctgagcattggagagccagtccct

SEQ ID NO: 595967 - DNA, 25 bp, Rattus norvegicus
tctgagcattggtgagccagtccct

SEQ ID NO: 595968 - DNA, 25 bp, Rattus norvegicus
tctgagccccgacgcctgtttatca

SEQ ID NO: 595969 - DNA, 25 bp, Rattus norvegicus
tctgagccccgaggcctgtttatca

SEQ ID NO: 595970 - DNA, 25 bp, Rattus norvegicus
tctgagccctatattgcctgtgaat

SEQ ID NO: 595971 - DNA, 25 bp, Rattus norvegicus
tctgagccctattttgcctgtgaat

SEQ ID NO: 595972 - DNA, 25 bp, Rattus norvegicus
tctgagccctttctcgtcaaatagg

SEQ ID NO: 595973 - DNA, 25 bp, Rattus norvegicus
tctgagccctttgtcgtcaaatagg

SEQ ID NO: 595974 - DNA, 25 bp, Rattus norvegicus
tctgagcctaatagcacttgagtgc

SEQ ID NO: 595975 - DNA, 25 bp, Rattus norvegicus
tctgagcctaattgcacttgagtgc

SEQ ID NO: 595976 - DNA, 25 bp, Rattus norvegicus
tctgagcctcccactgaaacagagg

SEQ ID NO: 595977 - DNA, 25 bp, Rattus norvegicus
tctgagcctccctctgaaacagagg

SEQ ID NO: 595978 - DNA, 25 bp, Rattus norvegicus
tctgagcctggtctgtcaagcacgg

SEQ ID NO: 595979 - DNA, 25 bp, Rattus norvegicus
tctgagcctggtgtgtcaagcacgg

SEQ ID NO: 595980 - DNA, 25 bp, Rattus norvegicus
tctgagcctgttcgtccttctagca

SEQ ID NO: 595981 - DNA, 25 bp, Rattus norvegicus
tctgagcctgttggtccttctagca

SEQ ID NO: 595982 - DNA, 25 bp, Rattus norvegicus
tctgagccttgtatcctgtagtgac

SEQ ID NO: 595983 - DNA, 25 bp, Rattus norvegicus
tctgagccttgtttcctgtagtgac

SEQ ID NO: 595984 - DNA, 25 bp, Rattus norvegicus
tctgagcgccatagcaagcaaaact

SEQ ID NO: 595985 - DNA, 25 bp, Rattus norvegicus
tctgagcgccattgcaagcaaaact

SEQ ID NO: 595986 - DNA, 25 bp, Rattus norvegicus
tctgagctagtcatttccgaattct

SEQ ID NO: 595987 - DNA, 25 bp, Rattus norvegicus
tctgagctagtcttttccgaattct

SEQ ID NO: 595988 - DNA, 25 bp, Rattus norvegicus
tctgagctgtgcctttgtactacca

SEQ ID NO: 595989 - DNA, 25 bp, Rattus norvegicus
tctgagctgtgcgtttgtactacca

SEQ ID NO: 595990 - DNA, 25 bp, Rattus norvegicus
tctgagcttagaccagccgtcaaat

SEQ ID NO: 595991 - DNA, 25 bp, Rattus norvegicus
tctgagcttagagcagccgtcaaat

SEQ ID NO: 595992 - DNA, 25 bp, Rattus norvegicus
tctgagcttgctctttgttttaaag

SEQ ID NO: 595993 - DNA, 25 bp, Rattus norvegicus
tctgagcttgctgtttgttttaaag

SEQ ID NO: 595994 - DNA, 25 bp, Rattus norvegicus
tctgagctttctactacctgttaaa

SEQ ID NO: 595995 - DNA, 25 bp, Rattus norvegicus
tctgagctttcttctacctgttaaa

SEQ ID NO: 595996 - DNA, 25 bp, Rattus norvegicus
tctgaggaaagcacccggcctcggg

SEQ ID NO: 595997 - DNA, 25 bp, Rattus norvegicus
tctgaggaaagctcccggcctcggg

SEQ ID NO: 595998 - DNA, 25 bp, Rattus norvegicus
tctgaggaacatccgctttgccaag

SEQ ID NO: 595999 - DNA, 25 bp, Rattus norvegicus
tctgaggaacatgcgctttgccaag

SEQ ID NO: 596000 - DNA, 25 bp, Rattus norvegicus
tctgaggaatccattctgggacaaa

SEQ ID NO: 596001 - DNA, 25 bp, Rattus norvegicus
tctgaggaatcctttctgggacaaa

SEQ ID NO: 596002 - DNA, 25 bp, Rattus norvegicus
tctgaggacaccactgggtctacat

SEQ ID NO: 596003 - DNA, 25 bp, Rattus norvegicus
tctgaggacacctctgggtctacat

SEQ ID NO: 596004 - DNA, 25 bp, Rattus norvegicus
tctgaggacctcaatctcggtggac

SEQ ID NO: 596005 - DNA, 25 bp, Rattus norvegicus
tctgaggacctctatctcggtggac

SEQ ID NO: 596006 - DNA, 25 bp, Rattus norvegicus
tctgaggagcaccagctgctgtgaa

SEQ ID NO: 596007 - DNA, 25 bp, Rattus norvegicus
tctgaggagcacgagctgctgtgaa

SEQ ID NO: 596008 - DNA, 25 bp, Rattus norvegicus
tctgaggagtccagcacaggcctgc

SEQ ID NO: 596009 - DNA, 25 bp, Rattus norvegicus
tctgaggagtcctgcacaggcctgc

SEQ ID NO: 596010 - DNA, 25 bp, Rattus norvegicus
tctgaggcaacaccccaatgtctaa

SEQ ID NO: 596011 - DNA, 25 bp, Rattus norvegicus
tctgaggcaacagcccaatgtctaa

SEQ ID NO: 596012 - DNA, 25 bp, Rattus norvegicus
tctgaggccccaattcttctgtgta

SEQ ID NO: 596013 - DNA, 25 bp, Rattus norvegicus
tctgaggccccatttcttctgtgta

SEQ ID NO: 596014 - DNA, 25 bp, Rattus norvegicus
tctgaggcccctcctgcaaactagg

SEQ ID NO: 596015 - DNA, 25 bp, Rattus norvegicus
tctgaggcccctgctgcaaactagg

SEQ ID NO: 596016 - DNA, 25 bp, Rattus norvegicus
tctgaggcctcacattctatcccaa

SEQ ID NO: 596017 - DNA, 25 bp, Rattus norvegicus
tctgaggcctcagattctatcccaa

SEQ ID NO: 596018 - DNA, 25 bp, Rattus norvegicus
tctgaggcctccaataccagctgtg

SEQ ID NO: 596019 - DNA, 25 bp, Rattus norvegicus
tctgaggcctcctataccagctgtg

SEQ ID NO: 596020 - DNA, 25 bp, Rattus norvegicus
tctgaggcctggagtgaagcttaca

SEQ ID NO: 596021 - DNA, 25 bp, Rattus norvegicus
tctgaggcctggtgtgaagcttaca

SEQ ID NO: 596022 - DNA, 25 bp, Rattus norvegicus
tctgaggctcctacaaggtctggag

SEQ ID NO: 596023 - DNA, 25 bp, Rattus norvegicus
tctgaggctccttcaaggtctggag

SEQ ID NO: 596024 - DNA, 25 bp, Rattus norvegicus
tctgagggactgcaacccatcaata

SEQ ID NO: 596025 - DNA, 25 bp, Rattus norvegicus
tctgagggactggaacccatcaata

SEQ ID NO: 596026 - DNA, 25 bp, Rattus norvegicus
tctgagggagagcttgcacctgcca

SEQ ID NO: 596027 - DNA, 25 bp, Rattus norvegicus
tctgagggagaggttgcacctgcca

SEQ ID NO: 596028 - DNA, 25 bp, Rattus norvegicus
tctgagggagctattcagccagttt

SEQ ID NO: 596029 - DNA, 25 bp, Rattus norvegicus
tctgagggagcttttcagccagttt

SEQ ID NO: 596030 - DNA, 25 bp, Rattus norvegicus
tctgagggctttcggtgatctgttc

SEQ ID NO: 596031 - DNA, 25 bp, Rattus norvegicus
tctgagggctttgggtgatctgttc

SEQ ID NO: 596032 - DNA, 25 bp, Rattus norvegicus
tctgagggtcatcactgcctgaagt

SEQ ID NO: 596033 - DNA, 25 bp, Rattus norvegicus
tctgagggtcatgactgcctgaagt

SEQ ID NO: 596034 - DNA, 25 bp, Rattus norvegicus
tctgagggtctcacactccacagat

SEQ ID NO: 596035 - DNA, 25 bp, Rattus norvegicus
tctgagggtctctcactccacagat

SEQ ID NO: 596036 - DNA, 25 bp, Rattus norvegicus
tctgagggtgtcaaacaagcttgta

SEQ ID NO: 596037 - DNA, 25 bp, Rattus norvegicus
tctgagggtgtctaacaagcttgta

SEQ ID NO: 596038 - DNA, 25 bp, Rattus norvegicus
tctgagggttctcaccttgttaagt

SEQ ID NO: 596039 - DNA, 25 bp, Rattus norvegicus
tctgagggttctgaccttgttaagt

SEQ ID NO: 596040 - DNA, 25 bp, Rattus norvegicus
tctgaggtactgagttccgcactgc

SEQ ID NO: 596041 - DNA, 25 bp, Rattus norvegicus
tctgaggtactgtgttccgcactgc

SEQ ID NO: 596042 - DNA, 25 bp, Rattus norvegicus
tctgaggtatcgctcgttcggagtc

SEQ ID NO: 596043 - DNA, 25 bp, Rattus norvegicus
tctgaggtatcggtcgttcggagtc

SEQ ID NO: 596044 - DNA, 25 bp, Rattus norvegicus
tctgaggtcctcagatctgaagcct

SEQ ID NO: 596045 - DNA, 25 bp, Rattus norvegicus
tctgaggtcctctgatctgaagcct

SEQ ID NO: 596046 - DNA, 25 bp, Rattus norvegicus
tctgaggtctctcctgttgctacca

SEQ ID NO: 596047 - DNA, 25 bp, Rattus norvegicus
tctgaggtctctgctgttgctacca

SEQ ID NO: 596048 - DNA, 25 bp, Rattus norvegicus
tctgaggtctttactgtcaccaagt

SEQ ID NO: 596049 - DNA, 25 bp, Rattus norvegicus
tctgaggtcttttctgtcaccaagt

SEQ ID NO: 596050 - DNA, 25 bp, Rattus norvegicus
tctgaggtgcccacgagtgtattcg

SEQ ID NO: 596051 - DNA, 25 bp, Rattus norvegicus
tctgaggtgccctcgagtgtattcg

SEQ ID NO: 596052 - DNA, 25 bp, Rattus norvegicus
tctgaggtgccgcttggagttcaaa

SEQ ID NO: 596053 - DNA, 25 bp, Rattus norvegicus
tctgaggtgccggttggagttcaaa

SEQ ID NO: 596054 - DNA, 25 bp, Rattus norvegicus
tctgagtacaggctacgccaccatt

SEQ ID NO: 596055 - DNA, 25 bp, Rattus norvegicus
tctgagtacagggtacgccaccatt

SEQ ID NO: 596056 - DNA, 25 bp, Rattus norvegicus
tctgagtcccagacctgtcagggcc

SEQ ID NO: 596057 - DNA, 25 bp, Rattus norvegicus
tctgagtcccagtcctgtcagggcc

SEQ ID NO: 596058 - DNA, 25 bp, Rattus norvegicus
tctgagtctcagagtatcctaaaga

SEQ ID NO: 596059 - DNA, 25 bp, Rattus norvegicus
tctgagtctcagtgtatcctaaaga

SEQ ID NO: 596060 - DNA, 25 bp, Rattus norvegicus
tctgagtctgttctccagtgcccta

SEQ ID NO: 596061 - DNA, 25 bp, Rattus norvegicus
tctgagtctgttgtccagtgcccta

SEQ ID NO: 596062 - DNA, 25 bp, Rattus norvegicus
tctgagtcttttcagcaaccgccac

SEQ ID NO: 596063 - DNA, 25 bp, Rattus norvegicus
tctgagtcttttgagcaaccgccac

SEQ ID NO: 596064 - DNA, 25 bp, Rattus norvegicus
tctgagtgacatctggttgggcctt

SEQ ID NO: 596065 - DNA, 25 bp, Rattus norvegicus
tctgagtgacatgtggttgggcctt

SEQ ID NO: 596066 - DNA, 25 bp, Rattus norvegicus
tctgagtgccgtatacatctgtgaa

SEQ ID NO: 596067 - DNA, 25 bp, Rattus norvegicus
tctgagtgccgtttacatctgtgaa

SEQ ID NO: 596068 - DNA, 25 bp, Rattus norvegicus
tctgagttcaccctcaacagggaat

SEQ ID NO: 596069 - DNA, 25 bp, Rattus norvegicus
tctgagttcaccgtcaacagggaat

SEQ ID NO: 596070 - DNA, 25 bp, Rattus norvegicus
tctgagttcgtacagtcatcgcgtt

SEQ ID NO: 596071 - DNA, 25 bp, Rattus norvegicus
tctgagttcgtagagtcatcgcgtt

SEQ ID NO: 596072 - DNA, 25 bp, Rattus norvegicus
tctgagttctgaatcctaggctgtt

SEQ ID NO: 596073 - DNA, 25 bp, Rattus norvegicus
tctgagttctgattcctaggctgtt

SEQ ID NO: 596074 - DNA, 25 bp, Rattus norvegicus
tctgagttctggcactgtaccgtga

SEQ ID NO: 596075 - DNA, 25 bp, Rattus norvegicus
tctgagttctgggactgtaccgtga

SEQ ID NO: 596076 - DNA, 25 bp, Rattus norvegicus
tctgagttctttcagttgcatatac

SEQ ID NO: 596077 - DNA, 25 bp, Rattus norvegicus
tctgagttctttgagttgcatatac

SEQ ID NO: 596078 - DNA, 25 bp, Rattus norvegicus
tctgagttttggcagctttgcgcgt

SEQ ID NO: 596079 - DNA, 25 bp, Rattus norvegicus
tctgagttttgggagctttgcgcgt

SEQ ID NO: 596080 - DNA, 25 bp, Rattus norvegicus
tctgataagctgctcttgcggaggc

SEQ ID NO: 596081 - DNA, 25 bp, Rattus norvegicus
tctgataagctggtcttgcggaggc

SEQ ID NO: 596082 - DNA, 25 bp, Rattus norvegicus
tctgatagaaaacctcttgccgccc

SEQ ID NO: 596083 - DNA, 25 bp, Rattus norvegicus
tctgatagaaaagctcttgccgccc

SEQ ID NO: 596084 - DNA, 25 bp, Rattus norvegicus
tctgatataccacaacagagttggg

SEQ ID NO: 596085 - DNA, 25 bp, Rattus norvegicus
tctgatataccagaacagagttggg

SEQ ID NO: 596086 - DNA, 25 bp, Rattus norvegicus
tctgatcagaggctgaggtccttcc

SEQ ID NO: 596087 - DNA, 25 bp, Rattus norvegicus
tctgatcagagggtgaggtccttcc

SEQ ID NO: 596088 - DNA, 25 bp, Rattus norvegicus
tctgatcagggccaataaatgttga

SEQ ID NO: 596089 - DNA, 25 bp, Rattus norvegicus
tctgatcagggcgaataaatgttga

SEQ ID NO: 596090 - DNA, 25 bp, Rattus norvegicus
tctgatccagtgaaggcacccatgt

SEQ ID NO: 596091 - DNA, 25 bp, Rattus norvegicus
tctgatccagtgtaggcacccatgt

SEQ ID NO: 596092 - DNA, 25 bp, Rattus norvegicus
tctgatccgcagagatccggcccgg

SEQ ID NO: 596093 - DNA, 25 bp, Rattus norvegicus
tctgatccgcagtgatccggcccgg

SEQ ID NO: 596094 - DNA, 25 bp, Rattus norvegicus
tctgatcctcacaacctggtaaatg

SEQ ID NO: 596095 - DNA, 25 bp, Rattus norvegicus
tctgatcctcactacctggtaaatg

SEQ ID NO: 596096 - DNA, 25 bp, Rattus norvegicus
tctgatcctggcctaagttgctgtc

SEQ ID NO: 596097 - DNA, 25 bp, Rattus norvegicus
tctgatcctggcgtaagttgctgtc

SEQ ID NO: 596098 - DNA, 25 bp, Rattus norvegicus
tctgatccttctaacctgtctaaat

SEQ ID NO: 596099 - DNA, 25 bp, Rattus norvegicus
tctgatccttcttacctgtctaaat

SEQ ID NO: 596100 - DNA, 25 bp, Rattus norvegicus
tctgatctccacctgtgcactgagg

SEQ ID NO: 596101 - DNA, 25 bp, Rattus norvegicus
tctgatctccacgtgtgcactgagg

SEQ ID NO: 596102 - DNA, 25 bp, Rattus norvegicus
tctgatctcggaagctaagcagggt

SEQ ID NO: 596103 - DNA, 25 bp, Rattus norvegicus
tctgatctcggatgctaagcagggt

SEQ ID NO: 596104 - DNA, 25 bp, Rattus norvegicus
tctgatctgggacgcactttgtggt

SEQ ID NO: 596105 - DNA, 25 bp, Rattus norvegicus
tctgatctgggaggcactttgtggt

SEQ ID NO: 596106 - DNA, 25 bp, Rattus norvegicus
tctgatcttccacgtgcttaccgag

SEQ ID NO: 596107 - DNA, 25 bp, Rattus norvegicus
tctgatcttccaggtgcttaccgag

SEQ ID NO: 596108 - DNA, 25 bp, Rattus norvegicus
tctgatgaaataacaaggagcttac

SEQ ID NO: 596109 - DNA, 25 bp, Rattus norvegicus
tctgatgaaatatcaaggagcttac

SEQ ID NO: 596110 - DNA, 25 bp, Rattus norvegicus
tctgatgacattactccctccaggt

SEQ ID NO: 596111 - DNA, 25 bp, Rattus norvegicus
tctgatgacatttctccctccaggt

SEQ ID NO: 596112 - DNA, 25 bp, Rattus norvegicus
tctgatgaccacacggatgcttttg

SEQ ID NO: 596113 - DNA, 25 bp, Rattus norvegicus
tctgatgaccactcggatgcttttg

SEQ ID NO: 596114 - DNA, 25 bp, Rattus norvegicus
tctgatgagaagactaccgtcccaa

SEQ ID NO: 596115 - DNA, 25 bp, Rattus norvegicus
tctgatgagaagtctaccgtcccaa

SEQ ID NO: 596116 - DNA, 25 bp, Rattus norvegicus
tctgatgagatgaacccttgtttga

SEQ ID NO: 596117 - DNA, 25 bp, Rattus norvegicus
tctgatgagatgtacccttgtttga

SEQ ID NO: 596118 - DNA, 25 bp, Rattus norvegicus
tctgatgataatctactgaacctct

SEQ ID NO: 596119 - DNA, 25 bp, Rattus norvegicus
tctgatgataatgtactgaacctct

SEQ ID NO: 596120 - DNA, 25 bp, Rattus norvegicus
tctgatgattcacagcggagaccct

SEQ ID NO: 596121 - DNA, 25 bp, Rattus norvegicus
tctgatgattcagagcggagaccct

SEQ ID NO: 596122 - DNA, 25 bp, Rattus norvegicus
tctgatgctgctacatctcagccag

SEQ ID NO: 596123 - DNA, 25 bp, Rattus norvegicus
tctgatgctgcttcatctcagccag

SEQ ID NO: 596124 - DNA, 25 bp, Rattus norvegicus
tctgatggaaaactcatggtctctt

SEQ ID NO: 596125 - DNA, 25 bp, Rattus norvegicus
tctgatggaaaagtcatggtctctt

SEQ ID NO: 596126 - DNA, 25 bp, Rattus norvegicus
tctgatgggactctgagatcttgct

SEQ ID NO: 596127 - DNA, 25 bp, Rattus norvegicus
tctgatgggactgtgagatcttgct

SEQ ID NO: 596128 - DNA, 25 bp, Rattus norvegicus
tctgatggtgtaataaagaccgacc

SEQ ID NO: 596129 - DNA, 25 bp, Rattus norvegicus
tctgatggtgtattaaagaccgacc

SEQ ID NO: 596130 - DNA, 25 bp, Rattus norvegicus
tctgatgtagtcagggacccctggc

SEQ ID NO: 596131 - DNA, 25 bp, Rattus norvegicus
tctgatgtagtctgggacccctggc

SEQ ID NO: 596132 - DNA, 25 bp, Rattus norvegicus
tctgatgtagttctgacccctcttt

SEQ ID NO: 596133 - DNA, 25 bp, Rattus norvegicus
tctgatgtagttgtgacccctcttt

SEQ ID NO: 596134 - DNA, 25 bp, Rattus norvegicus
tctgatgtatgactgcttcccttat

SEQ ID NO: 596135 - DNA, 25 bp, Rattus norvegicus
tctgatgtatgagtgcttcccttat

SEQ ID NO: 596136 - DNA, 25 bp, Rattus norvegicus
tctgatgtcagcacgcttagaggct

SEQ ID NO: 596137 - DNA, 25 bp, Rattus norvegicus
tctgatgtcagctcgcttagaggct

SEQ ID NO: 596138 - DNA, 25 bp, Rattus norvegicus
tctgatgtcatcagtgctcacacaa

SEQ ID NO: 596139 - DNA, 25 bp, Rattus norvegicus
tctgatgtcatctgtgctcacacaa

SEQ ID NO: 596140 - DNA, 25 bp, Rattus norvegicus
tctgatgtgcagcattggttccgga

SEQ ID NO: 596141 - DNA, 25 bp, Rattus norvegicus
tctgatgtgcaggattggttccgga

SEQ ID NO: 596142 - DNA, 25 bp, Rattus norvegicus
tctgatgtgcctcggcagcggacat

SEQ ID NO: 596143 - DNA, 25 bp, Rattus norvegicus
tctgatgtgcctgggcagcggacat

SEQ ID NO: 596144 - DNA, 25 bp, Rattus norvegicus
tctgatgttgctctcgttctacgtc

SEQ ID NO: 596145 - DNA, 25 bp, Rattus norvegicus
tctgatgttgctgtcgttctacgtc

SEQ ID NO: 596146 - DNA, 25 bp, Rattus norvegicus
tctgattcataacatctgatcgcgt

SEQ ID NO: 596147 - DNA, 25 bp, Rattus norvegicus
tctgattcataagatctgatcgcgt

SEQ ID NO: 596148 - DNA, 25 bp, Rattus norvegicus
tctgattcatagatatcctcctgcc

SEQ ID NO: 596149 - DNA, 25 bp, Rattus norvegicus
tctgattcatagttatcctcctgcc

SEQ ID NO: 596150 - DNA, 25 bp, Rattus norvegicus
tctgattccaccaccagcttggcga

SEQ ID NO: 596151 - DNA, 25 bp, Rattus norvegicus
tctgattccacctccagcttggcga

SEQ ID NO: 596152 - DNA, 25 bp, Rattus norvegicus
tctgattccatcactaatgcgctag

SEQ ID NO: 596153 - DNA, 25 bp, Rattus norvegicus
tctgattccatctctaatgcgctag

SEQ ID NO: 596154 - DNA, 25 bp, Rattus norvegicus
tctgattcccgcatcaatggtgtct

SEQ ID NO: 596155 - DNA, 25 bp, Rattus norvegicus
tctgattcccgcttcaatggtgtct

SEQ ID NO: 596156 - DNA, 25 bp, Rattus norvegicus
tctgattctgccagagttcctcaag

SEQ ID NO: 596157 - DNA, 25 bp, Rattus norvegicus
tctgattctgcctgagttcctcaag

SEQ ID NO: 596158 - DNA, 25 bp, Rattus norvegicus
tctgatttacctaaaacttccccat

SEQ ID NO: 596159 - DNA, 25 bp, Rattus norvegicus
tctgatttaccttaaacttccccat

SEQ ID NO: 596160 - DNA, 25 bp, Rattus norvegicus
tctgatttgctacttcttcctggta

SEQ ID NO: 596161 - DNA, 25 bp, Rattus norvegicus
tctgatttgctagttcttcctggta

SEQ ID NO: 596162 - DNA, 25 bp, Rattus norvegicus
tctgattttaccatgggactcgcgc

SEQ ID NO: 596163 - DNA, 25 bp, Rattus norvegicus
tctgattttaccttgggactcgcgc

SEQ ID NO: 596164 - DNA, 25 bp, Rattus norvegicus
tctgattttatgatttcttcccttc

SEQ ID NO: 596165 - DNA, 25 bp, Rattus norvegicus
tctgattttatgttttcttcccttc

SEQ ID NO: 596166 - DNA, 25 bp, Rattus norvegicus
tctgattttgccagacatgctgaaa

SEQ ID NO: 596167 - DNA, 25 bp, Rattus norvegicus
tctgattttgcctgacatgctgaaa

SEQ ID NO: 596168 - DNA, 25 bp, Rattus norvegicus
tctgcaaacgttctgtgaagaccca

SEQ ID NO: 596169 - DNA, 25 bp, Rattus norvegicus
tctgcaaacgttgtgtgaagaccca

SEQ ID NO: 596170 - DNA, 25 bp, Rattus norvegicus
tctgcaaaggagctgtgaccctact

SEQ ID NO: 596171 - DNA, 25 bp, Rattus norvegicus
tctgcaaaggaggtgtgaccctact

SEQ ID NO: 596172 - DNA, 25 bp, Rattus norvegicus
tctgcaacactcaggatcactgggt

SEQ ID NO: 596173 - DNA, 25 bp, Rattus norvegicus
tctgcaacactctggatcactgggt

SEQ ID NO: 596174 - DNA, 25 bp, Rattus norvegicus
tctgcaacagtcctcaggtgttcaa

SEQ ID NO: 596175 - DNA, 25 bp, Rattus norvegicus
tctgcaacagtcgtcaggtgttcaa

SEQ ID NO: 596176 - DNA, 25 bp, Rattus norvegicus
tctgcaagacccagttctgtgtaag

SEQ ID NO: 596177 - DNA, 25 bp, Rattus norvegicus
tctgcaagaccctgttctgtgtaag

SEQ ID NO: 596178 - DNA, 25 bp, Rattus norvegicus
tctgcaagctgaccagggaaacccg

SEQ ID NO: 596179 - DNA, 25 bp, Rattus norvegicus
tctgcaagctgagcagggaaacccg

SEQ ID NO: 596180 - DNA, 25 bp, Rattus norvegicus
tctgcaaggagtctcccaaatgaag

SEQ ID NO: 596181 - DNA, 25 bp, Rattus norvegicus
tctgcaaggagtgtcccaaatgaag

SEQ ID NO: 596182 - DNA, 25 bp, Rattus norvegicus
tctgcaaggctgaggttcacccctc

SEQ ID NO: 596183 - DNA, 25 bp, Rattus norvegicus
tctgcaaggctgtggttcacccctc

SEQ ID NO: 596184 - DNA, 25 bp, Rattus norvegicus
tctgcaagtagacaccaccaaggct

SEQ ID NO: 596185 - DNA, 25 bp, Rattus norvegicus
tctgcaagtagagaccaccaaggct

SEQ ID NO: 596186 - DNA, 25 bp, Rattus norvegicus
tctgcaatagggatagggccctctt

SEQ ID NO: 596187 - DNA, 25 bp, Rattus norvegicus
tctgcaatagggttagggccctctt

SEQ ID NO: 596188 - DNA, 25 bp, Rattus norvegicus
tctgcaatggctacctccagagcag

SEQ ID NO: 596189 - DNA, 25 bp, Rattus norvegicus
tctgcaatggcttcctccagagcag

SEQ ID NO: 596190 - DNA, 25 bp, Rattus norvegicus
tctgcaattaacaagccccacaaag

SEQ ID NO: 596191 - DNA, 25 bp, Rattus norvegicus
tctgcaattaactagccccacaaag

SEQ ID NO: 596192 - DNA, 25 bp, Rattus norvegicus
tctgcaattttcagagctattaatt

SEQ ID NO: 596193 - DNA, 25 bp, Rattus norvegicus
tctgcaattttctgagctattaatt

SEQ ID NO: 596194 - DNA, 25 bp, Rattus norvegicus
tctgcacaaaggagcgtcccaagtc

SEQ ID NO: 596195 - DNA, 25 bp, Rattus norvegicus
tctgcacaaaggtgcgtcccaagtc

SEQ ID NO: 596196 - DNA, 25 bp, Rattus norvegicus
tctgcacaatgacaagtatggtacg

SEQ ID NO: 596197 - DNA, 25 bp, Rattus norvegicus
tctgcacaatgagaagtatggtacg

SEQ ID NO: 596198 - DNA, 25 bp, Rattus norvegicus
tctgcacaatggagggcttgagctt

SEQ ID NO: 596199 - DNA, 25 bp, Rattus norvegicus
tctgcacaatggtgggcttgagctt

SEQ ID NO: 596200 - DNA, 25 bp, Rattus norvegicus
tctgcacaccaaatctcacgggagg

SEQ ID NO: 596201 - DNA, 25 bp, Rattus norvegicus
tctgcacaccaattctcacgggagg

SEQ ID NO: 596202 - DNA, 25 bp, Rattus norvegicus
tctgcacagatccactgagcttggg

SEQ ID NO: 596203 - DNA, 25 bp, Rattus norvegicus
tctgcacagatcgactgagcttggg

SEQ ID NO: 596204 - DNA, 25 bp, Rattus norvegicus
tctgcacagctcagccttcaaaagc

SEQ ID NO: 596205 - DNA, 25 bp, Rattus norvegicus
tctgcacagctcattgctacttaga

SEQ ID NO: 596206 - DNA, 25 bp, Rattus norvegicus
tctgcacagctctgccttcaaaagc

SEQ ID NO: 596207 - DNA, 25 bp, Rattus norvegicus
tctgcacagctctttgctacttaga

SEQ ID NO: 596208 - DNA, 25 bp, Rattus norvegicus
tctgcacaggccattgtatcatgaa

SEQ ID NO: 596209 - DNA, 25 bp, Rattus norvegicus
tctgcacaggcctttgtatcatgaa

SEQ ID NO: 596210 - DNA, 25 bp, Rattus norvegicus
tctgcacagggccttggaagtccac

SEQ ID NO: 596211 - DNA, 25 bp, Rattus norvegicus
tctgcacagggcgttggaagtccac

SEQ ID NO: 596212 - DNA, 25 bp, Rattus norvegicus
tctgcacagtaccttttgctctgga

SEQ ID NO: 596213 - DNA, 25 bp, Rattus norvegicus
tctgcacagtacgttttgctctgga

SEQ ID NO: 596214 - DNA, 25 bp, Rattus norvegicus
tctgcacagtcgcttaccaattaag

SEQ ID NO: 596215 - DNA, 25 bp, Rattus norvegicus
tctgcacagtcggttaccaattaag

SEQ ID NO: 596216 - DNA, 25 bp, Rattus norvegicus
tctgcacatcatccagatgccttaa

SEQ ID NO: 596217 - DNA, 25 bp, Rattus norvegicus
tctgcacatcatgcagatgccttaa

SEQ ID NO: 596218 - DNA, 25 bp, Rattus norvegicus
tctgcacatgaccacggcgggcaag

SEQ ID NO: 596219 - DNA, 25 bp, Rattus norvegicus
tctgcacatgacgacggcgggcaag

SEQ ID NO: 596220 - DNA, 25 bp, Rattus norvegicus
tctgcacatggacctctgaacgtgt

SEQ ID NO: 596221 - DNA, 25 bp, Rattus norvegicus
tctgcacatggagctctgaacgtgt

SEQ ID NO: 596222 - DNA, 25 bp, Rattus norvegicus
tctgcacccgccaggaggaatttga

SEQ ID NO: 596223 - DNA, 25 bp, Rattus norvegicus
tctgcacccgcctggaggaatttga

SEQ ID NO: 596224 - DNA, 25 bp, Rattus norvegicus
tctgcacccgttagtcatcaatgac

SEQ ID NO: 596225 - DNA, 25 bp, Rattus norvegicus
tctgcacccgtttgtcatcaatgac

SEQ ID NO: 596226 - DNA, 25 bp, Rattus norvegicus
tctgcaccctgcaacagtggtagac

SEQ ID NO: 596227 - DNA, 25 bp, Rattus norvegicus
tctgcaccctgctacagtggtagac

SEQ ID NO: 596228 - DNA, 25 bp, Rattus norvegicus
tctgcaccctggatttggatgtggt

SEQ ID NO: 596229 - DNA, 25 bp, Rattus norvegicus
tctgcaccctggttttggatgtggt

SEQ ID NO: 596230 - DNA, 25 bp, Rattus norvegicus
tctgcacctaccaaactagagatcc

SEQ ID NO: 596231 - DNA, 25 bp, Rattus norvegicus
tctgcacctacctaactagagatcc

SEQ ID NO: 596232 - DNA, 25 bp, Rattus norvegicus
tctgcacctgagcaaccaactgctt

SEQ ID NO: 596233 - DNA, 25 bp, Rattus norvegicus
tctgcacctgaggaaccaactgctt

SEQ ID NO: 596234 - DNA, 25 bp, Rattus norvegicus
tctgcaccttcgactgtttgataac

SEQ ID NO: 596235 - DNA, 25 bp, Rattus norvegicus
tctgcaccttcgtctgtttgataac

SEQ ID NO: 596236 - DNA, 25 bp, Rattus norvegicus
tctgcaccttgaaggacctcagaat

SEQ ID NO: 596237 - DNA, 25 bp, Rattus norvegicus
tctgcaccttgatggacctcagaat

SEQ ID NO: 596238 - DNA, 25 bp, Rattus norvegicus
tctgcacgaggacgtcctgccgctg

SEQ ID NO: 596239 - DNA, 25 bp, Rattus norvegicus
tctgcacgaggaggtcctgccgctg

SEQ ID NO: 596240 - DNA, 25 bp, Rattus norvegicus
tctgcacgcagtatcccagtgtaaa

SEQ ID NO: 596241 - DNA, 25 bp, Rattus norvegicus
tctgcacgcagtttcccagtgtaaa

SEQ ID NO: 596242 - DNA, 25 bp, Rattus norvegicus
tctgcacggtttacgccacaaaagt

SEQ ID NO: 596243 - DNA, 25 bp, Rattus norvegicus
tctgcacggttttcgccacaaaagt

SEQ ID NO: 596244 - DNA, 25 bp, Rattus norvegicus
tctgcactagatagggtctcgtact

SEQ ID NO: 596245 - DNA, 25 bp, Rattus norvegicus
tctgcactagattgggtctcgtact

SEQ ID NO: 596246 - DNA, 25 bp, Rattus norvegicus
tctgcactcattcttgctgggagat

SEQ ID NO: 596247 - DNA, 25 bp, Rattus norvegicus
tctgcactcattgttgctgggagat

SEQ ID NO: 596248 - DNA, 25 bp, Rattus norvegicus
tctgcactcctgacgggtacgggaa

SEQ ID NO: 596249 - DNA, 25 bp, Rattus norvegicus
tctgcactcctgtcgggtacgggaa

SEQ ID NO: 596250 - DNA, 25 bp, Rattus norvegicus
tctgcactgcacaacgatggactat

SEQ ID NO: 596251 - DNA, 25 bp, Rattus norvegicus
tctgcactgcactacgatggactat

SEQ ID NO: 596252 - DNA, 25 bp, Rattus norvegicus
tctgcacttaaaagccaggcctgct

SEQ ID NO: 596253 - DNA, 25 bp, Rattus norvegicus
tctgcacttaaatgccaggcctgct

SEQ ID NO: 596254 - DNA, 25 bp, Rattus norvegicus
tctgcacttatgacacgagaagcct

SEQ ID NO: 596255 - DNA, 25 bp, Rattus norvegicus
tctgcacttatgtcacgagaagcct

SEQ ID NO: 596256 - DNA, 25 bp, Rattus norvegicus
tctgcacttgggatcacttgagttt

SEQ ID NO: 596257 - DNA, 25 bp, Rattus norvegicus
tctgcacttgggttcacttgagttt

SEQ ID NO: 596258 - DNA, 25 bp, Rattus norvegicus
tctgcacttttaactcacactcaat

SEQ ID NO: 596259 - DNA, 25 bp, Rattus norvegicus
tctgcacttttatctcacactcaat

SEQ ID NO: 596260 - DNA, 25 bp, Rattus norvegicus
tctgcacttttccatgttatactcc

SEQ ID NO: 596261 - DNA, 25 bp, Rattus norvegicus
tctgcacttttcgatgttatactcc

SEQ ID NO: 596262 - DNA, 25 bp, Rattus norvegicus
tctgcagaaactcatgtcacagctc

SEQ ID NO: 596263 - DNA, 25 bp, Rattus norvegicus
tctgcagaaactgatgtcacagctc

SEQ ID NO: 596264 - DNA, 25 bp, Rattus norvegicus
tctgcagaagcaaccctcaaaagta

SEQ ID NO: 596265 - DNA, 25 bp, Rattus norvegicus
tctgcagaagcatccctcaaaagta

SEQ ID NO: 596266 - DNA, 25 bp, Rattus norvegicus
tctgcagacctaacaggcgccttgg

SEQ ID NO: 596267 - DNA, 25 bp, Rattus norvegicus
tctgcagacctatcaggcgccttgg

SEQ ID NO: 596268 - DNA, 25 bp, Rattus norvegicus
tctgcagactctcgctgtggattat

SEQ ID NO: 596269 - DNA, 25 bp, Rattus norvegicus
tctgcagactctggctgtggattat

SEQ ID NO: 596270 - DNA, 25 bp, Rattus norvegicus
tctgcagagcaaattgaatgaagtc

SEQ ID NO: 596271 - DNA, 25 bp, Rattus norvegicus
tctgcagagcaatttgaatgaagtc

SEQ ID NO: 596272 - DNA, 25 bp, Rattus norvegicus
tctgcagaggctacctcagtctgaa

SEQ ID NO: 596273 - DNA, 25 bp, Rattus norvegicus
tctgcagaggcttcctcagtctgaa

SEQ ID NO: 596274 - DNA, 25 bp, Rattus norvegicus
tctgcagagtgcagtctgctttcct

SEQ ID NO: 596275 - DNA, 25 bp, Rattus norvegicus
tctgcagagtgctgtctgctttcct

SEQ ID NO: 596276 - DNA, 25 bp, Rattus norvegicus
tctgcagagttgctgggagtctccc

SEQ ID NO: 596277 - DNA, 25 bp, Rattus norvegicus
tctgcagagttggtgggagtctccc

SEQ ID NO: 596278 - DNA, 25 bp, Rattus norvegicus
tctgcagatctaagacccctgggag

SEQ ID NO: 596279 - DNA, 25 bp, Rattus norvegicus
tctgcagatctatgacccctgggag

SEQ ID NO: 596280 - DNA, 25 bp, Rattus norvegicus
tctgcagatgccatttcgcgtatgc

SEQ ID NO: 596281 - DNA, 25 bp, Rattus norvegicus
tctgcagatgccttttcgcgtatgc

SEQ ID NO: 596282 - DNA, 25 bp, Rattus norvegicus
tctgcagattctcctggtttccgtc

SEQ ID NO: 596283 - DNA, 25 bp, Rattus norvegicus
tctgcagattctgctggtttccgtc

SEQ ID NO: 596284 - DNA, 25 bp, Rattus norvegicus
tctgcagcacctacgtttacaggtc

SEQ ID NO: 596285 - DNA, 25 bp, Rattus norvegicus
tctgcagcaccttcgtttacaggtc

SEQ ID NO: 596286 - DNA, 25 bp, Rattus norvegicus
tctgcagcacttccgggttataaca

SEQ ID NO: 596287 - DNA, 25 bp, Rattus norvegicus
tctgcagcacttgcgggttataaca

SEQ ID NO: 596288 - DNA, 25 bp, Rattus norvegicus
tctgcagcagaacgtccgggtgtcc

SEQ ID NO: 596289 - DNA, 25 bp, Rattus norvegicus
tctgcagcagaaggtccgggtgtcc

SEQ ID NO: 596290 - DNA, 25 bp, Rattus norvegicus
tctgcagcagcaacgggattcaatc

SEQ ID NO: 596291 - DNA, 25 bp, Rattus norvegicus
tctgcagcagcatcgggattcaatc

SEQ ID NO: 596292 - DNA, 25 bp, Rattus norvegicus
tctgcagcagcccatgagactctgc

SEQ ID NO: 596293 - DNA, 25 bp, Rattus norvegicus
tctgcagcagccgatgagactctgc

SEQ ID NO: 596294 - DNA, 25 bp, Rattus norvegicus
tctgcagccatcatgggaatatttt

SEQ ID NO: 596295 - DNA, 25 bp, Rattus norvegicus
tctgcagccatcttgggaatatttt

SEQ ID NO: 596296 - DNA, 25 bp, Rattus norvegicus
tctgcagccatgactgacagagaca

SEQ ID NO: 596297 - DNA, 25 bp, Rattus norvegicus
tctgcagccatgtctgacagagaca

SEQ ID NO: 596298 - DNA, 25 bp, Rattus norvegicus
tctgcagcccgacaaagtaatttat

SEQ ID NO: 596299 - DNA, 25 bp, Rattus norvegicus
tctgcagcccgagaaagtaatttat

SEQ ID NO: 596300 - DNA, 25 bp, Rattus norvegicus
tctgcagcccggctggctctttatt

SEQ ID NO: 596301 - DNA, 25 bp, Rattus norvegicus
tctgcagcccgggtggctctttatt

SEQ ID NO: 596302 - DNA, 25 bp, Rattus norvegicus
tctgcagccgagcacaagttctgta

SEQ ID NO: 596303 - DNA, 25 bp, Rattus norvegicus
tctgcagccgaggacaagttctgta

SEQ ID NO: 596304 - DNA, 25 bp, Rattus norvegicus
tctgcagccttgagtcttagcctac

SEQ ID NO: 596305 - DNA, 25 bp, Rattus norvegicus
tctgcagccttgtgtcttagcctac

SEQ ID NO: 596306 - DNA, 25 bp, Rattus norvegicus
tctgcagcgttcacttccagggcgg

SEQ ID NO: 596307 - DNA, 25 bp, Rattus norvegicus
tctgcagcgttctcttccagggcgg

SEQ ID NO: 596308 - DNA, 25 bp, Rattus norvegicus
tctgcagctacactggccgctggcg

SEQ ID NO: 596309 - DNA, 25 bp, Rattus norvegicus
tctgcagctacagtggccgctggcg

SEQ ID NO: 596310 - DNA, 25 bp, Rattus norvegicus
tctgcagctctaccagaggtgcctg

SEQ ID NO: 596311 - DNA, 25 bp, Rattus norvegicus
tctgcagctctagcagaggtgcctg

SEQ ID NO: 596312 - DNA, 25 bp, Rattus norvegicus
tctgcagctgctagtgggtgacttc

SEQ ID NO: 596313 - DNA, 25 bp, Rattus norvegicus
tctgcagctgcttgtgggtgacttc

SEQ ID NO: 596314 - DNA, 25 bp, Rattus norvegicus
tctgcagctgtgctgaatgttgatc

SEQ ID NO: 596315 - DNA, 25 bp, Rattus norvegicus
tctgcagctgtggtgaatgttgatc

SEQ ID NO: 596316 - DNA, 25 bp, Rattus norvegicus
tctgcagcttacagggaggatgacc

SEQ ID NO: 596317 - DNA, 25 bp, Rattus norvegicus
tctgcagcttactgggaggatgacc

SEQ ID NO: 596318 - DNA, 25 bp, Rattus norvegicus
tctgcagcttcactctggacgagtg

SEQ ID NO: 596319 - DNA, 25 bp, Rattus norvegicus
tctgcagcttcagtctggacgagtg

SEQ ID NO: 596320 - DNA, 25 bp, Rattus norvegicus
tctgcagcttttaggcacctgtgct

SEQ ID NO: 596321 - DNA, 25 bp, Rattus norvegicus
tctgcagctttttggcacctgtgct

SEQ ID NO: 596322 - DNA, 25 bp, Rattus norvegicus
tctgcaggaagaactggctcaggct

SEQ ID NO: 596323 - DNA, 25 bp, Rattus norvegicus
tctgcaggaagatctggctcaggct

SEQ ID NO: 596324 - DNA, 25 bp, Rattus norvegicus
tctgcaggacaacgcctcatgactt

SEQ ID NO: 596325 - DNA, 25 bp, Rattus norvegicus
tctgcaggacaaggcctcatgactt

SEQ ID NO: 596326 - DNA, 25 bp, Rattus norvegicus
tctgcaggacatatcccatgggagc

SEQ ID NO: 596327 - DNA, 25 bp, Rattus norvegicus
tctgcaggacatttcccatgggagc

SEQ ID NO: 596328 - DNA, 25 bp, Rattus norvegicus
tctgcaggagacaggacaccgacta

SEQ ID NO: 596329 - DNA, 25 bp, Rattus norvegicus
tctgcaggagactggacaccgacta

SEQ ID NO: 596330 - DNA, 25 bp, Rattus norvegicus
tctgcaggccccaaaatcatctggg

SEQ ID NO: 596331 - DNA, 25 bp, Rattus norvegicus
tctgcaggcccctaaatcatctggg

SEQ ID NO: 596332 - DNA, 25 bp, Rattus norvegicus
tctgcaggcctaacagtcacgtttt

SEQ ID NO: 596333 - DNA, 25 bp, Rattus norvegicus
tctgcaggcctatcagtcacgtttt

SEQ ID NO: 596334 - DNA, 25 bp, Rattus norvegicus
tctgcaggcctcatggagcaacgtg

SEQ ID NO: 596335 - DNA, 25 bp, Rattus norvegicus
tctgcaggcctcttggagcaacgtg

SEQ ID NO: 596336 - DNA, 25 bp, Rattus norvegicus
tctgcaggctcaccatttatcattt

SEQ ID NO: 596337 - DNA, 25 bp, Rattus norvegicus
tctgcaggctcagcatttatcattt

SEQ ID NO: 596338 - DNA, 25 bp, Rattus norvegicus
tctgcaggcttgatgttcatgtggt

SEQ ID NO: 596339 - DNA, 25 bp, Rattus norvegicus
tctgcaggcttgttgttcatgtggt

SEQ ID NO: 596340 - DNA, 25 bp, Rattus norvegicus
tctgcagggaatagtgggaactctt

SEQ ID NO: 596341 - DNA, 25 bp, Rattus norvegicus
tctgcagggaattgtgggaactctt

SEQ ID NO: 596342 - DNA, 25 bp, Rattus norvegicus
tctgcagggctaagagtctggctct

SEQ ID NO: 596343 - DNA, 25 bp, Rattus norvegicus
tctgcagggctatgagtctggctct

SEQ ID NO: 596344 - DNA, 25 bp, Rattus norvegicus
tctgcaggtctgaagggctggtcta

SEQ ID NO: 596345 - DNA, 25 bp, Rattus norvegicus
tctgcaggtctgtagggctggtcta

SEQ ID NO: 596346 - DNA, 25 bp, Rattus norvegicus
tctgcagtcacccaagtgtcacctg

SEQ ID NO: 596347 - DNA, 25 bp, Rattus norvegicus
tctgcagtcaccgaagtgtcacctg

SEQ ID NO: 596348 - DNA, 25 bp, Rattus norvegicus
tctgcagtcagtagaagccaagctt

SEQ ID NO: 596349 - DNA, 25 bp, Rattus norvegicus
tctgcagtcagttgaagccaagctt

SEQ ID NO: 596350 - DNA, 25 bp, Rattus norvegicus
tctgcagtcatgatagcctccaagg

SEQ ID NO: 596351 - DNA, 25 bp, Rattus norvegicus
tctgcagtcatgttagcctccaagg

SEQ ID NO: 596352 - DNA, 25 bp, Rattus norvegicus
tctgcagtcattctgtggcctgaat

SEQ ID NO: 596353 - DNA, 25 bp, Rattus norvegicus
tctgcagtcattgtgtggcctgaat

SEQ ID NO: 596354 - DNA, 25 bp, Rattus norvegicus
tctgcagtcgacaagactcggattg

SEQ ID NO: 596355 - DNA, 25 bp, Rattus norvegicus
tctgcagtcgactagactcggattg

SEQ ID NO: 596356 - DNA, 25 bp, Rattus norvegicus
tctgcagtcttcagacaccaagtgt

SEQ ID NO: 596357 - DNA, 25 bp, Rattus norvegicus
tctgcagtcttctgacaccaagtgt

SEQ ID NO: 596358 - DNA, 25 bp, Rattus norvegicus
tctgcagtgcttaaggctgggacta

SEQ ID NO: 596359 - DNA, 25 bp, Rattus norvegicus
tctgcagtgctttaggctgggacta

SEQ ID NO: 596360 - DNA, 25 bp, Rattus norvegicus
tctgcagtggcaattatctaaggat

SEQ ID NO: 596361 - DNA, 25 bp, Rattus norvegicus
tctgcagtggcatttatctaaggat

SEQ ID NO: 596362 - DNA, 25 bp, Rattus norvegicus
tctgcagttcacctgagctgggaga

SEQ ID NO: 596363 - DNA, 25 bp, Rattus norvegicus
tctgcagttcacgtgagctgggaga

SEQ ID NO: 596364 - DNA, 25 bp, Rattus norvegicus
tctgcagttctcaaacgagcatgat

SEQ ID NO: 596365 - DNA, 25 bp, Rattus norvegicus
tctgcagttctctaacgagcatgat

SEQ ID NO: 596366 - DNA, 25 bp, Rattus norvegicus
tctgcagttgtcaatgctgggcgct

SEQ ID NO: 596367 - DNA, 25 bp, Rattus norvegicus
tctgcagttgtctatgctgggcgct

SEQ ID NO: 596368 - DNA, 25 bp, Rattus norvegicus
tctgcataatcacgagtccattcct

SEQ ID NO: 596369 - DNA, 25 bp, Rattus norvegicus
tctgcataatcaggagtccattcct

SEQ ID NO: 596370 - DNA, 25 bp, Rattus norvegicus
tctgcatatgctagaagaggctttt

SEQ ID NO: 596371 - DNA, 25 bp, Rattus norvegicus
tctgcatatgcttgaagaggctttt

SEQ ID NO: 596372 - DNA, 25 bp, Rattus norvegicus
tctgcatattcccatacacacaatt

SEQ ID NO: 596373 - DNA, 25 bp, Rattus norvegicus
tctgcatattccgatacacacaatt

SEQ ID NO: 596374 - DNA, 25 bp, Rattus norvegicus
tctgcatcaagacacttccatggca

SEQ ID NO: 596375 - DNA, 25 bp, Rattus norvegicus
tctgcatcaagagacttccatggca

SEQ ID NO: 596376 - DNA, 25 bp, Rattus norvegicus
tctgcatcagagaggcctttgtgtg

SEQ ID NO: 596377 - DNA, 25 bp, Rattus norvegicus
tctgcatcagagtggcctttgtgtg

SEQ ID NO: 596378 - DNA, 25 bp, Rattus norvegicus
tctgcatcctatactgtgtcaggtg

SEQ ID NO: 596379 - DNA, 25 bp, Rattus norvegicus
tctgcatcctattctgtgtcaggtg

SEQ ID NO: 596380 - DNA, 25 bp, Rattus norvegicus
tctgcatcctgaacctttgtgccac

SEQ ID NO: 596381 - DNA, 25 bp, Rattus norvegicus
tctgcatcctgatcctttgtgccac

SEQ ID NO: 596382 - DNA, 25 bp, Rattus norvegicus
tctgcatcctggagtttctggagtt

SEQ ID NO: 596383 - DNA, 25 bp, Rattus norvegicus
tctgcatcctggtgtttctggagtt

SEQ ID NO: 596384 - DNA, 25 bp, Rattus norvegicus
tctgcatcctgtagtgagaaacatt

SEQ ID NO: 596385 - DNA, 25 bp, Rattus norvegicus
tctgcatcctgttgtgagaaacatt

SEQ ID NO: 596386 - DNA, 25 bp, Rattus norvegicus
tctgcatctcggagccttgaactga

SEQ ID NO: 596387 - DNA, 25 bp, Rattus norvegicus
tctgcatctcggtgccttgaactga

SEQ ID NO: 596388 - DNA, 25 bp, Rattus norvegicus
tctgcatctgacaggaggttcctcc

SEQ ID NO: 596389 - DNA, 25 bp, Rattus norvegicus
tctgcatctgactggaggttcctcc

SEQ ID NO: 596390 - DNA, 25 bp, Rattus norvegicus
tctgcatcttccacttgatagtcat

SEQ ID NO: 596391 - DNA, 25 bp, Rattus norvegicus
tctgcatcttcctcttgatagtcat

SEQ ID NO: 596392 - DNA, 25 bp, Rattus norvegicus
tctgcatgacagagcaaccagccag

SEQ ID NO: 596393 - DNA, 25 bp, Rattus norvegicus
tctgcatgacagtgcaaccagccag

SEQ ID NO: 596394 - DNA, 25 bp, Rattus norvegicus
tctgcatgaccacggatggtgctgt

SEQ ID NO: 596395 - DNA, 25 bp, Rattus norvegicus
tctgcatgaccagggatggtgctgt

SEQ ID NO: 596396 - DNA, 25 bp, Rattus norvegicus
tctgcatggacacgacagctcagct

SEQ ID NO: 596397 - DNA, 25 bp, Rattus norvegicus
tctgcatggacaggacagctcagct

SEQ ID NO: 596398 - DNA, 25 bp, Rattus norvegicus
tctgcatgtcatattaacttttgtg

SEQ ID NO: 596399 - DNA, 25 bp, Rattus norvegicus
tctgcatgtcattttaacttttgtg

SEQ ID NO: 596400 - DNA, 25 bp, Rattus norvegicus
tctgcatgtctgaggccactggcaa

SEQ ID NO: 596401 - DNA, 25 bp, Rattus norvegicus
tctgcatgtctgtggccactggcaa

SEQ ID NO: 596402 - DNA, 25 bp, Rattus norvegicus
tctgcatgtgctacgggcccaagaa

SEQ ID NO: 596403 - DNA, 25 bp, Rattus norvegicus
tctgcatgtgcttcgggcccaagaa

SEQ ID NO: 596404 - DNA, 25 bp, Rattus norvegicus
tctgcattattcacaccatctgtga

SEQ ID NO: 596405 - DNA, 25 bp, Rattus norvegicus
tctgcattattctcaccatctgtga

SEQ ID NO: 596406 - DNA, 25 bp, Rattus norvegicus
tctgcattccagacttaattttgta

SEQ ID NO: 596407 - DNA, 25 bp, Rattus norvegicus
tctgcattccagtcttaattttgta

SEQ ID NO: 596408 - DNA, 25 bp, Rattus norvegicus
tctgcattcctgacacatgatggac

SEQ ID NO: 596409 - DNA, 25 bp, Rattus norvegicus
tctgcattcctgtcacatgatggac

SEQ ID NO: 596410 - DNA, 25 bp, Rattus norvegicus
tctgcattctacattggagaggaca

SEQ ID NO: 596411 - DNA, 25 bp, Rattus norvegicus
tctgcattctactttggagaggaca

SEQ ID NO: 596412 - DNA, 25 bp, Rattus norvegicus
tctgcattctgtccactagtgccta

SEQ ID NO: 596413 - DNA, 25 bp, Rattus norvegicus
tctgcattctgtgcactagtgccta

SEQ ID NO: 596414 - DNA, 25 bp, Rattus norvegicus
tctgcattcttaaggcgtgcctatg

SEQ ID NO: 596415 - DNA, 25 bp, Rattus norvegicus
tctgcattcttatggcgtgcctatg

SEQ ID NO: 596416 - DNA, 25 bp, Rattus norvegicus
tctgcattgctgactccaactgttg

SEQ ID NO: 596417 - DNA, 25 bp, Rattus norvegicus
tctgcattgctgtctccaactgttg

SEQ ID NO: 596418 - DNA, 25 bp, Rattus norvegicus
tctgcattgtctacacgtgtgttct

SEQ ID NO: 596419 - DNA, 25 bp, Rattus norvegicus
tctgcattgtcttcacgtgtgttct

SEQ ID NO: 596420 - DNA, 25 bp, Rattus norvegicus
tctgcatttactcactaccgtggaa

SEQ ID NO: 596421 - DNA, 25 bp, Rattus norvegicus
tctgcatttactgactaccgtggaa

SEQ ID NO: 596422 - DNA, 25 bp, Rattus norvegicus
tctgcatttatgatcttgaaccctg

SEQ ID NO: 596423 - DNA, 25 bp, Rattus norvegicus
tctgcatttatgttcttgaaccctg

SEQ ID NO: 596424 - DNA, 25 bp, Rattus norvegicus
tctgcatttccaaagggttcaccgc

SEQ ID NO: 596425 - DNA, 25 bp, Rattus norvegicus
tctgcatttccatagggttcaccgc

SEQ ID NO: 596426 - DNA, 25 bp, Rattus norvegicus
tctgcatttcctccacatgtaatag

SEQ ID NO: 596427 - DNA, 25 bp, Rattus norvegicus
tctgcatttcctgcacatgtaatag

SEQ ID NO: 596428 - DNA, 25 bp, Rattus norvegicus
tctgcatttgcaagtgtctgcctga

SEQ ID NO: 596429 - DNA, 25 bp, Rattus norvegicus
tctgcatttgcatgtgtctgcctga

SEQ ID NO: 596430 - DNA, 25 bp, Rattus norvegicus
tctgcatttgggacttgaggctgag

SEQ ID NO: 596431 - DNA, 25 bp, Rattus norvegicus
tctgcatttgggtcttgaggctgag

SEQ ID NO: 596432 - DNA, 25 bp, Rattus norvegicus
tctgccaaacgaagacactagcctc

SEQ ID NO: 596433 - DNA, 25 bp, Rattus norvegicus
tctgccaaacgatgacactagcctc

SEQ ID NO: 596434 - DNA, 25 bp, Rattus norvegicus
tctgccaaagataaacaaccgtatg

SEQ ID NO: 596435 - DNA, 25 bp, Rattus norvegicus
tctgccaaagattaacaaccgtatg

SEQ ID NO: 596436 - DNA, 25 bp, Rattus norvegicus
tctgccaagaggctctcctggaaaa

SEQ ID NO: 596437 - DNA, 25 bp, Rattus norvegicus
tctgccaagagggtctcctggaaaa

SEQ ID NO: 596438 - DNA, 25 bp, Rattus norvegicus
tctgccaaggacaaggctggtcagc

SEQ ID NO: 596439 - DNA, 25 bp, Rattus norvegicus
tctgccaaggactaggctggtcagc

SEQ ID NO: 596440 - DNA, 25 bp, Rattus norvegicus
tctgccaagttaactttcccctttt

SEQ ID NO: 596441 - DNA, 25 bp, Rattus norvegicus
tctgccaagttatctttcccctttt

SEQ ID NO: 596442 - DNA, 25 bp, Rattus norvegicus
tctgccacacccataagttcaatag

SEQ ID NO: 596443 - DNA, 25 bp, Rattus norvegicus
tctgccacacccttaagttcaatag

SEQ ID NO: 596444 - DNA, 25 bp, Rattus norvegicus
tctgccaccacgattcgtgaaggag

SEQ ID NO: 596445 - DNA, 25 bp, Rattus norvegicus
tctgccaccacgtttcgtgaaggag

SEQ ID NO: 596446 - DNA, 25 bp, Rattus norvegicus
tctgccacggatagtttcctcagct

SEQ ID NO: 596447 - DNA, 25 bp, Rattus norvegicus
tctgccacggattgtttcctcagct

SEQ ID NO: 596448 - DNA, 25 bp, Rattus norvegicus
tctgccacgtgactcgggcactgtg

SEQ ID NO: 596449 - DNA, 25 bp, Rattus norvegicus
tctgccacgtgagtcgggcactgtg

SEQ ID NO: 596450 - DNA, 25 bp, Rattus norvegicus
tctgccactaatcgattgagttcta

SEQ ID NO: 596451 - DNA, 25 bp, Rattus norvegicus
tctgccactaatggattgagttcta

SEQ ID NO: 596452 - DNA, 25 bp, Rattus norvegicus
tctgccactgtaccatgccatgatg

SEQ ID NO: 596453 - DNA, 25 bp, Rattus norvegicus
tctgccactgtagcatgccatgatg

SEQ ID NO: 596454 - DNA, 25 bp, Rattus norvegicus
tctgccagacagatcataacagctg

SEQ ID NO: 596455 - DNA, 25 bp, Rattus norvegicus
tctgccagacagttcataacagctg

SEQ ID NO: 596456 - DNA, 25 bp, Rattus norvegicus
tctgccagctctctttactagcgaa

SEQ ID NO: 596457 - DNA, 25 bp, Rattus norvegicus
tctgccagctctgtttactagcgaa

SEQ ID NO: 596458 - DNA, 25 bp, Rattus norvegicus
tctgccaggttgaagaagtgaccac

SEQ ID NO: 596459 - DNA, 25 bp, Rattus norvegicus
tctgccaggttgtagaagtgaccac

SEQ ID NO: 596460 - DNA, 25 bp, Rattus norvegicus
tctgccagtaccccgactttaaaat

SEQ ID NO: 596461 - DNA, 25 bp, Rattus norvegicus
tctgccagtaccgcgactttaaaat

SEQ ID NO: 596462 - DNA, 25 bp, Rattus norvegicus
tctgccagtggaagctttctttgaa

SEQ ID NO: 596463 - DNA, 25 bp, Rattus norvegicus
tctgccagtggatgctttctttgaa

SEQ ID NO: 596464 - DNA, 25 bp, Rattus norvegicus
tctgccagttatattcttgctacac

SEQ ID NO: 596465 - DNA, 25 bp, Rattus norvegicus
tctgccagttattttcttgctacac

SEQ ID NO: 596466 - DNA, 25 bp, Rattus norvegicus
tctgccataggtagccacaaagttg

SEQ ID NO: 596467 - DNA, 25 bp, Rattus norvegicus
tctgccataggttgccacaaagttg

SEQ ID NO: 596468 - DNA, 25 bp, Rattus norvegicus
tctgccatccacatcactgaagttg

SEQ ID NO: 596469 - DNA, 25 bp, Rattus norvegicus
tctgccatccacttcactgaagttg

SEQ ID NO: 596470 - DNA, 25 bp, Rattus norvegicus
tctgccatgaagaccgttgctctat

SEQ ID NO: 596471 - DNA, 25 bp, Rattus norvegicus
tctgccatgaagtccgttgctctat

SEQ ID NO: 596472 - DNA, 25 bp, Rattus norvegicus
tctgccatgataaccagtcctgttg

SEQ ID NO: 596473 - DNA, 25 bp, Rattus norvegicus
tctgccatgatatccagtcctgttg

SEQ ID NO: 596474 - DNA, 25 bp, Rattus norvegicus
tctgccatgctcagctgcctcagag

SEQ ID NO: 596475 - DNA, 25 bp, Rattus norvegicus
tctgccatgctctgctgcctcagag

SEQ ID NO: 596476 - DNA, 25 bp, Rattus norvegicus
tctgccatgcttagatacctgggag

SEQ ID NO: 596477 - DNA, 25 bp, Rattus norvegicus
tctgccatgctttgatacctgggag

SEQ ID NO: 596478 - DNA, 25 bp, Rattus norvegicus
tctgccatggagcaatctggtacct

SEQ ID NO: 596479 - DNA, 25 bp, Rattus norvegicus
tctgccatggaggaatctggtacct

SEQ ID NO: 596480 - DNA, 25 bp, Rattus norvegicus
tctgccatgggtacctgaggtgaga

SEQ ID NO: 596481 - DNA, 25 bp, Rattus norvegicus
tctgccatgggttcctgaggtgaga

SEQ ID NO: 596482 - DNA, 25 bp, Rattus norvegicus
tctgccatgtcccttactttaaaaa

SEQ ID NO: 596483 - DNA, 25 bp, Rattus norvegicus
tctgccatgtccgttactttaaaaa

SEQ ID NO: 596484 - DNA, 25 bp, Rattus norvegicus
tctgccattgtgaccacatgctcta

SEQ ID NO: 596485 - DNA, 25 bp, Rattus norvegicus
tctgccattgtgtccacatgctcta

SEQ ID NO: 596486 - DNA, 25 bp, Rattus norvegicus
tctgccatttttcctcttgatattt

SEQ ID NO: 596487 - DNA, 25 bp, Rattus norvegicus
tctgccatttttgctcttgatattt

SEQ ID NO: 596488 - DNA, 25 bp, Rattus norvegicus
tctgcccaaaaaactttcccaagct

SEQ ID NO: 596489 - DNA, 25 bp, Rattus norvegicus
tctgcccaaaaatctttcccaagct

SEQ ID NO: 596490 - DNA, 25 bp, Rattus norvegicus
tctgcccaactgacaacctggataa

SEQ ID NO: 596491 - DNA, 25 bp, Rattus norvegicus
tctgcccaactgtcaacctggataa

SEQ ID NO: 596492 - DNA, 25 bp, Rattus norvegicus
tctgcccaaggaacccatgtttaag

SEQ ID NO: 596493 - DNA, 25 bp, Rattus norvegicus
tctgcccaaggatcccatgtttaag

SEQ ID NO: 596494 - DNA, 25 bp, Rattus norvegicus
tctgcccaatacagtccaccggaga

SEQ ID NO: 596495 - DNA, 25 bp, Rattus norvegicus
tctgcccaatactgtccaccggaga

SEQ ID NO: 596496 - DNA, 25 bp, Rattus norvegicus
tctgcccagagtacagctacgggtg

SEQ ID NO: 596497 - DNA, 25 bp, Rattus norvegicus
tctgcccagagttcagctacgggtg

SEQ ID NO: 596498 - DNA, 25 bp, Rattus norvegicus
tctgcccagcagagcttgtgaggta

SEQ ID NO: 596499 - DNA, 25 bp, Rattus norvegicus
tctgcccagcagtgcttgtgaggta

SEQ ID NO: 596500 - DNA, 25 bp, Rattus norvegicus
tctgcccagccaagtgagggtctga

SEQ ID NO: 596501 - DNA, 25 bp, Rattus norvegicus
tctgcccagccatgtgagggtctga

SEQ ID NO: 596502 - DNA, 25 bp, Rattus norvegicus
tctgcccagtgtaacatactccgaa

SEQ ID NO: 596503 - DNA, 25 bp, Rattus norvegicus
tctgcccagtgttacatactccgaa

SEQ ID NO: 596504 - DNA, 25 bp, Rattus norvegicus
tctgcccatttccttgtctgtctga

SEQ ID NO: 596505 - DNA, 25 bp, Rattus norvegicus
tctgcccatttcgttgtctgtctga

SEQ ID NO: 596506 - DNA, 25 bp, Rattus norvegicus
tctgccccaacgatcgacagaaact

SEQ ID NO: 596507 - DNA, 25 bp, Rattus norvegicus
tctgccccaacgttcgacagaaact

SEQ ID NO: 596508 - DNA, 25 bp, Rattus norvegicus
tctgccccacttagcggactgtagt

SEQ ID NO: 596509 - DNA, 25 bp, Rattus norvegicus
tctgccccactttgcggactgtagt

SEQ ID NO: 596510 - DNA, 25 bp, Rattus norvegicus
tctgccccagagatgtagccatttt

SEQ ID NO: 596511 - DNA, 25 bp, Rattus norvegicus
tctgccccagagttgtagccatttt

SEQ ID NO: 596512 - DNA, 25 bp, Rattus norvegicus
tctgccccagatcacggattatttg

SEQ ID NO: 596513 - DNA, 25 bp, Rattus norvegicus
tctgccccagatgacggattatttg

SEQ ID NO: 596514 - DNA, 25 bp, Rattus norvegicus
tctgccccaggcatttggagggtac

SEQ ID NO: 596515 - DNA, 25 bp, Rattus norvegicus
tctgccccaggcttttggagggtac

SEQ ID NO: 596516 - DNA, 25 bp, Rattus norvegicus
tctgccccgtagcatgaactggact

SEQ ID NO: 596517 - DNA, 25 bp, Rattus norvegicus
tctgccccgtaggatgaactggact

SEQ ID NO: 596518 - DNA, 25 bp, Rattus norvegicus
tctgcccctcagactggctgtaaaa

SEQ ID NO: 596519 - DNA, 25 bp, Rattus norvegicus
tctgcccctcagtctggctgtaaaa

SEQ ID NO: 596520 - DNA, 25 bp, Rattus norvegicus
tctgcccgacgtactcgaaaataaa

SEQ ID NO: 596521 - DNA, 25 bp, Rattus norvegicus
tctgcccgacgttctcgaaaataaa

SEQ ID NO: 596522 - DNA, 25 bp, Rattus norvegicus
tctgcccggctgagaggtcaaggac

SEQ ID NO: 596523 - DNA, 25 bp, Rattus norvegicus
tctgcccggctgtgaggtcaaggac

SEQ ID NO: 596524 - DNA, 25 bp, Rattus norvegicus
tctgcccgggacagtgagcctatgg

SEQ ID NO: 596525 - DNA, 25 bp, Rattus norvegicus
tctgcccgggactgtgagcctatgg

SEQ ID NO: 596526 - DNA, 25 bp, Rattus norvegicus
tctgccctaaaaaccaagctctaat

SEQ ID NO: 596527 - DNA, 25 bp, Rattus norvegicus
tctgccctaaaatccaagctctaat

SEQ ID NO: 596528 - DNA, 25 bp, Rattus norvegicus
tctgccctacttctggaactttgag

SEQ ID NO: 596529 - DNA, 25 bp, Rattus norvegicus
tctgccctacttgtggaactttgag

SEQ ID NO: 596530 - DNA, 25 bp, Rattus norvegicus
tctgccctatacagtgacttactta

SEQ ID NO: 596531 - DNA, 25 bp, Rattus norvegicus
tctgccctatactgtgacttactta

SEQ ID NO: 596532 - DNA, 25 bp, Rattus norvegicus
tctgccctatttcattgtgtgctgt

SEQ ID NO: 596533 - DNA, 25 bp, Rattus norvegicus
tctgccctatttgattgtgtgctgt

SEQ ID NO: 596534 - DNA, 25 bp, Rattus norvegicus
tctgccctcacgcatgctattaaag

SEQ ID NO: 596535 - DNA, 25 bp, Rattus norvegicus
tctgccctcacggatgctattaaag

SEQ ID NO: 596536 - DNA, 25 bp, Rattus norvegicus
tctgccctctgtataggaacgtaat

SEQ ID NO: 596537 - DNA, 25 bp, Rattus norvegicus
tctgccctctgtttaggaacgtaat

SEQ ID NO: 596538 - DNA, 25 bp, Rattus norvegicus
tctgccctgagcaatccatgctact

SEQ ID NO: 596539 - DNA, 25 bp, Rattus norvegicus
tctgccctgagctatccatgctact

SEQ ID NO: 596540 - DNA, 25 bp, Rattus norvegicus
tctgccctgcaccatgacaaagaat

SEQ ID NO: 596541 - DNA, 25 bp, Rattus norvegicus
tctgccctgcacgatgacaaagaat

SEQ ID NO: 596542 - DNA, 25 bp, Rattus norvegicus
tctgccctggctctctgtgtgtatg

SEQ ID NO: 596543 - DNA, 25 bp, Rattus norvegicus
tctgccctggctgtctgtgtgtatg

SEQ ID NO: 596544 - DNA, 25 bp, Rattus norvegicus
tctgccctgtggagccattaaagga

SEQ ID NO: 596545 - DNA, 25 bp, Rattus norvegicus
tctgccctgtggtgccattaaagga

SEQ ID NO: 596546 - DNA, 25 bp, Rattus norvegicus
tctgcccttggtatgtcactttata

SEQ ID NO: 596547 - DNA, 25 bp, Rattus norvegicus
tctgcccttggtttgtcactttata

SEQ ID NO: 596548 - DNA, 25 bp, Rattus norvegicus
tctgcccttgtcattgtgttcacaa

SEQ ID NO: 596549 - DNA, 25 bp, Rattus norvegicus
tctgcccttgtctttgtgttcacaa

SEQ ID NO: 596550 - DNA, 25 bp, Rattus norvegicus
tctgcccttttgatctctcttatta

SEQ ID NO: 596551 - DNA, 25 bp, Rattus norvegicus
tctgcccttttgttctctcttatta

SEQ ID NO: 596552 - DNA, 25 bp, Rattus norvegicus
tctgccgatgtcaacacaactacaa

SEQ ID NO: 596553 - DNA, 25 bp, Rattus norvegicus
tctgccgatgtctacacaactacaa

SEQ ID NO: 596554 - DNA, 25 bp, Rattus norvegicus
tctgccgctggcaatctgtagatag

SEQ ID NO: 596555 - DNA, 25 bp, Rattus norvegicus
tctgccgctggctatctgtagatag

SEQ ID NO: 596556 - DNA, 25 bp, Rattus norvegicus
tctgccgtcaatccctgtgagggag

SEQ ID NO: 596557 - DNA, 25 bp, Rattus norvegicus
tctgccgtcaatgcctgtgagggag

SEQ ID NO: 596558 - DNA, 25 bp, Rattus norvegicus
tctgccgtcctcaatcacagagaat

SEQ ID NO: 596559 - DNA, 25 bp, Rattus norvegicus
tctgccgtcctctatcacagagaat

SEQ ID NO: 596560 - DNA, 25 bp, Rattus norvegicus
tctgccgtgacacctcagtgaggga

SEQ ID NO: 596561 - DNA, 25 bp, Rattus norvegicus
tctgccgtgacagctcagtgaggga

SEQ ID NO: 596562 - DNA, 25 bp, Rattus norvegicus
tctgccgttcagataaccctttatt

SEQ ID NO: 596563 - DNA, 25 bp, Rattus norvegicus
tctgccgttcagttaaccctttatt

SEQ ID NO: 596564 - DNA, 25 bp, Rattus norvegicus
tctgccgttggcatacacgcaaggt

SEQ ID NO: 596565 - DNA, 25 bp, Rattus norvegicus
tctgccgttggcttacacgcaaggt

SEQ ID NO: 596566 - DNA, 25 bp, Rattus norvegicus
tctgcctaacacctgggactcaaag

SEQ ID NO: 596567 - DNA, 25 bp, Rattus norvegicus
tctgcctaacacgtgggactcaaag

SEQ ID NO: 596568 - DNA, 25 bp, Rattus norvegicus
tctgcctactcaaggtactctgtaa

SEQ ID NO: 596569 - DNA, 25 bp, Rattus norvegicus
tctgcctactcatggtactctgtaa

SEQ ID NO: 596570 - DNA, 25 bp, Rattus norvegicus
tctgcctagcttccagagcgaggaa

SEQ ID NO: 596571 - DNA, 25 bp, Rattus norvegicus
tctgcctagcttgcagagcgaggaa

SEQ ID NO: 596572 - DNA, 25 bp, Rattus norvegicus
tctgcctatccccattatgggttat

SEQ ID NO: 596573 - DNA, 25 bp, Rattus norvegicus
tctgcctatcccgattatgggttat

SEQ ID NO: 596574 - DNA, 25 bp, Rattus norvegicus
tctgcctatggacacggatgacact

SEQ ID NO: 596575 - DNA, 25 bp, Rattus norvegicus
tctgcctatggagacggatgacact

SEQ ID NO: 596576 - DNA, 25 bp, Rattus norvegicus
tctgcctatggcactcacaaggttg

SEQ ID NO: 596577 - DNA, 25 bp, Rattus norvegicus
tctgcctatggctctcacaaggttg

SEQ ID NO: 596578 - DNA, 25 bp, Rattus norvegicus
tctgcctcaaagactacagtgattt

SEQ ID NO: 596579 - DNA, 25 bp, Rattus norvegicus
tctgcctcaaagtctacagtgattt

SEQ ID NO: 596580 - DNA, 25 bp, Rattus norvegicus
tctgcctcacggacctggtgggata

SEQ ID NO: 596581 - DNA, 25 bp, Rattus norvegicus
tctgcctcacggtcctggtgggata

SEQ ID NO: 596582 - DNA, 25 bp, Rattus norvegicus
tctgcctcagacactgtctttagga

SEQ ID NO: 596583 - DNA, 25 bp, Rattus norvegicus
tctgcctcagactctgtctttagga

SEQ ID NO: 596584 - DNA, 25 bp, Rattus norvegicus
tctgcctcagggacactcagaagtg

SEQ ID NO: 596585 - DNA, 25 bp, Rattus norvegicus
tctgcctcagggtcactcagaagtg

SEQ ID NO: 596586 - DNA, 25 bp, Rattus norvegicus
tctgcctcatggctgcttagatcag

SEQ ID NO: 596587 - DNA, 25 bp, Rattus norvegicus
tctgcctcatgggtgcttagatcag

SEQ ID NO: 596588 - DNA, 25 bp, Rattus norvegicus
tctgcctcatttcaacctgacatat

SEQ ID NO: 596589 - DNA, 25 bp, Rattus norvegicus
tctgcctcatttgaacctgacatat

SEQ ID NO: 596590 - DNA, 25 bp, Rattus norvegicus
tctgcctccacgcatgattggttga

SEQ ID NO: 596591 - DNA, 25 bp, Rattus norvegicus
tctgcctccacggatgattggttga

SEQ ID NO: 596592 - DNA, 25 bp, Rattus norvegicus
tctgcctccatacagctcggattta

SEQ ID NO: 596593 - DNA, 25 bp, Rattus norvegicus
tctgcctccatagagctcggattta

SEQ ID NO: 596594 - DNA, 25 bp, Rattus norvegicus
tctgcctccatgagctgtgattata

SEQ ID NO: 596595 - DNA, 25 bp, Rattus norvegicus
tctgcctccatgtgctgtgattata

SEQ ID NO: 596596 - DNA, 25 bp, Rattus norvegicus
tctgcctcccaaaccttgaagatga

SEQ ID NO: 596597 - DNA, 25 bp, Rattus norvegicus
tctgcctcccaaccggcagggttga

SEQ ID NO: 596598 - DNA, 25 bp, Rattus norvegicus
tctgcctcccaactttcagtagtaa

SEQ ID NO: 596599 - DNA, 25 bp, Rattus norvegicus
tctgcctcccaagcggcagggttga

SEQ ID NO: 596600 - DNA, 25 bp, Rattus norvegicus
tctgcctcccaagtttcagtagtaa

SEQ ID NO: 596601 - DNA, 25 bp, Rattus norvegicus
tctgcctcccaatccttgaagatga

SEQ ID NO: 596602 - DNA, 25 bp, Rattus norvegicus
tctgcctcctagaaatggtagccat

SEQ ID NO: 596603 - DNA, 25 bp, Rattus norvegicus
tctgcctcctagtaatggtagccat

SEQ ID NO: 596604 - DNA, 25 bp, Rattus norvegicus
tctgcctcgctgcactgatatttgc

SEQ ID NO: 596605 - DNA, 25 bp, Rattus norvegicus
tctgcctcgctggactgatatttgc

SEQ ID NO: 596606 - DNA, 25 bp, Rattus norvegicus
tctgcctcggagagtctggaatagt

SEQ ID NO: 596607 - DNA, 25 bp, Rattus norvegicus
tctgcctcggagtgtctggaatagt

SEQ ID NO: 596608 - DNA, 25 bp, Rattus norvegicus
tctgcctcgtacaaaactcattgtg

SEQ ID NO: 596609 - DNA, 25 bp, Rattus norvegicus
tctgcctcgtactaaactcattgtg

SEQ ID NO: 596610 - DNA, 25 bp, Rattus norvegicus
tctgcctctcttctatttgccttgg

SEQ ID NO: 596611 - DNA, 25 bp, Rattus norvegicus
tctgcctctcttgtatttgccttgg

SEQ ID NO: 596612 - DNA, 25 bp, Rattus norvegicus
tctgcctctgacactgaagactcag

SEQ ID NO: 596613 - DNA, 25 bp, Rattus norvegicus
tctgcctctgactctgaagactcag

SEQ ID NO: 596614 - DNA, 25 bp, Rattus norvegicus
tctgcctctggcaatgtgaagtcat

SEQ ID NO: 596615 - DNA, 25 bp, Rattus norvegicus
tctgcctctggctatgtgaagtcat

SEQ ID NO: 596616 - DNA, 25 bp, Rattus norvegicus
tctgcctcttggctagtagatgtct

SEQ ID NO: 596617 - DNA, 25 bp, Rattus norvegicus
tctgcctcttgggtagtagatgtct

SEQ ID NO: 596618 - DNA, 25 bp, Rattus norvegicus
tctgcctctttgacaagtactgctg

SEQ ID NO: 596619 - DNA, 25 bp, Rattus norvegicus
tctgcctctttgtcaagtactgctg

SEQ ID NO: 596620 - DNA, 25 bp, Rattus norvegicus
tctgcctcttttcttgccgtaagac

SEQ ID NO: 596621 - DNA, 25 bp, Rattus norvegicus
tctgcctcttttgttgccgtaagac

SEQ ID NO: 596622 - DNA, 25 bp, Rattus norvegicus
tctgcctgaaacctgtctgtgctaa

SEQ ID NO: 596623 - DNA, 25 bp, Rattus norvegicus
tctgcctgaaacgtgtctgtgctaa

SEQ ID NO: 596624 - DNA, 25 bp, Rattus norvegicus
tctgcctgacacctatacatctatg

SEQ ID NO: 596625 - DNA, 25 bp, Rattus norvegicus
tctgcctgacacgtatacatctatg

SEQ ID NO: 596626 - DNA, 25 bp, Rattus norvegicus
tctgcctgactacacttaggactca

SEQ ID NO: 596627 - DNA, 25 bp, Rattus norvegicus
tctgcctgactagacttaggactca

SEQ ID NO: 596628 - DNA, 25 bp, Rattus norvegicus
tctgcctgactccatccaagatgta

SEQ ID NO: 596629 - DNA, 25 bp, Rattus norvegicus
tctgcctgactcgatccaagatgta

SEQ ID NO: 596630 - DNA, 25 bp, Rattus norvegicus
tctgcctgagagctccaatcatact

SEQ ID NO: 596631 - DNA, 25 bp, Rattus norvegicus
tctgcctgagaggtccaatcatact

SEQ ID NO: 596632 - DNA, 25 bp, Rattus norvegicus
tctgcctgaggtatcacggctgtcc

SEQ ID NO: 596633 - DNA, 25 bp, Rattus norvegicus
tctgcctgaggtttcacggctgtcc

SEQ ID NO: 596634 - DNA, 25 bp, Rattus norvegicus
tctgcctgatgaagcctgggcgaca

SEQ ID NO: 596635 - DNA, 25 bp, Rattus norvegicus
tctgcctgatgatgcctgggcgaca

SEQ ID NO: 596636 - DNA, 25 bp, Rattus norvegicus
tctgcctgcggactacgggattaaa

SEQ ID NO: 596637 - DNA, 25 bp, Rattus norvegicus
tctgcctgcggagtacgggattaaa

SEQ ID NO: 596638 - DNA, 25 bp, Rattus norvegicus
tctgcctgcgtcatcaaacatggac

SEQ ID NO: 596639 - DNA, 25 bp, Rattus norvegicus
tctgcctgcgtcttcaaacatggac

SEQ ID NO: 596640 - DNA, 25 bp, Rattus norvegicus
tctgcctgctgacacgctggtcaaa

SEQ ID NO: 596641 - DNA, 25 bp, Rattus norvegicus
tctgcctgctgacggcgtaataatt

SEQ ID NO: 596642 - DNA, 25 bp, Rattus norvegicus
tctgcctgctgagacgctggtcaaa

SEQ ID NO: 596643 - DNA, 25 bp, Rattus norvegicus
tctgcctgctgagggcgtaataatt

SEQ ID NO: 596644 - DNA, 25 bp, Rattus norvegicus
tctgcctggaaccacctgggctcag

SEQ ID NO: 596645 - DNA, 25 bp, Rattus norvegicus
tctgcctggaacgacctgggctcag

SEQ ID NO: 596646 - DNA, 25 bp, Rattus norvegicus
tctgcctggactctaaagctgacaa

SEQ ID NO: 596647 - DNA, 25 bp, Rattus norvegicus
tctgcctggactgtaaagctgacaa

SEQ ID NO: 596648 - DNA, 25 bp, Rattus norvegicus
tctgcctggagcacatataccaact

SEQ ID NO: 596649 - DNA, 25 bp, Rattus norvegicus
tctgcctggagctcatataccaact

SEQ ID NO: 596650 - DNA, 25 bp, Rattus norvegicus
tctgcctggcacatgtactttcttt

SEQ ID NO: 596651 - DNA, 25 bp, Rattus norvegicus
tctgcctggcacttgtactttcttt

SEQ ID NO: 596652 - DNA, 25 bp, Rattus norvegicus
tctgcctggctaatacccatcaaat

SEQ ID NO: 596653 - DNA, 25 bp, Rattus norvegicus
tctgcctggctattacccatcaaat

SEQ ID NO: 596654 - DNA, 25 bp, Rattus norvegicus
tctgcctggctcaaatcggatgttc

SEQ ID NO: 596655 - DNA, 25 bp, Rattus norvegicus
tctgcctggctctaatcggatgttc

SEQ ID NO: 596656 - DNA, 25 bp, Rattus norvegicus
tctgcctggtggattgctgacatgg

SEQ ID NO: 596657 - DNA, 25 bp, Rattus norvegicus
tctgcctggtggtttgctgacatgg

SEQ ID NO: 596658 - DNA, 25 bp, Rattus norvegicus
tctgcctggttgaacttctgggatc

SEQ ID NO: 596659 - DNA, 25 bp, Rattus norvegicus
tctgcctggttgtacttctgggatc

SEQ ID NO: 596660 - DNA, 25 bp, Rattus norvegicus
tctgcctgtactcgaactcatgctg

SEQ ID NO: 596661 - DNA, 25 bp, Rattus norvegicus
tctgcctgtactggaactcatgctg

SEQ ID NO: 596662 - DNA, 25 bp, Rattus norvegicus
tctgcctgtcgcatgagaacattaa

SEQ ID NO: 596663 - DNA, 25 bp, Rattus norvegicus
tctgcctgtcgcttgagaacattaa

SEQ ID NO: 596664 - DNA, 25 bp, Rattus norvegicus
tctgcctgtctacttttctgcaaaa

SEQ ID NO: 596665 - DNA, 25 bp, Rattus norvegicus
tctgcctgtctagttttctgcaaaa

SEQ ID NO: 596666 - DNA, 25 bp, Rattus norvegicus
tctgcctgtgcacacgtgtttcaaa

SEQ ID NO: 596667 - DNA, 25 bp, Rattus norvegicus
tctgcctgtgcagacgtgtttcaaa

SEQ ID NO: 596668 - DNA, 25 bp, Rattus norvegicus
tctgcctgtggaacctctcaggaaa

SEQ ID NO: 596669 - DNA, 25 bp, Rattus norvegicus
tctgcctgtggatcctctcaggaaa

SEQ ID NO: 596670 - DNA, 25 bp, Rattus norvegicus
tctgcctgtgttactttgagtatcc

SEQ ID NO: 596671 - DNA, 25 bp, Rattus norvegicus
tctgcctgtgtttctttgagtatcc

SEQ ID NO: 596672 - DNA, 25 bp, Rattus norvegicus
tctgcctgtttgcacaataggtttt

SEQ ID NO: 596673 - DNA, 25 bp, Rattus norvegicus
tctgcctgtttggacaataggtttt

SEQ ID NO: 596674 - DNA, 25 bp, Rattus norvegicus
tctgccttattcaattatgcatagg

SEQ ID NO: 596675 - DNA, 25 bp, Rattus norvegicus
tctgccttattctattatgcatagg

SEQ ID NO: 596676 - DNA, 25 bp, Rattus norvegicus
tctgccttcactccggtgacctgga

SEQ ID NO: 596677 - DNA, 25 bp, Rattus norvegicus
tctgccttcactgcggtgacctgga

SEQ ID NO: 596678 - DNA, 25 bp, Rattus norvegicus
tctgccttcatcatatcccaggata

SEQ ID NO: 596679 - DNA, 25 bp, Rattus norvegicus
tctgccttcatcttatcccaggata

SEQ ID NO: 596680 - DNA, 25 bp, Rattus norvegicus
tctgccttccccatctgaggaagaa

SEQ ID NO: 596681 - DNA, 25 bp, Rattus norvegicus
tctgccttccccttctgaggaagaa

SEQ ID NO: 596682 - DNA, 25 bp, Rattus norvegicus
tctgccttcctactggccatgtgac

SEQ ID NO: 596683 - DNA, 25 bp, Rattus norvegicus
tctgccttcctagtggccatgtgac

SEQ ID NO: 596684 - DNA, 25 bp, Rattus norvegicus
tctgccttccttaaacatcttctag

SEQ ID NO: 596685 - DNA, 25 bp, Rattus norvegicus
tctgccttcctttaacatcttctag

SEQ ID NO: 596686 - DNA, 25 bp, Rattus norvegicus
tctgccttcttgactgagaacaaat

SEQ ID NO: 596687 - DNA, 25 bp, Rattus norvegicus
tctgccttcttgtctgagaacaaat

SEQ ID NO: 596688 - DNA, 25 bp, Rattus norvegicus
tctgccttctttctctgagggagaa

SEQ ID NO: 596689 - DNA, 25 bp, Rattus norvegicus
tctgccttctttgtctgagggagaa

SEQ ID NO: 596690 - DNA, 25 bp, Rattus norvegicus
tctgcctttcagcttacttggtgaa

SEQ ID NO: 596691 - DNA, 25 bp, Rattus norvegicus
tctgcctttcaggttacttggtgaa

SEQ ID NO: 596692 - DNA, 25 bp, Rattus norvegicus
tctgcctttccactgctaagggtaa

SEQ ID NO: 596693 - DNA, 25 bp, Rattus norvegicus
tctgcctttccagtgctaagggtaa

SEQ ID NO: 596694 - DNA, 25 bp, Rattus norvegicus
tctgcctttctgcattgtccgcctt

SEQ ID NO: 596695 - DNA, 25 bp, Rattus norvegicus
tctgcctttctggattgtccgcctt

SEQ ID NO: 596696 - DNA, 25 bp, Rattus norvegicus
tctgcctttgacagtccgacatgta

SEQ ID NO: 596697 - DNA, 25 bp, Rattus norvegicus
tctgcctttgactgtccgacatgta

SEQ ID NO: 596698 - DNA, 25 bp, Rattus norvegicus
tctgcctttgctctctgtgtgaaca

SEQ ID NO: 596699 - DNA, 25 bp, Rattus norvegicus
tctgcctttgctgtctgtgtgaaca

SEQ ID NO: 596700 - DNA, 25 bp, Rattus norvegicus
tctgcctttggcactagactttaaa

SEQ ID NO: 596701 - DNA, 25 bp, Rattus norvegicus
tctgcctttggctctagactttaaa

SEQ ID NO: 596702 - DNA, 25 bp, Rattus norvegicus
tctgcctttttcagtctgtctcctt

SEQ ID NO: 596703 - DNA, 25 bp, Rattus norvegicus
tctgcctttttctgtctgtctcctt

SEQ ID NO: 596704 - DNA, 25 bp, Rattus norvegicus
tctgcgaaagccagcctgctgggta

SEQ ID NO: 596705 - DNA, 25 bp, Rattus norvegicus
tctgcgaaagcctgcctgctgggta

SEQ ID NO: 596706 - DNA, 25 bp, Rattus norvegicus
tctgcgaccacaccataaaggcgtt

SEQ ID NO: 596707 - DNA, 25 bp, Rattus norvegicus
tctgcgaccacagcataaaggcgtt

SEQ ID NO: 596708 - DNA, 25 bp, Rattus norvegicus
tctgcgagccgcatatttgggcgcc

SEQ ID NO: 596709 - DNA, 25 bp, Rattus norvegicus
tctgcgagccgcttatttgggcgcc

SEQ ID NO: 596710 - DNA, 25 bp, Rattus norvegicus
tctgcgagtcagacccggaaagcac

SEQ ID NO: 596711 - DNA, 25 bp, Rattus norvegicus
tctgcgagtcagtcccggaaagcac

SEQ ID NO: 596712 - DNA, 25 bp, Rattus norvegicus
tctgcgcagcccacggccaagtgga

SEQ ID NO: 596713 - DNA, 25 bp, Rattus norvegicus
tctgcgcagccctcggccaagtgga

SEQ ID NO: 596714 - DNA, 25 bp, Rattus norvegicus
tctgcgcagggcatggctggtcttc

SEQ ID NO: 596715 - DNA, 25 bp, Rattus norvegicus
tctgcgcagggcttggctggtcttc

SEQ ID NO: 596716 - DNA, 25 bp, Rattus norvegicus
tctgcgcatctcctgacttggaagg

SEQ ID NO: 596717 - DNA, 25 bp, Rattus norvegicus
tctgcgcatctcgtgacttggaagg

SEQ ID NO: 596718 - DNA, 25 bp, Rattus norvegicus
tctgcgcatgtcatcgttgcttaaa

SEQ ID NO: 596719 - DNA, 25 bp, Rattus norvegicus
tctgcgcatgtcttcgttgcttaaa

SEQ ID NO: 596720 - DNA, 25 bp, Rattus norvegicus
tctgcgcattccaggcggccagcaa

SEQ ID NO: 596721 - DNA, 25 bp, Rattus norvegicus
tctgcgcattcctggcggccagcaa

SEQ ID NO: 596722 - DNA, 25 bp, Rattus norvegicus
tctgcgccccaaagaggtagaagaa

SEQ ID NO: 596723 - DNA, 25 bp, Rattus norvegicus
tctgcgccccaatgaggtagaagaa

SEQ ID NO: 596724 - DNA, 25 bp, Rattus norvegicus
tctgcgcccgtgactacaagaggat

SEQ ID NO: 596725 - DNA, 25 bp, Rattus norvegicus
tctgcgcccgtgtctacaagaggat

SEQ ID NO: 596726 - DNA, 25 bp, Rattus norvegicus
tctgcggaggccatcggcatcatga

SEQ ID NO: 596727 - DNA, 25 bp, Rattus norvegicus
tctgcggaggccttcggcatcatga

SEQ ID NO: 596728 - DNA, 25 bp, Rattus norvegicus
tctgcggcaagtccttcactcagaa

SEQ ID NO: 596729 - DNA, 25 bp, Rattus norvegicus
tctgcggcaagtgcttcactcagaa

SEQ ID NO: 596730 - DNA, 25 bp, Rattus norvegicus
tctgcggcagtgaggaaactcgact

SEQ ID NO: 596731 - DNA, 25 bp, Rattus norvegicus
tctgcggcagtgtggaaactcgact

SEQ ID NO: 596732 - DNA, 25 bp, Rattus norvegicus
tctgcggctgtgagtgctctactaa

SEQ ID NO: 596733 - DNA, 25 bp, Rattus norvegicus
tctgcggctgtgtgtgctctactaa

SEQ ID NO: 596734 - DNA, 25 bp, Rattus norvegicus
tctgcggctttcctgttacaacagc

SEQ ID NO: 596735 - DNA, 25 bp, Rattus norvegicus
tctgcggctttcgtgttacaacagc

SEQ ID NO: 596736 - DNA, 25 bp, Rattus norvegicus
tctgcgggtctcatgccgggaaaat

SEQ ID NO: 596737 - DNA, 25 bp, Rattus norvegicus
tctgcgggtctcttgccgggaaaat

SEQ ID NO: 596738 - DNA, 25 bp, Rattus norvegicus
tctgcgtcagccaaggccagttgaa

SEQ ID NO: 596739 - DNA, 25 bp, Rattus norvegicus
tctgcgtcagcctaggccagttgaa

SEQ ID NO: 596740 - DNA, 25 bp, Rattus norvegicus
tctgcgtgaccaacgaggagtgctg

SEQ ID NO: 596741 - DNA, 25 bp, Rattus norvegicus
tctgcgtgaccatcgaggagtgctg

SEQ ID NO: 596742 - DNA, 25 bp, Rattus norvegicus
tctgcgtgagcaatgaggttattct

SEQ ID NO: 596743 - DNA, 25 bp, Rattus norvegicus
tctgcgtgagcattgaggttattct

SEQ ID NO: 596744 - DNA, 25 bp, Rattus norvegicus
tctgcgtgccataggactcatcact

SEQ ID NO: 596745 - DNA, 25 bp, Rattus norvegicus
tctgcgtgccattggactcatcact

SEQ ID NO: 596746 - DNA, 25 bp, Rattus norvegicus
tctgcgtgccctcattgatcggcga

SEQ ID NO: 596747 - DNA, 25 bp, Rattus norvegicus
tctgcgtgccctgattgatcggcga

SEQ ID NO: 596748 - DNA, 25 bp, Rattus norvegicus
tctgcgtgcttgcatccaactgtga

SEQ ID NO: 596749 - DNA, 25 bp, Rattus norvegicus
tctgcgtgcttggatccaactgtga

SEQ ID NO: 596750 - DNA, 25 bp, Rattus norvegicus
tctgcgtggctaccagtgtaggtac

SEQ ID NO: 596751 - DNA, 25 bp, Rattus norvegicus
tctgcgtggctagcagtgtaggtac

SEQ ID NO: 596752 - DNA, 25 bp, Rattus norvegicus
tctgcgtgtagtatgctttctcata

SEQ ID NO: 596753 - DNA, 25 bp, Rattus norvegicus
tctgcgtgtagtttgctttctcata

SEQ ID NO: 596754 - DNA, 25 bp, Rattus norvegicus
tctgcgtttggtatcagctcagcca

SEQ ID NO: 596755 - DNA, 25 bp, Rattus norvegicus
tctgcgtttggtttcagctcagcca

SEQ ID NO: 596756 - DNA, 25 bp, Rattus norvegicus
tctgcgttttgtccattttccaaca

SEQ ID NO: 596757 - DNA, 25 bp, Rattus norvegicus
tctgcgttttgtgcattttccaaca

SEQ ID NO: 596758 - DNA, 25 bp, Rattus norvegicus
tctgctaaagccctgtggaccaaac

SEQ ID NO: 596759 - DNA, 25 bp, Rattus norvegicus
tctgctaaagccgtgtggaccaaac

SEQ ID NO: 596760 - DNA, 25 bp, Rattus norvegicus
tctgctaaccccagggtggactctg

SEQ ID NO: 596761 - DNA, 25 bp, Rattus norvegicus
tctgctaacccctgggtggactctg

SEQ ID NO: 596762 - DNA, 25 bp, Rattus norvegicus
tctgctaactccacacaagaactga

SEQ ID NO: 596763 - DNA, 25 bp, Rattus norvegicus
tctgctaactcctcacaagaactga

SEQ ID NO: 596764 - DNA, 25 bp, Rattus norvegicus
tctgctacctttcttttgtcgtaag

SEQ ID NO: 596765 - DNA, 25 bp, Rattus norvegicus
tctgctacctttgttttgtcgtaag

SEQ ID NO: 596766 - DNA, 25 bp, Rattus norvegicus
tctgctactttgcaaacctggcggg

SEQ ID NO: 596767 - DNA, 25 bp, Rattus norvegicus
tctgctactttggaaacctggcggg

SEQ ID NO: 596768 - DNA, 25 bp, Rattus norvegicus
tctgctagggaacacctgctccaaa

SEQ ID NO: 596769 - DNA, 25 bp, Rattus norvegicus
tctgctagggaagacctgctccaaa

SEQ ID NO: 596770 - DNA, 25 bp, Rattus norvegicus
tctgctatccttagcctttggattt

SEQ ID NO: 596771 - DNA, 25 bp, Rattus norvegicus
tctgctatcctttgcctttggattt

SEQ ID NO: 596772 - DNA, 25 bp, Rattus norvegicus
tctgctatgccgactcatgaagtaa

SEQ ID NO: 596773 - DNA, 25 bp, Rattus norvegicus
tctgctatgccgtctcatgaagtaa

SEQ ID NO: 596774 - DNA, 25 bp, Rattus norvegicus
tctgctatgtcaacacacacggtga

SEQ ID NO: 596775 - DNA, 25 bp, Rattus norvegicus
tctgctatgtcaactgggactggca

SEQ ID NO: 596776 - DNA, 25 bp, Rattus norvegicus
tctgctatgtcatcacacacggtga

SEQ ID NO: 596777 - DNA, 25 bp, Rattus norvegicus
tctgctatgtcatctgggactggca

SEQ ID NO: 596778 - DNA, 25 bp, Rattus norvegicus
tctgctatgtgcagatgacaccaca

SEQ ID NO: 596779 - DNA, 25 bp, Rattus norvegicus
tctgctatgtgctgatgacaccaca

SEQ ID NO: 596780 - DNA, 25 bp, Rattus norvegicus
tctgctatgtttcagtgtcatttaa

SEQ ID NO: 596781 - DNA, 25 bp, Rattus norvegicus
tctgctatgtttgagtgtcatttaa

SEQ ID NO: 596782 - DNA, 25 bp, Rattus norvegicus
tctgctcaaacactcatgcctggtg

SEQ ID NO: 596783 - DNA, 25 bp, Rattus norvegicus
tctgctcaaacagtcatgcctggtg

SEQ ID NO: 596784 - DNA, 25 bp, Rattus norvegicus
tctgctcaacacactgctatggcca

SEQ ID NO: 596785 - DNA, 25 bp, Rattus norvegicus
tctgctcaacactctgctatggcca

SEQ ID NO: 596786 - DNA, 25 bp, Rattus norvegicus
tctgctcacggccaggtgctttgaa

SEQ ID NO: 596787 - DNA, 25 bp, Rattus norvegicus
tctgctcacggcgaggtgctttgaa

SEQ ID NO: 596788 - DNA, 25 bp, Rattus norvegicus
tctgctcactgcaaaacagtccatg

SEQ ID NO: 596789 - DNA, 25 bp, Rattus norvegicus
tctgctcactgctaaacagtccatg

SEQ ID NO: 596790 - DNA, 25 bp, Rattus norvegicus
tctgctcagacacgcctttcatgaa

SEQ ID NO: 596791 - DNA, 25 bp, Rattus norvegicus
tctgctcagacaggcctttcatgaa

SEQ ID NO: 596792 - DNA, 25 bp, Rattus norvegicus
tctgctcagagtcggcgctatccaa

SEQ ID NO: 596793 - DNA, 25 bp, Rattus norvegicus
tctgctcagagtgggcgctatccaa

SEQ ID NO: 596794 - DNA, 25 bp, Rattus norvegicus
tctgctcagcagatctagaaatcgc

SEQ ID NO: 596795 - DNA, 25 bp, Rattus norvegicus
tctgctcagcagttctagaaatcgc

SEQ ID NO: 596796 - DNA, 25 bp, Rattus norvegicus
tctgctcaggaacatgaactgtaat

SEQ ID NO: 596797 - DNA, 25 bp, Rattus norvegicus
tctgctcaggaagatgaactgtaat

SEQ ID NO: 596798 - DNA, 25 bp, Rattus norvegicus
tctgctcagtagacatttgtgtggt

SEQ ID NO: 596799 - DNA, 25 bp, Rattus norvegicus
tctgctcagtagtcatttgtgtggt

SEQ ID NO: 596800 - DNA, 25 bp, Rattus norvegicus
tctgctcataataccatctccgtga

SEQ ID NO: 596801 - DNA, 25 bp, Rattus norvegicus
tctgctcataattccatctccgtga

SEQ ID NO: 596802 - DNA, 25 bp, Rattus norvegicus
tctgctcatagtctccaccttttag

SEQ ID NO: 596803 - DNA, 25 bp, Rattus norvegicus
tctgctcatagtgtccaccttttag

SEQ ID NO: 596804 - DNA, 25 bp, Rattus norvegicus
tctgctcatgacagactgcctagag

SEQ ID NO: 596805 - DNA, 25 bp, Rattus norvegicus
tctgctcatgactgactgcctagag

SEQ ID NO: 596806 - DNA, 25 bp, Rattus norvegicus
tctgctcatggaacatgcccaggag

SEQ ID NO: 596807 - DNA, 25 bp, Rattus norvegicus
tctgctcatggatcatgcccaggag

SEQ ID NO: 596808 - DNA, 25 bp, Rattus norvegicus
tctgctcattttcctatggttctga

SEQ ID NO: 596809 - DNA, 25 bp, Rattus norvegicus
tctgctcattttgctatggttctga

SEQ ID NO: 596810 - DNA, 25 bp, Rattus norvegicus
tctgctccaaagctgatccaggctg

SEQ ID NO: 596811 - DNA, 25 bp, Rattus norvegicus
tctgctccaaaggtgatccaggctg

SEQ ID NO: 596812 - DNA, 25 bp, Rattus norvegicus
tctgctccactcagtaagggatcag

SEQ ID NO: 596813 - DNA, 25 bp, Rattus norvegicus
tctgctccactctgtaagggatcag

SEQ ID NO: 596814 - DNA, 25 bp, Rattus norvegicus
tctgctccagttcgtcaagctttaa

SEQ ID NO: 596815 - DNA, 25 bp, Rattus norvegicus
tctgctccagttggtcaagctttaa

SEQ ID NO: 596816 - DNA, 25 bp, Rattus norvegicus
tctgctcccagcagtttgaaggaca

SEQ ID NO: 596817 - DNA, 25 bp, Rattus norvegicus
tctgctcccagctgtttgaaggaca

SEQ ID NO: 596818 - DNA, 25 bp, Rattus norvegicus
tctgctcccatgcttggagcatgga

SEQ ID NO: 596819 - DNA, 25 bp, Rattus norvegicus
tctgctcccatggttggagcatgga

SEQ ID NO: 596820 - DNA, 25 bp, Rattus norvegicus
tctgctccccgacgcctgtagtggt

SEQ ID NO: 596821 - DNA, 25 bp, Rattus norvegicus
tctgctccccgaggcctgtagtggt

SEQ ID NO: 596822 - DNA, 25 bp, Rattus norvegicus
tctgctccctatcaagtttgaacta

SEQ ID NO: 596823 - DNA, 25 bp, Rattus norvegicus
tctgctccctatgaagtttgaacta

SEQ ID NO: 596824 - DNA, 25 bp, Rattus norvegicus
tctgctccctggacacgtatagtga

SEQ ID NO: 596825 - DNA, 25 bp, Rattus norvegicus
tctgctccctggtcacgtatagtga

SEQ ID NO: 596826 - DNA, 25 bp, Rattus norvegicus
tctgctccctgtaatgtagctacta

SEQ ID NO: 596827 - DNA, 25 bp, Rattus norvegicus
tctgctccctgttatgtagctacta

SEQ ID NO: 596828 - DNA, 25 bp, Rattus norvegicus
tctgctccgagtccgtctgtgtagg

SEQ ID NO: 596829 - DNA, 25 bp, Rattus norvegicus
tctgctccgagtgcgtctgtgtagg

SEQ ID NO: 596830 - DNA, 25 bp, Rattus norvegicus
tctgctccgcatctgccaaaagaga

SEQ ID NO: 596831 - DNA, 25 bp, Rattus norvegicus
tctgctccgcatgtgccaaaagaga

SEQ ID NO: 596832 - DNA, 25 bp, Rattus norvegicus
tctgctcctcctactagtgacagga

SEQ ID NO: 596833 - DNA, 25 bp, Rattus norvegicus
tctgctcctccttctagtgacagga

SEQ ID NO: 596834 - DNA, 25 bp, Rattus norvegicus
tctgctcctcttaggtgacttttag

SEQ ID NO: 596835 - DNA, 25 bp, Rattus norvegicus
tctgctcctctttggtgacttttag

SEQ ID NO: 596836 - DNA, 25 bp, Rattus norvegicus
tctgctcctgcacagtgagtaactc

SEQ ID NO: 596837 - DNA, 25 bp, Rattus norvegicus
tctgctcctgcagagtgagtaactc

SEQ ID NO: 596838 - DNA, 25 bp, Rattus norvegicus
tctgctcctggaagagatggacgag

SEQ ID NO: 596839 - DNA, 25 bp, Rattus norvegicus
tctgctcctggatgagatggacgag

SEQ ID NO: 596840 - DNA, 25 bp, Rattus norvegicus
tctgctcctgtgctatctttaagta

SEQ ID NO: 596841 - DNA, 25 bp, Rattus norvegicus
tctgctcctgtggtatctttaagta

SEQ ID NO: 596842 - DNA, 25 bp, Rattus norvegicus
tctgctccttcacattcatgcagct

SEQ ID NO: 596843 - DNA, 25 bp, Rattus norvegicus
tctgctccttcagattcatgcagct

SEQ ID NO: 596844 - DNA, 25 bp, Rattus norvegicus
tctgctccttctctaatattgaggg

SEQ ID NO: 596845 - DNA, 25 bp, Rattus norvegicus
tctgctccttctgtaatattgaggg

SEQ ID NO: 596846 - DNA, 25 bp, Rattus norvegicus
tctgctccttggcacagggttatag

SEQ ID NO: 596847 - DNA, 25 bp, Rattus norvegicus
tctgctccttgggacagggttatag

SEQ ID NO: 596848 - DNA, 25 bp, Rattus norvegicus
tctgctcgcttaactgctggatgca

SEQ ID NO: 596849 - DNA, 25 bp, Rattus norvegicus
tctgctcgcttatctgctggatgca

SEQ ID NO: 596850 - DNA, 25 bp, Rattus norvegicus
tctgctcgtgtcctaaaggagacct

SEQ ID NO: 596851 - DNA, 25 bp, Rattus norvegicus
tctgctcgtgtcgtaaaggagacct

SEQ ID NO: 596852 - DNA, 25 bp, Rattus norvegicus
tctgctcgtgttaaaccccttaaag

SEQ ID NO: 596853 - DNA, 25 bp, Rattus norvegicus
tctgctcgtgtttaaccccttaaag

SEQ ID NO: 596854 - DNA, 25 bp, Rattus norvegicus
tctgctctacctcgtagtacaccag

SEQ ID NO: 596855 - DNA, 25 bp, Rattus norvegicus
tctgctctacctggtagtacaccag

SEQ ID NO: 596856 - DNA, 25 bp, Rattus norvegicus
tctgctctcagtccggtgagtgtta

SEQ ID NO: 596857 - DNA, 25 bp, Rattus norvegicus
tctgctctcagtgcggtgagtgtta

SEQ ID NO: 596858 - DNA, 25 bp, Rattus norvegicus
tctgctctcataccctcgggaaagg

SEQ ID NO: 596859 - DNA, 25 bp, Rattus norvegicus
tctgctctcatagcctcgggaaagg

SEQ ID NO: 596860 - DNA, 25 bp, Rattus norvegicus
tctgctctcatgatcaaactctgtc

SEQ ID NO: 596861 - DNA, 25 bp, Rattus norvegicus
tctgctctcatgttcaaactctgtc

SEQ ID NO: 596862 - DNA, 25 bp, Rattus norvegicus
tctgctctcctgcaggctgagggaa

SEQ ID NO: 596863 - DNA, 25 bp, Rattus norvegicus
tctgctctcctggaggctgagggaa

SEQ ID NO: 596864 - DNA, 25 bp, Rattus norvegicus
tctgctctccttcggatctgtataa

SEQ ID NO: 596865 - DNA, 25 bp, Rattus norvegicus
tctgctctccttgggatctgtataa

SEQ ID NO: 596866 - DNA, 25 bp, Rattus norvegicus
tctgctctctagactggcttccaag

SEQ ID NO: 596867 - DNA, 25 bp, Rattus norvegicus
tctgctctctagtctggcttccaag

SEQ ID NO: 596868 - DNA, 25 bp, Rattus norvegicus
tctgctctgaaccatgccatgacag

SEQ ID NO: 596869 - DNA, 25 bp, Rattus norvegicus
tctgctctgaacgatgccatgacag

SEQ ID NO: 596870 - DNA, 25 bp, Rattus norvegicus
tctgctctgagtcccagtcctgtca

SEQ ID NO: 596871 - DNA, 25 bp, Rattus norvegicus
tctgctctgagtgccagtcctgtca

SEQ ID NO: 596872 - DNA, 25 bp, Rattus norvegicus
tctgctctgcccatgttaaaatctg

SEQ ID NO: 596873 - DNA, 25 bp, Rattus norvegicus
tctgctctgcccttgttaaaatctg

SEQ ID NO: 596874 - DNA, 25 bp, Rattus norvegicus
tctgctctgcctcaaaaacactggt

SEQ ID NO: 596875 - DNA, 25 bp, Rattus norvegicus
tctgctctgcctgaaaaacactggt

SEQ ID NO: 596876 - DNA, 25 bp, Rattus norvegicus
tctgctctgcgcaaacatcattgtg

SEQ ID NO: 596877 - DNA, 25 bp, Rattus norvegicus
tctgctctgcgctaacatcattgtg

SEQ ID NO: 596878 - DNA, 25 bp, Rattus norvegicus
tctgctctgcttccaagcccagtgg

SEQ ID NO: 596879 - DNA, 25 bp, Rattus norvegicus
tctgctctgcttgcaagcccagtgg

SEQ ID NO: 596880 - DNA, 25 bp, Rattus norvegicus
tctgctctgggcagatctagccaga

SEQ ID NO: 596881 - DNA, 25 bp, Rattus norvegicus
tctgctctgggctgatctagccaga

SEQ ID NO: 596882 - DNA, 25 bp, Rattus norvegicus
tctgctctgtaacccatctgtagta

SEQ ID NO: 596883 - DNA, 25 bp, Rattus norvegicus
tctgctctgtaagccatctgtagta

SEQ ID NO: 596884 - DNA, 25 bp, Rattus norvegicus
tctgctctgtgaataccatgttaat

SEQ ID NO: 596885 - DNA, 25 bp, Rattus norvegicus
tctgctctgtgattaccatgttaat

SEQ ID NO: 596886 - DNA, 25 bp, Rattus norvegicus
tctgctcttatgaggcaagcctctc

SEQ ID NO: 596887 - DNA, 25 bp, Rattus norvegicus
tctgctcttatgtggcaagcctctc

SEQ ID NO: 596888 - DNA, 25 bp, Rattus norvegicus
tctgctcttattatgaccatcttcg

SEQ ID NO: 596889 - DNA, 25 bp, Rattus norvegicus
tctgctcttattttgaccatcttcg

SEQ ID NO: 596890 - DNA, 25 bp, Rattus norvegicus
tctgctctttatactttggtctcat

SEQ ID NO: 596891 - DNA, 25 bp, Rattus norvegicus
tctgctctttattctttggtctcat

SEQ ID NO: 596892 - DNA, 25 bp, Rattus norvegicus
tctgctcttttgatgccggcttgga

SEQ ID NO: 596893 - DNA, 25 bp, Rattus norvegicus
tctgctcttttgttgccggcttgga

SEQ ID NO: 596894 - DNA, 25 bp, Rattus norvegicus
tctgctgaactacctgggtcacttg

SEQ ID NO: 596895 - DNA, 25 bp, Rattus norvegicus
tctgctgaactagctgggtcacttg

SEQ ID NO: 596896 - DNA, 25 bp, Rattus norvegicus
tctgctgaaggccaggattctgctg

SEQ ID NO: 596897 - DNA, 25 bp, Rattus norvegicus
tctgctgaaggcgaggattctgctg

SEQ ID NO: 596898 - DNA, 25 bp, Rattus norvegicus
tctgctgaagtcatgatcctctggc

SEQ ID NO: 596899 - DNA, 25 bp, Rattus norvegicus
tctgctgaagtcttgatcctctggc

SEQ ID NO: 596900 - DNA, 25 bp, Rattus norvegicus
tctgctgacctacggaagtcgtttg

SEQ ID NO: 596901 - DNA, 25 bp, Rattus norvegicus
tctgctgacctagggaagtcgtttg

SEQ ID NO: 596902 - DNA, 25 bp, Rattus norvegicus
tctgctgactgtacttggtcattat

SEQ ID NO: 596903 - DNA, 25 bp, Rattus norvegicus
tctgctgactgttcttggtcattat

SEQ ID NO: 596904 - DNA, 25 bp, Rattus norvegicus
tctgctgagattacccagtgtcaaa

SEQ ID NO: 596905 - DNA, 25 bp, Rattus norvegicus
tctgctgagatttcccagtgtcaaa

SEQ ID NO: 596906 - DNA, 25 bp, Rattus norvegicus
tctgctgagcgtatcggcgtgtgtc

SEQ ID NO: 596907 - DNA, 25 bp, Rattus norvegicus
tctgctgagcgtttcggcgtgtgtc

SEQ ID NO: 596908 - DNA, 25 bp, Rattus norvegicus
tctgctgatggccaccagccaccag

SEQ ID NO: 596909 - DNA, 25 bp, Rattus norvegicus
tctgctgatggcgaccagccaccag

SEQ ID NO: 596910 - DNA, 25 bp, Rattus norvegicus
tctgctgcagccagggcagtttcta

SEQ ID NO: 596911 - DNA, 25 bp, Rattus norvegicus
tctgctgcagcctgggcagtttcta

SEQ ID NO: 596912 - DNA, 25 bp, Rattus norvegicus
tctgctgcagctctgtataaaatat

SEQ ID NO: 596913 - DNA, 25 bp, Rattus norvegicus
tctgctgcagctgtgtataaaatat

SEQ ID NO: 596914 - DNA, 25 bp, Rattus norvegicus
tctgctgcaggaccttgacacagtg

SEQ ID NO: 596915 - DNA, 25 bp, Rattus norvegicus
tctgctgcaggagcttgacacagtg

SEQ ID NO: 596916 - DNA, 25 bp, Rattus norvegicus
tctgctgcaggcagctgcataaggg

SEQ ID NO: 596917 - DNA, 25 bp, Rattus norvegicus
tctgctgcaggctgctgcataaggg

SEQ ID NO: 596918 - DNA, 25 bp, Rattus norvegicus
tctgctgccattacctttttaaggg

SEQ ID NO: 596919 - DNA, 25 bp, Rattus norvegicus
tctgctgccatttcctttttaaggg

SEQ ID NO: 596920 - DNA, 25 bp, Rattus norvegicus
tctgctgcccagaggcatgaagttt

SEQ ID NO: 596921 - DNA, 25 bp, Rattus norvegicus
tctgctgcccagtggcatgaagttt

SEQ ID NO: 596922 - DNA, 25 bp, Rattus norvegicus
tctgctgcccgtctggttatgaaga

SEQ ID NO: 596923 - DNA, 25 bp, Rattus norvegicus
tctgctgcccgtgtggttatgaaga

SEQ ID NO: 596924 - DNA, 25 bp, Rattus norvegicus
tctgctgcctcacagtttgagtcat

SEQ ID NO: 596925 - DNA, 25 bp, Rattus norvegicus
tctgctgcctcagagtttgagtcat

SEQ ID NO: 596926 - DNA, 25 bp, Rattus norvegicus
tctgctgcctcgagaagggtccgaa

SEQ ID NO: 596927 - DNA, 25 bp, Rattus norvegicus
tctgctgcctcgtgaagggtccgaa

SEQ ID NO: 596928 - DNA, 25 bp, Rattus norvegicus
tctgctgccttccaggagaacgtgg

SEQ ID NO: 596929 - DNA, 25 bp, Rattus norvegicus
tctgctgccttcgaggagaacgtgg

SEQ ID NO: 596930 - DNA, 25 bp, Rattus norvegicus
tctgctgcggctcgcgctcaacgtg

SEQ ID NO: 596931 - DNA, 25 bp, Rattus norvegicus
tctgctgcggctggcgctcaacgtg

SEQ ID NO: 596932 - DNA, 25 bp, Rattus norvegicus
tctgctgctgatactgattttccca

SEQ ID NO: 596933 - DNA, 25 bp, Rattus norvegicus
tctgctgctgattctgattttccca

SEQ ID NO: 596934 - DNA, 25 bp, Rattus norvegicus
tctgctgctgctcataacgtgctga

SEQ ID NO: 596935 - DNA, 25 bp, Rattus norvegicus
tctgctgctgctgataacgtgctga

SEQ ID NO: 596936 - DNA, 25 bp, Rattus norvegicus
tctgctgctgtcaagtacgatgctc

SEQ ID NO: 596937 - DNA, 25 bp, Rattus norvegicus
tctgctgctgtcatttctgtaatat

SEQ ID NO: 596938 - DNA, 25 bp, Rattus norvegicus
tctgctgctgtctagtacgatgctc

SEQ ID NO: 596939 - DNA, 25 bp, Rattus norvegicus
tctgctgctgtcttttctgtaatat

SEQ ID NO: 596940 - DNA, 25 bp, Rattus norvegicus
tctgctgcttgaagcgccgctccag

SEQ ID NO: 596941 - DNA, 25 bp, Rattus norvegicus
tctgctgcttgatgcgccgctccag

SEQ ID NO: 596942 - DNA, 25 bp, Rattus norvegicus
tctgctgctttcctacaattttttc

SEQ ID NO: 596943 - DNA, 25 bp, Rattus norvegicus
tctgctgctttcgtacaattttttc

SEQ ID NO: 596944 - DNA, 25 bp, Rattus norvegicus
tctgctggacagctcttaactgaaa

SEQ ID NO: 596945 - DNA, 25 bp, Rattus norvegicus
tctgctggacaggtcttaactgaaa

SEQ ID NO: 596946 - DNA, 25 bp, Rattus norvegicus
tctgctggccaacgacgaccagaac

SEQ ID NO: 596947 - DNA, 25 bp, Rattus norvegicus
tctgctggccaaggacgaccagaac

SEQ ID NO: 596948 - DNA, 25 bp, Rattus norvegicus
tctgctgggagtcatcttggtgcca

SEQ ID NO: 596949 - DNA, 25 bp, Rattus norvegicus
tctgctgggagtgatcttggtgcca

SEQ ID NO: 596950 - DNA, 25 bp, Rattus norvegicus
tctgctgggcctctcatttgtgata

SEQ ID NO: 596951 - DNA, 25 bp, Rattus norvegicus
tctgctgggcctgtcatttgtgata

SEQ ID NO: 596952 - DNA, 25 bp, Rattus norvegicus
tctgctggtcacaaagtgtggccgc

SEQ ID NO: 596953 - DNA, 25 bp, Rattus norvegicus
tctgctggtcactaagtgtggccgc

SEQ ID NO: 596954 - DNA, 25 bp, Rattus norvegicus
tctgctggtgatcctgtggttgaca

SEQ ID NO: 596955 - DNA, 25 bp, Rattus norvegicus
tctgctggtgatgctgtggttgaca

SEQ ID NO: 596956 - DNA, 25 bp, Rattus norvegicus
tctgctggtttactctgttgtttta

SEQ ID NO: 596957 - DNA, 25 bp, Rattus norvegicus
tctgctggtttagtctgttgtttta

SEQ ID NO: 596958 - DNA, 25 bp, Rattus norvegicus
tctgctggtttcactttactgtata

SEQ ID NO: 596959 - DNA, 25 bp, Rattus norvegicus
tctgctggtttctctttactgtata

SEQ ID NO: 596960 - DNA, 25 bp, Rattus norvegicus
tctgctggtttgaaacgtaacgctt

SEQ ID NO: 596961 - DNA, 25 bp, Rattus norvegicus
tctgctggtttgtaacgtaacgctt

SEQ ID NO: 596962 - DNA, 25 bp, Rattus norvegicus
tctgctgtaacaactctgctttaaa

SEQ ID NO: 596963 - DNA, 25 bp, Rattus norvegicus
tctgctgtaacatctctgctttaaa

SEQ ID NO: 596964 - DNA, 25 bp, Rattus norvegicus
tctgctgtaacgcaccacggctggg

SEQ ID NO: 596965 - DNA, 25 bp, Rattus norvegicus
tctgctgtaacggaccacggctggg

SEQ ID NO: 596966 - DNA, 25 bp, Rattus norvegicus
tctgctgtacccagttgaaatgcca

SEQ ID NO: 596967 - DNA, 25 bp, Rattus norvegicus
tctgctgtaccctgttgaaatgcca

SEQ ID NO: 596968 - DNA, 25 bp, Rattus norvegicus
tctgctgtagctatttggatctcct

SEQ ID NO: 596969 - DNA, 25 bp, Rattus norvegicus
tctgctgtagctcccatgtcactgg

SEQ ID NO: 596970 - DNA, 25 bp, Rattus norvegicus
tctgctgtagctgccatgtcactgg

SEQ ID NO: 596971 - DNA, 25 bp, Rattus norvegicus
tctgctgtagctttttggatctcct

SEQ ID NO: 596972 - DNA, 25 bp, Rattus norvegicus
tctgctgtagggatgcctgggtctc

SEQ ID NO: 596973 - DNA, 25 bp, Rattus norvegicus
tctgctgtagggttgcctgggtctc

SEQ ID NO: 596974 - DNA, 25 bp, Rattus norvegicus
tctgctgtaggtcctcagacttgct

SEQ ID NO: 596975 - DNA, 25 bp, Rattus norvegicus
tctgctgtaggtgctcagacttgct

SEQ ID NO: 596976 - DNA, 25 bp, Rattus norvegicus
tctgctgtatggactgctctgtgtg

SEQ ID NO: 596977 - DNA, 25 bp, Rattus norvegicus
tctgctgtatggtctgctctgtgtg

SEQ ID NO: 596978 - DNA, 25 bp, Rattus norvegicus
tctgctgtcctccaagttcagtaaa

SEQ ID NO: 596979 - DNA, 25 bp, Rattus norvegicus
tctgctgtcctcgaagttcagtaaa

SEQ ID NO: 596980 - DNA, 25 bp, Rattus norvegicus
tctgctgtcttgactcttgagagag

SEQ ID NO: 596981 - DNA, 25 bp, Rattus norvegicus
tctgctgtcttgtctcttgagagag

SEQ ID NO: 596982 - DNA, 25 bp, Rattus norvegicus
tctgctgtgcagctcattctgaagg

SEQ ID NO: 596983 - DNA, 25 bp, Rattus norvegicus
tctgctgtgcaggtcattctgaagg

SEQ ID NO: 596984 - DNA, 25 bp, Rattus norvegicus
tctgctgtgccaatctgagtgggaa

SEQ ID NO: 596985 - DNA, 25 bp, Rattus norvegicus
tctgctgtgccattctgagtgggaa

SEQ ID NO: 596986 - DNA, 25 bp, Rattus norvegicus
tctgctgtgcctcccagaagaccag

SEQ ID NO: 596987 - DNA, 25 bp, Rattus norvegicus
tctgctgtgcctgccagaagaccag

SEQ ID NO: 596988 - DNA, 25 bp, Rattus norvegicus
tctgctgtgcgtatgaattctgctt

SEQ ID NO: 596989 - DNA, 25 bp, Rattus norvegicus
tctgctgtgcgtttgaattctgctt

SEQ ID NO: 596990 - DNA, 25 bp, Rattus norvegicus
tctgctgtgcttctattgtgactta

SEQ ID NO: 596991 - DNA, 25 bp, Rattus norvegicus
tctgctgtgcttgtattgtgactta

SEQ ID NO: 596992 - DNA, 25 bp, Rattus norvegicus
tctgctgtggccagagcatcctaat

SEQ ID NO: 596993 - DNA, 25 bp, Rattus norvegicus
tctgctgtggcctgagcatcctaat

SEQ ID NO: 596994 - DNA, 25 bp, Rattus norvegicus
tctgctgtggtacggctttcacaaa

SEQ ID NO: 596995 - DNA, 25 bp, Rattus norvegicus
tctgctgtggtagggctttcacaaa

SEQ ID NO: 596996 - DNA, 25 bp, Rattus norvegicus
tctgctgtggtgaagatctttcttt

SEQ ID NO: 596997 - DNA, 25 bp, Rattus norvegicus
tctgctgtggtgtagatctttcttt

SEQ ID NO: 596998 - DNA, 25 bp, Rattus norvegicus
tctgctgtgttcctgcaacagttgc

SEQ ID NO: 596999 - DNA, 25 bp, Rattus norvegicus
tctgctgtgttcgtgcaacagttgc

SEQ ID NO: 597000 - DNA, 25 bp, Rattus norvegicus
tctgctgttcagactatgacctaga

SEQ ID NO: 597001 - DNA, 25 bp, Rattus norvegicus
tctgctgttcagtctatgacctaga

SEQ ID NO: 597002 - DNA, 25 bp, Rattus norvegicus
tctgctgttgggactagtgcttatc

SEQ ID NO: 597003 - DNA, 25 bp, Rattus norvegicus
tctgctgttgggtctagtgcttatc

SEQ ID NO: 597004 - DNA, 25 bp, Rattus norvegicus
tctgctgtttggaagctcaatcaac

SEQ ID NO: 597005 - DNA, 25 bp, Rattus norvegicus
tctgctgtttggtagctcaatcaac

SEQ ID NO: 597006 - DNA, 25 bp, Rattus norvegicus
tctgcttaagtcagattccctctaa

SEQ ID NO: 597007 - DNA, 25 bp, Rattus norvegicus
tctgcttaagtctgattccctctaa

SEQ ID NO: 597008 - DNA, 25 bp, Rattus norvegicus
tctgcttacacacactttactgttc

SEQ ID NO: 597009 - DNA, 25 bp, Rattus norvegicus
tctgcttacacagactttactgttc

SEQ ID NO: 597010 - DNA, 25 bp, Rattus norvegicus
tctgcttacgggagcttgtcggaga

SEQ ID NO: 597011 - DNA, 25 bp, Rattus norvegicus
tctgcttacgggtgcttgtcggaga

SEQ ID NO: 597012 - DNA, 25 bp, Rattus norvegicus
tctgcttaggacatctgtttggatt

SEQ ID NO: 597013 - DNA, 25 bp, Rattus norvegicus
tctgcttaggacttctgtttggatt

SEQ ID NO: 597014 - DNA, 25 bp, Rattus norvegicus
tctgcttaggctctcccggaaggga

SEQ ID NO: 597015 - DNA, 25 bp, Rattus norvegicus
tctgcttaggctgtcccggaaggga

SEQ ID NO: 597016 - DNA, 25 bp, Rattus norvegicus
tctgcttatacacctagttttccca

SEQ ID NO: 597017 - DNA, 25 bp, Rattus norvegicus
tctgcttatacagctagttttccca

SEQ ID NO: 597018 - DNA, 25 bp, Rattus norvegicus
tctgcttatgtaagtgccaactccg

SEQ ID NO: 597019 - DNA, 25 bp, Rattus norvegicus
tctgcttatgtatgtgccaactccg

SEQ ID NO: 597020 - DNA, 25 bp, Rattus norvegicus
tctgcttcaaatcccgtatttcagg

SEQ ID NO: 597021 - DNA, 25 bp, Rattus norvegicus
tctgcttcaaatgccgtatttcagg

SEQ ID NO: 597022 - DNA, 25 bp, Rattus norvegicus
tctgcttcaagacgttctggctggt

SEQ ID NO: 597023 - DNA, 25 bp, Rattus norvegicus
tctgcttcaagaggttctggctggt

SEQ ID NO: 597024 - DNA, 25 bp, Rattus norvegicus
tctgcttcaagtcagctttcttgac

SEQ ID NO: 597025 - DNA, 25 bp, Rattus norvegicus
tctgcttcaagtgagctttcttgac

SEQ ID NO: 597026 - DNA, 25 bp, Rattus norvegicus
tctgcttcactacagccagggctga

SEQ ID NO: 597027 - DNA, 25 bp, Rattus norvegicus
tctgcttcactagagccagggctga

SEQ ID NO: 597028 - DNA, 25 bp, Rattus norvegicus
tctgcttcagttccagggctggata

SEQ ID NO: 597029 - DNA, 25 bp, Rattus norvegicus
tctgcttcagttgcagggctggata

SEQ ID NO: 597030 - DNA, 25 bp, Rattus norvegicus
tctgcttcatcaatggtgcctcatc

SEQ ID NO: 597031 - DNA, 25 bp, Rattus norvegicus
tctgcttcatcattggtgcctcatc

SEQ ID NO: 597032 - DNA, 25 bp, Rattus norvegicus
tctgcttcatcccaagggccaaggg

SEQ ID NO: 597033 - DNA, 25 bp, Rattus norvegicus
tctgcttcatccgaagggccaaggg

SEQ ID NO: 597034 - DNA, 25 bp, Rattus norvegicus
tctgcttccaggatggctctgtgaa

SEQ ID NO: 597035 - DNA, 25 bp, Rattus norvegicus
tctgcttccaggttggctctgtgaa

SEQ ID NO: 597036 - DNA, 25 bp, Rattus norvegicus
tctgcttccattacttgagtgctga

SEQ ID NO: 597037 - DNA, 25 bp, Rattus norvegicus
tctgcttccatttcttgagtgctga

SEQ ID NO: 597038 - DNA, 25 bp, Rattus norvegicus
tctgcttcccctaatggtagcttaa

SEQ ID NO: 597039 - DNA, 25 bp, Rattus norvegicus
tctgcttccccttatggtagcttaa

SEQ ID NO: 597040 - DNA, 25 bp, Rattus norvegicus
tctgcttccgaccatgatactgaaa

SEQ ID NO: 597041 - DNA, 25 bp, Rattus norvegicus
tctgcttccgacgatgatactgaaa

SEQ ID NO: 597042 - DNA, 25 bp, Rattus norvegicus
tctgcttccggcaaaagggctccaa

SEQ ID NO: 597043 - DNA, 25 bp, Rattus norvegicus
tctgcttccggctaaagggctccaa

SEQ ID NO: 597044 - DNA, 25 bp, Rattus norvegicus
tctgcttcctcacctatagaatggg

SEQ ID NO: 597045 - DNA, 25 bp, Rattus norvegicus
tctgcttcctcagctatagaatggg

SEQ ID NO: 597046 - DNA, 25 bp, Rattus norvegicus
tctgcttcctgcagcgggttggaaa

SEQ ID NO: 597047 - DNA, 25 bp, Rattus norvegicus
tctgcttcctgctgcgggttggaaa

SEQ ID NO: 597048 - DNA, 25 bp, Rattus norvegicus
tctgcttcctgtcagctattgagat

SEQ ID NO: 597049 - DNA, 25 bp, Rattus norvegicus
tctgcttcctgtgagctattgagat

SEQ ID NO: 597050 - DNA, 25 bp, Rattus norvegicus
tctgcttccttccagactgggtgac

SEQ ID NO: 597051 - DNA, 25 bp, Rattus norvegicus
tctgcttccttcgagactgggtgac

SEQ ID NO: 597052 - DNA, 25 bp, Rattus norvegicus
tctgcttctcatcatcagctaaagg

SEQ ID NO: 597053 - DNA, 25 bp, Rattus norvegicus
tctgcttctcatgatcagctaaagg

SEQ ID NO: 597054 - DNA, 25 bp, Rattus norvegicus
tctgcttctctaaatgttaggtggg

SEQ ID NO: 597055 - DNA, 25 bp, Rattus norvegicus
tctgcttctctatatgttaggtggg

SEQ ID NO: 597056 - DNA, 25 bp, Rattus norvegicus
tctgcttctctcaggaatactagaa

SEQ ID NO: 597057 - DNA, 25 bp, Rattus norvegicus
tctgcttctctctggaatactagaa

SEQ ID NO: 597058 - DNA, 25 bp, Rattus norvegicus
tctgcttctcttcaatcttcttcat

SEQ ID NO: 597059 - DNA, 25 bp, Rattus norvegicus
tctgcttctcttgaatcttcttcat

SEQ ID NO: 597060 - DNA, 25 bp, Rattus norvegicus
tctgcttgactaaatgcttcttcct

SEQ ID NO: 597061 - DNA, 25 bp, Rattus norvegicus
tctgcttgactatatgcttcttcct

SEQ ID NO: 597062 - DNA, 25 bp, Rattus norvegicus
tctgcttgcataacttctggctgaa

SEQ ID NO: 597063 - DNA, 25 bp, Rattus norvegicus
tctgcttgcatatcttctggctgaa

SEQ ID NO: 597064 - DNA, 25 bp, Rattus norvegicus
tctgcttgcatgagcctatgctgct

SEQ ID NO: 597065 - DNA, 25 bp, Rattus norvegicus
tctgcttgcatgtgcctatgctgct

SEQ ID NO: 597066 - DNA, 25 bp, Rattus norvegicus
tctgcttggcatctcttaaacccta

SEQ ID NO: 597067 - DNA, 25 bp, Rattus norvegicus
tctgcttggcatgtcttaaacccta

SEQ ID NO: 597068 - DNA, 25 bp, Rattus norvegicus
tctgcttgggccatatctgcattac

SEQ ID NO: 597069 - DNA, 25 bp, Rattus norvegicus
tctgcttgggccttatctgcattac

SEQ ID NO: 597070 - DNA, 25 bp, Rattus norvegicus
tctgcttgtctgagtgagcggccat

SEQ ID NO: 597071 - DNA, 25 bp, Rattus norvegicus
tctgcttgtctgtgtgagcggccat

SEQ ID NO: 597072 - DNA, 25 bp, Rattus norvegicus
tctgctttaatgcttcttttctgtg

SEQ ID NO: 597073 - DNA, 25 bp, Rattus norvegicus
tctgctttaatggttcttttctgtg

SEQ ID NO: 597074 - DNA, 25 bp, Rattus norvegicus
tctgctttacaacggcaactactcg

SEQ ID NO: 597075 - DNA, 25 bp, Rattus norvegicus
tctgctttacaagggcaactactcg

SEQ ID NO: 597076 - DNA, 25 bp, Rattus norvegicus
tctgctttacctacctggagatctt

SEQ ID NO: 597077 - DNA, 25 bp, Rattus norvegicus
tctgctttacctatcagcttttgtt

SEQ ID NO: 597078 - DNA, 25 bp, Rattus norvegicus
tctgctttaccttcctggagatctt

SEQ ID NO: 597079 - DNA, 25 bp, Rattus norvegicus
tctgctttacctttcagcttttgtt

SEQ ID NO: 597080 - DNA, 25 bp, Rattus norvegicus
tctgctttatacagatcggtgtttg

SEQ ID NO: 597081 - DNA, 25 bp, Rattus norvegicus
tctgctttatactgatcggtgtttg

SEQ ID NO: 597082 - DNA, 25 bp, Rattus norvegicus
tctgctttcatgaggagactgtctc

SEQ ID NO: 597083 - DNA, 25 bp, Rattus norvegicus
tctgctttcatgtggagactgtctc

SEQ ID NO: 597084 - DNA, 25 bp, Rattus norvegicus
tctgctttctatataatcactgttg

SEQ ID NO: 597085 - DNA, 25 bp, Rattus norvegicus
tctgctttctatttaatcactgttg

SEQ ID NO: 597086 - DNA, 25 bp, Rattus norvegicus
tctgctttctcaaatgtaccgggaa

SEQ ID NO: 597087 - DNA, 25 bp, Rattus norvegicus
tctgctttctcatatgtaccgggaa

SEQ ID NO: 597088 - DNA, 25 bp, Rattus norvegicus
tctgctttctgcctgtaaaactcat

SEQ ID NO: 597089 - DNA, 25 bp, Rattus norvegicus
tctgctttctgcgtgtaaaactcat

SEQ ID NO: 597090 - DNA, 25 bp, Rattus norvegicus
tctgctttctggaccttttgttgaa

SEQ ID NO: 597091 - DNA, 25 bp, Rattus norvegicus
tctgctttctggtccttttgttgaa

SEQ ID NO: 597092 - DNA, 25 bp, Rattus norvegicus
tctgctttgaggctaccttggccgg

SEQ ID NO: 597093 - DNA, 25 bp, Rattus norvegicus
tctgctttgagggtaccttggccgg

SEQ ID NO: 597094 - DNA, 25 bp, Rattus norvegicus
tctgctttgtcgagccaggcataag

SEQ ID NO: 597095 - DNA, 25 bp, Rattus norvegicus
tctgctttgtcgtgccaggcataag

SEQ ID NO: 597096 - DNA, 25 bp, Rattus norvegicus
tctgctttgtgtctccaagtactat

SEQ ID NO: 597097 - DNA, 25 bp, Rattus norvegicus
tctgctttgtgtgtccaagtactat

SEQ ID NO: 597098 - DNA, 25 bp, Rattus norvegicus
tctgcttttaacatttctcgtacac

SEQ ID NO: 597099 - DNA, 25 bp, Rattus norvegicus
tctgcttttaacttttctcgtacac

SEQ ID NO: 597100 - DNA, 25 bp, Rattus norvegicus
tctgcttttcagatgtccacttgac

SEQ ID NO: 597101 - DNA, 25 bp, Rattus norvegicus
tctgcttttcagctggcgattgctc

SEQ ID NO: 597102 - DNA, 25 bp, Rattus norvegicus
tctgcttttcaggtggcgattgctc

SEQ ID NO: 597103 - DNA, 25 bp, Rattus norvegicus
tctgcttttcagttgtccacttgac

SEQ ID NO: 597104 - DNA, 25 bp, Rattus norvegicus
tctgcttttgctcatttttcttctc

SEQ ID NO: 597105 - DNA, 25 bp, Rattus norvegicus
tctgcttttgctgatttttcttctc

SEQ ID NO: 597106 - DNA, 25 bp, Rattus norvegicus
tctgcttttttaatcacgggcttta

SEQ ID NO: 597107 - DNA, 25 bp, Rattus norvegicus
tctgcttttttattcacgggcttta

SEQ ID NO: 597108 - DNA, 25 bp, Rattus norvegicus
tctggaaaaactcgaacaaactggt

SEQ ID NO: 597109 - DNA, 25 bp, Rattus norvegicus
tctggaaaaactggaacaaactggt

SEQ ID NO: 597110 - DNA, 25 bp, Rattus norvegicus
tctggaaaagcacccggcactcaac

SEQ ID NO: 597111 - DNA, 25 bp, Rattus norvegicus
tctggaaaagcagccggcactcaac

SEQ ID NO: 597112 - DNA, 25 bp, Rattus norvegicus
tctggaaacaccaccaccattgtca

SEQ ID NO: 597113 - DNA, 25 bp, Rattus norvegicus
tctggaaacacctccaccattgtca

SEQ ID NO: 597114 - DNA, 25 bp, Rattus norvegicus
tctggaaaccaaacctgggttctct

SEQ ID NO: 597115 - DNA, 25 bp, Rattus norvegicus
tctggaaaccaatcctgggttctct

SEQ ID NO: 597116 - DNA, 25 bp, Rattus norvegicus
tctggaaacttcaagcatgactgca

SEQ ID NO: 597117 - DNA, 25 bp, Rattus norvegicus
tctggaaacttctagcatgactgca

SEQ ID NO: 597118 - DNA, 25 bp, Rattus norvegicus
tctggaaagttcattgcagggcctt

SEQ ID NO: 597119 - DNA, 25 bp, Rattus norvegicus
tctggaaagttctttgcagggcctt

SEQ ID NO: 597120 - DNA, 25 bp, Rattus norvegicus
tctggaaatgtcactctggagattg

SEQ ID NO: 597121 - DNA, 25 bp, Rattus norvegicus
tctggaaatgtctctctggagattg

SEQ ID NO: 597122 - DNA, 25 bp, Rattus norvegicus
tctggaacattcacacattttggtg

SEQ ID NO: 597123 - DNA, 25 bp, Rattus norvegicus
tctggaacattctcacattttggtg

SEQ ID NO: 597124 - DNA, 25 bp, Rattus norvegicus
tctggaaccaggcatcccgcaatca

SEQ ID NO: 597125 - DNA, 25 bp, Rattus norvegicus
tctggaaccagggatcccgcaatca

SEQ ID NO: 597126 - DNA, 25 bp, Rattus norvegicus
tctggaaccatgacgcctgccgggc

SEQ ID NO: 597127 - DNA, 25 bp, Rattus norvegicus
tctggaaccatgtcgcctgccgggc

SEQ ID NO: 597128 - DNA, 25 bp, Rattus norvegicus
tctggaacctggagtgcgcgtgcac

SEQ ID NO: 597129 - DNA, 25 bp, Rattus norvegicus
tctggaacctggtgtgcgcgtgcac

SEQ ID NO: 597130 - DNA, 25 bp, Rattus norvegicus
tctggaaccttgaggagggactttg

SEQ ID NO: 597131 - DNA, 25 bp, Rattus norvegicus
tctggaaccttgtggagggactttg

SEQ ID NO: 597132 - DNA, 25 bp, Rattus norvegicus
tctggaactgcaagtctctccgctg

SEQ ID NO: 597133 - DNA, 25 bp, Rattus norvegicus
tctggaactgcatgtctctccgctg

SEQ ID NO: 597134 - DNA, 25 bp, Rattus norvegicus
tctggaactggacaggtagccacct

SEQ ID NO: 597135 - DNA, 25 bp, Rattus norvegicus
tctggaactggagaggtagccacct

SEQ ID NO: 597136 - DNA, 25 bp, Rattus norvegicus
tctggaacttgtcagcagctgccaa

SEQ ID NO: 597137 - DNA, 25 bp, Rattus norvegicus
tctggaacttgtgagcagctgccaa

SEQ ID NO: 597138 - DNA, 25 bp, Rattus norvegicus
tctggaagaggcatggcttccactg

SEQ ID NO: 597139 - DNA, 25 bp, Rattus norvegicus
tctggaagaggcttggcttccactg

SEQ ID NO: 597140 - DNA, 25 bp, Rattus norvegicus
tctggaagcatcaacctgctcgaat

SEQ ID NO: 597141 - DNA, 25 bp, Rattus norvegicus
tctggaagcatctacctgctcgaat

SEQ ID NO: 597142 - DNA, 25 bp, Rattus norvegicus
tctggaagtggacctgttctctgct

SEQ ID NO: 597143 - DNA, 25 bp, Rattus norvegicus
tctggaagtggagctgttctctgct

SEQ ID NO: 597144 - DNA, 25 bp, Rattus norvegicus
tctggaagttccaccggcttgctac

SEQ ID NO: 597145 - DNA, 25 bp, Rattus norvegicus
tctggaagttcctccggcttgctac

SEQ ID NO: 597146 - DNA, 25 bp, Rattus norvegicus
tctggaataactatttgcgggaccg

SEQ ID NO: 597147 - DNA, 25 bp, Rattus norvegicus
tctggaataactttttgcgggaccg

SEQ ID NO: 597148 - DNA, 25 bp, Rattus norvegicus
tctggaataatgcacgccgctggca

SEQ ID NO: 597149 - DNA, 25 bp, Rattus norvegicus
tctggaataatggacgccgctggca

SEQ ID NO: 597150 - DNA, 25 bp, Rattus norvegicus
tctggaatacctcaccctgaatagt

SEQ ID NO: 597151 - DNA, 25 bp, Rattus norvegicus
tctggaatacctgaccctgaatagt

SEQ ID NO: 597152 - DNA, 25 bp, Rattus norvegicus
tctggaatatctcagctagtgctct

SEQ ID NO: 597153 - DNA, 25 bp, Rattus norvegicus
tctggaatatctgagctagtgctct

SEQ ID NO: 597154 - DNA, 25 bp, Rattus norvegicus
tctggaatcgtcctcttcaatgatg

SEQ ID NO: 597155 - DNA, 25 bp, Rattus norvegicus
tctggaatcgtcgtcttcaatgatg

SEQ ID NO: 597156 - DNA, 25 bp, Rattus norvegicus
tctggacaactcactatgatttcta

SEQ ID NO: 597157 - DNA, 25 bp, Rattus norvegicus
tctggacaactctctatgatttcta

SEQ ID NO: 597158 - DNA, 25 bp, Rattus norvegicus
tctggacacaaaacaagggcccttt

SEQ ID NO: 597159 - DNA, 25 bp, Rattus norvegicus
tctggacacaaatcaagggcccttt

SEQ ID NO: 597160 - DNA, 25 bp, Rattus norvegicus
tctggacaccgtacactgcttgtaa

SEQ ID NO: 597161 - DNA, 25 bp, Rattus norvegicus
tctggacaccgttcactgcttgtaa

SEQ ID NO: 597162 - DNA, 25 bp, Rattus norvegicus
tctggacagaatccccttcttagta

SEQ ID NO: 597163 - DNA, 25 bp, Rattus norvegicus
tctggacagaatgcccttcttagta

SEQ ID NO: 597164 - DNA, 25 bp, Rattus norvegicus
tctggacagataaacacagtctgct

SEQ ID NO: 597165 - DNA, 25 bp, Rattus norvegicus
tctggacagatatacacagtctgct

SEQ ID NO: 597166 - DNA, 25 bp, Rattus norvegicus
tctggacaggccattgctcaatcaa

SEQ ID NO: 597167 - DNA, 25 bp, Rattus norvegicus
tctggacaggcctttgctcaatcaa

SEQ ID NO: 597168 - DNA, 25 bp, Rattus norvegicus
tctggacatcaacaccatggctgtt

SEQ ID NO: 597169 - DNA, 25 bp, Rattus norvegicus
tctggacatcaagaccatggctgtt

SEQ ID NO: 597170 - DNA, 25 bp, Rattus norvegicus
tctggaccagttcacaaatgttctt

SEQ ID NO: 597171 - DNA, 25 bp, Rattus norvegicus
tctggaccagttgacaaatgttctt

SEQ ID NO: 597172 - DNA, 25 bp, Rattus norvegicus
tctggacccacgcaagggaactcag

SEQ ID NO: 597173 - DNA, 25 bp, Rattus norvegicus
tctggacccacggaagggaactcag

SEQ ID NO: 597174 - DNA, 25 bp, Rattus norvegicus
tctggacccattcgctggactcaat

SEQ ID NO: 597175 - DNA, 25 bp, Rattus norvegicus
tctggacccattggctggactcaat

SEQ ID NO: 597176 - DNA, 25 bp, Rattus norvegicus
tctggacccttcagtaggctactga

SEQ ID NO: 597177 - DNA, 25 bp, Rattus norvegicus
tctggacccttctgtaggctactga

SEQ ID NO: 597178 - DNA, 25 bp, Rattus norvegicus
tctggaccgagcagtcaattcaaag

SEQ ID NO: 597179 - DNA, 25 bp, Rattus norvegicus
tctggaccgagctgtcaattcaaag

SEQ ID NO: 597180 - DNA, 25 bp, Rattus norvegicus
tctggaccggcccatcaagaaaggc

SEQ ID NO: 597181 - DNA, 25 bp, Rattus norvegicus
tctggaccggccgatcaagaaaggc

SEQ ID NO: 597182 - DNA, 25 bp, Rattus norvegicus
tctggacctcagcatcttagctgta

SEQ ID NO: 597183 - DNA, 25 bp, Rattus norvegicus
tctggacctcaggatcttagctgta

SEQ ID NO: 597184 - DNA, 25 bp, Rattus norvegicus
tctggacctctgctgtgtaggactg

SEQ ID NO: 597185 - DNA, 25 bp, Rattus norvegicus
tctggacctctggtgtgtaggactg

SEQ ID NO: 597186 - DNA, 25 bp, Rattus norvegicus
tctggacctttacttatgaccaaag

SEQ ID NO: 597187 - DNA, 25 bp, Rattus norvegicus
tctggacctttagttatgaccaaag

SEQ ID NO: 597188 - DNA, 25 bp, Rattus norvegicus
tctggacgcaggagatgaggtcttc

SEQ ID NO: 597189 - DNA, 25 bp, Rattus norvegicus
tctggacgcaggtgatgaggtcttc

SEQ ID NO: 597190 - DNA, 25 bp, Rattus norvegicus
tctggacgctgactcttcgtttaaa

SEQ ID NO: 597191 - DNA, 25 bp, Rattus norvegicus
tctggacgctgagtcttcgtttaaa

SEQ ID NO: 597192 - DNA, 25 bp, Rattus norvegicus
tctggactacatactcagaggcata

SEQ ID NO: 597193 - DNA, 25 bp, Rattus norvegicus
tctggactacattctcagaggcata

SEQ ID NO: 597194 - DNA, 25 bp, Rattus norvegicus
tctggactgccaatagtgctatcct

SEQ ID NO: 597195 - DNA, 25 bp, Rattus norvegicus
tctggactgccattagtgctatcct

SEQ ID NO: 597196 - DNA, 25 bp, Rattus norvegicus
tctggactggtcaagaactcatagc

SEQ ID NO: 597197 - DNA, 25 bp, Rattus norvegicus
tctggactggtctagaactcatagc

SEQ ID NO: 597198 - DNA, 25 bp, Rattus norvegicus
tctggacttgaaacaacctgggatc

SEQ ID NO: 597199 - DNA, 25 bp, Rattus norvegicus
tctggacttgaatcaacctgggatc

SEQ ID NO: 597200 - DNA, 25 bp, Rattus norvegicus
tctggactttggctcgttttccacg

SEQ ID NO: 597201 - DNA, 25 bp, Rattus norvegicus
tctggactttgggtcgttttccacg

SEQ ID NO: 597202 - DNA, 25 bp, Rattus norvegicus
tctggagaacaaatgcctgagccct

SEQ ID NO: 597203 - DNA, 25 bp, Rattus norvegicus
tctggagaacaattgcctgagccct

SEQ ID NO: 597204 - DNA, 25 bp, Rattus norvegicus
tctggagaagctagcctgccagctg

SEQ ID NO: 597205 - DNA, 25 bp, Rattus norvegicus
tctggagaagcttgcctgccagctg

SEQ ID NO: 597206 - DNA, 25 bp, Rattus norvegicus
tctggagaagttaccccttacaaca

SEQ ID NO: 597207 - DNA, 25 bp, Rattus norvegicus
tctggagaagtttccccttacaaca

SEQ ID NO: 597208 - DNA, 25 bp, Rattus norvegicus
tctggagacacacaggccggacctt

SEQ ID NO: 597209 - DNA, 25 bp, Rattus norvegicus
tctggagacacagaggccggacctt

SEQ ID NO: 597210 - DNA, 25 bp, Rattus norvegicus
tctggagacactcacacgcctgaag

SEQ ID NO: 597211 - DNA, 25 bp, Rattus norvegicus
tctggagacactgacacgcctgaag

SEQ ID NO: 597212 - DNA, 25 bp, Rattus norvegicus
tctggagaccaaagctcccgtctta

SEQ ID NO: 597213 - DNA, 25 bp, Rattus norvegicus
tctggagaccaatgctcccgtctta

SEQ ID NO: 597214 - DNA, 25 bp, Rattus norvegicus
tctggagacctcagctgtgacagtc

SEQ ID NO: 597215 - DNA, 25 bp, Rattus norvegicus
tctggagacctctgctgtgacagtc

SEQ ID NO: 597216 - DNA, 25 bp, Rattus norvegicus
tctggagaggctcttcagcagctac

SEQ ID NO: 597217 - DNA, 25 bp, Rattus norvegicus
tctggagaggctgttcagcagctac

SEQ ID NO: 597218 - DNA, 25 bp, Rattus norvegicus
tctggagatcacctgtgccagggat

SEQ ID NO: 597219 - DNA, 25 bp, Rattus norvegicus
tctggagatcacgtgtgccagggat

SEQ ID NO: 597220 - DNA, 25 bp, Rattus norvegicus
tctggagcccctatctttaagcctg

SEQ ID NO: 597221 - DNA, 25 bp, Rattus norvegicus
tctggagcccctttctttaagcctg

SEQ ID NO: 597222 - DNA, 25 bp, Rattus norvegicus
tctggagcccgcagtgcgcttagga

SEQ ID NO: 597223 - DNA, 25 bp, Rattus norvegicus
tctggagcccgctgtgcgcttagga

SEQ ID NO: 597224 - DNA, 25 bp, Rattus norvegicus
tctggagccgacatactgttctggg

SEQ ID NO: 597225 - DNA, 25 bp, Rattus norvegicus
tctggagccgacttactgttctggg

SEQ ID NO: 597226 - DNA, 25 bp, Rattus norvegicus
tctggagcctttcacgtccttaaaa

SEQ ID NO: 597227 - DNA, 25 bp, Rattus norvegicus
tctggagcctttgacgtccttaaaa

SEQ ID NO: 597228 - DNA, 25 bp, Rattus norvegicus
tctggagcgccaagagcagcccgga

SEQ ID NO: 597229 - DNA, 25 bp, Rattus norvegicus
tctggagcgccatgagcagcccgga

SEQ ID NO: 597230 - DNA, 25 bp, Rattus norvegicus
tctggagctgtgatcctcaactagg

SEQ ID NO: 597231 - DNA, 25 bp, Rattus norvegicus
tctggagctgtgttcctcaactagg

SEQ ID NO: 597232 - DNA, 25 bp, Rattus norvegicus
tctggagcttgccagtaggagtcca

SEQ ID NO: 597233 - DNA, 25 bp, Rattus norvegicus
tctggagcttgcgagtaggagtcca

SEQ ID NO: 597234 - DNA, 25 bp, Rattus norvegicus
tctggaggacatcccttcttctcac

SEQ ID NO: 597235 - DNA, 25 bp, Rattus norvegicus
tctggaggacatgccttcttctcac

SEQ ID NO: 597236 - DNA, 25 bp, Rattus norvegicus
tctggaggagctaaggccggtctat

SEQ ID NO: 597237 - DNA, 25 bp, Rattus norvegicus
tctggaggagcttaggccggtctat

SEQ ID NO: 597238 - DNA, 25 bp, Rattus norvegicus
tctggaggatatcctgccacgctga

SEQ ID NO: 597239 - DNA, 25 bp, Rattus norvegicus
tctggaggatatgctgccacgctga

SEQ ID NO: 597240 - DNA, 25 bp, Rattus norvegicus
tctggaggcactcccaggtgaagct

SEQ ID NO: 597241 - DNA, 25 bp, Rattus norvegicus
tctggaggcactgccaggtgaagct

SEQ ID NO: 597242 - DNA, 25 bp, Rattus norvegicus
tctggagtaaatcgagtgctccgtg

SEQ ID NO: 597243 - DNA, 25 bp, Rattus norvegicus
tctggagtaaatggagtgctccgtg

SEQ ID NO: 597244 - DNA, 25 bp, Rattus norvegicus
tctggagtaacacccattgctctta

SEQ ID NO: 597245 - DNA, 25 bp, Rattus norvegicus
tctggagtaacagccattgctctta

SEQ ID NO: 597246 - DNA, 25 bp, Rattus norvegicus
tctggagtaagaacgccctggagaa

SEQ ID NO: 597247 - DNA, 25 bp, Rattus norvegicus
tctggagtaagatcgccctggagaa

SEQ ID NO: 597248 - DNA, 25 bp, Rattus norvegicus
tctggagtagaaaacctcaacggtt

SEQ ID NO: 597249 - DNA, 25 bp, Rattus norvegicus
tctggagtagaatacctcaacggtt

SEQ ID NO: 597250 - DNA, 25 bp, Rattus norvegicus
tctggagtagctcgtcatgaaggac

SEQ ID NO: 597251 - DNA, 25 bp, Rattus norvegicus
tctggagtagctggtcatgaaggac

SEQ ID NO: 597252 - DNA, 25 bp, Rattus norvegicus
tctggagtctctcttgactgttgag

SEQ ID NO: 597253 - DNA, 25 bp, Rattus norvegicus
tctggagtctctgttgactgttgag

SEQ ID NO: 597254 - DNA, 25 bp, Rattus norvegicus
tctggagtgcctaagtcctgagcta

SEQ ID NO: 597255 - DNA, 25 bp, Rattus norvegicus
tctggagtgccttagtcctgagcta

SEQ ID NO: 597256 - DNA, 25 bp, Rattus norvegicus
tctggagttcagcaggcaacactgg

SEQ ID NO: 597257 - DNA, 25 bp, Rattus norvegicus
tctggagttcaggaggcaacactgg

SEQ ID NO: 597258 - DNA, 25 bp, Rattus norvegicus
tctggatatcagctgcaagttgttt

SEQ ID NO: 597259 - DNA, 25 bp, Rattus norvegicus
tctggatatcaggtgcaagttgttt

SEQ ID NO: 597260 - DNA, 25 bp, Rattus norvegicus
tctggatatcttctaacctgtggga

SEQ ID NO: 597261 - DNA, 25 bp, Rattus norvegicus
tctggatatcttgtaacctgtggga

SEQ ID NO: 597262 - DNA, 25 bp, Rattus norvegicus
tctggatccatgctctctggagaag

SEQ ID NO: 597263 - DNA, 25 bp, Rattus norvegicus
tctggatccatggtctctggagaag

SEQ ID NO: 597264 - DNA, 25 bp, Rattus norvegicus
tctggatcctaaagccttttgtgaa

SEQ ID NO: 597265 - DNA, 25 bp, Rattus norvegicus
tctggatcctaatgccttttgtgaa

SEQ ID NO: 597266 - DNA, 25 bp, Rattus norvegicus
tctggatctcagactattggcttct

SEQ ID NO: 597267 - DNA, 25 bp, Rattus norvegicus
tctggatctcagtctattggcttct

SEQ ID NO: 597268 - DNA, 25 bp, Rattus norvegicus
tctggatcttagcattcttcccata

SEQ ID NO: 597269 - DNA, 25 bp, Rattus norvegicus
tctggatcttaggattcttcccata

SEQ ID NO: 597270 - DNA, 25 bp, Rattus norvegicus
tctggatcttctagggcctgacctt

SEQ ID NO: 597271 - DNA, 25 bp, Rattus norvegicus
tctggatcttcttgggcctgacctt

SEQ ID NO: 597272 - DNA, 25 bp, Rattus norvegicus
tctggatgaagccacatcagctctg

SEQ ID NO: 597273 - DNA, 25 bp, Rattus norvegicus
tctggatgaagcgacatcagctctg

SEQ ID NO: 597274 - DNA, 25 bp, Rattus norvegicus
tctggatgaatgacaacctcctgga

SEQ ID NO: 597275 - DNA, 25 bp, Rattus norvegicus
tctggatgaatgtcaacctcctgga

SEQ ID NO: 597276 - DNA, 25 bp, Rattus norvegicus
tctggatgatccagtctgtggtcat

SEQ ID NO: 597277 - DNA, 25 bp, Rattus norvegicus
tctggatgatcctgtctgtggtcat

SEQ ID NO: 597278 - DNA, 25 bp, Rattus norvegicus
tctggatgccagaccccgttttgta

SEQ ID NO: 597279 - DNA, 25 bp, Rattus norvegicus
tctggatgccagtccccgttttgta

SEQ ID NO: 597280 - DNA, 25 bp, Rattus norvegicus
tctggatgctggcaactaatgttaa

SEQ ID NO: 597281 - DNA, 25 bp, Rattus norvegicus
tctggatgctgggaactaatgttaa

SEQ ID NO: 597282 - DNA, 25 bp, Rattus norvegicus
tctggatgtccaaatgctgttgaat

SEQ ID NO: 597283 - DNA, 25 bp, Rattus norvegicus
tctggatgtccatatgctgttgaat

SEQ ID NO: 597284 - DNA, 25 bp, Rattus norvegicus
tctggatgtctaccttcaccacaaa

SEQ ID NO: 597285 - DNA, 25 bp, Rattus norvegicus
tctggatgtctagcttcaccacaaa

SEQ ID NO: 597286 - DNA, 25 bp, Rattus norvegicus
tctggatgtggcacatgccggcgac

SEQ ID NO: 597287 - DNA, 25 bp, Rattus norvegicus
tctggatgtggctcatgccggcgac

SEQ ID NO: 597288 - DNA, 25 bp, Rattus norvegicus
tctggatgttctcgtggcacacggc

SEQ ID NO: 597289 - DNA, 25 bp, Rattus norvegicus
tctggatgttctggtggcacacggc

SEQ ID NO: 597290 - DNA, 25 bp, Rattus norvegicus
tctggatgttttaccctggtatcaa

SEQ ID NO: 597291 - DNA, 25 bp, Rattus norvegicus
tctggatgtttttccctggtatcaa

SEQ ID NO: 597292 - DNA, 25 bp, Rattus norvegicus
tctggattactcaggctcactggaa

SEQ ID NO: 597293 - DNA, 25 bp, Rattus norvegicus
tctggattactctggctcactggaa

SEQ ID NO: 597294 - DNA, 25 bp, Rattus norvegicus
tctggattagatctgcctttaactt

SEQ ID NO: 597295 - DNA, 25 bp, Rattus norvegicus
tctggattagatgtgcctttaactt

SEQ ID NO: 597296 - DNA, 25 bp, Rattus norvegicus
tctggattcagcatgggtggatcaa

SEQ ID NO: 597297 - DNA, 25 bp, Rattus norvegicus
tctggattcagcttgggtggatcaa

SEQ ID NO: 597298 - DNA, 25 bp, Rattus norvegicus
tctggattctgaaggcattgcacac

SEQ ID NO: 597299 - DNA, 25 bp, Rattus norvegicus
tctggattctgatggcattgcacac

SEQ ID NO: 597300 - DNA, 25 bp, Rattus norvegicus
tctggattctttcttctgttttcat

SEQ ID NO: 597301 - DNA, 25 bp, Rattus norvegicus
tctggattctttgttctgttttcat

SEQ ID NO: 597302 - DNA, 25 bp, Rattus norvegicus
tctggattggcacccttatggttta

SEQ ID NO: 597303 - DNA, 25 bp, Rattus norvegicus
tctggattggcagccttatggttta

SEQ ID NO: 597304 - DNA, 25 bp, Rattus norvegicus
tctggattggctctgccctttataa

SEQ ID NO: 597305 - DNA, 25 bp, Rattus norvegicus
tctggattggctgtgccctttataa

SEQ ID NO: 597306 - DNA, 25 bp, Rattus norvegicus
tctggatttcgacccactgcttagc

SEQ ID NO: 597307 - DNA, 25 bp, Rattus norvegicus
tctggatttcgagccactgcttagc

SEQ ID NO: 597308 - DNA, 25 bp, Rattus norvegicus
tctggatttcttacacatcgtgtgc

SEQ ID NO: 597309 - DNA, 25 bp, Rattus norvegicus
tctggatttctttcacatcgtgtgc

SEQ ID NO: 597310 - DNA, 25 bp, Rattus norvegicus
tctggatttgccatctgagtgcatc

SEQ ID NO: 597311 - DNA, 25 bp, Rattus norvegicus
tctggatttgccttctgagtgcatc

SEQ ID NO: 597312 - DNA, 25 bp, Rattus norvegicus
tctggattttcaagcctgtgtctca

SEQ ID NO: 597313 - DNA, 25 bp, Rattus norvegicus
tctggattttcatgcctgtgtctca

SEQ ID NO: 597314 - DNA, 25 bp, Rattus norvegicus
tctggcaaaactacagtaggttaac

SEQ ID NO: 597315 - DNA, 25 bp, Rattus norvegicus
tctggcaaaacttcagtaggttaac

SEQ ID NO: 597316 - DNA, 25 bp, Rattus norvegicus
tctggcaaatggacttgtgtccttt

SEQ ID NO: 597317 - DNA, 25 bp, Rattus norvegicus
tctggcaaatggtcttgtgtccttt

SEQ ID NO: 597318 - DNA, 25 bp, Rattus norvegicus
tctggcaaggccctaccatgacaag

SEQ ID NO: 597319 - DNA, 25 bp, Rattus norvegicus
tctggcaaggccgtaccatgacaag

SEQ ID NO: 597320 - DNA, 25 bp, Rattus norvegicus
tctggcacagccagcaaggagctga

SEQ ID NO: 597321 - DNA, 25 bp, Rattus norvegicus
tctggcacagcctgcaaggagctga

SEQ ID NO: 597322 - DNA, 25 bp, Rattus norvegicus
tctggcacagctaactgggctgctg

SEQ ID NO: 597323 - DNA, 25 bp, Rattus norvegicus
tctggcacagcttactgggctgctg

SEQ ID NO: 597324 - DNA, 25 bp, Rattus norvegicus
tctggcaccatcacattgctttaat

SEQ ID NO: 597325 - DNA, 25 bp, Rattus norvegicus
tctggcaccatctcattgctttaat

SEQ ID NO: 597326 - DNA, 25 bp, Rattus norvegicus
tctggcacccgcatctgaagcagaa

SEQ ID NO: 597327 - DNA, 25 bp, Rattus norvegicus
tctggcacccgcttctgaagcagaa

SEQ ID NO: 597328 - DNA, 25 bp, Rattus norvegicus
tctggcaccttcagatactatagct

SEQ ID NO: 597329 - DNA, 25 bp, Rattus norvegicus
tctggcaccttctgatactatagct

SEQ ID NO: 597330 - DNA, 25 bp, Rattus norvegicus
tctggcactatgatggttggacgga

SEQ ID NO: 597331 - DNA, 25 bp, Rattus norvegicus
tctggcactatgttggttggacgga

SEQ ID NO: 597332 - DNA, 25 bp, Rattus norvegicus
tctggcactggcattctcctgtcat

SEQ ID NO: 597333 - DNA, 25 bp, Rattus norvegicus
tctggcactggctttctcctgtcat

SEQ ID NO: 597334 - DNA, 25 bp, Rattus norvegicus
tctggcactggtccgtacccgaatg

SEQ ID NO: 597335 - DNA, 25 bp, Rattus norvegicus
tctggcactggtgcgtacccgaatg

SEQ ID NO: 597336 - DNA, 25 bp, Rattus norvegicus
tctggcactttcaggcatcgatgaa

SEQ ID NO: 597337 - DNA, 25 bp, Rattus norvegicus
tctggcactttctggcatcgatgaa

SEQ ID NO: 597338 - DNA, 25 bp, Rattus norvegicus
tctggcagactaaggtggatatgat

SEQ ID NO: 597339 - DNA, 25 bp, Rattus norvegicus
tctggcagactacagtttctttccc

SEQ ID NO: 597340 - DNA, 25 bp, Rattus norvegicus
tctggcagactagagtttctttccc

SEQ ID NO: 597341 - DNA, 25 bp, Rattus norvegicus
tctggcagactatggtggatatgat

SEQ ID NO: 597342 - DNA, 25 bp, Rattus norvegicus
tctggcagccccaagggtgtacata

SEQ ID NO: 597343 - DNA, 25 bp, Rattus norvegicus
tctggcagcccctagggtgtacata

SEQ ID NO: 597344 - DNA, 25 bp, Rattus norvegicus
tctggcagccttagaattaaagtgt

SEQ ID NO: 597345 - DNA, 25 bp, Rattus norvegicus
tctggcagcctttgaattaaagtgt

SEQ ID NO: 597346 - DNA, 25 bp, Rattus norvegicus
tctggcaggaccaaacatccggtta

SEQ ID NO: 597347 - DNA, 25 bp, Rattus norvegicus
tctggcaggacctaacatccggtta

SEQ ID NO: 597348 - DNA, 25 bp, Rattus norvegicus
tctggcaggactccggatactttga

SEQ ID NO: 597349 - DNA, 25 bp, Rattus norvegicus
tctggcaggactgcggatactttga

SEQ ID NO: 597350 - DNA, 25 bp, Rattus norvegicus
tctggcagggttacaagggagctac

SEQ ID NO: 597351 - DNA, 25 bp, Rattus norvegicus
tctggcagggtttcaagggagctac

SEQ ID NO: 597352 - DNA, 25 bp, Rattus norvegicus
tctggcagtgagcacatctattttc

SEQ ID NO: 597353 - DNA, 25 bp, Rattus norvegicus
tctggcagtgaggacatctattttc

SEQ ID NO: 597354 - DNA, 25 bp, Rattus norvegicus
tctggcataggcacaggcccttata

SEQ ID NO: 597355 - DNA, 25 bp, Rattus norvegicus
tctggcataggctcaggcccttata

SEQ ID NO: 597356 - DNA, 25 bp, Rattus norvegicus
tctggcatagtgcaggctagacctt

SEQ ID NO: 597357 - DNA, 25 bp, Rattus norvegicus
tctggcatagtggaggctagacctt

SEQ ID NO: 597358 - DNA, 25 bp, Rattus norvegicus
tctggcatcctgaaccacagccaaa

SEQ ID NO: 597359 - DNA, 25 bp, Rattus norvegicus
tctggcatcctgtaccacagccaaa

SEQ ID NO: 597360 - DNA, 25 bp, Rattus norvegicus
tctggcatgctgatccagggaacca

SEQ ID NO: 597361 - DNA, 25 bp, Rattus norvegicus
tctggcatgctgttccagggaacca

SEQ ID NO: 597362 - DNA, 25 bp, Rattus norvegicus
tctggcatgttcatgtctgggctgc

SEQ ID NO: 597363 - DNA, 25 bp, Rattus norvegicus
tctggcatgttcttgtctgggctgc

SEQ ID NO: 597364 - DNA, 25 bp, Rattus norvegicus
tctggcattcccatttcgaattggc

SEQ ID NO: 597365 - DNA, 25 bp, Rattus norvegicus
tctggcattcccttttcgaattggc

SEQ ID NO: 597366 - DNA, 25 bp, Rattus norvegicus
tctggccaagagcttcaatgagaag

SEQ ID NO: 597367 - DNA, 25 bp, Rattus norvegicus
tctggccaagaggttcaatgagaag

SEQ ID NO: 597368 - DNA, 25 bp, Rattus norvegicus
tctggccagaggaagtcgtcatctt

SEQ ID NO: 597369 - DNA, 25 bp, Rattus norvegicus
tctggccagaggtagtcgtcatctt

SEQ ID NO: 597370 - DNA, 25 bp, Rattus norvegicus
tctggccagattccactgcttgaga

SEQ ID NO: 597371 - DNA, 25 bp, Rattus norvegicus
tctggccagattgcactgcttgaga

SEQ ID NO: 597372 - DNA, 25 bp, Rattus norvegicus
tctggccagtagcagctctcaataa

SEQ ID NO: 597373 - DNA, 25 bp, Rattus norvegicus
tctggccagtaggagctctcaataa

SEQ ID NO: 597374 - DNA, 25 bp, Rattus norvegicus
tctggccatcataggaattgtggtg

SEQ ID NO: 597375 - DNA, 25 bp, Rattus norvegicus
tctggccatcattggaattgtggtg

SEQ ID NO: 597376 - DNA, 25 bp, Rattus norvegicus
tctggccatcccaagtgtggcgttt

SEQ ID NO: 597377 - DNA, 25 bp, Rattus norvegicus
tctggccatccctagtgtggcgttt

SEQ ID NO: 597378 - DNA, 25 bp, Rattus norvegicus
tctggcccaaagctgtgcaacttac

SEQ ID NO: 597379 - DNA, 25 bp, Rattus norvegicus
tctggcccaaaggtgtgcaacttac

SEQ ID NO: 597380 - DNA, 25 bp, Rattus norvegicus
tctggcccaaggagcgaattctgaa

SEQ ID NO: 597381 - DNA, 25 bp, Rattus norvegicus
tctggcccaaggtgcgaattctgaa

SEQ ID NO: 597382 - DNA, 25 bp, Rattus norvegicus
tctggcccagcaacttctgatagaa

SEQ ID NO: 597383 - DNA, 25 bp, Rattus norvegicus
tctggcccagcacaaatgtcctgtt

SEQ ID NO: 597384 - DNA, 25 bp, Rattus norvegicus
tctggcccagcagaaatgtcctgtt

SEQ ID NO: 597385 - DNA, 25 bp, Rattus norvegicus
tctggcccagcatcttctgatagaa

SEQ ID NO: 597386 - DNA, 25 bp, Rattus norvegicus
tctggcccagttctacggtgtcata

SEQ ID NO: 597387 - DNA, 25 bp, Rattus norvegicus
tctggcccagttgtacggtgtcata

SEQ ID NO: 597388 - DNA, 25 bp, Rattus norvegicus
tctggcccatggcagcccggaaatg

SEQ ID NO: 597389 - DNA, 25 bp, Rattus norvegicus
tctggcccatgggagcccggaaatg

SEQ ID NO: 597390 - DNA, 25 bp, Rattus norvegicus
tctggccctaacatctatttgtttt

SEQ ID NO: 597391 - DNA, 25 bp, Rattus norvegicus
tctggccctaacttctatttgtttt

SEQ ID NO: 597392 - DNA, 25 bp, Rattus norvegicus
tctggccctaatcactaggtcgggt

SEQ ID NO: 597393 - DNA, 25 bp, Rattus norvegicus
tctggccctaatgactaggtcgggt

SEQ ID NO: 597394 - DNA, 25 bp, Rattus norvegicus
tctggccctccaaggttctatagag

SEQ ID NO: 597395 - DNA, 25 bp, Rattus norvegicus
tctggccctccacgtgttggcaaaa

SEQ ID NO: 597396 - DNA, 25 bp, Rattus norvegicus
tctggccctccaggtgttggcaaaa

SEQ ID NO: 597397 - DNA, 25 bp, Rattus norvegicus
tctggccctccatggttctatagag

SEQ ID NO: 597398 - DNA, 25 bp, Rattus norvegicus
tctggccctgtgaacttttgggata

SEQ ID NO: 597399 - DNA, 25 bp, Rattus norvegicus
tctggccctgtgtacttttgggata

SEQ ID NO: 597400 - DNA, 25 bp, Rattus norvegicus
tctggccggcttcacacactgaaga

SEQ ID NO: 597401 - DNA, 25 bp, Rattus norvegicus
tctggccggcttgacacactgaaga

SEQ ID NO: 597402 - DNA, 25 bp, Rattus norvegicus
tctggccgtattcagcactgggact

SEQ ID NO: 597403 - DNA, 25 bp, Rattus norvegicus
tctggccgtattgagcactgggact

SEQ ID NO: 597404 - DNA, 25 bp, Rattus norvegicus
tctggcctacagctgcagactgttt

SEQ ID NO: 597405 - DNA, 25 bp, Rattus norvegicus
tctggcctacaggtgcagactgttt

SEQ ID NO: 597406 - DNA, 25 bp, Rattus norvegicus
tctggcctcacccaggtatgtggac

SEQ ID NO: 597407 - DNA, 25 bp, Rattus norvegicus
tctggcctcaccgaggtatgtggac

SEQ ID NO: 597408 - DNA, 25 bp, Rattus norvegicus
tctggcctcagcaaacatctgtata

SEQ ID NO: 597409 - DNA, 25 bp, Rattus norvegicus
tctggcctcagctaacatctgtata

SEQ ID NO: 597410 - DNA, 25 bp, Rattus norvegicus
tctggcctccatccacacaggggta

SEQ ID NO: 597411 - DNA, 25 bp, Rattus norvegicus
tctggcctccatgcacacaggggta

SEQ ID NO: 597412 - DNA, 25 bp, Rattus norvegicus
tctggcctcctcatgtgttaaatag

SEQ ID NO: 597413 - DNA, 25 bp, Rattus norvegicus
tctggcctcctcttgtgttaaatag

SEQ ID NO: 597414 - DNA, 25 bp, Rattus norvegicus
tctggcctcctgagacagtatttaa

SEQ ID NO: 597415 - DNA, 25 bp, Rattus norvegicus
tctggcctcctgtgacagtatttaa

SEQ ID NO: 597416 - DNA, 25 bp, Rattus norvegicus
tctggcctcgagactctaccagcat

SEQ ID NO: 597417 - DNA, 25 bp, Rattus norvegicus
tctggcctcgagtctctaccagcat

SEQ ID NO: 597418 - DNA, 25 bp, Rattus norvegicus
tctggcctctagcacaattcttcga

SEQ ID NO: 597419 - DNA, 25 bp, Rattus norvegicus
tctggcctctagctatgtgtgagct

SEQ ID NO: 597420 - DNA, 25 bp, Rattus norvegicus
tctggcctctaggacaattcttcga

SEQ ID NO: 597421 - DNA, 25 bp, Rattus norvegicus
tctggcctctaggtatgtgtgagct

SEQ ID NO: 597422 - DNA, 25 bp, Rattus norvegicus
tctggcctctctaagggaactggtc

SEQ ID NO: 597423 - DNA, 25 bp, Rattus norvegicus
tctggcctctcttagggaactggtc

SEQ ID NO: 597424 - DNA, 25 bp, Rattus norvegicus
tctggcctctggatcagtatcaatt

SEQ ID NO: 597425 - DNA, 25 bp, Rattus norvegicus
tctggcctctggatttggtttccaa

SEQ ID NO: 597426 - DNA, 25 bp, Rattus norvegicus
tctggcctctggttcagtatcaatt

SEQ ID NO: 597427 - DNA, 25 bp, Rattus norvegicus
tctggcctctggttttggtttccaa

SEQ ID NO: 597428 - DNA, 25 bp, Rattus norvegicus
tctggcctgagaaacaaagcaatgt

SEQ ID NO: 597429 - DNA, 25 bp, Rattus norvegicus
tctggcctgagatacaaagcaatgt

SEQ ID NO: 597430 - DNA, 25 bp, Rattus norvegicus
tctggcctgcagaggagactcatca

SEQ ID NO: 597431 - DNA, 25 bp, Rattus norvegicus
tctggcctgcagtggagactcatca

SEQ ID NO: 597432 - DNA, 25 bp, Rattus norvegicus
tctggcctgctgcacaagatccggg

SEQ ID NO: 597433 - DNA, 25 bp, Rattus norvegicus
tctggcctgctggacaagatccggg

SEQ ID NO: 597434 - DNA, 25 bp, Rattus norvegicus
tctggcctgggacgcccatgtatac

SEQ ID NO: 597435 - DNA, 25 bp, Rattus norvegicus
tctggcctgggaggcccatgtatac

SEQ ID NO: 597436 - DNA, 25 bp, Rattus norvegicus
tctggcctgggtaagtgtccatgcg

SEQ ID NO: 597437 - DNA, 25 bp, Rattus norvegicus
tctggcctgggttagtgtccatgcg

SEQ ID NO: 597438 - DNA, 25 bp, Rattus norvegicus
tctggccttataatcttcccacttt

SEQ ID NO: 597439 - DNA, 25 bp, Rattus norvegicus
tctggccttatattcttcccacttt

SEQ ID NO: 597440 - DNA, 25 bp, Rattus norvegicus
tctggccttcagctgtgaatgctgc

SEQ ID NO: 597441 - DNA, 25 bp, Rattus norvegicus
tctggccttcaggtgtgaatgctgc

SEQ ID NO: 597442 - DNA, 25 bp, Rattus norvegicus
tctggccttcatagtctccggcgaa

SEQ ID NO: 597443 - DNA, 25 bp, Rattus norvegicus
tctggccttcattgtctccggcgaa

SEQ ID NO: 597444 - DNA, 25 bp, Rattus norvegicus
tctggccttcccatggtacttggaa

SEQ ID NO: 597445 - DNA, 25 bp, Rattus norvegicus
tctggccttcccttggtacttggaa

SEQ ID NO: 597446 - DNA, 25 bp, Rattus norvegicus
tctggccttgtgctgtctttaagaa

SEQ ID NO: 597447 - DNA, 25 bp, Rattus norvegicus
tctggccttgtggtgtctttaagaa

SEQ ID NO: 597448 - DNA, 25 bp, Rattus norvegicus
tctggcctttgaccttttcttgaca

SEQ ID NO: 597449 - DNA, 25 bp, Rattus norvegicus
tctggcctttgagcttttcttgaca

SEQ ID NO: 597450 - DNA, 25 bp, Rattus norvegicus
tctggcctttgcatttcgtcctggt

SEQ ID NO: 597451 - DNA, 25 bp, Rattus norvegicus
tctggcctttgcttttcgtcctggt

SEQ ID NO: 597452 - DNA, 25 bp, Rattus norvegicus
tctggcgactaccaatgtcacgtct

SEQ ID NO: 597453 - DNA, 25 bp, Rattus norvegicus
tctggcgactacgaatgtcacgtct

SEQ ID NO: 597454 - DNA, 25 bp, Rattus norvegicus
tctggcgcacacagtggacttgaaa

SEQ ID NO: 597455 - DNA, 25 bp, Rattus norvegicus
tctggcgcacactgtggacttgaaa

SEQ ID NO: 597456 - DNA, 25 bp, Rattus norvegicus
tctggcgctggacttaccttgttaa

SEQ ID NO: 597457 - DNA, 25 bp, Rattus norvegicus
tctggcgctggagttaccttgttaa

SEQ ID NO: 597458 - DNA, 25 bp, Rattus norvegicus
tctggcgggttactgacgatctctt

SEQ ID NO: 597459 - DNA, 25 bp, Rattus norvegicus
tctggcgggttagtgacgatctctt

SEQ ID NO: 597460 - DNA, 25 bp, Rattus norvegicus
tctggcgtccaaccgattgcactac

SEQ ID NO: 597461 - DNA, 25 bp, Rattus norvegicus
tctggcgtccaagcgattgcactac

SEQ ID NO: 597462 - DNA, 25 bp, Rattus norvegicus
tctggctaagccctgggactgtaat

SEQ ID NO: 597463 - DNA, 25 bp, Rattus norvegicus
tctggctaagccgtgggactgtaat

SEQ ID NO: 597464 - DNA, 25 bp, Rattus norvegicus
tctggctaaggaacattctctcggc

SEQ ID NO: 597465 - DNA, 25 bp, Rattus norvegicus
tctggctaaggatcattctctcggc

SEQ ID NO: 597466 - DNA, 25 bp, Rattus norvegicus
tctggctaaggtcagggtgaaccac

SEQ ID NO: 597467 - DNA, 25 bp, Rattus norvegicus
tctggctaaggtgagggtgaaccac

SEQ ID NO: 597468 - DNA, 25 bp, Rattus norvegicus
tctggctaagtgatcttgctaactt

SEQ ID NO: 597469 - DNA, 25 bp, Rattus norvegicus
tctggctaagtgttcttgctaactt

SEQ ID NO: 597470 - DNA, 25 bp, Rattus norvegicus
tctggctaatggcaaatgactgaag

SEQ ID NO: 597471 - DNA, 25 bp, Rattus norvegicus
tctggctaatgggaaatgactgaag

SEQ ID NO: 597472 - DNA, 25 bp, Rattus norvegicus
tctggctacaacaggatggactcat

SEQ ID NO: 597473 - DNA, 25 bp, Rattus norvegicus
tctggctacaactggatggactcat

SEQ ID NO: 597474 - DNA, 25 bp, Rattus norvegicus
tctggctaccatattgttttgcatt

SEQ ID NO: 597475 - DNA, 25 bp, Rattus norvegicus
tctggctaccattttgttttgcatt

SEQ ID NO: 597476 - DNA, 25 bp, Rattus norvegicus
tctggctactacagtttcttctaac

SEQ ID NO: 597477 - DNA, 25 bp, Rattus norvegicus
tctggctactactgtttcttctaac

SEQ ID NO: 597478 - DNA, 25 bp, Rattus norvegicus
tctggctaggtcactgctgagtaca

SEQ ID NO: 597479 - DNA, 25 bp, Rattus norvegicus
tctggctaggtctctgctgagtaca

SEQ ID NO: 597480 - DNA, 25 bp, Rattus norvegicus
tctggctatagacgcctcaggcttt

SEQ ID NO: 597481 - DNA, 25 bp, Rattus norvegicus
tctggctatagaggcctcaggcttt

SEQ ID NO: 597482 - DNA, 25 bp, Rattus norvegicus
tctggctatcggctacactggtgtg

SEQ ID NO: 597483 - DNA, 25 bp, Rattus norvegicus
tctggctatcgggtacactggtgtg

SEQ ID NO: 597484 - DNA, 25 bp, Rattus norvegicus
tctggctcaaagaatggtctagaat

SEQ ID NO: 597485 - DNA, 25 bp, Rattus norvegicus
tctggctcaaagtatggtctagaat

SEQ ID NO: 597486 - DNA, 25 bp, Rattus norvegicus
tctggctcaggtagctcaaagcaca

SEQ ID NO: 597487 - DNA, 25 bp, Rattus norvegicus
tctggctcaggttgctcaaagcaca

SEQ ID NO: 597488 - DNA, 25 bp, Rattus norvegicus
tctggctcctgactgggacctcttg

SEQ ID NO: 597489 - DNA, 25 bp, Rattus norvegicus
tctggctcctgagtgggacctcttg

SEQ ID NO: 597490 - DNA, 25 bp, Rattus norvegicus
tctggctcctttactggctctggga

SEQ ID NO: 597491 - DNA, 25 bp, Rattus norvegicus
tctggctccttttctggctctggga

SEQ ID NO: 597492 - DNA, 25 bp, Rattus norvegicus
tctggctctaacagagtcacaggcc

SEQ ID NO: 597493 - DNA, 25 bp, Rattus norvegicus
tctggctctaactgagtcacaggcc

SEQ ID NO: 597494 - DNA, 25 bp, Rattus norvegicus
tctggctctgaaagcgcagactcag

SEQ ID NO: 597495 - DNA, 25 bp, Rattus norvegicus
tctggctctgaatgcgcagactcag

SEQ ID NO: 597496 - DNA, 25 bp, Rattus norvegicus
tctggctctgcgaacggtcagccga

SEQ ID NO: 597497 - DNA, 25 bp, Rattus norvegicus
tctggctctgcgtacggtcagccga

SEQ ID NO: 597498 - DNA, 25 bp, Rattus norvegicus
tctggctcttgccacacagcaggag

SEQ ID NO: 597499 - DNA, 25 bp, Rattus norvegicus
tctggctcttgcgacacagcaggag

SEQ ID NO: 597500 - DNA, 25 bp, Rattus norvegicus
tctggctgaaggacagacctttagg

SEQ ID NO: 597501 - DNA, 25 bp, Rattus norvegicus
tctggctgaaggtcagacctttagg

SEQ ID NO: 597502 - DNA, 25 bp, Rattus norvegicus
tctggctgacctatctactttaaaa

SEQ ID NO: 597503 - DNA, 25 bp, Rattus norvegicus
tctggctgacctttctactttaaaa

SEQ ID NO: 597504 - DNA, 25 bp, Rattus norvegicus
tctggctgagctctgttccgtacat

SEQ ID NO: 597505 - DNA, 25 bp, Rattus norvegicus
tctggctgagctgtgttccgtacat

SEQ ID NO: 597506 - DNA, 25 bp, Rattus norvegicus
tctggctgccttatcacctggtgaa

SEQ ID NO: 597507 - DNA, 25 bp, Rattus norvegicus
tctggctgccttttcacctggtgaa

SEQ ID NO: 597508 - DNA, 25 bp, Rattus norvegicus
tctggctgcgctactaggcaggaag

SEQ ID NO: 597509 - DNA, 25 bp, Rattus norvegicus
tctggctgcgcttctaggcaggaag

SEQ ID NO: 597510 - DNA, 25 bp, Rattus norvegicus
tctggctgctagaggcaatggctgc

SEQ ID NO: 597511 - DNA, 25 bp, Rattus norvegicus
tctggctgctagtggcaatggctgc

SEQ ID NO: 597512 - DNA, 25 bp, Rattus norvegicus
tctggctgctatcctgagagagctc

SEQ ID NO: 597513 - DNA, 25 bp, Rattus norvegicus
tctggctgctatgctgagagagctc

SEQ ID NO: 597514 - DNA, 25 bp, Rattus norvegicus
tctggctgctccacggtagttgcgt

SEQ ID NO: 597515 - DNA, 25 bp, Rattus norvegicus
tctggctgctcctcggtagttgcgt

SEQ ID NO: 597516 - DNA, 25 bp, Rattus norvegicus
tctggctgctggagagctagacttt

SEQ ID NO: 597517 - DNA, 25 bp, Rattus norvegicus
tctggctgctggtgagctagacttt

SEQ ID NO: 597518 - DNA, 25 bp, Rattus norvegicus
tctggctgcttccactgaaacatag

SEQ ID NO: 597519 - DNA, 25 bp, Rattus norvegicus
tctggctgcttcgactgaaacatag

SEQ ID NO: 597520 - DNA, 25 bp, Rattus norvegicus
tctggctggagcacctccctgggag

SEQ ID NO: 597521 - DNA, 25 bp, Rattus norvegicus
tctggctggagctcctccctgggag

SEQ ID NO: 597522 - DNA, 25 bp, Rattus norvegicus
tctggctggcttactatgggagtta

SEQ ID NO: 597523 - DNA, 25 bp, Rattus norvegicus
tctggctggctttctatgggagtta

SEQ ID NO: 597524 - DNA, 25 bp, Rattus norvegicus
tctggctgggtaacatgtacaagaa

SEQ ID NO: 597525 - DNA, 25 bp, Rattus norvegicus
tctggctgggtaagggactctttgt

SEQ ID NO: 597526 - DNA, 25 bp, Rattus norvegicus
tctggctgggtatcatgtacaagaa

SEQ ID NO: 597527 - DNA, 25 bp, Rattus norvegicus
tctggctgggtatgggactctttgt

SEQ ID NO: 597528 - DNA, 25 bp, Rattus norvegicus
tctggctgtctgagatctcactatg

SEQ ID NO: 597529 - DNA, 25 bp, Rattus norvegicus
tctggctgtctgtgatctcactatg

SEQ ID NO: 597530 - DNA, 25 bp, Rattus norvegicus
tctggctgtgctctctcacatatct

SEQ ID NO: 597531 - DNA, 25 bp, Rattus norvegicus
tctggctgtgctgtctcacatatct

SEQ ID NO: 597532 - DNA, 25 bp, Rattus norvegicus
tctggcttaacccaatcctacctta

SEQ ID NO: 597533 - DNA, 25 bp, Rattus norvegicus
tctggcttaaccgaatcctacctta

SEQ ID NO: 597534 - DNA, 25 bp, Rattus norvegicus
tctggcttaagactcacggacacat

SEQ ID NO: 597535 - DNA, 25 bp, Rattus norvegicus
tctggcttaagagtcacggacacat

SEQ ID NO: 597536 - DNA, 25 bp, Rattus norvegicus
tctggcttcagtctgtcatgttcaa

SEQ ID NO: 597537 - DNA, 25 bp, Rattus norvegicus
tctggcttcagtgtgtcatgttcaa

SEQ ID NO: 597538 - DNA, 25 bp, Rattus norvegicus
tctggcttccctatactgagttatg

SEQ ID NO: 597539 - DNA, 25 bp, Rattus norvegicus
tctggcttccctatgcacaggcgca

SEQ ID NO: 597540 - DNA, 25 bp, Rattus norvegicus
tctggcttccctttactgagttatg

SEQ ID NO: 597541 - DNA, 25 bp, Rattus norvegicus
tctggcttccctttgcacaggcgca

SEQ ID NO: 597542 - DNA, 25 bp, Rattus norvegicus
tctggcttcctacggctgggattaa

SEQ ID NO: 597543 - DNA, 25 bp, Rattus norvegicus
tctggcttcctagggctgggattaa

SEQ ID NO: 597544 - DNA, 25 bp, Rattus norvegicus
tctggcttctgaacatacttccaag

SEQ ID NO: 597545 - DNA, 25 bp, Rattus norvegicus
tctggcttctgatcatacttccaag

SEQ ID NO: 597546 - DNA, 25 bp, Rattus norvegicus
tctggcttcttccaccttcggaagg

SEQ ID NO: 597547 - DNA, 25 bp, Rattus norvegicus
tctggcttcttcgaccttcggaagg

SEQ ID NO: 597548 - DNA, 25 bp, Rattus norvegicus
tctggcttgcccagactggtgcagc

SEQ ID NO: 597549 - DNA, 25 bp, Rattus norvegicus
tctggcttgccctgactggtgcagc

SEQ ID NO: 597550 - DNA, 25 bp, Rattus norvegicus
tctggcttgtccagccgcgagaact

SEQ ID NO: 597551 - DNA, 25 bp, Rattus norvegicus
tctggcttgtcctgccgcgagaact

SEQ ID NO: 597552 - DNA, 25 bp, Rattus norvegicus
tctggcttgtttactgtggtattgt

SEQ ID NO: 597553 - DNA, 25 bp, Rattus norvegicus
tctggcttgttttctgtggtattgt

SEQ ID NO: 597554 - DNA, 25 bp, Rattus norvegicus
tctggctttattacacaagcacgaa

SEQ ID NO: 597555 - DNA, 25 bp, Rattus norvegicus
tctggctttattcctagtgtgtctt

SEQ ID NO: 597556 - DNA, 25 bp, Rattus norvegicus
tctggctttattgctagtgtgtctt

SEQ ID NO: 597557 - DNA, 25 bp, Rattus norvegicus
tctggctttatttcacaagcacgaa

SEQ ID NO: 597558 - DNA, 25 bp, Rattus norvegicus
tctggctttggaagagacttttaaa

SEQ ID NO: 597559 - DNA, 25 bp, Rattus norvegicus
tctggctttggatgagacttttaaa

SEQ ID NO: 597560 - DNA, 25 bp, Rattus norvegicus
tctggctttgtgattttcaaacctt

SEQ ID NO: 597561 - DNA, 25 bp, Rattus norvegicus
tctggctttgtgtttttcaaacctt

SEQ ID NO: 597562 - DNA, 25 bp, Rattus norvegicus
tctgggaaacctccctttagctgaa

SEQ ID NO: 597563 - DNA, 25 bp, Rattus norvegicus
tctgggaaacctgcctttagctgaa

SEQ ID NO: 597564 - DNA, 25 bp, Rattus norvegicus
tctgggaaagcaaagtgccctccgg

SEQ ID NO: 597565 - DNA, 25 bp, Rattus norvegicus
tctgggaaagcatagtgccctccgg

SEQ ID NO: 597566 - DNA, 25 bp, Rattus norvegicus
tctgggaactagcttggtgccctgc

SEQ ID NO: 597567 - DNA, 25 bp, Rattus norvegicus
tctgggaactaggttggtgccctgc

SEQ ID NO: 597568 - DNA, 25 bp, Rattus norvegicus
tctgggaagcccatagacttaccat

SEQ ID NO: 597569 - DNA, 25 bp, Rattus norvegicus
tctgggaagcccttagacttaccat

SEQ ID NO: 597570 - DNA, 25 bp, Rattus norvegicus
tctgggaagcgcacagcatctcaaa

SEQ ID NO: 597571 - DNA, 25 bp, Rattus norvegicus
tctgggaagcgctcagcatctcaaa

SEQ ID NO: 597572 - DNA, 25 bp, Rattus norvegicus
tctgggaagggcatataacaccgtt

SEQ ID NO: 597573 - DNA, 25 bp, Rattus norvegicus
tctgggaagggcttataacaccgtt

SEQ ID NO: 597574 - DNA, 25 bp, Rattus norvegicus
tctgggaatccgaaggccgggctct

SEQ ID NO: 597575 - DNA, 25 bp, Rattus norvegicus
tctgggaatccgtaggccgggctct

SEQ ID NO: 597576 - DNA, 25 bp, Rattus norvegicus
tctgggaatcttaccattcgcaggc

SEQ ID NO: 597577 - DNA, 25 bp, Rattus norvegicus
tctgggaatctttccattcgcaggc

SEQ ID NO: 597578 - DNA, 25 bp, Rattus norvegicus
tctgggacacagagctagtcatcat

SEQ ID NO: 597579 - DNA, 25 bp, Rattus norvegicus
tctgggacacagtgctagtcatcat

SEQ ID NO: 597580 - DNA, 25 bp, Rattus norvegicus
tctgggacagccaagactatataga

SEQ ID NO: 597581 - DNA, 25 bp, Rattus norvegicus
tctgggacagcctagactatataga

SEQ ID NO: 597582 - DNA, 25 bp, Rattus norvegicus
tctgggacccagctgtttccaaaag

SEQ ID NO: 597583 - DNA, 25 bp, Rattus norvegicus
tctgggacccaggtgtttccaaaag

SEQ ID NO: 597584 - DNA, 25 bp, Rattus norvegicus
tctgggaccccacttcataggatgt

SEQ ID NO: 597585 - DNA, 25 bp, Rattus norvegicus
tctgggaccccagttcataggatgt

SEQ ID NO: 597586 - DNA, 25 bp, Rattus norvegicus
tctgggacccgaacaagtgctccca

SEQ ID NO: 597587 - DNA, 25 bp, Rattus norvegicus
tctgggacccgatcaagtgctccca

SEQ ID NO: 597588 - DNA, 25 bp, Rattus norvegicus
tctgggacccggagttctcggaaga

SEQ ID NO: 597589 - DNA, 25 bp, Rattus norvegicus
tctgggacccggtgttctcggaaga

SEQ ID NO: 597590 - DNA, 25 bp, Rattus norvegicus
tctgggaccttcacgggctagatca

SEQ ID NO: 597591 - DNA, 25 bp, Rattus norvegicus
tctgggaccttctcgggctagatca

SEQ ID NO: 597592 - DNA, 25 bp, Rattus norvegicus
tctgggacgctcatgccttgttcaa

SEQ ID NO: 597593 - DNA, 25 bp, Rattus norvegicus
tctgggacgctcttgccttgttcaa

SEQ ID NO: 597594 - DNA, 25 bp, Rattus norvegicus
tctgggactcacatgcattacttgg

SEQ ID NO: 597595 - DNA, 25 bp, Rattus norvegicus
tctgggactcacttgcattacttgg

SEQ ID NO: 597596 - DNA, 25 bp, Rattus norvegicus
tctgggactgtgaaccatgcagcaa

SEQ ID NO: 597597 - DNA, 25 bp, Rattus norvegicus
tctgggactgtgtaccatgcagcaa

SEQ ID NO: 597598 - DNA, 25 bp, Rattus norvegicus
tctgggagacgaacaaggcctggtt

SEQ ID NO: 597599 - DNA, 25 bp, Rattus norvegicus
tctgggagacgatcaaggcctggtt

SEQ ID NO: 597600 - DNA, 25 bp, Rattus norvegicus
tctgggagcacgaatctcacacgat

SEQ ID NO: 597601 - DNA, 25 bp, Rattus norvegicus
tctgggagcacgtatctcacacgat

SEQ ID NO: 597602 - DNA, 25 bp, Rattus norvegicus
tctgggagcgggaccggcttaataa

SEQ ID NO: 597603 - DNA, 25 bp, Rattus norvegicus
tctgggagcgggtccggcttaataa

SEQ ID NO: 597604 - DNA, 25 bp, Rattus norvegicus
tctgggagctgaaaaacacctgaaa

SEQ ID NO: 597605 - DNA, 25 bp, Rattus norvegicus
tctgggagctgataaacacctgaaa

SEQ ID NO: 597606 - DNA, 25 bp, Rattus norvegicus
tctgggagcttactgcagcttgaca

SEQ ID NO: 597607 - DNA, 25 bp, Rattus norvegicus
tctgggagcttagtgcagcttgaca

SEQ ID NO: 597608 - DNA, 25 bp, Rattus norvegicus
tctgggagtccccagaacactacga

SEQ ID NO: 597609 - DNA, 25 bp, Rattus norvegicus
tctgggagtcccgagaacactacga

SEQ ID NO: 597610 - DNA, 25 bp, Rattus norvegicus
tctgggagttctagagtttcgccga

SEQ ID NO: 597611 - DNA, 25 bp, Rattus norvegicus
tctgggagttcttgagtttcgccga

SEQ ID NO: 597612 - DNA, 25 bp, Rattus norvegicus
tctgggataagaaaccttcgctgtt

SEQ ID NO: 597613 - DNA, 25 bp, Rattus norvegicus
tctgggataagataccttcgctgtt

SEQ ID NO: 597614 - DNA, 25 bp, Rattus norvegicus
tctgggataattatggtgcttggat

SEQ ID NO: 597615 - DNA, 25 bp, Rattus norvegicus
tctgggataattttggtgcttggat

SEQ ID NO: 597616 - DNA, 25 bp, Rattus norvegicus
tctgggatagtcactgttcttcatc

SEQ ID NO: 597617 - DNA, 25 bp, Rattus norvegicus
tctgggatagtctctgttcttcatc

SEQ ID NO: 597618 - DNA, 25 bp, Rattus norvegicus
tctgggatatttcccaccggtggta

SEQ ID NO: 597619 - DNA, 25 bp, Rattus norvegicus
tctgggatatttgccaccggtggta

SEQ ID NO: 597620 - DNA, 25 bp, Rattus norvegicus
tctgggatcccactctacctagact

SEQ ID NO: 597621 - DNA, 25 bp, Rattus norvegicus
tctgggatcccagtctacctagact

SEQ ID NO: 597622 - DNA, 25 bp, Rattus norvegicus
tctgggatgtgactgaccgtgatat

SEQ ID NO: 597623 - DNA, 25 bp, Rattus norvegicus
tctgggatgtgagtgaccgtgatat

SEQ ID NO: 597624 - DNA, 25 bp, Rattus norvegicus
tctgggatttacaaacctctctcta

SEQ ID NO: 597625 - DNA, 25 bp, Rattus norvegicus
tctgggatttactaacctctctcta

SEQ ID NO: 597626 - DNA, 25 bp, Rattus norvegicus
tctgggatttatcttcctaccctca

SEQ ID NO: 597627 - DNA, 25 bp, Rattus norvegicus
tctgggatttatgttcctaccctca

SEQ ID NO: 597628 - DNA, 25 bp, Rattus norvegicus
tctgggcaaaataaatttcattgtt

SEQ ID NO: 597629 - DNA, 25 bp, Rattus norvegicus
tctgggcaaaattaatttcattgtt

SEQ ID NO: 597630 - DNA, 25 bp, Rattus norvegicus
tctgggcaacggcactttggaaata

SEQ ID NO: 597631 - DNA, 25 bp, Rattus norvegicus
tctgggcaacgggactttggaaata

SEQ ID NO: 597632 - DNA, 25 bp, Rattus norvegicus
tctgggcaatgcaggtgaacaaaca

SEQ ID NO: 597633 - DNA, 25 bp, Rattus norvegicus
tctgggcaatgctggtgaacaaaca

SEQ ID NO: 597634 - DNA, 25 bp, Rattus norvegicus
tctgggcacaccatatctggcactc

SEQ ID NO: 597635 - DNA, 25 bp, Rattus norvegicus
tctgggcacaccttatctggcactc

SEQ ID NO: 597636 - DNA, 25 bp, Rattus norvegicus
tctgggcaccacattgttttgtagc

SEQ ID NO: 597637 - DNA, 25 bp, Rattus norvegicus
tctgggcaccactttgttttgtagc

SEQ ID NO: 597638 - DNA, 25 bp, Rattus norvegicus
tctgggcacccaaactcttgtatat

SEQ ID NO: 597639 - DNA, 25 bp, Rattus norvegicus
tctgggcacccatactcttgtatat

SEQ ID NO: 597640 - DNA, 25 bp, Rattus norvegicus
tctgggcaccgcactggaagcacta

SEQ ID NO: 597641 - DNA, 25 bp, Rattus norvegicus
tctgggcaccgctctggaagcacta

SEQ ID NO: 597642 - DNA, 25 bp, Rattus norvegicus
tctgggcacgacacatagtacactt

SEQ ID NO: 597643 - DNA, 25 bp, Rattus norvegicus
tctgggcacgactcatagtacactt

SEQ ID NO: 597644 - DNA, 25 bp, Rattus norvegicus
tctgggcagatgctggtccattgat

SEQ ID NO: 597645 - DNA, 25 bp, Rattus norvegicus
tctgggcagatggtggtccattgat

SEQ ID NO: 597646 - DNA, 25 bp, Rattus norvegicus
tctgggcagcttccctaagtgcagg

SEQ ID NO: 597647 - DNA, 25 bp, Rattus norvegicus
tctgggcagcttgcctaagtgcagg

SEQ ID NO: 597648 - DNA, 25 bp, Rattus norvegicus
tctgggcagtacaaagggaaattgt

SEQ ID NO: 597649 - DNA, 25 bp, Rattus norvegicus
tctgggcagtactaagggaaattgt

SEQ ID NO: 597650 - DNA, 25 bp, Rattus norvegicus
tctgggcatcagctgtcaggctgct

SEQ ID NO: 597651 - DNA, 25 bp, Rattus norvegicus
tctgggcatcaggtgtcaggctgct

SEQ ID NO: 597652 - DNA, 25 bp, Rattus norvegicus
tctgggcatctgcaggtggcactca

SEQ ID NO: 597653 - DNA, 25 bp, Rattus norvegicus
tctgggcatctggaggtggcactca

SEQ ID NO: 597654 - DNA, 25 bp, Rattus norvegicus
tctgggccaaagactgccaagcatt

SEQ ID NO: 597655 - DNA, 25 bp, Rattus norvegicus
tctgggccaaagtctgccaagcatt

SEQ ID NO: 597656 - DNA, 25 bp, Rattus norvegicus
tctgggccactcagctcaaggagag

SEQ ID NO: 597657 - DNA, 25 bp, Rattus norvegicus
tctgggccactctgctcaaggagag

SEQ ID NO: 597658 - DNA, 25 bp, Rattus norvegicus
tctgggccaggtcatgtcttatttt

SEQ ID NO: 597659 - DNA, 25 bp, Rattus norvegicus
tctgggccaggtgatgtcttatttt

SEQ ID NO: 597660 - DNA, 25 bp, Rattus norvegicus
tctgggccataccaatagcctggaa

SEQ ID NO: 597661 - DNA, 25 bp, Rattus norvegicus
tctgggccatacgaatagcctggaa

SEQ ID NO: 597662 - DNA, 25 bp, Rattus norvegicus
tctgggccattgcacgggacccaaa

SEQ ID NO: 597663 - DNA, 25 bp, Rattus norvegicus
tctgggccattggacgggacccaaa

SEQ ID NO: 597664 - DNA, 25 bp, Rattus norvegicus
tctgggcccagaatcaatttgaagt

SEQ ID NO: 597665 - DNA, 25 bp, Rattus norvegicus
tctgggcccagattcaatttgaagt

SEQ ID NO: 597666 - DNA, 25 bp, Rattus norvegicus
tctgggcccgggacacacacacatt

SEQ ID NO: 597667 - DNA, 25 bp, Rattus norvegicus
tctgggcccgggtcacacacacatt

SEQ ID NO: 597668 - DNA, 25 bp, Rattus norvegicus
tctgggccctccatatatgtggctt

SEQ ID NO: 597669 - DNA, 25 bp, Rattus norvegicus
tctgggccctccttatatgtggctt

SEQ ID NO: 597670 - DNA, 25 bp, Rattus norvegicus
tctgggcctctaaccatgtttggaa

SEQ ID NO: 597671 - DNA, 25 bp, Rattus norvegicus
tctgggcctctatccatgtttggaa

SEQ ID NO: 597672 - DNA, 25 bp, Rattus norvegicus
tctgggcctgaaccgttactgctgc

SEQ ID NO: 597673 - DNA, 25 bp, Rattus norvegicus
tctgggcctgaagcgttactgctgc

SEQ ID NO: 597674 - DNA, 25 bp, Rattus norvegicus
tctgggcgagggacctatcaatcag

SEQ ID NO: 597675 - DNA, 25 bp, Rattus norvegicus
tctgggcgagggtcctatcaatcag

SEQ ID NO: 597676 - DNA, 25 bp, Rattus norvegicus
tctgggcgcacacccatcatgtgtg

SEQ ID NO: 597677 - DNA, 25 bp, Rattus norvegicus
tctgggcgcacagccatcatgtgtg

SEQ ID NO: 597678 - DNA, 25 bp, Rattus norvegicus
tctgggcgccagctacgatgcttgc

SEQ ID NO: 597679 - DNA, 25 bp, Rattus norvegicus
tctgggcgccaggtacgatgcttgc

SEQ ID NO: 597680 - DNA, 25 bp, Rattus norvegicus
tctgggctacaaaggaaactcaaag

SEQ ID NO: 597681 - DNA, 25 bp, Rattus norvegicus
tctgggctacaaagtatgatccatc

SEQ ID NO: 597682 - DNA, 25 bp, Rattus norvegicus
tctgggctacaatggaaactcaaag

SEQ ID NO: 597683 - DNA, 25 bp, Rattus norvegicus
tctgggctacaatgtatgatccatc

SEQ ID NO: 597684 - DNA, 25 bp, Rattus norvegicus
tctgggctagggaccggctgtccct

SEQ ID NO: 597685 - DNA, 25 bp, Rattus norvegicus
tctgggctagggtccggctgtccct

SEQ ID NO: 597686 - DNA, 25 bp, Rattus norvegicus
tctgggctatcactagactgtccac

SEQ ID NO: 597687 - DNA, 25 bp, Rattus norvegicus
tctgggctatcagtagactgtccac

SEQ ID NO: 597688 - DNA, 25 bp, Rattus norvegicus
tctgggctcagtcaagcatgggcct

SEQ ID NO: 597689 - DNA, 25 bp, Rattus norvegicus
tctgggctcagtgaagcatgggcct

SEQ ID NO: 597690 - DNA, 25 bp, Rattus norvegicus
tctgggctccatcgcaaggatgact

SEQ ID NO: 597691 - DNA, 25 bp, Rattus norvegicus
tctgggctccatggcaaggatgact

SEQ ID NO: 597692 - DNA, 25 bp, Rattus norvegicus
tctgggctcctgcattcgtggtaca

SEQ ID NO: 597693 - DNA, 25 bp, Rattus norvegicus
tctgggctcctggattcgtggtaca

SEQ ID NO: 597694 - DNA, 25 bp, Rattus norvegicus
tctgggctccttacaagctcttgga

SEQ ID NO: 597695 - DNA, 25 bp, Rattus norvegicus
tctgggctcctttcaagctcttgga

SEQ ID NO: 597696 - DNA, 25 bp, Rattus norvegicus
tctgggctcgataatcgcctttgaa

SEQ ID NO: 597697 - DNA, 25 bp, Rattus norvegicus
tctgggctcgattatcgcctttgaa

SEQ ID NO: 597698 - DNA, 25 bp, Rattus norvegicus
tctgggctctggactctgggctgac

SEQ ID NO: 597699 - DNA, 25 bp, Rattus norvegicus
tctgggctctggtctctgggctgac

SEQ ID NO: 597700 - DNA, 25 bp, Rattus norvegicus
tctgggctgccaaccctgggaagaa

SEQ ID NO: 597701 - DNA, 25 bp, Rattus norvegicus
tctgggctgccatccctgggaagaa

SEQ ID NO: 597702 - DNA, 25 bp, Rattus norvegicus
tctgggctggctatgggtacaaact

SEQ ID NO: 597703 - DNA, 25 bp, Rattus norvegicus
tctgggctggctttgggtacaaact

SEQ ID NO: 597704 - DNA, 25 bp, Rattus norvegicus
tctgggctgtgtcctgatcatgtac

SEQ ID NO: 597705 - DNA, 25 bp, Rattus norvegicus
tctgggctgtgtgctgatcatgtac

SEQ ID NO: 597706 - DNA, 25 bp, Rattus norvegicus
tctgggcttactaatgcattccttc

SEQ ID NO: 597707 - DNA, 25 bp, Rattus norvegicus
tctgggcttacttatgcattccttc

SEQ ID NO: 597708 - DNA, 25 bp, Rattus norvegicus
tctgggcttgcaacttgttgtgcat

SEQ ID NO: 597709 - DNA, 25 bp, Rattus norvegicus
tctgggcttgcatcttgttgtgcat

SEQ ID NO: 597710 - DNA, 25 bp, Rattus norvegicus
tctgggctttgaatcgtctgtgata

SEQ ID NO: 597711 - DNA, 25 bp, Rattus norvegicus
tctgggctttgattcgtctgtgata

SEQ ID NO: 597712 - DNA, 25 bp, Rattus norvegicus
tctgggtaatgtatgctccttgcgg

SEQ ID NO: 597713 - DNA, 25 bp, Rattus norvegicus
tctgggtaatgtttgctccttgcgg

SEQ ID NO: 597714 - DNA, 25 bp, Rattus norvegicus
tctgggtaggccctggtcactgaca

SEQ ID NO: 597715 - DNA, 25 bp, Rattus norvegicus
tctgggtaggccgtggtcactgaca

SEQ ID NO: 597716 - DNA, 25 bp, Rattus norvegicus
tctgggtcatctatatggcccaaat

SEQ ID NO: 597717 - DNA, 25 bp, Rattus norvegicus
tctgggtcatctttatggcccaaat

SEQ ID NO: 597718 - DNA, 25 bp, Rattus norvegicus
tctgggtccatccttgggtaactgc

SEQ ID NO: 597719 - DNA, 25 bp, Rattus norvegicus
tctgggtccatcgttgggtaactgc

SEQ ID NO: 597720 - DNA, 25 bp, Rattus norvegicus
tctgggtccgacaccgagagtgaaa

SEQ ID NO: 597721 - DNA, 25 bp, Rattus norvegicus
tctgggtccgactccgagagtgaaa

SEQ ID NO: 597722 - DNA, 25 bp, Rattus norvegicus
tctgggtcgagtagccaagctctta

SEQ ID NO: 597723 - DNA, 25 bp, Rattus norvegicus
tctgggtcgagttgccaagctctta

SEQ ID NO: 597724 - DNA, 25 bp, Rattus norvegicus
tctgggtctagcctcgtatattgta

SEQ ID NO: 597725 - DNA, 25 bp, Rattus norvegicus
tctgggtctagcgtcgtatattgta

SEQ ID NO: 597726 - DNA, 25 bp, Rattus norvegicus
tctgggtctcctacgagtgttaata

SEQ ID NO: 597727 - DNA, 25 bp, Rattus norvegicus
tctgggtctccttcgagtgttaata

SEQ ID NO: 597728 - DNA, 25 bp, Rattus norvegicus
tctgggtctggaaagaaggccacct

SEQ ID NO: 597729 - DNA, 25 bp, Rattus norvegicus
tctgggtctggatagaaggccacct

SEQ ID NO: 597730 - DNA, 25 bp, Rattus norvegicus
tctgggtcttttcttcaagttttgt

SEQ ID NO: 597731 - DNA, 25 bp, Rattus norvegicus
tctgggtcttttgttcaagttttgt

SEQ ID NO: 597732 - DNA, 25 bp, Rattus norvegicus
tctgggtgaagaccaatcagctgca

SEQ ID NO: 597733 - DNA, 25 bp, Rattus norvegicus
tctgggtgaagagcaatcagctgca

SEQ ID NO: 597734 - DNA, 25 bp, Rattus norvegicus
tctgggtgagcaagtcttctaccgc

SEQ ID NO: 597735 - DNA, 25 bp, Rattus norvegicus
tctgggtgagcatgtcttctaccgc

SEQ ID NO: 597736 - DNA, 25 bp, Rattus norvegicus
tctgggtgatcaaagcctctgctgc

SEQ ID NO: 597737 - DNA, 25 bp, Rattus norvegicus
tctgggtgatcatagcctctgctgc

SEQ ID NO: 597738 - DNA, 25 bp, Rattus norvegicus
tctgggtggcacaaagtacatctct

SEQ ID NO: 597739 - DNA, 25 bp, Rattus norvegicus
tctgggtggcactaagtacatctct

SEQ ID NO: 597740 - DNA, 25 bp, Rattus norvegicus
tctgggtgtcttcgtcttttatttt

SEQ ID NO: 597741 - DNA, 25 bp, Rattus norvegicus
tctgggtgtcttggtcttttatttt

SEQ ID NO: 597742 - DNA, 25 bp, Rattus norvegicus
tctgggtgtgacagatgagtgtcaa

SEQ ID NO: 597743 - DNA, 25 bp, Rattus norvegicus
tctgggtgtgactgatgagtgtcaa

SEQ ID NO: 597744 - DNA, 25 bp, Rattus norvegicus
tctgggtgttcacagggaatctccc

SEQ ID NO: 597745 - DNA, 25 bp, Rattus norvegicus
tctgggtgttcagagggaatctccc

SEQ ID NO: 597746 - DNA, 25 bp, Rattus norvegicus
tctgggttactcagtgtcctggaag

SEQ ID NO: 597747 - DNA, 25 bp, Rattus norvegicus
tctgggttactctgtgtcctggaag

SEQ ID NO: 597748 - DNA, 25 bp, Rattus norvegicus
tctgggttcctgctgggccataaga

SEQ ID NO: 597749 - DNA, 25 bp, Rattus norvegicus
tctgggttcctggtgggccataaga

SEQ ID NO: 597750 - DNA, 25 bp, Rattus norvegicus
tctgggttctgcaagatcctttctg

SEQ ID NO: 597751 - DNA, 25 bp, Rattus norvegicus
tctgggttctgctagatcctttctg

SEQ ID NO: 597752 - DNA, 25 bp, Rattus norvegicus
tctgggtttgctctagacatcgaaa

SEQ ID NO: 597753 - DNA, 25 bp, Rattus norvegicus
tctgggtttgctgtagacatcgaaa

SEQ ID NO: 597754 - DNA, 25 bp, Rattus norvegicus
tctgggttttccacaaattcctcat

SEQ ID NO: 597755 - DNA, 25 bp, Rattus norvegicus
tctgggttttcctcaaattcctcat

SEQ ID NO: 597756 - DNA, 25 bp, Rattus norvegicus
tctgggtttttcactgtggttattc

SEQ ID NO: 597757 - DNA, 25 bp, Rattus norvegicus
tctgggtttttctctgtggttattc

SEQ ID NO: 597758 - DNA, 25 bp, Rattus norvegicus
tctggtaacctgctactgtttttgt

SEQ ID NO: 597759 - DNA, 25 bp, Rattus norvegicus
tctggtaacctggtactgtttttgt

SEQ ID NO: 597760 - DNA, 25 bp, Rattus norvegicus
tctggtaatagaactgtgtgccttt

SEQ ID NO: 597761 - DNA, 25 bp, Rattus norvegicus
tctggtaatagatctgtgtgccttt

SEQ ID NO: 597762 - DNA, 25 bp, Rattus norvegicus
tctggtaattccaaccgaggcttca

SEQ ID NO: 597763 - DNA, 25 bp, Rattus norvegicus
tctggtaattcctaccgaggcttca

SEQ ID NO: 597764 - DNA, 25 bp, Rattus norvegicus
tctggtacctccagatgggtgcaca

SEQ ID NO: 597765 - DNA, 25 bp, Rattus norvegicus
tctggtacctcctgatgggtgcaca

SEQ ID NO: 597766 - DNA, 25 bp, Rattus norvegicus
tctggtactcttatcttcttaactt

SEQ ID NO: 597767 - DNA, 25 bp, Rattus norvegicus
tctggtactcttttcttcttaactt

SEQ ID NO: 597768 - DNA, 25 bp, Rattus norvegicus
tctggtactgccatgcggttaccaa

SEQ ID NO: 597769 - DNA, 25 bp, Rattus norvegicus
tctggtactgccttgcggttaccaa

SEQ ID NO: 597770 - DNA, 25 bp, Rattus norvegicus
tctggtactggtatgatccggaaat

SEQ ID NO: 597771 - DNA, 25 bp, Rattus norvegicus
tctggtactggtttgatccggaaat

SEQ ID NO: 597772 - DNA, 25 bp, Rattus norvegicus
tctggtactgtaaatggtgcccttt

SEQ ID NO: 597773 - DNA, 25 bp, Rattus norvegicus
tctggtactgtatatggtgcccttt

SEQ ID NO: 597774 - DNA, 25 bp, Rattus norvegicus
tctggtactttgagtcgcagctgaa

SEQ ID NO: 597775 - DNA, 25 bp, Rattus norvegicus
tctggtactttgtgtcgcagctgaa

SEQ ID NO: 597776 - DNA, 25 bp, Rattus norvegicus
tctggtatagtaattcagtgttcta

SEQ ID NO: 597777 - DNA, 25 bp, Rattus norvegicus
tctggtatagtatttcagtgttcta

SEQ ID NO: 597778 - DNA, 25 bp, Rattus norvegicus
tctggtatcaccacgtgttagcatt

SEQ ID NO: 597779 - DNA, 25 bp, Rattus norvegicus
tctggtatcacctcgtgttagcatt

SEQ ID NO: 597780 - DNA, 25 bp, Rattus norvegicus
tctggtatccagaacctacagggaa

SEQ ID NO: 597781 - DNA, 25 bp, Rattus norvegicus
tctggtatccagtacctacagggaa

SEQ ID NO: 597782 - DNA, 25 bp, Rattus norvegicus
tctggtcaagtacaagccgctcaag

SEQ ID NO: 597783 - DNA, 25 bp, Rattus norvegicus
tctggtcaagtagaagccgctcaag

SEQ ID NO: 597784 - DNA, 25 bp, Rattus norvegicus
tctggtcaccaacagctgttagctg

SEQ ID NO: 597785 - DNA, 25 bp, Rattus norvegicus
tctggtcaccaagagctgttagctg

SEQ ID NO: 597786 - DNA, 25 bp, Rattus norvegicus
tctggtcacccacgctcacagtggg

SEQ ID NO: 597787 - DNA, 25 bp, Rattus norvegicus
tctggtcacccaggctcacagtggg

SEQ ID NO: 597788 - DNA, 25 bp, Rattus norvegicus
tctggtcacttccaagccacagtgg

SEQ ID NO: 597789 - DNA, 25 bp, Rattus norvegicus
tctggtcacttcgaagccacagtgg

SEQ ID NO: 597790 - DNA, 25 bp, Rattus norvegicus
tctggtcagaagctttaggctatgc

SEQ ID NO: 597791 - DNA, 25 bp, Rattus norvegicus
tctggtcagaaggtttaggctatgc

SEQ ID NO: 597792 - DNA, 25 bp, Rattus norvegicus
tctggtcagtagaggaattcgattt

SEQ ID NO: 597793 - DNA, 25 bp, Rattus norvegicus
tctggtcagtagtggaattcgattt

SEQ ID NO: 597794 - DNA, 25 bp, Rattus norvegicus
tctggtcatcgacaaagcgtagcgc

SEQ ID NO: 597795 - DNA, 25 bp, Rattus norvegicus
tctggtcatcgagaaagcgtagcgc

SEQ ID NO: 597796 - DNA, 25 bp, Rattus norvegicus
tctggtcatggcactcttgagacaa

SEQ ID NO: 597797 - DNA, 25 bp, Rattus norvegicus
tctggtcatggctctcttgagacaa

SEQ ID NO: 597798 - DNA, 25 bp, Rattus norvegicus
tctggtcatttccttctgacatgtt

SEQ ID NO: 597799 - DNA, 25 bp, Rattus norvegicus
tctggtcatttcgttctgacatgtt

SEQ ID NO: 597800 - DNA, 25 bp, Rattus norvegicus
tctggtccaaaactggcccaaaatt

SEQ ID NO: 597801 - DNA, 25 bp, Rattus norvegicus
tctggtccaaaagtggcccaaaatt

SEQ ID NO: 597802 - DNA, 25 bp, Rattus norvegicus
tctggtccaaatccactgtggctag

SEQ ID NO: 597803 - DNA, 25 bp, Rattus norvegicus
tctggtccaaatgcactgtggctag

SEQ ID NO: 597804 - DNA, 25 bp, Rattus norvegicus
tctggtccacctctatctgggagaa

SEQ ID NO: 597805 - DNA, 25 bp, Rattus norvegicus
tctggtccacctgtatctgggagaa

SEQ ID NO: 597806 - DNA, 25 bp, Rattus norvegicus
tctggtccacgtaggtgacgagctc

SEQ ID NO: 597807 - DNA, 25 bp, Rattus norvegicus
tctggtccacgttggtgacgagctc

SEQ ID NO: 597808 - DNA, 25 bp, Rattus norvegicus
tctggtcccatgctggcttcaactg

SEQ ID NO: 597809 - DNA, 25 bp, Rattus norvegicus
tctggtcccatggtggcttcaactg

SEQ ID NO: 597810 - DNA, 25 bp, Rattus norvegicus
tctggtccccttatgttcagggaat

SEQ ID NO: 597811 - DNA, 25 bp, Rattus norvegicus
tctggtccccttttgttcagggaat

SEQ ID NO: 597812 - DNA, 25 bp, Rattus norvegicus
tctggtcctctcctagagcagaaag

SEQ ID NO: 597813 - DNA, 25 bp, Rattus norvegicus
tctggtcctctcgtagagcagaaag

SEQ ID NO: 597814 - DNA, 25 bp, Rattus norvegicus
tctggtcctgccattctgtgaaagc

SEQ ID NO: 597815 - DNA, 25 bp, Rattus norvegicus
tctggtcctgcctttctgtgaaagc

SEQ ID NO: 597816 - DNA, 25 bp, Rattus norvegicus
tctggtccttttaacaactactgaa

SEQ ID NO: 597817 - DNA, 25 bp, Rattus norvegicus
tctggtcctttttacaactactgaa

SEQ ID NO: 597818 - DNA, 25 bp, Rattus norvegicus
tctggtcgagagaaggtcaccggaa

SEQ ID NO: 597819 - DNA, 25 bp, Rattus norvegicus
tctggtcgagagtaggtcaccggaa

SEQ ID NO: 597820 - DNA, 25 bp, Rattus norvegicus
tctggtctcaatacccggctcaagg

SEQ ID NO: 597821 - DNA, 25 bp, Rattus norvegicus
tctggtctcaattcccggctcaagg

SEQ ID NO: 597822 - DNA, 25 bp, Rattus norvegicus
tctggtctcagtcttggactttgtt

SEQ ID NO: 597823 - DNA, 25 bp, Rattus norvegicus
tctggtctcagtgttggactttgtt

SEQ ID NO: 597824 - DNA, 25 bp, Rattus norvegicus
tctggtctccccactataaggagct

SEQ ID NO: 597825 - DNA, 25 bp, Rattus norvegicus
tctggtctcccctctataaggagct

SEQ ID NO: 597826 - DNA, 25 bp, Rattus norvegicus
tctggtctccctatggatcttaaaa

SEQ ID NO: 597827 - DNA, 25 bp, Rattus norvegicus
tctggtctccctttggatcttaaaa

SEQ ID NO: 597828 - DNA, 25 bp, Rattus norvegicus
tctggtctgagcatctggctatgaa

SEQ ID NO: 597829 - DNA, 25 bp, Rattus norvegicus
tctggtctgagcttctggctatgaa

SEQ ID NO: 597830 - DNA, 25 bp, Rattus norvegicus
tctggtctgtttattctgtttcccg

SEQ ID NO: 597831 - DNA, 25 bp, Rattus norvegicus
tctggtctgttttttctgtttcccg

SEQ ID NO: 597832 - DNA, 25 bp, Rattus norvegicus
tctggtcttgtaaaacatactgcaa

SEQ ID NO: 597833 - DNA, 25 bp, Rattus norvegicus
tctggtcttgtataacatactgcaa

SEQ ID NO: 597834 - DNA, 25 bp, Rattus norvegicus
tctggtgacacacgacacacattca

SEQ ID NO: 597835 - DNA, 25 bp, Rattus norvegicus
tctggtgacacaggacacacattca

SEQ ID NO: 597836 - DNA, 25 bp, Rattus norvegicus
tctggtgaccagaattcttccctcc

SEQ ID NO: 597837 - DNA, 25 bp, Rattus norvegicus
tctggtgaccagtattcttccctcc

SEQ ID NO: 597838 - DNA, 25 bp, Rattus norvegicus
tctggtgacccgagaggctgttaca

SEQ ID NO: 597839 - DNA, 25 bp, Rattus norvegicus
tctggtgacccgtgaggctgttaca

SEQ ID NO: 597840 - DNA, 25 bp, Rattus norvegicus
tctggtgagtcgcagtacattcaac

SEQ ID NO: 597841 - DNA, 25 bp, Rattus norvegicus
tctggtgagtcggagtacattcaac

SEQ ID NO: 597842 - DNA, 25 bp, Rattus norvegicus
tctggtgataaaacccaaagcacgg

SEQ ID NO: 597843 - DNA, 25 bp, Rattus norvegicus
tctggtgataaatcccaaagcacgg

SEQ ID NO: 597844 - DNA, 25 bp, Rattus norvegicus
tctggtgcaccacgatgtccccatg

SEQ ID NO: 597845 - DNA, 25 bp, Rattus norvegicus
tctggtgcaccaggatgtccccatg

SEQ ID NO: 597846 - DNA, 25 bp, Rattus norvegicus
tctggtgctgcgagtggagtaccca

SEQ ID NO: 597847 - DNA, 25 bp, Rattus norvegicus
tctggtgctgcgtgtggagtaccca

SEQ ID NO: 597848 - DNA, 25 bp, Rattus norvegicus
tctggtggaaaacgcccacacccga

SEQ ID NO: 597849 - DNA, 25 bp, Rattus norvegicus
tctggtggaaaaggcccacacccga

SEQ ID NO: 597850 - DNA, 25 bp, Rattus norvegicus
tctggtggccaacgacaaccaataa

SEQ ID NO: 597851 - DNA, 25 bp, Rattus norvegicus
tctggtggccaaggacaaccaataa

SEQ ID NO: 597852 - DNA, 25 bp, Rattus norvegicus
tctggtggccatagccctagagtaa

SEQ ID NO: 597853 - DNA, 25 bp, Rattus norvegicus
tctggtggccattgccctagagtaa

SEQ ID NO: 597854 - DNA, 25 bp, Rattus norvegicus
tctggtggctgactgcccaaactaa

SEQ ID NO: 597855 - DNA, 25 bp, Rattus norvegicus
tctggtggctgagtgcccaaactaa

SEQ ID NO: 597856 - DNA, 25 bp, Rattus norvegicus
tctggtgggacaattccctcagatg

SEQ ID NO: 597857 - DNA, 25 bp, Rattus norvegicus
tctggtgggacatttccctcagatg

SEQ ID NO: 597858 - DNA, 25 bp, Rattus norvegicus
tctggtgggcctcgttggtataaaa

SEQ ID NO: 597859 - DNA, 25 bp, Rattus norvegicus
tctggtgggcctggttggtataaaa

SEQ ID NO: 597860 - DNA, 25 bp, Rattus norvegicus
tctggtgggtcacttagcctctcac

SEQ ID NO: 597861 - DNA, 25 bp, Rattus norvegicus
tctggtgggtcagttagcctctcac

SEQ ID NO: 597862 - DNA, 25 bp, Rattus norvegicus
tctggtggtcagctttgccaacaag

SEQ ID NO: 597863 - DNA, 25 bp, Rattus norvegicus
tctggtggtcaggtttgccaacaag

SEQ ID NO: 597864 - DNA, 25 bp, Rattus norvegicus
tctggtgtacacactctttaataaa

SEQ ID NO: 597865 - DNA, 25 bp, Rattus norvegicus
tctggtgtacactctctttaataaa

SEQ ID NO: 597866 - DNA, 25 bp, Rattus norvegicus
tctggtgtcagcatgccttggaaac

SEQ ID NO: 597867 - DNA, 25 bp, Rattus norvegicus
tctggtgtcagcttgccttggaaac

SEQ ID NO: 597868 - DNA, 25 bp, Rattus norvegicus
tctggtgtccctaagagccttactc

SEQ ID NO: 597869 - DNA, 25 bp, Rattus norvegicus
tctggtgtcccttagagccttactc

SEQ ID NO: 597870 - DNA, 25 bp, Rattus norvegicus
tctggtgtcgaaaaggaggacccat

SEQ ID NO: 597871 - DNA, 25 bp, Rattus norvegicus
tctggtgtcgaataggaggacccat

SEQ ID NO: 597872 - DNA, 25 bp, Rattus norvegicus
tctggtgtcgcccagtcatcaaaaa

SEQ ID NO: 597873 - DNA, 25 bp, Rattus norvegicus
tctggtgtcgccgagtcatcaaaaa

SEQ ID NO: 597874 - DNA, 25 bp, Rattus norvegicus
tctggtgttcgtagagatccccttc

SEQ ID NO: 597875 - DNA, 25 bp, Rattus norvegicus
tctggtgttcgttgagatccccttc

SEQ ID NO: 597876 - DNA, 25 bp, Rattus norvegicus
tctggttacttcattctttatcatc

SEQ ID NO: 597877 - DNA, 25 bp, Rattus norvegicus
tctggttacttctttctttatcatc

SEQ ID NO: 597878 - DNA, 25 bp, Rattus norvegicus
tctggttcacccaaaggacattgat

SEQ ID NO: 597879 - DNA, 25 bp, Rattus norvegicus
tctggttcaccctaaggacattgat

SEQ ID NO: 597880 - DNA, 25 bp, Rattus norvegicus
tctggttcagtacagagccctccca

SEQ ID NO: 597881 - DNA, 25 bp, Rattus norvegicus
tctggttcagtagagagccctccca

SEQ ID NO: 597882 - DNA, 25 bp, Rattus norvegicus
tctggttccaggaaatacaatgccc

SEQ ID NO: 597883 - DNA, 25 bp, Rattus norvegicus
tctggttccaggtaatacaatgccc

SEQ ID NO: 597884 - DNA, 25 bp, Rattus norvegicus
tctggttcccagacaattgctgatc

SEQ ID NO: 597885 - DNA, 25 bp, Rattus norvegicus
tctggttcccagtcaattgctgatc

SEQ ID NO: 597886 - DNA, 25 bp, Rattus norvegicus
tctggttcccggatgaggaggctta

SEQ ID NO: 597887 - DNA, 25 bp, Rattus norvegicus
tctggttcccggttgaggaggctta

SEQ ID NO: 597888 - DNA, 25 bp, Rattus norvegicus
tctggttctggcagcaccaaggcga

SEQ ID NO: 597889 - DNA, 25 bp, Rattus norvegicus
tctggttctggctgcaccaaggcga

SEQ ID NO: 597890 - DNA, 25 bp, Rattus norvegicus
tctggttctgttccttttacttgac

SEQ ID NO: 597891 - DNA, 25 bp, Rattus norvegicus
tctggttctgttgcttttacttgac

SEQ ID NO: 597892 - DNA, 25 bp, Rattus norvegicus
tctggttctttgctcattggccact

SEQ ID NO: 597893 - DNA, 25 bp, Rattus norvegicus
tctggttctttggtcattggccact

SEQ ID NO: 597894 - DNA, 25 bp, Rattus norvegicus
tctggttgacccaaaggacatcaat

SEQ ID NO: 597895 - DNA, 25 bp, Rattus norvegicus
tctggttgaccctaaggacatcaat

SEQ ID NO: 597896 - DNA, 25 bp, Rattus norvegicus
tctggttgccaactctgacatggaa

SEQ ID NO: 597897 - DNA, 25 bp, Rattus norvegicus
tctggttgccaagtctgacatggaa

SEQ ID NO: 597898 - DNA, 25 bp, Rattus norvegicus
tctggttggaagattcatggtagac

SEQ ID NO: 597899 - DNA, 25 bp, Rattus norvegicus
tctggttggaagtttcatggtagac

SEQ ID NO: 597900 - DNA, 25 bp, Rattus norvegicus
tctggttgtgtgcttccttttacaa

SEQ ID NO: 597901 - DNA, 25 bp, Rattus norvegicus
tctggttgtgtggttccttttacaa

SEQ ID NO: 597902 - DNA, 25 bp, Rattus norvegicus
tctggtttcaggctgttatctcaat

SEQ ID NO: 597903 - DNA, 25 bp, Rattus norvegicus
tctggtttcagggtgttatctcaat

SEQ ID NO: 597904 - DNA, 25 bp, Rattus norvegicus
tctggtttccccatcgaggaagaca

SEQ ID NO: 597905 - DNA, 25 bp, Rattus norvegicus
tctggtttccccttcgaggaagaca

SEQ ID NO: 597906 - DNA, 25 bp, Rattus norvegicus
tctggtttccttacacgtgtataca

SEQ ID NO: 597907 - DNA, 25 bp, Rattus norvegicus
tctggtttcctttcacgtgtataca

SEQ ID NO: 597908 - DNA, 25 bp, Rattus norvegicus
tctggtttcggaagcggtaccacag

SEQ ID NO: 597909 - DNA, 25 bp, Rattus norvegicus
tctggtttcggatgcggtaccacag

SEQ ID NO: 597910 - DNA, 25 bp, Rattus norvegicus
tctggtttgtgtccgatatggcttc

SEQ ID NO: 597911 - DNA, 25 bp, Rattus norvegicus
tctggtttgtgtgcgatatggcttc

SEQ ID NO: 597912 - DNA, 25 bp, Rattus norvegicus
tctggttttccaattcagctctaaa

SEQ ID NO: 597913 - DNA, 25 bp, Rattus norvegicus
tctggttttccatttcagctctaaa

SEQ ID NO: 597914 - DNA, 25 bp, Rattus norvegicus
tctggttttcctctcaatttcttaa

SEQ ID NO: 597915 - DNA, 25 bp, Rattus norvegicus
tctggttttcctgtcaatttcttaa

SEQ ID NO: 597916 - DNA, 25 bp, Rattus norvegicus
tctggttttgatcttcttgggctac

SEQ ID NO: 597917 - DNA, 25 bp, Rattus norvegicus
tctggttttgatgttcttgggctac

SEQ ID NO: 597918 - DNA, 25 bp, Rattus norvegicus
tctggtttttacagctccctaattt

SEQ ID NO: 597919 - DNA, 25 bp, Rattus norvegicus
tctggtttttactgctccctaattt

SEQ ID NO: 597920 - DNA, 25 bp, Rattus norvegicus
tctgtaaaccttctggctaacctag

SEQ ID NO: 597921 - DNA, 25 bp, Rattus norvegicus
tctgtaaaccttgtggctaacctag

SEQ ID NO: 597922 - DNA, 25 bp, Rattus norvegicus
tctgtaaatatcatcgtgaccccac

SEQ ID NO: 597923 - DNA, 25 bp, Rattus norvegicus
tctgtaaatatcttcgtgaccccac

SEQ ID NO: 597924 - DNA, 25 bp, Rattus norvegicus
tctgtaaatgctactgccggtccaa

SEQ ID NO: 597925 - DNA, 25 bp, Rattus norvegicus
tctgtaaatgcttctgccggtccaa

SEQ ID NO: 597926 - DNA, 25 bp, Rattus norvegicus
tctgtaaattttcctctgaccttct

SEQ ID NO: 597927 - DNA, 25 bp, Rattus norvegicus
tctgtaaattttgctctgaccttct

SEQ ID NO: 597928 - DNA, 25 bp, Rattus norvegicus
tctgtaaccttcctgctgggtagca

SEQ ID NO: 597929 - DNA, 25 bp, Rattus norvegicus
tctgtaaccttcgtgctgggtagca

SEQ ID NO: 597930 - DNA, 25 bp, Rattus norvegicus
tctgtaacgacaacccatgacacac

SEQ ID NO: 597931 - DNA, 25 bp, Rattus norvegicus
tctgtaacgacatcccatgacacac

SEQ ID NO: 597932 - DNA, 25 bp, Rattus norvegicus
tctgtaactcccattttatgtaaca

SEQ ID NO: 597933 - DNA, 25 bp, Rattus norvegicus
tctgtaactccctttttatgtaaca

SEQ ID NO: 597934 - DNA, 25 bp, Rattus norvegicus
tctgtaactctactgccaagggatt

SEQ ID NO: 597935 - DNA, 25 bp, Rattus norvegicus
tctgtaactctagtgccaagggatt

SEQ ID NO: 597936 - DNA, 25 bp, Rattus norvegicus
tctgtaagaatcatccattccccag

SEQ ID NO: 597937 - DNA, 25 bp, Rattus norvegicus
tctgtaagaatcttccattccccag

SEQ ID NO: 597938 - DNA, 25 bp, Rattus norvegicus
tctgtaagacagcatcggtgggatt

SEQ ID NO: 597939 - DNA, 25 bp, Rattus norvegicus
tctgtaagacaggatcggtgggatt

SEQ ID NO: 597940 - DNA, 25 bp, Rattus norvegicus
tctgtaagcaggaaacggcaggaga

SEQ ID NO: 597941 - DNA, 25 bp, Rattus norvegicus
tctgtaagcaggtaacggcaggaga

SEQ ID NO: 597942 - DNA, 25 bp, Rattus norvegicus
tctgtaagtactaccctatacccat

SEQ ID NO: 597943 - DNA, 25 bp, Rattus norvegicus
tctgtaagtacttccctatacccat

SEQ ID NO: 597944 - DNA, 25 bp, Rattus norvegicus
tctgtaagttccactgccattttgc

SEQ ID NO: 597945 - DNA, 25 bp, Rattus norvegicus
tctgtaagttcctctgccattttgc

SEQ ID NO: 597946 - DNA, 25 bp, Rattus norvegicus
tctgtaataaatctgcctctgagga

SEQ ID NO: 597947 - DNA, 25 bp, Rattus norvegicus
tctgtaataaatgtgcctctgagga

SEQ ID NO: 597948 - DNA, 25 bp, Rattus norvegicus
tctgtaatcctacatctgtctttag

SEQ ID NO: 597949 - DNA, 25 bp, Rattus norvegicus
tctgtaatcctagatctgtctttag

SEQ ID NO: 597950 - DNA, 25 bp, Rattus norvegicus
tctgtaatcggtaagcagctcctgc

SEQ ID NO: 597951 - DNA, 25 bp, Rattus norvegicus
tctgtaatcggttagcagctcctgc

SEQ ID NO: 597952 - DNA, 25 bp, Rattus norvegicus
tctgtaatgcatccccttacgtgac

SEQ ID NO: 597953 - DNA, 25 bp, Rattus norvegicus
tctgtaatgcatgcccttacgtgac

SEQ ID NO: 597954 - DNA, 25 bp, Rattus norvegicus
tctgtaatggagagctgcagggcat

SEQ ID NO: 597955 - DNA, 25 bp, Rattus norvegicus
tctgtaatggagtgctgcagggcat

SEQ ID NO: 597956 - DNA, 25 bp, Rattus norvegicus
tctgtaatttggaagctgtccagct

SEQ ID NO: 597957 - DNA, 25 bp, Rattus norvegicus
tctgtaatttggtagctgtccagct

SEQ ID NO: 597958 - DNA, 25 bp, Rattus norvegicus
tctgtacaaggaacccagtctttgg

SEQ ID NO: 597959 - DNA, 25 bp, Rattus norvegicus
tctgtacaaggatcccagtctttgg

SEQ ID NO: 597960 - DNA, 25 bp, Rattus norvegicus
tctgtacacccaagggcagcggaga

SEQ ID NO: 597961 - DNA, 25 bp, Rattus norvegicus
tctgtacacccatgggcagcggaga

SEQ ID NO: 597962 - DNA, 25 bp, Rattus norvegicus
tctgtacacgttagttgctaactgt

SEQ ID NO: 597963 - DNA, 25 bp, Rattus norvegicus
tctgtacacgtttgttgctaactgt

SEQ ID NO: 597964 - DNA, 25 bp, Rattus norvegicus
tctgtacactcgcaacttcacgata

SEQ ID NO: 597965 - DNA, 25 bp, Rattus norvegicus
tctgtacactcggaacttcacgata

SEQ ID NO: 597966 - DNA, 25 bp, Rattus norvegicus
tctgtacagacacgcccattcagtg

SEQ ID NO: 597967 - DNA, 25 bp, Rattus norvegicus
tctgtacagacaggcccattcagtg

SEQ ID NO: 597968 - DNA, 25 bp, Rattus norvegicus
tctgtacagcatccctgcctaattg

SEQ ID NO: 597969 - DNA, 25 bp, Rattus norvegicus
tctgtacagcatgcctgcctaattg

SEQ ID NO: 597970 - DNA, 25 bp, Rattus norvegicus
tctgtacataaacctgagaccatgg

SEQ ID NO: 597971 - DNA, 25 bp, Rattus norvegicus
tctgtacataaagctgagaccatgg

SEQ ID NO: 597972 - DNA, 25 bp, Rattus norvegicus
tctgtacattccattcctatagtta

SEQ ID NO: 597973 - DNA, 25 bp, Rattus norvegicus
tctgtacattcctttcctatagtta

SEQ ID NO: 597974 - DNA, 25 bp, Rattus norvegicus
tctgtaccaccaccgtgtggcggcg

SEQ ID NO: 597975 - DNA, 25 bp, Rattus norvegicus
tctgtaccaccagcgtgtggcggcg

SEQ ID NO: 597976 - DNA, 25 bp, Rattus norvegicus
tctgtaccagagcatgggcttccag

SEQ ID NO: 597977 - DNA, 25 bp, Rattus norvegicus
tctgtaccagaggatgggcttccag

SEQ ID NO: 597978 - DNA, 25 bp, Rattus norvegicus
tctgtacccgaccacttttataaat

SEQ ID NO: 597979 - DNA, 25 bp, Rattus norvegicus
tctgtacccgacgacttttataaat

SEQ ID NO: 597980 - DNA, 25 bp, Rattus norvegicus
tctgtaccgtacactgcaagtcaaa

SEQ ID NO: 597981 - DNA, 25 bp, Rattus norvegicus
tctgtaccgtactctgcaagtcaaa

SEQ ID NO: 597982 - DNA, 25 bp, Rattus norvegicus
tctgtacctcgtctgtatctgaaga

SEQ ID NO: 597983 - DNA, 25 bp, Rattus norvegicus
tctgtacctcgtgtgtatctgaaga

SEQ ID NO: 597984 - DNA, 25 bp, Rattus norvegicus
tctgtacctgcaagtttcacacctg

SEQ ID NO: 597985 - DNA, 25 bp, Rattus norvegicus
tctgtacctgcatgtttcacacctg

SEQ ID NO: 597986 - DNA, 25 bp, Rattus norvegicus
tctgtacctggtagcatggcatttt

SEQ ID NO: 597987 - DNA, 25 bp, Rattus norvegicus
tctgtacctggttgcatggcatttt

SEQ ID NO: 597988 - DNA, 25 bp, Rattus norvegicus
tctgtacctgtacacacacgtgcag

SEQ ID NO: 597989 - DNA, 25 bp, Rattus norvegicus
tctgtacctgtagacacacgtgcag

SEQ ID NO: 597990 - DNA, 25 bp, Rattus norvegicus
tctgtacgaaacacccattttacgg

SEQ ID NO: 597991 - DNA, 25 bp, Rattus norvegicus
tctgtacgaaactcccattttacgg

SEQ ID NO: 597992 - DNA, 25 bp, Rattus norvegicus
tctgtactattcagagccttgctag

SEQ ID NO: 597993 - DNA, 25 bp, Rattus norvegicus
tctgtactattctgagccttgctag

SEQ ID NO: 597994 - DNA, 25 bp, Rattus norvegicus
tctgtactcagcacccgggagataa

SEQ ID NO: 597995 - DNA, 25 bp, Rattus norvegicus
tctgtactcagctcccgggagataa

SEQ ID NO: 597996 - DNA, 25 bp, Rattus norvegicus
tctgtactgtctagggctggctttc

SEQ ID NO: 597997 - DNA, 25 bp, Rattus norvegicus
tctgtactgtcttgggctggctttc

SEQ ID NO: 597998 - DNA, 25 bp, Rattus norvegicus
tctgtacttaccaaactttggaaga

SEQ ID NO: 597999 - DNA, 25 bp, Rattus norvegicus
tctgtacttacctaactttggaaga

SEQ ID NO: 598000 - DNA, 25 bp, Rattus norvegicus
tctgtacttcctatgtggttggcta

SEQ ID NO: 598001 - DNA, 25 bp, Rattus norvegicus
tctgtacttcctttgtggttggcta

SEQ ID NO: 598002 - DNA, 25 bp, Rattus norvegicus
tctgtacttctgacttgtgacttga

SEQ ID NO: 598003 - DNA, 25 bp, Rattus norvegicus
tctgtacttctgtcttgtgacttga

SEQ ID NO: 598004 - DNA, 25 bp, Rattus norvegicus
tctgtacttgttctgcggtgtgcgc

SEQ ID NO: 598005 - DNA, 25 bp, Rattus norvegicus
tctgtacttgttgtgcggtgtgcgc

SEQ ID NO: 598006 - DNA, 25 bp, Rattus norvegicus
tctgtactttgtcaacgcccaattt

SEQ ID NO: 598007 - DNA, 25 bp, Rattus norvegicus
tctgtactttgtgaacgcccaattt

SEQ ID NO: 598008 - DNA, 25 bp, Rattus norvegicus
tctgtagacccactcacatcagtat

SEQ ID NO: 598009 - DNA, 25 bp, Rattus norvegicus
tctgtagacccagtcacatcagtat

SEQ ID NO: 598010 - DNA, 25 bp, Rattus norvegicus
tctgtagactgactgaacttccctg

SEQ ID NO: 598011 - DNA, 25 bp, Rattus norvegicus
tctgtagactgagtgaacttccctg

SEQ ID NO: 598012 - DNA, 25 bp, Rattus norvegicus
tctgtagagcgtactttcttcccac

SEQ ID NO: 598013 - DNA, 25 bp, Rattus norvegicus
tctgtagagcgttctttcttcccac

SEQ ID NO: 598014 - DNA, 25 bp, Rattus norvegicus
tctgtagccctgaccagtgtgagga

SEQ ID NO: 598015 - DNA, 25 bp, Rattus norvegicus
tctgtagccctgagcacagcataag

SEQ ID NO: 598016 - DNA, 25 bp, Rattus norvegicus
tctgtagccctgtccagtgtgagga

SEQ ID NO: 598017 - DNA, 25 bp, Rattus norvegicus
tctgtagccctgtgcacagcataag

SEQ ID NO: 598018 - DNA, 25 bp, Rattus norvegicus
tctgtagcgccaactttttcacaac

SEQ ID NO: 598019 - DNA, 25 bp, Rattus norvegicus
tctgtagcgccatctttttcacaac

SEQ ID NO: 598020 - DNA, 25 bp, Rattus norvegicus
tctgtagcttacacatctcacttgt

SEQ ID NO: 598021 - DNA, 25 bp, Rattus norvegicus
tctgtagcttactcatctcacttgt

SEQ ID NO: 598022 - DNA, 25 bp, Rattus norvegicus
tctgtaggacgtacactaccctttt

SEQ ID NO: 598023 - DNA, 25 bp, Rattus norvegicus
tctgtaggacgttcactaccctttt

SEQ ID NO: 598024 - DNA, 25 bp, Rattus norvegicus
tctgtaggctgtctgattgcggaaa

SEQ ID NO: 598025 - DNA, 25 bp, Rattus norvegicus
tctgtaggctgtgtgattgcggaaa

SEQ ID NO: 598026 - DNA, 25 bp, Rattus norvegicus
tctgtaggtcttagtggtcatccac

SEQ ID NO: 598027 - DNA, 25 bp, Rattus norvegicus
tctgtaggtctttgtggtcatccac

SEQ ID NO: 598028 - DNA, 25 bp, Rattus norvegicus
tctgtagtggacaccgggctgactt

SEQ ID NO: 598029 - DNA, 25 bp, Rattus norvegicus
tctgtagtggactccgggctgactt

SEQ ID NO: 598030 - DNA, 25 bp, Rattus norvegicus
tctgtagtttctcctcacgagggag

SEQ ID NO: 598031 - DNA, 25 bp, Rattus norvegicus
tctgtagtttctgctcacgagggag

SEQ ID NO: 598032 - DNA, 25 bp, Rattus norvegicus
tctgtatacagaactcaatgatgtt

SEQ ID NO: 598033 - DNA, 25 bp, Rattus norvegicus
tctgtatacagatctcaatgatgtt

SEQ ID NO: 598034 - DNA, 25 bp, Rattus norvegicus
tctgtatagaaaagcttccacccac

SEQ ID NO: 598035 - DNA, 25 bp, Rattus norvegicus
tctgtatagaaatgcttccacccac

SEQ ID NO: 598036 - DNA, 25 bp, Rattus norvegicus
tctgtatatggtctcagtgctatgt

SEQ ID NO: 598037 - DNA, 25 bp, Rattus norvegicus
tctgtatatggtgtcagtgctatgt

SEQ ID NO: 598038 - DNA, 25 bp, Rattus norvegicus
tctgtatcatgtagaggctcctttt

SEQ ID NO: 598039 - DNA, 25 bp, Rattus norvegicus
tctgtatcatgttgaggctcctttt

SEQ ID NO: 598040 - DNA, 25 bp, Rattus norvegicus
tctgtatcttttccttcatctgtct

SEQ ID NO: 598041 - DNA, 25 bp, Rattus norvegicus
tctgtatcttttgcttcatctgtct

SEQ ID NO: 598042 - DNA, 25 bp, Rattus norvegicus
tctgtatgcaaaagcccaacatggc

SEQ ID NO: 598043 - DNA, 25 bp, Rattus norvegicus
tctgtatgcaaatgcccaacatggc

SEQ ID NO: 598044 - DNA, 25 bp, Rattus norvegicus
tctgtatgccttaccagctcaatgc

SEQ ID NO: 598045 - DNA, 25 bp, Rattus norvegicus
tctgtatgcctttccagctcaatgc

SEQ ID NO: 598046 - DNA, 25 bp, Rattus norvegicus
tctgtatggaatcttcctggcctca

SEQ ID NO: 598047 - DNA, 25 bp, Rattus norvegicus
tctgtatggaatgttcctggcctca

SEQ ID NO: 598048 - DNA, 25 bp, Rattus norvegicus
tctgtatgtatgatgaaagcggatc

SEQ ID NO: 598049 - DNA, 25 bp, Rattus norvegicus
tctgtatgtatgttgaaagcggatc

SEQ ID NO: 598050 - DNA, 25 bp, Rattus norvegicus
tctgtattctgacagcaggctccac

SEQ ID NO: 598051 - DNA, 25 bp, Rattus norvegicus
tctgtattctgagagcaggctccac

SEQ ID NO: 598052 - DNA, 25 bp, Rattus norvegicus
tctgtattgagaagcccacacctac

SEQ ID NO: 598053 - DNA, 25 bp, Rattus norvegicus
tctgtattgagatgcccacacctac

SEQ ID NO: 598054 - DNA, 25 bp, Rattus norvegicus
tctgtattgcttagacggcgggatg

SEQ ID NO: 598055 - DNA, 25 bp, Rattus norvegicus
tctgtattgctttgacggcgggatg

SEQ ID NO: 598056 - DNA, 25 bp, Rattus norvegicus
tctgtatttccccttctgtacataa

SEQ ID NO: 598057 - DNA, 25 bp, Rattus norvegicus
tctgtatttcccgttctgtacataa

SEQ ID NO: 598058 - DNA, 25 bp, Rattus norvegicus
tctgtcaaatgtctgctctccatta

SEQ ID NO: 598059 - DNA, 25 bp, Rattus norvegicus
tctgtcaaatgtgtgctctccatta

SEQ ID NO: 598060 - DNA, 25 bp, Rattus norvegicus
tctgtcaacagaacagtgttccccc

SEQ ID NO: 598061 - DNA, 25 bp, Rattus norvegicus
tctgtcaacagatcagtgttccccc

SEQ ID NO: 598062 - DNA, 25 bp, Rattus norvegicus
tctgtcaacattagcctattccctg

SEQ ID NO: 598063 - DNA, 25 bp, Rattus norvegicus
tctgtcaacatttgcctattccctg

SEQ ID NO: 598064 - DNA, 25 bp, Rattus norvegicus
tctgtcaaccagatgctgtgctgtt

SEQ ID NO: 598065 - DNA, 25 bp, Rattus norvegicus
tctgtcaaccagttgctgtgctgtt

SEQ ID NO: 598066 - DNA, 25 bp, Rattus norvegicus
tctgtcaacccaagtcggattagag

SEQ ID NO: 598067 - DNA, 25 bp, Rattus norvegicus
tctgtcaacccatgtcggattagag

SEQ ID NO: 598068 - DNA, 25 bp, Rattus norvegicus
tctgtcaagggcagggctggtccta

SEQ ID NO: 598069 - DNA, 25 bp, Rattus norvegicus
tctgtcaagggctgggctggtccta

SEQ ID NO: 598070 - DNA, 25 bp, Rattus norvegicus
tctgtcaatattcgtgggtctcttt

SEQ ID NO: 598071 - DNA, 25 bp, Rattus norvegicus
tctgtcaatattggtgggtctcttt

SEQ ID NO: 598072 - DNA, 25 bp, Rattus norvegicus
tctgtcaccatacaatcctggccag

SEQ ID NO: 598073 - DNA, 25 bp, Rattus norvegicus
tctgtcaccatagaatcctggccag

SEQ ID NO: 598074 - DNA, 25 bp, Rattus norvegicus
tctgtcacctcactgtagcaggcta

SEQ ID NO: 598075 - DNA, 25 bp, Rattus norvegicus
tctgtcacctcagtgtagcaggcta

SEQ ID NO: 598076 - DNA, 25 bp, Rattus norvegicus
tctgtcactgagattacattctccc

SEQ ID NO: 598077 - DNA, 25 bp, Rattus norvegicus
tctgtcactgagtttacattctccc

SEQ ID NO: 598078 - DNA, 25 bp, Rattus norvegicus
tctgtcactgttcccggaagcacag

SEQ ID NO: 598079 - DNA, 25 bp, Rattus norvegicus
tctgtcactgttgccggaagcacag

SEQ ID NO: 598080 - DNA, 25 bp, Rattus norvegicus
tctgtcagaaccatgaggctctgtt

SEQ ID NO: 598081 - DNA, 25 bp, Rattus norvegicus
tctgtcagaaccttgaggctctgtt

SEQ ID NO: 598082 - DNA, 25 bp, Rattus norvegicus
tctgtcagaaggaagccactggctt

SEQ ID NO: 598083 - DNA, 25 bp, Rattus norvegicus
tctgtcagaaggtagccactggctt

SEQ ID NO: 598084 - DNA, 25 bp, Rattus norvegicus
tctgtcagacagacttttcctatct

SEQ ID NO: 598085 - DNA, 25 bp, Rattus norvegicus
tctgtcagacagtcttttcctatct

SEQ ID NO: 598086 - DNA, 25 bp, Rattus norvegicus
tctgtcagagagatccacccgggat

SEQ ID NO: 598087 - DNA, 25 bp, Rattus norvegicus
tctgtcagagagttccacccgggat

SEQ ID NO: 598088 - DNA, 25 bp, Rattus norvegicus
tctgtcagagatctggcaaccttct

SEQ ID NO: 598089 - DNA, 25 bp, Rattus norvegicus
tctgtcagagatgtggcaaccttct

SEQ ID NO: 598090 - DNA, 25 bp, Rattus norvegicus
tctgtcaggagcacggagtctgttg

SEQ ID NO: 598091 - DNA, 25 bp, Rattus norvegicus
tctgtcaggagctcggagtctgttg

SEQ ID NO: 598092 - DNA, 25 bp, Rattus norvegicus
tctgtcaggccgactggtggccata

SEQ ID NO: 598093 - DNA, 25 bp, Rattus norvegicus
tctgtcaggccgtctggtggccata

SEQ ID NO: 598094 - DNA, 25 bp, Rattus norvegicus
tctgtcagggcaaccgcgattgtaa

SEQ ID NO: 598095 - DNA, 25 bp, Rattus norvegicus
tctgtcagggcatccgcgattgtaa

SEQ ID NO: 598096 - DNA, 25 bp, Rattus norvegicus
tctgtcagtcatcccaaagcagcag

SEQ ID NO: 598097 - DNA, 25 bp, Rattus norvegicus
tctgtcagtcatgccaaagcagcag

SEQ ID NO: 598098 - DNA, 25 bp, Rattus norvegicus
tctgtcagtccccaagtggttctat

SEQ ID NO: 598099 - DNA, 25 bp, Rattus norvegicus
tctgtcagtcccgaagtggttctat

SEQ ID NO: 598100 - DNA, 25 bp, Rattus norvegicus
tctgtcatcggtctggcaagagctt

SEQ ID NO: 598101 - DNA, 25 bp, Rattus norvegicus
tctgtcatcggtgtggcaagagctt

SEQ ID NO: 598102 - DNA, 25 bp, Rattus norvegicus
tctgtcatgactactgggttagtaa

SEQ ID NO: 598103 - DNA, 25 bp, Rattus norvegicus
tctgtcatgacttctgggttagtaa

SEQ ID NO: 598104 - DNA, 25 bp, Rattus norvegicus
tctgtcatttatccccaccttaaaa

SEQ ID NO: 598105 - DNA, 25 bp, Rattus norvegicus
tctgtcatttatgcccaccttaaaa

SEQ ID NO: 598106 - DNA, 25 bp, Rattus norvegicus
tctgtccagcacagccattcctgga

SEQ ID NO: 598107 - DNA, 25 bp, Rattus norvegicus
tctgtccagcactgccattcctgga

SEQ ID NO: 598108 - DNA, 25 bp, Rattus norvegicus
tctgtccaggaaatgcaagagctca

SEQ ID NO: 598109 - DNA, 25 bp, Rattus norvegicus
tctgtccaggaattgcaagagctca

SEQ ID NO: 598110 - DNA, 25 bp, Rattus norvegicus
tctgtccagggaccttgtttcaaag

SEQ ID NO: 598111 - DNA, 25 bp, Rattus norvegicus
tctgtccagggagcttgtttcaaag

SEQ ID NO: 598112 - DNA, 25 bp, Rattus norvegicus
tctgtccagggtagaagtcacgtcc

SEQ ID NO: 598113 - DNA, 25 bp, Rattus norvegicus
tctgtccagggttgaagtcacgtcc

SEQ ID NO: 598114 - DNA, 25 bp, Rattus norvegicus
tctgtccaggttccttatcacaagg

SEQ ID NO: 598115 - DNA, 25 bp, Rattus norvegicus
tctgtccaggttgcttatcacaagg

SEQ ID NO: 598116 - DNA, 25 bp, Rattus norvegicus
tctgtccagtacacttgtgtgggct

SEQ ID NO: 598117 - DNA, 25 bp, Rattus norvegicus
tctgtccagtactcttgtgtgggct

SEQ ID NO: 598118 - DNA, 25 bp, Rattus norvegicus
tctgtccagtgtctttttctgtcat

SEQ ID NO: 598119 - DNA, 25 bp, Rattus norvegicus
tctgtccagtgtgtttttctgtcat

SEQ ID NO: 598120 - DNA, 25 bp, Rattus norvegicus
tctgtccatacactgtggctgggct

SEQ ID NO: 598121 - DNA, 25 bp, Rattus norvegicus
tctgtccatacagtgtggctgggct

SEQ ID NO: 598122 - DNA, 25 bp, Rattus norvegicus
tctgtccatggaactgtgcatcaca

SEQ ID NO: 598123 - DNA, 25 bp, Rattus norvegicus
tctgtccatggatctgtgcatcaca

SEQ ID NO: 598124 - DNA, 25 bp, Rattus norvegicus
tctgtcccaggtctctaacgaataa

SEQ ID NO: 598125 - DNA, 25 bp, Rattus norvegicus
tctgtcccaggtgtctaacgaataa

SEQ ID NO: 598126 - DNA, 25 bp, Rattus norvegicus
tctgtcccatcccaattgatactac

SEQ ID NO: 598127 - DNA, 25 bp, Rattus norvegicus
tctgtcccatccgaattgatactac

SEQ ID NO: 598128 - DNA, 25 bp, Rattus norvegicus
tctgtcccctttacttatttattag

SEQ ID NO: 598129 - DNA, 25 bp, Rattus norvegicus
tctgtcccctttattattctcagga

SEQ ID NO: 598130 - DNA, 25 bp, Rattus norvegicus
tctgtcccctttcattccagctgaa

SEQ ID NO: 598131 - DNA, 25 bp, Rattus norvegicus
tctgtcccctttgattccagctgaa

SEQ ID NO: 598132 - DNA, 25 bp, Rattus norvegicus
tctgtccccttttcttatttattag

SEQ ID NO: 598133 - DNA, 25 bp, Rattus norvegicus
tctgtccccttttttattctcagga

SEQ ID NO: 598134 - DNA, 25 bp, Rattus norvegicus
tctgtcccgtgtcaagctgatgagg

SEQ ID NO: 598135 - DNA, 25 bp, Rattus norvegicus
tctgtcccgtgtgaagctgatgagg

SEQ ID NO: 598136 - DNA, 25 bp, Rattus norvegicus
tctgtccctatccttatgtttatta

SEQ ID NO: 598137 - DNA, 25 bp, Rattus norvegicus
tctgtccctatcgttatgtttatta

SEQ ID NO: 598138 - DNA, 25 bp, Rattus norvegicus
tctgtccctcctcatgtggctgtga

SEQ ID NO: 598139 - DNA, 25 bp, Rattus norvegicus
tctgtccctcctctaaccgggaaag

SEQ ID NO: 598140 - DNA, 25 bp, Rattus norvegicus
tctgtccctcctgatgtggctgtga

SEQ ID NO: 598141 - DNA, 25 bp, Rattus norvegicus
tctgtccctcctgtaaccgggaaag

SEQ ID NO: 598142 - DNA, 25 bp, Rattus norvegicus
tctgtccctctgaggaggtcagcaa

SEQ ID NO: 598143 - DNA, 25 bp, Rattus norvegicus
tctgtccctctgtggaggtcagcaa

SEQ ID NO: 598144 - DNA, 25 bp, Rattus norvegicus
tctgtccgtaccctgggatgacaaa

SEQ ID NO: 598145 - DNA, 25 bp, Rattus norvegicus
tctgtccgtaccgtgggatgacaaa

SEQ ID NO: 598146 - DNA, 25 bp, Rattus norvegicus
tctgtccgtttgccggtcgtgggcg

SEQ ID NO: 598147 - DNA, 25 bp, Rattus norvegicus
tctgtccgtttggcggtcgtgggcg

SEQ ID NO: 598148 - DNA, 25 bp, Rattus norvegicus
tctgtcctccacattcttgaataaa

SEQ ID NO: 598149 - DNA, 25 bp, Rattus norvegicus
tctgtcctccactttcttgaataaa

SEQ ID NO: 598150 - DNA, 25 bp, Rattus norvegicus
tctgtcctcccaaggtttgaaacaa

SEQ ID NO: 598151 - DNA, 25 bp, Rattus norvegicus
tctgtcctcccatggtttgaaacaa

SEQ ID NO: 598152 - DNA, 25 bp, Rattus norvegicus
tctgtcctcctacaatctggagtaa

SEQ ID NO: 598153 - DNA, 25 bp, Rattus norvegicus
tctgtcctcctagaatctggagtaa

SEQ ID NO: 598154 - DNA, 25 bp, Rattus norvegicus
tctgtcctctgtacagagccccttg

SEQ ID NO: 598155 - DNA, 25 bp, Rattus norvegicus
tctgtcctctgttcagagccccttg

SEQ ID NO: 598156 - DNA, 25 bp, Rattus norvegicus
tctgtcctctttcagctagtttagg

SEQ ID NO: 598157 - DNA, 25 bp, Rattus norvegicus
tctgtcctctttgagctagtttagg

SEQ ID NO: 598158 - DNA, 25 bp, Rattus norvegicus
tctgtcctgaacctatacatacctt

SEQ ID NO: 598159 - DNA, 25 bp, Rattus norvegicus
tctgtcctgaacgtatacatacctt

SEQ ID NO: 598160 - DNA, 25 bp, Rattus norvegicus
tctgtcctgagccttctgtgtttgt

SEQ ID NO: 598161 - DNA, 25 bp, Rattus norvegicus
tctgtcctgagcgttctgtgtttgt

SEQ ID NO: 598162 - DNA, 25 bp, Rattus norvegicus
tctgtcctgcagaagctctattaat

SEQ ID NO: 598163 - DNA, 25 bp, Rattus norvegicus
tctgtcctgcagtagctctattaat

SEQ ID NO: 598164 - DNA, 25 bp, Rattus norvegicus
tctgtcctgcctcggccattgaagc

SEQ ID NO: 598165 - DNA, 25 bp, Rattus norvegicus
tctgtcctgcctgggccattgaagc

SEQ ID NO: 598166 - DNA, 25 bp, Rattus norvegicus
tctgtcctgttccagagggtcggaa

SEQ ID NO: 598167 - DNA, 25 bp, Rattus norvegicus
tctgtcctgttcgagagggtcggaa

SEQ ID NO: 598168 - DNA, 25 bp, Rattus norvegicus
tctgtcctgtttattacactcacca

SEQ ID NO: 598169 - DNA, 25 bp, Rattus norvegicus
tctgtcctgttttttacactcacca

SEQ ID NO: 598170 - DNA, 25 bp, Rattus norvegicus
tctgtccttattacatttgatagtg

SEQ ID NO: 598171 - DNA, 25 bp, Rattus norvegicus
tctgtccttatttcatttgatagtg

SEQ ID NO: 598172 - DNA, 25 bp, Rattus norvegicus
tctgtccttcacaggcactgagagg

SEQ ID NO: 598173 - DNA, 25 bp, Rattus norvegicus
tctgtccttcactggcactgagagg

SEQ ID NO: 598174 - DNA, 25 bp, Rattus norvegicus
tctgtccttctaaactgggtcatac

SEQ ID NO: 598175 - DNA, 25 bp, Rattus norvegicus
tctgtccttctatactgggtcatac

SEQ ID NO: 598176 - DNA, 25 bp, Rattus norvegicus
tctgtccttggtacattcttctgaa

SEQ ID NO: 598177 - DNA, 25 bp, Rattus norvegicus
tctgtccttggttcattcttctgaa

SEQ ID NO: 598178 - DNA, 25 bp, Rattus norvegicus
tctgtcgtctgaactcacaaaacca

SEQ ID NO: 598179 - DNA, 25 bp, Rattus norvegicus
tctgtcgtctgatctcacaaaacca

SEQ ID NO: 598180 - DNA, 25 bp, Rattus norvegicus
tctgtcgtctgtattaagtccttcc

SEQ ID NO: 598181 - DNA, 25 bp, Rattus norvegicus
tctgtcgtctgttttaagtccttcc

SEQ ID NO: 598182 - DNA, 25 bp, Rattus norvegicus
tctgtctaccaaccgctactattaa

SEQ ID NO: 598183 - DNA, 25 bp, Rattus norvegicus
tctgtctaccaagcgctactattaa

SEQ ID NO: 598184 - DNA, 25 bp, Rattus norvegicus
tctgtctaggctactgggactgcaa

SEQ ID NO: 598185 - DNA, 25 bp, Rattus norvegicus
tctgtctaggcttctgggactgcaa

SEQ ID NO: 598186 - DNA, 25 bp, Rattus norvegicus
tctgtctagtgtctctctcttatgg

SEQ ID NO: 598187 - DNA, 25 bp, Rattus norvegicus
tctgtctagtgtgtctctcttatgg

SEQ ID NO: 598188 - DNA, 25 bp, Rattus norvegicus
tctgtctatgctagaggtcctctct

SEQ ID NO: 598189 - DNA, 25 bp, Rattus norvegicus
tctgtctatgcttgaggtcctctct

SEQ ID NO: 598190 - DNA, 25 bp, Rattus norvegicus
tctgtctatggcagggtccacagca

SEQ ID NO: 598191 - DNA, 25 bp, Rattus norvegicus
tctgtctatggctgggtccacagca

SEQ ID NO: 598192 - DNA, 25 bp, Rattus norvegicus
tctgtctcacctattccttgtcttc

SEQ ID NO: 598193 - DNA, 25 bp, Rattus norvegicus
tctgtctcaccttttccttgtcttc

SEQ ID NO: 598194 - DNA, 25 bp, Rattus norvegicus
tctgtctcagtcacatgcctattat

SEQ ID NO: 598195 - DNA, 25 bp, Rattus norvegicus
tctgtctcagtctcatgcctattat

SEQ ID NO: 598196 - DNA, 25 bp, Rattus norvegicus
tctgtctcccatccgagtatttaaa

SEQ ID NO: 598197 - DNA, 25 bp, Rattus norvegicus
tctgtctcccatgcgagtatttaaa

SEQ ID NO: 598198 - DNA, 25 bp, Rattus norvegicus
tctgtctccctgatttctgtaaaat

SEQ ID NO: 598199 - DNA, 25 bp, Rattus norvegicus
tctgtctccctgttttctgtaaaat

SEQ ID NO: 598200 - DNA, 25 bp, Rattus norvegicus
tctgtctccgtgcttttatttttga

SEQ ID NO: 598201 - DNA, 25 bp, Rattus norvegicus
tctgtctccgtggttttatttttga

SEQ ID NO: 598202 - DNA, 25 bp, Rattus norvegicus
tctgtctcctaaatgactgctgcat

SEQ ID NO: 598203 - DNA, 25 bp, Rattus norvegicus
tctgtctcctaaatggtgaccataa

SEQ ID NO: 598204 - DNA, 25 bp, Rattus norvegicus
tctgtctcctaattgactgctgcat

SEQ ID NO: 598205 - DNA, 25 bp, Rattus norvegicus
tctgtctcctaattggtgaccataa

SEQ ID NO: 598206 - DNA, 25 bp, Rattus norvegicus
tctgtctcctaccatagcaatgaaa

SEQ ID NO: 598207 - DNA, 25 bp, Rattus norvegicus
tctgtctcctacgatagcaatgaaa

SEQ ID NO: 598208 - DNA, 25 bp, Rattus norvegicus
tctgtctcctagcttcgtgaaatga

SEQ ID NO: 598209 - DNA, 25 bp, Rattus norvegicus
tctgtctcctaggttcgtgaaatga

SEQ ID NO: 598210 - DNA, 25 bp, Rattus norvegicus
tctgtctcctgtatttctaaccaag

SEQ ID NO: 598211 - DNA, 25 bp, Rattus norvegicus
tctgtctcctgtttttctaaccaag

SEQ ID NO: 598212 - DNA, 25 bp, Rattus norvegicus
tctgtctctcacacttaggtttggg

SEQ ID NO: 598213 - DNA, 25 bp, Rattus norvegicus
tctgtctctcactcttaggtttggg

SEQ ID NO: 598214 - DNA, 25 bp, Rattus norvegicus
tctgtctctctcatttgtaaggaaa

SEQ ID NO: 598215 - DNA, 25 bp, Rattus norvegicus
tctgtctctctcttttgtaaggaaa

SEQ ID NO: 598216 - DNA, 25 bp, Rattus norvegicus
tctgtctctgatcatcttggttgtg

SEQ ID NO: 598217 - DNA, 25 bp, Rattus norvegicus
tctgtctctgatgatcttggttgtg

SEQ ID NO: 598218 - DNA, 25 bp, Rattus norvegicus
tctgtctctgcactaggagtccagg

SEQ ID NO: 598219 - DNA, 25 bp, Rattus norvegicus
tctgtctctgcagtaggagtccagg

SEQ ID NO: 598220 - DNA, 25 bp, Rattus norvegicus
tctgtctctggacttgacccacaaa

SEQ ID NO: 598221 - DNA, 25 bp, Rattus norvegicus
tctgtctctggagttgacccacaaa

SEQ ID NO: 598222 - DNA, 25 bp, Rattus norvegicus
tctgtctctgttcccacagtttaaa

SEQ ID NO: 598223 - DNA, 25 bp, Rattus norvegicus
tctgtctctgttgccacagtttaaa

SEQ ID NO: 598224 - DNA, 25 bp, Rattus norvegicus
tctgtctcttcaatcccattttaaa

SEQ ID NO: 598225 - DNA, 25 bp, Rattus norvegicus
tctgtctcttcattcccattttaaa

SEQ ID NO: 598226 - DNA, 25 bp, Rattus norvegicus
tctgtctgacctcactacattcata

SEQ ID NO: 598227 - DNA, 25 bp, Rattus norvegicus
tctgtctgacctgactacattcata

SEQ ID NO: 598228 - DNA, 25 bp, Rattus norvegicus
tctgtctgacttctgtgtggtttat

SEQ ID NO: 598229 - DNA, 25 bp, Rattus norvegicus
tctgtctgacttgtgtgtggtttat

SEQ ID NO: 598230 - DNA, 25 bp, Rattus norvegicus
tctgtctgcataaccatccgtattt

SEQ ID NO: 598231 - DNA, 25 bp, Rattus norvegicus
tctgtctgcatatccatccgtattt

SEQ ID NO: 598232 - DNA, 25 bp, Rattus norvegicus
tctgtctgcccgaaattagtgcgga

SEQ ID NO: 598233 - DNA, 25 bp, Rattus norvegicus
tctgtctgcccgtaattagtgcgga

SEQ ID NO: 598234 - DNA, 25 bp, Rattus norvegicus
tctgtctgctgcacatcttcctgct

SEQ ID NO: 598235 - DNA, 25 bp, Rattus norvegicus
tctgtctgctgcctgattgggaaga

SEQ ID NO: 598236 - DNA, 25 bp, Rattus norvegicus
tctgtctgctgcgtgattgggaaga

SEQ ID NO: 598237 - DNA, 25 bp, Rattus norvegicus
tctgtctgctgctcatcttcctgct

SEQ ID NO: 598238 - DNA, 25 bp, Rattus norvegicus
tctgtctgctttcggttgtgagcca

SEQ ID NO: 598239 - DNA, 25 bp, Rattus norvegicus
tctgtctgctttgggttgtgagcca

SEQ ID NO: 598240 - DNA, 25 bp, Rattus norvegicus
tctgtctggacacacttcctgaaat

SEQ ID NO: 598241 - DNA, 25 bp, Rattus norvegicus
tctgtctggacacggcctagcttgg

SEQ ID NO: 598242 - DNA, 25 bp, Rattus norvegicus
tctgtctggacagacttcctgaaat

SEQ ID NO: 598243 - DNA, 25 bp, Rattus norvegicus
tctgtctggacagggcctagcttgg

SEQ ID NO: 598244 - DNA, 25 bp, Rattus norvegicus
tctgtctggcctcaaactctctatg

SEQ ID NO: 598245 - DNA, 25 bp, Rattus norvegicus
tctgtctggcctgaaactctctatg

SEQ ID NO: 598246 - DNA, 25 bp, Rattus norvegicus
tctgtctgggaaacccttccaaaga

SEQ ID NO: 598247 - DNA, 25 bp, Rattus norvegicus
tctgtctgggaatcccttccaaaga

SEQ ID NO: 598248 - DNA, 25 bp, Rattus norvegicus
tctgtctgggtaaatgtgctatctc

SEQ ID NO: 598249 - DNA, 25 bp, Rattus norvegicus
tctgtctgggtatatgtgctatctc

SEQ ID NO: 598250 - DNA, 25 bp, Rattus norvegicus
tctgtctgtcagctaggatcccaag

SEQ ID NO: 598251 - DNA, 25 bp, Rattus norvegicus
tctgtctgtcaggtaggatcccaag

SEQ ID NO: 598252 - DNA, 25 bp, Rattus norvegicus
tctgtctgtctaagtgtgtgcctct

SEQ ID NO: 598253 - DNA, 25 bp, Rattus norvegicus
tctgtctgtctatgtgtgtgcctct

SEQ ID NO: 598254 - DNA, 25 bp, Rattus norvegicus
tctgtctgtcttcggcattctgagg

SEQ ID NO: 598255 - DNA, 25 bp, Rattus norvegicus
tctgtctgtcttgggcattctgagg

SEQ ID NO: 598256 - DNA, 25 bp, Rattus norvegicus
tctgtctgtgagacaatcgagttgg

SEQ ID NO: 598257 - DNA, 25 bp, Rattus norvegicus
tctgtctgtgagtcaatcgagttgg

SEQ ID NO: 598258 - DNA, 25 bp, Rattus norvegicus
tctgtctgtgtccagtcacttgtga

SEQ ID NO: 598259 - DNA, 25 bp, Rattus norvegicus
tctgtctgtgtcgagtcacttgtga

SEQ ID NO: 598260 - DNA, 25 bp, Rattus norvegicus
tctgtctgttctctatcgaggctca

SEQ ID NO: 598261 - DNA, 25 bp, Rattus norvegicus
tctgtctgttctgtatcgaggctca

SEQ ID NO: 598262 - DNA, 25 bp, Rattus norvegicus
tctgtctgttgaatctgcttgggat

SEQ ID NO: 598263 - DNA, 25 bp, Rattus norvegicus
tctgtctgttgattctgcttgggat

SEQ ID NO: 598264 - DNA, 25 bp, Rattus norvegicus
tctgtcttaaaactgtgtgtagaaa

SEQ ID NO: 598265 - DNA, 25 bp, Rattus norvegicus
tctgtcttaaaagtgtgtgtagaaa

SEQ ID NO: 598266 - DNA, 25 bp, Rattus norvegicus
tctgtcttactgatttctttgctgt

SEQ ID NO: 598267 - DNA, 25 bp, Rattus norvegicus
tctgtcttactgttttctttgctgt

SEQ ID NO: 598268 - DNA, 25 bp, Rattus norvegicus
tctgtcttagcaagttagaaccttt

SEQ ID NO: 598269 - DNA, 25 bp, Rattus norvegicus
tctgtcttagcatgttagaaccttt

SEQ ID NO: 598270 - DNA, 25 bp, Rattus norvegicus
tctgtcttaggcacccataaaggga

SEQ ID NO: 598271 - DNA, 25 bp, Rattus norvegicus
tctgtcttaggctcccataaaggga

SEQ ID NO: 598272 - DNA, 25 bp, Rattus norvegicus
tctgtcttcatacctgagggccaaa

SEQ ID NO: 598273 - DNA, 25 bp, Rattus norvegicus
tctgtcttcatagctgagggccaaa

SEQ ID NO: 598274 - DNA, 25 bp, Rattus norvegicus
tctgtcttcccacctcaatagtgag

SEQ ID NO: 598275 - DNA, 25 bp, Rattus norvegicus
tctgtcttcccagctcaatagtgag

SEQ ID NO: 598276 - DNA, 25 bp, Rattus norvegicus
tctgtcttcgccatcggagagaata

SEQ ID NO: 598277 - DNA, 25 bp, Rattus norvegicus
tctgtcttcgccttcggagagaata

SEQ ID NO: 598278 - DNA, 25 bp, Rattus norvegicus
tctgtcttcttcctagggtttttag

SEQ ID NO: 598279 - DNA, 25 bp, Rattus norvegicus
tctgtcttcttcgtagggtttttag

SEQ ID NO: 598280 - DNA, 25 bp, Rattus norvegicus
tctgtcttgcttagctgaaatcctg

SEQ ID NO: 598281 - DNA, 25 bp, Rattus norvegicus
tctgtcttgctttgctgaaatcctg

SEQ ID NO: 598282 - DNA, 25 bp, Rattus norvegicus
tctgtcttgggacccggtttcaaaa

SEQ ID NO: 598283 - DNA, 25 bp, Rattus norvegicus
tctgtcttgggagccggtttcaaaa

SEQ ID NO: 598284 - DNA, 25 bp, Rattus norvegicus
tctgtcttgggcattctgaggtaac

SEQ ID NO: 598285 - DNA, 25 bp, Rattus norvegicus
tctgtcttgggctttctgaggtaac

SEQ ID NO: 598286 - DNA, 25 bp, Rattus norvegicus
tctgtctttacgctcctctggaaaa

SEQ ID NO: 598287 - DNA, 25 bp, Rattus norvegicus
tctgtctttacggtcctctggaaaa

SEQ ID NO: 598288 - DNA, 25 bp, Rattus norvegicus
tctgtctttcttagtgtctggtgtc

SEQ ID NO: 598289 - DNA, 25 bp, Rattus norvegicus
tctgtctttctttgtgtctggtgtc

SEQ ID NO: 598290 - DNA, 25 bp, Rattus norvegicus
tctgtctttgacagcattgtctgca

SEQ ID NO: 598291 - DNA, 25 bp, Rattus norvegicus
tctgtctttgactgcattgtctgca

SEQ ID NO: 598292 - DNA, 25 bp, Rattus norvegicus
tctgtcttttacctggaaatccata

SEQ ID NO: 598293 - DNA, 25 bp, Rattus norvegicus
tctgtcttttacgtggaaatccata

SEQ ID NO: 598294 - DNA, 25 bp, Rattus norvegicus
tctgtctttttactaatatgatctc

SEQ ID NO: 598295 - DNA, 25 bp, Rattus norvegicus
tctgtctttttagtaatatgatctc

SEQ ID NO: 598296 - DNA, 25 bp, Rattus norvegicus
tctgtctttttgcagggtcctggaa

SEQ ID NO: 598297 - DNA, 25 bp, Rattus norvegicus
tctgtctttttggagggtcctggaa

SEQ ID NO: 598298 - DNA, 25 bp, Rattus norvegicus
tctgtgaagggcatcttggctctac

SEQ ID NO: 598299 - DNA, 25 bp, Rattus norvegicus
tctgtgaagggcttcttggctctac

SEQ ID NO: 598300 - DNA, 25 bp, Rattus norvegicus
tctgtgaatcctctctacctacaaa

SEQ ID NO: 598301 - DNA, 25 bp, Rattus norvegicus
tctgtgaatcctgtctacctacaaa

SEQ ID NO: 598302 - DNA, 25 bp, Rattus norvegicus
tctgtgaatctgactcctctggaga

SEQ ID NO: 598303 - DNA, 25 bp, Rattus norvegicus
tctgtgaatctgcattgggtcctgt

SEQ ID NO: 598304 - DNA, 25 bp, Rattus norvegicus
tctgtgaatctggattgggtcctgt

SEQ ID NO: 598305 - DNA, 25 bp, Rattus norvegicus
tctgtgaatctgtctcctctggaga

SEQ ID NO: 598306 - DNA, 25 bp, Rattus norvegicus
tctgtgaatttgagagccgccttca

SEQ ID NO: 598307 - DNA, 25 bp, Rattus norvegicus
tctgtgaatttgtgagccgccttca

SEQ ID NO: 598308 - DNA, 25 bp, Rattus norvegicus
tctgtgacagtacttatcccttgat

SEQ ID NO: 598309 - DNA, 25 bp, Rattus norvegicus
tctgtgacagtagttatcccttgat

SEQ ID NO: 598310 - DNA, 25 bp, Rattus norvegicus
tctgtgacatcaacctgctcaattt

SEQ ID NO: 598311 - DNA, 25 bp, Rattus norvegicus
tctgtgacatcatcctgctcaattt

SEQ ID NO: 598312 - DNA, 25 bp, Rattus norvegicus
tctgtgacatggcttccttgacaaa

SEQ ID NO: 598313 - DNA, 25 bp, Rattus norvegicus
tctgtgacatgggttccttgacaaa

SEQ ID NO: 598314 - DNA, 25 bp, Rattus norvegicus
tctgtgacccagacacttatgctga

SEQ ID NO: 598315 - DNA, 25 bp, Rattus norvegicus
tctgtgacccagtcacttatgctga

SEQ ID NO: 598316 - DNA, 25 bp, Rattus norvegicus
tctgtgacctcaatcatcagtctcc

SEQ ID NO: 598317 - DNA, 25 bp, Rattus norvegicus
tctgtgacctcattcatcagtctcc

SEQ ID NO: 598318 - DNA, 25 bp, Rattus norvegicus
tctgtgacctccagtctgagggaga

SEQ ID NO: 598319 - DNA, 25 bp, Rattus norvegicus
tctgtgacctcctgtctgagggaga

SEQ ID NO: 598320 - DNA, 25 bp, Rattus norvegicus
tctgtgactacaataaggtggctct

SEQ ID NO: 598321 - DNA, 25 bp, Rattus norvegicus
tctgtgactacattaaggtggctct

SEQ ID NO: 598322 - DNA, 25 bp, Rattus norvegicus
tctgtgactgacaacaagcggcttc

SEQ ID NO: 598323 - DNA, 25 bp, Rattus norvegicus
tctgtgactgactacaagcggcttc

SEQ ID NO: 598324 - DNA, 25 bp, Rattus norvegicus
tctgtgactgtacgcggagaagaaa

SEQ ID NO: 598325 - DNA, 25 bp, Rattus norvegicus
tctgtgactgtaggcggagaagaaa

SEQ ID NO: 598326 - DNA, 25 bp, Rattus norvegicus
tctgtgactgtcacgatcttacaag

SEQ ID NO: 598327 - DNA, 25 bp, Rattus norvegicus
tctgtgactgtctcgatcttacaag

SEQ ID NO: 598328 - DNA, 25 bp, Rattus norvegicus
tctgtgagcatcaccataccctact

SEQ ID NO: 598329 - DNA, 25 bp, Rattus norvegicus
tctgtgagcatctccataccctact

SEQ ID NO: 598330 - DNA, 25 bp, Rattus norvegicus
tctgtgagggcaagcaagactgaaa

SEQ ID NO: 598331 - DNA, 25 bp, Rattus norvegicus
tctgtgagggcatgcaagactgaaa

SEQ ID NO: 598332 - DNA, 25 bp, Rattus norvegicus
tctgtgagtgcccttgaggctacta

SEQ ID NO: 598333 - DNA, 25 bp, Rattus norvegicus
tctgtgagtgccgttgaggctacta

SEQ ID NO: 598334 - DNA, 25 bp, Rattus norvegicus
tctgtgagtgttaagcctgtggcta

SEQ ID NO: 598335 - DNA, 25 bp, Rattus norvegicus
tctgtgagtgtttagcctgtggcta

SEQ ID NO: 598336 - DNA, 25 bp, Rattus norvegicus
tctgtgatctttatctttgctgtat

SEQ ID NO: 598337 - DNA, 25 bp, Rattus norvegicus
tctgtgatctttttctttgctgtat

SEQ ID NO: 598338 - DNA, 25 bp, Rattus norvegicus
tctgtgatgatcatcttgtggccca

SEQ ID NO: 598339 - DNA, 25 bp, Rattus norvegicus
tctgtgatgatcttcttgtggccca

SEQ ID NO: 598340 - DNA, 25 bp, Rattus norvegicus
tctgtgatgcctctttctttatgaa

SEQ ID NO: 598341 - DNA, 25 bp, Rattus norvegicus
tctgtgatgcctgtttctttatgaa

SEQ ID NO: 598342 - DNA, 25 bp, Rattus norvegicus
tctgtgatggttagcttcctggcca

SEQ ID NO: 598343 - DNA, 25 bp, Rattus norvegicus
tctgtgatggtttgcttcctggcca

SEQ ID NO: 598344 - DNA, 25 bp, Rattus norvegicus
tctgtgatgtgtctccattgctcaa

SEQ ID NO: 598345 - DNA, 25 bp, Rattus norvegicus
tctgtgatgtgtgtccattgctcaa

SEQ ID NO: 598346 - DNA, 25 bp, Rattus norvegicus
tctgtgattctgagggcagtgccca

SEQ ID NO: 598347 - DNA, 25 bp, Rattus norvegicus
tctgtgattctgtgggcagtgccca

SEQ ID NO: 598348 - DNA, 25 bp, Rattus norvegicus
tctgtgcaacatagggatttccctc

SEQ ID NO: 598349 - DNA, 25 bp, Rattus norvegicus
tctgtgcaacattgggatttccctc

SEQ ID NO: 598350 - DNA, 25 bp, Rattus norvegicus
tctgtgcaaccacgagtgcccctgt

SEQ ID NO: 598351 - DNA, 25 bp, Rattus norvegicus
tctgtgcaaccaggagtgcccctgt

SEQ ID NO: 598352 - DNA, 25 bp, Rattus norvegicus
tctgtgcacaggatctcattggaat

SEQ ID NO: 598353 - DNA, 25 bp, Rattus norvegicus
tctgtgcacaggttctcattggaat

SEQ ID NO: 598354 - DNA, 25 bp, Rattus norvegicus
tctgtgcactggaactgtagcggta

SEQ ID NO: 598355 - DNA, 25 bp, Rattus norvegicus
tctgtgcactggtactgtagcggta

SEQ ID NO: 598356 - DNA, 25 bp, Rattus norvegicus
tctgtgcagcatagtggcctggaca

SEQ ID NO: 598357 - DNA, 25 bp, Rattus norvegicus
tctgtgcagcattgtggcctggaca

SEQ ID NO: 598358 - DNA, 25 bp, Rattus norvegicus
tctgtgcagccactggcatcagatg

SEQ ID NO: 598359 - DNA, 25 bp, Rattus norvegicus
tctgtgcagccagtggcatcagatg

SEQ ID NO: 598360 - DNA, 25 bp, Rattus norvegicus
tctgtgcatagcctttctgcagaag

SEQ ID NO: 598361 - DNA, 25 bp, Rattus norvegicus
tctgtgcatagcgtttctgcagaag

SEQ ID NO: 598362 - DNA, 25 bp, Rattus norvegicus
tctgtgcatgagcaccagctccagg

SEQ ID NO: 598363 - DNA, 25 bp, Rattus norvegicus
tctgtgcatgaggaccagctccagg

SEQ ID NO: 598364 - DNA, 25 bp, Rattus norvegicus
tctgtgcatggcactcctggaggaa

SEQ ID NO: 598365 - DNA, 25 bp, Rattus norvegicus
tctgtgcatggctctcctggaggaa

SEQ ID NO: 598366 - DNA, 25 bp, Rattus norvegicus
tctgtgccaacacctgcttgcagga

SEQ ID NO: 598367 - DNA, 25 bp, Rattus norvegicus
tctgtgccaacagctgcttgcagga

SEQ ID NO: 598368 - DNA, 25 bp, Rattus norvegicus
tctgtgccagagacgtactgttgtt

SEQ ID NO: 598369 - DNA, 25 bp, Rattus norvegicus
tctgtgccagagtcgtactgttgtt

SEQ ID NO: 598370 - DNA, 25 bp, Rattus norvegicus
tctgtgccagcgacaatgccacgta

SEQ ID NO: 598371 - DNA, 25 bp, Rattus norvegicus
tctgtgccagcgtcaatgccacgta

SEQ ID NO: 598372 - DNA, 25 bp, Rattus norvegicus
tctgtgccagtaccatattgctttt

SEQ ID NO: 598373 - DNA, 25 bp, Rattus norvegicus
tctgtgccagtagcatattgctttt

SEQ ID NO: 598374 - DNA, 25 bp, Rattus norvegicus
tctgtgccatgtccactgagtgttg

SEQ ID NO: 598375 - DNA, 25 bp, Rattus norvegicus
tctgtgccatgtcctctgtgagaag

SEQ ID NO: 598376 - DNA, 25 bp, Rattus norvegicus
tctgtgccatgtgcactgagtgttg

SEQ ID NO: 598377 - DNA, 25 bp, Rattus norvegicus
tctgtgccatgtgctctgtgagaag

SEQ ID NO: 598378 - DNA, 25 bp, Rattus norvegicus
tctgtgcccaacagtccacaaataa

SEQ ID NO: 598379 - DNA, 25 bp, Rattus norvegicus
tctgtgcccaactgtccacaaataa

SEQ ID NO: 598380 - DNA, 25 bp, Rattus norvegicus
tctgtgcccgggacaattcatctga

SEQ ID NO: 598381 - DNA, 25 bp, Rattus norvegicus
tctgtgcccgggtcaattcatctga

SEQ ID NO: 598382 - DNA, 25 bp, Rattus norvegicus
tctgtgcctgaacagtggctgacct

SEQ ID NO: 598383 - DNA, 25 bp, Rattus norvegicus
tctgtgcctgaagagtggctgacct

SEQ ID NO: 598384 - DNA, 25 bp, Rattus norvegicus
tctgtgcctgggaacaagtagcgat

SEQ ID NO: 598385 - DNA, 25 bp, Rattus norvegicus
tctgtgcctgggtacaagtagcgat

SEQ ID NO: 598386 - DNA, 25 bp, Rattus norvegicus
tctgtgcgacttacagctactcggg

SEQ ID NO: 598387 - DNA, 25 bp, Rattus norvegicus
tctgtgcgactttcagctactcggg

SEQ ID NO: 598388 - DNA, 25 bp, Rattus norvegicus
tctgtgcgagcacaggcctctgtcc

SEQ ID NO: 598389 - DNA, 25 bp, Rattus norvegicus
tctgtgcgagcagaggcctctgtcc

SEQ ID NO: 598390 - DNA, 25 bp, Rattus norvegicus
tctgtgcgatcccagtgatgcggaa

SEQ ID NO: 598391 - DNA, 25 bp, Rattus norvegicus
tctgtgcgatccgagtgatgcggaa

SEQ ID NO: 598392 - DNA, 25 bp, Rattus norvegicus
tctgtgctcctaaaccctgaagaag

SEQ ID NO: 598393 - DNA, 25 bp, Rattus norvegicus
tctgtgctcctataccctgaagaag

SEQ ID NO: 598394 - DNA, 25 bp, Rattus norvegicus
tctgtgctctccagcctagctcaaa

SEQ ID NO: 598395 - DNA, 25 bp, Rattus norvegicus
tctgtgctctcctgcctagctcaaa

SEQ ID NO: 598396 - DNA, 25 bp, Rattus norvegicus
tctgtgctctggcagagtggaccct

SEQ ID NO: 598397 - DNA, 25 bp, Rattus norvegicus
tctgtgctctgggagagtggaccct

SEQ ID NO: 598398 - DNA, 25 bp, Rattus norvegicus
tctgtgctgagaagtaaatgtcaaa

SEQ ID NO: 598399 - DNA, 25 bp, Rattus norvegicus
tctgtgctgagatgtaaatgtcaaa

SEQ ID NO: 598400 - DNA, 25 bp, Rattus norvegicus
tctgtgctgcatctttctcaagaac

SEQ ID NO: 598401 - DNA, 25 bp, Rattus norvegicus
tctgtgctgcatgtttctcaagaac

SEQ ID NO: 598402 - DNA, 25 bp, Rattus norvegicus
tctgtgctgcccagagcatcagctc

SEQ ID NO: 598403 - DNA, 25 bp, Rattus norvegicus
tctgtgctgccctgagcatcagctc

SEQ ID NO: 598404 - DNA, 25 bp, Rattus norvegicus
tctgtgctggccataccaagtatga

SEQ ID NO: 598405 - DNA, 25 bp, Rattus norvegicus
tctgtgctggccttaccaagtatga

SEQ ID NO: 598406 - DNA, 25 bp, Rattus norvegicus
tctgtgcttctcagccagggctgtg

SEQ ID NO: 598407 - DNA, 25 bp, Rattus norvegicus
tctgtgcttctctgccagggctgtg

SEQ ID NO: 598408 - DNA, 25 bp, Rattus norvegicus
tctgtgcttgtgcacgtttgcacat

SEQ ID NO: 598409 - DNA, 25 bp, Rattus norvegicus
tctgtgcttgtggacgtttgcacat

SEQ ID NO: 598410 - DNA, 25 bp, Rattus norvegicus
tctgtgctttatcttctccagtcct

SEQ ID NO: 598411 - DNA, 25 bp, Rattus norvegicus
tctgtgctttatgttctccagtcct

SEQ ID NO: 598412 - DNA, 25 bp, Rattus norvegicus
tctgtgcttttgcacttctgagttc

SEQ ID NO: 598413 - DNA, 25 bp, Rattus norvegicus
tctgtgcttttggacttctgagttc

SEQ ID NO: 598414 - DNA, 25 bp, Rattus norvegicus
tctgtggacagacgcctggaccctg

SEQ ID NO: 598415 - DNA, 25 bp, Rattus norvegicus
tctgtggacagaggcctggaccctg

SEQ ID NO: 598416 - DNA, 25 bp, Rattus norvegicus
tctgtggacatgacctgtggaggct

SEQ ID NO: 598417 - DNA, 25 bp, Rattus norvegicus
tctgtggacatgtcctgtggaggct

SEQ ID NO: 598418 - DNA, 25 bp, Rattus norvegicus
tctgtggaccatcctatcctcaaac

SEQ ID NO: 598419 - DNA, 25 bp, Rattus norvegicus
tctgtggaccatgctatcctcaaac

SEQ ID NO: 598420 - DNA, 25 bp, Rattus norvegicus
tctgtggaccggaagatgttctcaa

SEQ ID NO: 598421 - DNA, 25 bp, Rattus norvegicus
tctgtggaccggtagatgttctcaa

SEQ ID NO: 598422 - DNA, 25 bp, Rattus norvegicus
tctgtggatattctgacctctgtca

SEQ ID NO: 598423 - DNA, 25 bp, Rattus norvegicus
tctgtggatattgtgacctctgtca

SEQ ID NO: 598424 - DNA, 25 bp, Rattus norvegicus
tctgtggatcgccagaggtcccgat

SEQ ID NO: 598425 - DNA, 25 bp, Rattus norvegicus
tctgtggatcgcgagaggtcccgat

SEQ ID NO: 598426 - DNA, 25 bp, Rattus norvegicus
tctgtggatgaaagagtggctcgca

SEQ ID NO: 598427 - DNA, 25 bp, Rattus norvegicus
tctgtggatgaatgagtggctcgca

SEQ ID NO: 598428 - DNA, 25 bp, Rattus norvegicus
tctgtggatgtgattagggacccca

SEQ ID NO: 598429 - DNA, 25 bp, Rattus norvegicus
tctgtggatgtgtttagggacccca

SEQ ID NO: 598430 - DNA, 25 bp, Rattus norvegicus
tctgtggcacagatggcctcacata

SEQ ID NO: 598431 - DNA, 25 bp, Rattus norvegicus
tctgtggcacagttggcctcacata

SEQ ID NO: 598432 - DNA, 25 bp, Rattus norvegicus
tctgtggcatcgctggtgatctgac

SEQ ID NO: 598433 - DNA, 25 bp, Rattus norvegicus
tctgtggcatcggtggtgatctgac

SEQ ID NO: 598434 - DNA, 25 bp, Rattus norvegicus
tctgtggcatggcaggacctcgcac

SEQ ID NO: 598435 - DNA, 25 bp, Rattus norvegicus
tctgtggcatgggaggacctcgcac

SEQ ID NO: 598436 - DNA, 25 bp, Rattus norvegicus
tctgtggcatttagttcagccggca

SEQ ID NO: 598437 - DNA, 25 bp, Rattus norvegicus
tctgtggcattttgttcagccggca

SEQ ID NO: 598438 - DNA, 25 bp, Rattus norvegicus
tctgtggccagacatttcggccatt

SEQ ID NO: 598439 - DNA, 25 bp, Rattus norvegicus
tctgtggccagagatttcggccatt

SEQ ID NO: 598440 - DNA, 25 bp, Rattus norvegicus
tctgtggccatcagcgagaggttcc

SEQ ID NO: 598441 - DNA, 25 bp, Rattus norvegicus
tctgtggccatctgcgagaggttcc

SEQ ID NO: 598442 - DNA, 25 bp, Rattus norvegicus
tctgtggcccacctatgcgtgaagt

SEQ ID NO: 598443 - DNA, 25 bp, Rattus norvegicus
tctgtggcccacgtatgcgtgaagt

SEQ ID NO: 598444 - DNA, 25 bp, Rattus norvegicus
tctgtggcctcacagtttggagaaa

SEQ ID NO: 598445 - DNA, 25 bp, Rattus norvegicus
tctgtggcctcagagtttggagaaa

SEQ ID NO: 598446 - DNA, 25 bp, Rattus norvegicus
tctgtggcctctagcttggtagaag

SEQ ID NO: 598447 - DNA, 25 bp, Rattus norvegicus
tctgtggcctcttgcttggtagaag

SEQ ID NO: 598448 - DNA, 25 bp, Rattus norvegicus
tctgtggccttgactgtgacacaag

SEQ ID NO: 598449 - DNA, 25 bp, Rattus norvegicus
tctgtggccttgtctgtgacacaag

SEQ ID NO: 598450 - DNA, 25 bp, Rattus norvegicus
tctgtggctgccaggaactcccgag

SEQ ID NO: 598451 - DNA, 25 bp, Rattus norvegicus
tctgtggctgcctggaactcccgag

SEQ ID NO: 598452 - DNA, 25 bp, Rattus norvegicus
tctgtggctggcatattttacttag

SEQ ID NO: 598453 - DNA, 25 bp, Rattus norvegicus
tctgtggctggcttattttacttag

SEQ ID NO: 598454 - DNA, 25 bp, Rattus norvegicus
tctgtggctgtaatgttctgtgtgt

SEQ ID NO: 598455 - DNA, 25 bp, Rattus norvegicus
tctgtggctgtattgttctgtgtgt

SEQ ID NO: 598456 - DNA, 25 bp, Rattus norvegicus
tctgtggctgtccagtacagagcat

SEQ ID NO: 598457 - DNA, 25 bp, Rattus norvegicus
tctgtggctgtcgagtacagagcat

SEQ ID NO: 598458 - DNA, 25 bp, Rattus norvegicus
tctgtggctttgaaaggagcacctt

SEQ ID NO: 598459 - DNA, 25 bp, Rattus norvegicus
tctgtggctttgtaaggagcacctt

SEQ ID NO: 598460 - DNA, 25 bp, Rattus norvegicus
tctgtgggaaaaagagtggcctgcc

SEQ ID NO: 598461 - DNA, 25 bp, Rattus norvegicus
tctgtgggaaaatgagtggcctgcc

SEQ ID NO: 598462 - DNA, 25 bp, Rattus norvegicus
tctgtgggacttcgattctgtggca

SEQ ID NO: 598463 - DNA, 25 bp, Rattus norvegicus
tctgtgggacttggattctgtggca

SEQ ID NO: 598464 - DNA, 25 bp, Rattus norvegicus
tctgtgggcccacgatgagacatcc

SEQ ID NO: 598465 - DNA, 25 bp, Rattus norvegicus
tctgtgggcccaggatgagacatcc

SEQ ID NO: 598466 - DNA, 25 bp, Rattus norvegicus
tctgtgggccgacaacaagtgaaca

SEQ ID NO: 598467 - DNA, 25 bp, Rattus norvegicus
tctgtgggccgagaacaagtgaaca

SEQ ID NO: 598468 - DNA, 25 bp, Rattus norvegicus
tctgtgggcctacctaaagtcctaa

SEQ ID NO: 598469 - DNA, 25 bp, Rattus norvegicus
tctgtgggcctagctaaagtcctaa

SEQ ID NO: 598470 - DNA, 25 bp, Rattus norvegicus
tctgtgggcggccatgttccaaaag

SEQ ID NO: 598471 - DNA, 25 bp, Rattus norvegicus
tctgtgggcggcgatgttccaaaag

SEQ ID NO: 598472 - DNA, 25 bp, Rattus norvegicus
tctgtgggtcttactcaggtttatc

SEQ ID NO: 598473 - DNA, 25 bp, Rattus norvegicus
tctgtgggtctttctcaggtttatc

SEQ ID NO: 598474 - DNA, 25 bp, Rattus norvegicus
tctgtgggtgctcttgcttgctgac

SEQ ID NO: 598475 - DNA, 25 bp, Rattus norvegicus
tctgtgggtgctgttgcttgctgac

SEQ ID NO: 598476 - DNA, 25 bp, Rattus norvegicus
tctgtgggttgactgactcctgaag

SEQ ID NO: 598477 - DNA, 25 bp, Rattus norvegicus
tctgtgggttgagtgactcctgaag

SEQ ID NO: 598478 - DNA, 25 bp, Rattus norvegicus
tctgtggtaaacagccccagtccag

SEQ ID NO: 598479 - DNA, 25 bp, Rattus norvegicus
tctgtggtaaactgccccagtccag

SEQ ID NO: 598480 - DNA, 25 bp, Rattus norvegicus
tctgtggtagagagtgaagccgaca

SEQ ID NO: 598481 - DNA, 25 bp, Rattus norvegicus
tctgtggtagagtgtgaagccgaca

SEQ ID NO: 598482 - DNA, 25 bp, Rattus norvegicus
tctgtggtccacaggtacagcatcc

SEQ ID NO: 598483 - DNA, 25 bp, Rattus norvegicus
tctgtggtccactggtacagcatcc

SEQ ID NO: 598484 - DNA, 25 bp, Rattus norvegicus
tctgtggtttctctattcttgatac

SEQ ID NO: 598485 - DNA, 25 bp, Rattus norvegicus
tctgtggtttctcttgaacccccaa

SEQ ID NO: 598486 - DNA, 25 bp, Rattus norvegicus
tctgtggtttctgtattcttgatac

SEQ ID NO: 598487 - DNA, 25 bp, Rattus norvegicus
tctgtggtttctgttgaacccccaa

SEQ ID NO: 598488 - DNA, 25 bp, Rattus norvegicus
tctgtggtttgtatcagctagcccc

SEQ ID NO: 598489 - DNA, 25 bp, Rattus norvegicus
tctgtggtttgtttcagctagcccc

SEQ ID NO: 598490 - DNA, 25 bp, Rattus norvegicus
tctgtgtaaattcatgtttgcctta

SEQ ID NO: 598491 - DNA, 25 bp, Rattus norvegicus
tctgtgtaaattgatgtttgcctta

SEQ ID NO: 598492 - DNA, 25 bp, Rattus norvegicus
tctgtgtaacatatcttggagtgga

SEQ ID NO: 598493 - DNA, 25 bp, Rattus norvegicus
tctgtgtaacatttcttggagtgga

SEQ ID NO: 598494 - DNA, 25 bp, Rattus norvegicus
tctgtgtagggtccttcttgagcag

SEQ ID NO: 598495 - DNA, 25 bp, Rattus norvegicus
tctgtgtagggtgcttcttgagcag

SEQ ID NO: 598496 - DNA, 25 bp, Rattus norvegicus
tctgtgtaggtacagtcctgagcca

SEQ ID NO: 598497 - DNA, 25 bp, Rattus norvegicus
tctgtgtaggtagagtcctgagcca

SEQ ID NO: 598498 - DNA, 25 bp, Rattus norvegicus
tctgtgtataggcttctgtttcctc

SEQ ID NO: 598499 - DNA, 25 bp, Rattus norvegicus
tctgtgtatagggttctgtttcctc

SEQ ID NO: 598500 - DNA, 25 bp, Rattus norvegicus
tctgtgtatcgtctggttcaccttt

SEQ ID NO: 598501 - DNA, 25 bp, Rattus norvegicus
tctgtgtatcgtgtggttcaccttt

SEQ ID NO: 598502 - DNA, 25 bp, Rattus norvegicus
tctgtgtcaattcctcactcttgag

SEQ ID NO: 598503 - DNA, 25 bp, Rattus norvegicus
tctgtgtcaattgctcactcttgag

SEQ ID NO: 598504 - DNA, 25 bp, Rattus norvegicus
tctgtgtcacctattccttgtgttt

SEQ ID NO: 598505 - DNA, 25 bp, Rattus norvegicus
tctgtgtcaccttttccttgtgttt

SEQ ID NO: 598506 - DNA, 25 bp, Rattus norvegicus
tctgtgtcagggatgtgttctttat

SEQ ID NO: 598507 - DNA, 25 bp, Rattus norvegicus
tctgtgtcagggttgtgttctttat

SEQ ID NO: 598508 - DNA, 25 bp, Rattus norvegicus
tctgtgtcatccaaggaagttcctt

SEQ ID NO: 598509 - DNA, 25 bp, Rattus norvegicus
tctgtgtcatcctaggaagttcctt

SEQ ID NO: 598510 - DNA, 25 bp, Rattus norvegicus
tctgtgtcatgtactgttgaagcag

SEQ ID NO: 598511 - DNA, 25 bp, Rattus norvegicus
tctgtgtcatgttctgttgaagcag

SEQ ID NO: 598512 - DNA, 25 bp, Rattus norvegicus
tctgtgtccaagagcacgcagtttg

SEQ ID NO: 598513 - DNA, 25 bp, Rattus norvegicus
tctgtgtccaagtgcacgcagtttg

SEQ ID NO: 598514 - DNA, 25 bp, Rattus norvegicus
tctgtgtccactatccctacagtag

SEQ ID NO: 598515 - DNA, 25 bp, Rattus norvegicus
tctgtgtccactttccctacagtag

SEQ ID NO: 598516 - DNA, 25 bp, Rattus norvegicus
tctgtgtccccgattgcaagagcag

SEQ ID NO: 598517 - DNA, 25 bp, Rattus norvegicus
tctgtgtccccgtttgcaagagcag

SEQ ID NO: 598518 - DNA, 25 bp, Rattus norvegicus
tctgtgtcctccataatgcctaaaa

SEQ ID NO: 598519 - DNA, 25 bp, Rattus norvegicus
tctgtgtcctccttaatgcctaaaa

SEQ ID NO: 598520 - DNA, 25 bp, Rattus norvegicus
tctgtgtcctgtaatttgggtccca

SEQ ID NO: 598521 - DNA, 25 bp, Rattus norvegicus
tctgtgtcctgttatttgggtccca

SEQ ID NO: 598522 - DNA, 25 bp, Rattus norvegicus
tctgtgtcctttcatgagtgactgt

SEQ ID NO: 598523 - DNA, 25 bp, Rattus norvegicus
tctgtgtcctttgatgagtgactgt

SEQ ID NO: 598524 - DNA, 25 bp, Rattus norvegicus
tctgtgtctagtctcctgtgtggaa

SEQ ID NO: 598525 - DNA, 25 bp, Rattus norvegicus
tctgtgtctagtgtcctgtgtggaa

SEQ ID NO: 598526 - DNA, 25 bp, Rattus norvegicus
tctgtgtctatgcagcggtccggac

SEQ ID NO: 598527 - DNA, 25 bp, Rattus norvegicus
tctgtgtctatggagcggtccggac

SEQ ID NO: 598528 - DNA, 25 bp, Rattus norvegicus
tctgtgtctgctaaataagtcttaa

SEQ ID NO: 598529 - DNA, 25 bp, Rattus norvegicus
tctgtgtctgcttaataagtcttaa

SEQ ID NO: 598530 - DNA, 25 bp, Rattus norvegicus
tctgtgtgagctagccaccattcta

SEQ ID NO: 598531 - DNA, 25 bp, Rattus norvegicus
tctgtgtgagcttgccaccattcta

SEQ ID NO: 598532 - DNA, 25 bp, Rattus norvegicus
tctgtgtgagtactgggagccatcc

SEQ ID NO: 598533 - DNA, 25 bp, Rattus norvegicus
tctgtgtgagtagtgggagccatcc

SEQ ID NO: 598534 - DNA, 25 bp, Rattus norvegicus
tctgtgtgatctcgctggaatgaca

SEQ ID NO: 598535 - DNA, 25 bp, Rattus norvegicus
tctgtgtgatctggctggaatgaca

SEQ ID NO: 598536 - DNA, 25 bp, Rattus norvegicus
tctgtgtgatttcgctggctgtttg

SEQ ID NO: 598537 - DNA, 25 bp, Rattus norvegicus
tctgtgtgatttggctggctgtttg

SEQ ID NO: 598538 - DNA, 25 bp, Rattus norvegicus
tctgtgtgcaccacagtcatgtctc

SEQ ID NO: 598539 - DNA, 25 bp, Rattus norvegicus
tctgtgtgcacctcagtcatgtctc

SEQ ID NO: 598540 - DNA, 25 bp, Rattus norvegicus
tctgtgtgccaacagctggcctcaa

SEQ ID NO: 598541 - DNA, 25 bp, Rattus norvegicus
tctgtgtgccaagagctggcctcaa

SEQ ID NO: 598542 - DNA, 25 bp, Rattus norvegicus
tctgtgtgctcaccgccatgaagat

SEQ ID NO: 598543 - DNA, 25 bp, Rattus norvegicus
tctgtgtgctcagcgccatgaagat

SEQ ID NO: 598544 - DNA, 25 bp, Rattus norvegicus
tctgtgtgctctagcagtgtctgat

SEQ ID NO: 598545 - DNA, 25 bp, Rattus norvegicus
tctgtgtgctcttgcagtgtctgat

SEQ ID NO: 598546 - DNA, 25 bp, Rattus norvegicus
tctgtgtgcttcctgcaagtttgct

SEQ ID NO: 598547 - DNA, 25 bp, Rattus norvegicus
tctgtgtgcttcgtgcaagtttgct

SEQ ID NO: 598548 - DNA, 25 bp, Rattus norvegicus
tctgtgtgtaggactgtagagctgt

SEQ ID NO: 598549 - DNA, 25 bp, Rattus norvegicus
tctgtgtgtaggtctgtagagctgt

SEQ ID NO: 598550 - DNA, 25 bp, Rattus norvegicus
tctgtgtgtcacaggcatttacttg

SEQ ID NO: 598551 - DNA, 25 bp, Rattus norvegicus
tctgtgtgtcactggcatttacttg

SEQ ID NO: 598552 - DNA, 25 bp, Rattus norvegicus
tctgtgtgtctgacagcctctggtt

SEQ ID NO: 598553 - DNA, 25 bp, Rattus norvegicus
tctgtgtgtctgcaccgatgcgtat

SEQ ID NO: 598554 - DNA, 25 bp, Rattus norvegicus
tctgtgtgtctggaccgatgcgtat

SEQ ID NO: 598555 - DNA, 25 bp, Rattus norvegicus
tctgtgtgtctgtcagcctctggtt

SEQ ID NO: 598556 - DNA, 25 bp, Rattus norvegicus
tctgtgtgtgttatgtgtatgggta

SEQ ID NO: 598557 - DNA, 25 bp, Rattus norvegicus
tctgtgtgtgttttgtgtatgggta

SEQ ID NO: 598558 - DNA, 25 bp, Rattus norvegicus
tctgtgtgtttcaagatagctgcta

SEQ ID NO: 598559 - DNA, 25 bp, Rattus norvegicus
tctgtgtgtttctagatagctgcta

SEQ ID NO: 598560 - DNA, 25 bp, Rattus norvegicus
tctgtgttacctacctcattcttta

SEQ ID NO: 598561 - DNA, 25 bp, Rattus norvegicus
tctgtgttaccttcctcattcttta

SEQ ID NO: 598562 - DNA, 25 bp, Rattus norvegicus
tctgtgttatacataactctaggga

SEQ ID NO: 598563 - DNA, 25 bp, Rattus norvegicus
tctgtgttatacttaactctaggga

SEQ ID NO: 598564 - DNA, 25 bp, Rattus norvegicus
tctgtgttcaggatcccagggcagc

SEQ ID NO: 598565 - DNA, 25 bp, Rattus norvegicus
tctgtgttcaggttcccagggcagc

SEQ ID NO: 598566 - DNA, 25 bp, Rattus norvegicus
tctgtgttcattctgctttgcgaca

SEQ ID NO: 598567 - DNA, 25 bp, Rattus norvegicus
tctgtgttcattgtgctttgcgaca

SEQ ID NO: 598568 - DNA, 25 bp, Rattus norvegicus
tctgtgttccacctagtcatcaaat

SEQ ID NO: 598569 - DNA, 25 bp, Rattus norvegicus
tctgtgttccacgtagtcatcaaat

SEQ ID NO: 598570 - DNA, 25 bp, Rattus norvegicus
tctgtgttcctgacagttactggtg

SEQ ID NO: 598571 - DNA, 25 bp, Rattus norvegicus
tctgtgttcctgtcagttactggtg

SEQ ID NO: 598572 - DNA, 25 bp, Rattus norvegicus
tctgtgttgtttatgagccttgctg

SEQ ID NO: 598573 - DNA, 25 bp, Rattus norvegicus
tctgtgttgtttattcccttgataa

SEQ ID NO: 598574 - DNA, 25 bp, Rattus norvegicus
tctgtgttgtttttgagccttgctg

SEQ ID NO: 598575 - DNA, 25 bp, Rattus norvegicus
tctgtgttgttttttcccttgataa

SEQ ID NO: 598576 - DNA, 25 bp, Rattus norvegicus
tctgtgtttaataacccaaccaaag

SEQ ID NO: 598577 - DNA, 25 bp, Rattus norvegicus
tctgtgtttaattacccaaccaaag

SEQ ID NO: 598578 - DNA, 25 bp, Rattus norvegicus
tctgtgtttatgctgcacatttggg

SEQ ID NO: 598579 - DNA, 25 bp, Rattus norvegicus
tctgtgtttatggtgcacatttggg

SEQ ID NO: 598580 - DNA, 25 bp, Rattus norvegicus
tctgtgtttctgattggaagcccct

SEQ ID NO: 598581 - DNA, 25 bp, Rattus norvegicus
tctgtgtttctgtttggaagcccct

SEQ ID NO: 598582 - DNA, 25 bp, Rattus norvegicus
tctgtgtttgtacccattggagaat

SEQ ID NO: 598583 - DNA, 25 bp, Rattus norvegicus
tctgtgtttgtagccattggagaat

SEQ ID NO: 598584 - DNA, 25 bp, Rattus norvegicus
tctgttaacaaaagccctgtccacg

SEQ ID NO: 598585 - DNA, 25 bp, Rattus norvegicus
tctgttaacaaatgccctgtccacg

SEQ ID NO: 598586 - DNA, 25 bp, Rattus norvegicus
tctgttaagggtccccaggagcgcc

SEQ ID NO: 598587 - DNA, 25 bp, Rattus norvegicus
tctgttaagggtgcccaggagcgcc

SEQ ID NO: 598588 - DNA, 25 bp, Rattus norvegicus
tctgttacctgcattctgaaatggc

SEQ ID NO: 598589 - DNA, 25 bp, Rattus norvegicus
tctgttacctgctttctgaaatggc

SEQ ID NO: 598590 - DNA, 25 bp, Rattus norvegicus
tctgttactctactcccaggagacc

SEQ ID NO: 598591 - DNA, 25 bp, Rattus norvegicus
tctgttactctagtcccaggagacc

SEQ ID NO: 598592 - DNA, 25 bp, Rattus norvegicus
tctgttacttaaacctgtcactcca

SEQ ID NO: 598593 - DNA, 25 bp, Rattus norvegicus
tctgttacttaatcctgtcactcca

SEQ ID NO: 598594 - DNA, 25 bp, Rattus norvegicus
tctgttagaaaaatcttccccaaag

SEQ ID NO: 598595 - DNA, 25 bp, Rattus norvegicus
tctgttagaaaattcttccccaaag

SEQ ID NO: 598596 - DNA, 25 bp, Rattus norvegicus
tctgttagtaggcaagacactcaca

SEQ ID NO: 598597 - DNA, 25 bp, Rattus norvegicus
tctgttagtagggaagacactcaca

SEQ ID NO: 598598 - DNA, 25 bp, Rattus norvegicus
tctgttatacttaggctgtggagca

SEQ ID NO: 598599 - DNA, 25 bp, Rattus norvegicus
tctgttatactttggctgtggagca

SEQ ID NO: 598600 - DNA, 25 bp, Rattus norvegicus
tctgttatagggaccccccctgacg

SEQ ID NO: 598601 - DNA, 25 bp, Rattus norvegicus
tctgttatagggtccccccctgacg

SEQ ID NO: 598602 - DNA, 25 bp, Rattus norvegicus
tctgttatcacccagaatccccaaa

SEQ ID NO: 598603 - DNA, 25 bp, Rattus norvegicus
tctgttatcaccgagaatccccaaa

SEQ ID NO: 598604 - DNA, 25 bp, Rattus norvegicus
tctgttatcacgacccatcttagag

SEQ ID NO: 598605 - DNA, 25 bp, Rattus norvegicus
tctgttatcacgtcccatcttagag

SEQ ID NO: 598606 - DNA, 25 bp, Rattus norvegicus
tctgttatccagaactccccgttag

SEQ ID NO: 598607 - DNA, 25 bp, Rattus norvegicus
tctgttatccagtactccccgttag

SEQ ID NO: 598608 - DNA, 25 bp, Rattus norvegicus
tctgttattatccaccacgaagcta

SEQ ID NO: 598609 - DNA, 25 bp, Rattus norvegicus
tctgttattatcgaccacgaagcta

SEQ ID NO: 598610 - DNA, 25 bp, Rattus norvegicus
tctgttattgagagcctgttctagg

SEQ ID NO: 598611 - DNA, 25 bp, Rattus norvegicus
tctgttattgagtgcctgttctagg

SEQ ID NO: 598612 - DNA, 25 bp, Rattus norvegicus
tctgttattgtaaggcctggccaac

SEQ ID NO: 598613 - DNA, 25 bp, Rattus norvegicus
tctgttattgtatggcctggccaac

SEQ ID NO: 598614 - DNA, 25 bp, Rattus norvegicus
tctgttcacagccaccgtagatatg

SEQ ID NO: 598615 - DNA, 25 bp, Rattus norvegicus
tctgttcacagcgaccgtagatatg

SEQ ID NO: 598616 - DNA, 25 bp, Rattus norvegicus
tctgttcacgacaggagccggcccg

SEQ ID NO: 598617 - DNA, 25 bp, Rattus norvegicus
tctgttcacgactggagccggcccg

SEQ ID NO: 598618 - DNA, 25 bp, Rattus norvegicus
tctgttcatcgcatctgtgtttatg

SEQ ID NO: 598619 - DNA, 25 bp, Rattus norvegicus
tctgttcatcgcttctgtgtttatg

SEQ ID NO: 598620 - DNA, 25 bp, Rattus norvegicus
tctgttcatgacaggtggagcccca

SEQ ID NO: 598621 - DNA, 25 bp, Rattus norvegicus
tctgttcatgactggtggagcccca

SEQ ID NO: 598622 - DNA, 25 bp, Rattus norvegicus
tctgttcatggcattcattcactgt

SEQ ID NO: 598623 - DNA, 25 bp, Rattus norvegicus
tctgttcatggctttcattcactgt

SEQ ID NO: 598624 - DNA, 25 bp, Rattus norvegicus
tctgttcattctactcactgtggaa

SEQ ID NO: 598625 - DNA, 25 bp, Rattus norvegicus
tctgttcattcttctcactgtggaa

SEQ ID NO: 598626 - DNA, 25 bp, Rattus norvegicus
tctgttcatttcaacgactggaggt

SEQ ID NO: 598627 - DNA, 25 bp, Rattus norvegicus
tctgttcatttctacgactggaggt

SEQ ID NO: 598628 - DNA, 25 bp, Rattus norvegicus
tctgttcattttcgtctctgactct

SEQ ID NO: 598629 - DNA, 25 bp, Rattus norvegicus
tctgttcattttggtctctgactct

SEQ ID NO: 598630 - DNA, 25 bp, Rattus norvegicus
tctgttccaggaagcggtggcgatc

SEQ ID NO: 598631 - DNA, 25 bp, Rattus norvegicus
tctgttccaggactagttactgctt

SEQ ID NO: 598632 - DNA, 25 bp, Rattus norvegicus
tctgttccaggagtagttactgctt

SEQ ID NO: 598633 - DNA, 25 bp, Rattus norvegicus
tctgttccaggatgcggtggcgatc

SEQ ID NO: 598634 - DNA, 25 bp, Rattus norvegicus
tctgttccaggccttgtacttcagc

SEQ ID NO: 598635 - DNA, 25 bp, Rattus norvegicus
tctgttccaggcgttgtacttcagc

SEQ ID NO: 598636 - DNA, 25 bp, Rattus norvegicus
tctgttccatttccccaagttttgt

SEQ ID NO: 598637 - DNA, 25 bp, Rattus norvegicus
tctgttccatttgcccaagttttgt

SEQ ID NO: 598638 - DNA, 25 bp, Rattus norvegicus
tctgttcccacacgcgtgtgaagtg

SEQ ID NO: 598639 - DNA, 25 bp, Rattus norvegicus
tctgttcccacaggcgtgtgaagtg

SEQ ID NO: 598640 - DNA, 25 bp, Rattus norvegicus
tctgttcccagcagggcatgtggaa

SEQ ID NO: 598641 - DNA, 25 bp, Rattus norvegicus
tctgttcccagctgggcatgtggaa

SEQ ID NO: 598642 - DNA, 25 bp, Rattus norvegicus
tctgttcccagtactgtgatgtacc

SEQ ID NO: 598643 - DNA, 25 bp, Rattus norvegicus
tctgttcccagtagcattccaaaac

SEQ ID NO: 598644 - DNA, 25 bp, Rattus norvegicus
tctgttcccagttctgtgatgtacc

SEQ ID NO: 598645 - DNA, 25 bp, Rattus norvegicus
tctgttcccagttgcattccaaaac

SEQ ID NO: 598646 - DNA, 25 bp, Rattus norvegicus
tctgttcccctgatttgtcttaaag

SEQ ID NO: 598647 - DNA, 25 bp, Rattus norvegicus
tctgttcccctgttttgtcttaaag

SEQ ID NO: 598648 - DNA, 25 bp, Rattus norvegicus
tctgttccctagacatgggctgtga

SEQ ID NO: 598649 - DNA, 25 bp, Rattus norvegicus
tctgttccctagtcatgggctgtga

SEQ ID NO: 598650 - DNA, 25 bp, Rattus norvegicus
tctgttcctggcatcaatgaagtca

SEQ ID NO: 598651 - DNA, 25 bp, Rattus norvegicus
tctgttcctggccactgaagagaga

SEQ ID NO: 598652 - DNA, 25 bp, Rattus norvegicus
tctgttcctggcgactgaagagaga

SEQ ID NO: 598653 - DNA, 25 bp, Rattus norvegicus
tctgttcctggcttcaatgaagtca

SEQ ID NO: 598654 - DNA, 25 bp, Rattus norvegicus
tctgttctacagaccgaggcgagta

SEQ ID NO: 598655 - DNA, 25 bp, Rattus norvegicus
tctgttctacagtccgaggcgagta

SEQ ID NO: 598656 - DNA, 25 bp, Rattus norvegicus
tctgttctagctattatggccctca

SEQ ID NO: 598657 - DNA, 25 bp, Rattus norvegicus
tctgttctagcttttatggccctca

SEQ ID NO: 598658 - DNA, 25 bp, Rattus norvegicus
tctgttctcagtcttctgctagcat

SEQ ID NO: 598659 - DNA, 25 bp, Rattus norvegicus
tctgttctcagtgttctgctagcat

SEQ ID NO: 598660 - DNA, 25 bp, Rattus norvegicus
tctgttctcatgaagatcacacttg

SEQ ID NO: 598661 - DNA, 25 bp, Rattus norvegicus
tctgttctcatgtagatcacacttg

SEQ ID NO: 598662 - DNA, 25 bp, Rattus norvegicus
tctgttctctgtcctcttctaaata

SEQ ID NO: 598663 - DNA, 25 bp, Rattus norvegicus
tctgttctctgtgctcttctaaata

SEQ ID NO: 598664 - DNA, 25 bp, Rattus norvegicus
tctgttctcttccttattaaaattt

SEQ ID NO: 598665 - DNA, 25 bp, Rattus norvegicus
tctgttctcttcgttattaaaattt

SEQ ID NO: 598666 - DNA, 25 bp, Rattus norvegicus
tctgttctgcctatctgaacctaaa

SEQ ID NO: 598667 - DNA, 25 bp, Rattus norvegicus
tctgttctgcctttctgaacctaaa

SEQ ID NO: 598668 - DNA, 25 bp, Rattus norvegicus
tctgttctggaaccacgagccaaaa

SEQ ID NO: 598669 - DNA, 25 bp, Rattus norvegicus
tctgttctggaagcacgagccaaaa

SEQ ID NO: 598670 - DNA, 25 bp, Rattus norvegicus
tctgttctggttcccactctgaaaa

SEQ ID NO: 598671 - DNA, 25 bp, Rattus norvegicus
tctgttctggttgccactctgaaaa

SEQ ID NO: 598672 - DNA, 25 bp, Rattus norvegicus
tctgttctgtcaactgccattcagc

SEQ ID NO: 598673 - DNA, 25 bp, Rattus norvegicus
tctgttctgtcatctgccattcagc

SEQ ID NO: 598674 - DNA, 25 bp, Rattus norvegicus
tctgttctgtttctgttggtgatac

SEQ ID NO: 598675 - DNA, 25 bp, Rattus norvegicus
tctgttctgtttgtgttggtgatac

SEQ ID NO: 598676 - DNA, 25 bp, Rattus norvegicus
tctgttcttaatacaaggacactgg

SEQ ID NO: 598677 - DNA, 25 bp, Rattus norvegicus
tctgttcttaattcaaggacactgg

SEQ ID NO: 598678 - DNA, 25 bp, Rattus norvegicus
tctgttcttacaactcgtctgcaaa

SEQ ID NO: 598679 - DNA, 25 bp, Rattus norvegicus
tctgttcttacatctcgtctgcaaa

SEQ ID NO: 598680 - DNA, 25 bp, Rattus norvegicus
tctgttcttagacctgtcctctaaa

SEQ ID NO: 598681 - DNA, 25 bp, Rattus norvegicus
tctgttcttagagctgtcctctaaa

SEQ ID NO: 598682 - DNA, 25 bp, Rattus norvegicus
tctgttcttattcgtgacatccgtc

SEQ ID NO: 598683 - DNA, 25 bp, Rattus norvegicus
tctgttcttattggtgacatccgtc

SEQ ID NO: 598684 - DNA, 25 bp, Rattus norvegicus
tctgttcttcctcctccttacagta

SEQ ID NO: 598685 - DNA, 25 bp, Rattus norvegicus
tctgttcttcctgctccttacagta

SEQ ID NO: 598686 - DNA, 25 bp, Rattus norvegicus
tctgttctttgaagtggattctcat

SEQ ID NO: 598687 - DNA, 25 bp, Rattus norvegicus
tctgttctttgatgtggattctcat

SEQ ID NO: 598688 - DNA, 25 bp, Rattus norvegicus
tctgttgaaattaaagcggccttaa

SEQ ID NO: 598689 - DNA, 25 bp, Rattus norvegicus
tctgttgaaatttaagcggccttaa

SEQ ID NO: 598690 - DNA, 25 bp, Rattus norvegicus
tctgttgacattacccacgtacata

SEQ ID NO: 598691 - DNA, 25 bp, Rattus norvegicus
tctgttgacatttcccacgtacata

SEQ ID NO: 598692 - DNA, 25 bp, Rattus norvegicus
tctgttgactgtctgacatcggata

SEQ ID NO: 598693 - DNA, 25 bp, Rattus norvegicus
tctgttgactgtgtgacatcggata

SEQ ID NO: 598694 - DNA, 25 bp, Rattus norvegicus
tctgttgcagttaccctggatagta

SEQ ID NO: 598695 - DNA, 25 bp, Rattus norvegicus
tctgttgcagtttccctggatagta

SEQ ID NO: 598696 - DNA, 25 bp, Rattus norvegicus
tctgttgcccaccattgtttgtaat

SEQ ID NO: 598697 - DNA, 25 bp, Rattus norvegicus
tctgttgcccacgattgtttgtaat

SEQ ID NO: 598698 - DNA, 25 bp, Rattus norvegicus
tctgttgcccataactatatatgtg

SEQ ID NO: 598699 - DNA, 25 bp, Rattus norvegicus
tctgttgcccattactatatatgtg

SEQ ID NO: 598700 - DNA, 25 bp, Rattus norvegicus
tctgttgccgaaaccacagatgcgt

SEQ ID NO: 598701 - DNA, 25 bp, Rattus norvegicus
tctgttgccgaatccacagatgcgt

SEQ ID NO: 598702 - DNA, 25 bp, Rattus norvegicus
tctgttgcctggactgggctaatta

SEQ ID NO: 598703 - DNA, 25 bp, Rattus norvegicus
tctgttgcctggtctgggctaatta

SEQ ID NO: 598704 - DNA, 25 bp, Rattus norvegicus
tctgttgctctcactaatgcaaagg

SEQ ID NO: 598705 - DNA, 25 bp, Rattus norvegicus
tctgttgctctctctaatgcaaagg

SEQ ID NO: 598706 - DNA, 25 bp, Rattus norvegicus
tctgttgctggtaggagaggccttt

SEQ ID NO: 598707 - DNA, 25 bp, Rattus norvegicus
tctgttgctggttggagaggccttt

SEQ ID NO: 598708 - DNA, 25 bp, Rattus norvegicus
tctgttgctgttaatgccttcatat

SEQ ID NO: 598709 - DNA, 25 bp, Rattus norvegicus
tctgttgctgtttatgccttcatat

SEQ ID NO: 598710 - DNA, 25 bp, Rattus norvegicus
tctgttgcttccctgatctctgcaa

SEQ ID NO: 598711 - DNA, 25 bp, Rattus norvegicus
tctgttgcttccgtgatctctgcaa

SEQ ID NO: 598712 - DNA, 25 bp, Rattus norvegicus
tctgttgggacacttgggagcaaaa

SEQ ID NO: 598713 - DNA, 25 bp, Rattus norvegicus
tctgttgggacagttgggagcaaaa

SEQ ID NO: 598714 - DNA, 25 bp, Rattus norvegicus
tctgttgggtgactgcaagtgaact

SEQ ID NO: 598715 - DNA, 25 bp, Rattus norvegicus
tctgttgggtgagtgcaagtgaact

SEQ ID NO: 598716 - DNA, 25 bp, Rattus norvegicus
tctgttggtagactggacgtccgtc

SEQ ID NO: 598717 - DNA, 25 bp, Rattus norvegicus
tctgttggtagagtggacgtccgtc

SEQ ID NO: 598718 - DNA, 25 bp, Rattus norvegicus
tctgttggtttaaactgtgccctta

SEQ ID NO: 598719 - DNA, 25 bp, Rattus norvegicus
tctgttggtttatactgtgccctta

SEQ ID NO: 598720 - DNA, 25 bp, Rattus norvegicus
tctgttgtctgcatggctcatgcca

SEQ ID NO: 598721 - DNA, 25 bp, Rattus norvegicus
tctgttgtctgcttggctcatgcca

SEQ ID NO: 598722 - DNA, 25 bp, Rattus norvegicus
tctgttgtgctgatgactgttgtga

SEQ ID NO: 598723 - DNA, 25 bp, Rattus norvegicus
tctgttgtgctgttgactgttgtga

SEQ ID NO: 598724 - DNA, 25 bp, Rattus norvegicus
tctgttgtggacatgctcctgcctt

SEQ ID NO: 598725 - DNA, 25 bp, Rattus norvegicus
tctgttgtggacttgctcctgcctt

SEQ ID NO: 598726 - DNA, 25 bp, Rattus norvegicus
tctgttgttcctcggcttcaagtta

SEQ ID NO: 598727 - DNA, 25 bp, Rattus norvegicus
tctgttgttcctgggcttcaagtta

SEQ ID NO: 598728 - DNA, 25 bp, Rattus norvegicus
tctgttgttctgaagactgcataat

SEQ ID NO: 598729 - DNA, 25 bp, Rattus norvegicus
tctgttgttctgtagactgcataat

SEQ ID NO: 598730 - DNA, 25 bp, Rattus norvegicus
tctgttgttgaaaggcagcctctgc

SEQ ID NO: 598731 - DNA, 25 bp, Rattus norvegicus
tctgttgttgaatggcagcctctgc

SEQ ID NO: 598732 - DNA, 25 bp, Rattus norvegicus
tctgttgttgctatgatcggtctct

SEQ ID NO: 598733 - DNA, 25 bp, Rattus norvegicus
tctgttgttgctttgatcggtctct

SEQ ID NO: 598734 - DNA, 25 bp, Rattus norvegicus
tctgttgttgggacatgtgctgagc

SEQ ID NO: 598735 - DNA, 25 bp, Rattus norvegicus
tctgttgttgggtcatgtgctgagc

SEQ ID NO: 598736 - DNA, 25 bp, Rattus norvegicus
tctgttgtttaaacttagctctggg

SEQ ID NO: 598737 - DNA, 25 bp, Rattus norvegicus
tctgttgtttaatcttagctctggg

SEQ ID NO: 598738 - DNA, 25 bp, Rattus norvegicus
tctgttgtttgaatcctctctatac

SEQ ID NO: 598739 - DNA, 25 bp, Rattus norvegicus
tctgttgtttgattcctctctatac

SEQ ID NO: 598740 - DNA, 25 bp, Rattus norvegicus
tctgttgtttgtaccattcccatag

SEQ ID NO: 598741 - DNA, 25 bp, Rattus norvegicus
tctgttgtttgttccattcccatag

SEQ ID NO: 598742 - DNA, 25 bp, Rattus norvegicus
tctgttgttttgattgcctaatttt

SEQ ID NO: 598743 - DNA, 25 bp, Rattus norvegicus
tctgttgttttgtttgcctaatttt

SEQ ID NO: 598744 - DNA, 25 bp, Rattus norvegicus
tctgtttacactctcatgatcctga

SEQ ID NO: 598745 - DNA, 25 bp, Rattus norvegicus
tctgtttacactgtcatgatcctga

SEQ ID NO: 598746 - DNA, 25 bp, Rattus norvegicus
tctgtttactctaggcacatggcat

SEQ ID NO: 598747 - DNA, 25 bp, Rattus norvegicus
tctgtttactcttggcacatggcat

SEQ ID NO: 598748 - DNA, 25 bp, Rattus norvegicus
tctgtttccagcaccctcgtgtaaa

SEQ ID NO: 598749 - DNA, 25 bp, Rattus norvegicus
tctgtttccagctccctcgtgtaaa

SEQ ID NO: 598750 - DNA, 25 bp, Rattus norvegicus
tctgtttccattagaccaagagctt

SEQ ID NO: 598751 - DNA, 25 bp, Rattus norvegicus
tctgtttccatttgaccaagagctt

SEQ ID NO: 598752 - DNA, 25 bp, Rattus norvegicus
tctgtttcccagctaagtcataata

SEQ ID NO: 598753 - DNA, 25 bp, Rattus norvegicus
tctgtttcccaggtaagtcataata

SEQ ID NO: 598754 - DNA, 25 bp, Rattus norvegicus
tctgtttccccaaagcttgctgctt

SEQ ID NO: 598755 - DNA, 25 bp, Rattus norvegicus
tctgtttccccatagcttgctgctt

SEQ ID NO: 598756 - DNA, 25 bp, Rattus norvegicus
tctgtttccttcagatgaaaaacta

SEQ ID NO: 598757 - DNA, 25 bp, Rattus norvegicus
tctgtttccttctgatgaaaaacta

SEQ ID NO: 598758 - DNA, 25 bp, Rattus norvegicus
tctgtttcgtttattctgttgttgg

SEQ ID NO: 598759 - DNA, 25 bp, Rattus norvegicus
tctgtttcgttttttctgttgttgg

SEQ ID NO: 598760 - DNA, 25 bp, Rattus norvegicus
tctgtttctctgagttcatcttgac

SEQ ID NO: 598761 - DNA, 25 bp, Rattus norvegicus
tctgtttctctgtgttcatcttgac

SEQ ID NO: 598762 - DNA, 25 bp, Rattus norvegicus
tctgtttctcttattgaccaaagga

SEQ ID NO: 598763 - DNA, 25 bp, Rattus norvegicus
tctgtttctctttttgaccaaagga

SEQ ID NO: 598764 - DNA, 25 bp, Rattus norvegicus
tctgtttgatgaccctttattcttt

SEQ ID NO: 598765 - DNA, 25 bp, Rattus norvegicus
tctgtttgatgagcctttattcttt

SEQ ID NO: 598766 - DNA, 25 bp, Rattus norvegicus
tctgtttgatgtcttggtctttttt

SEQ ID NO: 598767 - DNA, 25 bp, Rattus norvegicus
tctgtttgatgtgttggtctttttt

SEQ ID NO: 598768 - DNA, 25 bp, Rattus norvegicus
tctgtttgctccattccatgttgta

SEQ ID NO: 598769 - DNA, 25 bp, Rattus norvegicus
tctgtttgctcctttccatgttgta

SEQ ID NO: 598770 - DNA, 25 bp, Rattus norvegicus
tctgtttgctttcgtttctcatacc

SEQ ID NO: 598771 - DNA, 25 bp, Rattus norvegicus
tctgtttgctttggtttctcatacc

SEQ ID NO: 598772 - DNA, 25 bp, Rattus norvegicus
tctgtttggaagactcagtgtgaac

SEQ ID NO: 598773 - DNA, 25 bp, Rattus norvegicus
tctgtttggaagtctcagtgtgaac

SEQ ID NO: 598774 - DNA, 25 bp, Rattus norvegicus
tctgtttggtttaagtcgctggaaa

SEQ ID NO: 598775 - DNA, 25 bp, Rattus norvegicus
tctgtttggttttagtcgctggaaa

SEQ ID NO: 598776 - DNA, 25 bp, Rattus norvegicus
tctgtttgtctcatgcctatgaccc

SEQ ID NO: 598777 - DNA, 25 bp, Rattus norvegicus
tctgtttgtctcttgcctatgaccc

SEQ ID NO: 598778 - DNA, 25 bp, Rattus norvegicus
tctgtttgtgccaccttattttaat

SEQ ID NO: 598779 - DNA, 25 bp, Rattus norvegicus
tctgtttgtgcctccttattttaat

SEQ ID NO: 598780 - DNA, 25 bp, Rattus norvegicus
tctgtttgttaaagaggccgcctac

SEQ ID NO: 598781 - DNA, 25 bp, Rattus norvegicus
tctgtttgttaatgaggccgcctac

SEQ ID NO: 598782 - DNA, 25 bp, Rattus norvegicus
tctgtttgtttgataccagctggtg

SEQ ID NO: 598783 - DNA, 25 bp, Rattus norvegicus
tctgtttgtttgctttggagtttct

SEQ ID NO: 598784 - DNA, 25 bp, Rattus norvegicus
tctgtttgtttggtttggagtttct

SEQ ID NO: 598785 - DNA, 25 bp, Rattus norvegicus
tctgtttgtttgttaccagctggtg

SEQ ID NO: 598786 - DNA, 25 bp, Rattus norvegicus
tctgttttaagtccttccctacttg

SEQ ID NO: 598787 - DNA, 25 bp, Rattus norvegicus
tctgttttaagtgcttccctacttg

SEQ ID NO: 598788 - DNA, 25 bp, Rattus norvegicus
tctgttttacgacccaggaccttgt

SEQ ID NO: 598789 - DNA, 25 bp, Rattus norvegicus
tctgttttacgagccaggaccttgt

SEQ ID NO: 598790 - DNA, 25 bp, Rattus norvegicus
tctgttttatggcaaatatcctatg

SEQ ID NO: 598791 - DNA, 25 bp, Rattus norvegicus
tctgttttatgggaaatatcctatg

SEQ ID NO: 598792 - DNA, 25 bp, Rattus norvegicus
tctgttttccagaagattctcagta

SEQ ID NO: 598793 - DNA, 25 bp, Rattus norvegicus
tctgttttccagacttacgtaagaa

SEQ ID NO: 598794 - DNA, 25 bp, Rattus norvegicus
tctgttttccagtagattctcagta

SEQ ID NO: 598795 - DNA, 25 bp, Rattus norvegicus
tctgttttccagtcttacgtaagaa

SEQ ID NO: 598796 - DNA, 25 bp, Rattus norvegicus
tctgttttccgtacctgggagtaat

SEQ ID NO: 598797 - DNA, 25 bp, Rattus norvegicus
tctgttttccgttcctgggagtaat

SEQ ID NO: 598798 - DNA, 25 bp, Rattus norvegicus
tctgttttcgtccttttctcaggaa

SEQ ID NO: 598799 - DNA, 25 bp, Rattus norvegicus
tctgttttcgtcgttttctcaggaa

SEQ ID NO: 598800 - DNA, 25 bp, Rattus norvegicus
tctgttttctcaccttaggttggag

SEQ ID NO: 598801 - DNA, 25 bp, Rattus norvegicus
tctgttttctcagcttaggttggag

SEQ ID NO: 598802 - DNA, 25 bp, Rattus norvegicus
tctgttttgagaatactggaccatc

SEQ ID NO: 598803 - DNA, 25 bp, Rattus norvegicus
tctgttttgagattactggaccatc

SEQ ID NO: 598804 - DNA, 25 bp, Rattus norvegicus
tctgttttgagcatgactccctgaa

SEQ ID NO: 598805 - DNA, 25 bp, Rattus norvegicus
tctgttttgagcttgactccctgaa

SEQ ID NO: 598806 - DNA, 25 bp, Rattus norvegicus
tctgttttgtctcaagtgctgccac

SEQ ID NO: 598807 - DNA, 25 bp, Rattus norvegicus
tctgttttgtctgaagtgctgccac

SEQ ID NO: 598808 - DNA, 25 bp, Rattus norvegicus
tctgtttttaagcaccgagtaccaa

SEQ ID NO: 598809 - DNA, 25 bp, Rattus norvegicus
tctgtttttaaggaccgagtaccaa

SEQ ID NO: 598810 - DNA, 25 bp, Rattus norvegicus
tctgtttttcagctacgtcaagttg

SEQ ID NO: 598811 - DNA, 25 bp, Rattus norvegicus
tctgtttttcaggtacgtcaagttg

SEQ ID NO: 598812 - DNA, 25 bp, Rattus norvegicus
tctgtttttccccattgtgaatgct

SEQ ID NO: 598813 - DNA, 25 bp, Rattus norvegicus
tctgtttttcccctctaattataga

SEQ ID NO: 598814 - DNA, 25 bp, Rattus norvegicus
tctgtttttcccgattgtgaatgct

SEQ ID NO: 598815 - DNA, 25 bp, Rattus norvegicus
tctgtttttcccgtctaattataga

SEQ ID NO: 598816 - DNA, 25 bp, Rattus norvegicus
tctgtttttctcacacagtccaccg

SEQ ID NO: 598817 - DNA, 25 bp, Rattus norvegicus
tctgtttttctctcacagtccaccg

SEQ ID NO: 598818 - DNA, 25 bp, Rattus norvegicus
tctgtttttcttacaggtcgggtag

SEQ ID NO: 598819 - DNA, 25 bp, Rattus norvegicus
tctgtttttctttcaggtcgggtag

SEQ ID NO: 598820 - DNA, 25 bp, Rattus norvegicus
tctgtttttgacagtggatgccact

SEQ ID NO: 598821 - DNA, 25 bp, Rattus norvegicus
tctgtttttgactgtggatgccact

SEQ ID NO: 598822 - DNA, 25 bp, Rattus norvegicus
tcttaaaccattcttagtctctgcc

SEQ ID NO: 598823 - DNA, 25 bp, Rattus norvegicus
tcttaaaccattgttagtctctgcc

SEQ ID NO: 598824 - DNA, 25 bp, Rattus norvegicus
tcttaaacccagactccagagctgg

SEQ ID NO: 598825 - DNA, 25 bp, Rattus norvegicus
tcttaaacccagtctccagagctgg

SEQ ID NO: 598826 - DNA, 25 bp, Rattus norvegicus
tcttaaaccctacctgcaagcatag

SEQ ID NO: 598827 - DNA, 25 bp, Rattus norvegicus
tcttaaaccctagctgcaagcatag

SEQ ID NO: 598828 - DNA, 25 bp, Rattus norvegicus
tcttaaacctccacagccttatttt

SEQ ID NO: 598829 - DNA, 25 bp, Rattus norvegicus
tcttaaacctcctcagccttatttt

SEQ ID NO: 598830 - DNA, 25 bp, Rattus norvegicus
tcttaaactgttcttcagctgggag

SEQ ID NO: 598831 - DNA, 25 bp, Rattus norvegicus
tcttaaactgttgttcagctgggag

SEQ ID NO: 598832 - DNA, 25 bp, Rattus norvegicus
tcttaaacttgaaaaaactgctcca

SEQ ID NO: 598833 - DNA, 25 bp, Rattus norvegicus
tcttaaacttgacatcctcttgcct

SEQ ID NO: 598834 - DNA, 25 bp, Rattus norvegicus
tcttaaacttgagatcctcttgcct

SEQ ID NO: 598835 - DNA, 25 bp, Rattus norvegicus
tcttaaacttgataaaactgctcca

SEQ ID NO: 598836 - DNA, 25 bp, Rattus norvegicus
tcttaacacctgcactttacctgat

SEQ ID NO: 598837 - DNA, 25 bp, Rattus norvegicus
tcttaacacctggactttacctgat

SEQ ID NO: 598838 - DNA, 25 bp, Rattus norvegicus
tcttaacactcacggtagacgtaga

SEQ ID NO: 598839 - DNA, 25 bp, Rattus norvegicus
tcttaacactcagggtagacgtaga

SEQ ID NO: 598840 - DNA, 25 bp, Rattus norvegicus
tcttaacactggattgtccgcatgt

SEQ ID NO: 598841 - DNA, 25 bp, Rattus norvegicus
tcttaacactggtttgtccgcatgt

SEQ ID NO: 598842 - DNA, 25 bp, Rattus norvegicus
tcttaacaggcccagaattccgttt

SEQ ID NO: 598843 - DNA, 25 bp, Rattus norvegicus
tcttaacaggccgagaattccgttt

SEQ ID NO: 598844 - DNA, 25 bp, Rattus norvegicus
tcttaacgtgtcatgctgtggtgca

SEQ ID NO: 598845 - DNA, 25 bp, Rattus norvegicus
tcttaacgtgtcttgctgtggtgca

SEQ ID NO: 598846 - DNA, 25 bp, Rattus norvegicus
tcttaactattcatgtctccgctac

SEQ ID NO: 598847 - DNA, 25 bp, Rattus norvegicus
tcttaactattcttgtctccgctac

SEQ ID NO: 598848 - DNA, 25 bp, Rattus norvegicus
tcttaactgctcctgttttgttttt

SEQ ID NO: 598849 - DNA, 25 bp, Rattus norvegicus
tcttaactgctcgtgttttgttttt

SEQ ID NO: 598850 - DNA, 25 bp, Rattus norvegicus
tcttaacttatcacccggctgtaaa

SEQ ID NO: 598851 - DNA, 25 bp, Rattus norvegicus
tcttaacttatctcccggctgtaaa

SEQ ID NO: 598852 - DNA, 25 bp, Rattus norvegicus
tcttaagaacctccagggcctggac

SEQ ID NO: 598853 - DNA, 25 bp, Rattus norvegicus
tcttaagaacctgcagggcctggac

SEQ ID NO: 598854 - DNA, 25 bp, Rattus norvegicus
tcttaagaaggaatggcacagtgca

SEQ ID NO: 598855 - DNA, 25 bp, Rattus norvegicus
tcttaagaaggattggcacagtgca

SEQ ID NO: 598856 - DNA, 25 bp, Rattus norvegicus
tcttaagaaggccacccaacggttg

SEQ ID NO: 598857 - DNA, 25 bp, Rattus norvegicus
tcttaagaaggcgacccaacggttg

SEQ ID NO: 598858 - DNA, 25 bp, Rattus norvegicus
tcttaagagcacatgcccctgggtg

SEQ ID NO: 598859 - DNA, 25 bp, Rattus norvegicus
tcttaagagcacttgcccctgggtg

SEQ ID NO: 598860 - DNA, 25 bp, Rattus norvegicus
tcttaagagggcagcctccggacaa

SEQ ID NO: 598861 - DNA, 25 bp, Rattus norvegicus
tcttaagagggctgcctccggacaa

SEQ ID NO: 598862 - DNA, 25 bp, Rattus norvegicus
tcttaagcttgtatcgggaccgagt

SEQ ID NO: 598863 - DNA, 25 bp, Rattus norvegicus
tcttaagcttgtttcgggaccgagt

SEQ ID NO: 598864 - DNA, 25 bp, Rattus norvegicus
tcttaaggctaaatcctggaacaag

SEQ ID NO: 598865 - DNA, 25 bp, Rattus norvegicus
tcttaaggctaattcctggaacaag

SEQ ID NO: 598866 - DNA, 25 bp, Rattus norvegicus
tcttaaggtaggaacgcctggccct

SEQ ID NO: 598867 - DNA, 25 bp, Rattus norvegicus
tcttaaggtaggtacgcctggccct

SEQ ID NO: 598868 - DNA, 25 bp, Rattus norvegicus
tcttaagtaggtatccttggcatct

SEQ ID NO: 598869 - DNA, 25 bp, Rattus norvegicus
tcttaagtaggtttccttggcatct

SEQ ID NO: 598870 - DNA, 25 bp, Rattus norvegicus
tcttaagtctttatcctaaaccatg

SEQ ID NO: 598871 - DNA, 25 bp, Rattus norvegicus
tcttaagtctttttcctaaaccatg

SEQ ID NO: 598872 - DNA, 25 bp, Rattus norvegicus
tcttacaagggcatctggttcttaa

SEQ ID NO: 598873 - DNA, 25 bp, Rattus norvegicus
tcttacaagggcttctggttcttaa

SEQ ID NO: 598874 - DNA, 25 bp, Rattus norvegicus
tcttacacaactaacctactaaagg

SEQ ID NO: 598875 - DNA, 25 bp, Rattus norvegicus
tcttacacaacttacctactaaagg

SEQ ID NO: 598876 - DNA, 25 bp, Rattus norvegicus
tcttacacccttagcctggaatgta

SEQ ID NO: 598877 - DNA, 25 bp, Rattus norvegicus
tcttacaccctttgcctggaatgta

SEQ ID NO: 598878 - DNA, 25 bp, Rattus norvegicus
tcttacactgctattcatcagccag

SEQ ID NO: 598879 - DNA, 25 bp, Rattus norvegicus
tcttacactgcttttcatcagccag

SEQ ID NO: 598880 - DNA, 25 bp, Rattus norvegicus
tcttacagaggaccaacccaacagt

SEQ ID NO: 598881 - DNA, 25 bp, Rattus norvegicus
tcttacagaggagcaacccaacagt

SEQ ID NO: 598882 - DNA, 25 bp, Rattus norvegicus
tcttacagagttagctaccccatac

SEQ ID NO: 598883 - DNA, 25 bp, Rattus norvegicus
tcttacagagtttgctaccccatac

SEQ ID NO: 598884 - DNA, 25 bp, Rattus norvegicus
tcttacatcgtaataccccactttt

SEQ ID NO: 598885 - DNA, 25 bp, Rattus norvegicus
tcttacatcgtattaccccactttt

SEQ ID NO: 598886 - DNA, 25 bp, Rattus norvegicus
tcttacatgactagagatggagcct

SEQ ID NO: 598887 - DNA, 25 bp, Rattus norvegicus
tcttacatgacttgagatggagcct

SEQ ID NO: 598888 - DNA, 25 bp, Rattus norvegicus
tcttaccacaaccttcaggaggagt

SEQ ID NO: 598889 - DNA, 25 bp, Rattus norvegicus
tcttaccacaacgttcaggaggagt

SEQ ID NO: 598890 - DNA, 25 bp, Rattus norvegicus
tcttaccacttcaaccttagggaga

SEQ ID NO: 598891 - DNA, 25 bp, Rattus norvegicus
tcttaccacttctaccttagggaga

SEQ ID NO: 598892 - DNA, 25 bp, Rattus norvegicus
tcttaccatttacagtgcttgcaat

SEQ ID NO: 598893 - DNA, 25 bp, Rattus norvegicus
tcttaccatttagagtgcttgcaat

SEQ ID NO: 598894 - DNA, 25 bp, Rattus norvegicus
tcttacccctgcacatgttgtagaa

SEQ ID NO: 598895 - DNA, 25 bp, Rattus norvegicus
tcttacccctgctcatgttgtagaa

SEQ ID NO: 598896 - DNA, 25 bp, Rattus norvegicus
tcttacccgccacagtgaggttgaa

SEQ ID NO: 598897 - DNA, 25 bp, Rattus norvegicus
tcttacccgccagagtgaggttgaa

SEQ ID NO: 598898 - DNA, 25 bp, Rattus norvegicus
tcttacctagacatctgtgagccag

SEQ ID NO: 598899 - DNA, 25 bp, Rattus norvegicus
tcttacctagacttctgtgagccag

SEQ ID NO: 598900 - DNA, 25 bp, Rattus norvegicus
tcttacctccgaatggttctgagaa

SEQ ID NO: 598901 - DNA, 25 bp, Rattus norvegicus
tcttacctccgattggttctgagaa

SEQ ID NO: 598902 - DNA, 25 bp, Rattus norvegicus
tcttacctctgaaccaaacacattt

SEQ ID NO: 598903 - DNA, 25 bp, Rattus norvegicus
tcttacctctgatccaaacacattt

SEQ ID NO: 598904 - DNA, 25 bp, Rattus norvegicus
tcttacctgcatcctgtagagtaga

SEQ ID NO: 598905 - DNA, 25 bp, Rattus norvegicus
tcttacctgcatgctgtagagtaga

SEQ ID NO: 598906 - DNA, 25 bp, Rattus norvegicus
tcttacctgcttctcctgtctgaga

SEQ ID NO: 598907 - DNA, 25 bp, Rattus norvegicus
tcttacctgcttgtcctgtctgaga

SEQ ID NO: 598908 - DNA, 25 bp, Rattus norvegicus
tcttacctgtgtctgcgtggatgtg

SEQ ID NO: 598909 - DNA, 25 bp, Rattus norvegicus
tcttacctgtgtgtgcgtggatgtg

SEQ ID NO: 598910 - DNA, 25 bp, Rattus norvegicus
tcttaccttctcattatctacagtc

SEQ ID NO: 598911 - DNA, 25 bp, Rattus norvegicus
tcttaccttctctttatctacagtc

SEQ ID NO: 598912 - DNA, 25 bp, Rattus norvegicus
tcttaccttggtatagctgcacatc

SEQ ID NO: 598913 - DNA, 25 bp, Rattus norvegicus
tcttaccttggtttagctgcacatc

SEQ ID NO: 598914 - DNA, 25 bp, Rattus norvegicus
tcttacgacccaagctacagtttgg

SEQ ID NO: 598915 - DNA, 25 bp, Rattus norvegicus
tcttacgacccatgctacagtttgg

SEQ ID NO: 598916 - DNA, 25 bp, Rattus norvegicus
tcttacgagctactgatggtcccca

SEQ ID NO: 598917 - DNA, 25 bp, Rattus norvegicus
tcttacgagctagtgatggtcccca

SEQ ID NO: 598918 - DNA, 25 bp, Rattus norvegicus
tcttacgagttcctgatttcattaa

SEQ ID NO: 598919 - DNA, 25 bp, Rattus norvegicus
tcttacgagttcgtgatttcattaa

SEQ ID NO: 598920 - DNA, 25 bp, Rattus norvegicus
tcttacgccaagaatccctgtgttg

SEQ ID NO: 598921 - DNA, 25 bp, Rattus norvegicus
tcttacgccaagtatccctgtgttg

SEQ ID NO: 598922 - DNA, 25 bp, Rattus norvegicus
tcttacggctgcacggtagtcaagt

SEQ ID NO: 598923 - DNA, 25 bp, Rattus norvegicus
tcttacggctgctcggtagtcaagt

SEQ ID NO: 598924 - DNA, 25 bp, Rattus norvegicus
tcttactaaacccatcggaggtcgg

SEQ ID NO: 598925 - DNA, 25 bp, Rattus norvegicus
tcttactaaaccgatcggaggtcgg

SEQ ID NO: 598926 - DNA, 25 bp, Rattus norvegicus
tcttactaaccccttgcaactggtc

SEQ ID NO: 598927 - DNA, 25 bp, Rattus norvegicus
tcttactaacccgttgcaactggtc

SEQ ID NO: 598928 - DNA, 25 bp, Rattus norvegicus
tcttactaatttcgaatgttcaggc

SEQ ID NO: 598929 - DNA, 25 bp, Rattus norvegicus
tcttactaatttggaatgttcaggc

SEQ ID NO: 598930 - DNA, 25 bp, Rattus norvegicus
tcttactactggcacctgagggctg

SEQ ID NO: 598931 - DNA, 25 bp, Rattus norvegicus
tcttactactgggacctgagggctg

SEQ ID NO: 598932 - DNA, 25 bp, Rattus norvegicus
tcttactatagtccgatggagtctg

SEQ ID NO: 598933 - DNA, 25 bp, Rattus norvegicus
tcttactatagtgcgatggagtctg

SEQ ID NO: 598934 - DNA, 25 bp, Rattus norvegicus
tcttactatgtaaccccgactgtac

SEQ ID NO: 598935 - DNA, 25 bp, Rattus norvegicus
tcttactatgtatccccgactgtac

SEQ ID NO: 598936 - DNA, 25 bp, Rattus norvegicus
tcttactcagatacaggccttggct

SEQ ID NO: 598937 - DNA, 25 bp, Rattus norvegicus
tcttactcagattcaggccttggct

SEQ ID NO: 598938 - DNA, 25 bp, Rattus norvegicus
tcttactcagcgacagcgttcactg

SEQ ID NO: 598939 - DNA, 25 bp, Rattus norvegicus
tcttactcagcgtcagcgttcactg

SEQ ID NO: 598940 - DNA, 25 bp, Rattus norvegicus
tcttactcatacattgtcccaattc

SEQ ID NO: 598941 - DNA, 25 bp, Rattus norvegicus
tcttactcatactttgtcccaattc

SEQ ID NO: 598942 - DNA, 25 bp, Rattus norvegicus
tcttactccctaagtcctttagtgt

SEQ ID NO: 598943 - DNA, 25 bp, Rattus norvegicus
tcttactccctatgtcctttagtgt

SEQ ID NO: 598944 - DNA, 25 bp, Rattus norvegicus
tcttactccgtgacagggtttacct

SEQ ID NO: 598945 - DNA, 25 bp, Rattus norvegicus
tcttactccgtgtcagggtttacct

SEQ ID NO: 598946 - DNA, 25 bp, Rattus norvegicus
tcttactcctctcttgatgtggcca

SEQ ID NO: 598947 - DNA, 25 bp, Rattus norvegicus
tcttactcctctgttgatgtggcca

SEQ ID NO: 598948 - DNA, 25 bp, Rattus norvegicus
tcttactcggcgctgtacaactcac

SEQ ID NO: 598949 - DNA, 25 bp, Rattus norvegicus
tcttactcggcggtgtacaactcac

SEQ ID NO: 598950 - DNA, 25 bp, Rattus norvegicus
tcttactgatttcttggactctctc

SEQ ID NO: 598951 - DNA, 25 bp, Rattus norvegicus
tcttactgatttgttggactctctc

SEQ ID NO: 598952 - DNA, 25 bp, Rattus norvegicus
tcttactgcagcacacttgggtggg

SEQ ID NO: 598953 - DNA, 25 bp, Rattus norvegicus
tcttactgcagctcacttgggtggg

SEQ ID NO: 598954 - DNA, 25 bp, Rattus norvegicus
tcttactggcagcattttttctttc

SEQ ID NO: 598955 - DNA, 25 bp, Rattus norvegicus
tcttactggcaggattttttctttc

SEQ ID NO: 598956 - DNA, 25 bp, Rattus norvegicus
tcttacttcctcaggctaggctgga

SEQ ID NO: 598957 - DNA, 25 bp, Rattus norvegicus
tcttacttcctctggctaggctgga

SEQ ID NO: 598958 - DNA, 25 bp, Rattus norvegicus
tcttacttggcaccctgagaggatt

SEQ ID NO: 598959 - DNA, 25 bp, Rattus norvegicus
tcttacttggcagcctgagaggatt

SEQ ID NO: 598960 - DNA, 25 bp, Rattus norvegicus
tcttactttagcagcctggagtgtt

SEQ ID NO: 598961 - DNA, 25 bp, Rattus norvegicus
tcttactttagctgcctggagtgtt

SEQ ID NO: 598962 - DNA, 25 bp, Rattus norvegicus
tcttactttctcagcccaaataacg

SEQ ID NO: 598963 - DNA, 25 bp, Rattus norvegicus
tcttactttctctgcccaaataacg

SEQ ID NO: 598964 - DNA, 25 bp, Rattus norvegicus
tcttagaactgtcgcggcgcagtca

SEQ ID NO: 598965 - DNA, 25 bp, Rattus norvegicus
tcttagaactgtggcggcgcagtca

SEQ ID NO: 598966 - DNA, 25 bp, Rattus norvegicus
tcttagaagctcagagctcccggta

SEQ ID NO: 598967 - DNA, 25 bp, Rattus norvegicus
tcttagaagctctgagctcccggta

SEQ ID NO: 598968 - DNA, 25 bp, Rattus norvegicus
tcttagaattaaaggactgttgctt

SEQ ID NO: 598969 - DNA, 25 bp, Rattus norvegicus
tcttagaattaatggactgttgctt

SEQ ID NO: 598970 - DNA, 25 bp, Rattus norvegicus
tcttagagggctagacaccaggtcc

SEQ ID NO: 598971 - DNA, 25 bp, Rattus norvegicus
tcttagagggcttgacaccaggtcc

SEQ ID NO: 598972 - DNA, 25 bp, Rattus norvegicus
tcttagagtctcagctgctttaaca

SEQ ID NO: 598973 - DNA, 25 bp, Rattus norvegicus
tcttagagtctctgctgctttaaca

SEQ ID NO: 598974 - DNA, 25 bp, Rattus norvegicus
tcttagagtgacacagacccctgat

SEQ ID NO: 598975 - DNA, 25 bp, Rattus norvegicus
tcttagagtgactcagacccctgat

SEQ ID NO: 598976 - DNA, 25 bp, Rattus norvegicus
tcttagatgagtctccaggctggga

SEQ ID NO: 598977 - DNA, 25 bp, Rattus norvegicus
tcttagatgagtgtccaggctggga

SEQ ID NO: 598978 - DNA, 25 bp, Rattus norvegicus
tcttagattcttattcttaaaccag

SEQ ID NO: 598979 - DNA, 25 bp, Rattus norvegicus
tcttagattctttttcttaaaccag

SEQ ID NO: 598980 - DNA, 25 bp, Rattus norvegicus
tcttagattgtgagcccttgggcag

SEQ ID NO: 598981 - DNA, 25 bp, Rattus norvegicus
tcttagattgtgtgcccttgggcag

SEQ ID NO: 598982 - DNA, 25 bp, Rattus norvegicus
tcttagcaatttagacatgtccatg

SEQ ID NO: 598983 - DNA, 25 bp, Rattus norvegicus
tcttagcaattttgacatgtccatg

SEQ ID NO: 598984 - DNA, 25 bp, Rattus norvegicus
tcttagccaccgagccatctcagta

SEQ ID NO: 598985 - DNA, 25 bp, Rattus norvegicus
tcttagccaccgtgccatctcagta

SEQ ID NO: 598986 - DNA, 25 bp, Rattus norvegicus
tcttagccactgagatatccctata

SEQ ID NO: 598987 - DNA, 25 bp, Rattus norvegicus
tcttagccactgagttactcagagg

SEQ ID NO: 598988 - DNA, 25 bp, Rattus norvegicus
tcttagccactgtgatatccctata

SEQ ID NO: 598989 - DNA, 25 bp, Rattus norvegicus
tcttagccactgtgttactcagagg

SEQ ID NO: 598990 - DNA, 25 bp, Rattus norvegicus
tcttagccattgctgccgggatgaa

SEQ ID NO: 598991 - DNA, 25 bp, Rattus norvegicus
tcttagccattggtgccgggatgaa

SEQ ID NO: 598992 - DNA, 25 bp, Rattus norvegicus
tcttagcctagtcctgagtaaccag

SEQ ID NO: 598993 - DNA, 25 bp, Rattus norvegicus
tcttagcctagtgctgagtaaccag

SEQ ID NO: 598994 - DNA, 25 bp, Rattus norvegicus
tcttagctagttatgcctgctcgta

SEQ ID NO: 598995 - DNA, 25 bp, Rattus norvegicus
tcttagctagttttgcctgctcgta

SEQ ID NO: 598996 - DNA, 25 bp, Rattus norvegicus
tcttagctctaaatttcctgtctct

SEQ ID NO: 598997 - DNA, 25 bp, Rattus norvegicus
tcttagctctaattttcctgtctct

SEQ ID NO: 598998 - DNA, 25 bp, Rattus norvegicus
tcttagctgtttcagtcatttacag

SEQ ID NO: 598999 - DNA, 25 bp, Rattus norvegicus
tcttagctgtttgagtcatttacag

SEQ ID NO: 599000 - DNA, 25 bp, Rattus norvegicus
tcttagcttagcatcctgtctgtga

SEQ ID NO: 599001 - DNA, 25 bp, Rattus norvegicus
tcttagcttagcttcctgtctgtga

SEQ ID NO: 599002 - DNA, 25 bp, Rattus norvegicus
tcttagcttcagatctttccgagaa

SEQ ID NO: 599003 - DNA, 25 bp, Rattus norvegicus
tcttagcttcagttctttccgagaa

SEQ ID NO: 599004 - DNA, 25 bp, Rattus norvegicus
tcttaggaagagactcccctcttaa

SEQ ID NO: 599005 - DNA, 25 bp, Rattus norvegicus
tcttaggaagagtctcccctcttaa

SEQ ID NO: 599006 - DNA, 25 bp, Rattus norvegicus
tcttaggatgtgataccctgtggaa

SEQ ID NO: 599007 - DNA, 25 bp, Rattus norvegicus
tcttaggatgtgttaccctgtggaa

SEQ ID NO: 599008 - DNA, 25 bp, Rattus norvegicus
tcttaggattacctgggacacatca

SEQ ID NO: 599009 - DNA, 25 bp, Rattus norvegicus
tcttaggattacgtgggacacatca

SEQ ID NO: 599010 - DNA, 25 bp, Rattus norvegicus
tcttaggcaaaccagtttaattttg

SEQ ID NO: 599011 - DNA, 25 bp, Rattus norvegicus
tcttaggcaaacgagtttaattttg

SEQ ID NO: 599012 - DNA, 25 bp, Rattus norvegicus
tcttaggccaccagctgacacattg

SEQ ID NO: 599013 - DNA, 25 bp, Rattus norvegicus
tcttaggccacctgctgacacattg

SEQ ID NO: 599014 - DNA, 25 bp, Rattus norvegicus
tcttagggtggtcttttgatccccg

SEQ ID NO: 599015 - DNA, 25 bp, Rattus norvegicus
tcttagggtggtgttttgatccccg

SEQ ID NO: 599016 - DNA, 25 bp, Rattus norvegicus
tcttaggtccagatttgctttgctt

SEQ ID NO: 599017 - DNA, 25 bp, Rattus norvegicus
tcttaggtccagttttgctttgctt

SEQ ID NO: 599018 - DNA, 25 bp, Rattus norvegicus
tcttaggtctccacaccatggtgtt

SEQ ID NO: 599019 - DNA, 25 bp, Rattus norvegicus
tcttaggtctcctcaccatggtgtt

SEQ ID NO: 599020 - DNA, 25 bp, Rattus norvegicus
tcttaggtgggtcctaggctctaga

SEQ ID NO: 599021 - DNA, 25 bp, Rattus norvegicus
tcttaggtgggtgctaggctctaga

SEQ ID NO: 599022 - DNA, 25 bp, Rattus norvegicus
tcttaggtgttactgcttttgctca

SEQ ID NO: 599023 - DNA, 25 bp, Rattus norvegicus
tcttaggtgttagtgcttttgctca

SEQ ID NO: 599024 - DNA, 25 bp, Rattus norvegicus
tcttaggttgttctggtttcttgcc

SEQ ID NO: 599025 - DNA, 25 bp, Rattus norvegicus
tcttaggttgttgtggtttcttgcc

SEQ ID NO: 599026 - DNA, 25 bp, Rattus norvegicus
tcttagtctgctcctgggaagcatg

SEQ ID NO: 599027 - DNA, 25 bp, Rattus norvegicus
tcttagtctgctgctgggaagcatg

SEQ ID NO: 599028 - DNA, 25 bp, Rattus norvegicus
tcttagtctttgctctggcccagtg

SEQ ID NO: 599029 - DNA, 25 bp, Rattus norvegicus
tcttagtctttggtctggcccagtg

SEQ ID NO: 599030 - DNA, 25 bp, Rattus norvegicus
tcttagtgactaaaccttgcattaa

SEQ ID NO: 599031 - DNA, 25 bp, Rattus norvegicus
tcttagtgactataccttgcattaa

SEQ ID NO: 599032 - DNA, 25 bp, Rattus norvegicus
tcttagtggcccacttagtggatgt

SEQ ID NO: 599033 - DNA, 25 bp, Rattus norvegicus
tcttagtggccctcttagtggatgt

SEQ ID NO: 599034 - DNA, 25 bp, Rattus norvegicus
tcttagttttggactgagtctgcac

SEQ ID NO: 599035 - DNA, 25 bp, Rattus norvegicus
tcttagttttggtctgagtctgcac

SEQ ID NO: 599036 - DNA, 25 bp, Rattus norvegicus
tcttatacccaccaactttgcttta

SEQ ID NO: 599037 - DNA, 25 bp, Rattus norvegicus
tcttatacccacgaactttgcttta

SEQ ID NO: 599038 - DNA, 25 bp, Rattus norvegicus
tcttatacctgtagggagcactggc

SEQ ID NO: 599039 - DNA, 25 bp, Rattus norvegicus
tcttatacctgttgggagcactggc

SEQ ID NO: 599040 - DNA, 25 bp, Rattus norvegicus
tcttatattttcaaccccattgacc

SEQ ID NO: 599041 - DNA, 25 bp, Rattus norvegicus
tcttatattttctaccccattgacc

SEQ ID NO: 599042 - DNA, 25 bp, Rattus norvegicus
tcttatcatcgcaagctggtcagaa

SEQ ID NO: 599043 - DNA, 25 bp, Rattus norvegicus
tcttatcatcgctagctggtcagaa

SEQ ID NO: 599044 - DNA, 25 bp, Rattus norvegicus
tcttatccattcaccagaccatgtt

SEQ ID NO: 599045 - DNA, 25 bp, Rattus norvegicus
tcttatccattctccagaccatgtt

SEQ ID NO: 599046 - DNA, 25 bp, Rattus norvegicus
tcttatcgatttcagatatcccagg

SEQ ID NO: 599047 - DNA, 25 bp, Rattus norvegicus
tcttatcgatttgagatatcccagg

SEQ ID NO: 599048 - DNA, 25 bp, Rattus norvegicus
tcttatctaaagaagggcctctctg

SEQ ID NO: 599049 - DNA, 25 bp, Rattus norvegicus
tcttatctaaagtagggcctctctg

SEQ ID NO: 599050 - DNA, 25 bp, Rattus norvegicus
tcttatctgtgacaggctgggcaca

SEQ ID NO: 599051 - DNA, 25 bp, Rattus norvegicus
tcttatctgtgagaggctgggcaca

SEQ ID NO: 599052 - DNA, 25 bp, Rattus norvegicus
tcttatctttatacggtaatcggtt

SEQ ID NO: 599053 - DNA, 25 bp, Rattus norvegicus
tcttatctttattcggtaatcggtt

SEQ ID NO: 599054 - DNA, 25 bp, Rattus norvegicus
tcttatgactgaagagcctgcttcg

SEQ ID NO: 599055 - DNA, 25 bp, Rattus norvegicus
tcttatgactgatgagcctgcttcg

SEQ ID NO: 599056 - DNA, 25 bp, Rattus norvegicus
tcttatgagatcctgtccccggaaa

SEQ ID NO: 599057 - DNA, 25 bp, Rattus norvegicus
tcttatgagatcgtgtccccggaaa

SEQ ID NO: 599058 - DNA, 25 bp, Rattus norvegicus
tcttatggcacccttcagagagtga

SEQ ID NO: 599059 - DNA, 25 bp, Rattus norvegicus
tcttatggcaccgttcagagagtga

SEQ ID NO: 599060 - DNA, 25 bp, Rattus norvegicus
tcttatggccacacaagacaggcat

SEQ ID NO: 599061 - DNA, 25 bp, Rattus norvegicus
tcttatggccactcaagacaggcat

SEQ ID NO: 599062 - DNA, 25 bp, Rattus norvegicus
tcttatggcgagaggccacccctga

SEQ ID NO: 599063 - DNA, 25 bp, Rattus norvegicus
tcttatggcgagtggccacccctga

SEQ ID NO: 599064 - DNA, 25 bp, Rattus norvegicus
tcttattccccacagtagaacatac

SEQ ID NO: 599065 - DNA, 25 bp, Rattus norvegicus
tcttattccccagagtagaacatac

SEQ ID NO: 599066 - DNA, 25 bp, Rattus norvegicus
tcttattccctacttctgtcagtat

SEQ ID NO: 599067 - DNA, 25 bp, Rattus norvegicus
tcttattccctagttctgtcagtat

SEQ ID NO: 599068 - DNA, 25 bp, Rattus norvegicus
tcttattcgcaaacacaccagcttt

SEQ ID NO: 599069 - DNA, 25 bp, Rattus norvegicus
tcttattcgcaatcacaccagcttt

SEQ ID NO: 599070 - DNA, 25 bp, Rattus norvegicus
tcttattctaacaaccggagcccaa

SEQ ID NO: 599071 - DNA, 25 bp, Rattus norvegicus
tcttattctaactaccggagcccaa

SEQ ID NO: 599072 - DNA, 25 bp, Rattus norvegicus
tcttatttcaaaactgtgtgtccat

SEQ ID NO: 599073 - DNA, 25 bp, Rattus norvegicus
tcttatttcaaatctgtgtgtccat

SEQ ID NO: 599074 - DNA, 25 bp, Rattus norvegicus
tcttatttcctcactcatgttaagt

SEQ ID NO: 599075 - DNA, 25 bp, Rattus norvegicus
tcttatttcctctctcatgttaagt

SEQ ID NO: 599076 - DNA, 25 bp, Rattus norvegicus
tcttatttctttatggaccagggtg

SEQ ID NO: 599077 - DNA, 25 bp, Rattus norvegicus
tcttatttctttttggaccagggtg

SEQ ID NO: 599078 - DNA, 25 bp, Rattus norvegicus
tcttatttgagtacccactgtttgg

SEQ ID NO: 599079 - DNA, 25 bp, Rattus norvegicus
tcttatttgagttcccactgtttgg

SEQ ID NO: 599080 - DNA, 25 bp, Rattus norvegicus
tcttcaaacctcatgtggacactca

SEQ ID NO: 599081 - DNA, 25 bp, Rattus norvegicus
tcttcaaacctcttgtggacactca

SEQ ID NO: 599082 - DNA, 25 bp, Rattus norvegicus
tcttcaaagcacactgttgtcctga

SEQ ID NO: 599083 - DNA, 25 bp, Rattus norvegicus
tcttcaaagcactctgttgtcctga

SEQ ID NO: 599084 - DNA, 25 bp, Rattus norvegicus
tcttcaaatgaacgagacgggctcc

SEQ ID NO: 599085 - DNA, 25 bp, Rattus norvegicus
tcttcaaatgaaggagacgggctcc

SEQ ID NO: 599086 - DNA, 25 bp, Rattus norvegicus
tcttcaaattctccagtagctcttt

SEQ ID NO: 599087 - DNA, 25 bp, Rattus norvegicus
tcttcaaattctgcagtagctcttt

SEQ ID NO: 599088 - DNA, 25 bp, Rattus norvegicus
tcttcaaccaccctggatctgtcgg

SEQ ID NO: 599089 - DNA, 25 bp, Rattus norvegicus
tcttcaaccaccgtggatctgtcgg

SEQ ID NO: 599090 - DNA, 25 bp, Rattus norvegicus
tcttcaactaaaatcctcaggtttt

SEQ ID NO: 599091 - DNA, 25 bp, Rattus norvegicus
tcttcaactaaattcctcaggtttt

SEQ ID NO: 599092 - DNA, 25 bp, Rattus norvegicus
tcttcaactggcagggctacgccaa

SEQ ID NO: 599093 - DNA, 25 bp, Rattus norvegicus
tcttcaactggctgggctacgccaa

SEQ ID NO: 599094 - DNA, 25 bp, Rattus norvegicus
tcttcaagaccaaatttacccgagc

SEQ ID NO: 599095 - DNA, 25 bp, Rattus norvegicus
tcttcaagaccatatttacccgagc

SEQ ID NO: 599096 - DNA, 25 bp, Rattus norvegicus
tcttcaagaccccttttggagtcac

SEQ ID NO: 599097 - DNA, 25 bp, Rattus norvegicus
tcttcaagacccgttttggagtcac

SEQ ID NO: 599098 - DNA, 25 bp, Rattus norvegicus
tcttcaagatagatgcagtttgcct

SEQ ID NO: 599099 - DNA, 25 bp, Rattus norvegicus
tcttcaagatagttgcagtttgcct

SEQ ID NO: 599100 - DNA, 25 bp, Rattus norvegicus
tcttcaagcagtcacagcggtggga

SEQ ID NO: 599101 - DNA, 25 bp, Rattus norvegicus
tcttcaagcagtgacagcggtggga

SEQ ID NO: 599102 - DNA, 25 bp, Rattus norvegicus
tcttcaagctacagaggccccagaa

SEQ ID NO: 599103 - DNA, 25 bp, Rattus norvegicus
tcttcaagctactgaggccccagaa

SEQ ID NO: 599104 - DNA, 25 bp, Rattus norvegicus
tcttcaaggcatactttggtggtcc

SEQ ID NO: 599105 - DNA, 25 bp, Rattus norvegicus
tcttcaaggcattctttggtggtcc

SEQ ID NO: 599106 - DNA, 25 bp, Rattus norvegicus
tcttcaatcaaaccatgtgtgtctt

SEQ ID NO: 599107 - DNA, 25 bp, Rattus norvegicus
tcttcaatcaaagcatgtgtgtctt

SEQ ID NO: 599108 - DNA, 25 bp, Rattus norvegicus
tcttcaatgatgaagagtctgctct

SEQ ID NO: 599109 - DNA, 25 bp, Rattus norvegicus
tcttcaatgatgtagagtctgctct

SEQ ID NO: 599110 - DNA, 25 bp, Rattus norvegicus
tcttcaatgtatatgtgcctgtttc

SEQ ID NO: 599111 - DNA, 25 bp, Rattus norvegicus
tcttcaatgtatttgtgcctgtttc

SEQ ID NO: 599112 - DNA, 25 bp, Rattus norvegicus
tcttcaattcctcgtgtcctttaat

SEQ ID NO: 599113 - DNA, 25 bp, Rattus norvegicus
tcttcaattcctggtgtcctttaat

SEQ ID NO: 599114 - DNA, 25 bp, Rattus norvegicus
tcttcacaaagtctggtttcaatga

SEQ ID NO: 599115 - DNA, 25 bp, Rattus norvegicus
tcttcacaaagtgtggtttcaatga

SEQ ID NO: 599116 - DNA, 25 bp, Rattus norvegicus
tcttcacactctccgctttgagtgc

SEQ ID NO: 599117 - DNA, 25 bp, Rattus norvegicus
tcttcacactctccgttttctttaa

SEQ ID NO: 599118 - DNA, 25 bp, Rattus norvegicus
tcttcacactctgcgctttgagtgc

SEQ ID NO: 599119 - DNA, 25 bp, Rattus norvegicus
tcttcacactctgcgttttctttaa

SEQ ID NO: 599120 - DNA, 25 bp, Rattus norvegicus
tcttcacacttcacggcgagcagag

SEQ ID NO: 599121 - DNA, 25 bp, Rattus norvegicus
tcttcacacttctcggcgagcagag

SEQ ID NO: 599122 - DNA, 25 bp, Rattus norvegicus
tcttcacagctgacccattttaaga

SEQ ID NO: 599123 - DNA, 25 bp, Rattus norvegicus
tcttcacagctgtcccattttaaga

SEQ ID NO: 599124 - DNA, 25 bp, Rattus norvegicus
tcttcacaggtcacttggcacaggt

SEQ ID NO: 599125 - DNA, 25 bp, Rattus norvegicus
tcttcacaggtctcttggcacaggt

SEQ ID NO: 599126 - DNA, 25 bp, Rattus norvegicus
tcttcaccacctagggcaagcagat

SEQ ID NO: 599127 - DNA, 25 bp, Rattus norvegicus
tcttcaccaccttgggcaagcagat

SEQ ID NO: 599128 - DNA, 25 bp, Rattus norvegicus
tcttcaccctttacgtactgttgaa

SEQ ID NO: 599129 - DNA, 25 bp, Rattus norvegicus
tcttcacccttttcgtactgttgaa

SEQ ID NO: 599130 - DNA, 25 bp, Rattus norvegicus
tcttcaccgggactattagaccata

SEQ ID NO: 599131 - DNA, 25 bp, Rattus norvegicus
tcttcaccgggagtattagaccata

SEQ ID NO: 599132 - DNA, 25 bp, Rattus norvegicus
tcttcacctggcatttgctgaacta

SEQ ID NO: 599133 - DNA, 25 bp, Rattus norvegicus
tcttcacctggcttttgctgaacta

SEQ ID NO: 599134 - DNA, 25 bp, Rattus norvegicus
tcttcacgagggaggagcagcatga

SEQ ID NO: 599135 - DNA, 25 bp, Rattus norvegicus
tcttcacgagggtggagcagcatga

SEQ ID NO: 599136 - DNA, 25 bp, Rattus norvegicus
tcttcacgccctatgagatctgggt

SEQ ID NO: 599137 - DNA, 25 bp, Rattus norvegicus
tcttcacgccctttgagatctgggt

SEQ ID NO: 599138 - DNA, 25 bp, Rattus norvegicus
tcttcacgctgcaggatgcgcaaga

SEQ ID NO: 599139 - DNA, 25 bp, Rattus norvegicus
tcttcacgctgctggatgcgcaaga

SEQ ID NO: 599140 - DNA, 25 bp, Rattus norvegicus
tcttcacgcttgcagtcacgtagta

SEQ ID NO: 599141 - DNA, 25 bp, Rattus norvegicus
tcttcacgcttggagtcacgtagta

SEQ ID NO: 599142 - DNA, 25 bp, Rattus norvegicus
tcttcacgggtccaggtcaggtatc

SEQ ID NO: 599143 - DNA, 25 bp, Rattus norvegicus
tcttcacgggtcgaggtcaggtatc

SEQ ID NO: 599144 - DNA, 25 bp, Rattus norvegicus
tcttcacgttggatggtgggcacat

SEQ ID NO: 599145 - DNA, 25 bp, Rattus norvegicus
tcttcacgttggttggtgggcacat

SEQ ID NO: 599146 - DNA, 25 bp, Rattus norvegicus
tcttcactcagaacctcagggtcaa

SEQ ID NO: 599147 - DNA, 25 bp, Rattus norvegicus
tcttcactcagatcctcagggtcaa

SEQ ID NO: 599148 - DNA, 25 bp, Rattus norvegicus
tcttcactctctccacataagtata

SEQ ID NO: 599149 - DNA, 25 bp, Rattus norvegicus
tcttcactctctgcacataagtata

SEQ ID NO: 599150 - DNA, 25 bp, Rattus norvegicus
tcttcactgagtccattcctgacag

SEQ ID NO: 599151 - DNA, 25 bp, Rattus norvegicus
tcttcactgagtgcattcctgacag

SEQ ID NO: 599152 - DNA, 25 bp, Rattus norvegicus
tcttcactgcaacgcggcacgaacg

SEQ ID NO: 599153 - DNA, 25 bp, Rattus norvegicus
tcttcactgcaaggcggcacgaacg

SEQ ID NO: 599154 - DNA, 25 bp, Rattus norvegicus
tcttcactgcttagtgactctggtt

SEQ ID NO: 599155 - DNA, 25 bp, Rattus norvegicus
tcttcactgctttgtgactctggtt

SEQ ID NO: 599156 - DNA, 25 bp, Rattus norvegicus
tcttcactgtatacttcttcacctt

SEQ ID NO: 599157 - DNA, 25 bp, Rattus norvegicus
tcttcactgtattcttcttcacctt

SEQ ID NO: 599158 - DNA, 25 bp, Rattus norvegicus
tcttcactgtccagctatttgccag

SEQ ID NO: 599159 - DNA, 25 bp, Rattus norvegicus
tcttcactgtcctgctatttgccag

SEQ ID NO: 599160 - DNA, 25 bp, Rattus norvegicus
tcttcactgtctatcttcaggacac

SEQ ID NO: 599161 - DNA, 25 bp, Rattus norvegicus
tcttcactgtctttcttcaggacac

SEQ ID NO: 599162 - DNA, 25 bp, Rattus norvegicus
tcttcactgtgcatccatgggcttt

SEQ ID NO: 599163 - DNA, 25 bp, Rattus norvegicus
tcttcactgtgcttccatgggcttt

SEQ ID NO: 599164 - DNA, 25 bp, Rattus norvegicus
tcttcactttgaaactctggataaa

SEQ ID NO: 599165 - DNA, 25 bp, Rattus norvegicus
tcttcactttgatactctggataaa

SEQ ID NO: 599166 - DNA, 25 bp, Rattus norvegicus
tcttcagaaaagaggaggcttccca

SEQ ID NO: 599167 - DNA, 25 bp, Rattus norvegicus
tcttcagaaaagtggaggcttccca

SEQ ID NO: 599168 - DNA, 25 bp, Rattus norvegicus
tcttcagaatcaaggcctctagggc

SEQ ID NO: 599169 - DNA, 25 bp, Rattus norvegicus
tcttcagaatcatggcctctagggc

SEQ ID NO: 599170 - DNA, 25 bp, Rattus norvegicus
tcttcagacctcctgtagagagcca

SEQ ID NO: 599171 - DNA, 25 bp, Rattus norvegicus
tcttcagacctcgtgtagagagcca

SEQ ID NO: 599172 - DNA, 25 bp, Rattus norvegicus
tcttcagactttcttaggcagccag

SEQ ID NO: 599173 - DNA, 25 bp, Rattus norvegicus
tcttcagactttgttaggcagccag

SEQ ID NO: 599174 - DNA, 25 bp, Rattus norvegicus
tcttcagagacgacctgagggctgt

SEQ ID NO: 599175 - DNA, 25 bp, Rattus norvegicus
tcttcagagacgtcctgagggctgt

SEQ ID NO: 599176 - DNA, 25 bp, Rattus norvegicus
tcttcagcagaaccgagacgtgttt

SEQ ID NO: 599177 - DNA, 25 bp, Rattus norvegicus
tcttcagcagaagcgagacgtgttt

SEQ ID NO: 599178 - DNA, 25 bp, Rattus norvegicus
tcttcagcgtccatgttcattgtca

SEQ ID NO: 599179 - DNA, 25 bp, Rattus norvegicus
tcttcagcgtccttgttcattgtca

SEQ ID NO: 599180 - DNA, 25 bp, Rattus norvegicus
tcttcagctaccctggaatgcaagc

SEQ ID NO: 599181 - DNA, 25 bp, Rattus norvegicus
tcttcagctaccgtggaatgcaagc

SEQ ID NO: 599182 - DNA, 25 bp, Rattus norvegicus
tcttcagctactcagggatacaatg

SEQ ID NO: 599183 - DNA, 25 bp, Rattus norvegicus
tcttcagctactgagggatacaatg

SEQ ID NO: 599184 - DNA, 25 bp, Rattus norvegicus
tcttcagctagtactttgcctggaa

SEQ ID NO: 599185 - DNA, 25 bp, Rattus norvegicus
tcttcagctagttctttgcctggaa

SEQ ID NO: 599186 - DNA, 25 bp, Rattus norvegicus
tcttcagctcggaggtatgggtgct

SEQ ID NO: 599187 - DNA, 25 bp, Rattus norvegicus
tcttcagctcggtggtatgggtgct

SEQ ID NO: 599188 - DNA, 25 bp, Rattus norvegicus
tcttcagctctgcacagaaccagaa

SEQ ID NO: 599189 - DNA, 25 bp, Rattus norvegicus
tcttcagctctggacagaaccagaa

SEQ ID NO: 599190 - DNA, 25 bp, Rattus norvegicus
tcttcagctgaaccacgtaaacttg

SEQ ID NO: 599191 - DNA, 25 bp, Rattus norvegicus
tcttcagctgaagcacgtaaacttg

SEQ ID NO: 599192 - DNA, 25 bp, Rattus norvegicus
tcttcagctgctcctcagctagtga

SEQ ID NO: 599193 - DNA, 25 bp, Rattus norvegicus
tcttcagctgctgctcagctagtga

SEQ ID NO: 599194 - DNA, 25 bp, Rattus norvegicus
tcttcagcttcaatccagggcactc

SEQ ID NO: 599195 - DNA, 25 bp, Rattus norvegicus
tcttcagcttcattccagggcactc

SEQ ID NO: 599196 - DNA, 25 bp, Rattus norvegicus
tcttcagcttcgagccaggaacttg

SEQ ID NO: 599197 - DNA, 25 bp, Rattus norvegicus
tcttcagcttcgtgccaggaacttg

SEQ ID NO: 599198 - DNA, 25 bp, Rattus norvegicus
tcttcaggaaaacccgtccaccgaa

SEQ ID NO: 599199 - DNA, 25 bp, Rattus norvegicus
tcttcaggaaaagccgtccaccgaa

SEQ ID NO: 599200 - DNA, 25 bp, Rattus norvegicus
tcttcaggactcataaaagcacatt

SEQ ID NO: 599201 - DNA, 25 bp, Rattus norvegicus
tcttcaggactcttaaaagcacatt

SEQ ID NO: 599202 - DNA, 25 bp, Rattus norvegicus
tcttcaggactgaactgcgtgtgcc

SEQ ID NO: 599203 - DNA, 25 bp, Rattus norvegicus
tcttcaggactgtactgcgtgtgcc

SEQ ID NO: 599204 - DNA, 25 bp, Rattus norvegicus
tcttcaggagggactccggaagcag

SEQ ID NO: 599205 - DNA, 25 bp, Rattus norvegicus
tcttcaggagggtctccggaagcag

SEQ ID NO: 599206 - DNA, 25 bp, Rattus norvegicus
tcttcaggcctcaattgtgtacaat

SEQ ID NO: 599207 - DNA, 25 bp, Rattus norvegicus
tcttcaggcctctattgtgtacaat

SEQ ID NO: 599208 - DNA, 25 bp, Rattus norvegicus
tcttcaggcctgcttggatttgtca

SEQ ID NO: 599209 - DNA, 25 bp, Rattus norvegicus
tcttcaggcctggttggatttgtca

SEQ ID NO: 599210 - DNA, 25 bp, Rattus norvegicus
tcttcaggcggtagctgattctgga

SEQ ID NO: 599211 - DNA, 25 bp, Rattus norvegicus
tcttcaggcggttgctgattctgga

SEQ ID NO: 599212 - DNA, 25 bp, Rattus norvegicus
tcttcaggctccactgggacagtgg

SEQ ID NO: 599213 - DNA, 25 bp, Rattus norvegicus
tcttcaggctcctctgggacagtgg

SEQ ID NO: 599214 - DNA, 25 bp, Rattus norvegicus
tcttcaggctggcatagaggtatct

SEQ ID NO: 599215 - DNA, 25 bp, Rattus norvegicus
tcttcaggctgggatagaggtatct

SEQ ID NO: 599216 - DNA, 25 bp, Rattus norvegicus
tcttcaggctttccttcagtccgaa

SEQ ID NO: 599217 - DNA, 25 bp, Rattus norvegicus
tcttcaggctttgcttcagtccgaa

SEQ ID NO: 599218 - DNA, 25 bp, Rattus norvegicus
tcttcagggagcatgactgtcctta

SEQ ID NO: 599219 - DNA, 25 bp, Rattus norvegicus
tcttcagggagcttgactgtcctta

SEQ ID NO: 599220 - DNA, 25 bp, Rattus norvegicus
tcttcagggctgaccctttaaccaa

SEQ ID NO: 599221 - DNA, 25 bp, Rattus norvegicus
tcttcagggctgtccctttaaccaa

SEQ ID NO: 599222 - DNA, 25 bp, Rattus norvegicus
tcttcagtcctcaaacctggaaaga

SEQ ID NO: 599223 - DNA, 25 bp, Rattus norvegicus
tcttcagtcctcatcctgcgatatc

SEQ ID NO: 599224 - DNA, 25 bp, Rattus norvegicus
tcttcagtcctctaacctggaaaga

SEQ ID NO: 599225 - DNA, 25 bp, Rattus norvegicus
tcttcagtcctcttcctgcgatatc

SEQ ID NO: 599226 - DNA, 25 bp, Rattus norvegicus
tcttcagtctggacagttctcttca

SEQ ID NO: 599227 - DNA, 25 bp, Rattus norvegicus
tcttcagtctggtcagttctcttca

SEQ ID NO: 599228 - DNA, 25 bp, Rattus norvegicus
tcttcagtgtacagcgtggttttaa

SEQ ID NO: 599229 - DNA, 25 bp, Rattus norvegicus
tcttcagtgtactgcgtggttttaa

SEQ ID NO: 599230 - DNA, 25 bp, Rattus norvegicus
tcttcagttccaacaaaaggtttat

SEQ ID NO: 599231 - DNA, 25 bp, Rattus norvegicus
tcttcagttccatcaaaaggtttat

SEQ ID NO: 599232 - DNA, 25 bp, Rattus norvegicus
tcttcagttcgtctgctcttgagca

SEQ ID NO: 599233 - DNA, 25 bp, Rattus norvegicus
tcttcagttcgtgtgctcttgagca

SEQ ID NO: 599234 - DNA, 25 bp, Rattus norvegicus
tcttcagttctgacgatcttcaaat

SEQ ID NO: 599235 - DNA, 25 bp, Rattus norvegicus
tcttcagttctgcatgatacggtga

SEQ ID NO: 599236 - DNA, 25 bp, Rattus norvegicus
tcttcagttctggatgatacggtga

SEQ ID NO: 599237 - DNA, 25 bp, Rattus norvegicus
tcttcagttctgtcgatcttcaaat

SEQ ID NO: 599238 - DNA, 25 bp, Rattus norvegicus
tcttcagttgctaccgcggacggag

SEQ ID NO: 599239 - DNA, 25 bp, Rattus norvegicus
tcttcagttgcttccgcggacggag

SEQ ID NO: 599240 - DNA, 25 bp, Rattus norvegicus
tcttcagtttttcgaactcacccca

SEQ ID NO: 599241 - DNA, 25 bp, Rattus norvegicus
tcttcagtttttggaactcacccca

SEQ ID NO: 599242 - DNA, 25 bp, Rattus norvegicus
tcttcatagggtccactcgcatgtg

SEQ ID NO: 599243 - DNA, 25 bp, Rattus norvegicus
tcttcatagggtgcactcgcatgtg

SEQ ID NO: 599244 - DNA, 25 bp, Rattus norvegicus
tcttcatagtttcgcatggtcacaa

SEQ ID NO: 599245 - DNA, 25 bp, Rattus norvegicus
tcttcatagtttggcatggtcacaa

SEQ ID NO: 599246 - DNA, 25 bp, Rattus norvegicus
tcttcatatattcctggctttccag

SEQ ID NO: 599247 - DNA, 25 bp, Rattus norvegicus
tcttcatatattgctggctttccag

SEQ ID NO: 599248 - DNA, 25 bp, Rattus norvegicus
tcttcatattctcttgctctgtagg

SEQ ID NO: 599249 - DNA, 25 bp, Rattus norvegicus
tcttcatattctgttgctctgtagg

SEQ ID NO: 599250 - DNA, 25 bp, Rattus norvegicus
tcttcatcaccaatgggtccatcgg

SEQ ID NO: 599251 - DNA, 25 bp, Rattus norvegicus
tcttcatcaccaatgtcacctacaa

SEQ ID NO: 599252 - DNA, 25 bp, Rattus norvegicus
tcttcatcaccattgggtccatcgg

SEQ ID NO: 599253 - DNA, 25 bp, Rattus norvegicus
tcttcatcaccattgtcacctacaa

SEQ ID NO: 599254 - DNA, 25 bp, Rattus norvegicus
tcttcatcaggccaaagcaccaagt

SEQ ID NO: 599255 - DNA, 25 bp, Rattus norvegicus
tcttcatcaggcgaaagcaccaagt

SEQ ID NO: 599256 - DNA, 25 bp, Rattus norvegicus
tcttcatccagacttccatgggaat

SEQ ID NO: 599257 - DNA, 25 bp, Rattus norvegicus
tcttcatccagagttccatgggaat

SEQ ID NO: 599258 - DNA, 25 bp, Rattus norvegicus
tcttcatccccgagtccgtttattt

SEQ ID NO: 599259 - DNA, 25 bp, Rattus norvegicus
tcttcatccccgtgtccgtttattt

SEQ ID NO: 599260 - DNA, 25 bp, Rattus norvegicus
tcttcatcttccaccagtgttttaa

SEQ ID NO: 599261 - DNA, 25 bp, Rattus norvegicus
tcttcatcttcctccagtgttttaa

SEQ ID NO: 599262 - DNA, 25 bp, Rattus norvegicus
tcttcatcttctacgacatccagtt

SEQ ID NO: 599263 - DNA, 25 bp, Rattus norvegicus
tcttcatcttcttcgacatccagtt

SEQ ID NO: 599264 - DNA, 25 bp, Rattus norvegicus
tcttcatcttgtagctgagctggga

SEQ ID NO: 599265 - DNA, 25 bp, Rattus norvegicus
tcttcatcttgttgctgagctggga

SEQ ID NO: 599266 - DNA, 25 bp, Rattus norvegicus
tcttcatctttccacgacatcttaa

SEQ ID NO: 599267 - DNA, 25 bp, Rattus norvegicus
tcttcatctttcgacgacatcttaa

SEQ ID NO: 599268 - DNA, 25 bp, Rattus norvegicus
tcttcatgccttctggaactttagt

SEQ ID NO: 599269 - DNA, 25 bp, Rattus norvegicus
tcttcatgccttgtggaactttagt

SEQ ID NO: 599270 - DNA, 25 bp, Rattus norvegicus
tcttcatgctagatgctgtttttcc

SEQ ID NO: 599271 - DNA, 25 bp, Rattus norvegicus
tcttcatgctagttgctgtttttcc

SEQ ID NO: 599272 - DNA, 25 bp, Rattus norvegicus
tcttcatgctcaacgctttcaaaag

SEQ ID NO: 599273 - DNA, 25 bp, Rattus norvegicus
tcttcatgctcatcgctttcaaaag

SEQ ID NO: 599274 - DNA, 25 bp, Rattus norvegicus
tcttcatggcagcagcatcattcta

SEQ ID NO: 599275 - DNA, 25 bp, Rattus norvegicus
tcttcatggcaggagcatcattcta

SEQ ID NO: 599276 - DNA, 25 bp, Rattus norvegicus
tcttcatggctaagactgtggtgat

SEQ ID NO: 599277 - DNA, 25 bp, Rattus norvegicus
tcttcatggctatgactgtggtgat

SEQ ID NO: 599278 - DNA, 25 bp, Rattus norvegicus
tcttcatgggacatgagagctcaca

SEQ ID NO: 599279 - DNA, 25 bp, Rattus norvegicus
tcttcatgggacttgagagctcaca

SEQ ID NO: 599280 - DNA, 25 bp, Rattus norvegicus
tcttcatgggcgcagctcttatgaa

SEQ ID NO: 599281 - DNA, 25 bp, Rattus norvegicus
tcttcatgggcggagctcttatgaa

SEQ ID NO: 599282 - DNA, 25 bp, Rattus norvegicus
tcttcatggtggagagcctagtgct

SEQ ID NO: 599283 - DNA, 25 bp, Rattus norvegicus
tcttcatggtggtgagcctagtgct

SEQ ID NO: 599284 - DNA, 25 bp, Rattus norvegicus
tcttcatgtcatacacacttcactg

SEQ ID NO: 599285 - DNA, 25 bp, Rattus norvegicus
tcttcatgtcattcacacttcactg

SEQ ID NO: 599286 - DNA, 25 bp, Rattus norvegicus
tcttcatgtcctagaggctgtgcta

SEQ ID NO: 599287 - DNA, 25 bp, Rattus norvegicus
tcttcatgtccttgaggctgtgcta

SEQ ID NO: 599288 - DNA, 25 bp, Rattus norvegicus
tcttcatgttgactttctctaccag

SEQ ID NO: 599289 - DNA, 25 bp, Rattus norvegicus
tcttcatgttgagtttctctaccag

SEQ ID NO: 599290 - DNA, 25 bp, Rattus norvegicus
tcttcattagttaccaatggcctgt

SEQ ID NO: 599291 - DNA, 25 bp, Rattus norvegicus
tcttcattagtttccaatggcctgt

SEQ ID NO: 599292 - DNA, 25 bp, Rattus norvegicus
tcttcattccagaggctcgaacggg

SEQ ID NO: 599293 - DNA, 25 bp, Rattus norvegicus
tcttcattccagtggctcgaacggg

SEQ ID NO: 599294 - DNA, 25 bp, Rattus norvegicus
tcttcattcccgagagcggaccggg

SEQ ID NO: 599295 - DNA, 25 bp, Rattus norvegicus
tcttcattcccgtgagcggaccggg

SEQ ID NO: 599296 - DNA, 25 bp, Rattus norvegicus
tcttcattctctctggcaagttctg

SEQ ID NO: 599297 - DNA, 25 bp, Rattus norvegicus
tcttcattctctgtggcaagttctg

SEQ ID NO: 599298 - DNA, 25 bp, Rattus norvegicus
tcttcattctgaagtctaccctaga

SEQ ID NO: 599299 - DNA, 25 bp, Rattus norvegicus
tcttcattctgatgtctaccctaga

SEQ ID NO: 599300 - DNA, 25 bp, Rattus norvegicus
tcttcattgtcgactttgccctctt

SEQ ID NO: 599301 - DNA, 25 bp, Rattus norvegicus
tcttcattgtcgtctttgccctctt

SEQ ID NO: 599302 - DNA, 25 bp, Rattus norvegicus
tcttccaaacccacttgctgaaaag

SEQ ID NO: 599303 - DNA, 25 bp, Rattus norvegicus
tcttccaaaccctcttgctgaaaag

SEQ ID NO: 599304 - DNA, 25 bp, Rattus norvegicus
tcttccaaatgtctttatccctttc

SEQ ID NO: 599305 - DNA, 25 bp, Rattus norvegicus
tcttccaaatgtgtttatccctttc

SEQ ID NO: 599306 - DNA, 25 bp, Rattus norvegicus
tcttccaacacccagtcttaatagt

SEQ ID NO: 599307 - DNA, 25 bp, Rattus norvegicus
tcttccaacaccgagtcttaatagt

SEQ ID NO: 599308 - DNA, 25 bp, Rattus norvegicus
tcttccaacctgaacaagcacgtgg

SEQ ID NO: 599309 - DNA, 25 bp, Rattus norvegicus
tcttccaacctgtacaagcacgtgg

SEQ ID NO: 599310 - DNA, 25 bp, Rattus norvegicus
tcttccaacggcatcttgattgacg

SEQ ID NO: 599311 - DNA, 25 bp, Rattus norvegicus
tcttccaacggcttcttgattgacg

SEQ ID NO: 599312 - DNA, 25 bp, Rattus norvegicus
tcttccaacttgagacccttgcgcg

SEQ ID NO: 599313 - DNA, 25 bp, Rattus norvegicus
tcttccaacttgtgacccttgcgcg

SEQ ID NO: 599314 - DNA, 25 bp, Rattus norvegicus
tcttccaagcacaggtacacaggaa

SEQ ID NO: 599315 - DNA, 25 bp, Rattus norvegicus
tcttccaagcactggtacacaggaa

SEQ ID NO: 599316 - DNA, 25 bp, Rattus norvegicus
tcttccaagtcgagacactgaggca

SEQ ID NO: 599317 - DNA, 25 bp, Rattus norvegicus
tcttccaagtcgtgacactgaggca

SEQ ID NO: 599318 - DNA, 25 bp, Rattus norvegicus
tcttccaattctccctttataccta

SEQ ID NO: 599319 - DNA, 25 bp, Rattus norvegicus
tcttccaattctgcctttataccta

SEQ ID NO: 599320 - DNA, 25 bp, Rattus norvegicus
tcttccacacccaggactggaggtg

SEQ ID NO: 599321 - DNA, 25 bp, Rattus norvegicus
tcttccacaccctggactggaggtg

SEQ ID NO: 599322 - DNA, 25 bp, Rattus norvegicus
tcttccacagctccatttttgatag

SEQ ID NO: 599323 - DNA, 25 bp, Rattus norvegicus
tcttccacagctgcatttttgatag

SEQ ID NO: 599324 - DNA, 25 bp, Rattus norvegicus
tcttccacctgtactttgtgctgtg

SEQ ID NO: 599325 - DNA, 25 bp, Rattus norvegicus
tcttccacctgttctttgtgctgtg

SEQ ID NO: 599326 - DNA, 25 bp, Rattus norvegicus
tcttccacggtaagctcgatgaaat

SEQ ID NO: 599327 - DNA, 25 bp, Rattus norvegicus
tcttccacggtatgctcgatgaaat

SEQ ID NO: 599328 - DNA, 25 bp, Rattus norvegicus
tcttccactagtatatgccagcgat

SEQ ID NO: 599329 - DNA, 25 bp, Rattus norvegicus
tcttccactagtttatgccagcgat

SEQ ID NO: 599330 - DNA, 25 bp, Rattus norvegicus
tcttccagaagccagagactgttgt

SEQ ID NO: 599331 - DNA, 25 bp, Rattus norvegicus
tcttccagaagcgagagactgttgt

SEQ ID NO: 599332 - DNA, 25 bp, Rattus norvegicus
tcttccagagacacattctcagcag

SEQ ID NO: 599333 - DNA, 25 bp, Rattus norvegicus
tcttccagagactcattctcagcag

SEQ ID NO: 599334 - DNA, 25 bp, Rattus norvegicus
tcttccagaggacggtttttcagca

SEQ ID NO: 599335 - DNA, 25 bp, Rattus norvegicus
tcttccagaggagggtttttcagca

SEQ ID NO: 599336 - DNA, 25 bp, Rattus norvegicus
tcttccagagtgatgggcaggacaa

SEQ ID NO: 599337 - DNA, 25 bp, Rattus norvegicus
tcttccagagtgttgggcaggacaa

SEQ ID NO: 599338 - DNA, 25 bp, Rattus norvegicus
tcttccagcaacactgtatcctaaa

SEQ ID NO: 599339 - DNA, 25 bp, Rattus norvegicus
tcttccagcaactctgtatcctaaa

SEQ ID NO: 599340 - DNA, 25 bp, Rattus norvegicus
tcttccagcctaagaatacttccta

SEQ ID NO: 599341 - DNA, 25 bp, Rattus norvegicus
tcttccagcctatgaatacttccta

SEQ ID NO: 599342 - DNA, 25 bp, Rattus norvegicus
tcttccagctgccagtgaggtagat

SEQ ID NO: 599343 - DNA, 25 bp, Rattus norvegicus
tcttccagctgcgagtgaggtagat

SEQ ID NO: 599344 - DNA, 25 bp, Rattus norvegicus
tcttccagctggacagctcttgaga

SEQ ID NO: 599345 - DNA, 25 bp, Rattus norvegicus
tcttccagctggtcagctcttgaga

SEQ ID NO: 599346 - DNA, 25 bp, Rattus norvegicus
tcttccaggaggagacactcaggct

SEQ ID NO: 599347 - DNA, 25 bp, Rattus norvegicus
tcttccaggaggtgacactcaggct

SEQ ID NO: 599348 - DNA, 25 bp, Rattus norvegicus
tcttccaggagtcaaagcccaaggt

SEQ ID NO: 599349 - DNA, 25 bp, Rattus norvegicus
tcttccaggagtgaaagcccaaggt

SEQ ID NO: 599350 - DNA, 25 bp, Rattus norvegicus
tcttccaggtggctgacaggattta

SEQ ID NO: 599351 - DNA, 25 bp, Rattus norvegicus
tcttccaggtgggtgacaggattta

SEQ ID NO: 599352 - DNA, 25 bp, Rattus norvegicus
tcttccaggttaaaactcccatcaa

SEQ ID NO: 599353 - DNA, 25 bp, Rattus norvegicus
tcttccaggttataactcccatcaa

SEQ ID NO: 599354 - DNA, 25 bp, Rattus norvegicus
tcttccagtcatcttcacaactatt

SEQ ID NO: 599355 - DNA, 25 bp, Rattus norvegicus
tcttccagtcatgttcacaactatt

SEQ ID NO: 599356 - DNA, 25 bp, Rattus norvegicus
tcttccagtctgctgtcactagtta

SEQ ID NO: 599357 - DNA, 25 bp, Rattus norvegicus
tcttccagtctggtgtcactagtta

SEQ ID NO: 599358 - DNA, 25 bp, Rattus norvegicus
tcttccagtgaaccgctgttcagtt

SEQ ID NO: 599359 - DNA, 25 bp, Rattus norvegicus
tcttccagtgaagcgctgttcagtt

SEQ ID NO: 599360 - DNA, 25 bp, Rattus norvegicus
tcttccagtgtcctcagtgagagat

SEQ ID NO: 599361 - DNA, 25 bp, Rattus norvegicus
tcttccagtgtcgtcagtgagagat

SEQ ID NO: 599362 - DNA, 25 bp, Rattus norvegicus
tcttccagtgtgaccgatgagctaa

SEQ ID NO: 599363 - DNA, 25 bp, Rattus norvegicus
tcttccagtgtgtccgatgagctaa

SEQ ID NO: 599364 - DNA, 25 bp, Rattus norvegicus
tcttccagttttctgccagcctgca

SEQ ID NO: 599365 - DNA, 25 bp, Rattus norvegicus
tcttccagttttgtgccagcctgca

SEQ ID NO: 599366 - DNA, 25 bp, Rattus norvegicus
tcttccatagttaaccgatcaggct

SEQ ID NO: 599367 - DNA, 25 bp, Rattus norvegicus
tcttccatagtttaccgatcaggct

SEQ ID NO: 599368 - DNA, 25 bp, Rattus norvegicus
tcttccatcgcaaatgtcctttggg

SEQ ID NO: 599369 - DNA, 25 bp, Rattus norvegicus
tcttccatcgcatatgtcctttggg

SEQ ID NO: 599370 - DNA, 25 bp, Rattus norvegicus
tcttccatctcaccaaacatgtggc

SEQ ID NO: 599371 - DNA, 25 bp, Rattus norvegicus
tcttccatctcagcaaacatgtggc

SEQ ID NO: 599372 - DNA, 25 bp, Rattus norvegicus
tcttccattggcagcacttttgtca

SEQ ID NO: 599373 - DNA, 25 bp, Rattus norvegicus
tcttccattggctgcacttttgtca

SEQ ID NO: 599374 - DNA, 25 bp, Rattus norvegicus
tcttccattttacgtgacgattctc

SEQ ID NO: 599375 - DNA, 25 bp, Rattus norvegicus
tcttccattttaggtgacgattctc

SEQ ID NO: 599376 - DNA, 25 bp, Rattus norvegicus
tcttcccaactacatagctagcatg

SEQ ID NO: 599377 - DNA, 25 bp, Rattus norvegicus
tcttcccaactagatagctagcatg

SEQ ID NO: 599378 - DNA, 25 bp, Rattus norvegicus
tcttcccaagacaagttctgtgcat

SEQ ID NO: 599379 - DNA, 25 bp, Rattus norvegicus
tcttcccaagactagttctgtgcat

SEQ ID NO: 599380 - DNA, 25 bp, Rattus norvegicus
tcttcccaagatcccagacattgtt

SEQ ID NO: 599381 - DNA, 25 bp, Rattus norvegicus
tcttcccaagatgccagacattgtt

SEQ ID NO: 599382 - DNA, 25 bp, Rattus norvegicus
tcttcccaaggacgcaggtgttgct

SEQ ID NO: 599383 - DNA, 25 bp, Rattus norvegicus
tcttcccaaggaggcaggtgttgct

SEQ ID NO: 599384 - DNA, 25 bp, Rattus norvegicus
tcttcccaagtactaaggtcctcgt

SEQ ID NO: 599385 - DNA, 25 bp, Rattus norvegicus
tcttcccaagtagtaaggtcctcgt

SEQ ID NO: 599386 - DNA, 25 bp, Rattus norvegicus
tcttcccacagcatatgtcttctaa

SEQ ID NO: 599387 - DNA, 25 bp, Rattus norvegicus
tcttcccacagcttatgtcttctaa

SEQ ID NO: 599388 - DNA, 25 bp, Rattus norvegicus
tcttcccacctcaagatcaggatta

SEQ ID NO: 599389 - DNA, 25 bp, Rattus norvegicus
tcttcccacctctagatcaggatta

SEQ ID NO: 599390 - DNA, 25 bp, Rattus norvegicus
tcttcccacgtacacagatgactta

SEQ ID NO: 599391 - DNA, 25 bp, Rattus norvegicus
tcttcccacgtagacagatgactta

SEQ ID NO: 599392 - DNA, 25 bp, Rattus norvegicus
tcttcccacgtgacctttgatgaaa

SEQ ID NO: 599393 - DNA, 25 bp, Rattus norvegicus
tcttcccacgtgtcctttgatgaaa

SEQ ID NO: 599394 - DNA, 25 bp, Rattus norvegicus
tcttcccactcgcaagtaaaactga

SEQ ID NO: 599395 - DNA, 25 bp, Rattus norvegicus
tcttcccactcggaagtaaaactga

SEQ ID NO: 599396 - DNA, 25 bp, Rattus norvegicus
tcttcccagctaaggtgggccagga

SEQ ID NO: 599397 - DNA, 25 bp, Rattus norvegicus
tcttcccagctatggtgggccagga

SEQ ID NO: 599398 - DNA, 25 bp, Rattus norvegicus
tcttcccagggtctggagcaactaa

SEQ ID NO: 599399 - DNA, 25 bp, Rattus norvegicus
tcttcccagggtgtggagcaactaa

SEQ ID NO: 599400 - DNA, 25 bp, Rattus norvegicus
tcttcccaggtacactttgtcacct

SEQ ID NO: 599401 - DNA, 25 bp, Rattus norvegicus
tcttcccaggtacgtgtaggttatg

SEQ ID NO: 599402 - DNA, 25 bp, Rattus norvegicus
tcttcccaggtagactttgtcacct

SEQ ID NO: 599403 - DNA, 25 bp, Rattus norvegicus
tcttcccaggtaggtgtaggttatg

SEQ ID NO: 599404 - DNA, 25 bp, Rattus norvegicus
tcttcccaggtcactcttaggaaag

SEQ ID NO: 599405 - DNA, 25 bp, Rattus norvegicus
tcttcccaggtctctcttaggaaag

SEQ ID NO: 599406 - DNA, 25 bp, Rattus norvegicus
tcttcccatccaaggtcaaagcgat

SEQ ID NO: 599407 - DNA, 25 bp, Rattus norvegicus
tcttcccatccatggtcaaagcgat

SEQ ID NO: 599408 - DNA, 25 bp, Rattus norvegicus
tcttcccatgcgagaaacgttctgt

SEQ ID NO: 599409 - DNA, 25 bp, Rattus norvegicus
tcttcccatgcgtgaaacgttctgt

SEQ ID NO: 599410 - DNA, 25 bp, Rattus norvegicus
tcttccccaaagaaccagcaggact

SEQ ID NO: 599411 - DNA, 25 bp, Rattus norvegicus
tcttccccaaagagccttagacaga

SEQ ID NO: 599412 - DNA, 25 bp, Rattus norvegicus
tcttccccaaagtaccagcaggact

SEQ ID NO: 599413 - DNA, 25 bp, Rattus norvegicus
tcttccccaaagtgccttagacaga

SEQ ID NO: 599414 - DNA, 25 bp, Rattus norvegicus
tcttccccacctcaataggatggtg

SEQ ID NO: 599415 - DNA, 25 bp, Rattus norvegicus
tcttccccacctgaataggatggtg

SEQ ID NO: 599416 - DNA, 25 bp, Rattus norvegicus
tcttccccagagaatgatgcaggtc

SEQ ID NO: 599417 - DNA, 25 bp, Rattus norvegicus
tcttccccagagtatgatgcaggtc

SEQ ID NO: 599418 - DNA, 25 bp, Rattus norvegicus
tcttccccagtgaagctatcaggaa

SEQ ID NO: 599419 - DNA, 25 bp, Rattus norvegicus
tcttccccagtgtagctatcaggaa

SEQ ID NO: 599420 - DNA, 25 bp, Rattus norvegicus
tcttcccctcatagtgttcaagtgt

SEQ ID NO: 599421 - DNA, 25 bp, Rattus norvegicus
tcttcccctcattgtgttcaagtgt

SEQ ID NO: 599422 - DNA, 25 bp, Rattus norvegicus
tcttcccctcggatttatgtgagaa

SEQ ID NO: 599423 - DNA, 25 bp, Rattus norvegicus
tcttcccctcggttttatgtgagaa

SEQ ID NO: 599424 - DNA, 25 bp, Rattus norvegicus
tcttcccctggaattactgtactca

SEQ ID NO: 599425 - DNA, 25 bp, Rattus norvegicus
tcttcccctggatttactgtactca

SEQ ID NO: 599426 - DNA, 25 bp, Rattus norvegicus
tcttccccttcactgaacacagatt

SEQ ID NO: 599427 - DNA, 25 bp, Rattus norvegicus
tcttccccttcagtgaacacagatt

SEQ ID NO: 599428 - DNA, 25 bp, Rattus norvegicus
tcttccccttccagattaaagctta

SEQ ID NO: 599429 - DNA, 25 bp, Rattus norvegicus
tcttccccttccctagtgtaaatag

SEQ ID NO: 599430 - DNA, 25 bp, Rattus norvegicus
tcttccccttccgtagtgtaaatag

SEQ ID NO: 599431 - DNA, 25 bp, Rattus norvegicus
tcttccccttcctgattaaagctta

SEQ ID NO: 599432 - DNA, 25 bp, Rattus norvegicus
tcttccccttgtcctaggatgctgg

SEQ ID NO: 599433 - DNA, 25 bp, Rattus norvegicus
tcttccccttgtgctaggatgctgg

SEQ ID NO: 599434 - DNA, 25 bp, Rattus norvegicus
tcttcccgcagaaagagaggcgcca

SEQ ID NO: 599435 - DNA, 25 bp, Rattus norvegicus
tcttcccgcagatagagaggcgcca

SEQ ID NO: 599436 - DNA, 25 bp, Rattus norvegicus
tcttcccggtgacctttttagatgg

SEQ ID NO: 599437 - DNA, 25 bp, Rattus norvegicus
tcttcccggtgagctttttagatgg

SEQ ID NO: 599438 - DNA, 25 bp, Rattus norvegicus
tcttccctaagccattcccgtgggt

SEQ ID NO: 599439 - DNA, 25 bp, Rattus norvegicus
tcttccctaagcgattcccgtgggt

SEQ ID NO: 599440 - DNA, 25 bp, Rattus norvegicus
tcttccctattcaagactgtcaaca

SEQ ID NO: 599441 - DNA, 25 bp, Rattus norvegicus
tcttccctattctagactgtcaaca

SEQ ID NO: 599442 - DNA, 25 bp, Rattus norvegicus
tcttccctcagtactgtcttaagag

SEQ ID NO: 599443 - DNA, 25 bp, Rattus norvegicus
tcttccctcagttctgtcttaagag

SEQ ID NO: 599444 - DNA, 25 bp, Rattus norvegicus
tcttccctccagagttggatgcagg

SEQ ID NO: 599445 - DNA, 25 bp, Rattus norvegicus
tcttccctccagtgttggatgcagg

SEQ ID NO: 599446 - DNA, 25 bp, Rattus norvegicus
tcttccctctgtcttggcaagaaat

SEQ ID NO: 599447 - DNA, 25 bp, Rattus norvegicus
tcttccctctgtgttggcaagaaat

SEQ ID NO: 599448 - DNA, 25 bp, Rattus norvegicus
tcttccctcttcactgctttgtgac

SEQ ID NO: 599449 - DNA, 25 bp, Rattus norvegicus
tcttccctcttctctgctttgtgac

SEQ ID NO: 599450 - DNA, 25 bp, Rattus norvegicus
tcttccctggagaggtgaaaacaaa

SEQ ID NO: 599451 - DNA, 25 bp, Rattus norvegicus
tcttccctggagtggtgaaaacaaa

SEQ ID NO: 599452 - DNA, 25 bp, Rattus norvegicus
tcttccctgggaactatgttgaatc

SEQ ID NO: 599453 - DNA, 25 bp, Rattus norvegicus
tcttccctgggatctatgttgaatc

SEQ ID NO: 599454 - DNA, 25 bp, Rattus norvegicus
tcttccctgtgccttttcataaaaa

SEQ ID NO: 599455 - DNA, 25 bp, Rattus norvegicus
tcttccctgtgcgttttcataaaaa

SEQ ID NO: 599456 - DNA, 25 bp, Rattus norvegicus
tcttccctgttaactgctcagtaga

SEQ ID NO: 599457 - DNA, 25 bp, Rattus norvegicus
tcttccctgttatctgctcagtaga

SEQ ID NO: 599458 - DNA, 25 bp, Rattus norvegicus
tcttcccttgcacatgccataggaa

SEQ ID NO: 599459 - DNA, 25 bp, Rattus norvegicus
tcttcccttgcagatgccataggaa

SEQ ID NO: 599460 - DNA, 25 bp, Rattus norvegicus
tcttcccttgccagttttttctaga

SEQ ID NO: 599461 - DNA, 25 bp, Rattus norvegicus
tcttcccttgcctgttttttctaga

SEQ ID NO: 599462 - DNA, 25 bp, Rattus norvegicus
tcttcccttgggaagcctgagagtc

SEQ ID NO: 599463 - DNA, 25 bp, Rattus norvegicus
tcttcccttgggtagcctgagagtc

SEQ ID NO: 599464 - DNA, 25 bp, Rattus norvegicus
tcttcccttggtcacagctgaagga

SEQ ID NO: 599465 - DNA, 25 bp, Rattus norvegicus
tcttcccttggtgacagctgaagga

SEQ ID NO: 599466 - DNA, 25 bp, Rattus norvegicus
tcttccctttagaatttgccacaat

SEQ ID NO: 599467 - DNA, 25 bp, Rattus norvegicus
tcttccctttagtatttgccacaat

SEQ ID NO: 599468 - DNA, 25 bp, Rattus norvegicus
tcttcccttttcagtgaggtttctg

SEQ ID NO: 599469 - DNA, 25 bp, Rattus norvegicus
tcttcccttttctgtgaggtttctg

SEQ ID NO: 599470 - DNA, 25 bp, Rattus norvegicus
tcttcccttttgagatagagtccaa

SEQ ID NO: 599471 - DNA, 25 bp, Rattus norvegicus
tcttcccttttgtgatagagtccaa

SEQ ID NO: 599472 - DNA, 25 bp, Rattus norvegicus
tcttccgaacacagccgagaccggg

SEQ ID NO: 599473 - DNA, 25 bp, Rattus norvegicus
tcttccgaacactgccgagaccggg

SEQ ID NO: 599474 - DNA, 25 bp, Rattus norvegicus
tcttccgagtcacaaatcccacgaa

SEQ ID NO: 599475 - DNA, 25 bp, Rattus norvegicus
tcttccgagtcagaaatcccacgaa

SEQ ID NO: 599476 - DNA, 25 bp, Rattus norvegicus
tcttccgcagtcagattcatggtag

SEQ ID NO: 599477 - DNA, 25 bp, Rattus norvegicus
tcttccgcagtctgattcatggtag

SEQ ID NO: 599478 - DNA, 25 bp, Rattus norvegicus
tcttccgcccaaatagaatcatgtt

SEQ ID NO: 599479 - DNA, 25 bp, Rattus norvegicus
tcttccgcccaactgatgggaccaa

SEQ ID NO: 599480 - DNA, 25 bp, Rattus norvegicus
tcttccgcccaagtgatgggaccaa

SEQ ID NO: 599481 - DNA, 25 bp, Rattus norvegicus
tcttccgcccaattagaatcatgtt

SEQ ID NO: 599482 - DNA, 25 bp, Rattus norvegicus
tcttccgcccctacaagttattgtt

SEQ ID NO: 599483 - DNA, 25 bp, Rattus norvegicus
tcttccgccccttcaagttattgtt

SEQ ID NO: 599484 - DNA, 25 bp, Rattus norvegicus
tcttccgcgaataggccgaggagaa

SEQ ID NO: 599485 - DNA, 25 bp, Rattus norvegicus
tcttccgcgaattggccgaggagaa

SEQ ID NO: 599486 - DNA, 25 bp, Rattus norvegicus
tcttccgctattccaggcatggtgg

SEQ ID NO: 599487 - DNA, 25 bp, Rattus norvegicus
tcttccgctattgcaggcatggtgg

SEQ ID NO: 599488 - DNA, 25 bp, Rattus norvegicus
tcttccgctgtgaggatctgcccga

SEQ ID NO: 599489 - DNA, 25 bp, Rattus norvegicus
tcttccgctgtgtggatctgcccga

SEQ ID NO: 599490 - DNA, 25 bp, Rattus norvegicus
tcttccggggaacgttcagtctgaa

SEQ ID NO: 599491 - DNA, 25 bp, Rattus norvegicus
tcttccggggaaggttcagtctgaa

SEQ ID NO: 599492 - DNA, 25 bp, Rattus norvegicus
tcttccggtggccttgtacagggaa

SEQ ID NO: 599493 - DNA, 25 bp, Rattus norvegicus
tcttccggtggcgttgtacagggaa

SEQ ID NO: 599494 - DNA, 25 bp, Rattus norvegicus
tcttccgtaacccagagtaagaaag

SEQ ID NO: 599495 - DNA, 25 bp, Rattus norvegicus
tcttccgtaaccgagagtaagaaag

SEQ ID NO: 599496 - DNA, 25 bp, Rattus norvegicus
tcttccgtctccacagagtcagaat

SEQ ID NO: 599497 - DNA, 25 bp, Rattus norvegicus
tcttccgtctcctcagagtcagaat

SEQ ID NO: 599498 - DNA, 25 bp, Rattus norvegicus
tcttccgttgctcgcatgtaatttt

SEQ ID NO: 599499 - DNA, 25 bp, Rattus norvegicus
tcttccgttgctggcatgtaatttt

SEQ ID NO: 599500 - DNA, 25 bp, Rattus norvegicus
tcttcctaagcacccggagcggagc

SEQ ID NO: 599501 - DNA, 25 bp, Rattus norvegicus
tcttcctaagcagccggagcggagc

SEQ ID NO: 599502 - DNA, 25 bp, Rattus norvegicus
tcttcctaataaagccacacttcct

SEQ ID NO: 599503 - DNA, 25 bp, Rattus norvegicus
tcttcctaataatgccacacttcct

SEQ ID NO: 599504 - DNA, 25 bp, Rattus norvegicus
tcttcctacaaacccaggtgcttgg

SEQ ID NO: 599505 - DNA, 25 bp, Rattus norvegicus
tcttcctacaaagccaggtgcttgg

SEQ ID NO: 599506 - DNA, 25 bp, Rattus norvegicus
tcttcctactaaagggttctagata

SEQ ID NO: 599507 - DNA, 25 bp, Rattus norvegicus
tcttcctactaatgggttctagata

SEQ ID NO: 599508 - DNA, 25 bp, Rattus norvegicus
tcttcctatacccatggtgttcaca

SEQ ID NO: 599509 - DNA, 25 bp, Rattus norvegicus
tcttcctataccgatggtgttcaca

SEQ ID NO: 599510 - DNA, 25 bp, Rattus norvegicus
tcttcctcattgagtacttcggttt

SEQ ID NO: 599511 - DNA, 25 bp, Rattus norvegicus
tcttcctcattgtgtacttcggttt

SEQ ID NO: 599512 - DNA, 25 bp, Rattus norvegicus
tcttcctccatgcttgacaagagag

SEQ ID NO: 599513 - DNA, 25 bp, Rattus norvegicus
tcttcctccatggttgacaagagag

SEQ ID NO: 599514 - DNA, 25 bp, Rattus norvegicus
tcttcctccattagtgactgctatt

SEQ ID NO: 599515 - DNA, 25 bp, Rattus norvegicus
tcttcctccatttgtgactgctatt

SEQ ID NO: 599516 - DNA, 25 bp, Rattus norvegicus
tcttcctcccagactggatgataaa

SEQ ID NO: 599517 - DNA, 25 bp, Rattus norvegicus
tcttcctcccagtctggatgataaa

SEQ ID NO: 599518 - DNA, 25 bp, Rattus norvegicus
tcttcctcgggcagggcggatactg

SEQ ID NO: 599519 - DNA, 25 bp, Rattus norvegicus
tcttcctcgggctgggcggatactg

SEQ ID NO: 599520 - DNA, 25 bp, Rattus norvegicus
tcttcctcggtcagaatcatttttc

SEQ ID NO: 599521 - DNA, 25 bp, Rattus norvegicus
tcttcctcggtctgaatcatttttc

SEQ ID NO: 599522 - DNA, 25 bp, Rattus norvegicus
tcttcctctaacaggcctgtaataa

SEQ ID NO: 599523 - DNA, 25 bp, Rattus norvegicus
tcttcctctaactggcctgtaataa

SEQ ID NO: 599524 - DNA, 25 bp, Rattus norvegicus
tcttcctctagactgctgggactaa

SEQ ID NO: 599525 - DNA, 25 bp, Rattus norvegicus
tcttcctctagagtgctgggactaa

SEQ ID NO: 599526 - DNA, 25 bp, Rattus norvegicus
tcttcctgacacctttgtgcaagga

SEQ ID NO: 599527 - DNA, 25 bp, Rattus norvegicus
tcttcctgacacgtttgtgcaagga

SEQ ID NO: 599528 - DNA, 25 bp, Rattus norvegicus
tcttcctgactaaagagaccagcaa

SEQ ID NO: 599529 - DNA, 25 bp, Rattus norvegicus
tcttcctgactatagagaccagcaa

SEQ ID NO: 599530 - DNA, 25 bp, Rattus norvegicus
tcttcctgaggaagagagtcccaca

SEQ ID NO: 599531 - DNA, 25 bp, Rattus norvegicus
tcttcctgaggatgagagtcccaca

SEQ ID NO: 599532 - DNA, 25 bp, Rattus norvegicus
tcttcctgcacacccagtggtgcca

SEQ ID NO: 599533 - DNA, 25 bp, Rattus norvegicus
tcttcctgcacagccagtggtgcca

SEQ ID NO: 599534 - DNA, 25 bp, Rattus norvegicus
tcttcctgcaggaattcgaggccat

SEQ ID NO: 599535 - DNA, 25 bp, Rattus norvegicus
tcttcctgcaggtattcgaggccat

SEQ ID NO: 599536 - DNA, 25 bp, Rattus norvegicus
tcttcctgcttcagctgcttgcaga

SEQ ID NO: 599537 - DNA, 25 bp, Rattus norvegicus
tcttcctgcttctgctgcttgcaga

SEQ ID NO: 599538 - DNA, 25 bp, Rattus norvegicus
tcttcctggaacaggctggcatatg

SEQ ID NO: 599539 - DNA, 25 bp, Rattus norvegicus
tcttcctggaactggctggcatatg

SEQ ID NO: 599540 - DNA, 25 bp, Rattus norvegicus
tcttcctgggtgctcctaataaaat

SEQ ID NO: 599541 - DNA, 25 bp, Rattus norvegicus
tcttcctgggtggtcctaataaaat

SEQ ID NO: 599542 - DNA, 25 bp, Rattus norvegicus
tcttcctggtgcactgtttgaacag

SEQ ID NO: 599543 - DNA, 25 bp, Rattus norvegicus
tcttcctggtgctctgtttgaacag

SEQ ID NO: 599544 - DNA, 25 bp, Rattus norvegicus
tcttcctggtgtactagcaaatgtg

SEQ ID NO: 599545 - DNA, 25 bp, Rattus norvegicus
tcttcctggtgttctagcaaatgtg

SEQ ID NO: 599546 - DNA, 25 bp, Rattus norvegicus
tcttcctggtttccttatgtgttga

SEQ ID NO: 599547 - DNA, 25 bp, Rattus norvegicus
tcttcctggtttgcttatgtgttga

SEQ ID NO: 599548 - DNA, 25 bp, Rattus norvegicus
tcttcctgtagtaagcacaccagtt

SEQ ID NO: 599549 - DNA, 25 bp, Rattus norvegicus
tcttcctgtagttagcacaccagtt

SEQ ID NO: 599550 - DNA, 25 bp, Rattus norvegicus
tcttcctgtataatccaccctgtat

SEQ ID NO: 599551 - DNA, 25 bp, Rattus norvegicus
tcttcctgtatattccaccctgtat

SEQ ID NO: 599552 - DNA, 25 bp, Rattus norvegicus
tcttcctgtcctctctcaggtgaaa

SEQ ID NO: 599553 - DNA, 25 bp, Rattus norvegicus
tcttcctgtcctgtctcaggtgaaa

SEQ ID NO: 599554 - DNA, 25 bp, Rattus norvegicus
tcttcctgtctgatgtctgggacct

SEQ ID NO: 599555 - DNA, 25 bp, Rattus norvegicus
tcttcctgtctgttgtctgggacct

SEQ ID NO: 599556 - DNA, 25 bp, Rattus norvegicus
tcttcctgtgctacaatgtggttat

SEQ ID NO: 599557 - DNA, 25 bp, Rattus norvegicus
tcttcctgtgcttcaatgtggttat

SEQ ID NO: 599558 - DNA, 25 bp, Rattus norvegicus
tcttcctgtgtcactaggcccgtat

SEQ ID NO: 599559 - DNA, 25 bp, Rattus norvegicus
tcttcctgtgtctctaggcccgtat

SEQ ID NO: 599560 - DNA, 25 bp, Rattus norvegicus
tcttccttaaagacttcgctctcat

SEQ ID NO: 599561 - DNA, 25 bp, Rattus norvegicus
tcttccttaaagtcttcgctctcat

SEQ ID NO: 599562 - DNA, 25 bp, Rattus norvegicus
tcttccttaaccctatggaacaaga

SEQ ID NO: 599563 - DNA, 25 bp, Rattus norvegicus
tcttccttaaccgtatggaacaaga

SEQ ID NO: 599564 - DNA, 25 bp, Rattus norvegicus
tcttccttagtcactggacctagaa

SEQ ID NO: 599565 - DNA, 25 bp, Rattus norvegicus
tcttccttagtctctggacctagaa

SEQ ID NO: 599566 - DNA, 25 bp, Rattus norvegicus
tcttccttcactccaacctggttaa

SEQ ID NO: 599567 - DNA, 25 bp, Rattus norvegicus
tcttccttcactgcaacctggttaa

SEQ ID NO: 599568 - DNA, 25 bp, Rattus norvegicus
tcttccttcagtcctttgggacaga

SEQ ID NO: 599569 - DNA, 25 bp, Rattus norvegicus
tcttccttcagtgctttgggacaga

SEQ ID NO: 599570 - DNA, 25 bp, Rattus norvegicus
tcttccttcattattataacactat

SEQ ID NO: 599571 - DNA, 25 bp, Rattus norvegicus
tcttccttcatttttataacactat

SEQ ID NO: 599572 - DNA, 25 bp, Rattus norvegicus
tcttccttccaaactcatagctggg

SEQ ID NO: 599573 - DNA, 25 bp, Rattus norvegicus
tcttccttccaaccattggcagtga

SEQ ID NO: 599574 - DNA, 25 bp, Rattus norvegicus
tcttccttccaagcattggcagtga

SEQ ID NO: 599575 - DNA, 25 bp, Rattus norvegicus
tcttccttccaatctcatagctggg

SEQ ID NO: 599576 - DNA, 25 bp, Rattus norvegicus
tcttccttcccaagggtgtacagga

SEQ ID NO: 599577 - DNA, 25 bp, Rattus norvegicus
tcttccttcccatgggtgtacagga

SEQ ID NO: 599578 - DNA, 25 bp, Rattus norvegicus
tcttccttccttactgttaatcttt

SEQ ID NO: 599579 - DNA, 25 bp, Rattus norvegicus
tcttccttcctttctgttaatcttt

SEQ ID NO: 599580 - DNA, 25 bp, Rattus norvegicus
tcttccttcgatctgtttggcttaa

SEQ ID NO: 599581 - DNA, 25 bp, Rattus norvegicus
tcttccttcgatgtgtttggcttaa

SEQ ID NO: 599582 - DNA, 25 bp, Rattus norvegicus
tcttccttctctctaaaacctctaa

SEQ ID NO: 599583 - DNA, 25 bp, Rattus norvegicus
tcttccttctctgtaaaacctctaa

SEQ ID NO: 599584 - DNA, 25 bp, Rattus norvegicus
tcttccttcttgctcagtcagtata

SEQ ID NO: 599585 - DNA, 25 bp, Rattus norvegicus
tcttccttcttggtcagtcagtata

SEQ ID NO: 599586 - DNA, 25 bp, Rattus norvegicus
tcttccttgtggcttgaactctggt

SEQ ID NO: 599587 - DNA, 25 bp, Rattus norvegicus
tcttccttgtgggttgaactctggt

SEQ ID NO: 599588 - DNA, 25 bp, Rattus norvegicus
tcttcctttaaaactgcgagctgct

SEQ ID NO: 599589 - DNA, 25 bp, Rattus norvegicus
tcttcctttaaatctgcgagctgct

SEQ ID NO: 599590 - DNA, 25 bp, Rattus norvegicus
tcttcctttaccatgaaaactgctg

SEQ ID NO: 599591 - DNA, 25 bp, Rattus norvegicus
tcttcctttaccttgaaaactgctg

SEQ ID NO: 599592 - DNA, 25 bp, Rattus norvegicus
tcttcctttcatcacgtgtttggag

SEQ ID NO: 599593 - DNA, 25 bp, Rattus norvegicus
tcttcctttcatgacgtgtttggag

SEQ ID NO: 599594 - DNA, 25 bp, Rattus norvegicus
tcttcctttcctagctcataaaaca

SEQ ID NO: 599595 - DNA, 25 bp, Rattus norvegicus
tcttcctttccttgctcataaaaca

SEQ ID NO: 599596 - DNA, 25 bp, Rattus norvegicus
tcttcctttgacagggcaggccttg

SEQ ID NO: 599597 - DNA, 25 bp, Rattus norvegicus
tcttcctttgactgggcaggccttg

SEQ ID NO: 599598 - DNA, 25 bp, Rattus norvegicus
tcttcctttgcccagaaaacagaaa

SEQ ID NO: 599599 - DNA, 25 bp, Rattus norvegicus
tcttcctttgccgagaaaacagaaa

SEQ ID NO: 599600 - DNA, 25 bp, Rattus norvegicus
tcttccttttaacctacggagctca

SEQ ID NO: 599601 - DNA, 25 bp, Rattus norvegicus
tcttccttttaagctacggagctca

SEQ ID NO: 599602 - DNA, 25 bp, Rattus norvegicus
tcttccttttccaacagcctctgtg

SEQ ID NO: 599603 - DNA, 25 bp, Rattus norvegicus
tcttccttttccctccgctaggagg

SEQ ID NO: 599604 - DNA, 25 bp, Rattus norvegicus
tcttccttttccgtccgctaggagg

SEQ ID NO: 599605 - DNA, 25 bp, Rattus norvegicus
tcttccttttcctacagcctctgtg

SEQ ID NO: 599606 - DNA, 25 bp, Rattus norvegicus
tcttccttttgaagactcagctggt

SEQ ID NO: 599607 - DNA, 25 bp, Rattus norvegicus
tcttccttttgatgactcagctggt

SEQ ID NO: 599608 - DNA, 25 bp, Rattus norvegicus
tcttcctttttccagtgtgtgctca

SEQ ID NO: 599609 - DNA, 25 bp, Rattus norvegicus
tcttcctttttcgagtgtgtgctca

SEQ ID NO: 599610 - DNA, 25 bp, Rattus norvegicus
tcttcgacattccaggccagtgagg

SEQ ID NO: 599611 - DNA, 25 bp, Rattus norvegicus
tcttcgacattcgaggccagtgagg

SEQ ID NO: 599612 - DNA, 25 bp, Rattus norvegicus
tcttcgactactatgcggccagtgg

SEQ ID NO: 599613 - DNA, 25 bp, Rattus norvegicus
tcttcgactactttgcggccagtgg

SEQ ID NO: 599614 - DNA, 25 bp, Rattus norvegicus
tcttcgactggccactgaggtgaac

SEQ ID NO: 599615 - DNA, 25 bp, Rattus norvegicus
tcttcgactggcgactgaggtgaac

SEQ ID NO: 599616 - DNA, 25 bp, Rattus norvegicus
tcttcgagggtgacattctccagaa

SEQ ID NO: 599617 - DNA, 25 bp, Rattus norvegicus
tcttcgagggtgtcattctccagaa

SEQ ID NO: 599618 - DNA, 25 bp, Rattus norvegicus
tcttcgatcatcatacagggcaggt

SEQ ID NO: 599619 - DNA, 25 bp, Rattus norvegicus
tcttcgatcatcttacagggcaggt

SEQ ID NO: 599620 - DNA, 25 bp, Rattus norvegicus
tcttcgatgtccacacatggctggg

SEQ ID NO: 599621 - DNA, 25 bp, Rattus norvegicus
tcttcgatgtcctcacatggctggg

SEQ ID NO: 599622 - DNA, 25 bp, Rattus norvegicus
tcttcgcaccggagagcacagctgt

SEQ ID NO: 599623 - DNA, 25 bp, Rattus norvegicus
tcttcgcaccggtgagcacagctgt

SEQ ID NO: 599624 - DNA, 25 bp, Rattus norvegicus
tcttcgcctggtcacaaacttaatc

SEQ ID NO: 599625 - DNA, 25 bp, Rattus norvegicus
tcttcgcctggtgacaaacttaatc

SEQ ID NO: 599626 - DNA, 25 bp, Rattus norvegicus
tcttcgcggtgtacgatgagaccaa

SEQ ID NO: 599627 - DNA, 25 bp, Rattus norvegicus
tcttcgcggtgttcgatgagaccaa

SEQ ID NO: 599628 - DNA, 25 bp, Rattus norvegicus
tcttcggacattcatcagagaccct

SEQ ID NO: 599629 - DNA, 25 bp, Rattus norvegicus
tcttcggacattgatcagagaccct

SEQ ID NO: 599630 - DNA, 25 bp, Rattus norvegicus
tcttcggcctcaaagcccgggttgt

SEQ ID NO: 599631 - DNA, 25 bp, Rattus norvegicus
tcttcggcctcatagcccgggttgt

SEQ ID NO: 599632 - DNA, 25 bp, Rattus norvegicus
tcttcggcctggaggccctgctggc

SEQ ID NO: 599633 - DNA, 25 bp, Rattus norvegicus
tcttcggcctggtggccctgctggc

SEQ ID NO: 599634 - DNA, 25 bp, Rattus norvegicus
tcttcggctacacagaatgatcaga

SEQ ID NO: 599635 - DNA, 25 bp, Rattus norvegicus
tcttcggctacagagaatgatcaga

SEQ ID NO: 599636 - DNA, 25 bp, Rattus norvegicus
tcttcgggacatagaacgccttcat

SEQ ID NO: 599637 - DNA, 25 bp, Rattus norvegicus
tcttcgggacattgaacgccttcat

SEQ ID NO: 599638 - DNA, 25 bp, Rattus norvegicus
tcttcgggagcaatgatgacttcag

SEQ ID NO: 599639 - DNA, 25 bp, Rattus norvegicus
tcttcgggagcattgatgacttcag

SEQ ID NO: 599640 - DNA, 25 bp, Rattus norvegicus
tcttcgggcaacacagactgggcat

SEQ ID NO: 599641 - DNA, 25 bp, Rattus norvegicus
tcttcgggcaactcagactgggcat

SEQ ID NO: 599642 - DNA, 25 bp, Rattus norvegicus
tcttcgggccttcacggtagagaaa

SEQ ID NO: 599643 - DNA, 25 bp, Rattus norvegicus
tcttcgggccttgacggtagagaaa

SEQ ID NO: 599644 - DNA, 25 bp, Rattus norvegicus
tcttcgggcttcagcaagaaccaag

SEQ ID NO: 599645 - DNA, 25 bp, Rattus norvegicus
tcttcgggcttctgcaagaaccaag

SEQ ID NO: 599646 - DNA, 25 bp, Rattus norvegicus
tcttcggtccgaacatacctagtag

SEQ ID NO: 599647 - DNA, 25 bp, Rattus norvegicus
tcttcggtccgatcatacctagtag

SEQ ID NO: 599648 - DNA, 25 bp, Rattus norvegicus
tcttcggtcttacctcaactgtgaa

SEQ ID NO: 599649 - DNA, 25 bp, Rattus norvegicus
tcttcggtcttagctcaactgtgaa

SEQ ID NO: 599650 - DNA, 25 bp, Rattus norvegicus
tcttcgtacactaaaaccactggat

SEQ ID NO: 599651 - DNA, 25 bp, Rattus norvegicus
tcttcgtacacttaaaccactggat

SEQ ID NO: 599652 - DNA, 25 bp, Rattus norvegicus
tcttcgtagcttcaggtggactctc

SEQ ID NO: 599653 - DNA, 25 bp, Rattus norvegicus
tcttcgtagcttgaggtggactctc

SEQ ID NO: 599654 - DNA, 25 bp, Rattus norvegicus
tcttcgtaggcgatgccgatgccga

SEQ ID NO: 599655 - DNA, 25 bp, Rattus norvegicus
tcttcgtaggcgttgccgatgccga

SEQ ID NO: 599656 - DNA, 25 bp, Rattus norvegicus
tcttcgtcctccagcagttcaggtt

SEQ ID NO: 599657 - DNA, 25 bp, Rattus norvegicus
tcttcgtcctcctgcagttcaggtt

SEQ ID NO: 599658 - DNA, 25 bp, Rattus norvegicus
tcttcgtcctgtcgttctatctatt

SEQ ID NO: 599659 - DNA, 25 bp, Rattus norvegicus
tcttcgtcctgtggttctatctatt

SEQ ID NO: 599660 - DNA, 25 bp, Rattus norvegicus
tcttcgtcggttcgcgtcggcgtct

SEQ ID NO: 599661 - DNA, 25 bp, Rattus norvegicus
tcttcgtcggttggcgtcggcgtct

SEQ ID NO: 599662 - DNA, 25 bp, Rattus norvegicus
tcttcgtcgtccatggacagggagt

SEQ ID NO: 599663 - DNA, 25 bp, Rattus norvegicus
tcttcgtcgtccttggacagggagt

SEQ ID NO: 599664 - DNA, 25 bp, Rattus norvegicus
tcttcgtctatgatgagattcgcaa

SEQ ID NO: 599665 - DNA, 25 bp, Rattus norvegicus
tcttcgtctatgttgagattcgcaa

SEQ ID NO: 599666 - DNA, 25 bp, Rattus norvegicus
tcttcgtcttcaacaagcacttgta

SEQ ID NO: 599667 - DNA, 25 bp, Rattus norvegicus
tcttcgtcttcatcaagcacttgta

SEQ ID NO: 599668 - DNA, 25 bp, Rattus norvegicus
tcttcgtgaagtcggattctccagc

SEQ ID NO: 599669 - DNA, 25 bp, Rattus norvegicus
tcttcgtgaagtgggattctccagc

SEQ ID NO: 599670 - DNA, 25 bp, Rattus norvegicus
tcttcgtggaccatacgtgtcaatt

SEQ ID NO: 599671 - DNA, 25 bp, Rattus norvegicus
tcttcgtggaccttacgtgtcaatt

SEQ ID NO: 599672 - DNA, 25 bp, Rattus norvegicus
tcttcgtgggcacctggatggtcta

SEQ ID NO: 599673 - DNA, 25 bp, Rattus norvegicus
tcttcgtgggcagctggatggtcta

SEQ ID NO: 599674 - DNA, 25 bp, Rattus norvegicus
tcttcgttccgtcctatatcaatat

SEQ ID NO: 599675 - DNA, 25 bp, Rattus norvegicus
tcttcgttccgtgctatatcaatat

SEQ ID NO: 599676 - DNA, 25 bp, Rattus norvegicus
tcttcgttctttacgttctccagag

SEQ ID NO: 599677 - DNA, 25 bp, Rattus norvegicus
tcttcgttcttttcgttctccagag

SEQ ID NO: 599678 - DNA, 25 bp, Rattus norvegicus
tcttcgttttcaatctttggttgga

SEQ ID NO: 599679 - DNA, 25 bp, Rattus norvegicus
tcttcgttttcattctttggttgga

SEQ ID NO: 599680 - DNA, 25 bp, Rattus norvegicus
tcttctaagtccattgtggcttgta

SEQ ID NO: 599681 - DNA, 25 bp, Rattus norvegicus
tcttctaagtcctttgtggcttgta

SEQ ID NO: 599682 - DNA, 25 bp, Rattus norvegicus
tcttctacatccagtcataggcaaa

SEQ ID NO: 599683 - DNA, 25 bp, Rattus norvegicus
tcttctacatcctgtcataggcaaa

SEQ ID NO: 599684 - DNA, 25 bp, Rattus norvegicus
tcttctaccccaacccaagggaaag

SEQ ID NO: 599685 - DNA, 25 bp, Rattus norvegicus
tcttctaccccatcccaagggaaag

SEQ ID NO: 599686 - DNA, 25 bp, Rattus norvegicus
tcttctacgagccagatgcttttga

SEQ ID NO: 599687 - DNA, 25 bp, Rattus norvegicus
tcttctacgagcgagatgcttttga

SEQ ID NO: 599688 - DNA, 25 bp, Rattus norvegicus
tcttctactgtcctttcgcttcatg

SEQ ID NO: 599689 - DNA, 25 bp, Rattus norvegicus
tcttctactgtcgtttcgcttcatg

SEQ ID NO: 599690 - DNA, 25 bp, Rattus norvegicus
tcttctagagtcagtgaacccaaat

SEQ ID NO: 599691 - DNA, 25 bp, Rattus norvegicus
tcttctagagtctgtgaacccaaat

SEQ ID NO: 599692 - DNA, 25 bp, Rattus norvegicus
tcttctagggcactgggtggaattc

SEQ ID NO: 599693 - DNA, 25 bp, Rattus norvegicus
tcttctagggcagtgggtggaattc

SEQ ID NO: 599694 - DNA, 25 bp, Rattus norvegicus
tcttctagtggtaatggctccaact

SEQ ID NO: 599695 - DNA, 25 bp, Rattus norvegicus
tcttctagtggttatggctccaact

SEQ ID NO: 599696 - DNA, 25 bp, Rattus norvegicus
tcttctataggaatcactctgtctg

SEQ ID NO: 599697 - DNA, 25 bp, Rattus norvegicus
tcttctataggattcactctgtctg

SEQ ID NO: 599698 - DNA, 25 bp, Rattus norvegicus
tcttctatctttccccgttaggtaa

SEQ ID NO: 599699 - DNA, 25 bp, Rattus norvegicus
tcttctatctttcttcagccaagga

SEQ ID NO: 599700 - DNA, 25 bp, Rattus norvegicus
tcttctatctttgcccgttaggtaa

SEQ ID NO: 599701 - DNA, 25 bp, Rattus norvegicus
tcttctatctttgttcagccaagga

SEQ ID NO: 599702 - DNA, 25 bp, Rattus norvegicus
tcttctatgagaagtcggcctgtag

SEQ ID NO: 599703 - DNA, 25 bp, Rattus norvegicus
tcttctatgagatgtcggcctgtag

SEQ ID NO: 599704 - DNA, 25 bp, Rattus norvegicus
tcttctatgatgacctccagtgtga

SEQ ID NO: 599705 - DNA, 25 bp, Rattus norvegicus
tcttctatgatgtcctccagtgtga

SEQ ID NO: 599706 - DNA, 25 bp, Rattus norvegicus
tcttctattcctactggctatgctg

SEQ ID NO: 599707 - DNA, 25 bp, Rattus norvegicus
tcttctattccttctggctatgctg

SEQ ID NO: 599708 - DNA, 25 bp, Rattus norvegicus
tcttctcaccatacattattcttca

SEQ ID NO: 599709 - DNA, 25 bp, Rattus norvegicus
tcttctcaccattcattattcttca

SEQ ID NO: 599710 - DNA, 25 bp, Rattus norvegicus
tcttctcagagaaaagcctttaaca

SEQ ID NO: 599711 - DNA, 25 bp, Rattus norvegicus
tcttctcagagataagcctttaaca

SEQ ID NO: 599712 - DNA, 25 bp, Rattus norvegicus
tcttctcagagccacgactcaagaa

SEQ ID NO: 599713 - DNA, 25 bp, Rattus norvegicus
tcttctcagagcgacgactcaagaa

SEQ ID NO: 599714 - DNA, 25 bp, Rattus norvegicus
tcttctcagcctatatcacatgatg

SEQ ID NO: 599715 - DNA, 25 bp, Rattus norvegicus
tcttctcagcctttatcacatgatg

SEQ ID NO: 599716 - DNA, 25 bp, Rattus norvegicus
tcttctcagtctactgctgcagtga

SEQ ID NO: 599717 - DNA, 25 bp, Rattus norvegicus
tcttctcagtcttctgctgcagtga

SEQ ID NO: 599718 - DNA, 25 bp, Rattus norvegicus
tcttctcagttaatttcctcattgt

SEQ ID NO: 599719 - DNA, 25 bp, Rattus norvegicus
tcttctcagttattttcctcattgt

SEQ ID NO: 599720 - DNA, 25 bp, Rattus norvegicus
tcttctccaaaacgctgtctgctta

SEQ ID NO: 599721 - DNA, 25 bp, Rattus norvegicus
tcttctccaaaaggctgtctgctta

SEQ ID NO: 599722 - DNA, 25 bp, Rattus norvegicus
tcttctccaagcactacctgttctg

SEQ ID NO: 599723 - DNA, 25 bp, Rattus norvegicus
tcttctccaagctctacctgttctg

SEQ ID NO: 599724 - DNA, 25 bp, Rattus norvegicus
tcttctccaagtaggcttcccaaaa

SEQ ID NO: 599725 - DNA, 25 bp, Rattus norvegicus
tcttctccaagttggcttcccaaaa

SEQ ID NO: 599726 - DNA, 25 bp, Rattus norvegicus
tcttctccagctcgttttgcaaact

SEQ ID NO: 599727 - DNA, 25 bp, Rattus norvegicus
tcttctccagctggttttgcaaact

SEQ ID NO: 599728 - DNA, 25 bp, Rattus norvegicus
tcttctcccaccatgaaattaattt

SEQ ID NO: 599729 - DNA, 25 bp, Rattus norvegicus
tcttctcccaccttgaaattaattt

SEQ ID NO: 599730 - DNA, 25 bp, Rattus norvegicus
tcttctcccctaactgtgttcatgc

SEQ ID NO: 599731 - DNA, 25 bp, Rattus norvegicus
tcttctcccctatctgtgttcatgc

SEQ ID NO: 599732 - DNA, 25 bp, Rattus norvegicus
tcttctccctagagacatcttgagg

SEQ ID NO: 599733 - DNA, 25 bp, Rattus norvegicus
tcttctccctagctgacttttacaa

SEQ ID NO: 599734 - DNA, 25 bp, Rattus norvegicus
tcttctccctaggtgacttttacaa

SEQ ID NO: 599735 - DNA, 25 bp, Rattus norvegicus
tcttctccctagtgacatcttgagg

SEQ ID NO: 599736 - DNA, 25 bp, Rattus norvegicus
tcttctccctccattaaatgactca

SEQ ID NO: 599737 - DNA, 25 bp, Rattus norvegicus
tcttctccctcctttaaatgactca

SEQ ID NO: 599738 - DNA, 25 bp, Rattus norvegicus
tcttctccgtctaatggtatcctta

SEQ ID NO: 599739 - DNA, 25 bp, Rattus norvegicus
tcttctccgtcttatggtatcctta

SEQ ID NO: 599740 - DNA, 25 bp, Rattus norvegicus
tcttctcctattactctctattttg

SEQ ID NO: 599741 - DNA, 25 bp, Rattus norvegicus
tcttctcctatttctctctattttg

SEQ ID NO: 599742 - DNA, 25 bp, Rattus norvegicus
tcttctcctcagaggcaagacgtga

SEQ ID NO: 599743 - DNA, 25 bp, Rattus norvegicus
tcttctcctcagtggcaagacgtga

SEQ ID NO: 599744 - DNA, 25 bp, Rattus norvegicus
tcttctcctccccagtaactggaaa

SEQ ID NO: 599745 - DNA, 25 bp, Rattus norvegicus
tcttctcctcccgagtaactggaaa

SEQ ID NO: 599746 - DNA, 25 bp, Rattus norvegicus
tcttctcctgacatccatgtctgaa

SEQ ID NO: 599747 - DNA, 25 bp, Rattus norvegicus
tcttctcctgacttccatgtctgaa

SEQ ID NO: 599748 - DNA, 25 bp, Rattus norvegicus
tcttctcgaggtactgaccttcgga

SEQ ID NO: 599749 - DNA, 25 bp, Rattus norvegicus
tcttctcgaggttctgaccttcgga

SEQ ID NO: 599750 - DNA, 25 bp, Rattus norvegicus
tcttctcggaagatttcctgcttct

SEQ ID NO: 599751 - DNA, 25 bp, Rattus norvegicus
tcttctcggaagttttcctgcttct

SEQ ID NO: 599752 - DNA, 25 bp, Rattus norvegicus
tcttctcgggaactgcagtgcgcac

SEQ ID NO: 599753 - DNA, 25 bp, Rattus norvegicus
tcttctcgggaagtgcagtgcgcac

SEQ ID NO: 599754 - DNA, 25 bp, Rattus norvegicus
tcttctcgtaagaatgatgccagca

SEQ ID NO: 599755 - DNA, 25 bp, Rattus norvegicus
tcttctcgtaagtatgatgccagca

SEQ ID NO: 599756 - DNA, 25 bp, Rattus norvegicus
tcttctcgttctccggctgtccttt

SEQ ID NO: 599757 - DNA, 25 bp, Rattus norvegicus
tcttctcgttctgcggctgtccttt

SEQ ID NO: 599758 - DNA, 25 bp, Rattus norvegicus
tcttctctaaccatcgatcgctgga

SEQ ID NO: 599759 - DNA, 25 bp, Rattus norvegicus
tcttctctaaccttcgatcgctgga

SEQ ID NO: 599760 - DNA, 25 bp, Rattus norvegicus
tcttctctagcaccttgcactgagt

SEQ ID NO: 599761 - DNA, 25 bp, Rattus norvegicus
tcttctctagcagcttgcactgagt

SEQ ID NO: 599762 - DNA, 25 bp, Rattus norvegicus
tcttctctccaaaacgtacgtgctt

SEQ ID NO: 599763 - DNA, 25 bp, Rattus norvegicus
tcttctctccaatacgtacgtgctt

SEQ ID NO: 599764 - DNA, 25 bp, Rattus norvegicus
tcttctctccctcttgattattcat

SEQ ID NO: 599765 - DNA, 25 bp, Rattus norvegicus
tcttctctccctgttgattattcat

SEQ ID NO: 599766 - DNA, 25 bp, Rattus norvegicus
tcttctctccgcagaatggagccaa

SEQ ID NO: 599767 - DNA, 25 bp, Rattus norvegicus
tcttctctccgctgaatggagccaa

SEQ ID NO: 599768 - DNA, 25 bp, Rattus norvegicus
tcttctctcgccaggaccaaaggag

SEQ ID NO: 599769 - DNA, 25 bp, Rattus norvegicus
tcttctctcgcctggaccaaaggag

SEQ ID NO: 599770 - DNA, 25 bp, Rattus norvegicus
tcttctctcgtcaagaatgctatcg

SEQ ID NO: 599771 - DNA, 25 bp, Rattus norvegicus
tcttctctcgtctagaatgctatcg

SEQ ID NO: 599772 - DNA, 25 bp, Rattus norvegicus
tcttctctctgaagatggcagtctg

SEQ ID NO: 599773 - DNA, 25 bp, Rattus norvegicus
tcttctctctgatgatggcagtctg

SEQ ID NO: 599774 - DNA, 25 bp, Rattus norvegicus
tcttctctctgcaatggccttattg

SEQ ID NO: 599775 - DNA, 25 bp, Rattus norvegicus
tcttctctctgcagtcattttagga

SEQ ID NO: 599776 - DNA, 25 bp, Rattus norvegicus
tcttctctctgctatggccttattg

SEQ ID NO: 599777 - DNA, 25 bp, Rattus norvegicus
tcttctctctgctgtcattttagga

SEQ ID NO: 599778 - DNA, 25 bp, Rattus norvegicus
tcttctctgacgaggactccaagtg

SEQ ID NO: 599779 - DNA, 25 bp, Rattus norvegicus
tcttctctgacgtggactccaagtg

SEQ ID NO: 599780 - DNA, 25 bp, Rattus norvegicus
tcttctctgcccctataaggagcct

SEQ ID NO: 599781 - DNA, 25 bp, Rattus norvegicus
tcttctctgcccgtataaggagcct

SEQ ID NO: 599782 - DNA, 25 bp, Rattus norvegicus
tcttctctgcctagtacatagcaca

SEQ ID NO: 599783 - DNA, 25 bp, Rattus norvegicus
tcttctctgcctcttcatttgactg

SEQ ID NO: 599784 - DNA, 25 bp, Rattus norvegicus
tcttctctgcctgttcatttgactg

SEQ ID NO: 599785 - DNA, 25 bp, Rattus norvegicus
tcttctctgccttgtacatagcaca

SEQ ID NO: 599786 - DNA, 25 bp, Rattus norvegicus
tcttctctgctacgcaatggtataa

SEQ ID NO: 599787 - DNA, 25 bp, Rattus norvegicus
tcttctctgctaggcaatggtataa

SEQ ID NO: 599788 - DNA, 25 bp, Rattus norvegicus
tcttctctggtgagtatatattaat

SEQ ID NO: 599789 - DNA, 25 bp, Rattus norvegicus
tcttctctggtgtgtatatattaat

SEQ ID NO: 599790 - DNA, 25 bp, Rattus norvegicus
tcttctctgtcaatatagtcacttt

SEQ ID NO: 599791 - DNA, 25 bp, Rattus norvegicus
tcttctctgtcattatagtcacttt

SEQ ID NO: 599792 - DNA, 25 bp, Rattus norvegicus
tcttctctgtggctgatgtgctgta

SEQ ID NO: 599793 - DNA, 25 bp, Rattus norvegicus
tcttctctgtgggtgatgtgctgta

SEQ ID NO: 599794 - DNA, 25 bp, Rattus norvegicus
tcttctcttagcacttgtcctttta

SEQ ID NO: 599795 - DNA, 25 bp, Rattus norvegicus
tcttctcttagctcttgtcctttta

SEQ ID NO: 599796 - DNA, 25 bp, Rattus norvegicus
tcttctcttgcccattagagggtgt

SEQ ID NO: 599797 - DNA, 25 bp, Rattus norvegicus
tcttctcttgccgattagagggtgt

SEQ ID NO: 599798 - DNA, 25 bp, Rattus norvegicus
tcttctcttggtcggtccgggatca

SEQ ID NO: 599799 - DNA, 25 bp, Rattus norvegicus
tcttctcttggtgggtccgggatca

SEQ ID NO: 599800 - DNA, 25 bp, Rattus norvegicus
tcttctctttcgagtcctactttaa

SEQ ID NO: 599801 - DNA, 25 bp, Rattus norvegicus
tcttctctttcgtgtcctactttaa

SEQ ID NO: 599802 - DNA, 25 bp, Rattus norvegicus
tcttctctttctcgactcttgatag

SEQ ID NO: 599803 - DNA, 25 bp, Rattus norvegicus
tcttctctttctggactcttgatag

SEQ ID NO: 599804 - DNA, 25 bp, Rattus norvegicus
tcttctgaagttcgagcttctccac

SEQ ID NO: 599805 - DNA, 25 bp, Rattus norvegicus
tcttctgaagttggagcttctccac

SEQ ID NO: 599806 - DNA, 25 bp, Rattus norvegicus
tcttctgaccttagtgttgcttttt

SEQ ID NO: 599807 - DNA, 25 bp, Rattus norvegicus
tcttctgacctttgtgttgcttttt

SEQ ID NO: 599808 - DNA, 25 bp, Rattus norvegicus
tcttctgagttgagagtgactgtct

SEQ ID NO: 599809 - DNA, 25 bp, Rattus norvegicus
tcttctgagttgtgagtgactgtct

SEQ ID NO: 599810 - DNA, 25 bp, Rattus norvegicus
tcttctgatgttatgtagccataac

SEQ ID NO: 599811 - DNA, 25 bp, Rattus norvegicus
tcttctgatgttttgtagccataac

SEQ ID NO: 599812 - DNA, 25 bp, Rattus norvegicus
tcttctgcaagaccattaacggctc

SEQ ID NO: 599813 - DNA, 25 bp, Rattus norvegicus
tcttctgcaagagcattaacggctc

SEQ ID NO: 599814 - DNA, 25 bp, Rattus norvegicus
tcttctgcagagaccagcgagctga

SEQ ID NO: 599815 - DNA, 25 bp, Rattus norvegicus
tcttctgcagagtccagcgagctga

SEQ ID NO: 599816 - DNA, 25 bp, Rattus norvegicus
tcttctgcagatacctacacacaca

SEQ ID NO: 599817 - DNA, 25 bp, Rattus norvegicus
tcttctgcagattcctacacacaca

SEQ ID NO: 599818 - DNA, 25 bp, Rattus norvegicus
tcttctgcagctatgtttttgttgg

SEQ ID NO: 599819 - DNA, 25 bp, Rattus norvegicus
tcttctgcagctttgtttttgttgg

SEQ ID NO: 599820 - DNA, 25 bp, Rattus norvegicus
tcttctgcatccagttgtgagaaac

SEQ ID NO: 599821 - DNA, 25 bp, Rattus norvegicus
tcttctgcatcctgttgtgagaaac

SEQ ID NO: 599822 - DNA, 25 bp, Rattus norvegicus
tcttctgccaggcaacatcccaaat

SEQ ID NO: 599823 - DNA, 25 bp, Rattus norvegicus
tcttctgccagggaacatcccaaat

SEQ ID NO: 599824 - DNA, 25 bp, Rattus norvegicus
tcttctgccgggatcgagccatcag

SEQ ID NO: 599825 - DNA, 25 bp, Rattus norvegicus
tcttctgccgggttcgagccatcag

SEQ ID NO: 599826 - DNA, 25 bp, Rattus norvegicus
tcttctgcgaccaggtacttatcta

SEQ ID NO: 599827 - DNA, 25 bp, Rattus norvegicus
tcttctgcgacctggtacttatcta

SEQ ID NO: 599828 - DNA, 25 bp, Rattus norvegicus
tcttctgcttagaggtctctggata

SEQ ID NO: 599829 - DNA, 25 bp, Rattus norvegicus
tcttctgcttagtggtctctggata

SEQ ID NO: 599830 - DNA, 25 bp, Rattus norvegicus
tcttctggaccaatttcttaacctt

SEQ ID NO: 599831 - DNA, 25 bp, Rattus norvegicus
tcttctggaccattttcttaacctt

SEQ ID NO: 599832 - DNA, 25 bp, Rattus norvegicus
tcttctggactcaatgaacacctgc

SEQ ID NO: 599833 - DNA, 25 bp, Rattus norvegicus
tcttctggactctatgaacacctgc

SEQ ID NO: 599834 - DNA, 25 bp, Rattus norvegicus
tcttctggactgcagatacctgggc

SEQ ID NO: 599835 - DNA, 25 bp, Rattus norvegicus
tcttctggactggagatacctgggc

SEQ ID NO: 599836 - DNA, 25 bp, Rattus norvegicus
tcttctggcatgcagacagaacatg

SEQ ID NO: 599837 - DNA, 25 bp, Rattus norvegicus
tcttctggcatggagacagaacatg

SEQ ID NO: 599838 - DNA, 25 bp, Rattus norvegicus
tcttctggcctgaagaactgtgtgc

SEQ ID NO: 599839 - DNA, 25 bp, Rattus norvegicus
tcttctggcctgtagaactgtgtgc

SEQ ID NO: 599840 - DNA, 25 bp, Rattus norvegicus
tcttctggccttatagggcatctgc

SEQ ID NO: 599841 - DNA, 25 bp, Rattus norvegicus
tcttctggccttttagggcatctgc

SEQ ID NO: 599842 - DNA, 25 bp, Rattus norvegicus
tcttctggctgcaacaggtactaca

SEQ ID NO: 599843 - DNA, 25 bp, Rattus norvegicus
tcttctggctgctacaggtactaca

SEQ ID NO: 599844 - DNA, 25 bp, Rattus norvegicus
tcttctgggcctaactctgatagta

SEQ ID NO: 599845 - DNA, 25 bp, Rattus norvegicus
tcttctgggcctacagtaagtgtgt

SEQ ID NO: 599846 - DNA, 25 bp, Rattus norvegicus
tcttctgggccttactctgatagta

SEQ ID NO: 599847 - DNA, 25 bp, Rattus norvegicus
tcttctgggccttcagtaagtgtgt

SEQ ID NO: 599848 - DNA, 25 bp, Rattus norvegicus
tcttctggtataagtgagcttcaat

SEQ ID NO: 599849 - DNA, 25 bp, Rattus norvegicus
tcttctggtatatgtgagcttcaat

SEQ ID NO: 599850 - DNA, 25 bp, Rattus norvegicus
tcttctggtgatatttgattctgtc

SEQ ID NO: 599851 - DNA, 25 bp, Rattus norvegicus
tcttctggtgatttttgattctgtc

SEQ ID NO: 599852 - DNA, 25 bp, Rattus norvegicus
tcttctggttagcatgtagcactca

SEQ ID NO: 599853 - DNA, 25 bp, Rattus norvegicus
tcttctggttaggatgtagcactca

SEQ ID NO: 599854 - DNA, 25 bp, Rattus norvegicus
tcttctggtttcctttggaacaaga

SEQ ID NO: 599855 - DNA, 25 bp, Rattus norvegicus
tcttctggtttcgtttggaacaaga

SEQ ID NO: 599856 - DNA, 25 bp, Rattus norvegicus
tcttctgtaagcagagggccactct

SEQ ID NO: 599857 - DNA, 25 bp, Rattus norvegicus
tcttctgtaagctgagggccactct

SEQ ID NO: 599858 - DNA, 25 bp, Rattus norvegicus
tcttctgtacttagtagagatcggg

SEQ ID NO: 599859 - DNA, 25 bp, Rattus norvegicus
tcttctgtactttgtagagatcggg

SEQ ID NO: 599860 - DNA, 25 bp, Rattus norvegicus
tcttctgtatttactctcctattta

SEQ ID NO: 599861 - DNA, 25 bp, Rattus norvegicus
tcttctgtatttatcgtgcgtagcg

SEQ ID NO: 599862 - DNA, 25 bp, Rattus norvegicus
tcttctgtattttctctcctattta

SEQ ID NO: 599863 - DNA, 25 bp, Rattus norvegicus
tcttctgtatttttcgtgcgtagcg

SEQ ID NO: 599864 - DNA, 25 bp, Rattus norvegicus
tcttctgtcattctcaactcgtgag

SEQ ID NO: 599865 - DNA, 25 bp, Rattus norvegicus
tcttctgtcattgtcaactcgtgag

SEQ ID NO: 599866 - DNA, 25 bp, Rattus norvegicus
tcttctgtccctaggacctcttcta

SEQ ID NO: 599867 - DNA, 25 bp, Rattus norvegicus
tcttctgtcccttggacctcttcta

SEQ ID NO: 599868 - DNA, 25 bp, Rattus norvegicus
tcttctgtcgtgatcacaactgtgg

SEQ ID NO: 599869 - DNA, 25 bp, Rattus norvegicus
tcttctgtcgtgttcacaactgtgg

SEQ ID NO: 599870 - DNA, 25 bp, Rattus norvegicus
tcttctgtctctatgtacctttgta

SEQ ID NO: 599871 - DNA, 25 bp, Rattus norvegicus
tcttctgtctctttgtacctttgta

SEQ ID NO: 599872 - DNA, 25 bp, Rattus norvegicus
tcttctgtctgcatttcttatgtaa

SEQ ID NO: 599873 - DNA, 25 bp, Rattus norvegicus
tcttctgtctgcttttcttatgtaa

SEQ ID NO: 599874 - DNA, 25 bp, Rattus norvegicus
tcttctgtcttcaaactccatggaa

SEQ ID NO: 599875 - DNA, 25 bp, Rattus norvegicus
tcttctgtcttctaactccatggaa

SEQ ID NO: 599876 - DNA, 25 bp, Rattus norvegicus
tcttctgtgaagacggacttgccat

SEQ ID NO: 599877 - DNA, 25 bp, Rattus norvegicus
tcttctgtgaagtcggacttgccat

SEQ ID NO: 599878 - DNA, 25 bp, Rattus norvegicus
tcttctgtgtccactgtaattgtta

SEQ ID NO: 599879 - DNA, 25 bp, Rattus norvegicus
tcttctgtgtccatggcgacgggca

SEQ ID NO: 599880 - DNA, 25 bp, Rattus norvegicus
tcttctgtgtcctctgtaattgtta

SEQ ID NO: 599881 - DNA, 25 bp, Rattus norvegicus
tcttctgtgtccttggcgacgggca

SEQ ID NO: 599882 - DNA, 25 bp, Rattus norvegicus
tcttctgttcgtaaggagtttccgg

SEQ ID NO: 599883 - DNA, 25 bp, Rattus norvegicus
tcttctgttcgttaggagtttccgg

SEQ ID NO: 599884 - DNA, 25 bp, Rattus norvegicus
tcttctgttgcacggcgggtaacgt

SEQ ID NO: 599885 - DNA, 25 bp, Rattus norvegicus
tcttctgttgcagggcgggtaacgt

SEQ ID NO: 599886 - DNA, 25 bp, Rattus norvegicus
tcttctgtttagctgccagtcattt

SEQ ID NO: 599887 - DNA, 25 bp, Rattus norvegicus
tcttctgtttaggtgccagtcattt

SEQ ID NO: 599888 - DNA, 25 bp, Rattus norvegicus
tcttctgtttgacctctggttccta

SEQ ID NO: 599889 - DNA, 25 bp, Rattus norvegicus
tcttctgtttgagctctggttccta

SEQ ID NO: 599890 - DNA, 25 bp, Rattus norvegicus
tcttcttacctaccttgctgttttt

SEQ ID NO: 599891 - DNA, 25 bp, Rattus norvegicus
tcttcttacctagcttgctgttttt

SEQ ID NO: 599892 - DNA, 25 bp, Rattus norvegicus
tcttcttagtctacctgaccctcaa

SEQ ID NO: 599893 - DNA, 25 bp, Rattus norvegicus
tcttcttagtcttcctgaccctcaa

SEQ ID NO: 599894 - DNA, 25 bp, Rattus norvegicus
tcttcttatcaccttaattcctcat

SEQ ID NO: 599895 - DNA, 25 bp, Rattus norvegicus
tcttcttatcacgttaattcctcat

SEQ ID NO: 599896 - DNA, 25 bp, Rattus norvegicus
tcttcttcaaacaccggctacagtg

SEQ ID NO: 599897 - DNA, 25 bp, Rattus norvegicus
tcttcttcaaactccggctacagtg

SEQ ID NO: 599898 - DNA, 25 bp, Rattus norvegicus
tcttcttcaactacttcctcaacct

SEQ ID NO: 599899 - DNA, 25 bp, Rattus norvegicus
tcttcttcaacttcttcctcaacct

SEQ ID NO: 599900 - DNA, 25 bp, Rattus norvegicus
tcttcttcagggacgtctcacaggg

SEQ ID NO: 599901 - DNA, 25 bp, Rattus norvegicus
tcttcttcagggtcgtctcacaggg

SEQ ID NO: 599902 - DNA, 25 bp, Rattus norvegicus
tcttcttcatcacgtgcttgtcagt

SEQ ID NO: 599903 - DNA, 25 bp, Rattus norvegicus
tcttcttcatcaggtgcttgtcagt

SEQ ID NO: 599904 - DNA, 25 bp, Rattus norvegicus
tcttcttcattgacttcttctctat

SEQ ID NO: 599905 - DNA, 25 bp, Rattus norvegicus
tcttcttcattgtcttcttctctat

SEQ ID NO: 599906 - DNA, 25 bp, Rattus norvegicus
tcttcttccagcaaccgttttgtaa

SEQ ID NO: 599907 - DNA, 25 bp, Rattus norvegicus
tcttcttccagctaccgttttgtaa

SEQ ID NO: 599908 - DNA, 25 bp, Rattus norvegicus
tcttcttccctgactgctaaaggag

SEQ ID NO: 599909 - DNA, 25 bp, Rattus norvegicus
tcttcttccctgtctgctaaaggag

SEQ ID NO: 599910 - DNA, 25 bp, Rattus norvegicus
tcttcttcgcagagattggctttgg

SEQ ID NO: 599911 - DNA, 25 bp, Rattus norvegicus
tcttcttcgcagtgattggctttgg

SEQ ID NO: 599912 - DNA, 25 bp, Rattus norvegicus
tcttcttcgtccaccagaaaggagc

SEQ ID NO: 599913 - DNA, 25 bp, Rattus norvegicus
tcttcttcgtcctccagaaaggagc

SEQ ID NO: 599914 - DNA, 25 bp, Rattus norvegicus
tcttcttctcagataatcaccgact

SEQ ID NO: 599915 - DNA, 25 bp, Rattus norvegicus
tcttcttctcagttaatcaccgact

SEQ ID NO: 599916 - DNA, 25 bp, Rattus norvegicus
tcttcttctgaacggcttggcttaa

SEQ ID NO: 599917 - DNA, 25 bp, Rattus norvegicus
tcttcttctgaagggcttggcttaa

SEQ ID NO: 599918 - DNA, 25 bp, Rattus norvegicus
tcttcttctgtacccctgaagggac

SEQ ID NO: 599919 - DNA, 25 bp, Rattus norvegicus
tcttcttctgtagccctgaagggac

SEQ ID NO: 599920 - DNA, 25 bp, Rattus norvegicus
tcttcttcttgaccctggaggccga

SEQ ID NO: 599921 - DNA, 25 bp, Rattus norvegicus
tcttcttcttgacgatgtacacttt

SEQ ID NO: 599922 - DNA, 25 bp, Rattus norvegicus
tcttcttcttgagcctggaggccga

SEQ ID NO: 599923 - DNA, 25 bp, Rattus norvegicus
tcttcttcttgaggatgtacacttt

SEQ ID NO: 599924 - DNA, 25 bp, Rattus norvegicus
tcttcttctttgcaccttgatcagg

SEQ ID NO: 599925 - DNA, 25 bp, Rattus norvegicus
tcttcttctttggaccttgatcagg

SEQ ID NO: 599926 - DNA, 25 bp, Rattus norvegicus
tcttcttgactgaacgtgaccggtt

SEQ ID NO: 599927 - DNA, 25 bp, Rattus norvegicus
tcttcttgactgtacgtgaccggtt

SEQ ID NO: 599928 - DNA, 25 bp, Rattus norvegicus
tcttcttgagacaggccttgagcat

SEQ ID NO: 599929 - DNA, 25 bp, Rattus norvegicus
tcttcttgagactggccttgagcat

SEQ ID NO: 599930 - DNA, 25 bp, Rattus norvegicus
tcttcttgattgacatggcctgtaa

SEQ ID NO: 599931 - DNA, 25 bp, Rattus norvegicus
tcttcttgattgtcatggcctgtaa

SEQ ID NO: 599932 - DNA, 25 bp, Rattus norvegicus
tcttcttgcatacaaacatccttca

SEQ ID NO: 599933 - DNA, 25 bp, Rattus norvegicus
tcttcttgcatagaaacatccttca

SEQ ID NO: 599934 - DNA, 25 bp, Rattus norvegicus
tcttcttgcatgagaccagcagggc

SEQ ID NO: 599935 - DNA, 25 bp, Rattus norvegicus
tcttcttgcatgagaggacctcggt

SEQ ID NO: 599936 - DNA, 25 bp, Rattus norvegicus
tcttcttgcatgtgaccagcagggc

SEQ ID NO: 599937 - DNA, 25 bp, Rattus norvegicus
tcttcttgcatgtgaggacctcggt

SEQ ID NO: 599938 - DNA, 25 bp, Rattus norvegicus
tcttcttgctccacccagagggata

SEQ ID NO: 599939 - DNA, 25 bp, Rattus norvegicus
tcttcttgctcctcccagagggata

SEQ ID NO: 599940 - DNA, 25 bp, Rattus norvegicus
tcttcttgctttaattctctttcct

SEQ ID NO: 599941 - DNA, 25 bp, Rattus norvegicus
tcttcttgcttttattctctttcct

SEQ ID NO: 599942 - DNA, 25 bp, Rattus norvegicus
tcttcttggattactccctaattaa

SEQ ID NO: 599943 - DNA, 25 bp, Rattus norvegicus
tcttcttggatttctccctaattaa

SEQ ID NO: 599944 - DNA, 25 bp, Rattus norvegicus
tcttcttgtagaagtcttccaaaag

SEQ ID NO: 599945 - DNA, 25 bp, Rattus norvegicus
tcttcttgtagatgtcttccaaaag

SEQ ID NO: 599946 - DNA, 25 bp, Rattus norvegicus
tcttcttgtcctccagtggagcagt

SEQ ID NO: 599947 - DNA, 25 bp, Rattus norvegicus
tcttcttgtcctgcagtggagcagt

SEQ ID NO: 599948 - DNA, 25 bp, Rattus norvegicus
tcttctttaagaattggcctttcag

SEQ ID NO: 599949 - DNA, 25 bp, Rattus norvegicus
tcttctttaagatttggcctttcag

SEQ ID NO: 599950 - DNA, 25 bp, Rattus norvegicus
tcttctttcccacggcagcacttga

SEQ ID NO: 599951 - DNA, 25 bp, Rattus norvegicus
tcttctttcccagggcagcacttga

SEQ ID NO: 599952 - DNA, 25 bp, Rattus norvegicus
tcttctttctcacactttcatgata

SEQ ID NO: 599953 - DNA, 25 bp, Rattus norvegicus
tcttctttctcagactttcatgata

SEQ ID NO: 599954 - DNA, 25 bp, Rattus norvegicus
tcttctttcttcagagggtactgaa

SEQ ID NO: 599955 - DNA, 25 bp, Rattus norvegicus
tcttctttcttctgagggtactgaa

SEQ ID NO: 599956 - DNA, 25 bp, Rattus norvegicus
tcttctttgctactctcacgtgtga

SEQ ID NO: 599957 - DNA, 25 bp, Rattus norvegicus
tcttctttgctagtctcacgtgtga

SEQ ID NO: 599958 - DNA, 25 bp, Rattus norvegicus
tcttctttgctcattgtccatggta

SEQ ID NO: 599959 - DNA, 25 bp, Rattus norvegicus
tcttctttgctctttgtccatggta

SEQ ID NO: 599960 - DNA, 25 bp, Rattus norvegicus
tcttctttggatatcttatgttcac

SEQ ID NO: 599961 - DNA, 25 bp, Rattus norvegicus
tcttctttggatttcttatgttcac

SEQ ID NO: 599962 - DNA, 25 bp, Rattus norvegicus
tcttcttttctacgtgtttcttaca

SEQ ID NO: 599963 - DNA, 25 bp, Rattus norvegicus
tcttcttttctaggtgtttcttaca

SEQ ID NO: 599964 - DNA, 25 bp, Rattus norvegicus
tcttcttttgagaaaacttcgtgtt

SEQ ID NO: 599965 - DNA, 25 bp, Rattus norvegicus
tcttcttttgagtaaacttcgtgtt

SEQ ID NO: 599966 - DNA, 25 bp, Rattus norvegicus
tcttcttttgctactctacacagca

SEQ ID NO: 599967 - DNA, 25 bp, Rattus norvegicus
tcttcttttgctagaactgtttcag

SEQ ID NO: 599968 - DNA, 25 bp, Rattus norvegicus
tcttcttttgcttctctacacagca

SEQ ID NO: 599969 - DNA, 25 bp, Rattus norvegicus
tcttcttttgcttgaactgtttcag

SEQ ID NO: 599970 - DNA, 25 bp, Rattus norvegicus
tcttctttttccaaaactgtgtgcg

SEQ ID NO: 599971 - DNA, 25 bp, Rattus norvegicus
tcttctttttccattctctctgagg

SEQ ID NO: 599972 - DNA, 25 bp, Rattus norvegicus
tcttctttttcctaaactgtgtgcg

SEQ ID NO: 599973 - DNA, 25 bp, Rattus norvegicus
tcttctttttcctttctctctgagg

SEQ ID NO: 599974 - DNA, 25 bp, Rattus norvegicus
tcttgaaaaaccctgacctctctgt

SEQ ID NO: 599975 - DNA, 25 bp, Rattus norvegicus
tcttgaaaaaccgtgacctctctgt

SEQ ID NO: 599976 - DNA, 25 bp, Rattus norvegicus
tcttgaaaaatcaccccaactccta

SEQ ID NO: 599977 - DNA, 25 bp, Rattus norvegicus
tcttgaaaaatctccccaactccta

SEQ ID NO: 599978 - DNA, 25 bp, Rattus norvegicus
tcttgaaaacatctcctgcttggcc

SEQ ID NO: 599979 - DNA, 25 bp, Rattus norvegicus
tcttgaaaacatgtcctgcttggcc

SEQ ID NO: 599980 - DNA, 25 bp, Rattus norvegicus
tcttgaaaaggtcttgcctttgtta

SEQ ID NO: 599981 - DNA, 25 bp, Rattus norvegicus
tcttgaaaaggtgttgcctttgtta

SEQ ID NO: 599982 - DNA, 25 bp, Rattus norvegicus
tcttgaaaatcgagtggctgtgctt

SEQ ID NO: 599983 - DNA, 25 bp, Rattus norvegicus
tcttgaaaatcgtgtggctgtgctt

SEQ ID NO: 599984 - DNA, 25 bp, Rattus norvegicus
tcttgaacacagctttctggtaatt

SEQ ID NO: 599985 - DNA, 25 bp, Rattus norvegicus
tcttgaacacaggtttctggtaatt

SEQ ID NO: 599986 - DNA, 25 bp, Rattus norvegicus
tcttgaacctccctatagtccgaat

SEQ ID NO: 599987 - DNA, 25 bp, Rattus norvegicus
tcttgaacctccgtatagtccgaat

SEQ ID NO: 599988 - DNA, 25 bp, Rattus norvegicus
tcttgaactctgaacatgactgatg

SEQ ID NO: 599989 - DNA, 25 bp, Rattus norvegicus
tcttgaactctgtacatgactgatg

SEQ ID NO: 599990 - DNA, 25 bp, Rattus norvegicus
tcttgaacttgacacctggcctcct

SEQ ID NO: 599991 - DNA, 25 bp, Rattus norvegicus
tcttgaacttgagacctggcctcct

SEQ ID NO: 599992 - DNA, 25 bp, Rattus norvegicus
tcttgaactttaacggtctccttag

SEQ ID NO: 599993 - DNA, 25 bp, Rattus norvegicus
tcttgaactttatcggtctccttag

SEQ ID NO: 599994 - DNA, 25 bp, Rattus norvegicus
tcttgaagccagacaatcgacttgc

SEQ ID NO: 599995 - DNA, 25 bp, Rattus norvegicus
tcttgaagccagtcaatcgacttgc

SEQ ID NO: 599996 - DNA, 25 bp, Rattus norvegicus
tcttgaagccctcgcggtcgtatgt

SEQ ID NO: 599997 - DNA, 25 bp, Rattus norvegicus
tcttgaagccctggcggtcgtatgt

SEQ ID NO: 599998 - DNA, 25 bp, Rattus norvegicus
tcttgaagccttcttgtggatggac

SEQ ID NO: 599999 - DNA, 25 bp, Rattus norvegicus
tcttgaagccttgttgtggatggac

SEQ ID NO: 600000 - DNA, 25 bp, Rattus norvegicus
tcttgaaggagtcccggcgctctga

SEQ ID NO: 600001 - DNA, 25 bp, Rattus norvegicus
tcttgaaggagtgccggcgctctga

SEQ ID NO: 600002 - DNA, 25 bp, Rattus norvegicus
tcttgacagggtctgccagaaccta

SEQ ID NO: 600003 - DNA, 25 bp, Rattus norvegicus
tcttgacagggtgtgccagaaccta

SEQ ID NO: 600004 - DNA, 25 bp, Rattus norvegicus
tcttgacagtggaacagagccggct

SEQ ID NO: 600005 - DNA, 25 bp, Rattus norvegicus
tcttgacagtggtacagagccggct

SEQ ID NO: 600006 - DNA, 25 bp, Rattus norvegicus
tcttgacatgcactggaatccctca

SEQ ID NO: 600007 - DNA, 25 bp, Rattus norvegicus
tcttgacatgcagtggaatccctca

SEQ ID NO: 600008 - DNA, 25 bp, Rattus norvegicus
tcttgaccaaccatctctggtatca

SEQ ID NO: 600009 - DNA, 25 bp, Rattus norvegicus
tcttgaccaaccttctctggtatca

SEQ ID NO: 600010 - DNA, 25 bp, Rattus norvegicus
tcttgaccccacacaagttgtgagc

SEQ ID NO: 600011 - DNA, 25 bp, Rattus norvegicus
tcttgaccccactcaagttgtgagc

SEQ ID NO: 600012 - DNA, 25 bp, Rattus norvegicus
tcttgaccctttagtaccgaaccag

SEQ ID NO: 600013 - DNA, 25 bp, Rattus norvegicus
tcttgacccttttgtaccgaaccag

SEQ ID NO: 600014 - DNA, 25 bp, Rattus norvegicus
tcttgacctcggaccctcatagaga

SEQ ID NO: 600015 - DNA, 25 bp, Rattus norvegicus
tcttgacctcggtccctcatagaga

SEQ ID NO: 600016 - DNA, 25 bp, Rattus norvegicus
tcttgacctctgatatgcaaccgct

SEQ ID NO: 600017 - DNA, 25 bp, Rattus norvegicus
tcttgacctctgttatgcaaccgct

SEQ ID NO: 600018 - DNA, 25 bp, Rattus norvegicus
tcttgacctcttatcctttctaatt

SEQ ID NO: 600019 - DNA, 25 bp, Rattus norvegicus
tcttgacctcttttcctttctaatt

SEQ ID NO: 600020 - DNA, 25 bp, Rattus norvegicus
tcttgacctgggattctcttggttg

SEQ ID NO: 600021 - DNA, 25 bp, Rattus norvegicus
tcttgacctgggtttctcttggttg

SEQ ID NO: 600022 - DNA, 25 bp, Rattus norvegicus
tcttgacggttcagccatgaggcac

SEQ ID NO: 600023 - DNA, 25 bp, Rattus norvegicus
tcttgacggttctgccatgaggcac

SEQ ID NO: 600024 - DNA, 25 bp, Rattus norvegicus
tcttgactcctccttttaggatgtc

SEQ ID NO: 600025 - DNA, 25 bp, Rattus norvegicus
tcttgactcctcgttttaggatgtc

SEQ ID NO: 600026 - DNA, 25 bp, Rattus norvegicus
tcttgactgctcatgaccagctgct

SEQ ID NO: 600027 - DNA, 25 bp, Rattus norvegicus
tcttgactgctcttgaccagctgct

SEQ ID NO: 600028 - DNA, 25 bp, Rattus norvegicus
tcttgactgctgattgtacggccca

SEQ ID NO: 600029 - DNA, 25 bp, Rattus norvegicus
tcttgactgctgtttgtacggccca

SEQ ID NO: 600030 - DNA, 25 bp, Rattus norvegicus
tcttgagaaggcactgaccaccatg

SEQ ID NO: 600031 - DNA, 25 bp, Rattus norvegicus
tcttgagaaggctctgaccaccatg

SEQ ID NO: 600032 - DNA, 25 bp, Rattus norvegicus
tcttgagaccgcactaaccatgtgg

SEQ ID NO: 600033 - DNA, 25 bp, Rattus norvegicus
tcttgagaccgctctaaccatgtgg

SEQ ID NO: 600034 - DNA, 25 bp, Rattus norvegicus
tcttgagactgcaggtggcccgcac

SEQ ID NO: 600035 - DNA, 25 bp, Rattus norvegicus
tcttgagactgctggtggcccgcac

SEQ ID NO: 600036 - DNA, 25 bp, Rattus norvegicus
tcttgagactgtccagacgctgggc

SEQ ID NO: 600037 - DNA, 25 bp, Rattus norvegicus
tcttgagactgtgcagacgctgggc

SEQ ID NO: 600038 - DNA, 25 bp, Rattus norvegicus
tcttgagcaggacattggccgccag

SEQ ID NO: 600039 - DNA, 25 bp, Rattus norvegicus
tcttgagcaggagattggccgccag

SEQ ID NO: 600040 - DNA, 25 bp, Rattus norvegicus
tcttgagctctacatcagcctgggc

SEQ ID NO: 600041 - DNA, 25 bp, Rattus norvegicus
tcttgagctctagatcagcctgggc

SEQ ID NO: 600042 - DNA, 25 bp, Rattus norvegicus
tcttgagctggcagataagcttcat

SEQ ID NO: 600043 - DNA, 25 bp, Rattus norvegicus
tcttgagctggctgataagcttcat

SEQ ID NO: 600044 - DNA, 25 bp, Rattus norvegicus
tcttgagctttcattctgggaggga

SEQ ID NO: 600045 - DNA, 25 bp, Rattus norvegicus
tcttgagctttctttctgggaggga

SEQ ID NO: 600046 - DNA, 25 bp, Rattus norvegicus
tcttgaggaccgaccatcgaatctt

SEQ ID NO: 600047 - DNA, 25 bp, Rattus norvegicus
tcttgaggaccgtccatcgaatctt

SEQ ID NO: 600048 - DNA, 25 bp, Rattus norvegicus
tcttgaggactcagtggttcggcgc

SEQ ID NO: 600049 - DNA, 25 bp, Rattus norvegicus
tcttgaggactctgtggttcggcgc

SEQ ID NO: 600050 - DNA, 25 bp, Rattus norvegicus
tcttgaggacttcgtgaccactgac

SEQ ID NO: 600051 - DNA, 25 bp, Rattus norvegicus
tcttgaggacttggtgaccactgac

SEQ ID NO: 600052 - DNA, 25 bp, Rattus norvegicus
tcttgaggagttctgtaggcctcca

SEQ ID NO: 600053 - DNA, 25 bp, Rattus norvegicus
tcttgaggagttgtgtaggcctcca

SEQ ID NO: 600054 - DNA, 25 bp, Rattus norvegicus
tcttgagggcggacagtttcgatta

SEQ ID NO: 600055 - DNA, 25 bp, Rattus norvegicus
tcttgagggcggtcagtttcgatta

SEQ ID NO: 600056 - DNA, 25 bp, Rattus norvegicus
tcttgagggtttctgctctcctggg

SEQ ID NO: 600057 - DNA, 25 bp, Rattus norvegicus
tcttgagggtttgtgctctcctggg

SEQ ID NO: 600058 - DNA, 25 bp, Rattus norvegicus
tcttgagtcaatcctgcatcctgtt

SEQ ID NO: 600059 - DNA, 25 bp, Rattus norvegicus
tcttgagtcaatgctgcatcctgtt

SEQ ID NO: 600060 - DNA, 25 bp, Rattus norvegicus
tcttgagtcctcattggaggacaga

SEQ ID NO: 600061 - DNA, 25 bp, Rattus norvegicus
tcttgagtcctctttggaggacaga

SEQ ID NO: 600062 - DNA, 25 bp, Rattus norvegicus
tcttgagtctcaccagtatatttaa

SEQ ID NO: 600063 - DNA, 25 bp, Rattus norvegicus
tcttgagtctcagcagtatatttaa

SEQ ID NO: 600064 - DNA, 25 bp, Rattus norvegicus
tcttgagtgaggatcagatttcatt

SEQ ID NO: 600065 - DNA, 25 bp, Rattus norvegicus
tcttgagtgaggttcagatttcatt

SEQ ID NO: 600066 - DNA, 25 bp, Rattus norvegicus
tcttgagtttatatcctgggactgt

SEQ ID NO: 600067 - DNA, 25 bp, Rattus norvegicus
tcttgagtttatttcctgggactgt

SEQ ID NO: 600068 - DNA, 25 bp, Rattus norvegicus
tcttgagtttgacatttccacggct

SEQ ID NO: 600069 - DNA, 25 bp, Rattus norvegicus
tcttgagtttgagatttccacggct

SEQ ID NO: 600070 - DNA, 25 bp, Rattus norvegicus
tcttgataacacataacacttgaca

SEQ ID NO: 600071 - DNA, 25 bp, Rattus norvegicus
tcttgataacacttaacacttgaca

SEQ ID NO: 600072 - DNA, 25 bp, Rattus norvegicus
tcttgatattttacccagtctttaa

SEQ ID NO: 600073 - DNA, 25 bp, Rattus norvegicus
tcttgatatttttcccagtctttaa

SEQ ID NO: 600074 - DNA, 25 bp, Rattus norvegicus
tcttgatcaaagaacgtagtcgggt

SEQ ID NO: 600075 - DNA, 25 bp, Rattus norvegicus
tcttgatcaaagtacgtagtcgggt

SEQ ID NO: 600076 - DNA, 25 bp, Rattus norvegicus
tcttgatcagggagtctccttgtgc

SEQ ID NO: 600077 - DNA, 25 bp, Rattus norvegicus
tcttgatcagggtgtctccttgtgc

SEQ ID NO: 600078 - DNA, 25 bp, Rattus norvegicus
tcttgatcctgcctttcaatctgcc

SEQ ID NO: 600079 - DNA, 25 bp, Rattus norvegicus
tcttgatcctgcgtttcaatctgcc

SEQ ID NO: 600080 - DNA, 25 bp, Rattus norvegicus
tcttgatcctttccccatgaaatct

SEQ ID NO: 600081 - DNA, 25 bp, Rattus norvegicus
tcttgatcctttgcccatgaaatct

SEQ ID NO: 600082 - DNA, 25 bp, Rattus norvegicus
tcttgatctggaagccgactgcaaa

SEQ ID NO: 600083 - DNA, 25 bp, Rattus norvegicus
tcttgatctggatgccgactgcaaa

SEQ ID NO: 600084 - DNA, 25 bp, Rattus norvegicus
tcttgatgcaacagcttgttgcagt

SEQ ID NO: 600085 - DNA, 25 bp, Rattus norvegicus
tcttgatgcaactgcttgttgcagt

SEQ ID NO: 600086 - DNA, 25 bp, Rattus norvegicus
tcttgatggtgtaattcttttctta

SEQ ID NO: 600087 - DNA, 25 bp, Rattus norvegicus
tcttgatggtgttattcttttctta

SEQ ID NO: 600088 - DNA, 25 bp, Rattus norvegicus
tcttgattatctcttttgcctaccg

SEQ ID NO: 600089 - DNA, 25 bp, Rattus norvegicus
tcttgattatctgttttgcctaccg

SEQ ID NO: 600090 - DNA, 25 bp, Rattus norvegicus
tcttgattgattaaacaacgcccga

SEQ ID NO: 600091 - DNA, 25 bp, Rattus norvegicus
tcttgattgatttaacaacgcccga

SEQ ID NO: 600092 - DNA, 25 bp, Rattus norvegicus
tcttgattgcagattggcccagaat

SEQ ID NO: 600093 - DNA, 25 bp, Rattus norvegicus
tcttgattgcagtttggcccagaat

SEQ ID NO: 600094 - DNA, 25 bp, Rattus norvegicus
tcttgattgtacctgctctttgaaa

SEQ ID NO: 600095 - DNA, 25 bp, Rattus norvegicus
tcttgattgtacgtgctctttgaaa

SEQ ID NO: 600096 - DNA, 25 bp, Rattus norvegicus
tcttgatttaagagacgggccctat

SEQ ID NO: 600097 - DNA, 25 bp, Rattus norvegicus
tcttgatttaagtgacgggccctat

SEQ ID NO: 600098 - DNA, 25 bp, Rattus norvegicus
tcttgatttggacgtttgccagctt

SEQ ID NO: 600099 - DNA, 25 bp, Rattus norvegicus
tcttgatttggaggtttgccagctt

SEQ ID NO: 600100 - DNA, 25 bp, Rattus norvegicus
tcttgcaaagtgaccccatttataa

SEQ ID NO: 600101 - DNA, 25 bp, Rattus norvegicus
tcttgcaaagtgcactcaggacctt

SEQ ID NO: 600102 - DNA, 25 bp, Rattus norvegicus
tcttgcaaagtggactcaggacctt

SEQ ID NO: 600103 - DNA, 25 bp, Rattus norvegicus
tcttgcaaagtgtccccatttataa

SEQ ID NO: 600104 - DNA, 25 bp, Rattus norvegicus
tcttgcaaccaactctgatgacctg

SEQ ID NO: 600105 - DNA, 25 bp, Rattus norvegicus
tcttgcaaccaagtctgatgacctg

SEQ ID NO: 600106 - DNA, 25 bp, Rattus norvegicus
tcttgcaagtgcaacccatgtgagt

SEQ ID NO: 600107 - DNA, 25 bp, Rattus norvegicus
tcttgcaagtgctacccatgtgagt

SEQ ID NO: 600108 - DNA, 25 bp, Rattus norvegicus
tcttgcacagagaggctgctgctga

SEQ ID NO: 600109 - DNA, 25 bp, Rattus norvegicus
tcttgcacagagtggctgctgctga

SEQ ID NO: 600110 - DNA, 25 bp, Rattus norvegicus
tcttgcaccatcaaccacatgatat

SEQ ID NO: 600111 - DNA, 25 bp, Rattus norvegicus
tcttgcaccatctaccacatgatat

SEQ ID NO: 600112 - DNA, 25 bp, Rattus norvegicus
tcttgcactcatacaggatcttgga

SEQ ID NO: 600113 - DNA, 25 bp, Rattus norvegicus
tcttgcactcattcaggatcttgga

SEQ ID NO: 600114 - DNA, 25 bp, Rattus norvegicus
tcttgcacttccagggtcttgaatg

SEQ ID NO: 600115 - DNA, 25 bp, Rattus norvegicus
tcttgcacttcctgggtcttgaatg

SEQ ID NO: 600116 - DNA, 25 bp, Rattus norvegicus
tcttgcacttgcaggtggcagttag

SEQ ID NO: 600117 - DNA, 25 bp, Rattus norvegicus
tcttgcacttgctggtggcagttag

SEQ ID NO: 600118 - DNA, 25 bp, Rattus norvegicus
tcttgcagactgcacattcggctag

SEQ ID NO: 600119 - DNA, 25 bp, Rattus norvegicus
tcttgcagactggacattcggctag

SEQ ID NO: 600120 - DNA, 25 bp, Rattus norvegicus
tcttgcagagccatccaaaagcgtt

SEQ ID NO: 600121 - DNA, 25 bp, Rattus norvegicus
tcttgcagagccttccaaaagcgtt

SEQ ID NO: 600122 - DNA, 25 bp, Rattus norvegicus
tcttgcagcaccacacggtagataa

SEQ ID NO: 600123 - DNA, 25 bp, Rattus norvegicus
tcttgcagcacctcacggtagataa

SEQ ID NO: 600124 - DNA, 25 bp, Rattus norvegicus
tcttgcagccgtaccagatgggtgt

SEQ ID NO: 600125 - DNA, 25 bp, Rattus norvegicus
tcttgcagccgttccagatgggtgt

SEQ ID NO: 600126 - DNA, 25 bp, Rattus norvegicus
tcttgcatttctattgctttctgct

SEQ ID NO: 600127 - DNA, 25 bp, Rattus norvegicus
tcttgcatttcttttgctttctgct

SEQ ID NO: 600128 - DNA, 25 bp, Rattus norvegicus
tcttgccaagccaatcggatatcat

SEQ ID NO: 600129 - DNA, 25 bp, Rattus norvegicus
tcttgccaagcctatcggatatcat

SEQ ID NO: 600130 - DNA, 25 bp, Rattus norvegicus
tcttgccaagttcaatgagccatgg

SEQ ID NO: 600131 - DNA, 25 bp, Rattus norvegicus
tcttgccaagttgaatgagccatgg

SEQ ID NO: 600132 - DNA, 25 bp, Rattus norvegicus
tcttgccaccttattattcttgttt

SEQ ID NO: 600133 - DNA, 25 bp, Rattus norvegicus
tcttgccacctttttattcttgttt

SEQ ID NO: 600134 - DNA, 25 bp, Rattus norvegicus
tcttgccactcaacagatgctttgt

SEQ ID NO: 600135 - DNA, 25 bp, Rattus norvegicus
tcttgccactcatcagatgctttgt

SEQ ID NO: 600136 - DNA, 25 bp, Rattus norvegicus
tcttgccaggatcactgtgcactaa

SEQ ID NO: 600137 - DNA, 25 bp, Rattus norvegicus
tcttgccaggatgactgtgcactaa

SEQ ID NO: 600138 - DNA, 25 bp, Rattus norvegicus
tcttgccaggtgctccgacttagct

SEQ ID NO: 600139 - DNA, 25 bp, Rattus norvegicus
tcttgccaggtggtccgacttagct

SEQ ID NO: 600140 - DNA, 25 bp, Rattus norvegicus
tcttgccagtgtccagcacagccaa

SEQ ID NO: 600141 - DNA, 25 bp, Rattus norvegicus
tcttgccagtgtgcagcacagccaa

SEQ ID NO: 600142 - DNA, 25 bp, Rattus norvegicus
tcttgcccacgcagaattcgactga

SEQ ID NO: 600143 - DNA, 25 bp, Rattus norvegicus
tcttgcccacgctgaattcgactga

SEQ ID NO: 600144 - DNA, 25 bp, Rattus norvegicus
tcttgcccagctaattctattacct

SEQ ID NO: 600145 - DNA, 25 bp, Rattus norvegicus
tcttgcccagcttattctattacct

SEQ ID NO: 600146 - DNA, 25 bp, Rattus norvegicus
tcttgcccagggaaacatcagtatt

SEQ ID NO: 600147 - DNA, 25 bp, Rattus norvegicus
tcttgcccagggtaacatcagtatt

SEQ ID NO: 600148 - DNA, 25 bp, Rattus norvegicus
tcttgcccatttactgtgatcagct

SEQ ID NO: 600149 - DNA, 25 bp, Rattus norvegicus
tcttgcccattttctgtgatcagct

SEQ ID NO: 600150 - DNA, 25 bp, Rattus norvegicus
tcttgcccgaagaaggtctggttgt

SEQ ID NO: 600151 - DNA, 25 bp, Rattus norvegicus
tcttgcccgaagtaggtctggttgt

SEQ ID NO: 600152 - DNA, 25 bp, Rattus norvegicus
tcttgccctgctcaacatgactaaa

SEQ ID NO: 600153 - DNA, 25 bp, Rattus norvegicus
tcttgccctgctgaacatgactaaa

SEQ ID NO: 600154 - DNA, 25 bp, Rattus norvegicus
tcttgccctggacactaaaactagt

SEQ ID NO: 600155 - DNA, 25 bp, Rattus norvegicus
tcttgccctggagactaaaactagt

SEQ ID NO: 600156 - DNA, 25 bp, Rattus norvegicus
tcttgcccttctacattagtgcata

SEQ ID NO: 600157 - DNA, 25 bp, Rattus norvegicus
tcttgcccttcttcattagtgcata

SEQ ID NO: 600158 - DNA, 25 bp, Rattus norvegicus
tcttgcccttgtcaaaaccatctct

SEQ ID NO: 600159 - DNA, 25 bp, Rattus norvegicus
tcttgcccttgtgaaaaccatctct

SEQ ID NO: 600160 - DNA, 25 bp, Rattus norvegicus
tcttgcccttttagccattttcctc

SEQ ID NO: 600161 - DNA, 25 bp, Rattus norvegicus
tcttgccctttttgccattttcctc

SEQ ID NO: 600162 - DNA, 25 bp, Rattus norvegicus
tcttgccgcagccagggcagaagta

SEQ ID NO: 600163 - DNA, 25 bp, Rattus norvegicus
tcttgccgcagcgagggcagaagta

SEQ ID NO: 600164 - DNA, 25 bp, Rattus norvegicus
tcttgcctaattacctagaaacaaa

SEQ ID NO: 600165 - DNA, 25 bp, Rattus norvegicus
tcttgcctaatttcctagaaacaaa

SEQ ID NO: 600166 - DNA, 25 bp, Rattus norvegicus
tcttgcctgaagaacatccttttgt

SEQ ID NO: 600167 - DNA, 25 bp, Rattus norvegicus
tcttgcctgaagtacatccttttgt

SEQ ID NO: 600168 - DNA, 25 bp, Rattus norvegicus
tcttgcctgcagatcgaccagatgt

SEQ ID NO: 600169 - DNA, 25 bp, Rattus norvegicus
tcttgcctgcagttcgaccagatgt

SEQ ID NO: 600170 - DNA, 25 bp, Rattus norvegicus
tcttgcctgcccatcaaggttaaag

SEQ ID NO: 600171 - DNA, 25 bp, Rattus norvegicus
tcttgcctgcccttcaaggttaaag

SEQ ID NO: 600172 - DNA, 25 bp, Rattus norvegicus
tcttgccttcatataggttctgtag

SEQ ID NO: 600173 - DNA, 25 bp, Rattus norvegicus
tcttgccttcatttaggttctgtag

SEQ ID NO: 600174 - DNA, 25 bp, Rattus norvegicus
tcttgccttgtaatttaccccttgg

SEQ ID NO: 600175 - DNA, 25 bp, Rattus norvegicus
tcttgccttgtattttaccccttgg

SEQ ID NO: 600176 - DNA, 25 bp, Rattus norvegicus
tcttgcgaaagcattgttctcctgc

SEQ ID NO: 600177 - DNA, 25 bp, Rattus norvegicus
tcttgcgaaagctttgttctcctgc

SEQ ID NO: 600178 - DNA, 25 bp, Rattus norvegicus
tcttgcgatgtgacccatgttgggc

SEQ ID NO: 600179 - DNA, 25 bp, Rattus norvegicus
tcttgcgatgtgtcccatgttgggc

SEQ ID NO: 600180 - DNA, 25 bp, Rattus norvegicus
tcttgcgcaaagacctggtggccag

SEQ ID NO: 600181 - DNA, 25 bp, Rattus norvegicus
tcttgcgcaaagtcctggtggccag

SEQ ID NO: 600182 - DNA, 25 bp, Rattus norvegicus
tcttgcgcttgcaatgaggtcattg

SEQ ID NO: 600183 - DNA, 25 bp, Rattus norvegicus
tcttgcgcttgctatgaggtcattg

SEQ ID NO: 600184 - DNA, 25 bp, Rattus norvegicus
tcttgcggacacatgctactgtaat

SEQ ID NO: 600185 - DNA, 25 bp, Rattus norvegicus
tcttgcggacacttgctactgtaat

SEQ ID NO: 600186 - DNA, 25 bp, Rattus norvegicus
tcttgcggcaggaggtgaacatcac

SEQ ID NO: 600187 - DNA, 25 bp, Rattus norvegicus
tcttgcggcaggtggtgaacatcac

SEQ ID NO: 600188 - DNA, 25 bp, Rattus norvegicus
tcttgcggtgttaccagagattgga

SEQ ID NO: 600189 - DNA, 25 bp, Rattus norvegicus
tcttgcggtgtttccagagattgga

SEQ ID NO: 600190 - DNA, 25 bp, Rattus norvegicus
tcttgcgtcctaagtgcacactaac

SEQ ID NO: 600191 - DNA, 25 bp, Rattus norvegicus
tcttgcgtcctatgtgcacactaac

SEQ ID NO: 600192 - DNA, 25 bp, Rattus norvegicus
tcttgcgttagactatcatttgaag

SEQ ID NO: 600193 - DNA, 25 bp, Rattus norvegicus
tcttgcgttagagtatcatttgaag

SEQ ID NO: 600194 - DNA, 25 bp, Rattus norvegicus
tcttgcgttttcagccatcggtaat

SEQ ID NO: 600195 - DNA, 25 bp, Rattus norvegicus
tcttgcgttttctgccatcggtaat

SEQ ID NO: 600196 - DNA, 25 bp, Rattus norvegicus
tcttgctacacactatgtaccctca

SEQ ID NO: 600197 - DNA, 25 bp, Rattus norvegicus
tcttgctacacagtatgtaccctca

SEQ ID NO: 600198 - DNA, 25 bp, Rattus norvegicus
tcttgctacaccaagtacccaaagt

SEQ ID NO: 600199 - DNA, 25 bp, Rattus norvegicus
tcttgctacacctagtacccaaagt

SEQ ID NO: 600200 - DNA, 25 bp, Rattus norvegicus
tcttgctactgaaggagtggcctgc

SEQ ID NO: 600201 - DNA, 25 bp, Rattus norvegicus
tcttgctactgatggagtggcctgc

SEQ ID NO: 600202 - DNA, 25 bp, Rattus norvegicus
tcttgctatcagagaccagggagct

SEQ ID NO: 600203 - DNA, 25 bp, Rattus norvegicus
tcttgctatcagtgaccagggagct

SEQ ID NO: 600204 - DNA, 25 bp, Rattus norvegicus
tcttgctatcctctatgaccggaga

SEQ ID NO: 600205 - DNA, 25 bp, Rattus norvegicus
tcttgctatcctgtatgaccggaga

SEQ ID NO: 600206 - DNA, 25 bp, Rattus norvegicus
tcttgctcagatcgctcaggatcgt

SEQ ID NO: 600207 - DNA, 25 bp, Rattus norvegicus
tcttgctcagatggctcaggatcgt

SEQ ID NO: 600208 - DNA, 25 bp, Rattus norvegicus
tcttgctcccagctacataaatcct

SEQ ID NO: 600209 - DNA, 25 bp, Rattus norvegicus
tcttgctcccaggtacataaatcct

SEQ ID NO: 600210 - DNA, 25 bp, Rattus norvegicus
tcttgctcctgtaccaggcatgcgg

SEQ ID NO: 600211 - DNA, 25 bp, Rattus norvegicus
tcttgctcctgttccaggcatgcgg

SEQ ID NO: 600212 - DNA, 25 bp, Rattus norvegicus
tcttgctcggagacactaatttggt

SEQ ID NO: 600213 - DNA, 25 bp, Rattus norvegicus
tcttgctcggagtcactaatttggt

SEQ ID NO: 600214 - DNA, 25 bp, Rattus norvegicus
tcttgctcggtaagctgggaacaca

SEQ ID NO: 600215 - DNA, 25 bp, Rattus norvegicus
tcttgctcggtatgctgggaacaca

SEQ ID NO: 600216 - DNA, 25 bp, Rattus norvegicus
tcttgctctcacatagcttgggaaa

SEQ ID NO: 600217 - DNA, 25 bp, Rattus norvegicus
tcttgctctcacttagcttgggaaa

SEQ ID NO: 600218 - DNA, 25 bp, Rattus norvegicus
tcttgctctcccatgcaagtccatt

SEQ ID NO: 600219 - DNA, 25 bp, Rattus norvegicus
tcttgctctcccttgcaagtccatt

SEQ ID NO: 600220 - DNA, 25 bp, Rattus norvegicus
tcttgctgaagacttggtttggttc

SEQ ID NO: 600221 - DNA, 25 bp, Rattus norvegicus
tcttgctgaagagttggtttggttc

SEQ ID NO: 600222 - DNA, 25 bp, Rattus norvegicus
tcttgctgaagcaggcgttgcctgc

SEQ ID NO: 600223 - DNA, 25 bp, Rattus norvegicus
tcttgctgaagctggcgttgcctgc

SEQ ID NO: 600224 - DNA, 25 bp, Rattus norvegicus
tcttgctgagcaatctttaaataaa

SEQ ID NO: 600225 - DNA, 25 bp, Rattus norvegicus
tcttgctgagcattctttaaataaa

SEQ ID NO: 600226 - DNA, 25 bp, Rattus norvegicus
tcttgctgagtcacttccagaaaga

SEQ ID NO: 600227 - DNA, 25 bp, Rattus norvegicus
tcttgctgagtctcttccagaaaga

SEQ ID NO: 600228 - DNA, 25 bp, Rattus norvegicus
tcttgctgccttattcttttgtatt

SEQ ID NO: 600229 - DNA, 25 bp, Rattus norvegicus
tcttgctgcctttttcttttgtatt

SEQ ID NO: 600230 - DNA, 25 bp, Rattus norvegicus
tcttgctgcgacaggtgtgggttta

SEQ ID NO: 600231 - DNA, 25 bp, Rattus norvegicus
tcttgctgcgactggtgtgggttta

SEQ ID NO: 600232 - DNA, 25 bp, Rattus norvegicus
tcttgctgcgcacttggccgtctgt

SEQ ID NO: 600233 - DNA, 25 bp, Rattus norvegicus
tcttgctgcgcagttggccgtctgt

SEQ ID NO: 600234 - DNA, 25 bp, Rattus norvegicus
tcttgctggcttagacttctgtaaa

SEQ ID NO: 600235 - DNA, 25 bp, Rattus norvegicus
tcttgctggctttgacttctgtaaa

SEQ ID NO: 600236 - DNA, 25 bp, Rattus norvegicus
tcttgctggttcatttttactcaag

SEQ ID NO: 600237 - DNA, 25 bp, Rattus norvegicus
tcttgctggttcttttttactcaag

SEQ ID NO: 600238 - DNA, 25 bp, Rattus norvegicus
tcttgctgtgttcacaccctcaaca

SEQ ID NO: 600239 - DNA, 25 bp, Rattus norvegicus
tcttgctgtgttgacaccctcaaca

SEQ ID NO: 600240 - DNA, 25 bp, Rattus norvegicus
tcttgctgttctcatcatgctgagt

SEQ ID NO: 600241 - DNA, 25 bp, Rattus norvegicus
tcttgctgttctgatcatgctgagt

SEQ ID NO: 600242 - DNA, 25 bp, Rattus norvegicus
tcttgcttagctcttggatcatccc

SEQ ID NO: 600243 - DNA, 25 bp, Rattus norvegicus
tcttgcttagctgttggatcatccc

SEQ ID NO: 600244 - DNA, 25 bp, Rattus norvegicus
tcttgcttcccaatggtggaactat

SEQ ID NO: 600245 - DNA, 25 bp, Rattus norvegicus
tcttgcttcccattggtggaactat

SEQ ID NO: 600246 - DNA, 25 bp, Rattus norvegicus
tcttgcttccccataaaagggtctg

SEQ ID NO: 600247 - DNA, 25 bp, Rattus norvegicus
tcttgcttccccttaaaagggtctg

SEQ ID NO: 600248 - DNA, 25 bp, Rattus norvegicus
tcttgcttctccacagccatagaat

SEQ ID NO: 600249 - DNA, 25 bp, Rattus norvegicus
tcttgcttctccatgaagtcctggc

SEQ ID NO: 600250 - DNA, 25 bp, Rattus norvegicus
tcttgcttctcctcagccatagaat

SEQ ID NO: 600251 - DNA, 25 bp, Rattus norvegicus
tcttgcttctccttgaagtcctggc

SEQ ID NO: 600252 - DNA, 25 bp, Rattus norvegicus
tcttgcttctggaaccacgcctcat

SEQ ID NO: 600253 - DNA, 25 bp, Rattus norvegicus
tcttgcttctggactgtgccacagg

SEQ ID NO: 600254 - DNA, 25 bp, Rattus norvegicus
tcttgcttctggtaccacgcctcat

SEQ ID NO: 600255 - DNA, 25 bp, Rattus norvegicus
tcttgcttctggtctgtgccacagg

SEQ ID NO: 600256 - DNA, 25 bp, Rattus norvegicus
tcttgcttgcgtattggtctgtaaa

SEQ ID NO: 600257 - DNA, 25 bp, Rattus norvegicus
tcttgcttgcgttttggtctgtaaa

SEQ ID NO: 600258 - DNA, 25 bp, Rattus norvegicus
tcttgcttgcttccttctaatggta

SEQ ID NO: 600259 - DNA, 25 bp, Rattus norvegicus
tcttgcttgcttgcttctaatggta

SEQ ID NO: 600260 - DNA, 25 bp, Rattus norvegicus
tcttgcttgtttatctttggacaaa

SEQ ID NO: 600261 - DNA, 25 bp, Rattus norvegicus
tcttgcttgtttttctttggacaaa

SEQ ID NO: 600262 - DNA, 25 bp, Rattus norvegicus
tcttgctttcagctcgtgtaaatat

SEQ ID NO: 600263 - DNA, 25 bp, Rattus norvegicus
tcttgctttcaggtcgtgtaaatat

SEQ ID NO: 600264 - DNA, 25 bp, Rattus norvegicus
tcttgctttgtccatgggcaccaga

SEQ ID NO: 600265 - DNA, 25 bp, Rattus norvegicus
tcttgctttgtcgatgggcaccaga

SEQ ID NO: 600266 - DNA, 25 bp, Rattus norvegicus
tcttggaactttctttcttgtagaa

SEQ ID NO: 600267 - DNA, 25 bp, Rattus norvegicus
tcttggaactttgtttcttgtagaa

SEQ ID NO: 600268 - DNA, 25 bp, Rattus norvegicus
tcttggaagccaactgagtccgtgg

SEQ ID NO: 600269 - DNA, 25 bp, Rattus norvegicus
tcttggaagccatctgagtccgtgg

SEQ ID NO: 600270 - DNA, 25 bp, Rattus norvegicus
tcttggaagggtcgctaaggcctta

SEQ ID NO: 600271 - DNA, 25 bp, Rattus norvegicus
tcttggaagggtggctaaggcctta

SEQ ID NO: 600272 - DNA, 25 bp, Rattus norvegicus
tcttggaatgacacactgctgcgtt

SEQ ID NO: 600273 - DNA, 25 bp, Rattus norvegicus
tcttggaatgactcactgctgcgtt

SEQ ID NO: 600274 - DNA, 25 bp, Rattus norvegicus
tcttggacccaacccggactgaaaa

SEQ ID NO: 600275 - DNA, 25 bp, Rattus norvegicus
tcttggacccaagccggactgaaaa

SEQ ID NO: 600276 - DNA, 25 bp, Rattus norvegicus
tcttggacttccaatggcacaacat

SEQ ID NO: 600277 - DNA, 25 bp, Rattus norvegicus
tcttggacttcctatggcacaacat

SEQ ID NO: 600278 - DNA, 25 bp, Rattus norvegicus
tcttggagaccaattgccttgggca

SEQ ID NO: 600279 - DNA, 25 bp, Rattus norvegicus
tcttggagaccatttgccttgggca

SEQ ID NO: 600280 - DNA, 25 bp, Rattus norvegicus
tcttggagaggacccgcacttcagg

SEQ ID NO: 600281 - DNA, 25 bp, Rattus norvegicus
tcttggagaggagccgcacttcagg

SEQ ID NO: 600282 - DNA, 25 bp, Rattus norvegicus
tcttggagcccaccgactctttttt

SEQ ID NO: 600283 - DNA, 25 bp, Rattus norvegicus
tcttggagcccagcgactctttttt

SEQ ID NO: 600284 - DNA, 25 bp, Rattus norvegicus
tcttggagctttcgctgtctttgta

SEQ ID NO: 600285 - DNA, 25 bp, Rattus norvegicus
tcttggagctttggctgtctttgta

SEQ ID NO: 600286 - DNA, 25 bp, Rattus norvegicus
tcttggagtttgctcccagctggca

SEQ ID NO: 600287 - DNA, 25 bp, Rattus norvegicus
tcttggagtttggtcccagctggca

SEQ ID NO: 600288 - DNA, 25 bp, Rattus norvegicus
tcttggatactgacttacaggcccc

SEQ ID NO: 600289 - DNA, 25 bp, Rattus norvegicus
tcttggatactgtcttacaggcccc

SEQ ID NO: 600290 - DNA, 25 bp, Rattus norvegicus
tcttggatctggatgcccttcggaa

SEQ ID NO: 600291 - DNA, 25 bp, Rattus norvegicus
tcttggatctggttgcccttcggaa

SEQ ID NO: 600292 - DNA, 25 bp, Rattus norvegicus
tcttggatgcccactttatctatgt

SEQ ID NO: 600293 - DNA, 25 bp, Rattus norvegicus
tcttggatgccctctttatctatgt

SEQ ID NO: 600294 - DNA, 25 bp, Rattus norvegicus
tcttggatgtgaacccagctcactg

SEQ ID NO: 600295 - DNA, 25 bp, Rattus norvegicus
tcttggatgtgatcccagctcactg

SEQ ID NO: 600296 - DNA, 25 bp, Rattus norvegicus
tcttggcaatcgagcggcgggaata

SEQ ID NO: 600297 - DNA, 25 bp, Rattus norvegicus
tcttggcaatcgtgcggcgggaata

SEQ ID NO: 600298 - DNA, 25 bp, Rattus norvegicus
tcttggcacctaactcaaagcacaa

SEQ ID NO: 600299 - DNA, 25 bp, Rattus norvegicus
tcttggcacctatctcaaagcacaa

SEQ ID NO: 600300 - DNA, 25 bp, Rattus norvegicus
tcttggcactagcaggacactttct

SEQ ID NO: 600301 - DNA, 25 bp, Rattus norvegicus
tcttggcactaggaggacactttct

SEQ ID NO: 600302 - DNA, 25 bp, Rattus norvegicus
tcttggcattcgctctctgttaaaa

SEQ ID NO: 600303 - DNA, 25 bp, Rattus norvegicus
tcttggcattcggtctctgttaaaa

SEQ ID NO: 600304 - DNA, 25 bp, Rattus norvegicus
tcttggccaaggagcacgagctgga

SEQ ID NO: 600305 - DNA, 25 bp, Rattus norvegicus
tcttggccaaggtgcacgagctgga

SEQ ID NO: 600306 - DNA, 25 bp, Rattus norvegicus
tcttggccagcacccctgagtcaga

SEQ ID NO: 600307 - DNA, 25 bp, Rattus norvegicus
tcttggccagcagccctgagtcaga

SEQ ID NO: 600308 - DNA, 25 bp, Rattus norvegicus
tcttggccagctatgttgggtttta

SEQ ID NO: 600309 - DNA, 25 bp, Rattus norvegicus
tcttggccagctttgttgggtttta

SEQ ID NO: 600310 - DNA, 25 bp, Rattus norvegicus
tcttggccgctaatcgcggcgtgtc

SEQ ID NO: 600311 - DNA, 25 bp, Rattus norvegicus
tcttggccgctattcgcggcgtgtc

SEQ ID NO: 600312 - DNA, 25 bp, Rattus norvegicus
tcttggccgtgaactccaggaaagg

SEQ ID NO: 600313 - DNA, 25 bp, Rattus norvegicus
tcttggccgtgatctccaggaaagg

SEQ ID NO: 600314 - DNA, 25 bp, Rattus norvegicus
tcttggcctcctcgttgatgaagaa

SEQ ID NO: 600315 - DNA, 25 bp, Rattus norvegicus
tcttggcctcctggttgatgaagaa

SEQ ID NO: 600316 - DNA, 25 bp, Rattus norvegicus
tcttggcctgagattgatggaccta

SEQ ID NO: 600317 - DNA, 25 bp, Rattus norvegicus
tcttggcctgagtttgatggaccta

SEQ ID NO: 600318 - DNA, 25 bp, Rattus norvegicus
tcttggcctggtacagcagagaagt

SEQ ID NO: 600319 - DNA, 25 bp, Rattus norvegicus
tcttggcctggttcagcagagaagt

SEQ ID NO: 600320 - DNA, 25 bp, Rattus norvegicus
tcttggccttgtactcagctccagg

SEQ ID NO: 600321 - DNA, 25 bp, Rattus norvegicus
tcttggccttgttctcagctccagg

SEQ ID NO: 600322 - DNA, 25 bp, Rattus norvegicus
tcttggcgcattacttcgagaacat

SEQ ID NO: 600323 - DNA, 25 bp, Rattus norvegicus
tcttggcgcatttcttcgagaacat

SEQ ID NO: 600324 - DNA, 25 bp, Rattus norvegicus
tcttggctatgtaactagggaacct

SEQ ID NO: 600325 - DNA, 25 bp, Rattus norvegicus
tcttggctatgttactagggaacct

SEQ ID NO: 600326 - DNA, 25 bp, Rattus norvegicus
tcttggctcagtccctgaaggtaag

SEQ ID NO: 600327 - DNA, 25 bp, Rattus norvegicus
tcttggctcagtgcctgaaggtaag

SEQ ID NO: 600328 - DNA, 25 bp, Rattus norvegicus
tcttggctccgtccccactatggta

SEQ ID NO: 600329 - DNA, 25 bp, Rattus norvegicus
tcttggctccgtgcccactatggta

SEQ ID NO: 600330 - DNA, 25 bp, Rattus norvegicus
tcttggctcctccagtaccaagtca

SEQ ID NO: 600331 - DNA, 25 bp, Rattus norvegicus
tcttggctcctcgagtaccaagtca

SEQ ID NO: 600332 - DNA, 25 bp, Rattus norvegicus
tcttggctctagaaactacttcctt

SEQ ID NO: 600333 - DNA, 25 bp, Rattus norvegicus
tcttggctctagtaactacttcctt

SEQ ID NO: 600334 - DNA, 25 bp, Rattus norvegicus
tcttggctctgcctcagtacgtgga

SEQ ID NO: 600335 - DNA, 25 bp, Rattus norvegicus
tcttggctctgcgtcagtacgtgga

SEQ ID NO: 600336 - DNA, 25 bp, Rattus norvegicus
tcttggctgctccatccaggaacca

SEQ ID NO: 600337 - DNA, 25 bp, Rattus norvegicus
tcttggctgctcgatccaggaacca

SEQ ID NO: 600338 - DNA, 25 bp, Rattus norvegicus
tcttggctggctatctctggtgttg

SEQ ID NO: 600339 - DNA, 25 bp, Rattus norvegicus
tcttggctggctttctctggtgttg

SEQ ID NO: 600340 - DNA, 25 bp, Rattus norvegicus
tcttggctgtacaatgggcttggta

SEQ ID NO: 600341 - DNA, 25 bp, Rattus norvegicus
tcttggctgtactatgggcttggta

SEQ ID NO: 600342 - DNA, 25 bp, Rattus norvegicus
tcttggctgtagctcttttgtgtta

SEQ ID NO: 600343 - DNA, 25 bp, Rattus norvegicus
tcttggctgtaggtcttttgtgtta

SEQ ID NO: 600344 - DNA, 25 bp, Rattus norvegicus
tcttggcttcctccaggtgacacaa

SEQ ID NO: 600345 - DNA, 25 bp, Rattus norvegicus
tcttggcttcctgcaggtgacacaa

SEQ ID NO: 600346 - DNA, 25 bp, Rattus norvegicus
tcttggcttctgcaaccatcagtgg

SEQ ID NO: 600347 - DNA, 25 bp, Rattus norvegicus
tcttggcttctggaaccatcagtgg

SEQ ID NO: 600348 - DNA, 25 bp, Rattus norvegicus
tcttgggaagttcaatttgagctca

SEQ ID NO: 600349 - DNA, 25 bp, Rattus norvegicus
tcttgggaagttgaatttgagctca

SEQ ID NO: 600350 - DNA, 25 bp, Rattus norvegicus
tcttgggacccacttaccttagagg

SEQ ID NO: 600351 - DNA, 25 bp, Rattus norvegicus
tcttgggacccagttaccttagagg

SEQ ID NO: 600352 - DNA, 25 bp, Rattus norvegicus
tcttgggactccaattcctgacaaa

SEQ ID NO: 600353 - DNA, 25 bp, Rattus norvegicus
tcttgggactcctattcctgacaaa

SEQ ID NO: 600354 - DNA, 25 bp, Rattus norvegicus
tcttgggactgtccctcagggatca

SEQ ID NO: 600355 - DNA, 25 bp, Rattus norvegicus
tcttgggactgtgcctcagggatca

SEQ ID NO: 600356 - DNA, 25 bp, Rattus norvegicus
tcttgggagaagacacttggtttat

SEQ ID NO: 600357 - DNA, 25 bp, Rattus norvegicus
tcttgggagaagtcacttggtttat

SEQ ID NO: 600358 - DNA, 25 bp, Rattus norvegicus
tcttgggagaggacagggattcatc

SEQ ID NO: 600359 - DNA, 25 bp, Rattus norvegicus
tcttgggagaggtcagggattcatc

SEQ ID NO: 600360 - DNA, 25 bp, Rattus norvegicus
tcttgggagcttcatacataagtac

SEQ ID NO: 600361 - DNA, 25 bp, Rattus norvegicus
tcttgggagcttgatacataagtac

SEQ ID NO: 600362 - DNA, 25 bp, Rattus norvegicus
tcttgggaggacaccccagcggcgc

SEQ ID NO: 600363 - DNA, 25 bp, Rattus norvegicus
tcttgggaggacatcacatcctttt

SEQ ID NO: 600364 - DNA, 25 bp, Rattus norvegicus
tcttgggaggactccccagcggcgc

SEQ ID NO: 600365 - DNA, 25 bp, Rattus norvegicus
tcttgggaggacttcacatcctttt

SEQ ID NO: 600366 - DNA, 25 bp, Rattus norvegicus
tcttgggagtttcccgtatgtgacc

SEQ ID NO: 600367 - DNA, 25 bp, Rattus norvegicus
tcttgggagtttgccgtatgtgacc

SEQ ID NO: 600368 - DNA, 25 bp, Rattus norvegicus
tcttgggatcgtccatgtcctagcc

SEQ ID NO: 600369 - DNA, 25 bp, Rattus norvegicus
tcttgggatcgtgcatgtcctagcc

SEQ ID NO: 600370 - DNA, 25 bp, Rattus norvegicus
tcttgggcaagtatgtagttataac

SEQ ID NO: 600371 - DNA, 25 bp, Rattus norvegicus
tcttgggcaagtttgtagttataac

SEQ ID NO: 600372 - DNA, 25 bp, Rattus norvegicus
tcttgggcatccatatcatccttag

SEQ ID NO: 600373 - DNA, 25 bp, Rattus norvegicus
tcttgggcatccttatcatccttag

SEQ ID NO: 600374 - DNA, 25 bp, Rattus norvegicus
tcttgggcattcagaggtaacctct

SEQ ID NO: 600375 - DNA, 25 bp, Rattus norvegicus
tcttgggcattctgaggtaacctct

SEQ ID NO: 600376 - DNA, 25 bp, Rattus norvegicus
tcttgggcccagctgtggttgtaaa

SEQ ID NO: 600377 - DNA, 25 bp, Rattus norvegicus
tcttgggcccaggtgtggttgtaaa

SEQ ID NO: 600378 - DNA, 25 bp, Rattus norvegicus
tcttgggccgaacatgcagcctgaa

SEQ ID NO: 600379 - DNA, 25 bp, Rattus norvegicus
tcttgggccgaagatgcagcctgaa

SEQ ID NO: 600380 - DNA, 25 bp, Rattus norvegicus
tcttgggccttcattctgcagaaga

SEQ ID NO: 600381 - DNA, 25 bp, Rattus norvegicus
tcttgggccttctttctgcagaaga

SEQ ID NO: 600382 - DNA, 25 bp, Rattus norvegicus
tcttgggctcacctgtcataggcaa

SEQ ID NO: 600383 - DNA, 25 bp, Rattus norvegicus
tcttgggctcacgtgtcataggcaa

SEQ ID NO: 600384 - DNA, 25 bp, Rattus norvegicus
tcttgggcttttcggatgtcatcac

SEQ ID NO: 600385 - DNA, 25 bp, Rattus norvegicus
tcttgggcttttgggatgtcatcac

SEQ ID NO: 600386 - DNA, 25 bp, Rattus norvegicus
tcttgggtacctatagattcctgta

SEQ ID NO: 600387 - DNA, 25 bp, Rattus norvegicus
tcttgggtacctttagattcctgta

SEQ ID NO: 600388 - DNA, 25 bp, Rattus norvegicus
tcttgggtcatgaggatgggatcac

SEQ ID NO: 600389 - DNA, 25 bp, Rattus norvegicus
tcttgggtcatgtggatgggatcac

SEQ ID NO: 600390 - DNA, 25 bp, Rattus norvegicus
tcttgggtccttcttacagagaaat

SEQ ID NO: 600391 - DNA, 25 bp, Rattus norvegicus
tcttgggtccttgttacagagaaat

SEQ ID NO: 600392 - DNA, 25 bp, Rattus norvegicus
tcttgggtctggctctcacatggga

SEQ ID NO: 600393 - DNA, 25 bp, Rattus norvegicus
tcttgggtctgggtctcacatggga

SEQ ID NO: 600394 - DNA, 25 bp, Rattus norvegicus
tcttgggtgctgctcagttactact

SEQ ID NO: 600395 - DNA, 25 bp, Rattus norvegicus
tcttgggtgctggtcagttactact

SEQ ID NO: 600396 - DNA, 25 bp, Rattus norvegicus
tcttgggttctcagagttctcacat

SEQ ID NO: 600397 - DNA, 25 bp, Rattus norvegicus
tcttgggttctctgagttctcacat

SEQ ID NO: 600398 - DNA, 25 bp, Rattus norvegicus
tcttgggttgggatatcctgagaga

SEQ ID NO: 600399 - DNA, 25 bp, Rattus norvegicus
tcttgggttgggttatcctgagaga

SEQ ID NO: 600400 - DNA, 25 bp, Rattus norvegicus
tcttggtaccaacgtgtgtcttctt

SEQ ID NO: 600401 - DNA, 25 bp, Rattus norvegicus
tcttggtaccaaggtgtgtcttctt

SEQ ID NO: 600402 - DNA, 25 bp, Rattus norvegicus
tcttggtaccacaagctcatatttc

SEQ ID NO: 600403 - DNA, 25 bp, Rattus norvegicus
tcttggtaccactagctcatatttc

SEQ ID NO: 600404 - DNA, 25 bp, Rattus norvegicus
tcttggtatcaactcttttggcgaa

SEQ ID NO: 600405 - DNA, 25 bp, Rattus norvegicus
tcttggtatcaagtcttttggcgaa

SEQ ID NO: 600406 - DNA, 25 bp, Rattus norvegicus
tcttggtccattactgaacaggccg

SEQ ID NO: 600407 - DNA, 25 bp, Rattus norvegicus
tcttggtccatttctgaacaggccg

SEQ ID NO: 600408 - DNA, 25 bp, Rattus norvegicus
tcttggtccttgagcactgtgttac

SEQ ID NO: 600409 - DNA, 25 bp, Rattus norvegicus
tcttggtccttgtgcactgtgttac

SEQ ID NO: 600410 - DNA, 25 bp, Rattus norvegicus
tcttggtcgccaaggtcatcacagg

SEQ ID NO: 600411 - DNA, 25 bp, Rattus norvegicus
tcttggtcgccatggtcatcacagg

SEQ ID NO: 600412 - DNA, 25 bp, Rattus norvegicus
tcttggtctcttctctttactgtat

SEQ ID NO: 600413 - DNA, 25 bp, Rattus norvegicus
tcttggtctcttgtctttactgtat

SEQ ID NO: 600414 - DNA, 25 bp, Rattus norvegicus
tcttggtgattcctgagcttgcaca

SEQ ID NO: 600415 - DNA, 25 bp, Rattus norvegicus
tcttggtgattcgtgagcttgcaca

SEQ ID NO: 600416 - DNA, 25 bp, Rattus norvegicus
tcttggtgccttccagagagactca

SEQ ID NO: 600417 - DNA, 25 bp, Rattus norvegicus
tcttggtgccttctgtaggtagtca

SEQ ID NO: 600418 - DNA, 25 bp, Rattus norvegicus
tcttggtgccttgcagagagactca

SEQ ID NO: 600419 - DNA, 25 bp, Rattus norvegicus
tcttggtgccttgtgtaggtagtca

SEQ ID NO: 600420 - DNA, 25 bp, Rattus norvegicus
tcttggtgctctatgtttccttata

SEQ ID NO: 600421 - DNA, 25 bp, Rattus norvegicus
tcttggtgctctttgtttccttata

SEQ ID NO: 600422 - DNA, 25 bp, Rattus norvegicus
tcttggtgtattacttatgcaaaca

SEQ ID NO: 600423 - DNA, 25 bp, Rattus norvegicus
tcttggtgtatttcttatgcaaaca

SEQ ID NO: 600424 - DNA, 25 bp, Rattus norvegicus
tcttggtgtctactgcatatgcagc

SEQ ID NO: 600425 - DNA, 25 bp, Rattus norvegicus
tcttggtgtctagtgcatatgcagc

SEQ ID NO: 600426 - DNA, 25 bp, Rattus norvegicus
tcttggttgctaagagaactatctc

SEQ ID NO: 600427 - DNA, 25 bp, Rattus norvegicus
tcttggttgctatgagaactatctc

SEQ ID NO: 600428 - DNA, 25 bp, Rattus norvegicus
tcttggttgtttatcggctagtagc

SEQ ID NO: 600429 - DNA, 25 bp, Rattus norvegicus
tcttggttgtttttcggctagtagc

SEQ ID NO: 600430 - DNA, 25 bp, Rattus norvegicus
tcttggtttgatccagatctggcct

SEQ ID NO: 600431 - DNA, 25 bp, Rattus norvegicus
tcttggtttgatgcagatctggcct

SEQ ID NO: 600432 - DNA, 25 bp, Rattus norvegicus
tcttgtaacaaacccatcccagaga

SEQ ID NO: 600433 - DNA, 25 bp, Rattus norvegicus
tcttgtaacaaagccatcccagaga

SEQ ID NO: 600434 - DNA, 25 bp, Rattus norvegicus
tcttgtaatgcactccctatggttt

SEQ ID NO: 600435 - DNA, 25 bp, Rattus norvegicus
tcttgtaatgcagtccctatggttt

SEQ ID NO: 600436 - DNA, 25 bp, Rattus norvegicus
tcttgtaatgtcactgctcttctca

SEQ ID NO: 600437 - DNA, 25 bp, Rattus norvegicus
tcttgtaatgtctctgctcttctca

SEQ ID NO: 600438 - DNA, 25 bp, Rattus norvegicus
tcttgtacccagaagttgagaggat

SEQ ID NO: 600439 - DNA, 25 bp, Rattus norvegicus
tcttgtacccagtagttgagaggat

SEQ ID NO: 600440 - DNA, 25 bp, Rattus norvegicus
tcttgtacgtttagttctgctgctc

SEQ ID NO: 600441 - DNA, 25 bp, Rattus norvegicus
tcttgtacgttttgttctgctgctc

SEQ ID NO: 600442 - DNA, 25 bp, Rattus norvegicus
tcttgtactcagctatatttgggaa

SEQ ID NO: 600443 - DNA, 25 bp, Rattus norvegicus
tcttgtactcaggtatatttgggaa

SEQ ID NO: 600444 - DNA, 25 bp, Rattus norvegicus
tcttgtagactgactggcgcggcct

SEQ ID NO: 600445 - DNA, 25 bp, Rattus norvegicus
tcttgtagactgtctggcgcggcct

SEQ ID NO: 600446 - DNA, 25 bp, Rattus norvegicus
tcttgtagctctactcctcaactct

SEQ ID NO: 600447 - DNA, 25 bp, Rattus norvegicus
tcttgtagctcttctcctcaactct

SEQ ID NO: 600448 - DNA, 25 bp, Rattus norvegicus
tcttgtagggagattctatcgcaac

SEQ ID NO: 600449 - DNA, 25 bp, Rattus norvegicus
tcttgtagggagtttctatcgcaac

SEQ ID NO: 600450 - DNA, 25 bp, Rattus norvegicus
tcttgtataggaattggccagcatc

SEQ ID NO: 600451 - DNA, 25 bp, Rattus norvegicus
tcttgtataggatttggccagcatc

SEQ ID NO: 600452 - DNA, 25 bp, Rattus norvegicus
tcttgtatatttcttcttttgcttg

SEQ ID NO: 600453 - DNA, 25 bp, Rattus norvegicus
tcttgtatatttgttcttttgcttg

SEQ ID NO: 600454 - DNA, 25 bp, Rattus norvegicus
tcttgtatcgagaccatgaggtcta

SEQ ID NO: 600455 - DNA, 25 bp, Rattus norvegicus
tcttgtatcgagtccatgaggtcta

SEQ ID NO: 600456 - DNA, 25 bp, Rattus norvegicus
tcttgtatctttcgttgcttctgac

SEQ ID NO: 600457 - DNA, 25 bp, Rattus norvegicus
tcttgtatctttggttgcttctgac

SEQ ID NO: 600458 - DNA, 25 bp, Rattus norvegicus
tcttgtcacaaaatgctccacctta

SEQ ID NO: 600459 - DNA, 25 bp, Rattus norvegicus
tcttgtcacaaattgctccacctta

SEQ ID NO: 600460 - DNA, 25 bp, Rattus norvegicus
tcttgtcaccaaagtagccaggctt

SEQ ID NO: 600461 - DNA, 25 bp, Rattus norvegicus
tcttgtcaccaatgtagccaggctt

SEQ ID NO: 600462 - DNA, 25 bp, Rattus norvegicus
tcttgtcactcacaggtctctcgtc

SEQ ID NO: 600463 - DNA, 25 bp, Rattus norvegicus
tcttgtcactcagaggtctctcgtc

SEQ ID NO: 600464 - DNA, 25 bp, Rattus norvegicus
tcttgtcactgtatcttaccgtgta

SEQ ID NO: 600465 - DNA, 25 bp, Rattus norvegicus
tcttgtcactgtttcttaccgtgta

SEQ ID NO: 600466 - DNA, 25 bp, Rattus norvegicus
tcttgtcagggtcactctgtttaca

SEQ ID NO: 600467 - DNA, 25 bp, Rattus norvegicus
tcttgtcagggtgactctgtttaca

SEQ ID NO: 600468 - DNA, 25 bp, Rattus norvegicus
tcttgtcatcccaggcttactttga

SEQ ID NO: 600469 - DNA, 25 bp, Rattus norvegicus
tcttgtcatccctggcttactttga

SEQ ID NO: 600470 - DNA, 25 bp, Rattus norvegicus
tcttgtcatcctcggttccgttagc

SEQ ID NO: 600471 - DNA, 25 bp, Rattus norvegicus
tcttgtcatcctgggttccgttagc

SEQ ID NO: 600472 - DNA, 25 bp, Rattus norvegicus
tcttgtcattatattcagcctgttt

SEQ ID NO: 600473 - DNA, 25 bp, Rattus norvegicus
tcttgtcattattttcagcctgttt

SEQ ID NO: 600474 - DNA, 25 bp, Rattus norvegicus
tcttgtcccagccatgaggtgaaac

SEQ ID NO: 600475 - DNA, 25 bp, Rattus norvegicus
tcttgtcccagcgatgaggtgaaac

SEQ ID NO: 600476 - DNA, 25 bp, Rattus norvegicus
tcttgtccggttccaacaggcccat

SEQ ID NO: 600477 - DNA, 25 bp, Rattus norvegicus
tcttgtccggttgcaacaggcccat

SEQ ID NO: 600478 - DNA, 25 bp, Rattus norvegicus
tcttgtcctgctacctaaataaact

SEQ ID NO: 600479 - DNA, 25 bp, Rattus norvegicus
tcttgtcctgcttcctaaataaact

SEQ ID NO: 600480 - DNA, 25 bp, Rattus norvegicus
tcttgtcctggacacgcaatgcgaa

SEQ ID NO: 600481 - DNA, 25 bp, Rattus norvegicus
tcttgtcctggagacgcaatgcgaa

SEQ ID NO: 600482 - DNA, 25 bp, Rattus norvegicus
tcttgtccttgcacttgttatgtag

SEQ ID NO: 600483 - DNA, 25 bp, Rattus norvegicus
tcttgtccttgctcttgttatgtag

SEQ ID NO: 600484 - DNA, 25 bp, Rattus norvegicus
tcttgtcgccttcacagtgatttta

SEQ ID NO: 600485 - DNA, 25 bp, Rattus norvegicus
tcttgtcgccttgacagtgatttta

SEQ ID NO: 600486 - DNA, 25 bp, Rattus norvegicus
tcttgtcgcttcatagcccgatcct

SEQ ID NO: 600487 - DNA, 25 bp, Rattus norvegicus
tcttgtcgcttcttagcccgatcct

SEQ ID NO: 600488 - DNA, 25 bp, Rattus norvegicus
tcttgtctaaaccttccactgttag

SEQ ID NO: 600489 - DNA, 25 bp, Rattus norvegicus
tcttgtctaaacgttccactgttag

SEQ ID NO: 600490 - DNA, 25 bp, Rattus norvegicus
tcttgtctattgaagacctggctgg

SEQ ID NO: 600491 - DNA, 25 bp, Rattus norvegicus
tcttgtctattgtagacctggctgg

SEQ ID NO: 600492 - DNA, 25 bp, Rattus norvegicus
tcttgtctcagtcgaaagctttcct

SEQ ID NO: 600493 - DNA, 25 bp, Rattus norvegicus
tcttgtctcagtggaaagctttcct

SEQ ID NO: 600494 - DNA, 25 bp, Rattus norvegicus
tcttgtctccggacttcaacagaag

SEQ ID NO: 600495 - DNA, 25 bp, Rattus norvegicus
tcttgtctccggtcttcaacagaag

SEQ ID NO: 600496 - DNA, 25 bp, Rattus norvegicus
tcttgtctcgacatgtgggtaggaa

SEQ ID NO: 600497 - DNA, 25 bp, Rattus norvegicus
tcttgtctcgacttgtgggtaggaa

SEQ ID NO: 600498 - DNA, 25 bp, Rattus norvegicus
tcttgtctctgaacctgggaagtga

SEQ ID NO: 600499 - DNA, 25 bp, Rattus norvegicus
tcttgtctctgatcctgggaagtga

SEQ ID NO: 600500 - DNA, 25 bp, Rattus norvegicus
tcttgtctttatctttgggatccac

SEQ ID NO: 600501 - DNA, 25 bp, Rattus norvegicus
tcttgtctttatgtttgggatccac

SEQ ID NO: 600502 - DNA, 25 bp, Rattus norvegicus
tcttgtctttgaagggttcaggcct

SEQ ID NO: 600503 - DNA, 25 bp, Rattus norvegicus
tcttgtctttgatgggttcaggcct

SEQ ID NO: 600504 - DNA, 25 bp, Rattus norvegicus
tcttgtctttgtcgcctacaggtca

SEQ ID NO: 600505 - DNA, 25 bp, Rattus norvegicus
tcttgtctttgtggcctacaggtca

SEQ ID NO: 600506 - DNA, 25 bp, Rattus norvegicus
tcttgtcttttcagttggctataac

SEQ ID NO: 600507 - DNA, 25 bp, Rattus norvegicus
tcttgtcttttctgttggctataac

SEQ ID NO: 600508 - DNA, 25 bp, Rattus norvegicus
tcttgtgaacaaattctttttcctg

SEQ ID NO: 600509 - DNA, 25 bp, Rattus norvegicus
tcttgtgaacaatttctttttcctg

SEQ ID NO: 600510 - DNA, 25 bp, Rattus norvegicus
tcttgtgacagcctgaagccctggg

SEQ ID NO: 600511 - DNA, 25 bp, Rattus norvegicus
tcttgtgacagcgtgaagccctggg

SEQ ID NO: 600512 - DNA, 25 bp, Rattus norvegicus
tcttgtgaggacatgaccgaccttt

SEQ ID NO: 600513 - DNA, 25 bp, Rattus norvegicus
tcttgtgaggacttgaccgaccttt

SEQ ID NO: 600514 - DNA, 25 bp, Rattus norvegicus
tcttgtgagtccatttgttttccct

SEQ ID NO: 600515 - DNA, 25 bp, Rattus norvegicus
tcttgtgagtccttttgttttccct

SEQ ID NO: 600516 - DNA, 25 bp, Rattus norvegicus
tcttgtgattctaggcattctgctg

SEQ ID NO: 600517 - DNA, 25 bp, Rattus norvegicus
tcttgtgattcttggcattctgctg

SEQ ID NO: 600518 - DNA, 25 bp, Rattus norvegicus
tcttgtgcaagaactcccggacaga

SEQ ID NO: 600519 - DNA, 25 bp, Rattus norvegicus
tcttgtgcaagatctcccggacaga

SEQ ID NO: 600520 - DNA, 25 bp, Rattus norvegicus
tcttgtgcctttccttggaagcttt

SEQ ID NO: 600521 - DNA, 25 bp, Rattus norvegicus
tcttgtgcctttgcttggaagcttt

SEQ ID NO: 600522 - DNA, 25 bp, Rattus norvegicus
tcttgtgctcctccatgacagaaat

SEQ ID NO: 600523 - DNA, 25 bp, Rattus norvegicus
tcttgtgctcctgcatgacagaaat

SEQ ID NO: 600524 - DNA, 25 bp, Rattus norvegicus
tcttgtgctgagctcttggtgtact

SEQ ID NO: 600525 - DNA, 25 bp, Rattus norvegicus
tcttgtgctgaggtcttggtgtact

SEQ ID NO: 600526 - DNA, 25 bp, Rattus norvegicus
tcttgtgcttcaactttgtagacag

SEQ ID NO: 600527 - DNA, 25 bp, Rattus norvegicus
tcttgtgcttcatctttgtagacag

SEQ ID NO: 600528 - DNA, 25 bp, Rattus norvegicus
tcttgtgcttgtacttgggtttgat

SEQ ID NO: 600529 - DNA, 25 bp, Rattus norvegicus
tcttgtgcttgttcttgggtttgat

SEQ ID NO: 600530 - DNA, 25 bp, Rattus norvegicus
tcttgtggacacatggttctggagt

SEQ ID NO: 600531 - DNA, 25 bp, Rattus norvegicus
tcttgtggacacttggttctggagt

SEQ ID NO: 600532 - DNA, 25 bp, Rattus norvegicus
tcttgtggagcgagccctgggctcc

SEQ ID NO: 600533 - DNA, 25 bp, Rattus norvegicus
tcttgtggagcgtgccctgggctcc

SEQ ID NO: 600534 - DNA, 25 bp, Rattus norvegicus
tcttgtggcattctctggacgataa

SEQ ID NO: 600535 - DNA, 25 bp, Rattus norvegicus
tcttgtggcattgtctggacgataa

SEQ ID NO: 600536 - DNA, 25 bp, Rattus norvegicus
tcttgtgggccgagtggtcatcgaa

SEQ ID NO: 600537 - DNA, 25 bp, Rattus norvegicus
tcttgtgggccgtgtggtcatcgaa

SEQ ID NO: 600538 - DNA, 25 bp, Rattus norvegicus
tcttgtgggtctacgaggctgctga

SEQ ID NO: 600539 - DNA, 25 bp, Rattus norvegicus
tcttgtgggtcttcgaggctgctga

SEQ ID NO: 600540 - DNA, 25 bp, Rattus norvegicus
tcttgtggtgccagttaaatgatcc

SEQ ID NO: 600541 - DNA, 25 bp, Rattus norvegicus
tcttgtggtgcctgttaaatgatcc

SEQ ID NO: 600542 - DNA, 25 bp, Rattus norvegicus
tcttgtggtggcacacgggtgcaca

SEQ ID NO: 600543 - DNA, 25 bp, Rattus norvegicus
tcttgtggtggctcacgggtgcaca

SEQ ID NO: 600544 - DNA, 25 bp, Rattus norvegicus
tcttgtggtttgactcttttgataa

SEQ ID NO: 600545 - DNA, 25 bp, Rattus norvegicus
tcttgtggtttgtctcttttgataa

SEQ ID NO: 600546 - DNA, 25 bp, Rattus norvegicus
tcttgtgtaccgataggaccttgct

SEQ ID NO: 600547 - DNA, 25 bp, Rattus norvegicus
tcttgtgtaccgttaggaccttgct

SEQ ID NO: 600548 - DNA, 25 bp, Rattus norvegicus
tcttgtgtattcactcctccctgga

SEQ ID NO: 600549 - DNA, 25 bp, Rattus norvegicus
tcttgtgtattctctcctccctgga

SEQ ID NO: 600550 - DNA, 25 bp, Rattus norvegicus
tcttgtgtcctgaggttgatttcct

SEQ ID NO: 600551 - DNA, 25 bp, Rattus norvegicus
tcttgtgtcctgtggttgatttcct

SEQ ID NO: 600552 - DNA, 25 bp, Rattus norvegicus
tcttgtgtctacatttatcttttta

SEQ ID NO: 600553 - DNA, 25 bp, Rattus norvegicus
tcttgtgtctacttttatcttttta

SEQ ID NO: 600554 - DNA, 25 bp, Rattus norvegicus
tcttgtgtctcccaagtgcggcacc

SEQ ID NO: 600555 - DNA, 25 bp, Rattus norvegicus
tcttgtgtctccgaagtgcggcacc

SEQ ID NO: 600556 - DNA, 25 bp, Rattus norvegicus
tcttgtgtctgtctcatggctgcca

SEQ ID NO: 600557 - DNA, 25 bp, Rattus norvegicus
tcttgtgtctgtgtcatggctgcca

SEQ ID NO: 600558 - DNA, 25 bp, Rattus norvegicus
tcttgtgtgctcatgtctggattca

SEQ ID NO: 600559 - DNA, 25 bp, Rattus norvegicus
tcttgtgtgctcttgtctggattca

SEQ ID NO: 600560 - DNA, 25 bp, Rattus norvegicus
tcttgtgttcaactagaatcagact

SEQ ID NO: 600561 - DNA, 25 bp, Rattus norvegicus
tcttgtgttcaagtagaatcagact

SEQ ID NO: 600562 - DNA, 25 bp, Rattus norvegicus
tcttgtgttgcacagcgctggcctc

SEQ ID NO: 600563 - DNA, 25 bp, Rattus norvegicus
tcttgtgttgcagagcgctggcctc

SEQ ID NO: 600564 - DNA, 25 bp, Rattus norvegicus
tcttgtgttgctaggtgtgtcagcc

SEQ ID NO: 600565 - DNA, 25 bp, Rattus norvegicus
tcttgtgttgcttggtgtgtcagcc

SEQ ID NO: 600566 - DNA, 25 bp, Rattus norvegicus
tcttgtgtttctaatcagctgcttt

SEQ ID NO: 600567 - DNA, 25 bp, Rattus norvegicus
tcttgtgtttcttatcagctgcttt

SEQ ID NO: 600568 - DNA, 25 bp, Rattus norvegicus
tcttgttaagaactcagttaccgtt

SEQ ID NO: 600569 - DNA, 25 bp, Rattus norvegicus
tcttgttaagaagtcagttaccgtt

SEQ ID NO: 600570 - DNA, 25 bp, Rattus norvegicus
tcttgttaggaaacaccaggcttgt

SEQ ID NO: 600571 - DNA, 25 bp, Rattus norvegicus
tcttgttaggaatcaccaggcttgt

SEQ ID NO: 600572 - DNA, 25 bp, Rattus norvegicus
tcttgttaggctagctcttttgggt

SEQ ID NO: 600573 - DNA, 25 bp, Rattus norvegicus
tcttgttaggcttgctcttttgggt

SEQ ID NO: 600574 - DNA, 25 bp, Rattus norvegicus
tcttgttagggtatgggtggtatat

SEQ ID NO: 600575 - DNA, 25 bp, Rattus norvegicus
tcttgttagggtttgggtggtatat

SEQ ID NO: 600576 - DNA, 25 bp, Rattus norvegicus
tcttgttcagaccaccatagatcct

SEQ ID NO: 600577 - DNA, 25 bp, Rattus norvegicus
tcttgttcagacgaccatagatcct

SEQ ID NO: 600578 - DNA, 25 bp, Rattus norvegicus
tcttgttcatgaaggacgcctctaa

SEQ ID NO: 600579 - DNA, 25 bp, Rattus norvegicus
tcttgttcatgatggacgcctctaa

SEQ ID NO: 600580 - DNA, 25 bp, Rattus norvegicus
tcttgttccagcagcatcagcaaaa

SEQ ID NO: 600581 - DNA, 25 bp, Rattus norvegicus
tcttgttccagctgcatcagcaaaa

SEQ ID NO: 600582 - DNA, 25 bp, Rattus norvegicus
tcttgttccctgagagcctgtccct

SEQ ID NO: 600583 - DNA, 25 bp, Rattus norvegicus
tcttgttccctgtgagcctgtccct

SEQ ID NO: 600584 - DNA, 25 bp, Rattus norvegicus
tcttgttccgtgacgtattgtgttt

SEQ ID NO: 600585 - DNA, 25 bp, Rattus norvegicus
tcttgttccgtgactatgggctgaa

SEQ ID NO: 600586 - DNA, 25 bp, Rattus norvegicus
tcttgttccgtgtcgtattgtgttt

SEQ ID NO: 600587 - DNA, 25 bp, Rattus norvegicus
tcttgttccgtgtctatgggctgaa

SEQ ID NO: 600588 - DNA, 25 bp, Rattus norvegicus
tcttgttctgagaatccttgacatt

SEQ ID NO: 600589 - DNA, 25 bp, Rattus norvegicus
tcttgttctgagtatccttgacatt

SEQ ID NO: 600590 - DNA, 25 bp, Rattus norvegicus
tcttgttcttgcattgaggagtcgt

SEQ ID NO: 600591 - DNA, 25 bp, Rattus norvegicus
tcttgttcttgccacagagggataa

SEQ ID NO: 600592 - DNA, 25 bp, Rattus norvegicus
tcttgttcttgcgacagagggataa

SEQ ID NO: 600593 - DNA, 25 bp, Rattus norvegicus
tcttgttcttgctttgaggagtcgt

SEQ ID NO: 600594 - DNA, 25 bp, Rattus norvegicus
tcttgttcttgtcgccacagacaat

SEQ ID NO: 600595 - DNA, 25 bp, Rattus norvegicus
tcttgttcttgtggccacagacaat

SEQ ID NO: 600596 - DNA, 25 bp, Rattus norvegicus
tcttgttctttcacaggaagctcct

SEQ ID NO: 600597 - DNA, 25 bp, Rattus norvegicus
tcttgttctttctcaggaagctcct

SEQ ID NO: 600598 - DNA, 25 bp, Rattus norvegicus
tcttgttgctttatcactggactgt

SEQ ID NO: 600599 - DNA, 25 bp, Rattus norvegicus
tcttgttgctttttcactggactgt

SEQ ID NO: 600600 - DNA, 25 bp, Rattus norvegicus
tcttgttgtttacgcatggagtcac

SEQ ID NO: 600601 - DNA, 25 bp, Rattus norvegicus
tcttgttgtttaggcatggagtcac

SEQ ID NO: 600602 - DNA, 25 bp, Rattus norvegicus
tcttgtttccataggtgaccatcta

SEQ ID NO: 600603 - DNA, 25 bp, Rattus norvegicus
tcttgtttccatcactggtgtctgg

SEQ ID NO: 600604 - DNA, 25 bp, Rattus norvegicus
tcttgtttccatgactggtgtctgg

SEQ ID NO: 600605 - DNA, 25 bp, Rattus norvegicus
tcttgtttccattggtgaccatcta

SEQ ID NO: 600606 - DNA, 25 bp, Rattus norvegicus
tcttgtttcctgacattcgcagagg

SEQ ID NO: 600607 - DNA, 25 bp, Rattus norvegicus
tcttgtttcctgtcattcgcagagg

SEQ ID NO: 600608 - DNA, 25 bp, Rattus norvegicus
tcttgtttcgatatcctttgcttgt

SEQ ID NO: 600609 - DNA, 25 bp, Rattus norvegicus
tcttgtttcgatttcctttgcttgt

SEQ ID NO: 600610 - DNA, 25 bp, Rattus norvegicus
tcttgtttcgttatgcttacaaatg

SEQ ID NO: 600611 - DNA, 25 bp, Rattus norvegicus
tcttgtttcgttttgcttacaaatg

SEQ ID NO: 600612 - DNA, 25 bp, Rattus norvegicus
tcttgtttctgtatgaactttcggt

SEQ ID NO: 600613 - DNA, 25 bp, Rattus norvegicus
tcttgtttctgtccacaggcttttg

SEQ ID NO: 600614 - DNA, 25 bp, Rattus norvegicus
tcttgtttctgtgcacaggcttttg

SEQ ID NO: 600615 - DNA, 25 bp, Rattus norvegicus
tcttgtttctgtttgaactttcggt

SEQ ID NO: 600616 - DNA, 25 bp, Rattus norvegicus
tcttgtttgggtcgactcttagaaa

SEQ ID NO: 600617 - DNA, 25 bp, Rattus norvegicus
tcttgtttgggtggactcttagaaa

SEQ ID NO: 600618 - DNA, 25 bp, Rattus norvegicus
tcttgttttgtaaatgaaggcttca

SEQ ID NO: 600619 - DNA, 25 bp, Rattus norvegicus
tcttgttttgtatatgaaggcttca

SEQ ID NO: 600620 - DNA, 25 bp, Rattus norvegicus
tcttgtttttctaattctcttccct

SEQ ID NO: 600621 - DNA, 25 bp, Rattus norvegicus
tcttgtttttcttattctcttccct

SEQ ID NO: 600622 - DNA, 25 bp, Rattus norvegicus
tctttaaaatcaatccctggttgta

SEQ ID NO: 600623 - DNA, 25 bp, Rattus norvegicus
tctttaaaatcattccctggttgta

SEQ ID NO: 600624 - DNA, 25 bp, Rattus norvegicus
tctttaaagctgatgacccgggcct

SEQ ID NO: 600625 - DNA, 25 bp, Rattus norvegicus
tctttaaagctgttgacccgggcct

SEQ ID NO: 600626 - DNA, 25 bp, Rattus norvegicus
tctttaaagtcccataagcacctcc

SEQ ID NO: 600627 - DNA, 25 bp, Rattus norvegicus
tctttaaagtccgataagcacctcc

SEQ ID NO: 600628 - DNA, 25 bp, Rattus norvegicus
tctttaaataccagtctccagggcc

SEQ ID NO: 600629 - DNA, 25 bp, Rattus norvegicus
tctttaaatacctgtctccagggcc

SEQ ID NO: 600630 - DNA, 25 bp, Rattus norvegicus
tctttaaatgttaactctgttaagc

SEQ ID NO: 600631 - DNA, 25 bp, Rattus norvegicus
tctttaaatgtttactctgttaagc

SEQ ID NO: 600632 - DNA, 25 bp, Rattus norvegicus
tctttaagatccaccacagtgacga

SEQ ID NO: 600633 - DNA, 25 bp, Rattus norvegicus
tctttaagatcctccacagtgacga

SEQ ID NO: 600634 - DNA, 25 bp, Rattus norvegicus
tctttaagcattagatccacagtaa

SEQ ID NO: 600635 - DNA, 25 bp, Rattus norvegicus
tctttaagcatttgatccacagtaa

SEQ ID NO: 600636 - DNA, 25 bp, Rattus norvegicus
tctttaagctacagatgacccataa

SEQ ID NO: 600637 - DNA, 25 bp, Rattus norvegicus
tctttaagctactgatgacccataa

SEQ ID NO: 600638 - DNA, 25 bp, Rattus norvegicus
tctttaagcttaactctgcaaccat

SEQ ID NO: 600639 - DNA, 25 bp, Rattus norvegicus
tctttaagcttatctctgcaaccat

SEQ ID NO: 600640 - DNA, 25 bp, Rattus norvegicus
tctttaatacctacatgtccctgac

SEQ ID NO: 600641 - DNA, 25 bp, Rattus norvegicus
tctttaataccttcatgtccctgac

SEQ ID NO: 600642 - DNA, 25 bp, Rattus norvegicus
tctttaattttgagccactgtggct

SEQ ID NO: 600643 - DNA, 25 bp, Rattus norvegicus
tctttaattttgtgccactgtggct

SEQ ID NO: 600644 - DNA, 25 bp, Rattus norvegicus
tctttacagaaccttgtagtgccaa

SEQ ID NO: 600645 - DNA, 25 bp, Rattus norvegicus
tctttacagaacgttgtagtgccaa

SEQ ID NO: 600646 - DNA, 25 bp, Rattus norvegicus
tctttacagggcaaagccatcctga

SEQ ID NO: 600647 - DNA, 25 bp, Rattus norvegicus
tctttacagggctaagccatcctga

SEQ ID NO: 600648 - DNA, 25 bp, Rattus norvegicus
tctttaccaaagaccaggagcagga

SEQ ID NO: 600649 - DNA, 25 bp, Rattus norvegicus
tctttaccaaagtccaggagcagga

SEQ ID NO: 600650 - DNA, 25 bp, Rattus norvegicus
tctttaccagccctatgtgttttta

SEQ ID NO: 600651 - DNA, 25 bp, Rattus norvegicus
tctttaccagccgtatgtgttttta

SEQ ID NO: 600652 - DNA, 25 bp, Rattus norvegicus
tctttacccactcagttccagtaag

SEQ ID NO: 600653 - DNA, 25 bp, Rattus norvegicus
tctttacccactgagttccagtaag

SEQ ID NO: 600654 - DNA, 25 bp, Rattus norvegicus
tctttacccagtaccgttggatgaa

SEQ ID NO: 600655 - DNA, 25 bp, Rattus norvegicus
tctttacccagttccgttggatgaa

SEQ ID NO: 600656 - DNA, 25 bp, Rattus norvegicus
tctttaccggtgaatgtcgctgtca

SEQ ID NO: 600657 - DNA, 25 bp, Rattus norvegicus
tctttaccggtgtatgtcgctgtca

SEQ ID NO: 600658 - DNA, 25 bp, Rattus norvegicus
tctttactgtccagcagggtaccag

SEQ ID NO: 600659 - DNA, 25 bp, Rattus norvegicus
tctttactgtcctgcagggtaccag

SEQ ID NO: 600660 - DNA, 25 bp, Rattus norvegicus
tctttacttcctcgctgcaatgatg

SEQ ID NO: 600661 - DNA, 25 bp, Rattus norvegicus
tctttacttcctggctgcaatgatg

SEQ ID NO: 600662 - DNA, 25 bp, Rattus norvegicus
tctttagaatcactttgcctcctta

SEQ ID NO: 600663 - DNA, 25 bp, Rattus norvegicus
tctttagaatcagtttgcctcctta

SEQ ID NO: 600664 - DNA, 25 bp, Rattus norvegicus
tctttagatcgcaccgaagaggcaa

SEQ ID NO: 600665 - DNA, 25 bp, Rattus norvegicus
tctttagatcgctccgaagaggcaa

SEQ ID NO: 600666 - DNA, 25 bp, Rattus norvegicus
tctttagatgtcctatccggaggag

SEQ ID NO: 600667 - DNA, 25 bp, Rattus norvegicus
tctttagatgtcgtatccggaggag

SEQ ID NO: 600668 - DNA, 25 bp, Rattus norvegicus
tctttagattccagtgtacctgcac

SEQ ID NO: 600669 - DNA, 25 bp, Rattus norvegicus
tctttagattcctgtgtacctgcac

SEQ ID NO: 600670 - DNA, 25 bp, Rattus norvegicus
tctttagcactgaccactctgaatg

SEQ ID NO: 600671 - DNA, 25 bp, Rattus norvegicus
tctttagcactgagtctgcccatga

SEQ ID NO: 600672 - DNA, 25 bp, Rattus norvegicus
tctttagcactgtccactctgaatg

SEQ ID NO: 600673 - DNA, 25 bp, Rattus norvegicus
tctttagcactgtgtctgcccatga

SEQ ID NO: 600674 - DNA, 25 bp, Rattus norvegicus
tctttagcttctccggattgccaca

SEQ ID NO: 600675 - DNA, 25 bp, Rattus norvegicus
tctttagcttctgcggattgccaca

SEQ ID NO: 600676 - DNA, 25 bp, Rattus norvegicus
tctttagtcccaatccttccaataa

SEQ ID NO: 600677 - DNA, 25 bp, Rattus norvegicus
tctttagtcccattccttccaataa

SEQ ID NO: 600678 - DNA, 25 bp, Rattus norvegicus
tctttagtgtgaacttggtcgccaa

SEQ ID NO: 600679 - DNA, 25 bp, Rattus norvegicus
tctttagtgtgatcttggtcgccaa

SEQ ID NO: 600680 - DNA, 25 bp, Rattus norvegicus
tctttataatatcccgtgtagtaaa

SEQ ID NO: 600681 - DNA, 25 bp, Rattus norvegicus
tctttataatatgccgtgtagtaaa

SEQ ID NO: 600682 - DNA, 25 bp, Rattus norvegicus
tctttatactcacccatccaatcag

SEQ ID NO: 600683 - DNA, 25 bp, Rattus norvegicus
tctttatactcagccatccaatcag

SEQ ID NO: 600684 - DNA, 25 bp, Rattus norvegicus
tctttatatttgaggagggtctccc

SEQ ID NO: 600685 - DNA, 25 bp, Rattus norvegicus
tctttatatttgtggagggtctccc

SEQ ID NO: 600686 - DNA, 25 bp, Rattus norvegicus
tctttatcccgaattcgcgtcatga

SEQ ID NO: 600687 - DNA, 25 bp, Rattus norvegicus
tctttatcccgatttcgcgtcatga

SEQ ID NO: 600688 - DNA, 25 bp, Rattus norvegicus
tctttatcccttacacgacatcaaa

SEQ ID NO: 600689 - DNA, 25 bp, Rattus norvegicus
tctttatccctttcacgacatcaaa

SEQ ID NO: 600690 - DNA, 25 bp, Rattus norvegicus
tctttatcttgacgtccagggccac

SEQ ID NO: 600691 - DNA, 25 bp, Rattus norvegicus
tctttatcttgaggtccagggccac

SEQ ID NO: 600692 - DNA, 25 bp, Rattus norvegicus
tctttatgggacatggtgttacaac

SEQ ID NO: 600693 - DNA, 25 bp, Rattus norvegicus
tctttatgggacttggtgttacaac

SEQ ID NO: 600694 - DNA, 25 bp, Rattus norvegicus
tctttatgttaacttgctccctgac

SEQ ID NO: 600695 - DNA, 25 bp, Rattus norvegicus
tctttatgttaagttgctccctgac

SEQ ID NO: 600696 - DNA, 25 bp, Rattus norvegicus
tctttattaataaccccagggctcc

SEQ ID NO: 600697 - DNA, 25 bp, Rattus norvegicus
tctttattaatatccccagggctcc

SEQ ID NO: 600698 - DNA, 25 bp, Rattus norvegicus
tctttattcagtcagtgtccacccc

SEQ ID NO: 600699 - DNA, 25 bp, Rattus norvegicus
tctttattcagtgagtgtccacccc

SEQ ID NO: 600700 - DNA, 25 bp, Rattus norvegicus
tctttattctgtatgctgcaccttg

SEQ ID NO: 600701 - DNA, 25 bp, Rattus norvegicus
tctttattctgtttgctgcaccttg

SEQ ID NO: 600702 - DNA, 25 bp, Rattus norvegicus
tctttattgttgacctggcgctcca

SEQ ID NO: 600703 - DNA, 25 bp, Rattus norvegicus
tctttattgttgtcctggcgctcca

SEQ ID NO: 600704 - DNA, 25 bp, Rattus norvegicus
tctttatttctgattatgccccttc

SEQ ID NO: 600705 - DNA, 25 bp, Rattus norvegicus
tctttatttctgtttatgccccttc

SEQ ID NO: 600706 - DNA, 25 bp, Rattus norvegicus
tctttcaaaacaagcggtccaaaca

SEQ ID NO: 600707 - DNA, 25 bp, Rattus norvegicus
tctttcaaaacatgcggtccaaaca

SEQ ID NO: 600708 - DNA, 25 bp, Rattus norvegicus
tctttcaaagacatttccccttcca

SEQ ID NO: 600709 - DNA, 25 bp, Rattus norvegicus
tctttcaaagacttttccccttcca

SEQ ID NO: 600710 - DNA, 25 bp, Rattus norvegicus
tctttcaaaggaaccaggttcggtt

SEQ ID NO: 600711 - DNA, 25 bp, Rattus norvegicus
tctttcaaaggatccaggttcggtt

SEQ ID NO: 600712 - DNA, 25 bp, Rattus norvegicus
tctttcaaggcaccaagggctctag

SEQ ID NO: 600713 - DNA, 25 bp, Rattus norvegicus
tctttcaaggcagcaagggctctag

SEQ ID NO: 600714 - DNA, 25 bp, Rattus norvegicus
tctttcaatcctcgcttggctgtgg

SEQ ID NO: 600715 - DNA, 25 bp, Rattus norvegicus
tctttcaatcctggcttggctgtgg

SEQ ID NO: 600716 - DNA, 25 bp, Rattus norvegicus
tctttcaattgccactctctttttt

SEQ ID NO: 600717 - DNA, 25 bp, Rattus norvegicus
tctttcaattgcgactctctttttt

SEQ ID NO: 600718 - DNA, 25 bp, Rattus norvegicus
tctttcagctttatagctctccctt

SEQ ID NO: 600719 - DNA, 25 bp, Rattus norvegicus
tctttcagctttttagctctccctt

SEQ ID NO: 600720 - DNA, 25 bp, Rattus norvegicus
tctttcaggcggaagcttcagttct

SEQ ID NO: 600721 - DNA, 25 bp, Rattus norvegicus
tctttcaggcggtagcttcagttct

SEQ ID NO: 600722 - DNA, 25 bp, Rattus norvegicus
tctttcatctagaggcctcgcgtct

SEQ ID NO: 600723 - DNA, 25 bp, Rattus norvegicus
tctttcatctagtggcctcgcgtct

SEQ ID NO: 600724 - DNA, 25 bp, Rattus norvegicus
tctttcatgatcaactcccattcaa

SEQ ID NO: 600725 - DNA, 25 bp, Rattus norvegicus
tctttcatgatctactcccattcaa

SEQ ID NO: 600726 - DNA, 25 bp, Rattus norvegicus
tctttcatgttgatttcgctgctat

SEQ ID NO: 600727 - DNA, 25 bp, Rattus norvegicus
tctttcatgttgttttcgctgctat

SEQ ID NO: 600728 - DNA, 25 bp, Rattus norvegicus
tctttcatttgaacgtgccttttca

SEQ ID NO: 600729 - DNA, 25 bp, Rattus norvegicus
tctttcatttgatcgtgccttttca

SEQ ID NO: 600730 - DNA, 25 bp, Rattus norvegicus
tctttccacgggatttacaaaatcg

SEQ ID NO: 600731 - DNA, 25 bp, Rattus norvegicus
tctttccacgggttttacaaaatcg

SEQ ID NO: 600732 - DNA, 25 bp, Rattus norvegicus
tctttccagaggcaattctataacc

SEQ ID NO: 600733 - DNA, 25 bp, Rattus norvegicus
tctttccagagggaattctataacc

SEQ ID NO: 600734 - DNA, 25 bp, Rattus norvegicus
tctttccagctcaaggtcctaaggt

SEQ ID NO: 600735 - DNA, 25 bp, Rattus norvegicus
tctttccagctctaggtcctaaggt

SEQ ID NO: 600736 - DNA, 25 bp, Rattus norvegicus
tctttccagtggcaattctgtaaca

SEQ ID NO: 600737 - DNA, 25 bp, Rattus norvegicus
tctttccagtgggaattctgtaaca

SEQ ID NO: 600738 - DNA, 25 bp, Rattus norvegicus
tctttccatcctcagcatatgctga

SEQ ID NO: 600739 - DNA, 25 bp, Rattus norvegicus
tctttccatcctgagcatatgctga

SEQ ID NO: 600740 - DNA, 25 bp, Rattus norvegicus
tctttccatgttaggctgttggttt

SEQ ID NO: 600741 - DNA, 25 bp, Rattus norvegicus
tctttccatgtttggctgttggttt

SEQ ID NO: 600742 - DNA, 25 bp, Rattus norvegicus
tctttccattcaccagaccattccg

SEQ ID NO: 600743 - DNA, 25 bp, Rattus norvegicus
tctttccattcagcagaccattccg

SEQ ID NO: 600744 - DNA, 25 bp, Rattus norvegicus
tctttccatttgagagggtgccgct

SEQ ID NO: 600745 - DNA, 25 bp, Rattus norvegicus
tctttccatttgtgagggtgccgct

SEQ ID NO: 600746 - DNA, 25 bp, Rattus norvegicus
tctttcccagtaagctcagcaggac

SEQ ID NO: 600747 - DNA, 25 bp, Rattus norvegicus
tctttcccagtactgtagtcggctc

SEQ ID NO: 600748 - DNA, 25 bp, Rattus norvegicus
tctttcccagtagtgtagtcggctc

SEQ ID NO: 600749 - DNA, 25 bp, Rattus norvegicus
tctttcccagtatgctcagcaggac

SEQ ID NO: 600750 - DNA, 25 bp, Rattus norvegicus
tctttcccatccctatttctgggat

SEQ ID NO: 600751 - DNA, 25 bp, Rattus norvegicus
tctttcccatccgtatttctgggat

SEQ ID NO: 600752 - DNA, 25 bp, Rattus norvegicus
tctttccccaaacgcagcattacat

SEQ ID NO: 600753 - DNA, 25 bp, Rattus norvegicus
tctttccccaaaggcagcattacat

SEQ ID NO: 600754 - DNA, 25 bp, Rattus norvegicus
tctttccccaacaggctttctttag

SEQ ID NO: 600755 - DNA, 25 bp, Rattus norvegicus
tctttccccaactggctttctttag

SEQ ID NO: 600756 - DNA, 25 bp, Rattus norvegicus
tctttccccagacttagcttctgaa

SEQ ID NO: 600757 - DNA, 25 bp, Rattus norvegicus
tctttccccagagttagcttctgaa

SEQ ID NO: 600758 - DNA, 25 bp, Rattus norvegicus
tctttccccagtaacattcctgaat

SEQ ID NO: 600759 - DNA, 25 bp, Rattus norvegicus
tctttccccagttacattcctgaat

SEQ ID NO: 600760 - DNA, 25 bp, Rattus norvegicus
tctttccccgagatgctgatataga

SEQ ID NO: 600761 - DNA, 25 bp, Rattus norvegicus
tctttccccgagttgctgatataga

SEQ ID NO: 600762 - DNA, 25 bp, Rattus norvegicus
tctttccctacaatgcttcttgtga

SEQ ID NO: 600763 - DNA, 25 bp, Rattus norvegicus
tctttccctacattgcttcttgtga

SEQ ID NO: 600764 - DNA, 25 bp, Rattus norvegicus
tctttccctgcaattgcacagtgta

SEQ ID NO: 600765 - DNA, 25 bp, Rattus norvegicus
tctttccctgcatttgcacagtgta

SEQ ID NO: 600766 - DNA, 25 bp, Rattus norvegicus
tctttccctgctccttcaaaataaa

SEQ ID NO: 600767 - DNA, 25 bp, Rattus norvegicus
tctttccctgctgcttcaaaataaa

SEQ ID NO: 600768 - DNA, 25 bp, Rattus norvegicus
tctttcccttgtattatcgcatgta

SEQ ID NO: 600769 - DNA, 25 bp, Rattus norvegicus
tctttcccttgttttatcgcatgta

SEQ ID NO: 600770 - DNA, 25 bp, Rattus norvegicus
tctttccgagagaggcacacactga

SEQ ID NO: 600771 - DNA, 25 bp, Rattus norvegicus
tctttccgagagtggcacacactga

SEQ ID NO: 600772 - DNA, 25 bp, Rattus norvegicus
tctttccgaggacctgtgcctacat

SEQ ID NO: 600773 - DNA, 25 bp, Rattus norvegicus
tctttccgaggagctgtgcctacat

SEQ ID NO: 600774 - DNA, 25 bp, Rattus norvegicus
tctttccgcgcgaggaagcttgaga

SEQ ID NO: 600775 - DNA, 25 bp, Rattus norvegicus
tctttccgcgcgtggaagcttgaga

SEQ ID NO: 600776 - DNA, 25 bp, Rattus norvegicus
tctttccgctctccacaattgagga

SEQ ID NO: 600777 - DNA, 25 bp, Rattus norvegicus
tctttccgctctgcacaattgagga

SEQ ID NO: 600778 - DNA, 25 bp, Rattus norvegicus
tctttccgttttacattcacccaag

SEQ ID NO: 600779 - DNA, 25 bp, Rattus norvegicus
tctttccgtttttcattcacccaag

SEQ ID NO: 600780 - DNA, 25 bp, Rattus norvegicus
tctttcctaactcgtgtgggcttag

SEQ ID NO: 600781 - DNA, 25 bp, Rattus norvegicus
tctttcctaactggtgtgggcttag

SEQ ID NO: 600782 - DNA, 25 bp, Rattus norvegicus
tctttcctatgcacatggcaatcct

SEQ ID NO: 600783 - DNA, 25 bp, Rattus norvegicus
tctttcctatgctcatggcaatcct

SEQ ID NO: 600784 - DNA, 25 bp, Rattus norvegicus
tctttcctccacatcagaggtcagg

SEQ ID NO: 600785 - DNA, 25 bp, Rattus norvegicus
tctttcctccacttcagaggtcagg

SEQ ID NO: 600786 - DNA, 25 bp, Rattus norvegicus
tctttcctcctacagttttcttaag

SEQ ID NO: 600787 - DNA, 25 bp, Rattus norvegicus
tctttcctcctagagttttcttaag

SEQ ID NO: 600788 - DNA, 25 bp, Rattus norvegicus
tctttcctctagatcctggatctga

SEQ ID NO: 600789 - DNA, 25 bp, Rattus norvegicus
tctttcctctagttcctggatctga

SEQ ID NO: 600790 - DNA, 25 bp, Rattus norvegicus
tctttcctctcccattgatcttttc

SEQ ID NO: 600791 - DNA, 25 bp, Rattus norvegicus
tctttcctctccgattgatcttttc

SEQ ID NO: 600792 - DNA, 25 bp, Rattus norvegicus
tctttcctgaggagcttgaacttgg

SEQ ID NO: 600793 - DNA, 25 bp, Rattus norvegicus
tctttcctgaggtgcttgaacttgg

SEQ ID NO: 600794 - DNA, 25 bp, Rattus norvegicus
tctttcctggaaagtgaagcccggt

SEQ ID NO: 600795 - DNA, 25 bp, Rattus norvegicus
tctttcctggaatgtgaagcccggt

SEQ ID NO: 600796 - DNA, 25 bp, Rattus norvegicus
tctttcctggccaccaaatatacat

SEQ ID NO: 600797 - DNA, 25 bp, Rattus norvegicus
tctttcctggcctccaaatatacat

SEQ ID NO: 600798 - DNA, 25 bp, Rattus norvegicus
tctttcctgggacgtgatgtgccta

SEQ ID NO: 600799 - DNA, 25 bp, Rattus norvegicus
tctttcctgggaggtgatgtgccta

SEQ ID NO: 600800 - DNA, 25 bp, Rattus norvegicus
tctttcctgtagacagtgtttactg

SEQ ID NO: 600801 - DNA, 25 bp, Rattus norvegicus
tctttcctgtagtcagtgtttactg

SEQ ID NO: 600802 - DNA, 25 bp, Rattus norvegicus
tctttccttcaaacaacaccatttc

SEQ ID NO: 600803 - DNA, 25 bp, Rattus norvegicus
tctttccttcaatcaacaccatttc

SEQ ID NO: 600804 - DNA, 25 bp, Rattus norvegicus
tctttccttggtcaccaagtctgcc

SEQ ID NO: 600805 - DNA, 25 bp, Rattus norvegicus
tctttccttggtgaccaagtctgcc

SEQ ID NO: 600806 - DNA, 25 bp, Rattus norvegicus
tctttcctttatcagatggtgacca

SEQ ID NO: 600807 - DNA, 25 bp, Rattus norvegicus
tctttcctttatgagatggtgacca

SEQ ID NO: 600808 - DNA, 25 bp, Rattus norvegicus
tctttcctttcactttcacttggac

SEQ ID NO: 600809 - DNA, 25 bp, Rattus norvegicus
tctttcctttcagtttcacttggac

SEQ ID NO: 600810 - DNA, 25 bp, Rattus norvegicus
tctttcgaggagacttaacccagaa

SEQ ID NO: 600811 - DNA, 25 bp, Rattus norvegicus
tctttcgaggagtcttaacccagaa

SEQ ID NO: 600812 - DNA, 25 bp, Rattus norvegicus
tctttcgcaaggacacaacccagtg

SEQ ID NO: 600813 - DNA, 25 bp, Rattus norvegicus
tctttcgcaaggtcacaacccagtg

SEQ ID NO: 600814 - DNA, 25 bp, Rattus norvegicus
tctttcgtttttagcccctgaggat

SEQ ID NO: 600815 - DNA, 25 bp, Rattus norvegicus
tctttcgttttttgcccctgaggat

SEQ ID NO: 600816 - DNA, 25 bp, Rattus norvegicus
tctttctaaaacctttgcgcttcgc

SEQ ID NO: 600817 - DNA, 25 bp, Rattus norvegicus
tctttctaaaacgtttgcgcttcgc

SEQ ID NO: 600818 - DNA, 25 bp, Rattus norvegicus
tctttctaatccctgtctgtgagaa

SEQ ID NO: 600819 - DNA, 25 bp, Rattus norvegicus
tctttctaatccgtgtctgtgagaa

SEQ ID NO: 600820 - DNA, 25 bp, Rattus norvegicus
tctttctacgtgcagggtgacgcag

SEQ ID NO: 600821 - DNA, 25 bp, Rattus norvegicus
tctttctacgtggagggtgacgcag

SEQ ID NO: 600822 - DNA, 25 bp, Rattus norvegicus
tctttctactgacgtttcactaaca

SEQ ID NO: 600823 - DNA, 25 bp, Rattus norvegicus
tctttctactgaggtttcactaaca

SEQ ID NO: 600824 - DNA, 25 bp, Rattus norvegicus
tctttctatctgagttggacaacag

SEQ ID NO: 600825 - DNA, 25 bp, Rattus norvegicus
tctttctatctgtgttggacaacag

SEQ ID NO: 600826 - DNA, 25 bp, Rattus norvegicus
tctttctattctagggtttcgcaag

SEQ ID NO: 600827 - DNA, 25 bp, Rattus norvegicus
tctttctattcttgggtttcgcaag

SEQ ID NO: 600828 - DNA, 25 bp, Rattus norvegicus
tctttctcaaatcttaccgccttag

SEQ ID NO: 600829 - DNA, 25 bp, Rattus norvegicus
tctttctcaaatgttaccgccttag

SEQ ID NO: 600830 - DNA, 25 bp, Rattus norvegicus
tctttctcacaaccagattgaccat

SEQ ID NO: 600831 - DNA, 25 bp, Rattus norvegicus
tctttctcacaagcagattgaccat

SEQ ID NO: 600832 - DNA, 25 bp, Rattus norvegicus
tctttctcccacacataggacggag

SEQ ID NO: 600833 - DNA, 25 bp, Rattus norvegicus
tctttctcccactcataggacggag

SEQ ID NO: 600834 - DNA, 25 bp, Rattus norvegicus
tctttctcctcacggcttttacaaa

SEQ ID NO: 600835 - DNA, 25 bp, Rattus norvegicus
tctttctcctcagggcttttacaaa

SEQ ID NO: 600836 - DNA, 25 bp, Rattus norvegicus
tctttctctatcctgccaatggtct

SEQ ID NO: 600837 - DNA, 25 bp, Rattus norvegicus
tctttctctatcgtgccaatggtct

SEQ ID NO: 600838 - DNA, 25 bp, Rattus norvegicus
tctttctctgagaacctgattttcc

SEQ ID NO: 600839 - DNA, 25 bp, Rattus norvegicus
tctttctctgagtacctgattttcc

SEQ ID NO: 600840 - DNA, 25 bp, Rattus norvegicus
tctttctctggaactgcaagtctct

SEQ ID NO: 600841 - DNA, 25 bp, Rattus norvegicus
tctttctctggatctgcaagtctct

SEQ ID NO: 600842 - DNA, 25 bp, Rattus norvegicus
tctttctctttaaattgctaccggg

SEQ ID NO: 600843 - DNA, 25 bp, Rattus norvegicus
tctttctctttatattgctaccggg

SEQ ID NO: 600844 - DNA, 25 bp, Rattus norvegicus
tctttctgatttaagcttagcgtgt

SEQ ID NO: 600845 - DNA, 25 bp, Rattus norvegicus
tctttctgattttagcttagcgtgt

SEQ ID NO: 600846 - DNA, 25 bp, Rattus norvegicus
tctttctgcctgatgggtccttgac

SEQ ID NO: 600847 - DNA, 25 bp, Rattus norvegicus
tctttctgcctgttgggtccttgac

SEQ ID NO: 600848 - DNA, 25 bp, Rattus norvegicus
tctttctgccttcgaagatgccagc

SEQ ID NO: 600849 - DNA, 25 bp, Rattus norvegicus
tctttctgccttggaagatgccagc

SEQ ID NO: 600850 - DNA, 25 bp, Rattus norvegicus
tctttctgggtcagtcacctctagg

SEQ ID NO: 600851 - DNA, 25 bp, Rattus norvegicus
tctttctgggtctgtcacctctagg

SEQ ID NO: 600852 - DNA, 25 bp, Rattus norvegicus
tctttctggtcacatgtttaccctg

SEQ ID NO: 600853 - DNA, 25 bp, Rattus norvegicus
tctttctggtcagatgtttaccctg

SEQ ID NO: 600854 - DNA, 25 bp, Rattus norvegicus
tctttctgtctgattctgtgttgga

SEQ ID NO: 600855 - DNA, 25 bp, Rattus norvegicus
tctttctgtctgtttctgtgttgga

SEQ ID NO: 600856 - DNA, 25 bp, Rattus norvegicus
tctttctgtgggatggacgagccat

SEQ ID NO: 600857 - DNA, 25 bp, Rattus norvegicus
tctttctgtgggttggacgagccat

SEQ ID NO: 600858 - DNA, 25 bp, Rattus norvegicus
tctttcttcaagcttcccaagcggt

SEQ ID NO: 600859 - DNA, 25 bp, Rattus norvegicus
tctttcttcaaggttcccaagcggt

SEQ ID NO: 600860 - DNA, 25 bp, Rattus norvegicus
tctttcttcagaccgatgcggctga

SEQ ID NO: 600861 - DNA, 25 bp, Rattus norvegicus
tctttcttcagagcgatgcggctga

SEQ ID NO: 600862 - DNA, 25 bp, Rattus norvegicus
tctttcttcaggcttgtgtctttag

SEQ ID NO: 600863 - DNA, 25 bp, Rattus norvegicus
tctttcttcagggttgtgtctttag

SEQ ID NO: 600864 - DNA, 25 bp, Rattus norvegicus
tctttcttcattataccgtcaatcc

SEQ ID NO: 600865 - DNA, 25 bp, Rattus norvegicus
tctttcttcattttaccgtcaatcc

SEQ ID NO: 600866 - DNA, 25 bp, Rattus norvegicus
tctttcttccaaactgatgtcacca

SEQ ID NO: 600867 - DNA, 25 bp, Rattus norvegicus
tctttcttccaatctgatgtcacca

SEQ ID NO: 600868 - DNA, 25 bp, Rattus norvegicus
tctttcttccagctttcttgggaaa

SEQ ID NO: 600869 - DNA, 25 bp, Rattus norvegicus
tctttcttccaggtttcttgggaaa

SEQ ID NO: 600870 - DNA, 25 bp, Rattus norvegicus
tctttcttctgtactttcccaagga

SEQ ID NO: 600871 - DNA, 25 bp, Rattus norvegicus
tctttcttctgttctttcccaagga

SEQ ID NO: 600872 - DNA, 25 bp, Rattus norvegicus
tctttcttctttctccagacaatac

SEQ ID NO: 600873 - DNA, 25 bp, Rattus norvegicus
tctttcttctttgtccagacaatac

SEQ ID NO: 600874 - DNA, 25 bp, Rattus norvegicus
tctttctttaatccgtctcctcgaa

SEQ ID NO: 600875 - DNA, 25 bp, Rattus norvegicus
tctttctttaatgcgtctcctcgaa

SEQ ID NO: 600876 - DNA, 25 bp, Rattus norvegicus
tctttctttcccatgtgttaagaag

SEQ ID NO: 600877 - DNA, 25 bp, Rattus norvegicus
tctttctttcccttgtgttaagaag

SEQ ID NO: 600878 - DNA, 25 bp, Rattus norvegicus
tctttctttctaagtaactcataga

SEQ ID NO: 600879 - DNA, 25 bp, Rattus norvegicus
tctttctttctatgtaactcataga

SEQ ID NO: 600880 - DNA, 25 bp, Rattus norvegicus
tctttctttctcatgttaatgcttt

SEQ ID NO: 600881 - DNA, 25 bp, Rattus norvegicus
tctttctttctcttgttaatgcttt

SEQ ID NO: 600882 - DNA, 25 bp, Rattus norvegicus
tctttctttgtaagtggtcagtcac

SEQ ID NO: 600883 - DNA, 25 bp, Rattus norvegicus
tctttctttgtatgtggtcagtcac

SEQ ID NO: 600884 - DNA, 25 bp, Rattus norvegicus
tctttctttttaattgctcgcacct

SEQ ID NO: 600885 - DNA, 25 bp, Rattus norvegicus
tctttctttttatttgctcgcacct

SEQ ID NO: 600886 - DNA, 25 bp, Rattus norvegicus
tctttgaaatctcgcctaggaacgt

SEQ ID NO: 600887 - DNA, 25 bp, Rattus norvegicus
tctttgaaatctggcctaggaacgt

SEQ ID NO: 600888 - DNA, 25 bp, Rattus norvegicus
tctttgaagtcacccatcagtttgt

SEQ ID NO: 600889 - DNA, 25 bp, Rattus norvegicus
tctttgaagtcagccatcagtttgt

SEQ ID NO: 600890 - DNA, 25 bp, Rattus norvegicus
tctttgacaagtccagtctgccctt

SEQ ID NO: 600891 - DNA, 25 bp, Rattus norvegicus
tctttgacaagtgcagtctgccctt

SEQ ID NO: 600892 - DNA, 25 bp, Rattus norvegicus
tctttgacatcaatcgggaccctga

SEQ ID NO: 600893 - DNA, 25 bp, Rattus norvegicus
tctttgacatcattcgggaccctga

SEQ ID NO: 600894 - DNA, 25 bp, Rattus norvegicus
tctttgacctcacgttgccttatat

SEQ ID NO: 600895 - DNA, 25 bp, Rattus norvegicus
tctttgacctcaggttgccttatat

SEQ ID NO: 600896 - DNA, 25 bp, Rattus norvegicus
tctttgaccttcaccccgatagaaa

SEQ ID NO: 600897 - DNA, 25 bp, Rattus norvegicus
tctttgaccttctccccgatagaaa

SEQ ID NO: 600898 - DNA, 25 bp, Rattus norvegicus
tctttgactcatatccggtgttgga

SEQ ID NO: 600899 - DNA, 25 bp, Rattus norvegicus
tctttgactcatttccggtgttgga

SEQ ID NO: 600900 - DNA, 25 bp, Rattus norvegicus
tctttgagaagcacagttccctggt

SEQ ID NO: 600901 - DNA, 25 bp, Rattus norvegicus
tctttgagaagctcagttccctggt

SEQ ID NO: 600902 - DNA, 25 bp, Rattus norvegicus
tctttgagacaaccgttcactgtgt

SEQ ID NO: 600903 - DNA, 25 bp, Rattus norvegicus
tctttgagacaagcgttcactgtgt

SEQ ID NO: 600904 - DNA, 25 bp, Rattus norvegicus
tctttgagcccaaggtcaggactga

SEQ ID NO: 600905 - DNA, 25 bp, Rattus norvegicus
tctttgagcccatggtcaggactga

SEQ ID NO: 600906 - DNA, 25 bp, Rattus norvegicus
tctttgatctctatgctcggttaat

SEQ ID NO: 600907 - DNA, 25 bp, Rattus norvegicus
tctttgatctctttgctcggttaat

SEQ ID NO: 600908 - DNA, 25 bp, Rattus norvegicus
tctttgatcttgcttttccttttta

SEQ ID NO: 600909 - DNA, 25 bp, Rattus norvegicus
tctttgatcttggttttccttttta

SEQ ID NO: 600910 - DNA, 25 bp, Rattus norvegicus
tctttgatggtgctggcgtgccaac

SEQ ID NO: 600911 - DNA, 25 bp, Rattus norvegicus
tctttgatggtggtggcgtgccaac

SEQ ID NO: 600912 - DNA, 25 bp, Rattus norvegicus
tctttgattatcatctgggaccagt

SEQ ID NO: 600913 - DNA, 25 bp, Rattus norvegicus
tctttgattatcttctgggaccagt

SEQ ID NO: 600914 - DNA, 25 bp, Rattus norvegicus
tctttgcaccaaatactacggcgac

SEQ ID NO: 600915 - DNA, 25 bp, Rattus norvegicus
tctttgcaccaattactacggcgac

SEQ ID NO: 600916 - DNA, 25 bp, Rattus norvegicus
tctttgcaggttactgtagccggaa

SEQ ID NO: 600917 - DNA, 25 bp, Rattus norvegicus
tctttgcaggtttctgtagccggaa

SEQ ID NO: 600918 - DNA, 25 bp, Rattus norvegicus
tctttgcatcctacctttctaggta

SEQ ID NO: 600919 - DNA, 25 bp, Rattus norvegicus
tctttgcatccttcctttctaggta

SEQ ID NO: 600920 - DNA, 25 bp, Rattus norvegicus
tctttgccagcaccggaggacttaa

SEQ ID NO: 600921 - DNA, 25 bp, Rattus norvegicus
tctttgccagcagcggaggacttaa

SEQ ID NO: 600922 - DNA, 25 bp, Rattus norvegicus
tctttgccaggaatcacatgccatt

SEQ ID NO: 600923 - DNA, 25 bp, Rattus norvegicus
tctttgccaggattcacatgccatt

SEQ ID NO: 600924 - DNA, 25 bp, Rattus norvegicus
tctttgccatcaaggcctaggactt

SEQ ID NO: 600925 - DNA, 25 bp, Rattus norvegicus
tctttgccatcatggcctaggactt

SEQ ID NO: 600926 - DNA, 25 bp, Rattus norvegicus
tctttgccccatctactatgagaat

SEQ ID NO: 600927 - DNA, 25 bp, Rattus norvegicus
tctttgccccatgtactatgagaat

SEQ ID NO: 600928 - DNA, 25 bp, Rattus norvegicus
tctttgcccctgacataccaagaaa

SEQ ID NO: 600929 - DNA, 25 bp, Rattus norvegicus
tctttgcccctgtcataccaagaaa

SEQ ID NO: 600930 - DNA, 25 bp, Rattus norvegicus
tctttgccctaaattggccccaaat

SEQ ID NO: 600931 - DNA, 25 bp, Rattus norvegicus
tctttgccctaatttggccccaaat

SEQ ID NO: 600932 - DNA, 25 bp, Rattus norvegicus
tctttgccctctcgtgtgatggaga

SEQ ID NO: 600933 - DNA, 25 bp, Rattus norvegicus
tctttgccctctggtgtgatggaga

SEQ ID NO: 600934 - DNA, 25 bp, Rattus norvegicus
tctttgccctgcaccaggatttaaa

SEQ ID NO: 600935 - DNA, 25 bp, Rattus norvegicus
tctttgccctgctccaggatttaaa

SEQ ID NO: 600936 - DNA, 25 bp, Rattus norvegicus
tctttgcccttaatgtgatcaacaa

SEQ ID NO: 600937 - DNA, 25 bp, Rattus norvegicus
tctttgcccttattgtgatcaacaa

SEQ ID NO: 600938 - DNA, 25 bp, Rattus norvegicus
tctttgcctaagattgggacagtgg

SEQ ID NO: 600939 - DNA, 25 bp, Rattus norvegicus
tctttgcctaagtttgggacagtgg

SEQ ID NO: 600940 - DNA, 25 bp, Rattus norvegicus
tctttgcctctgacccagagagaaa

SEQ ID NO: 600941 - DNA, 25 bp, Rattus norvegicus
tctttgcctctgtcccagagagaaa

SEQ ID NO: 600942 - DNA, 25 bp, Rattus norvegicus
tctttgcctgtaaagctgtccatag

SEQ ID NO: 600943 - DNA, 25 bp, Rattus norvegicus
tctttgcctgtatagctgtccatag

SEQ ID NO: 600944 - DNA, 25 bp, Rattus norvegicus
tctttgccttctactatccatttag

SEQ ID NO: 600945 - DNA, 25 bp, Rattus norvegicus
tctttgccttcttctatccatttag

SEQ ID NO: 600946 - DNA, 25 bp, Rattus norvegicus
tctttgccttgtcttactttaccct

SEQ ID NO: 600947 - DNA, 25 bp, Rattus norvegicus
tctttgccttgtgttactttaccct

SEQ ID NO: 600948 - DNA, 25 bp, Rattus norvegicus
tctttgcctttaaccttcttttgag

SEQ ID NO: 600949 - DNA, 25 bp, Rattus norvegicus
tctttgcctttatccttcttttgag

SEQ ID NO: 600950 - DNA, 25 bp, Rattus norvegicus
tctttgctaacgaatgcccttcctg

SEQ ID NO: 600951 - DNA, 25 bp, Rattus norvegicus
tctttgctaacgtatgcccttcctg

SEQ ID NO: 600952 - DNA, 25 bp, Rattus norvegicus
tctttgctctacaatgacagggaca

SEQ ID NO: 600953 - DNA, 25 bp, Rattus norvegicus
tctttgctctactatgacagggaca

SEQ ID NO: 600954 - DNA, 25 bp, Rattus norvegicus
tctttgctgccaagttcttttttac

SEQ ID NO: 600955 - DNA, 25 bp, Rattus norvegicus
tctttgctgccatgttcttttttac

SEQ ID NO: 600956 - DNA, 25 bp, Rattus norvegicus
tctttgctgcttcgaagttccgtgg

SEQ ID NO: 600957 - DNA, 25 bp, Rattus norvegicus
tctttgctgcttggaagttccgtgg

SEQ ID NO: 600958 - DNA, 25 bp, Rattus norvegicus
tctttgctgtttcctttcttaaaat

SEQ ID NO: 600959 - DNA, 25 bp, Rattus norvegicus
tctttgctgtttgctttcttaaaat

SEQ ID NO: 600960 - DNA, 25 bp, Rattus norvegicus
tctttgcttcctaactgtgagtctc

SEQ ID NO: 600961 - DNA, 25 bp, Rattus norvegicus
tctttgcttccttactgtgagtctc

SEQ ID NO: 600962 - DNA, 25 bp, Rattus norvegicus
tctttggacaaacggtgtagggcta

SEQ ID NO: 600963 - DNA, 25 bp, Rattus norvegicus
tctttggacaaagggtgtagggcta

SEQ ID NO: 600964 - DNA, 25 bp, Rattus norvegicus
tctttggaccctcactagagacaat

SEQ ID NO: 600965 - DNA, 25 bp, Rattus norvegicus
tctttggaccctgactagagacaat

SEQ ID NO: 600966 - DNA, 25 bp, Rattus norvegicus
tctttggagactaggctgccctaga

SEQ ID NO: 600967 - DNA, 25 bp, Rattus norvegicus
tctttggagacttggctgccctaga

SEQ ID NO: 600968 - DNA, 25 bp, Rattus norvegicus
tctttggagattaaggccgcggctg

SEQ ID NO: 600969 - DNA, 25 bp, Rattus norvegicus
tctttggagatttaggccgcggctg

SEQ ID NO: 600970 - DNA, 25 bp, Rattus norvegicus
tctttggaggctctgggtctcgacc

SEQ ID NO: 600971 - DNA, 25 bp, Rattus norvegicus
tctttggaggctgtgggtctcgacc

SEQ ID NO: 600972 - DNA, 25 bp, Rattus norvegicus
tctttggatagcaacctcgagggtt

SEQ ID NO: 600973 - DNA, 25 bp, Rattus norvegicus
tctttggatagctacctcgagggtt

SEQ ID NO: 600974 - DNA, 25 bp, Rattus norvegicus
tctttggcccagaatttcagacagt

SEQ ID NO: 600975 - DNA, 25 bp, Rattus norvegicus
tctttggcccagtatttcagacagt

SEQ ID NO: 600976 - DNA, 25 bp, Rattus norvegicus
tctttggcctggctagccagtttgt

SEQ ID NO: 600977 - DNA, 25 bp, Rattus norvegicus
tctttggcctgggtagccagtttgt

SEQ ID NO: 600978 - DNA, 25 bp, Rattus norvegicus
tctttggcggatatctgggactctt

SEQ ID NO: 600979 - DNA, 25 bp, Rattus norvegicus
tctttggcggatttctgggactctt

SEQ ID NO: 600980 - DNA, 25 bp, Rattus norvegicus
tctttggctcctctaacctgcttat

SEQ ID NO: 600981 - DNA, 25 bp, Rattus norvegicus
tctttggctcctgtaacctgcttat

SEQ ID NO: 600982 - DNA, 25 bp, Rattus norvegicus
tctttggctgccactgggatcagaa

SEQ ID NO: 600983 - DNA, 25 bp, Rattus norvegicus
tctttggctgcctctgggatcagaa

SEQ ID NO: 600984 - DNA, 25 bp, Rattus norvegicus
tctttggctgctattgagtcttatg

SEQ ID NO: 600985 - DNA, 25 bp, Rattus norvegicus
tctttggctgcttttgagtcttatg

SEQ ID NO: 600986 - DNA, 25 bp, Rattus norvegicus
tctttgggatctattttgcctctta

SEQ ID NO: 600987 - DNA, 25 bp, Rattus norvegicus
tctttgggatcttttttgcctctta

SEQ ID NO: 600988 - DNA, 25 bp, Rattus norvegicus
tctttgggcttcaaatgtccttaaa

SEQ ID NO: 600989 - DNA, 25 bp, Rattus norvegicus
tctttgggcttctaatgtccttaaa

SEQ ID NO: 600990 - DNA, 25 bp, Rattus norvegicus
tctttgggtcatctcctctgataaa

SEQ ID NO: 600991 - DNA, 25 bp, Rattus norvegicus
tctttgggtcatgtcctctgataaa

SEQ ID NO: 600992 - DNA, 25 bp, Rattus norvegicus
tctttgggtctcctgttagtgccag

SEQ ID NO: 600993 - DNA, 25 bp, Rattus norvegicus
tctttgggtctcgtgttagtgccag

SEQ ID NO: 600994 - DNA, 25 bp, Rattus norvegicus
tctttggtaaaccgctcagatctta

SEQ ID NO: 600995 - DNA, 25 bp, Rattus norvegicus
tctttggtaaacggctcagatctta

SEQ ID NO: 600996 - DNA, 25 bp, Rattus norvegicus
tctttggtaccacctgtgacttttc

SEQ ID NO: 600997 - DNA, 25 bp, Rattus norvegicus
tctttggtaccagctgtgacttttc

SEQ ID NO: 600998 - DNA, 25 bp, Rattus norvegicus
tctttggttctgcattatgataagc

SEQ ID NO: 600999 - DNA, 25 bp, Rattus norvegicus
tctttggttctggattatgataagc

SEQ ID NO: 601000 - DNA, 25 bp, Rattus norvegicus
tctttggtttacatgcggtttctca

SEQ ID NO: 601001 - DNA, 25 bp, Rattus norvegicus
tctttggtttacttgcggtttctca

SEQ ID NO: 601002 - DNA, 25 bp, Rattus norvegicus
tctttgtaacacagattctcccctg

SEQ ID NO: 601003 - DNA, 25 bp, Rattus norvegicus
tctttgtaacactgattctcccctg

SEQ ID NO: 601004 - DNA, 25 bp, Rattus norvegicus
tctttgtaaccaccagagggcgcca

SEQ ID NO: 601005 - DNA, 25 bp, Rattus norvegicus
tctttgtaaccagcagagggcgcca

SEQ ID NO: 601006 - DNA, 25 bp, Rattus norvegicus
tctttgtaacccattatgatcctag

SEQ ID NO: 601007 - DNA, 25 bp, Rattus norvegicus
tctttgtaaccctttatgatcctag

SEQ ID NO: 601008 - DNA, 25 bp, Rattus norvegicus
tctttgtaatgtcctgtctcatctc

SEQ ID NO: 601009 - DNA, 25 bp, Rattus norvegicus
tctttgtaatgtgctgtctcatctc

SEQ ID NO: 601010 - DNA, 25 bp, Rattus norvegicus
tctttgtacctgcacttcgcgtagc

SEQ ID NO: 601011 - DNA, 25 bp, Rattus norvegicus
tctttgtacctggacttcgcgtagc

SEQ ID NO: 601012 - DNA, 25 bp, Rattus norvegicus
tctttgtatcagacacctcctcaaa

SEQ ID NO: 601013 - DNA, 25 bp, Rattus norvegicus
tctttgtatcagtcacctcctcaaa

SEQ ID NO: 601014 - DNA, 25 bp, Rattus norvegicus
tctttgtatttcaacattcttgctt

SEQ ID NO: 601015 - DNA, 25 bp, Rattus norvegicus
tctttgtatttctacattcttgctt

SEQ ID NO: 601016 - DNA, 25 bp, Rattus norvegicus
tctttgtcacctctgctctaagcag

SEQ ID NO: 601017 - DNA, 25 bp, Rattus norvegicus
tctttgtcacctgtgctctaagcag

SEQ ID NO: 601018 - DNA, 25 bp, Rattus norvegicus
tctttgtcatctagtgtcactgcct

SEQ ID NO: 601019 - DNA, 25 bp, Rattus norvegicus
tctttgtcatcttgtgtcactgcct

SEQ ID NO: 601020 - DNA, 25 bp, Rattus norvegicus
tctttgtccaccacagtactttaaa

SEQ ID NO: 601021 - DNA, 25 bp, Rattus norvegicus
tctttgtccacctcagtactttaaa

SEQ ID NO: 601022 - DNA, 25 bp, Rattus norvegicus
tctttgtccccaccggaataaatat

SEQ ID NO: 601023 - DNA, 25 bp, Rattus norvegicus
tctttgtccccagcggaataaatat

SEQ ID NO: 601024 - DNA, 25 bp, Rattus norvegicus
tctttgtcctgcaaccatggcattg

SEQ ID NO: 601025 - DNA, 25 bp, Rattus norvegicus
tctttgtcctgctaccatggcattg

SEQ ID NO: 601026 - DNA, 25 bp, Rattus norvegicus
tctttgtctgtcactcttacataca

SEQ ID NO: 601027 - DNA, 25 bp, Rattus norvegicus
tctttgtctgtctctcttacataca

SEQ ID NO: 601028 - DNA, 25 bp, Rattus norvegicus
tctttgtctgttctctctgaggatg

SEQ ID NO: 601029 - DNA, 25 bp, Rattus norvegicus
tctttgtctgttgtctctgaggatg

SEQ ID NO: 601030 - DNA, 25 bp, Rattus norvegicus
tctttgtgaaagcagttcttccagc

SEQ ID NO: 601031 - DNA, 25 bp, Rattus norvegicus
tctttgtgaaaggagttcttccagc

SEQ ID NO: 601032 - DNA, 25 bp, Rattus norvegicus
tctttgtgcccgcatgtgcagacag

SEQ ID NO: 601033 - DNA, 25 bp, Rattus norvegicus
tctttgtgcccggatgtgcagacag

SEQ ID NO: 601034 - DNA, 25 bp, Rattus norvegicus
tctttgtgccgactacagagataga

SEQ ID NO: 601035 - DNA, 25 bp, Rattus norvegicus
tctttgtgccgagtacagagataga

SEQ ID NO: 601036 - DNA, 25 bp, Rattus norvegicus
tctttgtggccaccctttgagaggc

SEQ ID NO: 601037 - DNA, 25 bp, Rattus norvegicus
tctttgtggccagcctttgagaggc

SEQ ID NO: 601038 - DNA, 25 bp, Rattus norvegicus
tctttgtggcttactttacccagaa

SEQ ID NO: 601039 - DNA, 25 bp, Rattus norvegicus
tctttgtggctttctttacccagaa

SEQ ID NO: 601040 - DNA, 25 bp, Rattus norvegicus
tctttgtgggcccttgatgagagca

SEQ ID NO: 601041 - DNA, 25 bp, Rattus norvegicus
tctttgtgggccgttgatgagagca

SEQ ID NO: 601042 - DNA, 25 bp, Rattus norvegicus
tctttgtggtctacatgctgcccag

SEQ ID NO: 601043 - DNA, 25 bp, Rattus norvegicus
tctttgtggtcttcatgctgcccag

SEQ ID NO: 601044 - DNA, 25 bp, Rattus norvegicus
tctttgtggtgacatcatcagtgtg

SEQ ID NO: 601045 - DNA, 25 bp, Rattus norvegicus
tctttgtggtgagatcatcagtgtg

SEQ ID NO: 601046 - DNA, 25 bp, Rattus norvegicus
tctttgtgtccaccattggcatgaa

SEQ ID NO: 601047 - DNA, 25 bp, Rattus norvegicus
tctttgtgtccagcattggcatgaa

SEQ ID NO: 601048 - DNA, 25 bp, Rattus norvegicus
tctttgtgtccgacatgagtcatca

SEQ ID NO: 601049 - DNA, 25 bp, Rattus norvegicus
tctttgtgtccgtcatgagtcatca

SEQ ID NO: 601050 - DNA, 25 bp, Rattus norvegicus
tctttgtgtcttactactatctcct

SEQ ID NO: 601051 - DNA, 25 bp, Rattus norvegicus
tctttgtgtctttctactatctcct

SEQ ID NO: 601052 - DNA, 25 bp, Rattus norvegicus
tctttgtgtgtcatccgtgttccca

SEQ ID NO: 601053 - DNA, 25 bp, Rattus norvegicus
tctttgtgtgtcttccgtgttccca

SEQ ID NO: 601054 - DNA, 25 bp, Rattus norvegicus
tctttgttaacaacctctcactcta

SEQ ID NO: 601055 - DNA, 25 bp, Rattus norvegicus
tctttgttaacatcctctcactcta

SEQ ID NO: 601056 - DNA, 25 bp, Rattus norvegicus
tctttgttagccacttgctctgcaa

SEQ ID NO: 601057 - DNA, 25 bp, Rattus norvegicus
tctttgttagcctcttgctctgcaa

SEQ ID NO: 601058 - DNA, 25 bp, Rattus norvegicus
tctttgttccgtatcccttcagaag

SEQ ID NO: 601059 - DNA, 25 bp, Rattus norvegicus
tctttgttccgtttcccttcagaag

SEQ ID NO: 601060 - DNA, 25 bp, Rattus norvegicus
tctttgttgcctacaggtggacgaa

SEQ ID NO: 601061 - DNA, 25 bp, Rattus norvegicus
tctttgttgccttcaggtggacgaa

SEQ ID NO: 601062 - DNA, 25 bp, Rattus norvegicus
tctttgttgctgattctcggagagc

SEQ ID NO: 601063 - DNA, 25 bp, Rattus norvegicus
tctttgttgctgtttctcggagagc

SEQ ID NO: 601064 - DNA, 25 bp, Rattus norvegicus
tctttgttgtgtctacgttggtatt

SEQ ID NO: 601065 - DNA, 25 bp, Rattus norvegicus
tctttgttgtgtgtacgttggtatt

SEQ ID NO: 601066 - DNA, 25 bp, Rattus norvegicus
tctttgtttacaccttttctcctta

SEQ ID NO: 601067 - DNA, 25 bp, Rattus norvegicus
tctttgtttacagcttttctcctta

SEQ ID NO: 601068 - DNA, 25 bp, Rattus norvegicus
tctttgtttgcaacctgtctgtgac

SEQ ID NO: 601069 - DNA, 25 bp, Rattus norvegicus
tctttgtttgcatcctgtctgtgac

SEQ ID NO: 601070 - DNA, 25 bp, Rattus norvegicus
tctttgtttgttaatctctcaattt

SEQ ID NO: 601071 - DNA, 25 bp, Rattus norvegicus
tctttgtttgtttatctctcaattt

SEQ ID NO: 601072 - DNA, 25 bp, Rattus norvegicus
tcttttaacgctatttggagtgaat

SEQ ID NO: 601073 - DNA, 25 bp, Rattus norvegicus
tcttttaacgctttttggagtgaat

SEQ ID NO: 601074 - DNA, 25 bp, Rattus norvegicus
tcttttaacttcacagactctaagt

SEQ ID NO: 601075 - DNA, 25 bp, Rattus norvegicus
tcttttaacttctcagactctaagt

SEQ ID NO: 601076 - DNA, 25 bp, Rattus norvegicus
tcttttaatttcagtttctcagcaa

SEQ ID NO: 601077 - DNA, 25 bp, Rattus norvegicus
tcttttaatttctgtttctcagcaa

SEQ ID NO: 601078 - DNA, 25 bp, Rattus norvegicus
tcttttaccctacagacgttttctg

SEQ ID NO: 601079 - DNA, 25 bp, Rattus norvegicus
tcttttaccctagagacgttttctg

SEQ ID NO: 601080 - DNA, 25 bp, Rattus norvegicus
tcttttacgtgtcactgagtgccat

SEQ ID NO: 601081 - DNA, 25 bp, Rattus norvegicus
tcttttacgtgtgactgagtgccat

SEQ ID NO: 601082 - DNA, 25 bp, Rattus norvegicus
tcttttatcagacgccacgacaata

SEQ ID NO: 601083 - DNA, 25 bp, Rattus norvegicus
tcttttatcagaggccacgacaata

SEQ ID NO: 601084 - DNA, 25 bp, Rattus norvegicus
tcttttatccatagcattcctacca

SEQ ID NO: 601085 - DNA, 25 bp, Rattus norvegicus
tcttttatccattgcattcctacca

SEQ ID NO: 601086 - DNA, 25 bp, Rattus norvegicus
tcttttatgaaactcctactggagc

SEQ ID NO: 601087 - DNA, 25 bp, Rattus norvegicus
tcttttatgaaagtcctactggagc

SEQ ID NO: 601088 - DNA, 25 bp, Rattus norvegicus
tcttttatgaggagcactcacagca

SEQ ID NO: 601089 - DNA, 25 bp, Rattus norvegicus
tcttttatgaggtgcactcacagca

SEQ ID NO: 601090 - DNA, 25 bp, Rattus norvegicus
tcttttattttcaggtaacttgtga

SEQ ID NO: 601091 - DNA, 25 bp, Rattus norvegicus
tcttttattttctggtaacttgtga

SEQ ID NO: 601092 - DNA, 25 bp, Rattus norvegicus
tcttttcactccagtccattgaaga

SEQ ID NO: 601093 - DNA, 25 bp, Rattus norvegicus
tcttttcactcctgtccattgaaga

SEQ ID NO: 601094 - DNA, 25 bp, Rattus norvegicus
tcttttcagaggagctcacactttt

SEQ ID NO: 601095 - DNA, 25 bp, Rattus norvegicus
tcttttcagaggtgctcacactttt

SEQ ID NO: 601096 - DNA, 25 bp, Rattus norvegicus
tcttttcagtgccatttcacccttc

SEQ ID NO: 601097 - DNA, 25 bp, Rattus norvegicus
tcttttcagtgcgatttcacccttc

SEQ ID NO: 601098 - DNA, 25 bp, Rattus norvegicus
tcttttcatagcactgactgtcatg

SEQ ID NO: 601099 - DNA, 25 bp, Rattus norvegicus
tcttttcatagctctgactgtcatg

SEQ ID NO: 601100 - DNA, 25 bp, Rattus norvegicus
tcttttccaagacccatgatttcta

SEQ ID NO: 601101 - DNA, 25 bp, Rattus norvegicus
tcttttccaagagccatgatttcta

SEQ ID NO: 601102 - DNA, 25 bp, Rattus norvegicus
tcttttccatgcactgatcacctaa

SEQ ID NO: 601103 - DNA, 25 bp, Rattus norvegicus
tcttttccatgctctgatcacctaa

SEQ ID NO: 601104 - DNA, 25 bp, Rattus norvegicus
tcttttcccagcaagaccgtgagga

SEQ ID NO: 601105 - DNA, 25 bp, Rattus norvegicus
tcttttcccagctagaccgtgagga

SEQ ID NO: 601106 - DNA, 25 bp, Rattus norvegicus
tcttttccctgtaaactgctgcacg

SEQ ID NO: 601107 - DNA, 25 bp, Rattus norvegicus
tcttttccctgttaactgctgcacg

SEQ ID NO: 601108 - DNA, 25 bp, Rattus norvegicus
tcttttcctaccctcattatttgga

SEQ ID NO: 601109 - DNA, 25 bp, Rattus norvegicus
tcttttcctaccgtcattatttgga

SEQ ID NO: 601110 - DNA, 25 bp, Rattus norvegicus
tcttttcctatcatgcatgtctgag

SEQ ID NO: 601111 - DNA, 25 bp, Rattus norvegicus
tcttttcctatcttgcatgtctgag

SEQ ID NO: 601112 - DNA, 25 bp, Rattus norvegicus
tcttttcctcagattggatcaggaa

SEQ ID NO: 601113 - DNA, 25 bp, Rattus norvegicus
tcttttcctcagtttggatcaggaa

SEQ ID NO: 601114 - DNA, 25 bp, Rattus norvegicus
tcttttcctcccagatgtaactaaa

SEQ ID NO: 601115 - DNA, 25 bp, Rattus norvegicus
tcttttcctccctgatgtaactaaa

SEQ ID NO: 601116 - DNA, 25 bp, Rattus norvegicus
tcttttcctcgtatccagattcttt

SEQ ID NO: 601117 - DNA, 25 bp, Rattus norvegicus
tcttttcctcgtttccagattcttt

SEQ ID NO: 601118 - DNA, 25 bp, Rattus norvegicus
tcttttcctctcaacattcttaggg

SEQ ID NO: 601119 - DNA, 25 bp, Rattus norvegicus
tcttttcctctctacattcttaggg

SEQ ID NO: 601120 - DNA, 25 bp, Rattus norvegicus
tcttttcctcttcactgggctactg

SEQ ID NO: 601121 - DNA, 25 bp, Rattus norvegicus
tcttttcctcttgactgggctactg

SEQ ID NO: 601122 - DNA, 25 bp, Rattus norvegicus
tcttttcctgctctttttcaaccga

SEQ ID NO: 601123 - DNA, 25 bp, Rattus norvegicus
tcttttcctgctgtttttcaaccga

SEQ ID NO: 601124 - DNA, 25 bp, Rattus norvegicus
tcttttccttttatgagcttcgata

SEQ ID NO: 601125 - DNA, 25 bp, Rattus norvegicus
tcttttccttttttgagcttcgata

SEQ ID NO: 601126 - DNA, 25 bp, Rattus norvegicus
tcttttctaacacggcacagtggtc

SEQ ID NO: 601127 - DNA, 25 bp, Rattus norvegicus
tcttttctaacagggcacagtggtc

SEQ ID NO: 601128 - DNA, 25 bp, Rattus norvegicus
tcttttctacggagaacgttgcctt

SEQ ID NO: 601129 - DNA, 25 bp, Rattus norvegicus
tcttttctacggtgaacgttgcctt

SEQ ID NO: 601130 - DNA, 25 bp, Rattus norvegicus
tcttttctagtacctgtggcagatt

SEQ ID NO: 601131 - DNA, 25 bp, Rattus norvegicus
tcttttctagtagctgtggcagatt

SEQ ID NO: 601132 - DNA, 25 bp, Rattus norvegicus
tcttttctagttctagactcatcat

SEQ ID NO: 601133 - DNA, 25 bp, Rattus norvegicus
tcttttctagttgtagactcatcat

SEQ ID NO: 601134 - DNA, 25 bp, Rattus norvegicus
tcttttctccgcagggacatacata

SEQ ID NO: 601135 - DNA, 25 bp, Rattus norvegicus
tcttttctccgctgggacatacata

SEQ ID NO: 601136 - DNA, 25 bp, Rattus norvegicus
tcttttctcctcctaagggcttcaa

SEQ ID NO: 601137 - DNA, 25 bp, Rattus norvegicus
tcttttctcctcgtaagggcttcaa

SEQ ID NO: 601138 - DNA, 25 bp, Rattus norvegicus
tcttttctcctgaggtactttcaaa

SEQ ID NO: 601139 - DNA, 25 bp, Rattus norvegicus
tcttttctcctgattcttgaggtga

SEQ ID NO: 601140 - DNA, 25 bp, Rattus norvegicus
tcttttctcctgtggtactttcaaa

SEQ ID NO: 601141 - DNA, 25 bp, Rattus norvegicus
tcttttctcctgtttcttgaggtga

SEQ ID NO: 601142 - DNA, 25 bp, Rattus norvegicus
tcttttctccttattgtgtgtatgt

SEQ ID NO: 601143 - DNA, 25 bp, Rattus norvegicus
tcttttctcctttttgtgtgtatgt

SEQ ID NO: 601144 - DNA, 25 bp, Rattus norvegicus
tcttttctctgccaactgtgaaagt

SEQ ID NO: 601145 - DNA, 25 bp, Rattus norvegicus
tcttttctctgcgaactgtgaaagt

SEQ ID NO: 601146 - DNA, 25 bp, Rattus norvegicus
tcttttctgcaacactgactcttcc

SEQ ID NO: 601147 - DNA, 25 bp, Rattus norvegicus
tcttttctgcaagactgactcttcc

SEQ ID NO: 601148 - DNA, 25 bp, Rattus norvegicus
tcttttctgcagcagatccattcag

SEQ ID NO: 601149 - DNA, 25 bp, Rattus norvegicus
tcttttctgcaggagatccattcag

SEQ ID NO: 601150 - DNA, 25 bp, Rattus norvegicus
tcttttctgctccaagaagtgacac

SEQ ID NO: 601151 - DNA, 25 bp, Rattus norvegicus
tcttttctgctcgaagaagtgacac

SEQ ID NO: 601152 - DNA, 25 bp, Rattus norvegicus
tcttttctgggtcttctatggagct

SEQ ID NO: 601153 - DNA, 25 bp, Rattus norvegicus
tcttttctgggtgttctatggagct

SEQ ID NO: 601154 - DNA, 25 bp, Rattus norvegicus
tcttttctggttaccctactactga

SEQ ID NO: 601155 - DNA, 25 bp, Rattus norvegicus
tcttttctggtttccctactactga

SEQ ID NO: 601156 - DNA, 25 bp, Rattus norvegicus
tcttttctgtgcactctgtttgtaa

SEQ ID NO: 601157 - DNA, 25 bp, Rattus norvegicus
tcttttctgtgctctctgtttgtaa

SEQ ID NO: 601158 - DNA, 25 bp, Rattus norvegicus
tcttttcttaccacagccctaggga

SEQ ID NO: 601159 - DNA, 25 bp, Rattus norvegicus
tcttttcttacctcagccctaggga

SEQ ID NO: 601160 - DNA, 25 bp, Rattus norvegicus
tcttttcttctgagagtctaggatg

SEQ ID NO: 601161 - DNA, 25 bp, Rattus norvegicus
tcttttcttctgtgagtctaggatg

SEQ ID NO: 601162 - DNA, 25 bp, Rattus norvegicus
tcttttctttatactatgttctggg

SEQ ID NO: 601163 - DNA, 25 bp, Rattus norvegicus
tcttttctttattctatgttctggg

SEQ ID NO: 601164 - DNA, 25 bp, Rattus norvegicus
tcttttctttcaaacagcctcagct

SEQ ID NO: 601165 - DNA, 25 bp, Rattus norvegicus
tcttttctttcatacagcctcagct

SEQ ID NO: 601166 - DNA, 25 bp, Rattus norvegicus
tcttttgacagaatacctccatggt

SEQ ID NO: 601167 - DNA, 25 bp, Rattus norvegicus
tcttttgacagattacctccatggt

SEQ ID NO: 601168 - DNA, 25 bp, Rattus norvegicus
tcttttgactaaccattgcccttaa

SEQ ID NO: 601169 - DNA, 25 bp, Rattus norvegicus
tcttttgactaagcattgcccttaa

SEQ ID NO: 601170 - DNA, 25 bp, Rattus norvegicus
tcttttgactttctggctgtgtgct

SEQ ID NO: 601171 - DNA, 25 bp, Rattus norvegicus
tcttttgactttgtggctgtgtgct

SEQ ID NO: 601172 - DNA, 25 bp, Rattus norvegicus
tcttttgaggaacgccagtggcaca

SEQ ID NO: 601173 - DNA, 25 bp, Rattus norvegicus
tcttttgaggaaggccagtggcaca

SEQ ID NO: 601174 - DNA, 25 bp, Rattus norvegicus
tcttttgatcagatgtgttcggtac

SEQ ID NO: 601175 - DNA, 25 bp, Rattus norvegicus
tcttttgatcagttgtgttcggtac

SEQ ID NO: 601176 - DNA, 25 bp, Rattus norvegicus
tcttttgcaacccagaactcattgt

SEQ ID NO: 601177 - DNA, 25 bp, Rattus norvegicus
tcttttgcaaccgagaactcattgt

SEQ ID NO: 601178 - DNA, 25 bp, Rattus norvegicus
tcttttgcaagaccagcagcacctc

SEQ ID NO: 601179 - DNA, 25 bp, Rattus norvegicus
tcttttgcaagagcagcagcacctc

SEQ ID NO: 601180 - DNA, 25 bp, Rattus norvegicus
tcttttgcactgagtgggcaggaaa

SEQ ID NO: 601181 - DNA, 25 bp, Rattus norvegicus
tcttttgcactgtgtgggcaggaaa

SEQ ID NO: 601182 - DNA, 25 bp, Rattus norvegicus
tcttttgcagacctcctaaggctaa

SEQ ID NO: 601183 - DNA, 25 bp, Rattus norvegicus
tcttttgcagacgtcctaaggctaa

SEQ ID NO: 601184 - DNA, 25 bp, Rattus norvegicus
tcttttgcagggattgacccctgct

SEQ ID NO: 601185 - DNA, 25 bp, Rattus norvegicus
tcttttgcagggtttgacccctgct

SEQ ID NO: 601186 - DNA, 25 bp, Rattus norvegicus
tcttttgcatctaggcttcaccaat

SEQ ID NO: 601187 - DNA, 25 bp, Rattus norvegicus
tcttttgcatcttggcttcaccaat

SEQ ID NO: 601188 - DNA, 25 bp, Rattus norvegicus
tcttttgccacaattactgtgccta

SEQ ID NO: 601189 - DNA, 25 bp, Rattus norvegicus
tcttttgccacatttactgtgccta

SEQ ID NO: 601190 - DNA, 25 bp, Rattus norvegicus
tcttttgctgctctgttagttgata

SEQ ID NO: 601191 - DNA, 25 bp, Rattus norvegicus
tcttttgctgctgtgttagttgata

SEQ ID NO: 601192 - DNA, 25 bp, Rattus norvegicus
tcttttgctgtaaagccctggatgt

SEQ ID NO: 601193 - DNA, 25 bp, Rattus norvegicus
tcttttgctgtatagccctggatgt

SEQ ID NO: 601194 - DNA, 25 bp, Rattus norvegicus
tcttttgctttcactggcctgagaa

SEQ ID NO: 601195 - DNA, 25 bp, Rattus norvegicus
tcttttgctttctctggcctgagaa

SEQ ID NO: 601196 - DNA, 25 bp, Rattus norvegicus
tcttttgctttgactgtgctgcaaa

SEQ ID NO: 601197 - DNA, 25 bp, Rattus norvegicus
tcttttgctttgtctgtgctgcaaa

SEQ ID NO: 601198 - DNA, 25 bp, Rattus norvegicus
tcttttggcctcagctgtcaccagg

SEQ ID NO: 601199 - DNA, 25 bp, Rattus norvegicus
tcttttggcctctgctgtcaccagg

SEQ ID NO: 601200 - DNA, 25 bp, Rattus norvegicus
tcttttgggtgacctgtttgtgttc

SEQ ID NO: 601201 - DNA, 25 bp, Rattus norvegicus
tcttttgggtgagctgtttgtgttc

SEQ ID NO: 601202 - DNA, 25 bp, Rattus norvegicus
tcttttgtactgacccggctgggag

SEQ ID NO: 601203 - DNA, 25 bp, Rattus norvegicus
tcttttgtactgtcccggctgggag

SEQ ID NO: 601204 - DNA, 25 bp, Rattus norvegicus
tcttttgtattcagagttctcccac

SEQ ID NO: 601205 - DNA, 25 bp, Rattus norvegicus
tcttttgtattctgagttctcccac

SEQ ID NO: 601206 - DNA, 25 bp, Rattus norvegicus
tcttttgtcagaaagtgtccaggaa

SEQ ID NO: 601207 - DNA, 25 bp, Rattus norvegicus
tcttttgtcagatagtgtccaggaa

SEQ ID NO: 601208 - DNA, 25 bp, Rattus norvegicus
tcttttgtccacatcttcagcaaat

SEQ ID NO: 601209 - DNA, 25 bp, Rattus norvegicus
tcttttgtccacttcttcagcaaat

SEQ ID NO: 601210 - DNA, 25 bp, Rattus norvegicus
tcttttgtcccacttaccgactgaa

SEQ ID NO: 601211 - DNA, 25 bp, Rattus norvegicus
tcttttgtcccagttaccgactgaa

SEQ ID NO: 601212 - DNA, 25 bp, Rattus norvegicus
tcttttgtgcaaatattactgtaat

SEQ ID NO: 601213 - DNA, 25 bp, Rattus norvegicus
tcttttgtgcaattattactgtaat

SEQ ID NO: 601214 - DNA, 25 bp, Rattus norvegicus
tcttttgtgcggacacgatccctat

SEQ ID NO: 601215 - DNA, 25 bp, Rattus norvegicus
tcttttgtgcggtcacgatccctat

SEQ ID NO: 601216 - DNA, 25 bp, Rattus norvegicus
tcttttgtgtttcggttctttgtgc

SEQ ID NO: 601217 - DNA, 25 bp, Rattus norvegicus
tcttttgtgtttgggttctttgtgc

SEQ ID NO: 601218 - DNA, 25 bp, Rattus norvegicus
tctttttaaatcacgtgctgaccat

SEQ ID NO: 601219 - DNA, 25 bp, Rattus norvegicus
tctttttaaatctcgtgctgaccat

SEQ ID NO: 601220 - DNA, 25 bp, Rattus norvegicus
tctttttaatccaggctcgaagccc

SEQ ID NO: 601221 - DNA, 25 bp, Rattus norvegicus
tctttttaatcctggctcgaagccc

SEQ ID NO: 601222 - DNA, 25 bp, Rattus norvegicus
tctttttagactatgtatggctgga

SEQ ID NO: 601223 - DNA, 25 bp, Rattus norvegicus
tctttttagactttgtatggctgga

SEQ ID NO: 601224 - DNA, 25 bp, Rattus norvegicus
tctttttcaaatctcccagtggcaa

SEQ ID NO: 601225 - DNA, 25 bp, Rattus norvegicus
tctttttcaaatgtcccagtggcaa

SEQ ID NO: 601226 - DNA, 25 bp, Rattus norvegicus
tctttttcagccaggatgtggagct

SEQ ID NO: 601227 - DNA, 25 bp, Rattus norvegicus
tctttttcagcctggatgtggagct

SEQ ID NO: 601228 - DNA, 25 bp, Rattus norvegicus
tctttttcccttagacgacatcaag

SEQ ID NO: 601229 - DNA, 25 bp, Rattus norvegicus
tctttttccctttgacgacatcaag

SEQ ID NO: 601230 - DNA, 25 bp, Rattus norvegicus
tctttttccttcattacagcatatt

SEQ ID NO: 601231 - DNA, 25 bp, Rattus norvegicus
tctttttccttctttacagcatatt

SEQ ID NO: 601232 - DNA, 25 bp, Rattus norvegicus
tctttttcctttagcatagaatgct

SEQ ID NO: 601233 - DNA, 25 bp, Rattus norvegicus
tctttttccttttgcatagaatgct

SEQ ID NO: 601234 - DNA, 25 bp, Rattus norvegicus
tctttttctactccccaaacacaaa

SEQ ID NO: 601235 - DNA, 25 bp, Rattus norvegicus
tctttttctactgcccaaacacaaa

SEQ ID NO: 601236 - DNA, 25 bp, Rattus norvegicus
tctttttctattcacaggcttgggt

SEQ ID NO: 601237 - DNA, 25 bp, Rattus norvegicus
tctttttctattgacaggcttgggt

SEQ ID NO: 601238 - DNA, 25 bp, Rattus norvegicus
tctttttctcttagcaccttttggt

SEQ ID NO: 601239 - DNA, 25 bp, Rattus norvegicus
tctttttctctttgcaccttttggt

SEQ ID NO: 601240 - DNA, 25 bp, Rattus norvegicus
tctttttctgaacgtgtcccggaga

SEQ ID NO: 601241 - DNA, 25 bp, Rattus norvegicus
tctttttctgaaggtgtcccggaga

SEQ ID NO: 601242 - DNA, 25 bp, Rattus norvegicus
tctttttctgtcattattgcctccc

SEQ ID NO: 601243 - DNA, 25 bp, Rattus norvegicus
tctttttctgtctttattgcctccc

SEQ ID NO: 601244 - DNA, 25 bp, Rattus norvegicus
tctttttctgttacccagttcatta

SEQ ID NO: 601245 - DNA, 25 bp, Rattus norvegicus
tctttttctgtttcccagttcatta

SEQ ID NO: 601246 - DNA, 25 bp, Rattus norvegicus
tctttttgcataactgtggttcctg

SEQ ID NO: 601247 - DNA, 25 bp, Rattus norvegicus
tctttttgcatatctgtggttcctg

SEQ ID NO: 601248 - DNA, 25 bp, Rattus norvegicus
tctttttgccctaaatgcctcgatg

SEQ ID NO: 601249 - DNA, 25 bp, Rattus norvegicus
tctttttgcccttaatgcctcgatg

SEQ ID NO: 601250 - DNA, 25 bp, Rattus norvegicus
tctttttggatcactgtacacttaa

SEQ ID NO: 601251 - DNA, 25 bp, Rattus norvegicus
tctttttggatctctgtacacttaa

SEQ ID NO: 601252 - DNA, 25 bp, Rattus norvegicus
tctttttggcctagattccatgtgg

SEQ ID NO: 601253 - DNA, 25 bp, Rattus norvegicus
tctttttggccttgattccatgtgg

SEQ ID NO: 601254 - DNA, 25 bp, Rattus norvegicus
tctttttgtccactctttggttcct

SEQ ID NO: 601255 - DNA, 25 bp, Rattus norvegicus
tctttttgtccagtctttggttcct

SEQ ID NO: 601256 - DNA, 25 bp, Rattus norvegicus
tctttttgttacatgggcagcctca

SEQ ID NO: 601257 - DNA, 25 bp, Rattus norvegicus
tctttttgttacttgggcagcctca

SEQ ID NO: 601258 - DNA, 25 bp, Rattus norvegicus
tctttttgttctcctatggcagcag

SEQ ID NO: 601259 - DNA, 25 bp, Rattus norvegicus
tctttttgttctgctatggcagcag

SEQ ID NO: 601260 - DNA, 25 bp, Rattus norvegicus
tcttttttaattctggccaatctta

SEQ ID NO: 601261 - DNA, 25 bp, Rattus norvegicus
tcttttttaattgtggccaatctta

SEQ ID NO: 601262 - DNA, 25 bp, Rattus norvegicus
tcttttttacctagagcacttgcct

SEQ ID NO: 601263 - DNA, 25 bp, Rattus norvegicus
tcttttttaccttgagcacttgcct

SEQ ID NO: 601264 - DNA, 25 bp, Rattus norvegicus
tcttttttagctacactgatggcaa

SEQ ID NO: 601265 - DNA, 25 bp, Rattus norvegicus
tcttttttagcttcactgatggcaa

SEQ ID NO: 601266 - DNA, 25 bp, Rattus norvegicus
tcttttttatatattggccaaatgc

SEQ ID NO: 601267 - DNA, 25 bp, Rattus norvegicus
tcttttttatattttggccaaatgc

SEQ ID NO: 601268 - DNA, 25 bp, Rattus norvegicus
tcttttttatttactcgcatttgtg

SEQ ID NO: 601269 - DNA, 25 bp, Rattus norvegicus
tcttttttattttctcgcatttgtg

SEQ ID NO: 601270 - DNA, 25 bp, Rattus norvegicus
tcttttttccccatgtgtatcacta

SEQ ID NO: 601271 - DNA, 25 bp, Rattus norvegicus
tcttttttccccttgtgtatcacta

SEQ ID NO: 601272 - DNA, 25 bp, Rattus norvegicus
tcttttttcttcagtttatgtctgt

SEQ ID NO: 601273 - DNA, 25 bp, Rattus norvegicus
tcttttttcttctgtttatgtctgt

SEQ ID NO: 601274 - DNA, 25 bp, Rattus norvegicus
tcttttttctttcccatacatcttt

SEQ ID NO: 601275 - DNA, 25 bp, Rattus norvegicus
tcttttttctttgccatacatcttt

SEQ ID NO: 601276 - DNA, 25 bp, Rattus norvegicus
tcttttttggcgcacttttcggcat

SEQ ID NO: 601277 - DNA, 25 bp, Rattus norvegicus
tcttttttggcggacttttcggcat

SEQ ID NO: 601278 - DNA, 25 bp, Rattus norvegicus
tcttttttggttcctttctgccctg

SEQ ID NO: 601279 - DNA, 25 bp, Rattus norvegicus
tcttttttggttgctttctgccctg

SEQ ID NO: 601280 - DNA, 25 bp, Rattus norvegicus
tgaaaaaacccactgcgactgcaat

SEQ ID NO: 601281 - DNA, 25 bp, Rattus norvegicus
tgaaaaaacccagtgcgactgcaat

SEQ ID NO: 601282 - DNA, 25 bp, Rattus norvegicus
tgaaaaaactcacctgggcggtggt

SEQ ID NO: 601283 - DNA, 25 bp, Rattus norvegicus
tgaaaaaactcagctgggcggtggt

SEQ ID NO: 601284 - DNA, 25 bp, Rattus norvegicus
tgaaaaacactccactcctgtagaa

SEQ ID NO: 601285 - DNA, 25 bp, Rattus norvegicus
tgaaaaacactcgactcctgtagaa

SEQ ID NO: 601286 - DNA, 25 bp, Rattus norvegicus
tgaaaaactgcaactctccctgtgt

SEQ ID NO: 601287 - DNA, 25 bp, Rattus norvegicus
tgaaaaactgcatctctccctgtgt

SEQ ID NO: 601288 - DNA, 25 bp, Rattus norvegicus
tgaaaaactgtcatcctcctgattc

SEQ ID NO: 601289 - DNA, 25 bp, Rattus norvegicus
tgaaaaactgtcttcctcctgattc

SEQ ID NO: 601290 - DNA, 25 bp, Rattus norvegicus
tgaaaaagacccagcttgacccctt

SEQ ID NO: 601291 - DNA, 25 bp, Rattus norvegicus
tgaaaaagaccctgcttgacccctt

SEQ ID NO: 601292 - DNA, 25 bp, Rattus norvegicus
tgaaaaagaccgaacctgccgctgg

SEQ ID NO: 601293 - DNA, 25 bp, Rattus norvegicus
tgaaaaagaccgtacctgccgctgg

SEQ ID NO: 601294 - DNA, 25 bp, Rattus norvegicus
tgaaaaagccgtcccaccttctggg

SEQ ID NO: 601295 - DNA, 25 bp, Rattus norvegicus
tgaaaaagccgtgccaccttctggg

SEQ ID NO: 601296 - DNA, 25 bp, Rattus norvegicus
tgaaaaagccttagagttctttgct

SEQ ID NO: 601297 - DNA, 25 bp, Rattus norvegicus
tgaaaaagcctttgagttctttgct

SEQ ID NO: 601298 - DNA, 25 bp, Rattus norvegicus
tgaaaaagctaaccctgaaccccag

SEQ ID NO: 601299 - DNA, 25 bp, Rattus norvegicus
tgaaaaagctaagcctgaaccccag

SEQ ID NO: 601300 - DNA, 25 bp, Rattus norvegicus
tgaaaaaggcttcccttgaactgtt

SEQ ID NO: 601301 - DNA, 25 bp, Rattus norvegicus
tgaaaaaggcttgccttgaactgtt

SEQ ID NO: 601302 - DNA, 25 bp, Rattus norvegicus
tgaaaaaggtcgagcttcccagctg

SEQ ID NO: 601303 - DNA, 25 bp, Rattus norvegicus
tgaaaaaggtcgtgcttcccagctg

SEQ ID NO: 601304 - DNA, 25 bp, Rattus norvegicus
tgaaaaagttgtattgggacgatgt

SEQ ID NO: 601305 - DNA, 25 bp, Rattus norvegicus
tgaaaaagttgttttgggacgatgt

SEQ ID NO: 601306 - DNA, 25 bp, Rattus norvegicus
tgaaaaatctgcagttcctgctttg

SEQ ID NO: 601307 - DNA, 25 bp, Rattus norvegicus
tgaaaaatctgctgttcctgctttg

SEQ ID NO: 601308 - DNA, 25 bp, Rattus norvegicus
tgaaaaatgtccacgtggcccctct

SEQ ID NO: 601309 - DNA, 25 bp, Rattus norvegicus
tgaaaaatgtcctcgtggcccctct

SEQ ID NO: 601310 - DNA, 25 bp, Rattus norvegicus
tgaaaaattcccaaaagcccctgag

SEQ ID NO: 601311 - DNA, 25 bp, Rattus norvegicus
tgaaaaattccctaaagcccctgag

SEQ ID NO: 601312 - DNA, 25 bp, Rattus norvegicus
tgaaaaattcctaccatgcatgccc

SEQ ID NO: 601313 - DNA, 25 bp, Rattus norvegicus
tgaaaaattccttccatgcatgccc

SEQ ID NO: 601314 - DNA, 25 bp, Rattus norvegicus
tgaaaacaacacatttctccttccg

SEQ ID NO: 601315 - DNA, 25 bp, Rattus norvegicus
tgaaaacaacacttttctccttccg

SEQ ID NO: 601316 - DNA, 25 bp, Rattus norvegicus
tgaaaacaaccaatcctctagcttc

SEQ ID NO: 601317 - DNA, 25 bp, Rattus norvegicus
tgaaaacaaccattcctctagcttc

SEQ ID NO: 601318 - DNA, 25 bp, Rattus norvegicus
tgaaaacaagttctctttggtctgg

SEQ ID NO: 601319 - DNA, 25 bp, Rattus norvegicus
tgaaaacaagttgtctttggtctgg

SEQ ID NO: 601320 - DNA, 25 bp, Rattus norvegicus
tgaaaacactttaccctcatcctta

SEQ ID NO: 601321 - DNA, 25 bp, Rattus norvegicus
tgaaaacacttttccctcatcctta

SEQ ID NO: 601322 - DNA, 25 bp, Rattus norvegicus
tgaaaacagactccacgtccgtgtc

SEQ ID NO: 601323 - DNA, 25 bp, Rattus norvegicus
tgaaaacagactgcacgtccgtgtc

SEQ ID NO: 601324 - DNA, 25 bp, Rattus norvegicus
tgaaaacagttgagtgcacacagtt

SEQ ID NO: 601325 - DNA, 25 bp, Rattus norvegicus
tgaaaacagttgtgtgcacacagtt

SEQ ID NO: 601326 - DNA, 25 bp, Rattus norvegicus
tgaaaacattgtaaacttaagccct

SEQ ID NO: 601327 - DNA, 25 bp, Rattus norvegicus
tgaaaacattgttaacttaagccct

SEQ ID NO: 601328 - DNA, 25 bp, Rattus norvegicus
tgaaaacatttaccatgcacacatg

SEQ ID NO: 601329 - DNA, 25 bp, Rattus norvegicus
tgaaaacatttagcatgcacacatg

SEQ ID NO: 601330 - DNA, 25 bp, Rattus norvegicus
tgaaaaccaagaacctcagcctgtc

SEQ ID NO: 601331 - DNA, 25 bp, Rattus norvegicus
tgaaaaccaagatcctcagcctgtc

SEQ ID NO: 601332 - DNA, 25 bp, Rattus norvegicus
tgaaaaccacttcatacgctcagca

SEQ ID NO: 601333 - DNA, 25 bp, Rattus norvegicus
tgaaaaccacttgatacgctcagca

SEQ ID NO: 601334 - DNA, 25 bp, Rattus norvegicus
tgaaaacccaaaatttgaaggcctg

SEQ ID NO: 601335 - DNA, 25 bp, Rattus norvegicus
tgaaaacccaaaccctattccatag

SEQ ID NO: 601336 - DNA, 25 bp, Rattus norvegicus
tgaaaacccaaagcctattccatag

SEQ ID NO: 601337 - DNA, 25 bp, Rattus norvegicus
tgaaaacccaaattttgaaggcctg

SEQ ID NO: 601338 - DNA, 25 bp, Rattus norvegicus
tgaaaacccacgcactcaaaacagt

SEQ ID NO: 601339 - DNA, 25 bp, Rattus norvegicus
tgaaaacccacggactcaaaacagt

SEQ ID NO: 601340 - DNA, 25 bp, Rattus norvegicus
tgaaaacccatcactgttgtccaag

SEQ ID NO: 601341 - DNA, 25 bp, Rattus norvegicus
tgaaaacccatctctgttgtccaag

SEQ ID NO: 601342 - DNA, 25 bp, Rattus norvegicus
tgaaaaccccagattatcctcgtca

SEQ ID NO: 601343 - DNA, 25 bp, Rattus norvegicus
tgaaaaccccagtttatcctcgtca

SEQ ID NO: 601344 - DNA, 25 bp, Rattus norvegicus
tgaaaacccgccctgggtgggcaag

SEQ ID NO: 601345 - DNA, 25 bp, Rattus norvegicus
tgaaaacccgccgtgggtgggcaag

SEQ ID NO: 601346 - DNA, 25 bp, Rattus norvegicus
tgaaaaccctgaatcctaccttgga

SEQ ID NO: 601347 - DNA, 25 bp, Rattus norvegicus
tgaaaaccctgattcctaccttgga

SEQ ID NO: 601348 - DNA, 25 bp, Rattus norvegicus
tgaaaacctgaaactagccacgtcc

SEQ ID NO: 601349 - DNA, 25 bp, Rattus norvegicus
tgaaaacctgaatctagccacgtcc

SEQ ID NO: 601350 - DNA, 25 bp, Rattus norvegicus
tgaaaacctggaatttgccaccttc

SEQ ID NO: 601351 - DNA, 25 bp, Rattus norvegicus
tgaaaacctggattttgccaccttc

SEQ ID NO: 601352 - DNA, 25 bp, Rattus norvegicus
tgaaaacctgtacctgggaactgat

SEQ ID NO: 601353 - DNA, 25 bp, Rattus norvegicus
tgaaaacctgtagctgggaactgat

SEQ ID NO: 601354 - DNA, 25 bp, Rattus norvegicus
tgaaaacgtgaactcccagggctag

SEQ ID NO: 601355 - DNA, 25 bp, Rattus norvegicus
tgaaaacgtgaagtcccagggctag

SEQ ID NO: 601356 - DNA, 25 bp, Rattus norvegicus
tgaaaactcattactttctcctggt

SEQ ID NO: 601357 - DNA, 25 bp, Rattus norvegicus
tgaaaactcatttctttctcctggt

SEQ ID NO: 601358 - DNA, 25 bp, Rattus norvegicus
tgaaaactcgagactgacttcttcc

SEQ ID NO: 601359 - DNA, 25 bp, Rattus norvegicus
tgaaaactcgagtctgacttcttcc

SEQ ID NO: 601360 - DNA, 25 bp, Rattus norvegicus
tgaaaactgcccagccctgatttag

SEQ ID NO: 601361 - DNA, 25 bp, Rattus norvegicus
tgaaaactgccctgccctgatttag

SEQ ID NO: 601362 - DNA, 25 bp, Rattus norvegicus
tgaaaactgggaaaaactctcacct

SEQ ID NO: 601363 - DNA, 25 bp, Rattus norvegicus
tgaaaactgggataaactctcacct

SEQ ID NO: 601364 - DNA, 25 bp, Rattus norvegicus
tgaaaacttcgcaggctacggagcc

SEQ ID NO: 601365 - DNA, 25 bp, Rattus norvegicus
tgaaaacttcgctggctacggagcc

SEQ ID NO: 601366 - DNA, 25 bp, Rattus norvegicus
tgaaaactttcaagcggccatctcc

SEQ ID NO: 601367 - DNA, 25 bp, Rattus norvegicus
tgaaaactttcatgcggccatctcc

SEQ ID NO: 601368 - DNA, 25 bp, Rattus norvegicus
tgaaaactttggctgctgtctgcat

SEQ ID NO: 601369 - DNA, 25 bp, Rattus norvegicus
tgaaaactttgggtgctgtctgcat

SEQ ID NO: 601370 - DNA, 25 bp, Rattus norvegicus
tgaaaactttttcctactttagcag

SEQ ID NO: 601371 - DNA, 25 bp, Rattus norvegicus
tgaaaactttttgctactttagcag

SEQ ID NO: 601372 - DNA, 25 bp, Rattus norvegicus
tgaaaagaacccctaagcctcatct

SEQ ID NO: 601373 - DNA, 25 bp, Rattus norvegicus
tgaaaagaacccgtaagcctcatct

SEQ ID NO: 601374 - DNA, 25 bp, Rattus norvegicus
tgaaaagacagtagtgcctgcaggg

SEQ ID NO: 601375 - DNA, 25 bp, Rattus norvegicus
tgaaaagacagttgtgcctgcaggg

SEQ ID NO: 601376 - DNA, 25 bp, Rattus norvegicus
tgaaaagacgctatgcaccagctgc

SEQ ID NO: 601377 - DNA, 25 bp, Rattus norvegicus
tgaaaagacgctttgcaccagctgc

SEQ ID NO: 601378 - DNA, 25 bp, Rattus norvegicus
tgaaaagcaagtataccctcaaagt

SEQ ID NO: 601379 - DNA, 25 bp, Rattus norvegicus
tgaaaagcaagtttaccctcaaagt

SEQ ID NO: 601380 - DNA, 25 bp, Rattus norvegicus
tgaaaagcagccctcctgcgaagcc

SEQ ID NO: 601381 - DNA, 25 bp, Rattus norvegicus
tgaaaagcagccgtcctgcgaagcc

SEQ ID NO: 601382 - DNA, 25 bp, Rattus norvegicus
tgaaaagcatacacccgcaggctgc

SEQ ID NO: 601383 - DNA, 25 bp, Rattus norvegicus
tgaaaagcatactcccgcaggctgc

SEQ ID NO: 601384 - DNA, 25 bp, Rattus norvegicus
tgaaaagcatccaaacagtctgtgc

SEQ ID NO: 601385 - DNA, 25 bp, Rattus norvegicus
tgaaaagcatcctaacagtctgtgc

SEQ ID NO: 601386 - DNA, 25 bp, Rattus norvegicus
tgaaaagcatgtctgggccttgacc

SEQ ID NO: 601387 - DNA, 25 bp, Rattus norvegicus
tgaaaagcatgtgtgggccttgacc

SEQ ID NO: 601388 - DNA, 25 bp, Rattus norvegicus
tgaaaagccaacatagtgtccactt

SEQ ID NO: 601389 - DNA, 25 bp, Rattus norvegicus
tgaaaagccaacttagtgtccactt

SEQ ID NO: 601390 - DNA, 25 bp, Rattus norvegicus
tgaaaagccagcctcacggcagagg

SEQ ID NO: 601391 - DNA, 25 bp, Rattus norvegicus
tgaaaagccagcgtcacggcagagg

SEQ ID NO: 601392 - DNA, 25 bp, Rattus norvegicus
tgaaaagcccaaattcctgtcctga

SEQ ID NO: 601393 - DNA, 25 bp, Rattus norvegicus
tgaaaagcccaatttcctgtcctga

SEQ ID NO: 601394 - DNA, 25 bp, Rattus norvegicus
tgaaaagccgcaagtcatcgcagac

SEQ ID NO: 601395 - DNA, 25 bp, Rattus norvegicus
tgaaaagccgcatgtcatcgcagac

SEQ ID NO: 601396 - DNA, 25 bp, Rattus norvegicus
tgaaaagcctcactgttcgcctgtc

SEQ ID NO: 601397 - DNA, 25 bp, Rattus norvegicus
tgaaaagcctcagtgttcgcctgtc

SEQ ID NO: 601398 - DNA, 25 bp, Rattus norvegicus
tgaaaagctcttactctctgtgaaa

SEQ ID NO: 601399 - DNA, 25 bp, Rattus norvegicus
tgaaaagctctttctctctgtgaaa

SEQ ID NO: 601400 - DNA, 25 bp, Rattus norvegicus
tgaaaagctgcccttgatctcaacc

SEQ ID NO: 601401 - DNA, 25 bp, Rattus norvegicus
tgaaaagctgccgttgatctcaacc

SEQ ID NO: 601402 - DNA, 25 bp, Rattus norvegicus
tgaaaagctgctatctcttggaaat

SEQ ID NO: 601403 - DNA, 25 bp, Rattus norvegicus
tgaaaagctgctttctcttggaaat

SEQ ID NO: 601404 - DNA, 25 bp, Rattus norvegicus
tgaaaagctgtgacctcgaggttta

SEQ ID NO: 601405 - DNA, 25 bp, Rattus norvegicus
tgaaaagctgtgtcctcgaggttta

SEQ ID NO: 601406 - DNA, 25 bp, Rattus norvegicus
tgaaaagcttgacctgcctgcgaca

SEQ ID NO: 601407 - DNA, 25 bp, Rattus norvegicus
tgaaaagcttgagctgcctgcgaca

SEQ ID NO: 601408 - DNA, 25 bp, Rattus norvegicus
tgaaaaggacccagctcctgcatga

SEQ ID NO: 601409 - DNA, 25 bp, Rattus norvegicus
tgaaaaggaccctgctcctgcatga

SEQ ID NO: 601410 - DNA, 25 bp, Rattus norvegicus
tgaaaaggcaccagtcccacccatt

SEQ ID NO: 601411 - DNA, 25 bp, Rattus norvegicus
tgaaaaggcacctgtcccacccatt

SEQ ID NO: 601412 - DNA, 25 bp, Rattus norvegicus
tgaaaaggctctactctaccagtac

SEQ ID NO: 601413 - DNA, 25 bp, Rattus norvegicus
tgaaaaggctcttctctaccagtac

SEQ ID NO: 601414 - DNA, 25 bp, Rattus norvegicus
tgaaaagggtgtctgagaacctacc

SEQ ID NO: 601415 - DNA, 25 bp, Rattus norvegicus
tgaaaagggtgtgtgagaacctacc

SEQ ID NO: 601416 - DNA, 25 bp, Rattus norvegicus
tgaaaaggtcatcctggaaggcccc

SEQ ID NO: 601417 - DNA, 25 bp, Rattus norvegicus
tgaaaaggtcatgctggaaggcccc

SEQ ID NO: 601418 - DNA, 25 bp, Rattus norvegicus
tgaaaagtaagtccccttccatccc

SEQ ID NO: 601419 - DNA, 25 bp, Rattus norvegicus
tgaaaagtaagtgcccttccatccc

SEQ ID NO: 601420 - DNA, 25 bp, Rattus norvegicus
tgaaaagtactacccctacattcct

SEQ ID NO: 601421 - DNA, 25 bp, Rattus norvegicus
tgaaaagtactagccctacattcct

SEQ ID NO: 601422 - DNA, 25 bp, Rattus norvegicus
tgaaaagtatctccccttcctacaa

SEQ ID NO: 601423 - DNA, 25 bp, Rattus norvegicus
tgaaaagtatctgcccttcctacaa

SEQ ID NO: 601424 - DNA, 25 bp, Rattus norvegicus
tgaaaagtcctgctgtctcagcgcc

SEQ ID NO: 601425 - DNA, 25 bp, Rattus norvegicus
tgaaaagtcctggtgtctcagcgcc

SEQ ID NO: 601426 - DNA, 25 bp, Rattus norvegicus
tgaaaagtccttagacacgtcaacg

SEQ ID NO: 601427 - DNA, 25 bp, Rattus norvegicus
tgaaaagtcctttgacacgtcaacg

SEQ ID NO: 601428 - DNA, 25 bp, Rattus norvegicus
tgaaaagtctccatctggttccaaa

SEQ ID NO: 601429 - DNA, 25 bp, Rattus norvegicus
tgaaaagtctccttctggttccaaa

SEQ ID NO: 601430 - DNA, 25 bp, Rattus norvegicus
tgaaaagtgttacagcagctgggct

SEQ ID NO: 601431 - DNA, 25 bp, Rattus norvegicus
tgaaaagtgttagagcagctgggct

SEQ ID NO: 601432 - DNA, 25 bp, Rattus norvegicus
tgaaaagttaacaccttccctgcca

SEQ ID NO: 601433 - DNA, 25 bp, Rattus norvegicus
tgaaaagttaactccttccctgcca

SEQ ID NO: 601434 - DNA, 25 bp, Rattus norvegicus
tgaaaagttcgtcctttctgcccac

SEQ ID NO: 601435 - DNA, 25 bp, Rattus norvegicus
tgaaaagttcgtgctttctgcccac

SEQ ID NO: 601436 - DNA, 25 bp, Rattus norvegicus
tgaaaagtttgaccaaaagcctggc

SEQ ID NO: 601437 - DNA, 25 bp, Rattus norvegicus
tgaaaagtttgagcaaaagcctggc

SEQ ID NO: 601438 - DNA, 25 bp, Rattus norvegicus
tgaaaagttttcactattgtaaaat

SEQ ID NO: 601439 - DNA, 25 bp, Rattus norvegicus
tgaaaagttttctctattgtaaaat

SEQ ID NO: 601440 - DNA, 25 bp, Rattus norvegicus
tgaaaataggacagacacacacaca

SEQ ID NO: 601441 - DNA, 25 bp, Rattus norvegicus
tgaaaataggactgacacacacaca

SEQ ID NO: 601442 - DNA, 25 bp, Rattus norvegicus
tgaaaatatggccatcgtgaccgtg

SEQ ID NO: 601443 - DNA, 25 bp, Rattus norvegicus
tgaaaatatggcgatcgtgaccgtg

SEQ ID NO: 601444 - DNA, 25 bp, Rattus norvegicus
tgaaaatccaaaccttccattcctt

SEQ ID NO: 601445 - DNA, 25 bp, Rattus norvegicus
tgaaaatccaaagcttccattcctt

SEQ ID NO: 601446 - DNA, 25 bp, Rattus norvegicus
tgaaaatccgctattacatgcctgt

SEQ ID NO: 601447 - DNA, 25 bp, Rattus norvegicus
tgaaaatccgcttttacatgcctgt

SEQ ID NO: 601448 - DNA, 25 bp, Rattus norvegicus
tgaaaatcctcaataccagtctcca

SEQ ID NO: 601449 - DNA, 25 bp, Rattus norvegicus
tgaaaatcctcattaccagtctcca

SEQ ID NO: 601450 - DNA, 25 bp, Rattus norvegicus
tgaaaatcctgaatgctgtctgcgt

SEQ ID NO: 601451 - DNA, 25 bp, Rattus norvegicus
tgaaaatcctgattgctgtctgcgt

SEQ ID NO: 601452 - DNA, 25 bp, Rattus norvegicus
tgaaaatcctgccacagccaacagc

SEQ ID NO: 601453 - DNA, 25 bp, Rattus norvegicus
tgaaaatcctgcgacagccaacagc

SEQ ID NO: 601454 - DNA, 25 bp, Rattus norvegicus
tgaaaatccttcatgcggtgactga

SEQ ID NO: 601455 - DNA, 25 bp, Rattus norvegicus
tgaaaatccttcttgcggtgactga

SEQ ID NO: 601456 - DNA, 25 bp, Rattus norvegicus
tgaaaatgcaggaggctctgcctcc

SEQ ID NO: 601457 - DNA, 25 bp, Rattus norvegicus
tgaaaatgcaggtggctctgcctcc

SEQ ID NO: 601458 - DNA, 25 bp, Rattus norvegicus
tgaaaatgcagtacagatcaggatg

SEQ ID NO: 601459 - DNA, 25 bp, Rattus norvegicus
tgaaaatgcagttcagatcaggatg

SEQ ID NO: 601460 - DNA, 25 bp, Rattus norvegicus
tgaaaatgcccactcacgcatgtgg

SEQ ID NO: 601461 - DNA, 25 bp, Rattus norvegicus
tgaaaatgcccagtcacgcatgtgg

SEQ ID NO: 601462 - DNA, 25 bp, Rattus norvegicus
tgaaaatgctatagcccaagtggct

SEQ ID NO: 601463 - DNA, 25 bp, Rattus norvegicus
tgaaaatgctattgcccaagtggct

SEQ ID NO: 601464 - DNA, 25 bp, Rattus norvegicus
tgaaaatggactactttctctcccc

SEQ ID NO: 601465 - DNA, 25 bp, Rattus norvegicus
tgaaaatggacttctttctctcccc

SEQ ID NO: 601466 - DNA, 25 bp, Rattus norvegicus
tgaaaatggcttccctgtccacttt

SEQ ID NO: 601467 - DNA, 25 bp, Rattus norvegicus
tgaaaatggcttgcctgtccacttt

SEQ ID NO: 601468 - DNA, 25 bp, Rattus norvegicus
tgaaaatgtaacattcctcacagca

SEQ ID NO: 601469 - DNA, 25 bp, Rattus norvegicus
tgaaaatgtaactttcctcacagca

SEQ ID NO: 601470 - DNA, 25 bp, Rattus norvegicus
tgaaaatgtaccatggtgcacccct

SEQ ID NO: 601471 - DNA, 25 bp, Rattus norvegicus
tgaaaatgtaccttggtgcacccct

SEQ ID NO: 601472 - DNA, 25 bp, Rattus norvegicus
tgaaaatgtcacagtgtcacccatt

SEQ ID NO: 601473 - DNA, 25 bp, Rattus norvegicus
tgaaaatgtcacctttcacgctctt

SEQ ID NO: 601474 - DNA, 25 bp, Rattus norvegicus
tgaaaatgtcacgtttcacgctctt

SEQ ID NO: 601475 - DNA, 25 bp, Rattus norvegicus
tgaaaatgtcactgtgtcacccatt

SEQ ID NO: 601476 - DNA, 25 bp, Rattus norvegicus
tgaaaatgtcatcggagccctgctc

SEQ ID NO: 601477 - DNA, 25 bp, Rattus norvegicus
tgaaaatgtcatgggagccctgctc

SEQ ID NO: 601478 - DNA, 25 bp, Rattus norvegicus
tgaaaatgtccaacagcggagctgg

SEQ ID NO: 601479 - DNA, 25 bp, Rattus norvegicus
tgaaaatgtccaccacgaagcacca

SEQ ID NO: 601480 - DNA, 25 bp, Rattus norvegicus
tgaaaatgtccagcacgaagcacca

SEQ ID NO: 601481 - DNA, 25 bp, Rattus norvegicus
tgaaaatgtccatcagcggagctgg

SEQ ID NO: 601482 - DNA, 25 bp, Rattus norvegicus
tgaaaatgtgtccagtgccgcctta

SEQ ID NO: 601483 - DNA, 25 bp, Rattus norvegicus
tgaaaatgtgtcgagtgccgcctta

SEQ ID NO: 601484 - DNA, 25 bp, Rattus norvegicus
tgaaaatgtttcactcgttcctgcc

SEQ ID NO: 601485 - DNA, 25 bp, Rattus norvegicus
tgaaaatgtttctctcgttcctgcc

SEQ ID NO: 601486 - DNA, 25 bp, Rattus norvegicus
tgaaaatgtttgatctttacctcga

SEQ ID NO: 601487 - DNA, 25 bp, Rattus norvegicus
tgaaaatgtttgttctttacctcga

SEQ ID NO: 601488 - DNA, 25 bp, Rattus norvegicus
tgaaaattcagacagggacagtatc

SEQ ID NO: 601489 - DNA, 25 bp, Rattus norvegicus
tgaaaattcagagagggacagtatc

SEQ ID NO: 601490 - DNA, 25 bp, Rattus norvegicus
tgaaaattccaaagtcctgcccttt

SEQ ID NO: 601491 - DNA, 25 bp, Rattus norvegicus
tgaaaattccaatgtcctgcccttt

SEQ ID NO: 601492 - DNA, 25 bp, Rattus norvegicus
tgaaaattcctacccctctttctgg

SEQ ID NO: 601493 - DNA, 25 bp, Rattus norvegicus
tgaaaattcctagccctctttctgg

SEQ ID NO: 601494 - DNA, 25 bp, Rattus norvegicus
tgaaaattctatacccacttcctgc

SEQ ID NO: 601495 - DNA, 25 bp, Rattus norvegicus
tgaaaattctattcccacttcctgc

SEQ ID NO: 601496 - DNA, 25 bp, Rattus norvegicus
tgaaaattcttacttgtctgccttt

SEQ ID NO: 601497 - DNA, 25 bp, Rattus norvegicus
tgaaaattcttagttgtctgccttt

SEQ ID NO: 601498 - DNA, 25 bp, Rattus norvegicus
tgaaaattgcttagatcgcgcatga

SEQ ID NO: 601499 - DNA, 25 bp, Rattus norvegicus
tgaaaattgctttgatcgcgcatga

SEQ ID NO: 601500 - DNA, 25 bp, Rattus norvegicus
tgaaaattgtcactcacctcatggg

SEQ ID NO: 601501 - DNA, 25 bp, Rattus norvegicus
tgaaaattgtcagtcacctcatggg

SEQ ID NO: 601502 - DNA, 25 bp, Rattus norvegicus
tgaaaattgtgcctcaccctaactg

SEQ ID NO: 601503 - DNA, 25 bp, Rattus norvegicus
tgaaaattgtgcgtcaccctaactg

SEQ ID NO: 601504 - DNA, 25 bp, Rattus norvegicus
tgaaaatttcagaccctcctttcct

SEQ ID NO: 601505 - DNA, 25 bp, Rattus norvegicus
tgaaaatttcagtccctcctttcct

SEQ ID NO: 601506 - DNA, 25 bp, Rattus norvegicus
tgaaacaaactcattgagccccagc

SEQ ID NO: 601507 - DNA, 25 bp, Rattus norvegicus
tgaaacaaactctttgagccccagc

SEQ ID NO: 601508 - DNA, 25 bp, Rattus norvegicus
tgaaacaaagccactctggcctgga

SEQ ID NO: 601509 - DNA, 25 bp, Rattus norvegicus
tgaaacaaagcctctctggcctgga

SEQ ID NO: 601510 - DNA, 25 bp, Rattus norvegicus
tgaaacaacgcaatggagctccttg

SEQ ID NO: 601511 - DNA, 25 bp, Rattus norvegicus
tgaaacaacgcattggagctccttg

SEQ ID NO: 601512 - DNA, 25 bp, Rattus norvegicus
tgaaacaactggataaaagcctttg

SEQ ID NO: 601513 - DNA, 25 bp, Rattus norvegicus
tgaaacaactggttaaaagcctttg

SEQ ID NO: 601514 - DNA, 25 bp, Rattus norvegicus
tgaaacaacttaagcacctccggga

SEQ ID NO: 601515 - DNA, 25 bp, Rattus norvegicus
tgaaacaacttatgcacctccggga

SEQ ID NO: 601516 - DNA, 25 bp, Rattus norvegicus
tgaaacaatattcccacagagtgag

SEQ ID NO: 601517 - DNA, 25 bp, Rattus norvegicus
tgaaacaatattgccacagagtgag

SEQ ID NO: 601518 - DNA, 25 bp, Rattus norvegicus
tgaaacacctttcccttttgggaat

SEQ ID NO: 601519 - DNA, 25 bp, Rattus norvegicus
tgaaacacctttgccttttgggaat

SEQ ID NO: 601520 - DNA, 25 bp, Rattus norvegicus
tgaaacactgaccacactggcctaa

SEQ ID NO: 601521 - DNA, 25 bp, Rattus norvegicus
tgaaacactgacgacactggcctaa

SEQ ID NO: 601522 - DNA, 25 bp, Rattus norvegicus
tgaaacacttgaagcagcaccatca

SEQ ID NO: 601523 - DNA, 25 bp, Rattus norvegicus
tgaaacacttgatgcagcaccatca

SEQ ID NO: 601524 - DNA, 25 bp, Rattus norvegicus
tgaaacactttgatttggcctgccc

SEQ ID NO: 601525 - DNA, 25 bp, Rattus norvegicus
tgaaacactttgctgcaccatccct

SEQ ID NO: 601526 - DNA, 25 bp, Rattus norvegicus
tgaaacactttggtgcaccatccct

SEQ ID NO: 601527 - DNA, 25 bp, Rattus norvegicus
tgaaacactttgttttggcctgccc

SEQ ID NO: 601528 - DNA, 25 bp, Rattus norvegicus
tgaaacacttttaaggcttgttccg

SEQ ID NO: 601529 - DNA, 25 bp, Rattus norvegicus
tgaaacactttttaggcttgttccg

SEQ ID NO: 601530 - DNA, 25 bp, Rattus norvegicus
tgaaacagaagaagcagccccacct

SEQ ID NO: 601531 - DNA, 25 bp, Rattus norvegicus
tgaaacagaagatgcagccccacct

SEQ ID NO: 601532 - DNA, 25 bp, Rattus norvegicus
tgaaacagccaaacaaccccaaata

SEQ ID NO: 601533 - DNA, 25 bp, Rattus norvegicus
tgaaacagccaatcaaccccaaata

SEQ ID NO: 601534 - DNA, 25 bp, Rattus norvegicus
tgaaacagcgctcgagtccttgcac

SEQ ID NO: 601535 - DNA, 25 bp, Rattus norvegicus
tgaaacagcgctggagtccttgcac

SEQ ID NO: 601536 - DNA, 25 bp, Rattus norvegicus
tgaaacaggcgcactcggagtcgag

SEQ ID NO: 601537 - DNA, 25 bp, Rattus norvegicus
tgaaacaggcgctctcggagtcgag

SEQ ID NO: 601538 - DNA, 25 bp, Rattus norvegicus
tgaaacaggctaacctgaccactgg

SEQ ID NO: 601539 - DNA, 25 bp, Rattus norvegicus
tgaaacaggctatcctgaccactgg

SEQ ID NO: 601540 - DNA, 25 bp, Rattus norvegicus
tgaaacagggctcgagacattgctc

SEQ ID NO: 601541 - DNA, 25 bp, Rattus norvegicus
tgaaacagggctggagacattgctc

SEQ ID NO: 601542 - DNA, 25 bp, Rattus norvegicus
tgaaacagtctgatacctcatccct

SEQ ID NO: 601543 - DNA, 25 bp, Rattus norvegicus
tgaaacagtctgttacctcatccct

SEQ ID NO: 601544 - DNA, 25 bp, Rattus norvegicus
tgaaacagttccctacagggtattt

SEQ ID NO: 601545 - DNA, 25 bp, Rattus norvegicus
tgaaacagttccgtacagggtattt

SEQ ID NO: 601546 - DNA, 25 bp, Rattus norvegicus
tgaaacagttctcgttgttcctggg

SEQ ID NO: 601547 - DNA, 25 bp, Rattus norvegicus
tgaaacagttctggttgttcctggg

SEQ ID NO: 601548 - DNA, 25 bp, Rattus norvegicus
tgaaacagtttgattcacgccgttg

SEQ ID NO: 601549 - DNA, 25 bp, Rattus norvegicus
tgaaacagtttgtttcacgccgttg

SEQ ID NO: 601550 - DNA, 25 bp, Rattus norvegicus
tgaaacatccagacatcctctaaca

SEQ ID NO: 601551 - DNA, 25 bp, Rattus norvegicus
tgaaacatccagacttcggccaggt

SEQ ID NO: 601552 - DNA, 25 bp, Rattus norvegicus
tgaaacatccagctcccttcttgga

SEQ ID NO: 601553 - DNA, 25 bp, Rattus norvegicus
tgaaacatccaggtcccttcttgga

SEQ ID NO: 601554 - DNA, 25 bp, Rattus norvegicus
tgaaacatccagtcatcctctaaca

SEQ ID NO: 601555 - DNA, 25 bp, Rattus norvegicus
tgaaacatccagtcttcggccaggt

SEQ ID NO: 601556 - DNA, 25 bp, Rattus norvegicus
tgaaacatgcttacagatctgtcta

SEQ ID NO: 601557 - DNA, 25 bp, Rattus norvegicus
tgaaacatgctttcagatctgtcta

SEQ ID NO: 601558 - DNA, 25 bp, Rattus norvegicus
tgaaacatggacagatggccccaag

SEQ ID NO: 601559 - DNA, 25 bp, Rattus norvegicus
tgaaacatggactgatggccccaag

SEQ ID NO: 601560 - DNA, 25 bp, Rattus norvegicus
tgaaacattactcttgcactgctgg

SEQ ID NO: 601561 - DNA, 25 bp, Rattus norvegicus
tgaaacattactgttgcactgctgg

SEQ ID NO: 601562 - DNA, 25 bp, Rattus norvegicus
tgaaacattagtatttgggttcttg

SEQ ID NO: 601563 - DNA, 25 bp, Rattus norvegicus
tgaaacattagtttttgggttcttg

SEQ ID NO: 601564 - DNA, 25 bp, Rattus norvegicus
tgaaacattatgactgttcagtctg

SEQ ID NO: 601565 - DNA, 25 bp, Rattus norvegicus
tgaaacattatgtctgttcagtctg

SEQ ID NO: 601566 - DNA, 25 bp, Rattus norvegicus
tgaaacattccgacccatgtatcag

SEQ ID NO: 601567 - DNA, 25 bp, Rattus norvegicus
tgaaacattccgtcccatgtatcag

SEQ ID NO: 601568 - DNA, 25 bp, Rattus norvegicus
tgaaacattctactgagcctgagcc

SEQ ID NO: 601569 - DNA, 25 bp, Rattus norvegicus
tgaaacattctagtgagcctgagcc

SEQ ID NO: 601570 - DNA, 25 bp, Rattus norvegicus
tgaaacatttcactattgggtaaga

SEQ ID NO: 601571 - DNA, 25 bp, Rattus norvegicus
tgaaacatttcagtattgggtaaga

SEQ ID NO: 601572 - DNA, 25 bp, Rattus norvegicus
tgaaaccaacagcacatctactcgt

SEQ ID NO: 601573 - DNA, 25 bp, Rattus norvegicus
tgaaaccaacaggacatctactcgt

SEQ ID NO: 601574 - DNA, 25 bp, Rattus norvegicus
tgaaaccaatcaaagccaagcccca

SEQ ID NO: 601575 - DNA, 25 bp, Rattus norvegicus
tgaaaccaatcatagccaagcccca

SEQ ID NO: 601576 - DNA, 25 bp, Rattus norvegicus
tgaaaccacactcctgacagccaag

SEQ ID NO: 601577 - DNA, 25 bp, Rattus norvegicus
tgaaaccacactgctgacagccaag

SEQ ID NO: 601578 - DNA, 25 bp, Rattus norvegicus
tgaaaccacctcagtaaagtaggag

SEQ ID NO: 601579 - DNA, 25 bp, Rattus norvegicus
tgaaaccacctctgtaaagtaggag

SEQ ID NO: 601580 - DNA, 25 bp, Rattus norvegicus
tgaaaccactggagcctacacacat

SEQ ID NO: 601581 - DNA, 25 bp, Rattus norvegicus
tgaaaccactggtgcctacacacat

SEQ ID NO: 601582 - DNA, 25 bp, Rattus norvegicus
tgaaaccagattaaccttcccaaag

SEQ ID NO: 601583 - DNA, 25 bp, Rattus norvegicus
tgaaaccagatttaccttcccaaag

SEQ ID NO: 601584 - DNA, 25 bp, Rattus norvegicus
tgaaaccaggtgactgagtcgccct

SEQ ID NO: 601585 - DNA, 25 bp, Rattus norvegicus
tgaaaccaggtgtctgagtcgccct

SEQ ID NO: 601586 - DNA, 25 bp, Rattus norvegicus
tgaaaccagtctcggttggtgcaga

SEQ ID NO: 601587 - DNA, 25 bp, Rattus norvegicus
tgaaaccagtctgggttggtgcaga

SEQ ID NO: 601588 - DNA, 25 bp, Rattus norvegicus
tgaaaccatccaatgctctgttgtt

SEQ ID NO: 601589 - DNA, 25 bp, Rattus norvegicus
tgaaaccatccattgctctgttgtt

SEQ ID NO: 601590 - DNA, 25 bp, Rattus norvegicus
tgaaaccatgctccccaacgaagtg

SEQ ID NO: 601591 - DNA, 25 bp, Rattus norvegicus
tgaaaccatgctgcccaacgaagtg

SEQ ID NO: 601592 - DNA, 25 bp, Rattus norvegicus
tgaaaccattcaccaggtatacgct

SEQ ID NO: 601593 - DNA, 25 bp, Rattus norvegicus
tgaaaccattcagcaggtatacgct

SEQ ID NO: 601594 - DNA, 25 bp, Rattus norvegicus
tgaaacccaacacgattttggccct

SEQ ID NO: 601595 - DNA, 25 bp, Rattus norvegicus
tgaaacccaacaggattttggccct

SEQ ID NO: 601596 - DNA, 25 bp, Rattus norvegicus
tgaaacccacccatggcactgggag

SEQ ID NO: 601597 - DNA, 25 bp, Rattus norvegicus
tgaaacccacccttggcactgggag

SEQ ID NO: 601598 - DNA, 25 bp, Rattus norvegicus
tgaaacccattgagactggatttgg

SEQ ID NO: 601599 - DNA, 25 bp, Rattus norvegicus
tgaaacccattgtgactggatttgg

SEQ ID NO: 601600 - DNA, 25 bp, Rattus norvegicus
tgaaaccccaaacccgaggctggag

SEQ ID NO: 601601 - DNA, 25 bp, Rattus norvegicus
tgaaaccccaaagccgaggctggag

SEQ ID NO: 601602 - DNA, 25 bp, Rattus norvegicus
tgaaaccccaagatgatgtgtgtcc

SEQ ID NO: 601603 - DNA, 25 bp, Rattus norvegicus
tgaaaccccaagttgatgtgtgtcc

SEQ ID NO: 601604 - DNA, 25 bp, Rattus norvegicus
tgaaaccccgttcggcagagatcat

SEQ ID NO: 601605 - DNA, 25 bp, Rattus norvegicus
tgaaaccccgttgggcagagatcat

SEQ ID NO: 601606 - DNA, 25 bp, Rattus norvegicus
tgaaacccctgtcctgagatcaaca

SEQ ID NO: 601607 - DNA, 25 bp, Rattus norvegicus
tgaaacccctgtgctgagatcaaca

SEQ ID NO: 601608 - DNA, 25 bp, Rattus norvegicus
tgaaaccccttcagttacttgttca

SEQ ID NO: 601609 - DNA, 25 bp, Rattus norvegicus
tgaaaccccttctgttacttgttca

SEQ ID NO: 601610 - DNA, 25 bp, Rattus norvegicus
tgaaacccgggcactgtgacttggg

SEQ ID NO: 601611 - DNA, 25 bp, Rattus norvegicus
tgaaacccgggctctgtgacttggg

SEQ ID NO: 601612 - DNA, 25 bp, Rattus norvegicus
tgaaaccctatactgccattcatag

SEQ ID NO: 601613 - DNA, 25 bp, Rattus norvegicus
tgaaaccctatagtgccattcatag

SEQ ID NO: 601614 - DNA, 25 bp, Rattus norvegicus
tgaaaccctctcctggtgagggcag

SEQ ID NO: 601615 - DNA, 25 bp, Rattus norvegicus
tgaaaccctctcgtggtgagggcag

SEQ ID NO: 601616 - DNA, 25 bp, Rattus norvegicus
tgaaaccctgaaattgacccacttg

SEQ ID NO: 601617 - DNA, 25 bp, Rattus norvegicus
tgaaaccctgaatttgacccacttg

SEQ ID NO: 601618 - DNA, 25 bp, Rattus norvegicus
tgaaaccctgttactagcccttatg

SEQ ID NO: 601619 - DNA, 25 bp, Rattus norvegicus
tgaaaccctgtttctagcccttatg

SEQ ID NO: 601620 - DNA, 25 bp, Rattus norvegicus
tgaaaccgcagaccacgttgggcca

SEQ ID NO: 601621 - DNA, 25 bp, Rattus norvegicus
tgaaaccgcagagcacgttgggcca

SEQ ID NO: 601622 - DNA, 25 bp, Rattus norvegicus
tgaaaccgctttccgttgtgttctt

SEQ ID NO: 601623 - DNA, 25 bp, Rattus norvegicus
tgaaaccgctttgcgttgtgttctt

SEQ ID NO: 601624 - DNA, 25 bp, Rattus norvegicus
tgaaacctgcccctgaataaacttg

SEQ ID NO: 601625 - DNA, 25 bp, Rattus norvegicus
tgaaacctgcccgtgaataaacttg

SEQ ID NO: 601626 - DNA, 25 bp, Rattus norvegicus
tgaaacctggatagccttggagatc

SEQ ID NO: 601627 - DNA, 25 bp, Rattus norvegicus
tgaaacctggattgccttggagatc

SEQ ID NO: 601628 - DNA, 25 bp, Rattus norvegicus
tgaaacctgggcaggtgtgcacagt

SEQ ID NO: 601629 - DNA, 25 bp, Rattus norvegicus
tgaaacctgggctggtgtgcacagt

SEQ ID NO: 601630 - DNA, 25 bp, Rattus norvegicus
tgaaacctgtttagggagtttctct

SEQ ID NO: 601631 - DNA, 25 bp, Rattus norvegicus
tgaaacctgttttgggagtttctct

SEQ ID NO: 601632 - DNA, 25 bp, Rattus norvegicus
tgaaaccttactcttgaatgcccac

SEQ ID NO: 601633 - DNA, 25 bp, Rattus norvegicus
tgaaaccttactgttgaatgcccac

SEQ ID NO: 601634 - DNA, 25 bp, Rattus norvegicus
tgaaaccttggtacctatcttgggt

SEQ ID NO: 601635 - DNA, 25 bp, Rattus norvegicus
tgaaaccttggttcctatcttgggt

SEQ ID NO: 601636 - DNA, 25 bp, Rattus norvegicus
tgaaaccttgttcatttccccaatt

SEQ ID NO: 601637 - DNA, 25 bp, Rattus norvegicus
tgaaaccttgttgatttccccaatt

SEQ ID NO: 601638 - DNA, 25 bp, Rattus norvegicus
tgaaacctttaactcggcagcccag

SEQ ID NO: 601639 - DNA, 25 bp, Rattus norvegicus
tgaaacctttaagtcggcagcccag

SEQ ID NO: 601640 - DNA, 25 bp, Rattus norvegicus
tgaaacctttatatcctcagcccta

SEQ ID NO: 601641 - DNA, 25 bp, Rattus norvegicus
tgaaacctttatttcctcagcccta

SEQ ID NO: 601642 - DNA, 25 bp, Rattus norvegicus
tgaaaccttttcagagctgtcgctg

SEQ ID NO: 601643 - DNA, 25 bp, Rattus norvegicus
tgaaaccttttctgagctgtcgctg

SEQ ID NO: 601644 - DNA, 25 bp, Rattus norvegicus
tgaaaccttttgagaccctgctgtc

SEQ ID NO: 601645 - DNA, 25 bp, Rattus norvegicus
tgaaaccttttgtgaccctgctgtc

SEQ ID NO: 601646 - DNA, 25 bp, Rattus norvegicus
tgaaacgaaatcagacagccggtgt

SEQ ID NO: 601647 - DNA, 25 bp, Rattus norvegicus
tgaaacgaaatctgacagccggtgt

SEQ ID NO: 601648 - DNA, 25 bp, Rattus norvegicus
tgaaacgacttaattttgtgggctt

SEQ ID NO: 601649 - DNA, 25 bp, Rattus norvegicus
tgaaacgacttatttttgtgggctt

SEQ ID NO: 601650 - DNA, 25 bp, Rattus norvegicus
tgaaacgatcagctcccaacaggat

SEQ ID NO: 601651 - DNA, 25 bp, Rattus norvegicus
tgaaacgatcaggtcccaacaggat

SEQ ID NO: 601652 - DNA, 25 bp, Rattus norvegicus
tgaaacgcacggagtcagacaacag

SEQ ID NO: 601653 - DNA, 25 bp, Rattus norvegicus
tgaaacgcacggtgtcagacaacag

SEQ ID NO: 601654 - DNA, 25 bp, Rattus norvegicus
tgaaacgcccgcatgcagaggacaa

SEQ ID NO: 601655 - DNA, 25 bp, Rattus norvegicus
tgaaacgcccgcttgcagaggacaa

SEQ ID NO: 601656 - DNA, 25 bp, Rattus norvegicus
tgaaacgctgtcatgtgagcatgac

SEQ ID NO: 601657 - DNA, 25 bp, Rattus norvegicus
tgaaacgctgtcttgtgagcatgac

SEQ ID NO: 601658 - DNA, 25 bp, Rattus norvegicus
tgaaacgcttgcaagaactgtgtct

SEQ ID NO: 601659 - DNA, 25 bp, Rattus norvegicus
tgaaacgcttgctagaactgtgtct

SEQ ID NO: 601660 - DNA, 25 bp, Rattus norvegicus
tgaaacggaaatctcccgccatcag

SEQ ID NO: 601661 - DNA, 25 bp, Rattus norvegicus
tgaaacggaaatgtcccgccatcag

SEQ ID NO: 601662 - DNA, 25 bp, Rattus norvegicus
tgaaacggacacatttggtcctggg

SEQ ID NO: 601663 - DNA, 25 bp, Rattus norvegicus
tgaaacggacacttttggtcctggg

SEQ ID NO: 601664 - DNA, 25 bp, Rattus norvegicus
tgaaacggctttacaccatctcaac

SEQ ID NO: 601665 - DNA, 25 bp, Rattus norvegicus
tgaaacggcttttcaccatctcaac

SEQ ID NO: 601666 - DNA, 25 bp, Rattus norvegicus
tgaaacggttttccttccactatat

SEQ ID NO: 601667 - DNA, 25 bp, Rattus norvegicus
tgaaacggttttgcttccactatat

SEQ ID NO: 601668 - DNA, 25 bp, Rattus norvegicus
tgaaacgtcgccagtgtcgccttga

SEQ ID NO: 601669 - DNA, 25 bp, Rattus norvegicus
tgaaacgtcgcctgtgtcgccttga

SEQ ID NO: 601670 - DNA, 25 bp, Rattus norvegicus
tgaaacgtgtatctgcaaaccccgg

SEQ ID NO: 601671 - DNA, 25 bp, Rattus norvegicus
tgaaacgtgtatgtgcaaaccccgg

SEQ ID NO: 601672 - DNA, 25 bp, Rattus norvegicus
tgaaacgttttacccatgtcctgta

SEQ ID NO: 601673 - DNA, 25 bp, Rattus norvegicus
tgaaacgttttagccatgtcctgta

SEQ ID NO: 601674 - DNA, 25 bp, Rattus norvegicus
tgaaactaacacatacacccgcatg

SEQ ID NO: 601675 - DNA, 25 bp, Rattus norvegicus
tgaaactaacacttacacccgcatg

SEQ ID NO: 601676 - DNA, 25 bp, Rattus norvegicus
tgaaactacttgctatctcctactt

SEQ ID NO: 601677 - DNA, 25 bp, Rattus norvegicus
tgaaactacttggtatctcctactt

SEQ ID NO: 601678 - DNA, 25 bp, Rattus norvegicus
tgaaactagggtacatatcctacct

SEQ ID NO: 601679 - DNA, 25 bp, Rattus norvegicus
tgaaactagggttcatatcctacct

SEQ ID NO: 601680 - DNA, 25 bp, Rattus norvegicus
tgaaactatggacctcctcgtgcac

SEQ ID NO: 601681 - DNA, 25 bp, Rattus norvegicus
tgaaactatggagctcctcgtgcac

SEQ ID NO: 601682 - DNA, 25 bp, Rattus norvegicus
tgaaactatgttcgctctctcactg

SEQ ID NO: 601683 - DNA, 25 bp, Rattus norvegicus
tgaaactatgttggctctctcactg

SEQ ID NO: 601684 - DNA, 25 bp, Rattus norvegicus
tgaaactcaagcaccttctggatat

SEQ ID NO: 601685 - DNA, 25 bp, Rattus norvegicus
tgaaactcaagctccttctggatat

SEQ ID NO: 601686 - DNA, 25 bp, Rattus norvegicus
tgaaactcacccagagcaagacctg

SEQ ID NO: 601687 - DNA, 25 bp, Rattus norvegicus
tgaaactcaccctgagcaagacctg

SEQ ID NO: 601688 - DNA, 25 bp, Rattus norvegicus
tgaaactcagatagtcaggcacact

SEQ ID NO: 601689 - DNA, 25 bp, Rattus norvegicus
tgaaactcagatcccgtgtgttcag

SEQ ID NO: 601690 - DNA, 25 bp, Rattus norvegicus
tgaaactcagatgccgtgtgttcag

SEQ ID NO: 601691 - DNA, 25 bp, Rattus norvegicus
tgaaactcagattgtcaggcacact

SEQ ID NO: 601692 - DNA, 25 bp, Rattus norvegicus
tgaaactcatagagtccttctctca

SEQ ID NO: 601693 - DNA, 25 bp, Rattus norvegicus
tgaaactcatagtgtccttctctca

SEQ ID NO: 601694 - DNA, 25 bp, Rattus norvegicus
tgaaactcatgaccccaatggcgtg

SEQ ID NO: 601695 - DNA, 25 bp, Rattus norvegicus
tgaaactcatgagcccaatggcgtg

SEQ ID NO: 601696 - DNA, 25 bp, Rattus norvegicus
tgaaactccatcagctccctcattg

SEQ ID NO: 601697 - DNA, 25 bp, Rattus norvegicus
tgaaactccatctgctccctcattg

SEQ ID NO: 601698 - DNA, 25 bp, Rattus norvegicus
tgaaactcccctagttgtctggtta

SEQ ID NO: 601699 - DNA, 25 bp, Rattus norvegicus
tgaaactccccttgttgtctggtta

SEQ ID NO: 601700 - DNA, 25 bp, Rattus norvegicus
tgaaactccctcatcgcaggtgact

SEQ ID NO: 601701 - DNA, 25 bp, Rattus norvegicus
tgaaactccctcttcgcaggtgact

SEQ ID NO: 601702 - DNA, 25 bp, Rattus norvegicus
tgaaactcgtttaggctcctggctc

SEQ ID NO: 601703 - DNA, 25 bp, Rattus norvegicus
tgaaactcgttttggctcctggctc

SEQ ID NO: 601704 - DNA, 25 bp, Rattus norvegicus
tgaaactctgaaatggctgccgtga

SEQ ID NO: 601705 - DNA, 25 bp, Rattus norvegicus
tgaaactctgaattggctgccgtga

SEQ ID NO: 601706 - DNA, 25 bp, Rattus norvegicus
tgaaactctggccttaactgtgtgg

SEQ ID NO: 601707 - DNA, 25 bp, Rattus norvegicus
tgaaactctggcgttaactgtgtgg

SEQ ID NO: 601708 - DNA, 25 bp, Rattus norvegicus
tgaaactcttggatggacttctaag

SEQ ID NO: 601709 - DNA, 25 bp, Rattus norvegicus
tgaaactcttggttggacttctaag

SEQ ID NO: 601710 - DNA, 25 bp, Rattus norvegicus
tgaaactctttgctccgttctcact

SEQ ID NO: 601711 - DNA, 25 bp, Rattus norvegicus
tgaaactctttggtccgttctcact

SEQ ID NO: 601712 - DNA, 25 bp, Rattus norvegicus
tgaaactgactcaacaacatctgtt

SEQ ID NO: 601713 - DNA, 25 bp, Rattus norvegicus
tgaaactgactctacaacatctgtt

SEQ ID NO: 601714 - DNA, 25 bp, Rattus norvegicus
tgaaactgccacatcaagttgtccc

SEQ ID NO: 601715 - DNA, 25 bp, Rattus norvegicus
tgaaactgccacttcaagttgtccc

SEQ ID NO: 601716 - DNA, 25 bp, Rattus norvegicus
tgaaactgccccaggtttttgaaat

SEQ ID NO: 601717 - DNA, 25 bp, Rattus norvegicus
tgaaactgcccctggtttttgaaat

SEQ ID NO: 601718 - DNA, 25 bp, Rattus norvegicus
tgaaactgccttacagtaccttccg

SEQ ID NO: 601719 - DNA, 25 bp, Rattus norvegicus
tgaaactgcctttcagtaccttccg

SEQ ID NO: 601720 - DNA, 25 bp, Rattus norvegicus
tgaaactgcgcgacaggcagggcct

SEQ ID NO: 601721 - DNA, 25 bp, Rattus norvegicus
tgaaactgcgcgtcaggcagggcct

SEQ ID NO: 601722 - DNA, 25 bp, Rattus norvegicus
tgaaactgctacctacaacctatcc

SEQ ID NO: 601723 - DNA, 25 bp, Rattus norvegicus
tgaaactgctacgtacaacctatcc

SEQ ID NO: 601724 - DNA, 25 bp, Rattus norvegicus
tgaaactgctcccttcatcaaaaga

SEQ ID NO: 601725 - DNA, 25 bp, Rattus norvegicus
tgaaactgctccgttcatcaaaaga

SEQ ID NO: 601726 - DNA, 25 bp, Rattus norvegicus
tgaaactgctgacactccacttggg

SEQ ID NO: 601727 - DNA, 25 bp, Rattus norvegicus
tgaaactgctgagactccacttggg

SEQ ID NO: 601728 - DNA, 25 bp, Rattus norvegicus
tgaaactgcttcactgcttctctct

SEQ ID NO: 601729 - DNA, 25 bp, Rattus norvegicus
tgaaactgcttctctgcttctctct

SEQ ID NO: 601730 - DNA, 25 bp, Rattus norvegicus
tgaaactggatcacaccatagccca

SEQ ID NO: 601731 - DNA, 25 bp, Rattus norvegicus
tgaaactggatctcaccatagccca

SEQ ID NO: 601732 - DNA, 25 bp, Rattus norvegicus
tgaaactggattcttctcctactgc

SEQ ID NO: 601733 - DNA, 25 bp, Rattus norvegicus
tgaaactggattgttctcctactgc

SEQ ID NO: 601734 - DNA, 25 bp, Rattus norvegicus
tgaaactggctgagacggtgtccca

SEQ ID NO: 601735 - DNA, 25 bp, Rattus norvegicus
tgaaactggctgtgacggtgtccca

SEQ ID NO: 601736 - DNA, 25 bp, Rattus norvegicus
tgaaactgtggcatctgaccagctg

SEQ ID NO: 601737 - DNA, 25 bp, Rattus norvegicus
tgaaactgtggcttctgaccagctg

SEQ ID NO: 601738 - DNA, 25 bp, Rattus norvegicus
tgaaactgtttgaggtccctgcgga

SEQ ID NO: 601739 - DNA, 25 bp, Rattus norvegicus
tgaaactgtttgtggtccctgcgga

SEQ ID NO: 601740 - DNA, 25 bp, Rattus norvegicus
tgaaacttactgatggccactgcca

SEQ ID NO: 601741 - DNA, 25 bp, Rattus norvegicus
tgaaacttactgttggccactgcca

SEQ ID NO: 601742 - DNA, 25 bp, Rattus norvegicus
tgaaacttcactaactactctgctt

SEQ ID NO: 601743 - DNA, 25 bp, Rattus norvegicus
tgaaacttcacttactactctgctt

SEQ ID NO: 601744 - DNA, 25 bp, Rattus norvegicus
tgaaacttgaatctcccttccaact

SEQ ID NO: 601745 - DNA, 25 bp, Rattus norvegicus
tgaaacttgaatgtcccttccaact

SEQ ID NO: 601746 - DNA, 25 bp, Rattus norvegicus
tgaaacttgagtagaccaccctcac

SEQ ID NO: 601747 - DNA, 25 bp, Rattus norvegicus
tgaaacttgagttgaccaccctcac

SEQ ID NO: 601748 - DNA, 25 bp, Rattus norvegicus
tgaaacttggcaccgaggttacttg

SEQ ID NO: 601749 - DNA, 25 bp, Rattus norvegicus
tgaaacttggcagcgaggttacttg

SEQ ID NO: 601750 - DNA, 25 bp, Rattus norvegicus
tgaaacttgtcaccacgtcaattcc

SEQ ID NO: 601751 - DNA, 25 bp, Rattus norvegicus
tgaaacttgtcagcacgtcaattcc

SEQ ID NO: 601752 - DNA, 25 bp, Rattus norvegicus
tgaaacttgtctcaggccatatcct

SEQ ID NO: 601753 - DNA, 25 bp, Rattus norvegicus
tgaaacttgtctgaggccatatcct

SEQ ID NO: 601754 - DNA, 25 bp, Rattus norvegicus
tgaaactttcaccagcagagtcttg

SEQ ID NO: 601755 - DNA, 25 bp, Rattus norvegicus
tgaaactttcacgagcagagtcttg

SEQ ID NO: 601756 - DNA, 25 bp, Rattus norvegicus
tgaaacttttccaggcaactggtaa

SEQ ID NO: 601757 - DNA, 25 bp, Rattus norvegicus
tgaaacttttccattctcagcctct

SEQ ID NO: 601758 - DNA, 25 bp, Rattus norvegicus
tgaaacttttcctggcaactggtaa

SEQ ID NO: 601759 - DNA, 25 bp, Rattus norvegicus
tgaaacttttcctttctcagcctct

SEQ ID NO: 601760 - DNA, 25 bp, Rattus norvegicus
tgaaactttttgactccagtctgct

SEQ ID NO: 601761 - DNA, 25 bp, Rattus norvegicus
tgaaactttttgtctccagtctgct

SEQ ID NO: 601762 - DNA, 25 bp, Rattus norvegicus
tgaaagaaacccagggccaccagga

SEQ ID NO: 601763 - DNA, 25 bp, Rattus norvegicus
tgaaagaaacccatctcttctcagc

SEQ ID NO: 601764 - DNA, 25 bp, Rattus norvegicus
tgaaagaaaccctgggccaccagga

SEQ ID NO: 601765 - DNA, 25 bp, Rattus norvegicus
tgaaagaaacccttctcttctcagc

SEQ ID NO: 601766 - DNA, 25 bp, Rattus norvegicus
tgaaagaaccgtaggtctcagcttt

SEQ ID NO: 601767 - DNA, 25 bp, Rattus norvegicus
tgaaagaaccgttggtctcagcttt

SEQ ID NO: 601768 - DNA, 25 bp, Rattus norvegicus
tgaaagaactcacttaccaaactga

SEQ ID NO: 601769 - DNA, 25 bp, Rattus norvegicus
tgaaagaactcagttaccaaactga

SEQ ID NO: 601770 - DNA, 25 bp, Rattus norvegicus
tgaaagaactctccttatttaaata

SEQ ID NO: 601771 - DNA, 25 bp, Rattus norvegicus
tgaaagaactctgcttatttaaata

SEQ ID NO: 601772 - DNA, 25 bp, Rattus norvegicus
tgaaagaagcaacccttccccttgt

SEQ ID NO: 601773 - DNA, 25 bp, Rattus norvegicus
tgaaagaagcaagccttccccttgt

SEQ ID NO: 601774 - DNA, 25 bp, Rattus norvegicus
tgaaagaagcttcacacccagtcac

SEQ ID NO: 601775 - DNA, 25 bp, Rattus norvegicus
tgaaagaagcttgacacccagtcac

SEQ ID NO: 601776 - DNA, 25 bp, Rattus norvegicus
tgaaagaaggttacgcaccccaggt

SEQ ID NO: 601777 - DNA, 25 bp, Rattus norvegicus
tgaaagaaggtttcgcaccccaggt

SEQ ID NO: 601778 - DNA, 25 bp, Rattus norvegicus
tgaaagacagtgctgcgtcctgcca

SEQ ID NO: 601779 - DNA, 25 bp, Rattus norvegicus
tgaaagacagtggtgcgtcctgcca

SEQ ID NO: 601780 - DNA, 25 bp, Rattus norvegicus
tgaaagaccacaacccttaacttag

SEQ ID NO: 601781 - DNA, 25 bp, Rattus norvegicus
tgaaagaccacatcccttaacttag

SEQ ID NO: 601782 - DNA, 25 bp, Rattus norvegicus
tgaaagacccacctggtggcagctc

SEQ ID NO: 601783 - DNA, 25 bp, Rattus norvegicus
tgaaagacccacgtggtggcagctc

SEQ ID NO: 601784 - DNA, 25 bp, Rattus norvegicus
tgaaagacctcacggcacattcctc

SEQ ID NO: 601785 - DNA, 25 bp, Rattus norvegicus
tgaaagacctcagggcacattcctc

SEQ ID NO: 601786 - DNA, 25 bp, Rattus norvegicus
tgaaagacgaagagaccccttctcc

SEQ ID NO: 601787 - DNA, 25 bp, Rattus norvegicus
tgaaagacgaagtgaccccttctcc

SEQ ID NO: 601788 - DNA, 25 bp, Rattus norvegicus
tgaaagacgtccatcagtcagcttc

SEQ ID NO: 601789 - DNA, 25 bp, Rattus norvegicus
tgaaagacgtccttcagtcagcttc

SEQ ID NO: 601790 - DNA, 25 bp, Rattus norvegicus
tgaaagactcgacagcaggtgcctc

SEQ ID NO: 601791 - DNA, 25 bp, Rattus norvegicus
tgaaagactcgagagcaggtgcctc

SEQ ID NO: 601792 - DNA, 25 bp, Rattus norvegicus
tgaaagactgaaatggaaatcgctc

SEQ ID NO: 601793 - DNA, 25 bp, Rattus norvegicus
tgaaagactgaattggaaatcgctc

SEQ ID NO: 601794 - DNA, 25 bp, Rattus norvegicus
tgaaagagacctaactgcctgccac

SEQ ID NO: 601795 - DNA, 25 bp, Rattus norvegicus
tgaaagagaccttactgcctgccac

SEQ ID NO: 601796 - DNA, 25 bp, Rattus norvegicus
tgaaagagcagcctctggcctcatc

SEQ ID NO: 601797 - DNA, 25 bp, Rattus norvegicus
tgaaagagcagcgtctggcctcatc

SEQ ID NO: 601798 - DNA, 25 bp, Rattus norvegicus
tgaaagaggagacccctggttagtc

SEQ ID NO: 601799 - DNA, 25 bp, Rattus norvegicus
tgaaagaggagagccctggttagtc

SEQ ID NO: 601800 - DNA, 25 bp, Rattus norvegicus
tgaaagagtctcaggagcgcaccct

SEQ ID NO: 601801 - DNA, 25 bp, Rattus norvegicus
tgaaagagtctctggagcgcaccct

SEQ ID NO: 601802 - DNA, 25 bp, Rattus norvegicus
tgaaagatcctcatagcctcaacca

SEQ ID NO: 601803 - DNA, 25 bp, Rattus norvegicus
tgaaagatcctcttagcctcaacca

SEQ ID NO: 601804 - DNA, 25 bp, Rattus norvegicus
tgaaagcaacttaccaccaggctgg

SEQ ID NO: 601805 - DNA, 25 bp, Rattus norvegicus
tgaaagcaactttccaccaggctgg

SEQ ID NO: 601806 - DNA, 25 bp, Rattus norvegicus
tgaaagcaccttctcagacttaagc

SEQ ID NO: 601807 - DNA, 25 bp, Rattus norvegicus
tgaaagcaccttgtcagacttaagc

SEQ ID NO: 601808 - DNA, 25 bp, Rattus norvegicus
tgaaagcagacgattacccaggccg

SEQ ID NO: 601809 - DNA, 25 bp, Rattus norvegicus
tgaaagcagacgtttacccaggccg

SEQ ID NO: 601810 - DNA, 25 bp, Rattus norvegicus
tgaaagcagactacactcggatccc

SEQ ID NO: 601811 - DNA, 25 bp, Rattus norvegicus
tgaaagcagacttcactcggatccc

SEQ ID NO: 601812 - DNA, 25 bp, Rattus norvegicus
tgaaagcagcatactgtacccatcc

SEQ ID NO: 601813 - DNA, 25 bp, Rattus norvegicus
tgaaagcagcattctgtacccatcc

SEQ ID NO: 601814 - DNA, 25 bp, Rattus norvegicus
tgaaagcaggttagcatcgccagct

SEQ ID NO: 601815 - DNA, 25 bp, Rattus norvegicus
tgaaagcaggtttgcatcgccagct

SEQ ID NO: 601816 - DNA, 25 bp, Rattus norvegicus
tgaaagcagtttccctgcccagtga

SEQ ID NO: 601817 - DNA, 25 bp, Rattus norvegicus
tgaaagcagtttgcctgcccagtga

SEQ ID NO: 601818 - DNA, 25 bp, Rattus norvegicus
tgaaagccacatcccagagcagagg

SEQ ID NO: 601819 - DNA, 25 bp, Rattus norvegicus
tgaaagccacatgccagagcagagg

SEQ ID NO: 601820 - DNA, 25 bp, Rattus norvegicus
tgaaagccacgaccgggtgttcagc

SEQ ID NO: 601821 - DNA, 25 bp, Rattus norvegicus
tgaaagccacgagcgggtgttcagc

SEQ ID NO: 601822 - DNA, 25 bp, Rattus norvegicus
tgaaagccattccaggtagccctgc

SEQ ID NO: 601823 - DNA, 25 bp, Rattus norvegicus
tgaaagccattcgaggtagccctgc

SEQ ID NO: 601824 - DNA, 25 bp, Rattus norvegicus
tgaaagcccagtctctgaggtcctt

SEQ ID NO: 601825 - DNA, 25 bp, Rattus norvegicus
tgaaagcccagtgtctgaggtcctt

SEQ ID NO: 601826 - DNA, 25 bp, Rattus norvegicus
tgaaagccccaaatacagtcacctt

SEQ ID NO: 601827 - DNA, 25 bp, Rattus norvegicus
tgaaagccccaattacagtcacctt

SEQ ID NO: 601828 - DNA, 25 bp, Rattus norvegicus
tgaaagccctgtctgttggtgccca

SEQ ID NO: 601829 - DNA, 25 bp, Rattus norvegicus
tgaaagccctgtgtgttggtgccca

SEQ ID NO: 601830 - DNA, 25 bp, Rattus norvegicus
tgaaagcccttcaaagctcggcctg

SEQ ID NO: 601831 - DNA, 25 bp, Rattus norvegicus
tgaaagcccttctaagctcggcctg

SEQ ID NO: 601832 - DNA, 25 bp, Rattus norvegicus
tgaaagccgttcaactgagcaccaa

SEQ ID NO: 601833 - DNA, 25 bp, Rattus norvegicus
tgaaagccgttctactgagcaccaa

SEQ ID NO: 601834 - DNA, 25 bp, Rattus norvegicus
tgaaagcctctcacgttgcttgtaa

SEQ ID NO: 601835 - DNA, 25 bp, Rattus norvegicus
tgaaagcctctctcgttgcttgtaa

SEQ ID NO: 601836 - DNA, 25 bp, Rattus norvegicus
tgaaagcctgccctcttggtatggg

SEQ ID NO: 601837 - DNA, 25 bp, Rattus norvegicus
tgaaagcctgccgtcttggtatggg

SEQ ID NO: 601838 - DNA, 25 bp, Rattus norvegicus
tgaaagcctgtcacctgtgtgtggt

SEQ ID NO: 601839 - DNA, 25 bp, Rattus norvegicus
tgaaagcctgtctcctgtgtgtggt

SEQ ID NO: 601840 - DNA, 25 bp, Rattus norvegicus
tgaaagccttcgagtgctcccttct

SEQ ID NO: 601841 - DNA, 25 bp, Rattus norvegicus
tgaaagccttcgtgtgctcccttct

SEQ ID NO: 601842 - DNA, 25 bp, Rattus norvegicus
tgaaagccttttctgctgaccaact

SEQ ID NO: 601843 - DNA, 25 bp, Rattus norvegicus
tgaaagccttttgtgctgaccaact

SEQ ID NO: 601844 - DNA, 25 bp, Rattus norvegicus
tgaaagcgctccaggcttttctgac

SEQ ID NO: 601845 - DNA, 25 bp, Rattus norvegicus
tgaaagcgctcctggcttttctgac

SEQ ID NO: 601846 - DNA, 25 bp, Rattus norvegicus
tgaaagcgcttcagtggcactagcc

SEQ ID NO: 601847 - DNA, 25 bp, Rattus norvegicus
tgaaagcgcttctgtggcactagcc

SEQ ID NO: 601848 - DNA, 25 bp, Rattus norvegicus
tgaaagctacccaggttctcatctt

SEQ ID NO: 601849 - DNA, 25 bp, Rattus norvegicus
tgaaagctaccctggttctcatctt

SEQ ID NO: 601850 - DNA, 25 bp, Rattus norvegicus
tgaaagctagcaaagcccctactgt

SEQ ID NO: 601851 - DNA, 25 bp, Rattus norvegicus
tgaaagctagcatagcccctactgt

SEQ ID NO: 601852 - DNA, 25 bp, Rattus norvegicus
tgaaagctatcgacacatgccagtg

SEQ ID NO: 601853 - DNA, 25 bp, Rattus norvegicus
tgaaagctatcgtcacatgccagtg

SEQ ID NO: 601854 - DNA, 25 bp, Rattus norvegicus
tgaaagctcacccatcgtggagaag

SEQ ID NO: 601855 - DNA, 25 bp, Rattus norvegicus
tgaaagctcaccgatcgtggagaag

SEQ ID NO: 601856 - DNA, 25 bp, Rattus norvegicus
tgaaagctcctaacaactgctggct

SEQ ID NO: 601857 - DNA, 25 bp, Rattus norvegicus
tgaaagctcctatcaactgctggct

SEQ ID NO: 601858 - DNA, 25 bp, Rattus norvegicus
tgaaagctctcaccaccctgtggtc

SEQ ID NO: 601859 - DNA, 25 bp, Rattus norvegicus
tgaaagctctcagcaccctgtggtc

SEQ ID NO: 601860 - DNA, 25 bp, Rattus norvegicus
tgaaagctctttagctctaccacat

SEQ ID NO: 601861 - DNA, 25 bp, Rattus norvegicus
tgaaagctcttttgctctaccacat

SEQ ID NO: 601862 - DNA, 25 bp, Rattus norvegicus
tgaaagctgatcatccctgtacaag

SEQ ID NO: 601863 - DNA, 25 bp, Rattus norvegicus
tgaaagctgatcttccctgtacaag

SEQ ID NO: 601864 - DNA, 25 bp, Rattus norvegicus
tgaaagctgcacagggaggccctgc

SEQ ID NO: 601865 - DNA, 25 bp, Rattus norvegicus
tgaaagctgcactgggaggccctgc

SEQ ID NO: 601866 - DNA, 25 bp, Rattus norvegicus
tgaaagctgcctctagaacctacct

SEQ ID NO: 601867 - DNA, 25 bp, Rattus norvegicus
tgaaagctgcctgtagaacctacct

SEQ ID NO: 601868 - DNA, 25 bp, Rattus norvegicus
tgaaagctgctgctttccatacgca

SEQ ID NO: 601869 - DNA, 25 bp, Rattus norvegicus
tgaaagctgctggtttccatacgca

SEQ ID NO: 601870 - DNA, 25 bp, Rattus norvegicus
tgaaagctgtttctaccacgtggct

SEQ ID NO: 601871 - DNA, 25 bp, Rattus norvegicus
tgaaagctgtttgtaccacgtggct

SEQ ID NO: 601872 - DNA, 25 bp, Rattus norvegicus
tgaaaggacagaccggcattcctgt

SEQ ID NO: 601873 - DNA, 25 bp, Rattus norvegicus
tgaaaggacagagcggcattcctgt

SEQ ID NO: 601874 - DNA, 25 bp, Rattus norvegicus
tgaaaggaccagagcgcatgcctac

SEQ ID NO: 601875 - DNA, 25 bp, Rattus norvegicus
tgaaaggaccagcagtcttcccagc

SEQ ID NO: 601876 - DNA, 25 bp, Rattus norvegicus
tgaaaggaccaggagtcttcccagc

SEQ ID NO: 601877 - DNA, 25 bp, Rattus norvegicus
tgaaaggaccagtgcgcatgcctac

SEQ ID NO: 601878 - DNA, 25 bp, Rattus norvegicus
tgaaaggacctgacgccagtttgac

SEQ ID NO: 601879 - DNA, 25 bp, Rattus norvegicus
tgaaaggacctgtcgccagtttgac

SEQ ID NO: 601880 - DNA, 25 bp, Rattus norvegicus
tgaaaggactcaagctgccacctgg

SEQ ID NO: 601881 - DNA, 25 bp, Rattus norvegicus
tgaaaggactcatgctgccacctgg

SEQ ID NO: 601882 - DNA, 25 bp, Rattus norvegicus
tgaaaggactccattctccccaagg

SEQ ID NO: 601883 - DNA, 25 bp, Rattus norvegicus
tgaaaggactcctttctccccaagg

SEQ ID NO: 601884 - DNA, 25 bp, Rattus norvegicus
tgaaaggagaaaccacccacagttt

SEQ ID NO: 601885 - DNA, 25 bp, Rattus norvegicus
tgaaaggagaaacccggcctcattt

SEQ ID NO: 601886 - DNA, 25 bp, Rattus norvegicus
tgaaaggagaaagcacccacagttt

SEQ ID NO: 601887 - DNA, 25 bp, Rattus norvegicus
tgaaaggagaaagccggcctcattt

SEQ ID NO: 601888 - DNA, 25 bp, Rattus norvegicus
tgaaaggagtagaccgttttctgta

SEQ ID NO: 601889 - DNA, 25 bp, Rattus norvegicus
tgaaaggagtagtccgttttctgta

SEQ ID NO: 601890 - DNA, 25 bp, Rattus norvegicus
tgaaaggagtttatcttggcacttt

SEQ ID NO: 601891 - DNA, 25 bp, Rattus norvegicus
tgaaaggagtttttcttggcacttt

SEQ ID NO: 601892 - DNA, 25 bp, Rattus norvegicus
tgaaaggataatctccatcggagtg

SEQ ID NO: 601893 - DNA, 25 bp, Rattus norvegicus
tgaaaggataatgtccatcggagtg

SEQ ID NO: 601894 - DNA, 25 bp, Rattus norvegicus
tgaaaggatcttactcttgccccat

SEQ ID NO: 601895 - DNA, 25 bp, Rattus norvegicus
tgaaaggatctttctcttgccccat

SEQ ID NO: 601896 - DNA, 25 bp, Rattus norvegicus
tgaaaggcactcagctttgggtgtg

SEQ ID NO: 601897 - DNA, 25 bp, Rattus norvegicus
tgaaaggcactctgctttgggtgtg

SEQ ID NO: 601898 - DNA, 25 bp, Rattus norvegicus
tgaaaggcagatagagcagtctcag

SEQ ID NO: 601899 - DNA, 25 bp, Rattus norvegicus
tgaaaggcagattgagcagtctcag

SEQ ID NO: 601900 - DNA, 25 bp, Rattus norvegicus
tgaaaggcaggcataacccttccca

SEQ ID NO: 601901 - DNA, 25 bp, Rattus norvegicus
tgaaaggcaggcatccaccaagctg

SEQ ID NO: 601902 - DNA, 25 bp, Rattus norvegicus
tgaaaggcaggcttaacccttccca

SEQ ID NO: 601903 - DNA, 25 bp, Rattus norvegicus
tgaaaggcaggcttccaccaagctg

SEQ ID NO: 601904 - DNA, 25 bp, Rattus norvegicus
tgaaaggcagttagccacccctcaa

SEQ ID NO: 601905 - DNA, 25 bp, Rattus norvegicus
tgaaaggcagtttgccacccctcaa

SEQ ID NO: 601906 - DNA, 25 bp, Rattus norvegicus
tgaaaggccagcatgcatgagcatt

SEQ ID NO: 601907 - DNA, 25 bp, Rattus norvegicus
tgaaaggccagcttgcatgagcatt

SEQ ID NO: 601908 - DNA, 25 bp, Rattus norvegicus
tgaaaggcggccagtcggcttttct

SEQ ID NO: 601909 - DNA, 25 bp, Rattus norvegicus
tgaaaggcggcctgtcggcttttct

SEQ ID NO: 601910 - DNA, 25 bp, Rattus norvegicus
tgaaaggctggcaccccttgtcctg

SEQ ID NO: 601911 - DNA, 25 bp, Rattus norvegicus
tgaaaggctggctccccttgtcctg

SEQ ID NO: 601912 - DNA, 25 bp, Rattus norvegicus
tgaaagggacagagctccagccact

SEQ ID NO: 601913 - DNA, 25 bp, Rattus norvegicus
tgaaagggacagtgctccagccact

SEQ ID NO: 601914 - DNA, 25 bp, Rattus norvegicus
tgaaaggtcaatacaacgcaacttg

SEQ ID NO: 601915 - DNA, 25 bp, Rattus norvegicus
tgaaaggtcaattcaacgcaacttg

SEQ ID NO: 601916 - DNA, 25 bp, Rattus norvegicus
tgaaaggtcacactgcactctcata

SEQ ID NO: 601917 - DNA, 25 bp, Rattus norvegicus
tgaaaggtcacagtgcactctcata

SEQ ID NO: 601918 - DNA, 25 bp, Rattus norvegicus
tgaaaggtcctcagccccgggctct

SEQ ID NO: 601919 - DNA, 25 bp, Rattus norvegicus
tgaaaggtcctctgccccgggctct

SEQ ID NO: 601920 - DNA, 25 bp, Rattus norvegicus
tgaaaggtgcttcttcaacctaccc

SEQ ID NO: 601921 - DNA, 25 bp, Rattus norvegicus
tgaaaggtgcttgttcaacctaccc

SEQ ID NO: 601922 - DNA, 25 bp, Rattus norvegicus
tgaaaggttctaacttacacacaga

SEQ ID NO: 601923 - DNA, 25 bp, Rattus norvegicus
tgaaaggttctatcttacacacaga

SEQ ID NO: 601924 - DNA, 25 bp, Rattus norvegicus
tgaaagtaccgcatttccaccacga

SEQ ID NO: 601925 - DNA, 25 bp, Rattus norvegicus
tgaaagtaccgcttttccaccacga

SEQ ID NO: 601926 - DNA, 25 bp, Rattus norvegicus
tgaaagtcaactctggcctgcaatt

SEQ ID NO: 601927 - DNA, 25 bp, Rattus norvegicus
tgaaagtcaactgtggcctgcaatt

SEQ ID NO: 601928 - DNA, 25 bp, Rattus norvegicus
tgaaagtcacttctcactaagcctg

SEQ ID NO: 601929 - DNA, 25 bp, Rattus norvegicus
tgaaagtcacttgtcactaagcctg

SEQ ID NO: 601930 - DNA, 25 bp, Rattus norvegicus
tgaaagtcagatccccatctgcatg

SEQ ID NO: 601931 - DNA, 25 bp, Rattus norvegicus
tgaaagtcagatgcccatctgcatg

SEQ ID NO: 601932 - DNA, 25 bp, Rattus norvegicus
tgaaagtcagctacaacccagatgc

SEQ ID NO: 601933 - DNA, 25 bp, Rattus norvegicus
tgaaagtcagcttcaacccagatgc

SEQ ID NO: 601934 - DNA, 25 bp, Rattus norvegicus
tgaaagtcagtcaagctcatctcct

SEQ ID NO: 601935 - DNA, 25 bp, Rattus norvegicus
tgaaagtcagtctagctcatctcct

SEQ ID NO: 601936 - DNA, 25 bp, Rattus norvegicus
tgaaagtcatacaccaccgagtcta

SEQ ID NO: 601937 - DNA, 25 bp, Rattus norvegicus
tgaaagtcatactccaccgagtcta

SEQ ID NO: 601938 - DNA, 25 bp, Rattus norvegicus
tgaaagtccctgaggtagccatgcc

SEQ ID NO: 601939 - DNA, 25 bp, Rattus norvegicus
tgaaagtccctgtggtagccatgcc

SEQ ID NO: 601940 - DNA, 25 bp, Rattus norvegicus
tgaaagtctcagcaggagcacccct

SEQ ID NO: 601941 - DNA, 25 bp, Rattus norvegicus
tgaaagtctcaggaggagcacccct

SEQ ID NO: 601942 - DNA, 25 bp, Rattus norvegicus
tgaaagtcttagatgctcccaggct

SEQ ID NO: 601943 - DNA, 25 bp, Rattus norvegicus
tgaaagtcttagttgctcccaggct

SEQ ID NO: 601944 - DNA, 25 bp, Rattus norvegicus
tgaaagtgaactactctgaccgagt

SEQ ID NO: 601945 - DNA, 25 bp, Rattus norvegicus
tgaaagtgaacttctctgaccgagt

SEQ ID NO: 601946 - DNA, 25 bp, Rattus norvegicus
tgaaagtgcagaacgccgtggccaa

SEQ ID NO: 601947 - DNA, 25 bp, Rattus norvegicus
tgaaagtgcagatcgccgtggccaa

SEQ ID NO: 601948 - DNA, 25 bp, Rattus norvegicus
tgaaagtgctcaagtcgtgtaggga

SEQ ID NO: 601949 - DNA, 25 bp, Rattus norvegicus
tgaaagtgctcatgtcgtgtaggga

SEQ ID NO: 601950 - DNA, 25 bp, Rattus norvegicus
tgaaagtgctccatgcagtcacgcc

SEQ ID NO: 601951 - DNA, 25 bp, Rattus norvegicus
tgaaagtgctccttgcagtcacgcc

SEQ ID NO: 601952 - DNA, 25 bp, Rattus norvegicus
tgaaagtggcaaatccgctggagct

SEQ ID NO: 601953 - DNA, 25 bp, Rattus norvegicus
tgaaagtggcaattccgctggagct

SEQ ID NO: 601954 - DNA, 25 bp, Rattus norvegicus
tgaaagtggcgtattctccgcccca

SEQ ID NO: 601955 - DNA, 25 bp, Rattus norvegicus
tgaaagtggcgttttctccgcccca

SEQ ID NO: 601956 - DNA, 25 bp, Rattus norvegicus
tgaaagtgtgccacgcctcttcaga

SEQ ID NO: 601957 - DNA, 25 bp, Rattus norvegicus
tgaaagtgtgcctcgcctcttcaga

SEQ ID NO: 601958 - DNA, 25 bp, Rattus norvegicus
tgaaagtgtgtcattgctttttcct

SEQ ID NO: 601959 - DNA, 25 bp, Rattus norvegicus
tgaaagtgtgtctttgctttttcct

SEQ ID NO: 601960 - DNA, 25 bp, Rattus norvegicus
tgaaagtgtgttaaaaccctccagg

SEQ ID NO: 601961 - DNA, 25 bp, Rattus norvegicus
tgaaagtgtgtttaaaccctccagg

SEQ ID NO: 601962 - DNA, 25 bp, Rattus norvegicus
tgaaagttcactcttgtctctctgc

SEQ ID NO: 601963 - DNA, 25 bp, Rattus norvegicus
tgaaagttcactgttgtctctctgc

SEQ ID NO: 601964 - DNA, 25 bp, Rattus norvegicus
tgaaagttccttcctcgagttaagt

SEQ ID NO: 601965 - DNA, 25 bp, Rattus norvegicus
tgaaagttccttgctcgagttaagt

SEQ ID NO: 601966 - DNA, 25 bp, Rattus norvegicus
tgaaagttgctcaattgtccccact

SEQ ID NO: 601967 - DNA, 25 bp, Rattus norvegicus
tgaaagttgctctattgtccccact

SEQ ID NO: 601968 - DNA, 25 bp, Rattus norvegicus
tgaaagttgtccatcggtgctcaca

SEQ ID NO: 601969 - DNA, 25 bp, Rattus norvegicus
tgaaagttgtccttcggtgctcaca

SEQ ID NO: 601970 - DNA, 25 bp, Rattus norvegicus
tgaaagtttacaatgcagtagcatt

SEQ ID NO: 601971 - DNA, 25 bp, Rattus norvegicus
tgaaagtttacattgcagtagcatt

SEQ ID NO: 601972 - DNA, 25 bp, Rattus norvegicus
tgaaagtttcccctctaaattctca

SEQ ID NO: 601973 - DNA, 25 bp, Rattus norvegicus
tgaaagtttcccgtctaaattctca

SEQ ID NO: 601974 - DNA, 25 bp, Rattus norvegicus
tgaaatacatctatacgtgcccgct

SEQ ID NO: 601975 - DNA, 25 bp, Rattus norvegicus
tgaaatacatctttacgtgcccgct

SEQ ID NO: 601976 - DNA, 25 bp, Rattus norvegicus
tgaaataccagaagctacccaaact

SEQ ID NO: 601977 - DNA, 25 bp, Rattus norvegicus
tgaaataccagatgctacccaaact

SEQ ID NO: 601978 - DNA, 25 bp, Rattus norvegicus
tgaaatacctttctgtgtagatggg

SEQ ID NO: 601979 - DNA, 25 bp, Rattus norvegicus
tgaaatacctttgtgtgtagatggg

SEQ ID NO: 601980 - DNA, 25 bp, Rattus norvegicus
tgaaatacgtttccaaaacaggagg

SEQ ID NO: 601981 - DNA, 25 bp, Rattus norvegicus
tgaaatacgtttgcaaaacaggagg

SEQ ID NO: 601982 - DNA, 25 bp, Rattus norvegicus
tgaaatacttgcatagggcctaact

SEQ ID NO: 601983 - DNA, 25 bp, Rattus norvegicus
tgaaatacttgcttagggcctaact

SEQ ID NO: 601984 - DNA, 25 bp, Rattus norvegicus
tgaaatagactgatcccagggcaat

SEQ ID NO: 601985 - DNA, 25 bp, Rattus norvegicus
tgaaatagactgttcccagggcaat

SEQ ID NO: 601986 - DNA, 25 bp, Rattus norvegicus
tgaaatagccctagtttgccccatt

SEQ ID NO: 601987 - DNA, 25 bp, Rattus norvegicus
tgaaatagcccttgtttgccccatt

SEQ ID NO: 601988 - DNA, 25 bp, Rattus norvegicus
tgaaatagggcaccgtcccacatgc

SEQ ID NO: 601989 - DNA, 25 bp, Rattus norvegicus
tgaaatagggcagcgtcccacatgc

SEQ ID NO: 601990 - DNA, 25 bp, Rattus norvegicus
tgaaatagttctcaaagtacttcac

SEQ ID NO: 601991 - DNA, 25 bp, Rattus norvegicus
tgaaatagttctgaaagtacttcac

SEQ ID NO: 601992 - DNA, 25 bp, Rattus norvegicus
tgaaatatcacacagctccatgcct

SEQ ID NO: 601993 - DNA, 25 bp, Rattus norvegicus
tgaaatatcacagagctccatgcct

SEQ ID NO: 601994 - DNA, 25 bp, Rattus norvegicus
tgaaatatctcccagcttcagacac

SEQ ID NO: 601995 - DNA, 25 bp, Rattus norvegicus
tgaaatatctccgagcttcagacac

SEQ ID NO: 601996 - DNA, 25 bp, Rattus norvegicus
tgaaatatgaccacagcggctccct

SEQ ID NO: 601997 - DNA, 25 bp, Rattus norvegicus
tgaaatatgaccaggtggcctccac

SEQ ID NO: 601998 - DNA, 25 bp, Rattus norvegicus
tgaaatatgacctcagcggctccct

SEQ ID NO: 601999 - DNA, 25 bp, Rattus norvegicus
tgaaatatgacctggtggcctccac

SEQ ID NO: 602000 - DNA, 25 bp, Rattus norvegicus
tgaaatattgcaagccggcgtggga

SEQ ID NO: 602001 - DNA, 25 bp, Rattus norvegicus
tgaaatattgcatgccggcgtggga

SEQ ID NO: 602002 - DNA, 25 bp, Rattus norvegicus
tgaaatatttgccacctatgcccat

SEQ ID NO: 602003 - DNA, 25 bp, Rattus norvegicus
tgaaatatttgcgacctatgcccat

SEQ ID NO: 602004 - DNA, 25 bp, Rattus norvegicus
tgaaatcaaactccatctaccctgt

SEQ ID NO: 602005 - DNA, 25 bp, Rattus norvegicus
tgaaatcaaactgcatctaccctgt

SEQ ID NO: 602006 - DNA, 25 bp, Rattus norvegicus
tgaaatcaaataatccccatcctcc

SEQ ID NO: 602007 - DNA, 25 bp, Rattus norvegicus
tgaaatcaaatattccccatcctcc

SEQ ID NO: 602008 - DNA, 25 bp, Rattus norvegicus
tgaaatcaacgtactgcgaaacagg

SEQ ID NO: 602009 - DNA, 25 bp, Rattus norvegicus
tgaaatcaacgttctgcgaaacagg

SEQ ID NO: 602010 - DNA, 25 bp, Rattus norvegicus
tgaaatcaactcactgcctcgtgtg

SEQ ID NO: 602011 - DNA, 25 bp, Rattus norvegicus
tgaaatcaactctctgcctcgtgtg

SEQ ID NO: 602012 - DNA, 25 bp, Rattus norvegicus
tgaaatcaacttcttcgctactccg

SEQ ID NO: 602013 - DNA, 25 bp, Rattus norvegicus
tgaaatcaacttgttcgctactccg

SEQ ID NO: 602014 - DNA, 25 bp, Rattus norvegicus
tgaaatcaagtacacaaatccatgt

SEQ ID NO: 602015 - DNA, 25 bp, Rattus norvegicus
tgaaatcaagtagacaaatccatgt

SEQ ID NO: 602016 - DNA, 25 bp, Rattus norvegicus
tgaaatcacagaccaggacccgcct

SEQ ID NO: 602017 - DNA, 25 bp, Rattus norvegicus
tgaaatcacagagcaggacccgcct

SEQ ID NO: 602018 - DNA, 25 bp, Rattus norvegicus
tgaaatcatcagcattttcttcctt

SEQ ID NO: 602019 - DNA, 25 bp, Rattus norvegicus
tgaaatcatcaggattttcttcctt

SEQ ID NO: 602020 - DNA, 25 bp, Rattus norvegicus
tgaaatcatccccatgagcatcaga

SEQ ID NO: 602021 - DNA, 25 bp, Rattus norvegicus
tgaaatcatcccgatgagcatcaga

SEQ ID NO: 602022 - DNA, 25 bp, Rattus norvegicus
tgaaatcatcttctaccttgctggc

SEQ ID NO: 602023 - DNA, 25 bp, Rattus norvegicus
tgaaatcatcttgtaccttgctggc

SEQ ID NO: 602024 - DNA, 25 bp, Rattus norvegicus
tgaaatccaagccaagcgcctcttc

SEQ ID NO: 602025 - DNA, 25 bp, Rattus norvegicus
tgaaatccaagcgaagcgcctcttc

SEQ ID NO: 602026 - DNA, 25 bp, Rattus norvegicus
tgaaatccaggtctcgggtctgatt

SEQ ID NO: 602027 - DNA, 25 bp, Rattus norvegicus
tgaaatccaggtgtcgggtctgatt

SEQ ID NO: 602028 - DNA, 25 bp, Rattus norvegicus
tgaaatccatcgcatccagggactg

SEQ ID NO: 602029 - DNA, 25 bp, Rattus norvegicus
tgaaatccatcggatccagggactg

SEQ ID NO: 602030 - DNA, 25 bp, Rattus norvegicus
tgaaatccatttaatcccttgccta

SEQ ID NO: 602031 - DNA, 25 bp, Rattus norvegicus
tgaaatccatttcctttgaccctgc

SEQ ID NO: 602032 - DNA, 25 bp, Rattus norvegicus
tgaaatccatttgctttgaccctgc

SEQ ID NO: 602033 - DNA, 25 bp, Rattus norvegicus
tgaaatccattttatcccttgccta

SEQ ID NO: 602034 - DNA, 25 bp, Rattus norvegicus
tgaaatccgagacaggccaccgtcc

SEQ ID NO: 602035 - DNA, 25 bp, Rattus norvegicus
tgaaatccgagagaggccaccgtcc

SEQ ID NO: 602036 - DNA, 25 bp, Rattus norvegicus
tgaaatccgtcaagtcctagtcaca

SEQ ID NO: 602037 - DNA, 25 bp, Rattus norvegicus
tgaaatccgtcatgtcctagtcaca

SEQ ID NO: 602038 - DNA, 25 bp, Rattus norvegicus
tgaaatccgtgtctgatggccaaga

SEQ ID NO: 602039 - DNA, 25 bp, Rattus norvegicus
tgaaatccgtgtgtgatggccaaga

SEQ ID NO: 602040 - DNA, 25 bp, Rattus norvegicus
tgaaatcctgatcctttcctggcca

SEQ ID NO: 602041 - DNA, 25 bp, Rattus norvegicus
tgaaatcctgatctgactgaccacc

SEQ ID NO: 602042 - DNA, 25 bp, Rattus norvegicus
tgaaatcctgatgctttcctggcca

SEQ ID NO: 602043 - DNA, 25 bp, Rattus norvegicus
tgaaatcctgatgtgactgaccacc

SEQ ID NO: 602044 - DNA, 25 bp, Rattus norvegicus
tgaaatcctgtcctctatgttgctt

SEQ ID NO: 602045 - DNA, 25 bp, Rattus norvegicus
tgaaatcctgtcgtctatgttgctt

SEQ ID NO: 602046 - DNA, 25 bp, Rattus norvegicus
tgaaatccttcacgcatatcagctg

SEQ ID NO: 602047 - DNA, 25 bp, Rattus norvegicus
tgaaatccttcaggcatatcagctg

SEQ ID NO: 602048 - DNA, 25 bp, Rattus norvegicus
tgaaatcgaagccatcgctgtccag

SEQ ID NO: 602049 - DNA, 25 bp, Rattus norvegicus
tgaaatcgaagcgatcgctgtccag

SEQ ID NO: 602050 - DNA, 25 bp, Rattus norvegicus
tgaaatcgcccgaagagggaacaga

SEQ ID NO: 602051 - DNA, 25 bp, Rattus norvegicus
tgaaatcgcccgtagagggaacaga

SEQ ID NO: 602052 - DNA, 25 bp, Rattus norvegicus
tgaaatcgtgcaccactatgccagc

SEQ ID NO: 602053 - DNA, 25 bp, Rattus norvegicus
tgaaatcgtgcagcactatgccagc

SEQ ID NO: 602054 - DNA, 25 bp, Rattus norvegicus
tgaaatcgttttcctcattgtctgc

SEQ ID NO: 602055 - DNA, 25 bp, Rattus norvegicus
tgaaatcgttttgctcattgtctgc

SEQ ID NO: 602056 - DNA, 25 bp, Rattus norvegicus
tgaaatctaggcatggccaacccgt

SEQ ID NO: 602057 - DNA, 25 bp, Rattus norvegicus
tgaaatctaggcttggccaacccgt

SEQ ID NO: 602058 - DNA, 25 bp, Rattus norvegicus
tgaaatctattcacaggcgcctgca

SEQ ID NO: 602059 - DNA, 25 bp, Rattus norvegicus
tgaaatctattctcaggcgcctgca

SEQ ID NO: 602060 - DNA, 25 bp, Rattus norvegicus
tgaaatctcgtgactctaccaaagc

SEQ ID NO: 602061 - DNA, 25 bp, Rattus norvegicus
tgaaatctcgtgtctctaccaaagc

SEQ ID NO: 602062 - DNA, 25 bp, Rattus norvegicus
tgaaatctctggaggtcttgggccc

SEQ ID NO: 602063 - DNA, 25 bp, Rattus norvegicus
tgaaatctctggtggtcttgggccc

SEQ ID NO: 602064 - DNA, 25 bp, Rattus norvegicus
tgaaatctgtgcctcccatcttgcc

SEQ ID NO: 602065 - DNA, 25 bp, Rattus norvegicus
tgaaatctgtgcgtcccatcttgcc

SEQ ID NO: 602066 - DNA, 25 bp, Rattus norvegicus
tgaaatcttagaaactacccagggt

SEQ ID NO: 602067 - DNA, 25 bp, Rattus norvegicus
tgaaatcttagatactacccagggt

SEQ ID NO: 602068 - DNA, 25 bp, Rattus norvegicus
tgaaatcttccccaatggcacggtg

SEQ ID NO: 602069 - DNA, 25 bp, Rattus norvegicus
tgaaatcttcccgaatggcacggtg

SEQ ID NO: 602070 - DNA, 25 bp, Rattus norvegicus
tgaaatcttttccatgcccatgagg

SEQ ID NO: 602071 - DNA, 25 bp, Rattus norvegicus
tgaaatcttttcgatgcccatgagg

SEQ ID NO: 602072 - DNA, 25 bp, Rattus norvegicus
tgaaatctttttcctttgcttgaaa

SEQ ID NO: 602073 - DNA, 25 bp, Rattus norvegicus
tgaaatctttttgctttgcttgaaa

SEQ ID NO: 602074 - DNA, 25 bp, Rattus norvegicus
tgaaatgacaataccaggcttggat

SEQ ID NO: 602075 - DNA, 25 bp, Rattus norvegicus
tgaaatgacaattccaggcttggat

SEQ ID NO: 602076 - DNA, 25 bp, Rattus norvegicus
tgaaatgactgtcctttccaacctc

SEQ ID NO: 602077 - DNA, 25 bp, Rattus norvegicus
tgaaatgactgtgctttccaacctc

SEQ ID NO: 602078 - DNA, 25 bp, Rattus norvegicus
tgaaatgagtccctatccctcctgg

SEQ ID NO: 602079 - DNA, 25 bp, Rattus norvegicus
tgaaatgagtccgtatccctcctgg

SEQ ID NO: 602080 - DNA, 25 bp, Rattus norvegicus
tgaaatgatccaccggacttctcca

SEQ ID NO: 602081 - DNA, 25 bp, Rattus norvegicus
tgaaatgatccagcggacttctcca

SEQ ID NO: 602082 - DNA, 25 bp, Rattus norvegicus
tgaaatgatgagatgcttgcctgct

SEQ ID NO: 602083 - DNA, 25 bp, Rattus norvegicus
tgaaatgatgagttgcttgcctgct

SEQ ID NO: 602084 - DNA, 25 bp, Rattus norvegicus
tgaaatgcaacgaaggcgccatatt

SEQ ID NO: 602085 - DNA, 25 bp, Rattus norvegicus
tgaaatgcaacgtaggcgccatatt

SEQ ID NO: 602086 - DNA, 25 bp, Rattus norvegicus
tgaaatgcaatcattcctcggcctg

SEQ ID NO: 602087 - DNA, 25 bp, Rattus norvegicus
tgaaatgcaatctttcctcggcctg

SEQ ID NO: 602088 - DNA, 25 bp, Rattus norvegicus
tgaaatgcaccgattgggtccccag

SEQ ID NO: 602089 - DNA, 25 bp, Rattus norvegicus
tgaaatgcaccgtttgggtccccag

SEQ ID NO: 602090 - DNA, 25 bp, Rattus norvegicus
tgaaatgcatacatccctcctgtgg

SEQ ID NO: 602091 - DNA, 25 bp, Rattus norvegicus
tgaaatgcatacttccctcctgtgg

SEQ ID NO: 602092 - DNA, 25 bp, Rattus norvegicus
tgaaatgcgtgaacccaccaaggcc

SEQ ID NO: 602093 - DNA, 25 bp, Rattus norvegicus
tgaaatgcgtgatcccaccaaggcc

SEQ ID NO: 602094 - DNA, 25 bp, Rattus norvegicus
tgaaatgctcacagggctcctgact

SEQ ID NO: 602095 - DNA, 25 bp, Rattus norvegicus
tgaaatgctcactgggctcctgact

SEQ ID NO: 602096 - DNA, 25 bp, Rattus norvegicus
tgaaatgctggcctatcaccgaaag

SEQ ID NO: 602097 - DNA, 25 bp, Rattus norvegicus
tgaaatgctggcgtatcaccgaaag

SEQ ID NO: 602098 - DNA, 25 bp, Rattus norvegicus
tgaaatgcttccacatgacacctac

SEQ ID NO: 602099 - DNA, 25 bp, Rattus norvegicus
tgaaatgcttccattttaatgttga

SEQ ID NO: 602100 - DNA, 25 bp, Rattus norvegicus
tgaaatgcttcctcatgacacctac

SEQ ID NO: 602101 - DNA, 25 bp, Rattus norvegicus
tgaaatgcttcctttttaatgttga

SEQ ID NO: 602102 - DNA, 25 bp, Rattus norvegicus
tgaaatgctttccagcccagtacct

SEQ ID NO: 602103 - DNA, 25 bp, Rattus norvegicus
tgaaatgctttcgagcccagtacct

SEQ ID NO: 602104 - DNA, 25 bp, Rattus norvegicus
tgaaatggaaaacgtcccgtgggat

SEQ ID NO: 602105 - DNA, 25 bp, Rattus norvegicus
tgaaatggaaaaggtcccgtgggat

SEQ ID NO: 602106 - DNA, 25 bp, Rattus norvegicus
tgaaatggacccagtctgctgtgac

SEQ ID NO: 602107 - DNA, 25 bp, Rattus norvegicus
tgaaatggaccctgtctgctgtgac

SEQ ID NO: 602108 - DNA, 25 bp, Rattus norvegicus
tgaaatggacctccctttggaatac

SEQ ID NO: 602109 - DNA, 25 bp, Rattus norvegicus
tgaaatggacctgcctttggaatac

SEQ ID NO: 602110 - DNA, 25 bp, Rattus norvegicus
tgaaatggcaccaactcttcaggcc

SEQ ID NO: 602111 - DNA, 25 bp, Rattus norvegicus
tgaaatggcacctactcttcaggcc

SEQ ID NO: 602112 - DNA, 25 bp, Rattus norvegicus
tgaaatggccataacctgtctgtcc

SEQ ID NO: 602113 - DNA, 25 bp, Rattus norvegicus
tgaaatggccattacctgtctgtcc

SEQ ID NO: 602114 - DNA, 25 bp, Rattus norvegicus
tgaaatgggagtagggacctgccca

SEQ ID NO: 602115 - DNA, 25 bp, Rattus norvegicus
tgaaatgggagttgggacctgccca

SEQ ID NO: 602116 - DNA, 25 bp, Rattus norvegicus
tgaaatgggccactgattcctatct

SEQ ID NO: 602117 - DNA, 25 bp, Rattus norvegicus
tgaaatgggccagtgattcctatct

SEQ ID NO: 602118 - DNA, 25 bp, Rattus norvegicus
tgaaatggttgccacgcagccccag

SEQ ID NO: 602119 - DNA, 25 bp, Rattus norvegicus
tgaaatggttgcgacgcagccccag

SEQ ID NO: 602120 - DNA, 25 bp, Rattus norvegicus
tgaaatgtatccatcttttcccctc

SEQ ID NO: 602121 - DNA, 25 bp, Rattus norvegicus
tgaaatgtatccttcttttcccctc

SEQ ID NO: 602122 - DNA, 25 bp, Rattus norvegicus
tgaaatgtcgacacccactctgtcc

SEQ ID NO: 602123 - DNA, 25 bp, Rattus norvegicus
tgaaatgtcgactcccactctgtcc

SEQ ID NO: 602124 - DNA, 25 bp, Rattus norvegicus
tgaaatgtctctacagcttccagtg

SEQ ID NO: 602125 - DNA, 25 bp, Rattus norvegicus
tgaaatgtctcttcagcttccagtg

SEQ ID NO: 602126 - DNA, 25 bp, Rattus norvegicus
tgaaatgtctgacctttccacacta

SEQ ID NO: 602127 - DNA, 25 bp, Rattus norvegicus
tgaaatgtctgagctttccacacta

SEQ ID NO: 602128 - DNA, 25 bp, Rattus norvegicus
tgaaatgtgacgatgcgtttcctct

SEQ ID NO: 602129 - DNA, 25 bp, Rattus norvegicus
tgaaatgtgacgttgcgtttcctct

SEQ ID NO: 602130 - DNA, 25 bp, Rattus norvegicus
tgaaatgtgggcctcttcacagctt

SEQ ID NO: 602131 - DNA, 25 bp, Rattus norvegicus
tgaaatgtgggcgtcttcacagctt

SEQ ID NO: 602132 - DNA, 25 bp, Rattus norvegicus
tgaaatgtgggtagctcctcagcgc

SEQ ID NO: 602133 - DNA, 25 bp, Rattus norvegicus
tgaaatgtgggttgctcctcagcgc

SEQ ID NO: 602134 - DNA, 25 bp, Rattus norvegicus
tgaaatgttactatctaaccttcgg

SEQ ID NO: 602135 - DNA, 25 bp, Rattus norvegicus
tgaaatgttactttctaaccttcgg

SEQ ID NO: 602136 - DNA, 25 bp, Rattus norvegicus
tgaaatgttggcaggccaggcacct

SEQ ID NO: 602137 - DNA, 25 bp, Rattus norvegicus
tgaaatgttggctggccaggcacct

SEQ ID NO: 602138 - DNA, 25 bp, Rattus norvegicus
tgaaatgttttcactggtctcccgg

SEQ ID NO: 602139 - DNA, 25 bp, Rattus norvegicus
tgaaatgttttcagggcccttgatc

SEQ ID NO: 602140 - DNA, 25 bp, Rattus norvegicus
tgaaatgttttctctggtctcccgg

SEQ ID NO: 602141 - DNA, 25 bp, Rattus norvegicus
tgaaatgttttctgggcccttgatc

SEQ ID NO: 602142 - DNA, 25 bp, Rattus norvegicus
tgaaattaactgactgtgattcctt

SEQ ID NO: 602143 - DNA, 25 bp, Rattus norvegicus
tgaaattaactgtctgtgattcctt

SEQ ID NO: 602144 - DNA, 25 bp, Rattus norvegicus
tgaaattacactcttaaccccttct

SEQ ID NO: 602145 - DNA, 25 bp, Rattus norvegicus
tgaaattacactgttaaccccttct

SEQ ID NO: 602146 - DNA, 25 bp, Rattus norvegicus
tgaaattaccaacgaagagcttaat

SEQ ID NO: 602147 - DNA, 25 bp, Rattus norvegicus
tgaaattaccaaggaagagcttaat

SEQ ID NO: 602148 - DNA, 25 bp, Rattus norvegicus
tgaaattacccacgcccgaaaggag

SEQ ID NO: 602149 - DNA, 25 bp, Rattus norvegicus
tgaaattacccaggcccgaaaggag

SEQ ID NO: 602150 - DNA, 25 bp, Rattus norvegicus
tgaaattactccatgctacagacga

SEQ ID NO: 602151 - DNA, 25 bp, Rattus norvegicus
tgaaattactccttgctacagacga

SEQ ID NO: 602152 - DNA, 25 bp, Rattus norvegicus
tgaaattatcctatctgcacctcag

SEQ ID NO: 602153 - DNA, 25 bp, Rattus norvegicus
tgaaattatcctttctgcacctcag

SEQ ID NO: 602154 - DNA, 25 bp, Rattus norvegicus
tgaaattatgtcctcagccagcttc

SEQ ID NO: 602155 - DNA, 25 bp, Rattus norvegicus
tgaaattatgtcgtcagccagcttc

SEQ ID NO: 602156 - DNA, 25 bp, Rattus norvegicus
tgaaattatttcaggtgacctcatc

SEQ ID NO: 602157 - DNA, 25 bp, Rattus norvegicus
tgaaattatttctggtgacctcatc

SEQ ID NO: 602158 - DNA, 25 bp, Rattus norvegicus
tgaaattcacccaaaccagaccatc

SEQ ID NO: 602159 - DNA, 25 bp, Rattus norvegicus
tgaaattcaccctaaccagaccatc

SEQ ID NO: 602160 - DNA, 25 bp, Rattus norvegicus
tgaaattcagacattccacctccag

SEQ ID NO: 602161 - DNA, 25 bp, Rattus norvegicus
tgaaattcagactttccacctccag

SEQ ID NO: 602162 - DNA, 25 bp, Rattus norvegicus
tgaaattccaccacttaaaggccta

SEQ ID NO: 602163 - DNA, 25 bp, Rattus norvegicus
tgaaattccacctcttaaaggccta

SEQ ID NO: 602164 - DNA, 25 bp, Rattus norvegicus
tgaaattcctcacctcctgtgacac

SEQ ID NO: 602165 - DNA, 25 bp, Rattus norvegicus
tgaaattcctcagctcctgtgacac

SEQ ID NO: 602166 - DNA, 25 bp, Rattus norvegicus
tgaaattctaatccctaccaggttt

SEQ ID NO: 602167 - DNA, 25 bp, Rattus norvegicus
tgaaattctaatgcctaccaggttt

SEQ ID NO: 602168 - DNA, 25 bp, Rattus norvegicus
tgaaattctaggaccgtatcgccct

SEQ ID NO: 602169 - DNA, 25 bp, Rattus norvegicus
tgaaattctaggtccgtatcgccct

SEQ ID NO: 602170 - DNA, 25 bp, Rattus norvegicus
tgaaattctgccagaacagtcctcc

SEQ ID NO: 602171 - DNA, 25 bp, Rattus norvegicus
tgaaattctgcctgaacagtcctcc

SEQ ID NO: 602172 - DNA, 25 bp, Rattus norvegicus
tgaaattgccccaggccctccccaa

SEQ ID NO: 602173 - DNA, 25 bp, Rattus norvegicus
tgaaattgcccctggccctccccaa

SEQ ID NO: 602174 - DNA, 25 bp, Rattus norvegicus
tgaaattgcttcaccagtctaacct

SEQ ID NO: 602175 - DNA, 25 bp, Rattus norvegicus
tgaaattgcttctccagtctaacct

SEQ ID NO: 602176 - DNA, 25 bp, Rattus norvegicus
tgaaattggaccacagctgtggccc

SEQ ID NO: 602177 - DNA, 25 bp, Rattus norvegicus
tgaaattggacctcagctgtggccc

SEQ ID NO: 602178 - DNA, 25 bp, Rattus norvegicus
tgaaattggctgagtcctttccaag

SEQ ID NO: 602179 - DNA, 25 bp, Rattus norvegicus
tgaaattggctgtgtcctttccaag

SEQ ID NO: 602180 - DNA, 25 bp, Rattus norvegicus
tgaaattgttcacatgagctaccaa

SEQ ID NO: 602181 - DNA, 25 bp, Rattus norvegicus
tgaaattgttcagatgagctaccaa

SEQ ID NO: 602182 - DNA, 25 bp, Rattus norvegicus
tgaaattgttgaaactcccctcctt

SEQ ID NO: 602183 - DNA, 25 bp, Rattus norvegicus
tgaaattgttgatactcccctcctt

SEQ ID NO: 602184 - DNA, 25 bp, Rattus norvegicus
tgaaattgtttccacccatggtcgc

SEQ ID NO: 602185 - DNA, 25 bp, Rattus norvegicus
tgaaattgtttcgacccatggtcgc

SEQ ID NO: 602186 - DNA, 25 bp, Rattus norvegicus
tgaaatttctttaattggcacttgg

SEQ ID NO: 602187 - DNA, 25 bp, Rattus norvegicus
tgaaatttcttttattggcacttgg

SEQ ID NO: 602188 - DNA, 25 bp, Rattus norvegicus
tgaaattttaccatacctgtaagct

SEQ ID NO: 602189 - DNA, 25 bp, Rattus norvegicus
tgaaattttaccttacctgtaagct

SEQ ID NO: 602190 - DNA, 25 bp, Rattus norvegicus
tgaaattttgggaaatgggccccat

SEQ ID NO: 602191 - DNA, 25 bp, Rattus norvegicus
tgaaattttgggtaatgggccccat

SEQ ID NO: 602192 - DNA, 25 bp, Rattus norvegicus
tgaacaaaagcgagcccttcctcac

SEQ ID NO: 602193 - DNA, 25 bp, Rattus norvegicus
tgaacaaaagcgtgcccttcctcac

SEQ ID NO: 602194 - DNA, 25 bp, Rattus norvegicus
tgaacaaaatcacgagcatggcccc

SEQ ID NO: 602195 - DNA, 25 bp, Rattus norvegicus
tgaacaaaatcaggagcatggcccc

SEQ ID NO: 602196 - DNA, 25 bp, Rattus norvegicus
tgaacaaagcacacctgaccgtcca

SEQ ID NO: 602197 - DNA, 25 bp, Rattus norvegicus
tgaacaaagcactcctgaccgtcca

SEQ ID NO: 602198 - DNA, 25 bp, Rattus norvegicus
tgaacaaagcgtccagcttgtccgc

SEQ ID NO: 602199 - DNA, 25 bp, Rattus norvegicus
tgaacaaagcgtgcagcttgtccgc

SEQ ID NO: 602200 - DNA, 25 bp, Rattus norvegicus
tgaacaaatcccatgcaaggccact

SEQ ID NO: 602201 - DNA, 25 bp, Rattus norvegicus
tgaacaaatcccttgcaaggccact

SEQ ID NO: 602202 - DNA, 25 bp, Rattus norvegicus
tgaacaaattttactcagtgacctc

SEQ ID NO: 602203 - DNA, 25 bp, Rattus norvegicus
tgaacaaatttttctcagtgacctc

SEQ ID NO: 602204 - DNA, 25 bp, Rattus norvegicus
tgaacaacatgcagtgtccggccat

SEQ ID NO: 602205 - DNA, 25 bp, Rattus norvegicus
tgaacaacatgctgtgtccggccat

SEQ ID NO: 602206 - DNA, 25 bp, Rattus norvegicus
tgaacaaccatgcaagtcttccctg

SEQ ID NO: 602207 - DNA, 25 bp, Rattus norvegicus
tgaacaaccatggaagtcttccctg

SEQ ID NO: 602208 - DNA, 25 bp, Rattus norvegicus
tgaacaacccacacaaagaaccact

SEQ ID NO: 602209 - DNA, 25 bp, Rattus norvegicus
tgaacaacccactcaaagaaccact

SEQ ID NO: 602210 - DNA, 25 bp, Rattus norvegicus
tgaacaacctcaagtgatgcctggc

SEQ ID NO: 602211 - DNA, 25 bp, Rattus norvegicus
tgaacaacctcatgtgatgcctggc

SEQ ID NO: 602212 - DNA, 25 bp, Rattus norvegicus
tgaacaacctgccatccttgaaaga

SEQ ID NO: 602213 - DNA, 25 bp, Rattus norvegicus
tgaacaacctgcgatccttgaaaga

SEQ ID NO: 602214 - DNA, 25 bp, Rattus norvegicus
tgaacaacctggagagtcccggcag

SEQ ID NO: 602215 - DNA, 25 bp, Rattus norvegicus
tgaacaacctggtgagtcccggcag

SEQ ID NO: 602216 - DNA, 25 bp, Rattus norvegicus
tgaacaaccttacgtgaccacagca

SEQ ID NO: 602217 - DNA, 25 bp, Rattus norvegicus
tgaacaaccttaggtgaccacagca

SEQ ID NO: 602218 - DNA, 25 bp, Rattus norvegicus
tgaacaactctgctgtcacacactc

SEQ ID NO: 602219 - DNA, 25 bp, Rattus norvegicus
tgaacaactctggtgtcacacactc

SEQ ID NO: 602220 - DNA, 25 bp, Rattus norvegicus
tgaacaactgctcgacccttggcca

SEQ ID NO: 602221 - DNA, 25 bp, Rattus norvegicus
tgaacaactgctggacccttggcca

SEQ ID NO: 602222 - DNA, 25 bp, Rattus norvegicus
tgaacaactggtctcatcttcctac

SEQ ID NO: 602223 - DNA, 25 bp, Rattus norvegicus
tgaacaactggtgtcatcttcctac

SEQ ID NO: 602224 - DNA, 25 bp, Rattus norvegicus
tgaacaacttccaactttcctatga

SEQ ID NO: 602225 - DNA, 25 bp, Rattus norvegicus
tgaacaacttcctactttcctatga

SEQ ID NO: 602226 - DNA, 25 bp, Rattus norvegicus
tgaacaactttcaagccacctgaac

SEQ ID NO: 602227 - DNA, 25 bp, Rattus norvegicus
tgaacaactttcagacttcgtcctc

SEQ ID NO: 602228 - DNA, 25 bp, Rattus norvegicus
tgaacaactttctagccacctgaac

SEQ ID NO: 602229 - DNA, 25 bp, Rattus norvegicus
tgaacaactttctgacttcgtcctc

SEQ ID NO: 602230 - DNA, 25 bp, Rattus norvegicus
tgaacaagatccagggcttcaccat

SEQ ID NO: 602231 - DNA, 25 bp, Rattus norvegicus
tgaacaagatcctgggcttcaccat

SEQ ID NO: 602232 - DNA, 25 bp, Rattus norvegicus
tgaacaagcaagaacttccccactg

SEQ ID NO: 602233 - DNA, 25 bp, Rattus norvegicus
tgaacaagcaagtacttccccactg

SEQ ID NO: 602234 - DNA, 25 bp, Rattus norvegicus
tgaacaagcagcaggcatgcccatg

SEQ ID NO: 602235 - DNA, 25 bp, Rattus norvegicus
tgaacaagcagctggcatgcccatg

SEQ ID NO: 602236 - DNA, 25 bp, Rattus norvegicus
tgaacaagccagaactgccggtgtc

SEQ ID NO: 602237 - DNA, 25 bp, Rattus norvegicus
tgaacaagccagtactgccggtgtc

SEQ ID NO: 602238 - DNA, 25 bp, Rattus norvegicus
tgaacaagcgaccatcatagccttc

SEQ ID NO: 602239 - DNA, 25 bp, Rattus norvegicus
tgaacaagcgacgatcatagccttc

SEQ ID NO: 602240 - DNA, 25 bp, Rattus norvegicus
tgaacaaggcctacaagcgtctctt

SEQ ID NO: 602241 - DNA, 25 bp, Rattus norvegicus
tgaacaaggccttcaagcgtctctt

SEQ ID NO: 602242 - DNA, 25 bp, Rattus norvegicus
tgaacaagtcacactatcctttggc

SEQ ID NO: 602243 - DNA, 25 bp, Rattus norvegicus
tgaacaagtcactctatcctttggc

SEQ ID NO: 602244 - DNA, 25 bp, Rattus norvegicus
tgaacaatctcaacctaccaagtac

SEQ ID NO: 602245 - DNA, 25 bp, Rattus norvegicus
tgaacaatctcatcctaccaagtac

SEQ ID NO: 602246 - DNA, 25 bp, Rattus norvegicus
tgaacaatctgcatcagagccagag

SEQ ID NO: 602247 - DNA, 25 bp, Rattus norvegicus
tgaacaatctgcttcagagccagag

SEQ ID NO: 602248 - DNA, 25 bp, Rattus norvegicus
tgaacaatgcagctcccatggtgga

SEQ ID NO: 602249 - DNA, 25 bp, Rattus norvegicus
tgaacaatgcaggtcccatggtgga

SEQ ID NO: 602250 - DNA, 25 bp, Rattus norvegicus
tgaacaattcacacacacgtgctaa

SEQ ID NO: 602251 - DNA, 25 bp, Rattus norvegicus
tgaacaattcactcacacgtgctaa

SEQ ID NO: 602252 - DNA, 25 bp, Rattus norvegicus
tgaacacaatggacagcaccgctgc

SEQ ID NO: 602253 - DNA, 25 bp, Rattus norvegicus
tgaacacaatggtcagcaccgctgc

SEQ ID NO: 602254 - DNA, 25 bp, Rattus norvegicus
tgaacacacccacactgcaaggcag

SEQ ID NO: 602255 - DNA, 25 bp, Rattus norvegicus
tgaacacacccagactgcaaggcag

SEQ ID NO: 602256 - DNA, 25 bp, Rattus norvegicus
tgaacacacctgcagccatgcaaag

SEQ ID NO: 602257 - DNA, 25 bp, Rattus norvegicus
tgaacacacctggagccatgcaaag

SEQ ID NO: 602258 - DNA, 25 bp, Rattus norvegicus
tgaacacacgttccggaaggccttt

SEQ ID NO: 602259 - DNA, 25 bp, Rattus norvegicus
tgaacacacgttgcggaaggccttt

SEQ ID NO: 602260 - DNA, 25 bp, Rattus norvegicus
tgaacacacttgcatgtctgcatct

SEQ ID NO: 602261 - DNA, 25 bp, Rattus norvegicus
tgaacacacttggatgtctgcatct

SEQ ID NO: 602262 - DNA, 25 bp, Rattus norvegicus
tgaacacagaggacttagatacgct

SEQ ID NO: 602263 - DNA, 25 bp, Rattus norvegicus
tgaacacagaggtcttagatacgct

SEQ ID NO: 602264 - DNA, 25 bp, Rattus norvegicus
tgaacacagagtccgcaacagccag

SEQ ID NO: 602265 - DNA, 25 bp, Rattus norvegicus
tgaacacagagtgcgcaacagccag

SEQ ID NO: 602266 - DNA, 25 bp, Rattus norvegicus
tgaacacaggcactgcaagcataac

SEQ ID NO: 602267 - DNA, 25 bp, Rattus norvegicus
tgaacacaggcagtgcaagcataac

SEQ ID NO: 602268 - DNA, 25 bp, Rattus norvegicus
tgaacacaggtccaatcttcctcaa

SEQ ID NO: 602269 - DNA, 25 bp, Rattus norvegicus
tgaacacaggtcgaatcttcctcaa

SEQ ID NO: 602270 - DNA, 25 bp, Rattus norvegicus
tgaacacagtcacataccttggcct

SEQ ID NO: 602271 - DNA, 25 bp, Rattus norvegicus
tgaacacagtcagataccttggcct

SEQ ID NO: 602272 - DNA, 25 bp, Rattus norvegicus
tgaacacataccacgagcttgactc

SEQ ID NO: 602273 - DNA, 25 bp, Rattus norvegicus
tgaacacatacctcgagcttgactc

SEQ ID NO: 602274 - DNA, 25 bp, Rattus norvegicus
tgaacacatcagatcagccaccatc

SEQ ID NO: 602275 - DNA, 25 bp, Rattus norvegicus
tgaacacatcagttcagccaccatc

SEQ ID NO: 602276 - DNA, 25 bp, Rattus norvegicus
tgaacaccaaggactatcgggccct

SEQ ID NO: 602277 - DNA, 25 bp, Rattus norvegicus
tgaacaccaaggtctatcgggccct

SEQ ID NO: 602278 - DNA, 25 bp, Rattus norvegicus
tgaacaccacccatcacagtgtgag

SEQ ID NO: 602279 - DNA, 25 bp, Rattus norvegicus
tgaacaccacccttcacagtgtgag

SEQ ID NO: 602280 - DNA, 25 bp, Rattus norvegicus
tgaacaccatgtccttaaccagagt

SEQ ID NO: 602281 - DNA, 25 bp, Rattus norvegicus
tgaacaccatgtgcttaaccagagt

SEQ ID NO: 602282 - DNA, 25 bp, Rattus norvegicus
tgaacacccaagagctagccacatt

SEQ ID NO: 602283 - DNA, 25 bp, Rattus norvegicus
tgaacacccaagtgctagccacatt

SEQ ID NO: 602284 - DNA, 25 bp, Rattus norvegicus
tgaacacccatcacatcctgaatta

SEQ ID NO: 602285 - DNA, 25 bp, Rattus norvegicus
tgaacacccatctcatcctgaatta

SEQ ID NO: 602286 - DNA, 25 bp, Rattus norvegicus
tgaacaccttcaaagtcaaaaggag

SEQ ID NO: 602287 - DNA, 25 bp, Rattus norvegicus
tgaacaccttcatagtcaaaaggag

SEQ ID NO: 602288 - DNA, 25 bp, Rattus norvegicus
tgaacacgagttccaccaatgccaa

SEQ ID NO: 602289 - DNA, 25 bp, Rattus norvegicus
tgaacacgagttgcaccaatgccaa

SEQ ID NO: 602290 - DNA, 25 bp, Rattus norvegicus
tgaacacgcatcactgtggaccagc

SEQ ID NO: 602291 - DNA, 25 bp, Rattus norvegicus
tgaacacgcatctctgtggaccagc

SEQ ID NO: 602292 - DNA, 25 bp, Rattus norvegicus
tgaacacggacaacagcatcctgtc

SEQ ID NO: 602293 - DNA, 25 bp, Rattus norvegicus
tgaacacggacatcagcatcctgtc

SEQ ID NO: 602294 - DNA, 25 bp, Rattus norvegicus
tgaacacggcggactgtcgcgatcc

SEQ ID NO: 602295 - DNA, 25 bp, Rattus norvegicus
tgaacacggcggtctgtcgcgatcc

SEQ ID NO: 602296 - DNA, 25 bp, Rattus norvegicus
tgaacacggctgacatcctgtcgta

SEQ ID NO: 602297 - DNA, 25 bp, Rattus norvegicus
tgaacacggctgtcatcctgtcgta

SEQ ID NO: 602298 - DNA, 25 bp, Rattus norvegicus
tgaacacggtgcagagtcccgggat

SEQ ID NO: 602299 - DNA, 25 bp, Rattus norvegicus
tgaacacggtgctgagtcccgggat

SEQ ID NO: 602300 - DNA, 25 bp, Rattus norvegicus
tgaacacgttctcgaggaccccatg

SEQ ID NO: 602301 - DNA, 25 bp, Rattus norvegicus
tgaacacgttctggaggaccccatg

SEQ ID NO: 602302 - DNA, 25 bp, Rattus norvegicus
tgaacactacagactgccttggagc

SEQ ID NO: 602303 - DNA, 25 bp, Rattus norvegicus
tgaacactacagtctgccttggagc

SEQ ID NO: 602304 - DNA, 25 bp, Rattus norvegicus
tgaacactacctccatgccagacaa

SEQ ID NO: 602305 - DNA, 25 bp, Rattus norvegicus
tgaacactacctgcatgccagacaa

SEQ ID NO: 602306 - DNA, 25 bp, Rattus norvegicus
tgaacactctgaatcctacaagtcc

SEQ ID NO: 602307 - DNA, 25 bp, Rattus norvegicus
tgaacactctgattcctacaagtcc

SEQ ID NO: 602308 - DNA, 25 bp, Rattus norvegicus
tgaacactcttaacagcttaccaga

SEQ ID NO: 602309 - DNA, 25 bp, Rattus norvegicus
tgaacactcttatcagcttaccaga

SEQ ID NO: 602310 - DNA, 25 bp, Rattus norvegicus
tgaacactgaccactcgtgcctcga

SEQ ID NO: 602311 - DNA, 25 bp, Rattus norvegicus
tgaacactgaccctggcgatgcctt

SEQ ID NO: 602312 - DNA, 25 bp, Rattus norvegicus
tgaacactgaccgtggcgatgcctt

SEQ ID NO: 602313 - DNA, 25 bp, Rattus norvegicus
tgaacactgacctctcgtgcctcga

SEQ ID NO: 602314 - DNA, 25 bp, Rattus norvegicus
tgaacactgctgagagccctgtata

SEQ ID NO: 602315 - DNA, 25 bp, Rattus norvegicus
tgaacactgctgtgagccctgtata

SEQ ID NO: 602316 - DNA, 25 bp, Rattus norvegicus
tgaacactggccagagtagcaccct

SEQ ID NO: 602317 - DNA, 25 bp, Rattus norvegicus
tgaacactggcctgagtagcaccct

SEQ ID NO: 602318 - DNA, 25 bp, Rattus norvegicus
tgaacactgtctaatcacatcacca

SEQ ID NO: 602319 - DNA, 25 bp, Rattus norvegicus
tgaacactgtcttatcacatcacca

SEQ ID NO: 602320 - DNA, 25 bp, Rattus norvegicus
tgaacactgttacccttgcttcaag

SEQ ID NO: 602321 - DNA, 25 bp, Rattus norvegicus
tgaacactgttagccttgcttcaag

SEQ ID NO: 602322 - DNA, 25 bp, Rattus norvegicus
tgaacacttcaacacgacgtcccag

SEQ ID NO: 602323 - DNA, 25 bp, Rattus norvegicus
tgaacacttcaagacgacgtcccag

SEQ ID NO: 602324 - DNA, 25 bp, Rattus norvegicus
tgaacacttccaaacaacgctactt

SEQ ID NO: 602325 - DNA, 25 bp, Rattus norvegicus
tgaacacttccatacaacgctactt

SEQ ID NO: 602326 - DNA, 25 bp, Rattus norvegicus
tgaacacttctcatttccagctaga

SEQ ID NO: 602327 - DNA, 25 bp, Rattus norvegicus
tgaacacttctcttttccagctaga

SEQ ID NO: 602328 - DNA, 25 bp, Rattus norvegicus
tgaacacttgtcaaatagctatggt

SEQ ID NO: 602329 - DNA, 25 bp, Rattus norvegicus
tgaacacttgtctaatagctatggt

SEQ ID NO: 602330 - DNA, 25 bp, Rattus norvegicus
tgaacactttgtaacctccttggat

SEQ ID NO: 602331 - DNA, 25 bp, Rattus norvegicus
tgaacactttgttacctccttggat

SEQ ID NO: 602332 - DNA, 25 bp, Rattus norvegicus
tgaacagaacatcccatgccatgca

SEQ ID NO: 602333 - DNA, 25 bp, Rattus norvegicus
tgaacagaacatgccatgccatgca

SEQ ID NO: 602334 - DNA, 25 bp, Rattus norvegicus
tgaacagaactgacacccataccag

SEQ ID NO: 602335 - DNA, 25 bp, Rattus norvegicus
tgaacagaactgtcacccataccag

SEQ ID NO: 602336 - DNA, 25 bp, Rattus norvegicus
tgaacagacactcctagttttcctc

SEQ ID NO: 602337 - DNA, 25 bp, Rattus norvegicus
tgaacagacactgctagttttcctc

SEQ ID NO: 602338 - DNA, 25 bp, Rattus norvegicus
tgaacagaccctcactaggcactga

SEQ ID NO: 602339 - DNA, 25 bp, Rattus norvegicus
tgaacagaccctgactaggcactga

SEQ ID NO: 602340 - DNA, 25 bp, Rattus norvegicus
tgaacagacttcctgctgctggtgt

SEQ ID NO: 602341 - DNA, 25 bp, Rattus norvegicus
tgaacagacttcgtgctgctggtgt

SEQ ID NO: 602342 - DNA, 25 bp, Rattus norvegicus
tgaacagagcagacaccgggcgact

SEQ ID NO: 602343 - DNA, 25 bp, Rattus norvegicus
tgaacagagcagtcaccgggcgact

SEQ ID NO: 602344 - DNA, 25 bp, Rattus norvegicus
tgaacagagcctcctgtcaggttat

SEQ ID NO: 602345 - DNA, 25 bp, Rattus norvegicus
tgaacagagcctgctgtcaggttat

SEQ ID NO: 602346 - DNA, 25 bp, Rattus norvegicus
tgaacagataatagccccagaaaga

SEQ ID NO: 602347 - DNA, 25 bp, Rattus norvegicus
tgaacagataattgccccagaaaga

SEQ ID NO: 602348 - DNA, 25 bp, Rattus norvegicus
tgaacagatcgaagcctggctccca

SEQ ID NO: 602349 - DNA, 25 bp, Rattus norvegicus
tgaacagatcgatgcctggctccca

SEQ ID NO: 602350 - DNA, 25 bp, Rattus norvegicus
tgaacagatttccagtgcgcattct

SEQ ID NO: 602351 - DNA, 25 bp, Rattus norvegicus
tgaacagatttcgagtgcgcattct

SEQ ID NO: 602352 - DNA, 25 bp, Rattus norvegicus
tgaacagcaaacactacgtccaaag

SEQ ID NO: 602353 - DNA, 25 bp, Rattus norvegicus
tgaacagcaaactctacgtccaaag

SEQ ID NO: 602354 - DNA, 25 bp, Rattus norvegicus
tgaacagcacacacttccttggtgt

SEQ ID NO: 602355 - DNA, 25 bp, Rattus norvegicus
tgaacagcacactcttccttggtgt

SEQ ID NO: 602356 - DNA, 25 bp, Rattus norvegicus
tgaacagcacgaagactcagaagac

SEQ ID NO: 602357 - DNA, 25 bp, Rattus norvegicus
tgaacagcacgatgactcagaagac

SEQ ID NO: 602358 - DNA, 25 bp, Rattus norvegicus
tgaacagcaggcagcattcctgttg

SEQ ID NO: 602359 - DNA, 25 bp, Rattus norvegicus
tgaacagcaggctgcattcctgttg

SEQ ID NO: 602360 - DNA, 25 bp, Rattus norvegicus
tgaacagcatcaaggttctacccca

SEQ ID NO: 602361 - DNA, 25 bp, Rattus norvegicus
tgaacagcatcatggttctacccca

SEQ ID NO: 602362 - DNA, 25 bp, Rattus norvegicus
tgaacagcatttcactttgccgcga

SEQ ID NO: 602363 - DNA, 25 bp, Rattus norvegicus
tgaacagcatttgactttgccgcga

SEQ ID NO: 602364 - DNA, 25 bp, Rattus norvegicus
tgaacagccaaacggcgatgccgat

SEQ ID NO: 602365 - DNA, 25 bp, Rattus norvegicus
tgaacagccaaagggcgatgccgat

SEQ ID NO: 602366 - DNA, 25 bp, Rattus norvegicus
tgaacagccagtccgtttcttattt

SEQ ID NO: 602367 - DNA, 25 bp, Rattus norvegicus
tgaacagccagtgcgtttcttattt

SEQ ID NO: 602368 - DNA, 25 bp, Rattus norvegicus
tgaacagcccacctcatcaagggag

SEQ ID NO: 602369 - DNA, 25 bp, Rattus norvegicus
tgaacagcccacgtcatcaagggag

SEQ ID NO: 602370 - DNA, 25 bp, Rattus norvegicus
tgaacagccttcagtgagcctggct

SEQ ID NO: 602371 - DNA, 25 bp, Rattus norvegicus
tgaacagccttctgtgagcctggct

SEQ ID NO: 602372 - DNA, 25 bp, Rattus norvegicus
tgaacagcgctaacagccacacgaa

SEQ ID NO: 602373 - DNA, 25 bp, Rattus norvegicus
tgaacagcgctatcagccacacgaa

SEQ ID NO: 602374 - DNA, 25 bp, Rattus norvegicus
tgaacagcgtgtatcctcgaaggtc

SEQ ID NO: 602375 - DNA, 25 bp, Rattus norvegicus
tgaacagcgtgtttcctcgaaggtc

SEQ ID NO: 602376 - DNA, 25 bp, Rattus norvegicus
tgaacagctcccattgtgtaccaca

SEQ ID NO: 602377 - DNA, 25 bp, Rattus norvegicus
tgaacagctccctttgtgtaccaca

SEQ ID NO: 602378 - DNA, 25 bp, Rattus norvegicus
tgaacagctctgctcatgcaacaac

SEQ ID NO: 602379 - DNA, 25 bp, Rattus norvegicus
tgaacagctctggtcatgcaacaac

SEQ ID NO: 602380 - DNA, 25 bp, Rattus norvegicus
tgaacagctgccatctcatttgttc

SEQ ID NO: 602381 - DNA, 25 bp, Rattus norvegicus
tgaacagctgccttctcatttgttc

SEQ ID NO: 602382 - DNA, 25 bp, Rattus norvegicus
tgaacagctggtctgtcagtacccc

SEQ ID NO: 602383 - DNA, 25 bp, Rattus norvegicus
tgaacagctggtgtgtcagtacccc

SEQ ID NO: 602384 - DNA, 25 bp, Rattus norvegicus
tgaacagcttccatactgtctatgc

SEQ ID NO: 602385 - DNA, 25 bp, Rattus norvegicus
tgaacagcttccttactgtctatgc

SEQ ID NO: 602386 - DNA, 25 bp, Rattus norvegicus
tgaacagcttgtacctcctactctt

SEQ ID NO: 602387 - DNA, 25 bp, Rattus norvegicus
tgaacagcttgttcctcctactctt

SEQ ID NO: 602388 - DNA, 25 bp, Rattus norvegicus
tgaacaggaaggactctcagcgccg

SEQ ID NO: 602389 - DNA, 25 bp, Rattus norvegicus
tgaacaggaaggtctctcagcgccg

SEQ ID NO: 602390 - DNA, 25 bp, Rattus norvegicus
tgaacaggaccccagacataggcct

SEQ ID NO: 602391 - DNA, 25 bp, Rattus norvegicus
tgaacaggacccgagacataggcct

SEQ ID NO: 602392 - DNA, 25 bp, Rattus norvegicus
tgaacaggacctcaccaagcttctc

SEQ ID NO: 602393 - DNA, 25 bp, Rattus norvegicus
tgaacaggacctgaccaagcttctc

SEQ ID NO: 602394 - DNA, 25 bp, Rattus norvegicus
tgaacaggatctacgggttcccagc

SEQ ID NO: 602395 - DNA, 25 bp, Rattus norvegicus
tgaacaggatcttcgggttcccagc

SEQ ID NO: 602396 - DNA, 25 bp, Rattus norvegicus
tgaacaggcccacgagatcataact

SEQ ID NO: 602397 - DNA, 25 bp, Rattus norvegicus
tgaacaggcccaggagatcataact

SEQ ID NO: 602398 - DNA, 25 bp, Rattus norvegicus
tgaacaggctcactggctctgcggt

SEQ ID NO: 602399 - DNA, 25 bp, Rattus norvegicus
tgaacaggctcagtggctctgcggt

SEQ ID NO: 602400 - DNA, 25 bp, Rattus norvegicus
tgaacaggctggaccccgactcaca

SEQ ID NO: 602401 - DNA, 25 bp, Rattus norvegicus
tgaacaggctggtccccgactcaca

SEQ ID NO: 602402 - DNA, 25 bp, Rattus norvegicus
tgaacaggctgtattgctccagcca

SEQ ID NO: 602403 - DNA, 25 bp, Rattus norvegicus
tgaacaggctgtcagtcgtacttaa

SEQ ID NO: 602404 - DNA, 25 bp, Rattus norvegicus
tgaacaggctgtgagtcgtacttaa

SEQ ID NO: 602405 - DNA, 25 bp, Rattus norvegicus
tgaacaggctgttttgctccagcca

SEQ ID NO: 602406 - DNA, 25 bp, Rattus norvegicus
tgaacaggtatcacatccgagacgt

SEQ ID NO: 602407 - DNA, 25 bp, Rattus norvegicus
tgaacaggtatctcatccgagacgt

SEQ ID NO: 602408 - DNA, 25 bp, Rattus norvegicus
tgaacaggtcttccttaattccttg

SEQ ID NO: 602409 - DNA, 25 bp, Rattus norvegicus
tgaacaggtcttgcttaattccttg

SEQ ID NO: 602410 - DNA, 25 bp, Rattus norvegicus
tgaacaggtgctcgagtcggcgcgc

SEQ ID NO: 602411 - DNA, 25 bp, Rattus norvegicus
tgaacaggtgctggagtcggcgcgc

SEQ ID NO: 602412 - DNA, 25 bp, Rattus norvegicus
tgaacagtactgactgtcacctctc

SEQ ID NO: 602413 - DNA, 25 bp, Rattus norvegicus
tgaacagtactgtctgtcacctctc

SEQ ID NO: 602414 - DNA, 25 bp, Rattus norvegicus
tgaacagtcttcagccacagttgtg

SEQ ID NO: 602415 - DNA, 25 bp, Rattus norvegicus
tgaacagtcttctgccacagttgtg

SEQ ID NO: 602416 - DNA, 25 bp, Rattus norvegicus
tgaacagtgaacacagtgtccggca

SEQ ID NO: 602417 - DNA, 25 bp, Rattus norvegicus
tgaacagtgaactcagtgtccggca

SEQ ID NO: 602418 - DNA, 25 bp, Rattus norvegicus
tgaacagtgaccaggagcccttcaa

SEQ ID NO: 602419 - DNA, 25 bp, Rattus norvegicus
tgaacagtgacctggagcccttcaa

SEQ ID NO: 602420 - DNA, 25 bp, Rattus norvegicus
tgaacagtgacgaacccgaggtgct

SEQ ID NO: 602421 - DNA, 25 bp, Rattus norvegicus
tgaacagtgacgtacccgaggtgct

SEQ ID NO: 602422 - DNA, 25 bp, Rattus norvegicus
tgaacagtgactcacctgctctcac

SEQ ID NO: 602423 - DNA, 25 bp, Rattus norvegicus
tgaacagtgactcccaatcccaatg

SEQ ID NO: 602424 - DNA, 25 bp, Rattus norvegicus
tgaacagtgactgacctgctctcac

SEQ ID NO: 602425 - DNA, 25 bp, Rattus norvegicus
tgaacagtgactgccaatcccaatg

SEQ ID NO: 602426 - DNA, 25 bp, Rattus norvegicus
tgaacagtggtgcttttccttcttg

SEQ ID NO: 602427 - DNA, 25 bp, Rattus norvegicus
tgaacagtggtggttttccttcttg

SEQ ID NO: 602428 - DNA, 25 bp, Rattus norvegicus
tgaacagtgtatcatgagtgcattg

SEQ ID NO: 602429 - DNA, 25 bp, Rattus norvegicus
tgaacagtgtatgatgagtgcattg

SEQ ID NO: 602430 - DNA, 25 bp, Rattus norvegicus
tgaacagtgtgtcctagtagaccat

SEQ ID NO: 602431 - DNA, 25 bp, Rattus norvegicus
tgaacagtgtgtgctagtagaccat

SEQ ID NO: 602432 - DNA, 25 bp, Rattus norvegicus
tgaacagttgcaagggagagagcct

SEQ ID NO: 602433 - DNA, 25 bp, Rattus norvegicus
tgaacagttgcaatcatttgtggta

SEQ ID NO: 602434 - DNA, 25 bp, Rattus norvegicus
tgaacagttgcatgggagagagcct

SEQ ID NO: 602435 - DNA, 25 bp, Rattus norvegicus
tgaacagttgcattcatttgtggta

SEQ ID NO: 602436 - DNA, 25 bp, Rattus norvegicus
tgaacagttgttcctctgatttttt

SEQ ID NO: 602437 - DNA, 25 bp, Rattus norvegicus
tgaacagttgttgctctgatttttt

SEQ ID NO: 602438 - DNA, 25 bp, Rattus norvegicus
tgaacatacatcatttacccaccca

SEQ ID NO: 602439 - DNA, 25 bp, Rattus norvegicus
tgaacatacatcttttacccaccca

SEQ ID NO: 602440 - DNA, 25 bp, Rattus norvegicus
tgaacatacctgctccagagtctgg

SEQ ID NO: 602441 - DNA, 25 bp, Rattus norvegicus
tgaacatacctggtccagagtctgg

SEQ ID NO: 602442 - DNA, 25 bp, Rattus norvegicus
tgaacataggtgaggctccgtgtat

SEQ ID NO: 602443 - DNA, 25 bp, Rattus norvegicus
tgaacataggtgtggctccgtgtat

SEQ ID NO: 602444 - DNA, 25 bp, Rattus norvegicus
tgaacatatcacagacttgcccttt

SEQ ID NO: 602445 - DNA, 25 bp, Rattus norvegicus
tgaacatatcactgacttgcccttt

SEQ ID NO: 602446 - DNA, 25 bp, Rattus norvegicus
tgaacatatttcagggtgccttaga

SEQ ID NO: 602447 - DNA, 25 bp, Rattus norvegicus
tgaacatatttctgggtgccttaga

SEQ ID NO: 602448 - DNA, 25 bp, Rattus norvegicus
tgaacatcaaccattggtccacggt

SEQ ID NO: 602449 - DNA, 25 bp, Rattus norvegicus
tgaacatcaacctttggtccacggt

SEQ ID NO: 602450 - DNA, 25 bp, Rattus norvegicus
tgaacatcacatctgcccatattgg

SEQ ID NO: 602451 - DNA, 25 bp, Rattus norvegicus
tgaacatcacatgtgcccatattgg

SEQ ID NO: 602452 - DNA, 25 bp, Rattus norvegicus
tgaacatcagatacaggagaactgg

SEQ ID NO: 602453 - DNA, 25 bp, Rattus norvegicus
tgaacatcagattcaggagaactgg

SEQ ID NO: 602454 - DNA, 25 bp, Rattus norvegicus
tgaacatcagctccgtgatctttac

SEQ ID NO: 602455 - DNA, 25 bp, Rattus norvegicus
tgaacatcagctgcgtgatctttac

SEQ ID NO: 602456 - DNA, 25 bp, Rattus norvegicus
tgaacatcaggacatctgtggcccc

SEQ ID NO: 602457 - DNA, 25 bp, Rattus norvegicus
tgaacatcaggagatctgtggcccc

SEQ ID NO: 602458 - DNA, 25 bp, Rattus norvegicus
tgaacatccattactggtctccatg

SEQ ID NO: 602459 - DNA, 25 bp, Rattus norvegicus
tgaacatccatttctggtctccatg

SEQ ID NO: 602460 - DNA, 25 bp, Rattus norvegicus
tgaacatcccaccagtagtccatac

SEQ ID NO: 602461 - DNA, 25 bp, Rattus norvegicus
tgaacatcccacgagtagtccatac

SEQ ID NO: 602462 - DNA, 25 bp, Rattus norvegicus
tgaacatccccacagtgggcattgt

SEQ ID NO: 602463 - DNA, 25 bp, Rattus norvegicus
tgaacatccccagagtgggcattgt

SEQ ID NO: 602464 - DNA, 25 bp, Rattus norvegicus
tgaacatcctctcttacctattgga

SEQ ID NO: 602465 - DNA, 25 bp, Rattus norvegicus
tgaacatcctctgttacctattgga

SEQ ID NO: 602466 - DNA, 25 bp, Rattus norvegicus
tgaacatcggcaccttcgacttggc

SEQ ID NO: 602467 - DNA, 25 bp, Rattus norvegicus
tgaacatcggcagcttcgacttggc

SEQ ID NO: 602468 - DNA, 25 bp, Rattus norvegicus
tgaacatctacgaggacatcatcaa

SEQ ID NO: 602469 - DNA, 25 bp, Rattus norvegicus
tgaacatctacgtggacatcatcaa

SEQ ID NO: 602470 - DNA, 25 bp, Rattus norvegicus
tgaacatctgagcttgcactgacct

SEQ ID NO: 602471 - DNA, 25 bp, Rattus norvegicus
tgaacatctgaggttgcactgacct

SEQ ID NO: 602472 - DNA, 25 bp, Rattus norvegicus
tgaacatctgtaatcccaacctgtg

SEQ ID NO: 602473 - DNA, 25 bp, Rattus norvegicus
tgaacatctgtattcccaacctgtg

SEQ ID NO: 602474 - DNA, 25 bp, Rattus norvegicus
tgaacatgaactcagcaccctatat

SEQ ID NO: 602475 - DNA, 25 bp, Rattus norvegicus
tgaacatgaactgagcaccctatat

SEQ ID NO: 602476 - DNA, 25 bp, Rattus norvegicus
tgaacatggcccagctgagaacagc

SEQ ID NO: 602477 - DNA, 25 bp, Rattus norvegicus
tgaacatggccctgctgagaacagc

SEQ ID NO: 602478 - DNA, 25 bp, Rattus norvegicus
tgaacatgtctcagctgattctccc

SEQ ID NO: 602479 - DNA, 25 bp, Rattus norvegicus
tgaacatgtctctgctgattctccc

SEQ ID NO: 602480 - DNA, 25 bp, Rattus norvegicus
tgaacatgtcttcccagtcacctag

SEQ ID NO: 602481 - DNA, 25 bp, Rattus norvegicus
tgaacatgtcttgccagtcacctag

SEQ ID NO: 602482 - DNA, 25 bp, Rattus norvegicus
tgaacattaaggcactcggcatgat

SEQ ID NO: 602483 - DNA, 25 bp, Rattus norvegicus
tgaacattaagggactcggcatgat

SEQ ID NO: 602484 - DNA, 25 bp, Rattus norvegicus
tgaacattaggtcctctaccccagt

SEQ ID NO: 602485 - DNA, 25 bp, Rattus norvegicus
tgaacattaggtgctctaccccagt

SEQ ID NO: 602486 - DNA, 25 bp, Rattus norvegicus
tgaacattcaagactccggagcaca

SEQ ID NO: 602487 - DNA, 25 bp, Rattus norvegicus
tgaacattcaagtctccggagcaca

SEQ ID NO: 602488 - DNA, 25 bp, Rattus norvegicus
tgaacattcaccacccttaaagtct

SEQ ID NO: 602489 - DNA, 25 bp, Rattus norvegicus
tgaacattcacctcccttaaagtct

SEQ ID NO: 602490 - DNA, 25 bp, Rattus norvegicus
tgaacattccttacatagtttgttg

SEQ ID NO: 602491 - DNA, 25 bp, Rattus norvegicus
tgaacattcctttcatagtttgttg

SEQ ID NO: 602492 - DNA, 25 bp, Rattus norvegicus
tgaacattgcagaagatgcctcccc

SEQ ID NO: 602493 - DNA, 25 bp, Rattus norvegicus
tgaacattgcagtagatgcctcccc

SEQ ID NO: 602494 - DNA, 25 bp, Rattus norvegicus
tgaacattgggcctgaccgaaccag

SEQ ID NO: 602495 - DNA, 25 bp, Rattus norvegicus
tgaacattgggcgtgaccgaaccag

SEQ ID NO: 602496 - DNA, 25 bp, Rattus norvegicus
tgaacattgtcgatcctaactctgc

SEQ ID NO: 602497 - DNA, 25 bp, Rattus norvegicus
tgaacattgtcgttcctaactctgc

SEQ ID NO: 602498 - DNA, 25 bp, Rattus norvegicus
tgaacattgtgcatcaccgctttaa

SEQ ID NO: 602499 - DNA, 25 bp, Rattus norvegicus
tgaacattgtgcttcaccgctttaa

SEQ ID NO: 602500 - DNA, 25 bp, Rattus norvegicus
tgaacatttcacacccttggtatct

SEQ ID NO: 602501 - DNA, 25 bp, Rattus norvegicus
tgaacatttcactcccttggtatct

SEQ ID NO: 602502 - DNA, 25 bp, Rattus norvegicus
tgaacatttcgccaatcactgctca

SEQ ID NO: 602503 - DNA, 25 bp, Rattus norvegicus
tgaacatttcgcgaatcactgctca

SEQ ID NO: 602504 - DNA, 25 bp, Rattus norvegicus
tgaacatttttcactgcttcttcaa

SEQ ID NO: 602505 - DNA, 25 bp, Rattus norvegicus
tgaacatttttctctgcttcttcaa

SEQ ID NO: 602506 - DNA, 25 bp, Rattus norvegicus
tgaaccaaaaacacttcgatgactg

SEQ ID NO: 602507 - DNA, 25 bp, Rattus norvegicus
tgaaccaaaaactcttcgatgactg

SEQ ID NO: 602508 - DNA, 25 bp, Rattus norvegicus
tgaaccaaaaatccctctgacctgt

SEQ ID NO: 602509 - DNA, 25 bp, Rattus norvegicus
tgaaccaaaaatgcctctgacctgt

SEQ ID NO: 602510 - DNA, 25 bp, Rattus norvegicus
tgaaccaaagccatgaaccaaaata

SEQ ID NO: 602511 - DNA, 25 bp, Rattus norvegicus
tgaaccaaagccttgaaccaaaata

SEQ ID NO: 602512 - DNA, 25 bp, Rattus norvegicus
tgaaccaacattcccaccacaatga

SEQ ID NO: 602513 - DNA, 25 bp, Rattus norvegicus
tgaaccaacattgccaccacaatga

SEQ ID NO: 602514 - DNA, 25 bp, Rattus norvegicus
tgaaccaactctctgtcaacttgtg

SEQ ID NO: 602515 - DNA, 25 bp, Rattus norvegicus
tgaaccaactctgtgtcaacttgtg

SEQ ID NO: 602516 - DNA, 25 bp, Rattus norvegicus
tgaaccaacttccttaactctgctg

SEQ ID NO: 602517 - DNA, 25 bp, Rattus norvegicus
tgaaccaacttcgttaactctgctg

SEQ ID NO: 602518 - DNA, 25 bp, Rattus norvegicus
tgaaccaattcacccgaagtaggct

SEQ ID NO: 602519 - DNA, 25 bp, Rattus norvegicus
tgaaccaattcagccgaagtaggct

SEQ ID NO: 602520 - DNA, 25 bp, Rattus norvegicus
tgaaccacaatgacaggccactacg

SEQ ID NO: 602521 - DNA, 25 bp, Rattus norvegicus
tgaaccacaatgtcaggccactacg

SEQ ID NO: 602522 - DNA, 25 bp, Rattus norvegicus
tgaaccacagccaaatcacaaccat

SEQ ID NO: 602523 - DNA, 25 bp, Rattus norvegicus
tgaaccacagcctaatcacaaccat

SEQ ID NO: 602524 - DNA, 25 bp, Rattus norvegicus
tgaaccacatccatgagccttacgt

SEQ ID NO: 602525 - DNA, 25 bp, Rattus norvegicus
tgaaccacatccttgagccttacgt

SEQ ID NO: 602526 - DNA, 25 bp, Rattus norvegicus
tgaaccaccagaacctcagcagagg

SEQ ID NO: 602527 - DNA, 25 bp, Rattus norvegicus
tgaaccaccagatcctcagcagagg

SEQ ID NO: 602528 - DNA, 25 bp, Rattus norvegicus
tgaaccaccataccccattttgatt

SEQ ID NO: 602529 - DNA, 25 bp, Rattus norvegicus
tgaaccaccatagcccattttgatt

SEQ ID NO: 602530 - DNA, 25 bp, Rattus norvegicus
tgaaccaccgctccagcagtatgat

SEQ ID NO: 602531 - DNA, 25 bp, Rattus norvegicus
tgaaccaccgctgcagcagtatgat

SEQ ID NO: 602532 - DNA, 25 bp, Rattus norvegicus
tgaaccacgattatggcactcttcc

SEQ ID NO: 602533 - DNA, 25 bp, Rattus norvegicus
tgaaccacgattttggcactcttcc

SEQ ID NO: 602534 - DNA, 25 bp, Rattus norvegicus
tgaaccacgggtccgcttggagcta

SEQ ID NO: 602535 - DNA, 25 bp, Rattus norvegicus
tgaaccacgggtgcgcttggagcta

SEQ ID NO: 602536 - DNA, 25 bp, Rattus norvegicus
tgaaccactggacacttgtaacatt

SEQ ID NO: 602537 - DNA, 25 bp, Rattus norvegicus
tgaaccactggagacttgtaacatt

SEQ ID NO: 602538 - DNA, 25 bp, Rattus norvegicus
tgaaccactgttctgcaactgtgaa

SEQ ID NO: 602539 - DNA, 25 bp, Rattus norvegicus
tgaaccactgttgtgcaactgtgaa

SEQ ID NO: 602540 - DNA, 25 bp, Rattus norvegicus
tgaaccacttcgatttgccaacatg

SEQ ID NO: 602541 - DNA, 25 bp, Rattus norvegicus
tgaaccacttcgttttgccaacatg

SEQ ID NO: 602542 - DNA, 25 bp, Rattus norvegicus
tgaaccacttggatttatatcagtg

SEQ ID NO: 602543 - DNA, 25 bp, Rattus norvegicus
tgaaccacttggttttatatcagtg

SEQ ID NO: 602544 - DNA, 25 bp, Rattus norvegicus
tgaaccagaatgcaaccgtcactcg

SEQ ID NO: 602545 - DNA, 25 bp, Rattus norvegicus
tgaaccagaatggaaccgtcactcg

SEQ ID NO: 602546 - DNA, 25 bp, Rattus norvegicus
tgaaccagatgaatgctcgccggga

SEQ ID NO: 602547 - DNA, 25 bp, Rattus norvegicus
tgaaccagatgattgctcgccggga

SEQ ID NO: 602548 - DNA, 25 bp, Rattus norvegicus
tgaaccagatgcaccgcttaggccg

SEQ ID NO: 602549 - DNA, 25 bp, Rattus norvegicus
tgaaccagatgctccgcttaggccg

SEQ ID NO: 602550 - DNA, 25 bp, Rattus norvegicus
tgaaccagatttcctgcatggccca

SEQ ID NO: 602551 - DNA, 25 bp, Rattus norvegicus
tgaaccagatttgctgcatggccca

SEQ ID NO: 602552 - DNA, 25 bp, Rattus norvegicus
tgaaccagccgtccaagtgacagag

SEQ ID NO: 602553 - DNA, 25 bp, Rattus norvegicus
tgaaccagccgtgcaagtgacagag

SEQ ID NO: 602554 - DNA, 25 bp, Rattus norvegicus
tgaaccagctaactcccaagatttg

SEQ ID NO: 602555 - DNA, 25 bp, Rattus norvegicus
tgaaccagctaagtcccaagatttg

SEQ ID NO: 602556 - DNA, 25 bp, Rattus norvegicus
tgaaccagctccatccagaatagtc

SEQ ID NO: 602557 - DNA, 25 bp, Rattus norvegicus
tgaaccagctccttccagaatagtc

SEQ ID NO: 602558 - DNA, 25 bp, Rattus norvegicus
tgaaccaggctgctgctgatctgaa

SEQ ID NO: 602559 - DNA, 25 bp, Rattus norvegicus
tgaaccaggctggtgctgatctgaa

SEQ ID NO: 602560 - DNA, 25 bp, Rattus norvegicus
tgaaccagtaacaactcctccagga

SEQ ID NO: 602561 - DNA, 25 bp, Rattus norvegicus
tgaaccagtaactactcctccagga

SEQ ID NO: 602562 - DNA, 25 bp, Rattus norvegicus
tgaaccagtggcatgagagctatgg

SEQ ID NO: 602563 - DNA, 25 bp, Rattus norvegicus
tgaaccagtggcttgagagctatgg

SEQ ID NO: 602564 - DNA, 25 bp, Rattus norvegicus
tgaaccagttaccactccttcttgc

SEQ ID NO: 602565 - DNA, 25 bp, Rattus norvegicus
tgaaccagttacgactccttcttgc

SEQ ID NO: 602566 - DNA, 25 bp, Rattus norvegicus
tgaaccatcacgaggccaggatttg

SEQ ID NO: 602567 - DNA, 25 bp, Rattus norvegicus
tgaaccatcacgtggccaggatttg

SEQ ID NO: 602568 - DNA, 25 bp, Rattus norvegicus
tgaaccatcagaagcctgtggccaa

SEQ ID NO: 602569 - DNA, 25 bp, Rattus norvegicus
tgaaccatcagatgcctgtggccaa

SEQ ID NO: 602570 - DNA, 25 bp, Rattus norvegicus
tgaaccatgggtattgtgctcctca

SEQ ID NO: 602571 - DNA, 25 bp, Rattus norvegicus
tgaaccatgggttttgtgctcctca

SEQ ID NO: 602572 - DNA, 25 bp, Rattus norvegicus
tgaaccatggtgaatccaactctca

SEQ ID NO: 602573 - DNA, 25 bp, Rattus norvegicus
tgaaccatggtgtatccaactctca

SEQ ID NO: 602574 - DNA, 25 bp, Rattus norvegicus
tgaaccatgtgaccggagtcgccag

SEQ ID NO: 602575 - DNA, 25 bp, Rattus norvegicus
tgaaccatgtgagcggagtcgccag

SEQ ID NO: 602576 - DNA, 25 bp, Rattus norvegicus
tgaacccaagtcattttacctcaag

SEQ ID NO: 602577 - DNA, 25 bp, Rattus norvegicus
tgaacccaagtctttttacctcaag

SEQ ID NO: 602578 - DNA, 25 bp, Rattus norvegicus
tgaacccacacaagtctgtgctgct

SEQ ID NO: 602579 - DNA, 25 bp, Rattus norvegicus
tgaacccacacatgtctgtgctgct

SEQ ID NO: 602580 - DNA, 25 bp, Rattus norvegicus
tgaacccacctcatgtagactatag

SEQ ID NO: 602581 - DNA, 25 bp, Rattus norvegicus
tgaacccacctcttgtagactatag

SEQ ID NO: 602582 - DNA, 25 bp, Rattus norvegicus
tgaacccagcaaaaggatccgactc

SEQ ID NO: 602583 - DNA, 25 bp, Rattus norvegicus
tgaacccagcaataggatccgactc

SEQ ID NO: 602584 - DNA, 25 bp, Rattus norvegicus
tgaacccagcccagagcctaaagag

SEQ ID NO: 602585 - DNA, 25 bp, Rattus norvegicus
tgaacccagccctgagcctaaagag

SEQ ID NO: 602586 - DNA, 25 bp, Rattus norvegicus
tgaacccagggtactgactttgaac

SEQ ID NO: 602587 - DNA, 25 bp, Rattus norvegicus
tgaacccagggttctgactttgaac

SEQ ID NO: 602588 - DNA, 25 bp, Rattus norvegicus
tgaacccatctgaaaggaactgctt

SEQ ID NO: 602589 - DNA, 25 bp, Rattus norvegicus
tgaacccatctgtaaggaactgctt

SEQ ID NO: 602590 - DNA, 25 bp, Rattus norvegicus
tgaacccattataacagtgtgcttt

SEQ ID NO: 602591 - DNA, 25 bp, Rattus norvegicus
tgaacccattattacagtgtgcttt

SEQ ID NO: 602592 - DNA, 25 bp, Rattus norvegicus
tgaaccccaaggcagtctacactgt

SEQ ID NO: 602593 - DNA, 25 bp, Rattus norvegicus
tgaaccccaagggagtctacactgt

SEQ ID NO: 602594 - DNA, 25 bp, Rattus norvegicus
tgaaccccagagcatttctgctaat

SEQ ID NO: 602595 - DNA, 25 bp, Rattus norvegicus
tgaaccccagaggatttctgctaat

SEQ ID NO: 602596 - DNA, 25 bp, Rattus norvegicus
tgaaccccatacacagcatcttgac

SEQ ID NO: 602597 - DNA, 25 bp, Rattus norvegicus
tgaaccccatactcagcatcttgac

SEQ ID NO: 602598 - DNA, 25 bp, Rattus norvegicus
tgaaccccatccattacgttataat

SEQ ID NO: 602599 - DNA, 25 bp, Rattus norvegicus
tgaaccccatcctttacgttataat

SEQ ID NO: 602600 - DNA, 25 bp, Rattus norvegicus
tgaaccccatctatggccagaaggg

SEQ ID NO: 602601 - DNA, 25 bp, Rattus norvegicus
tgaaccccatctttggccagaaggg

SEQ ID NO: 602602 - DNA, 25 bp, Rattus norvegicus
tgaaccccatggaaccctggcaaag

SEQ ID NO: 602603 - DNA, 25 bp, Rattus norvegicus
tgaaccccatggtaccctggcaaag

SEQ ID NO: 602604 - DNA, 25 bp, Rattus norvegicus
tgaaccccattcagatctctcgtag

SEQ ID NO: 602605 - DNA, 25 bp, Rattus norvegicus
tgaaccccattctgatctctcgtag

SEQ ID NO: 602606 - DNA, 25 bp, Rattus norvegicus
tgaaccccatttagtgtgagcagca

SEQ ID NO: 602607 - DNA, 25 bp, Rattus norvegicus
tgaaccccattttgtgtgagcagca

SEQ ID NO: 602608 - DNA, 25 bp, Rattus norvegicus
tgaaccccggaccttataaccagat

SEQ ID NO: 602609 - DNA, 25 bp, Rattus norvegicus
tgaaccccggacgttataaccagat

SEQ ID NO: 602610 - DNA, 25 bp, Rattus norvegicus
tgaaccccttcaccatgcaggagga

SEQ ID NO: 602611 - DNA, 25 bp, Rattus norvegicus
tgaaccccttcagcatgcaggagga

SEQ ID NO: 602612 - DNA, 25 bp, Rattus norvegicus
tgaacccgacttccatgctgttgag

SEQ ID NO: 602613 - DNA, 25 bp, Rattus norvegicus
tgaacccgacttgcatgctgttgag

SEQ ID NO: 602614 - DNA, 25 bp, Rattus norvegicus
tgaacccgagtcctcagttcttggg

SEQ ID NO: 602615 - DNA, 25 bp, Rattus norvegicus
tgaacccgagtcgtcagttcttggg

SEQ ID NO: 602616 - DNA, 25 bp, Rattus norvegicus
tgaacccggttgagccaccagctgg

SEQ ID NO: 602617 - DNA, 25 bp, Rattus norvegicus
tgaacccggttgtgccaccagctgg

SEQ ID NO: 602618 - DNA, 25 bp, Rattus norvegicus
tgaacccgtctgagctcgaggactt

SEQ ID NO: 602619 - DNA, 25 bp, Rattus norvegicus
tgaacccgtctgtgctcgaggactt

SEQ ID NO: 602620 - DNA, 25 bp, Rattus norvegicus
tgaaccctaactaccccagaactgg

SEQ ID NO: 602621 - DNA, 25 bp, Rattus norvegicus
tgaaccctaacttccccagaactgg

SEQ ID NO: 602622 - DNA, 25 bp, Rattus norvegicus
tgaaccctaagtagggaggcccctg

SEQ ID NO: 602623 - DNA, 25 bp, Rattus norvegicus
tgaaccctaagttgggaggcccctg

SEQ ID NO: 602624 - DNA, 25 bp, Rattus norvegicus
tgaaccctcacgaacacctggtagg

SEQ ID NO: 602625 - DNA, 25 bp, Rattus norvegicus
tgaaccctcacgtacacctggtagg

SEQ ID NO: 602626 - DNA, 25 bp, Rattus norvegicus
tgaaccctcaggacatgaccttatt

SEQ ID NO: 602627 - DNA, 25 bp, Rattus norvegicus
tgaaccctcaggactgcagcagagt

SEQ ID NO: 602628 - DNA, 25 bp, Rattus norvegicus
tgaaccctcaggtcatgaccttatt

SEQ ID NO: 602629 - DNA, 25 bp, Rattus norvegicus
tgaaccctcaggtctgcagcagagt

SEQ ID NO: 602630 - DNA, 25 bp, Rattus norvegicus
tgaaccctctctagccttgaaacta

SEQ ID NO: 602631 - DNA, 25 bp, Rattus norvegicus
tgaaccctctctatctttaagtagc

SEQ ID NO: 602632 - DNA, 25 bp, Rattus norvegicus
tgaaccctctcttgccttgaaacta

SEQ ID NO: 602633 - DNA, 25 bp, Rattus norvegicus
tgaaccctctctttctttaagtagc

SEQ ID NO: 602634 - DNA, 25 bp, Rattus norvegicus
tgaaccctgaataccagtccacatg

SEQ ID NO: 602635 - DNA, 25 bp, Rattus norvegicus
tgaaccctgaattccagtccacatg

SEQ ID NO: 602636 - DNA, 25 bp, Rattus norvegicus
tgaaccctgatgagactgtccttgg

SEQ ID NO: 602637 - DNA, 25 bp, Rattus norvegicus
tgaaccctgatgtgactgtccttgg

SEQ ID NO: 602638 - DNA, 25 bp, Rattus norvegicus
tgaaccctggctcgtcaggccccaa

SEQ ID NO: 602639 - DNA, 25 bp, Rattus norvegicus
tgaaccctggctggtcaggccccaa

SEQ ID NO: 602640 - DNA, 25 bp, Rattus norvegicus
tgaaccctgggcagtgtagactatt

SEQ ID NO: 602641 - DNA, 25 bp, Rattus norvegicus
tgaaccctgggctgtgtagactatt

SEQ ID NO: 602642 - DNA, 25 bp, Rattus norvegicus
tgaaccctgtccataaatgctctgt

SEQ ID NO: 602643 - DNA, 25 bp, Rattus norvegicus
tgaaccctgtccttaaatgctctgt

SEQ ID NO: 602644 - DNA, 25 bp, Rattus norvegicus
tgaaccctgtctatacctggtataa

SEQ ID NO: 602645 - DNA, 25 bp, Rattus norvegicus
tgaaccctgtctttacctggtataa

SEQ ID NO: 602646 - DNA, 25 bp, Rattus norvegicus
tgaaccctgtgtcggcgtaagtgca

SEQ ID NO: 602647 - DNA, 25 bp, Rattus norvegicus
tgaaccctgtgtgggcgtaagtgca

SEQ ID NO: 602648 - DNA, 25 bp, Rattus norvegicus
tgaacccttccaccgtcgggaacag

SEQ ID NO: 602649 - DNA, 25 bp, Rattus norvegicus
tgaacccttccagcgtcgggaacag

SEQ ID NO: 602650 - DNA, 25 bp, Rattus norvegicus
tgaacccttggtagacactgacctg

SEQ ID NO: 602651 - DNA, 25 bp, Rattus norvegicus
tgaacccttggttgacactgacctg

SEQ ID NO: 602652 - DNA, 25 bp, Rattus norvegicus
tgaaccctttgacagcatccaggat

SEQ ID NO: 602653 - DNA, 25 bp, Rattus norvegicus
tgaaccctttgagagcatccaggat

SEQ ID NO: 602654 - DNA, 25 bp, Rattus norvegicus
tgaaccgaagcccttcatgtagctc

SEQ ID NO: 602655 - DNA, 25 bp, Rattus norvegicus
tgaaccgaagccgttcatgtagctc

SEQ ID NO: 602656 - DNA, 25 bp, Rattus norvegicus
tgaaccgaatttctccaatgctctc

SEQ ID NO: 602657 - DNA, 25 bp, Rattus norvegicus
tgaaccgaatttgtccaatgctctc

SEQ ID NO: 602658 - DNA, 25 bp, Rattus norvegicus
tgaaccgacaacacctacctcaggg

SEQ ID NO: 602659 - DNA, 25 bp, Rattus norvegicus
tgaaccgacaactcctacctcaggg

SEQ ID NO: 602660 - DNA, 25 bp, Rattus norvegicus
tgaaccgagaggacagctccctgaa

SEQ ID NO: 602661 - DNA, 25 bp, Rattus norvegicus
tgaaccgagaggtcagctccctgaa

SEQ ID NO: 602662 - DNA, 25 bp, Rattus norvegicus
tgaaccgagggaccatgtgtacatt

SEQ ID NO: 602663 - DNA, 25 bp, Rattus norvegicus
tgaaccgagggagcatgtgtacatt

SEQ ID NO: 602664 - DNA, 25 bp, Rattus norvegicus
tgaaccgcacggagctcctcggtcg

SEQ ID NO: 602665 - DNA, 25 bp, Rattus norvegicus
tgaaccgcacggtgctcctcggtcg

SEQ ID NO: 602666 - DNA, 25 bp, Rattus norvegicus
tgaaccgcgtgcaacatcagtatgc

SEQ ID NO: 602667 - DNA, 25 bp, Rattus norvegicus
tgaaccgcgtgctacatcagtatgc

SEQ ID NO: 602668 - DNA, 25 bp, Rattus norvegicus
tgaaccgctgaaatgtccggagcca

SEQ ID NO: 602669 - DNA, 25 bp, Rattus norvegicus
tgaaccgctgaattgtccggagcca

SEQ ID NO: 602670 - DNA, 25 bp, Rattus norvegicus
tgaaccgcttcaagccactgaatac

SEQ ID NO: 602671 - DNA, 25 bp, Rattus norvegicus
tgaaccgcttcatgccactgaatac

SEQ ID NO: 602672 - DNA, 25 bp, Rattus norvegicus
tgaaccggaaatcagacactgacac

SEQ ID NO: 602673 - DNA, 25 bp, Rattus norvegicus
tgaaccggaaatgagacactgacac

SEQ ID NO: 602674 - DNA, 25 bp, Rattus norvegicus
tgaaccggatgtctcggcattaatc

SEQ ID NO: 602675 - DNA, 25 bp, Rattus norvegicus
tgaaccggatgtgtcggcattaatc

SEQ ID NO: 602676 - DNA, 25 bp, Rattus norvegicus
tgaaccggcagacctgtggtcttga

SEQ ID NO: 602677 - DNA, 25 bp, Rattus norvegicus
tgaaccggcagagctgtggtcttga

SEQ ID NO: 602678 - DNA, 25 bp, Rattus norvegicus
tgaaccggctgcaggtgaccgaagt

SEQ ID NO: 602679 - DNA, 25 bp, Rattus norvegicus
tgaaccggctgctggtgaccgaagt

SEQ ID NO: 602680 - DNA, 25 bp, Rattus norvegicus
tgaaccgggtcgagtaggagttact

SEQ ID NO: 602681 - DNA, 25 bp, Rattus norvegicus
tgaaccgggtcgtgtaggagttact

SEQ ID NO: 602682 - DNA, 25 bp, Rattus norvegicus
tgaaccgtatatcgttatcactggg

SEQ ID NO: 602683 - DNA, 25 bp, Rattus norvegicus
tgaaccgtatatggttatcactggg

SEQ ID NO: 602684 - DNA, 25 bp, Rattus norvegicus
tgaaccgtgggcatgcaatttctca

SEQ ID NO: 602685 - DNA, 25 bp, Rattus norvegicus
tgaaccgtgggcttgcaatttctca

SEQ ID NO: 602686 - DNA, 25 bp, Rattus norvegicus
tgaaccgtgtgcacttgactgagtt

SEQ ID NO: 602687 - DNA, 25 bp, Rattus norvegicus
tgaaccgtgtgcctcagccagagta

SEQ ID NO: 602688 - DNA, 25 bp, Rattus norvegicus
tgaaccgtgtgcgtcagccagagta

SEQ ID NO: 602689 - DNA, 25 bp, Rattus norvegicus
tgaaccgtgtgctcttgactgagtt

SEQ ID NO: 602690 - DNA, 25 bp, Rattus norvegicus
tgaaccgttgcaccctccagaggga

SEQ ID NO: 602691 - DNA, 25 bp, Rattus norvegicus
tgaaccgttgcagcctccagaggga

SEQ ID NO: 602692 - DNA, 25 bp, Rattus norvegicus
tgaaccgtttacacatgccaactgt

SEQ ID NO: 602693 - DNA, 25 bp, Rattus norvegicus
tgaaccgtttactcatgccaactgt

SEQ ID NO: 602694 - DNA, 25 bp, Rattus norvegicus
tgaaccgtttatatgatccccactg

SEQ ID NO: 602695 - DNA, 25 bp, Rattus norvegicus
tgaaccgtttatttgatccccactg

SEQ ID NO: 602696 - DNA, 25 bp, Rattus norvegicus
tgaacctaagacaatgccttgcctc

SEQ ID NO: 602697 - DNA, 25 bp, Rattus norvegicus
tgaacctaagactatgccttgcctc

SEQ ID NO: 602698 - DNA, 25 bp, Rattus norvegicus
tgaacctatgtcctctgtaactgca

SEQ ID NO: 602699 - DNA, 25 bp, Rattus norvegicus
tgaacctatgtcgtctgtaactgca

SEQ ID NO: 602700 - DNA, 25 bp, Rattus norvegicus
tgaacctatgttacccgagggacat

SEQ ID NO: 602701 - DNA, 25 bp, Rattus norvegicus
tgaacctatgtttcccgagggacat

SEQ ID NO: 602702 - DNA, 25 bp, Rattus norvegicus
tgaacctcacacagatttattggga

SEQ ID NO: 602703 - DNA, 25 bp, Rattus norvegicus
tgaacctcacactgatttattggga

SEQ ID NO: 602704 - DNA, 25 bp, Rattus norvegicus
tgaacctcagaaagcgctgtaccct

SEQ ID NO: 602705 - DNA, 25 bp, Rattus norvegicus
tgaacctcagaaccatacacagctt

SEQ ID NO: 602706 - DNA, 25 bp, Rattus norvegicus
tgaacctcagaactgtgatcctcca

SEQ ID NO: 602707 - DNA, 25 bp, Rattus norvegicus
tgaacctcagaagcatacacagctt

SEQ ID NO: 602708 - DNA, 25 bp, Rattus norvegicus
tgaacctcagaagtgtgatcctcca

SEQ ID NO: 602709 - DNA, 25 bp, Rattus norvegicus
tgaacctcagaatgcgctgtaccct

SEQ ID NO: 602710 - DNA, 25 bp, Rattus norvegicus
tgaacctcagaccttcatgctgatt

SEQ ID NO: 602711 - DNA, 25 bp, Rattus norvegicus
tgaacctcagacgttcatgctgatt

SEQ ID NO: 602712 - DNA, 25 bp, Rattus norvegicus
tgaacctcagagcagcacagtaact

SEQ ID NO: 602713 - DNA, 25 bp, Rattus norvegicus
tgaacctcagaggagcacagtaact

SEQ ID NO: 602714 - DNA, 25 bp, Rattus norvegicus
tgaacctcagtgagtgttccaaccc

SEQ ID NO: 602715 - DNA, 25 bp, Rattus norvegicus
tgaacctcagtgtgtgttccaaccc

SEQ ID NO: 602716 - DNA, 25 bp, Rattus norvegicus
tgaacctcagttattgatctgcaca

SEQ ID NO: 602717 - DNA, 25 bp, Rattus norvegicus
tgaacctcagttctccatcaaacat

SEQ ID NO: 602718 - DNA, 25 bp, Rattus norvegicus
tgaacctcagttgtccatcaaacat

SEQ ID NO: 602719 - DNA, 25 bp, Rattus norvegicus
tgaacctcagtttttgatctgcaca

SEQ ID NO: 602720 - DNA, 25 bp, Rattus norvegicus
tgaacctcctcgatcctgttgtgta

SEQ ID NO: 602721 - DNA, 25 bp, Rattus norvegicus
tgaacctcctcgttcctgttgtgta

SEQ ID NO: 602722 - DNA, 25 bp, Rattus norvegicus
tgaacctcggccctagcactaggaa

SEQ ID NO: 602723 - DNA, 25 bp, Rattus norvegicus
tgaacctcggccgtagcactaggaa

SEQ ID NO: 602724 - DNA, 25 bp, Rattus norvegicus
tgaacctcggttccttgaagaagtt

SEQ ID NO: 602725 - DNA, 25 bp, Rattus norvegicus
tgaacctcggttgcttgaagaagtt

SEQ ID NO: 602726 - DNA, 25 bp, Rattus norvegicus
tgaacctctctgacttgaagtgtga

SEQ ID NO: 602727 - DNA, 25 bp, Rattus norvegicus
tgaacctctctgtcttgaagtgtga

SEQ ID NO: 602728 - DNA, 25 bp, Rattus norvegicus
tgaacctctggtaggaagcccctga

SEQ ID NO: 602729 - DNA, 25 bp, Rattus norvegicus
tgaacctctggttggaagcccctga

SEQ ID NO: 602730 - DNA, 25 bp, Rattus norvegicus
tgaacctcttctctcatggaacaag

SEQ ID NO: 602731 - DNA, 25 bp, Rattus norvegicus
tgaacctcttctgtcatggaacaag

SEQ ID NO: 602732 - DNA, 25 bp, Rattus norvegicus
tgaacctcttggattttaccacctg

SEQ ID NO: 602733 - DNA, 25 bp, Rattus norvegicus
tgaacctcttggtttttaccacctg

SEQ ID NO: 602734 - DNA, 25 bp, Rattus norvegicus
tgaacctcttttcctcaaatctttg

SEQ ID NO: 602735 - DNA, 25 bp, Rattus norvegicus
tgaacctcttttgctcaaatctttg

SEQ ID NO: 602736 - DNA, 25 bp, Rattus norvegicus
tgaacctgcagcaaacctgtggtgg

SEQ ID NO: 602737 - DNA, 25 bp, Rattus norvegicus
tgaacctgcagctaacctgtggtgg

SEQ ID NO: 602738 - DNA, 25 bp, Rattus norvegicus
tgaacctgcattataaccctcgctt

SEQ ID NO: 602739 - DNA, 25 bp, Rattus norvegicus
tgaacctgcattttaaccctcgctt

SEQ ID NO: 602740 - DNA, 25 bp, Rattus norvegicus
tgaacctgccatctttctgttctat

SEQ ID NO: 602741 - DNA, 25 bp, Rattus norvegicus
tgaacctgccatgtttctgttctat

SEQ ID NO: 602742 - DNA, 25 bp, Rattus norvegicus
tgaacctgcctgctgaacagcctgt

SEQ ID NO: 602743 - DNA, 25 bp, Rattus norvegicus
tgaacctgcctggtgaacagcctgt

SEQ ID NO: 602744 - DNA, 25 bp, Rattus norvegicus
tgaacctgcgggagggcgccacctg

SEQ ID NO: 602745 - DNA, 25 bp, Rattus norvegicus
tgaacctgcgggtgggcgccacctg

SEQ ID NO: 602746 - DNA, 25 bp, Rattus norvegicus
tgaacctgctttccccacattgtag

SEQ ID NO: 602747 - DNA, 25 bp, Rattus norvegicus
tgaacctgctttcttgagttacccc

SEQ ID NO: 602748 - DNA, 25 bp, Rattus norvegicus
tgaacctgctttgcccacattgtag

SEQ ID NO: 602749 - DNA, 25 bp, Rattus norvegicus
tgaacctgctttgttgagttacccc

SEQ ID NO: 602750 - DNA, 25 bp, Rattus norvegicus
tgaacctggtatcgagtgctgctct

SEQ ID NO: 602751 - DNA, 25 bp, Rattus norvegicus
tgaacctggtatggagtgctgctct

SEQ ID NO: 602752 - DNA, 25 bp, Rattus norvegicus
tgaacctggtgccacactgaagact

SEQ ID NO: 602753 - DNA, 25 bp, Rattus norvegicus
tgaacctggtgcgacactgaagact

SEQ ID NO: 602754 - DNA, 25 bp, Rattus norvegicus
tgaacctggtggaagctggccgcac

SEQ ID NO: 602755 - DNA, 25 bp, Rattus norvegicus
tgaacctggtggtagctggccgcac

SEQ ID NO: 602756 - DNA, 25 bp, Rattus norvegicus
tgaacctggttcagtgcattcagaa

SEQ ID NO: 602757 - DNA, 25 bp, Rattus norvegicus
tgaacctggttctgtgcattcagaa

SEQ ID NO: 602758 - DNA, 25 bp, Rattus norvegicus
tgaacctggttgaatccttaggact

SEQ ID NO: 602759 - DNA, 25 bp, Rattus norvegicus
tgaacctggttgtatccttaggact

SEQ ID NO: 602760 - DNA, 25 bp, Rattus norvegicus
tgaacctgtgtcacctttgtatccc

SEQ ID NO: 602761 - DNA, 25 bp, Rattus norvegicus
tgaacctgtgtctcctttgtatccc

SEQ ID NO: 602762 - DNA, 25 bp, Rattus norvegicus
tgaacctgtgtgagcttcgcctcta

SEQ ID NO: 602763 - DNA, 25 bp, Rattus norvegicus
tgaacctgtgtgtgcttcgcctcta

SEQ ID NO: 602764 - DNA, 25 bp, Rattus norvegicus
tgaacctgttgcacacgaggcactg

SEQ ID NO: 602765 - DNA, 25 bp, Rattus norvegicus
tgaacctgttgctcacgaggcactg

SEQ ID NO: 602766 - DNA, 25 bp, Rattus norvegicus
tgaaccttaaacctcagctaatgaa

SEQ ID NO: 602767 - DNA, 25 bp, Rattus norvegicus
tgaaccttaaacgtcagctaatgaa

SEQ ID NO: 602768 - DNA, 25 bp, Rattus norvegicus
tgaaccttatatcggatgggtaatt

SEQ ID NO: 602769 - DNA, 25 bp, Rattus norvegicus
tgaaccttatatgggatgggtaatt

SEQ ID NO: 602770 - DNA, 25 bp, Rattus norvegicus
tgaaccttatctacccatggacata

SEQ ID NO: 602771 - DNA, 25 bp, Rattus norvegicus
tgaaccttatcttcccatggacata

SEQ ID NO: 602772 - DNA, 25 bp, Rattus norvegicus
tgaaccttcatcaagtgaccctttg

SEQ ID NO: 602773 - DNA, 25 bp, Rattus norvegicus
tgaaccttcatctagtgaccctttg

SEQ ID NO: 602774 - DNA, 25 bp, Rattus norvegicus
tgaaccttcctactcatctgtgaac

SEQ ID NO: 602775 - DNA, 25 bp, Rattus norvegicus
tgaaccttcctagtcatctgtgaac

SEQ ID NO: 602776 - DNA, 25 bp, Rattus norvegicus
tgaaccttctgtcactaactcctag

SEQ ID NO: 602777 - DNA, 25 bp, Rattus norvegicus
tgaaccttctgtgactaactcctag

SEQ ID NO: 602778 - DNA, 25 bp, Rattus norvegicus
tgaaccttcttgagtaccggactaa

SEQ ID NO: 602779 - DNA, 25 bp, Rattus norvegicus
tgaaccttcttgtgtaccggactaa

SEQ ID NO: 602780 - DNA, 25 bp, Rattus norvegicus
tgaaccttgcatatccttcatctct

SEQ ID NO: 602781 - DNA, 25 bp, Rattus norvegicus
tgaaccttgcatttccttcatctct

SEQ ID NO: 602782 - DNA, 25 bp, Rattus norvegicus
tgaaccttgctgcactgggctggac

SEQ ID NO: 602783 - DNA, 25 bp, Rattus norvegicus
tgaaccttgctggactgggctggac

SEQ ID NO: 602784 - DNA, 25 bp, Rattus norvegicus
tgaaccttgttcagcatattgtagt

SEQ ID NO: 602785 - DNA, 25 bp, Rattus norvegicus
tgaaccttgttctgcatattgtagt

SEQ ID NO: 602786 - DNA, 25 bp, Rattus norvegicus
tgaacctttagtcttcggccttgta

SEQ ID NO: 602787 - DNA, 25 bp, Rattus norvegicus
tgaacctttagtgttcggccttgta

SEQ ID NO: 602788 - DNA, 25 bp, Rattus norvegicus
tgaacctttctcatcatccttagga

SEQ ID NO: 602789 - DNA, 25 bp, Rattus norvegicus
tgaacctttctcttcatccttagga

SEQ ID NO: 602790 - DNA, 25 bp, Rattus norvegicus
tgaacctttgtaattttgctcctaa

SEQ ID NO: 602791 - DNA, 25 bp, Rattus norvegicus
tgaacctttgtatttttgctcctaa

SEQ ID NO: 602792 - DNA, 25 bp, Rattus norvegicus
tgaacctttgtgctcctttcctgag

SEQ ID NO: 602793 - DNA, 25 bp, Rattus norvegicus
tgaacctttgtggtcctttcctgag

SEQ ID NO: 602794 - DNA, 25 bp, Rattus norvegicus
tgaaccttttgcaccggccttcttg

SEQ ID NO: 602795 - DNA, 25 bp, Rattus norvegicus
tgaaccttttgctccggccttcttg

SEQ ID NO: 602796 - DNA, 25 bp, Rattus norvegicus
tgaacgaactcgctggcccctgaag

SEQ ID NO: 602797 - DNA, 25 bp, Rattus norvegicus
tgaacgaactcggtggcccctgaag

SEQ ID NO: 602798 - DNA, 25 bp, Rattus norvegicus
tgaacgacctcacttccttgtcctt

SEQ ID NO: 602799 - DNA, 25 bp, Rattus norvegicus
tgaacgacctcagttccttgtcctt

SEQ ID NO: 602800 - DNA, 25 bp, Rattus norvegicus
tgaacgacctggaagcacttccttg

SEQ ID NO: 602801 - DNA, 25 bp, Rattus norvegicus
tgaacgacctggtagcacttccttg

SEQ ID NO: 602802 - DNA, 25 bp, Rattus norvegicus
tgaacgactccgacgccaacagtga

SEQ ID NO: 602803 - DNA, 25 bp, Rattus norvegicus
tgaacgactccgtcgccaacagtga

SEQ ID NO: 602804 - DNA, 25 bp, Rattus norvegicus
tgaacgactgtaattgccaaagcac

SEQ ID NO: 602805 - DNA, 25 bp, Rattus norvegicus
tgaacgactgtatttgccaaagcac

SEQ ID NO: 602806 - DNA, 25 bp, Rattus norvegicus
tgaacgagagccctgagcactgagc

SEQ ID NO: 602807 - DNA, 25 bp, Rattus norvegicus
tgaacgagagccgtgagcactgagc

SEQ ID NO: 602808 - DNA, 25 bp, Rattus norvegicus
tgaacgagatgtagaccttccccat

SEQ ID NO: 602809 - DNA, 25 bp, Rattus norvegicus
tgaacgagatgttgaccttccccat

SEQ ID NO: 602810 - DNA, 25 bp, Rattus norvegicus
tgaacgagcaacaagcacagtcctt

SEQ ID NO: 602811 - DNA, 25 bp, Rattus norvegicus
tgaacgagcaactagcacagtcctt

SEQ ID NO: 602812 - DNA, 25 bp, Rattus norvegicus
tgaacgagtaccacaccagggccaa

SEQ ID NO: 602813 - DNA, 25 bp, Rattus norvegicus
tgaacgagtacctcaccagggccaa

SEQ ID NO: 602814 - DNA, 25 bp, Rattus norvegicus
tgaacgagttgacgcggccccgact

SEQ ID NO: 602815 - DNA, 25 bp, Rattus norvegicus
tgaacgagttgaggcggccccgact

SEQ ID NO: 602816 - DNA, 25 bp, Rattus norvegicus
tgaacgatgggtcctattgcctgca

SEQ ID NO: 602817 - DNA, 25 bp, Rattus norvegicus
tgaacgatgggtgctattgcctgca

SEQ ID NO: 602818 - DNA, 25 bp, Rattus norvegicus
tgaacgcacagcctctggtgcagga

SEQ ID NO: 602819 - DNA, 25 bp, Rattus norvegicus
tgaacgcacagcgtctggtgcagga

SEQ ID NO: 602820 - DNA, 25 bp, Rattus norvegicus
tgaacgcagagcaaaagacccagat

SEQ ID NO: 602821 - DNA, 25 bp, Rattus norvegicus
tgaacgcagagctaaagacccagat

SEQ ID NO: 602822 - DNA, 25 bp, Rattus norvegicus
tgaacgcagcccatcactagaaaat

SEQ ID NO: 602823 - DNA, 25 bp, Rattus norvegicus
tgaacgcagcccttcactagaaaat

SEQ ID NO: 602824 - DNA, 25 bp, Rattus norvegicus
tgaacgcatctaaactggttatgat

SEQ ID NO: 602825 - DNA, 25 bp, Rattus norvegicus
tgaacgcatctatactggttatgat

SEQ ID NO: 602826 - DNA, 25 bp, Rattus norvegicus
tgaacgccacacataccttattaaa

SEQ ID NO: 602827 - DNA, 25 bp, Rattus norvegicus
tgaacgccacacttaccttattaaa

SEQ ID NO: 602828 - DNA, 25 bp, Rattus norvegicus
tgaacgccatcgagccatgtgtgat

SEQ ID NO: 602829 - DNA, 25 bp, Rattus norvegicus
tgaacgccatcgtgccatgtgtgat

SEQ ID NO: 602830 - DNA, 25 bp, Rattus norvegicus
tgaacgccattgatcggtggtcccg

SEQ ID NO: 602831 - DNA, 25 bp, Rattus norvegicus
tgaacgccattgttcggtggtcccg

SEQ ID NO: 602832 - DNA, 25 bp, Rattus norvegicus
tgaacgccctcaccaatgagctgag

SEQ ID NO: 602833 - DNA, 25 bp, Rattus norvegicus
tgaacgccctcagcaatgagctgag

SEQ ID NO: 602834 - DNA, 25 bp, Rattus norvegicus
tgaacgccgagcaggaggtgaagaa

SEQ ID NO: 602835 - DNA, 25 bp, Rattus norvegicus
tgaacgccgagctggaggtgaagaa

SEQ ID NO: 602836 - DNA, 25 bp, Rattus norvegicus
tgaacgccttctccaaatgactgtt

SEQ ID NO: 602837 - DNA, 25 bp, Rattus norvegicus
tgaacgccttctgcaaatgactgtt

SEQ ID NO: 602838 - DNA, 25 bp, Rattus norvegicus
tgaacgcctttcctcaaacaccagt

SEQ ID NO: 602839 - DNA, 25 bp, Rattus norvegicus
tgaacgcctttcgtcaaacaccagt

SEQ ID NO: 602840 - DNA, 25 bp, Rattus norvegicus
tgaacgcgactgagcactggcagct

SEQ ID NO: 602841 - DNA, 25 bp, Rattus norvegicus
tgaacgcgactgtgcactggcagct

SEQ ID NO: 602842 - DNA, 25 bp, Rattus norvegicus
tgaacgcgatctcctatgtagtgat

SEQ ID NO: 602843 - DNA, 25 bp, Rattus norvegicus
tgaacgcgatctgctatgtagtgat

SEQ ID NO: 602844 - DNA, 25 bp, Rattus norvegicus
tgaacgcgcccgatctcgtctgatc

SEQ ID NO: 602845 - DNA, 25 bp, Rattus norvegicus
tgaacgcgcccgttctcgtctgatc

SEQ ID NO: 602846 - DNA, 25 bp, Rattus norvegicus
tgaacgcgtgatcagacgctaccgg

SEQ ID NO: 602847 - DNA, 25 bp, Rattus norvegicus
tgaacgcgtgatgagacgctaccgg

SEQ ID NO: 602848 - DNA, 25 bp, Rattus norvegicus
tgaacgctgagcagtaccctacatt

SEQ ID NO: 602849 - DNA, 25 bp, Rattus norvegicus
tgaacgctgagctgtaccctacatt

SEQ ID NO: 602850 - DNA, 25 bp, Rattus norvegicus
tgaacgctgccgaattcacttcaag

SEQ ID NO: 602851 - DNA, 25 bp, Rattus norvegicus
tgaacgctgccgtattcacttcaag

SEQ ID NO: 602852 - DNA, 25 bp, Rattus norvegicus
tgaacgcttaccaccgttgttgatg

SEQ ID NO: 602853 - DNA, 25 bp, Rattus norvegicus
tgaacgcttacctccgttgttgatg

SEQ ID NO: 602854 - DNA, 25 bp, Rattus norvegicus
tgaacgcttagtcaggcgcccgtca

SEQ ID NO: 602855 - DNA, 25 bp, Rattus norvegicus
tgaacgcttagtgaggcgcccgtca

SEQ ID NO: 602856 - DNA, 25 bp, Rattus norvegicus
tgaacgcttcacaagccaagggagc

SEQ ID NO: 602857 - DNA, 25 bp, Rattus norvegicus
tgaacgcttcactagccaagggagc

SEQ ID NO: 602858 - DNA, 25 bp, Rattus norvegicus
tgaacgcttcatctgaggccaagac

SEQ ID NO: 602859 - DNA, 25 bp, Rattus norvegicus
tgaacgcttcatgtgaggccaagac

SEQ ID NO: 602860 - DNA, 25 bp, Rattus norvegicus
tgaacgcttccacgcagaacgatgc

SEQ ID NO: 602861 - DNA, 25 bp, Rattus norvegicus
tgaacgcttccaggcagaacgatgc

SEQ ID NO: 602862 - DNA, 25 bp, Rattus norvegicus
tgaacggaaacgcaaggaacctcgg

SEQ ID NO: 602863 - DNA, 25 bp, Rattus norvegicus
tgaacggaaacggaaggaacctcgg

SEQ ID NO: 602864 - DNA, 25 bp, Rattus norvegicus
tgaacggaacccctacaagatcttc

SEQ ID NO: 602865 - DNA, 25 bp, Rattus norvegicus
tgaacggaacccgtacaagatcttc

SEQ ID NO: 602866 - DNA, 25 bp, Rattus norvegicus
tgaacggacccaatacctgtgccta

SEQ ID NO: 602867 - DNA, 25 bp, Rattus norvegicus
tgaacggacccattacctgtgccta

SEQ ID NO: 602868 - DNA, 25 bp, Rattus norvegicus
tgaacggattttcagcctttttctg

SEQ ID NO: 602869 - DNA, 25 bp, Rattus norvegicus
tgaacggattttgagcctttttctg

SEQ ID NO: 602870 - DNA, 25 bp, Rattus norvegicus
tgaacggcatccagctacagctcat

SEQ ID NO: 602871 - DNA, 25 bp, Rattus norvegicus
tgaacggcatcctgctacagctcat

SEQ ID NO: 602872 - DNA, 25 bp, Rattus norvegicus
tgaacggccacaaacacccagtaaa

SEQ ID NO: 602873 - DNA, 25 bp, Rattus norvegicus
tgaacggccacatacacccagtaaa

SEQ ID NO: 602874 - DNA, 25 bp, Rattus norvegicus
tgaacggcgtgtactaccaaggtcc

SEQ ID NO: 602875 - DNA, 25 bp, Rattus norvegicus
tgaacggcgtgttctaccaaggtcc

SEQ ID NO: 602876 - DNA, 25 bp, Rattus norvegicus
tgaacggcttcacaggcgagtgcac

SEQ ID NO: 602877 - DNA, 25 bp, Rattus norvegicus
tgaacggcttcagaggcgagtgcac

SEQ ID NO: 602878 - DNA, 25 bp, Rattus norvegicus
tgaacgggataacactttttatggt

SEQ ID NO: 602879 - DNA, 25 bp, Rattus norvegicus
tgaacgggataagactttttatggt

SEQ ID NO: 602880 - DNA, 25 bp, Rattus norvegicus
tgaacgggcgctactcggcctcgga

SEQ ID NO: 602881 - DNA, 25 bp, Rattus norvegicus
tgaacgggcgcttctcggcctcgga

SEQ ID NO: 602882 - DNA, 25 bp, Rattus norvegicus
tgaacgggttacaccgtgcacatct

SEQ ID NO: 602883 - DNA, 25 bp, Rattus norvegicus
tgaacgggttactccgtgcacatct

SEQ ID NO: 602884 - DNA, 25 bp, Rattus norvegicus
tgaacggtactgactgcactgactc

SEQ ID NO: 602885 - DNA, 25 bp, Rattus norvegicus
tgaacggtactgtctgcactgactc

SEQ ID NO: 602886 - DNA, 18 bp, Rattus norvegicus
tgaacggtagcatcttga

SEQ ID NO: 602887 - DNA, 25 bp, Rattus norvegicus
tgaacggtggctatgctggaagaca

SEQ ID NO: 602888 - DNA, 25 bp, Rattus norvegicus
tgaacggtggctttgctggaagaca

SEQ ID NO: 602889 - DNA, 25 bp, Rattus norvegicus
tgaacggtgtgcctggcttcctgtt

SEQ ID NO: 602890 - DNA, 25 bp, Rattus norvegicus
tgaacggtgtgcgtggcttcctgtt

SEQ ID NO: 602891 - DNA, 25 bp, Rattus norvegicus
tgaacggttccacagtagcctttac

SEQ ID NO: 602892 - DNA, 25 bp, Rattus norvegicus
tgaacggttccagagtagcctttac

SEQ ID NO: 602893 - DNA, 25 bp, Rattus norvegicus
tgaacggtttccaggttggttccag

SEQ ID NO: 602894 - DNA, 25 bp, Rattus norvegicus
tgaacggtttcctggttggttccag

SEQ ID NO: 602895 - DNA, 25 bp, Rattus norvegicus
tgaacgtccacgctaaggctgtaat

SEQ ID NO: 602896 - DNA, 25 bp, Rattus norvegicus
tgaacgtccacggtaaggctgtaat

SEQ ID NO: 602897 - DNA, 25 bp, Rattus norvegicus
tgaacgtccggcattagtccactgg

SEQ ID NO: 602898 - DNA, 25 bp, Rattus norvegicus
tgaacgtccggctttagtccactgg

SEQ ID NO: 602899 - DNA, 25 bp, Rattus norvegicus
tgaacgtctgttccccaagatgatg

SEQ ID NO: 602900 - DNA, 25 bp, Rattus norvegicus
tgaacgtctgttgcccaagatgatg

SEQ ID NO: 602901 - DNA, 25 bp, Rattus norvegicus
tgaacgtcttccagagtccagtggc

SEQ ID NO: 602902 - DNA, 25 bp, Rattus norvegicus
tgaacgtcttcctgagtccagtggc

SEQ ID NO: 602903 - DNA, 25 bp, Rattus norvegicus
tgaacgtgacacaagctcgagtagc

SEQ ID NO: 602904 - DNA, 25 bp, Rattus norvegicus
tgaacgtgacactagctcgagtagc

SEQ ID NO: 602905 - DNA, 25 bp, Rattus norvegicus
tgaacgtgactgaagctggctcaaa

SEQ ID NO: 602906 - DNA, 25 bp, Rattus norvegicus
tgaacgtgactgtagctggctcaaa

SEQ ID NO: 602907 - DNA, 25 bp, Rattus norvegicus
tgaacgtggttgaccacctaaggcc

SEQ ID NO: 602908 - DNA, 25 bp, Rattus norvegicus
tgaacgtggttgtccacctaaggcc

SEQ ID NO: 602909 - DNA, 25 bp, Rattus norvegicus
tgaacgttaatgcagcttttgagct

SEQ ID NO: 602910 - DNA, 25 bp, Rattus norvegicus
tgaacgttaatggagcttttgagct

SEQ ID NO: 602911 - DNA, 25 bp, Rattus norvegicus
tgaacgttaccaacttccatttgac

SEQ ID NO: 602912 - DNA, 25 bp, Rattus norvegicus
tgaacgttaccatcttccatttgac

SEQ ID NO: 602913 - DNA, 25 bp, Rattus norvegicus
tgaactaaaataccccccctgtgtt

SEQ ID NO: 602914 - DNA, 25 bp, Rattus norvegicus
tgaactaaaatagcccccctgtgtt

SEQ ID NO: 602915 - DNA, 25 bp, Rattus norvegicus
tgaactaaagcaaccaactgccctg

SEQ ID NO: 602916 - DNA, 25 bp, Rattus norvegicus
tgaactaaagcatccaactgccctg

SEQ ID NO: 602917 - DNA, 25 bp, Rattus norvegicus
tgaactaaagctcgccctgaatgag

SEQ ID NO: 602918 - DNA, 25 bp, Rattus norvegicus
tgaactaaagctggccctgaatgag

SEQ ID NO: 602919 - DNA, 25 bp, Rattus norvegicus
tgaactaagtcaaagtccccttctg

SEQ ID NO: 602920 - DNA, 25 bp, Rattus norvegicus
tgaactaagtcatagtccccttctg

SEQ ID NO: 602921 - DNA, 25 bp, Rattus norvegicus
tgaactaatgccattcctagctatt

SEQ ID NO: 602922 - DNA, 25 bp, Rattus norvegicus
tgaactaatgcctttcctagctatt

SEQ ID NO: 602923 - DNA, 25 bp, Rattus norvegicus
tgaactacacaaactcctctgtgcc

SEQ ID NO: 602924 - DNA, 25 bp, Rattus norvegicus
tgaactacacaatctcctctgtgcc

SEQ ID NO: 602925 - DNA, 25 bp, Rattus norvegicus
tgaactacaccacatcccagtttgt

SEQ ID NO: 602926 - DNA, 25 bp, Rattus norvegicus
tgaactacaccagatcccagtttgt

SEQ ID NO: 602927 - DNA, 25 bp, Rattus norvegicus
tgaactacactacactacctaatct

SEQ ID NO: 602928 - DNA, 25 bp, Rattus norvegicus
tgaactacactagactacctaatct

SEQ ID NO: 602929 - DNA, 25 bp, Rattus norvegicus
tgaactacagcgaccacgatgtcat

SEQ ID NO: 602930 - DNA, 25 bp, Rattus norvegicus
tgaactacagcgtccacgatgtcat

SEQ ID NO: 602931 - DNA, 25 bp, Rattus norvegicus
tgaactacatgtccctagctaattg

SEQ ID NO: 602932 - DNA, 25 bp, Rattus norvegicus
tgaactacatgtgcctagctaattg

SEQ ID NO: 602933 - DNA, 25 bp, Rattus norvegicus
tgaactacctaactccctgactcag

SEQ ID NO: 602934 - DNA, 25 bp, Rattus norvegicus
tgaactacctaagtccctgactcag

SEQ ID NO: 602935 - DNA, 25 bp, Rattus norvegicus
tgaactagatttaccctgtgggtac

SEQ ID NO: 602936 - DNA, 25 bp, Rattus norvegicus
tgaactagattttccctgtgggtac

SEQ ID NO: 602937 - DNA, 25 bp, Rattus norvegicus
tgaactagcatacaatcccagcgcc

SEQ ID NO: 602938 - DNA, 25 bp, Rattus norvegicus
tgaactagcatagaatcccagcgcc

SEQ ID NO: 602939 - DNA, 25 bp, Rattus norvegicus
tgaactagcttcaaaacgtctgccc

SEQ ID NO: 602940 - DNA, 25 bp, Rattus norvegicus
tgaactagcttctaaacgtctgccc

SEQ ID NO: 602941 - DNA, 25 bp, Rattus norvegicus
tgaactaggattaatgcagacattt

SEQ ID NO: 602942 - DNA, 25 bp, Rattus norvegicus
tgaactaggatttatgcagacattt

SEQ ID NO: 602943 - DNA, 25 bp, Rattus norvegicus
tgaactaggtcaatccagggacact

SEQ ID NO: 602944 - DNA, 25 bp, Rattus norvegicus
tgaactaggtcattccagggacact

SEQ ID NO: 602945 - DNA, 25 bp, Rattus norvegicus
tgaactagtccaagttaccacgtag

SEQ ID NO: 602946 - DNA, 25 bp, Rattus norvegicus
tgaactagtccatgttaccacgtag

SEQ ID NO: 602947 - DNA, 25 bp, Rattus norvegicus
tgaactagtgttactcctgcctcag

SEQ ID NO: 602948 - DNA, 25 bp, Rattus norvegicus
tgaactagtgtttctcctgcctcag

SEQ ID NO: 602949 - DNA, 25 bp, Rattus norvegicus
tgaactatcagcaccattcctgggc

SEQ ID NO: 602950 - DNA, 25 bp, Rattus norvegicus
tgaactatcagctccattcctgggc

SEQ ID NO: 602951 - DNA, 25 bp, Rattus norvegicus
tgaactatccaaaacgtgcctgcca

SEQ ID NO: 602952 - DNA, 25 bp, Rattus norvegicus
tgaactatccaatacgtgcctgcca

SEQ ID NO: 602953 - DNA, 25 bp, Rattus norvegicus
tgaactatccacagtgctgccacaa

SEQ ID NO: 602954 - DNA, 25 bp, Rattus norvegicus
tgaactatccactgtgctgccacaa

SEQ ID NO: 602955 - DNA, 25 bp, Rattus norvegicus
tgaactatctaaatctctctcctcc

SEQ ID NO: 602956 - DNA, 25 bp, Rattus norvegicus
tgaactatctaattctctctcctcc

SEQ ID NO: 602957 - DNA, 25 bp, Rattus norvegicus
tgaactatctatccccagatcagta

SEQ ID NO: 602958 - DNA, 25 bp, Rattus norvegicus
tgaactatctatgcccagatcagta

SEQ ID NO: 602959 - DNA, 25 bp, Rattus norvegicus
tgaactattatacgcagctgaattc

SEQ ID NO: 602960 - DNA, 25 bp, Rattus norvegicus
tgaactattataggcagctgaattc

SEQ ID NO: 602961 - DNA, 25 bp, Rattus norvegicus
tgaactcaagtcatacgcgctggga

SEQ ID NO: 602962 - DNA, 25 bp, Rattus norvegicus
tgaactcaagtcttacgcgctggga

SEQ ID NO: 602963 - DNA, 25 bp, Rattus norvegicus
tgaactcaagttaccattttatgtg

SEQ ID NO: 602964 - DNA, 25 bp, Rattus norvegicus
tgaactcaagttagcggtaaccttc

SEQ ID NO: 602965 - DNA, 25 bp, Rattus norvegicus
tgaactcaagtttccattttatgtg

SEQ ID NO: 602966 - DNA, 25 bp, Rattus norvegicus
tgaactcaagtttgcggtaaccttc

SEQ ID NO: 602967 - DNA, 25 bp, Rattus norvegicus
tgaactcacatcctctttatgcgat

SEQ ID NO: 602968 - DNA, 25 bp, Rattus norvegicus
tgaactcacatcgtctttatgcgat

SEQ ID NO: 602969 - DNA, 25 bp, Rattus norvegicus
tgaactcactgacatttgcctcctt

SEQ ID NO: 602970 - DNA, 25 bp, Rattus norvegicus
tgaactcactgagatttgcctcctt

SEQ ID NO: 602971 - DNA, 25 bp, Rattus norvegicus
tgaactcagaaaacggccagcttct

SEQ ID NO: 602972 - DNA, 25 bp, Rattus norvegicus
tgaactcagaaatcggccagcttct

SEQ ID NO: 602973 - DNA, 25 bp, Rattus norvegicus
tgaactcagagaaccccttgggatt

SEQ ID NO: 602974 - DNA, 25 bp, Rattus norvegicus
tgaactcagagatccccttgggatt

SEQ ID NO: 602975 - DNA, 25 bp, Rattus norvegicus
tgaactcagataactatatgcgtct

SEQ ID NO: 602976 - DNA, 25 bp, Rattus norvegicus
tgaactcagatatctatatgcgtct

SEQ ID NO: 602977 - DNA, 25 bp, Rattus norvegicus
tgaactcaggatcgtcacctcccat

SEQ ID NO: 602978 - DNA, 25 bp, Rattus norvegicus
tgaactcaggatggtcacctcccat

SEQ ID NO: 602979 - DNA, 25 bp, Rattus norvegicus
tgaactcaggctcctcctgcttcag

SEQ ID NO: 602980 - DNA, 25 bp, Rattus norvegicus
tgaactcaggctgctcctgcttcag

SEQ ID NO: 602981 - DNA, 25 bp, Rattus norvegicus
tgaactcagggacatggccactctg

SEQ ID NO: 602982 - DNA, 25 bp, Rattus norvegicus
tgaactcagggagatggccactctg

SEQ ID NO: 602983 - DNA, 25 bp, Rattus norvegicus
tgaactcagtttccttgctgtctgt

SEQ ID NO: 602984 - DNA, 25 bp, Rattus norvegicus
tgaactcagtttgcttgctgtctgt

SEQ ID NO: 602985 - DNA, 25 bp, Rattus norvegicus
tgaactcatagacctccatctgtct

SEQ ID NO: 602986 - DNA, 25 bp, Rattus norvegicus
tgaactcatagagctccatctgtct

SEQ ID NO: 602987 - DNA, 25 bp, Rattus norvegicus
tgaactcatatccagctaactccaa

SEQ ID NO: 602988 - DNA, 25 bp, Rattus norvegicus
tgaactcatatcgagctaactccaa

SEQ ID NO: 602989 - DNA, 25 bp, Rattus norvegicus
tgaactcatgtaaccttcagtccac

SEQ ID NO: 602990 - DNA, 25 bp, Rattus norvegicus
tgaactcatgtatccttcagtccac

SEQ ID NO: 602991 - DNA, 25 bp, Rattus norvegicus
tgaactcattacagccccgttatgt

SEQ ID NO: 602992 - DNA, 25 bp, Rattus norvegicus
tgaactcattactgccccgttatgt

SEQ ID NO: 602993 - DNA, 25 bp, Rattus norvegicus
tgaactccaaaacggcaactcatgt

SEQ ID NO: 602994 - DNA, 25 bp, Rattus norvegicus
tgaactccaaaagggcaactcatgt

SEQ ID NO: 602995 - DNA, 25 bp, Rattus norvegicus
tgaactccaactctaccccagaatg

SEQ ID NO: 602996 - DNA, 25 bp, Rattus norvegicus
tgaactccaactgtaccccagaatg

SEQ ID NO: 602997 - DNA, 25 bp, Rattus norvegicus
tgaactccaagaagtctgggctcct

SEQ ID NO: 602998 - DNA, 25 bp, Rattus norvegicus
tgaactccaagatgtctgggctcct

SEQ ID NO: 602999 - DNA, 25 bp, Rattus norvegicus
tgaactccagaaattatcaagtgct

SEQ ID NO: 603000 - DNA, 25 bp, Rattus norvegicus
tgaactccagaatttatcaagtgct

SEQ ID NO: 603001 - DNA, 25 bp, Rattus norvegicus
tgaactccagacattcctcttggta

SEQ ID NO: 603002 - DNA, 25 bp, Rattus norvegicus
tgaactccagactttcctcttggta

SEQ ID NO: 603003 - DNA, 25 bp, Rattus norvegicus
tgaactccagagagcttggctgacc

SEQ ID NO: 603004 - DNA, 25 bp, Rattus norvegicus
tgaactccagagtgcttggctgacc

SEQ ID NO: 603005 - DNA, 25 bp, Rattus norvegicus
tgaactccagcacccttgaactcag

SEQ ID NO: 603006 - DNA, 25 bp, Rattus norvegicus
tgaactccagcagccttgaactcag

SEQ ID NO: 603007 - DNA, 25 bp, Rattus norvegicus
tgaactccagcgagtgtagccatcc

SEQ ID NO: 603008 - DNA, 25 bp, Rattus norvegicus
tgaactccagcgtgtgtagccatcc

SEQ ID NO: 603009 - DNA, 25 bp, Rattus norvegicus
tgaactcccagaactgtctcagtgc

SEQ ID NO: 603010 - DNA, 25 bp, Rattus norvegicus
tgaactcccagatctgtctcagtgc

SEQ ID NO: 603011 - DNA, 25 bp, Rattus norvegicus
tgaactccccacacatgtatgtaaa

SEQ ID NO: 603012 - DNA, 25 bp, Rattus norvegicus
tgaactccccactcatgtatgtaaa

SEQ ID NO: 603013 - DNA, 25 bp, Rattus norvegicus
tgaactcccctgaacctttgaaaag

SEQ ID NO: 603014 - DNA, 25 bp, Rattus norvegicus
tgaactcccctgtacctttgaaaag

SEQ ID NO: 603015 - DNA, 25 bp, Rattus norvegicus
tgaactccggcgaggtcccagcctg

SEQ ID NO: 603016 - DNA, 25 bp, Rattus norvegicus
tgaactccggcgtggtcccagcctg

SEQ ID NO: 603017 - DNA, 25 bp, Rattus norvegicus
tgaactccggctatctctggtgtga

SEQ ID NO: 603018 - DNA, 25 bp, Rattus norvegicus
tgaactccggctttctctggtgtga

SEQ ID NO: 603019 - DNA, 25 bp, Rattus norvegicus
tgaactccgggaaacaggcttcttt

SEQ ID NO: 603020 - DNA, 25 bp, Rattus norvegicus
tgaactccgggatacaggcttcttt

SEQ ID NO: 603021 - DNA, 25 bp, Rattus norvegicus
tgaactccggtaacaaccactgctg

SEQ ID NO: 603022 - DNA, 25 bp, Rattus norvegicus
tgaactccggtatcaaccactgctg

SEQ ID NO: 603023 - DNA, 25 bp, Rattus norvegicus
tgaactcctgatcttactgcctgtc

SEQ ID NO: 603024 - DNA, 25 bp, Rattus norvegicus
tgaactcctgatgttactgcctgtc

SEQ ID NO: 603025 - DNA, 25 bp, Rattus norvegicus
tgaactcctgccctaactaattaac

SEQ ID NO: 603026 - DNA, 25 bp, Rattus norvegicus
tgaactcctgccgtaactaattaac

SEQ ID NO: 603027 - DNA, 25 bp, Rattus norvegicus
tgaactcctttaagggtttttccat

SEQ ID NO: 603028 - DNA, 25 bp, Rattus norvegicus
tgaactcctttacgcccactgtgaa

SEQ ID NO: 603029 - DNA, 25 bp, Rattus norvegicus
tgaactcctttaggcccactgtgaa

SEQ ID NO: 603030 - DNA, 25 bp, Rattus norvegicus
tgaactcctttatgggtttttccat

SEQ ID NO: 603031 - DNA, 25 bp, Rattus norvegicus
tgaactcgagccaagatttcaggca

SEQ ID NO: 603032 - DNA, 25 bp, Rattus norvegicus
tgaactcgagcctagatttcaggca

SEQ ID NO: 603033 - DNA, 25 bp, Rattus norvegicus
tgaactcgctgtactctgtctattc

SEQ ID NO: 603034 - DNA, 25 bp, Rattus norvegicus
tgaactcgctgttctctgtctattc

SEQ ID NO: 603035 - DNA, 25 bp, Rattus norvegicus
tgaactcggaccacaggcataggca

SEQ ID NO: 603036 - DNA, 25 bp, Rattus norvegicus
tgaactcggacctcaggcataggca

SEQ ID NO: 603037 - DNA, 25 bp, Rattus norvegicus
tgaactcggcatcaattctcatgga

SEQ ID NO: 603038 - DNA, 25 bp, Rattus norvegicus
tgaactcggcatgaattctcatgga

SEQ ID NO: 603039 - DNA, 25 bp, Rattus norvegicus
tgaactcgtaagagtaccttccctg

SEQ ID NO: 603040 - DNA, 25 bp, Rattus norvegicus
tgaactcgtaagtgtaccttccctg

SEQ ID NO: 603041 - DNA, 25 bp, Rattus norvegicus
tgaactctaaataacactgtggtga

SEQ ID NO: 603042 - DNA, 25 bp, Rattus norvegicus
tgaactctaaattacactgtggtga

SEQ ID NO: 603043 - DNA, 25 bp, Rattus norvegicus
tgaactctaagcacttgatccctgg

SEQ ID NO: 603044 - DNA, 25 bp, Rattus norvegicus
tgaactctaagctcttgatccctgg

SEQ ID NO: 603045 - DNA, 25 bp, Rattus norvegicus
tgaactctacccaatcagtttcaaa

SEQ ID NO: 603046 - DNA, 25 bp, Rattus norvegicus
tgaactctaccctatcagtttcaaa

SEQ ID NO: 603047 - DNA, 25 bp, Rattus norvegicus
tgaactctatctcccgtgtgaatgt

SEQ ID NO: 603048 - DNA, 25 bp, Rattus norvegicus
tgaactctatctgccgtgtgaatgt

SEQ ID NO: 603049 - DNA, 25 bp, Rattus norvegicus
tgaactctattaacaccaagccggt

SEQ ID NO: 603050 - DNA, 25 bp, Rattus norvegicus
tgaactctattatcaccaagccggt

SEQ ID NO: 603051 - DNA, 25 bp, Rattus norvegicus
tgaactctctccactgtggacacac

SEQ ID NO: 603052 - DNA, 25 bp, Rattus norvegicus
tgaactctctcctctgtggacacac

SEQ ID NO: 603053 - DNA, 25 bp, Rattus norvegicus
tgaactctgatcctgtggcttgtgg

SEQ ID NO: 603054 - DNA, 25 bp, Rattus norvegicus
tgaactctgatcgtgtggcttgtgg

SEQ ID NO: 603055 - DNA, 25 bp, Rattus norvegicus
tgaactctgcagctagccagggtct

SEQ ID NO: 603056 - DNA, 25 bp, Rattus norvegicus
tgaactctgcaggtagccagggtct

SEQ ID NO: 603057 - DNA, 25 bp, Rattus norvegicus
tgaactctgcctaggctttcagaac

SEQ ID NO: 603058 - DNA, 25 bp, Rattus norvegicus
tgaactctgcctagggccagtacca

SEQ ID NO: 603059 - DNA, 25 bp, Rattus norvegicus
tgaactctgcctcaagggccttaat

SEQ ID NO: 603060 - DNA, 25 bp, Rattus norvegicus
tgaactctgcctgaagggccttaat

SEQ ID NO: 603061 - DNA, 25 bp, Rattus norvegicus
tgaactctgccttggctttcagaac

SEQ ID NO: 603062 - DNA, 25 bp, Rattus norvegicus
tgaactctgccttgggccagtacca

SEQ ID NO: 603063 - DNA, 25 bp, Rattus norvegicus
tgaactctgctactgagcgggctcg

SEQ ID NO: 603064 - DNA, 25 bp, Rattus norvegicus
tgaactctgctagtgagcgggctcg

SEQ ID NO: 603065 - DNA, 25 bp, Rattus norvegicus
tgaactctggccaggcttttttaaa

SEQ ID NO: 603066 - DNA, 25 bp, Rattus norvegicus
tgaactctggcctggcttttttaaa

SEQ ID NO: 603067 - DNA, 25 bp, Rattus norvegicus
tgaactctgggtccggtattgaagt

SEQ ID NO: 603068 - DNA, 25 bp, Rattus norvegicus
tgaactctgggtgcggtattgaagt

SEQ ID NO: 603069 - DNA, 25 bp, Rattus norvegicus
tgaactctggttacattctttttaa

SEQ ID NO: 603070 - DNA, 25 bp, Rattus norvegicus
tgaactctggtttcattctttttaa

SEQ ID NO: 603071 - DNA, 25 bp, Rattus norvegicus
tgaactctgtgaaggccaggctgac

SEQ ID NO: 603072 - DNA, 25 bp, Rattus norvegicus
tgaactctgtgatggccaggctgac

SEQ ID NO: 603073 - DNA, 25 bp, Rattus norvegicus
tgaactctgtgccaacacaacctga

SEQ ID NO: 603074 - DNA, 25 bp, Rattus norvegicus
tgaactctgtgcgaacacaacctga

SEQ ID NO: 603075 - DNA, 25 bp, Rattus norvegicus
tgaactctgtggacatcttgcactg

SEQ ID NO: 603076 - DNA, 25 bp, Rattus norvegicus
tgaactctgtggtcatcttgcactg

SEQ ID NO: 603077 - DNA, 25 bp, Rattus norvegicus
tgaactcttaacagtcacatccgcc

SEQ ID NO: 603078 - DNA, 25 bp, Rattus norvegicus
tgaactcttaactgtcacatccgcc

SEQ ID NO: 603079 - DNA, 25 bp, Rattus norvegicus
tgaactcttaagatttcctgtcctc

SEQ ID NO: 603080 - DNA, 25 bp, Rattus norvegicus
tgaactcttaagttttcctgtcctc

SEQ ID NO: 603081 - DNA, 25 bp, Rattus norvegicus
tgaactcttgcacttgagcccgtag

SEQ ID NO: 603082 - DNA, 25 bp, Rattus norvegicus
tgaactcttgcagttgagcccgtag

SEQ ID NO: 603083 - DNA, 25 bp, Rattus norvegicus
tgaactctttttcaggcccatcatt

SEQ ID NO: 603084 - DNA, 25 bp, Rattus norvegicus
tgaactctttttgaggcccatcatt

SEQ ID NO: 603085 - DNA, 25 bp, Rattus norvegicus
tgaactgaatgccacttgtcccact

SEQ ID NO: 603086 - DNA, 25 bp, Rattus norvegicus
tgaactgaatgcgacttgtcccact

SEQ ID NO: 603087 - DNA, 25 bp, Rattus norvegicus
tgaactgacacactccaggctaatg

SEQ ID NO: 603088 - DNA, 25 bp, Rattus norvegicus
tgaactgacacagtccaggctaatg

SEQ ID NO: 603089 - DNA, 25 bp, Rattus norvegicus
tgaactgacatcctgatgagcccca

SEQ ID NO: 603090 - DNA, 25 bp, Rattus norvegicus
tgaactgacatcgtgatgagcccca

SEQ ID NO: 603091 - DNA, 25 bp, Rattus norvegicus
tgaactgaccatcaagctgagcgtg

SEQ ID NO: 603092 - DNA, 25 bp, Rattus norvegicus
tgaactgaccatgaagctgagcgtg

SEQ ID NO: 603093 - DNA, 25 bp, Rattus norvegicus
tgaactgacccacggctatgatgac

SEQ ID NO: 603094 - DNA, 25 bp, Rattus norvegicus
tgaactgacccagggctatgatgac

SEQ ID NO: 603095 - DNA, 25 bp, Rattus norvegicus
tgaactgagggtatctactgaggga

SEQ ID NO: 603096 - DNA, 25 bp, Rattus norvegicus
tgaactgagggtttctactgaggga

SEQ ID NO: 603097 - DNA, 25 bp, Rattus norvegicus
tgaactgcagagaacccatgtcctt

SEQ ID NO: 603098 - DNA, 25 bp, Rattus norvegicus
tgaactgcagagtacccatgtcctt

SEQ ID NO: 603099 - DNA, 25 bp, Rattus norvegicus
tgaactgcagcaatatcccacgggt

SEQ ID NO: 603100 - DNA, 25 bp, Rattus norvegicus
tgaactgcagcattatcccacgggt

SEQ ID NO: 603101 - DNA, 25 bp, Rattus norvegicus
tgaactgccaggctagtggtccacc

SEQ ID NO: 603102 - DNA, 25 bp, Rattus norvegicus
tgaactgccagggtagtggtccacc

SEQ ID NO: 603103 - DNA, 25 bp, Rattus norvegicus
tgaactgcccagagatggacccaat

SEQ ID NO: 603104 - DNA, 25 bp, Rattus norvegicus
tgaactgcccagtgatggacccaat

SEQ ID NO: 603105 - DNA, 25 bp, Rattus norvegicus
tgaactgccttcagtgccaacacat

SEQ ID NO: 603106 - DNA, 25 bp, Rattus norvegicus
tgaactgccttctgtgccaacacat

SEQ ID NO: 603107 - DNA, 25 bp, Rattus norvegicus
tgaactgctaggagaccggctacgc

SEQ ID NO: 603108 - DNA, 25 bp, Rattus norvegicus
tgaactgctaggtgaccggctacgc

SEQ ID NO: 603109 - DNA, 25 bp, Rattus norvegicus
tgaactgctagtccttaccgagcta

SEQ ID NO: 603110 - DNA, 25 bp, Rattus norvegicus
tgaactgctagtgcttaccgagcta

SEQ ID NO: 603111 - DNA, 25 bp, Rattus norvegicus
tgaactgctatacgatgacatctat

SEQ ID NO: 603112 - DNA, 25 bp, Rattus norvegicus
tgaactgctataggatgacatctat

SEQ ID NO: 603113 - DNA, 25 bp, Rattus norvegicus
tgaactgctccacttggcatttgga

SEQ ID NO: 603114 - DNA, 25 bp, Rattus norvegicus
tgaactgctccagttggcatttgga

SEQ ID NO: 603115 - DNA, 25 bp, Rattus norvegicus
tgaactgctgcaaaacggtaattta

SEQ ID NO: 603116 - DNA, 25 bp, Rattus norvegicus
tgaactgctgcaagtcctgtgaatg

SEQ ID NO: 603117 - DNA, 25 bp, Rattus norvegicus
tgaactgctgcataacggtaattta

SEQ ID NO: 603118 - DNA, 25 bp, Rattus norvegicus
tgaactgctgcatgtcctgtgaatg

SEQ ID NO: 603119 - DNA, 25 bp, Rattus norvegicus
tgaactgctgctagattctcacgta

SEQ ID NO: 603120 - DNA, 25 bp, Rattus norvegicus
tgaactgctgcttgattctcacgta

SEQ ID NO: 603121 - DNA, 25 bp, Rattus norvegicus
tgaactgctgtaccggcgtgtcatc

SEQ ID NO: 603122 - DNA, 25 bp, Rattus norvegicus
tgaactgctgtagcggcgtgtcatc

SEQ ID NO: 603123 - DNA, 25 bp, Rattus norvegicus
tgaactgctgtgcactctggcctgt

SEQ ID NO: 603124 - DNA, 25 bp, Rattus norvegicus
tgaactgctgtggactctggcctgt

SEQ ID NO: 603125 - DNA, 25 bp, Rattus norvegicus
tgaactgctgttcggtctgattgac

SEQ ID NO: 603126 - DNA, 25 bp, Rattus norvegicus
tgaactgctgttgggtctgattgac

SEQ ID NO: 603127 - DNA, 25 bp, Rattus norvegicus
tgaactgcttccctaggactcagaa

SEQ ID NO: 603128 - DNA, 25 bp, Rattus norvegicus
tgaactgcttccgtaggactcagaa

SEQ ID NO: 603129 - DNA, 25 bp, Rattus norvegicus
tgaactgcttctccgttatggaatt

SEQ ID NO: 603130 - DNA, 25 bp, Rattus norvegicus
tgaactgcttctgcgttatggaatt

SEQ ID NO: 603131 - DNA, 25 bp, Rattus norvegicus
tgaactggaaaaatggccccacttt

SEQ ID NO: 603132 - DNA, 25 bp, Rattus norvegicus
tgaactggaaaattggccccacttt

SEQ ID NO: 603133 - DNA, 25 bp, Rattus norvegicus
tgaactggaatgctggcaccctgga

SEQ ID NO: 603134 - DNA, 25 bp, Rattus norvegicus
tgaactggaatggtggcaccctgga

SEQ ID NO: 603135 - DNA, 25 bp, Rattus norvegicus
tgaactggacagagagtcctcgctg

SEQ ID NO: 603136 - DNA, 25 bp, Rattus norvegicus
tgaactggacagtgagtcctcgctg

SEQ ID NO: 603137 - DNA, 25 bp, Rattus norvegicus
tgaactggactactgccacatgctg

SEQ ID NO: 603138 - DNA, 25 bp, Rattus norvegicus
tgaactggactagtgccacatgctg

SEQ ID NO: 603139 - DNA, 25 bp, Rattus norvegicus
tgaactggacttagctcagcaggtg

SEQ ID NO: 603140 - DNA, 25 bp, Rattus norvegicus
tgaactggactttgctcagcaggtg

SEQ ID NO: 603141 - DNA, 25 bp, Rattus norvegicus
tgaactggagacacatcttcacctc

SEQ ID NO: 603142 - DNA, 25 bp, Rattus norvegicus
tgaactggagactcatcttcacctc

SEQ ID NO: 603143 - DNA, 25 bp, Rattus norvegicus
tgaactggataaagactgcccgtct

SEQ ID NO: 603144 - DNA, 25 bp, Rattus norvegicus
tgaactggataatgactgcccgtct

SEQ ID NO: 603145 - DNA, 25 bp, Rattus norvegicus
tgaactggcaaaatcacctcagcct

SEQ ID NO: 603146 - DNA, 25 bp, Rattus norvegicus
tgaactggcaaattcacctcagcct

SEQ ID NO: 603147 - DNA, 25 bp, Rattus norvegicus
tgaactggccccagagatgactgca

SEQ ID NO: 603148 - DNA, 25 bp, Rattus norvegicus
tgaactggcccctgagatgactgca

SEQ ID NO: 603149 - DNA, 25 bp, Rattus norvegicus
tgaactggcggaccttgttcccatg

SEQ ID NO: 603150 - DNA, 25 bp, Rattus norvegicus
tgaactggcggagcttgttcccatg

SEQ ID NO: 603151 - DNA, 25 bp, Rattus norvegicus
tgaactggctctatcagtcccgaaa

SEQ ID NO: 603152 - DNA, 25 bp, Rattus norvegicus
tgaactggctctttcagtcccgaaa

SEQ ID NO: 603153 - DNA, 25 bp, Rattus norvegicus
tgaactgggattccattgcagacca

SEQ ID NO: 603154 - DNA, 25 bp, Rattus norvegicus
tgaactgggattgcattgcagacca

SEQ ID NO: 603155 - DNA, 25 bp, Rattus norvegicus
tgaactgggcagacggtggtcacca

SEQ ID NO: 603156 - DNA, 25 bp, Rattus norvegicus
tgaactgggcagtcggtggtcacca

SEQ ID NO: 603157 - DNA, 25 bp, Rattus norvegicus
tgaactgggcatctgaagcggtatt

SEQ ID NO: 603158 - DNA, 25 bp, Rattus norvegicus
tgaactgggcatgtgaagcggtatt

SEQ ID NO: 603159 - DNA, 25 bp, Rattus norvegicus
tgaactggtggactacattacaata

SEQ ID NO: 603160 - DNA, 25 bp, Rattus norvegicus
tgaactggtggagtacattacaata

SEQ ID NO: 603161 - DNA, 25 bp, Rattus norvegicus
tgaactgtacaactaacgctcgctt

SEQ ID NO: 603162 - DNA, 25 bp, Rattus norvegicus
tgaactgtacaagtaacgctcgctt

SEQ ID NO: 603163 - DNA, 25 bp, Rattus norvegicus
tgaactgtcaaaaatgagcattgtg

SEQ ID NO: 603164 - DNA, 25 bp, Rattus norvegicus
tgaactgtcaaatatgagcattgtg

SEQ ID NO: 603165 - DNA, 25 bp, Rattus norvegicus
tgaactgtcaccaccacttacgacg

SEQ ID NO: 603166 - DNA, 25 bp, Rattus norvegicus
tgaactgtcacctccacttacgacg

SEQ ID NO: 603167 - DNA, 25 bp, Rattus norvegicus
tgaactgtcttaaggctgctgctgc

SEQ ID NO: 603168 - DNA, 25 bp, Rattus norvegicus
tgaactgtcttatggctgctgctgc

SEQ ID NO: 603169 - DNA, 25 bp, Rattus norvegicus
tgaactgtgaagaccccacgcctgt

SEQ ID NO: 603170 - DNA, 25 bp, Rattus norvegicus
tgaactgtgaagtccccacgcctgt

SEQ ID NO: 603171 - DNA, 25 bp, Rattus norvegicus
tgaactgtgacacatccctgcagag

SEQ ID NO: 603172 - DNA, 25 bp, Rattus norvegicus
tgaactgtgacagatccctgcagag

SEQ ID NO: 603173 - DNA, 25 bp, Rattus norvegicus
tgaactgtgatgctgccgctgtgca

SEQ ID NO: 603174 - DNA, 25 bp, Rattus norvegicus
tgaactgtgatggtgccgctgtgca

SEQ ID NO: 603175 - DNA, 25 bp, Rattus norvegicus
tgaactgtggccaggacggactgca

SEQ ID NO: 603176 - DNA, 25 bp, Rattus norvegicus
tgaactgtggcctggacggactgca

SEQ ID NO: 603177 - DNA, 25 bp, Rattus norvegicus
tgaactgtgtggcactgcctcaaaa

SEQ ID NO: 603178 - DNA, 25 bp, Rattus norvegicus
tgaactgtgtgggactgcctcaaaa

SEQ ID NO: 603179 - DNA, 25 bp, Rattus norvegicus
tgaactgttactaagcttgctggcc

SEQ ID NO: 603180 - DNA, 25 bp, Rattus norvegicus
tgaactgttacttagcttgctggcc

SEQ ID NO: 603181 - DNA, 25 bp, Rattus norvegicus
tgaactgttccccatatgcttgcta

SEQ ID NO: 603182 - DNA, 25 bp, Rattus norvegicus
tgaactgttcccgatatgcttgcta

SEQ ID NO: 603183 - DNA, 25 bp, Rattus norvegicus
tgaactgttgacatgcactgccttt

SEQ ID NO: 603184 - DNA, 25 bp, Rattus norvegicus
tgaactgttgacttgcactgccttt

SEQ ID NO: 603185 - DNA, 25 bp, Rattus norvegicus
tgaactgtttacaggctctagctca

SEQ ID NO: 603186 - DNA, 25 bp, Rattus norvegicus
tgaactgtttactggctctagctca

SEQ ID NO: 603187 - DNA, 25 bp, Rattus norvegicus
tgaactgttttccaatgctgtcggg

SEQ ID NO: 603188 - DNA, 25 bp, Rattus norvegicus
tgaactgttttcgaatgctgtcggg

SEQ ID NO: 603189 - DNA, 25 bp, Rattus norvegicus
tgaacttaaaccacagcctctgtca

SEQ ID NO: 603190 - DNA, 25 bp, Rattus norvegicus
tgaacttaaacctcagcctctgtca

SEQ ID NO: 603191 - DNA, 25 bp, Rattus norvegicus
tgaacttaacttctggtcttcccat

SEQ ID NO: 603192 - DNA, 25 bp, Rattus norvegicus
tgaacttaacttgtggtcttcccat

SEQ ID NO: 603193 - DNA, 25 bp, Rattus norvegicus
tgaacttaatacagacactcctgcc

SEQ ID NO: 603194 - DNA, 25 bp, Rattus norvegicus
tgaacttaatactgacactcctgcc

SEQ ID NO: 603195 - DNA, 25 bp, Rattus norvegicus
tgaacttacagacaaccgcttgcct

SEQ ID NO: 603196 - DNA, 25 bp, Rattus norvegicus
tgaacttacagagaaccgcttgcct

SEQ ID NO: 603197 - DNA, 25 bp, Rattus norvegicus
tgaacttactcacgaaagccagccc

SEQ ID NO: 603198 - DNA, 25 bp, Rattus norvegicus
tgaacttactcaggaaagccagccc

SEQ ID NO: 603199 - DNA, 25 bp, Rattus norvegicus
tgaacttagattcttctgcctctac

SEQ ID NO: 603200 - DNA, 25 bp, Rattus norvegicus
tgaacttagattgttctgcctctac

SEQ ID NO: 603201 - DNA, 25 bp, Rattus norvegicus
tgaacttagcctacatccaaaccta

SEQ ID NO: 603202 - DNA, 25 bp, Rattus norvegicus
tgaacttagccttcatccaaaccta

SEQ ID NO: 603203 - DNA, 25 bp, Rattus norvegicus
tgaacttatcaacttcctcctgcct

SEQ ID NO: 603204 - DNA, 25 bp, Rattus norvegicus
tgaacttatcaagttcctcctgcct

SEQ ID NO: 603205 - DNA, 25 bp, Rattus norvegicus
tgaacttcaatacctgccttcctca

SEQ ID NO: 603206 - DNA, 25 bp, Rattus norvegicus
tgaacttcaatactcttccctaggc

SEQ ID NO: 603207 - DNA, 25 bp, Rattus norvegicus
tgaacttcaatagctgccttcctca

SEQ ID NO: 603208 - DNA, 25 bp, Rattus norvegicus
tgaacttcaatagtcttccctaggc

SEQ ID NO: 603209 - DNA, 25 bp, Rattus norvegicus
tgaacttcacctagtgtgccacagt

SEQ ID NO: 603210 - DNA, 25 bp, Rattus norvegicus
tgaacttcaccttgtgtgccacagt

SEQ ID NO: 603211 - DNA, 25 bp, Rattus norvegicus
tgaacttcacttctggtggctccaa

SEQ ID NO: 603212 - DNA, 25 bp, Rattus norvegicus
tgaacttcacttgtggtggctccaa

SEQ ID NO: 603213 - DNA, 25 bp, Rattus norvegicus
tgaacttcatggattccctttgatg

SEQ ID NO: 603214 - DNA, 25 bp, Rattus norvegicus
tgaacttcatggtttccctttgatg

SEQ ID NO: 603215 - DNA, 25 bp, Rattus norvegicus
tgaacttcatttcgcttaacagctt

SEQ ID NO: 603216 - DNA, 25 bp, Rattus norvegicus
tgaacttcatttggcttaacagctt

SEQ ID NO: 603217 - DNA, 25 bp, Rattus norvegicus
tgaacttccaagacgagctttcggt

SEQ ID NO: 603218 - DNA, 25 bp, Rattus norvegicus
tgaacttccaagtcgagctttcggt

SEQ ID NO: 603219 - DNA, 25 bp, Rattus norvegicus
tgaacttcctagaacttcctgcagt

SEQ ID NO: 603220 - DNA, 25 bp, Rattus norvegicus
tgaacttcctagtacttcctgcagt

SEQ ID NO: 603221 - DNA, 25 bp, Rattus norvegicus
tgaacttcgcacactgagcattcac

SEQ ID NO: 603222 - DNA, 25 bp, Rattus norvegicus
tgaacttcgcactctgagcattcac

SEQ ID NO: 603223 - DNA, 25 bp, Rattus norvegicus
tgaacttctccacaatcaccctgag

SEQ ID NO: 603224 - DNA, 25 bp, Rattus norvegicus
tgaacttctccagaatcaccctgag

SEQ ID NO: 603225 - DNA, 25 bp, Rattus norvegicus
tgaacttctcctcacccaatgtata

SEQ ID NO: 603226 - DNA, 25 bp, Rattus norvegicus
tgaacttctcctgacccaatgtata

SEQ ID NO: 603227 - DNA, 25 bp, Rattus norvegicus
tgaacttctcttagacctctggtgg

SEQ ID NO: 603228 - DNA, 25 bp, Rattus norvegicus
tgaacttctctttgacctctggtgg

SEQ ID NO: 603229 - DNA, 25 bp, Rattus norvegicus
tgaacttctggtcctgcttatctgt

SEQ ID NO: 603230 - DNA, 25 bp, Rattus norvegicus
tgaacttctggtgctgcttatctgt

SEQ ID NO: 603231 - DNA, 25 bp, Rattus norvegicus
tgaacttctgtgctgggatctccgt

SEQ ID NO: 603232 - DNA, 25 bp, Rattus norvegicus
tgaacttctgtggtgggatctccgt

SEQ ID NO: 603233 - DNA, 25 bp, Rattus norvegicus
tgaacttgaaacataccctggaggg

SEQ ID NO: 603234 - DNA, 25 bp, Rattus norvegicus
tgaacttgaaacttaccctggaggg

SEQ ID NO: 603235 - DNA, 25 bp, Rattus norvegicus
tgaacttgaactcagccccagcggg

SEQ ID NO: 603236 - DNA, 25 bp, Rattus norvegicus
tgaacttgaactgagccccagcggg

SEQ ID NO: 603237 - DNA, 25 bp, Rattus norvegicus
tgaacttgacagacttccggctcag

SEQ ID NO: 603238 - DNA, 25 bp, Rattus norvegicus
tgaacttgacagtcttccggctcag

SEQ ID NO: 603239 - DNA, 25 bp, Rattus norvegicus
tgaacttgagcgctgagccctggtt

SEQ ID NO: 603240 - DNA, 25 bp, Rattus norvegicus
tgaacttgagcggtgagccctggtt

SEQ ID NO: 603241 - DNA, 25 bp, Rattus norvegicus
tgaacttgccaccaggaactcaaca

SEQ ID NO: 603242 - DNA, 25 bp, Rattus norvegicus
tgaacttgccacgaggaactcaaca

SEQ ID NO: 603243 - DNA, 25 bp, Rattus norvegicus
tgaacttgccgtacacccttgataa

SEQ ID NO: 603244 - DNA, 25 bp, Rattus norvegicus
tgaacttgccgttcacccttgataa

SEQ ID NO: 603245 - DNA, 25 bp, Rattus norvegicus
tgaacttgccttctgtgacacacag

SEQ ID NO: 603246 - DNA, 25 bp, Rattus norvegicus
tgaacttgccttgtgtgacacacag

SEQ ID NO: 603247 - DNA, 25 bp, Rattus norvegicus
tgaacttgcgccaccgagtttgaat

SEQ ID NO: 603248 - DNA, 25 bp, Rattus norvegicus
tgaacttgcgcctccgagtttgaat

SEQ ID NO: 603249 - DNA, 25 bp, Rattus norvegicus
tgaacttgcgtaccctgtagctaga

SEQ ID NO: 603250 - DNA, 25 bp, Rattus norvegicus
tgaacttgcgtagcctgtagctaga

SEQ ID NO: 603251 - DNA, 25 bp, Rattus norvegicus
tgaacttggaatctaccctttgcct

SEQ ID NO: 603252 - DNA, 25 bp, Rattus norvegicus
tgaacttggaatgtaccctttgcct

SEQ ID NO: 603253 - DNA, 25 bp, Rattus norvegicus
tgaacttggacaacacccgagagcc

SEQ ID NO: 603254 - DNA, 25 bp, Rattus norvegicus
tgaacttggacatcacccgagagcc

SEQ ID NO: 603255 - DNA, 25 bp, Rattus norvegicus
tgaacttggcgactcgctcctgcgg

SEQ ID NO: 603256 - DNA, 25 bp, Rattus norvegicus
tgaacttggcgagtcgctcctgcgg

SEQ ID NO: 603257 - DNA, 25 bp, Rattus norvegicus
tgaacttggctaactcacagcagag

SEQ ID NO: 603258 - DNA, 25 bp, Rattus norvegicus
tgaacttggctatctcacagcagag

SEQ ID NO: 603259 - DNA, 25 bp, Rattus norvegicus
tgaacttggctcatcatccatagct

SEQ ID NO: 603260 - DNA, 25 bp, Rattus norvegicus
tgaacttggctcttcatccatagct

SEQ ID NO: 603261 - DNA, 25 bp, Rattus norvegicus
tgaacttgtcctacgggctccagga

SEQ ID NO: 603262 - DNA, 25 bp, Rattus norvegicus
tgaacttgtccttcgggctccagga

SEQ ID NO: 603263 - DNA, 25 bp, Rattus norvegicus
tgaacttgtgtgagaggttacctca

SEQ ID NO: 603264 - DNA, 25 bp, Rattus norvegicus
tgaacttgtgtgtgaggttacctca

SEQ ID NO: 603265 - DNA, 25 bp, Rattus norvegicus
tgaacttgtgttctactctgtagaa

SEQ ID NO: 603266 - DNA, 25 bp, Rattus norvegicus
tgaacttgtgttgtactctgtagaa

SEQ ID NO: 603267 - DNA, 25 bp, Rattus norvegicus
tgaacttgttcaaggctggattttt

SEQ ID NO: 603268 - DNA, 25 bp, Rattus norvegicus
tgaacttgttcatggctggattttt

SEQ ID NO: 603269 - DNA, 25 bp, Rattus norvegicus
tgaactttaaaccttggattggcct

SEQ ID NO: 603270 - DNA, 25 bp, Rattus norvegicus
tgaactttaaacgttggattggcct

SEQ ID NO: 603271 - DNA, 25 bp, Rattus norvegicus
tgaactttaacgctctccttagcaa

SEQ ID NO: 603272 - DNA, 25 bp, Rattus norvegicus
tgaactttaacggtctccttagcaa

SEQ ID NO: 603273 - DNA, 25 bp, Rattus norvegicus
tgaactttagctctttcctcaaaaa

SEQ ID NO: 603274 - DNA, 25 bp, Rattus norvegicus
tgaactttagctgtttcctcaaaaa

SEQ ID NO: 603275 - DNA, 25 bp, Rattus norvegicus
tgaactttccaaaacctagcgagga

SEQ ID NO: 603276 - DNA, 25 bp, Rattus norvegicus
tgaactttccaatacctagcgagga

SEQ ID NO: 603277 - DNA, 25 bp, Rattus norvegicus
tgaactttcctaacatagctcccat

SEQ ID NO: 603278 - DNA, 25 bp, Rattus norvegicus
tgaactttcctatcatagctcccat

SEQ ID NO: 603279 - DNA, 25 bp, Rattus norvegicus
tgaactttcctcaatctacgatgga

SEQ ID NO: 603280 - DNA, 25 bp, Rattus norvegicus
tgaactttcctcctgtgcatggatg

SEQ ID NO: 603281 - DNA, 25 bp, Rattus norvegicus
tgaactttcctcgtgtgcatggatg

SEQ ID NO: 603282 - DNA, 25 bp, Rattus norvegicus
tgaactttcctctatctacgatgga

SEQ ID NO: 603283 - DNA, 25 bp, Rattus norvegicus
tgaactttctgaccctttcgagttt

SEQ ID NO: 603284 - DNA, 25 bp, Rattus norvegicus
tgaactttctgagcctttcgagttt

SEQ ID NO: 603285 - DNA, 25 bp, Rattus norvegicus
tgaactttctgcattcttatgaccc

SEQ ID NO: 603286 - DNA, 25 bp, Rattus norvegicus
tgaactttctgctttcttatgaccc

SEQ ID NO: 603287 - DNA, 25 bp, Rattus norvegicus
tgaactttcttccacctttgttaat

SEQ ID NO: 603288 - DNA, 25 bp, Rattus norvegicus
tgaactttcttcgacctttgttaat

SEQ ID NO: 603289 - DNA, 25 bp, Rattus norvegicus
tgaactttgaggagccatttgcgcc

SEQ ID NO: 603290 - DNA, 25 bp, Rattus norvegicus
tgaactttgaggtgccatttgcgcc

SEQ ID NO: 603291 - DNA, 25 bp, Rattus norvegicus
tgaactttgcctacgagtctctgag

SEQ ID NO: 603292 - DNA, 25 bp, Rattus norvegicus
tgaactttgccttcgagtctctgag

SEQ ID NO: 603293 - DNA, 25 bp, Rattus norvegicus
tgaactttgctaagatctcctggcc

SEQ ID NO: 603294 - DNA, 25 bp, Rattus norvegicus
tgaactttgctatgatctcctggcc

SEQ ID NO: 603295 - DNA, 25 bp, Rattus norvegicus
tgaactttgggcctctttggaggca

SEQ ID NO: 603296 - DNA, 25 bp, Rattus norvegicus
tgaactttgggcgtctttggaggca

SEQ ID NO: 603297 - DNA, 25 bp, Rattus norvegicus
tgaactttgtgcagcttcggccaga

SEQ ID NO: 603298 - DNA, 25 bp, Rattus norvegicus
tgaactttgtgctgcttcggccaga

SEQ ID NO: 603299 - DNA, 25 bp, Rattus norvegicus
tgaacttttcagataccaaattctt

SEQ ID NO: 603300 - DNA, 25 bp, Rattus norvegicus
tgaacttttcagttaccaaattctt

SEQ ID NO: 603301 - DNA, 25 bp, Rattus norvegicus
tgaacttttgtgatctggaggcatt

SEQ ID NO: 603302 - DNA, 25 bp, Rattus norvegicus
tgaacttttgtgttctggaggcatt

SEQ ID NO: 603303 - DNA, 25 bp, Rattus norvegicus
tgaagaaaaccaacggcccttgttc

SEQ ID NO: 603304 - DNA, 25 bp, Rattus norvegicus
tgaagaaaaccatcggcccttgttc

SEQ ID NO: 603305 - DNA, 25 bp, Rattus norvegicus
tgaagaaacccacgcttgcttctcg

SEQ ID NO: 603306 - DNA, 25 bp, Rattus norvegicus
tgaagaaacccaggcttgcttctcg

SEQ ID NO: 603307 - DNA, 25 bp, Rattus norvegicus
tgaagaaagccaattccaccttgat

SEQ ID NO: 603308 - DNA, 25 bp, Rattus norvegicus
tgaagaaagccatttccaccttgat

SEQ ID NO: 603309 - DNA, 25 bp, Rattus norvegicus
tgaagaaagttgctgcctcccgcag

SEQ ID NO: 603310 - DNA, 25 bp, Rattus norvegicus
tgaagaaagttggtgcctcccgcag

SEQ ID NO: 603311 - DNA, 25 bp, Rattus norvegicus
tgaagaaatccgagcgctctcagag

SEQ ID NO: 603312 - DNA, 25 bp, Rattus norvegicus
tgaagaaatccgtgcgctctcagag

SEQ ID NO: 603313 - DNA, 25 bp, Rattus norvegicus
tgaagaaattcccaggacccgtcgt

SEQ ID NO: 603314 - DNA, 25 bp, Rattus norvegicus
tgaagaaattccgaggacccgtcgt

SEQ ID NO: 603315 - DNA, 25 bp, Rattus norvegicus
tgaagaacaacccttgggtggagaa

SEQ ID NO: 603316 - DNA, 25 bp, Rattus norvegicus
tgaagaacaaccgttgggtggagaa

SEQ ID NO: 603317 - DNA, 25 bp, Rattus norvegicus
tgaagaacagccagcctgcacaagc

SEQ ID NO: 603318 - DNA, 25 bp, Rattus norvegicus
tgaagaacagccagcgtagtctccc

SEQ ID NO: 603319 - DNA, 25 bp, Rattus norvegicus
tgaagaacagcctgcctgcacaagc

SEQ ID NO: 603320 - DNA, 25 bp, Rattus norvegicus
tgaagaacagcctgcgtagtctccc

SEQ ID NO: 603321 - DNA, 25 bp, Rattus norvegicus
tgaagaacatgtcccagcgcatcgg

SEQ ID NO: 603322 - DNA, 25 bp, Rattus norvegicus
tgaagaacatgtgccagcgcatcgg

SEQ ID NO: 603323 - DNA, 25 bp, Rattus norvegicus
tgaagaaccacacaggcggacatct

SEQ ID NO: 603324 - DNA, 25 bp, Rattus norvegicus
tgaagaaccacagaggcggacatct

SEQ ID NO: 603325 - DNA, 25 bp, Rattus norvegicus
tgaagaacccacattctgattccct

SEQ ID NO: 603326 - DNA, 25 bp, Rattus norvegicus
tgaagaacccactttctgattccct

SEQ ID NO: 603327 - DNA, 25 bp, Rattus norvegicus
tgaagaacctcaagtcctgggccag

SEQ ID NO: 603328 - DNA, 25 bp, Rattus norvegicus
tgaagaacctcatgtcctgggccag

SEQ ID NO: 603329 - DNA, 25 bp, Rattus norvegicus
tgaagaacgaagctcctgtggcctc

SEQ ID NO: 603330 - DNA, 25 bp, Rattus norvegicus
tgaagaacgaaggtcctgtggcctc

SEQ ID NO: 603331 - DNA, 25 bp, Rattus norvegicus
tgaagaacgatacccatcttcccta

SEQ ID NO: 603332 - DNA, 25 bp, Rattus norvegicus
tgaagaacgatagccatcttcccta

SEQ ID NO: 603333 - DNA, 25 bp, Rattus norvegicus
tgaagaacgcttctggtcttggcct

SEQ ID NO: 603334 - DNA, 25 bp, Rattus norvegicus
tgaagaacgcttgtggtcttggcct

SEQ ID NO: 603335 - DNA, 25 bp, Rattus norvegicus
tgaagaacggtgatctcagaattga

SEQ ID NO: 603336 - DNA, 25 bp, Rattus norvegicus
tgaagaacggtgttctcagaattga

SEQ ID NO: 603337 - DNA, 25 bp, Rattus norvegicus
tgaagaacgtcaagctcactgccat

SEQ ID NO: 603338 - DNA, 25 bp, Rattus norvegicus
tgaagaacgtcatgctcactgccat

SEQ ID NO: 603339 - DNA, 25 bp, Rattus norvegicus
tgaagaactctcaggtttaccaccc

SEQ ID NO: 603340 - DNA, 25 bp, Rattus norvegicus
tgaagaactctctggtttaccaccc

SEQ ID NO: 603341 - DNA, 25 bp, Rattus norvegicus
tgaagaacttgccttgctcagtacc

SEQ ID NO: 603342 - DNA, 25 bp, Rattus norvegicus
tgaagaacttgcgttgctcagtacc

SEQ ID NO: 603343 - DNA, 25 bp, Rattus norvegicus
tgaagaagaagcacgcctactggct

SEQ ID NO: 603344 - DNA, 25 bp, Rattus norvegicus
tgaagaagaagctcgcctactggct

SEQ ID NO: 603345 - DNA, 25 bp, Rattus norvegicus
tgaagaagagggatctccccggact

SEQ ID NO: 603346 - DNA, 25 bp, Rattus norvegicus
tgaagaagagggttctccccggact

SEQ ID NO: 603347 - DNA, 25 bp, Rattus norvegicus
tgaagaagcagtaccgccgtgcagt

SEQ ID NO: 603348 - DNA, 25 bp, Rattus norvegicus
tgaagaagcagttccgccgtgcagt

SEQ ID NO: 603349 - DNA, 25 bp, Rattus norvegicus
tgaagaagcattcactctcccaagc

SEQ ID NO: 603350 - DNA, 25 bp, Rattus norvegicus
tgaagaagcattgactctcccaagc

SEQ ID NO: 603351 - DNA, 25 bp, Rattus norvegicus
tgaagaagccttcggacttgagcca

SEQ ID NO: 603352 - DNA, 25 bp, Rattus norvegicus
tgaagaagccttgggacttgagcca

SEQ ID NO: 603353 - DNA, 25 bp, Rattus norvegicus
tgaagaagcgctacagcaccacgcg

SEQ ID NO: 603354 - DNA, 25 bp, Rattus norvegicus
tgaagaagcgcttcagcaccacgcg

SEQ ID NO: 603355 - DNA, 25 bp, Rattus norvegicus
tgaagaagctcaactcccacatggg

SEQ ID NO: 603356 - DNA, 25 bp, Rattus norvegicus
tgaagaagctcatctcccacatggg

SEQ ID NO: 603357 - DNA, 25 bp, Rattus norvegicus
tgaagaaggcgcatcactcccagct

SEQ ID NO: 603358 - DNA, 25 bp, Rattus norvegicus
tgaagaaggcgcttcactcccagct

SEQ ID NO: 603359 - DNA, 25 bp, Rattus norvegicus
tgaagaaggctacatgactcccatg

SEQ ID NO: 603360 - DNA, 25 bp, Rattus norvegicus
tgaagaaggctagatgactcccatg

SEQ ID NO: 603361 - DNA, 25 bp, Rattus norvegicus
tgaagaaggtgcagcggctccagca

SEQ ID NO: 603362 - DNA, 25 bp, Rattus norvegicus
tgaagaaggtgctgcggctccagca

SEQ ID NO: 603363 - DNA, 25 bp, Rattus norvegicus
tgaagaagtccgaagcagctcccaa

SEQ ID NO: 603364 - DNA, 25 bp, Rattus norvegicus
tgaagaagtccgtagcagctcccaa

SEQ ID NO: 603365 - DNA, 25 bp, Rattus norvegicus
tgaagaagtctcctgatttcccggt

SEQ ID NO: 603366 - DNA, 25 bp, Rattus norvegicus
tgaagaagtctcgtgatttcccggt

SEQ ID NO: 603367 - DNA, 25 bp, Rattus norvegicus
tgaagaagttctctctgacgccagc

SEQ ID NO: 603368 - DNA, 25 bp, Rattus norvegicus
tgaagaagttctgtctgacgccagc

SEQ ID NO: 603369 - DNA, 25 bp, Rattus norvegicus
tgaagaatcactcggcattaaacct

SEQ ID NO: 603370 - DNA, 25 bp, Rattus norvegicus
tgaagaatcactgggcattaaacct

SEQ ID NO: 603371 - DNA, 25 bp, Rattus norvegicus
tgaagaatcccgctaactccacaaa

SEQ ID NO: 603372 - DNA, 25 bp, Rattus norvegicus
tgaagaatcccggtaactccacaaa

SEQ ID NO: 603373 - DNA, 25 bp, Rattus norvegicus
tgaagaatctctacccatgagtaat

SEQ ID NO: 603374 - DNA, 25 bp, Rattus norvegicus
tgaagaatctcttcccatgagtaat

SEQ ID NO: 603375 - DNA, 25 bp, Rattus norvegicus
tgaagaatgacgaccaccctgatgt

SEQ ID NO: 603376 - DNA, 25 bp, Rattus norvegicus
tgaagaatgacgtccaccctgatgt

SEQ ID NO: 603377 - DNA, 25 bp, Rattus norvegicus
tgaagaatgggcaaccgccggctgc

SEQ ID NO: 603378 - DNA, 25 bp, Rattus norvegicus
tgaagaatgggctaccgccggctgc

SEQ ID NO: 603379 - DNA, 25 bp, Rattus norvegicus
tgaagaatgttaacccggcagggcg

SEQ ID NO: 603380 - DNA, 25 bp, Rattus norvegicus
tgaagaatgttatcccggcagggcg

SEQ ID NO: 603381 - DNA, 25 bp, Rattus norvegicus
tgaagaattaccagtctgaagcaac

SEQ ID NO: 603382 - DNA, 25 bp, Rattus norvegicus
tgaagaattacctgtctgaagcaac

SEQ ID NO: 603383 - DNA, 25 bp, Rattus norvegicus
tgaagaattagaccccatggacccc

SEQ ID NO: 603384 - DNA, 25 bp, Rattus norvegicus
tgaagaattagagcccatggacccc

SEQ ID NO: 603385 - DNA, 25 bp, Rattus norvegicus
tgaagaattcacagcccagaaccct

SEQ ID NO: 603386 - DNA, 25 bp, Rattus norvegicus
tgaagaattcactgcccagaaccct

SEQ ID NO: 603387 - DNA, 25 bp, Rattus norvegicus
tgaagaattcatcttgccggcgctc

SEQ ID NO: 603388 - DNA, 25 bp, Rattus norvegicus
tgaagaattcatgttgccggcgctc

SEQ ID NO: 603389 - DNA, 25 bp, Rattus norvegicus
tgaagaattgttaccggatgactga

SEQ ID NO: 603390 - DNA, 25 bp, Rattus norvegicus
tgaagaattgtttccggatgactga

SEQ ID NO: 603391 - DNA, 25 bp, Rattus norvegicus
tgaagacaacttccttgtgcccata

SEQ ID NO: 603392 - DNA, 25 bp, Rattus norvegicus
tgaagacaacttgcttgtgcccata

SEQ ID NO: 603393 - DNA, 25 bp, Rattus norvegicus
tgaagacaatggcttctccacccaa

SEQ ID NO: 603394 - DNA, 25 bp, Rattus norvegicus
tgaagacaatgggttctccacccaa

SEQ ID NO: 603395 - DNA, 25 bp, Rattus norvegicus
tgaagacacaccattcctgggcata

SEQ ID NO: 603396 - DNA, 25 bp, Rattus norvegicus
tgaagacacacctttcctgggcata

SEQ ID NO: 603397 - DNA, 25 bp, Rattus norvegicus
tgaagacacggcactgagtccagtt

SEQ ID NO: 603398 - DNA, 25 bp, Rattus norvegicus
tgaagacacggctctgagtccagtt

SEQ ID NO: 603399 - DNA, 25 bp, Rattus norvegicus
tgaagacactccagagctcactggg

SEQ ID NO: 603400 - DNA, 25 bp, Rattus norvegicus
tgaagacactcctgagctcactggg

SEQ ID NO: 603401 - DNA, 25 bp, Rattus norvegicus
tgaagacagccgctcacctgagtga

SEQ ID NO: 603402 - DNA, 25 bp, Rattus norvegicus
tgaagacagccggtcacctgagtga

SEQ ID NO: 603403 - DNA, 25 bp, Rattus norvegicus
tgaagacagcctcttgggaacccag

SEQ ID NO: 603404 - DNA, 25 bp, Rattus norvegicus
tgaagacagcctgttgggaacccag

SEQ ID NO: 603405 - DNA, 25 bp, Rattus norvegicus
tgaagacagcttcgacatcatccac

SEQ ID NO: 603406 - DNA, 25 bp, Rattus norvegicus
tgaagacagcttggacatcatccac

SEQ ID NO: 603407 - DNA, 25 bp, Rattus norvegicus
tgaagacatcccacatgctgtggct

SEQ ID NO: 603408 - DNA, 25 bp, Rattus norvegicus
tgaagacatccctcatgctgtggct

SEQ ID NO: 603409 - DNA, 25 bp, Rattus norvegicus
tgaagacatcctaccctagggacat

SEQ ID NO: 603410 - DNA, 25 bp, Rattus norvegicus
tgaagacatccttccctagggacat

SEQ ID NO: 603411 - DNA, 25 bp, Rattus norvegicus
tgaagacatggccagttcctagacc

SEQ ID NO: 603412 - DNA, 25 bp, Rattus norvegicus
tgaagacatggcgagttcctagacc

SEQ ID NO: 603413 - DNA, 25 bp, Rattus norvegicus
tgaagaccaagaagcagcagcggaa

SEQ ID NO: 603414 - DNA, 25 bp, Rattus norvegicus
tgaagaccaagatgcagcagcggaa

SEQ ID NO: 603415 - DNA, 25 bp, Rattus norvegicus
tgaagaccacagagggctccacagc

SEQ ID NO: 603416 - DNA, 25 bp, Rattus norvegicus
tgaagaccacagtgggctccacagc

SEQ ID NO: 603417 - DNA, 25 bp, Rattus norvegicus
tgaagaccacgtcgcgacatgctgc

SEQ ID NO: 603418 - DNA, 25 bp, Rattus norvegicus
tgaagaccacgtggcgacatgctgc

SEQ ID NO: 603419 - DNA, 25 bp, Rattus norvegicus
tgaagaccactgaaggtgcctgctg

SEQ ID NO: 603420 - DNA, 25 bp, Rattus norvegicus
tgaagaccactgtaggtgcctgctg

SEQ ID NO: 603421 - DNA, 25 bp, Rattus norvegicus
tgaagaccagcacgtccgctacaat

SEQ ID NO: 603422 - DNA, 25 bp, Rattus norvegicus
tgaagaccagcaggtccgctacaat

SEQ ID NO: 603423 - DNA, 25 bp, Rattus norvegicus
tgaagaccagcgagccaaagccccg

SEQ ID NO: 603424 - DNA, 25 bp, Rattus norvegicus
tgaagaccagcgtgccaaagccccg

SEQ ID NO: 603425 - DNA, 25 bp, Rattus norvegicus
tgaagaccatatagcagtgcgccct

SEQ ID NO: 603426 - DNA, 25 bp, Rattus norvegicus
tgaagaccatattgcagtgcgccct

SEQ ID NO: 603427 - DNA, 25 bp, Rattus norvegicus
tgaagaccatggatcgccgcggaaa

SEQ ID NO: 603428 - DNA, 25 bp, Rattus norvegicus
tgaagaccatggttcgccgcggaaa

SEQ ID NO: 603429 - DNA, 25 bp, Rattus norvegicus
tgaagacccaagcttctgtccagac

SEQ ID NO: 603430 - DNA, 25 bp, Rattus norvegicus
tgaagacccaaggttctgtccagac

SEQ ID NO: 603431 - DNA, 25 bp, Rattus norvegicus
tgaagacccgatagtgaccctgtgt

SEQ ID NO: 603432 - DNA, 25 bp, Rattus norvegicus
tgaagacccgattgtgaccctgtgt

SEQ ID NO: 603433 - DNA, 25 bp, Rattus norvegicus
tgaagaccctgtatttcgtttgtaa

SEQ ID NO: 603434 - DNA, 25 bp, Rattus norvegicus
tgaagaccctgtttttcgtttgtaa

SEQ ID NO: 603435 - DNA, 25 bp, Rattus norvegicus
tgaagaccgtagagctgtgcgccgt

SEQ ID NO: 603436 - DNA, 25 bp, Rattus norvegicus
tgaagaccgtagtgctgtgcgccgt

SEQ ID NO: 603437 - DNA, 25 bp, Rattus norvegicus
tgaagaccgtctagtttcctggact

SEQ ID NO: 603438 - DNA, 25 bp, Rattus norvegicus
tgaagaccgtcttgtttcctggact

SEQ ID NO: 603439 - DNA, 25 bp, Rattus norvegicus
tgaagacctactatcaactactttc

SEQ ID NO: 603440 - DNA, 25 bp, Rattus norvegicus
tgaagacctactttcaactactttc

SEQ ID NO: 603441 - DNA, 25 bp, Rattus norvegicus
tgaagacctatgctttgactcctac

SEQ ID NO: 603442 - DNA, 25 bp, Rattus norvegicus
tgaagacctatggtttgactcctac

SEQ ID NO: 603443 - DNA, 25 bp, Rattus norvegicus
tgaagacctcatacacgagcctgaa

SEQ ID NO: 603444 - DNA, 25 bp, Rattus norvegicus
tgaagacctcattcacgagcctgaa

SEQ ID NO: 603445 - DNA, 25 bp, Rattus norvegicus
tgaagacctgagcaaagccctccag

SEQ ID NO: 603446 - DNA, 25 bp, Rattus norvegicus
tgaagacctgaggaaagccctccag

SEQ ID NO: 603447 - DNA, 25 bp, Rattus norvegicus
tgaagacctgatcttcctgaactgt

SEQ ID NO: 603448 - DNA, 25 bp, Rattus norvegicus
tgaagacctgatgttcctgaactgt

SEQ ID NO: 603449 - DNA, 25 bp, Rattus norvegicus
tgaagacctggcctatgcacctctt

SEQ ID NO: 603450 - DNA, 25 bp, Rattus norvegicus
tgaagacctggcgtatgcacctctt

SEQ ID NO: 603451 - DNA, 25 bp, Rattus norvegicus
tgaagacgctctcttacctcatgtc

SEQ ID NO: 603452 - DNA, 25 bp, Rattus norvegicus
tgaagacgctctgttacctcatgtc

SEQ ID NO: 603453 - DNA, 25 bp, Rattus norvegicus
tgaagacgcttcacctctgttccat

SEQ ID NO: 603454 - DNA, 25 bp, Rattus norvegicus
tgaagacgcttctcctctgttccat

SEQ ID NO: 603455 - DNA, 25 bp, Rattus norvegicus
tgaagacggaaacgctccacctcac

SEQ ID NO: 603456 - DNA, 25 bp, Rattus norvegicus
tgaagacggaaaggctccacctcac

SEQ ID NO: 603457 - DNA, 25 bp, Rattus norvegicus
tgaagacggaccactagccagtcat

SEQ ID NO: 603458 - DNA, 25 bp, Rattus norvegicus
tgaagacggacctctagccagtcat

SEQ ID NO: 603459 - DNA, 25 bp, Rattus norvegicus
tgaagacggactactcacatggctc

SEQ ID NO: 603460 - DNA, 25 bp, Rattus norvegicus
tgaagacggacttctcacatggctc

SEQ ID NO: 603461 - DNA, 25 bp, Rattus norvegicus
tgaagacggcgcatggcctgttctt

SEQ ID NO: 603462 - DNA, 25 bp, Rattus norvegicus
tgaagacggcgcttggcctgttctt

SEQ ID NO: 603463 - DNA, 25 bp, Rattus norvegicus
tgaagacggcttcctgtacatggtc

SEQ ID NO: 603464 - DNA, 25 bp, Rattus norvegicus
tgaagacggcttgctgtacatggtc

SEQ ID NO: 603465 - DNA, 25 bp, Rattus norvegicus
tgaagacggtcacacacgtacacct

SEQ ID NO: 603466 - DNA, 25 bp, Rattus norvegicus
tgaagacggtcagacacgtacacct

SEQ ID NO: 603467 - DNA, 25 bp, Rattus norvegicus
tgaagacgtcttcaggaggcccaga

SEQ ID NO: 603468 - DNA, 25 bp, Rattus norvegicus
tgaagacgtcttgaggaggcccaga

SEQ ID NO: 603469 - DNA, 25 bp, Rattus norvegicus
tgaagacgttctcgtgatgcactat

SEQ ID NO: 603470 - DNA, 25 bp, Rattus norvegicus
tgaagacgttctggtgatgcactat

SEQ ID NO: 603471 - DNA, 25 bp, Rattus norvegicus
tgaagactagccacatttccaacac

SEQ ID NO: 603472 - DNA, 25 bp, Rattus norvegicus
tgaagactagcctcatttccaacac

SEQ ID NO: 603473 - DNA, 25 bp, Rattus norvegicus
tgaagactatccaagctgtgctgac

SEQ ID NO: 603474 - DNA, 25 bp, Rattus norvegicus
tgaagactatcctagctgtgctgac

SEQ ID NO: 603475 - DNA, 25 bp, Rattus norvegicus
tgaagactcaacagcacaacggaaa

SEQ ID NO: 603476 - DNA, 25 bp, Rattus norvegicus
tgaagactcaactgcacaacggaaa

SEQ ID NO: 603477 - DNA, 25 bp, Rattus norvegicus
tgaagactcagtcactttctcactt

SEQ ID NO: 603478 - DNA, 25 bp, Rattus norvegicus
tgaagactcagtgactttctcactt

SEQ ID NO: 603479 - DNA, 25 bp, Rattus norvegicus
tgaagactcatgcatgccggccctg

SEQ ID NO: 603480 - DNA, 25 bp, Rattus norvegicus
tgaagactcatggatgccggccctg

SEQ ID NO: 603481 - DNA, 25 bp, Rattus norvegicus
tgaagactcccaacttaaagggcca

SEQ ID NO: 603482 - DNA, 25 bp, Rattus norvegicus
tgaagactcccatcttaaagggcca

SEQ ID NO: 603483 - DNA, 25 bp, Rattus norvegicus
tgaagactcctaccagtgccatcac

SEQ ID NO: 603484 - DNA, 25 bp, Rattus norvegicus
tgaagactcctagcagtgccatcac

SEQ ID NO: 603485 - DNA, 25 bp, Rattus norvegicus
tgaagactcgtaacccctttagaag

SEQ ID NO: 603486 - DNA, 25 bp, Rattus norvegicus
tgaagactcgtatcccctttagaag

SEQ ID NO: 603487 - DNA, 25 bp, Rattus norvegicus
tgaagactctcaaactgaccctctg

SEQ ID NO: 603488 - DNA, 25 bp, Rattus norvegicus
tgaagactctcatactgaccctctg

SEQ ID NO: 603489 - DNA, 25 bp, Rattus norvegicus
tgaagactcttcctagtctgcccaa

SEQ ID NO: 603490 - DNA, 25 bp, Rattus norvegicus
tgaagactcttcgtagtctgcccaa

SEQ ID NO: 603491 - DNA, 25 bp, Rattus norvegicus
tgaagactctttacacctaccctag

SEQ ID NO: 603492 - DNA, 25 bp, Rattus norvegicus
tgaagactcttttcacctaccctag

SEQ ID NO: 603493 - DNA, 25 bp, Rattus norvegicus
tgaagactgatgatctctcccaaac

SEQ ID NO: 603494 - DNA, 25 bp, Rattus norvegicus
tgaagactgatgttctctcccaaac

SEQ ID NO: 603495 - DNA, 25 bp, Rattus norvegicus
tgaagactggtacaaccccggtccg

SEQ ID NO: 603496 - DNA, 25 bp, Rattus norvegicus
tgaagactggtagaaccccggtccg

SEQ ID NO: 603497 - DNA, 25 bp, Rattus norvegicus
tgaagactgtgactcctactgcaag

SEQ ID NO: 603498 - DNA, 25 bp, Rattus norvegicus
tgaagactgtgagtcctactgcaag

SEQ ID NO: 603499 - DNA, 25 bp, Rattus norvegicus
tgaagactgttgattccagcaggaa

SEQ ID NO: 603500 - DNA, 25 bp, Rattus norvegicus
tgaagactgttgtttccagcaggaa

SEQ ID NO: 603501 - DNA, 25 bp, Rattus norvegicus
tgaagacttaacattcgacgttcgg

SEQ ID NO: 603502 - DNA, 25 bp, Rattus norvegicus
tgaagacttaactttcgacgttcgg

SEQ ID NO: 603503 - DNA, 25 bp, Rattus norvegicus
tgaagacttacgatcatctcatgat

SEQ ID NO: 603504 - DNA, 25 bp, Rattus norvegicus
tgaagacttacgttcatctcatgat

SEQ ID NO: 603505 - DNA, 25 bp, Rattus norvegicus
tgaagacttcatcatgcctttccaa

SEQ ID NO: 603506 - DNA, 25 bp, Rattus norvegicus
tgaagacttcatgatgcctttccaa

SEQ ID NO: 603507 - DNA, 25 bp, Rattus norvegicus
tgaagacttcgtcagacagcgttac

SEQ ID NO: 603508 - DNA, 25 bp, Rattus norvegicus
tgaagacttcgtgagacagcgttac

SEQ ID NO: 603509 - DNA, 25 bp, Rattus norvegicus
tgaagacttgcaccctgacccagac

SEQ ID NO: 603510 - DNA, 25 bp, Rattus norvegicus
tgaagacttgcagcctgacccagac

SEQ ID NO: 603511 - DNA, 25 bp, Rattus norvegicus
tgaagacttggtctctgtccctgtg

SEQ ID NO: 603512 - DNA, 25 bp, Rattus norvegicus
tgaagacttggtgtctgtccctgtg

SEQ ID NO: 603513 - DNA, 25 bp, Rattus norvegicus
tgaagagaaccaacctgccacacga

SEQ ID NO: 603514 - DNA, 25 bp, Rattus norvegicus
tgaagagaaccatcctgccacacga

SEQ ID NO: 603515 - DNA, 25 bp, Rattus norvegicus
tgaagagaacctcaatcccaatgct

SEQ ID NO: 603516 - DNA, 25 bp, Rattus norvegicus
tgaagagaacctgaatcccaatgct

SEQ ID NO: 603517 - DNA, 25 bp, Rattus norvegicus
tgaagagaagttcccactgcgacca

SEQ ID NO: 603518 - DNA, 25 bp, Rattus norvegicus
tgaagagaagttgccactgcgacca

SEQ ID NO: 603519 - DNA, 25 bp, Rattus norvegicus
tgaagagacctcaaaccagcctctg

SEQ ID NO: 603520 - DNA, 25 bp, Rattus norvegicus
tgaagagacctctaaccagcctctg

SEQ ID NO: 603521 - DNA, 25 bp, Rattus norvegicus
tgaagagacgccatgaccacagcag

SEQ ID NO: 603522 - DNA, 25 bp, Rattus norvegicus
tgaagagacgccttgaccacagcag

SEQ ID NO: 603523 - DNA, 25 bp, Rattus norvegicus
tgaagagactgtccccttatccatt

SEQ ID NO: 603524 - DNA, 25 bp, Rattus norvegicus
tgaagagactgtgcccttatccatt

SEQ ID NO: 603525 - DNA, 25 bp, Rattus norvegicus
tgaagagatagtccccgtcccctgt

SEQ ID NO: 603526 - DNA, 25 bp, Rattus norvegicus
tgaagagatagtgcccgtcccctgt

SEQ ID NO: 603527 - DNA, 25 bp, Rattus norvegicus
tgaagagatccacatcctcggacag

SEQ ID NO: 603528 - DNA, 25 bp, Rattus norvegicus
tgaagagatccagatcctcggacag

SEQ ID NO: 603529 - DNA, 25 bp, Rattus norvegicus
tgaagagatcccaccggacgtgctg

SEQ ID NO: 603530 - DNA, 25 bp, Rattus norvegicus
tgaagagatccctccggacgtgctg

SEQ ID NO: 603531 - DNA, 25 bp, Rattus norvegicus
tgaagagcaagtcagccgtgccaac

SEQ ID NO: 603532 - DNA, 25 bp, Rattus norvegicus
tgaagagcaagtgagccgtgccaac

SEQ ID NO: 603533 - DNA, 25 bp, Rattus norvegicus
tgaagagcacccagtggcagacact

SEQ ID NO: 603534 - DNA, 25 bp, Rattus norvegicus
tgaagagcaccctgtggcagacact

SEQ ID NO: 603535 - DNA, 25 bp, Rattus norvegicus
tgaagagcacgtactgttcttgcag

SEQ ID NO: 603536 - DNA, 25 bp, Rattus norvegicus
tgaagagcacgttctgttcttgcag

SEQ ID NO: 603537 - DNA, 25 bp, Rattus norvegicus
tgaagagcagaccttcctacagctg

SEQ ID NO: 603538 - DNA, 25 bp, Rattus norvegicus
tgaagagcagacgttcctacagctg

SEQ ID NO: 603539 - DNA, 25 bp, Rattus norvegicus
tgaagagcagctacatagccctgcc

SEQ ID NO: 603540 - DNA, 25 bp, Rattus norvegicus
tgaagagcagcttcatagccctgcc

SEQ ID NO: 603541 - DNA, 25 bp, Rattus norvegicus
tgaagagcaggcacgggcatctctc

SEQ ID NO: 603542 - DNA, 25 bp, Rattus norvegicus
tgaagagcaggctcgggcatctctc

SEQ ID NO: 603543 - DNA, 25 bp, Rattus norvegicus
tgaagagcatccagtcctcaaggct

SEQ ID NO: 603544 - DNA, 25 bp, Rattus norvegicus
tgaagagcatcctgtcctcaaggct

SEQ ID NO: 603545 - DNA, 25 bp, Rattus norvegicus
tgaagagcatttcccgcgccaagat

SEQ ID NO: 603546 - DNA, 25 bp, Rattus norvegicus
tgaagagcatttgccgcgccaagat

SEQ ID NO: 603547 - DNA, 25 bp, Rattus norvegicus
tgaagagccattcagggccctcagg

SEQ ID NO: 603548 - DNA, 25 bp, Rattus norvegicus
tgaagagccattgagggccctcagg

SEQ ID NO: 603549 - DNA, 25 bp, Rattus norvegicus
tgaagagcccttcagtcacatcctt

SEQ ID NO: 603550 - DNA, 25 bp, Rattus norvegicus
tgaagagcccttgagtcacatcctt

SEQ ID NO: 603551 - DNA, 25 bp, Rattus norvegicus
tgaagagcgacaagccccagaccaa

SEQ ID NO: 603552 - DNA, 25 bp, Rattus norvegicus
tgaagagcgacatgccccagaccaa

SEQ ID NO: 603553 - DNA, 25 bp, Rattus norvegicus
tgaagagcgaggagccctgactaaa

SEQ ID NO: 603554 - DNA, 25 bp, Rattus norvegicus
tgaagagcgaggtgccctgactaaa

SEQ ID NO: 603555 - DNA, 25 bp, Rattus norvegicus
tgaagagctcatctcctggaacggt

SEQ ID NO: 603556 - DNA, 25 bp, Rattus norvegicus
tgaagagctcatgtcctggaacggt

SEQ ID NO: 603557 - DNA, 25 bp, Rattus norvegicus
tgaagagctgccaatggctccacca

SEQ ID NO: 603558 - DNA, 25 bp, Rattus norvegicus
tgaagagctgcctatggctccacca

SEQ ID NO: 603559 - DNA, 25 bp, Rattus norvegicus
tgaagagctgctccaacctgctgaa

SEQ ID NO: 603560 - DNA, 25 bp, Rattus norvegicus
tgaagagctgctgcaacctgctgaa

SEQ ID NO: 603561 - DNA, 25 bp, Rattus norvegicus
tgaagagcttccatttcacatccgt

SEQ ID NO: 603562 - DNA, 25 bp, Rattus norvegicus
tgaagagcttccttttcacatccgt

SEQ ID NO: 603563 - DNA, 25 bp, Rattus norvegicus
tgaagaggaagacgtgctgatcccc

SEQ ID NO: 603564 - DNA, 25 bp, Rattus norvegicus
tgaagaggaagaggtgctgatcccc

SEQ ID NO: 603565 - DNA, 25 bp, Rattus norvegicus
tgaagaggacacacccgtgtggtaa

SEQ ID NO: 603566 - DNA, 25 bp, Rattus norvegicus
tgaagaggacactcccgtgtggtaa

SEQ ID NO: 603567 - DNA, 25 bp, Rattus norvegicus
tgaagaggacagcaccctacgggaa

SEQ ID NO: 603568 - DNA, 25 bp, Rattus norvegicus
tgaagaggacaggaccctacgggaa

SEQ ID NO: 603569 - DNA, 25 bp, Rattus norvegicus
tgaagaggacgcactgtcgcgactg

SEQ ID NO: 603570 - DNA, 25 bp, Rattus norvegicus
tgaagaggacgctctgtcgcgactg

SEQ ID NO: 603571 - DNA, 25 bp, Rattus norvegicus
tgaagaggatgcatctcccacttgt

SEQ ID NO: 603572 - DNA, 25 bp, Rattus norvegicus
tgaagaggatgcttctcccacttgt

SEQ ID NO: 603573 - DNA, 25 bp, Rattus norvegicus
tgaagaggccagcatcgccgtgcta

SEQ ID NO: 603574 - DNA, 25 bp, Rattus norvegicus
tgaagaggccaggatcgccgtgcta

SEQ ID NO: 603575 - DNA, 25 bp, Rattus norvegicus
tgaagaggccggaatgaacatctgt

SEQ ID NO: 603576 - DNA, 25 bp, Rattus norvegicus
tgaagaggccggtatgaacatctgt

SEQ ID NO: 603577 - DNA, 25 bp, Rattus norvegicus
tgaagaggcgctaacacgccacgga

SEQ ID NO: 603578 - DNA, 25 bp, Rattus norvegicus
tgaagaggcgcttacacgccacgga

SEQ ID NO: 603579 - DNA, 25 bp, Rattus norvegicus
tgaagaggtatactgtctgtctgcc

SEQ ID NO: 603580 - DNA, 25 bp, Rattus norvegicus
tgaagaggtatagtgtctgtctgcc

SEQ ID NO: 603581 - DNA, 25 bp, Rattus norvegicus
tgaagaggtctccatgaagcacgtg

SEQ ID NO: 603582 - DNA, 25 bp, Rattus norvegicus
tgaagaggtctcgatgaagcacgtg

SEQ ID NO: 603583 - DNA, 25 bp, Rattus norvegicus
tgaagaggtgtgacgctgtgtccca

SEQ ID NO: 603584 - DNA, 25 bp, Rattus norvegicus
tgaagaggtgtgtcgctgtgtccca

SEQ ID NO: 603585 - DNA, 25 bp, Rattus norvegicus
tgaagagtacccagtttggtcagag

SEQ ID NO: 603586 - DNA, 25 bp, Rattus norvegicus
tgaagagtaccctgtttggtcagag

SEQ ID NO: 603587 - DNA, 25 bp, Rattus norvegicus
tgaagagtcaccagctgaggctacc

SEQ ID NO: 603588 - DNA, 25 bp, Rattus norvegicus
tgaagagtcacctgctgaggctacc

SEQ ID NO: 603589 - DNA, 25 bp, Rattus norvegicus
tgaagagtccaccttttctttccag

SEQ ID NO: 603590 - DNA, 25 bp, Rattus norvegicus
tgaagagtccacgttttctttccag

SEQ ID NO: 603591 - DNA, 25 bp, Rattus norvegicus
tgaagagtccagatgctcagtagat

SEQ ID NO: 603592 - DNA, 25 bp, Rattus norvegicus
tgaagagtccagttgctcagtagat

SEQ ID NO: 603593 - DNA, 25 bp, Rattus norvegicus
tgaagagtcccacatggcagccttg

SEQ ID NO: 603594 - DNA, 25 bp, Rattus norvegicus
tgaagagtcccagatggcagccttg

SEQ ID NO: 603595 - DNA, 25 bp, Rattus norvegicus
tgaagagtccctaatttattcctta

SEQ ID NO: 603596 - DNA, 25 bp, Rattus norvegicus
tgaagagtccctatggcaacctcag

SEQ ID NO: 603597 - DNA, 25 bp, Rattus norvegicus
tgaagagtcccttatttattcctta

SEQ ID NO: 603598 - DNA, 25 bp, Rattus norvegicus
tgaagagtccctttggcaacctcag

SEQ ID NO: 603599 - DNA, 25 bp, Rattus norvegicus
tgaagagtcgtcacacatgcacctg

SEQ ID NO: 603600 - DNA, 25 bp, Rattus norvegicus
tgaagagtcgtctcacatgcacctg

SEQ ID NO: 603601 - DNA, 25 bp, Rattus norvegicus
tgaagagtggccagagcccttaacc

SEQ ID NO: 603602 - DNA, 25 bp, Rattus norvegicus
tgaagagtggcctgagcccttaacc

SEQ ID NO: 603603 - DNA, 25 bp, Rattus norvegicus
tgaagagttagtcatcccttcccat

SEQ ID NO: 603604 - DNA, 25 bp, Rattus norvegicus
tgaagagttagtgatcccttcccat

SEQ ID NO: 603605 - DNA, 25 bp, Rattus norvegicus
tgaagataacccatgctaccgtgta

SEQ ID NO: 603606 - DNA, 25 bp, Rattus norvegicus
tgaagataacccttgctaccgtgta

SEQ ID NO: 603607 - DNA, 25 bp, Rattus norvegicus
tgaagataaccgagcctgtccaaag

SEQ ID NO: 603608 - DNA, 25 bp, Rattus norvegicus
tgaagataaccgtgcctgtccaaag

SEQ ID NO: 603609 - DNA, 25 bp, Rattus norvegicus
tgaagatagcttcgccaggtggttc

SEQ ID NO: 603610 - DNA, 25 bp, Rattus norvegicus
tgaagatagcttggccaggtggttc

SEQ ID NO: 603611 - DNA, 25 bp, Rattus norvegicus
tgaagatatctcatgtagtccaggc

SEQ ID NO: 603612 - DNA, 25 bp, Rattus norvegicus
tgaagatatctcttgtagtccaggc

SEQ ID NO: 603613 - DNA, 25 bp, Rattus norvegicus
tgaagatatggaccgcgcactacga

SEQ ID NO: 603614 - DNA, 25 bp, Rattus norvegicus
tgaagatatggagcgcgcactacga

SEQ ID NO: 603615 - DNA, 25 bp, Rattus norvegicus
tgaagatcaataaccacacgcatat

SEQ ID NO: 603616 - DNA, 25 bp, Rattus norvegicus
tgaagatcaatatccacacgcatat

SEQ ID NO: 603617 - DNA, 25 bp, Rattus norvegicus
tgaagatcaattccatcctctcgtc

SEQ ID NO: 603618 - DNA, 25 bp, Rattus norvegicus
tgaagatcaattgcatcctctcgtc

SEQ ID NO: 603619 - DNA, 25 bp, Rattus norvegicus
tgaagatcacctcctctaatgtccc

SEQ ID NO: 603620 - DNA, 25 bp, Rattus norvegicus
tgaagatcacctgctctaatgtccc

SEQ ID NO: 603621 - DNA, 25 bp, Rattus norvegicus
tgaagatcagccacccatagagcag

SEQ ID NO: 603622 - DNA, 25 bp, Rattus norvegicus
tgaagatcagcccaacctcattgtc

SEQ ID NO: 603623 - DNA, 25 bp, Rattus norvegicus
tgaagatcagccgaacctcattgtc

SEQ ID NO: 603624 - DNA, 25 bp, Rattus norvegicus
tgaagatcagcctcccatagagcag

SEQ ID NO: 603625 - DNA, 25 bp, Rattus norvegicus
tgaagatcatcacaagcgcggctgc

SEQ ID NO: 603626 - DNA, 25 bp, Rattus norvegicus
tgaagatcatcagaagcgcggctgc

SEQ ID NO: 603627 - DNA, 25 bp, Rattus norvegicus
tgaagatcgccaacacaatcactgt

SEQ ID NO: 603628 - DNA, 25 bp, Rattus norvegicus
tgaagatcgccatcacaatcactgt

SEQ ID NO: 603629 - DNA, 25 bp, Rattus norvegicus
tgaagatctcagagtccatcgcatg

SEQ ID NO: 603630 - DNA, 25 bp, Rattus norvegicus
tgaagatctcagtgtccatcgcatg

SEQ ID NO: 603631 - DNA, 25 bp, Rattus norvegicus
tgaagatctggcatacgtaccctat

SEQ ID NO: 603632 - DNA, 25 bp, Rattus norvegicus
tgaagatctggcttacgtaccctat

SEQ ID NO: 603633 - DNA, 25 bp, Rattus norvegicus
tgaagatcttccctgactctgagca

SEQ ID NO: 603634 - DNA, 25 bp, Rattus norvegicus
tgaagatcttccgtgactctgagca

SEQ ID NO: 603635 - DNA, 25 bp, Rattus norvegicus
tgaagatctttgacaacgaccccac

SEQ ID NO: 603636 - DNA, 25 bp, Rattus norvegicus
tgaagatctttgtcaacgaccccac

SEQ ID NO: 603637 - DNA, 25 bp, Rattus norvegicus
tgaagatgaaccatggcctcagccc

SEQ ID NO: 603638 - DNA, 25 bp, Rattus norvegicus
tgaagatgaaccttggcctcagccc

SEQ ID NO: 603639 - DNA, 25 bp, Rattus norvegicus
tgaagatgaagaaagcatgactttt

SEQ ID NO: 603640 - DNA, 25 bp, Rattus norvegicus
tgaagatgaagatagcatgactttt

SEQ ID NO: 603641 - DNA, 25 bp, Rattus norvegicus
tgaagatgacctcgcatgttccctg

SEQ ID NO: 603642 - DNA, 25 bp, Rattus norvegicus
tgaagatgacctggcatgttccctg

SEQ ID NO: 603643 - DNA, 25 bp, Rattus norvegicus
tgaagatgacttcagctcccctggc

SEQ ID NO: 603644 - DNA, 25 bp, Rattus norvegicus
tgaagatgacttcctgagccagccc

SEQ ID NO: 603645 - DNA, 25 bp, Rattus norvegicus
tgaagatgacttgagctcccctggc

SEQ ID NO: 603646 - DNA, 25 bp, Rattus norvegicus
tgaagatgacttgctgagccagccc

SEQ ID NO: 603647 - DNA, 25 bp, Rattus norvegicus
tgaagatgagcccaagcctgcgttc

SEQ ID NO: 603648 - DNA, 25 bp, Rattus norvegicus
tgaagatgagccgaagcctgcgttc

SEQ ID NO: 603649 - DNA, 25 bp, Rattus norvegicus
tgaagatgatcccaacatactcctt

SEQ ID NO: 603650 - DNA, 25 bp, Rattus norvegicus
tgaagatgatccgaacatactcctt

SEQ ID NO: 603651 - DNA, 25 bp, Rattus norvegicus
tgaagatgatctcccctgagctgga

SEQ ID NO: 603652 - DNA, 25 bp, Rattus norvegicus
tgaagatgatctgccctgagctgga

SEQ ID NO: 603653 - DNA, 25 bp, Rattus norvegicus
tgaagatgcaccattgccctggtta

SEQ ID NO: 603654 - DNA, 25 bp, Rattus norvegicus
tgaagatgcacctttgccctggtta

SEQ ID NO: 603655 - DNA, 25 bp, Rattus norvegicus
tgaagatgccccaacacttgtcttt

SEQ ID NO: 603656 - DNA, 25 bp, Rattus norvegicus
tgaagatgcccctacacttgtcttt

SEQ ID NO: 603657 - DNA, 25 bp, Rattus norvegicus
tgaagatgctcaagtacctctcaca

SEQ ID NO: 603658 - DNA, 25 bp, Rattus norvegicus
tgaagatgctcatgtacctctcaca

SEQ ID NO: 603659 - DNA, 25 bp, Rattus norvegicus
tgaagatgctccacgctttgatcat

SEQ ID NO: 603660 - DNA, 25 bp, Rattus norvegicus
tgaagatgctcctcgctttgatcat

SEQ ID NO: 603661 - DNA, 25 bp, Rattus norvegicus
tgaagatgctgaacccacggtcact

SEQ ID NO: 603662 - DNA, 25 bp, Rattus norvegicus
tgaagatgctgatcccacggtcact

SEQ ID NO: 603663 - DNA, 25 bp, Rattus norvegicus
tgaagatggccaccctcagccatgc

SEQ ID NO: 603664 - DNA, 25 bp, Rattus norvegicus
tgaagatggccagcctcagccatgc

SEQ ID NO: 603665 - DNA, 25 bp, Rattus norvegicus
tgaagatgggcaccttcgccagacc

SEQ ID NO: 603666 - DNA, 25 bp, Rattus norvegicus
tgaagatgggcagcttcgccagacc

SEQ ID NO: 603667 - DNA, 25 bp, Rattus norvegicus
tgaagatgggccagccaggaaccca

SEQ ID NO: 603668 - DNA, 25 bp, Rattus norvegicus
tgaagatgggcctgccaggaaccca

SEQ ID NO: 603669 - DNA, 25 bp, Rattus norvegicus
tgaagatggtcccttacggttccca

SEQ ID NO: 603670 - DNA, 25 bp, Rattus norvegicus
tgaagatggtccgttacggttccca

SEQ ID NO: 603671 - DNA, 25 bp, Rattus norvegicus
tgaagatgtcccacacactgaattg

SEQ ID NO: 603672 - DNA, 25 bp, Rattus norvegicus
tgaagatgtccctcacactgaattg

SEQ ID NO: 603673 - DNA, 25 bp, Rattus norvegicus
tgaagatgtctgcagccacttcccg

SEQ ID NO: 603674 - DNA, 25 bp, Rattus norvegicus
tgaagatgtctggagccacttcccg

SEQ ID NO: 603675 - DNA, 25 bp, Rattus norvegicus
tgaagatgtcttcccaccgagactt

SEQ ID NO: 603676 - DNA, 25 bp, Rattus norvegicus
tgaagatgtcttgccaccgagactt

SEQ ID NO: 603677 - DNA, 25 bp, Rattus norvegicus
tgaagatgtgagatcccaccttctg

SEQ ID NO: 603678 - DNA, 25 bp, Rattus norvegicus
tgaagatgtgagttcccaccttctg

SEQ ID NO: 603679 - DNA, 25 bp, Rattus norvegicus
tgaagatgttggcacactaccgcat

SEQ ID NO: 603680 - DNA, 25 bp, Rattus norvegicus
tgaagatgttgggacactaccgcat

SEQ ID NO: 603681 - DNA, 25 bp, Rattus norvegicus
tgaagatgttgtacgctggctacgg

SEQ ID NO: 603682 - DNA, 25 bp, Rattus norvegicus
tgaagatgttgttcgctggctacgg

SEQ ID NO: 603683 - DNA, 25 bp, Rattus norvegicus
tgaagattcccactcagtagctcat

SEQ ID NO: 603684 - DNA, 25 bp, Rattus norvegicus
tgaagattcccagtcagtagctcat

SEQ ID NO: 603685 - DNA, 25 bp, Rattus norvegicus
tgaagattgatcagcttgtgtatgg

SEQ ID NO: 603686 - DNA, 25 bp, Rattus norvegicus
tgaagattgatctgcttgtgtatgg

SEQ ID NO: 603687 - DNA, 25 bp, Rattus norvegicus
tgaagattgccaaagaccagggtaa

SEQ ID NO: 603688 - DNA, 25 bp, Rattus norvegicus
tgaagattgccaagcctctctccag

SEQ ID NO: 603689 - DNA, 25 bp, Rattus norvegicus
tgaagattgccatagaccagggtaa

SEQ ID NO: 603690 - DNA, 25 bp, Rattus norvegicus
tgaagattgccatgcctctctccag

SEQ ID NO: 603691 - DNA, 25 bp, Rattus norvegicus
tgaagatttcaaacgaactcgactt

SEQ ID NO: 603692 - DNA, 25 bp, Rattus norvegicus
tgaagatttcaatcgaactcgactt

SEQ ID NO: 603693 - DNA, 25 bp, Rattus norvegicus
tgaagatttcccagagtcctagcgt

SEQ ID NO: 603694 - DNA, 25 bp, Rattus norvegicus
tgaagatttccctgagtcctagcgt

SEQ ID NO: 603695 - DNA, 25 bp, Rattus norvegicus
tgaagatttctcctctccagtgagg

SEQ ID NO: 603696 - DNA, 25 bp, Rattus norvegicus
tgaagatttctcgtctccagtgagg

SEQ ID NO: 603697 - DNA, 25 bp, Rattus norvegicus
tgaagattttggaccacacctcact

SEQ ID NO: 603698 - DNA, 25 bp, Rattus norvegicus
tgaagattttggtccacacctcact

SEQ ID NO: 603699 - DNA, 25 bp, Rattus norvegicus
tgaagcaaaaacactcctggcccaa

SEQ ID NO: 603700 - DNA, 25 bp, Rattus norvegicus
tgaagcaaaaactctcctggcccaa

SEQ ID NO: 603701 - DNA, 25 bp, Rattus norvegicus
tgaagcaaacctatgagcgcctcgt

SEQ ID NO: 603702 - DNA, 25 bp, Rattus norvegicus
tgaagcaaacctttgagcgcctcgt

SEQ ID NO: 603703 - DNA, 25 bp, Rattus norvegicus
tgaagcaaatctcgtgcgggtcacc

SEQ ID NO: 603704 - DNA, 25 bp, Rattus norvegicus
tgaagcaaatctggtgcgggtcacc

SEQ ID NO: 603705 - DNA, 25 bp, Rattus norvegicus
tgaagcaaatgtacccagctcagcc

SEQ ID NO: 603706 - DNA, 25 bp, Rattus norvegicus
tgaagcaaatgttcccagctcagcc

SEQ ID NO: 603707 - DNA, 25 bp, Rattus norvegicus
tgaagcaagcccagaccctgatgac

SEQ ID NO: 603708 - DNA, 25 bp, Rattus norvegicus
tgaagcaagccctgaccctgatgac

SEQ ID NO: 603709 - DNA, 25 bp, Rattus norvegicus
tgaagcaagctcacttgaccaccga

SEQ ID NO: 603710 - DNA, 25 bp, Rattus norvegicus
tgaagcaagctctcttgaccaccga

SEQ ID NO: 603711 - DNA, 25 bp, Rattus norvegicus
tgaagcaagtgaccgctgtcaccag

SEQ ID NO: 603712 - DNA, 25 bp, Rattus norvegicus
tgaagcaagtgagcgctgtcaccag

SEQ ID NO: 603713 - DNA, 25 bp, Rattus norvegicus
tgaagcaagttcacggccagatggt

SEQ ID NO: 603714 - DNA, 25 bp, Rattus norvegicus
tgaagcaagttctcggccagatggt

SEQ ID NO: 603715 - DNA, 25 bp, Rattus norvegicus
tgaagcaatcttaaacctgtatgta

SEQ ID NO: 603716 - DNA, 25 bp, Rattus norvegicus
tgaagcaatctttaacctgtatgta

SEQ ID NO: 603717 - DNA, 25 bp, Rattus norvegicus
tgaagcaatgctagaggccccttac

SEQ ID NO: 603718 - DNA, 25 bp, Rattus norvegicus
tgaagcaatgcttgaggccccttac

SEQ ID NO: 603719 - DNA, 25 bp, Rattus norvegicus
tgaagcacaactcggtttgcactaa

SEQ ID NO: 603720 - DNA, 25 bp, Rattus norvegicus
tgaagcacaactgggtttgcactaa

SEQ ID NO: 603721 - DNA, 25 bp, Rattus norvegicus
tgaagcacaatgctgtgcccaccgt

SEQ ID NO: 603722 - DNA, 25 bp, Rattus norvegicus
tgaagcacaatggtgtgcccaccgt

SEQ ID NO: 603723 - DNA, 25 bp, Rattus norvegicus
tgaagcacagatctcctcccgtgtt

SEQ ID NO: 603724 - DNA, 25 bp, Rattus norvegicus
tgaagcacagatgtcctcccgtgtt

SEQ ID NO: 603725 - DNA, 25 bp, Rattus norvegicus
tgaagcacaggcacctgctggctgt

SEQ ID NO: 603726 - DNA, 25 bp, Rattus norvegicus
tgaagcacaggctcctgctggctgt

SEQ ID NO: 603727 - DNA, 25 bp, Rattus norvegicus
tgaagcacagtgcagcaagcccttt

SEQ ID NO: 603728 - DNA, 25 bp, Rattus norvegicus
tgaagcacagtggagcaagcccttt

SEQ ID NO: 603729 - DNA, 25 bp, Rattus norvegicus
tgaagcacatacagacacagggtcc

SEQ ID NO: 603730 - DNA, 25 bp, Rattus norvegicus
tgaagcacatactgacacagggtcc

SEQ ID NO: 603731 - DNA, 25 bp, Rattus norvegicus
tgaagcacatcaaggccagctgagc

SEQ ID NO: 603732 - DNA, 25 bp, Rattus norvegicus
tgaagcacatcatggccagctgagc

SEQ ID NO: 603733 - DNA, 25 bp, Rattus norvegicus
tgaagcacatgcatttcctgttctt

SEQ ID NO: 603734 - DNA, 25 bp, Rattus norvegicus
tgaagcacatgcttttcctgttctt

SEQ ID NO: 603735 - DNA, 25 bp, Rattus norvegicus
tgaagcaccatgacaacgtacgcac

SEQ ID NO: 603736 - DNA, 25 bp, Rattus norvegicus
tgaagcaccatgtcaacgtacgcac

SEQ ID NO: 603737 - DNA, 25 bp, Rattus norvegicus
tgaagcacccaccatgatgacggag

SEQ ID NO: 603738 - DNA, 25 bp, Rattus norvegicus
tgaagcacccacgatgatgacggag

SEQ ID NO: 603739 - DNA, 25 bp, Rattus norvegicus
tgaagcacccagcagcagccaggat

SEQ ID NO: 603740 - DNA, 25 bp, Rattus norvegicus
tgaagcacccaggagcagccaggat

SEQ ID NO: 603741 - DNA, 25 bp, Rattus norvegicus
tgaagcacctccacagtacgttttg

SEQ ID NO: 603742 - DNA, 25 bp, Rattus norvegicus
tgaagcacctcctcagtacgttttg

SEQ ID NO: 603743 - DNA, 25 bp, Rattus norvegicus
tgaagcacctcgaagccctgtaggg

SEQ ID NO: 603744 - DNA, 25 bp, Rattus norvegicus
tgaagcacctcgtagccctgtaggg

SEQ ID NO: 603745 - DNA, 25 bp, Rattus norvegicus
tgaagcacctgcagagtggacactc

SEQ ID NO: 603746 - DNA, 25 bp, Rattus norvegicus
tgaagcacctgctgagtggacactc

SEQ ID NO: 603747 - DNA, 25 bp, Rattus norvegicus
tgaagcacggctcgcaagctaacat

SEQ ID NO: 603748 - DNA, 25 bp, Rattus norvegicus
tgaagcacggctggcaagctaacat

SEQ ID NO: 603749 - DNA, 25 bp, Rattus norvegicus
tgaagcacgtgtactgacctggcag

SEQ ID NO: 603750 - DNA, 25 bp, Rattus norvegicus
tgaagcacgtgttctgacctggcag

SEQ ID NO: 603751 - DNA, 25 bp, Rattus norvegicus
tgaagcactcccagtctgtagcaca

SEQ ID NO: 603752 - DNA, 25 bp, Rattus norvegicus
tgaagcactccctgtctgtagcaca

SEQ ID NO: 603753 - DNA, 25 bp, Rattus norvegicus
tgaagcactgcactttggacaccat

SEQ ID NO: 603754 - DNA, 25 bp, Rattus norvegicus
tgaagcactgcagtttggacaccat

SEQ ID NO: 603755 - DNA, 25 bp, Rattus norvegicus
tgaagcactgtgctcgggtgccctc

SEQ ID NO: 603756 - DNA, 25 bp, Rattus norvegicus
tgaagcactgtgcttcccctggtat

SEQ ID NO: 603757 - DNA, 25 bp, Rattus norvegicus
tgaagcactgtggtcgggtgccctc

SEQ ID NO: 603758 - DNA, 25 bp, Rattus norvegicus
tgaagcactgtggttcccctggtat

SEQ ID NO: 603759 - DNA, 25 bp, Rattus norvegicus
tgaagcacttagagctccctagggc

SEQ ID NO: 603760 - DNA, 25 bp, Rattus norvegicus
tgaagcacttagtgctccctagggc

SEQ ID NO: 603761 - DNA, 25 bp, Rattus norvegicus
tgaagcacttgccactactgacgaa

SEQ ID NO: 603762 - DNA, 25 bp, Rattus norvegicus
tgaagcacttgcgactactgacgaa

SEQ ID NO: 603763 - DNA, 25 bp, Rattus norvegicus
tgaagcacttggctctagcactctc

SEQ ID NO: 603764 - DNA, 25 bp, Rattus norvegicus
tgaagcacttgggtctagcactctc

SEQ ID NO: 603765 - DNA, 25 bp, Rattus norvegicus
tgaagcagaagccatttccacccgc

SEQ ID NO: 603766 - DNA, 25 bp, Rattus norvegicus
tgaagcagaagcgatttccacccgc

SEQ ID NO: 603767 - DNA, 25 bp, Rattus norvegicus
tgaagcagagcaccgatccatccaa

SEQ ID NO: 603768 - DNA, 25 bp, Rattus norvegicus
tgaagcagagcagcgatccatccaa

SEQ ID NO: 603769 - DNA, 25 bp, Rattus norvegicus
tgaagcagatgccacacattcccaa

SEQ ID NO: 603770 - DNA, 25 bp, Rattus norvegicus
tgaagcagatgcgacacattcccaa

SEQ ID NO: 603771 - DNA, 25 bp, Rattus norvegicus
tgaagcagcatcaccactattagtg

SEQ ID NO: 603772 - DNA, 25 bp, Rattus norvegicus
tgaagcagcatctccactattagtg

SEQ ID NO: 603773 - DNA, 25 bp, Rattus norvegicus
tgaagcagcgagcattccacacagt

SEQ ID NO: 603774 - DNA, 25 bp, Rattus norvegicus
tgaagcagcgaggattccacacagt

SEQ ID NO: 603775 - DNA, 25 bp, Rattus norvegicus
tgaagcagctcaacgacaatatcct

SEQ ID NO: 603776 - DNA, 25 bp, Rattus norvegicus
tgaagcagctcatcgacaatatcct

SEQ ID NO: 603777 - DNA, 25 bp, Rattus norvegicus
tgaagcagctgaccgtcgagcccta

SEQ ID NO: 603778 - DNA, 25 bp, Rattus norvegicus
tgaagcagctgagcgtcgagcccta

SEQ ID NO: 603779 - DNA, 25 bp, Rattus norvegicus
tgaagcagctggacgacgccatgaa

SEQ ID NO: 603780 - DNA, 25 bp, Rattus norvegicus
tgaagcagctggtcgacgccatgaa

SEQ ID NO: 603781 - DNA, 25 bp, Rattus norvegicus
tgaagcagctttcagcacgcaaccg

SEQ ID NO: 603782 - DNA, 25 bp, Rattus norvegicus
tgaagcagctttgagcacgcaaccg

SEQ ID NO: 603783 - DNA, 25 bp, Rattus norvegicus
tgaagcaggagaccgcctcagcata

SEQ ID NO: 603784 - DNA, 25 bp, Rattus norvegicus
tgaagcaggagagcgcctcagcata

SEQ ID NO: 603785 - DNA, 25 bp, Rattus norvegicus
tgaagcaggagcaacgccatctgct

SEQ ID NO: 603786 - DNA, 25 bp, Rattus norvegicus
tgaagcaggagctacgccatctgct

SEQ ID NO: 603787 - DNA, 25 bp, Rattus norvegicus
tgaagcaggagtaccaggccaccgt

SEQ ID NO: 603788 - DNA, 25 bp, Rattus norvegicus
tgaagcaggagttccaggccaccgt

SEQ ID NO: 603789 - DNA, 25 bp, Rattus norvegicus
tgaagcaggcttctctgtatagccc

SEQ ID NO: 603790 - DNA, 25 bp, Rattus norvegicus
tgaagcaggcttgtctgtatagccc

SEQ ID NO: 603791 - DNA, 25 bp, Rattus norvegicus
tgaagcaggtgcctgtcccatcgag

SEQ ID NO: 603792 - DNA, 25 bp, Rattus norvegicus
tgaagcaggtgcgtgtcccatcgag

SEQ ID NO: 603793 - DNA, 25 bp, Rattus norvegicus
tgaagcagtcccagctgttggctct

SEQ ID NO: 603794 - DNA, 25 bp, Rattus norvegicus
tgaagcagtccctgctgttggctct

SEQ ID NO: 603795 - DNA, 25 bp, Rattus norvegicus
tgaagcagtttaaggcccctggaac

SEQ ID NO: 603796 - DNA, 25 bp, Rattus norvegicus
tgaagcagtttatggcccctggaac

SEQ ID NO: 603797 - DNA, 25 bp, Rattus norvegicus
tgaagcatctgtcgaggacgctccc

SEQ ID NO: 603798 - DNA, 25 bp, Rattus norvegicus
tgaagcatctgtggaggacgctccc

SEQ ID NO: 603799 - DNA, 25 bp, Rattus norvegicus
tgaagcatgactacagtgccctgaa

SEQ ID NO: 603800 - DNA, 25 bp, Rattus norvegicus
tgaagcatgacttcagtgccctgaa

SEQ ID NO: 603801 - DNA, 25 bp, Rattus norvegicus
tgaagcatgtccatcctgtgagacc

SEQ ID NO: 603802 - DNA, 25 bp, Rattus norvegicus
tgaagcatgtccttcctgtgagacc

SEQ ID NO: 603803 - DNA, 25 bp, Rattus norvegicus
tgaagcattgtgatccgggactgtc

SEQ ID NO: 603804 - DNA, 25 bp, Rattus norvegicus
tgaagcattgtgttccgggactgtc

SEQ ID NO: 603805 - DNA, 25 bp, Rattus norvegicus
tgaagcatttatccagccaaccaac

SEQ ID NO: 603806 - DNA, 25 bp, Rattus norvegicus
tgaagcatttatgcagccaaccaac

SEQ ID NO: 603807 - DNA, 25 bp, Rattus norvegicus
tgaagcattttgaccattctcatgg

SEQ ID NO: 603808 - DNA, 25 bp, Rattus norvegicus
tgaagcattttgtccattctcatgg

SEQ ID NO: 603809 - DNA, 25 bp, Rattus norvegicus
tgaagccaaaacactactacacata

SEQ ID NO: 603810 - DNA, 25 bp, Rattus norvegicus
tgaagccaaaactctactacacata

SEQ ID NO: 603811 - DNA, 25 bp, Rattus norvegicus
tgaagccaaaccatagccaaaccct

SEQ ID NO: 603812 - DNA, 25 bp, Rattus norvegicus
tgaagccaaaccttagccaaaccct

SEQ ID NO: 603813 - DNA, 25 bp, Rattus norvegicus
tgaagccaaactccaccgagttcac

SEQ ID NO: 603814 - DNA, 25 bp, Rattus norvegicus
tgaagccaaactgcaccgagttcac

SEQ ID NO: 603815 - DNA, 25 bp, Rattus norvegicus
tgaagccaaagtcactaccagggaa

SEQ ID NO: 603816 - DNA, 25 bp, Rattus norvegicus
tgaagccaaagtgactaccagggaa

SEQ ID NO: 603817 - DNA, 25 bp, Rattus norvegicus
tgaagccaaatcagctatgcatggg

SEQ ID NO: 603818 - DNA, 25 bp, Rattus norvegicus
tgaagccaaatctgctatgcatggg

SEQ ID NO: 603819 - DNA, 25 bp, Rattus norvegicus
tgaagccaaggaagccccacagtta

SEQ ID NO: 603820 - DNA, 25 bp, Rattus norvegicus
tgaagccaaggatgccccacagtta

SEQ ID NO: 603821 - DNA, 25 bp, Rattus norvegicus
tgaagccaaggtccgcgtcctgctg

SEQ ID NO: 603822 - DNA, 25 bp, Rattus norvegicus
tgaagccaaggtgcgcgtcctgctg

SEQ ID NO: 603823 - DNA, 25 bp, Rattus norvegicus
tgaagccaatgtccaatagagagag

SEQ ID NO: 603824 - DNA, 25 bp, Rattus norvegicus
tgaagccaatgtgcaatagagagag

SEQ ID NO: 603825 - DNA, 25 bp, Rattus norvegicus
tgaagccacactacggtctttctta

SEQ ID NO: 603826 - DNA, 25 bp, Rattus norvegicus
tgaagccacacttcggtctttctta

SEQ ID NO: 603827 - DNA, 25 bp, Rattus norvegicus
tgaagccacagtcacctagtgaaat

SEQ ID NO: 603828 - DNA, 25 bp, Rattus norvegicus
tgaagccacagtgacctagtgaaat

SEQ ID NO: 603829 - DNA, 25 bp, Rattus norvegicus
tgaagccaccacacatcttttatat

SEQ ID NO: 603830 - DNA, 25 bp, Rattus norvegicus
tgaagccaccactcatcttttatat

SEQ ID NO: 603831 - DNA, 25 bp, Rattus norvegicus
tgaagccaccagaatgactccacaa

SEQ ID NO: 603832 - DNA, 25 bp, Rattus norvegicus
tgaagccaccagtatgactccacaa

SEQ ID NO: 603833 - DNA, 25 bp, Rattus norvegicus
tgaagccaccatctgccaactagtt

SEQ ID NO: 603834 - DNA, 25 bp, Rattus norvegicus
tgaagccaccatgtgccaactagtt

SEQ ID NO: 603835 - DNA, 25 bp, Rattus norvegicus
tgaagccacgtaccctctgagttga

SEQ ID NO: 603836 - DNA, 25 bp, Rattus norvegicus
tgaagccacgtagcctctgagttga

SEQ ID NO: 603837 - DNA, 25 bp, Rattus norvegicus
tgaagccactctagcacaggattcc

SEQ ID NO: 603838 - DNA, 25 bp, Rattus norvegicus
tgaagccactcttgcacaggattcc

SEQ ID NO: 603839 - DNA, 25 bp, Rattus norvegicus
tgaagccactgtcatgaaccccata

SEQ ID NO: 603840 - DNA, 25 bp, Rattus norvegicus
tgaagccactgtgatgaaccccata

SEQ ID NO: 603841 - DNA, 25 bp, Rattus norvegicus
tgaagccagcaaccaactgactttg

SEQ ID NO: 603842 - DNA, 25 bp, Rattus norvegicus
tgaagccagcaagcaactgactttg

SEQ ID NO: 603843 - DNA, 25 bp, Rattus norvegicus
tgaagccagcatcctagttctagct

SEQ ID NO: 603844 - DNA, 25 bp, Rattus norvegicus
tgaagccagcatgctagttctagct

SEQ ID NO: 603845 - DNA, 25 bp, Rattus norvegicus
tgaagccagcccaggagatccagtc

SEQ ID NO: 603846 - DNA, 25 bp, Rattus norvegicus
tgaagccagccctggagatccagtc

SEQ ID NO: 603847 - DNA, 25 bp, Rattus norvegicus
tgaagccagctgcttcaaggccatt

SEQ ID NO: 603848 - DNA, 25 bp, Rattus norvegicus
tgaagccagctggttcaaggccatt

SEQ ID NO: 603849 - DNA, 25 bp, Rattus norvegicus
tgaagccaggatcagtgcacacaga

SEQ ID NO: 603850 - DNA, 25 bp, Rattus norvegicus
tgaagccaggatgagtgcacacaga

SEQ ID NO: 603851 - DNA, 25 bp, Rattus norvegicus
tgaagccaggttcagagagcctctg

SEQ ID NO: 603852 - DNA, 25 bp, Rattus norvegicus
tgaagccaggttgagagagcctctg

SEQ ID NO: 603853 - DNA, 25 bp, Rattus norvegicus
tgaagccagtgcagatggtgcccgc

SEQ ID NO: 603854 - DNA, 25 bp, Rattus norvegicus
tgaagccagtgctgatggtgcccgc

SEQ ID NO: 603855 - DNA, 25 bp, Rattus norvegicus
tgaagccataatccccaactatttc

SEQ ID NO: 603856 - DNA, 25 bp, Rattus norvegicus
tgaagccataatgcccaactatttc

SEQ ID NO: 603857 - DNA, 25 bp, Rattus norvegicus
tgaagccatacaagtgacccaacct

SEQ ID NO: 603858 - DNA, 25 bp, Rattus norvegicus
tgaagccatacatgtgacccaacct

SEQ ID NO: 603859 - DNA, 25 bp, Rattus norvegicus
tgaagccatcaacctgctggtgaac

SEQ ID NO: 603860 - DNA, 25 bp, Rattus norvegicus
tgaagccatcaagctgctggtgaac

SEQ ID NO: 603861 - DNA, 25 bp, Rattus norvegicus
tgaagccatcctatgctggcgaaag

SEQ ID NO: 603862 - DNA, 25 bp, Rattus norvegicus
tgaagccatcctttgctggcgaaag

SEQ ID NO: 603863 - DNA, 25 bp, Rattus norvegicus
tgaagccatcggatgttctgtcggg

SEQ ID NO: 603864 - DNA, 25 bp, Rattus norvegicus
tgaagccatcggttgttctgtcggg

SEQ ID NO: 603865 - DNA, 25 bp, Rattus norvegicus
tgaagccatgagacggtacctgctc

SEQ ID NO: 603866 - DNA, 25 bp, Rattus norvegicus
tgaagccatgagtcggtacctgctc

SEQ ID NO: 603867 - DNA, 25 bp, Rattus norvegicus
tgaagccattgaattgattcccagc

SEQ ID NO: 603868 - DNA, 25 bp, Rattus norvegicus
tgaagccattgatttgattcccagc

SEQ ID NO: 603869 - DNA, 25 bp, Rattus norvegicus
tgaagcccaaggacgtggacatcct

SEQ ID NO: 603870 - DNA, 25 bp, Rattus norvegicus
tgaagcccaaggtcgtggacatcct

SEQ ID NO: 603871 - DNA, 25 bp, Rattus norvegicus
tgaagcccactccttttctaatttt

SEQ ID NO: 603872 - DNA, 25 bp, Rattus norvegicus
tgaagcccactcgttttctaatttt

SEQ ID NO: 603873 - DNA, 25 bp, Rattus norvegicus
tgaagcccagaacctgtgaacacgt

SEQ ID NO: 603874 - DNA, 25 bp, Rattus norvegicus
tgaagcccagaagctgtgaacacgt

SEQ ID NO: 603875 - DNA, 25 bp, Rattus norvegicus
tgaagcccagccattgcggtcaaaa

SEQ ID NO: 603876 - DNA, 25 bp, Rattus norvegicus
tgaagcccagcctttgcggtcaaaa

SEQ ID NO: 603877 - DNA, 25 bp, Rattus norvegicus
tgaagcccagctctccagtgatgga

SEQ ID NO: 603878 - DNA, 25 bp, Rattus norvegicus
tgaagcccagctgtccagtgatgga

SEQ ID NO: 603879 - DNA, 25 bp, Rattus norvegicus
tgaagcccaggcataatacttattt

SEQ ID NO: 603880 - DNA, 25 bp, Rattus norvegicus
tgaagcccaggcttaatacttattt

SEQ ID NO: 603881 - DNA, 25 bp, Rattus norvegicus
tgaagcccagtcctttagtgagcac

SEQ ID NO: 603882 - DNA, 25 bp, Rattus norvegicus
tgaagcccagtcgtttagtgagcac

SEQ ID NO: 603883 - DNA, 25 bp, Rattus norvegicus
tgaagcccctcaaattgcatcctta

SEQ ID NO: 603884 - DNA, 25 bp, Rattus norvegicus
tgaagcccctcatattgcatcctta

SEQ ID NO: 603885 - DNA, 25 bp, Rattus norvegicus
tgaagcccctcccaggagatgtagg

SEQ ID NO: 603886 - DNA, 25 bp, Rattus norvegicus
tgaagcccctccgaggagatgtagg

SEQ ID NO: 603887 - DNA, 25 bp, Rattus norvegicus
tgaagccccttaaaatccaccgcat

SEQ ID NO: 603888 - DNA, 25 bp, Rattus norvegicus
tgaagccccttataatccaccgcat

SEQ ID NO: 603889 - DNA, 25 bp, Rattus norvegicus
tgaagcccgatcagacaacctaaat

SEQ ID NO: 603890 - DNA, 25 bp, Rattus norvegicus
tgaagcccgatctgacaacctaaat

SEQ ID NO: 603891 - DNA, 25 bp, Rattus norvegicus
tgaagcccgctgactgaacagtcct

SEQ ID NO: 603892 - DNA, 25 bp, Rattus norvegicus
tgaagcccgctgtctgaacagtcct

SEQ ID NO: 603893 - DNA, 25 bp, Rattus norvegicus
tgaagccctacacagccatgagaac

SEQ ID NO: 603894 - DNA, 25 bp, Rattus norvegicus
tgaagccctacagagccatgagaac

SEQ ID NO: 603895 - DNA, 25 bp, Rattus norvegicus
tgaagccctcttctggctgaagaga

SEQ ID NO: 603896 - DNA, 25 bp, Rattus norvegicus
tgaagccctcttgtggctgaagaga

SEQ ID NO: 603897 - DNA, 25 bp, Rattus norvegicus
tgaagccctgggacagctgtggatt

SEQ ID NO: 603898 - DNA, 25 bp, Rattus norvegicus
tgaagccctgggtcagctgtggatt

SEQ ID NO: 603899 - DNA, 25 bp, Rattus norvegicus
tgaagccctgtcattgatttcttta

SEQ ID NO: 603900 - DNA, 25 bp, Rattus norvegicus
tgaagccctgtctttgatttcttta

SEQ ID NO: 603901 - DNA, 25 bp, Rattus norvegicus
tgaagccgaacacctggctcggtaa

SEQ ID NO: 603902 - DNA, 25 bp, Rattus norvegicus
tgaagccgaacagctggctcggtaa

SEQ ID NO: 603903 - DNA, 25 bp, Rattus norvegicus
tgaagccgatgcagagctgtttcca

SEQ ID NO: 603904 - DNA, 25 bp, Rattus norvegicus
tgaagccgatgctgagctgtttcca

SEQ ID NO: 603905 - DNA, 25 bp, Rattus norvegicus
tgaagccggagacccatgcatttaa

SEQ ID NO: 603906 - DNA, 25 bp, Rattus norvegicus
tgaagccggagagccatgcatttaa

SEQ ID NO: 603907 - DNA, 25 bp, Rattus norvegicus
tgaagccgttttcctgtcctcagat

SEQ ID NO: 603908 - DNA, 25 bp, Rattus norvegicus
tgaagccgttttgctgtcctcagat

SEQ ID NO: 603909 - DNA, 25 bp, Rattus norvegicus
tgaagcctcagtaacagtcccctga

SEQ ID NO: 603910 - DNA, 25 bp, Rattus norvegicus
tgaagcctcagttacagtcccctga

SEQ ID NO: 603911 - DNA, 25 bp, Rattus norvegicus
tgaagcctcctcaatccggtatggg

SEQ ID NO: 603912 - DNA, 25 bp, Rattus norvegicus
tgaagcctcctctatccggtatggg

SEQ ID NO: 603913 - DNA, 25 bp, Rattus norvegicus
tgaagcctccttcgcctttaacaaa

SEQ ID NO: 603914 - DNA, 25 bp, Rattus norvegicus
tgaagcctccttggcctttaacaaa

SEQ ID NO: 603915 - DNA, 25 bp, Rattus norvegicus
tgaagcctctccaggagctggctca

SEQ ID NO: 603916 - DNA, 25 bp, Rattus norvegicus
tgaagcctctcctggagctggctca

SEQ ID NO: 603917 - DNA, 25 bp, Rattus norvegicus
tgaagcctctgtcctggaagctggc

SEQ ID NO: 603918 - DNA, 25 bp, Rattus norvegicus
tgaagcctctgtgctggaagctggc

SEQ ID NO: 603919 - DNA, 25 bp, Rattus norvegicus
tgaagcctgcccactagagtccctg

SEQ ID NO: 603920 - DNA, 25 bp, Rattus norvegicus
tgaagcctgccctctagagtccctg

SEQ ID NO: 603921 - DNA, 25 bp, Rattus norvegicus
tgaagcctgctacaacctgctgtgg

SEQ ID NO: 603922 - DNA, 25 bp, Rattus norvegicus
tgaagcctgctagaacctgctgtgg

SEQ ID NO: 603923 - DNA, 25 bp, Rattus norvegicus
tgaagcctggctcccgggcggcggg

SEQ ID NO: 603924 - DNA, 25 bp, Rattus norvegicus
tgaagcctggctgccgggcggcggg

SEQ ID NO: 603925 - DNA, 25 bp, Rattus norvegicus
tgaagcctgggtatcattggcacct

SEQ ID NO: 603926 - DNA, 25 bp, Rattus norvegicus
tgaagcctgggtttcattggcacct

SEQ ID NO: 603927 - DNA, 25 bp, Rattus norvegicus
tgaagcctgtacacaagttgccttg

SEQ ID NO: 603928 - DNA, 25 bp, Rattus norvegicus
tgaagcctgtactcaagttgccttg

SEQ ID NO: 603929 - DNA, 25 bp, Rattus norvegicus
tgaagcctgtgacttggtccaagat

SEQ ID NO: 603930 - DNA, 25 bp, Rattus norvegicus
tgaagcctgtgagttggtccaagat

SEQ ID NO: 603931 - DNA, 25 bp, Rattus norvegicus
tgaagcctgtgcctgtgccatacat

SEQ ID NO: 603932 - DNA, 25 bp, Rattus norvegicus
tgaagcctgtgcgtgtgccatacat

SEQ ID NO: 603933 - DNA, 25 bp, Rattus norvegicus
tgaagcctgtgtactgagtccccaa

SEQ ID NO: 603934 - DNA, 25 bp, Rattus norvegicus
tgaagcctgtgtctggtaactgcat

SEQ ID NO: 603935 - DNA, 25 bp, Rattus norvegicus
tgaagcctgtgtgtggtaactgcat

SEQ ID NO: 603936 - DNA, 25 bp, Rattus norvegicus
tgaagcctgtgttctgagtccccaa

SEQ ID NO: 603937 - DNA, 25 bp, Rattus norvegicus
tgaagcctgttccatttttgacctc

SEQ ID NO: 603938 - DNA, 25 bp, Rattus norvegicus
tgaagcctgttcgatttttgacctc

SEQ ID NO: 603939 - DNA, 25 bp, Rattus norvegicus
tgaagccttccacagttgcaggtcc

SEQ ID NO: 603940 - DNA, 25 bp, Rattus norvegicus
tgaagccttccagagttgcaggtcc

SEQ ID NO: 603941 - DNA, 25 bp, Rattus norvegicus
tgaagccttcgtatcagcattgctt

SEQ ID NO: 603942 - DNA, 25 bp, Rattus norvegicus
tgaagccttcgtttcagcattgctt

SEQ ID NO: 603943 - DNA, 25 bp, Rattus norvegicus
tgaagccttgcacctcgtcaggcag

SEQ ID NO: 603944 - DNA, 25 bp, Rattus norvegicus
tgaagccttgcagctcgtcaggcag

SEQ ID NO: 603945 - DNA, 25 bp, Rattus norvegicus
tgaagccttggaagctctggatgct

SEQ ID NO: 603946 - DNA, 25 bp, Rattus norvegicus
tgaagccttggatgctctggatgct

SEQ ID NO: 603947 - DNA, 25 bp, Rattus norvegicus
tgaagccttgggacgatgagacaga

SEQ ID NO: 603948 - DNA, 25 bp, Rattus norvegicus
tgaagccttgggtcgatgagacaga

SEQ ID NO: 603949 - DNA, 25 bp, Rattus norvegicus
tgaagccttgtcacttaactgcagc

SEQ ID NO: 603950 - DNA, 25 bp, Rattus norvegicus
tgaagccttgtctcttaactgcagc

SEQ ID NO: 603951 - DNA, 25 bp, Rattus norvegicus
tgaagccttttgaccgtgcagattt

SEQ ID NO: 603952 - DNA, 25 bp, Rattus norvegicus
tgaagccttttgtccgtgcagattt

SEQ ID NO: 603953 - DNA, 25 bp, Rattus norvegicus
tgaagcgatcttagaaacctccacc

SEQ ID NO: 603954 - DNA, 25 bp, Rattus norvegicus
tgaagcgatctttgaaacctccacc

SEQ ID NO: 603955 - DNA, 25 bp, Rattus norvegicus
tgaagcgcatcgacgagggcatcct

SEQ ID NO: 603956 - DNA, 25 bp, Rattus norvegicus
tgaagcgcatcgtcgagggcatcct

SEQ ID NO: 603957 - DNA, 25 bp, Rattus norvegicus
tgaagcgccaccaggactatgtgaa

SEQ ID NO: 603958 - DNA, 25 bp, Rattus norvegicus
tgaagcgccacctggactatgtgaa

SEQ ID NO: 603959 - DNA, 25 bp, Rattus norvegicus
tgaagcgctacgcatctttgctcaa

SEQ ID NO: 603960 - DNA, 25 bp, Rattus norvegicus
tgaagcgctacggatctttgctcaa

SEQ ID NO: 603961 - DNA, 25 bp, Rattus norvegicus
tgaagcgctcgaacacagcagccct

SEQ ID NO: 603962 - DNA, 25 bp, Rattus norvegicus
tgaagcgctcgatcacagcagccct

SEQ ID NO: 603963 - DNA, 25 bp, Rattus norvegicus
tgaagcgctttgctgagtctctacc

SEQ ID NO: 603964 - DNA, 25 bp, Rattus norvegicus
tgaagcgctttggtgagtctctacc

SEQ ID NO: 603965 - DNA, 25 bp, Rattus norvegicus
tgaagcggagtcagggacccatatc

SEQ ID NO: 603966 - DNA, 25 bp, Rattus norvegicus
tgaagcggagtctgggacccatatc

SEQ ID NO: 603967 - DNA, 25 bp, Rattus norvegicus
tgaagcggccctactaagtttttct

SEQ ID NO: 603968 - DNA, 25 bp, Rattus norvegicus
tgaagcggcccttctaagtttttct

SEQ ID NO: 603969 - DNA, 25 bp, Rattus norvegicus
tgaagcggctcaccagctcggagtt

SEQ ID NO: 603970 - DNA, 25 bp, Rattus norvegicus
tgaagcggctcagcagctcggagtt

SEQ ID NO: 603971 - DNA, 25 bp, Rattus norvegicus
tgaagcgggcctcaagctgttcctc

SEQ ID NO: 603972 - DNA, 25 bp, Rattus norvegicus
tgaagcgggcctgaagctgttcctc

SEQ ID NO: 603973 - DNA, 25 bp, Rattus norvegicus
tgaagcgggctaagtcggtgctcac

SEQ ID NO: 603974 - DNA, 25 bp, Rattus norvegicus
tgaagcgggctatgtcggtgctcac

SEQ ID NO: 603975 - DNA, 25 bp, Rattus norvegicus
tgaagcgggctgaggccaactgcca

SEQ ID NO: 603976 - DNA, 25 bp, Rattus norvegicus
tgaagcgggctgtggccaactgcca

SEQ ID NO: 603977 - DNA, 25 bp, Rattus norvegicus
tgaagcggttggacgaatagttgtt

SEQ ID NO: 603978 - DNA, 25 bp, Rattus norvegicus
tgaagcggttggtcgaatagttgtt

SEQ ID NO: 603979 - DNA, 25 bp, Rattus norvegicus
tgaagcgtgaagagcgcctccgcaa

SEQ ID NO: 603980 - DNA, 25 bp, Rattus norvegicus
tgaagcgtgaagtgcgcctccgcaa

SEQ ID NO: 603981 - DNA, 25 bp, Rattus norvegicus
tgaagcgtgtctcctcaaacacaaa

SEQ ID NO: 603982 - DNA, 25 bp, Rattus norvegicus
tgaagcgtgtctgctcaaacacaaa

SEQ ID NO: 603983 - DNA, 25 bp, Rattus norvegicus
tgaagcgtgttcactcaaccactaa

SEQ ID NO: 603984 - DNA, 25 bp, Rattus norvegicus
tgaagcgtgttctctcaaccactaa

SEQ ID NO: 603985 - DNA, 25 bp, Rattus norvegicus
tgaagcgttttgaccagtggctgaa

SEQ ID NO: 603986 - DNA, 25 bp, Rattus norvegicus
tgaagcgttttgtccagtggctgaa

SEQ ID NO: 603987 - DNA, 25 bp, Rattus norvegicus
tgaagctaatccaggagttccacca

SEQ ID NO: 603988 - DNA, 25 bp, Rattus norvegicus
tgaagctaatcctggagttccacca

SEQ ID NO: 603989 - DNA, 25 bp, Rattus norvegicus
tgaagctaatgcatccactctcttt

SEQ ID NO: 603990 - DNA, 25 bp, Rattus norvegicus
tgaagctaatgcttccactctcttt

SEQ ID NO: 603991 - DNA, 25 bp, Rattus norvegicus
tgaagctaatgtcagtctctccaga

SEQ ID NO: 603992 - DNA, 25 bp, Rattus norvegicus
tgaagctaatgtgagtctctccaga

SEQ ID NO: 603993 - DNA, 25 bp, Rattus norvegicus
tgaagctagactcccatcctgtgat

SEQ ID NO: 603994 - DNA, 25 bp, Rattus norvegicus
tgaagctagactgccatcctgtgat

SEQ ID NO: 603995 - DNA, 25 bp, Rattus norvegicus
tgaagctaggctctctgcatgtccc

SEQ ID NO: 603996 - DNA, 25 bp, Rattus norvegicus
tgaagctaggctgtctgcatgtccc

SEQ ID NO: 603997 - DNA, 25 bp, Rattus norvegicus
tgaagctaggtcctttttaaagatt

SEQ ID NO: 603998 - DNA, 25 bp, Rattus norvegicus
tgaagctaggtcgtttttaaagatt

SEQ ID NO: 603999 - DNA, 25 bp, Rattus norvegicus
tgaagctagtgcaggcctccgaaga

SEQ ID NO: 604000 - DNA, 25 bp, Rattus norvegicus
tgaagctagtgctggcctccgaaga

SEQ ID NO: 604001 - DNA, 25 bp, Rattus norvegicus
tgaagctagttcagtactccctagg

SEQ ID NO: 604002 - DNA, 25 bp, Rattus norvegicus
tgaagctagttctgtactccctagg

SEQ ID NO: 604003 - DNA, 25 bp, Rattus norvegicus
tgaagctatcaacggtctgcgcaaa

SEQ ID NO: 604004 - DNA, 25 bp, Rattus norvegicus
tgaagctatcaagggtctgcgcaaa

SEQ ID NO: 604005 - DNA, 25 bp, Rattus norvegicus
tgaagctatccaaaggttgctggct

SEQ ID NO: 604006 - DNA, 25 bp, Rattus norvegicus
tgaagctatccataggttgctggct

SEQ ID NO: 604007 - DNA, 25 bp, Rattus norvegicus
tgaagctatcctatgtcatctcaac

SEQ ID NO: 604008 - DNA, 25 bp, Rattus norvegicus
tgaagctatcctttgtcatctcaac

SEQ ID NO: 604009 - DNA, 25 bp, Rattus norvegicus
tgaagctattacagttggtaaacct

SEQ ID NO: 604010 - DNA, 25 bp, Rattus norvegicus
tgaagctattactgttggtaaacct

SEQ ID NO: 604011 - DNA, 25 bp, Rattus norvegicus
tgaagctattgcacacccacaagta

SEQ ID NO: 604012 - DNA, 25 bp, Rattus norvegicus
tgaagctattgctcacccacaagta

SEQ ID NO: 604013 - DNA, 25 bp, Rattus norvegicus
tgaagctatttccagcttgccgtca

SEQ ID NO: 604014 - DNA, 25 bp, Rattus norvegicus
tgaagctatttcgagcttgccgtca

SEQ ID NO: 604015 - DNA, 25 bp, Rattus norvegicus
tgaagctcaaagaccagacccacgt

SEQ ID NO: 604016 - DNA, 25 bp, Rattus norvegicus
tgaagctcaaagtccagacccacgt

SEQ ID NO: 604017 - DNA, 25 bp, Rattus norvegicus
tgaagctcaagtactgccgctacta

SEQ ID NO: 604018 - DNA, 25 bp, Rattus norvegicus
tgaagctcaagttctgccgctacta

SEQ ID NO: 604019 - DNA, 25 bp, Rattus norvegicus
tgaagctcaatactcggccgtccaa

SEQ ID NO: 604020 - DNA, 25 bp, Rattus norvegicus
tgaagctcaatagtcggccgtccaa

SEQ ID NO: 604021 - DNA, 25 bp, Rattus norvegicus
tgaagctcaccacattgtacgcgac

SEQ ID NO: 604022 - DNA, 25 bp, Rattus norvegicus
tgaagctcaccagattgtacgcgac

SEQ ID NO: 604023 - DNA, 25 bp, Rattus norvegicus
tgaagctccacaagttttgaaaaga

SEQ ID NO: 604024 - DNA, 25 bp, Rattus norvegicus
tgaagctccacatgttttgaaaaga

SEQ ID NO: 604025 - DNA, 25 bp, Rattus norvegicus
tgaagctccagaacagcctcatgca

SEQ ID NO: 604026 - DNA, 25 bp, Rattus norvegicus
tgaagctccagatcagcctcatgca

SEQ ID NO: 604027 - DNA, 25 bp, Rattus norvegicus
tgaagctccagcagacacaccagtt

SEQ ID NO: 604028 - DNA, 25 bp, Rattus norvegicus
tgaagctccagctgacacaccagtt

SEQ ID NO: 604029 - DNA, 25 bp, Rattus norvegicus
tgaagctccccgactgatcgaggag

SEQ ID NO: 604030 - DNA, 25 bp, Rattus norvegicus
tgaagctccccgtctgatcgaggag

SEQ ID NO: 604031 - DNA, 25 bp, Rattus norvegicus
tgaagctcctcaagcatcagtactc

SEQ ID NO: 604032 - DNA, 25 bp, Rattus norvegicus
tgaagctcctcaccaaagtgctggc

SEQ ID NO: 604033 - DNA, 25 bp, Rattus norvegicus
tgaagctcctcagcaaagtgctggc

SEQ ID NO: 604034 - DNA, 25 bp, Rattus norvegicus
tgaagctcctcatgcatcagtactc

SEQ ID NO: 604035 - DNA, 25 bp, Rattus norvegicus
tgaagctcctgcaacttctctgagc

SEQ ID NO: 604036 - DNA, 25 bp, Rattus norvegicus
tgaagctcctgctacttctctgagc

SEQ ID NO: 604037 - DNA, 25 bp, Rattus norvegicus
tgaagctccttcctttgggcaagag

SEQ ID NO: 604038 - DNA, 25 bp, Rattus norvegicus
tgaagctccttcgtttgggcaagag

SEQ ID NO: 604039 - DNA, 25 bp, Rattus norvegicus
tgaagctctgtcatatctgaggcca

SEQ ID NO: 604040 - DNA, 25 bp, Rattus norvegicus
tgaagctctgtcttatctgaggcca

SEQ ID NO: 604041 - DNA, 25 bp, Rattus norvegicus
tgaagctctttcatgcctcaggaat

SEQ ID NO: 604042 - DNA, 25 bp, Rattus norvegicus
tgaagctctttcttgcctcaggaat

SEQ ID NO: 604043 - DNA, 25 bp, Rattus norvegicus
tgaagctgacagaacatggagtgtt

SEQ ID NO: 604044 - DNA, 25 bp, Rattus norvegicus
tgaagctgacagtacatggagtgtt

SEQ ID NO: 604045 - DNA, 25 bp, Rattus norvegicus
tgaagctgaccaacgcagtcttctt

SEQ ID NO: 604046 - DNA, 25 bp, Rattus norvegicus
tgaagctgaccatcgcagtcttctt

SEQ ID NO: 604047 - DNA, 25 bp, Rattus norvegicus
tgaagctgacgcaaggtcggcagtc

SEQ ID NO: 604048 - DNA, 25 bp, Rattus norvegicus
tgaagctgacgctaggtcggcagtc

SEQ ID NO: 604049 - DNA, 25 bp, Rattus norvegicus
tgaagctgatgaagccctcgtggat

SEQ ID NO: 604050 - DNA, 25 bp, Rattus norvegicus
tgaagctgatgatgccctcgtggat

SEQ ID NO: 604051 - DNA, 25 bp, Rattus norvegicus
tgaagctgcaagaagcatcagacag

SEQ ID NO: 604052 - DNA, 25 bp, Rattus norvegicus
tgaagctgcaagtagcatcagacag

SEQ ID NO: 604053 - DNA, 25 bp, Rattus norvegicus
tgaagctgccagaagggtacacccc

SEQ ID NO: 604054 - DNA, 25 bp, Rattus norvegicus
tgaagctgccagtagggtacacccc

SEQ ID NO: 604055 - DNA, 25 bp, Rattus norvegicus
tgaagctgcctcagagcatactttg

SEQ ID NO: 604056 - DNA, 25 bp, Rattus norvegicus
tgaagctgcctctgagcatactttg

SEQ ID NO: 604057 - DNA, 25 bp, Rattus norvegicus
tgaagctgctagacaaattcggcgc

SEQ ID NO: 604058 - DNA, 25 bp, Rattus norvegicus
tgaagctgctagtcaaattcggcgc

SEQ ID NO: 604059 - DNA, 25 bp, Rattus norvegicus
tgaagctgctgcactgaggtccttg

SEQ ID NO: 604060 - DNA, 25 bp, Rattus norvegicus
tgaagctgctgctctgaggtccttg

SEQ ID NO: 604061 - DNA, 25 bp, Rattus norvegicus
tgaagctgctttaactacggcctac

SEQ ID NO: 604062 - DNA, 25 bp, Rattus norvegicus
tgaagctgctttagcactgacgcat

SEQ ID NO: 604063 - DNA, 25 bp, Rattus norvegicus
tgaagctgcttttactacggcctac

SEQ ID NO: 604064 - DNA, 25 bp, Rattus norvegicus
tgaagctgcttttgcactgacgcat

SEQ ID NO: 604065 - DNA, 25 bp, Rattus norvegicus
tgaagctggaacactcagtgaggtc

SEQ ID NO: 604066 - DNA, 25 bp, Rattus norvegicus
tgaagctggaactctcagtgaggtc

SEQ ID NO: 604067 - DNA, 25 bp, Rattus norvegicus
tgaagctggagacgagccacccact

SEQ ID NO: 604068 - DNA, 25 bp, Rattus norvegicus
tgaagctggagaggagccacccact

SEQ ID NO: 604069 - DNA, 25 bp, Rattus norvegicus
tgaagctggcacattgcctgttttc

SEQ ID NO: 604070 - DNA, 25 bp, Rattus norvegicus
tgaagctggcactttgcctgttttc

SEQ ID NO: 604071 - DNA, 25 bp, Rattus norvegicus
tgaagctggcgtagcctgccgctcg

SEQ ID NO: 604072 - DNA, 25 bp, Rattus norvegicus
tgaagctggcgttgcctgccgctcg

SEQ ID NO: 604073 - DNA, 25 bp, Rattus norvegicus
tgaagctgggtccttgttgctcacc

SEQ ID NO: 604074 - DNA, 25 bp, Rattus norvegicus
tgaagctgggtcgttgttgctcacc

SEQ ID NO: 604075 - DNA, 25 bp, Rattus norvegicus
tgaagctgtaacaggctctctcatt

SEQ ID NO: 604076 - DNA, 25 bp, Rattus norvegicus
tgaagctgtaactggctctctcatt

SEQ ID NO: 604077 - DNA, 25 bp, Rattus norvegicus
tgaagctgtataaattcctggcatc

SEQ ID NO: 604078 - DNA, 25 bp, Rattus norvegicus
tgaagctgtatatattcctggcatc

SEQ ID NO: 604079 - DNA, 25 bp, Rattus norvegicus
tgaagctgtccaagatgtctttgat

SEQ ID NO: 604080 - DNA, 25 bp, Rattus norvegicus
tgaagctgtccatgatgtctttgat

SEQ ID NO: 604081 - DNA, 25 bp, Rattus norvegicus
tgaagctgtcccacctgaaggaagg

SEQ ID NO: 604082 - DNA, 25 bp, Rattus norvegicus
tgaagctgtccctcctgaaggaagg

SEQ ID NO: 604083 - DNA, 25 bp, Rattus norvegicus
tgaagctgtgtcacgggaactgaaa

SEQ ID NO: 604084 - DNA, 25 bp, Rattus norvegicus
tgaagctgtgtctcgggaactgaaa

SEQ ID NO: 604085 - DNA, 25 bp, Rattus norvegicus
tgaagcttagtacgtggctgagcct

SEQ ID NO: 604086 - DNA, 25 bp, Rattus norvegicus
tgaagcttagtaggtggctgagcct

SEQ ID NO: 604087 - DNA, 25 bp, Rattus norvegicus
tgaagcttcagacccacgcataatt

SEQ ID NO: 604088 - DNA, 25 bp, Rattus norvegicus
tgaagcttcagagccacgcataatt

SEQ ID NO: 604089 - DNA, 25 bp, Rattus norvegicus
tgaagcttccccatcaggtcagttt

SEQ ID NO: 604090 - DNA, 25 bp, Rattus norvegicus
tgaagcttccccttcaggtcagttt

SEQ ID NO: 604091 - DNA, 25 bp, Rattus norvegicus
tgaagcttccttatattcaccccat

SEQ ID NO: 604092 - DNA, 25 bp, Rattus norvegicus
tgaagcttccttttattcaccccat

SEQ ID NO: 604093 - DNA, 25 bp, Rattus norvegicus
tgaagcttcgcccaaaggaaaactg

SEQ ID NO: 604094 - DNA, 25 bp, Rattus norvegicus
tgaagcttcgccgaaaggaaaactg

SEQ ID NO: 604095 - DNA, 25 bp, Rattus norvegicus
tgaagcttctcaatcttccacaggt

SEQ ID NO: 604096 - DNA, 25 bp, Rattus norvegicus
tgaagcttctcattcttccacaggt

SEQ ID NO: 604097 - DNA, 25 bp, Rattus norvegicus
tgaagcttctctaggctctgggcat

SEQ ID NO: 604098 - DNA, 25 bp, Rattus norvegicus
tgaagcttctcttggctctgggcat

SEQ ID NO: 604099 - DNA, 25 bp, Rattus norvegicus
tgaagcttcttgaatttgtctaaaa

SEQ ID NO: 604100 - DNA, 25 bp, Rattus norvegicus
tgaagcttcttgtatttgtctaaaa

SEQ ID NO: 604101 - DNA, 25 bp, Rattus norvegicus
tgaagcttgactcccaagttgccat

SEQ ID NO: 604102 - DNA, 25 bp, Rattus norvegicus
tgaagcttgactgccaagttgccat

SEQ ID NO: 604103 - DNA, 25 bp, Rattus norvegicus
tgaagcttgctaatccatcagggat

SEQ ID NO: 604104 - DNA, 25 bp, Rattus norvegicus
tgaagcttgctattccatcagggat

SEQ ID NO: 604105 - DNA, 25 bp, Rattus norvegicus
tgaagcttgctcctgttggacagga

SEQ ID NO: 604106 - DNA, 25 bp, Rattus norvegicus
tgaagcttgctcgtgttggacagga

SEQ ID NO: 604107 - DNA, 25 bp, Rattus norvegicus
tgaagcttttgacggcagactgcca

SEQ ID NO: 604108 - DNA, 25 bp, Rattus norvegicus
tgaagcttttgagggcagactgcca

SEQ ID NO: 604109 - DNA, 25 bp, Rattus norvegicus
tgaaggaaacccctgctgttgcatc

SEQ ID NO: 604110 - DNA, 25 bp, Rattus norvegicus
tgaaggaaacccgtgctgttgcatc

SEQ ID NO: 604111 - DNA, 25 bp, Rattus norvegicus
tgaaggaacctgaagcccagatccc

SEQ ID NO: 604112 - DNA, 25 bp, Rattus norvegicus
tgaaggaacctgtagcccagatccc

SEQ ID NO: 604113 - DNA, 25 bp, Rattus norvegicus
tgaaggaacgttcttacctgccttg

SEQ ID NO: 604114 - DNA, 25 bp, Rattus norvegicus
tgaaggaacgttgttacctgccttg

SEQ ID NO: 604115 - DNA, 25 bp, Rattus norvegicus
tgaaggaagccaagctggtgtctcc

SEQ ID NO: 604116 - DNA, 25 bp, Rattus norvegicus
tgaaggaagccatgctggtgtctcc

SEQ ID NO: 604117 - DNA, 25 bp, Rattus norvegicus
tgaaggaagcctatgctctttgcct

SEQ ID NO: 604118 - DNA, 25 bp, Rattus norvegicus
tgaaggaagcctttgctctttgcct

SEQ ID NO: 604119 - DNA, 25 bp, Rattus norvegicus
tgaaggacaaccacagtgacattgt

SEQ ID NO: 604120 - DNA, 25 bp, Rattus norvegicus
tgaaggacaaccacgggtgtcactc

SEQ ID NO: 604121 - DNA, 25 bp, Rattus norvegicus
tgaaggacaacctcagtgacattgt

SEQ ID NO: 604122 - DNA, 25 bp, Rattus norvegicus
tgaaggacaacctcgggtgtcactc

SEQ ID NO: 604123 - DNA, 25 bp, Rattus norvegicus
tgaaggacaggcatttcccttgttt

SEQ ID NO: 604124 - DNA, 25 bp, Rattus norvegicus
tgaaggacaggcttttcccttgttt

SEQ ID NO: 604125 - DNA, 25 bp, Rattus norvegicus
tgaaggacagggataaacttccttt

SEQ ID NO: 604126 - DNA, 25 bp, Rattus norvegicus
tgaaggacagggttaaacttccttt

SEQ ID NO: 604127 - DNA, 25 bp, Rattus norvegicus
tgaaggacatttcctctaccgtgca

SEQ ID NO: 604128 - DNA, 25 bp, Rattus norvegicus
tgaaggacatttgctctaccgtgca

SEQ ID NO: 604129 - DNA, 25 bp, Rattus norvegicus
tgaaggaccccgaggtgtgcacaga

SEQ ID NO: 604130 - DNA, 25 bp, Rattus norvegicus
tgaaggaccccgtggtgtgcacaga

SEQ ID NO: 604131 - DNA, 25 bp, Rattus norvegicus
tgaaggacccctaaagtcaacccag

SEQ ID NO: 604132 - DNA, 25 bp, Rattus norvegicus
tgaaggaccccttaagtcaacccag

SEQ ID NO: 604133 - DNA, 25 bp, Rattus norvegicus
tgaaggaccgccaggtatcacaagt

SEQ ID NO: 604134 - DNA, 25 bp, Rattus norvegicus
tgaaggaccgcctggtatcacaagt

SEQ ID NO: 604135 - DNA, 25 bp, Rattus norvegicus
tgaaggacctgtacctggaggctgc

SEQ ID NO: 604136 - DNA, 25 bp, Rattus norvegicus
tgaaggacctgttcctggaggctgc

SEQ ID NO: 604137 - DNA, 25 bp, Rattus norvegicus
tgaaggaccttgaccagcattgcca

SEQ ID NO: 604138 - DNA, 25 bp, Rattus norvegicus
tgaaggaccttgtccagcattgcca

SEQ ID NO: 604139 - DNA, 25 bp, Rattus norvegicus
tgaaggactgcaagcctcacgtgcc

SEQ ID NO: 604140 - DNA, 25 bp, Rattus norvegicus
tgaaggactgcatgcctcacgtgcc

SEQ ID NO: 604141 - DNA, 25 bp, Rattus norvegicus
tgaaggactgtgagccgtagcgccc

SEQ ID NO: 604142 - DNA, 25 bp, Rattus norvegicus
tgaaggactgtgtgccgtagcgccc

SEQ ID NO: 604143 - DNA, 25 bp, Rattus norvegicus
tgaaggacttctcgcaaacaccgca

SEQ ID NO: 604144 - DNA, 25 bp, Rattus norvegicus
tgaaggacttctggcaaacaccgca

SEQ ID NO: 604145 - DNA, 25 bp, Rattus norvegicus
tgaaggagaattcacacactgtgct

SEQ ID NO: 604146 - DNA, 25 bp, Rattus norvegicus
tgaaggagaattgacacactgtgct

SEQ ID NO: 604147 - DNA, 25 bp, Rattus norvegicus
tgaaggagaccaccccgaaaatcgg

SEQ ID NO: 604148 - DNA, 25 bp, Rattus norvegicus
tgaaggagaccagcccgaaaatcgg

SEQ ID NO: 604149 - DNA, 25 bp, Rattus norvegicus
tgaaggagcagaaggcctcttccca

SEQ ID NO: 604150 - DNA, 25 bp, Rattus norvegicus
tgaaggagcagatggcctcttccca

SEQ ID NO: 604151 - DNA, 25 bp, Rattus norvegicus
tgaaggagcagcctggatcacccga

SEQ ID NO: 604152 - DNA, 25 bp, Rattus norvegicus
tgaaggagcagcgtggatcacccga

SEQ ID NO: 604153 - DNA, 25 bp, Rattus norvegicus
tgaaggagccggactgcaagccaga

SEQ ID NO: 604154 - DNA, 25 bp, Rattus norvegicus
tgaaggagccggtctgcaagccaga

SEQ ID NO: 604155 - DNA, 25 bp, Rattus norvegicus
tgaaggagctttcccaaactcccta

SEQ ID NO: 604156 - DNA, 25 bp, Rattus norvegicus
tgaaggagctttgccaaactcccta

SEQ ID NO: 604157 - DNA, 25 bp, Rattus norvegicus
tgaaggaggcccagaacagcctctc

SEQ ID NO: 604158 - DNA, 25 bp, Rattus norvegicus
tgaaggaggcccagggtcccacagt

SEQ ID NO: 604159 - DNA, 25 bp, Rattus norvegicus
tgaaggaggccctgaacagcctctc

SEQ ID NO: 604160 - DNA, 25 bp, Rattus norvegicus
tgaaggaggccctgggtcccacagt

SEQ ID NO: 604161 - DNA, 25 bp, Rattus norvegicus
tgaaggaggcttacccggaagccaa
